United States Patent 12,606,847 (ENGINEERED VIRAL CAPSID POLYPEPTIDES AND USES THEREOF) - sequence listing, part 3

SEQ ID NO: 45054 - protein, 32 aa, Artificial Sequence
  Description of Artificial Sequence: Synthetic polypeptide
AEEEIRTTNPVATEQYGSVSTTNNLGQEDTNG

SEQ ID NO: 45055 - protein, 31 aa, Artificial Sequence
  Description of Artificial Sequence: Synthetic polypeptide
DGEEIRTTNPVATEQWGSVTSTPLLQGGVHR

SEQ ID NO: 45056 - protein, 28 aa, Artificial Sequence
  Description of Artificial Sequence: Synthetic peptide
DEHEIATTNPVAYEPYGSVATNLADGND

SEQ ID NO: 45057 - protein, 33 aa, Artificial Sequence
  Description of Artificial Sequence: Synthetic polypeptide
AEEEIRTTNPVATEQYGSVSTTNNLGQNQGNIE

SEQ ID NO: 45058 - protein, 32 aa, Artificial Sequence
  Description of Artificial Sequence: Synthetic polypeptide
AEEEIRTTNPVATEQYGSVSTTNNLGQTGISG

SEQ ID NO: 45059 - protein, 30 aa, Artificial Sequence
  Description of Artificial Sequence: Synthetic polypeptide
DEHEIATTNPVATEQYGSVSWNEQMDGNTQ

SEQ ID NO: 45060 - protein, 33 aa, Artificial Sequence
  Description of Artificial Sequence: Synthetic polypeptide
AEEEIRTTNPVATEQYGSVSTTNNLDNQQGNTE

SEQ ID NO: 45061 - protein, 31 aa, Artificial Sequence
  Description of Artificial Sequence: Synthetic polypeptide
DEHEIRTTNPCATECYGSVSTNLQGDMGNQD

SEQ ID NO: 45062 - protein, 31 aa, Artificial Sequence
  Description of Artificial Sequence: Synthetic polypeptide
DGEEIRTTNPVATEQWGSCTSTLLQRGTQRD

SEQ ID NO: 45063 - protein, 33 aa, Artificial Sequence
  Description of Artificial Sequence: Synthetic polypeptide
AEEEIRTTNPVATEQYGSVSTTNNLQENGTNSD

SEQ ID NO: 45064 - protein, 31 aa, Artificial Sequence
  Description of Artificial Sequence: Synthetic polypeptide
DEHEIRTTNPCATEQYGSVSTNLQGDGGMDE

SEQ ID NO: 45065 - protein, 32 aa, Artificial Sequence
  Description of Artificial Sequence: Synthetic polypeptide
DEHEIRTTNPCATEQYGSVSTNLQGDLGGNND

SEQ ID NO: 45066 - protein, 32 aa, Artificial Sequence
  Description of Artificial Sequence: Synthetic polypeptide
DEHEIRTTNPCATEQYGSVSTNLQGEHGNGSD

SEQ ID NO: 45067 - protein, 31 aa, Artificial Sequence
  Description of Artificial Sequence: Synthetic polypeptide
DEHEIRTTNPCATEQYGTVSTNPDQGMGGNR

SEQ ID NO: 45068 - protein, 30 aa, Artificial Sequence
  Description of Artificial Sequence: Synthetic polypeptide
DGEEIATTNPVATEQWGSVTSTLDQRGETR

SEQ ID NO: 45069 - protein, 31 aa, Artificial Sequence
  Description of Artificial Sequence: Synthetic polypeptide
DEHEIRTTNPCATESYGSVSTNNDGQDGGNR

SEQ ID NO: 45070 - protein, 29 aa, Artificial Sequence
  Description of Artificial Sequence: Synthetic peptide
SEEEIRTTNPIATECYGSTVAENWMRGNR

SEQ ID NO: 45071 - protein, 31 aa, Artificial Sequence
  Description of Artificial Sequence: Synthetic polypeptide
DEHEIRTTNPCATEWYGSVSTNLQGGGDNEQ

SEQ ID NO: 45072 - protein, 30 aa, Artificial Sequence
  Description of Artificial Sequence: Synthetic polypeptide
DEHEIRTTNPCAYEQYGTVSTNGGQMGDNR

SEQ ID NO: 45073 - protein, 33 aa, Artificial Sequence
  Description of Artificial Sequence: Synthetic polypeptide
DEHEIRTTNPLAYEQYGSVSCTNLSQRPGGNNR

SEQ ID NO: 45074 - protein, 31 aa, Artificial Sequence
  Description of Artificial Sequence: Synthetic polypeptide
DEHEIRTTNPLAYEQYGSVSVTNMLSQPGNA

SEQ ID NO: 45075 - protein, 31 aa, Artificial Sequence
  Description of Artificial Sequence: Synthetic polypeptide
DEHEIRTTNPVATCQYGSVCNTELQRFGSNQ

SEQ ID NO: 45076 - protein, 31 aa, Artificial Sequence
  Description of Artificial Sequence: Synthetic polypeptide
SEEEIRTTNPCATEQYGSCSTNNLERGNDTP

SEQ ID NO: 45077 - protein, 29 aa, Artificial Sequence
  Description of Artificial Sequence: Synthetic peptide
DEHEIRTTNPVATDQWGSVATQLQGGNDT

SEQ ID NO: 45078 - protein, 32 aa, Artificial Sequence
  Description of Artificial Sequence: Synthetic polypeptide
DEHEIRTTNPCATEQYGSVSTNLNQGDMGNED

SEQ ID NO: 45079 - protein, 28 aa, Artificial Sequence
  Description of Artificial Sequence: Synthetic peptide
SEEEIRTTNPIATEQWGDVSEILMRGNA

SEQ ID NO: 45080 - protein, 30 aa, Artificial Sequence
  Description of Artificial Sequence: Synthetic polypeptide
DGEEIATTNPVATEQWGSVTSTLLQEDGTR

SEQ ID NO: 45081 - protein, 31 aa, Artificial Sequence
  Description of Artificial Sequence: Synthetic polypeptide
DEHEIRTTNPCATEQYGSVSTNLNDAGGNGQ

SEQ ID NO: 45082 - protein, 28 aa, Artificial Sequence
  Description of Artificial Sequence: Synthetic peptide
SEEEIRTTNPIATEQYGEAPEVCQRGNR

SEQ ID NO: 45083 - protein, 31 aa, Artificial Sequence
  Description of Artificial Sequence: Synthetic polypeptide
DGEEIRTTNPVATEQWGCVTSTLLQIGNTRN

SEQ ID NO: 45084 - protein, 30 aa, Artificial Sequence
  Description of Artificial Sequence: Synthetic polypeptide
DEHEIRTTNPCATEHYGSVSTNGGDGDNDR

SEQ ID NO: 45085 - protein, 29 aa, Artificial Sequence
  Description of Artificial Sequence: Synthetic peptide
DGEEIRTTNPVATEQWGCVTSTELQNGEA

SEQ ID NO: 45086 - protein, 29 aa, Artificial Sequence
  Description of Artificial Sequence: Synthetic peptide
DDEDIRTTNPVATEQYGKVSTNHQRVDEL

SEQ ID NO: 45087 - protein, 29 aa, Artificial Sequence
  Description of Artificial Sequence: Synthetic peptide
DDEDIRTTNPVATEQYGKVSTNHQLVNLE

SEQ ID NO: 45088 - protein, 33 aa, Artificial Sequence
  Description of Artificial Sequence: Synthetic polypeptide
DEHEIRTTNPCATEQYGSVSTDNGLQDMNGNGR

SEQ ID NO: 45089 - protein, 30 aa, Artificial Sequence
  Description of Artificial Sequence: Synthetic polypeptide
DEHEIRTTNPCATECYGSVSTNPQHDNGNQ

SEQ ID NO: 45090 - protein, 31 aa, Artificial Sequence
  Description of Artificial Sequence: Synthetic polypeptide
DGEEIRTTNPVATEQWGAVTSTLLQRGTQRE

SEQ ID NO: 45091 - protein, 29 aa, Artificial Sequence
  Description of Artificial Sequence: Synthetic peptide
SEEEIRTTNPIATEQWGSVSENLMNRGDA

SEQ ID NO: 45092 - protein, 29 aa, Artificial Sequence
  Description of Artificial Sequence: Synthetic peptide
SEEEIRTTNPIATEQWGSVSENLMNREDR

SEQ ID NO: 45093 - protein, 33 aa, Artificial Sequence
  Description of Artificial Sequence: Synthetic polypeptide
AEEEIRTTNPVATEQYGSVSTTNNLQEDEGNNE

SEQ ID NO: 45094 - protein, 32 aa, Artificial Sequence
  Description of Artificial Sequence: Synthetic polypeptide
DEHEIRTTNPCATEQYGSVSTGNLQGDGGMMR

SEQ ID NO: 45095 - protein, 30 aa, Artificial Sequence
  Description of Artificial Sequence: Synthetic polypeptide
SEEEIRTTNPIATEQWGSVSENEPMRGENR

SEQ ID NO: 45096 - protein, 30 aa, Artificial Sequence
  Description of Artificial Sequence: Synthetic polypeptide
DEHEIRTTNPCATEQYGSVSTNGGNAGNGQ

SEQ ID NO: 45097 - protein, 32 aa, Artificial Sequence
  Description of Artificial Sequence: Synthetic polypeptide
AEEEIRTTNPVATEQYGSVSTTNNLQEGQGTI

SEQ ID NO: 45098 - protein, 33 aa, Artificial Sequence
  Description of Artificial Sequence: Synthetic polypeptide
AEEEIRTTNPVATEQYGSVSTTNNLQAGQGNQD

SEQ ID NO: 45099 - protein, 31 aa, Artificial Sequence
  Description of Artificial Sequence: Synthetic polypeptide
DEHEIATTNPVATEQYGSVSANPLNRNNMNR

SEQ ID NO: 45100 - protein, 30 aa, Artificial Sequence
  Description of Artificial Sequence: Synthetic polypeptide
DEHEIATTNPVATEQYGSVSAGNLMANMNR

SEQ ID NO: 45101 - protein, 32 aa, Artificial Sequence
  Description of Artificial Sequence: Synthetic polypeptide
AEEEIRTTNPVATEQYGSVSTTNNLDNQGNST

SEQ ID NO: 45102 - protein, 29 aa, Artificial Sequence
  Description of Artificial Sequence: Synthetic peptide
DEGEIRTTNPVSTEQYGSVANNLQGGQTQ

SEQ ID NO: 45103 - protein, 33 aa, Artificial Sequence
  Description of Artificial Sequence: Synthetic polypeptide
AEEEIRTTNPVATEQYGSVSTTNLQVNTNGQNV

SEQ ID NO: 45104 - protein, 29 aa, Artificial Sequence
  Description of Artificial Sequence: Synthetic peptide
DEGEISTTNPVATEQYGSVQTGLIGEMNR

SEQ ID NO: 45105 - protein, 33 aa, Artificial Sequence
  Description of Artificial Sequence: Synthetic polypeptide
AEEEIRTTNPVATEQYGSVSTTNLQYGNAEEEE

SEQ ID NO: 45106 - protein, 33 aa, Artificial Sequence
  Description of Artificial Sequence: Synthetic polypeptide
AEEEIRTTNPVATEQYGSVSTTNLQYGNGNNQV

SEQ ID NO: 45107 - protein, 30 aa, Artificial Sequence
  Description of Artificial Sequence: Synthetic polypeptide
DEGMIRTTNPVATEQYGSASTTLINEGNVR

SEQ ID NO: 45108 - protein, 33 aa, Artificial Sequence
  Description of Artificial Sequence: Synthetic polypeptide
AEEEIRTTNPVATEQYGSVSTTNLQYGNINENQ

SEQ ID NO: 45109 - protein, 31 aa, Artificial Sequence
  Description of Artificial Sequence: Synthetic polypeptide
SEEEIRTTNPVATEAYGSVSNTNLHSGSDQR

SEQ ID NO: 45110 - protein, 33 aa, Artificial Sequence
  Description of Artificial Sequence: Synthetic polypeptide
AEEEIRTTNPVATEQYGSVSTTNLQYGNTEGNV

SEQ ID NO: 45111 - protein, 31 aa, Artificial Sequence
  Description of Artificial Sequence: Synthetic polypeptide
DEGTIRTTNPVATEQYGSVTSTNLIIGQERG

SEQ ID NO: 45112 - protein, 31 aa, Artificial Sequence
  Description of Artificial Sequence: Synthetic polypeptide
AEEEIRTTNPVATEQYGSVSTTNLTQGQTTI

SEQ ID NO: 45113 - protein, 32 aa, Artificial Sequence
  Description of Artificial Sequence: Synthetic polypeptide
AEEEIRTTNPVATEQYGSVSTTNLVQGTNVEG

SEQ ID NO: 45114 - protein, 29 aa, Artificial Sequence
  Description of Artificial Sequence: Synthetic peptide
DEGVIACTNPVATEQYGSCSTNLDTGNRQ

SEQ ID NO: 45115 - protein, 30 aa, Artificial Sequence
  Description of Artificial Sequence: Synthetic polypeptide
QEEEIRTTNPVATEGYGCTSINLQRAGGNE

SEQ ID NO: 45116 - protein, 31 aa, Artificial Sequence
  Description of Artificial Sequence: Synthetic polypeptide
SEEEIRTTNPTATEMYGSVISEMNLQQGNTR

SEQ ID NO: 45117 - protein, 28 aa, Artificial Sequence
  Description of Artificial Sequence: Synthetic peptide
DEGEIRTTNPVSTEQYGSVAANPQGGQT

SEQ ID NO: 45118 - protein, 31 aa, Artificial Sequence
  Description of Artificial Sequence: Synthetic polypeptide
DDEEIRCTNPVATEQYGSQVSTNLQNGSQTQ

SEQ ID NO: 45119 - protein, 30 aa, Artificial Sequence
  Description of Artificial Sequence: Synthetic polypeptide
DEGEIRTTNPVAYEQYGSVATAELSTRVNR

SEQ ID NO: 45120 - protein, 30 aa, Artificial Sequence
  Description of Artificial Sequence: Synthetic polypeptide
SEEEIRTTNPVATEAYGSVSNTNLIHGDQQ

SEQ ID NO: 45121 - protein, 29 aa, Artificial Sequence
  Description of Artificial Sequence: Synthetic peptide
DEGEIRTTNPVATEQYGVVVTNYTQETNE

SEQ ID NO: 45122 - protein, 33 aa, Artificial Sequence
  Description of Artificial Sequence: Synthetic polypeptide
AEEEIRTTNPVATEQYGSVSTTNLQQQTQGNQE

SEQ ID NO: 45123 - protein, 29 aa, Artificial Sequence
  Description of Artificial Sequence: Synthetic peptide
DEGEIRTTNPVATESYGSVANNLQHGDTS

SEQ ID NO: 45124 - protein, 33 aa, Artificial Sequence
  Description of Artificial Sequence: Synthetic polypeptide
AEEEIRTTNPVATEQYGSVSTTNLQQQTQGTND

SEQ ID NO: 45125 - protein, 31 aa, Artificial Sequence
  Description of Artificial Sequence: Synthetic polypeptide
DEGEIRTTNPVATGHYGSVSTDNMLQRTQNM

SEQ ID NO: 45126 - protein, 33 aa, Artificial Sequence
  Description of Artificial Sequence: Synthetic polypeptide
AEEEIRTTNPVATEQYGSVSTTNLQQSIGTNEE

SEQ ID NO: 45127 - protein, 33 aa, Artificial Sequence
  Description of Artificial Sequence: Synthetic polypeptide
AEEEIRTTNPVATEQYGSVSTTNLQQTNGGNLD

SEQ ID NO: 45128 - protein, 30 aa, Artificial Sequence
  Description of Artificial Sequence: Synthetic polypeptide
DEGVIATTNPVATEQYGCVATNPQGREGNR

SEQ ID NO: 45129 - protein, 29 aa, Artificial Sequence
  Description of Artificial Sequence: Synthetic peptide
DDEEIRSTNPVATEQYGCSSWNDQRGSNQ

SEQ ID NO: 45130 - protein, 30 aa, Artificial Sequence
  Description of Artificial Sequence: Synthetic polypeptide
DDEEIRSTNPVATEQYGCSSTGNPQRGSNQ

SEQ ID NO: 45131 - protein, 32 aa, Artificial Sequence
  Description of Artificial Sequence: Synthetic polypeptide
AEEEIRTTNPVATEQYGSVSTTNLQSNTDGQE

SEQ ID NO: 45132 - protein, 30 aa, Artificial Sequence
  Description of Artificial Sequence: Synthetic polypeptide
DDEEIRSTNPVATEQYGCSCSTNPQHGSNQ

SEQ ID NO: 45133 - protein, 29 aa, Artificial Sequence
  Description of Artificial Sequence: Synthetic peptide
DEGEIRTTNPVAYEAYGSVQTALSTRVNR

SEQ ID NO: 45134 - protein, 31 aa, Artificial Sequence
  Description of Artificial Sequence: Synthetic polypeptide
DEGEIRTTNPVAYEAYGSVSNNLSQRGGTNA

SEQ ID NO: 45135 - protein, 32 aa, Artificial Sequence
  Description of Artificial Sequence: Synthetic polypeptide
AEEEIRTTNPVATEQYGSVSTTNLQVNAGTIM

SEQ ID NO: 45136 - protein, 29 aa, Artificial Sequence
  Description of Artificial Sequence: Synthetic peptide
DEGEIRTTNPVAYEQWGSVQTPLIREDNR

SEQ ID NO: 45137 - protein, 29 aa, Artificial Sequence
  Description of Artificial Sequence: Synthetic peptide
DDEEIRSTNPVATEQYGCSSTNMQNGSNA

SEQ ID NO: 45138 - protein, 29 aa, Artificial Sequence
  Description of Artificial Sequence: Synthetic peptide
DEGVIATTNPVATEQYGCVATNPQMNGNR

SEQ ID NO: 45139 - protein, 29 aa, Artificial Sequence
  Description of Artificial Sequence: Synthetic peptide
DEGVIATTNPVATEQYGSCSTNLDDNGNE

SEQ ID NO: 45140 - protein, 30 aa, Artificial Sequence
  Description of Artificial Sequence: Synthetic polypeptide
DEGVIATTNPVATEQYGSCSTNLDIDHGNR

SEQ ID NO: 45141 - protein, 30 aa, Artificial Sequence
  Description of Artificial Sequence: Synthetic polypeptide
DEHEIATTNPVATAQYGSVATQLDQRGDND

SEQ ID NO: 45142 - protein, 31 aa, Artificial Sequence
  Description of Artificial Sequence: Synthetic polypeptide
DGEEIRTTNPVAYEQWGSVCSTDLLQRDGTR

SEQ ID NO: 45143 - protein, 29 aa, Artificial Sequence
  Description of Artificial Sequence: Synthetic peptide
DEHEIATTNPVATDQYGSVASQLQRDGND

SEQ ID NO: 45144 - protein, 30 aa, Artificial Sequence
  Description of Artificial Sequence: Synthetic polypeptide
DEHEIATTNPVATDQYGSVVATGLDQRGND

SEQ ID NO: 45145 - protein, 33 aa, Artificial Sequence
  Description of Artificial Sequence: Synthetic polypeptide
SEEEIRTTNPIATEQYGSVSSTNLNMRNGMNPR

SEQ ID NO: 45146 - protein, 31 aa, Artificial Sequence
  Description of Artificial Sequence: Synthetic polypeptide
DEHEIATTNPVATECYGSVSTNLQGNMGQDR

SEQ ID NO: 45147 - protein, 31 aa, Artificial Sequence
  Description of Artificial Sequence: Synthetic polypeptide
DEHEIATTNPVATEHYGSVSTNLQRGDGDAG

SEQ ID NO: 45148 - protein, 29 aa, Artificial Sequence
  Description of Artificial Sequence: Synthetic peptide
DEHEIATTNPVATAQYGSVATALQRDNED

SEQ ID NO: 45149 - protein, 31 aa, Artificial Sequence
  Description of Artificial Sequence: Synthetic polypeptide
DEHEIATTNPVATEHYGVVSTNLQHDGDNQR

SEQ ID NO: 45150 - protein, 31 aa, Artificial Sequence
  Description of Artificial Sequence: Synthetic polypeptide
DEHEIATTNPVATENYGSVSTNPQAGNDNDR

SEQ ID NO: 45151 - protein, 31 aa, Artificial Sequence
  Description of Artificial Sequence: Synthetic polypeptide
DGEEIRTTNPVATEQWGVVTSTLPLQRGTQR

SEQ ID NO: 45152 - protein, 31 aa, Artificial Sequence
  Description of Artificial Sequence: Synthetic polypeptide
DEHEIATTNPVATEQYGEVSTNLQGDGNNAQ

SEQ ID NO: 45153 - protein, 32 aa, Artificial Sequence
  Description of Artificial Sequence: Synthetic polypeptide
AEEEIRTTNPVATEQYGSVSTTNNGQIQGNEE

SEQ ID NO: 45154 - protein, 30 aa, Artificial Sequence
  Description of Artificial Sequence: Synthetic polypeptide
DEHEIATTNPVATEQYGSVANNPQRNGNPV

SEQ ID NO: 45155 - protein, 30 aa, Artificial Sequence
  Description of Artificial Sequence: Synthetic polypeptide
DGEEIRTTNPVATEQWGSVTTTLLQRDDTR

SEQ ID NO: 45156 - protein, 30 aa, Artificial Sequence
  Description of Artificial Sequence: Synthetic polypeptide
DEHEIATTNPVATEQYGSVSAGNLFRNDNN

SEQ ID NO: 45157 - protein, 32 aa, Artificial Sequence
  Description of Artificial Sequence: Synthetic polypeptide
SEEEIRTTNPIATEQYGSVSSENLNRNGMNPR

SEQ ID NO: 45158 - protein, 30 aa, Artificial Sequence
  Description of Artificial Sequence: Synthetic polypeptide
DEYVIRTTNPVATEQYGCVCETQNPERGNR

SEQ ID NO: 45159 - protein, 32 aa, Artificial Sequence
  Description of Artificial Sequence: Synthetic polypeptide
AEEEIRTTNPVATEQYGSVSTTNNEQEGENNN

SEQ ID NO: 45160 - protein, 29 aa, Artificial Sequence
  Description of Artificial Sequence: Synthetic peptide
SEEEIRTTNPIATEQYGTISEDLQQQGNR

SEQ ID NO: 45161 - protein, 28 aa, Artificial Sequence
  Description of Artificial Sequence: Synthetic peptide
SEEEIRTTNPNATEEYGSVATNHGRGDA

SEQ ID NO: 45162 - protein, 30 aa, Artificial Sequence
  Description of Artificial Sequence: Synthetic polypeptide
SEEEIRTTNPISTEQYGSVSMNLQQQNGNH

SEQ ID NO: 45163 - protein, 28 aa, Artificial Sequence
  Description of Artificial Sequence: Synthetic peptide
DEGVICTTNPVATEQYGSCATNLIGGND

SEQ ID NO: 45164 - protein, 30 aa, Artificial Sequence
  Description of Artificial Sequence: Synthetic polypeptide
SEEEIRTTNPIATEQYGTVSEDIMQRNGNR

SEQ ID NO: 45165 - protein, 28 aa, Artificial Sequence
  Description of Artificial Sequence: Synthetic peptide
DEGVIRATNPVATEQYGCVATNPQDGND

SEQ ID NO: 45166 - protein, 32 aa, Artificial Sequence
  Description of Artificial Sequence: Synthetic polypeptide
DDEEIRATNPVATEQYGSVVGSTNLQNDGQTR

SEQ ID NO: 45167 - protein, 30 aa, Artificial Sequence
  Description of Artificial Sequence: Synthetic polypeptide
DEGVIRTTNPVATEQYGCVCETNPEDRGNR

SEQ ID NO: 45168 - protein, 31 aa, Artificial Sequence
  Description of Artificial Sequence: Synthetic polypeptide
DGEEIRTTNPVAYEQWGSVTSTDGLQDRGTR

SEQ ID NO: 45169 - protein, 32 aa, Artificial Sequence
  Description of Artificial Sequence: Synthetic polypeptide
DDEEIRATNPVATEQYGSVSTNLQTRNGQGGQ

SEQ ID NO: 45170 - protein, 30 aa, Artificial Sequence
  Description of Artificial Sequence: Synthetic polypeptide
DEGVISTTNPVATEQYGCVATNPQRDGNRN

SEQ ID NO: 45171 - protein, 31 aa, Artificial Sequence
  Description of Artificial Sequence: Synthetic polypeptide
DDEEIRATNPVATEQYGSVSSTNNMQEGFNN

SEQ ID NO: 45172 - protein, 32 aa, Artificial Sequence
  Description of Artificial Sequence: Synthetic polypeptide
DDEEIRATNPVATEQYGSVSSTNMDQRGNINQ

SEQ ID NO: 45173 - protein, 30 aa, Artificial Sequence
  Description of Artificial Sequence: Synthetic polypeptide
DGENIRTTNPVATEQWGSVTSTLLQRGVTI

SEQ ID NO: 45174 - protein, 29 aa, Artificial Sequence
  Description of Artificial Sequence: Synthetic peptide
DEHEIACTNPVATEQYGSVATNLERPNPN

SEQ ID NO: 45175 - protein, 29 aa, Artificial Sequence
  Description of Artificial Sequence: Synthetic peptide
DEHEIACTNPVATEQYGSVSANLGRNMER

SEQ ID NO: 45176 - protein, 31 aa, Artificial Sequence
  Description of Artificial Sequence: Synthetic polypeptide
DDEEIRATNPVATEQYGSVDTNLQARNGQGF

SEQ ID NO: 45177 - protein, 31 aa, Artificial Sequence
  Description of Artificial Sequence: Synthetic polypeptide
DDEEIRATNPVATEQYGSVSTGLQARNGQGI

SEQ ID NO: 45178 - protein, 30 aa, Artificial Sequence
  Description of Artificial Sequence: Synthetic polypeptide
DEHEIRTTNPVATDQYGSVATQDLQGGNDA

SEQ ID NO: 45179 - protein, 29 aa, Artificial Sequence
  Description of Artificial Sequence: Synthetic peptide
DEHEIRTTNPVATDQYGSVATQDQGGDND

SEQ ID NO: 45180 - protein, 30 aa, Artificial Sequence
  Description of Artificial Sequence: Synthetic polypeptide
DEHEIRTTNPVATDQYGSVATQLQGDGNDE

SEQ ID NO: 45181 - protein, 32 aa, Artificial Sequence
  Description of Artificial Sequence: Synthetic polypeptide
AEEEIRTTNPVATEQYGSVSTTNNLSNEQGNS

SEQ ID NO: 45182 - protein, 31 aa, Artificial Sequence
  Description of Artificial Sequence: Synthetic polypeptide
DEHEIRTTNPVATEQYGSVSQNLFPGNMNHN

SEQ ID NO: 45183 - protein, 30 aa, Artificial Sequence
  Description of Artificial Sequence: Synthetic polypeptide
DDAEIRTTNPVATEQYGSVSTEALQGGSDQ

SEQ ID NO: 45184 - protein, 30 aa, Artificial Sequence
  Description of Artificial Sequence: Synthetic polypeptide
SEEEIRCTNPVATEQYGTVSENPVEREGNR

SEQ ID NO: 45185 - protein, 32 aa, Artificial Sequence
  Description of Artificial Sequence: Synthetic polypeptide
DEHEIRTTNPVATEQYGSVSQTNLGEVNMNSR

SEQ ID NO: 45186 - protein, 30 aa, Artificial Sequence
  Description of Artificial Sequence: Synthetic polypeptide
DEHEIRTTNPVATEQYGSVSSQNLFENMNE

SEQ ID NO: 45187 - protein, 32 aa, Artificial Sequence
  Description of Artificial Sequence: Synthetic polypeptide
DEHEIRTTNPVATEQYGSVSSTNLDGNMGNNN

SEQ ID NO: 45188 - protein, 28 aa, Artificial Sequence
  Description of Artificial Sequence: Synthetic peptide
AENEIACTNPVATEQYGEASMNLQRGGR

SEQ ID NO: 45189 - protein, 30 aa, Artificial Sequence
  Description of Artificial Sequence: Synthetic polypeptide
DDAEIRTTNPVATEQYGCVSTNDLQSFGDA

SEQ ID NO: 45190 - protein, 31 aa, Artificial Sequence
  Description of Artificial Sequence: Synthetic polypeptide
DEHEIRTTNPVATEQYGSVSTDMCNRQNERD

SEQ ID NO: 45191 - protein, 34 aa, Artificial Sequence
  Description of Artificial Sequence: Synthetic polypeptide
DEHEIRTTNPVATEQYGSVSTGNLPQGEQGNNIR

SEQ ID NO: 45192 - protein, 34 aa, Artificial Sequence
  Description of Artificial Sequence: Synthetic polypeptide
DEHEIRTTNPVATEQYGSVSTGNLPQNAQGNNDR

SEQ ID NO: 45193 - protein, 33 aa, Artificial Sequence
  Description of Artificial Sequence: Synthetic polypeptide
DEHEIRTTNPVATEQYGSVSTNDSGADRGNDGR

SEQ ID NO: 45194 - protein, 30 aa, Artificial Sequence
  Description of Artificial Sequence: Synthetic polypeptide
DDAEIRTTNPVATEQYGCCCSTVLQHGSNR

SEQ ID NO: 45195 - protein, 32 aa, Artificial Sequence
  Description of Artificial Sequence: Synthetic polypeptide
DEHEIRTTNPVATEQYGSVSTNLNADGNNGGQ

SEQ ID NO: 45196 - protein, 32 aa, Artificial Sequence
  Description of Artificial Sequence: Synthetic polypeptide
DEHEIRTTNPVATEQYGSVSPTNSERGNNEEG

SEQ ID NO: 45197 - protein, 31 aa, Artificial Sequence
  Description of Artificial Sequence: Synthetic polypeptide
DEHEIRTTNPVATEQYGSVSPTNLENNENQG

SEQ ID NO: 45198 - protein, 28 aa, Artificial Sequence
  Description of Artificial Sequence: Synthetic peptide
SEEEIRCTNPVCTEQYGVVSDNLMSGNQ

SEQ ID NO: 45199 - protein, 32 aa, Artificial Sequence
  Description of Artificial Sequence: Synthetic polypeptide
AEEEIRTTNPVATEQYGSVSTTNNLQVTGQGE

SEQ ID NO: 45200 - protein, 32 aa, Artificial Sequence
  Description of Artificial Sequence: Synthetic polypeptide
DEHEIRTTNPVATEQYGSISWTNITQREGLER

SEQ ID NO: 45201 - protein, 30 aa, Artificial Sequence
  Description of Artificial Sequence: Synthetic polypeptide
DEHEIRTTNPVATEQYGSIWSTNTQEEGEW

SEQ ID NO: 45202 - protein, 33 aa, Artificial Sequence
  Description of Artificial Sequence: Synthetic polypeptide
AEEEIRTTNPVATEQYGSVSTTNNLQQTGNIDT

SEQ ID NO: 45203 - protein, 31 aa, Artificial Sequence
  Description of Artificial Sequence: Synthetic polypeptide
DEHEIRTTNPVATEQYGSSSTNTQQEEGELR

SEQ ID NO: 45204 - protein, 31 aa, Artificial Sequence
  Description of Artificial Sequence: Synthetic polypeptide
DEHEIRTTNPVATEQYGSSSTNTQQREGLGQ

SEQ ID NO: 45205 - protein, 30 aa, Artificial Sequence
  Description of Artificial Sequence: Synthetic polypeptide
DEHEIRTTNPVATEQYGSSSTVTQQREGLF

SEQ ID NO: 45206 - protein, 28 aa, Artificial Sequence
  Description of Artificial Sequence: Synthetic peptide
AENEIACTNPVATEQYGEASHNLQRGGR

SEQ ID NO: 45207 - protein, 31 aa, Artificial Sequence
  Description of Artificial Sequence: Synthetic polypeptide
DEHEIRTTNPVATEQYGSVSTNLNGADGDGQ

SEQ ID NO: 45208 - protein, 31 aa, Artificial Sequence
  Description of Artificial Sequence: Synthetic polypeptide
DEHEIRTTNPVATEQYGSVATDNGNQGDPNR

SEQ ID NO: 45209 - protein, 32 aa, Artificial Sequence
  Description of Artificial Sequence: Synthetic polypeptide
AEEEIRTTNPVATEQYGSVSTTNNLQTGEGVT

SEQ ID NO: 45210 - protein, 33 aa, Artificial Sequence
  Description of Artificial Sequence: Synthetic polypeptide
DEHEIRTTNPVATEQYGSVCSTNDGQERDMGIR

SEQ ID NO: 45211 - protein, 33 aa, Artificial Sequence
  Description of Artificial Sequence: Synthetic polypeptide
AEEEIRTTNPVATEQYGSVSTTNNLQTGNIGNF

SEQ ID NO: 45212 - protein, 28 aa, Artificial Sequence
  Description of Artificial Sequence: Synthetic peptide
AENEIACTNPVATEQYGEASINLQRGGR

SEQ ID NO: 45213 - protein, 28 aa, Artificial Sequence
  Description of Artificial Sequence: Synthetic peptide
AENEIACTNPVATEQYGEASKNLQRGGR

SEQ ID NO: 45214 - protein, 28 aa, Artificial Sequence
  Description of Artificial Sequence: Synthetic peptide
AENEIACTNPVATEQYGEASLNLQRGER

SEQ ID NO: 45215 - protein, 28 aa, Artificial Sequence
  Description of Artificial Sequence: Synthetic peptide
AENEIACTNPVATEQYGEASLNLQRGGR

SEQ ID NO: 45216 - protein, 28 aa, Artificial Sequence
  Description of Artificial Sequence: Synthetic peptide
SEEEIRCTNPVGTEQYGVVSSTLMRGDR

SEQ ID NO: 45217 - protein, 31 aa, Artificial Sequence
  Description of Artificial Sequence: Synthetic polypeptide
DEHEIRTTNPVATEQYGSVSTNLNGAGDTGQ

SEQ ID NO: 45218 - protein, 32 aa, Artificial Sequence
  Description of Artificial Sequence: Synthetic polypeptide
DEHEIRTTNPVATEQYGSVSTNLNGAGENGGQ

SEQ ID NO: 45219 - protein, 32 aa, Artificial Sequence
  Description of Artificial Sequence: Synthetic polypeptide
DEHEIRTTNPVATEQYGSVSTNLNQNGQDEDG

SEQ ID NO: 45220 - protein, 28 aa, Artificial Sequence
  Description of Artificial Sequence: Synthetic peptide
AENEIACTNPVATEQYGEASPNLQRGDR

SEQ ID NO: 45221 - protein, 30 aa, Artificial Sequence
  Description of Artificial Sequence: Synthetic polypeptide
SEEEIRCTNPVATEQYGSVSSENGNRGNPV

SEQ ID NO: 45222 - protein, 31 aa, Artificial Sequence
  Description of Artificial Sequence: Synthetic polypeptide
DEHEIRTTNPVATEQYGSVSTTGQDGGQNEQ

SEQ ID NO: 45223 - protein, 31 aa, Artificial Sequence
  Description of Artificial Sequence: Synthetic polypeptide
DEHEIRTTNPVATEQYGSVSTTIQGGGDNDQ

SEQ ID NO: 45224 - protein, 32 aa, Artificial Sequence
  Description of Artificial Sequence: Synthetic polypeptide
DEHEIRTTNPVATEQYGSVSTTLQDGGGDNLQ

SEQ ID NO: 45225 - protein, 32 aa, Artificial Sequence
  Description of Artificial Sequence: Synthetic polypeptide
DEHEIRTTNPVATEQYGSVSTTNAGDAGNNER

SEQ ID NO: 45226 - protein, 31 aa, Artificial Sequence
  Description of Artificial Sequence: Synthetic polypeptide
DCEEIRTTNPVATEQYGSCSTNLHRSPVNQM

SEQ ID NO: 45227 - protein, 28 aa, Artificial Sequence
  Description of Artificial Sequence: Synthetic peptide
AENEIACTNPVATEQYGEASNNLQRGGR

SEQ ID NO: 45228 - protein, 34 aa, Artificial Sequence
  Description of Artificial Sequence: Synthetic polypeptide
DEHEIRTTNPVATEQYGSVSTTNGDQERNGGNGR

SEQ ID NO: 45229 - protein, 30 aa, Artificial Sequence
  Description of Artificial Sequence: Synthetic polypeptide
QEEEIRTTNPVATEQWGSVSEVEPQDRGNG

SEQ ID NO: 45230 - protein, 29 aa, Artificial Sequence
  Description of Artificial Sequence: Synthetic peptide
DCEEIRTTNPVATEQWGAVMSVLLQRGTL

SEQ ID NO: 45231 - protein, 29 aa, Artificial Sequence
  Description of Artificial Sequence: Synthetic peptide
SEEEIRCTNPVATEQYGSVSENLMAAEDR

SEQ ID NO: 45232 - protein, 32 aa, Artificial Sequence
  Description of Artificial Sequence: Synthetic polypeptide
DCEEIRTTNPVATDQYGSVSTNGGDQGGGNHR

SEQ ID NO: 45233 - protein, 30 aa, Artificial Sequence
  Description of Artificial Sequence: Synthetic polypeptide
DCEEIRTTNPVATDQYGEVSTNGDGNGNSR

SEQ ID NO: 45234 - protein, 32 aa, Artificial Sequence
  Description of Artificial Sequence: Synthetic polypeptide
DEHEIRTTNPVATEQYGSVSTTNGQQGPNDEN

SEQ ID NO: 45235 - protein, 33 aa, Artificial Sequence
  Description of Artificial Sequence: Synthetic polypeptide
DEHEIRTTNPVATEQYGSVSTTNNGLQDGNTNE

SEQ ID NO: 45236 - protein, 33 aa, Artificial Sequence
  Description of Artificial Sequence: Synthetic polypeptide
DEHEIRTTNPVATEQYGSVSTTNGDQVNGGNER

SEQ ID NO: 45237 - protein, 31 aa, Artificial Sequence
  Description of Artificial Sequence: Synthetic polypeptide
DEHEIRTTNPVATEQYGSISTNTSTRTGGSR

SEQ ID NO: 45238 - protein, 32 aa, Artificial Sequence
  Description of Artificial Sequence: Synthetic polypeptide
DEHEIRTTNPVATEQYGSVSTTGGQQRDGDSR

SEQ ID NO: 45239 - protein, 30 aa, Artificial Sequence
  Description of Artificial Sequence: Synthetic polypeptide
DEHEIRTTNPVATEQYGSVSTTGDGQQGMA

SEQ ID NO: 45240 - protein, 33 aa, Artificial Sequence
  Description of Artificial Sequence: Synthetic polypeptide
DEHEIRTTNPVATEQYGSVSTNLQGNGGDQGRG

SEQ ID NO: 45241 - protein, 33 aa, Artificial Sequence
  Description of Artificial Sequence: Synthetic polypeptide
DEHEIRTTNPVATEQYGSVSTNLQGNQGQNGDG

SEQ ID NO: 45242 - protein, 28 aa, Artificial Sequence
  Description of Artificial Sequence: Synthetic peptide
DCTDIRTTNPCATEQWGSVSVNLHSGNR

SEQ ID NO: 45243 - protein, 33 aa, Artificial Sequence
  Description of Artificial Sequence: Synthetic polypeptide
DEHEIRTTNPVATEQYGSVSTNLQNQGGPNDAN

SEQ ID NO: 45244 - protein, 33 aa, Artificial Sequence
  Description of Artificial Sequence: Synthetic polypeptide
DEHEIRTTNPVATEQYGSVSTNLQQNGGPNENE

SEQ ID NO: 45245 - protein, 32 aa, Artificial Sequence
  Description of Artificial Sequence: Synthetic polypeptide
DEHEIRTTNPVATEQYGSVSTNNAGDVGGNER

SEQ ID NO: 45246 - protein, 31 aa, Artificial Sequence
  Description of Artificial Sequence: Synthetic polypeptide
DCGEIRTTNPVATEQYGSVSTNKLDEDPGMR

SEQ ID NO: 45247 - protein, 32 aa, Artificial Sequence
  Description of Artificial Sequence: Synthetic polypeptide
DEHEIRTTNPVATEQYGSVSTTGGLDDRQGNE

SEQ ID NO: 45248 - protein, 31 aa, Artificial Sequence
  Description of Artificial Sequence: Synthetic polypeptide
DEHEIRTTNPVATEQYGSVSTNNMQQGVQMD

SEQ ID NO: 45249 - protein, 30 aa, Artificial Sequence
  Description of Artificial Sequence: Synthetic polypeptide
DCEEISGTNPVATEQYGSVSTNQQAHNGQR

SEQ ID NO: 45250 - protein, 31 aa, Artificial Sequence
  Description of Artificial Sequence: Synthetic polypeptide
DCEEIRVTNPVATEQYGSVSTNQQAHNGQRT

SEQ ID NO: 45251 - protein, 31 aa, Artificial Sequence
  Description of Artificial Sequence: Synthetic polypeptide
DCEEIRTTNPVAYEQWGSVTSTLLQDRGTER

SEQ ID NO: 45252 - protein, 32 aa, Artificial Sequence
  Description of Artificial Sequence: Synthetic polypeptide
DEHEIRTTNPVATEQYGSVSTTDGEDRGNNDR

SEQ ID NO: 45253 - protein, 32 aa, Artificial Sequence
  Description of Artificial Sequence: Synthetic polypeptide
DCEEIRTTNPVATEQYGSVSTPNLQRVIYQDI

SEQ ID NO: 45254 - protein, 31 aa, Artificial Sequence
  Description of Artificial Sequence: Synthetic polypeptide
DCEEIRTTNPVATEQYGSVSTNIESNGDNTQ

SEQ ID NO: 45255 - protein, 30 aa, Artificial Sequence
  Description of Artificial Sequence: Synthetic polypeptide
DCEEIRTTNPVATEQYGSVSTNENRVLDDG

SEQ ID NO: 45256 - protein, 31 aa, Artificial Sequence
  Description of Artificial Sequence: Synthetic polypeptide
DEHEIRTTNPVATEQYGSVSTNNPGDGNDGI

SEQ ID NO: 45257 - protein, 32 aa, Artificial Sequence
  Description of Artificial Sequence: Synthetic polypeptide
AEEEIRTTNPVATEQYGSVSTTNLQQQTANGT

SEQ ID NO: 45258 - protein, 31 aa, Artificial Sequence
  Description of Artificial Sequence: Synthetic polypeptide
DEHEIRTTNPVATEQYGSISTNTGQGEGQSR

SEQ ID NO: 45259 - protein, 31 aa, Artificial Sequence
  Description of Artificial Sequence: Synthetic polypeptide
DEHEIRTTNPVATEQYGSISTNGNQGEGLDR

SEQ ID NO: 45260 - protein, 33 aa, Artificial Sequence
  Description of Artificial Sequence: Synthetic polypeptide
AEEEIRTTNPVATEQYGSVSTTNNLQQGENNAQ

SEQ ID NO: 45261 - protein, 32 aa, Artificial Sequence
  Description of Artificial Sequence: Synthetic polypeptide
DEHEIRTTNPVATEAYGSISTNHSQREGGSNR

SEQ ID NO: 45262 - protein, 32 aa, Artificial Sequence
  Description of Artificial Sequence: Synthetic polypeptide
DEHEIRTTNPVATEAYGSVSTNLNQQGDGNNM

SEQ ID NO: 45263 - protein, 32 aa, Artificial Sequence
  Description of Artificial Sequence: Synthetic polypeptide
DEHEIRTTNPVATEAYGSVSTNLQGNMGGDGR

SEQ ID NO: 45264 - protein, 28 aa, Artificial Sequence
  Description of Artificial Sequence: Synthetic peptide
AENEIACTNPVATEQYGEASGNLQRGGR

SEQ ID NO: 45265 - protein, 31 aa, Artificial Sequence
  Description of Artificial Sequence: Synthetic polypeptide
DEHEIRTTNPVATECWGSVTTNLQRGDDGER

SEQ ID NO: 45266 - protein, 28 aa, Artificial Sequence
  Description of Artificial Sequence: Synthetic peptide
DDECIRTTNPVATEQYGCVSTEHQYINL

SEQ ID NO: 45267 - protein, 30 aa, Artificial Sequence
  Description of Artificial Sequence: Synthetic polypeptide
DEHEIRTTNPVATECYGSVSWNEQDHGNTA

SEQ ID NO: 45268 - protein, 33 aa, Artificial Sequence
  Description of Artificial Sequence: Synthetic polypeptide
AEEEIRTTNPVATEQYGSVSTTNNLQQGIGNQD

SEQ ID NO: 45269 - protein, 31 aa, Artificial Sequence
  Description of Artificial Sequence: Synthetic polypeptide
DEYEIRTTNPVATEQYGSWSLPNMLERDDNR

SEQ ID NO: 45270 - protein, 31 aa, Artificial Sequence
  Description of Artificial Sequence: Synthetic polypeptide
DEHEIRTTNPVATEGWGSVSTNLNQGGGNSG

SEQ ID NO: 45271 - protein, 30 aa, Artificial Sequence
  Description of Artificial Sequence: Synthetic polypeptide
DEHEIRTTNPVATEGWGSVSTNLQGNDGQT

SEQ ID NO: 45272 - protein, 31 aa, Artificial Sequence
  Description of Artificial Sequence: Synthetic polypeptide
DEHEIRTTNPVATEGYGEVSTNLQGGGNGGS

SEQ ID NO: 45273 - protein, 33 aa, Artificial Sequence
  Description of Artificial Sequence: Synthetic polypeptide
AEEEIRTTNPVATEQYGSVSTTNNLQQGNEGQT

SEQ ID NO: 45274 - protein, 31 aa, Artificial Sequence
  Description of Artificial Sequence: Synthetic polypeptide
DEHEIRTTNPVATEHYGVVSTNLQFDGNNDD

SEQ ID NO: 45275 - protein, 32 aa, Artificial Sequence
  Description of Artificial Sequence: Synthetic polypeptide
DEYEIRTTNPVAYEAYGSVSCTNLSQEGGNRM

SEQ ID NO: 45276 - protein, 30 aa, Artificial Sequence
  Description of Artificial Sequence: Synthetic polypeptide
DEHEIRTTNPVATDQYGSVTNTQLQNRGED

SEQ ID NO: 45277 - protein, 31 aa, Artificial Sequence
  Description of Artificial Sequence: Synthetic polypeptide
DEHEIRTTNPVATDQYGSVSNTQLQGGGDND

SEQ ID NO: 45278 - protein, 31 aa, Artificial Sequence
  Description of Artificial Sequence: Synthetic polypeptide
DEHEIRTTNPVATDQYGSVSNTQGLQDGNDN

SEQ ID NO: 45279 - protein, 28 aa, Artificial Sequence
  Description of Artificial Sequence: Synthetic peptide
SEEEIRSVNPICTEQYGSVSENLMSGNR

SEQ ID NO: 45280 - protein, 31 aa, Artificial Sequence
  Description of Artificial Sequence: Synthetic polypeptide
DEYVIATTNPVATEQSGSVSITEFLQRQGNR

SEQ ID NO: 45281 - protein, 31 aa, Artificial Sequence
  Description of Artificial Sequence: Synthetic polypeptide
DEHEIRTTNPVATDQYGSVNETQLDQREGND

SEQ ID NO: 45282 - protein, 33 aa, Artificial Sequence
  Description of Artificial Sequence: Synthetic polypeptide
AEEEIRTTNPVATEQYGSVSTTNNLQNGEEAND

SEQ ID NO: 45283 - protein, 30 aa, Artificial Sequence
  Description of Artificial Sequence: Synthetic polypeptide
DEHEIRTTNPVATDQYGSVNNTQQQRGNQD

SEQ ID NO: 45284 - protein, 31 aa, Artificial Sequence
  Description of Artificial Sequence: Synthetic polypeptide
DEHEIRTTNPVATDQYGSVNTGLQRTGGNND

SEQ ID NO: 45285 - protein, 31 aa, Artificial Sequence
  Description of Artificial Sequence: Synthetic polypeptide
DEHEIRTTNPVATDQYGSVNTNQDLEQRGED

SEQ ID NO: 45286 - protein, 31 aa, Artificial Sequence
  Description of Artificial Sequence: Synthetic polypeptide
DEHEIRTTNPVATEIYGCVSTNLQGGPNGDM

SEQ ID NO: 45287 - protein, 33 aa, Artificial Sequence
  Description of Artificial Sequence: Synthetic polypeptide
AEEEIRTTNPVATEQYGSVSTTNNLQNNGNVSG

SEQ ID NO: 45288 - protein, 30 aa, Artificial Sequence
  Description of Artificial Sequence: Synthetic polypeptide
DEHEIRTTNPVATDQYGSVNTQLQRGTFDG

SEQ ID NO: 45289 - protein, 30 aa, Artificial Sequence
  Description of Artificial Sequence: Synthetic polypeptide
DEHEIRTTNPVATDQYGSVNTQLQRTQNDN

SEQ ID NO: 45290 - protein, 30 aa, Artificial Sequence
  Description of Artificial Sequence: Synthetic polypeptide
DEYEIYTTNPVATEQYGSVSTGLEMEAGNT

SEQ ID NO: 45291 - protein, 28 aa, Artificial Sequence
  Description of Artificial Sequence: Synthetic peptide
AENEIACTNPVATEQYGEASFNLQRGGR

SEQ ID NO: 45292 - protein, 30 aa, Artificial Sequence
  Description of Artificial Sequence: Synthetic polypeptide
DEHEIRTTNPVATDQYGSVNTTQLQRGGTD

SEQ ID NO: 45293 - protein, 32 aa, Artificial Sequence
  Description of Artificial Sequence: Synthetic polypeptide
AEEEIRTTNPVATEQYGSVSVTTNNQQQGNNN

SEQ ID NO: 45294 - protein, 28 aa, Artificial Sequence
  Description of Artificial Sequence: Synthetic peptide
SEEEIRSTNPISTEQYGSVAENLMRGQR

SEQ ID NO: 45295 - protein, 30 aa, Artificial Sequence
  Description of Artificial Sequence: Synthetic polypeptide
DEHEIRTTNPVATDQYGSVNTQDQRGGEND

SEQ ID NO: 45296 - protein, 32 aa, Artificial Sequence
  Description of Artificial Sequence: Synthetic polypeptide
DEHEIRTTNPVATEIYGSVCSNNLQRDGTNTD

SEQ ID NO: 45297 - protein, 31 aa, Artificial Sequence
  Description of Artificial Sequence: Synthetic polypeptide
DEHEIRTTNPVATEIYGTVSTNLQDGGNGNK

SEQ ID NO: 45298 - protein, 28 aa, Artificial Sequence
  Description of Artificial Sequence: Synthetic peptide
SEEEIRSTNPICTEQYGSVSENLMSGNQ

SEQ ID NO: 45299 - protein, 28 aa, Artificial Sequence
  Description of Artificial Sequence: Synthetic peptide
SEEEIRPTNPCSTEQYGIVSCNLQSGTR

SEQ ID NO: 45300 - protein, 33 aa, Artificial Sequence
  Description of Artificial Sequence: Synthetic polypeptide
SEEEIRNTNPVATEQYGSVSTGNGNMQRGENDR

SEQ ID NO: 45301 - protein, 31 aa, Artificial Sequence
  Description of Artificial Sequence: Synthetic polypeptide
DEHEIRTTNPVATEQYGCVSTVLQGDGGNET

SEQ ID NO: 45302 - protein, 33 aa, Artificial Sequence
  Description of Artificial Sequence: Synthetic polypeptide
AEEEIRTTNPVATEQYGSVSTTNNLQQQQGNNM

SEQ ID NO: 45303 - protein, 31 aa, Artificial Sequence
  Description of Artificial Sequence: Synthetic polypeptide
QEEEIRTTNPVATEQWGSVSEINCPQDRGNK

SEQ ID NO: 45304 - protein, 32 aa, Artificial Sequence
  Description of Artificial Sequence: Synthetic polypeptide
DEHEIRTTNPVATEQYGEVSTNLQGDHGGNQM

SEQ ID NO: 45305 - protein, 32 aa, Artificial Sequence
  Description of Artificial Sequence: Synthetic polypeptide
DEHEIRTTNPVATEQYGEVSTNLQNNGDNGDA

SEQ ID NO: 45306 - protein, 30 aa, Artificial Sequence
  Description of Artificial Sequence: Synthetic polypeptide
DEHEIRTTNPVATEQYGCVATNLQPGGDMQ

SEQ ID NO: 45307 - protein, 32 aa, Artificial Sequence
  Description of Artificial Sequence: Synthetic polypeptide
DEHEIRTTNPVATEQYGEVSTNLQQGDSGGNM

SEQ ID NO: 45308 - protein, 31 aa, Artificial Sequence
  Description of Artificial Sequence: Synthetic polypeptide
DEHEIRTTNPVATEQYGHVSPSNDAQRGNDD

SEQ ID NO: 45309 - protein, 30 aa, Artificial Sequence
  Description of Artificial Sequence: Synthetic polypeptide
DEHEIRTTNPVATEQYGIVCTGLQGSGNTS

SEQ ID NO: 45310 - protein, 28 aa, Artificial Sequence
  Description of Artificial Sequence: Synthetic peptide
DEHEIRTTNPVATEQYGSASEAICQGNE

SEQ ID NO: 45311 - protein, 29 aa, Artificial Sequence
  Description of Artificial Sequence: Synthetic peptide
SEEEIRCTNPVSTEPYGTISMNLQQRGNR

SEQ ID NO: 45312 - protein, 33 aa, Artificial Sequence
  Description of Artificial Sequence: Synthetic polypeptide
DEHEIRTTNPVATEQYGSISCTNTSQRTGGMNR

SEQ ID NO: 45313 - protein, 28 aa, Artificial Sequence
  Description of Artificial Sequence: Synthetic peptide
SEEEIRCTNPVSTEPYGSVSEDLMQGNR

SEQ ID NO: 45314 - protein, 31 aa, Artificial Sequence
  Description of Artificial Sequence: Synthetic polypeptide
DEHEIRTTNPVATEQYGSISTGNTQGEGDTR

SEQ ID NO: 45315 - protein, 31 aa, Artificial Sequence
  Description of Artificial Sequence: Synthetic polypeptide
DEHEIRTTNPVATEQYGEVSTNLQSNGDMGD

SEQ ID NO: 45316 - protein, 30 aa, Artificial Sequence
  Description of Artificial Sequence: Synthetic polypeptide
DEHEIRTTNPVATEQYGSISTNIQGEALMR

SEQ ID NO: 45317 - protein, 31 aa, Artificial Sequence
  Description of Artificial Sequence: Synthetic polypeptide
DEHEIRTTNPVATEQYGAVSTNIGQGNGDAR

SEQ ID NO: 45318 - protein, 30 aa, Artificial Sequence
  Description of Artificial Sequence: Synthetic polypeptide
DEHEIRTTNPVATEQWGWISTNTQGEGNLR

SEQ ID NO: 45319 - protein, 30 aa, Artificial Sequence
  Description of Artificial Sequence: Synthetic polypeptide
SEEEIRSTNPAATEQYGSVSIENMLMRGNA

SEQ ID NO: 45320 - protein, 31 aa, Artificial Sequence
  Description of Artificial Sequence: Synthetic polypeptide
DEHEIRTTNPVATENYGSVSTNGQGNGNNEP

SEQ ID NO: 45321 - protein, 33 aa, Artificial Sequence
  Description of Artificial Sequence: Synthetic polypeptide
AEEEIRTTNPVATEQYGSVSTTNNLQQQGENNE

SEQ ID NO: 45322 - protein, 31 aa, Artificial Sequence
  Description of Artificial Sequence: Synthetic polypeptide
DEHEIRTTNPVATEPYGSVCFTNQTNRAGNR

SEQ ID NO: 45323 - protein, 32 aa, Artificial Sequence
  Description of Artificial Sequence: Synthetic polypeptide
DEHEIRTTNPVATEPYGSVSTTNGQGQDGNER

SEQ ID NO: 45324 - protein, 33 aa, Artificial Sequence
  Description of Artificial Sequence: Synthetic polypeptide
DEHEIRTTNPVATEPYGSVSTTNLGQDDGNNER

SEQ ID NO: 45325 - protein, 31 aa, Artificial Sequence
  Description of Artificial Sequence: Synthetic polypeptide
DEHEIRTTNPVATEQWGEVSTNAQRDGDNGE

SEQ ID NO: 45326 - protein, 29 aa, Artificial Sequence
  Description of Artificial Sequence: Synthetic peptide
DEHEIRTTNPVATEQYASISTNIQGEAER

SEQ ID NO: 45327 - protein, 31 aa, Artificial Sequence
  Description of Artificial Sequence: Synthetic polypeptide
DEHEIRTTNPVATEQWGEVSTNLQPGGNNAQ

SEQ ID NO: 45328 - protein, 31 aa, Artificial Sequence
  Description of Artificial Sequence: Synthetic polypeptide
DDEAIRTTNPVATEQYGCVSTENHQRFGSNQ

SEQ ID NO: 45329 - protein, 29 aa, Artificial Sequence
  Description of Artificial Sequence: Synthetic peptide
DDEAIRTTNPVATEQYGCVSTEHQRSNNL

SEQ ID NO: 45330 - protein, 30 aa, Artificial Sequence
  Description of Artificial Sequence: Synthetic polypeptide
DEHEIRTTNPVATEQWGSISTNTQGEGDQR

SEQ ID NO: 45331 - protein, 30 aa, Artificial Sequence
  Description of Artificial Sequence: Synthetic polypeptide
DDEAIRTTNPVATEQYGCVCSTNHQRNSNQ

SEQ ID NO: 45332 - protein, 31 aa, Artificial Sequence
  Description of Artificial Sequence: Synthetic polypeptide
DEHEIRTTNPVATEQWGSSPSDTNLGDPGNR

SEQ ID NO: 45333 - protein, 33 aa, Artificial Sequence
  Description of Artificial Sequence: Synthetic polypeptide
AEEEIRTTNPVATEQYGSVSTTNNLQQQIGNQN

SEQ ID NO: 45334 - protein, 31 aa, Artificial Sequence
  Description of Artificial Sequence: Synthetic polypeptide
DEHEIRTTNPVATEQWGSVSQTNLGEHNMNR

SEQ ID NO: 45335 - protein, 33 aa, Artificial Sequence
  Description of Artificial Sequence: Synthetic polypeptide
AEEEIRTTNPVATEQYGSVSTTNNLQQQGNQES

SEQ ID NO: 45336 - protein, 32 aa, Artificial Sequence
  Description of Artificial Sequence: Synthetic polypeptide
AEEEIRTTNPVATEQYGSVSTTNLQQQTANDT

SEQ ID NO: 45337 - protein, 32 aa, Artificial Sequence
  Description of Artificial Sequence: Synthetic polypeptide
DEGEIRTTNPVATEQYGSVWNTYNLQRSVNLM

SEQ ID NO: 45338 - protein, 32 aa, Artificial Sequence
  Description of Artificial Sequence: Synthetic polypeptide
DDEEIRSTNPVATEQYGQSVCSTNLQERSGQQ

SEQ ID NO: 45339 - protein, 30 aa, Artificial Sequence
  Description of Artificial Sequence: Synthetic polypeptide
DEGEIATTNPCSTEQYGSVSSTNLNSGMNR

SEQ ID NO: 45340 - protein, 33 aa, Artificial Sequence
  Description of Artificial Sequence: Synthetic polypeptide
AEEEIRTTNPVATEQYGSVSTTNLNQQGNESND

SEQ ID NO: 45341 - protein, 29 aa, Artificial Sequence
  Description of Artificial Sequence: Synthetic peptide
SEEEIRTTNPVATEQWGDVSEILMRAGNA

SEQ ID NO: 45342 - protein, 33 aa, Artificial Sequence
  Description of Artificial Sequence: Synthetic polypeptide
AEEEIRTTNPVATEQYGSVSTTNLNQQTGGTNQ

SEQ ID NO: 45343 - protein, 33 aa, Artificial Sequence
  Description of Artificial Sequence: Synthetic polypeptide
AEEEIRTTNPVATEQYGSVSTTNLNQTGTNEAN

SEQ ID NO: 45344 - protein, 33 aa, Artificial Sequence
  Description of Artificial Sequence: Synthetic polypeptide
AEEEIRTTNPVATEQYGSVSTTNLNQVENGNNL

SEQ ID NO: 45345 - protein, 32 aa, Artificial Sequence
  Description of Artificial Sequence: Synthetic polypeptide
AEEEIRTTNPVATEQYGSVSTTNLNQVNGQGE

SEQ ID NO: 45346 - protein, 32 aa, Artificial Sequence
  Description of Artificial Sequence: Synthetic polypeptide
AEEEIRTTNPVATEQYGSVSTTNLNQVNGVTI

SEQ ID NO: 45347 - protein, 33 aa, Artificial Sequence
  Description of Artificial Sequence: Synthetic polypeptide
AEEEIRTTNPVATEQYGSVSTTNLQAGGNGTGE

SEQ ID NO: 45348 - protein, 30 aa, Artificial Sequence
  Description of Artificial Sequence: Synthetic polypeptide
DEGEIATTNPVATEPYGSVAATNLQQGNDL

SEQ ID NO: 45349 - protein, 30 aa, Artificial Sequence
  Description of Artificial Sequence: Synthetic polypeptide
DEGEIATTNPVATEPYGSVAATNLQQGNQN

SEQ ID NO: 45350 - protein, 33 aa, Artificial Sequence
  Description of Artificial Sequence: Synthetic polypeptide
AEEEIRTTNPVATEQYGSVSTTNLQAGNTEGND

SEQ ID NO: 45351 - protein, 33 aa, Artificial Sequence
  Description of Artificial Sequence: Synthetic polypeptide
AEEEIRTTNPVATEQYGSVSTTNLQDNQGENTE

SEQ ID NO: 45352 - protein, 31 aa, Artificial Sequence
  Description of Artificial Sequence: Synthetic polypeptide
DDEEIRTTNPVATEQWGSVVTSTLDQREGTR

SEQ ID NO: 45353 - protein, 32 aa, Artificial Sequence
  Description of Artificial Sequence: Synthetic polypeptide
AEEEIRTTNPVATEQYGSVSTTNLQEDEENEG

SEQ ID NO: 45354 - protein, 33 aa, Artificial Sequence
  Description of Artificial Sequence: Synthetic polypeptide
AEEEIRTTNPVATEQYGSVSTTNLNQQGGNNNQ

SEQ ID NO: 45355 - protein, 33 aa, Artificial Sequence
  Description of Artificial Sequence: Synthetic polypeptide
AEEEIRTTNPVATEQYGSVSTTNLNQQENGNND

SEQ ID NO: 45356 - protein, 32 aa, Artificial Sequence
  Description of Artificial Sequence: Synthetic polypeptide
DDEEIRTTNPVATEQYGCQVYSTPLELRGNPR

SEQ ID NO: 45357 - protein, 30 aa, Artificial Sequence
  Description of Artificial Sequence: Synthetic polypeptide
SEEEIRTTNPVATEQWGSVATNLQQGDEQA

SEQ ID NO: 45358 - protein, 31 aa, Artificial Sequence
  Description of Artificial Sequence: Synthetic polypeptide
SEEEIRTTNPVATEQYGCVATNLQAEEGTRN

SEQ ID NO: 45359 - protein, 28 aa, Artificial Sequence
  Description of Artificial Sequence: Synthetic peptide
DEGEIAPTNPVSSEQYGIVSCNLQSGNR

SEQ ID NO: 45360 - protein, 33 aa, Artificial Sequence
  Description of Artificial Sequence: Synthetic polypeptide
AEEEIRTTNPVATEQYGSVSTTNLNQDEGNNEQ

SEQ ID NO: 45361 - protein, 28 aa, Artificial Sequence
  Description of Artificial Sequence: Synthetic peptide
DEGEIAPTNPVSSEQYGSVSCNLQSGER

SEQ ID NO: 45362 - protein, 28 aa, Artificial Sequence
  Description of Artificial Sequence: Synthetic peptide
DEGEIAPTNPVSSEQYGSVSCNLQSGTR

SEQ ID NO: 45363 - protein, 32 aa, Artificial Sequence
  Description of Artificial Sequence: Synthetic polypeptide
AEEEIRTTNPVATEQYGSVSTTNLNQEDTNDG

SEQ ID NO: 45364 - protein, 32 aa, Artificial Sequence
  Description of Artificial Sequence: Synthetic polypeptide
AEEEIRTTNPVATEQYGSVSTTNLNQEDTNGN

SEQ ID NO: 45365 - protein, 32 aa, Artificial Sequence
  Description of Artificial Sequence: Synthetic polypeptide
AEEEIRTTNPVATEQYGSVSTTNLQEEDTENG

SEQ ID NO: 45366 - protein, 33 aa, Artificial Sequence
  Description of Artificial Sequence: Synthetic polypeptide
AEEEIRTTNPVATEQYGSVSTTNLNQESGTNNT

SEQ ID NO: 45367 - protein, 30 aa, Artificial Sequence
  Description of Artificial Sequence: Synthetic polypeptide
DEGEIATTNPCATEQWGIVSCNLQREGENR

SEQ ID NO: 45368 - protein, 31 aa, Artificial Sequence
  Description of Artificial Sequence: Synthetic polypeptide
SEEEIRTTNPVATEQWGSVSCINLPMRGENG

SEQ ID NO: 45369 - protein, 33 aa, Artificial Sequence
  Description of Artificial Sequence: Synthetic polypeptide
AEEEIRTTNPVATEQYGSVSTTNLNQGQGTEND

SEQ ID NO: 45370 - protein, 31 aa, Artificial Sequence
  Description of Artificial Sequence: Synthetic polypeptide
SEEEIRTTNPVATEQWGSVSCINEPQRGENG

SEQ ID NO: 45371 - protein, 30 aa, Artificial Sequence
  Description of Artificial Sequence: Synthetic polypeptide
DEGEIATTNPCATEQYGIVSSCNLPQRGTR

SEQ ID NO: 45372 - protein, 31 aa, Artificial Sequence
  Description of Artificial Sequence: Synthetic polypeptide
AEEEIRTTNPVATEQYGSVSVTTTGEQGGND

SEQ ID NO: 45373 - protein, 33 aa, Artificial Sequence
  Description of Artificial Sequence: Synthetic polypeptide
AEEEIRTTNPVATEQYGSVSTTNLNQNNGINTV

SEQ ID NO: 45374 - protein, 32 aa, Artificial Sequence
  Description of Artificial Sequence: Synthetic polypeptide
AEEEIRTTNPVATEQYGSVSTTNLNQGNAQGE

SEQ ID NO: 45375 - protein, 31 aa, Artificial Sequence
  Description of Artificial Sequence: Synthetic polypeptide
AEEEIRTTNPVATEQYGSVSTTNLQENEEEE

SEQ ID NO: 45376 - protein, 28 aa, Artificial Sequence
  Description of Artificial Sequence: Synthetic peptide
QEEEIRTTNPIATECYGSVSECLQHEER

SEQ ID NO: 45377 - protein, 30 aa, Artificial Sequence
  Description of Artificial Sequence: Synthetic polypeptide
DEGEIATTNPVATEQWGSVSQNPQERGNED

SEQ ID NO: 45378 - protein, 32 aa, Artificial Sequence
  Description of Artificial Sequence: Synthetic polypeptide
AEEEIRTTNPVATEQYGSVSTTNLQGQGETGN

SEQ ID NO: 45379 - protein, 33 aa, Artificial Sequence
  Description of Artificial Sequence: Synthetic polypeptide
AEEEIRTTNPVATEQYGSVSTTNLQGQGNNNTQ

SEQ ID NO: 45380 - protein, 32 aa, Artificial Sequence
  Description of Artificial Sequence: Synthetic polypeptide
AEEEIRTTNPVATEQYGSVSTTNLQGQGTQID

SEQ ID NO: 45381 - protein, 30 aa, Artificial Sequence
  Description of Artificial Sequence: Synthetic polypeptide
DDEEIRTTNPVATEQWGSQTSTLLQRGTVG

SEQ ID NO: 45382 - protein, 28 aa, Artificial Sequence
  Description of Artificial Sequence: Synthetic peptide
DEGEIATTNPVATEQYGSVATALIHMER

SEQ ID NO: 45383 - protein, 29 aa, Artificial Sequence
  Description of Artificial Sequence: Synthetic peptide
DEGEIATTNPVATEQYGSVATALIRSNDM

SEQ ID NO: 45384 - protein, 30 aa, Artificial Sequence
  Description of Artificial Sequence: Synthetic polypeptide
DEGEIATTNPVATEQYGSVATALTGEMGNR

SEQ ID NO: 45385 - protein, 29 aa, Artificial Sequence
  Description of Artificial Sequence: Synthetic peptide
DEGEIATTNPVATEQYGSVAMNLQQNNDL

SEQ ID NO: 45386 - protein, 30 aa, Artificial Sequence
  Description of Artificial Sequence: Synthetic polypeptide
DEGEIATTNPVATEQYGSVATNLDRPNDAE

SEQ ID NO: 45387 - protein, 30 aa, Artificial Sequence
  Description of Artificial Sequence: Synthetic polypeptide
DEGEIATTNPVATEQYGSVATNLEAGENEE

SEQ ID NO: 45388 - protein, 33 aa, Artificial Sequence
  Description of Artificial Sequence: Synthetic polypeptide
AEEEIRTTNPVATEQYGSVSTTNLQGQNGETNA

SEQ ID NO: 45389 - protein, 33 aa, Artificial Sequence
  Description of Artificial Sequence: Synthetic polypeptide
AEEEIRTTNPVATEQYGSVSTTNLQGQNGNNED

SEQ ID NO: 45390 - protein, 30 aa, Artificial Sequence
  Description of Artificial Sequence: Synthetic polypeptide
DEGEIATTNPVATEQYGSVATNLERGDTEN

SEQ ID NO: 45391 - protein, 30 aa, Artificial Sequence
  Description of Artificial Sequence: Synthetic polypeptide
DEGEIATTNPVATEQYGSVATNLERPDNPE

SEQ ID NO: 45392 - protein, 32 aa, Artificial Sequence
  Description of Artificial Sequence: Synthetic polypeptide
AEEEIRTTNPVATEQYGSVSTTNLQGQNNQNE

SEQ ID NO: 45393 - protein, 33 aa, Artificial Sequence
  Description of Artificial Sequence: Synthetic polypeptide
AEEEIRTTNPVATEQYGSVSTTNLQGVTGNQGE

SEQ ID NO: 45394 - protein, 33 aa, Artificial Sequence
  Description of Artificial Sequence: Synthetic polypeptide
AEEEIRTTNPVATEQYGSVSTTNLQGQGTTTND

SEQ ID NO: 45395 - protein, 28 aa, Artificial Sequence
  Description of Artificial Sequence: Synthetic peptide
DEGEIAPTNPVASEQYGIVSCNLQFGTR

SEQ ID NO: 45396 - protein, 31 aa, Artificial Sequence
  Description of Artificial Sequence: Synthetic polypeptide
DDEEIRTTNPVATEQWGSVTSTDLQRGMGDG

SEQ ID NO: 45397 - protein, 30 aa, Artificial Sequence
  Description of Artificial Sequence: Synthetic polypeptide
DDEEIRTTNPVATEQWGSVTSTELQNGTAS

SEQ ID NO: 45398 - protein, 28 aa, Artificial Sequence
  Description of Artificial Sequence: Synthetic peptide
QEEEIRTTNPIATECYGSVSENLMHENL

SEQ ID NO: 45399 - protein, 29 aa, Artificial Sequence
  Description of Artificial Sequence: Synthetic peptide
AENEIACTNPVATEQYGEASENLQRGGNR

SEQ ID NO: 45400 - protein, 32 aa, Artificial Sequence
  Description of Artificial Sequence: Synthetic polypeptide
AEEEIRTTNPVATEQYGSVSTTNLQGGQGTIG

SEQ ID NO: 45401 - protein, 32 aa, Artificial Sequence
  Description of Artificial Sequence: Synthetic polypeptide
AEEEIRTTNPVATEQYGSVSTTNLQGNDTTDT

SEQ ID NO: 45402 - protein, 33 aa, Artificial Sequence
  Description of Artificial Sequence: Synthetic polypeptide
AEEEIRTTNPVATEQYGSVSTTNLQGNGNNQNQ

SEQ ID NO: 45403 - protein, 29 aa, Artificial Sequence
  Description of Artificial Sequence: Synthetic peptide
DEGEIATTNPVATEQYGCVATNLQENGDE

SEQ ID NO: 45404 - protein, 33 aa, Artificial Sequence
  Description of Artificial Sequence: Synthetic polypeptide
AEEEIRTTNPVATEQYGSVSTTNLQGNLGINAT

SEQ ID NO: 45405 - protein, 33 aa, Artificial Sequence
  Description of Artificial Sequence: Synthetic polypeptide
AEEEIRTTNPVATEQYGSVSTTNLQGQEGENEG

SEQ ID NO: 45406 - protein, 31 aa, Artificial Sequence
  Description of Artificial Sequence: Synthetic polypeptide
DDEEIRTTNPVATEQWGSVVSTLLQRVGTDD

SEQ ID NO: 45407 - protein, 29 aa, Artificial Sequence
  Description of Artificial Sequence: Synthetic peptide
DEGEIATTNPVATEQYGIVSTDLESEGER

SEQ ID NO: 45408 - protein, 32 aa, Artificial Sequence
  Description of Artificial Sequence: Synthetic polypeptide
SEEEIRTTNPVATEMYGSVSTNLQQPGEDTRA

SEQ ID NO: 45409 - protein, 31 aa, Artificial Sequence
  Description of Artificial Sequence: Synthetic polypeptide
AEEEIRTTNPVATEQYGSVSTTNLQGQDTII

SEQ ID NO: 45410 - protein, 31 aa, Artificial Sequence
  Description of Artificial Sequence: Synthetic polypeptide
DDEEIRTTNPVATEQWGSVTSVTLLQRGTIQ

SEQ ID NO: 45411 - protein, 31 aa, Artificial Sequence
  Description of Artificial Sequence: Synthetic polypeptide
DDEEIRTTNPVATEQWGSVTSVTLLQRGTDD

SEQ ID NO: 45412 - protein, 31 aa, Artificial Sequence
  Description of Artificial Sequence: Synthetic polypeptide
DDEEIRTTNPVATEQWGSVTSTLLQRFGDAG

SEQ ID NO: 45413 - protein, 30 aa, Artificial Sequence
  Description of Artificial Sequence: Synthetic polypeptide
DDEEIRTTNPVATEQWGSVTSTELQNSGDA

SEQ ID NO: 45414 - protein, 33 aa, Artificial Sequence
  Description of Artificial Sequence: Synthetic polypeptide
AEEEIRTTNPVATEQYGSVSTTNLQGNLGINNN

SEQ ID NO: 45415 - protein, 32 aa, Artificial Sequence
  Description of Artificial Sequence: Synthetic polypeptide
AEEEIRTTNPVATEQYGSVSTTNLQLNSNNAN

SEQ ID NO: 45416 - protein, 32 aa, Artificial Sequence
  Description of Artificial Sequence: Synthetic polypeptide
AEEEIRTTNPVATEQYGSVSTTNLNLNVGGNE

SEQ ID NO: 45417 - protein, 31 aa, Artificial Sequence
  Description of Artificial Sequence: Synthetic polypeptide
AEEEIRTTNPVATEQYGSVSVTTTGGQGGND

SEQ ID NO: 45418 - protein, 31 aa, Artificial Sequence
  Description of Artificial Sequence: Synthetic polypeptide
DEFVIGTTNPVATEQMGSVSTDFLQRGSNDR

SEQ ID NO: 45419 - protein, 33 aa, Artificial Sequence
  Description of Artificial Sequence: Synthetic polypeptide
SEEEIRTTNPVATEQYGCVCSTNLQERSGSNQS

SEQ ID NO: 45420 - protein, 29 aa, Artificial Sequence
  Description of Artificial Sequence: Synthetic peptide
DEFVIGTTNPVATEQWGSVSTEWLQYGNQ

SEQ ID NO: 45421 - protein, 29 aa, Artificial Sequence
  Description of Artificial Sequence: Synthetic peptide
DEFVIGTTNPVATEQYGCVETDPQRGNNR

SEQ ID NO: 45422 - protein, 31 aa, Artificial Sequence
  Description of Artificial Sequence: Synthetic polypeptide
DEFVIKTTNPVATEQWGSVSTDELSQRGTNR

SEQ ID NO: 45423 - protein, 33 aa, Artificial Sequence
  Description of Artificial Sequence: Synthetic polypeptide
AEEEIRTTNPVATEQYGSVSTTNLLQNNQGNEG

SEQ ID NO: 45424 - protein, 33 aa, Artificial Sequence
  Description of Artificial Sequence: Synthetic polypeptide
AEEEIRTTNPVATEQYGSVSTTNLLQNQGTNEG

SEQ ID NO: 45425 - protein, 29 aa, Artificial Sequence
  Description of Artificial Sequence: Synthetic peptide
DEFVIRTTNPVATEQYGCVETAPQRGDNE

SEQ ID NO: 45426 - protein, 33 aa, Artificial Sequence
  Description of Artificial Sequence: Synthetic polypeptide
AEEEIRTTNPVATEQYGSVSTTNLLQNQNGTNA

SEQ ID NO: 45427 - protein, 31 aa, Artificial Sequence
  Description of Artificial Sequence: Synthetic polypeptide
DDEEIRTTNPVATEQYGCVCSTNLQASGSDQ

SEQ ID NO: 45428 - protein, 33 aa, Artificial Sequence
  Description of Artificial Sequence: Synthetic polypeptide
AEEEIRTTNPVATEQYGSVSTTNLLQQENGTNS

SEQ ID NO: 45429 - protein, 29 aa, Artificial Sequence
  Description of Artificial Sequence: Synthetic peptide
DNEEISTTNPVATTQYGSVSTNPMAVNSR

SEQ ID NO: 45430 - protein, 30 aa, Artificial Sequence
  Description of Artificial Sequence: Synthetic polypeptide
DEFVIRTTNPVATEQYGCVETPNPQRDNQR

SEQ ID NO: 45431 - protein, 30 aa, Artificial Sequence
  Description of Artificial Sequence: Synthetic polypeptide
DEFVIRTTNPVATEQYGCVETPNQRGNQRP

SEQ ID NO: 45432 - protein, 30 aa, Artificial Sequence
  Description of Artificial Sequence: Synthetic polypeptide
DEFVIRTTNPVATEQYGCVETYDPQRGNQR

SEQ ID NO: 45433 - protein, 31 aa, Artificial Sequence
  Description of Artificial Sequence: Synthetic polypeptide
DEFVIGTTNPVATEQMGSVCSTMDFLQRGNR

SEQ ID NO: 45434 - protein, 32 aa, Artificial Sequence
  Description of Artificial Sequence: Synthetic polypeptide
AEEEIRTTNPVATEQYGSVSTTNLLQGQENND

SEQ ID NO: 45435 - protein, 32 aa, Artificial Sequence
  Description of Artificial Sequence: Synthetic polypeptide
SEEEIRTTNPVATEQYGCVCSTNLQGFGSNQA

SEQ ID NO: 45436 - protein, 30 aa, Artificial Sequence
  Description of Artificial Sequence: Synthetic polypeptide
DEFVIGTTNPVATEQDGSVSTDALQRGDRQ

SEQ ID NO: 45437 - protein, 29 aa, Artificial Sequence
  Description of Artificial Sequence: Synthetic peptide
DEFEIRTTNPVATDQYGSVNTQDEQRGED

SEQ ID NO: 45438 - protein, 34 aa, Artificial Sequence
  Description of Artificial Sequence: Synthetic polypeptide
DDEEIRTTNPVATEQYGESVSTPNLQSGGNNGRP

SEQ ID NO: 45439 - protein, 29 aa, Artificial Sequence
  Description of Artificial Sequence: Synthetic peptide
AENEIACTNPVATEQYGEASENLQREGNR

SEQ ID NO: 45440 - protein, 29 aa, Artificial Sequence
  Description of Artificial Sequence: Synthetic peptide
DEFEISTVNPVATEQYGCVTSTNLFHGNA

SEQ ID NO: 45441 - protein, 33 aa, Artificial Sequence
  Description of Artificial Sequence: Synthetic polypeptide
AEEEIRTTNPVATEQYGSVSTTNLLNQQGNATE

SEQ ID NO: 45442 - protein, 31 aa, Artificial Sequence
  Description of Artificial Sequence: Synthetic polypeptide
SEEEIRTTNPVATEQYGCVCSTNPQRNSNQD

SEQ ID NO: 45443 - protein, 30 aa, Artificial Sequence
  Description of Artificial Sequence: Synthetic polypeptide
DDEEIRTTNPVATEQYGCVSWELQGFGSNQ

SEQ ID NO: 45444 - protein, 30 aa, Artificial Sequence
  Description of Artificial Sequence: Synthetic polypeptide
DEFVIRTTNPVATEQYGCVEYNPQRGNQRE

SEQ ID NO: 45445 - protein, 32 aa, Artificial Sequence
  Description of Artificial Sequence: Synthetic polypeptide
DDEEIRTTNPVATEQYGCVSTGNLQHFGSERD

SEQ ID NO: 45446 - protein, 32 aa, Artificial Sequence
  Description of Artificial Sequence: Synthetic polypeptide
DDEEIRTTNPVATEQYGCVSTGNHQRFGSNQN

SEQ ID NO: 45447 - protein, 29 aa, Artificial Sequence
  Description of Artificial Sequence: Synthetic peptide
DEFVIGTTNPVATEGMGSVSTDFLERGNR

SEQ ID NO: 45448 - protein, 30 aa, Artificial Sequence
  Description of Artificial Sequence: Synthetic polypeptide
DEFVIGTTNPVATEQAGSVSETTFLERGNR

SEQ ID NO: 45449 - protein, 29 aa, Artificial Sequence
  Description of Artificial Sequence: Synthetic peptide
DEFVIGTTNPVATEQDGSSSTDAMQRGNR

SEQ ID NO: 45450 - protein, 30 aa, Artificial Sequence
  Description of Artificial Sequence: Synthetic polypeptide
DEFVIGTTNPVATEQDGSVISTDFTQRGNR

SEQ ID NO: 45451 - protein, 30 aa, Artificial Sequence
  Description of Artificial Sequence: Synthetic polypeptide
DEFVIGTTNPVATEQDGSVSDTDFSQRGNR

SEQ ID NO: 45452 - protein, 33 aa, Artificial Sequence
  Description of Artificial Sequence: Synthetic polypeptide
AEEEIRTTNPVATEQYGSVSTTNLLQGNGGINE

SEQ ID NO: 45453 - protein, 33 aa, Artificial Sequence
  Description of Artificial Sequence: Synthetic polypeptide
AEEEIRTTNPVATEQYGSVSTTNLLQDENGTNS

SEQ ID NO: 45454 - protein, 31 aa, Artificial Sequence
  Description of Artificial Sequence: Synthetic polypeptide
SEEEIRTTNPVATEQYGCVCSTNHQRNSNFQ

SEQ ID NO: 45455 - protein, 29 aa, Artificial Sequence
  Description of Artificial Sequence: Synthetic peptide
DEGAICTTNPVATEQYGSCSTNLIIENRE

SEQ ID NO: 45456 - protein, 28 aa, Artificial Sequence
  Description of Artificial Sequence: Synthetic peptide
AENEIACTNPVATEQYGEASENLQRGAR

SEQ ID NO: 45457 - protein, 29 aa, Artificial Sequence
  Description of Artificial Sequence: Synthetic peptide
DEGAISTTNPVATEQYGSFSTGNLIIGER

SEQ ID NO: 45458 - protein, 31 aa, Artificial Sequence
  Description of Artificial Sequence: Synthetic polypeptide
DEGCIRTTNPVATEQYGSTISTNELSIIGNR

SEQ ID NO: 45459 - protein, 28 aa, Artificial Sequence
  Description of Artificial Sequence: Synthetic peptide
AENEIACTNPVATEQYGEASENLQRGFR

SEQ ID NO: 45460 - protein, 32 aa, Artificial Sequence
  Description of Artificial Sequence: Synthetic polypeptide
DDEEIRTTNPVATEQYGCVCSNTNLQGGSNIA

SEQ ID NO: 45461 - protein, 29 aa, Artificial Sequence
  Description of Artificial Sequence: Synthetic peptide
DEGEIACTNPVATEHYGVVSTNLQRGDQY

SEQ ID NO: 45462 - protein, 30 aa, Artificial Sequence
  Description of Artificial Sequence: Synthetic polypeptide
DEGEIACTNPVATEHYGVVSTNLQRGNENP

SEQ ID NO: 45463 - protein, 30 aa, Artificial Sequence
  Description of Artificial Sequence: Synthetic polypeptide
DEGEIACTNPVATEQYGSVATNLEDRGNED

SEQ ID NO: 45464 - protein, 28 aa, Artificial Sequence
  Description of Artificial Sequence: Synthetic peptide
DEGAISTTNPVATEQWGSFSTNDIIGNR

SEQ ID NO: 45465 - protein, 32 aa, Artificial Sequence
  Description of Artificial Sequence: Synthetic polypeptide
AEEEIRTTNPVATEQYGSVSTTNLLQQVNGTI

SEQ ID NO: 45466 - protein, 30 aa, Artificial Sequence
  Description of Artificial Sequence: Synthetic polypeptide
DEGEIACTNPVATEQYGSVATNLERGNPEN

SEQ ID NO: 45467 - protein, 32 aa, Artificial Sequence
  Description of Artificial Sequence: Synthetic polypeptide
AEEEIRTTNPVATEQYGSVSTTNLMNGGNNNT

SEQ ID NO: 45468 - protein, 31 aa, Artificial Sequence
  Description of Artificial Sequence: Synthetic polypeptide
SEEEIRTTNPVATEQYGCVATNLQRENPNES

SEQ ID NO: 45469 - protein, 31 aa, Artificial Sequence
  Description of Artificial Sequence: Synthetic polypeptide
AEEEIRTTNPVATEQYGSVSTTNLNEDTNTN

SEQ ID NO: 45470 - protein, 30 aa, Artificial Sequence
  Description of Artificial Sequence: Synthetic polypeptide
DNEEISTTNPVATLQYGSVSTNDPMDVGNR

SEQ ID NO: 45471 - protein, 32 aa, Artificial Sequence
  Description of Artificial Sequence: Synthetic polypeptide
AEEEIRTTNPVATEQYGSVSTTNLNGGINNNL

SEQ ID NO: 45472 - protein, 31 aa, Artificial Sequence
  Description of Artificial Sequence: Synthetic polypeptide
DNEEISTTNPVATDQYGSVSTNPEVRNGNMR

SEQ ID NO: 45473 - protein, 28 aa, Artificial Sequence
  Description of Artificial Sequence: Synthetic peptide
DNEEISTTNPVATTQYGQVSTNIMGVNR

SEQ ID NO: 45474 - protein, 32 aa, Artificial Sequence
  Description of Artificial Sequence: Synthetic polypeptide
AEEEIRTTNPVATEQYGSVSTTNLNGGINNSE

SEQ ID NO: 45475 - protein, 29 aa, Artificial Sequence
  Description of Artificial Sequence: Synthetic peptide
DEGAISTTNPVATEQWGSCSTNLIIGNER

SEQ ID NO: 45476 - protein, 31 aa, Artificial Sequence
  Description of Artificial Sequence: Synthetic polypeptide
SEEEIRTTNPVATEQYGCVCSTALQFFGSDR

SEQ ID NO: 45477 - protein, 30 aa, Artificial Sequence
  Description of Artificial Sequence: Synthetic polypeptide
DEGAIRCTNPVATEQYGSFSETNLIIGENR

SEQ ID NO: 45478 - protein, 29 aa, Artificial Sequence
  Description of Artificial Sequence: Synthetic peptide
DEGAIRTTNPEATEQYGSFSTPNLIIGER

SEQ ID NO: 45479 - protein, 30 aa, Artificial Sequence
  Description of Artificial Sequence: Synthetic polypeptide
DEGAIRTTNPVATEQWGSCSTNLIGDGQNR

SEQ ID NO: 45480 - protein, 32 aa, Artificial Sequence
  Description of Artificial Sequence: Synthetic polypeptide
AEEEIRTTNPVATEQYGSVSTTNLLQQNDTNT

SEQ ID NO: 45481 - protein, 28 aa, Artificial Sequence
  Description of Artificial Sequence: Synthetic peptide
AENEIACTNPVATEQYGEASENLQRGDR

SEQ ID NO: 45482 - protein, 28 aa, Artificial Sequence
  Description of Artificial Sequence: Synthetic peptide
QEEEIRTTNPIATECYGSVSECLMHGNL

SEQ ID NO: 45483 - protein, 30 aa, Artificial Sequence
  Description of Artificial Sequence: Synthetic polypeptide
DEGAIRTTNPVATEQYGSFSETNLIIGDNQ

SEQ ID NO: 45484 - protein, 28 aa, Artificial Sequence
  Description of Artificial Sequence: Synthetic peptide
AENEIACTNPVATEQYGEASENLQRGER

SEQ ID NO: 45485 - protein, 30 aa, Artificial Sequence
  Description of Artificial Sequence: Synthetic polypeptide
DEGAIRTTNPVATEQYGSFSPTNLIEIGER

SEQ ID NO: 45486 - protein, 30 aa, Artificial Sequence
  Description of Artificial Sequence: Synthetic polypeptide
DEGAIRTTNPVATEQYGSFSTLNLIEIQNR

SEQ ID NO: 45487 - protein, 31 aa, Artificial Sequence
  Description of Artificial Sequence: Synthetic polypeptide
DDEEIRTTNPVATEQYGCVCSSNLQGGSNQA

SEQ ID NO: 45488 - protein, 33 aa, Artificial Sequence
  Description of Artificial Sequence: Synthetic polypeptide
AEEEIRTTNPVATEQYGSVSTTNLLQQQGNNQG

SEQ ID NO: 45489 - protein, 31 aa, Artificial Sequence
  Description of Artificial Sequence: Synthetic polypeptide
DEGAIRTTNPVATEQYGSISTNALGITGGNR

SEQ ID NO: 45490 - protein, 32 aa, Artificial Sequence
  Description of Artificial Sequence: Synthetic polypeptide
DEGAIRTTNPVATEQYGSVISTNELSGIGGNR

SEQ ID NO: 45491 - protein, 33 aa, Artificial Sequence
  Description of Artificial Sequence: Synthetic polypeptide
AEEEIRTTNPVATEQYGSVSVTTTNLQAGINTE

SEQ ID NO: 45492 - protein, 33 aa, Artificial Sequence
  Description of Artificial Sequence: Synthetic polypeptide
AEEEIRTTNPVATEQYGSVSTTNLLQQQIGNNE

SEQ ID NO: 45493 - protein, 29 aa, Artificial Sequence
  Description of Artificial Sequence: Synthetic peptide
DEGAIRTTNPVATEQYGSFSTLLIEIGNE

SEQ ID NO: 45494 - protein, 32 aa, Artificial Sequence
  Description of Artificial Sequence: Synthetic polypeptide
AEEEIRTTNPVATEQYGSVSTNNNNQQIGNTG

SEQ ID NO: 45495 - protein, 32 aa, Artificial Sequence
  Description of Artificial Sequence: Synthetic polypeptide
AEEEIRTTNPVATEQYGSVSTTNLQLNSTNQA

SEQ ID NO: 45496 - protein, 29 aa, Artificial Sequence
  Description of Artificial Sequence: Synthetic peptide
SEEEIRTTNPVATEMYGSVATNLQQEDTA

SEQ ID NO: 45497 - protein, 31 aa, Artificial Sequence
  Description of Artificial Sequence: Synthetic polypeptide
SEEEIRTTNPVATEEYGSVCSNTNLAYGDQR

SEQ ID NO: 45498 - protein, 28 aa, Artificial Sequence
  Description of Artificial Sequence: Synthetic peptide
AENEIACTNPVATEQYGEASENLQRGQR

SEQ ID NO: 45499 - protein, 31 aa, Artificial Sequence
  Description of Artificial Sequence: Synthetic polypeptide
DMEEIRSTNPVATEQYGSVSTTNLETGNGQI

SEQ ID NO: 45500 - protein, 31 aa, Artificial Sequence
  Description of Artificial Sequence: Synthetic polypeptide
DEGEIRTTNPVATEQYGCVSTVLQSRGEDII

SEQ ID NO: 45501 - protein, 30 aa, Artificial Sequence
  Description of Artificial Sequence: Synthetic polypeptide
SEEEIRTTNPVATECYGVVSTNLQNPNENF

SEQ ID NO: 45502 - protein, 28 aa, Artificial Sequence
  Description of Artificial Sequence: Synthetic peptide
SEEEIRTTNPVATECYGTHSTAEQRDNF

SEQ ID NO: 45503 - protein, 33 aa, Artificial Sequence
  Description of Artificial Sequence: Synthetic polypeptide
AEEEIRTTNPVATEQYGSVSTTNLQQQNNGTNI

SEQ ID NO: 45504 - protein, 31 aa, Artificial Sequence
  Description of Artificial Sequence: Synthetic polypeptide
DMEEIRSTNPVATEQYGSVSTTNIETRNGQR

SEQ ID NO: 45505 - protein, 28 aa, Artificial Sequence
  Description of Artificial Sequence: Synthetic peptide
AENEIACTNPVATEQYGEASENLQRGSR

SEQ ID NO: 45506 - protein, 28 aa, Artificial Sequence
  Description of Artificial Sequence: Synthetic peptide
AENEIACTNPVATEQYGEASENLQRGTR

SEQ ID NO: 45507 - protein, 33 aa, Artificial Sequence
  Description of Artificial Sequence: Synthetic polypeptide
AEEEIRTTNPVATEQYGSVSTTNLQQQNQGNEG

SEQ ID NO: 45508 - protein, 30 aa, Artificial Sequence
  Description of Artificial Sequence: Synthetic polypeptide
DEGEIRTTNPVATEQYGSCSTNNQEMNNEE

SEQ ID NO: 45509 - protein, 32 aa, Artificial Sequence
  Description of Artificial Sequence: Synthetic polypeptide
DEGEIRTTNPVATEQYGSTSMTENLSERIGNQ

SEQ ID NO: 45510 - protein, 31 aa, Artificial Sequence
  Description of Artificial Sequence: Synthetic polypeptide
DEGEIRTTNPVATEQYGSVAQTALGREMDNR

SEQ ID NO: 45511 - protein, 32 aa, Artificial Sequence
  Description of Artificial Sequence: Synthetic polypeptide
SEEEIRTTNPVATECYGSVSNTDNLHERGDQR

SEQ ID NO: 45512 - protein, 28 aa, Artificial Sequence
  Description of Artificial Sequence: Synthetic peptide
AENEIACTNPVATEQYGEASENLQRGPR

SEQ ID NO: 45513 - protein, 31 aa, Artificial Sequence
  Description of Artificial Sequence: Synthetic polypeptide
DEGEIRTTNPVATEQYGCVSTNNDNRNGDNQ

SEQ ID NO: 45514 - protein, 28 aa, Artificial Sequence
  Description of Artificial Sequence: Synthetic peptide
AENEIACTNPVATEQYGEASENLQRGNQ

SEQ ID NO: 45515 - protein, 32 aa, Artificial Sequence
  Description of Artificial Sequence: Synthetic polypeptide
DEGEIRTTNPVATEQYGCVSTNLQNRNGIDGM

SEQ ID NO: 45516 - protein, 28 aa, Artificial Sequence
  Description of Artificial Sequence: Synthetic peptide
AENEIACTNPVATEQYGEASENLQRGMR

SEQ ID NO: 45517 - protein, 31 aa, Artificial Sequence
  Description of Artificial Sequence: Synthetic polypeptide
DEGEIRTTNPVATDQYGSVNCTGLSQRGGND

SEQ ID NO: 45518 - protein, 29 aa, Artificial Sequence
  Description of Artificial Sequence: Synthetic peptide
AENEIACTNPVATEQYGEASENLQRGNGR

SEQ ID NO: 45519 - protein, 31 aa, Artificial Sequence
  Description of Artificial Sequence: Synthetic polypeptide
DEGEIRTTNPVATEAYGSVVATALSIRVGNR

SEQ ID NO: 45520 - protein, 33 aa, Artificial Sequence
  Description of Artificial Sequence: Synthetic polypeptide
AEEEIRTTNPVATEQYGSVSTTNLQQQGNNNDD

SEQ ID NO: 45521 - protein, 33 aa, Artificial Sequence
  Description of Artificial Sequence: Synthetic polypeptide
AEEEIRTTNPVATEQYGSVSTTNLQQQGNNNDN

SEQ ID NO: 45522 - protein, 31 aa, Artificial Sequence
  Description of Artificial Sequence: Synthetic polypeptide
DEGEIRTTNPVATEPYGSVQCTALSTRVGNR

SEQ ID NO: 45523 - protein, 30 aa, Artificial Sequence
  Description of Artificial Sequence: Synthetic polypeptide
DEGEIRTTNPVATEQYGSVAQTGLIREMNS

SEQ ID NO: 45524 - protein, 31 aa, Artificial Sequence
  Description of Artificial Sequence: Synthetic polypeptide
DEGEIRTTNPVATEQWGSVATNLERPGENPN

SEQ ID NO: 45525 - protein, 31 aa, Artificial Sequence
  Description of Artificial Sequence: Synthetic polypeptide
DEGEIRTTNPVATEQYGCVSQTVLERGDNDQ

SEQ ID NO: 45526 - protein, 33 aa, Artificial Sequence
  Description of Artificial Sequence: Synthetic polypeptide
AEEEIRTTNPVATEQYGSVSTTNLQQQGTNPEG

SEQ ID NO: 45527 - protein, 33 aa, Artificial Sequence
  Description of Artificial Sequence: Synthetic polypeptide
AEEEIRTTNPVATEQYGSVSTTNLQQQIGENDN

SEQ ID NO: 45528 - protein, 33 aa, Artificial Sequence
  Description of Artificial Sequence: Synthetic polypeptide
AEEEIRTTNPVATEQYGSVSTTNLQQQIGNNNV

SEQ ID NO: 45529 - protein, 30 aa, Artificial Sequence
  Description of Artificial Sequence: Synthetic polypeptide
DEGEIRTTNPVATEQYGCVSTNLFMLNDEI

SEQ ID NO: 45530 - protein, 30 aa, Artificial Sequence
  Description of Artificial Sequence: Synthetic polypeptide
DEGEIRTTNPVATEQYGCVSTNLQETDDEI

SEQ ID NO: 45531 - protein, 30 aa, Artificial Sequence
  Description of Artificial Sequence: Synthetic polypeptide
DEGEIRTTNPVATEQYGCVSTNLQMSEDEI

SEQ ID NO: 45532 - protein, 33 aa, Artificial Sequence
  Description of Artificial Sequence: Synthetic polypeptide
AEEEIRTTNPVATEQYGSVSTTNLQQQGTNNVA

SEQ ID NO: 45533 - protein, 29 aa, Artificial Sequence
  Description of Artificial Sequence: Synthetic peptide
DEGEIRTTNPVATEQYGSVATALIHMENT

SEQ ID NO: 45534 - protein, 30 aa, Artificial Sequence
  Description of Artificial Sequence: Synthetic polypeptide
DEGEIRTTNPVATEQYGSVATALSREMNGS

SEQ ID NO: 45535 - protein, 31 aa, Artificial Sequence
  Description of Artificial Sequence: Synthetic polypeptide
DMEEIRSTNPVATEQYGSVSTNDLETRNGQE

SEQ ID NO: 45536 - protein, 32 aa, Artificial Sequence
  Description of Artificial Sequence: Synthetic polypeptide
DMEEIGTTNPVATEQYGSVSTNLLQERFPNQE

SEQ ID NO: 45537 - protein, 33 aa, Artificial Sequence
  Description of Artificial Sequence: Synthetic polypeptide
AEEEIRTTNPVATEQYGSVSTTNLQQQQGNNQD

SEQ ID NO: 45538 - protein, 30 aa, Artificial Sequence
  Description of Artificial Sequence: Synthetic polypeptide
DEGEIRTTNPVATEQYGSVSTNDNDNEGDQ

SEQ ID NO: 45539 - protein, 32 aa, Artificial Sequence
  Description of Artificial Sequence: Synthetic polypeptide
DEGEIRTTNPVATEQYGSVSTNDNDNRGENQN

SEQ ID NO: 45540 - protein, 33 aa, Artificial Sequence
  Description of Artificial Sequence: Synthetic polypeptide
AEEEIRTTNPVATEQYGSVSTTNLQQQQGNQED

SEQ ID NO: 45541 - protein, 32 aa, Artificial Sequence
  Description of Artificial Sequence: Synthetic polypeptide
DDEEIRSTNPVATEQYGSVSVDGTNMQRGNNE

SEQ ID NO: 45542 - protein, 32 aa, Artificial Sequence
  Description of Artificial Sequence: Synthetic polypeptide
DDEEIRSTNPVATEQYGSVSTQNLQARNGQGM

SEQ ID NO: 45543 - protein, 33 aa, Artificial Sequence
  Description of Artificial Sequence: Synthetic polypeptide
AEEEIRTTNPVATEQYGSVSTTNLQQQQGNNNT

SEQ ID NO: 45544 - protein, 32 aa, Artificial Sequence
  Description of Artificial Sequence: Synthetic polypeptide
DDEEIRSTNPVATEQYGSVSTELQARSGSQRN

SEQ ID NO: 45545 - protein, 32 aa, Artificial Sequence
  Description of Artificial Sequence: Synthetic polypeptide
DDEEIRSTNPVATEQYGSVSSTNMDQRGGNGN

SEQ ID NO: 45546 - protein, 31 aa, Artificial Sequence
  Description of Artificial Sequence: Synthetic polypeptide
DDEEIRSTNPVATEQYGSVSPTNLETINEQR

SEQ ID NO: 45547 - protein, 31 aa, Artificial Sequence
  Description of Artificial Sequence: Synthetic polypeptide
DDEEIRSTNPVATEQYGSVSIENMQRGLNND

SEQ ID NO: 45548 - protein, 33 aa, Artificial Sequence
  Description of Artificial Sequence: Synthetic polypeptide
AEEEIRTTNPVATEQYGSVSTTNLQQQQNGNQD

SEQ ID NO: 45549 - protein, 33 aa, Artificial Sequence
  Description of Artificial Sequence: Synthetic polypeptide
SEEEIRTTNPVATEAYGSVSVTNALQHTGGNNR

SEQ ID NO: 45550 - protein, 30 aa, Artificial Sequence
  Description of Artificial Sequence: Synthetic polypeptide
DEGEIRTTNPVATEQYGSVTTYDLIIRMNE

SEQ ID NO: 45551 - protein, 33 aa, Artificial Sequence
  Description of Artificial Sequence: Synthetic polypeptide
AEEEIRTTNPVATEQYGSVSTTNLQQQQQGNDQ

SEQ ID NO: 45552 - protein, 32 aa, Artificial Sequence
  Description of Artificial Sequence: Synthetic polypeptide
DDEEIRSTNPVATEQYGSVSSTNMDQRGNGEF

SEQ ID NO: 45553 - protein, 33 aa, Artificial Sequence
  Description of Artificial Sequence: Synthetic polypeptide
DEGEIRTTNPLATEAYGSVSCTNLSQRPGGNNR

SEQ ID NO: 45554 - protein, 30 aa, Artificial Sequence
  Description of Artificial Sequence: Synthetic polypeptide
DEGEIRTTNPVATEQYGSVSTDYQEGEDGI

SEQ ID NO: 45555 - protein, 29 aa, Artificial Sequence
  Description of Artificial Sequence: Synthetic peptide
DDEEIRTTNPCATEMYGSVSVNTAQAENR

SEQ ID NO: 45556 - protein, 31 aa, Artificial Sequence
  Description of Artificial Sequence: Synthetic polypeptide
DDEEIRTTNPVATDQYGSVSTNGVQNGGNQG

SEQ ID NO: 45557 - protein, 31 aa, Artificial Sequence
  Description of Artificial Sequence: Synthetic polypeptide
DDEEIRTTNPVATDQYGSVSTNGVQNGGNNT

SEQ ID NO: 45558 - protein, 30 aa, Artificial Sequence
  Description of Artificial Sequence: Synthetic polypeptide
DDEEIRTTNPVATDQYGSVSTNGVNNGNGD

SEQ ID NO: 45559 - protein, 30 aa, Artificial Sequence
  Description of Artificial Sequence: Synthetic polypeptide
DDEEIRTTNPVATDQYGSVSTNGVENGNIQ

SEQ ID NO: 45560 - protein, 30 aa, Artificial Sequence
  Description of Artificial Sequence: Synthetic polypeptide
DDEEIRTTNPVATDQYGSVSTMGVQNGNGT

SEQ ID NO: 45561 - protein, 30 aa, Artificial Sequence
  Description of Artificial Sequence: Synthetic polypeptide
SEEEIRTTNPVATECYGSVSENEPMRGENG

SEQ ID NO: 45562 - protein, 28 aa, Artificial Sequence
  Description of Artificial Sequence: Synthetic peptide
AENEIACTNPVATEQYGEASENLQRGVR

SEQ ID NO: 45563 - protein, 28 aa, Artificial Sequence
  Description of Artificial Sequence: Synthetic peptide
SEEEIRTTNPVATECYGDVSECLMHENR

SEQ ID NO: 45564 - protein, 28 aa, Artificial Sequence
  Description of Artificial Sequence: Synthetic peptide
AENEIACTNPVATEQYGEASENLQRGYR

SEQ ID NO: 45565 - protein, 29 aa, Artificial Sequence
  Description of Artificial Sequence: Synthetic peptide
DMEEIRSTNPVATEQYGSSSTNWMQEGDL

SEQ ID NO: 45566 - protein, 29 aa, Artificial Sequence
  Description of Artificial Sequence: Synthetic peptide
DEGEIRTTNPVATEQYGSVQTALIGEMND

SEQ ID NO: 45567 - protein, 28 aa, Artificial Sequence
  Description of Artificial Sequence: Synthetic peptide
QEEEIRTTNPVATECYGSVSECLQHEEL

SEQ ID NO: 45568 - protein, 30 aa, Artificial Sequence
  Description of Artificial Sequence: Synthetic polypeptide
DEGEIRTTNPVATEQYGSVQTDLIPMNNRD

SEQ ID NO: 45569 - protein, 28 aa, Artificial Sequence
  Description of Artificial Sequence: Synthetic peptide
DDEEIRTTNPQATEHYGCVSWNLQNNNA

SEQ ID NO: 45570 - protein, 30 aa, Artificial Sequence
  Description of Artificial Sequence: Synthetic polypeptide
DEGEIRTTNPVATEQYGSVQTSALIRMNNE

SEQ ID NO: 45571 - protein, 33 aa, Artificial Sequence
  Description of Artificial Sequence: Synthetic polypeptide
AEEEIRTTNPVATEQYGSVSTTNLQQQQGNDTE

SEQ ID NO: 45572 - protein, 28 aa, Artificial Sequence
  Description of Artificial Sequence: Synthetic peptide
QEEEIRTTNPVATECYGDVSENLMHENL

SEQ ID NO: 45573 - protein, 32 aa, Artificial Sequence
  Description of Artificial Sequence: Synthetic polypeptide
AEEEIRTTNPVATEQYGSVSTTNLQLQNDTNA

SEQ ID NO: 45574 - protein, 28 aa, Artificial Sequence
  Description of Artificial Sequence: Synthetic peptide
DEGEIRTTNPCSTEQYGIVSCNLMSGTR

SEQ ID NO: 45575 - protein, 28 aa, Artificial Sequence
  Description of Artificial Sequence: Synthetic peptide
DEGEIRTTNPCSSEQYGIVSCNLQSGTR

SEQ ID NO: 45576 - protein, 32 aa, Artificial Sequence
  Description of Artificial Sequence: Synthetic polypeptide
AEEEIRTTNPVATEQYGSVSTTNLQQEGELGG

SEQ ID NO: 45577 - protein, 31 aa, Artificial Sequence
  Description of Artificial Sequence: Synthetic polypeptide
DDEEIRTTNPVATEQWGAVTSTLLQRVGTRE

SEQ ID NO: 45578 - protein, 30 aa, Artificial Sequence
  Description of Artificial Sequence: Synthetic polypeptide
DEGEIATTNPVAYDQYGQTVSTALSQRGNR

SEQ ID NO: 45579 - protein, 33 aa, Artificial Sequence
  Description of Artificial Sequence: Synthetic polypeptide
AEEEIRTTNPVATEQYGSVSTTNLQQGDEGNQG

SEQ ID NO: 45580 - protein, 29 aa, Artificial Sequence
  Description of Artificial Sequence: Synthetic peptide
DEGEIATTNPVAYEPYGSVATNLQDGNID

SEQ ID NO: 45581 - protein, 30 aa, Artificial Sequence
  Description of Artificial Sequence: Synthetic polypeptide
DEGEIATTNPVAYEPYGSVATNLQRDGNED

SEQ ID NO: 45582 - protein, 33 aa, Artificial Sequence
  Description of Artificial Sequence: Synthetic polypeptide
AEEEIRTTNPVATEQYGSVSTTNLQQGDNGNGE

SEQ ID NO: 45583 - protein, 31 aa, Artificial Sequence
  Description of Artificial Sequence: Synthetic polypeptide
SEEEIRTTNPVATEHYGSVSCTNLSHRVDQR

SEQ ID NO: 45584 - protein, 32 aa, Artificial Sequence
  Description of Artificial Sequence: Synthetic polypeptide
AEEEIRTTNPVATEQYGSVSTTNLQQGEGIST

SEQ ID NO: 45585 - protein, 30 aa, Artificial Sequence
  Description of Artificial Sequence: Synthetic polypeptide
DEGEIATTNPVAYEQYGSVATNLETGDNQR

SEQ ID NO: 45586 - protein, 28 aa, Artificial Sequence
  Description of Artificial Sequence: Synthetic peptide
QEEEIRTTNPIATEQYGSAPENLQREEK

SEQ ID NO: 45587 - protein, 30 aa, Artificial Sequence
  Description of Artificial Sequence: Synthetic polypeptide
DEGEIATTNPVAYEQYGSVATNLQDSGNAQ

SEQ ID NO: 45588 - protein, 31 aa, Artificial Sequence
  Description of Artificial Sequence: Synthetic polypeptide
SEEEIRTTNPVATEGYGSVSNTNLVREGDQI

SEQ ID NO: 45589 - protein, 32 aa, Artificial Sequence
  Description of Artificial Sequence: Synthetic polypeptide
DNEEIRTTNPVATEQYGCVSTTNLADSGQVNR

SEQ ID NO: 45590 - protein, 31 aa, Artificial Sequence
  Description of Artificial Sequence: Synthetic polypeptide
SEEEIRTTNPVATEGYGSVSNTNLANFGDNQ

SEQ ID NO: 45591 - protein, 32 aa, Artificial Sequence
  Description of Artificial Sequence: Synthetic polypeptide
AEEEIRTTNPVATEQYGSVSTTNLQQDETNNE

SEQ ID NO: 45592 - protein, 33 aa, Artificial Sequence
  Description of Artificial Sequence: Synthetic polypeptide
AEEEIRTTNPVATEQYGSVSTTNLQQDEGGNVS

SEQ ID NO: 45593 - protein, 32 aa, Artificial Sequence
  Description of Artificial Sequence: Synthetic polypeptide
AEEEIRTTNPVATEQYGSVSTTNLQNSTNGET

SEQ ID NO: 45594 - protein, 30 aa, Artificial Sequence
  Description of Artificial Sequence: Synthetic polypeptide
DEGEIATTNPVATEQYGSVSTDLESEGEDR

SEQ ID NO: 45595 - protein, 29 aa, Artificial Sequence
  Description of Artificial Sequence: Synthetic peptide
SEEEIRTTNPVATEMWGSVATNLQPGTAS

SEQ ID NO: 45596 - protein, 30 aa, Artificial Sequence
  Description of Artificial Sequence: Synthetic polypeptide
DEGEIATTNPVATEQYGSVATNLQESGDHN

SEQ ID NO: 45597 - protein, 31 aa, Artificial Sequence
  Description of Artificial Sequence: Synthetic polypeptide
AEEEIRTTNPVATEQYGSVSVTTQGQGGNNS

SEQ ID NO: 45598 - protein, 32 aa, Artificial Sequence
  Description of Artificial Sequence: Synthetic polypeptide
AEEEIRTTNPVATEQYGSVSTTNLQLSNANDY

SEQ ID NO: 45599 - protein, 31 aa, Artificial Sequence
  Description of Artificial Sequence: Synthetic polypeptide
DEGEIATTNPVATEQYGSVATNLQQPENPRE

SEQ ID NO: 45600 - protein, 33 aa, Artificial Sequence
  Description of Artificial Sequence: Synthetic polypeptide
AEEEIRTTNPVATEQYGSVSTTNLQNDNGNGEE

SEQ ID NO: 45601 - protein, 33 aa, Artificial Sequence
  Description of Artificial Sequence: Synthetic polypeptide
AEEEIRTTNPVATEQYGSVSTTNLQNDNGNIAT

SEQ ID NO: 45602 - protein, 33 aa, Artificial Sequence
  Description of Artificial Sequence: Synthetic polypeptide
AEEEIRTTNPVATEQYGSVSTTNLQQGNSGGDG

SEQ ID NO: 45603 - protein, 30 aa, Artificial Sequence
  Description of Artificial Sequence: Synthetic polypeptide
DDEEIRTTNPVATEQWGCVTSTELQRGDAM

SEQ ID NO: 45604 - protein, 33 aa, Artificial Sequence
  Description of Artificial Sequence: Synthetic polypeptide
AEEEIRTTNPVATEQYGSVSTTNLQNGQGTTNQ

SEQ ID NO: 45605 - protein, 33 aa, Artificial Sequence
  Description of Artificial Sequence: Synthetic polypeptide
AEEEIRTTNPVATEQYGSVSTTNLQNNGGINNV

SEQ ID NO: 45606 - protein, 30 aa, Artificial Sequence
  Description of Artificial Sequence: Synthetic polypeptide
DEGEIATTNPVATEQYGSVATPGLERGNDQ

SEQ ID NO: 45607 - protein, 31 aa, Artificial Sequence
  Description of Artificial Sequence: Synthetic polypeptide
DEGEIATTNPVATEQYGSVATPNGLQNQGNQ

SEQ ID NO: 45608 - protein, 31 aa, Artificial Sequence
  Description of Artificial Sequence: Synthetic polypeptide
DEGEIATTNPVATEQYGSVATPNLDRGNPQP

SEQ ID NO: 45609 - protein, 33 aa, Artificial Sequence
  Description of Artificial Sequence: Synthetic polypeptide
AEEEIRTTNPVATEQYGSVSTTNLQNNQGTNIA

SEQ ID NO: 45610 - protein, 32 aa, Artificial Sequence
  Description of Artificial Sequence: Synthetic polypeptide
AEEEIRTTNPVATEQYGSVSTTNLQNNTDGTE

SEQ ID NO: 45611 - protein, 33 aa, Artificial Sequence
  Description of Artificial Sequence: Synthetic polypeptide
AEEEIRTTNPVATEQYGSVSTTNLQNENGETNS

SEQ ID NO: 45612 - protein, 31 aa, Artificial Sequence
  Description of Artificial Sequence: Synthetic polypeptide
DEGEIATTNPVAYEQYGSVATNLQRGDNPEQ

SEQ ID NO: 45613 - protein, 33 aa, Artificial Sequence
  Description of Artificial Sequence: Synthetic polypeptide
AEEEIRTTNPVATEQYGSVSTTNLQQGNVGNSE

SEQ ID NO: 45614 - protein, 32 aa, Artificial Sequence
  Description of Artificial Sequence: Synthetic polypeptide
AEEEIRTTNPVATEQYGSVSTTNLQQGQGETI

SEQ ID NO: 45615 - protein, 28 aa, Artificial Sequence
  Description of Artificial Sequence: Synthetic peptide
DEGEIKTTNPVATEQYGSVQTAGIRMNS

SEQ ID NO: 45616 - protein, 30 aa, Artificial Sequence
  Description of Artificial Sequence: Synthetic polypeptide
SEEEIRTTNPVATEGYGCTSIIGNLQRGNG

SEQ ID NO: 45617 - protein, 28 aa, Artificial Sequence
  Description of Artificial Sequence: Synthetic peptide
AENEIACTNPVATEQYGEASENLQRGIR

SEQ ID NO: 45618 - protein, 30 aa, Artificial Sequence
  Description of Artificial Sequence: Synthetic polypeptide
DEGEIRATNPVATEQYGCVAATNLDQMGND

SEQ ID NO: 45619 - protein, 33 aa, Artificial Sequence
  Description of Artificial Sequence: Synthetic polypeptide
AEEEIRTTNPVATEQYGSVSTTNLQQNQIGNNA

SEQ ID NO: 45620 - protein, 28 aa, Artificial Sequence
  Description of Artificial Sequence: Synthetic peptide
AENEIACTNPVATEQYGEASENLQRGKR

SEQ ID NO: 45621 - protein, 31 aa, Artificial Sequence
  Description of Artificial Sequence: Synthetic polypeptide
DEGEIRPTNPVATEQWGSVSCNEQDREGENR

SEQ ID NO: 45622 - protein, 32 aa, Artificial Sequence
  Description of Artificial Sequence: Synthetic polypeptide
DEGEIGTTNPVATEQYGCVSTNLLQERMGNQE

SEQ ID NO: 45623 - protein, 29 aa, Artificial Sequence
  Description of Artificial Sequence: Synthetic peptide
DEGEIRPTNPVATEQYGIVSCNEQNAGDR

SEQ ID NO: 45624 - protein, 28 aa, Artificial Sequence
  Description of Artificial Sequence: Synthetic peptide
DEGEIRPTNPVSTEQYGDVSCNEQAGDR

SEQ ID NO: 45625 - protein, 32 aa, Artificial Sequence
  Description of Artificial Sequence: Synthetic polypeptide
AEEEIRTTNPVATEQYGSVSTTNLQQNTQNQD

SEQ ID NO: 45626 - protein, 29 aa, Artificial Sequence
  Description of Artificial Sequence: Synthetic peptide
DEGEIRPTNPVSTEQYGIVSCNLQNAGDR

SEQ ID NO: 45627 - protein, 32 aa, Artificial Sequence
  Description of Artificial Sequence: Synthetic polypeptide
AEEEIRTTNPVATEQYGSVSTTNLQQQENGVG

SEQ ID NO: 45628 - protein, 32 aa, Artificial Sequence
  Description of Artificial Sequence: Synthetic polypeptide
AEEEIRTTNPVATEQYGSVSTTNLQQQGESEQ

SEQ ID NO: 45629 - protein, 31 aa, Artificial Sequence
  Description of Artificial Sequence: Synthetic polypeptide
DMEEIRTTNPVATEQYGCVSWTMLQDGEDRF

SEQ ID NO: 45630 - protein, 32 aa, Artificial Sequence
  Description of Artificial Sequence: Synthetic polypeptide
DEGEIRTTNPCATEQYGIVSSTTNLPQRNGTR

SEQ ID NO: 45631 - protein, 28 aa, Artificial Sequence
  Description of Artificial Sequence: Synthetic peptide
DEGEIRPTNPVSSEQYGDVSCNLQSGTR

SEQ ID NO: 45632 - protein, 28 aa, Artificial Sequence
  Description of Artificial Sequence: Synthetic peptide
AENEIACTNPVATEQYGEASENLQRGLR

SEQ ID NO: 45633 - protein, 32 aa, Artificial Sequence
  Description of Artificial Sequence: Synthetic polypeptide
AEEEIRTTNPVATEQYGSVSTTNLQQNNDGQE

SEQ ID NO: 45634 - protein, 33 aa, Artificial Sequence
  Description of Artificial Sequence: Synthetic polypeptide
AEEEIRTTNPVATEQYGSVSTTNLQQNDGNNVE

SEQ ID NO: 45635 - protein, 32 aa, Artificial Sequence
  Description of Artificial Sequence: Synthetic polypeptide
AEEEIRTTNPVATEQYGSVSVTTNQQQQGNEV

SEQ ID NO: 45636 - protein, 33 aa, Artificial Sequence
  Description of Artificial Sequence: Synthetic polypeptide
AEEEIRTTNPVATEQYGSVSTTNLQQGQGTENS

SEQ ID NO: 45637 - protein, 32 aa, Artificial Sequence
  Description of Artificial Sequence: Synthetic polypeptide
AEEEIRTTNPVATEQYGSVSTTNLQQGQGTTN

SEQ ID NO: 45638 - protein, 29 aa, Artificial Sequence
  Description of Artificial Sequence: Synthetic peptide
DNEEIATTNPVATTQYGVVSTNPMGDGNR

SEQ ID NO: 45639 - protein, 30 aa, Artificial Sequence
  Description of Artificial Sequence: Synthetic polypeptide
DEGEIATTNPVSSEQYGSVSCINLQREGTR

SEQ ID NO: 45640 - protein, 30 aa, Artificial Sequence
  Description of Artificial Sequence: Synthetic polypeptide
DNEEIATTNPVATTQYGSVSTNNPMRGQNE

SEQ ID NO: 45641 - protein, 29 aa, Artificial Sequence
  Description of Artificial Sequence: Synthetic peptide
DNAEISTTNPVATTQYGSVSTNPMDVGNR

SEQ ID NO: 45642 - protein, 31 aa, Artificial Sequence
  Description of Artificial Sequence: Synthetic polypeptide
DEGEICTTNPVATEQYGVVSTNNNRAGNMRL

SEQ ID NO: 45643 - protein, 33 aa, Artificial Sequence
  Description of Artificial Sequence: Synthetic polypeptide
AEEEIRTTNPVATEQYGSVSTTNLQQGTNANFY

SEQ ID NO: 45644 - protein, 33 aa, Artificial Sequence
  Description of Artificial Sequence: Synthetic polypeptide
AEEEIRTTNPVATEQYGSVSTTNLQQLGNQDET

SEQ ID NO: 45645 - protein, 28 aa, Artificial Sequence
  Description of Artificial Sequence: Synthetic peptide
AENEIACTNPVATEQYGEASENLQRGHR

SEQ ID NO: 45646 - protein, 30 aa, Artificial Sequence
  Description of Artificial Sequence: Synthetic polypeptide
DEGEIATTNPVSTEQYGSVSATNLQDHGEL

SEQ ID NO: 45647 - protein, 30 aa, Artificial Sequence
  Description of Artificial Sequence: Synthetic polypeptide
DEGEIATTNPVSTEQYGSVSATNLQDHGTL

SEQ ID NO: 45648 - protein, 31 aa, Artificial Sequence
  Description of Artificial Sequence: Synthetic polypeptide
SEEEIRTTNPVATEGYGCTSVILNLQREGNI

SEQ ID NO: 45649 - protein, 29 aa, Artificial Sequence
  Description of Artificial Sequence: Synthetic peptide
DEGEIATVNPVATEQYGSVAATNLAPGNH

SEQ ID NO: 45650 - protein, 30 aa, Artificial Sequence
  Description of Artificial Sequence: Synthetic polypeptide
SEEEIRTTNPVATEGYGCTSINNLQREGNI

SEQ ID NO: 45651 - protein, 33 aa, Artificial Sequence
  Description of Artificial Sequence: Synthetic polypeptide
AEEEIRTTNPVATEQYGSVSTTNLQQIGNNQNI

SEQ ID NO: 45652 - protein, 32 aa, Artificial Sequence
  Description of Artificial Sequence: Synthetic polypeptide
DEHEIRTTNPVATEQYGSVSTTNQAGGVGNER

SEQ ID NO: 45653 - protein, 29 aa, Artificial Sequence
  Description of Artificial Sequence: Synthetic peptide
DEEEIVCTNPIATEQYGSVCSENPMFGNR

SEQ ID NO: 45654 - protein, 32 aa, Artificial Sequence
  Description of Artificial Sequence: Synthetic polypeptide
AEEEIRTTNPVATEQYGSVSTNNNNQLGSNQS

SEQ ID NO: 45655 - protein, 34 aa, Artificial Sequence
  Description of Artificial Sequence: Synthetic polypeptide
DEEEIRTTNPVAYEQYGQSVSTNDLLQPRGQIRI

SEQ ID NO: 45656 - protein, 33 aa, Artificial Sequence
  Description of Artificial Sequence: Synthetic polypeptide
DEEEIRTTNPVAYEQYGQSVSTNDLLQRGIADP

SEQ ID NO: 45657 - protein, 29 aa, Artificial Sequence
  Description of Artificial Sequence: Synthetic peptide
DTAEIRTTNPVATEQYGCCSTVLQAGNGN

SEQ ID NO: 45658 - protein, 33 aa, Artificial Sequence
  Description of Artificial Sequence: Synthetic polypeptide
DEEEIRTTNPVAYEQYGQSVSTNDLLQRSIDRF

SEQ ID NO: 45659 - protein, 29 aa, Artificial Sequence
  Description of Artificial Sequence: Synthetic peptide
DTAEIRTTNPVATEQYGCCSTVLDQHGNA

SEQ ID NO: 45660 - protein, 33 aa, Artificial Sequence
  Description of Artificial Sequence: Synthetic polypeptide
DEEEIRTTNPVAYEQYGQSVSTNDLNQRGSETA

SEQ ID NO: 45661 - protein, 32 aa, Artificial Sequence
  Description of Artificial Sequence: Synthetic polypeptide
DEEEIRTTNPVAYEQYGQSVSTNDLVQPGIAE

SEQ ID NO: 45662 - protein, 33 aa, Artificial Sequence
  Description of Artificial Sequence: Synthetic polypeptide
DEEEIRTTNPVAYEQYGQSVSTNGSQTGGNNRD

SEQ ID NO: 45663 - protein, 32 aa, Artificial Sequence
  Description of Artificial Sequence: Synthetic polypeptide
AEEEIRTTNPVATEQYGSVSSNTNTNQQGNSA

SEQ ID NO: 45664 - protein, 33 aa, Artificial Sequence
  Description of Artificial Sequence: Synthetic polypeptide
DEEEIRTTNPVAYEQYGQSVSTQDQLQRVGVGR

SEQ ID NO: 45665 - protein, 33 aa, Artificial Sequence
  Description of Artificial Sequence: Synthetic polypeptide
DEEEIRTTNPVAYEQYGQSVSTTNDLNQRGSEV

SEQ ID NO: 45666 - protein, 31 aa, Artificial Sequence
  Description of Artificial Sequence: Synthetic polypeptide
DTAEIRATNPVATEQYGSTVSTNLQIFGTQR

SEQ ID NO: 45667 - protein, 29 aa, Artificial Sequence
  Description of Artificial Sequence: Synthetic peptide
SETEIRCTNPIATEQYGSVWSENWARGNR

SEQ ID NO: 45668 - protein, 33 aa, Artificial Sequence
  Description of Artificial Sequence: Synthetic polypeptide
DEEEIRTTNPVAYEQYGQSVSVDNDLTQRGIRR

SEQ ID NO: 45669 - protein, 32 aa, Artificial Sequence
  Description of Artificial Sequence: Synthetic polypeptide
DEEEIRTTNPVAYEQYGQSVSVNDLEQRGIEH

SEQ ID NO: 45670 - protein, 33 aa, Artificial Sequence
  Description of Artificial Sequence: Synthetic polypeptide
DEEEIRTTNPVAYEQYGQSVSTNDLLQIRSIER

SEQ ID NO: 45671 - protein, 28 aa, Artificial Sequence
  Description of Artificial Sequence: Synthetic peptide
AENEIACTNPVATECYGEVSENLQRGGR

SEQ ID NO: 45672 - protein, 32 aa, Artificial Sequence
  Description of Artificial Sequence: Synthetic polypeptide
DEEEIRTTNPVAYEQYGQSVSTNDDEQYGSDR

SEQ ID NO: 45673 - protein, 32 aa, Artificial Sequence
  Description of Artificial Sequence: Synthetic polypeptide
AEEEIRTTNPVATEQYGSVSSNNNNLQGGNSA

SEQ ID NO: 45674 - protein, 32 aa, Artificial Sequence
  Description of Artificial Sequence: Synthetic polypeptide
DEEEIRTTNPVAYEQYGQSVSSADLNQRGSQR

SEQ ID NO: 45675 - protein, 30 aa, Artificial Sequence
  Description of Artificial Sequence: Synthetic polypeptide
DTEEIATTNPCATEHYGSVSFNEQREGNTR

SEQ ID NO: 45676 - protein, 32 aa, Artificial Sequence
  Description of Artificial Sequence: Synthetic polypeptide
AEEEIRTTNPVATEQYGSVVTNNLQQEGTNQG

SEQ ID NO: 45677 - protein, 30 aa, Artificial Sequence
  Description of Artificial Sequence: Synthetic polypeptide
DTEEIAATNPVATEQYGSVVSTNLQNGTDA

SEQ ID NO: 45678 - protein, 31 aa, Artificial Sequence
  Description of Artificial Sequence: Synthetic polypeptide
AEEEIRTTNPVATEQYGSVSSNNENQGTGNG

SEQ ID NO: 45679 - protein, 29 aa, Artificial Sequence
  Description of Artificial Sequence: Synthetic peptide
DTEEIAATNPVATEQYGSVVATNLQNGTM

SEQ ID NO: 45680 - protein, 33 aa, Artificial Sequence
  Description of Artificial Sequence: Synthetic polypeptide
DEEEIRTTNPVAYEQYGQSVSSGNDLDQRGSQR

SEQ ID NO: 45681 - protein, 31 aa, Artificial Sequence
  Description of Artificial Sequence: Synthetic polypeptide
AEEEIRTTNPVATEQYGSVVTNLQNQEETNG

SEQ ID NO: 45682 - protein, 33 aa, Artificial Sequence
  Description of Artificial Sequence: Synthetic polypeptide
DEEEIRTTNPVAYEQYGQSVSSNDALQRGIDIR

SEQ ID NO: 45683 - protein, 32 aa, Artificial Sequence
  Description of Artificial Sequence: Synthetic polypeptide
AEEEIRTTNPVATEQYGSVVTNLQQQEGTNLG

SEQ ID NO: 45684 - protein, 32 aa, Artificial Sequence
  Description of Artificial Sequence: Synthetic polypeptide
DEEEIRTTNPVAYEQYGQSVSSNDLLQRNSQR

SEQ ID NO: 45685 - protein, 32 aa, Artificial Sequence
  Description of Artificial Sequence: Synthetic polypeptide
AEEEIRTTNPVATEQYGSVSSNNLQNQQGNIG

SEQ ID NO: 45686 - protein, 34 aa, Artificial Sequence
  Description of Artificial Sequence: Synthetic polypeptide
DEEEIRTTNPVAYEQYGQSVSSTNMLSQRTGGVR

SEQ ID NO: 45687 - protein, 28 aa, Artificial Sequence
  Description of Artificial Sequence: Synthetic peptide
QEEEIATTNPVCTEQYGVVSENLQHENL

SEQ ID NO: 45688 - protein, 33 aa, Artificial Sequence
  Description of Artificial Sequence: Synthetic polypeptide
DEEEIRTTNPVAYEQYGQSVSSVNDLLQRGGQR

SEQ ID NO: 45689 - protein, 32 aa, Artificial Sequence
  Description of Artificial Sequence: Synthetic polypeptide
DEEEIRTTNPVAYEQYGQSVSTNAFSQKGGTR

SEQ ID NO: 45690 - protein, 32 aa, Artificial Sequence
  Description of Artificial Sequence: Synthetic polypeptide
DEEEIRTTNPVAYEQYGQSVSSNDLEQNGSQR

SEQ ID NO: 45691 - protein, 33 aa, Artificial Sequence
  Description of Artificial Sequence: Synthetic polypeptide
DEEEIRTTNPVAYEQYGQSVSQWNDLAQRGIRR

SEQ ID NO: 45692 - protein, 31 aa, Artificial Sequence
  Description of Artificial Sequence: Synthetic polypeptide
AEEEIRTTNPVATEQYGSVSSTANNTEGGNQ

SEQ ID NO: 45693 - protein, 31 aa, Artificial Sequence
  Description of Artificial Sequence: Synthetic polypeptide
AEEEIRTTNPVATEQYGSVSSTDNGNDQGNT

SEQ ID NO: 45694 - protein, 32 aa, Artificial Sequence
  Description of Artificial Sequence: Synthetic polypeptide
DEEEIRTTNPVAYEQYGQVSCQNLQSAGGNNR

SEQ ID NO: 45695 - protein, 32 aa, Artificial Sequence
  Description of Artificial Sequence: Synthetic polypeptide
AEEEIRTTNPVATEQYGSVSSTNGNQTGTNNS

SEQ ID NO: 45696 - protein, 30 aa, Artificial Sequence
  Description of Artificial Sequence: Synthetic polypeptide
AEEEIRTTNPVATEQYGSVSSTNLANNQEN

SEQ ID NO: 45697 - protein, 33 aa, Artificial Sequence
  Description of Artificial Sequence: Synthetic polypeptide
DEEEIRTTNPVAYEQYGQVSTGNLSQATGGNRQ

SEQ ID NO: 45698 - protein, 31 aa, Artificial Sequence
  Description of Artificial Sequence: Synthetic polypeptide
DSSEIRTTNPVATEQYGSTVANWNLLRVGNR

SEQ ID NO: 45699 - protein, 32 aa, Artificial Sequence
  Description of Artificial Sequence: Synthetic polypeptide
DEEEIRTTNPVAYEQYGQVSTNLSQATGGNQH

SEQ ID NO: 45700 - protein, 32 aa, Artificial Sequence
  Description of Artificial Sequence: Synthetic polypeptide
AEEEIRTTNPVATEQYGSVSSTNLANQQGIGN

SEQ ID NO: 45701 - protein, 31 aa, Artificial Sequence
  Description of Artificial Sequence: Synthetic polypeptide
DSSEIRTTNPVATEPYGSVSTGLSQRGGNNA

SEQ ID NO: 45702 - protein, 32 aa, Artificial Sequence
  Description of Artificial Sequence: Synthetic polypeptide
DSSEIRTTNPLATEQYGSVSCTNLSQPPGGNR

SEQ ID NO: 45703 - protein, 32 aa, Artificial Sequence
  Description of Artificial Sequence: Synthetic polypeptide
AEEEIRTTNPVATEQYGSVSSTNLENLGGNNE

SEQ ID NO: 45704 - protein, 31 aa, Artificial Sequence
  Description of Artificial Sequence: Synthetic polypeptide
DSSEIRSTNPVATEQYGSVVSTNLSQNGGTR

SEQ ID NO: 45705 - protein, 32 aa, Artificial Sequence
  Description of Artificial Sequence: Synthetic polypeptide
AEEEIRTTNPVATEQYGSVSSTNLENNGGNET

SEQ ID NO: 45706 - protein, 33 aa, Artificial Sequence
  Description of Artificial Sequence: Synthetic polypeptide
AEEEIRTTNPVATEQYGSVSSTNLGQAGTNQTE

SEQ ID NO: 45707 - protein, 31 aa, Artificial Sequence
  Description of Artificial Sequence: Synthetic polypeptide
AEEEIRTTNPVATEQYGSVSSTNLGQEQEEE

SEQ ID NO: 45708 - protein, 33 aa, Artificial Sequence
  Description of Artificial Sequence: Synthetic polypeptide
DEEEIRTTNPVAYEQYGQVVSSTNDLLQRGIAR

SEQ ID NO: 45709 - protein, 32 aa, Artificial Sequence
  Description of Artificial Sequence: Synthetic polypeptide
AEEEIRTTNPVATEQYGSVSSTNGNQIGNNTN

SEQ ID NO: 45710 - protein, 32 aa, Artificial Sequence
  Description of Artificial Sequence: Synthetic polypeptide
AEEEIRTTNPVATEQYGSVSSTNGNNQDGTNV

SEQ ID NO: 45711 - protein, 30 aa, Artificial Sequence
  Description of Artificial Sequence: Synthetic polypeptide
DEEEIRTTNPVAYEQYGQVSCQNLGSGGNE

SEQ ID NO: 45712 - protein, 32 aa, Artificial Sequence
  Description of Artificial Sequence: Synthetic polypeptide
DEEEIRTTNPVAYEQYGQVSCQNGLSQAGNNR

SEQ ID NO: 45713 - protein, 33 aa, Artificial Sequence
  Description of Artificial Sequence: Synthetic polypeptide
DEEEIRTTNPVAYEQYGQSVSVTNMPSQRGGSR

SEQ ID NO: 45714 - protein, 33 aa, Artificial Sequence
  Description of Artificial Sequence: Synthetic polypeptide
DEEEIRTTNPVAYEQYGQSVSVVNDLLQRGIAR

SEQ ID NO: 45715 - protein, 33 aa, Artificial Sequence
  Description of Artificial Sequence: Synthetic polypeptide
DEEEIRTTNPVAYEQYGQSVSWGNDLLQRGITR

SEQ ID NO: 45716 - protein, 33 aa, Artificial Sequence
  Description of Artificial Sequence: Synthetic polypeptide
DEEEIRTTNPVAYEQYGQSVSYGNDLLQRGQIR

SEQ ID NO: 45717 - protein, 33 aa, Artificial Sequence
  Description of Artificial Sequence: Synthetic polypeptide
DEEEIRTTNPVAYEQYGQSVSYMNDLLQRGDTR

SEQ ID NO: 45718 - protein, 32 aa, Artificial Sequence
  Description of Artificial Sequence: Synthetic polypeptide
AEEEIRTTNPVATEQYGSVSSTENGTNQEGNN

SEQ ID NO: 45719 - protein, 32 aa, Artificial Sequence
  Description of Artificial Sequence: Synthetic polypeptide
AEEEIRTTNPVATEQYGSVSSTNAENQNGENI

SEQ ID NO: 45720 - protein, 33 aa, Artificial Sequence
  Description of Artificial Sequence: Synthetic polypeptide
DEEEIRTTNPVAYEQYGQSVSVNGALQRGIGPR

SEQ ID NO: 45721 - protein, 31 aa, Artificial Sequence
  Description of Artificial Sequence: Synthetic polypeptide
AEEEIRTTNPVATEQYGSVSSTNDNQNQEND

SEQ ID NO: 45722 - protein, 33 aa, Artificial Sequence
  Description of Artificial Sequence: Synthetic polypeptide
DEEEIRTTNPVAYEQYGQSVVSQNALSQRGTIR

SEQ ID NO: 45723 - protein, 34 aa, Artificial Sequence
  Description of Artificial Sequence: Synthetic polypeptide
DEEEIRTTNPVAYEQYGQSVVSTNALSQVRGGDR

SEQ ID NO: 45724 - protein, 34 aa, Artificial Sequence
  Description of Artificial Sequence: Synthetic polypeptide
DEEEIRTTNPVAYEQYGQSVYSQTNDLEQRGIER

SEQ ID NO: 45725 - protein, 32 aa, Artificial Sequence
  Description of Artificial Sequence: Synthetic polypeptide
DEEEIRTTNPVAYEQYGQTVSCQNLQSGGNRA

SEQ ID NO: 45726 - protein, 31 aa, Artificial Sequence
  Description of Artificial Sequence: Synthetic polypeptide
AEEEIRTTNPVATEQYGSVSSTNDNQQENDT

SEQ ID NO: 45727 - protein, 31 aa, Artificial Sequence
  Description of Artificial Sequence: Synthetic polypeptide
DEEEIRTTNPVAYEQYGQVCCQNLSQSGNNR

SEQ ID NO: 45728 - protein, 31 aa, Artificial Sequence
  Description of Artificial Sequence: Synthetic polypeptide
DEEEIRTTNPVAYEQYGQVSCQGNGQSGGNR

SEQ ID NO: 45729 - protein, 31 aa, Artificial Sequence
  Description of Artificial Sequence: Synthetic polypeptide
DSSEIRTTNPVAYERYGSVSTLNLSQAGGNR

SEQ ID NO: 45730 - protein, 32 aa, Artificial Sequence
  Description of Artificial Sequence: Synthetic polypeptide
AEEEIRTTNPVATEQYGSVSSNLQQQGNGIGN

SEQ ID NO: 45731 - protein, 33 aa, Artificial Sequence
  Description of Artificial Sequence: Synthetic polypeptide
DEEEIRTTNPVAYEQYGQSVSQVNDLEQRGIQR

SEQ ID NO: 45732 - protein, 33 aa, Artificial Sequence
  Description of Artificial Sequence: Synthetic polypeptide
DEEEIRTTNPVAYEQYGQSVSQTNNLLQEGIER

SEQ ID NO: 45733 - protein, 32 aa, Artificial Sequence
  Description of Artificial Sequence: Synthetic polypeptide
AEEEIRTTNPVATEQYGSVSNTNLQQQNENDT

SEQ ID NO: 45734 - protein, 32 aa, Artificial Sequence
  Description of Artificial Sequence: Synthetic polypeptide
DEEEIRTTNPVAYEQYGQSVSLNDLLQPGITR

SEQ ID NO: 45735 - protein, 32 aa, Artificial Sequence
  Description of Artificial Sequence: Synthetic polypeptide
AEEEIRTTNPVATEQYGSVSNTNLVNNGGGND

SEQ ID NO: 45736 - protein, 33 aa, Artificial Sequence
  Description of Artificial Sequence: Synthetic polypeptide
AEEEIRTTNPVATEQYGSVSNTNNLQNNGNNGI

SEQ ID NO: 45737 - protein, 28 aa, Artificial Sequence
  Description of Artificial Sequence: Synthetic peptide
SEYEIRATNPVATEQYGSVEMNLQENNQ

SEQ ID NO: 45738 - protein, 33 aa, Artificial Sequence
  Description of Artificial Sequence: Synthetic polypeptide
AEEEIRTTNPVATEQYGSVSNTNQLGNQQGNNE

SEQ ID NO: 45739 - protein, 33 aa, Artificial Sequence
  Description of Artificial Sequence: Synthetic polypeptide
DEEEIRTTNPVAYEQYGQSVSMTNDTQQRGVER

SEQ ID NO: 45740 - protein, 34 aa, Artificial Sequence
  Description of Artificial Sequence: Synthetic polypeptide
DEEEIRTTNPVAYEQYGQSVSMTNQLLQRGVERI

SEQ ID NO: 45741 - protein, 30 aa, Artificial Sequence
  Description of Artificial Sequence: Synthetic polypeptide
SEYEIRATNPVATEQYGSVCTNLQGGGNGQ

SEQ ID NO: 45742 - protein, 31 aa, Artificial Sequence
  Description of Artificial Sequence: Synthetic polypeptide
DTEEIATTNPVATTQYGSVSTNGDQQNGNHR

SEQ ID NO: 45743 - protein, 31 aa, Artificial Sequence
  Description of Artificial Sequence: Synthetic polypeptide
AEEEIRTTNPVATEQYGSVSNTNTNQQANED

SEQ ID NO: 45744 - protein, 33 aa, Artificial Sequence
  Description of Artificial Sequence: Synthetic polypeptide
DEEEIRTTNPVAYEQYGQSVSNQNDLNQRGSER

SEQ ID NO: 45745 - protein, 33 aa, Artificial Sequence
  Description of Artificial Sequence: Synthetic polypeptide
DEEEIRTTNPVAYEQYGQSVSNTNDLNQYGSER

SEQ ID NO: 45746 - protein, 32 aa, Artificial Sequence
  Description of Artificial Sequence: Synthetic polypeptide
DEEEIRTTNPVAYEQYGQSVSPNDLLQEGQIR

SEQ ID NO: 45747 - protein, 34 aa, Artificial Sequence
  Description of Artificial Sequence: Synthetic polypeptide
DEEEIRTTNPVAYEQYGQSVSPTNGELQRGVVRP

SEQ ID NO: 45748 - protein, 33 aa, Artificial Sequence
  Description of Artificial Sequence: Synthetic polypeptide
DEEEIRTTNPVAYEQYGQSVSLENDLMQRGIQR

SEQ ID NO: 45749 - protein, 33 aa, Artificial Sequence
  Description of Artificial Sequence: Synthetic polypeptide
DEEEIRTTNPVAYEQYGQSVSISNDLLQRGIRR

SEQ ID NO: 45750 - protein, 33 aa, Artificial Sequence
  Description of Artificial Sequence: Synthetic polypeptide
DEEEIRTTNPVAYEQYGQSVSINDLLQRGIIRN

SEQ ID NO: 45751 - protein, 33 aa, Artificial Sequence
  Description of Artificial Sequence: Synthetic polypeptide
DEEEIRTTNPVAYEQYGQSVSGMNDLNQRGIAR

SEQ ID NO: 45752 - protein, 29 aa, Artificial Sequence
  Description of Artificial Sequence: Synthetic peptide
SEYEIRMTNPVATEQYGSVETNLQHTNQQ

SEQ ID NO: 45753 - protein, 29 aa, Artificial Sequence
  Description of Artificial Sequence: Synthetic peptide
SEYEIRMTNPVATEQYGSVETNLQHTNGQ

SEQ ID NO: 45754 - protein, 33 aa, Artificial Sequence
  Description of Artificial Sequence: Synthetic polypeptide
DEEEIRTTNPVAYEQYGQSVSAVNDLLQRGIIR

SEQ ID NO: 45755 - protein, 31 aa, Artificial Sequence
  Description of Artificial Sequence: Synthetic polypeptide
AEEEIRTTNPVATEQYGSVSNNQNQETGNED

SEQ ID NO: 45756 - protein, 29 aa, Artificial Sequence
  Description of Artificial Sequence: Synthetic peptide
SEYEIRMTNPVATEQYGAVETNLQPHGNQ

SEQ ID NO: 45757 - protein, 33 aa, Artificial Sequence
  Description of Artificial Sequence: Synthetic polypeptide
DEEEIRTTNPVAYEQYGQSVSCQNMLSQRGGIR

SEQ ID NO: 45758 - protein, 29 aa, Artificial Sequence
  Description of Artificial Sequence: Synthetic peptide
DTEEICTTNPVATTQYGSVSTNPEGGNGN

SEQ ID NO: 45759 - protein, 35 aa, Artificial Sequence
  Description of Artificial Sequence: Synthetic polypeptide
DEEEIRTTNPVAYEQYGQSVSPTNGELQRVGVVNR

SEQ ID NO: 45760 - protein, 31 aa, Artificial Sequence
  Description of Artificial Sequence: Synthetic polypeptide
AEEEIRTTNPVATEQYGSVSNSNENQQTGNE

SEQ ID NO: 45761 - protein, 33 aa, Artificial Sequence
  Description of Artificial Sequence: Synthetic polypeptide
DEEEIRTTNPVAYEQYGQSVSDENDLLQRGIDR

SEQ ID NO: 45762 - protein, 28 aa, Artificial Sequence
  Description of Artificial Sequence: Synthetic peptide
QEEEIATTNPVCTEQYGVVPDNLQHGNQ

SEQ ID NO: 45763 - protein, 29 aa, Artificial Sequence
  Description of Artificial Sequence: Synthetic peptide
DTEEICTTNPVATTQYGSVSTNNMEGGNV

SEQ ID NO: 45764 - protein, 34 aa, Artificial Sequence
  Description of Artificial Sequence: Synthetic polypeptide
DEEEIRTTNPVAYEQYGQSVSETNDLCQLRGIER

SEQ ID NO: 45765 - protein, 31 aa, Artificial Sequence
  Description of Artificial Sequence: Synthetic polypeptide
AEEEIRTTNPVATEQYGSVSNTNDEIGGTNN

SEQ ID NO: 45766 - protein, 32 aa, Artificial Sequence
  Description of Artificial Sequence: Synthetic polypeptide
AEEEIRTTNPVATEQYGSVSNTNDQQGNGNIN

SEQ ID NO: 45767 - protein, 33 aa, Artificial Sequence
  Description of Artificial Sequence: Synthetic polypeptide
AEEEIRTTNPVATEQYGSVSNTNLQQGEGNETE

SEQ ID NO: 45768 - protein, 29 aa, Artificial Sequence
  Description of Artificial Sequence: Synthetic peptide
DTEEICTTNPVATTQYGSVSTNPDGGGNN

SEQ ID NO: 45769 - protein, 33 aa, Artificial Sequence
  Description of Artificial Sequence: Synthetic polypeptide
AEEEIRTTNPVATEQYGSVSNTTNLQNNGNNIG

SEQ ID NO: 45770 - protein, 29 aa, Artificial Sequence
  Description of Artificial Sequence: Synthetic peptide
SEVEIRCTNPIATEQYGSVSENLMRGNLD

SEQ ID NO: 45771 - protein, 30 aa, Artificial Sequence
  Description of Artificial Sequence: Synthetic polypeptide
DTEEIATTNPVATEQWGSVSENLQQGMERE

SEQ ID NO: 45772 - protein, 32 aa, Artificial Sequence
  Description of Artificial Sequence: Synthetic polypeptide
DEEEIRTTNPVAYEQYGQSVSQNDLLARGVER

SEQ ID NO: 45773 - protein, 31 aa, Artificial Sequence
  Description of Artificial Sequence: Synthetic polypeptide
AEEEIRTTNPVATEQYGSVSSNENQGTGTNN

SEQ ID NO: 45774 - protein, 29 aa, Artificial Sequence
  Description of Artificial Sequence: Synthetic peptide
DDSEVRCTNPIATEQYGSVSAENLMRGNR

SEQ ID NO: 45775 - protein, 31 aa, Artificial Sequence
  Description of Artificial Sequence: Synthetic polypeptide
AEEEIRTTNPVATEQYGSVSSNENQQTGNAT

SEQ ID NO: 45776 - protein, 33 aa, Artificial Sequence
  Description of Artificial Sequence: Synthetic polypeptide
DEEEIRTTNPVAYEQYGQSVSQNDLTQRGIEVR

SEQ ID NO: 45777 - protein, 32 aa, Artificial Sequence
  Description of Artificial Sequence: Synthetic polypeptide
DEEEIRTTNPVAYEQYGQSVSQNELSQGGGIR

SEQ ID NO: 45778 - protein, 33 aa, Artificial Sequence
  Description of Artificial Sequence: Synthetic polypeptide
DEEEIRTTNPVAYEQYGQSVSQNNDLLQRGIIR

SEQ ID NO: 45779 - protein, 32 aa, Artificial Sequence
  Description of Artificial Sequence: Synthetic polypeptide
DEEEIRTTNPVAYEQYGQSVSQNDLIQREILR

SEQ ID NO: 45780 - protein, 32 aa, Artificial Sequence
  Description of Artificial Sequence: Synthetic polypeptide
DEEEIRTTNPVAYEQYGQSVSQNNLLQEGIIR

SEQ ID NO: 45781 - protein, 33 aa, Artificial Sequence
  Description of Artificial Sequence: Synthetic polypeptide
DEEEIRTTNPVAYEQYGQSVSQQNDLGQRGIER

SEQ ID NO: 45782 - protein, 31 aa, Artificial Sequence
  Description of Artificial Sequence: Synthetic polypeptide
AEEEIRTTNPVATEQYGSVSSNENQQTGNNA

SEQ ID NO: 45783 - protein, 32 aa, Artificial Sequence
  Description of Artificial Sequence: Synthetic polypeptide
AEEEIRTTNPVATEQYGSVSSNLQNQEGNIGT

SEQ ID NO: 45784 - protein, 33 aa, Artificial Sequence
  Description of Artificial Sequence: Synthetic polypeptide
DEEEIRTTNPVAYEQYGQSVSQTNMLSQFGGSR

SEQ ID NO: 45785 - protein, 29 aa, Artificial Sequence
  Description of Artificial Sequence: Synthetic peptide
DTEEIATTNPCATEHYGSVSFNLQDENNR

SEQ ID NO: 45786 - protein, 34 aa, Artificial Sequence
  Description of Artificial Sequence: Synthetic polypeptide
DEEEIRTTNPVAYEQYGQSVSQTNMLSQRGGDNG

SEQ ID NO: 45787 - protein, 31 aa, Artificial Sequence
  Description of Artificial Sequence: Synthetic polypeptide
AEEEIRTTNPVATEQYGSVSSNLQNQNLGIG

SEQ ID NO: 45788 - protein, 33 aa, Artificial Sequence
  Description of Artificial Sequence: Synthetic polypeptide
DEEEIRTTNPVAYEQYGQSVSQNSGSQRGGPNR

SEQ ID NO: 45789 - protein, 32 aa, Artificial Sequence
  Description of Artificial Sequence: Synthetic polypeptide
AEEEIRTTNPVATEQYGSVSSTNLNEEEGNNN

SEQ ID NO: 45790 - protein, 31 aa, Artificial Sequence
  Description of Artificial Sequence: Synthetic polypeptide
AEEEIRTTNPVATEQYGSVSSNENQDETGNG

SEQ ID NO: 45791 - protein, 33 aa, Artificial Sequence
  Description of Artificial Sequence: Synthetic polypeptide
DEEEIRTTNPVAYEQYGQSVSQMNDLYQRGIGR

SEQ ID NO: 45792 - protein, 31 aa, Artificial Sequence
  Description of Artificial Sequence: Synthetic polypeptide
AEEEIRTTNPVATEQYGSVSNVNGNQNTGNI

SEQ ID NO: 45793 - protein, 31 aa, Artificial Sequence
  Description of Artificial Sequence: Synthetic polypeptide
AEEEIRTTNPVATEQYGSVSNVNGNQTGNQS

SEQ ID NO: 45794 - protein, 31 aa, Artificial Sequence
  Description of Artificial Sequence: Synthetic polypeptide
AEEEIRTTNPVATEQYGSVSNVNGQTGTNGI

SEQ ID NO: 45795 - protein, 33 aa, Artificial Sequence
  Description of Artificial Sequence: Synthetic polypeptide
DEEEIRTTNPVAYEQYGQSVSPTNSELQRGVVP

SEQ ID NO: 45796 - protein, 29 aa, Artificial Sequence
  Description of Artificial Sequence: Synthetic peptide
DTEEIATTNPVATAQWGSVSTGNPDRGND

SEQ ID NO: 45797 - protein, 32 aa, Artificial Sequence
  Description of Artificial Sequence: Synthetic polypeptide
DEEEIRTTNPVAYEQYGQSVSPVDLLQRGIIR

SEQ ID NO: 45798 - protein, 31 aa, Artificial Sequence
  Description of Artificial Sequence: Synthetic polypeptide
AEEEIRTTNPVATEQYGSVSNVNGQTIGNNI

SEQ ID NO: 45799 - protein, 33 aa, Artificial Sequence
  Description of Artificial Sequence: Synthetic polypeptide
DEEEIRTTNPVAYEQYGQSVSQMNDLYQRGILR

SEQ ID NO: 45800 - protein, 28 aa, Artificial Sequence
  Description of Artificial Sequence: Synthetic peptide
QEEEIATTNPVCTEQYGVVSDCLQHGNL

SEQ ID NO: 45801 - protein, 32 aa, Artificial Sequence
  Description of Artificial Sequence: Synthetic polypeptide
DEEEIRTTNPVAYEQYGQSVSQADLLQRGSER

SEQ ID NO: 45802 - protein, 33 aa, Artificial Sequence
  Description of Artificial Sequence: Synthetic polypeptide
DEEEIRTTNPVAYEQYGQSVSQGNALPQRGTTR

SEQ ID NO: 45803 - protein, 34 aa, Artificial Sequence
  Description of Artificial Sequence: Synthetic polypeptide
AEEEIRTTNPVATEQYGSVSPTSNLEQEGGENSR

SEQ ID NO: 45804 - protein, 34 aa, Artificial Sequence
  Description of Artificial Sequence: Synthetic polypeptide
AEEEIRTTNPVATEQYGSVSPTSNLEQFRTENSR

SEQ ID NO: 45805 - protein, 33 aa, Artificial Sequence
  Description of Artificial Sequence: Synthetic polypeptide
DEEEIRTTNPVAYEQYGQSVSQGNELPQRGMSR

SEQ ID NO: 45806 - protein, 33 aa, Artificial Sequence
  Description of Artificial Sequence: Synthetic polypeptide
DEEEIRTTNPVAYEQYGQSVSQLNDALQRGQIR

SEQ ID NO: 45807 - protein, 33 aa, Artificial Sequence
  Description of Artificial Sequence: Synthetic polypeptide
DEEEIRTTNPVAYEQYGQSVSQLNDLLQEGNER

SEQ ID NO: 45808 - protein, 34 aa, Artificial Sequence
  Description of Artificial Sequence: Synthetic polypeptide
SETEIRTTNPVATEQYGSTVPSCTNLSQRTGTNR

SEQ ID NO: 45809 - protein, 29 aa, Artificial Sequence
  Description of Artificial Sequence: Synthetic peptide
DSHEIGTTNPVATEQYGSISTNIQGEGLR

SEQ ID NO: 45810 - protein, 33 aa, Artificial Sequence
  Description of Artificial Sequence: Synthetic polypeptide
DEEEIRTTNPVAYEQYGQVVSTNLSQATGGNRA

SEQ ID NO: 45811 - protein, 32 aa, Artificial Sequence
  Description of Artificial Sequence: Synthetic polypeptide
DEEEIRTTNPVAYEQYGQYVSGNDLLQRGIER

SEQ ID NO: 45812 - protein, 31 aa, Artificial Sequence
  Description of Artificial Sequence: Synthetic polypeptide
AEEEIRTTNPVATEQYGSVVSTNNQNQNTVG

SEQ ID NO: 45813 - protein, 33 aa, Artificial Sequence
  Description of Artificial Sequence: Synthetic polypeptide
DEEEIRTTNPVAYEQYGSVPSCTNLQHGGNYSQ

SEQ ID NO: 45814 - protein, 33 aa, Artificial Sequence
  Description of Artificial Sequence: Synthetic polypeptide
DEEEIRTTNPVAYEQYGSVPSCTNLSQHGENSQ

SEQ ID NO: 45815 - protein, 30 aa, Artificial Sequence
  Description of Artificial Sequence: Synthetic polypeptide
DSEEIRTTNPVGTEQWGTVSTNLQNRGDEL

SEQ ID NO: 45816 - protein, 32 aa, Artificial Sequence
  Description of Artificial Sequence: Synthetic polypeptide
AEEEIRTTNPVATEQYGSVSSTNNQIGTNTTT

SEQ ID NO: 45817 - protein, 32 aa, Artificial Sequence
  Description of Artificial Sequence: Synthetic polypeptide
AEEEIRTTNPVATEQYGSVSSTNNQQIGNTTN

SEQ ID NO: 45818 - protein, 31 aa, Artificial Sequence
  Description of Artificial Sequence: Synthetic polypeptide
AEEEIRTTNPVATEQYGSVVSTNNNQNGGIG

SEQ ID NO: 45819 - protein, 33 aa, Artificial Sequence
  Description of Artificial Sequence: Synthetic polypeptide
DEEEIRTTNPVAYEQYGSVPSTNMLSMNGGNRL

SEQ ID NO: 45820 - protein, 35 aa, Artificial Sequence
  Description of Artificial Sequence: Synthetic polypeptide
DEEEIRTTNPVAYEQYGSVPSVTNALPQRTVLGNR

SEQ ID NO: 45821 - protein, 32 aa, Artificial Sequence
  Description of Artificial Sequence: Synthetic polypeptide
AEEEIRTTNPVATEQYGSVSSTNNQQQIGNTN

SEQ ID NO: 45822 - protein, 31 aa, Artificial Sequence
  Description of Artificial Sequence: Synthetic polypeptide
AEEEIRTTNPVATEQYGSVSSTNNSTSTGND

SEQ ID NO: 45823 - protein, 32 aa, Artificial Sequence
  Description of Artificial Sequence: Synthetic polypeptide
AEEEIRTTNPVATEQYGSVSSTNQNNQDGNGV

SEQ ID NO: 45824 - protein, 31 aa, Artificial Sequence
  Description of Artificial Sequence: Synthetic polypeptide
AEEEIRTTNPVATEQYGSVSSTNQNQDEENE

SEQ ID NO: 45825 - protein, 32 aa, Artificial Sequence
  Description of Artificial Sequence: Synthetic polypeptide
AEEEIRTTNPVATEQYGSVVSTNLNQGQNDEG

SEQ ID NO: 45826 - protein, 30 aa, Artificial Sequence
  Description of Artificial Sequence: Synthetic polypeptide
DSEEIRTTNPVGTEQWGTVSTNLQHGDERH

SEQ ID NO: 45827 - protein, 32 aa, Artificial Sequence
  Description of Artificial Sequence: Synthetic polypeptide
AEEEIRTTNPVATEQYGSVSSTNNQEIGTNTE

SEQ ID NO: 45828 - protein, 33 aa, Artificial Sequence
  Description of Artificial Sequence: Synthetic polypeptide
DEEEIRTTNPVAYEQYGSVPSCTNEHQTTTGNR

SEQ ID NO: 45829 - protein, 32 aa, Artificial Sequence
  Description of Artificial Sequence: Synthetic polypeptide
AEEEIRTTNPVATEQYGSVSSTNNNQIGNTTG

SEQ ID NO: 45830 - protein, 32 aa, Artificial Sequence
  Description of Artificial Sequence: Synthetic polypeptide
AEEEIRTTNPVATEQYGSVSSTNNNQIGNTNT

SEQ ID NO: 45831 - protein, 33 aa, Artificial Sequence
  Description of Artificial Sequence: Synthetic polypeptide
DEEEIRTTNPVAYEQYGSVCSCTNALSLPGNNR

SEQ ID NO: 45832 - protein, 33 aa, Artificial Sequence
  Description of Artificial Sequence: Synthetic polypeptide
DEEEIRTTNPVAYEQYGSVCSCTNALSTQGDNR

SEQ ID NO: 45833 - protein, 33 aa, Artificial Sequence
  Description of Artificial Sequence: Synthetic polypeptide
DEEEIRTTNPVAYEQYGSVCSCTNLSLSGGNRI

SEQ ID NO: 45834 - protein, 33 aa, Artificial Sequence
  Description of Artificial Sequence: Synthetic polypeptide
DEEEIRTTNPVAYEQYGSVCSCTNLSPTPGGNR

SEQ ID NO: 45835 - protein, 31 aa, Artificial Sequence
  Description of Artificial Sequence: Synthetic polypeptide
DEEEIRTTNPVAYEQYGSVCSTEELQFGSQQ

SEQ ID NO: 45836 - protein, 33 aa, Artificial Sequence
  Description of Artificial Sequence: Synthetic polypeptide
DEEEIRTTNPVAYEQYGSVCSTELQERFGSNAN

SEQ ID NO: 45837 - protein, 32 aa, Artificial Sequence
  Description of Artificial Sequence: Synthetic polypeptide
DEEEIRTTNPVAYEQYGSVCSTNHQGFGSNQV

SEQ ID NO: 45838 - protein, 31 aa, Artificial Sequence
  Description of Artificial Sequence: Synthetic polypeptide
AEEEIRTTNPVATEQYGSVVSTNLNGNQNDE

SEQ ID NO: 45839 - protein, 29 aa, Artificial Sequence
  Description of Artificial Sequence: Synthetic peptide
DSEEIRTTNPVGYEQWGMVSTNLQGDGSR

SEQ ID NO: 45840 - protein, 32 aa, Artificial Sequence
  Description of Artificial Sequence: Synthetic polypeptide
AEEEIRTTNPVATEQYGSVSSTNNNQEQGNPI

SEQ ID NO: 45841 - protein, 31 aa, Artificial Sequence
  Description of Artificial Sequence: Synthetic polypeptide
AEEEIRTTNPVATEQYGSVVSTNQGTETGNG

SEQ ID NO: 45842 - protein, 31 aa, Artificial Sequence
  Description of Artificial Sequence: Synthetic polypeptide
DSEEIRTTNPVGTEQWGVVSYTNLSQRGGVR

SEQ ID NO: 45843 - protein, 33 aa, Artificial Sequence
  Description of Artificial Sequence: Synthetic polypeptide
DEEEIRTTNPVAYEQYGSVFTTGNELSQRSNNR

SEQ ID NO: 45844 - protein, 32 aa, Artificial Sequence
  Description of Artificial Sequence: Synthetic polypeptide
AEEEIRTTNPVATEQYGSVSSTNNNQIGNTED

SEQ ID NO: 45845 - protein, 31 aa, Artificial Sequence
  Description of Artificial Sequence: Synthetic polypeptide
DSEEIRTTNPVGTEQWGTVSTNLSQRGGVTR

SEQ ID NO: 45846 - protein, 30 aa, Artificial Sequence
  Description of Artificial Sequence: Synthetic polypeptide
DSEEIRTTNPVGTEQWGTVSTNLQRGDSLD

SEQ ID NO: 45847 - protein, 32 aa, Artificial Sequence
  Description of Artificial Sequence: Synthetic polypeptide
AEEEIRTTNPVATEQYGSVSSTNNNQDNGNNV

SEQ ID NO: 45848 - protein, 31 aa, Artificial Sequence
  Description of Artificial Sequence: Synthetic polypeptide
DEEEIRTTNPVAYEQYGSVPWTNLSQGFVSR

SEQ ID NO: 45849 - protein, 32 aa, Artificial Sequence
  Description of Artificial Sequence: Synthetic polypeptide
DEEEIRTTNPVAYEQYGSVQACTALSQRSGNH

SEQ ID NO: 45850 - protein, 32 aa, Artificial Sequence
  Description of Artificial Sequence: Synthetic polypeptide
AEEEIRTTNPVATEQYGSVSSTNQNQIGNTEE

SEQ ID NO: 45851 - protein, 32 aa, Artificial Sequence
  Description of Artificial Sequence: Synthetic polypeptide
AEEEIRTTNPVATEQYGSVSSTNQNQQIGNTD

SEQ ID NO: 45852 - protein, 32 aa, Artificial Sequence
  Description of Artificial Sequence: Synthetic polypeptide
AEEEIRTTNPVATEQYGSVSSTNQQQTTGNIT

SEQ ID NO: 45853 - protein, 31 aa, Artificial Sequence
  Description of Artificial Sequence: Synthetic polypeptide
AEEEIRTTNPVATEQYGSVSSTNSNTQTNNI

SEQ ID NO: 45854 - protein, 32 aa, Artificial Sequence
  Description of Artificial Sequence: Synthetic polypeptide
DEEEIRTTNPVAYEQYGSVVATAAGSQRGNNR

SEQ ID NO: 45855 - protein, 32 aa, Artificial Sequence
  Description of Artificial Sequence: Synthetic polypeptide
DEEEIRTTNPVAYEQYGSVVCTGNLQGTEGNG

SEQ ID NO: 45856 - protein, 33 aa, Artificial Sequence
  Description of Artificial Sequence: Synthetic polypeptide
DEEEIRTTNPVAYEQYGSVVCTNLQRTEGNNGL

SEQ ID NO: 45857 - protein, 33 aa, Artificial Sequence
  Description of Artificial Sequence: Synthetic polypeptide
DEEEIRTTNPVAYEQYGSVVFTNLSQREGGNQL

SEQ ID NO: 45858 - protein, 30 aa, Artificial Sequence
  Description of Artificial Sequence: Synthetic polypeptide
DSEEIRTTNPVGTEQWGTVSTNLQERGDED

SEQ ID NO: 45859 - protein, 33 aa, Artificial Sequence
  Description of Artificial Sequence: Synthetic polypeptide
DEEEIRTTNPVAYEQYGSVVLQTNDLLQRGIAR

SEQ ID NO: 45860 - protein, 33 aa, Artificial Sequence
  Description of Artificial Sequence: Synthetic polypeptide
AEEEIRTTNPVATEQYGSVSSTTNLNQGGNENT

SEQ ID NO: 45861 - protein, 34 aa, Artificial Sequence
  Description of Artificial Sequence: Synthetic polypeptide
DEEEIRTTNPVAYEQYGSVVSCTNMLSQRGGGRL

SEQ ID NO: 45862 - protein, 32 aa, Artificial Sequence
  Description of Artificial Sequence: Synthetic polypeptide
DEEEIRTTNPVAYEQYGSVVSQNELLQRGIGD

SEQ ID NO: 45863 - protein, 32 aa, Artificial Sequence
  Description of Artificial Sequence: Synthetic polypeptide
DEEEIRTTNPVAYEQYGSVVSQNNLLQYGIER

SEQ ID NO: 45864 - protein, 33 aa, Artificial Sequence
  Description of Artificial Sequence: Synthetic polypeptide
DEEEIRTTNPVAYEQYGSVVSQTNNLLQEGIFR

SEQ ID NO: 45865 - protein, 31 aa, Artificial Sequence
  Description of Artificial Sequence: Synthetic polypeptide
SESEIRTTNPVATEQYGSVSCINLPMDRGNG

SEQ ID NO: 45866 - protein, 33 aa, Artificial Sequence
  Description of Artificial Sequence: Synthetic polypeptide
DEEEIRTTNPVAYEQYGSVVSTGNLSQLGGPRV

SEQ ID NO: 45867 - protein, 33 aa, Artificial Sequence
  Description of Artificial Sequence: Synthetic polypeptide
DEEEIRTTNPVAYEQYGSVVPSCTNALSSRGNV

SEQ ID NO: 45868 - protein, 33 aa, Artificial Sequence
  Description of Artificial Sequence: Synthetic polypeptide
DEEEIRTTNPVAYEQYGSVCSCTGLSQRSQNNR

SEQ ID NO: 45869 - protein, 33 aa, Artificial Sequence
  Description of Artificial Sequence: Synthetic polypeptide
DEEEIRTTNPVAYEQYGSVSVTGFLSGNRVGNR

SEQ ID NO: 45870 - protein, 35 aa, Artificial Sequence
  Description of Artificial Sequence: Synthetic polypeptide
DEEEIRTTNPVAYEQYGSVSTTGNELSQRGTNNRC

SEQ ID NO: 45871 - protein, 33 aa, Artificial Sequence
  Description of Artificial Sequence: Synthetic polypeptide
DEEEIRTTNPVAYEQYGSVQSTNMESQSGGNNR

SEQ ID NO: 45872 - protein, 32 aa, Artificial Sequence
  Description of Artificial Sequence: Synthetic polypeptide
DEEEIRTTNPVAYEQYGSVSCENLSQHGGNSQ

SEQ ID NO: 45873 - protein, 33 aa, Artificial Sequence
  Description of Artificial Sequence: Synthetic polypeptide
DEEEIRTTNPVAYEQYGSVSCTNALAQHGGNSQ

SEQ ID NO: 45874 - protein, 32 aa, Artificial Sequence
  Description of Artificial Sequence: Synthetic polypeptide
DEEEIRTTNPVAYEQYGSVSCTNASQHGNNSQ

SEQ ID NO: 45875 - protein, 31 aa, Artificial Sequence
  Description of Artificial Sequence: Synthetic polypeptide
AEEEIRTTNPVATEQYGSVVSTNGNEQGQNE

SEQ ID NO: 45876 - protein, 31 aa, Artificial Sequence
  Description of Artificial Sequence: Synthetic polypeptide
DEEEIRTTNPVAYEQYGSVSDVVDLQGGDNE

SEQ ID NO: 45877 - protein, 32 aa, Artificial Sequence
  Description of Artificial Sequence: Synthetic polypeptide
DEEEIRTTNPVAYEQYGSVSINALSQRGGPQV

SEQ ID NO: 45878 - protein, 31 aa, Artificial Sequence
  Description of Artificial Sequence: Synthetic polypeptide
DEEEIRTTNPVAYEQYGSVSTVNASDTGPRP

SEQ ID NO: 45879 - protein, 32 aa, Artificial Sequence
  Description of Artificial Sequence: Synthetic polypeptide
DEEEIRTTNPVAYEQYGSVSKTEALNERGNQS

SEQ ID NO: 45880 - protein, 32 aa, Artificial Sequence
  Description of Artificial Sequence: Synthetic polypeptide
AEEEIRTTNPVATEQYGSVVSSTNNQQGTNGQ

SEQ ID NO: 45881 - protein, 31 aa, Artificial Sequence
  Description of Artificial Sequence: Synthetic polypeptide
DEEEIRTTNPVAYEQYGSVSTEPQNFGSNDF

SEQ ID NO: 45882 - protein, 32 aa, Artificial Sequence
  Description of Artificial Sequence: Synthetic polypeptide
DEEEIRTTNPVAYEQYGSVSTGNLQSFGSEQY

SEQ ID NO: 45883 - protein, 32 aa, Artificial Sequence
  Description of Artificial Sequence: Synthetic polypeptide
DEEEIRTTNPVAYEQYGSVSTNLSQSVTNNPA

SEQ ID NO: 45884 - protein, 31 aa, Artificial Sequence
  Description of Artificial Sequence: Synthetic polypeptide
DEEEIRTTNPVAYEQYGSVSTNPQNFGSEDD

SEQ ID NO: 45885 - protein, 33 aa, Artificial Sequence
  Description of Artificial Sequence: Synthetic polypeptide
DEEEIRTTNPVAYEQYGSVSTSNNLNDMLGMNR

SEQ ID NO: 45886 - protein, 33 aa, Artificial Sequence
  Description of Artificial Sequence: Synthetic polypeptide
DEEEIRTTNPVAYEQYGSVSTTGNELSQDVNNR

SEQ ID NO: 45887 - protein, 32 aa, Artificial Sequence
  Description of Artificial Sequence: Synthetic polypeptide
DEEEIRTTNPVAYEQYGSVSTELQEYFGSNQP

SEQ ID NO: 45888 - protein, 29 aa, Artificial Sequence
  Description of Artificial Sequence: Synthetic peptide
SEYEIRMTNPVATEQYGSVETNLQQHGEQ

SEQ ID NO: 45889 - protein, 30 aa, Artificial Sequence
  Description of Artificial Sequence: Synthetic polypeptide
DSEEIRTTNPVGYEQWGMVSTNLQGEGNDR

SEQ ID NO: 45890 - protein, 32 aa, Artificial Sequence
  Description of Artificial Sequence: Synthetic polypeptide
DEEEIRTTNPVAYEQYGSVCCTTLSQRPGGNF

SEQ ID NO: 45891 - protein, 30 aa, Artificial Sequence
  Description of Artificial Sequence: Synthetic polypeptide
DSEEISTTNPVAYTQYGSTVSTNQSMRGNR

SEQ ID NO: 45892 - protein, 31 aa, Artificial Sequence
  Description of Artificial Sequence: Synthetic polypeptide
AEEEIRTTNPVATEQYGSVSSTNLQEEEDEE

SEQ ID NO: 45893 - protein, 34 aa, Artificial Sequence
  Description of Artificial Sequence: Synthetic polypeptide
DEEEIRTTNPVAYEQYGSTVSCTNELAFRGGNYR

SEQ ID NO: 45894 - protein, 31 aa, Artificial Sequence
  Description of Artificial Sequence: Synthetic polypeptide
AEEEIRTTNPVATEQYGSVSSTNLQEEEEEQ

SEQ ID NO: 45895 - protein, 32 aa, Artificial Sequence
  Description of Artificial Sequence: Synthetic polypeptide
AEEEIRTTNPVATEQYGSVVTANLNQEGTNVA

SEQ ID NO: 45896 - protein, 31 aa, Artificial Sequence
  Description of Artificial Sequence: Synthetic polypeptide
AEEEIRTTNPVATEQYGSVSSTNLQENEEEE

SEQ ID NO: 45897 - protein, 31 aa, Artificial Sequence
  Description of Artificial Sequence: Synthetic polypeptide
AEEEIRTTNPVATEQYGSVSSTNLQNEEEDE

SEQ ID NO: 45898 - protein, 33 aa, Artificial Sequence
  Description of Artificial Sequence: Synthetic polypeptide
DEEEIRTTNPVAYEQYGSTVSTNAFSQRSGARF

SEQ ID NO: 45899 - protein, 31 aa, Artificial Sequence
  Description of Artificial Sequence: Synthetic polypeptide
DEEEIRTTNPVAYEQYGSTVSTNHFGFVGNE

SEQ ID NO: 45900 - protein, 32 aa, Artificial Sequence
  Description of Artificial Sequence: Synthetic polypeptide
DEEEIRTTNPVAYEQYGSTVSTNLSTISGARF

SEQ ID NO: 45901 - protein, 33 aa, Artificial Sequence
  Description of Artificial Sequence: Synthetic polypeptide
DEEEIRTTNPVAYEQYGSTVSTNQSQRAVGARF

SEQ ID NO: 45902 - protein, 32 aa, Artificial Sequence
  Description of Artificial Sequence: Synthetic polypeptide
AEEEIRTTNPVATEQYGSVVTANLNQEGNNNV

SEQ ID NO: 45903 - protein, 30 aa, Artificial Sequence
  Description of Artificial Sequence: Synthetic polypeptide
DSEEISTTNPVATTQYGSVSTNPSTEGGNR

SEQ ID NO: 45904 - protein, 33 aa, Artificial Sequence
  Description of Artificial Sequence: Synthetic polypeptide
DEEEIRTTNPVAYEQYGSTVSYTNLSGRSGARF

SEQ ID NO: 45905 - protein, 32 aa, Artificial Sequence
  Description of Artificial Sequence: Synthetic polypeptide
AEEEIRTTNPVATEQYGSVSSTNLQQGEEDED

SEQ ID NO: 45906 - protein, 32 aa, Artificial Sequence
  Description of Artificial Sequence: Synthetic polypeptide
AEEEIRTTNPVATEQYGSVSSTNLQDNTNNGG

SEQ ID NO: 45907 - protein, 34 aa, Artificial Sequence
  Description of Artificial Sequence: Synthetic polypeptide
DEEEIRTTNPVAYEQYGSTVCSTNMLSQRSGARF

SEQ ID NO: 45908 - protein, 33 aa, Artificial Sequence
  Description of Artificial Sequence: Synthetic polypeptide
AEEEIRTTNPVATEQYGSVSSTNLNQQQGENNE

SEQ ID NO: 45909 - protein, 33 aa, Artificial Sequence
  Description of Artificial Sequence: Synthetic polypeptide
DEEEIRTTNPVAYEQYGSTVCSCTNALSLQGNR

SEQ ID NO: 45910 - protein, 30 aa, Artificial Sequence
  Description of Artificial Sequence: Synthetic polypeptide
DEEEIRTTNPVAYEQYGSASATNNNQMGIT

SEQ ID NO: 45911 - protein, 28 aa, Artificial Sequence
  Description of Artificial Sequence: Synthetic peptide
QEEEIATTNPVSTEQYGIASCNLQSGTR

SEQ ID NO: 45912 - protein, 33 aa, Artificial Sequence
  Description of Artificial Sequence: Synthetic polypeptide
DSGEIRTTNPVATEQYGSVVSTNMLSQLGGMNR

SEQ ID NO: 45913 - protein, 33 aa, Artificial Sequence
  Description of Artificial Sequence: Synthetic polypeptide
AEEEIRTTNPVATEQYGSVSSTNLNQAGNGNNA

SEQ ID NO: 45914 - protein, 31 aa, Artificial Sequence
  Description of Artificial Sequence: Synthetic polypeptide
AEEEIRTTNPVATEQYGSVSSTNLNQEEEEE

SEQ ID NO: 45915 - protein, 33 aa, Artificial Sequence
  Description of Artificial Sequence: Synthetic polypeptide
AEEEIRTTNPVATEQYGSVSSTNLNQEQGTNVE

SEQ ID NO: 45916 - protein, 33 aa, Artificial Sequence
  Description of Artificial Sequence: Synthetic polypeptide
AEEEIRTTNPVATEQYGSVSSTNLNQNGGNENE

SEQ ID NO: 45917 - protein, 32 aa, Artificial Sequence
  Description of Artificial Sequence: Synthetic polypeptide
AEEEIRTTNPVATEQYGSVSSTNLQQNQENNM

SEQ ID NO: 45918 - protein, 32 aa, Artificial Sequence
  Description of Artificial Sequence: Synthetic polypeptide
DSGEIRTTNPVATEQYGSVSCTGNMLSQLGMR

SEQ ID NO: 45919 - protein, 33 aa, Artificial Sequence
  Description of Artificial Sequence: Synthetic polypeptide
AEEEIRTTNPVATEQYGSVSSTNLNQQGGNNAE

SEQ ID NO: 45920 - protein, 33 aa, Artificial Sequence
  Description of Artificial Sequence: Synthetic polypeptide
DEEEIRTTNPVAYEQYGSSVSQTNDLLQDGIIR

SEQ ID NO: 45921 - protein, 32 aa, Artificial Sequence
  Description of Artificial Sequence: Synthetic polypeptide
DEEEIRTTNPVAYEQYGSSVSTNGLLARGIPI

SEQ ID NO: 45922 - protein, 33 aa, Artificial Sequence
  Description of Artificial Sequence: Synthetic polypeptide
DEEEIRTTNPVAYEQYGSTCSCTVGLSQRGGNR

SEQ ID NO: 45923 - protein, 31 aa, Artificial Sequence
  Description of Artificial Sequence: Synthetic polypeptide
DSGEIRTTNPVATEQYGSVPATNALSQLGMR

SEQ ID NO: 45924 - protein, 33 aa, Artificial Sequence
  Description of Artificial Sequence: Synthetic polypeptide
AEEEIRTTNPVATEQYGSVSSTNLNQQGIGNND

SEQ ID NO: 45925 - protein, 28 aa, Artificial Sequence
  Description of Artificial Sequence: Synthetic peptide
SETEIRCTNPIATEQYGSVSEQLMRWNR

SEQ ID NO: 45926 - protein, 32 aa, Artificial Sequence
  Description of Artificial Sequence: Synthetic polypeptide
DEEEIRTTNPVAYEQYGSSVEENDDLQRGIER

SEQ ID NO: 45927 - protein, 32 aa, Artificial Sequence
  Description of Artificial Sequence: Synthetic polypeptide
DSEEISTTNPVATEQYGVVPSTNLSARGGNNR

SEQ ID NO: 45928 - protein, 31 aa, Artificial Sequence
  Description of Artificial Sequence: Synthetic polypeptide
DSEEISTTNPVATDQYGSVPSTNPSMRGGNR

SEQ ID NO: 45929 - protein, 31 aa, Artificial Sequence
  Description of Artificial Sequence: Synthetic polypeptide
DEEEIRTTNPVAYEQYGSVACTNALQVADSR

SEQ ID NO: 45930 - protein, 31 aa, Artificial Sequence
  Description of Artificial Sequence: Synthetic polypeptide
DEEEIRTTNPVAYEQYGSVATNLQGNPEGTP

SEQ ID NO: 45931 - protein, 32 aa, Artificial Sequence
  Description of Artificial Sequence: Synthetic polypeptide
AEEEIRTTNPVATEQYGSVSSTNNLQNANNVE

SEQ ID NO: 45932 - protein, 33 aa, Artificial Sequence
  Description of Artificial Sequence: Synthetic polypeptide
AEEEIRTTNPVATEQYGSVSSTNNLQQGENNAD

SEQ ID NO: 45933 - protein, 33 aa, Artificial Sequence
  Description of Artificial Sequence: Synthetic polypeptide
AEEEIRTTNPVATEQYGSVSSTNNLQQGTNGSG

SEQ ID NO: 45934 - protein, 31 aa, Artificial Sequence
  Description of Artificial Sequence: Synthetic polypeptide
DEEEIRTTNPVAYEQYGSVATNLQNPGTAME

SEQ ID NO: 45935 - protein, 31 aa, Artificial Sequence
  Description of Artificial Sequence: Synthetic polypeptide
DEEEIRTTNPVAYEQYGSVATNLQNSDGSVE

SEQ ID NO: 45936 - protein, 32 aa, Artificial Sequence
  Description of Artificial Sequence: Synthetic polypeptide
AEEEIRTTNPVATEQYGSVSSTNNLQQNANNQ

SEQ ID NO: 45937 - protein, 31 aa, Artificial Sequence
  Description of Artificial Sequence: Synthetic polypeptide
AEEEIRTTNPVATEQYGSVSSTNNLQEEETE

SEQ ID NO: 45938 - protein, 33 aa, Artificial Sequence
  Description of Artificial Sequence: Synthetic polypeptide
AEEEIRTTNPVATEQYGSVSSTNNLQQQGENNE

SEQ ID NO: 45939 - protein, 32 aa, Artificial Sequence
  Description of Artificial Sequence: Synthetic polypeptide
AEEEIRTTNPVATEQYGSVSSTNNNAQNGNTD

SEQ ID NO: 45940 - protein, 32 aa, Artificial Sequence
  Description of Artificial Sequence: Synthetic polypeptide
AEEEIRTTNPVATEQYGSVVTANLNNQEGNVT

SEQ ID NO: 45941 - protein, 32 aa, Artificial Sequence
  Description of Artificial Sequence: Synthetic polypeptide
AEEEIRTTNPVATEQYGSVVTANLGNQEGNTV

SEQ ID NO: 45942 - protein, 31 aa, Artificial Sequence
  Description of Artificial Sequence: Synthetic polypeptide
DEEEIRTTNPVAYEQYGSVATNLQVPDNSAN

SEQ ID NO: 45943 - protein, 30 aa, Artificial Sequence
  Description of Artificial Sequence: Synthetic polypeptide
DEEEIRTTNPVAYEQYGSVATNLQVPDSPE

SEQ ID NO: 45944 - protein, 33 aa, Artificial Sequence
  Description of Artificial Sequence: Synthetic polypeptide
DEEEIRTTNPVAYEQYGSVATNLSTNRTGNNRY

SEQ ID NO: 45945 - protein, 28 aa, Artificial Sequence
  Description of Artificial Sequence: Synthetic peptide
SETEIRCTNPIATECYGSVSENLMPGNR

SEQ ID NO: 45946 - protein, 30 aa, Artificial Sequence
  Description of Artificial Sequence: Synthetic polypeptide
DEEEIRTTNPVAYEQYGSVATNLQVPDDDN

SEQ ID NO: 45947 - protein, 31 aa, Artificial Sequence
  Description of Artificial Sequence: Synthetic polypeptide
AEEEIRTTNPVATEQYGSVVSVTNNQNGTVG

SEQ ID NO: 45948 - protein, 32 aa, Artificial Sequence
  Description of Artificial Sequence: Synthetic polypeptide
DEEEIRTTNPVAYEQYGSVATNLQGDPTEGNP

SEQ ID NO: 45949 - protein, 31 aa, Artificial Sequence
  Description of Artificial Sequence: Synthetic polypeptide
DEEEIRTTNPVAYEQYGSVATNLQANPTEHR

SEQ ID NO: 45950 - protein, 32 aa, Artificial Sequence
  Description of Artificial Sequence: Synthetic polypeptide
DEEEIRTTNPVAYEQYGSVACTPLSQRTGDND

SEQ ID NO: 45951 - protein, 32 aa, Artificial Sequence
  Description of Artificial Sequence: Synthetic polypeptide
DEEEIRTTNPVAYEQYGSVACTTLSQGTGLNR

SEQ ID NO: 45952 - protein, 33 aa, Artificial Sequence
  Description of Artificial Sequence: Synthetic polypeptide
AEEEIRTTNPVATEQYGSVSSTNLQQQGENNAE

SEQ ID NO: 45953 - protein, 29 aa, Artificial Sequence
  Description of Artificial Sequence: Synthetic peptide
SETEIRCTNPIATEQYGSVSENLMPGNYR

SEQ ID NO: 45954 - protein, 29 aa, Artificial Sequence
  Description of Artificial Sequence: Synthetic peptide
DSEEISTTNPVATCQYGSVSTNPIRGSEQ

SEQ ID NO: 45955 - protein, 32 aa, Artificial Sequence
  Description of Artificial Sequence: Synthetic polypeptide
AEEEIRTTNPVATEQYGSVSSTNNEQIGENIN

SEQ ID NO: 45956 - protein, 30 aa, Artificial Sequence
  Description of Artificial Sequence: Synthetic polypeptide
DEEEIRTTNPVAYEQYGSVATNDQVPDSRN

SEQ ID NO: 45957 - protein, 31 aa, Artificial Sequence
  Description of Artificial Sequence: Synthetic polypeptide
DEEEIRTTNPVAYEQYGSVATNLQDTGDDTQ

SEQ ID NO: 45958 - protein, 32 aa, Artificial Sequence
  Description of Artificial Sequence: Synthetic polypeptide
DEEEIRTTNPVAYEQYGSVATNLQAAEGNDND

SEQ ID NO: 45959 - protein, 33 aa, Artificial Sequence
  Description of Artificial Sequence: Synthetic polypeptide
AEEEIRTTNPVATEQYGSVSSTNNLGQNGNNII

SEQ ID NO: 45960 - protein, 31 aa, Artificial Sequence
  Description of Artificial Sequence: Synthetic polypeptide
DEEEIRTTNPVAYEQYGSVATNLQAAPDGMN

SEQ ID NO: 45961 - protein, 31 aa, Artificial Sequence
  Description of Artificial Sequence: Synthetic polypeptide
DEEEIRTTNPVAYEQYGSVATNLQAEPNEDD

SEQ ID NO: 45962 - protein, 31 aa, Artificial Sequence
  Description of Artificial Sequence: Synthetic polypeptide
DEEEIRTTNPVAYEQYGSVATNLQANGPEHE

SEQ ID NO: 45963 - protein, 31 aa, Artificial Sequence
  Description of Artificial Sequence: Synthetic polypeptide
DEEEIRTTNPVAYEQYGSVATNLQANGPPEN

SEQ ID NO: 45964 - protein, 31 aa, Artificial Sequence
  Description of Artificial Sequence: Synthetic polypeptide
AEEEIRTTNPVATEQYGSVSSTNNLQEEDED

SEQ ID NO: 45965 - protein, 31 aa, Artificial Sequence
  Description of Artificial Sequence: Synthetic polypeptide
DEEEIRTTNPVAYEQYGSVATNLQANPEGEN

SEQ ID NO: 45966 - protein, 32 aa, Artificial Sequence
  Description of Artificial Sequence: Synthetic polypeptide
AEEEIRTTNPVATEQYGSVSSTNNEQIGINTE

SEQ ID NO: 45967 - protein, 33 aa, Artificial Sequence
  Description of Artificial Sequence: Synthetic polypeptide
AEEEIRTTNPVATEQYGSVSSTTNLQQAGENNE

SEQ ID NO: 45968 - protein, 29 aa, Artificial Sequence
  Description of Artificial Sequence: Synthetic peptide
SEYEIRMTNPVATEQYGSVETNNQEHGNQ

SEQ ID NO: 45969 - protein, 30 aa, Artificial Sequence
  Description of Artificial Sequence: Synthetic polypeptide
AEEEIRTTNPVATEQYGSVSNNQEIGGNNG

SEQ ID NO: 45970 - protein, 32 aa, Artificial Sequence
  Description of Artificial Sequence: Synthetic polypeptide
DEEEIRTTNPVAYEHYGSIPSTFALSQRGGNR

SEQ ID NO: 45971 - protein, 32 aa, Artificial Sequence
  Description of Artificial Sequence: Synthetic polypeptide
DEEEIRTTNPVAYEHYGSTVNQNGLSQRGGNR

SEQ ID NO: 45972 - protein, 31 aa, Artificial Sequence
  Description of Artificial Sequence: Synthetic polypeptide
DEEEIRTTNPVAYEHYGSVAQNLSQRPGGNE

SEQ ID NO: 45973 - protein, 32 aa, Artificial Sequence
  Description of Artificial Sequence: Synthetic polypeptide
DEEEIRTTNPVAYEHYGSVAYQNLSQRGGNRI

SEQ ID NO: 45974 - protein, 32 aa, Artificial Sequence
  Description of Artificial Sequence: Synthetic polypeptide
DEEEIRTTNPVAYEHYGSVCPCTNLSQRGNNS

SEQ ID NO: 45975 - protein, 32 aa, Artificial Sequence
  Description of Artificial Sequence: Synthetic polypeptide
DEEEIRTTNPVAYEHYGSVSCTTTLSQRGGNE

SEQ ID NO: 45976 - protein, 32 aa, Artificial Sequence
  Description of Artificial Sequence: Synthetic polypeptide
DEEEIRTTNPVAYEHYGSVSTTGLSQRTGGNE

SEQ ID NO: 45977 - protein, 31 aa, Artificial Sequence
  Description of Artificial Sequence: Synthetic polypeptide
DEEEIRTTNPVAYEHYGSVVAQNLSQRGGND

SEQ ID NO: 45978 - protein, 32 aa, Artificial Sequence
  Description of Artificial Sequence: Synthetic polypeptide
DEEEIRTTNPVAYEIYGSVSTTNDSQERVANR

SEQ ID NO: 45979 - protein, 29 aa, Artificial Sequence
  Description of Artificial Sequence: Synthetic peptide
SSEEIRTTNPVATEQWGTVSWNLEEGNGR

SEQ ID NO: 45980 - protein, 32 aa, Artificial Sequence
  Description of Artificial Sequence: Synthetic polypeptide
AEEEIRTTNPVATEQYGEVSSTTNLNRNGMNV

SEQ ID NO: 45981 - protein, 32 aa, Artificial Sequence
  Description of Artificial Sequence: Synthetic polypeptide
QEEEIATTNPVAYEQYGSVATNLQDRGGNGRM

SEQ ID NO: 45982 - protein, 30 aa, Artificial Sequence
  Description of Artificial Sequence: Synthetic polypeptide
DEEEIRTTNPVAYEPDGKVSTMSLQRGEER

SEQ ID NO: 45983 - protein, 32 aa, Artificial Sequence
  Description of Artificial Sequence: Synthetic polypeptide
AEEEIRTTNPVATEQYGSVVTSTNGNLTQGNI

SEQ ID NO: 45984 - protein, 31 aa, Artificial Sequence
  Description of Artificial Sequence: Synthetic polypeptide
DEEEIRTTNPVAYEPWGSVPTNLSQRTGNNT

SEQ ID NO: 45985 - protein, 31 aa, Artificial Sequence
  Description of Artificial Sequence: Synthetic polypeptide
DEEEIRTTNPVAYEHYGCVFCTNLSQRGNNT

SEQ ID NO: 45986 - protein, 31 aa, Artificial Sequence
  Description of Artificial Sequence: Synthetic polypeptide
AEEEIRTTNPVATEQYGCVTSTNHQNFGSNQ

SEQ ID NO: 45987 - protein, 29 aa, Artificial Sequence
  Description of Artificial Sequence: Synthetic peptide
SSEEIRTTNPVATHQWGSVSTWDQRNGNF

SEQ ID NO: 45988 - protein, 28 aa, Artificial Sequence
  Description of Artificial Sequence: Synthetic peptide
AENEIAATNPVATEQYGEASCNLQRGGR

SEQ ID NO: 45989 - protein, 30 aa, Artificial Sequence
  Description of Artificial Sequence: Synthetic polypeptide
SSEEIRTTNPVATHQYGCVSTELQRSGSNQ

SEQ ID NO: 45990 - protein, 32 aa, Artificial Sequence
  Description of Artificial Sequence: Synthetic polypeptide
DEEEIRTTNPVAYEAYGWVSVTNLSTRGGNPR

SEQ ID NO: 45991 - protein, 31 aa, Artificial Sequence
  Description of Artificial Sequence: Synthetic polypeptide
DEEEIRTTNPVAYECYGCVSCENLSQEGGNR

SEQ ID NO: 45992 - protein, 31 aa, Artificial Sequence
  Description of Artificial Sequence: Synthetic polypeptide
DEEEIRTTNPVAYECYGCVSTNELSQEGGNS

SEQ ID NO: 45993 - protein, 32 aa, Artificial Sequence
  Description of Artificial Sequence: Synthetic polypeptide
DEEEIRTTNPVAYECYGICTVSTNLSQEGGNR

SEQ ID NO: 45994 - protein, 30 aa, Artificial Sequence
  Description of Artificial Sequence: Synthetic polypeptide
DETEIRTTNPVAVEQYGSVISTNGLERNEF

SEQ ID NO: 45995 - protein, 30 aa, Artificial Sequence
  Description of Artificial Sequence: Synthetic polypeptide
DEEEIRTTNPVAYECYGKISTNQSQRVGNF

SEQ ID NO: 45996 - protein, 28 aa, Artificial Sequence
  Description of Artificial Sequence: Synthetic peptide
AENEIAATNPVATEQYGEASENLQRGGR

SEQ ID NO: 45997 - protein, 34 aa, Artificial Sequence
  Description of Artificial Sequence: Synthetic polypeptide
DEEEIRTTNPVAYECYGSVCSCTNMLSQRGGNRT

SEQ ID NO: 45998 - protein, 31 aa, Artificial Sequence
  Description of Artificial Sequence: Synthetic polypeptide
DTEEIRCTNPVATEQYGSTVSTNEDQGNGTR

SEQ ID NO: 45999 - protein, 33 aa, Artificial Sequence
  Description of Artificial Sequence: Synthetic polypeptide
DEEEIRTTNPVAYEEYGSTVSTGNLSQRSGARF

SEQ ID NO: 46000 - protein, 30 aa, Artificial Sequence
  Description of Artificial Sequence: Synthetic polypeptide
SSEEIRTTNPVATHQYGCVSTELQRFGNQS

SEQ ID NO: 46001 - protein, 32 aa, Artificial Sequence
  Description of Artificial Sequence: Synthetic polypeptide
AEEEIRTTNPVATEQYGCVNTGNLDQRGSNTA

SEQ ID NO: 46002 - protein, 31 aa, Artificial Sequence
  Description of Artificial Sequence: Synthetic polypeptide
DTEEIRCTNPVATEQYGSQVSTNDQNFGSQR

SEQ ID NO: 46003 - protein, 29 aa, Artificial Sequence
  Description of Artificial Sequence: Synthetic peptide
AEEEIRTTNPVATEQYGCVQTGALQNGEQ

SEQ ID NO: 46004 - protein, 31 aa, Artificial Sequence
  Description of Artificial Sequence: Synthetic polypeptide
AEEEIRTTNPVATEQYGCVSNTELQRFGSQQ

SEQ ID NO: 46005 - protein, 32 aa, Artificial Sequence
  Description of Artificial Sequence: Synthetic polypeptide
DEEEIRTTNPVAYECYGSVPSCTFLSQRGGNM

SEQ ID NO: 46006 - protein, 32 aa, Artificial Sequence
  Description of Artificial Sequence: Synthetic polypeptide
DEEEIRTTNPVAYEAYGTVSTLNLSQNGGNRC

SEQ ID NO: 46007 - protein, 29 aa, Artificial Sequence
  Description of Artificial Sequence: Synthetic peptide
SSEEIRTTNPVATDQYGSVSYWEDQRGNF

SEQ ID NO: 46008 - protein, 32 aa, Artificial Sequence
  Description of Artificial Sequence: Synthetic polypeptide
DEEEIRTTNPVAYEPWGSVSTNNLSQRNVGAR

SEQ ID NO: 46009 - protein, 33 aa, Artificial Sequence
  Description of Artificial Sequence: Synthetic polypeptide
AEEEIRTTNPVATEQYGSVVTSNGTNLQGNGND

SEQ ID NO: 46010 - protein, 32 aa, Artificial Sequence
  Description of Artificial Sequence: Synthetic polypeptide
DEEEIRTTNPVAYEPYGSVCFTNLSTRAGNNR

SEQ ID NO: 46011 - protein, 31 aa, Artificial Sequence
  Description of Artificial Sequence: Synthetic polypeptide
DTEEIRATNPVATEQYGSVVVSTNLNQNGTT

SEQ ID NO: 46012 - protein, 30 aa, Artificial Sequence
  Description of Artificial Sequence: Synthetic polypeptide
SSEEIRTTNPVATDQYGSVSPTWLQRGFDD

SEQ ID NO: 46013 - protein, 31 aa, Artificial Sequence
  Description of Artificial Sequence: Synthetic polypeptide
DEEEIRTTNPVAYEPYGSVPCTNLSQRVNNH

SEQ ID NO: 46014 - protein, 31 aa, Artificial Sequence
  Description of Artificial Sequence: Synthetic polypeptide
DEEEIRTTNPVAYEPYGSVPSTNAHSQRVNN

SEQ ID NO: 46015 - protein, 31 aa, Artificial Sequence
  Description of Artificial Sequence: Synthetic polypeptide
DEEEIRTTNPVAYEPYGSVSCTNLSQHVNAN

SEQ ID NO: 46016 - protein, 32 aa, Artificial Sequence
  Description of Artificial Sequence: Synthetic polypeptide
DEEEIRTTNPVAYEPYGSVSCTNLSQQTGSRY

SEQ ID NO: 46017 - protein, 29 aa, Artificial Sequence
  Description of Artificial Sequence: Synthetic peptide
SSEEIRTTNPVATDQYGSVHPTDLQRGEF

SEQ ID NO: 46018 - protein, 32 aa, Artificial Sequence
  Description of Artificial Sequence: Synthetic polypeptide
DEEEIRTTNPVAYEPYGSVVSTDALSQQGNNR

SEQ ID NO: 46019 - protein, 33 aa, Artificial Sequence
  Description of Artificial Sequence: Synthetic polypeptide
DEEEIRTTNPVAYEPYGSVVSTNALSQRGGSRY

SEQ ID NO: 46020 - protein, 31 aa, Artificial Sequence
  Description of Artificial Sequence: Synthetic polypeptide
DTEEIRATNPVATEQYGSVVSTTNLQNGTED

SEQ ID NO: 46021 - protein, 31 aa, Artificial Sequence
  Description of Artificial Sequence: Synthetic polypeptide
DTEEIRATNPVATEQYGSVVSTNLQQNGETD

SEQ ID NO: 46022 - protein, 31 aa, Artificial Sequence
  Description of Artificial Sequence: Synthetic polypeptide
DTEEIRATNPVATEQYGSVVSTNLQNGTTTT

SEQ ID NO: 46023 - protein, 32 aa, Artificial Sequence
  Description of Artificial Sequence: Synthetic polypeptide
DEEEIRTTNPVAYEQWGCSVSRNDLDQRGTGR

SEQ ID NO: 46024 - protein, 30 aa, Artificial Sequence
  Description of Artificial Sequence: Synthetic polypeptide
SSEEIRTTNPVATDQYGSVSTDLQDGGQNF

SEQ ID NO: 46025 - protein, 31 aa, Artificial Sequence
  Description of Artificial Sequence: Synthetic polypeptide
SSEEIRTTNPVATDQYGSVSTDLQRMGNGFD

SEQ ID NO: 46026 - protein, 30 aa, Artificial Sequence
  Description of Artificial Sequence: Synthetic polypeptide
DEEEIRTTNPVAYEPYGSVAQNLSVRGGNE

SEQ ID NO: 46027 - protein, 31 aa, Artificial Sequence
  Description of Artificial Sequence: Synthetic polypeptide
DEEEIRTTNPVAYEPYGSVAQNLSERGGNYR

SEQ ID NO: 46028 - protein, 31 aa, Artificial Sequence
  Description of Artificial Sequence: Synthetic polypeptide
AEEEIRTTNPVATEQYGSVVTSTDGNQIGNT

SEQ ID NO: 46029 - protein, 30 aa, Artificial Sequence
  Description of Artificial Sequence: Synthetic polypeptide
DEEEIRTTNPVAYEPYGCVAQPLSQRGGNR

SEQ ID NO: 46030 - protein, 30 aa, Artificial Sequence
  Description of Artificial Sequence: Synthetic polypeptide
SSEEIRTTNPVATDQYGSVSTTGGQRGNEF

SEQ ID NO: 46031 - protein, 31 aa, Artificial Sequence
  Description of Artificial Sequence: Synthetic polypeptide
DEEEIRTTNPVAYEPYGCVSVTNLSGRGGDR

SEQ ID NO: 46032 - protein, 30 aa, Artificial Sequence
  Description of Artificial Sequence: Synthetic polypeptide
DEEEIRTTNPVAYEPYGEVATNLSQNGGGR

SEQ ID NO: 46033 - protein, 32 aa, Artificial Sequence
  Description of Artificial Sequence: Synthetic polypeptide
DEEEIRTTNPVAYEPYGEVSTNALSQRGGSRH

SEQ ID NO: 46034 - protein, 30 aa, Artificial Sequence
  Description of Artificial Sequence: Synthetic polypeptide
DEEEIRTTNPVAYEPYGEVSTTLSQNGGSR

SEQ ID NO: 46035 - protein, 31 aa, Artificial Sequence
  Description of Artificial Sequence: Synthetic polypeptide
SSEEIRTTNPVATDQYGSVSVTYELQRGNFG

SEQ ID NO: 46036 - protein, 29 aa, Artificial Sequence
  Description of Artificial Sequence: Synthetic peptide
AENEIAATNPVATEQYGTVASENLQRGGR

SEQ ID NO: 46037 - protein, 33 aa, Artificial Sequence
  Description of Artificial Sequence: Synthetic polypeptide
DEEEIRTTNPVAYEPYGISVSTLNLSQERVTNR

SEQ ID NO: 46038 - protein, 31 aa, Artificial Sequence
  Description of Artificial Sequence: Synthetic polypeptide
AEEEIRTTNPVATEQYGSVVTSNNQLGIGNT

SEQ ID NO: 46039 - protein, 31 aa, Artificial Sequence
  Description of Artificial Sequence: Synthetic polypeptide
AEEEIRTTNPVATEQYGSVVTSNNNLGIGNN

SEQ ID NO: 46040 - protein, 32 aa, Artificial Sequence
  Description of Artificial Sequence: Synthetic polypeptide
DEEEIRTTNPVAYEPYGQSVPCTNLSQRGNNK

SEQ ID NO: 46041 - protein, 31 aa, Artificial Sequence
  Description of Artificial Sequence: Synthetic polypeptide
AEEEIRTTNPVATEQYGSVVTSNNLGIGTND

SEQ ID NO: 46042 - protein, 31 aa, Artificial Sequence
  Description of Artificial Sequence: Synthetic polypeptide
SSEEIRTTNPVATDQYGSVSTGELSQRGGNF

SEQ ID NO: 46043 - protein, 30 aa, Artificial Sequence
  Description of Artificial Sequence: Synthetic polypeptide
SSEEIRTTNPVATDQYGSVSTEGGQERGNF

SEQ ID NO: 46044 - protein, 33 aa, Artificial Sequence
  Description of Artificial Sequence: Synthetic polypeptide
DEEEIRTTNPVAYEPYGISVSTGNMLQDRVTNR

SEQ ID NO: 46045 - protein, 32 aa, Artificial Sequence
  Description of Artificial Sequence: Synthetic polypeptide
DEEEIRTTNPVAYEAYGSVVWQNWLSQRGGNR

SEQ ID NO: 46046 - protein, 32 aa, Artificial Sequence
  Description of Artificial Sequence: Synthetic polypeptide
DEEEIRTTNPVAYEAYGSVVSTNALSERGGNA

SEQ ID NO: 46047 - protein, 33 aa, Artificial Sequence
  Description of Artificial Sequence: Synthetic polypeptide
DEEEIRTTNPVAYEAYGSVVSDTNMLSQRGGNA

SEQ ID NO: 46048 - protein, 30 aa, Artificial Sequence
  Description of Artificial Sequence: Synthetic polypeptide
DTEEIRTTNPCATEAYGSVSTVNLQGENQA

SEQ ID NO: 46049 - protein, 33 aa, Artificial Sequence
  Description of Artificial Sequence: Synthetic polypeptide
AEEEIRTTNPVATEQYGSVVTSTNLQQGTVGNE

SEQ ID NO: 46050 - protein, 30 aa, Artificial Sequence
  Description of Artificial Sequence: Synthetic polypeptide
QEEEIATTNPVAYEQYGSVATNLETGNDRA

SEQ ID NO: 46051 - protein, 28 aa, Artificial Sequence
  Description of Artificial Sequence: Synthetic peptide
DTEEIRTTNPAATEMYGSVSVSAQAENR

SEQ ID NO: 46052 - protein, 32 aa, Artificial Sequence
  Description of Artificial Sequence: Synthetic polypeptide
DEEEIRTTNPVAYEAYGQSVSCTNLSQRGSSA

SEQ ID NO: 46053 - protein, 32 aa, Artificial Sequence
  Description of Artificial Sequence: Synthetic polypeptide
DEEEIRTTNPVAYEAYGQSVSQNMLSQRGGQR

SEQ ID NO: 46054 - protein, 31 aa, Artificial Sequence
  Description of Artificial Sequence: Synthetic polypeptide
DEEEIRTTNPVAYEAYGQVACTNGLQRGGNA

SEQ ID NO: 46055 - protein, 30 aa, Artificial Sequence
  Description of Artificial Sequence: Synthetic polypeptide
SSEEIRTTNPVAYEQWGTVSTNLQEGGNDR

SEQ ID NO: 46056 - protein, 31 aa, Artificial Sequence
  Description of Artificial Sequence: Synthetic polypeptide
DEEEIRTTNPVAYEAYGQVSCTNLSQRGSSF

SEQ ID NO: 46057 - protein, 31 aa, Artificial Sequence
  Description of Artificial Sequence: Synthetic polypeptide
DTEEIRSTNPVAYEQYGTSTVSTNLQNGDTR

SEQ ID NO: 46058 - protein, 29 aa, Artificial Sequence
  Description of Artificial Sequence: Synthetic peptide
SSEEIRTTNPVATTQYGCVSTWHDQRGNF

SEQ ID NO: 46059 - protein, 32 aa, Artificial Sequence
  Description of Artificial Sequence: Synthetic polypeptide
DEEEIRTTNPVAYEAYGSTSCTENLSQRTVNR

SEQ ID NO: 46060 - protein, 32 aa, Artificial Sequence
  Description of Artificial Sequence: Synthetic polypeptide
DEEEIRTTNPVAYEAYGSTVSCTNGEQRGGNA

SEQ ID NO: 46061 - protein, 31 aa, Artificial Sequence
  Description of Artificial Sequence: Synthetic polypeptide
DTEEIRSTNPVAYEQWGSPVSTNLQHNGNTR

SEQ ID NO: 46062 - protein, 29 aa, Artificial Sequence
  Description of Artificial Sequence: Synthetic peptide
SSEEIRTTNPVATLQYGSVSTTLQTVNFV

SEQ ID NO: 46063 - protein, 31 aa, Artificial Sequence
  Description of Artificial Sequence: Synthetic polypeptide
DEEEIRTTNPVAYEAYGKVSTGNLSQSGNDE

SEQ ID NO: 46064 - protein, 32 aa, Artificial Sequence
  Description of Artificial Sequence: Synthetic polypeptide
DEEEIRTTNPVAYEAYGKVSLTNMLSQRGGNA

SEQ ID NO: 46065 - protein, 29 aa, Artificial Sequence
  Description of Artificial Sequence: Synthetic peptide
STEEIATTNPVATAQWGTVSTNDLQNGNR

SEQ ID NO: 46066 - protein, 29 aa, Artificial Sequence
  Description of Artificial Sequence: Synthetic peptide
TAEEEIACTNPVATEPYGSVATNLQQGNM

SEQ ID NO: 46067 - protein, 29 aa, Artificial Sequence
  Description of Artificial Sequence: Synthetic peptide
DEEEIRTTNPVAWEQWGSVWTNWQVDDSR

SEQ ID NO: 46068 - protein, 32 aa, Artificial Sequence
  Description of Artificial Sequence: Synthetic polypeptide
TAEEIRSTNPVATEQYGMSVSTNLQAGNGQAR

SEQ ID NO: 46069 - protein, 29 aa, Artificial Sequence
  Description of Artificial Sequence: Synthetic peptide
TAEEIATTNPVATEPYGSVSANLQQGNDQ

SEQ ID NO: 46070 - protein, 30 aa, Artificial Sequence
  Description of Artificial Sequence: Synthetic polypeptide
DEEEIRTTNPVAWEQYGSVAWTNDQHMDSR

SEQ ID NO: 46071 - protein, 30 aa, Artificial Sequence
  Description of Artificial Sequence: Synthetic polypeptide
DEEEIRTTNPVAWEQYGSVWTDLQDHDMSR

SEQ ID NO: 46072 - protein, 29 aa, Artificial Sequence
  Description of Artificial Sequence: Synthetic peptide
DTEEIRTTNPCATEAYGSVSVNLQQNENQ

SEQ ID NO: 46073 - protein, 30 aa, Artificial Sequence
  Description of Artificial Sequence: Synthetic polypeptide
DEEEIRTTNPVAWEQYGSVWTNDQDFDKSR

SEQ ID NO: 46074 - protein, 33 aa, Artificial Sequence
  Description of Artificial Sequence: Synthetic polypeptide
DEEEIRTTNPVAYEAYGSTVSTNLSQERSGARF

SEQ ID NO: 46075 - protein, 29 aa, Artificial Sequence
  Description of Artificial Sequence: Synthetic peptide
DTEEIRTTNPCATEAYGSVSVNLQLETNS

SEQ ID NO: 46076 - protein, 33 aa, Artificial Sequence
  Description of Artificial Sequence: Synthetic polypeptide
DEEEIRTTNPVAYDQYGSTVSCTTNLSQLGGNR

SEQ ID NO: 46077 - protein, 32 aa, Artificial Sequence
  Description of Artificial Sequence: Synthetic polypeptide
DEEEIRTTNPVAYDQYGSVSCTTNLSGGGGNR

SEQ ID NO: 46078 - protein, 33 aa, Artificial Sequence
  Description of Artificial Sequence: Synthetic polypeptide
AEEEIRTTNPVATEQYGSVVTSTNNNLQTGNAA

SEQ ID NO: 46079 - protein, 31 aa, Artificial Sequence
  Description of Artificial Sequence: Synthetic polypeptide
DTEEIRTTNPCATEAYGSVSTVNNLQRENQG

SEQ ID NO: 46080 - protein, 33 aa, Artificial Sequence
  Description of Artificial Sequence: Synthetic polypeptide
DEEEIRTTNPVAYEAYGCSVVSTLNALSQRGNQ

SEQ ID NO: 46081 - protein, 32 aa, Artificial Sequence
  Description of Artificial Sequence: Synthetic polypeptide
DEEEIRTTNPVAYEAYGCSVVSTNALSTRGNG

SEQ ID NO: 46082 - protein, 30 aa, Artificial Sequence
  Description of Artificial Sequence: Synthetic polypeptide
DTEEIRTTNPCATEAYGSVSTVNLQLQENQ

SEQ ID NO: 46083 - protein, 29 aa, Artificial Sequence
  Description of Artificial Sequence: Synthetic peptide
DTEEIRTTNPCATEAYGSVSVNLQGSENS

SEQ ID NO: 46084 - protein, 32 aa, Artificial Sequence
  Description of Artificial Sequence: Synthetic polypeptide
DEEEIRTTNPVAYEAYGSVAPCTNLSQRGNNT

SEQ ID NO: 46085 - protein, 30 aa, Artificial Sequence
  Description of Artificial Sequence: Synthetic polypeptide
DEEEIRTTNPVAYEAYGSVATNLSQPVSRY

SEQ ID NO: 46086 - protein, 28 aa, Artificial Sequence
  Description of Artificial Sequence: Synthetic peptide
SSEEIRTTNPVATHQYGSVSTWQENGNF

SEQ ID NO: 46087 - protein, 33 aa, Artificial Sequence
  Description of Artificial Sequence: Synthetic polypeptide
DEEEIRTTNPVAYEAYGSVSTGNLSQNTGGNRC

SEQ ID NO: 46088 - protein, 31 aa, Artificial Sequence
  Description of Artificial Sequence: Synthetic polypeptide
SSEEIRTTNPVATHQYGSVSTPLSQRGGNNQ

SEQ ID NO: 46089 - protein, 31 aa, Artificial Sequence
  Description of Artificial Sequence: Synthetic polypeptide
AEEEIRTTNPVATEQYGCVCSTYLQNGSNQP

SEQ ID NO: 46090 - protein, 31 aa, Artificial Sequence
  Description of Artificial Sequence: Synthetic polypeptide
SSEEIRTTNPVATHQYGSVSTGELQRGGNNQ

SEQ ID NO: 46091 - protein, 33 aa, Artificial Sequence
  Description of Artificial Sequence: Synthetic polypeptide
AEEEIRTTNPVATEQYGSVVTSTNLQNGENNEQ

SEQ ID NO: 46092 - protein, 29 aa, Artificial Sequence
  Description of Artificial Sequence: Synthetic peptide
QEEEIATTNPVAYEQYGSVATNLQDGPDH

SEQ ID NO: 46093 - protein, 31 aa, Artificial Sequence
  Description of Artificial Sequence: Synthetic polypeptide
DEEEIRTTNPVAYEAYGSVSTNLSQRTVSQY

SEQ ID NO: 46094 - protein, 32 aa, Artificial Sequence
  Description of Artificial Sequence: Synthetic polypeptide
AEEEIRTTNPVATEQYGCVCSTNLQRFNSNVD

SEQ ID NO: 46095 - protein, 33 aa, Artificial Sequence
  Description of Artificial Sequence: Synthetic polypeptide
DTEEIRSTNPVATEQYGSVVSCTNLSQNGGTNR

SEQ ID NO: 46096 - protein, 32 aa, Artificial Sequence
  Description of Artificial Sequence: Synthetic polypeptide
DEEEIRTTNPVAYEAYGSVSTVNALQRVGEYM

SEQ ID NO: 46097 - protein, 30 aa, Artificial Sequence
  Description of Artificial Sequence: Synthetic polypeptide
SSEEIRTTNPVATHQYGSVCSTWLERGVNF

SEQ ID NO: 46098 - protein, 31 aa, Artificial Sequence
  Description of Artificial Sequence: Synthetic polypeptide
DTEEIRSTNPVATEQWGSVVSTNLSQNGGSR

SEQ ID NO: 46099 - protein, 31 aa, Artificial Sequence
  Description of Artificial Sequence: Synthetic polypeptide
DEEEIRTTNPVAYEAYGSVSVTNLSQRVSEY

SEQ ID NO: 46100 - protein, 33 aa, Artificial Sequence
  Description of Artificial Sequence: Synthetic polypeptide
DEEEIRTTNPVAYEAYGSVSYTLNLSQNGTNRC

SEQ ID NO: 46101 - protein, 33 aa, Artificial Sequence
  Description of Artificial Sequence: Synthetic polypeptide
DEEEIRTTNPVAYEAYGSVVSCTNMLSQPGNRL

SEQ ID NO: 46102 - protein, 30 aa, Artificial Sequence
  Description of Artificial Sequence: Synthetic polypeptide
DTEEIRSTNPVATECYGSCSTNMQRGGDNN

SEQ ID NO: 46103 - protein, 30 aa, Artificial Sequence
  Description of Artificial Sequence: Synthetic polypeptide
SSEEIRTTNPVATHQYGSVSPTWLEQRGDF

SEQ ID NO: 46104 - protein, 28 aa, Artificial Sequence
  Description of Artificial Sequence: Synthetic peptide
AENEIACTNPCATEQYGEVSCNLQRGGR

SEQ ID NO: 46105 - protein, 32 aa, Artificial Sequence
  Description of Artificial Sequence: Synthetic polypeptide
DEEEIRTTNPVAYEAYGSVSTGNLSANGNNRY

SEQ ID NO: 46106 - protein, 31 aa, Artificial Sequence
  Description of Artificial Sequence: Synthetic polypeptide
AEEEIRTTNPVATEQYGCVCSTNLQNGSQAP

SEQ ID NO: 46107 - protein, 30 aa, Artificial Sequence
  Description of Artificial Sequence: Synthetic polypeptide
SSEEIRTTNPVATHQYGSVSTWQDDQRGNF

SEQ ID NO: 46108 - protein, 33 aa, Artificial Sequence
  Description of Artificial Sequence: Synthetic polypeptide
DEEEIRTTNPVAYEAYGSVPSTLSALQRGGENR

SEQ ID NO: 46109 - protein, 31 aa, Artificial Sequence
  Description of Artificial Sequence: Synthetic polypeptide
SSEEIRTTNPVATHQYGSVSTWDLQDRGNFE

SEQ ID NO: 46110 - protein, 30 aa, Artificial Sequence
  Description of Artificial Sequence: Synthetic polypeptide
QEEEIATTNPVAYEQYGSVATNLQAAGNDN

SEQ ID NO: 46111 - protein, 31 aa, Artificial Sequence
  Description of Artificial Sequence: Synthetic polypeptide
AEEEIRTTNPVATEQYGCVCSTNLLQNGSED

SEQ ID NO: 46112 - protein, 31 aa, Artificial Sequence
  Description of Artificial Sequence: Synthetic polypeptide
SSEEIRTTNPVATHQYGSVSTPLSQRTGNNE

SEQ ID NO: 46113 - protein, 31 aa, Artificial Sequence
  Description of Artificial Sequence: Synthetic polypeptide
DEEEIRTTNPVAYEAYGSVQINMLSQRGGNA

SEQ ID NO: 46114 - protein, 31 aa, Artificial Sequence
  Description of Artificial Sequence: Synthetic polypeptide
DEEEIRTTNPVAYEAYGSVSTDMHSQRGGNA

SEQ ID NO: 46115 - protein, 32 aa, Artificial Sequence
  Description of Artificial Sequence: Synthetic polypeptide
DEEEIRTTNPVAYEAYGSVSCTLNGSQSGNRC

SEQ ID NO: 46116 - protein, 32 aa, Artificial Sequence
  Description of Artificial Sequence: Synthetic polypeptide
AEEEIRTTNPVATEQYGCVCSTNLQAFGSDRL

SEQ ID NO: 46117 - protein, 32 aa, Artificial Sequence
  Description of Artificial Sequence: Synthetic polypeptide
DEEEIRTTNPVAYEAYGSVSCTNGLQGGGNYA

SEQ ID NO: 46118 - protein, 31 aa, Artificial Sequence
  Description of Artificial Sequence: Synthetic polypeptide
DEEEIRTTNPVAYEAYGSVSCTNGSQRGSSG

SEQ ID NO: 46119 - protein, 32 aa, Artificial Sequence
  Description of Artificial Sequence: Synthetic polypeptide
DEEEIRTTNPVAYEAYGSVSCTNLSQRGSTSY

SEQ ID NO: 46120 - protein, 32 aa, Artificial Sequence
  Description of Artificial Sequence: Synthetic polypeptide
DEEEIRTTNPVAYEAYGSVSCTNLSQRPGSKY

SEQ ID NO: 46121 - protein, 32 aa, Artificial Sequence
  Description of Artificial Sequence: Synthetic polypeptide
AEEEIRTTNPVATEQYGCVCSTNLQHFGSNVA

SEQ ID NO: 46122 - protein, 32 aa, Artificial Sequence
  Description of Artificial Sequence: Synthetic polypeptide
DEEEIRTTNPVAYEAYGSVSCTNMLSQRGSSQ

SEQ ID NO: 46123 - protein, 33 aa, Artificial Sequence
  Description of Artificial Sequence: Synthetic polypeptide
DEEEIRTTNPVAYEAYGSVSCTLNLSQNTGNRC

SEQ ID NO: 46124 - protein, 30 aa, Artificial Sequence
  Description of Artificial Sequence: Synthetic polypeptide
SSEEIRTTNPVATCQYGCVSTELQERGSNF

SEQ ID NO: 46125 - protein, 30 aa, Artificial Sequence
  Description of Artificial Sequence: Synthetic polypeptide
DEEEIRTTNPVAYEQWGEVWTELQVGDSNR

SEQ ID NO: 46126 - protein, 28 aa, Artificial Sequence
  Description of Artificial Sequence: Synthetic peptide
SSEEIRTTNPVATCQYGCVSTEDQNGNF

SEQ ID NO: 46127 - protein, 34 aa, Artificial Sequence
  Description of Artificial Sequence: Synthetic polypeptide
DEEEIRTTNPVAYEQYGESVSETNDLLQRGIEMR

SEQ ID NO: 46128 - protein, 32 aa, Artificial Sequence
  Description of Artificial Sequence: Synthetic polypeptide
AEEEIRTTNPVATEQYGSVVTNTNELQGGNVN

SEQ ID NO: 46129 - protein, 33 aa, Artificial Sequence
  Description of Artificial Sequence: Synthetic polypeptide
DEEEIRTTNPVAYEQYGEVSYTNLSQRTGGNPS

SEQ ID NO: 46130 - protein, 33 aa, Artificial Sequence
  Description of Artificial Sequence: Synthetic polypeptide
DEEEIRTTNPVAYEQYGFSVSQNDLLQRGPPRE

SEQ ID NO: 46131 - protein, 32 aa, Artificial Sequence
  Description of Artificial Sequence: Synthetic polypeptide
AEEEIRTTNPVATEQYGSVNTSNLVQNGENGE

SEQ ID NO: 46132 - protein, 32 aa, Artificial Sequence
  Description of Artificial Sequence: Synthetic polypeptide
AEEEIRTTNPVATEQYGSVNTSNLVQQGENEQ

SEQ ID NO: 46133 - protein, 29 aa, Artificial Sequence
  Description of Artificial Sequence: Synthetic peptide
SQEEIATTNPVATEQWGTVSTNLQHEGNS

SEQ ID NO: 46134 - protein, 30 aa, Artificial Sequence
  Description of Artificial Sequence: Synthetic polypeptide
SQEEIATTNPVATEQWGTVSTNLQEGGNAR

SEQ ID NO: 46135 - protein, 33 aa, Artificial Sequence
  Description of Artificial Sequence: Synthetic polypeptide
DEEEIRTTNPVAYEQYGHVSITNALSNRGGNNR

SEQ ID NO: 46136 - protein, 33 aa, Artificial Sequence
  Description of Artificial Sequence: Synthetic polypeptide
DEEEIRTTNPVAYEQYGHVVSCCTNLSNRGGNR

SEQ ID NO: 46137 - protein, 33 aa, Artificial Sequence
  Description of Artificial Sequence: Synthetic polypeptide
DEEEIRTTNPVAYEQYGISTVSTNLSQRSGAEF

SEQ ID NO: 46138 - protein, 29 aa, Artificial Sequence
  Description of Artificial Sequence: Synthetic peptide
SQAEIRTTNPVATEQWGCVSTNQQEGNNR

SEQ ID NO: 46139 - protein, 31 aa, Artificial Sequence
  Description of Artificial Sequence: Synthetic polypeptide
SNEEIRTTNPVATEQYGVVSTNQQDGGPNRQ

SEQ ID NO: 46140 - protein, 30 aa, Artificial Sequence
  Description of Artificial Sequence: Synthetic polypeptide
AEEEIRTTNPVATEQYGSVSAGNPDEAGNN

SEQ ID NO: 46141 - protein, 32 aa, Artificial Sequence
  Description of Artificial Sequence: Synthetic polypeptide
AEEEIRTTNPVATEQYGSVSATNQQQGENNNT

SEQ ID NO: 46142 - protein, 33 aa, Artificial Sequence
  Description of Artificial Sequence: Synthetic polypeptide
DEEEIRTTNPVAYEQYGDVPSYTNLSQRTGGNP

SEQ ID NO: 46143 - protein, 31 aa, Artificial Sequence
  Description of Artificial Sequence: Synthetic polypeptide
DEEEIRTTNPVAYEQYGCVSTNHQNGGSNQM

SEQ ID NO: 46144 - protein, 32 aa, Artificial Sequence
  Description of Artificial Sequence: Synthetic polypeptide
DEEEIRTTNPVAYEQYGCVSTGNLQRFGSEQA

SEQ ID NO: 46145 - protein, 32 aa, Artificial Sequence
  Description of Artificial Sequence: Synthetic polypeptide
AEEEIRTTNPVATEQYGSVNTSNLVQAGENND

SEQ ID NO: 46146 - protein, 30 aa, Artificial Sequence
  Description of Artificial Sequence: Synthetic polypeptide
SQEEIRCTNPIATEQYGSVSCENELMRGNR

SEQ ID NO: 46147 - protein, 30 aa, Artificial Sequence
  Description of Artificial Sequence: Synthetic polypeptide
DEEEIRTTNPVAYEQYGCVCSTEPQRGSEA

SEQ ID NO: 46148 - protein, 32 aa, Artificial Sequence
  Description of Artificial Sequence: Synthetic polypeptide
AEEEIRTTNPVATEQYGSVNSTNLQQNTNNQI

SEQ ID NO: 46149 - protein, 32 aa, Artificial Sequence
  Description of Artificial Sequence: Synthetic polypeptide
DEEEIRTTNPVAYEQYGCVCSTNDQRFGSNTQ

SEQ ID NO: 46150 - protein, 32 aa, Artificial Sequence
  Description of Artificial Sequence: Synthetic polypeptide
AEEEIRTTNPVATEQYGSVNTGNLDQNGSNYQ

SEQ ID NO: 46151 - protein, 31 aa, Artificial Sequence
  Description of Artificial Sequence: Synthetic polypeptide
DEEEIRTTNPVAYEQYGCVCSTNLQNFISNQ

SEQ ID NO: 46152 - protein, 33 aa, Artificial Sequence
  Description of Artificial Sequence: Synthetic polypeptide
DEEEIRTTNPVAYEQYGCVCSTNLQRFGSDTRS

SEQ ID NO: 46153 - protein, 32 aa, Artificial Sequence
  Description of Artificial Sequence: Synthetic polypeptide
AEEEIRTTNPVATEQYGSVSCTTNLLQYEGLG

SEQ ID NO: 46154 - protein, 28 aa, Artificial Sequence
  Description of Artificial Sequence: Synthetic peptide
AENEIACTNPIATEQYGEVSENLQRGGR

SEQ ID NO: 46155 - protein, 32 aa, Artificial Sequence
  Description of Artificial Sequence: Synthetic polypeptide
DTEEIRATNPVATEQYGSVSTNLTNMEQQGNN

SEQ ID NO: 46156 - protein, 31 aa, Artificial Sequence
  Description of Artificial Sequence: Synthetic polypeptide
DTEEIRATNPVATEQYGSVSTNLQQMNGQGT

SEQ ID NO: 46157 - protein, 32 aa, Artificial Sequence
  Description of Artificial Sequence: Synthetic polypeptide
AEEEIRTTNPVATEQYGSVNTSNLDQAGNNVT

SEQ ID NO: 46158 - protein, 33 aa, Artificial Sequence
  Description of Artificial Sequence: Synthetic polypeptide
DEAAIRTTNPVATEQYGCVSTNLLDQRPGDNRS

SEQ ID NO: 46159 - protein, 30 aa, Artificial Sequence
  Description of Artificial Sequence: Synthetic polypeptide
DEAAIRTTNPVATEQYGCFTSTNLINGSNR

SEQ ID NO: 46160 - protein, 32 aa, Artificial Sequence
  Description of Artificial Sequence: Synthetic polypeptide
DTEEIRATNPVATEQYGSVSTNLQAGNGEQIF

SEQ ID NO: 46161 - protein, 30 aa, Artificial Sequence
  Description of Artificial Sequence: Synthetic polypeptide
DEEEIRTTNPVAYEQYGCVSTEPQSFGSER

SEQ ID NO: 46162 - protein, 31 aa, Artificial Sequence
  Description of Artificial Sequence: Synthetic polypeptide
DEEEIRTTNPVAYEQYGCVCSTNNQHFGSNQ

SEQ ID NO: 46163 - protein, 32 aa, Artificial Sequence
  Description of Artificial Sequence: Synthetic polypeptide
DEEEIRTTNPVAYEQYGISVSVNDLEQRSIER

SEQ ID NO: 46164 - protein, 32 aa, Artificial Sequence
  Description of Artificial Sequence: Synthetic polypeptide
DEEEIRTTNPVAYEQYGKCSLGNMLSQRDGNR

SEQ ID NO: 46165 - protein, 33 aa, Artificial Sequence
  Description of Artificial Sequence: Synthetic polypeptide
AEEEIRTTNPVATEQYGSVSETSNLQRNENEYS

SEQ ID NO: 46166 - protein, 33 aa, Artificial Sequence
  Description of Artificial Sequence: Synthetic polypeptide
DEEEIRTTNPVAYEQYGQSTSQTNDLLQRGILR

SEQ ID NO: 46167 - protein, 29 aa, Artificial Sequence
  Description of Artificial Sequence: Synthetic peptide
SEYEIRSTNPVATEQYGSVETNPQHGSNQ

SEQ ID NO: 46168 - protein, 34 aa, Artificial Sequence
  Description of Artificial Sequence: Synthetic polypeptide
DEEEIRTTNPVAYEQYGQSTVSYTNELSQRGDPR

SEQ ID NO: 46169 - protein, 31 aa, Artificial Sequence
  Description of Artificial Sequence: Synthetic polypeptide
DTEEIRATNPVATEQYGSTVSTNIQGNDGTR

SEQ ID NO: 46170 - protein, 32 aa, Artificial Sequence
  Description of Artificial Sequence: Synthetic polypeptide
DEEEIRTTNPVAYEQYGQSVATNDLLQAGEGR

SEQ ID NO: 46171 - protein, 33 aa, Artificial Sequence
  Description of Artificial Sequence: Synthetic polypeptide
DEEEIRTTNPVAYEQYGQSVATNNSLSQRVGDR

SEQ ID NO: 46172 - protein, 31 aa, Artificial Sequence
  Description of Artificial Sequence: Synthetic polypeptide
AEEEIRTTNPVATEQYGSVSNNNQGIIQGNN

SEQ ID NO: 46173 - protein, 32 aa, Artificial Sequence
  Description of Artificial Sequence: Synthetic polypeptide
DEEEIRTTNPVAYEQYGQSDSTNDLLQRLVPR

SEQ ID NO: 46174 - protein, 29 aa, Artificial Sequence
  Description of Artificial Sequence: Synthetic peptide
SEYEIRSTNPVATEQYGSVETNLQHFGEQ

SEQ ID NO: 46175 - protein, 30 aa, Artificial Sequence
  Description of Artificial Sequence: Synthetic polypeptide
SEYEIRQTNPVATEQYGSVCETNLQHFGNQ

SEQ ID NO: 46176 - protein, 33 aa, Artificial Sequence
  Description of Artificial Sequence: Synthetic polypeptide
DEEEIRTTNPVAYEQYGQSVCTNDLDQQRGILR

SEQ ID NO: 46177 - protein, 30 aa, Artificial Sequence
  Description of Artificial Sequence: Synthetic polypeptide
DTEEICTTNPVATTQYGSVSTNPTEQGGNN

SEQ ID NO: 46178 - protein, 32 aa, Artificial Sequence
  Description of Artificial Sequence: Synthetic polypeptide
DEEEIRTTNPVAYEQYGQSVEQNDLIQRGIER

SEQ ID NO: 46179 - protein, 28 aa, Artificial Sequence
  Description of Artificial Sequence: Synthetic peptide
QEEEIATTNPVCTECYGVVSDNLQSGNQ

SEQ ID NO: 46180 - protein, 32 aa, Artificial Sequence
  Description of Artificial Sequence: Synthetic polypeptide
DEEEIRTTNPVAYEQYGQSVIQNDLLQRGIFR

SEQ ID NO: 46181 - protein, 33 aa, Artificial Sequence
  Description of Artificial Sequence: Synthetic polypeptide
DEEEIRTTNPVAYEQYGQSVNETNDLLQRGQIR

SEQ ID NO: 46182 - protein, 33 aa, Artificial Sequence
  Description of Artificial Sequence: Synthetic polypeptide
DEEEIRTTNPVAYEQYGQSVCSTNDLEQRGGEQ

SEQ ID NO: 46183 - protein, 30 aa, Artificial Sequence
  Description of Artificial Sequence: Synthetic polypeptide
DEEEIRTTNPVAYEQYGCVCSTELQFNSQR

SEQ ID NO: 46184 - protein, 32 aa, Artificial Sequence
  Description of Artificial Sequence: Synthetic polypeptide
DTEEIRATNPVATEQYGSTVSTNLDQGNGDTR

SEQ ID NO: 46185 - protein, 31 aa, Artificial Sequence
  Description of Artificial Sequence: Synthetic polypeptide
AEEEIRTTNPVATEQYGSVSNNNLNSGGGND

SEQ ID NO: 46186 - protein, 30 aa, Artificial Sequence
  Description of Artificial Sequence: Synthetic polypeptide
AEEEIRTTNPVATEQYGSVSNENGNDGNQT

SEQ ID NO: 46187 - protein, 33 aa, Artificial Sequence
  Description of Artificial Sequence: Synthetic polypeptide
DEEEIRTTNPVAYEQYGKVPSYTGNLSQRGNQA

SEQ ID NO: 46188 - protein, 31 aa, Artificial Sequence
  Description of Artificial Sequence: Synthetic polypeptide
AEEEIRTTNPVATEQYGSVSNNENQETGNTN

SEQ ID NO: 46189 - protein, 32 aa, Artificial Sequence
  Description of Artificial Sequence: Synthetic polypeptide
DEEEIRTTNPVAYEQYGKVSQTNHSQETGNNR

SEQ ID NO: 46190 - protein, 31 aa, Artificial Sequence
  Description of Artificial Sequence: Synthetic polypeptide
DEEEIRTTNPVAYEQYGKVSTNMLSPSNGSR

SEQ ID NO: 46191 - protein, 32 aa, Artificial Sequence
  Description of Artificial Sequence: Synthetic polypeptide
DEEEIRTTNPVAYEQYGKVVSTGNLSQQGTPR

SEQ ID NO: 46192 - protein, 31 aa, Artificial Sequence
  Description of Artificial Sequence: Synthetic polypeptide
AEEEIRTTNPVATEQYGSVSNNLQLGQEEEQ

SEQ ID NO: 46193 - protein, 31 aa, Artificial Sequence
  Description of Artificial Sequence: Synthetic polypeptide
DTEEIRATNPVATEQYGSVSNTNDQAGTNNM

SEQ ID NO: 46194 - protein, 32 aa, Artificial Sequence
  Description of Artificial Sequence: Synthetic polypeptide
AEEEIRTTNPVATEQYGSVSNNLQNNGEGGND

SEQ ID NO: 46195 - protein, 33 aa, Artificial Sequence
  Description of Artificial Sequence: Synthetic polypeptide
DEEEIRTTNPVAYEQYGNVVSQTNDLLQRGIFR

SEQ ID NO: 46196 - protein, 31 aa, Artificial Sequence
  Description of Artificial Sequence: Synthetic polypeptide
DTEEIRATNPVATEQYGSVSSVTNMQTGNNN

SEQ ID NO: 46197 - protein, 31 aa, Artificial Sequence
  Description of Artificial Sequence: Synthetic polypeptide
AEEEIRTTNPVATEQYGSVSNNNENQETGNS

SEQ ID NO: 46198 - protein, 28 aa, Artificial Sequence
  Description of Artificial Sequence: Synthetic peptide
AENEIACTNPTATEQYGEASENLQRGNR

SEQ ID NO: 46199 - protein, 31 aa, Artificial Sequence
  Description of Artificial Sequence: Synthetic polypeptide
DTEEIRATNPVATEQYGSVSNTNMQQGTNND

SEQ ID NO: 46200 - protein, 33 aa, Artificial Sequence
  Description of Artificial Sequence: Synthetic polypeptide
DEEEIRTTNPVAYEQYGQSASMTNVLLQRGVER

SEQ ID NO: 46201 - protein, 31 aa, Artificial Sequence
  Description of Artificial Sequence: Synthetic polypeptide
AEEEIRTTNPVATEQYGSVSNNNLDNGGGND

SEQ ID NO: 46202 - protein, 31 aa, Artificial Sequence
  Description of Artificial Sequence: Synthetic polypeptide
AEEEIRTTNPVATEQYGSVSNNLQQQEGEDN

SEQ ID NO: 46203 - protein, 29 aa, Artificial Sequence
  Description of Artificial Sequence: Synthetic peptide
DTEEICTTNPVATTQYGSVSTNPETGGNV

SEQ ID NO: 46204 - protein, 32 aa, Artificial Sequence
  Description of Artificial Sequence: Synthetic polypeptide
AEEEIRTTNPVATEQYGSVCSTNLQGFGSVDY

SEQ ID NO: 46205 - protein, 30 aa, Artificial Sequence
  Description of Artificial Sequence: Synthetic polypeptide
DEEEIRTTNPVAYEQYGCVACTNLSTRSNS

SEQ ID NO: 46206 - protein, 31 aa, Artificial Sequence
  Description of Artificial Sequence: Synthetic polypeptide
DEEEIRTTNPVAYEQWGQSVSTHELLRGGNS

SEQ ID NO: 46207 - protein, 30 aa, Artificial Sequence
  Description of Artificial Sequence: Synthetic polypeptide
SQEEIRTTNPVATHQYGSVSTYLQRENQFD

SEQ ID NO: 46208 - protein, 30 aa, Artificial Sequence
  Description of Artificial Sequence: Synthetic polypeptide
SQEEIRTTNPVATEQWGTVYSTINGQGGNR

SEQ ID NO: 46209 - protein, 31 aa, Artificial Sequence
  Description of Artificial Sequence: Synthetic polypeptide
DEEEIRTTNPVAYEQWGQVSCQNLSQSGGNR

SEQ ID NO: 46210 - protein, 31 aa, Artificial Sequence
  Description of Artificial Sequence: Synthetic polypeptide
DEEEIRTTNPVAYEQWGQVSYTNFSQRGGNT

SEQ ID NO: 46211 - protein, 30 aa, Artificial Sequence
  Description of Artificial Sequence: Synthetic polypeptide
DEEEIRTTNPVAYEQWGSASLPNMDQRDNR

SEQ ID NO: 46212 - protein, 31 aa, Artificial Sequence
  Description of Artificial Sequence: Synthetic polypeptide
SQEEIRTTNPVATEQWGTVWSTNLQEGENDR

SEQ ID NO: 46213 - protein, 29 aa, Artificial Sequence
  Description of Artificial Sequence: Synthetic peptide
SQEEIRTTNPVATEQWGTVWSTNLQEGEF

SEQ ID NO: 46214 - protein, 29 aa, Artificial Sequence
  Description of Artificial Sequence: Synthetic peptide
SQEEIRTTNPVATEQWGTVSWNLEATGNR

SEQ ID NO: 46215 - protein, 32 aa, Artificial Sequence
  Description of Artificial Sequence: Synthetic polypeptide
DEEEIRTTNPVAYEQWGSTSPTDNLDQRDSNR

SEQ ID NO: 46216 - protein, 33 aa, Artificial Sequence
  Description of Artificial Sequence: Synthetic polypeptide
AEEEIRTTNPVATEQYGQSVCSTENLQNGSNQM

SEQ ID NO: 46217 - protein, 32 aa, Artificial Sequence
  Description of Artificial Sequence: Synthetic polypeptide
AEEEIRTTNPVATEQYGQSVSTELQGFGSNQM

SEQ ID NO: 46218 - protein, 33 aa, Artificial Sequence
  Description of Artificial Sequence: Synthetic polypeptide
DEEEIRTTNPVAYEQWGSTSPTENLDQRDGENR

SEQ ID NO: 46219 - protein, 29 aa, Artificial Sequence
  Description of Artificial Sequence: Synthetic peptide
AEEEIRTTNPVATEQYGSTSTALQDTQGG

SEQ ID NO: 46220 - protein, 34 aa, Artificial Sequence
  Description of Artificial Sequence: Synthetic polypeptide
DEEEIRTTNPVAYEQWGSTVPSTNALPQRTGNRP

SEQ ID NO: 46221 - protein, 30 aa, Artificial Sequence
  Description of Artificial Sequence: Synthetic polypeptide
SQEEIRTTNPVAYEQWGTVSTNLQNEGNTR

SEQ ID NO: 46222 - protein, 31 aa, Artificial Sequence
  Description of Artificial Sequence: Synthetic polypeptide
DTEEIRATNPVATEQYGSVSVSTNTQQGNNN

SEQ ID NO: 46223 - protein, 32 aa, Artificial Sequence
  Description of Artificial Sequence: Synthetic polypeptide
DTEEIRATNPVATEQYGSVSVTNLQAGNGQTF

SEQ ID NO: 46224 - protein, 32 aa, Artificial Sequence
  Description of Artificial Sequence: Synthetic polypeptide
DEEEIRTTNPVAYEQWGQSTSTNDLLQRGIGR

SEQ ID NO: 46225 - protein, 28 aa, Artificial Sequence
  Description of Artificial Sequence: Synthetic peptide
AENEIACTNPCATEQYGEVSENLQRGTR

SEQ ID NO: 46226 - protein, 32 aa, Artificial Sequence
  Description of Artificial Sequence: Synthetic polypeptide
DEEEIRTTNPVAYEQWGISVPSQGNLQTGGNR

SEQ ID NO: 46227 - protein, 31 aa, Artificial Sequence
  Description of Artificial Sequence: Synthetic polypeptide
DTEEIRATNPVATEQYGSVSVVTNMQIGNNI

SEQ ID NO: 46228 - protein, 32 aa, Artificial Sequence
  Description of Artificial Sequence: Synthetic polypeptide
DEEEIRTTNPVAYEQWGISVSQGNLSQHGGNR

SEQ ID NO: 46229 - protein, 31 aa, Artificial Sequence
  Description of Artificial Sequence: Synthetic polypeptide
DEEEIRTTNPVAYEQWGKVATGNLSQRGNNS

SEQ ID NO: 46230 - protein, 30 aa, Artificial Sequence
  Description of Artificial Sequence: Synthetic polypeptide
DEEEIRTTNPVAYEQWGKVATNLSQRTGDE

SEQ ID NO: 46231 - protein, 31 aa, Artificial Sequence
  Description of Artificial Sequence: Synthetic polypeptide
DEEEIRTTNPVAYEQWGKVCSTELSQRGGNS

SEQ ID NO: 46232 - protein, 33 aa, Artificial Sequence
  Description of Artificial Sequence: Synthetic polypeptide
DEEEIRTTNPVAYEQWGSTVSCFNALSQRGNNR

SEQ ID NO: 46233 - protein, 30 aa, Artificial Sequence
  Description of Artificial Sequence: Synthetic polypeptide
DEEEIRTTNPVAYEQWGKVPSINLSQRGSS

SEQ ID NO: 46234 - protein, 31 aa, Artificial Sequence
  Description of Artificial Sequence: Synthetic polypeptide
DEEEIRTTNPVAYEQWGKVSCINLSQNRGNS

SEQ ID NO: 46235 - protein, 31 aa, Artificial Sequence
  Description of Artificial Sequence: Synthetic polypeptide
DEEEIRTTNPVAYEQWGKVSCINLSQRGNPT

SEQ ID NO: 46236 - protein, 30 aa, Artificial Sequence
  Description of Artificial Sequence: Synthetic polypeptide
DEEEIRTTNPVAYEQWGKVSCINLSQSGNI

SEQ ID NO: 46237 - protein, 32 aa, Artificial Sequence
  Description of Artificial Sequence: Synthetic polypeptide
DEEEIRTTNPVAYEQWGKVSCTPNLAQRGGNS

SEQ ID NO: 46238 - protein, 31 aa, Artificial Sequence
  Description of Artificial Sequence: Synthetic polypeptide
DEEEIRTTNPVAYEQWGKVSQGNLAQTGGNR

SEQ ID NO: 46239 - protein, 31 aa, Artificial Sequence
  Description of Artificial Sequence: Synthetic polypeptide
DTEEIRATNPVATEQYGSVSVTNNMQQGNNE

SEQ ID NO: 46240 - protein, 31 aa, Artificial Sequence
  Description of Artificial Sequence: Synthetic polypeptide
DEEEIRTTNPVAYEQWGQKTVSTNFSQRGNS

SEQ ID NO: 46241 - protein, 31 aa, Artificial Sequence
  Description of Artificial Sequence: Synthetic polypeptide
DEEEIRTTNPVAYEQWGKVPSTNLSQNTGNS

SEQ ID NO: 46242 - protein, 29 aa, Artificial Sequence
  Description of Artificial Sequence: Synthetic peptide
AEEEIRTTNPVATEQYGSTSTDLQNEQGV

SEQ ID NO: 46243 - protein, 29 aa, Artificial Sequence
  Description of Artificial Sequence: Synthetic peptide
AEEEIRTTNPVATEQYGSTSTQLNQTQGG

SEQ ID NO: 46244 - protein, 30 aa, Artificial Sequence
  Description of Artificial Sequence: Synthetic polypeptide
AEEEIRTTNPVATEQYGSTSTQLQGQQGTE

SEQ ID NO: 46245 - protein, 32 aa, Artificial Sequence
  Description of Artificial Sequence: Synthetic polypeptide
DTEEIRATNPVATEQYGSVSTTNNLQAGNGQM

SEQ ID NO: 46246 - protein, 31 aa, Artificial Sequence
  Description of Artificial Sequence: Synthetic polypeptide
DEEEIRTTNPVAYEQWGTSVCSTQLLRDGNS

SEQ ID NO: 46247 - protein, 31 aa, Artificial Sequence
  Description of Artificial Sequence: Synthetic polypeptide
SQEEIRTTNPVATEQWGKVSCTNLSQEGNNR

SEQ ID NO: 46248 - protein, 32 aa, Artificial Sequence
  Description of Artificial Sequence: Synthetic polypeptide
QEEEIATTNPVAYEQYGSVSTNLQERGDNDQM

SEQ ID NO: 46249 - protein, 32 aa, Artificial Sequence
  Description of Artificial Sequence: Synthetic polypeptide
DTEEIRATNPVATEQYGSVSTTNLQAGNGQED

SEQ ID NO: 46250 - protein, 30 aa, Artificial Sequence
  Description of Artificial Sequence: Synthetic polypeptide
DEEEIRTTNPVAYEQWGTVVSTGLLRAGNS

SEQ ID NO: 46251 - protein, 31 aa, Artificial Sequence
  Description of Artificial Sequence: Synthetic polypeptide
DTEEIRATNPVATEQYGSVSTSTNMQTGNNV

SEQ ID NO: 46252 - protein, 30 aa, Artificial Sequence
  Description of Artificial Sequence: Synthetic polypeptide
QEEEIATTNPVAYEQYGSVSTNLQAEDNNN

SEQ ID NO: 46253 - protein, 32 aa, Artificial Sequence
  Description of Artificial Sequence: Synthetic polypeptide
DEEEIRTTNPVAYEQWGVSVSRNDLNQRGERR

SEQ ID NO: 46254 - protein, 31 aa, Artificial Sequence
  Description of Artificial Sequence: Synthetic polypeptide
SQEEIRTTNPVATEQWGCVSTGNLQEFGSNR

SEQ ID NO: 46255 - protein, 29 aa, Artificial Sequence
  Description of Artificial Sequence: Synthetic peptide
SQEEIRTTNPVATEQWGCVSTELQEGEER

SEQ ID NO: 46256 - protein, 34 aa, Artificial Sequence
  Description of Artificial Sequence: Synthetic polypeptide
AEEEIRTTNPVATEQYGSVCNTSNLKQDRGENSR

SEQ ID NO: 46257 - protein, 31 aa, Artificial Sequence
  Description of Artificial Sequence: Synthetic polypeptide
QEEEIATTNPVAYEQYGSVSTNLQHGENADQ

SEQ ID NO: 46258 - protein, 33 aa, Artificial Sequence
  Description of Artificial Sequence: Synthetic polypeptide
AEEEIRTTNPVATEQYGSVCSTMNLQNFGSNQT

SEQ ID NO: 46259 - protein, 32 aa, Artificial Sequence
  Description of Artificial Sequence: Synthetic polypeptide
DEEEIRTTNPVAYEQYGCDVSTQNNLQEQGNA

SEQ ID NO: 46260 - protein, 33 aa, Artificial Sequence
  Description of Artificial Sequence: Synthetic polypeptide
DEEEIRTTNPVAYEQYGCTVPSTGNLSQPGNRA

SEQ ID NO: 46261 - protein, 28 aa, Artificial Sequence
  Description of Artificial Sequence: Synthetic peptide
AENEIACTNPIATEQYGEASENLQRGNR

SEQ ID NO: 46262 - protein, 30 aa, Artificial Sequence
  Description of Artificial Sequence: Synthetic polypeptide
DEEEIRTTNPVAYEQYGCVCGTNLQYFDSR

SEQ ID NO: 46263 - protein, 33 aa, Artificial Sequence
  Description of Artificial Sequence: Synthetic polypeptide
DTEEIRATNPVATEQYGSVSTTSNLQAGNDEQR

SEQ ID NO: 46264 - protein, 30 aa, Artificial Sequence
  Description of Artificial Sequence: Synthetic polypeptide
SQEEIRTTNPVATEQWGTVSTENLQYGSNQ

SEQ ID NO: 46265 - protein, 29 aa, Artificial Sequence
  Description of Artificial Sequence: Synthetic peptide
AEEEIRTTNPVATEQYGSTSTTLQDEQGT

SEQ ID NO: 46266 - protein, 30 aa, Artificial Sequence
  Description of Artificial Sequence: Synthetic polypeptide
SQEEIRTTNPVATEQWGTVSTNLQPEGEER

SEQ ID NO: 46267 - protein, 31 aa, Artificial Sequence
  Description of Artificial Sequence: Synthetic polypeptide
DEEEIRTTNPVAYEQWGSVSQGNLSQTGGNQ

SEQ ID NO: 46268 - protein, 31 aa, Artificial Sequence
  Description of Artificial Sequence: Synthetic polypeptide
DEEEIRTTNPVAYEQWGSVSSGNGSQTGGNR

SEQ ID NO: 46269 - protein, 30 aa, Artificial Sequence
  Description of Artificial Sequence: Synthetic polypeptide
AEEEIRTTNPVATEQYGSVATALDQGNGVE

SEQ ID NO: 46270 - protein, 30 aa, Artificial Sequence
  Description of Artificial Sequence: Synthetic polypeptide
SQEEIRTTNPVATEQWGTVSTNLQNGSNQE

SEQ ID NO: 46271 - protein, 32 aa, Artificial Sequence
  Description of Artificial Sequence: Synthetic polypeptide
DEEEIRTTNPVAYEQWGSVSTNNLSQGTGNYQ

SEQ ID NO: 46272 - protein, 30 aa, Artificial Sequence
  Description of Artificial Sequence: Synthetic polypeptide
DEEEIRTTNPVAYEQWGTSISTPLNDRGNS

SEQ ID NO: 46273 - protein, 32 aa, Artificial Sequence
  Description of Artificial Sequence: Synthetic polypeptide
DEEEIRTTNPVAYEQWGSVSVQGNLSQEGGNR

SEQ ID NO: 46274 - protein, 31 aa, Artificial Sequence
  Description of Artificial Sequence: Synthetic polypeptide
DEEEIRTTNPVAYEQWGSVSYQGNLQTGGNE

SEQ ID NO: 46275 - protein, 30 aa, Artificial Sequence
  Description of Artificial Sequence: Synthetic polypeptide
SQEEIRTTNPVATEQWGTVSTNLQGGSNAS

SEQ ID NO: 46276 - protein, 30 aa, Artificial Sequence
  Description of Artificial Sequence: Synthetic polypeptide
SQEEIRTTNPVATEQWGTVSTNLEEGNFRN

SEQ ID NO: 46277 - protein, 32 aa, Artificial Sequence
  Description of Artificial Sequence: Synthetic polypeptide
DEEEIRTTNPVAYEQWGSVWSLDNDLQLDGNR

SEQ ID NO: 46278 - protein, 32 aa, Artificial Sequence
  Description of Artificial Sequence: Synthetic polypeptide
DEEEIRTTNPVAYEQWGSVWSLDNDLQRDGER

SEQ ID NO: 46279 - protein, 30 aa, Artificial Sequence
  Description of Artificial Sequence: Synthetic polypeptide
SQEEIRTTNPVATEQWGTVSTMNLQEGERQ

SEQ ID NO: 46280 - protein, 30 aa, Artificial Sequence
  Description of Artificial Sequence: Synthetic polypeptide
SQEEIRTTNPVATEQWGTVSTGNLQSGSNA

SEQ ID NO: 46281 - protein, 32 aa, Artificial Sequence
  Description of Artificial Sequence: Synthetic polypeptide
AEEEIRTTNPVATEQYGSVVTSGTNNQQGNNA

SEQ ID NO: 46282 - protein, 34 aa, Artificial Sequence
  Description of Artificial Sequence: Synthetic polypeptide
DEEEIRTTNPVAYEQYGSVVSTTELSQARGGNNR

SEQ ID NO: 46283 - protein, 33 aa, Artificial Sequence
  Description of Artificial Sequence: Synthetic polypeptide
AEEEIRTTNPVATEQYGSVSSTTNNLQQGENNA

SEQ ID NO: 46284 - protein, 32 aa, Artificial Sequence
  Description of Artificial Sequence: Synthetic polypeptide
DEEEIRTTNPVAYEQYGSVVTNNDTLQRGIGT

SEQ ID NO: 46285 - protein, 31 aa, Artificial Sequence
  Description of Artificial Sequence: Synthetic polypeptide
DEEEISTTNPMATEQYGSVPVNLQHRQNVGR

SEQ ID NO: 46286 - protein, 28 aa, Artificial Sequence
  Description of Artificial Sequence: Synthetic peptide
SEGEIRCTNPIATEQYGSVSCNLMSGTR

SEQ ID NO: 46287 - protein, 33 aa, Artificial Sequence
  Description of Artificial Sequence: Synthetic polypeptide
AEEEIRTTNPVATEQYGSVSTNLNLQQQNGNNT

SEQ ID NO: 46288 - protein, 30 aa, Artificial Sequence
  Description of Artificial Sequence: Synthetic polypeptide
DSEEIRCTNPVATEQYGCVSTNLQEYFGQQ

SEQ ID NO: 46289 - protein, 31 aa, Artificial Sequence
  Description of Artificial Sequence: Synthetic polypeptide
QEEEICTTNPVATEQYGSVATNLQEAGNMDQ

SEQ ID NO: 46290 - protein, 28 aa, Artificial Sequence
  Description of Artificial Sequence: Synthetic peptide
SEGEIRCTNPCSTEQYGIVSENLQRGTR

SEQ ID NO: 46291 - protein, 32 aa, Artificial Sequence
  Description of Artificial Sequence: Synthetic polypeptide
DEEEISTTNPVATEGYGSVCSTELQEHFGSNR

SEQ ID NO: 46292 - protein, 30 aa, Artificial Sequence
  Description of Artificial Sequence: Synthetic polypeptide
SEGEIATTNPVATEQYGSVATNLDRGNDQL

SEQ ID NO: 46293 - protein, 28 aa, Artificial Sequence
  Description of Artificial Sequence: Synthetic peptide
SEGEIAPTNPISSEQYGSVSCNLQRGNR

SEQ ID NO: 46294 - protein, 31 aa, Artificial Sequence
  Description of Artificial Sequence: Synthetic polypeptide
QEEEICTTNPVATEQYGSVATNLQEVGGNDD

SEQ ID NO: 46295 - protein, 28 aa, Artificial Sequence
  Description of Artificial Sequence: Synthetic peptide
SEGEIAPTNPIASEQYGSVSCNLQRGTR

SEQ ID NO: 46296 - protein, 28 aa, Artificial Sequence
  Description of Artificial Sequence: Synthetic peptide
SEGEIAPTNPCSSEQYGSVSCNLQRGNR

SEQ ID NO: 46297 - protein, 30 aa, Artificial Sequence
  Description of Artificial Sequence: Synthetic polypeptide
DSEEIRATNPVATEQYGSVVATNLQNNHTR

SEQ ID NO: 46298 - protein, 28 aa, Artificial Sequence
  Description of Artificial Sequence: Synthetic peptide
SEGEIAPTNPCATEQYGSVSENLMRGTR

SEQ ID NO: 46299 - protein, 29 aa, Artificial Sequence
  Description of Artificial Sequence: Synthetic peptide
SEGEIACTNPVATEQYGSVATNLQNSGNQ

SEQ ID NO: 46300 - protein, 32 aa, Artificial Sequence
  Description of Artificial Sequence: Synthetic polypeptide
DEEEISTTNPMATEQYGSVPTNLQERGSNTQA

SEQ ID NO: 46301 - protein, 32 aa, Artificial Sequence
  Description of Artificial Sequence: Synthetic polypeptide
AEEEIRTTNPVATEQYGSVSTNLNLNDEFGNV

SEQ ID NO: 46302 - protein, 32 aa, Artificial Sequence
  Description of Artificial Sequence: Synthetic polypeptide
DSEEIRCTNPVATEQYGSVSTNLQERFGSQQS

SEQ ID NO: 46303 - protein, 29 aa, Artificial Sequence
  Description of Artificial Sequence: Synthetic peptide
DEEEISTTNPEATCQYGCVPTDLQRFGNF

SEQ ID NO: 46304 - protein, 28 aa, Artificial Sequence
  Description of Artificial Sequence: Synthetic peptide
SEGEIRPTNPIATEQYGSVSCNLMSGTR

SEQ ID NO: 46305 - protein, 30 aa, Artificial Sequence
  Description of Artificial Sequence: Synthetic polypeptide
DEEEIRYTNPVATEQYGSVSVNQDIGQNSA

SEQ ID NO: 46306 - protein, 28 aa, Artificial Sequence
  Description of Artificial Sequence: Synthetic peptide
SEGEIRPTNPIASEQYGSVSENLMRGTR

SEQ ID NO: 46307 - protein, 33 aa, Artificial Sequence
  Description of Artificial Sequence: Synthetic polypeptide
AEEEIRTTNPVATEQYGSVTVTSTTNLQNGNEA

SEQ ID NO: 46308 - protein, 32 aa, Artificial Sequence
  Description of Artificial Sequence: Synthetic polypeptide
AEEEIRTTNPVATEQYGSVSTNLNGTVGNNVN

SEQ ID NO: 46309 - protein, 30 aa, Artificial Sequence
  Description of Artificial Sequence: Synthetic polypeptide
DEEEIRYTNPVATEQYGSVSVNQPRGSTSV

SEQ ID NO: 46310 - protein, 31 aa, Artificial Sequence
  Description of Artificial Sequence: Synthetic polypeptide
DEEEISCTNPVATEQYGCVSTNLQNFGSENQ

SEQ ID NO: 46311 - protein, 33 aa, Artificial Sequence
  Description of Artificial Sequence: Synthetic polypeptide
AEEEIRTTNPVATEQYGSVSTNLNPEEQGGNQG

SEQ ID NO: 46312 - protein, 31 aa, Artificial Sequence
  Description of Artificial Sequence: Synthetic polypeptide
DSEEIRSTNPVATEAYGSVVSTNLSQNVGTR

SEQ ID NO: 46313 - protein, 32 aa, Artificial Sequence
  Description of Artificial Sequence: Synthetic polypeptide
DEEEISTTNPCATEQYGSVCPTNLQERFGNGQ

SEQ ID NO: 46314 - protein, 32 aa, Artificial Sequence
  Description of Artificial Sequence: Synthetic polypeptide
DSEEIRSTNPVATEAYGSTVSTNLSQARTGQR

SEQ ID NO: 46315 - protein, 31 aa, Artificial Sequence
  Description of Artificial Sequence: Synthetic polypeptide
DEEEISTTNPCATEQYGSVNTNLLQHGGNGG

SEQ ID NO: 46316 - protein, 31 aa, Artificial Sequence
  Description of Artificial Sequence: Synthetic polypeptide
QEEEICTTNPVATEQYGSVATNLQDPGNAEM

SEQ ID NO: 46317 - protein, 31 aa, Artificial Sequence
  Description of Artificial Sequence: Synthetic polypeptide
DEEEISTTNPCATEQYGSVPTTNLQAGGNGG

SEQ ID NO: 46318 - protein, 31 aa, Artificial Sequence
  Description of Artificial Sequence: Synthetic polypeptide
DEEEISTTNPCATEQYGSVTTNLQHGGNGGD

SEQ ID NO: 46319 - protein, 32 aa, Artificial Sequence
  Description of Artificial Sequence: Synthetic polypeptide
DSEEIRCTNPVAYEQYGSVVSCTNLQNGGTNR

SEQ ID NO: 46320 - protein, 32 aa, Artificial Sequence
  Description of Artificial Sequence: Synthetic polypeptide
DSEEIRSTNPVATEAYGSVSTNELQARTGGQR

SEQ ID NO: 46321 - protein, 30 aa, Artificial Sequence
  Description of Artificial Sequence: Synthetic polypeptide
DEEEIRYTNPVATEQYGSVSVNQDEGSNNI

SEQ ID NO: 46322 - protein, 32 aa, Artificial Sequence
  Description of Artificial Sequence: Synthetic polypeptide
DSEEIRATNPVATEQYGEVSCTNLSQGGGNNR

SEQ ID NO: 46323 - protein, 29 aa, Artificial Sequence
  Description of Artificial Sequence: Synthetic peptide
SEGEIACTNPVATEQYGSVATNLQAGNQV

SEQ ID NO: 46324 - protein, 31 aa, Artificial Sequence
  Description of Artificial Sequence: Synthetic polypeptide
QEEEICTTNPVATEQYGSVATNLQMGGNDTL

SEQ ID NO: 46325 - protein, 32 aa, Artificial Sequence
  Description of Artificial Sequence: Synthetic polypeptide
AEEEIRTTNPVATEQYGSVSTNLQNEDENTGE

SEQ ID NO: 46326 - protein, 33 aa, Artificial Sequence
  Description of Artificial Sequence: Synthetic polypeptide
DEEEISTTNPVATEQYGCVCSTGNLQRGSNNDF

SEQ ID NO: 46327 - protein, 33 aa, Artificial Sequence
  Description of Artificial Sequence: Synthetic polypeptide
DEEEISTTNPVATEQYGCVCSTGNLQRSGSNNQ

SEQ ID NO: 46328 - protein, 33 aa, Artificial Sequence
  Description of Artificial Sequence: Synthetic polypeptide
AEEEIRTTNPVATEQYGSVSTNLQNEQGNNSET

SEQ ID NO: 46329 - protein, 32 aa, Artificial Sequence
  Description of Artificial Sequence: Synthetic polypeptide
AEEEIRTTNPVATEQYGSVSTNLQNNNANNQD

SEQ ID NO: 46330 - protein, 33 aa, Artificial Sequence
  Description of Artificial Sequence: Synthetic polypeptide
AEEEIRTTNPVATEQYGSVSTNLQNQQGENSTE

SEQ ID NO: 46331 - protein, 33 aa, Artificial Sequence
  Description of Artificial Sequence: Synthetic polypeptide
DEEEISTTNPVATEQYGCVCSTNDLQERSGSER

SEQ ID NO: 46332 - protein, 33 aa, Artificial Sequence
  Description of Artificial Sequence: Synthetic polypeptide
AEEEIRTTNPVATEQYGSVSTNLQNQQGNNITD

SEQ ID NO: 46333 - protein, 32 aa, Artificial Sequence
  Description of Artificial Sequence: Synthetic polypeptide
DEEEISTTNPVATEQYGCVCSTNGLQNFGSNQ

SEQ ID NO: 46334 - protein, 32 aa, Artificial Sequence
  Description of Artificial Sequence: Synthetic polypeptide
AEEEIRTTNPVATEQYGSVSTNLQNQQNNIED

SEQ ID NO: 46335 - protein, 31 aa, Artificial Sequence
  Description of Artificial Sequence: Synthetic polypeptide
DEEEISTTNPVATEQYGCVCSTNHQNFGNQF

SEQ ID NO: 46336 - protein, 33 aa, Artificial Sequence
  Description of Artificial Sequence: Synthetic polypeptide
AEEEIRTTNPVATEQYGSVSTNLQPGNVGGNEV

SEQ ID NO: 46337 - protein, 32 aa, Artificial Sequence
  Description of Artificial Sequence: Synthetic polypeptide
AEEEIRTTNPVATEQYGSVSTNLQPSSNANDY

SEQ ID NO: 46338 - protein, 28 aa, Artificial Sequence
  Description of Artificial Sequence: Synthetic peptide
SEEPIRCTNPIATEQYGKVSEDLMRGNR

SEQ ID NO: 46339 - protein, 29 aa, Artificial Sequence
  Description of Artificial Sequence: Synthetic peptide
DSEEIKTTNPVGTEQWGMVNSTNLERGVR

SEQ ID NO: 46340 - protein, 33 aa, Artificial Sequence
  Description of Artificial Sequence: Synthetic polypeptide
AEEEIRTTNPVATEQYGSVSTNLQLQQQGNNAG

SEQ ID NO: 46341 - protein, 33 aa, Artificial Sequence
  Description of Artificial Sequence: Synthetic polypeptide
DEEEISTTNPVATEQYGCVCSTGNLQERGSNTD

SEQ ID NO: 46342 - protein, 32 aa, Artificial Sequence
  Description of Artificial Sequence: Synthetic polypeptide
AEEEIRTTNPVATEQYGSVSTNLQIQNNANEQ

SEQ ID NO: 46343 - protein, 32 aa, Artificial Sequence
  Description of Artificial Sequence: Synthetic polypeptide
DEEEISTTNPVATEQYGCVCSNTPLQRFGSNQ

SEQ ID NO: 46344 - protein, 28 aa, Artificial Sequence
  Description of Artificial Sequence: Synthetic peptide
SEGEIACTNPISSEQYGSVSCNLQRGNR

SEQ ID NO: 46345 - protein, 29 aa, Artificial Sequence
  Description of Artificial Sequence: Synthetic peptide
AENEIACTNPVATEQYGEACSENLQRGNR

SEQ ID NO: 46346 - protein, 33 aa, Artificial Sequence
  Description of Artificial Sequence: Synthetic polypeptide
AEEEIRTTNPVATEQYGSVSTNLNQGQTGENNA

SEQ ID NO: 46347 - protein, 28 aa, Artificial Sequence
  Description of Artificial Sequence: Synthetic peptide
SEGEIACTNPIASEQYGSVSCNLQRGTR

SEQ ID NO: 46348 - protein, 30 aa, Artificial Sequence
  Description of Artificial Sequence: Synthetic polypeptide
DEEEISTTNPVATEQYGCVCSTEHQRFTNQ

SEQ ID NO: 46349 - protein, 33 aa, Artificial Sequence
  Description of Artificial Sequence: Synthetic polypeptide
AEEEIRTTNPVATEQYGSVSTNLNQNQQGNVTE

SEQ ID NO: 46350 - protein, 29 aa, Artificial Sequence
  Description of Artificial Sequence: Synthetic peptide
SEGEIACTNPVATEQYGSVATNLQGAGNQ

SEQ ID NO: 46351 - protein, 31 aa, Artificial Sequence
  Description of Artificial Sequence: Synthetic polypeptide
QEEEICTTNPVATEQYGSVATNLQEVGNEDF

SEQ ID NO: 46352 - protein, 32 aa, Artificial Sequence
  Description of Artificial Sequence: Synthetic polypeptide
AEEEIRTTNPVATEQYGSVTVTNLQNTENGNS

SEQ ID NO: 46353 - protein, 31 aa, Artificial Sequence
  Description of Artificial Sequence: Synthetic polypeptide
DEEEISTTNPVATEQYGCVCSTELQNSGNQS

SEQ ID NO: 46354 - protein, 31 aa, Artificial Sequence
  Description of Artificial Sequence: Synthetic polypeptide
SEETIRTTNPVATEQYGSVSTNLEDYGMERI

SEQ ID NO: 46355 - protein, 33 aa, Artificial Sequence
  Description of Artificial Sequence: Synthetic polypeptide
AEEEIRTTNPVATEQYGSVSTNLNQQQGANNNE

SEQ ID NO: 46356 - protein, 32 aa, Artificial Sequence
  Description of Artificial Sequence: Synthetic polypeptide
AEEEIRTTNPVATEQYGSVSTNLNQSNANNQD

SEQ ID NO: 46357 - protein, 31 aa, Artificial Sequence
  Description of Artificial Sequence: Synthetic polypeptide
DEEEISTTNPVATEQYGCVCSTEPNQRGSER

SEQ ID NO: 46358 - protein, 32 aa, Artificial Sequence
  Description of Artificial Sequence: Synthetic polypeptide
AEEEIRTTNPVATEQYGSVSTNLNSNEQGNES

SEQ ID NO: 46359 - protein, 29 aa, Artificial Sequence
  Description of Artificial Sequence: Synthetic peptide
DSEEIRATNPVATEQWGSCSTNHQRDSNS

SEQ ID NO: 46360 - protein, 32 aa, Artificial Sequence
  Description of Artificial Sequence: Synthetic polypeptide
AEEEIRTTNPVATEQYGSVSTNLGQQNQNQND

SEQ ID NO: 46361 - protein, 32 aa, Artificial Sequence
  Description of Artificial Sequence: Synthetic polypeptide
AEEEIRTTNPVATEQYGSVSTNLESNEGGNQS

SEQ ID NO: 46362 - protein, 31 aa, Artificial Sequence
  Description of Artificial Sequence: Synthetic polypeptide
DEEEIRYTNPVATEQYGSVSVNNQDGGENDT

SEQ ID NO: 46363 - protein, 31 aa, Artificial Sequence
  Description of Artificial Sequence: Synthetic polypeptide
AEEEIRTTNPVATEQYGSVSTNGNGTVGGNT

SEQ ID NO: 46364 - protein, 31 aa, Artificial Sequence
  Description of Artificial Sequence: Synthetic polypeptide
DEEEIRTVNPVATEQYGCVSTELQRNSQNQL

SEQ ID NO: 46365 - protein, 31 aa, Artificial Sequence
  Description of Artificial Sequence: Synthetic polypeptide
DSEEIRSTNPVATEQYGSTISCTNDSQRGNN

SEQ ID NO: 46366 - protein, 28 aa, Artificial Sequence
  Description of Artificial Sequence: Synthetic peptide
DEEEIRTVNPVATEQYGCVSTPDQNNQQ

SEQ ID NO: 46367 - protein, 30 aa, Artificial Sequence
  Description of Artificial Sequence: Synthetic polypeptide
DSEEIRSTNPVATEQYGSISCTNQSQRGSN

SEQ ID NO: 46368 - protein, 32 aa, Artificial Sequence
  Description of Artificial Sequence: Synthetic polypeptide
DEEEIRTVNPVATEQYGSTVSTHLSQRTVGQE

SEQ ID NO: 46369 - protein, 31 aa, Artificial Sequence
  Description of Artificial Sequence: Synthetic polypeptide
DEEEIRTVNPVATEQYGSTVSTRLSQRTPQE

SEQ ID NO: 46370 - protein, 31 aa, Artificial Sequence
  Description of Artificial Sequence: Synthetic polypeptide
DEEEIRTVNPVATEQYGSVATGLQSRDNQEE

SEQ ID NO: 46371 - protein, 32 aa, Artificial Sequence
  Description of Artificial Sequence: Synthetic polypeptide
AEEEIRTTNPVATEQYGSVSTNGNNQQTGNNL

SEQ ID NO: 46372 - protein, 30 aa, Artificial Sequence
  Description of Artificial Sequence: Synthetic polypeptide
DEEEIRTVNPVATEQYGSVSELLQRNPQET

SEQ ID NO: 46373 - protein, 31 aa, Artificial Sequence
  Description of Artificial Sequence: Synthetic polypeptide
DEEEIRTVNPVATEQYGSVSPTLLDSRNQNN

SEQ ID NO: 46374 - protein, 31 aa, Artificial Sequence
  Description of Artificial Sequence: Synthetic polypeptide
QEEEICTTNPVATEQYGSVATNLDQNEGNEQ

SEQ ID NO: 46375 - protein, 30 aa, Artificial Sequence
  Description of Artificial Sequence: Synthetic polypeptide
DEEEIRTVNPVATEQYGSVSPTLLLDYNQV

SEQ ID NO: 46376 - protein, 32 aa, Artificial Sequence
  Description of Artificial Sequence: Synthetic polypeptide
AEEEIRTTNPVATEQYGSVSTNGNQDEGENIG

SEQ ID NO: 46377 - protein, 32 aa, Artificial Sequence
  Description of Artificial Sequence: Synthetic polypeptide
AEEEIRTTNPVATEQYGSVSTNGNQGNTVGNV

SEQ ID NO: 46378 - protein, 31 aa, Artificial Sequence
  Description of Artificial Sequence: Synthetic polypeptide
DSEEIRSTNPVATEQYGSTISTNQSQRGGNQ

SEQ ID NO: 46379 - protein, 32 aa, Artificial Sequence
  Description of Artificial Sequence: Synthetic polypeptide
AEEEIRTTNPVATEQYGSVSTNGEQQENGGNT

SEQ ID NO: 46380 - protein, 31 aa, Artificial Sequence
  Description of Artificial Sequence: Synthetic polypeptide
DEEEIRTVNPVATEQWGSVSTDLQRPNDQEE

SEQ ID NO: 46381 - protein, 30 aa, Artificial Sequence
  Description of Artificial Sequence: Synthetic polypeptide
DEEEIRTVNPVATEQWGSVSTDLQRDDTEE

SEQ ID NO: 46382 - protein, 30 aa, Artificial Sequence
  Description of Artificial Sequence: Synthetic polypeptide
QEEEICTTNPVATEQYGSVATNDQRDDNGA

SEQ ID NO: 46383 - protein, 31 aa, Artificial Sequence
  Description of Artificial Sequence: Synthetic polypeptide
QEEEICTTNPVATEQYGSVATNDQRPGQERA

SEQ ID NO: 46384 - protein, 30 aa, Artificial Sequence
  Description of Artificial Sequence: Synthetic polypeptide
QEEEICTTNPVATEQYGSVATNDQRPNDTA

SEQ ID NO: 46385 - protein, 30 aa, Artificial Sequence
  Description of Artificial Sequence: Synthetic polypeptide
DEEEIRTTNPVSTEQYGVVSDEDLQQSGNQ

SEQ ID NO: 46386 - protein, 29 aa, Artificial Sequence
  Description of Artificial Sequence: Synthetic peptide
DEEEIRTTNPVSTEQYGWVTSNLQVGGQT

SEQ ID NO: 46387 - protein, 28 aa, Artificial Sequence
  Description of Artificial Sequence: Synthetic peptide
SENEIACTNPVATEQYGEASENLQRGGR

SEQ ID NO: 46388 - protein, 31 aa, Artificial Sequence
  Description of Artificial Sequence: Synthetic polypeptide
QEEEICTTNPVATEQYGSVATNEQRGEPNLP

SEQ ID NO: 46389 - protein, 31 aa, Artificial Sequence
  Description of Artificial Sequence: Synthetic polypeptide
DSEEIRSTNPVATEQYGSISCTNGQRTGGNN

SEQ ID NO: 46390 - protein, 33 aa, Artificial Sequence
  Description of Artificial Sequence: Synthetic polypeptide
DSEEIRSTNPVATEQYGSVPSTNLSQARTGTQR

SEQ ID NO: 46391 - protein, 32 aa, Artificial Sequence
  Description of Artificial Sequence: Synthetic polypeptide
AEEEIRTTNPVATEQYGSVSTNDNNQEEQGND

SEQ ID NO: 46392 - protein, 28 aa, Artificial Sequence
  Description of Artificial Sequence: Synthetic peptide
SENEIACTNPVATECYGSVSECLQRGER

SEQ ID NO: 46393 - protein, 29 aa, Artificial Sequence
  Description of Artificial Sequence: Synthetic peptide
DEEEIRTTNPVSYEQYGSVFLNLQGGGQT

SEQ ID NO: 46394 - protein, 28 aa, Artificial Sequence
  Description of Artificial Sequence: Synthetic peptide
SENEIACTNPIATEQYGEVSENLQRGGR

SEQ ID NO: 46395 - protein, 32 aa, Artificial Sequence
  Description of Artificial Sequence: Synthetic polypeptide
AEEEIRTTNPVATEQYGSVSTNGENQNQGGNT

SEQ ID NO: 46396 - protein, 28 aa, Artificial Sequence
  Description of Artificial Sequence: Synthetic peptide
SENEIACTNPIATEQYGEASENLQRGNR

SEQ ID NO: 46397 - protein, 29 aa, Artificial Sequence
  Description of Artificial Sequence: Synthetic peptide
DEEEIRTTNPVTTEQYGSVSTNAIGTDEP

SEQ ID NO: 46398 - protein, 32 aa, Artificial Sequence
  Description of Artificial Sequence: Synthetic polypeptide
AEEEIRTTNPVATEQYGSVSTNDEQGNEGGNT

SEQ ID NO: 46399 - protein, 28 aa, Artificial Sequence
  Description of Artificial Sequence: Synthetic peptide
AENEIACTNPVATEQYGDASENLQRGGR

SEQ ID NO: 46400 - protein, 32 aa, Artificial Sequence
  Description of Artificial Sequence: Synthetic polypeptide
DEEEIRTVNPVATEQYGSVSSTPALQMSGMNV

SEQ ID NO: 46401 - protein, 31 aa, Artificial Sequence
  Description of Artificial Sequence: Synthetic polypeptide
QEEEICTTNPVATEQYGSVATNLDQTGNEAM

SEQ ID NO: 46402 - protein, 31 aa, Artificial Sequence
  Description of Artificial Sequence: Synthetic polypeptide
DEEEIRTVNPVAYEQYGSVSTHELSQRNSNE

SEQ ID NO: 46403 - protein, 33 aa, Artificial Sequence
  Description of Artificial Sequence: Synthetic polypeptide
AEEEIRTTNPVATEQYGSVSTNLDQQQEGTNNE

SEQ ID NO: 46404 - protein, 33 aa, Artificial Sequence
  Description of Artificial Sequence: Synthetic polypeptide
AEEEIRTTNPVATEQYGSVSTNLDQQQNGTNNE

SEQ ID NO: 46405 - protein, 30 aa, Artificial Sequence
  Description of Artificial Sequence: Synthetic polypeptide
DEEEIRTVNPVSTEQYGTVSDENLQQNGNH

SEQ ID NO: 46406 - protein, 30 aa, Artificial Sequence
  Description of Artificial Sequence: Synthetic polypeptide
DEEEIRTVNPVSTEQYGTVSDENLQQNGNQ

SEQ ID NO: 46407 - protein, 33 aa, Artificial Sequence
  Description of Artificial Sequence: Synthetic polypeptide
AEEEIRTTNPVATEQYGSVSTNLEQGNVGTNNE

SEQ ID NO: 46408 - protein, 30 aa, Artificial Sequence
  Description of Artificial Sequence: Synthetic polypeptide
DEEEIRTVNPVSTEQYGTVSDENLQSNGNQ

SEQ ID NO: 46409 - protein, 29 aa, Artificial Sequence
  Description of Artificial Sequence: Synthetic peptide
SEMEIRCTNPIATEQYGSVCSEGLMRGNR

SEQ ID NO: 46410 - protein, 31 aa, Artificial Sequence
  Description of Artificial Sequence: Synthetic polypeptide
DEEEIRVTNPVATEQYGSVCVNQDRDGENSR

SEQ ID NO: 46411 - protein, 30 aa, Artificial Sequence
  Description of Artificial Sequence: Synthetic polypeptide
DEEEIRYTNPVATEQYGSVIVNQDRGSNSD

SEQ ID NO: 46412 - protein, 32 aa, Artificial Sequence
  Description of Artificial Sequence: Synthetic polypeptide
AEEEIRTTNPVATEQYGSVSTNLEQGSNANDY

SEQ ID NO: 46413 - protein, 31 aa, Artificial Sequence
  Description of Artificial Sequence: Synthetic polypeptide
DEEEIRYTNPVATEQYGSVSSNHDERGSNNA

SEQ ID NO: 46414 - protein, 30 aa, Artificial Sequence
  Description of Artificial Sequence: Synthetic polypeptide
DEEEIRYTNPVATEQYGSVSSNHDHGSNPQ

SEQ ID NO: 46415 - protein, 30 aa, Artificial Sequence
  Description of Artificial Sequence: Synthetic polypeptide
DEEEIRYTNPVATEQYGSVSSNHDNGSNTA

SEQ ID NO: 46416 - protein, 28 aa, Artificial Sequence
  Description of Artificial Sequence: Synthetic peptide
AENEIACTNPVATEQYGDASINLQRGGR

SEQ ID NO: 46417 - protein, 31 aa, Artificial Sequence
  Description of Artificial Sequence: Synthetic polypeptide
DEEEIRYTNPVATEQYGSVSVNGQNGGENST

SEQ ID NO: 46418 - protein, 31 aa, Artificial Sequence
  Description of Artificial Sequence: Synthetic polypeptide
DEEEIRYTNPVATEQYGSVILENQDRGSNSR

SEQ ID NO: 46419 - protein, 33 aa, Artificial Sequence
  Description of Artificial Sequence: Synthetic polypeptide
DEEEISTTNPVATEQYGCVCSTNLFQSFGSNRS

SEQ ID NO: 46420 - protein, 30 aa, Artificial Sequence
  Description of Artificial Sequence: Synthetic polypeptide
DEEEIRTVNPVAYEQYGSVSCTPLSQRNQE

SEQ ID NO: 46421 - protein, 31 aa, Artificial Sequence
  Description of Artificial Sequence: Synthetic polypeptide
DEEEIRTVNPVAYEQYGSTVSTRLSQRVGQE

SEQ ID NO: 46422 - protein, 31 aa, Artificial Sequence
  Description of Artificial Sequence: Synthetic polypeptide
DEEEIRTVNPVATEQYGSVSTEELQRNSQES

SEQ ID NO: 46423 - protein, 31 aa, Artificial Sequence
  Description of Artificial Sequence: Synthetic polypeptide
DEEEIRTVNPVATEQYGSVSTELQNSNSQQA

SEQ ID NO: 46424 - protein, 31 aa, Artificial Sequence
  Description of Artificial Sequence: Synthetic polypeptide
DEEEIRTVNPVATEQYGSVSTRALSQRTVSE

SEQ ID NO: 46425 - protein, 30 aa, Artificial Sequence
  Description of Artificial Sequence: Synthetic polypeptide
DEEEIRTVNPVATEQYGSVSTSLLIERNQE

SEQ ID NO: 46426 - protein, 32 aa, Artificial Sequence
  Description of Artificial Sequence: Synthetic polypeptide
AEEEIRTTNPVATEQYGSVSTNGNQQQGNDTN

SEQ ID NO: 46427 - protein, 30 aa, Artificial Sequence
  Description of Artificial Sequence: Synthetic polypeptide
DEEEIRTVNPVATEQYGSVSTSLLQVNEQE

SEQ ID NO: 46428 - protein, 30 aa, Artificial Sequence
  Description of Artificial Sequence: Synthetic polypeptide
DEEEIRTVNPVATEQYGSVSTTEDQRNSQQ

SEQ ID NO: 46429 - protein, 33 aa, Artificial Sequence
  Description of Artificial Sequence: Synthetic polypeptide
AEEEIRTTNPVATEQYGSVSTNLDQQGNGNNNE

SEQ ID NO: 46430 - protein, 31 aa, Artificial Sequence
  Description of Artificial Sequence: Synthetic polypeptide
DEEEIRTVNPVATEQYGSVSTVLQERNQDEE

SEQ ID NO: 46431 - protein, 30 aa, Artificial Sequence
  Description of Artificial Sequence: Synthetic polypeptide
SEMEIRCTNPIATEQYGSVCSTDNLEFGNR

SEQ ID NO: 46432 - protein, 31 aa, Artificial Sequence
  Description of Artificial Sequence: Synthetic polypeptide
DEEEIRTVNPVATEQYGSVTSTELQRNSQQL

SEQ ID NO: 46433 - protein, 32 aa, Artificial Sequence
  Description of Artificial Sequence: Synthetic polypeptide
DEEEIRTVNPVATEQYGVVSCNLPQDREGENQ

SEQ ID NO: 46434 - protein, 31 aa, Artificial Sequence
  Description of Artificial Sequence: Synthetic polypeptide
AEEEIRTTNPVATEQYGSVSTNLANFNSNFA

SEQ ID NO: 46435 - protein, 30 aa, Artificial Sequence
  Description of Artificial Sequence: Synthetic polypeptide
DEEEIRTVNPVAYEQWGSVSCTRLQRNGSE

SEQ ID NO: 46436 - protein, 30 aa, Artificial Sequence
  Description of Artificial Sequence: Synthetic polypeptide
DEEEIRTVNPVAYEQWGSVSTRLSQRPGQE

SEQ ID NO: 46437 - protein, 33 aa, Artificial Sequence
  Description of Artificial Sequence: Synthetic polypeptide
AEEEIRTTNPVATEQYGSVSTNLDENQEQGNND

SEQ ID NO: 46438 - protein, 30 aa, Artificial Sequence
  Description of Artificial Sequence: Synthetic polypeptide
QEEEICTTNPVATEQYGSVATNLEIRDNTP

SEQ ID NO: 46439 - protein, 33 aa, Artificial Sequence
  Description of Artificial Sequence: Synthetic polypeptide
AEEEIRTTNPVATEQYGSVSTNLQQNNLGNGAE

SEQ ID NO: 46440 - protein, 33 aa, Artificial Sequence
  Description of Artificial Sequence: Synthetic polypeptide
AEEEIRTTNPVATEQYGSVSTNLQQQEQGNLGG

SEQ ID NO: 46441 - protein, 31 aa, Artificial Sequence
  Description of Artificial Sequence: Synthetic polypeptide
AEEEIRTTNPVATEQYGSVSTNLQQQETELG

SEQ ID NO: 46442 - protein, 32 aa, Artificial Sequence
  Description of Artificial Sequence: Synthetic polypeptide
DEEEISTTNPVATEQYGSVCSTNSHFQVRGEQ

SEQ ID NO: 46443 - protein, 32 aa, Artificial Sequence
  Description of Artificial Sequence: Synthetic polypeptide
DEEEISTTNPVATEQYGSVCSTNSLFQEHGEF

SEQ ID NO: 46444 - protein, 28 aa, Artificial Sequence
  Description of Artificial Sequence: Synthetic peptide
DSEDIATTNPVAYEQYGCVSTNGQRVNL

SEQ ID NO: 46445 - protein, 33 aa, Artificial Sequence
  Description of Artificial Sequence: Synthetic polypeptide
AEEEIRTTNPVATEQYGSVSTNNNLQQQGNETQ

SEQ ID NO: 46446 - protein, 31 aa, Artificial Sequence
  Description of Artificial Sequence: Synthetic polypeptide
DEEEISTTNPVATEQYGSVCSTPLQGFGSDQ

SEQ ID NO: 46447 - protein, 32 aa, Artificial Sequence
  Description of Artificial Sequence: Synthetic polypeptide
DEEEISTTNPVATEQYGSVCSTPLQGFGSNTF

SEQ ID NO: 46448 - protein, 29 aa, Artificial Sequence
  Description of Artificial Sequence: Synthetic peptide
DSEDIATTNPVATEQYGCVSTNQQRDVNL

SEQ ID NO: 46449 - protein, 32 aa, Artificial Sequence
  Description of Artificial Sequence: Synthetic polypeptide
DEEEISTTNPVATEQYGSVCSTPLQRFISNFS

SEQ ID NO: 46450 - protein, 32 aa, Artificial Sequence
  Description of Artificial Sequence: Synthetic polypeptide
DEEEISTTNPVATEQYGSVCSTPLQRFLSNQP

SEQ ID NO: 46451 - protein, 32 aa, Artificial Sequence
  Description of Artificial Sequence: Synthetic polypeptide
DEEEISTTNPVATEQYGSVCSTPLQSFGSNFN

SEQ ID NO: 46452 - protein, 33 aa, Artificial Sequence
  Description of Artificial Sequence: Synthetic polypeptide
DEEEISTTNPVATEQYGSVCSTPNLQFFGSNTS

SEQ ID NO: 46453 - protein, 31 aa, Artificial Sequence
  Description of Artificial Sequence: Synthetic polypeptide
DEEEISTTNPVATEQYGSVCSTTPQRHWNDL

SEQ ID NO: 46454 - protein, 32 aa, Artificial Sequence
  Description of Artificial Sequence: Synthetic polypeptide
DEEEISTTNPVATEQYGSVCSTYLNQNFGSNA

SEQ ID NO: 46455 - protein, 33 aa, Artificial Sequence
  Description of Artificial Sequence: Synthetic polypeptide
DEEEISTTNPVATEQYGSVCSTYLQERSGSNQE

SEQ ID NO: 46456 - protein, 32 aa, Artificial Sequence
  Description of Artificial Sequence: Synthetic polypeptide
DEEEISTTNPVATEQYGSVCSTYLQHFGSNAM

SEQ ID NO: 46457 - protein, 33 aa, Artificial Sequence
  Description of Artificial Sequence: Synthetic polypeptide
DEEEISTTNPVATEQYGSVCSTNNLQFFGSNQA

SEQ ID NO: 46458 - protein, 32 aa, Artificial Sequence
  Description of Artificial Sequence: Synthetic polypeptide
DEEEISTTNPVATEQYGSVCSTNLQYFGSVDA

SEQ ID NO: 46459 - protein, 33 aa, Artificial Sequence
  Description of Artificial Sequence: Synthetic polypeptide
DEEEISTTNPVATEQYGSVCSTNLQNFGSNNEA

SEQ ID NO: 46460 - protein, 31 aa, Artificial Sequence
  Description of Artificial Sequence: Synthetic polypeptide
DEEEISTTNPVATEQYGSVCSTNHQYGSVQG

SEQ ID NO: 46461 - protein, 32 aa, Artificial Sequence
  Description of Artificial Sequence: Synthetic polypeptide
DSEEIATTNPVAYEQYGSVVSCTANLQRGGNE

SEQ ID NO: 46462 - protein, 32 aa, Artificial Sequence
  Description of Artificial Sequence: Synthetic polypeptide
AEEEIRTTNPVATEQYGSVSTNNNLNQGNGGI

SEQ ID NO: 46463 - protein, 31 aa, Artificial Sequence
  Description of Artificial Sequence: Synthetic polypeptide
DSEEIATTNPVAYEQYGSVSTGNALQIGGND

SEQ ID NO: 46464 - protein, 32 aa, Artificial Sequence
  Description of Artificial Sequence: Synthetic polypeptide
DEEEISTTNPVATEQYGSVCSTELNQYGSNQV

SEQ ID NO: 46465 - protein, 33 aa, Artificial Sequence
  Description of Artificial Sequence: Synthetic polypeptide
AEEEIRTTNPVATEQYGSVSTNNNLQNGENEQV

SEQ ID NO: 46466 - protein, 31 aa, Artificial Sequence
  Description of Artificial Sequence: Synthetic polypeptide
DSEEIATTNPVAYEQYGSTVSTGNLSTRGNE

SEQ ID NO: 46467 - protein, 30 aa, Artificial Sequence
  Description of Artificial Sequence: Synthetic polypeptide
QEEEICTTNPVATEQYGSVATNLTEGGNVD

SEQ ID NO: 46468 - protein, 32 aa, Artificial Sequence
  Description of Artificial Sequence: Synthetic polypeptide
AEEEIRTTNPVATEQYGSVTTSNLQQDGENYG

SEQ ID NO: 46469 - protein, 30 aa, Artificial Sequence
  Description of Artificial Sequence: Synthetic polypeptide
SEEEVRCTNPVATEQYGSVSAETIQSRGNR

SEQ ID NO: 46470 - protein, 32 aa, Artificial Sequence
  Description of Artificial Sequence: Synthetic polypeptide
DEEEISTTNPVATEQYGSVCSTGNHQNLGSNQ

SEQ ID NO: 46471 - protein, 33 aa, Artificial Sequence
  Description of Artificial Sequence: Synthetic polypeptide
DEEEISTTNPVATEQYGSVCSTGNLQHLGSNQS

SEQ ID NO: 46472 - protein, 33 aa, Artificial Sequence
  Description of Artificial Sequence: Synthetic polypeptide
AEEEIRTTNPVATEQYGSVSTNNNLQQGSEDNE

SEQ ID NO: 46473 - protein, 32 aa, Artificial Sequence
  Description of Artificial Sequence: Synthetic polypeptide
DEEEISTTNPVATEQYGSVCSTMNLQYMGEVF

SEQ ID NO: 46474 - protein, 31 aa, Artificial Sequence
  Description of Artificial Sequence: Synthetic polypeptide
DSEEIATTNPVAYEQYGKVPSTGNLSQRGNE

SEQ ID NO: 46475 - protein, 33 aa, Artificial Sequence
  Description of Artificial Sequence: Synthetic polypeptide
AEEEIRTTNPVATEQYGSVSTNNNLQQQEGNQT

SEQ ID NO: 46476 - protein, 31 aa, Artificial Sequence
  Description of Artificial Sequence: Synthetic polypeptide
DSEEIATTNPVATEQWGSVPSTHLSQRGTTR

SEQ ID NO: 46477 - protein, 31 aa, Artificial Sequence
  Description of Artificial Sequence: Synthetic polypeptide
DEEEISTTNPVATEQYGSVCSTGNHQNGSEL

SEQ ID NO: 46478 - protein, 29 aa, Artificial Sequence
  Description of Artificial Sequence: Synthetic peptide
DSEDIATTNPVATEQYGCVSTNHQERDNE

SEQ ID NO: 46479 - protein, 32 aa, Artificial Sequence
  Description of Artificial Sequence: Synthetic polypeptide
DEEEISTTNPVATEQYGSVSCTNMGSQGGGNS

SEQ ID NO: 46480 - protein, 33 aa, Artificial Sequence
  Description of Artificial Sequence: Synthetic polypeptide
DEEEISTTNPVATEQYGSVSDTNLQNFGSNTQP

SEQ ID NO: 46481 - protein, 29 aa, Artificial Sequence
  Description of Artificial Sequence: Synthetic peptide
DSEDIATTNPVATEQYGCVSTNEQRMNLH

SEQ ID NO: 46482 - protein, 32 aa, Artificial Sequence
  Description of Artificial Sequence: Synthetic polypeptide
DEEEISTTNPVAYEQYGSTVSENALSQPGGNR

SEQ ID NO: 46483 - protein, 32 aa, Artificial Sequence
  Description of Artificial Sequence: Synthetic polypeptide
DEEEISTTNPVAYEQYGSVSCTNMLSQTGGNS

SEQ ID NO: 46484 - protein, 31 aa, Artificial Sequence
  Description of Artificial Sequence: Synthetic polypeptide
DEEEISTTNPVAYEQYGSVSTNMLSGLGGNE

SEQ ID NO: 46485 - protein, 32 aa, Artificial Sequence
  Description of Artificial Sequence: Synthetic polypeptide
DEEEISTTNPVAYEQYGSVVSCTNLSGRDNNR

SEQ ID NO: 46486 - protein, 30 aa, Artificial Sequence
  Description of Artificial Sequence: Synthetic polypeptide
SEEEVACTNPVATEQYGSVSANTIQSRGNR

SEQ ID NO: 46487 - protein, 32 aa, Artificial Sequence
  Description of Artificial Sequence: Synthetic polypeptide
DEEEITTTNPVATEQYGSVSLTNSLQQVRPEM

SEQ ID NO: 46488 - protein, 31 aa, Artificial Sequence
  Description of Artificial Sequence: Synthetic polypeptide
DEEEISTTNPVAYECYGCVSTNLSQEGGNNR

SEQ ID NO: 46489 - protein, 31 aa, Artificial Sequence
  Description of Artificial Sequence: Synthetic polypeptide
QEEEICTTNPVATEQYGSVATNLTQNGNDTA

SEQ ID NO: 46490 - protein, 32 aa, Artificial Sequence
  Description of Artificial Sequence: Synthetic polypeptide
DEEEITTTNPVATEQYGSVSSNQLEVERMGNL

SEQ ID NO: 46491 - protein, 29 aa, Artificial Sequence
  Description of Artificial Sequence: Synthetic peptide
DDSEIACTNPVATEQYGNVSENLMSRGNR

SEQ ID NO: 46492 - protein, 30 aa, Artificial Sequence
  Description of Artificial Sequence: Synthetic polypeptide
DDSEIACTNPVATEQYGNVSAENLQSRGNR

SEQ ID NO: 46493 - protein, 32 aa, Artificial Sequence
  Description of Artificial Sequence: Synthetic polypeptide
AEEEIRTTNPVATEQYGSVSTNNNNQGGSNNL

SEQ ID NO: 46494 - protein, 29 aa, Artificial Sequence
  Description of Artificial Sequence: Synthetic peptide
DDSDIRTTNPVATEQYGKVSTNHQRVNLV

SEQ ID NO: 46495 - protein, 31 aa, Artificial Sequence
  Description of Artificial Sequence: Synthetic polypeptide
DEEEITTTNPVAYEAYGSVCCTNLSQRVNNR

SEQ ID NO: 46496 - protein, 32 aa, Artificial Sequence
  Description of Artificial Sequence: Synthetic polypeptide
DEEEITTTNPVAYEQYGSVPCCTNLSQTGNNR

SEQ ID NO: 46497 - protein, 30 aa, Artificial Sequence
  Description of Artificial Sequence: Synthetic polypeptide
QEEEICTTNPVATEQYGSVATNNQRGPPED

SEQ ID NO: 46498 - protein, 33 aa, Artificial Sequence
  Description of Artificial Sequence: Synthetic polypeptide
AEEEIRTTNPVATEQYGSVSTNNNLGQEGNNST

SEQ ID NO: 46499 - protein, 32 aa, Artificial Sequence
  Description of Artificial Sequence: Synthetic polypeptide
AEEEIRTTNPVATEQYGSVSTNNNLVSGGGNA

SEQ ID NO: 46500 - protein, 31 aa, Artificial Sequence
  Description of Artificial Sequence: Synthetic polypeptide
DEEEISTTNPVATEQYGVVCSWELQRFGSER

SEQ ID NO: 46501 - protein, 33 aa, Artificial Sequence
  Description of Artificial Sequence: Synthetic polypeptide
DEEEISTTNPVATEQYGSVSNTNLQNFGSETRA

SEQ ID NO: 46502 - protein, 31 aa, Artificial Sequence
  Description of Artificial Sequence: Synthetic polypeptide
DEEEISTTNPVATEQYGSVSTEDLQNNSNQS

SEQ ID NO: 46503 - protein, 31 aa, Artificial Sequence
  Description of Artificial Sequence: Synthetic polypeptide
DEEEISTTNPVATEQYGSVSTEELQRNSEQD

SEQ ID NO: 46504 - protein, 30 aa, Artificial Sequence
  Description of Artificial Sequence: Synthetic polypeptide
DEEEISTTNPVATEQYGSVSTEHQHGSEQG

SEQ ID NO: 46505 - protein, 31 aa, Artificial Sequence
  Description of Artificial Sequence: Synthetic polypeptide
DEEEISTTNPVATEQYGSVSTELQNFNSDQS

SEQ ID NO: 46506 - protein, 31 aa, Artificial Sequence
  Description of Artificial Sequence: Synthetic polypeptide
DEEEISTTNPVATEQYGSVSTNDQENNSNQS

SEQ ID NO: 46507 - protein, 31 aa, Artificial Sequence
  Description of Artificial Sequence: Synthetic polypeptide
DEEEISTTNPVATEQYGSVSTNHQSFGSEQP

SEQ ID NO: 46508 - protein, 31 aa, Artificial Sequence
  Description of Artificial Sequence: Synthetic polypeptide
DEEEISTTNPVATEQYGVVSTELQAFGSNQS

SEQ ID NO: 46509 - protein, 32 aa, Artificial Sequence
  Description of Artificial Sequence: Synthetic polypeptide
DEEEISTTNPVATEQYGSVSTNSLEVVRGGEF

SEQ ID NO: 46510 - protein, 33 aa, Artificial Sequence
  Description of Artificial Sequence: Synthetic polypeptide
DEEEISTTNPVATEQYGSVSTNSLQQVRGPEFV

SEQ ID NO: 46511 - protein, 31 aa, Artificial Sequence
  Description of Artificial Sequence: Synthetic polypeptide
DEEEISTTNPVATEQYGSVSTNSNNQVQGEF

SEQ ID NO: 46512 - protein, 31 aa, Artificial Sequence
  Description of Artificial Sequence: Synthetic polypeptide
DEEEISTTNPVATEQYGSVSTPHQNFGSNFS

SEQ ID NO: 46513 - protein, 34 aa, Artificial Sequence
  Description of Artificial Sequence: Synthetic polypeptide
DEEEISTTNPVATEQYGSVVSTNSLSQVRGGENQ

SEQ ID NO: 46514 - protein, 33 aa, Artificial Sequence
  Description of Artificial Sequence: Synthetic polypeptide
DEEEISTTNPVATEQYGVVCSNTNPQRFGSNRN

SEQ ID NO: 46515 - protein, 28 aa, Artificial Sequence
  Description of Artificial Sequence: Synthetic peptide
SEEEVACTNPVATEQYGSVSNTIQRGQR

SEQ ID NO: 46516 - protein, 33 aa, Artificial Sequence
  Description of Artificial Sequence: Synthetic polypeptide
AEEEIRTTNPVATEQYGSVSTNNNLQQQGTNIF

SEQ ID NO: 46517 - protein, 32 aa, Artificial Sequence
  Description of Artificial Sequence: Synthetic polypeptide
DEEEISTTNPVATEQYGSVSTNSLFQVAGSEF

SEQ ID NO: 46518 - protein, 29 aa, Artificial Sequence
  Description of Artificial Sequence: Synthetic peptide
DSEEIRSTNPVAYEQWGSISTNSSQRGNN

SEQ ID NO: 46519 - protein, 30 aa, Artificial Sequence
  Description of Artificial Sequence: Synthetic polypeptide
DEEEISTTNPVATEQYGSVCSTEDQNGEQS

SEQ ID NO: 46520 - protein, 33 aa, Artificial Sequence
  Description of Artificial Sequence: Synthetic polypeptide
DEEEISTTNPVATEQYGSVCSMTNLQRFGSDLG

SEQ ID NO: 46521 - protein, 31 aa, Artificial Sequence
  Description of Artificial Sequence: Synthetic polypeptide
AEEEIRTTNPVATEQYGSVSTNMGVNGTNIG

SEQ ID NO: 46522 - protein, 31 aa, Artificial Sequence
  Description of Artificial Sequence: Synthetic polypeptide
AEEEIRTTNPVATEQYGSVSTNMNQEENNQG

SEQ ID NO: 46523 - protein, 31 aa, Artificial Sequence
  Description of Artificial Sequence: Synthetic polypeptide
DEEEISTTNPVATEQYGCVCSWNLQYSGSER

SEQ ID NO: 46524 - protein, 31 aa, Artificial Sequence
  Description of Artificial Sequence: Synthetic polypeptide
DEEEISTTNPVATEQYGCVFTNLQNFGSNQS

SEQ ID NO: 46525 - protein, 31 aa, Artificial Sequence
  Description of Artificial Sequence: Synthetic polypeptide
QEEEICTTNPVATEQYGSVATNLQPEENPRD

SEQ ID NO: 46526 - protein, 33 aa, Artificial Sequence
  Description of Artificial Sequence: Synthetic polypeptide
DEEEISTTNPVATEQYGCVSNTNLQNFGSENRQ

SEQ ID NO: 46527 - protein, 32 aa, Artificial Sequence
  Description of Artificial Sequence: Synthetic polypeptide
DEEEISTTNPVATEQYGCVSNTNLQSSGSNQA

SEQ ID NO: 46528 - protein, 31 aa, Artificial Sequence
  Description of Artificial Sequence: Synthetic polypeptide
AEEEIRTTNPVATEQYGSVSTNMQGEENGEG

SEQ ID NO: 46529 - protein, 31 aa, Artificial Sequence
  Description of Artificial Sequence: Synthetic polypeptide
DEEEISTTNPVATEQYGCVSSNLQYFGSNQQ

SEQ ID NO: 46530 - protein, 31 aa, Artificial Sequence
  Description of Artificial Sequence: Synthetic polypeptide
AEEEIRTTNPVATEQYGSVSTNNDGTVGTNA

SEQ ID NO: 46531 - protein, 32 aa, Artificial Sequence
  Description of Artificial Sequence: Synthetic polypeptide
AEEEIRTTNPVATEQYGSVSTNNENQETGVNT

SEQ ID NO: 46532 - protein, 30 aa, Artificial Sequence
  Description of Artificial Sequence: Synthetic polypeptide
DEEEISTTNPVATEQYGCVSTEEHQFGSNQ

SEQ ID NO: 46533 - protein, 31 aa, Artificial Sequence
  Description of Artificial Sequence: Synthetic polypeptide
AEEEIRTTNPVATEQYGSVSTNNGGTVGNVN

SEQ ID NO: 46534 - protein, 32 aa, Artificial Sequence
  Description of Artificial Sequence: Synthetic polypeptide
AEEEIRTTNPVATEQYGSVSTNNGQIQGTNNE

SEQ ID NO: 46535 - protein, 31 aa, Artificial Sequence
  Description of Artificial Sequence: Synthetic polypeptide
AEEEIRTTNPVATEQYGSVSTNNGTVGNNAA

SEQ ID NO: 46536 - protein, 31 aa, Artificial Sequence
  Description of Artificial Sequence: Synthetic polypeptide
DEEEISTTNPVATEQYGCVCSWNHQHGSNNR

SEQ ID NO: 46537 - protein, 31 aa, Artificial Sequence
  Description of Artificial Sequence: Synthetic polypeptide
AEEEIRTTNPVATEQYGSVSTNMGVNGNNGG

SEQ ID NO: 46538 - protein, 31 aa, Artificial Sequence
  Description of Artificial Sequence: Synthetic polypeptide
AEEEIRTTNPVATEQYGSVSTNMGNVNGNQG

SEQ ID NO: 46539 - protein, 31 aa, Artificial Sequence
  Description of Artificial Sequence: Synthetic polypeptide
AEEEIRTTNPVATEQYGSVSTNMGGVAGNIG

SEQ ID NO: 46540 - protein, 31 aa, Artificial Sequence
  Description of Artificial Sequence: Synthetic polypeptide
QEEEICTTNPVATEQYGSVATNLQNPGNEMF

SEQ ID NO: 46541 - protein, 32 aa, Artificial Sequence
  Description of Artificial Sequence: Synthetic polypeptide
DEEEISTTNPVATEQYGCVCSTNLQERGSEQI

SEQ ID NO: 46542 - protein, 32 aa, Artificial Sequence
  Description of Artificial Sequence: Synthetic polypeptide
DEEEISTTNPVATEQYGCVCSTNLQHFGSNQS

SEQ ID NO: 46543 - protein, 32 aa, Artificial Sequence
  Description of Artificial Sequence: Synthetic polypeptide
DEEEISTTNPVATEQYGCVCSTNLQHIGSNQE

SEQ ID NO: 46544 - protein, 32 aa, Artificial Sequence
  Description of Artificial Sequence: Synthetic polypeptide
DEEEISTTNPVATEQYGCVCSTNLQHLGSNQP

SEQ ID NO: 46545 - protein, 32 aa, Artificial Sequence
  Description of Artificial Sequence: Synthetic polypeptide
DEEEISTTNPVATEQYGCVCSTNLQNFGSENQ

SEQ ID NO: 46546 - protein, 30 aa, Artificial Sequence
  Description of Artificial Sequence: Synthetic polypeptide
DEEEISTTNPVATEQYGCVCSTNLQNFIDQ

SEQ ID NO: 46547 - protein, 31 aa, Artificial Sequence
  Description of Artificial Sequence: Synthetic polypeptide
AEEEIRTTNPVATEQYGSVSTNNINDEGNND

SEQ ID NO: 46548 - protein, 32 aa, Artificial Sequence
  Description of Artificial Sequence: Synthetic polypeptide
AEEEIRTTNPVATEQYGSVSTNLQQQNDTNED

SEQ ID NO: 46549 - protein, 31 aa, Artificial Sequence
  Description of Artificial Sequence: Synthetic polypeptide
DEEEISTTNPVATEQYGCVCSTNLQNNSNFS

SEQ ID NO: 46550 - protein, 32 aa, Artificial Sequence
  Description of Artificial Sequence: Synthetic polypeptide
AEEEIRTTNPVATEQYGSVSTNLQQQNGTTEL

SEQ ID NO: 46551 - protein, 32 aa, Artificial Sequence
  Description of Artificial Sequence: Synthetic polypeptide
AEEEIRTTNPVATEQYGSVSTNLQQQQGDEQQ

SEQ ID NO: 46552 - protein, 33 aa, Artificial Sequence
  Description of Artificial Sequence: Synthetic polypeptide
DEEEISTTNPVATEQYGCVCSTNSLQSFGSNRG

SEQ ID NO: 46553 - protein, 33 aa, Artificial Sequence
  Description of Artificial Sequence: Synthetic polypeptide
AEEEIRTTNPVATEQYGSVSTNLQQQQGNNQNE

SEQ ID NO: 46554 - protein, 31 aa, Artificial Sequence
  Description of Artificial Sequence: Synthetic polypeptide
DEEEISTTNPVATEQYGCVCSTPLQSFGNQQ

SEQ ID NO: 46555 - protein, 31 aa, Artificial Sequence
  Description of Artificial Sequence: Synthetic polypeptide
DEEEISTTNPVATEQYGCVCSTPLQSFGSNA

SEQ ID NO: 46556 - protein, 31 aa, Artificial Sequence
  Description of Artificial Sequence: Synthetic polypeptide
DEEEISTTNPVATEQYGCVCSTNLQNGSDII

SEQ ID NO: 46557 - protein, 31 aa, Artificial Sequence
  Description of Artificial Sequence: Synthetic polypeptide
DDSEIRTTNPVATEQYGYTISTNELQRGERQ

SEQ ID NO: 46558 - protein, 30 aa, Artificial Sequence
  Description of Artificial Sequence: Synthetic polypeptide
DEEEISTTNPVATEQYGCVSTELQHPSNDG

SEQ ID NO: 46559 - protein, 33 aa, Artificial Sequence
  Description of Artificial Sequence: Synthetic polypeptide
AEEEIRTTNPVATEQYGSVSTNNLGQNEQGTNS

SEQ ID NO: 46560 - protein, 32 aa, Artificial Sequence
  Description of Artificial Sequence: Synthetic polypeptide
AEEEIRTTNPVATEQYGSVSTNNNDQQIGENG

SEQ ID NO: 46561 - protein, 30 aa, Artificial Sequence
  Description of Artificial Sequence: Synthetic polypeptide
QEEEICTTNPVATEQYGSVATNLQRAPDIE

SEQ ID NO: 46562 - protein, 32 aa, Artificial Sequence
  Description of Artificial Sequence: Synthetic polypeptide
AEEEIRTTNPVATEQYGSVSTNNNGNQIQGNE

SEQ ID NO: 46563 - protein, 31 aa, Artificial Sequence
  Description of Artificial Sequence: Synthetic polypeptide
QEEEICTTNPVATEQYGSVATNLQRGAPDQV

SEQ ID NO: 46564 - protein, 33 aa, Artificial Sequence
  Description of Artificial Sequence: Synthetic polypeptide
AEEEIRTTNPVATEQYGSVSTNNNLGQEEGTNS

SEQ ID NO: 46565 - protein, 30 aa, Artificial Sequence
  Description of Artificial Sequence: Synthetic polypeptide
DEEEISTTNPVATEQYGCVSWPLQRFGSEQ

SEQ ID NO: 46566 - protein, 33 aa, Artificial Sequence
  Description of Artificial Sequence: Synthetic polypeptide
AEEEIRTTNPVATEQYGSVSTNNNLGQEGNNSE

SEQ ID NO: 46567 - protein, 32 aa, Artificial Sequence
  Description of Artificial Sequence: Synthetic polypeptide
DSEEICTTNPVATEQYGSTVSTNDSQPPVGNR

SEQ ID NO: 46568 - protein, 32 aa, Artificial Sequence
  Description of Artificial Sequence: Synthetic polypeptide
DEEEISTTNPVATEQYGKVSTNELQDGLNNKQ

SEQ ID NO: 46569 - protein, 29 aa, Artificial Sequence
  Description of Artificial Sequence: Synthetic peptide
DSEEIATTNPVAYTQWGSVSTNPSMRGNR

SEQ ID NO: 46570 - protein, 31 aa, Artificial Sequence
  Description of Artificial Sequence: Synthetic polypeptide
DEEEISTTNPVATEQYGQCVSTELQGGSNQF

SEQ ID NO: 46571 - protein, 31 aa, Artificial Sequence
  Description of Artificial Sequence: Synthetic polypeptide
QEEEICTTNPVATEQYGSVATNLQRNPEGEM

SEQ ID NO: 46572 - protein, 32 aa, Artificial Sequence
  Description of Artificial Sequence: Synthetic polypeptide
DEEEISTTNPVATEQYGQSCVAYSGNLTRGER

SEQ ID NO: 46573 - protein, 32 aa, Artificial Sequence
  Description of Artificial Sequence: Synthetic polypeptide
DEEEISTTNPVATEQYGQSVCSSPLQRFGSNQ

SEQ ID NO: 46574 - protein, 31 aa, Artificial Sequence
  Description of Artificial Sequence: Synthetic polypeptide
DEEEISTTNPVATEQYGQSVSTEHQNGSNQF

SEQ ID NO: 46575 - protein, 32 aa, Artificial Sequence
  Description of Artificial Sequence: Synthetic polypeptide
DEEEISTTNPVATEQYGQSVSTELQYFGSNQF

SEQ ID NO: 46576 - protein, 31 aa, Artificial Sequence
  Description of Artificial Sequence: Synthetic polypeptide
QEEEICTTNPVATEQYGSVATNLQRGAPEGE

SEQ ID NO: 46577 - protein, 32 aa, Artificial Sequence
  Description of Artificial Sequence: Synthetic polypeptide
DEEEISTTNPVATEQYGSVCSNTEHQRMGSNA

SEQ ID NO: 46578 - protein, 31 aa, Artificial Sequence
  Description of Artificial Sequence: Synthetic polypeptide
DEEEISTTNPVATEQYGCVSTNSLFQEGGEF

SEQ ID NO: 46579 - protein, 31 aa, Artificial Sequence
  Description of Artificial Sequence: Synthetic polypeptide
DEEEISTTNPVATEQYGCVSTNLQNFMSNNQ

SEQ ID NO: 46580 - protein, 32 aa, Artificial Sequence
  Description of Artificial Sequence: Synthetic polypeptide
AEEEIRTTNPVATEQYGSVSTNNLNQGTGGGI

SEQ ID NO: 46581 - protein, 32 aa, Artificial Sequence
  Description of Artificial Sequence: Synthetic polypeptide
AEEEIRTTNPVATEQYGSVSTNNLQQNTINNT

SEQ ID NO: 46582 - protein, 31 aa, Artificial Sequence
  Description of Artificial Sequence: Synthetic polypeptide
DEEEISTTNPVATEQYGCVSTENLQSGSEQP

SEQ ID NO: 46583 - protein, 33 aa, Artificial Sequence
  Description of Artificial Sequence: Synthetic polypeptide
AEEEIRTTNPVATEQYGSVSTNNLQQQGTNQTD

SEQ ID NO: 46584 - protein, 29 aa, Artificial Sequence
  Description of Artificial Sequence: Synthetic peptide
DEEEISTTNPVATEQYGCVSTEPQNGSEA

SEQ ID NO: 46585 - protein, 30 aa, Artificial Sequence
  Description of Artificial Sequence: Synthetic polypeptide
DDSEIRTTNPVATEQYGSVSTNNLELGMQQ

SEQ ID NO: 46586 - protein, 30 aa, Artificial Sequence
  Description of Artificial Sequence: Synthetic polypeptide
DEEEISTTNPVATEQYGCVSTEPQRFGSEV

SEQ ID NO: 46587 - protein, 29 aa, Artificial Sequence
  Description of Artificial Sequence: Synthetic peptide
SEEGIGTTNPVATEQYGCVSSNHQRGSNQ

SEQ ID NO: 46588 - protein, 30 aa, Artificial Sequence
  Description of Artificial Sequence: Synthetic polypeptide
DEEEISTTNPVATEQYGCVSTGEPQRGSEQ

SEQ ID NO: 46589 - protein, 32 aa, Artificial Sequence
  Description of Artificial Sequence: Synthetic polypeptide
AEEEIRTTNPVATEQYGSVSTNNLVNGNGGNP

SEQ ID NO: 46590 - protein, 31 aa, Artificial Sequence
  Description of Artificial Sequence: Synthetic polypeptide
DEEEISTTNPVATEQYGCVSTMNLQNFGSDQ

SEQ ID NO: 46591 - protein, 31 aa, Artificial Sequence
  Description of Artificial Sequence: Synthetic polypeptide
AEEEIRTTNPVATEQYGSVSTNNNDEIGGNV

SEQ ID NO: 46592 - protein, 31 aa, Artificial Sequence
  Description of Artificial Sequence: Synthetic polypeptide
DEEEISTTNPVATEQYGCVSTNHQNFGSNNQ

SEQ ID NO: 46593 - protein, 31 aa, Artificial Sequence
  Description of Artificial Sequence: Synthetic polypeptide
DEEEISTTNPVATEQYGCVSTNHQRNSNNQT

SEQ ID NO: 46594 - protein, 31 aa, Artificial Sequence
  Description of Artificial Sequence: Synthetic polypeptide
DEEEISTTNPVATEQYGCVSTNHQSGSENQG

SEQ ID NO: 46595 - protein, 30 aa, Artificial Sequence
  Description of Artificial Sequence: Synthetic polypeptide
QEEEICTTNPVATEQYGSVATNLQQGEQMD

SEQ ID NO: 46596 - protein, 32 aa, Artificial Sequence
  Description of Artificial Sequence: Synthetic polypeptide
AEEEIRTTNPVATEQYGSVSTNNLQQTQGIDT

SEQ ID NO: 46597 - protein, 30 aa, Artificial Sequence
  Description of Artificial Sequence: Synthetic polypeptide
QEEEICTTNPVATEQYGSVASNLQPEGNDQ

SEQ ID NO: 46598 - protein, 30 aa, Artificial Sequence
  Description of Artificial Sequence: Synthetic polypeptide
DEEEIRTTNPVSTEQYGSVVTDNGQGGQET

SEQ ID NO: 46599 - protein, 28 aa, Artificial Sequence
  Description of Artificial Sequence: Synthetic peptide
SENEIRCTNPIATEQYGEASENLQRGGR

SEQ ID NO: 46600 - protein, 30 aa, Artificial Sequence
  Description of Artificial Sequence: Synthetic polypeptide
DSEEIRTTNPVAYEQWGEVSTNFSQRGGNP

SEQ ID NO: 46601 - protein, 31 aa, Artificial Sequence
  Description of Artificial Sequence: Synthetic polypeptide
DEEEIRTTNPVCTEHYGSVSLLVNEQRGNPL

SEQ ID NO: 46602 - protein, 31 aa, Artificial Sequence
  Description of Artificial Sequence: Synthetic polypeptide
DEEEIRTTNPVCTEHYGSVSMPNDQRGNSLM

SEQ ID NO: 46603 - protein, 31 aa, Artificial Sequence
  Description of Artificial Sequence: Synthetic polypeptide
DEEEIRTTNPVCTEHYGSVSMPNGEQRVGNE

SEQ ID NO: 46604 - protein, 32 aa, Artificial Sequence
  Description of Artificial Sequence: Synthetic polypeptide
DEEEIRTTNPVCTEHYGSVSMPNLQDRGNDNS

SEQ ID NO: 46605 - protein, 30 aa, Artificial Sequence
  Description of Artificial Sequence: Synthetic polypeptide
DEEEIRTTNPVCTEHYGSVSMPNLTRGEAL

SEQ ID NO: 46606 - protein, 31 aa, Artificial Sequence
  Description of Artificial Sequence: Synthetic polypeptide
DEEEIRTTNPVCTEHYGSVSMPNLYQRGGDL

SEQ ID NO: 46607 - protein, 31 aa, Artificial Sequence
  Description of Artificial Sequence: Synthetic polypeptide
DEEEIRTTNPVCTEHYGSVSSPELQRFGSNL

SEQ ID NO: 46608 - protein, 32 aa, Artificial Sequence
  Description of Artificial Sequence: Synthetic polypeptide
DEEEIRTTNPVCTEHYGSVSTGPNDDQRDGNS

SEQ ID NO: 46609 - protein, 31 aa, Artificial Sequence
  Description of Artificial Sequence: Synthetic polypeptide
AEEEIRTTNPVATEQYGSVSTANENEGGTNQ

SEQ ID NO: 46610 - protein, 31 aa, Artificial Sequence
  Description of Artificial Sequence: Synthetic polypeptide
AEEEIRTTNPVATEQYGSVSTANGNEGGNQN

SEQ ID NO: 46611 - protein, 31 aa, Artificial Sequence
  Description of Artificial Sequence: Synthetic polypeptide
DEEEIRTTNPVCTEHYGSVSTGPNDQRDGDL

SEQ ID NO: 46612 - protein, 31 aa, Artificial Sequence
  Description of Artificial Sequence: Synthetic polypeptide
DEEEIRTTNPVCTEHYGSVSTMPNDDRGNEL

SEQ ID NO: 46613 - protein, 31 aa, Artificial Sequence
  Description of Artificial Sequence: Synthetic polypeptide
DSEEIRTTNPVAYEPYGVVPSTNELSARGNR

SEQ ID NO: 46614 - protein, 32 aa, Artificial Sequence
  Description of Artificial Sequence: Synthetic polypeptide
AEEEIRTTNPVATEQYGSVSTANGNEQGGNTE

SEQ ID NO: 46615 - protein, 31 aa, Artificial Sequence
  Description of Artificial Sequence: Synthetic polypeptide
DEEEIRTTNPVCTEHYGSVSGGNDDQRGGNL

SEQ ID NO: 46616 - protein, 32 aa, Artificial Sequence
  Description of Artificial Sequence: Synthetic polypeptide
DEEEIRTTNPVCTEHYGSVSCIPNLSQRGGNL

SEQ ID NO: 46617 - protein, 28 aa, Artificial Sequence
  Description of Artificial Sequence: Synthetic peptide
QEEEIATVNPVATEQYGVVSDCLQSGNL

SEQ ID NO: 46618 - protein, 31 aa, Artificial Sequence
  Description of Artificial Sequence: Synthetic polypeptide
DSEEIRTTNPVAYEQWGSVVSTGELQRGGTR

SEQ ID NO: 46619 - protein, 28 aa, Artificial Sequence
  Description of Artificial Sequence: Synthetic peptide
AENEIACTNPVATEQYGCHSENLQRGGR

SEQ ID NO: 46620 - protein, 31 aa, Artificial Sequence
  Description of Artificial Sequence: Synthetic polypeptide
DSEEIRTTNPVAYHQYGSVSTNEHQNGGNNR

SEQ ID NO: 46621 - protein, 32 aa, Artificial Sequence
  Description of Artificial Sequence: Synthetic polypeptide
DEEEIRTTNPVAYEWYGMSVSQNDLLQRGIER

SEQ ID NO: 46622 - protein, 32 aa, Artificial Sequence
  Description of Artificial Sequence: Synthetic polypeptide
DSEEIRTTNPVAYERYGQSVSTNSLSQRVGDR

SEQ ID NO: 46623 - protein, 32 aa, Artificial Sequence
  Description of Artificial Sequence: Synthetic polypeptide
DEEEIRTTNPVCTEAYGSVSDPNLQREGDNGE

SEQ ID NO: 46624 - protein, 32 aa, Artificial Sequence
  Description of Artificial Sequence: Synthetic polypeptide
DSEEIRTTNPVAYEQYGSTVPTNLSQRTGNNT

SEQ ID NO: 46625 - protein, 31 aa, Artificial Sequence
  Description of Artificial Sequence: Synthetic polypeptide
AEEEIRTTNPVATEQYGSVSTANANEEGGNE

SEQ ID NO: 46626 - protein, 31 aa, Artificial Sequence
  Description of Artificial Sequence: Synthetic polypeptide
DSEEIRTTNPVAYEPYGSVPFTNLSTRAGNR

SEQ ID NO: 46627 - protein, 32 aa, Artificial Sequence
  Description of Artificial Sequence: Synthetic polypeptide
DEEEIRTTNPVCTEAYGSVSDPNLQREGNNLE

SEQ ID NO: 46628 - protein, 31 aa, Artificial Sequence
  Description of Artificial Sequence: Synthetic polypeptide
AEEEIRTTNPVATEQYGSVSTANELGEGGGG

SEQ ID NO: 46629 - protein, 32 aa, Artificial Sequence
  Description of Artificial Sequence: Synthetic polypeptide
DEEEIRTTNPVCTEAYGSVVSDDPNLQREGNL

SEQ ID NO: 46630 - protein, 31 aa, Artificial Sequence
  Description of Artificial Sequence: Synthetic polypeptide
DEEEIRTTNPVCTEGYGSVSWPNLQNSGSNL

SEQ ID NO: 46631 - protein, 31 aa, Artificial Sequence
  Description of Artificial Sequence: Synthetic polypeptide
DSEEIRTTNPVAYEQWGSVVSTSLSQRGTTR

SEQ ID NO: 46632 - protein, 28 aa, Artificial Sequence
  Description of Artificial Sequence: Synthetic peptide
QEEEIATVNPVATEQYGVVPDNLQSGNK

SEQ ID NO: 46633 - protein, 30 aa, Artificial Sequence
  Description of Artificial Sequence: Synthetic polypeptide
DEEEIRTTNPVCTEHYGCVCSWGNLQNGNL

SEQ ID NO: 46634 - protein, 30 aa, Artificial Sequence
  Description of Artificial Sequence: Synthetic polypeptide
DEEEIRTTNPVCTEHYGCVSWPNHQRGNQS

SEQ ID NO: 46635 - protein, 28 aa, Artificial Sequence
  Description of Artificial Sequence: Synthetic peptide
QEEEIATVNPVATEQYGVVPDNLQHGNK

SEQ ID NO: 46636 - protein, 31 aa, Artificial Sequence
  Description of Artificial Sequence: Synthetic polypeptide
AEEEIRTTNPVATEQYGSVSTANGNSEGGNS

SEQ ID NO: 46637 - protein, 32 aa, Artificial Sequence
  Description of Artificial Sequence: Synthetic polypeptide
DEEEIRTTNPVCTEPYGSVSCPNLSQRGGNNL

SEQ ID NO: 46638 - protein, 32 aa, Artificial Sequence
  Description of Artificial Sequence: Synthetic polypeptide
DEEEIRTTNPVCTEPYGSVSIPNELSQRGGNL

SEQ ID NO: 46639 - protein, 31 aa, Artificial Sequence
  Description of Artificial Sequence: Synthetic polypeptide
AEEEIRTTNPVATEQYGSVSTANNNEGGNGQ

SEQ ID NO: 46640 - protein, 30 aa, Artificial Sequence
  Description of Artificial Sequence: Synthetic polypeptide
DEEEIRTTNPVGTEQWGSVSTNELGNGPPQ

SEQ ID NO: 46641 - protein, 29 aa, Artificial Sequence
  Description of Artificial Sequence: Synthetic peptide
SESEIRCTNPIATEGYGSVSETLQRVGNR

SEQ ID NO: 46642 - protein, 31 aa, Artificial Sequence
  Description of Artificial Sequence: Synthetic polypeptide
DEEEIRTTNPVGTEQWGSVSTNELGRGPPMD

SEQ ID NO: 46643 - protein, 30 aa, Artificial Sequence
  Description of Artificial Sequence: Synthetic polypeptide
DEEEIRTTNPVGTEQWGSVSTNMLSGRVSP

SEQ ID NO: 46644 - protein, 31 aa, Artificial Sequence
  Description of Artificial Sequence: Synthetic polypeptide
DEEEIRTTNPVGTEQWGTSVSTELGRDGNDS

SEQ ID NO: 46645 - protein, 32 aa, Artificial Sequence
  Description of Artificial Sequence: Synthetic polypeptide
AEEEIRTTNPVATEQYGSVSTANNNQEQGGNE

SEQ ID NO: 46646 - protein, 31 aa, Artificial Sequence
  Description of Artificial Sequence: Synthetic polypeptide
AEEEIRTTNPVATEQYGSVSTANNNEGGNEE

SEQ ID NO: 46647 - protein, 32 aa, Artificial Sequence
  Description of Artificial Sequence: Synthetic polypeptide
AEEEIRTTNPVATEQYGSVSTANNNQGNIGNE

SEQ ID NO: 46648 - protein, 31 aa, Artificial Sequence
  Description of Artificial Sequence: Synthetic polypeptide
AEEEIRTTNPVATEQYGSVSTANQNEGGNET

SEQ ID NO: 46649 - protein, 29 aa, Artificial Sequence
  Description of Artificial Sequence: Synthetic peptide
SESEIRCTNPIATECYGSVSCNEQREGNR

SEQ ID NO: 46650 - protein, 32 aa, Artificial Sequence
  Description of Artificial Sequence: Synthetic polypeptide
AEEEIRTTNPVATEQYGSVSTANQNQEGGNTE

SEQ ID NO: 46651 - protein, 31 aa, Artificial Sequence
  Description of Artificial Sequence: Synthetic polypeptide
AEEEIRTTNPVATEQYGSVSTANSNEGGGNE

SEQ ID NO: 46652 - protein, 31 aa, Artificial Sequence
  Description of Artificial Sequence: Synthetic polypeptide
DSEEIRTTNPVATHAYGSVSTNEVQNGGNNR

SEQ ID NO: 46653 - protein, 31 aa, Artificial Sequence
  Description of Artificial Sequence: Synthetic polypeptide
DEEEIRTTNPVGTEQYGCVCSTNELIRGSDQ

SEQ ID NO: 46654 - protein, 33 aa, Artificial Sequence
  Description of Artificial Sequence: Synthetic polypeptide
DSEEIRTTNPVATEQYGVVVPSCTNELSARGNR

SEQ ID NO: 46655 - protein, 28 aa, Artificial Sequence
  Description of Artificial Sequence: Synthetic peptide
QEEEIATVNPVATEQYGVVSDVLQHGNK

SEQ ID NO: 46656 - protein, 31 aa, Artificial Sequence
  Description of Artificial Sequence: Synthetic polypeptide
AEEEIRTTNPVATEQYGSVSTALQGTNENTA

SEQ ID NO: 46657 - protein, 32 aa, Artificial Sequence
  Description of Artificial Sequence: Synthetic polypeptide
DSEEIRTTNPVAYEAYGSVSTVNLSQREGEYR

SEQ ID NO: 46658 - protein, 28 aa, Artificial Sequence
  Description of Artificial Sequence: Synthetic peptide
SESEIRCTNPIATEQYGSMSENLMHGNR

SEQ ID NO: 46659 - protein, 31 aa, Artificial Sequence
  Description of Artificial Sequence: Synthetic polypeptide
DEEEIRTTNPVCTEPYGSVSMPNLSQTGGNL

SEQ ID NO: 46660 - protein, 28 aa, Artificial Sequence
  Description of Artificial Sequence: Synthetic peptide
SESEIRCTNPIATEQYGSMSSNLMHGNR

SEQ ID NO: 46661 - protein, 32 aa, Artificial Sequence
  Description of Artificial Sequence: Synthetic polypeptide
DEEEIRTTNPVCTESYGSVSEMVNTLQRGNEL

SEQ ID NO: 46662 - protein, 31 aa, Artificial Sequence
  Description of Artificial Sequence: Synthetic polypeptide
DEEEIRTTNPVCYEHYGSVSCQPNALQRGNL

SEQ ID NO: 46663 - protein, 31 aa, Artificial Sequence
  Description of Artificial Sequence: Synthetic polypeptide
AEEEIRTTNPVATEQYGSVSTANNAEGGNQG

SEQ ID NO: 46664 - protein, 31 aa, Artificial Sequence
  Description of Artificial Sequence: Synthetic polypeptide
AEEEIRTTNPVATEQYGSVSTANNDEGGNEI

SEQ ID NO: 46665 - protein, 31 aa, Artificial Sequence
  Description of Artificial Sequence: Synthetic polypeptide
AEEEIRTTNPVATEQYGSVSTANNDEGGNST

SEQ ID NO: 46666 - protein, 30 aa, Artificial Sequence
  Description of Artificial Sequence: Synthetic polypeptide
DEEEIRTTNPVGTEQWGSVSATGELGRGPP

SEQ ID NO: 46667 - protein, 31 aa, Artificial Sequence
  Description of Artificial Sequence: Synthetic polypeptide
AEEEIRTTNPVATEQYGSVSTANNEAGGNSG

SEQ ID NO: 46668 - protein, 31 aa, Artificial Sequence
  Description of Artificial Sequence: Synthetic polypeptide
AEEEIRTTNPVATEQYGSVSTANNEGGTNEQ

SEQ ID NO: 46669 - protein, 30 aa, Artificial Sequence
  Description of Artificial Sequence: Synthetic polypeptide
DEEEIRTTNPVGTEAYGSVSDGNGQTGENL

SEQ ID NO: 46670 - protein, 31 aa, Artificial Sequence
  Description of Artificial Sequence: Synthetic polypeptide
AEEEIRTTNPVATEQYGSVSTANNELGGNQA

SEQ ID NO: 46671 - protein, 31 aa, Artificial Sequence
  Description of Artificial Sequence: Synthetic polypeptide
DEEEIRTTNPVGTEFYGSVNMVNLQREGNEG

SEQ ID NO: 46672 - protein, 32 aa, Artificial Sequence
  Description of Artificial Sequence: Synthetic polypeptide
AEEEIRTTNPVATEQYGSVSTANNENQQTGNS

SEQ ID NO: 46673 - protein, 32 aa, Artificial Sequence
  Description of Artificial Sequence: Synthetic polypeptide
DEEEIRTTNPVGTEGYGSVVTMPNGLQREGNL

SEQ ID NO: 46674 - protein, 32 aa, Artificial Sequence
  Description of Artificial Sequence: Synthetic polypeptide
DEEEIRTTNPVGTEHYGSVSMPNLQQRGVNEN

SEQ ID NO: 46675 - protein, 31 aa, Artificial Sequence
  Description of Artificial Sequence: Synthetic polypeptide
AEEEIRTTNPVATEQYGSVSTANNEEGGNEV

SEQ ID NO: 46676 - protein, 31 aa, Artificial Sequence
  Description of Artificial Sequence: Synthetic polypeptide
DEEEIRTTNPVGTEQYGCVCSTNGLGRGSDA

SEQ ID NO: 46677 - protein, 32 aa, Artificial Sequence
  Description of Artificial Sequence: Synthetic polypeptide
DEEEIRTTNPVAYERYGSVACTPLSQRTGLNR

SEQ ID NO: 46678 - protein, 28 aa, Artificial Sequence
  Description of Artificial Sequence: Synthetic peptide
DSEEIRTTNPVCTEQWGMVSWPLQRGEH

SEQ ID NO: 46679 - protein, 32 aa, Artificial Sequence
  Description of Artificial Sequence: Synthetic polypeptide
DEEEIRTTNPVAYEQYGTISCTNNALQREGNN

SEQ ID NO: 46680 - protein, 32 aa, Artificial Sequence
  Description of Artificial Sequence: Synthetic polypeptide
DEEEIRTTNPVAYEQYGTISTGNSLSQRVGNN

SEQ ID NO: 46681 - protein, 30 aa, Artificial Sequence
  Description of Artificial Sequence: Synthetic polypeptide
SESEIRSTNPVATEQYGSVFTGNLQHGGNQ

SEQ ID NO: 46682 - protein, 32 aa, Artificial Sequence
  Description of Artificial Sequence: Synthetic polypeptide
DEEEIRTTNPVAYEQYGTSVSNNDGWQRGIDR

SEQ ID NO: 46683 - protein, 28 aa, Artificial Sequence
  Description of Artificial Sequence: Synthetic peptide
DSEEIRTTNPVGTEQWGMVSDNLQREVD

SEQ ID NO: 46684 - protein, 33 aa, Artificial Sequence
  Description of Artificial Sequence: Synthetic polypeptide
DEEEIRTTNPVAYEQYGTSVSQRNDDLQRGDGR

SEQ ID NO: 46685 - protein, 34 aa, Artificial Sequence
  Description of Artificial Sequence: Synthetic polypeptide
DEEEIRTTNPVAYEQYGTSVSQTNDDLQHRGIRR

SEQ ID NO: 46686 - protein, 33 aa, Artificial Sequence
  Description of Artificial Sequence: Synthetic polypeptide
DEEEIRTTNPVAYEQYGTSVSQTNDLLQDGIER

SEQ ID NO: 46687 - protein, 31 aa, Artificial Sequence
  Description of Artificial Sequence: Synthetic polypeptide
DSEEIRTTNPVGTEQWGMVPSTNLSQRGGGR

SEQ ID NO: 46688 - protein, 33 aa, Artificial Sequence
  Description of Artificial Sequence: Synthetic polypeptide
DEEEIRTTNPVAYEQYGTSVSQTNDPLQPGIRR

SEQ ID NO: 46689 - protein, 31 aa, Artificial Sequence
  Description of Artificial Sequence: Synthetic polypeptide
AEEEIRTTNPVATEQYGSVSSVNENQNTGNT

SEQ ID NO: 46690 - protein, 31 aa, Artificial Sequence
  Description of Artificial Sequence: Synthetic polypeptide
AEEEIRTTNPVATEQYGSVVSNNLGIGNNQN

SEQ ID NO: 46691 - protein, 31 aa, Artificial Sequence
  Description of Artificial Sequence: Synthetic polypeptide
DEEEIRTTNPVAYEQYGTVACTNLSTRDVNR

SEQ ID NO: 46692 - protein, 32 aa, Artificial Sequence
  Description of Artificial Sequence: Synthetic polypeptide
DEEEIRTTNPVAYEQYGTVACTPLSQRTGENR

SEQ ID NO: 46693 - protein, 31 aa, Artificial Sequence
  Description of Artificial Sequence: Synthetic polypeptide
DEEEIRTTNPVAYEQYGTVCSTIDHLQRENS

SEQ ID NO: 46694 - protein, 32 aa, Artificial Sequence
  Description of Artificial Sequence: Synthetic polypeptide
DEEEIRTTNPVAYEQYGTIPSTLELSQRGGNR

SEQ ID NO: 46695 - protein, 30 aa, Artificial Sequence
  Description of Artificial Sequence: Synthetic polypeptide
DEEEIRTTNPVAYEQYGTCSTINPLQDENS

SEQ ID NO: 46696 - protein, 30 aa, Artificial Sequence
  Description of Artificial Sequence: Synthetic polypeptide
DSEEIRTTNPVGTEQWGMVSTNLQGDGTER

SEQ ID NO: 46697 - protein, 30 aa, Artificial Sequence
  Description of Artificial Sequence: Synthetic polypeptide
DSEEIRTTNPVGTEQWGMVSTNLQGEGGQR

SEQ ID NO: 46698 - protein, 32 aa, Artificial Sequence
  Description of Artificial Sequence: Synthetic polypeptide
DEEEIRTTNPVAYEQYGSVWMTNLQGVFDGSR

SEQ ID NO: 46699 - protein, 33 aa, Artificial Sequence
  Description of Artificial Sequence: Synthetic polypeptide
AEEEIRTTNPVATEQYGSVSSTTNNLQQGTNAA

SEQ ID NO: 46700 - protein, 30 aa, Artificial Sequence
  Description of Artificial Sequence: Synthetic polypeptide
DEEEIRTTNPVAYEQYGSVWTELQYFDSDR

SEQ ID NO: 46701 - protein, 30 aa, Artificial Sequence
  Description of Artificial Sequence: Synthetic polypeptide
DEEEIRTTNPVAYEQYGSVWTGNLQNFDDA

SEQ ID NO: 46702 - protein, 28 aa, Artificial Sequence
  Description of Artificial Sequence: Synthetic peptide
AENEIACTNPVATEQWGEVSENLQRGGR

SEQ ID NO: 46703 - protein, 28 aa, Artificial Sequence
  Description of Artificial Sequence: Synthetic peptide
AENEIACTNPVATEQYGAASENLQRGGR

SEQ ID NO: 46704 - protein, 30 aa, Artificial Sequence
  Description of Artificial Sequence: Synthetic polypeptide
DEEEIRTTNPVAYEQYGSVWTNLQHFDDQP

SEQ ID NO: 46705 - protein, 29 aa, Artificial Sequence
  Description of Artificial Sequence: Synthetic peptide
SESEIRSTNPIATEQYGSVSETLMRVGNR

SEQ ID NO: 46706 - protein, 30 aa, Artificial Sequence
  Description of Artificial Sequence: Synthetic polypeptide
DSEEIRTTNPVGTEQWGMVSTNLQREVQRI

SEQ ID NO: 46707 - protein, 29 aa, Artificial Sequence
  Description of Artificial Sequence: Synthetic peptide
DEEEIRTTNPVAYEQYGSVWTNLTVFDSF

SEQ ID NO: 46708 - protein, 30 aa, Artificial Sequence
  Description of Artificial Sequence: Synthetic polypeptide
DEEEIRTTNPVAYEQYGSVWTNPLQVEDSD

SEQ ID NO: 46709 - protein, 32 aa, Artificial Sequence
  Description of Artificial Sequence: Synthetic polypeptide
AEEEIRTTNPVATEQYGSVSSTTNNQIGNNTQ

SEQ ID NO: 46710 - protein, 32 aa, Artificial Sequence
  Description of Artificial Sequence: Synthetic polypeptide
AEEEIRTTNPVATEQYGSVSSTTNNQQIGNTT

SEQ ID NO: 46711 - protein, 32 aa, Artificial Sequence
  Description of Artificial Sequence: Synthetic polypeptide
AEEEIRTTNPVATEQYGSVSSTTNQNQIGNTT

SEQ ID NO: 46712 - protein, 32 aa, Artificial Sequence
  Description of Artificial Sequence: Synthetic polypeptide
AEEEIRTTNPVATEQYGSVSSTTNQQEGTNVA

SEQ ID NO: 46713 - protein, 31 aa, Artificial Sequence
  Description of Artificial Sequence: Synthetic polypeptide
DEEEIRTTNPVAYEQYGSYNTVNLNERFGNA

SEQ ID NO: 46714 - protein, 32 aa, Artificial Sequence
  Description of Artificial Sequence: Synthetic polypeptide
AEEEIRTTNPVATEQYGSVSSTTNNQGQGNLT

SEQ ID NO: 46715 - protein, 30 aa, Artificial Sequence
  Description of Artificial Sequence: Synthetic polypeptide
DSEEIRTTNPVGTEQWGMIVSTNLQGGPER

SEQ ID NO: 46716 - protein, 34 aa, Artificial Sequence
  Description of Artificial Sequence: Synthetic polypeptide
DEEEIRTTNPVAYEQYGTVTPSCTNELSQRGGNR

SEQ ID NO: 46717 - protein, 33 aa, Artificial Sequence
  Description of Artificial Sequence: Synthetic polypeptide
DEEEIRTTNPVAYEQYGTVVSQTNDDLQRGDRR

SEQ ID NO: 46718 - protein, 32 aa, Artificial Sequence
  Description of Artificial Sequence: Synthetic polypeptide
DEEEIRTTNPVAYEQYGVSVSTNDLLDEGIRR

SEQ ID NO: 46719 - protein, 30 aa, Artificial Sequence
  Description of Artificial Sequence: Synthetic polypeptide
DSEEIRTTNPVGTEQWGCVCSTNLQGGVRG

SEQ ID NO: 46720 - protein, 32 aa, Artificial Sequence
  Description of Artificial Sequence: Synthetic polypeptide
AEEEIRTTNPVATEQYGSVSSVTNLQVNNGTI

SEQ ID NO: 46721 - protein, 28 aa, Artificial Sequence
  Description of Artificial Sequence: Synthetic peptide
QEEEIATVNPVATEQYGDVSECLQHGNL

SEQ ID NO: 46722 - protein, 29 aa, Artificial Sequence
  Description of Artificial Sequence: Synthetic peptide
SESEIRCTNPISTEQYGSVSAENLMRGNR

SEQ ID NO: 46723 - protein, 30 aa, Artificial Sequence
  Description of Artificial Sequence: Synthetic polypeptide
SESEIRCTNPIATEQYGSVSENLPMDRGNR

SEQ ID NO: 46724 - protein, 32 aa, Artificial Sequence
  Description of Artificial Sequence: Synthetic polypeptide
DEEEIRTTNPVAYEQYGVVVSQNNLLQRGERR

SEQ ID NO: 46725 - protein, 33 aa, Artificial Sequence
  Description of Artificial Sequence: Synthetic polypeptide
DEEEIRTTNPVAYEQYGVSVSQTNDLGQNGIRR

SEQ ID NO: 46726 - protein, 31 aa, Artificial Sequence
  Description of Artificial Sequence: Synthetic polypeptide
AEEEIRTTNPVATEQYGSVVNTNNQNGNGVG

SEQ ID NO: 46727 - protein, 30 aa, Artificial Sequence
  Description of Artificial Sequence: Synthetic polypeptide
DSEEIRTTNPVGTEAWGMVSTNLSQRGGPR

SEQ ID NO: 46728 - protein, 28 aa, Artificial Sequence
  Description of Artificial Sequence: Synthetic peptide
SESEIRCTNPIATEQYGSVSENLMHGDR

SEQ ID NO: 46729 - protein, 32 aa, Artificial Sequence
  Description of Artificial Sequence: Synthetic polypeptide
DEEEIRTTNPVAYEQYGYSVSQNDALQEGVER

SEQ ID NO: 46730 - protein, 32 aa, Artificial Sequence
  Description of Artificial Sequence: Synthetic polypeptide
AEEEIRTTNPVATEQYGSVSSVTNNQQQGNNS

SEQ ID NO: 46731 - protein, 31 aa, Artificial Sequence
  Description of Artificial Sequence: Synthetic polypeptide
DEEEIRTTNPVAYERYGISVHQNLSDRVGNR

SEQ ID NO: 46732 - protein, 30 aa, Artificial Sequence
  Description of Artificial Sequence: Synthetic polypeptide
SESEIRCTNPIATEQYGSVSENLMDRGENR

SEQ ID NO: 46733 - protein, 30 aa, Artificial Sequence
  Description of Artificial Sequence: Synthetic polypeptide
AEEEIRTTNPVATEQYGSVSTAGGTGGNNA

SEQ ID NO: 46734 - protein, 32 aa, Artificial Sequence
  Description of Artificial Sequence: Synthetic polypeptide
DEEEIRTTNPVAYEQYGVVVTNNDLLQRGIIR

SEQ ID NO: 46735 - protein, 32 aa, Artificial Sequence
  Description of Artificial Sequence: Synthetic polypeptide
DEEEIRTTNPVAYERYGSTVSCTNSQSGNNRK

SEQ ID NO: 46736 - protein, 33 aa, Artificial Sequence
  Description of Artificial Sequence: Synthetic polypeptide
DEEEIRTTNPVAYEQYGVSVSQPNDLLQRGIRR

SEQ ID NO: 46737 - protein, 33 aa, Artificial Sequence
  Description of Artificial Sequence: Synthetic polypeptide
DEEEIRTTNPVAYEQYGVSVSQNDLLQDRGIGR

SEQ ID NO: 46738 - protein, 32 aa, Artificial Sequence
  Description of Artificial Sequence: Synthetic polypeptide
DEEEIRTTNPVAYEQYGTVVSTNDLLQNGIER

SEQ ID NO: 46739 - protein, 32 aa, Artificial Sequence
  Description of Artificial Sequence: Synthetic polypeptide
DEEEIRTTNPVAYEQYGVSHSQNDGLQRGDHR

SEQ ID NO: 46740 - protein, 32 aa, Artificial Sequence
  Description of Artificial Sequence: Synthetic polypeptide
DEEEIRTTNPVAYEQYGVSHSQNDLLQRGGDR

SEQ ID NO: 46741 - protein, 28 aa, Artificial Sequence
  Description of Artificial Sequence: Synthetic peptide
SESEIRCTNPVGTEQYGVMASNLQRGNR

SEQ ID NO: 46742 - protein, 32 aa, Artificial Sequence
  Description of Artificial Sequence: Synthetic polypeptide
AEEEIRTTNPVATEQYGSVSSVTNGNQGGNSG

SEQ ID NO: 46743 - protein, 28 aa, Artificial Sequence
  Description of Artificial Sequence: Synthetic peptide
AENEIACTNPVATEQYGCASENLQRGGR

SEQ ID NO: 46744 - protein, 32 aa, Artificial Sequence
  Description of Artificial Sequence: Synthetic polypeptide
DEEEIRTTNPVAYEQYGVSVLTDDLHQRGDRR

SEQ ID NO: 46745 - protein, 32 aa, Artificial Sequence
  Description of Artificial Sequence: Synthetic polypeptide
DEEEIRTTNPVAYEQYGVSVSQNDLLQEGIDR

SEQ ID NO: 46746 - protein, 30 aa, Artificial Sequence
  Description of Artificial Sequence: Synthetic polypeptide
DSEEIRTTNPVGTEQWGCVSTNLSQEGGVR

SEQ ID NO: 46747 - protein, 29 aa, Artificial Sequence
  Description of Artificial Sequence: Synthetic peptide
AENEIACTNPVATEQYGCASSNLQRGNGR

SEQ ID NO: 46748 - protein, 33 aa, Artificial Sequence
  Description of Artificial Sequence: Synthetic polypeptide
AEEEIRTTNPVATEQYGSVSSVTNLQGNLGING

SEQ ID NO: 46749 - protein, 32 aa, Artificial Sequence
  Description of Artificial Sequence: Synthetic polypeptide
DEEEIRTTNPVAYEQYGVSVSQDDLLQRGERR

SEQ ID NO: 46750 - protein, 30 aa, Artificial Sequence
  Description of Artificial Sequence: Synthetic polypeptide
DSEEIRTTNPVGTEQWGCVSTNLQRSGSVF

SEQ ID NO: 46751 - protein, 33 aa, Artificial Sequence
  Description of Artificial Sequence: Synthetic polypeptide
DEEEIRTTNPVAYEQYGVSVSQLNDGLQRGERR

SEQ ID NO: 46752 - protein, 33 aa, Artificial Sequence
  Description of Artificial Sequence: Synthetic polypeptide
DEEEIRTTNPVAYEQYGVSVSQNDLDQRGGQRR

SEQ ID NO: 46753 - protein, 29 aa, Artificial Sequence
  Description of Artificial Sequence: Synthetic peptide
DSEEIRTTNPVGTEQWGCVSTNLQREVYQ

SEQ ID NO: 46754 - protein, 34 aa, Artificial Sequence
  Description of Artificial Sequence: Synthetic polypeptide
DEEEIRTTNPVAYEQYGVSVSATNDLGQPRGPAR

SEQ ID NO: 46755 - protein, 33 aa, Artificial Sequence
  Description of Artificial Sequence: Synthetic polypeptide
DEEEIVATTNPVAYEQWGSVSCTNLDQRTGGNR

SEQ ID NO: 46756 - protein, 30 aa, Artificial Sequence
  Description of Artificial Sequence: Synthetic polypeptide
DEEEIRTTNPVGTEQYGCVSTNAHGRGSEQ

SEQ ID NO: 46757 - protein, 34 aa, Artificial Sequence
  Description of Artificial Sequence: Synthetic polypeptide
DSEEIRTTNPVATEQYGSVVPSCTGNLSGRGNMR

SEQ ID NO: 46758 - protein, 32 aa, Artificial Sequence
  Description of Artificial Sequence: Synthetic polypeptide
DSEEIRTTNPLATEAYGSVPSFNELSQREGNR

SEQ ID NO: 46759 - protein, 32 aa, Artificial Sequence
  Description of Artificial Sequence: Synthetic polypeptide
AEEEIRTTNPVATEQYGSVSTGNQQEDEGNNV

SEQ ID NO: 46760 - protein, 32 aa, Artificial Sequence
  Description of Artificial Sequence: Synthetic polypeptide
AEEEIRTTNPVATEQYGSVSTGNQQGTDEGNN

SEQ ID NO: 46761 - protein, 28 aa, Artificial Sequence
  Description of Artificial Sequence: Synthetic peptide
SENEIRTTNPIATEQYGSVSENLMREDA

SEQ ID NO: 46762 - protein, 32 aa, Artificial Sequence
  Description of Artificial Sequence: Synthetic polypeptide
AEEEIRTTNPVATEQYGSVSTGNQQQGIETNL

SEQ ID NO: 46763 - protein, 32 aa, Artificial Sequence
  Description of Artificial Sequence: Synthetic polypeptide
DSEEIRTTNPIATEHYGSVSCQNELSQREGNR

SEQ ID NO: 46764 - protein, 29 aa, Artificial Sequence
  Description of Artificial Sequence: Synthetic peptide
DEEEIRTTNPVSTEQYGSVTDGNLTGGQT

SEQ ID NO: 46765 - protein, 29 aa, Artificial Sequence
  Description of Artificial Sequence: Synthetic peptide
DEEEIRTTNPVSTEQYGSVTDNGQGGQEQ

SEQ ID NO: 46766 - protein, 29 aa, Artificial Sequence
  Description of Artificial Sequence: Synthetic peptide
DEEEIRTTNPVSTEQYGSVTDNGQGGQGG

SEQ ID NO: 46767 - protein, 29 aa, Artificial Sequence
  Description of Artificial Sequence: Synthetic peptide
SENEIRTTNPIATEQYGSVSENEMNRENR

SEQ ID NO: 46768 - protein, 30 aa, Artificial Sequence
  Description of Artificial Sequence: Synthetic polypeptide
DEEEIRTTNPVSTEQYGSVTDNGQGGQNTD

SEQ ID NO: 46769 - protein, 31 aa, Artificial Sequence
  Description of Artificial Sequence: Synthetic polypeptide
DSEEIRTTNPCAYEHYGSVSCNELSQREGNR

SEQ ID NO: 46770 - protein, 30 aa, Artificial Sequence
  Description of Artificial Sequence: Synthetic polypeptide
SENEIRTTNPIATEPYGSVSMEDLMQRGNR

SEQ ID NO: 46771 - protein, 30 aa, Artificial Sequence
  Description of Artificial Sequence: Synthetic polypeptide
DEEEIRTTNPVSTEQYGSVTFNDLQGGGTQ

SEQ ID NO: 46772 - protein, 29 aa, Artificial Sequence
  Description of Artificial Sequence: Synthetic peptide
SENEIRCTNPVATEQYGSVSENLMAAGDR

SEQ ID NO: 46773 - protein, 31 aa, Artificial Sequence
  Description of Artificial Sequence: Synthetic polypeptide
SENEIRTTNPVATEPYGSVSMEDLQQQRGNR

SEQ ID NO: 46774 - protein, 30 aa, Artificial Sequence
  Description of Artificial Sequence: Synthetic polypeptide
QEEEICTTNPVATEPYGSVSANLERGDNTP

SEQ ID NO: 46775 - protein, 30 aa, Artificial Sequence
  Description of Artificial Sequence: Synthetic polypeptide
QEEEICTTNPVATEPYGSVATNLQQGESRD

SEQ ID NO: 46776 - protein, 32 aa, Artificial Sequence
  Description of Artificial Sequence: Synthetic polypeptide
DEEEIRTTNPVSTEQYGSVSTPAGQNQRNGNV

SEQ ID NO: 46777 - protein, 32 aa, Artificial Sequence
  Description of Artificial Sequence: Synthetic polypeptide
AEEEIRTTNPVATEQYGSVSTENNNQQNGNTS

SEQ ID NO: 46778 - protein, 32 aa, Artificial Sequence
  Description of Artificial Sequence: Synthetic polypeptide
DSEEIRTTNPVATEAWGCQVSTNALSQRGGNR

SEQ ID NO: 46779 - protein, 30 aa, Artificial Sequence
  Description of Artificial Sequence: Synthetic polypeptide
DEEEIRTTNPVSTEQYGSVITDNDGQGGQT

SEQ ID NO: 46780 - protein, 30 aa, Artificial Sequence
  Description of Artificial Sequence: Synthetic polypeptide
DEEEIRTTNPVSTEQYGSVNTNFLGRSSEP

SEQ ID NO: 46781 - protein, 31 aa, Artificial Sequence
  Description of Artificial Sequence: Synthetic polypeptide
SENEIRTTNPVATESYGSVSNTDNLERGDQR

SEQ ID NO: 46782 - protein, 29 aa, Artificial Sequence
  Description of Artificial Sequence: Synthetic peptide
SENEIRTTNPVATEQYGTISEDLQQQGNR

SEQ ID NO: 46783 - protein, 31 aa, Artificial Sequence
  Description of Artificial Sequence: Synthetic polypeptide
QEEEICTTNPVATEMYGSVSTNLQDHGNDAM

SEQ ID NO: 46784 - protein, 31 aa, Artificial Sequence
  Description of Artificial Sequence: Synthetic polypeptide
AEEEIRTTNPVATEQYGSVSTINNGTNDGNT

SEQ ID NO: 46785 - protein, 30 aa, Artificial Sequence
  Description of Artificial Sequence: Synthetic polypeptide
DEEEIRTTNPVSTEQYGSVPFNLQVQGAQT

SEQ ID NO: 46786 - protein, 32 aa, Artificial Sequence
  Description of Artificial Sequence: Synthetic polypeptide
AEEEIRTTNPVATEQYGSVSTENQNQQIGNNS

SEQ ID NO: 46787 - protein, 32 aa, Artificial Sequence
  Description of Artificial Sequence: Synthetic polypeptide
AEEEIRTTNPVATEQYGSVSTENQNQQNGNNS

SEQ ID NO: 46788 - protein, 30 aa, Artificial Sequence
  Description of Artificial Sequence: Synthetic polypeptide
DEEEIRTTNPVSTEQYGSVSTENDLGAVIP

SEQ ID NO: 46789 - protein, 31 aa, Artificial Sequence
  Description of Artificial Sequence: Synthetic polypeptide
DEEEIRTTNPVSTEQYGSVSTNFLPDVNLFP

SEQ ID NO: 46790 - protein, 31 aa, Artificial Sequence
  Description of Artificial Sequence: Synthetic polypeptide
DEEEIRTTNPVSTEQYGSVSTNFLVDSGQFP

SEQ ID NO: 46791 - protein, 30 aa, Artificial Sequence
  Description of Artificial Sequence: Synthetic polypeptide
SENEIRTTNPVATEQYGSVSEILMNRAGDR

SEQ ID NO: 46792 - protein, 32 aa, Artificial Sequence
  Description of Artificial Sequence: Synthetic polypeptide
DEEEIRTTNPVSTEQYGSVSTPAGPNQRNGNV

SEQ ID NO: 46793 - protein, 31 aa, Artificial Sequence
  Description of Artificial Sequence: Synthetic polypeptide
DSEEIRTTNPTAYEEYGSVSCINLSQRPGNR

SEQ ID NO: 46794 - protein, 32 aa, Artificial Sequence
  Description of Artificial Sequence: Synthetic polypeptide
AEEEIRTTNPVATEQYGSVSTLLQTNGGNNNN

SEQ ID NO: 46795 - protein, 32 aa, Artificial Sequence
  Description of Artificial Sequence: Synthetic polypeptide
AEEEIRTTNPVATEQYGSVSTLNQQQANGNNV

SEQ ID NO: 46796 - protein, 29 aa, Artificial Sequence
  Description of Artificial Sequence: Synthetic peptide
DEEEIRTTNPVSTEQYGSVTFNDQQGGQP

SEQ ID NO: 46797 - protein, 29 aa, Artificial Sequence
  Description of Artificial Sequence: Synthetic peptide
SENEIRCTNPIATEQYGSVSENEMRAGNR

SEQ ID NO: 46798 - protein, 30 aa, Artificial Sequence
  Description of Artificial Sequence: Synthetic polypeptide
QEEEICTTNPVATEQYGSVAAGNLQSENRE

SEQ ID NO: 46799 - protein, 28 aa, Artificial Sequence
  Description of Artificial Sequence: Synthetic peptide
SENEIRCTNPIATEQYGSVSENEMAGNR

SEQ ID NO: 46800 - protein, 30 aa, Artificial Sequence
  Description of Artificial Sequence: Synthetic polypeptide
DEEEIRTTNPVSTEQYGSVTPWNLQQGQPT

SEQ ID NO: 46801 - protein, 31 aa, Artificial Sequence
  Description of Artificial Sequence: Synthetic polypeptide
DSEEIRSTNPVAYEQWGSVSTNLQARTGGQR

SEQ ID NO: 46802 - protein, 30 aa, Artificial Sequence
  Description of Artificial Sequence: Synthetic polypeptide
DEEEIRTTNPVSTEQYGSVTQFNLQQGEQD

SEQ ID NO: 46803 - protein, 29 aa, Artificial Sequence
  Description of Artificial Sequence: Synthetic peptide
DEEEIRTTNPVSTEQYGSVTQFNLQQQVT

SEQ ID NO: 46804 - protein, 30 aa, Artificial Sequence
  Description of Artificial Sequence: Synthetic polypeptide
QEEEICTTNPVATEQYGNVSVTMLQGGNES

SEQ ID NO: 46805 - protein, 31 aa, Artificial Sequence
  Description of Artificial Sequence: Synthetic polypeptide
DEEEIRTTNPVSTEQYGSVTSFNDLQGGQSE

SEQ ID NO: 46806 - protein, 30 aa, Artificial Sequence
  Description of Artificial Sequence: Synthetic polypeptide
DEEEIRTTNPVSTEQYGSVTSNLQEGFGQQ

SEQ ID NO: 46807 - protein, 29 aa, Artificial Sequence
  Description of Artificial Sequence: Synthetic peptide
DEEEIRTTNPVSTEQYGSVTVNGQEGGQT

SEQ ID NO: 46808 - protein, 30 aa, Artificial Sequence
  Description of Artificial Sequence: Synthetic polypeptide
DEEEIRTTNPVSTEQYGSVTVNLQNGGQGT

SEQ ID NO: 46809 - protein, 30 aa, Artificial Sequence
  Description of Artificial Sequence: Synthetic polypeptide
DEEEIRTTNPVSTEQYGSVVFNLSQGGGST

SEQ ID NO: 46810 - protein, 30 aa, Artificial Sequence
  Description of Artificial Sequence: Synthetic polypeptide
DEEEIRTTNPVSTEQYGSVVNFNLQGGGST

SEQ ID NO: 46811 - protein, 31 aa, Artificial Sequence
  Description of Artificial Sequence: Synthetic polypeptide
QEEEICTTNPVATEQYGSVAANLQREGNAQV

SEQ ID NO: 46812 - protein, 30 aa, Artificial Sequence
  Description of Artificial Sequence: Synthetic polypeptide
DEEEIRTTNPVSTEQYGSVVNTDNGQGGQT

SEQ ID NO: 46813 - protein, 29 aa, Artificial Sequence
  Description of Artificial Sequence: Synthetic peptide
DEEEIRTTNPVSTEQYGSVTSNGLQGEQT

SEQ ID NO: 46814 - protein, 32 aa, Artificial Sequence
  Description of Artificial Sequence: Synthetic polypeptide
AEEEIRTTNPVATEQYGSVSTENNNQQGIGNS

SEQ ID NO: 46815 - protein, 29 aa, Artificial Sequence
  Description of Artificial Sequence: Synthetic peptide
SENEIRCTNPIATEQYGSVSENLMRAGDR

SEQ ID NO: 46816 - protein, 30 aa, Artificial Sequence
  Description of Artificial Sequence: Synthetic polypeptide
DEEEIRTTNPVSTEQYGSVTPFNLQVGSQT

SEQ ID NO: 46817 - protein, 30 aa, Artificial Sequence
  Description of Artificial Sequence: Synthetic polypeptide
DEEEIRTTNPVSTEQYGSVTFNLGQTGSQT

SEQ ID NO: 46818 - protein, 29 aa, Artificial Sequence
  Description of Artificial Sequence: Synthetic peptide
QEEEICTTNPVATEQYGNVSVTMLQGGEH

SEQ ID NO: 46819 - protein, 32 aa, Artificial Sequence
  Description of Artificial Sequence: Synthetic polypeptide
DSEEIRSTNPVAYEQYGSVSTNALQARNGGER

SEQ ID NO: 46820 - protein, 29 aa, Artificial Sequence
  Description of Artificial Sequence: Synthetic peptide
DEEEIRTTNPVSTEQYGSVTFNLQGEDQT

SEQ ID NO: 46821 - protein, 31 aa, Artificial Sequence
  Description of Artificial Sequence: Synthetic polypeptide
AEEEIRTTNPVATEQYGSVSTLNQQQGVGIN

SEQ ID NO: 46822 - protein, 30 aa, Artificial Sequence
  Description of Artificial Sequence: Synthetic polypeptide
DEEEIRTTNPVSTEQYGSVTFNLQGGQDTF

SEQ ID NO: 46823 - protein, 31 aa, Artificial Sequence
  Description of Artificial Sequence: Synthetic polypeptide
AEEEIRTTNPVATEQYGSVSTLNQQQVEGIN

SEQ ID NO: 46824 - protein, 28 aa, Artificial Sequence
  Description of Artificial Sequence: Synthetic peptide
SENEIRCTNPIATEQYGSVSENLMREDR

SEQ ID NO: 46825 - protein, 31 aa, Artificial Sequence
  Description of Artificial Sequence: Synthetic polypeptide
AEEEIRTTNPVATEQYGSVSTLQQLNGNNTT

SEQ ID NO: 46826 - protein, 31 aa, Artificial Sequence
  Description of Artificial Sequence: Synthetic polypeptide
AEEEIRTTNPVATEQYGSVSTNALGTEGGGG

SEQ ID NO: 46827 - protein, 31 aa, Artificial Sequence
  Description of Artificial Sequence: Synthetic polypeptide
DSEEIRSTNPVAYEQYGSVISTNVSQRGGNQ

SEQ ID NO: 46828 - protein, 30 aa, Artificial Sequence
  Description of Artificial Sequence: Synthetic polypeptide
DEEEIRTTNPVSTEQYGSVTGDNHQRGGQQ

SEQ ID NO: 46829 - protein, 30 aa, Artificial Sequence
  Description of Artificial Sequence: Synthetic polypeptide
DEEEIRTTNPVSTEQYGSVTGDNLGQGGQT

SEQ ID NO: 46830 - protein, 29 aa, Artificial Sequence
  Description of Artificial Sequence: Synthetic peptide
DEEEIRTTNPVSTEQYGSVTGDNMQGGTT

SEQ ID NO: 46831 - protein, 31 aa, Artificial Sequence
  Description of Artificial Sequence: Synthetic polypeptide
DSEEIRSTNPVAYEQYGSVISTNDSQRGNNE

SEQ ID NO: 46832 - protein, 28 aa, Artificial Sequence
  Description of Artificial Sequence: Synthetic peptide
SENEIRCTNPIATEQYGSVSENLMRENL

SEQ ID NO: 46833 - protein, 31 aa, Artificial Sequence
  Description of Artificial Sequence: Synthetic polypeptide
AEEEIRTTNPVATEQYGSVSTMNQQQGIETT

SEQ ID NO: 46834 - protein, 32 aa, Artificial Sequence
  Description of Artificial Sequence: Synthetic polypeptide
DSEEIRTTNPVATEQYGVVPSCTNSSARGNNR

SEQ ID NO: 46835 - protein, 28 aa, Artificial Sequence
  Description of Artificial Sequence: Synthetic peptide
SENEISCTNPVATEQYGEASENLQRGGR

SEQ ID NO: 46836 - protein, 33 aa, Artificial Sequence
  Description of Artificial Sequence: Synthetic polypeptide
AEEEIRTTNPVATEQYGSVSTENNLQQNNGNEQ

SEQ ID NO: 46837 - protein, 32 aa, Artificial Sequence
  Description of Artificial Sequence: Synthetic polypeptide
DEEEIRTTNPVGTEQYGSVSTNGLGEGGGQNT

SEQ ID NO: 46838 - protein, 31 aa, Artificial Sequence
  Description of Artificial Sequence: Synthetic polypeptide
DEEEIRTTNPVGTEQYGSVSTNGLGEQGDTP

SEQ ID NO: 46839 - protein, 31 aa, Artificial Sequence
  Description of Artificial Sequence: Synthetic polypeptide
AEEEIRTTNPVATEQYGSVSTDNGNDGGNTT

SEQ ID NO: 46840 - protein, 31 aa, Artificial Sequence
  Description of Artificial Sequence: Synthetic polypeptide
DEEEIRTTNPVGTEQYGSVSTNGQGEGGFDE

SEQ ID NO: 46841 - protein, 31 aa, Artificial Sequence
  Description of Artificial Sequence: Synthetic polypeptide
DSEEIRTTNPVATEQYGSTVSTNHSGGGGNM

SEQ ID NO: 46842 - protein, 30 aa, Artificial Sequence
  Description of Artificial Sequence: Synthetic polypeptide
DEEEIRTTNPVGTEQYGSVSWNDLGTGGDP

SEQ ID NO: 46843 - protein, 30 aa, Artificial Sequence
  Description of Artificial Sequence: Synthetic polypeptide
DEEEIRTTNPVGTEQYGSVSWNDNGPRGDP

SEQ ID NO: 46844 - protein, 29 aa, Artificial Sequence
  Description of Artificial Sequence: Synthetic peptide
SESEIACTNPIATEQYGNVSENLQSRGNR

SEQ ID NO: 46845 - protein, 31 aa, Artificial Sequence
  Description of Artificial Sequence: Synthetic polypeptide
DEEEIRTTNPVGTEQYGSVSWNEGEGRGNDP

SEQ ID NO: 46846 - protein, 34 aa, Artificial Sequence
  Description of Artificial Sequence: Synthetic polypeptide
DSEEIRTTNPVATEQYGSTCSCTGNELSQRGGNR

SEQ ID NO: 46847 - protein, 29 aa, Artificial Sequence
  Description of Artificial Sequence: Synthetic peptide
DEEEIRTTNPVGTEQYGSVSWNEGGHGDP

SEQ ID NO: 46848 - protein, 31 aa, Artificial Sequence
  Description of Artificial Sequence: Synthetic polypeptide
AEEEIRTTNPVATEQYGSVSTDNGNNDGNTQ

SEQ ID NO: 46849 - protein, 31 aa, Artificial Sequence
  Description of Artificial Sequence: Synthetic polypeptide
AEEEIRTTNPVATEQYGSVSTDNGNTDGNET

SEQ ID NO: 46850 - protein, 31 aa, Artificial Sequence
  Description of Artificial Sequence: Synthetic polypeptide
DEEEIRTTNPVGTEQYGSVSWNEQDGREGGQ

SEQ ID NO: 46851 - protein, 31 aa, Artificial Sequence
  Description of Artificial Sequence: Synthetic polypeptide
DEEEIRTTNPVGTEQYGSVVSTNALSGRVDP

SEQ ID NO: 46852 - protein, 31 aa, Artificial Sequence
  Description of Artificial Sequence: Synthetic polypeptide
DEEEIRTTNPVGTEQYGSVSTNGLGEGGFQG

SEQ ID NO: 46853 - protein, 28 aa, Artificial Sequence
  Description of Artificial Sequence: Synthetic peptide
SESEIACTNPIATEQYGSVSETLQRGQR

SEQ ID NO: 46854 - protein, 29 aa, Artificial Sequence
  Description of Artificial Sequence: Synthetic peptide
DEEEIRTTNPVGTEQYGSVSTNFTGTDFP

SEQ ID NO: 46855 - protein, 30 aa, Artificial Sequence
  Description of Artificial Sequence: Synthetic polypeptide
DEEEIRTTNPVGTEQYGSVSTNFNGEGDFP

SEQ ID NO: 46856 - protein, 32 aa, Artificial Sequence
  Description of Artificial Sequence: Synthetic polypeptide
DSEEIRTTNPVATEQYGSVSCTNLSQIVENNP

SEQ ID NO: 46857 - protein, 31 aa, Artificial Sequence
  Description of Artificial Sequence: Synthetic polypeptide
DEEEIRTTNPVGTEQYGSVCSTEDLGRGSDA

SEQ ID NO: 46858 - protein, 29 aa, Artificial Sequence
  Description of Artificial Sequence: Synthetic peptide
SESEIACTNPVATEQYGNVAENLQSRGNR

SEQ ID NO: 46859 - protein, 31 aa, Artificial Sequence
  Description of Artificial Sequence: Synthetic polypeptide
AEEEIRTTNPVATEQYGSVVNSTNNQNGEIG

SEQ ID NO: 46860 - protein, 32 aa, Artificial Sequence
  Description of Artificial Sequence: Synthetic polypeptide
DEEEIRTTNPVGTEQYGSVSCTNMLSGRVGDP

SEQ ID NO: 46861 - protein, 31 aa, Artificial Sequence
  Description of Artificial Sequence: Synthetic polypeptide
DEEEIRTTNPVGTEQYGSVSITNGLGEGETP

SEQ ID NO: 46862 - protein, 32 aa, Artificial Sequence
  Description of Artificial Sequence: Synthetic polypeptide
DEEEIRTTNPVGTEQYGSVSPTNMLIERGEFP

SEQ ID NO: 46863 - protein, 32 aa, Artificial Sequence
  Description of Artificial Sequence: Synthetic polypeptide
AEEEIRTTNPVATEQYGSVVNSTNLQLNNNND

SEQ ID NO: 46864 - protein, 31 aa, Artificial Sequence
  Description of Artificial Sequence: Synthetic polypeptide
DEEEIRTTNPVGTEQYGSVSPTNWLSEVGFP

SEQ ID NO: 46865 - protein, 33 aa, Artificial Sequence
  Description of Artificial Sequence: Synthetic polypeptide
AEEEIRTTNPVATEQYGSVVNSTNLQQGNTNNM

SEQ ID NO: 46866 - protein, 30 aa, Artificial Sequence
  Description of Artificial Sequence: Synthetic polypeptide
AEEEIRTTNPVATEQYGSVSTDLNGTDGGG

SEQ ID NO: 46867 - protein, 31 aa, Artificial Sequence
  Description of Artificial Sequence: Synthetic polypeptide
DEEEIRTTNPVGTEQYGSVSTENGLGGGQGP

SEQ ID NO: 46868 - protein, 32 aa, Artificial Sequence
  Description of Artificial Sequence: Synthetic polypeptide
AEEEIRTTNPVATEQYGSVSTDNENQNQTGNT

SEQ ID NO: 46869 - protein, 31 aa, Artificial Sequence
  Description of Artificial Sequence: Synthetic polypeptide
AEEEIRTTNPVATEQYGSVSTDNGENDEGNT

SEQ ID NO: 46870 - protein, 31 aa, Artificial Sequence
  Description of Artificial Sequence: Synthetic polypeptide
DEEEIRTTNPVGTEQYGSVSTNALGHFGSDQ

SEQ ID NO: 46871 - protein, 31 aa, Artificial Sequence
  Description of Artificial Sequence: Synthetic polypeptide
DEEEIRTTNPVGTEQYGSVSTNELSGDGGDD

SEQ ID NO: 46872 - protein, 31 aa, Artificial Sequence
  Description of Artificial Sequence: Synthetic polypeptide
DEEEIRTTNPVGTEQYGSVSPTNYGTRIGEP

SEQ ID NO: 46873 - protein, 32 aa, Artificial Sequence
  Description of Artificial Sequence: Synthetic polypeptide
AEEEIRTTNPVATEQYGSVVNSTNLQDTTNNS

SEQ ID NO: 46874 - protein, 32 aa, Artificial Sequence
  Description of Artificial Sequence: Synthetic polypeptide
DEEEIRTTNPVGYEQYGQVVSTNDLLQRGIDR

SEQ ID NO: 46875 - protein, 31 aa, Artificial Sequence
  Description of Artificial Sequence: Synthetic polypeptide
AEEEIRTTNPVATEQYGSVVNSNNNQGGNVQ

SEQ ID NO: 46876 - protein, 32 aa, Artificial Sequence
  Description of Artificial Sequence: Synthetic polypeptide
DSEEIRTTNPVATEQWGQSVSTYVLSQRGNQE

SEQ ID NO: 46877 - protein, 30 aa, Artificial Sequence
  Description of Artificial Sequence: Synthetic polypeptide
QEEEICTTNPTAYEQYGSVATNLQNRGNTA

SEQ ID NO: 46878 - protein, 28 aa, Artificial Sequence
  Description of Artificial Sequence: Synthetic peptide
DEEEIRTTNPVSTEQYGCVESELQGGQT

SEQ ID NO: 46879 - protein, 31 aa, Artificial Sequence
  Description of Artificial Sequence: Synthetic polypeptide
QEEEICTTNPVATECYGSVSTNLERGDNETP

SEQ ID NO: 46880 - protein, 29 aa, Artificial Sequence
  Description of Artificial Sequence: Synthetic peptide
DEEEIRTTNPVSTEQYGCVFSNLQGGQQA

SEQ ID NO: 46881 - protein, 31 aa, Artificial Sequence
  Description of Artificial Sequence: Synthetic polypeptide
DSEEIRTTNPVATEPWGSVPSTTLSQRGTTR

SEQ ID NO: 46882 - protein, 32 aa, Artificial Sequence
  Description of Artificial Sequence: Synthetic polypeptide
AEEEIRTTNPVATEQYGSVSTELLQQGNQINA

SEQ ID NO: 46883 - protein, 30 aa, Artificial Sequence
  Description of Artificial Sequence: Synthetic polypeptide
QEEEICTTNPTAYEQYGSVATNLQHRGEDR

SEQ ID NO: 46884 - protein, 31 aa, Artificial Sequence
  Description of Artificial Sequence: Synthetic polypeptide
AEEEIRTTNPVATEQYGSVSTENGNEDGNQE

SEQ ID NO: 46885 - protein, 32 aa, Artificial Sequence
  Description of Artificial Sequence: Synthetic polypeptide
AEEEIRTTNPVATEQYGSVSTENGNNQDGNIG

SEQ ID NO: 46886 - protein, 33 aa, Artificial Sequence
  Description of Artificial Sequence: Synthetic polypeptide
AEEEIRTTNPVATEQYGSVSTENLQGNQNGNQT

SEQ ID NO: 46887 - protein, 29 aa, Artificial Sequence
  Description of Artificial Sequence: Synthetic peptide
DEEEIRTTNPVSTEQYGHSVTSYLQGGQT

SEQ ID NO: 46888 - protein, 33 aa, Artificial Sequence
  Description of Artificial Sequence: Synthetic polypeptide
AEEEIRTTNPVATEQYGSVSTENLQQGNDEINN

SEQ ID NO: 46889 - protein, 32 aa, Artificial Sequence
  Description of Artificial Sequence: Synthetic polypeptide
DSEEIRTTNPVATEMYGSVSANLQDGMANFRL

SEQ ID NO: 46890 - protein, 30 aa, Artificial Sequence
  Description of Artificial Sequence: Synthetic polypeptide
DEEEIRTTNPVSTEQYGSVALNELSQGGQT

SEQ ID NO: 46891 - protein, 30 aa, Artificial Sequence
  Description of Artificial Sequence: Synthetic polypeptide
DEEEIRTTNPVSTEQYGSVAQNLQGTGGQT

SEQ ID NO: 46892 - protein, 28 aa, Artificial Sequence
  Description of Artificial Sequence: Synthetic peptide
DEEEIRTTNPVSTEQYGCVQSNHQGGQQ

SEQ ID NO: 46893 - protein, 30 aa, Artificial Sequence
  Description of Artificial Sequence: Synthetic polypeptide
DEEEIRTTNPVSTEQYGSVATNLNLQGIQT

SEQ ID NO: 46894 - protein, 30 aa, Artificial Sequence
  Description of Artificial Sequence: Synthetic polypeptide
SEQEIRATNPVATEQYGSVVETNLQHGQNQ

SEQ ID NO: 46895 - protein, 31 aa, Artificial Sequence
  Description of Artificial Sequence: Synthetic polypeptide
QEEEICTTNPTATEQYGSVATNLQHRGDNDL

SEQ ID NO: 46896 - protein, 31 aa, Artificial Sequence
  Description of Artificial Sequence: Synthetic polypeptide
SEQEIRTTNPVATESYGSVSNTNLERGDQRS

SEQ ID NO: 46897 - protein, 31 aa, Artificial Sequence
  Description of Artificial Sequence: Synthetic polypeptide
DEEEIRTTNPVGYEQYGSVSTNALSGRVSNP

SEQ ID NO: 46898 - protein, 31 aa, Artificial Sequence
  Description of Artificial Sequence: Synthetic polypeptide
AEEEIRTTNPVATEQYGSVVNANLGNQTGNE

SEQ ID NO: 46899 - protein, 30 aa, Artificial Sequence
  Description of Artificial Sequence: Synthetic polypeptide
SEQEIRTTNPVATEQYGSVSEDLMDHEGNR

SEQ ID NO: 46900 - protein, 30 aa, Artificial Sequence
  Description of Artificial Sequence: Synthetic polypeptide
SEQEIRTTNPVATEQYGSVSEDLEDHEGNR

SEQ ID NO: 46901 - protein, 28 aa, Artificial Sequence
  Description of Artificial Sequence: Synthetic peptide
DEEEIRTTNPVSTEGYGHVTCNLQGGQT

SEQ ID NO: 46902 - protein, 31 aa, Artificial Sequence
  Description of Artificial Sequence: Synthetic polypeptide
DEEEIRTTNPVSTEHYGSVSGGNDDQRSGNA

SEQ ID NO: 46903 - protein, 30 aa, Artificial Sequence
  Description of Artificial Sequence: Synthetic polypeptide
AEEEIRTTNPVATEQYGSVSTDQGNDNGNQ

SEQ ID NO: 46904 - protein, 31 aa, Artificial Sequence
  Description of Artificial Sequence: Synthetic polypeptide
AEEEIRTTNPVATEQYGSVSTDNNGTVGNNV

SEQ ID NO: 46905 - protein, 30 aa, Artificial Sequence
  Description of Artificial Sequence: Synthetic polypeptide
DEEEIRTTNPVSTEPYGSVSMNIQQQNGNH

SEQ ID NO: 46906 - protein, 30 aa, Artificial Sequence
  Description of Artificial Sequence: Synthetic polypeptide
DEEEIRTTNPVSTEPYGTVSEDLQQQQGNR

SEQ ID NO: 46907 - protein, 28 aa, Artificial Sequence
  Description of Artificial Sequence: Synthetic peptide
QEEEIATVNPVCTEQYGEVSENLQHGNQ

SEQ ID NO: 46908 - protein, 28 aa, Artificial Sequence
  Description of Artificial Sequence: Synthetic peptide
QEEEIATVNPVCTEQYGVVSDNLQSGNQ

SEQ ID NO: 46909 - protein, 32 aa, Artificial Sequence
  Description of Artificial Sequence: Synthetic polypeptide
QEEEICTTNPTATEQYGSVATNLQDRGDNGRM

SEQ ID NO: 46910 - protein, 28 aa, Artificial Sequence
  Description of Artificial Sequence: Synthetic peptide
DEEEIRTTNPVSTEQWGSVAPNDQGGQT

SEQ ID NO: 46911 - protein, 31 aa, Artificial Sequence
  Description of Artificial Sequence: Synthetic polypeptide
AEEEIRTTNPVATEQYGSVSTDNQGGNDGNT

SEQ ID NO: 46912 - protein, 29 aa, Artificial Sequence
  Description of Artificial Sequence: Synthetic peptide
SEQEIRTTNPIATEQYGSVSAEDLMHGNR

SEQ ID NO: 46913 - protein, 31 aa, Artificial Sequence
  Description of Artificial Sequence: Synthetic polypeptide
DCEEIRSTNPVATEQYGSVSTNVVARNGDQR

SEQ ID NO: 46914 - protein, 32 aa, Artificial Sequence
  Description of Artificial Sequence: Synthetic polypeptide
DEHEIRTTNPVATEQYGSVSTTQGDRQGNDDR

SEQ ID NO: 46915 - protein, 31 aa, Artificial Sequence
  Description of Artificial Sequence: Synthetic polypeptide
DCEEIRSTNPVATEQYGSVSTNQQARNGQIE

SEQ ID NO: 46916 - protein, 33 aa, Artificial Sequence
  Description of Artificial Sequence: Synthetic polypeptide
DEQEIRTTNPVATEQYGSVTTNLQTREGDQYRH

SEQ ID NO: 46917 - protein, 32 aa, Artificial Sequence
  Description of Artificial Sequence: Synthetic polypeptide
SEAEIRTTNPLAYEQYGSVSCTNLSQRPGGNR

SEQ ID NO: 46918 - protein, 30 aa, Artificial Sequence
  Description of Artificial Sequence: Synthetic polypeptide
SEAEIRSTNPVATEQYGSVHCTNLQHGGNQ

SEQ ID NO: 46919 - protein, 28 aa, Artificial Sequence
  Description of Artificial Sequence: Synthetic peptide
SEAEIRCTNPVATEQYGCVETELQHGNQ

SEQ ID NO: 46920 - protein, 29 aa, Artificial Sequence
  Description of Artificial Sequence: Synthetic peptide
SEAEIRATNPVATEQYGVVVTNLQHDGNQ

SEQ ID NO: 46921 - protein, 30 aa, Artificial Sequence
  Description of Artificial Sequence: Synthetic polypeptide
CEEEIACTNPVATEQYGSVATNLQEAGNEE

SEQ ID NO: 46922 - protein, 29 aa, Artificial Sequence
  Description of Artificial Sequence: Synthetic peptide
SEAEIRATNPVATEQYGSVVTNLQHGESQ

SEQ ID NO: 46923 - protein, 30 aa, Artificial Sequence
  Description of Artificial Sequence: Synthetic polypeptide
SEAEIRATNPVATEQYGSVVTNLQHEGGNQ

SEQ ID NO: 46924 - protein, 30 aa, Artificial Sequence
  Description of Artificial Sequence: Synthetic polypeptide
SEAEIRATNPVATEQYGSVFTNLQHGGNNQ

SEQ ID NO: 46925 - protein, 30 aa, Artificial Sequence
  Description of Artificial Sequence: Synthetic polypeptide
SEAEIRATNPVATEQYGSVATNMLQHGGNQ

SEQ ID NO: 46926 - protein, 33 aa, Artificial Sequence
  Description of Artificial Sequence: Synthetic polypeptide
AEEEIRTTNPVATEQYGSVSVTNNLQSGSNENE

SEQ ID NO: 46927 - protein, 29 aa, Artificial Sequence
  Description of Artificial Sequence: Synthetic peptide
SEAEIRATNPVATEQYGEVVTNLQHGNEQ

SEQ ID NO: 46928 - protein, 32 aa, Artificial Sequence
  Description of Artificial Sequence: Synthetic polypeptide
DEQEIRTTNPVATEQYGVVSTGNGLQGDGNEQ

SEQ ID NO: 46929 - protein, 31 aa, Artificial Sequence
  Description of Artificial Sequence: Synthetic polypeptide
DEQEIRTTNPVATEQYGVVSTLLQVRPDNDE

SEQ ID NO: 46930 - protein, 33 aa, Artificial Sequence
  Description of Artificial Sequence: Synthetic polypeptide
AEEEIRTTNPVATEQYGSVSVTNNLQQSGINTN

SEQ ID NO: 46931 - protein, 31 aa, Artificial Sequence
  Description of Artificial Sequence: Synthetic polypeptide
DEQEIRTTNPVATEQYGSVSYPNLEQRSEQM

SEQ ID NO: 46932 - protein, 31 aa, Artificial Sequence
  Description of Artificial Sequence: Synthetic polypeptide
SEAEIRTTNPVAYEQYGQVSCTGLSQRGGNR

SEQ ID NO: 46933 - protein, 33 aa, Artificial Sequence
  Description of Artificial Sequence: Synthetic polypeptide
AEEEIRTTNPVATEQYGSVSVTNNLQSGSNNQQ

SEQ ID NO: 46934 - protein, 31 aa, Artificial Sequence
  Description of Artificial Sequence: Synthetic polypeptide
DEQEIRTTNPVATEQYGSVSWNISRGTNEHD

SEQ ID NO: 46935 - protein, 29 aa, Artificial Sequence
  Description of Artificial Sequence: Synthetic peptide
SEDEIACTNPVATEPYGSVATNLQRGNML

SEQ ID NO: 46936 - protein, 33 aa, Artificial Sequence
  Description of Artificial Sequence: Synthetic polypeptide
AEEEIRTTNPVATEQYGSVSVTNNNLQESGNDT

SEQ ID NO: 46937 - protein, 30 aa, Artificial Sequence
  Description of Artificial Sequence: Synthetic polypeptide
SECEIRATNPVATEQYGSVETTNLQHGNQQ

SEQ ID NO: 46938 - protein, 30 aa, Artificial Sequence
  Description of Artificial Sequence: Synthetic polypeptide
SECEIRATNPVATEQYGSVETNLQHGVNQS

SEQ ID NO: 46939 - protein, 29 aa, Artificial Sequence
  Description of Artificial Sequence: Synthetic peptide
SECEIRATNPVATEQYGSVETNLQHGSVQ

SEQ ID NO: 46940 - protein, 30 aa, Artificial Sequence
  Description of Artificial Sequence: Synthetic polypeptide
DEQEIRTTNPVATEQYGSVSTVNNDNEGDQ

SEQ ID NO: 46941 - protein, 29 aa, Artificial Sequence
  Description of Artificial Sequence: Synthetic peptide
SECEIRATNPVATEQYGSVETNLQHGIQN

SEQ ID NO: 46942 - protein, 31 aa, Artificial Sequence
  Description of Artificial Sequence: Synthetic polypeptide
DEVEIATTNPVATEQYGSVSTNQQLGQNEME

SEQ ID NO: 46943 - protein, 32 aa, Artificial Sequence
  Description of Artificial Sequence: Synthetic polypeptide
DEQEIRTTNPVATEQYGSVSVNLVRVGENPTA

SEQ ID NO: 46944 - protein, 31 aa, Artificial Sequence
  Description of Artificial Sequence: Synthetic polypeptide
DEVEIATTNPVATEQYGSVSTVLDQHGNGNQ

SEQ ID NO: 46945 - protein, 31 aa, Artificial Sequence
  Description of Artificial Sequence: Synthetic polypeptide
DEQEIRTTNPVATEQYGSVSVTDLQRTEVQA

SEQ ID NO: 46946 - protein, 32 aa, Artificial Sequence
  Description of Artificial Sequence: Synthetic polypeptide
AEEEIRTTNPVATEQYGSVSVTNNNEQIGNTE

SEQ ID NO: 46947 - protein, 32 aa, Artificial Sequence
  Description of Artificial Sequence: Synthetic polypeptide
DEQEIRTTNPVATEQYGSVSVTMLDQEVNDNR

SEQ ID NO: 46948 - protein, 30 aa, Artificial Sequence
  Description of Artificial Sequence: Synthetic polypeptide
CEEEIACTNPVATEQYGSVATNLQRNANEE

SEQ ID NO: 46949 - protein, 31 aa, Artificial Sequence
  Description of Artificial Sequence: Synthetic polypeptide
CEEEIACTNPVATEQYGSVATNLQNRGNEAV

SEQ ID NO: 46950 - protein, 30 aa, Artificial Sequence
  Description of Artificial Sequence: Synthetic polypeptide
DEQEIRTTNPVATEQYGSVSVVLNFRDEDR

SEQ ID NO: 46951 - protein, 29 aa, Artificial Sequence
  Description of Artificial Sequence: Synthetic peptide
SECEIRATNPVATEQYGSVETNLQHGDEQ

SEQ ID NO: 46952 - protein, 31 aa, Artificial Sequence
  Description of Artificial Sequence: Synthetic polypeptide
DEQEIRTTNPVATEQYGSVSTNTNDEGQDSR

SEQ ID NO: 46953 - protein, 31 aa, Artificial Sequence
  Description of Artificial Sequence: Synthetic polypeptide
DEVEIATTNPVATEQYGSVSTNQQHEGGQNM

SEQ ID NO: 46954 - protein, 28 aa, Artificial Sequence
  Description of Artificial Sequence: Synthetic peptide
AENEIATTNPVATEQYGDASENLQRGEL

SEQ ID NO: 46955 - protein, 32 aa, Artificial Sequence
  Description of Artificial Sequence: Synthetic polypeptide
DEVEIATTNPVATEQYGSVSTNLQGQDEGQNM

SEQ ID NO: 46956 - protein, 29 aa, Artificial Sequence
  Description of Artificial Sequence: Synthetic peptide
SEAEIACTNPVATEQYGSVATNLERPNRN

SEQ ID NO: 46957 - protein, 29 aa, Artificial Sequence
  Description of Artificial Sequence: Synthetic peptide
DEQVIGTTNPVATEQWGSVSTDTLQGGNA

SEQ ID NO: 46958 - protein, 29 aa, Artificial Sequence
  Description of Artificial Sequence: Synthetic peptide
DEQVIRTTNPVATEQYGCVCETNPERGNF

SEQ ID NO: 46959 - protein, 30 aa, Artificial Sequence
  Description of Artificial Sequence: Synthetic polypeptide
DEREICTVNPVATEQYGSVSTNLNFGGGNI

SEQ ID NO: 46960 - protein, 31 aa, Artificial Sequence
  Description of Artificial Sequence: Synthetic polypeptide
DEREICTVNPVATEQYGSVSTNLQFEEGNGT

SEQ ID NO: 46961 - protein, 31 aa, Artificial Sequence
  Description of Artificial Sequence: Synthetic polypeptide
DEREICTVNPVATEQYGSVSTNLQFGENGNT

SEQ ID NO: 46962 - protein, 29 aa, Artificial Sequence
  Description of Artificial Sequence: Synthetic peptide
SEAEIACTNPVATEQYGSVATNLERGIND

SEQ ID NO: 46963 - protein, 29 aa, Artificial Sequence
  Description of Artificial Sequence: Synthetic peptide
SEAEIACTNPVATEPYGSVSTNLQDGNEN

SEQ ID NO: 46964 - protein, 28 aa, Artificial Sequence
  Description of Artificial Sequence: Synthetic peptide
AENEIATTNPVATEQYGEASEDLQRGGR

SEQ ID NO: 46965 - protein, 32 aa, Artificial Sequence
  Description of Artificial Sequence: Synthetic polypeptide
DEVEIATTNPVATEQYGSVSTNLQGDAGNNDM

SEQ ID NO: 46966 - protein, 33 aa, Artificial Sequence
  Description of Artificial Sequence: Synthetic polypeptide
DEREIRTTNPVATEQYGSVSTNDFPRSGNEVRN

SEQ ID NO: 46967 - protein, 32 aa, Artificial Sequence
  Description of Artificial Sequence: Synthetic polypeptide
DEREIRTTNPVATEQYGSVSTNDMERTGEEVR

SEQ ID NO: 46968 - protein, 29 aa, Artificial Sequence
  Description of Artificial Sequence: Synthetic peptide
AENEIATTNPVATEQYGEASEFNLQRGGR

SEQ ID NO: 46969 - protein, 29 aa, Artificial Sequence
  Description of Artificial Sequence: Synthetic peptide
SDSEVACTNPVATEQYGSVSAENLQRGNR

SEQ ID NO: 46970 - protein, 31 aa, Artificial Sequence
  Description of Artificial Sequence: Synthetic polypeptide
DEQTIRTTNPVATEQYGSVSTNLEDYGMENM

SEQ ID NO: 46971 - protein, 29 aa, Artificial Sequence
  Description of Artificial Sequence: Synthetic peptide
SEAEIACTNPVATEQYGSVATNLQHGNQA

SEQ ID NO: 46972 - protein, 32 aa, Artificial Sequence
  Description of Artificial Sequence: Synthetic polypeptide
DEVEIATTNPVATEQYGSVSTNLQIGGGNTTD

SEQ ID NO: 46973 - protein, 32 aa, Artificial Sequence
  Description of Artificial Sequence: Synthetic polypeptide
DEVEIATTNPVATEQYGSVSTNLQMGDGQNEK

SEQ ID NO: 46974 - protein, 31 aa, Artificial Sequence
  Description of Artificial Sequence: Synthetic polypeptide
SEAEIATTNPVATEQYGVVSTNLQRGDNPSV

SEQ ID NO: 46975 - protein, 31 aa, Artificial Sequence
  Description of Artificial Sequence: Synthetic polypeptide
DEQEIRTTNPVATEQYGYTISTNELQEGNEW

SEQ ID NO: 46976 - protein, 30 aa, Artificial Sequence
  Description of Artificial Sequence: Synthetic polypeptide
DEQEIRTTNPVATEQYGYTISTNELQELER

SEQ ID NO: 46977 - protein, 28 aa, Artificial Sequence
  Description of Artificial Sequence: Synthetic peptide
AENEIATTNPVATEQYGDVSENLQHEER

SEQ ID NO: 46978 - protein, 28 aa, Artificial Sequence
  Description of Artificial Sequence: Synthetic peptide
AENEIATTNPVATEQYGDVSENLQHGEL

SEQ ID NO: 46979 - protein, 30 aa, Artificial Sequence
  Description of Artificial Sequence: Synthetic polypeptide
SEAEIATTNPVATEQYGSVATNLQQGNEHL

SEQ ID NO: 46980 - protein, 30 aa, Artificial Sequence
  Description of Artificial Sequence: Synthetic polypeptide
DEQEIRTTNPVATETYGSVSNNLQLVGDTP

SEQ ID NO: 46981 - protein, 33 aa, Artificial Sequence
  Description of Artificial Sequence: Synthetic polypeptide
AEEEIRTTNPVATEQYGSVSVTNNLQQSGINEG

SEQ ID NO: 46982 - protein, 30 aa, Artificial Sequence
  Description of Artificial Sequence: Synthetic polypeptide
SEAEIATTNPVATEQYGSVATNLERGNQDQ

SEQ ID NO: 46983 - protein, 28 aa, Artificial Sequence
  Description of Artificial Sequence: Synthetic peptide
AENEIATTNPVATEQYGEAAENLQRGGR

SEQ ID NO: 46984 - protein, 33 aa, Artificial Sequence
  Description of Artificial Sequence: Synthetic polypeptide
DEQEIRTTNPVAYEQYGSVACTNALPQRTGNNR

SEQ ID NO: 46985 - protein, 29 aa, Artificial Sequence
  Description of Artificial Sequence: Synthetic peptide
CEEEIACTNPVATEQYGSCATNLQDGNDS

SEQ ID NO: 46986 - protein, 28 aa, Artificial Sequence
  Description of Artificial Sequence: Synthetic peptide
DEQNICTTNPVATEQYGTVETNPQQGNG

SEQ ID NO: 46987 - protein, 32 aa, Artificial Sequence
  Description of Artificial Sequence: Synthetic polypeptide
DEVEIATTNPVATEQYGSVSTNLQQMGGDNET

SEQ ID NO: 46988 - protein, 28 aa, Artificial Sequence
  Description of Artificial Sequence: Synthetic peptide
SEAEIASTNPVATEQYGSVVTNDQHGNQ

SEQ ID NO: 46989 - protein, 28 aa, Artificial Sequence
  Description of Artificial Sequence: Synthetic peptide
SEAEIACTNPVAYEQYGSVATNLVRGDR

SEQ ID NO: 46990 - protein, 28 aa, Artificial Sequence
  Description of Artificial Sequence: Synthetic peptide
AENEIATTNPVATEQYGDVSENLQREEL

SEQ ID NO: 46991 - protein, 31 aa, Artificial Sequence
  Description of Artificial Sequence: Synthetic polypeptide
DEQEIRTTNPVATEQYGSVSTNNLENNNQQG

SEQ ID NO: 46992 - protein, 31 aa, Artificial Sequence
  Description of Artificial Sequence: Synthetic polypeptide
DEQEIRTTNPVATEQYGSVSTNLVVADNDVI

SEQ ID NO: 46993 - protein, 32 aa, Artificial Sequence
  Description of Artificial Sequence: Synthetic polypeptide
DEQEIRTTNPVATEQYGSVSTNLVEVGVVPRA

SEQ ID NO: 46994 - protein, 28 aa, Artificial Sequence
  Description of Artificial Sequence: Synthetic peptide
SEEEIACTNPIATEQYGDVSENLQHENR

SEQ ID NO: 46995 - protein, 28 aa, Artificial Sequence
  Description of Artificial Sequence: Synthetic peptide
SEEEIACTNPIATEQYGDVSENLMRGER

SEQ ID NO: 46996 - protein, 31 aa, Artificial Sequence
  Description of Artificial Sequence: Synthetic polypeptide
DEQEIRTTNPVATEEYGSVSGQNLQNTGNYS

SEQ ID NO: 46997 - protein, 28 aa, Artificial Sequence
  Description of Artificial Sequence: Synthetic peptide
SEEEIACTNPIATEQYGDVSENLMRENR

SEQ ID NO: 46998 - protein, 31 aa, Artificial Sequence
  Description of Artificial Sequence: Synthetic polypeptide
DEQEIRTTNPVATEQWGSVSTINEEDREGNG

SEQ ID NO: 46999 - protein, 30 aa, Artificial Sequence
  Description of Artificial Sequence: Synthetic polypeptide
DEVEIATTNPVATETYGSVSTNQQGDGQNM

SEQ ID NO: 47000 - protein, 32 aa, Artificial Sequence
  Description of Artificial Sequence: Synthetic polypeptide
DEQEIRTTNPVATEQWGSVSTINEQDREGENG

SEQ ID NO: 47001 - protein, 32 aa, Artificial Sequence
  Description of Artificial Sequence: Synthetic polypeptide
DEQEIRTTNPVATEQWGSVSTNLPEDREGENG

SEQ ID NO: 47002 - protein, 30 aa, Artificial Sequence
  Description of Artificial Sequence: Synthetic polypeptide
DEQEIRTTNPVATEQYGCVSTNGERGSTQQ

SEQ ID NO: 47003 - protein, 28 aa, Artificial Sequence
  Description of Artificial Sequence: Synthetic peptide
SEEEIACTNPIATEGYGSVSSNLMRGDR

SEQ ID NO: 47004 - protein, 31 aa, Artificial Sequence
  Description of Artificial Sequence: Synthetic polypeptide
DEQEIRTTNPVATEQYGCVSTNLERQSDNQF

SEQ ID NO: 47005 - protein, 28 aa, Artificial Sequence
  Description of Artificial Sequence: Synthetic peptide
SEEEIACTNPIATEGYGSVSENLMRGDR

SEQ ID NO: 47006 - protein, 29 aa, Artificial Sequence
  Description of Artificial Sequence: Synthetic peptide
DEQEIRTTNPVATEQYGCVSTNNDNEGDQ

SEQ ID NO: 47007 - protein, 31 aa, Artificial Sequence
  Description of Artificial Sequence: Synthetic polypeptide
DEQEIRTTNPVATEQYGCVSTNNQEGGNPQE

SEQ ID NO: 47008 - protein, 31 aa, Artificial Sequence
  Description of Artificial Sequence: Synthetic polypeptide
DEQEIRTTNPVATEQYGCVSTNNQEGGNQIT

SEQ ID NO: 47009 - protein, 32 aa, Artificial Sequence
  Description of Artificial Sequence: Synthetic polypeptide
DEQEIRTTNPVATECYGSVSCINLQDREGENG

SEQ ID NO: 47010 - protein, 28 aa, Artificial Sequence
  Description of Artificial Sequence: Synthetic peptide
SEEEIACTNPIATEQYGEASENLQHGNR

SEQ ID NO: 47011 - protein, 28 aa, Artificial Sequence
  Description of Artificial Sequence: Synthetic peptide
SEEEIACTNPIATEQYGEASENLQRGGR

SEQ ID NO: 47012 - protein, 29 aa, Artificial Sequence
  Description of Artificial Sequence: Synthetic peptide
DEQEIRCTNPVATEQYGSVSTDLEHGEDL

SEQ ID NO: 47013 - protein, 30 aa, Artificial Sequence
  Description of Artificial Sequence: Synthetic polypeptide
DEQEIATTNPVSSEQYGSVSTNLQDSGEDR

SEQ ID NO: 47014 - protein, 28 aa, Artificial Sequence
  Description of Artificial Sequence: Synthetic peptide
SEEEIACTNPIATEQYGSVSENLMNGNH

SEQ ID NO: 47015 - protein, 30 aa, Artificial Sequence
  Description of Artificial Sequence: Synthetic polypeptide
SEEEIACTNPIATEQYGSVSENLMDREGNR

SEQ ID NO: 47016 - protein, 30 aa, Artificial Sequence
  Description of Artificial Sequence: Synthetic polypeptide
DEQEICTTNPCATEQWGSVPTNLQHEGNGR

SEQ ID NO: 47017 - protein, 30 aa, Artificial Sequence
  Description of Artificial Sequence: Synthetic polypeptide
DEQEICTTNPCATEQYGSVPTELQHDGNGR

SEQ ID NO: 47018 - protein, 28 aa, Artificial Sequence
  Description of Artificial Sequence: Synthetic peptide
SEEEIACTNPIATEQYGSVAENLMRQNR

SEQ ID NO: 47019 - protein, 28 aa, Artificial Sequence
  Description of Artificial Sequence: Synthetic peptide
SEEEIACTNPIATEQYGSVAENLARGNE

SEQ ID NO: 47020 - protein, 30 aa, Artificial Sequence
  Description of Artificial Sequence: Synthetic polypeptide
DEQEIRTTNPVATEQYGCVSTVNQEGGNIV

SEQ ID NO: 47021 - protein, 31 aa, Artificial Sequence
  Description of Artificial Sequence: Synthetic polypeptide
DEQEICTVNPVATEQYGSVSTNLQFEGGNNQ

SEQ ID NO: 47022 - protein, 28 aa, Artificial Sequence
  Description of Artificial Sequence: Synthetic peptide
SEEEIACTNPIATEQYGSASENLMHGNR

SEQ ID NO: 47023 - protein, 30 aa, Artificial Sequence
  Description of Artificial Sequence: Synthetic polypeptide
DEQEIRCTNPIATEQYGSVSATNLMHGEDR

SEQ ID NO: 47024 - protein, 28 aa, Artificial Sequence
  Description of Artificial Sequence: Synthetic peptide
SEEEIACTNPIATEQYGEVSENLMRGNK

SEQ ID NO: 47025 - protein, 29 aa, Artificial Sequence
  Description of Artificial Sequence: Synthetic peptide
DEQEIRCTNPIATEQYGSVSENLMHEGER

SEQ ID NO: 47026 - protein, 31 aa, Artificial Sequence
  Description of Artificial Sequence: Synthetic polypeptide
DEVEIATTNPVATEVYGSVSTNLQEGDGMNG

SEQ ID NO: 47027 - protein, 31 aa, Artificial Sequence
  Description of Artificial Sequence: Synthetic polypeptide
DEQEIRCTNPVATEQYGSVSATDLMREGNDL

SEQ ID NO: 47028 - protein, 31 aa, Artificial Sequence
  Description of Artificial Sequence: Synthetic polypeptide
DEVEIATTNPVATEVWGSVSTNLQGDSGNTR

SEQ ID NO: 47029 - protein, 30 aa, Artificial Sequence
  Description of Artificial Sequence: Synthetic polypeptide
DEQEIRCTNPIATEQYGSVSAENLMRGEDR

SEQ ID NO: 47030 - protein, 30 aa, Artificial Sequence
  Description of Artificial Sequence: Synthetic polypeptide
DEQEIRTTNPVATEQYGDVNDTNLMIQGNL

SEQ ID NO: 47031 - protein, 28 aa, Artificial Sequence
  Description of Artificial Sequence: Synthetic peptide
SEEEIACTNPIATECYGSVSENLQREER

SEQ ID NO: 47032 - protein, 31 aa, Artificial Sequence
  Description of Artificial Sequence: Synthetic polypeptide
DEVEIATTNPVATESYGSVSTNLQQMGDNDS

SEQ ID NO: 47033 - protein, 32 aa, Artificial Sequence
  Description of Artificial Sequence: Synthetic polypeptide
DEQEIRTTNPVATEQYGSVSINLEQEEGVNTE

SEQ ID NO: 47034 - protein, 30 aa, Artificial Sequence
  Description of Artificial Sequence: Synthetic polypeptide
SEEAIRCTNPIATEQYVGSVLSENLMRGNR

SEQ ID NO: 47035 - protein, 31 aa, Artificial Sequence
  Description of Artificial Sequence: Synthetic polypeptide
SEDEIRTTNPVATEQYGEVSTNLQGNGDNGH

SEQ ID NO: 47036 - protein, 30 aa, Artificial Sequence
  Description of Artificial Sequence: Synthetic polypeptide
SEDEIRTTNPVATEQYGATVSTNEQVDGER

SEQ ID NO: 47037 - protein, 32 aa, Artificial Sequence
  Description of Artificial Sequence: Synthetic polypeptide
DEQEIRTTNPVATEQYGSVSPTNIQRTDEDRD

SEQ ID NO: 47038 - protein, 29 aa, Artificial Sequence
  Description of Artificial Sequence: Synthetic peptide
SEDEIRCTNPIATEQYGSVHSEGLMRGNR

SEQ ID NO: 47039 - protein, 31 aa, Artificial Sequence
  Description of Artificial Sequence: Synthetic polypeptide
DEQEIRTTNPVATEQYGSVSSTNSLDRMHEQ

SEQ ID NO: 47040 - protein, 33 aa, Artificial Sequence
  Description of Artificial Sequence: Synthetic polypeptide
DEQEIRTTNPVATEQYGSVSETENLQGRIVNEQ

SEQ ID NO: 47041 - protein, 30 aa, Artificial Sequence
  Description of Artificial Sequence: Synthetic polypeptide
DEQEIRTTNPVATEQYGSVSTDEQDHEGEG

SEQ ID NO: 47042 - protein, 31 aa, Artificial Sequence
  Description of Artificial Sequence: Synthetic polypeptide
DEQEIRTTNPVATEQYGSVSTIDLEDHEGNG

SEQ ID NO: 47043 - protein, 31 aa, Artificial Sequence
  Description of Artificial Sequence: Synthetic polypeptide
DEQEIRTTNPVATEQYGSVSTIDLEDHEGNL

SEQ ID NO: 47044 - protein, 31 aa, Artificial Sequence
  Description of Artificial Sequence: Synthetic polypeptide
DEQEIRTTNPVATEQYGSVSTINEEDHEGNG

SEQ ID NO: 47045 - protein, 32 aa, Artificial Sequence
  Description of Artificial Sequence: Synthetic polypeptide
DEQEIRTTNPVATEQYGSVSTNDLDEITGDRN

SEQ ID NO: 47046 - protein, 33 aa, Artificial Sequence
  Description of Artificial Sequence: Synthetic polypeptide
DEQEIRTTNPVATEQYGSVSTNDLLQNMGQDRN

SEQ ID NO: 47047 - protein, 32 aa, Artificial Sequence
  Description of Artificial Sequence: Synthetic polypeptide
DEQEIRTTNPVATEQYGSVSTNLEIDQDNERP

SEQ ID NO: 47048 - protein, 30 aa, Artificial Sequence
  Description of Artificial Sequence: Synthetic polypeptide
DEQEIRTTNPVATEQYGSVSTNLETNSVQQ

SEQ ID NO: 47049 - protein, 31 aa, Artificial Sequence
  Description of Artificial Sequence: Synthetic polypeptide
DEQEIRTTNPVATEQYGSVSTEVLQRAVEED

SEQ ID NO: 47050 - protein, 32 aa, Artificial Sequence
  Description of Artificial Sequence: Synthetic polypeptide
DEVEIATTNPVATEQYGSVSTNLQGDAGNGSE

SEQ ID NO: 47051 - protein, 31 aa, Artificial Sequence
  Description of Artificial Sequence: Synthetic polypeptide
DEQEIRTTNPVATEQYGSVSAVDLQRGVDEE

SEQ ID NO: 47052 - protein, 34 aa, Artificial Sequence
  Description of Artificial Sequence: Synthetic polypeptide
QEEEIRTTNPVATEQYGSVWNETSNLDQRGENYR

SEQ ID NO: 47053 - protein, 31 aa, Artificial Sequence
  Description of Artificial Sequence: Synthetic polypeptide
DEVEIATTNPVATESYGSVSTNLQIGGGNTI

SEQ ID NO: 47054 - protein, 31 aa, Artificial Sequence
  Description of Artificial Sequence: Synthetic polypeptide
DEVEIATTNPVATESYGSVSTNLQEGGMNTG

SEQ ID NO: 47055 - protein, 32 aa, Artificial Sequence
  Description of Artificial Sequence: Synthetic polypeptide
DEQEIRTTNPVATEQYGSCSTTNLHEGNGEER

SEQ ID NO: 47056 - protein, 30 aa, Artificial Sequence
  Description of Artificial Sequence: Synthetic polypeptide
DEQEIRTTNPVATEQYGSFSNDPLQRGIDM

SEQ ID NO: 47057 - protein, 28 aa, Artificial Sequence
  Description of Artificial Sequence: Synthetic peptide
SEEEIACTNPIASEQYGSVSENLMRGTR

SEQ ID NO: 47058 - protein, 31 aa, Artificial Sequence
  Description of Artificial Sequence: Synthetic polypeptide
DEQEIRTTNPVATEQYGSVEWDNVQRGEQRH

SEQ ID NO: 47059 - protein, 32 aa, Artificial Sequence
  Description of Artificial Sequence: Synthetic polypeptide
DEQEIRTTNPVATEQYGSVITNLQVFVGNEIG

SEQ ID NO: 47060 - protein, 32 aa, Artificial Sequence
  Description of Artificial Sequence: Synthetic polypeptide
AEEEIRTTNPVATEQYGSVSVTNNNLQTTIRE

SEQ ID NO: 47061 - protein, 33 aa, Artificial Sequence
  Description of Artificial Sequence: Synthetic polypeptide
DEQEIRTTNPVATEQYGSVNSTNLEQLELENRQ

SEQ ID NO: 47062 - protein, 30 aa, Artificial Sequence
  Description of Artificial Sequence: Synthetic polypeptide
DEVEIATTNPVATERYGVVSTNLQEGDGNG

SEQ ID NO: 47063 - protein, 30 aa, Artificial Sequence
  Description of Artificial Sequence: Synthetic polypeptide
DEVEIATTNPVATERYGTVSTNLQEGGNGS

SEQ ID NO: 47064 - protein, 31 aa, Artificial Sequence
  Description of Artificial Sequence: Synthetic polypeptide
DEVEIATTNPVATERYGSVSTNLQEGNGNGQ

SEQ ID NO: 47065 - protein, 31 aa, Artificial Sequence
  Description of Artificial Sequence: Synthetic polypeptide
DEVEIATTNPVATEQYGVVSTNLQIGGGNMI

SEQ ID NO: 47066 - protein, 28 aa, Artificial Sequence
  Description of Artificial Sequence: Synthetic peptide
SEECIRCTNPIATEHWGSVSENLMRGNR

SEQ ID NO: 47067 - protein, 31 aa, Artificial Sequence
  Description of Artificial Sequence: Synthetic polypeptide
DEVEIATTNPVATEQYGVVSTNLQHQGTNDQ

SEQ ID NO: 47068 - protein, 30 aa, Artificial Sequence
  Description of Artificial Sequence: Synthetic polypeptide
QEEEIRTTNPVATEQYGSVVATALQNGFDE

SEQ ID NO: 47069 - protein, 28 aa, Artificial Sequence
  Description of Artificial Sequence: Synthetic peptide
SEEEIACTNPCATEQYGIVSCNLMSGNR

SEQ ID NO: 47070 - protein, 28 aa, Artificial Sequence
  Description of Artificial Sequence: Synthetic peptide
AENEIATTNPVATEQYGEASENCQRGGR

SEQ ID NO: 47071 - protein, 32 aa, Artificial Sequence
  Description of Artificial Sequence: Synthetic polypeptide
AEEEIRTTNPVATEQYGSVSTVTNQNQDGNVE

SEQ ID NO: 47072 - protein, 31 aa, Artificial Sequence
  Description of Artificial Sequence: Synthetic polypeptide
SDEEIRTTNPVATEQHGTVSTNLQENGVNGR

SEQ ID NO: 47073 - protein, 31 aa, Artificial Sequence
  Description of Artificial Sequence: Synthetic polypeptide
DESEIATTNPVATEQYGSVSTNLMPTGGNNT

SEQ ID NO: 47074 - protein, 32 aa, Artificial Sequence
  Description of Artificial Sequence: Synthetic polypeptide
DESEIATTNPVATEQYGSVSTNLQGDGGEGRH

SEQ ID NO: 47075 - protein, 32 aa, Artificial Sequence
  Description of Artificial Sequence: Synthetic polypeptide
DESEIATTNPVATEQYGSVSTNLQGDGGQNDH

SEQ ID NO: 47076 - protein, 31 aa, Artificial Sequence
  Description of Artificial Sequence: Synthetic polypeptide
DESEIATTNPVATEQYGSVSTNLSMATGNNT

SEQ ID NO: 47077 - protein, 30 aa, Artificial Sequence
  Description of Artificial Sequence: Synthetic polypeptide
DEVEIATTNPVATEQYGAVSTNLQGQDNDQ

SEQ ID NO: 47078 - protein, 31 aa, Artificial Sequence
  Description of Artificial Sequence: Synthetic polypeptide
DEVEIATTNPVATEQYGAVSTNLQGGVNDDQ

SEQ ID NO: 47079 - protein, 28 aa, Artificial Sequence
  Description of Artificial Sequence: Synthetic peptide
QESEIRSTNPVATEGYGVVASTLQRGDR

SEQ ID NO: 47080 - protein, 29 aa, Artificial Sequence
  Description of Artificial Sequence: Synthetic peptide
QESEIRPTNPCATECWGSVSCNLQREGNR

SEQ ID NO: 47081 - protein, 30 aa, Artificial Sequence
  Description of Artificial Sequence: Synthetic polypeptide
DESEIATTNPVATEQYGVVSTNLQHNGDTN

SEQ ID NO: 47082 - protein, 32 aa, Artificial Sequence
  Description of Artificial Sequence: Synthetic polypeptide
DEVEIATTNPVATEQYGAVSTNLQGEHGQNDR

SEQ ID NO: 47083 - protein, 28 aa, Artificial Sequence
  Description of Artificial Sequence: Synthetic peptide
QESEIRCTNPVATEQYGVVASTLMRGNI

SEQ ID NO: 47084 - protein, 28 aa, Artificial Sequence
  Description of Artificial Sequence: Synthetic peptide
QESEIRCTNPVATEQYGVVASNLMRGNI

SEQ ID NO: 47085 - protein, 28 aa, Artificial Sequence
  Description of Artificial Sequence: Synthetic peptide
QESEIRCTNPVATEQYGSMSSTLQRGDI

SEQ ID NO: 47086 - protein, 29 aa, Artificial Sequence
  Description of Artificial Sequence: Synthetic peptide
DESEIATTNPVATTHYGSVSTNLQGLTNM

SEQ ID NO: 47087 - protein, 30 aa, Artificial Sequence
  Description of Artificial Sequence: Synthetic polypeptide
DESEIATTNPVAYDQYGEVSCTALSQRGNR

SEQ ID NO: 47088 - protein, 33 aa, Artificial Sequence
  Description of Artificial Sequence: Synthetic polypeptide
AEEEIRTTNPVATEQYGSVSVTNNLQLGGNLDT

SEQ ID NO: 47089 - protein, 31 aa, Artificial Sequence
  Description of Artificial Sequence: Synthetic polypeptide
DEVEIATTNPVATEQYGCVSTNLGGDPGNER

SEQ ID NO: 47090 - protein, 33 aa, Artificial Sequence
  Description of Artificial Sequence: Synthetic polypeptide
AEEEIRTTNPVATEQYGSVSVTNNLQNEEGENF

SEQ ID NO: 47091 - protein, 33 aa, Artificial Sequence
  Description of Artificial Sequence: Synthetic polypeptide
AEEEIRTTNPVATEQYGSVSVTNNLQNIGINNV

SEQ ID NO: 47092 - protein, 29 aa, Artificial Sequence
  Description of Artificial Sequence: Synthetic peptide
REEEIACTNPVATEQYGAVFTNLQDGVDR

SEQ ID NO: 47093 - protein, 29 aa, Artificial Sequence
  Description of Artificial Sequence: Synthetic peptide
AENEIATTNPVATEQYGSASENLQRGGDL

SEQ ID NO: 47094 - protein, 32 aa, Artificial Sequence
  Description of Artificial Sequence: Synthetic polypeptide
AEEEIRTTNPVATEQYGSVSTVTTNNNQDGNL

SEQ ID NO: 47095 - protein, 30 aa, Artificial Sequence
  Description of Artificial Sequence: Synthetic polypeptide
DESEIATTNPVATEQYGSVATNLEDGNNDD

SEQ ID NO: 47096 - protein, 31 aa, Artificial Sequence
  Description of Artificial Sequence: Synthetic polypeptide
DESEIATTNPVATEQYGSVATNLERPGNQDQ

SEQ ID NO: 47097 - protein, 30 aa, Artificial Sequence
  Description of Artificial Sequence: Synthetic polypeptide
DESEIATTNPVATEQYGSVATNLQEDLNDN

SEQ ID NO: 47098 - protein, 30 aa, Artificial Sequence
  Description of Artificial Sequence: Synthetic polypeptide
QEVEIKTTNPVATEQYGSVCSTNLQPMGTP

SEQ ID NO: 47099 - protein, 28 aa, Artificial Sequence
  Description of Artificial Sequence: Synthetic peptide
DESEIATTNPVAYDTYGSVSTNLQHDNM

SEQ ID NO: 47100 - protein, 29 aa, Artificial Sequence
  Description of Artificial Sequence: Synthetic peptide
DESEIATTNPVATEQYGSVPEVCQREGNG

SEQ ID NO: 47101 - protein, 31 aa, Artificial Sequence
  Description of Artificial Sequence: Synthetic polypeptide
DEVEIATTNPVATEQYGEVSTNLQGGGTNDQ

SEQ ID NO: 47102 - protein, 33 aa, Artificial Sequence
  Description of Artificial Sequence: Synthetic polypeptide
AEEEIRTTNPVATEQYGSVSVTNNLQQDNGNTE

SEQ ID NO: 47103 - protein, 33 aa, Artificial Sequence
  Description of Artificial Sequence: Synthetic polypeptide
AEEEIRTTNPVATEQYGSVSVTNNLQNSNGNET

SEQ ID NO: 47104 - protein, 30 aa, Artificial Sequence
  Description of Artificial Sequence: Synthetic polypeptide
DEVEIATTNPVATEQYGEVATNLQGDENRE

SEQ ID NO: 47105 - protein, 31 aa, Artificial Sequence
  Description of Artificial Sequence: Synthetic polypeptide
DESEIATTNPVATEQYGSVSATNLQDHEGEL

SEQ ID NO: 47106 - protein, 30 aa, Artificial Sequence
  Description of Artificial Sequence: Synthetic polypeptide
AENEIATTNPVATEQYGSASTDLQREGEDR

SEQ ID NO: 47107 - protein, 31 aa, Artificial Sequence
  Description of Artificial Sequence: Synthetic polypeptide
DESEIATTNPVATEQYGSVSCINEPQREGNG

SEQ ID NO: 47108 - protein, 29 aa, Artificial Sequence
  Description of Artificial Sequence: Synthetic peptide
DESEIATTNPVATEQYGSVPEVCQREGNK

SEQ ID NO: 47109 - protein, 28 aa, Artificial Sequence
  Description of Artificial Sequence: Synthetic peptide
QESEIRCTNPIATEGYGSVSENLMHGNR

SEQ ID NO: 47110 - protein, 28 aa, Artificial Sequence
  Description of Artificial Sequence: Synthetic peptide
DEVEIATTNPVATEQWGSVAMNLDDGNH

SEQ ID NO: 47111 - protein, 31 aa, Artificial Sequence
  Description of Artificial Sequence: Synthetic polypeptide
DESEIATTNPVAYEQYGSVAATNLQRGDNDQ

SEQ ID NO: 47112 - protein, 28 aa, Artificial Sequence
  Description of Artificial Sequence: Synthetic peptide
QESEIACTNPVATEQYGEASENLQRGGR

SEQ ID NO: 47113 - protein, 30 aa, Artificial Sequence
  Description of Artificial Sequence: Synthetic polypeptide
DEVEIATTNPVATEIYGSVSTNLQGNDDDM

SEQ ID NO: 47114 - protein, 31 aa, Artificial Sequence
  Description of Artificial Sequence: Synthetic polypeptide
DEVEIATTNPVATEIYGSVSTNLQGGQGNES

SEQ ID NO: 47115 - protein, 31 aa, Artificial Sequence
  Description of Artificial Sequence: Synthetic polypeptide
DEVEIATTNPVATEIYGSVSTNLQGGDDDDR

SEQ ID NO: 47116 - protein, 33 aa, Artificial Sequence
  Description of Artificial Sequence: Synthetic polypeptide
AEEEIRTTNPVATEQYGSVSVTNNLNQQEGENF

SEQ ID NO: 47117 - protein, 30 aa, Artificial Sequence
  Description of Artificial Sequence: Synthetic polypeptide
CEEEIACTNPVATEHYGVVSTNLQQGNERM

SEQ ID NO: 47118 - protein, 30 aa, Artificial Sequence
  Description of Artificial Sequence: Synthetic polypeptide
DESEICTTNPVATEQYGSVATNLEGGDNDH

SEQ ID NO: 47119 - protein, 28 aa, Artificial Sequence
  Description of Artificial Sequence: Synthetic peptide
QESEIACTNPVATEQYGEASSNLQRGGR

SEQ ID NO: 47120 - protein, 30 aa, Artificial Sequence
  Description of Artificial Sequence: Synthetic polypeptide
DESEICTTNPVATEQYGSVATNLERDNEDA

SEQ ID NO: 47121 - protein, 31 aa, Artificial Sequence
  Description of Artificial Sequence: Synthetic polypeptide
DEVEIATTNPVATEIYGSVSTNLQGDQGQNS

SEQ ID NO: 47122 - protein, 29 aa, Artificial Sequence
  Description of Artificial Sequence: Synthetic peptide
QEQEIATTNPVATEQYGSVSTCLQHEGEL

SEQ ID NO: 47123 - protein, 31 aa, Artificial Sequence
  Description of Artificial Sequence: Synthetic polypeptide
DEVEIATTNPVATEIYGSVSTNLQGDQGDDR

SEQ ID NO: 47124 - protein, 29 aa, Artificial Sequence
  Description of Artificial Sequence: Synthetic peptide
DESEICTTNPVAYDTYGSVSTNLQRTNDM

SEQ ID NO: 47125 - protein, 30 aa, Artificial Sequence
  Description of Artificial Sequence: Synthetic polypeptide
DEVEIATTNPVATEIYGSVSTNLQGDDDER

SEQ ID NO: 47126 - protein, 33 aa, Artificial Sequence
  Description of Artificial Sequence: Synthetic polypeptide
AEEEIRTTNPVATEQYGSVSVTNNLNLQVGTND

SEQ ID NO: 47127 - protein, 30 aa, Artificial Sequence
  Description of Artificial Sequence: Synthetic polypeptide
DESEICTTNPVAYEQYGSVATNLQHGDNDI

SEQ ID NO: 47128 - protein, 31 aa, Artificial Sequence
  Description of Artificial Sequence: Synthetic polypeptide
DESEICTTNPVATEQYGSVATNLERHGNEQP

SEQ ID NO: 47129 - protein, 29 aa, Artificial Sequence
  Description of Artificial Sequence: Synthetic peptide
AENEIATTNPVATEQYGSASEDLQREGGR

SEQ ID NO: 47130 - protein, 29 aa, Artificial Sequence
  Description of Artificial Sequence: Synthetic peptide
DESEICTTNPVATDHYGSVSTNLQRTDDM

SEQ ID NO: 47131 - protein, 33 aa, Artificial Sequence
  Description of Artificial Sequence: Synthetic polypeptide
AEEEIRTTNPVATEQYGSVSVTNNLNQQEGTNG

SEQ ID NO: 47132 - protein, 29 aa, Artificial Sequence
  Description of Artificial Sequence: Synthetic peptide
DEVEIATTNPVATEPYGSVSANNQEQGNQ

SEQ ID NO: 47133 - protein, 30 aa, Artificial Sequence
  Description of Artificial Sequence: Synthetic polypeptide
DEVEIATTNPVATENYGSVSTNLQQMGEDS

SEQ ID NO: 47134 - protein, 32 aa, Artificial Sequence
  Description of Artificial Sequence: Synthetic polypeptide
QEEEVRTTNPVATEQYGSVSLTWNLDQQIGER

SEQ ID NO: 47135 - protein, 31 aa, Artificial Sequence
  Description of Artificial Sequence: Synthetic polypeptide
DESEIATTNPVAYEQYGSVATNLQRGMNMDI

SEQ ID NO: 47136 - protein, 30 aa, Artificial Sequence
  Description of Artificial Sequence: Synthetic polypeptide
DESEIATTNPVAYEQYGSVSTNLMDGGNNT

SEQ ID NO: 47137 - protein, 30 aa, Artificial Sequence
  Description of Artificial Sequence: Synthetic polypeptide
DESEIATTNPVAYEQYGSVSTNLSMPGNNT

SEQ ID NO: 47138 - protein, 29 aa, Artificial Sequence
  Description of Artificial Sequence: Synthetic peptide
QESEIATTNPVATECWGSVSCNLQRGETR

SEQ ID NO: 47139 - protein, 31 aa, Artificial Sequence
  Description of Artificial Sequence: Synthetic polypeptide
DEVEIATTNPVATEIYGSVSTNLQGNDGNGS

SEQ ID NO: 47140 - protein, 30 aa, Artificial Sequence
  Description of Artificial Sequence: Synthetic polypeptide
DESEIATTNPVAYEQYGSVVATNLQNGNDQ

SEQ ID NO: 47141 - protein, 30 aa, Artificial Sequence
  Description of Artificial Sequence: Synthetic polypeptide
QESEIATTNPVATECWGSVSCNLQDRGENR

SEQ ID NO: 47142 - protein, 32 aa, Artificial Sequence
  Description of Artificial Sequence: Synthetic polypeptide
AEEEIRTTNPVATEQYGSVSVTNNLQGETENF

SEQ ID NO: 47143 - protein, 33 aa, Artificial Sequence
  Description of Artificial Sequence: Synthetic polypeptide
AEEEIRTTNPVATEQYGSVSVTNNLQENGENIF

SEQ ID NO: 47144 - protein, 29 aa, Artificial Sequence
  Description of Artificial Sequence: Synthetic peptide
DESEIATVNPVATEQYGSVATNLADPGNH

SEQ ID NO: 47145 - protein, 30 aa, Artificial Sequence
  Description of Artificial Sequence: Synthetic polypeptide
DEVEIATTNPVATENYGSVATNLQEGGMNG

SEQ ID NO: 47146 - protein, 33 aa, Artificial Sequence
  Description of Artificial Sequence: Synthetic polypeptide
AEEEIRTTNPVATEQYGSVSVTNNLQEEEGNTE

SEQ ID NO: 47147 - protein, 33 aa, Artificial Sequence
  Description of Artificial Sequence: Synthetic polypeptide
AEEEIRTTNPVATEQYGSVSVTNNLQDEGNEQV

SEQ ID NO: 47148 - protein, 29 aa, Artificial Sequence
  Description of Artificial Sequence: Synthetic peptide
DESEIATTNPVAYHHYGSVSTNLSQRVNM

SEQ ID NO: 47149 - protein, 28 aa, Artificial Sequence
  Description of Artificial Sequence: Synthetic peptide
SEEEIACTNPIATEQYGSVSENLMRGEM

SEQ ID NO: 47150 - protein, 29 aa, Artificial Sequence
  Description of Artificial Sequence: Synthetic peptide
AENEIATTNPVATEQYGSASEDLQREGER

SEQ ID NO: 47151 - protein, 32 aa, Artificial Sequence
  Description of Artificial Sequence: Synthetic polypeptide
DESEIATTNPVATEQYGKLVPSTNLSQTGGNR

SEQ ID NO: 47152 - protein, 28 aa, Artificial Sequence
  Description of Artificial Sequence: Synthetic peptide
AENEIATTNPVATEQYGEASENLQHGGR

SEQ ID NO: 47153 - protein, 29 aa, Artificial Sequence
  Description of Artificial Sequence: Synthetic peptide
SAEEIATTNPVATEQWGTVSGTNLQNGNS

SEQ ID NO: 47154 - protein, 29 aa, Artificial Sequence
  Description of Artificial Sequence: Synthetic peptide
DESCSRTTNPIAYEQYGEVSTNLQRGNDD

SEQ ID NO: 47155 - protein, 29 aa, Artificial Sequence
  Description of Artificial Sequence: Synthetic peptide
DESEIACTNPISTEQYGSVAAENLQRGNR

SEQ ID NO: 47156 - protein, 29 aa, Artificial Sequence
  Description of Artificial Sequence: Synthetic peptide
SAEEIATTNPVATEQWGTCSTNLQEGNRD

SEQ ID NO: 47157 - protein, 30 aa, Artificial Sequence
  Description of Artificial Sequence: Synthetic polypeptide
DESEIACTNPVATEQYGNVAENLQSRVGNR

SEQ ID NO: 47158 - protein, 29 aa, Artificial Sequence
  Description of Artificial Sequence: Synthetic peptide
AENEIATTNPVATEQYGEASENLQRAGDR

SEQ ID NO: 47159 - protein, 29 aa, Artificial Sequence
  Description of Artificial Sequence: Synthetic peptide
AENEIATTNPVATEQYGEASENLQRAGGR

SEQ ID NO: 47160 - protein, 30 aa, Artificial Sequence
  Description of Artificial Sequence: Synthetic polypeptide
DESEIACTNPVATEQYGNVSAETLQRVGNR

SEQ ID NO: 47161 - protein, 32 aa, Artificial Sequence
  Description of Artificial Sequence: Synthetic polypeptide
DEVEIATTNPVATEQYGSVSTNLEQNDGNLDQ

SEQ ID NO: 47162 - protein, 29 aa, Artificial Sequence
  Description of Artificial Sequence: Synthetic peptide
SAEEIATTNPVATAQYGSVSTGLQHGNEA

SEQ ID NO: 47163 - protein, 29 aa, Artificial Sequence
  Description of Artificial Sequence: Synthetic peptide
SAEEIATTNPVATAQYGSVSTGLQDGNDS

SEQ ID NO: 47164 - protein, 29 aa, Artificial Sequence
  Description of Artificial Sequence: Synthetic peptide
SAEEIATTNPVATAQYGSVCSTDLQNGNF

SEQ ID NO: 47165 - protein, 28 aa, Artificial Sequence
  Description of Artificial Sequence: Synthetic peptide
AENEIATTNPVATEQYGEASENLQREGR

SEQ ID NO: 47166 - protein, 28 aa, Artificial Sequence
  Description of Artificial Sequence: Synthetic peptide
SAEEIATTNPVATAQWGSVSTGLQHGNQ

SEQ ID NO: 47167 - protein, 32 aa, Artificial Sequence
  Description of Artificial Sequence: Synthetic polypeptide
DEVEIATTNPVATEQYGSVSTNLNGDAGGNNR

SEQ ID NO: 47168 - protein, 28 aa, Artificial Sequence
  Description of Artificial Sequence: Synthetic peptide
DESCIRTTNPVAYEQWGCVETNPQRGNI

SEQ ID NO: 47169 - protein, 29 aa, Artificial Sequence
  Description of Artificial Sequence: Synthetic peptide
SAEEIATTNPVATEQWGTVSTNLQDGNDD

SEQ ID NO: 47170 - protein, 30 aa, Artificial Sequence
  Description of Artificial Sequence: Synthetic polypeptide
SAEEIATTNPVATEQYGCVSTNLQDGPNEH

SEQ ID NO: 47171 - protein, 32 aa, Artificial Sequence
  Description of Artificial Sequence: Synthetic polypeptide
DEVEIATTNPVATEQYGSVSTNLNQGGEGNEK

SEQ ID NO: 47172 - protein, 32 aa, Artificial Sequence
  Description of Artificial Sequence: Synthetic polypeptide
DEREISTTNPVATEQYGSVCSTGNLQNGSNQL

SEQ ID NO: 47173 - protein, 31 aa, Artificial Sequence
  Description of Artificial Sequence: Synthetic polypeptide
SAEEIRTTNPVATEQWGTVSTNLQEGDNSRD

SEQ ID NO: 47174 - protein, 29 aa, Artificial Sequence
  Description of Artificial Sequence: Synthetic peptide
DEDVIRTTNPVATEQYGCVETNHQGGTNN

SEQ ID NO: 47175 - protein, 31 aa, Artificial Sequence
  Description of Artificial Sequence: Synthetic polypeptide
DESAIRTTNPVATEQYGSISTNELSIIGGNR

SEQ ID NO: 47176 - protein, 31 aa, Artificial Sequence
  Description of Artificial Sequence: Synthetic polypeptide
DEVEIATTNPVATEQYGSVSTNLNMGDNGET

SEQ ID NO: 47177 - protein, 30 aa, Artificial Sequence
  Description of Artificial Sequence: Synthetic polypeptide
SAEEIATTNPVATEQYGSVATNLQNNGDNP

SEQ ID NO: 47178 - protein, 28 aa, Artificial Sequence
  Description of Artificial Sequence: Synthetic peptide
AENEIATTNPVATEQYGEASENLQRGEL

SEQ ID NO: 47179 - protein, 29 aa, Artificial Sequence
  Description of Artificial Sequence: Synthetic peptide
DESCIRCTNPVATEQYGSVSWNFERGQNQ

SEQ ID NO: 47180 - protein, 30 aa, Artificial Sequence
  Description of Artificial Sequence: Synthetic polypeptide
SAEEIATTNPVATEQYGSVATNLQEAGNDN

SEQ ID NO: 47181 - protein, 29 aa, Artificial Sequence
  Description of Artificial Sequence: Synthetic peptide
DESCIRCTNPVATEQYGSVSWNNFQEGNQ

SEQ ID NO: 47182 - protein, 29 aa, Artificial Sequence
  Description of Artificial Sequence: Synthetic peptide
DESCIRCTNPVATEQYGSVSWNSQPGNNL

SEQ ID NO: 47183 - protein, 28 aa, Artificial Sequence
  Description of Artificial Sequence: Synthetic peptide
DESCIRCTNPVATEQYGSVSWPIQDGNQ

SEQ ID NO: 47184 - protein, 29 aa, Artificial Sequence
  Description of Artificial Sequence: Synthetic peptide
DESCIRTTNPVATEIYGQVTTDLQRQSNR

SEQ ID NO: 47185 - protein, 29 aa, Artificial Sequence
  Description of Artificial Sequence: Synthetic peptide
DESCIRTTNPVATEQYGCVSTNSQFGDKS

SEQ ID NO: 47186 - protein, 31 aa, Artificial Sequence
  Description of Artificial Sequence: Synthetic polypeptide
DEVEIATTNPVATEQYGSVSTNLNGMEGDSR

SEQ ID NO: 47187 - protein, 30 aa, Artificial Sequence
  Description of Artificial Sequence: Synthetic polypeptide
DESCIRCTNPVATEQYGSVSWNLFERGNQM

SEQ ID NO: 47188 - protein, 30 aa, Artificial Sequence
  Description of Artificial Sequence: Synthetic polypeptide
DESEIASTNPVATEQYGNVSAETLQRVGNR

SEQ ID NO: 47189 - protein, 28 aa, Artificial Sequence
  Description of Artificial Sequence: Synthetic peptide
SAEEIATTNPVATAQWGSVSTDLQNGNN

SEQ ID NO: 47190 - protein, 28 aa, Artificial Sequence
  Description of Artificial Sequence: Synthetic peptide
AENEIATTNPVATEQYGEASENLQRGGH

SEQ ID NO: 47191 - protein, 31 aa, Artificial Sequence
  Description of Artificial Sequence: Synthetic polypeptide
DESEIATTNPVATEHYGSVSTNTGQSTGNPR

SEQ ID NO: 47192 - protein, 31 aa, Artificial Sequence
  Description of Artificial Sequence: Synthetic polypeptide
DESEIATTNPVATEPYGSVSTNLQGDGEGQR

SEQ ID NO: 47193 - protein, 31 aa, Artificial Sequence
  Description of Artificial Sequence: Synthetic polypeptide
AEEEIRTTNPVATEQYGSVSTVTQQQGIENN

SEQ ID NO: 47194 - protein, 29 aa, Artificial Sequence
  Description of Artificial Sequence: Synthetic peptide
DEVEIATTNPVATEQYGSVATNLERTTDE

SEQ ID NO: 47195 - protein, 30 aa, Artificial Sequence
  Description of Artificial Sequence: Synthetic polypeptide
DESEIATTNPVATEQWGSASEINEQDRGNR

SEQ ID NO: 47196 - protein, 32 aa, Artificial Sequence
  Description of Artificial Sequence: Synthetic polypeptide
AEEEIRTTNPVATEQYGSVSVTNNLQQEGELG

SEQ ID NO: 47197 - protein, 28 aa, Artificial Sequence
  Description of Artificial Sequence: Synthetic peptide
AENEIATTNPVATEQYGEVSENLQHGEL

SEQ ID NO: 47198 - protein, 29 aa, Artificial Sequence
  Description of Artificial Sequence: Synthetic peptide
DEVEIATTNPVATEQYGSVATNLNGGEGE

SEQ ID NO: 47199 - protein, 31 aa, Artificial Sequence
  Description of Artificial Sequence: Synthetic polypeptide
DESEIATTNPVATEQWGSVSCINLPQDRGNG

SEQ ID NO: 47200 - protein, 28 aa, Artificial Sequence
  Description of Artificial Sequence: Synthetic peptide
DEVEIATTNPVATEQYGSVANNLTDGTE

SEQ ID NO: 47201 - protein, 29 aa, Artificial Sequence
  Description of Artificial Sequence: Synthetic peptide
DEVEIATTNPVATEQYGSVANNLTDGNEH

SEQ ID NO: 47202 - protein, 30 aa, Artificial Sequence
  Description of Artificial Sequence: Synthetic polypeptide
DESEIATTNPVATEQWGSVSTNLQDHEGEL

SEQ ID NO: 47203 - protein, 30 aa, Artificial Sequence
  Description of Artificial Sequence: Synthetic polypeptide
DESEIATTNPVATEQYGCVATNLERGDNDQ

SEQ ID NO: 47204 - protein, 30 aa, Artificial Sequence
  Description of Artificial Sequence: Synthetic polypeptide
DEVEIATTNPVATEQYGNVSTNLQGNTNDQ

SEQ ID NO: 47205 - protein, 30 aa, Artificial Sequence
  Description of Artificial Sequence: Synthetic polypeptide
AENEIATTNPVATEQYGSASAENLQDRGGR

SEQ ID NO: 47206 - protein, 31 aa, Artificial Sequence
  Description of Artificial Sequence: Synthetic polypeptide
DESEIATTNPVATEQYGEVSTNLQGNGDNGA

SEQ ID NO: 47207 - protein, 33 aa, Artificial Sequence
  Description of Artificial Sequence: Synthetic polypeptide
AEEEIRTTNPVATEQYGSVSVTNNLQQDNGNTQ

SEQ ID NO: 47208 - protein, 31 aa, Artificial Sequence
  Description of Artificial Sequence: Synthetic polypeptide
DEVEIATTNPVATEQYGEVSTNLQHGGGNTI

SEQ ID NO: 47209 - protein, 30 aa, Artificial Sequence
  Description of Artificial Sequence: Synthetic polypeptide
REEEIRTTNPVATEQYGSVATLLQETQFDR

SEQ ID NO: 47210 - protein, 30 aa, Artificial Sequence
  Description of Artificial Sequence: Synthetic polypeptide
AENEIATTNPVATEQYGEVSCNLQDRGEGR

SEQ ID NO: 47211 - protein, 28 aa, Artificial Sequence
  Description of Artificial Sequence: Synthetic peptide
AENEIATTNPVATEQYGEASENLQRGGL

SEQ ID NO: 47212 - protein, 29 aa, Artificial Sequence
  Description of Artificial Sequence: Synthetic peptide
DESEIASTNPVATEQYGSVSATDLQHGEI

SEQ ID NO: 47213 - protein, 29 aa, Artificial Sequence
  Description of Artificial Sequence: Synthetic peptide
AENEIATTNPVATEQYGEASENLQRNGGR

SEQ ID NO: 47214 - protein, 31 aa, Artificial Sequence
  Description of Artificial Sequence: Synthetic polypeptide
QEEEISTTNPVATEQYGNVYTTNPLNARGNR

SEQ ID NO: 47215 - protein, 29 aa, Artificial Sequence
  Description of Artificial Sequence: Synthetic peptide
DESEIATTNPVATAFYGTVSTNLQRDNEM

SEQ ID NO: 47216 - protein, 30 aa, Artificial Sequence
  Description of Artificial Sequence: Synthetic polypeptide
DESEIATTNPVATAHYGSVSTNLSQRVNNM

SEQ ID NO: 47217 - protein, 31 aa, Artificial Sequence
  Description of Artificial Sequence: Synthetic polypeptide
DESEIATTNPVATDAYGSVPSTNLSQRVGNM

SEQ ID NO: 47218 - protein, 29 aa, Artificial Sequence
  Description of Artificial Sequence: Synthetic peptide
REEEISTTNPVATEGYGSFVITNLDDGER

SEQ ID NO: 47219 - protein, 31 aa, Artificial Sequence
  Description of Artificial Sequence: Synthetic polypeptide
DESEIATTNPVATDHYGSVSTNLSQRTVGNM

SEQ ID NO: 47220 - protein, 33 aa, Artificial Sequence
  Description of Artificial Sequence: Synthetic polypeptide
AEEEIRTTNPVATEQYGSVSVTNNLQQGNNGNP

SEQ ID NO: 47221 - protein, 30 aa, Artificial Sequence
  Description of Artificial Sequence: Synthetic polypeptide
AENEIATTNPVATEQYGEASTTNLQRGMNV

SEQ ID NO: 47222 - protein, 28 aa, Artificial Sequence
  Description of Artificial Sequence: Synthetic peptide
RENEIACTNPVATEQYGEASENLQRGGR

SEQ ID NO: 47223 - protein, 29 aa, Artificial Sequence
  Description of Artificial Sequence: Synthetic peptide
AENEIATTNPVATEQYGETSENLQRKGGR

SEQ ID NO: 47224 - protein, 33 aa, Artificial Sequence
  Description of Artificial Sequence: Synthetic polypeptide
AEEEIRTTNPVATEQYGSVSVTNNLQQGIGNVN

SEQ ID NO: 47225 - protein, 29 aa, Artificial Sequence
  Description of Artificial Sequence: Synthetic peptide
DEVEIATTNPVATEQYGSVATNLQAEAAE

SEQ ID NO: 47226 - protein, 29 aa, Artificial Sequence
  Description of Artificial Sequence: Synthetic peptide
DESEIATTNPVATECWGSVSCNEQREGNG

SEQ ID NO: 47227 - protein, 30 aa, Artificial Sequence
  Description of Artificial Sequence: Synthetic polypeptide
DESEIATTNPVATDHYGSVVSTNLSQRVNM

SEQ ID NO: 47228 - protein, 29 aa, Artificial Sequence
  Description of Artificial Sequence: Synthetic peptide
DESEICTVNPVATEPYGSVSTNELTEGNH

SEQ ID NO: 47229 - protein, 30 aa, Artificial Sequence
  Description of Artificial Sequence: Synthetic polypeptide
SEEEIACTNPIATEQYGSVSENLMRTGGNR

SEQ ID NO: 47230 - protein, 33 aa, Artificial Sequence
  Description of Artificial Sequence: Synthetic polypeptide
AEEEIRTTNPVATEQYGSVSTVTNNLQNNGNED

SEQ ID NO: 47231 - protein, 31 aa, Artificial Sequence
  Description of Artificial Sequence: Synthetic polypeptide
DEPEIRTTNPVATEQYGSVISTNTGQEEGLE

SEQ ID NO: 47232 - protein, 32 aa, Artificial Sequence
  Description of Artificial Sequence: Synthetic polypeptide
DEPEIRTTNPVATEQYGSVISTNTGQGEGGND

SEQ ID NO: 47233 - protein, 28 aa, Artificial Sequence
  Description of Artificial Sequence: Synthetic peptide
SEEEIASVNPVCTEQYGVVSDNLQSGNR

SEQ ID NO: 47234 - protein, 32 aa, Artificial Sequence
  Description of Artificial Sequence: Synthetic polypeptide
DEPEIRTTNPVATEQYGSVLSTELQPNGVNLG

SEQ ID NO: 47235 - protein, 31 aa, Artificial Sequence
  Description of Artificial Sequence: Synthetic polypeptide
DEPEIRTTNPVATEQYGSVNSTDLVQEQNDQ

SEQ ID NO: 47236 - protein, 28 aa, Artificial Sequence
  Description of Artificial Sequence: Synthetic peptide
AENEIASTNPVATEQYGVASENLQRGNQ

SEQ ID NO: 47237 - protein, 31 aa, Artificial Sequence
  Description of Artificial Sequence: Synthetic polypeptide
DEPEIRTTNPVATEQYGSVSALNLQSMDNNE

SEQ ID NO: 47238 - protein, 28 aa, Artificial Sequence
  Description of Artificial Sequence: Synthetic peptide
SEEEIASVNPVCTEQYGVVSDNLQRGNQ

SEQ ID NO: 47239 - protein, 28 aa, Artificial Sequence
  Description of Artificial Sequence: Synthetic peptide
SEEEIASVNPVCTEQYGSVSDNLQSGNQ

SEQ ID NO: 47240 - protein, 30 aa, Artificial Sequence
  Description of Artificial Sequence: Synthetic polypeptide
DEPEIRTTNPVATEQYGSVSIDELSVRGPN

SEQ ID NO: 47241 - protein, 31 aa, Artificial Sequence
  Description of Artificial Sequence: Synthetic polypeptide
DEPEIRTTNPVATEQYGSVSINLQEQGPETV

SEQ ID NO: 47242 - protein, 31 aa, Artificial Sequence
  Description of Artificial Sequence: Synthetic polypeptide
DEVEIATTNPVAYEQYGSVSTNLQNQGDNGD

SEQ ID NO: 47243 - protein, 32 aa, Artificial Sequence
  Description of Artificial Sequence: Synthetic polypeptide
DEPEIRTTNPVATEQYGSVSLVNLARNVNERM

SEQ ID NO: 47244 - protein, 30 aa, Artificial Sequence
  Description of Artificial Sequence: Synthetic polypeptide
DEPEIRTTNPVATEQYGSVSMLLARNVNED

SEQ ID NO: 47245 - protein, 29 aa, Artificial Sequence
  Description of Artificial Sequence: Synthetic peptide
SEEEIASTNPVATEQYGSVAENLMSRGQR

SEQ ID NO: 47246 - protein, 28 aa, Artificial Sequence
  Description of Artificial Sequence: Synthetic peptide
SEEEIASVNPVCTEQYGVVSENLQRGNQ

SEQ ID NO: 47247 - protein, 32 aa, Artificial Sequence
  Description of Artificial Sequence: Synthetic polypeptide
AEEEIRTTNPVATEQYGSVSVTNQQQQIGNED

SEQ ID NO: 47248 - protein, 31 aa, Artificial Sequence
  Description of Artificial Sequence: Synthetic polypeptide
DEPEIRTTNPVATEQYGSISTTNQQQEGLIR

SEQ ID NO: 47249 - protein, 30 aa, Artificial Sequence
  Description of Artificial Sequence: Synthetic polypeptide
DEPEIRTTNPVATEQYGSISTINQQQEGLG

SEQ ID NO: 47250 - protein, 29 aa, Artificial Sequence
  Description of Artificial Sequence: Synthetic peptide
DEPEIRTTNPVATDQYGDVSTNGLEGGDG

SEQ ID NO: 47251 - protein, 30 aa, Artificial Sequence
  Description of Artificial Sequence: Synthetic polypeptide
DEPEIRTTNPVATDQYGDVSTNGLGGGNEP

SEQ ID NO: 47252 - protein, 30 aa, Artificial Sequence
  Description of Artificial Sequence: Synthetic polypeptide
DEPEIRTTNPVATDQYGDVSTNNGLEGGNP

SEQ ID NO: 47253 - protein, 30 aa, Artificial Sequence
  Description of Artificial Sequence: Synthetic polypeptide
CEEEIRTTNPVATEQYGCVCSTEDQSGSNA

SEQ ID NO: 47254 - protein, 31 aa, Artificial Sequence
  Description of Artificial Sequence: Synthetic polypeptide
CEEEIRTTNPVATEQYGCVCSSNLQRGSEAS

SEQ ID NO: 47255 - protein, 31 aa, Artificial Sequence
  Description of Artificial Sequence: Synthetic polypeptide
DEVEIATTNPVAYEQYGSVSTNLQSGGGNTD

SEQ ID NO: 47256 - protein, 32 aa, Artificial Sequence
  Description of Artificial Sequence: Synthetic polypeptide
AEEEIRTTNPVATEQYGSVSTVSNQQVNGINT

SEQ ID NO: 47257 - protein, 32 aa, Artificial Sequence
  Description of Artificial Sequence: Synthetic polypeptide
CEEEIRTTNPVATEQYGCVCSMTNLQGMGSNQ

SEQ ID NO: 47258 - protein, 28 aa, Artificial Sequence
  Description of Artificial Sequence: Synthetic peptide
SEEEIATTNPIATEQYGDVSENLQHEER

SEQ ID NO: 47259 - protein, 28 aa, Artificial Sequence
  Description of Artificial Sequence: Synthetic peptide
SEEEIATTNPIATECYGSVSENLQREEL

SEQ ID NO: 47260 - protein, 28 aa, Artificial Sequence
  Description of Artificial Sequence: Synthetic peptide
SEEEIATTNPIATECYGSVSENLMRGEL

SEQ ID NO: 47261 - protein, 31 aa, Artificial Sequence
  Description of Artificial Sequence: Synthetic polypeptide
DEPEIRTTNPVATEQYGETSTNLQQRADNSV

SEQ ID NO: 47262 - protein, 28 aa, Artificial Sequence
  Description of Artificial Sequence: Synthetic peptide
AENEIASTNPVATEQYGEVSDNLQSGGR

SEQ ID NO: 47263 - protein, 31 aa, Artificial Sequence
  Description of Artificial Sequence: Synthetic polypeptide
DEPEIRTTNPVATEQYGETSTTNLQQRGDSV

SEQ ID NO: 47264 - protein, 28 aa, Artificial Sequence
  Description of Artificial Sequence: Synthetic peptide
AENEIASTNPVATEQYGKASENLQRGGR

SEQ ID NO: 47265 - protein, 31 aa, Artificial Sequence
  Description of Artificial Sequence: Synthetic polypeptide
DEVEIATTNPVAYEQYGSVSTNLQSDGGNDS

SEQ ID NO: 47266 - protein, 33 aa, Artificial Sequence
  Description of Artificial Sequence: Synthetic polypeptide
AEEEIRTTNPVATEQYGSVSTVSTNLQAGNEIN

SEQ ID NO: 47267 - protein, 30 aa, Artificial Sequence
  Description of Artificial Sequence: Synthetic polypeptide
DEVEIATTNPVAYEQYGSVVTNLQGNGNDE

SEQ ID NO: 47268 - protein, 31 aa, Artificial Sequence
  Description of Artificial Sequence: Synthetic polypeptide
DEVEIATTNPVAYEQYGSVSTNLQNGQGNVN

SEQ ID NO: 47269 - protein, 31 aa, Artificial Sequence
  Description of Artificial Sequence: Synthetic polypeptide
DEVEIATTNPVAYEQYGSVSTNLQIGGGNEI

SEQ ID NO: 47270 - protein, 30 aa, Artificial Sequence
  Description of Artificial Sequence: Synthetic polypeptide
DEPEIYTTNPVATEQYGSVSVNLMYEGVNT

SEQ ID NO: 47271 - protein, 32 aa, Artificial Sequence
  Description of Artificial Sequence: Synthetic polypeptide
AEEEIRTTNPVATEQYGSVSVTNQQQQGNQTQ

SEQ ID NO: 47272 - protein, 30 aa, Artificial Sequence
  Description of Artificial Sequence: Synthetic polypeptide
DEQAICTTNPVATEQYGSVNSTNLIIGNTT

SEQ ID NO: 47273 - protein, 30 aa, Artificial Sequence
  Description of Artificial Sequence: Synthetic polypeptide
DEQAICTTNPVATEQYGSVSSTNNLIIGNV

SEQ ID NO: 47274 - protein, 31 aa, Artificial Sequence
  Description of Artificial Sequence: Synthetic polypeptide
DEVEIATTNPVAYEQYGSVSTNLGQGSGGNV

SEQ ID NO: 47275 - protein, 32 aa, Artificial Sequence
  Description of Artificial Sequence: Synthetic polypeptide
CEEEIRTTNPVATEAYGKVSVTNELSTRGGNR

SEQ ID NO: 47276 - protein, 29 aa, Artificial Sequence
  Description of Artificial Sequence: Synthetic peptide
SEEEIACTNPVATESYGSVATNLQAGNHN

SEQ ID NO: 47277 - protein, 29 aa, Artificial Sequence
  Description of Artificial Sequence: Synthetic peptide
DEQEIACTNPIATEQYGSVSTNLEDHGER

SEQ ID NO: 47278 - protein, 28 aa, Artificial Sequence
  Description of Artificial Sequence: Synthetic peptide
AENEIASVNPVATEQYGEVSENLQRGGR

SEQ ID NO: 47279 - protein, 29 aa, Artificial Sequence
  Description of Artificial Sequence: Synthetic peptide
DEQEIACTNPVATEQYGEASTNLEDRGER

SEQ ID NO: 47280 - protein, 28 aa, Artificial Sequence
  Description of Artificial Sequence: Synthetic peptide
AENEIASVNPVATEQYGVVSENLQRGGR

SEQ ID NO: 47281 - protein, 32 aa, Artificial Sequence
  Description of Artificial Sequence: Synthetic polypeptide
AEEEIRTTNPVATEQYGSVSTVTNDQVGNITN

SEQ ID NO: 47282 - protein, 28 aa, Artificial Sequence
  Description of Artificial Sequence: Synthetic peptide
DEQEIACTNPVATEQYGEVSTDLQHGGL

SEQ ID NO: 47283 - protein, 30 aa, Artificial Sequence
  Description of Artificial Sequence: Synthetic polypeptide
DEQEIACTNPVATEQYGSVATNLERGNDYN

SEQ ID NO: 47284 - protein, 28 aa, Artificial Sequence
  Description of Artificial Sequence: Synthetic peptide
AENEIASVNPVATEQYGVVSENLQRGNQ

SEQ ID NO: 47285 - protein, 30 aa, Artificial Sequence
  Description of Artificial Sequence: Synthetic polypeptide
DEPEIYTTNPVATEQYGSVSSNLMEVGNIP

SEQ ID NO: 47286 - protein, 32 aa, Artificial Sequence
  Description of Artificial Sequence: Synthetic polypeptide
AEEEIRTTNPVATEQYGSVSVTNQQQQGNTEQ

SEQ ID NO: 47287 - protein, 30 aa, Artificial Sequence
  Description of Artificial Sequence: Synthetic polypeptide
DEPEITTTNPVATEQYGSVSSNLMEVGQNT

SEQ ID NO: 47288 - protein, 31 aa, Artificial Sequence
  Description of Artificial Sequence: Synthetic polypeptide
CEEEIRTTNPVATECYGSVVSTTLSQNRGGL

SEQ ID NO: 47289 - protein, 32 aa, Artificial Sequence
  Description of Artificial Sequence: Synthetic polypeptide
DEPEIRTTNPVATEQYGSVSQNLPARNVNERV

SEQ ID NO: 47290 - protein, 28 aa, Artificial Sequence
  Description of Artificial Sequence: Synthetic peptide
SEEEIAPTNPISSEQYGSVSCNLQRGTR

SEQ ID NO: 47291 - protein, 31 aa, Artificial Sequence
  Description of Artificial Sequence: Synthetic polypeptide
DEVEIATTNPVAYEQYGSVSTNLQGSGGGNQ

SEQ ID NO: 47292 - protein, 31 aa, Artificial Sequence
  Description of Artificial Sequence: Synthetic polypeptide
DEPEIRTTNPVATEQYGSVSTLLDETGDNQE

SEQ ID NO: 47293 - protein, 33 aa, Artificial Sequence
  Description of Artificial Sequence: Synthetic polypeptide
DEPEIRTTNPVATEQYGSVSTNELTQETGEDRQ

SEQ ID NO: 47294 - protein, 33 aa, Artificial Sequence
  Description of Artificial Sequence: Synthetic polypeptide
DEPEIRTTNPVATEQYGSVSTNLEPRVAENERF

SEQ ID NO: 47295 - protein, 32 aa, Artificial Sequence
  Description of Artificial Sequence: Synthetic polypeptide
DEPEIRTTNPVATEQYGSVSTNLQGFGDIIQD

SEQ ID NO: 47296 - protein, 28 aa, Artificial Sequence
  Description of Artificial Sequence: Synthetic peptide
SEEEIASTNPVATEGYGSMSENLMRGNI

SEQ ID NO: 47297 - protein, 33 aa, Artificial Sequence
  Description of Artificial Sequence: Synthetic polypeptide
CEEEIRTTNPVATEPWGSVSTNELSQRNGGPNR

SEQ ID NO: 47298 - protein, 28 aa, Artificial Sequence
  Description of Artificial Sequence: Synthetic peptide
SEEEIACVNPVCTEQYGVVSDNLQSGNR

SEQ ID NO: 47299 - protein, 30 aa, Artificial Sequence
  Description of Artificial Sequence: Synthetic polypeptide
DEVEIATTNPVAYEQYGSVSTNLQGQGGDE

SEQ ID NO: 47300 - protein, 30 aa, Artificial Sequence
  Description of Artificial Sequence: Synthetic polypeptide
DEPEIRTTNPVATEQYGSVSTPVGFQRMEN

SEQ ID NO: 47301 - protein, 31 aa, Artificial Sequence
  Description of Artificial Sequence: Synthetic polypeptide
DEVEIATTNPVAYEQYGSVSTNLQGGAGNDA

SEQ ID NO: 47302 - protein, 31 aa, Artificial Sequence
  Description of Artificial Sequence: Synthetic polypeptide
DEPEIRTTNPVATEQYGSVYFTNLQRFDEPD

SEQ ID NO: 47303 - protein, 30 aa, Artificial Sequence
  Description of Artificial Sequence: Synthetic polypeptide
DEVEIATTNPVAYEQYGSVSTNLQGDGDGI

SEQ ID NO: 47304 - protein, 30 aa, Artificial Sequence
  Description of Artificial Sequence: Synthetic polypeptide
DEPEISTTNPVATEQYGSVSSNLMEVGNNT

SEQ ID NO: 47305 - protein, 31 aa, Artificial Sequence
  Description of Artificial Sequence: Synthetic polypeptide
CEEEIRTTNPVATENYGSVSSEQNPQVMGNR

SEQ ID NO: 47306 - protein, 28 aa, Artificial Sequence
  Description of Artificial Sequence: Synthetic peptide
AENEIASTNPVATEQYGEASSNLQRGGR

SEQ ID NO: 47307 - protein, 28 aa, Artificial Sequence
  Description of Artificial Sequence: Synthetic peptide
SEEEIATTNPIATEQYGSVSENLMHEER

SEQ ID NO: 47308 - protein, 28 aa, Artificial Sequence
  Description of Artificial Sequence: Synthetic peptide
AENEIASTNPVATEQYGEASSNLQRGDR

SEQ ID NO: 47309 - protein, 31 aa, Artificial Sequence
  Description of Artificial Sequence: Synthetic polypeptide
SEEEIATTNPVATEQYGSVATNDNRNGNERT

SEQ ID NO: 47310 - protein, 30 aa, Artificial Sequence
  Description of Artificial Sequence: Synthetic polypeptide
SEEEIATTNPVATEQYGSVATALQNNNSER

SEQ ID NO: 47311 - protein, 28 aa, Artificial Sequence
  Description of Artificial Sequence: Synthetic peptide
DENEIVCTNPVATEQYGEASENLQFGGR

SEQ ID NO: 47312 - protein, 29 aa, Artificial Sequence
  Description of Artificial Sequence: Synthetic peptide
DENEIVCTNPVATEQYGTVSAENPQFGNR

SEQ ID NO: 47313 - protein, 29 aa, Artificial Sequence
  Description of Artificial Sequence: Synthetic peptide
SEEEIATTNPVATEQYGSVATADQNGQRH

SEQ ID NO: 47314 - protein, 28 aa, Artificial Sequence
  Description of Artificial Sequence: Synthetic peptide
AENEIAQTNPVATEQYGEASENLQRGGR

SEQ ID NO: 47315 - protein, 31 aa, Artificial Sequence
  Description of Artificial Sequence: Synthetic polypeptide
SEEEIATTNPVATEQYGSVAITNLERGNTEH

SEQ ID NO: 47316 - protein, 28 aa, Artificial Sequence
  Description of Artificial Sequence: Synthetic peptide
DENEIVTTNPVATEQYGDVSECLQHGEL

SEQ ID NO: 47317 - protein, 30 aa, Artificial Sequence
  Description of Artificial Sequence: Synthetic polypeptide
SEEEIATTNPVATEQYGSVAITNDQQGNPE

SEQ ID NO: 47318 - protein, 30 aa, Artificial Sequence
  Description of Artificial Sequence: Synthetic polypeptide
DEVEIATTNPVAYEQYGTVSTNLQEGGNAQ

SEQ ID NO: 47319 - protein, 30 aa, Artificial Sequence
  Description of Artificial Sequence: Synthetic polypeptide
DENEIVTTNPVATEQYGEVSTNPVEFEGNR

SEQ ID NO: 47320 - protein, 32 aa, Artificial Sequence
  Description of Artificial Sequence: Synthetic polypeptide
QEEEIRTTNPVATEQYGSVSSTCAGNMRNGNR

SEQ ID NO: 47321 - protein, 31 aa, Artificial Sequence
  Description of Artificial Sequence: Synthetic polypeptide
DENHIGTTNPVATEQYGSVCTNQLQARMGNL

SEQ ID NO: 47322 - protein, 30 aa, Artificial Sequence
  Description of Artificial Sequence: Synthetic polypeptide
DEVEIATTNPVAYEQYGTVSTNLQEGGGNH

SEQ ID NO: 47323 - protein, 28 aa, Artificial Sequence
  Description of Artificial Sequence: Synthetic peptide
DENRIACTNPVATEQYGEASENLQRGGR

SEQ ID NO: 47324 - protein, 30 aa, Artificial Sequence
  Description of Artificial Sequence: Synthetic polypeptide
SEEEIATTNPVATEQYGSVATNDQANGNET

SEQ ID NO: 47325 - protein, 29 aa, Artificial Sequence
  Description of Artificial Sequence: Synthetic peptide
CEEEIRTTNPVATEQYGCVGTALQNFGFQ

SEQ ID NO: 47326 - protein, 30 aa, Artificial Sequence
  Description of Artificial Sequence: Synthetic polypeptide
SEEEIATTNPVATEQYGSVATNDQDQGNEQ

SEQ ID NO: 47327 - protein, 32 aa, Artificial Sequence
  Description of Artificial Sequence: Synthetic polypeptide
CEEEIRTTNPVATEQYGCVSTELFQRFGSNDA

SEQ ID NO: 47328 - protein, 33 aa, Artificial Sequence
  Description of Artificial Sequence: Synthetic polypeptide
DENEIRTTNPVAYEQYGSVSYTLNALSQAGGNR

SEQ ID NO: 47329 - protein, 30 aa, Artificial Sequence
  Description of Artificial Sequence: Synthetic polypeptide
DENEIRTTNPVCTEHYGSVSMPSLQRGGNE

SEQ ID NO: 47330 - protein, 30 aa, Artificial Sequence
  Description of Artificial Sequence: Synthetic polypeptide
DENEIRTTNPVCTEHYGSVSSPNLERGNFL

SEQ ID NO: 47331 - protein, 31 aa, Artificial Sequence
  Description of Artificial Sequence: Synthetic polypeptide
DENEIRTTNPVCTEHYGSVSSPNLQIRGNEL

SEQ ID NO: 47332 - protein, 30 aa, Artificial Sequence
  Description of Artificial Sequence: Synthetic polypeptide
DENEIRTTNPVCTEHYGSVTSMPDLQRGNL

SEQ ID NO: 47333 - protein, 28 aa, Artificial Sequence
  Description of Artificial Sequence: Synthetic peptide
AENEIAPTNPVATEQYGIASENLQRGGR

SEQ ID NO: 47334 - protein, 30 aa, Artificial Sequence
  Description of Artificial Sequence: Synthetic polypeptide
CEEEIRTTNPVATEQYGCVSTNNQNNSNQS

SEQ ID NO: 47335 - protein, 28 aa, Artificial Sequence
  Description of Artificial Sequence: Synthetic peptide
AENEIASTNPVATEQYGEASDNLQSGNR

SEQ ID NO: 47336 - protein, 32 aa, Artificial Sequence
  Description of Artificial Sequence: Synthetic polypeptide
CEEEIRTTNPVATEQYGCVSTNLNQGFGSNQE

SEQ ID NO: 47337 - protein, 31 aa, Artificial Sequence
  Description of Artificial Sequence: Synthetic polypeptide
CEEEIRTTNPVATEQYGCVSTNHQNSNSNRD

SEQ ID NO: 47338 - protein, 33 aa, Artificial Sequence
  Description of Artificial Sequence: Synthetic polypeptide
AEEEIRTTNPVATEQYGSVSTVQNLQIGTNNEE

SEQ ID NO: 47339 - protein, 30 aa, Artificial Sequence
  Description of Artificial Sequence: Synthetic polypeptide
CEEEIRTTNPVATEQYGCVSTNHQNGSEAN

SEQ ID NO: 47340 - protein, 31 aa, Artificial Sequence
  Description of Artificial Sequence: Synthetic polypeptide
CEEEIRTTNPVATEQYGCVSTGNLQNSGSEQ

SEQ ID NO: 47341 - protein, 31 aa, Artificial Sequence
  Description of Artificial Sequence: Synthetic polypeptide
DENEIRTTNPVSTEPYGSVSMEDLQQQRGNR

SEQ ID NO: 47342 - protein, 33 aa, Artificial Sequence
  Description of Artificial Sequence: Synthetic polypeptide
CEEEIRTTNPVATEQYGCVSTENLNQRFGENNQ

SEQ ID NO: 47343 - protein, 32 aa, Artificial Sequence
  Description of Artificial Sequence: Synthetic polypeptide
CEEEIRTTNPVATEQYGCVSTELQERFNSNRD

SEQ ID NO: 47344 - protein, 32 aa, Artificial Sequence
  Description of Artificial Sequence: Synthetic polypeptide
CEEEIRTTNPVATEQYGCVSTNLEQRFNSNQD

SEQ ID NO: 47345 - protein, 29 aa, Artificial Sequence
  Description of Artificial Sequence: Synthetic peptide
DENTIRTTNPVATEGYGCVETNPDQRGNG

SEQ ID NO: 47346 - protein, 31 aa, Artificial Sequence
  Description of Artificial Sequence: Synthetic polypeptide
SEEEIATTNPVATEQWGSVSATNLQQGNEIA

SEQ ID NO: 47347 - protein, 32 aa, Artificial Sequence
  Description of Artificial Sequence: Synthetic polypeptide
CEEEIRTTNPVATEQYGCVCSTNLQRFMSERP

SEQ ID NO: 47348 - protein, 31 aa, Artificial Sequence
  Description of Artificial Sequence: Synthetic polypeptide
AEEEIRTTNPVATEQYGSVSTVQQQQTNGNM

SEQ ID NO: 47349 - protein, 30 aa, Artificial Sequence
  Description of Artificial Sequence: Synthetic polypeptide
AEEEIRTTNPVATEQYGSVSTVQQQQTTNN

SEQ ID NO: 47350 - protein, 32 aa, Artificial Sequence
  Description of Artificial Sequence: Synthetic polypeptide
AEEEIRTTNPVATEQYGSVSVTNQQQQQGNEM

SEQ ID NO: 47351 - protein, 31 aa, Artificial Sequence
  Description of Artificial Sequence: Synthetic polypeptide
DEPEIATTNPVATEQYGSVSSNLMQEVGNTG

SEQ ID NO: 47352 - protein, 30 aa, Artificial Sequence
  Description of Artificial Sequence: Synthetic polypeptide
SEEEIATTNPVATEGYGSVSTNLQQGDEQG

SEQ ID NO: 47353 - protein, 30 aa, Artificial Sequence
  Description of Artificial Sequence: Synthetic polypeptide
DEPEIATTNPVATWQYGMVSITTQQRGNER

SEQ ID NO: 47354 - protein, 30 aa, Artificial Sequence
  Description of Artificial Sequence: Synthetic polypeptide
DEPEIATTNPVATWQYGMVSTTEEQRGNRE

SEQ ID NO: 47355 - protein, 32 aa, Artificial Sequence
  Description of Artificial Sequence: Synthetic polypeptide
AEEEIRTTNPVATEQYGSVSVTNQQQQQGNVE

SEQ ID NO: 47356 - protein, 28 aa, Artificial Sequence
  Description of Artificial Sequence: Synthetic peptide
DEPEIATTNPVATWQYGMVSTTEQNGNG

SEQ ID NO: 47357 - protein, 31 aa, Artificial Sequence
  Description of Artificial Sequence: Synthetic polypeptide
CEEEIRTTNPVATEQYGCVCSTEPQRNSNRD

SEQ ID NO: 47358 - protein, 32 aa, Artificial Sequence
  Description of Artificial Sequence: Synthetic polypeptide
DEPEICTTNPVATEQYGSVSTQNGLFQQRGEF

SEQ ID NO: 47359 - protein, 31 aa, Artificial Sequence
  Description of Artificial Sequence: Synthetic polypeptide
DEPEIGTTNPVATEQYGSVSTNGLFGERGEF

SEQ ID NO: 47360 - protein, 31 aa, Artificial Sequence
  Description of Artificial Sequence: Synthetic polypeptide
CEEEIRTTNPVATEQYGCVCSTELQYGSNVS

SEQ ID NO: 47361 - protein, 31 aa, Artificial Sequence
  Description of Artificial Sequence: Synthetic polypeptide
DEPEIGTTNPVATEQYGSVSTNGLGQQGGEF

SEQ ID NO: 47362 - protein, 31 aa, Artificial Sequence
  Description of Artificial Sequence: Synthetic polypeptide
CEEEIRTTNPVATEQYGCVCSTELQNMSNRP

SEQ ID NO: 47363 - protein, 31 aa, Artificial Sequence
  Description of Artificial Sequence: Synthetic polypeptide
CEEEIRTTNPVATEQYGCVCSTELQHSGSNA

SEQ ID NO: 47364 - protein, 31 aa, Artificial Sequence
  Description of Artificial Sequence: Synthetic polypeptide
DEPEIATTNPVAYEQYGSVSTNLQERGGLEA

SEQ ID NO: 47365 - protein, 29 aa, Artificial Sequence
  Description of Artificial Sequence: Synthetic peptide
DEQEIACTNPVATEQYGSVSEDLMHGNDR

SEQ ID NO: 47366 - protein, 31 aa, Artificial Sequence
  Description of Artificial Sequence: Synthetic polypeptide
CEEEIRTTNPVATEQYGCVCSTGNDQFGSNQ

SEQ ID NO: 47367 - protein, 31 aa, Artificial Sequence
  Description of Artificial Sequence: Synthetic polypeptide
CEEEIRTTNPVATEQYGCVCSTGNHQRGSDA

SEQ ID NO: 47368 - protein, 31 aa, Artificial Sequence
  Description of Artificial Sequence: Synthetic polypeptide
CEEEIRTTNPVATEQYGCVCSTNLQNGSQQN

SEQ ID NO: 47369 - protein, 30 aa, Artificial Sequence
  Description of Artificial Sequence: Synthetic polypeptide
DENTIRTTNPVATEQYGSTSETNYIGIGNR

SEQ ID NO: 47370 - protein, 30 aa, Artificial Sequence
  Description of Artificial Sequence: Synthetic polypeptide
DENTIRTTNPVATEQYGSVSTNLEDYAMER

SEQ ID NO: 47371 - protein, 32 aa, Artificial Sequence
  Description of Artificial Sequence: Synthetic polypeptide
CEEEIRTTNPVATEQYGCVCSTNLQFFNSNRD

SEQ ID NO: 47372 - protein, 32 aa, Artificial Sequence
  Description of Artificial Sequence: Synthetic polypeptide
CEEEIRTTNPVATEQYGCVCSTNLQERGSEQN

SEQ ID NO: 47373 - protein, 28 aa, Artificial Sequence
  Description of Artificial Sequence: Synthetic peptide
DENVICTTNPVATEQYGCVETNPQQGND

SEQ ID NO: 47374 - protein, 31 aa, Artificial Sequence
  Description of Artificial Sequence: Synthetic polypeptide
CEEEIRTTNPVATEQYGCVCSTNHQSGSNVS

SEQ ID NO: 47375 - protein, 30 aa, Artificial Sequence
  Description of Artificial Sequence: Synthetic polypeptide
SEEEIATTNPVATEQWGSVATNLDRGGNDQ

SEQ ID NO: 47376 - protein, 28 aa, Artificial Sequence
  Description of Artificial Sequence: Synthetic peptide
AENEIASTNPVATEQYGEASENLQRGGR

SEQ ID NO: 47377 - protein, 31 aa, Artificial Sequence
  Description of Artificial Sequence: Synthetic polypeptide
CEEEIRTTNPVATEQYGCVCSTNHQHFGSNV

SEQ ID NO: 47378 - protein, 29 aa, Artificial Sequence
  Description of Artificial Sequence: Synthetic peptide
DENVICTTNPVATEQYGVVETNPQIGNNR

SEQ ID NO: 47379 - protein, 30 aa, Artificial Sequence
  Description of Artificial Sequence: Synthetic polypeptide
DENVIGTTNPVATEQWGCVCSTDDLQRGNR

SEQ ID NO: 47380 - protein, 32 aa, Artificial Sequence
  Description of Artificial Sequence: Synthetic polypeptide
CEEEIRTTNPVATEQYGCVCSTNEQRFGSNQF

SEQ ID NO: 47381 - protein, 32 aa, Artificial Sequence
  Description of Artificial Sequence: Synthetic polypeptide
CEEEIRTTNPVATEQYGCVCSTNDLQRGSDQN

SEQ ID NO: 47382 - protein, 33 aa, Artificial Sequence
  Description of Artificial Sequence: Synthetic polypeptide
CEEEIRTTNPVATEQYGCVCSTGNLQRFGSNVS

SEQ ID NO: 47383 - protein, 29 aa, Artificial Sequence
  Description of Artificial Sequence: Synthetic peptide
DENVIGTTNPVATEQWGSVSTDQLQTGNA

SEQ ID NO: 47384 - protein, 31 aa, Artificial Sequence
  Description of Artificial Sequence: Synthetic polypeptide
CEEEIRTTNPVATEQYGCVCSTNHQHGSNNA

SEQ ID NO: 47385 - protein, 30 aa, Artificial Sequence
  Description of Artificial Sequence: Synthetic polypeptide
DEVEIATTNPVAYEQYGSVSTNDQHSGGND

SEQ ID NO: 47386 - protein, 29 aa, Artificial Sequence
  Description of Artificial Sequence: Synthetic peptide
DEQEIAPTNPCATEQYGIVSTNLQDHGTR

SEQ ID NO: 47387 - protein, 29 aa, Artificial Sequence
  Description of Artificial Sequence: Synthetic peptide
DEQEIAPTNPCATEQYGIVSTNLQDSGTR

SEQ ID NO: 47388 - protein, 29 aa, Artificial Sequence
  Description of Artificial Sequence: Synthetic peptide
DEQEIATTNPVATEQYGSVSTDLEHEGEL

SEQ ID NO: 47389 - protein, 29 aa, Artificial Sequence
  Description of Artificial Sequence: Synthetic peptide
DEQEIATTNPVATEQYGSVSTDLEHGEDL

SEQ ID NO: 47390 - protein, 30 aa, Artificial Sequence
  Description of Artificial Sequence: Synthetic polypeptide
SEEEIACTNPVATEPYGSVATNLQRGNQDQ

SEQ ID NO: 47391 - protein, 30 aa, Artificial Sequence
  Description of Artificial Sequence: Synthetic polypeptide
DEQEIATTNPVATEQYGSVSTDLQDHEGEL

SEQ ID NO: 47392 - protein, 28 aa, Artificial Sequence
  Description of Artificial Sequence: Synthetic peptide
AENEIATTNPVATECYGEVSENLQRGEL

SEQ ID NO: 47393 - protein, 29 aa, Artificial Sequence
  Description of Artificial Sequence: Synthetic peptide
SEEEIACTNPVATEMYGSVSTNDQEGNQM

SEQ ID NO: 47394 - protein, 31 aa, Artificial Sequence
  Description of Artificial Sequence: Synthetic polypeptide
DEQEIATTNPVATEQYGSVSTNDLQMNPDDR

SEQ ID NO: 47395 - protein, 31 aa, Artificial Sequence
  Description of Artificial Sequence: Synthetic polypeptide
AEEEIRTTNPVATEQYGSVSVTNNTEQINND

SEQ ID NO: 47396 - protein, 31 aa, Artificial Sequence
  Description of Artificial Sequence: Synthetic polypeptide
DEQEIATTNPVATEQYGSVSTNLEDHEGNDL

SEQ ID NO: 47397 - protein, 29 aa, Artificial Sequence
  Description of Artificial Sequence: Synthetic peptide
SEEEIACTNPVATEIYGVVSTNLQDGNDQ

SEQ ID NO: 47398 - protein, 29 aa, Artificial Sequence
  Description of Artificial Sequence: Synthetic peptide
SEEEIACTNPVATEGYGVVSTNLQRPDRL

SEQ ID NO: 47399 - protein, 31 aa, Artificial Sequence
  Description of Artificial Sequence: Synthetic polypeptide
DEQEIATTNPVATEQYGSVSTNLNMGDNNGD

SEQ ID NO: 47400 - protein, 31 aa, Artificial Sequence
  Description of Artificial Sequence: Synthetic polypeptide
DEQEIATTNPVATEQYGSVSTNLQDHEGEDL

SEQ ID NO: 47401 - protein, 31 aa, Artificial Sequence
  Description of Artificial Sequence: Synthetic polypeptide
DEQEIATTNPVATEQYGSVSTNLQGNDDNNN

SEQ ID NO: 47402 - protein, 32 aa, Artificial Sequence
  Description of Artificial Sequence: Synthetic polypeptide
DEQEIATTNPVATEQYGSVSTNLQGNDSGNNS

SEQ ID NO: 47403 - protein, 32 aa, Artificial Sequence
  Description of Artificial Sequence: Synthetic polypeptide
AEEEIRTTNPVATEQYGSVSVTNQDQGNGNEE

SEQ ID NO: 47404 - protein, 30 aa, Artificial Sequence
  Description of Artificial Sequence: Synthetic polypeptide
DEQEIATTNPVATEQYGSVSTDLEDREGEL

SEQ ID NO: 47405 - protein, 29 aa, Artificial Sequence
  Description of Artificial Sequence: Synthetic peptide
DEVEIATTNPVATIQYGMVSTAQQRHGNN

SEQ ID NO: 47406 - protein, 29 aa, Artificial Sequence
  Description of Artificial Sequence: Synthetic peptide
DEVEIATTNPVATIQYGMVSTEAPQRGTR

SEQ ID NO: 47407 - protein, 31 aa, Artificial Sequence
  Description of Artificial Sequence: Synthetic polypeptide
DEQEIATTNPVATEQYGSVSATNLEDSEGNL

SEQ ID NO: 47408 - protein, 32 aa, Artificial Sequence
  Description of Artificial Sequence: Synthetic polypeptide
AEEEIRTTNPVATEQYGSVSVTNQDQGNGNQA

SEQ ID NO: 47409 - protein, 30 aa, Artificial Sequence
  Description of Artificial Sequence: Synthetic polypeptide
DEVEIATTNPVATTQYGMVSTANQRDGDNR

SEQ ID NO: 47410 - protein, 32 aa, Artificial Sequence
  Description of Artificial Sequence: Synthetic polypeptide
DEQEIATTNPVATEQYGSVSATNLQDHEGEDR

SEQ ID NO: 47411 - protein, 31 aa, Artificial Sequence
  Description of Artificial Sequence: Synthetic polypeptide
DEQEIATTNPVATEQYGSVSATNLQDHGEDL

SEQ ID NO: 47412 - protein, 30 aa, Artificial Sequence
  Description of Artificial Sequence: Synthetic polypeptide
DEVEIATTNPVATTQYGMVSTADQRGGNER

SEQ ID NO: 47413 - protein, 30 aa, Artificial Sequence
  Description of Artificial Sequence: Synthetic polypeptide
DEQEIATTNPVATEQYGSVSDNLQDHEGEL

SEQ ID NO: 47414 - protein, 32 aa, Artificial Sequence
  Description of Artificial Sequence: Synthetic polypeptide
DEQEIATTNPVATEQYGSVSTNLQGNMGNDNK

SEQ ID NO: 47415 - protein, 30 aa, Artificial Sequence
  Description of Artificial Sequence: Synthetic polypeptide
DEQEIATTNPVATEQYGSVSDNLQDSEGEL

SEQ ID NO: 47416 - protein, 30 aa, Artificial Sequence
  Description of Artificial Sequence: Synthetic polypeptide
DEVEIATTNPVATTQYGEVSTALQDGMNER

SEQ ID NO: 47417 - protein, 28 aa, Artificial Sequence
  Description of Artificial Sequence: Synthetic peptide
DEQEIATTNPVATEQYGSVSEDLQHEEK

SEQ ID NO: 47418 - protein, 28 aa, Artificial Sequence
  Description of Artificial Sequence: Synthetic peptide
AENEIATTNPVATECYGEASENLQRGGR

SEQ ID NO: 47419 - protein, 28 aa, Artificial Sequence
  Description of Artificial Sequence: Synthetic peptide
DEQEIATTNPVATEQYGSVSTCLEHEEL

SEQ ID NO: 47420 - protein, 32 aa, Artificial Sequence
  Description of Artificial Sequence: Synthetic polypeptide
AEEEIRTTNPVATEQYGSVSTVTNLQNDEINN

SEQ ID NO: 47421 - protein, 29 aa, Artificial Sequence
  Description of Artificial Sequence: Synthetic peptide
DEVEIATTNPVATIQYGMVSTEQLQGGNP

SEQ ID NO: 47422 - protein, 30 aa, Artificial Sequence
  Description of Artificial Sequence: Synthetic polypeptide
SEEEIACTNPVATEQWGSVATNLDRGNDRL

SEQ ID NO: 47423 - protein, 28 aa, Artificial Sequence
  Description of Artificial Sequence: Synthetic peptide
DEQEIATTNPVATEQYGSVSEDLEHGEL

SEQ ID NO: 47424 - protein, 32 aa, Artificial Sequence
  Description of Artificial Sequence: Synthetic polypeptide
DEQEIATTNPVATEQYGSVSTNLQGNSGNDDS

SEQ ID NO: 47425 - protein, 32 aa, Artificial Sequence
  Description of Artificial Sequence: Synthetic polypeptide
DEQEIATTNPVATEQYGSVSTNLQGNSGNENN

SEQ ID NO: 47426 - protein, 32 aa, Artificial Sequence
  Description of Artificial Sequence: Synthetic polypeptide
AEEEIRTTNPVATEQYGSVSTVTNLVQGTNVE

SEQ ID NO: 47427 - protein, 30 aa, Artificial Sequence
  Description of Artificial Sequence: Synthetic polypeptide
DEQEIATTNPVAYEQYGSVAATNDQRGNSF

SEQ ID NO: 47428 - protein, 29 aa, Artificial Sequence
  Description of Artificial Sequence: Synthetic peptide
SEEEIACTNPTATEQYGSVSENLMRGNED

SEQ ID NO: 47429 - protein, 32 aa, Artificial Sequence
  Description of Artificial Sequence: Synthetic polypeptide
AEEEIRTTNPVATEQYGSVSVTNNNQQGNNSE

SEQ ID NO: 47430 - protein, 30 aa, Artificial Sequence
  Description of Artificial Sequence: Synthetic polypeptide
DEQEIATTNPVAYEQYGSVAATNLQDGPRQ

SEQ ID NO: 47431 - protein, 31 aa, Artificial Sequence
  Description of Artificial Sequence: Synthetic polypeptide
DEQEIATTNPVAYEQYGSVAATNLQNNGNRP

SEQ ID NO: 47432 - protein, 33 aa, Artificial Sequence
  Description of Artificial Sequence: Synthetic polypeptide
CEEEIATTNPVATEQYGSVATSNLEQRNGENDR

SEQ ID NO: 47433 - protein, 29 aa, Artificial Sequence
  Description of Artificial Sequence: Synthetic peptide
DEQEIATTNPVAYEQYGSVSAANDDRGND

SEQ ID NO: 47434 - protein, 32 aa, Artificial Sequence
  Description of Artificial Sequence: Synthetic polypeptide
AEEEIRTTNPVATEQYGSVSVTNNNQQQGNNS

SEQ ID NO: 47435 - protein, 31 aa, Artificial Sequence
  Description of Artificial Sequence: Synthetic polypeptide
CEEEIATTNPVATEQYGSVAITNLQDSGNDF

SEQ ID NO: 47436 - protein, 30 aa, Artificial Sequence
  Description of Artificial Sequence: Synthetic polypeptide
DEQEIATTNPVAYEQYGSVSTGNLPQYVNV

SEQ ID NO: 47437 - protein, 32 aa, Artificial Sequence
  Description of Artificial Sequence: Synthetic polypeptide
AEEEIRTTNPVATEQYGSVSVTNNNQIGNTEQ

SEQ ID NO: 47438 - protein, 28 aa, Artificial Sequence
  Description of Artificial Sequence: Synthetic peptide
SEEEIACTNPICTEQYGSVSENLMRGNQ

SEQ ID NO: 47439 - protein, 30 aa, Artificial Sequence
  Description of Artificial Sequence: Synthetic polypeptide
CEEEIATTNPVATEQYGSCSTHLQDEQGDR

SEQ ID NO: 47440 - protein, 29 aa, Artificial Sequence
  Description of Artificial Sequence: Synthetic peptide
DEQEIATTNPVAYERYGSVSTNPQDGNTM

SEQ ID NO: 47441 - protein, 28 aa, Artificial Sequence
  Description of Artificial Sequence: Synthetic peptide
SEEEIACTNPIAYEQYGSVSENLMRGNN

SEQ ID NO: 47442 - protein, 32 aa, Artificial Sequence
  Description of Artificial Sequence: Synthetic polypeptide
AEEEIRTTNPVATEQYGSVSVTNNNQEIGNQD

SEQ ID NO: 47443 - protein, 28 aa, Artificial Sequence
  Description of Artificial Sequence: Synthetic peptide
SEEEIACTNPIGTEQYGSVAENLMRGNR

SEQ ID NO: 47444 - protein, 30 aa, Artificial Sequence
  Description of Artificial Sequence: Synthetic polypeptide
SEEEIACTNPVATEQYGSVATNDQRGHNDP

SEQ ID NO: 47445 - protein, 32 aa, Artificial Sequence
  Description of Artificial Sequence: Synthetic polypeptide
AEEEIRTTNPVATEQYGSVSVTNNQQGNNQSG

SEQ ID NO: 47446 - protein, 32 aa, Artificial Sequence
  Description of Artificial Sequence: Synthetic polypeptide
AEEEIRTTNPVATEQYGSVSVTNNQQGTTIRE

SEQ ID NO: 47447 - protein, 29 aa, Artificial Sequence
  Description of Artificial Sequence: Synthetic peptide
SEEEIACTNPVATEGYGSVSTNLQRQDMD

SEQ ID NO: 47448 - protein, 29 aa, Artificial Sequence
  Description of Artificial Sequence: Synthetic peptide
DEQEIATTNPVATEQYGSVSTVLEDHGEK

SEQ ID NO: 47449 - protein, 31 aa, Artificial Sequence
  Description of Artificial Sequence: Synthetic polypeptide
DEQEIATTNPVATEQYGSVTTTDLQNREQNR

SEQ ID NO: 47450 - protein, 28 aa, Artificial Sequence
  Description of Artificial Sequence: Synthetic peptide
SEEEIACTNPVATEGYGSVATNLQRQDA

SEQ ID NO: 47451 - protein, 32 aa, Artificial Sequence
  Description of Artificial Sequence: Synthetic polypeptide
AEEEIRTTNPVATEQYGSVSVTNNQQQQGNEG

SEQ ID NO: 47452 - protein, 28 aa, Artificial Sequence
  Description of Artificial Sequence: Synthetic peptide
DEVEIATTNPVATIQYGMVSTALQPENQ

SEQ ID NO: 47453 - protein, 31 aa, Artificial Sequence
  Description of Artificial Sequence: Synthetic polypeptide
SEEEIACTNPVATEAYGSVSTNLQTEGNERD

SEQ ID NO: 47454 - protein, 30 aa, Artificial Sequence
  Description of Artificial Sequence: Synthetic polypeptide
DEQEIATTNPVAYEQYGSVAATNDQNGNRQ

SEQ ID NO: 47455 - protein, 31 aa, Artificial Sequence
  Description of Artificial Sequence: Synthetic polypeptide
DEQEIATTNPVATESYGSVSTNLQHDQGNAQ

SEQ ID NO: 47456 - protein, 31 aa, Artificial Sequence
  Description of Artificial Sequence: Synthetic polypeptide
SEEEIACTNPVATEAYGSVSTNLQEGPNERV

SEQ ID NO: 47457 - protein, 30 aa, Artificial Sequence
  Description of Artificial Sequence: Synthetic polypeptide
SEEEIACTNPVATEAYGSVSTNLQEGDERE

SEQ ID NO: 47458 - protein, 31 aa, Artificial Sequence
  Description of Artificial Sequence: Synthetic polypeptide
DEQEIATTNPVAYEQWGSVSTNLQMDGGENR

SEQ ID NO: 47459 - protein, 30 aa, Artificial Sequence
  Description of Artificial Sequence: Synthetic polypeptide
DEQEIATTNPVAYEQWGSVSTNLQNDGNTN

SEQ ID NO: 47460 - protein, 29 aa, Artificial Sequence
  Description of Artificial Sequence: Synthetic peptide
DEVEIATTNPVATIQYGMVSTALQNGDNQ

SEQ ID NO: 47461 - protein, 30 aa, Artificial Sequence
  Description of Artificial Sequence: Synthetic polypeptide
DEVEIATTNPVATIQYGMVSTALQLGNQRM

SEQ ID NO: 47462 - protein, 32 aa, Artificial Sequence
  Description of Artificial Sequence: Synthetic polypeptide
AEEEIRTTNPVATEQYGSVSVTNNQQQGNNSQ

SEQ ID NO: 47463 - protein, 30 aa, Artificial Sequence
  Description of Artificial Sequence: Synthetic polypeptide
SEEEIACTNPVATEAYGSVSTNLQEMGNEE

SEQ ID NO: 47464 - protein, 30 aa, Artificial Sequence
  Description of Artificial Sequence: Synthetic polypeptide
SEEEIACTNPIATEQYGSVSENNLMREGNR

SEQ ID NO: 47465 - protein, 33 aa, Artificial Sequence
  Description of Artificial Sequence: Synthetic polypeptide
AEEEIRTTNPVATEQYGSVSVTNQLGQNGNNQQ

SEQ ID NO: 47466 - protein, 33 aa, Artificial Sequence
  Description of Artificial Sequence: Synthetic polypeptide
AEEEIRTTNPVATEQYGSVSVTNQLGQTNGNNP

SEQ ID NO: 47467 - protein, 33 aa, Artificial Sequence
  Description of Artificial Sequence: Synthetic polypeptide
QEEEIRTTNPVATEQYGSVSSTNLQNGGGNEGN

SEQ ID NO: 47468 - protein, 28 aa, Artificial Sequence
  Description of Artificial Sequence: Synthetic peptide
AENEIATTNPVATEAYGEASENLQRGGR

SEQ ID NO: 47469 - protein, 32 aa, Artificial Sequence
  Description of Artificial Sequence: Synthetic polypeptide
AEEEIRTTNPVATEQYGSVSVTNQQQQGENES

SEQ ID NO: 47470 - protein, 30 aa, Artificial Sequence
  Description of Artificial Sequence: Synthetic polypeptide
SEEEIACTNPVATEQYGSVATNLQQGNDLE

SEQ ID NO: 47471 - protein, 31 aa, Artificial Sequence
  Description of Artificial Sequence: Synthetic polypeptide
CEEEIRCTNPIATEQYGSVSVNDLMVRGNRD

SEQ ID NO: 47472 - protein, 30 aa, Artificial Sequence
  Description of Artificial Sequence: Synthetic polypeptide
SEEEIACTNPVATEQYGSVATNLQQGGNNQ

SEQ ID NO: 47473 - protein, 30 aa, Artificial Sequence
  Description of Artificial Sequence: Synthetic polypeptide
DEQEIATTNPVATEQWGSVATPNLQPGNVD

SEQ ID NO: 47474 - protein, 32 aa, Artificial Sequence
  Description of Artificial Sequence: Synthetic polypeptide
AEEEIRTTNPVATEQYGSVSTVTNLLQIQGEG

SEQ ID NO: 47475 - protein, 32 aa, Artificial Sequence
  Description of Artificial Sequence: Synthetic polypeptide
AEEEIRTTNPVATEQYGSVSVTNQQQLGNAEE

SEQ ID NO: 47476 - protein, 29 aa, Artificial Sequence
  Description of Artificial Sequence: Synthetic peptide
DEQEIATTNPVATEQYGCVATNLQGANPE

SEQ ID NO: 47477 - protein, 32 aa, Artificial Sequence
  Description of Artificial Sequence: Synthetic polypeptide
AEEEIRTTNPVATEQYGSVSVTNQQQLGGNET

SEQ ID NO: 47478 - protein, 32 aa, Artificial Sequence
  Description of Artificial Sequence: Synthetic polypeptide
DEQEIATTNPVATEQYGEVSATNLQDREGEDR

SEQ ID NO: 47479 - protein, 29 aa, Artificial Sequence
  Description of Artificial Sequence: Synthetic peptide
SEEEIACTNPVATEQYGSVATNLQNNSNN

SEQ ID NO: 47480 - protein, 29 aa, Artificial Sequence
  Description of Artificial Sequence: Synthetic peptide
DEQEIATTNPVATEQYGEVSTDLEDRGEL

SEQ ID NO: 47481 - protein, 33 aa, Artificial Sequence
  Description of Artificial Sequence: Synthetic polypeptide
QEEEIRTTNPVATEQYGSVSSTTNLPNRGMNPV

SEQ ID NO: 47482 - protein, 30 aa, Artificial Sequence
  Description of Artificial Sequence: Synthetic polypeptide
SEEEIACTNPVATEQYGSVATNLQRDDNEH

SEQ ID NO: 47483 - protein, 30 aa, Artificial Sequence
  Description of Artificial Sequence: Synthetic polypeptide
DEVEIATTNPVAYEQYGSVATNDQRHNDRE

SEQ ID NO: 47484 - protein, 31 aa, Artificial Sequence
  Description of Artificial Sequence: Synthetic polypeptide
DEQEIATTNPVATECYGSVSCINLQDREGNG

SEQ ID NO: 47485 - protein, 31 aa, Artificial Sequence
  Description of Artificial Sequence: Synthetic polypeptide
DEVEIATTNPVAYEQYGSVATNLQERGNDEA

SEQ ID NO: 47486 - protein, 28 aa, Artificial Sequence
  Description of Artificial Sequence: Synthetic peptide
DEQEIAPTNPVSSEQYGSVSCNLQSGER

SEQ ID NO: 47487 - protein, 29 aa, Artificial Sequence
  Description of Artificial Sequence: Synthetic peptide
DEVEIATTNPVAYEQYGSVSTDGDRGNNG

SEQ ID NO: 47488 - protein, 30 aa, Artificial Sequence
  Description of Artificial Sequence: Synthetic polypeptide
DEQEIASTNPVATEQYGSVSATNLEDSGNQ

SEQ ID NO: 47489 - protein, 29 aa, Artificial Sequence
  Description of Artificial Sequence: Synthetic peptide
SEEEIACTNPVATEQYGSVSAENLERGEL

SEQ ID NO: 47490 - protein, 30 aa, Artificial Sequence
  Description of Artificial Sequence: Synthetic polypeptide
SEEEIACTNPVATEQYGSVATPLQRNGNEH

SEQ ID NO: 47491 - protein, 29 aa, Artificial Sequence
  Description of Artificial Sequence: Synthetic peptide
SEEEIACTNPVATEQYGSVATPLERGNES

SEQ ID NO: 47492 - protein, 30 aa, Artificial Sequence
  Description of Artificial Sequence: Synthetic polypeptide
DEVEIATTNPVAYEQYGSVATNLQTGGNDE

SEQ ID NO: 47493 - protein, 30 aa, Artificial Sequence
  Description of Artificial Sequence: Synthetic polypeptide
SEEEIACTNPVATEQYGSVATNLQGGADRG

SEQ ID NO: 47494 - protein, 30 aa, Artificial Sequence
  Description of Artificial Sequence: Synthetic polypeptide
DEVEIATTNPVAYEQYGSVATNLQNGDNDT

SEQ ID NO: 47495 - protein, 28 aa, Artificial Sequence
  Description of Artificial Sequence: Synthetic peptide
DEQEIATTNPCAYEPYGSVATNLQDGND

SEQ ID NO: 47496 - protein, 29 aa, Artificial Sequence
  Description of Artificial Sequence: Synthetic peptide
SEEEIACTNPVATEQYGSVATNLQSENIH

SEQ ID NO: 47497 - protein, 30 aa, Artificial Sequence
  Description of Artificial Sequence: Synthetic polypeptide
SEEEIACTNPVATEQYGSVATNLQRTDNPD

SEQ ID NO: 47498 - protein, 30 aa, Artificial Sequence
  Description of Artificial Sequence: Synthetic polypeptide
DEQEIATTNPIATEQYGSVSATDLMDRGER

SEQ ID NO: 47499 - protein, 30 aa, Artificial Sequence
  Description of Artificial Sequence: Synthetic polypeptide
SEEEIACTNPVATEQYGSVATNLQRENDED

SEQ ID NO: 47500 - protein, 31 aa, Artificial Sequence
  Description of Artificial Sequence: Synthetic polypeptide
DEQEIATTNPVATEAYGSVSTNLQRGEGDDQ

SEQ ID NO: 47501 - protein, 29 aa, Artificial Sequence
  Description of Artificial Sequence: Synthetic peptide
SEEEIACTNPVATEQYGSVATNLQREDIV

SEQ ID NO: 47502 - protein, 31 aa, Artificial Sequence
  Description of Artificial Sequence: Synthetic polypeptide
DEQEIATTNPCATEQYGSVSTNLQHNGGNNM

SEQ ID NO: 47503 - protein, 31 aa, Artificial Sequence
  Description of Artificial Sequence: Synthetic polypeptide
CEEEIGTTNPVATEQYGCVCSTNLQNGSNAN

SEQ ID NO: 47504 - protein, 30 aa, Artificial Sequence
  Description of Artificial Sequence: Synthetic polypeptide
DEQEIATTNPVATEQYGSVAATANLMMGNP

SEQ ID NO: 47505 - protein, 29 aa, Artificial Sequence
  Description of Artificial Sequence: Synthetic peptide
DEQEIATTNPVATEQYGSVAMNLQQNNED

SEQ ID NO: 47506 - protein, 31 aa, Artificial Sequence
  Description of Artificial Sequence: Synthetic polypeptide
SEEEIACTNPVATEQYGSVATNLQAEDGNER

SEQ ID NO: 47507 - protein, 33 aa, Artificial Sequence
  Description of Artificial Sequence: Synthetic polypeptide
AEEEIRTTNPVATEQYGSVSVTNQLQNIGTNSE

SEQ ID NO: 47508 - protein, 31 aa, Artificial Sequence
  Description of Artificial Sequence: Synthetic polypeptide
DEQEIATTNPVATEQYGSVSATDLEDHEGNR

SEQ ID NO: 47509 - protein, 32 aa, Artificial Sequence
  Description of Artificial Sequence: Synthetic polypeptide
AEEEIRTTNPVATEQYGSVSVTNQLNTTGNEG

SEQ ID NO: 47510 - protein, 29 aa, Artificial Sequence
  Description of Artificial Sequence: Synthetic peptide
DEVEIATTNPVAYEPYGSVATNLQDTGND

SEQ ID NO: 47511 - protein, 32 aa, Artificial Sequence
  Description of Artificial Sequence: Synthetic polypeptide
AEEEIRTTNPVATEQYGSVSVTNQLNQGNNGE

SEQ ID NO: 47512 - protein, 30 aa, Artificial Sequence
  Description of Artificial Sequence: Synthetic polypeptide
DEVEIATTNPVAYDQYGTVSCTALQRGNNR

SEQ ID NO: 47513 - protein, 33 aa, Artificial Sequence
  Description of Artificial Sequence: Synthetic polypeptide
AEEEIRTTNPVATEQYGSVSVTNQLQQNIGNTE

SEQ ID NO: 47514 - protein, 30 aa, Artificial Sequence
  Description of Artificial Sequence: Synthetic polypeptide
SEEEIACTNPVATEQYGSVATNLQADGNEN

SEQ ID NO: 47515 - protein, 29 aa, Artificial Sequence
  Description of Artificial Sequence: Synthetic peptide
CEEEIATTNPVAYEQYGSVATNLETGNDQ

SEQ ID NO: 47516 - protein, 30 aa, Artificial Sequence
  Description of Artificial Sequence: Synthetic polypeptide
DEVEIATTNPVAYDQYGQVPSTALSQRGNR

SEQ ID NO: 47517 - protein, 30 aa, Artificial Sequence
  Description of Artificial Sequence: Synthetic polypeptide
DEVEIATTNPVATTQYGTVSTALQRDGDER

SEQ ID NO: 47518 - protein, 31 aa, Artificial Sequence
  Description of Artificial Sequence: Synthetic polypeptide
AEEEIRTTNPVATEQYGSVSTVTNLQGQIQV

SEQ ID NO: 47519 - protein, 33 aa, Artificial Sequence
  Description of Artificial Sequence: Synthetic polypeptide
AEEEIRTTNPVATEQYGSVSTVTNLQLGNIVEL

SEQ ID NO: 47520 - protein, 30 aa, Artificial Sequence
  Description of Artificial Sequence: Synthetic polypeptide
DEQEIATTNPVATEQYGSVSATGLEHEGND

SEQ ID NO: 47521 - protein, 30 aa, Artificial Sequence
  Description of Artificial Sequence: Synthetic polypeptide
DEQEIATTNPVATEQYGSVSATGLEHEGNL

SEQ ID NO: 47522 - protein, 30 aa, Artificial Sequence
  Description of Artificial Sequence: Synthetic polypeptide
CEEEIATTNPVAYEQYGSVATNLQDSGNDV

SEQ ID NO: 47523 - protein, 30 aa, Artificial Sequence
  Description of Artificial Sequence: Synthetic polypeptide
DEVEIATTNPVATTQYGMVSTGLGQDGNER

SEQ ID NO: 47524 - protein, 30 aa, Artificial Sequence
  Description of Artificial Sequence: Synthetic polypeptide
DEVEIATTNPVAYEQWGSVSTNLQGMEGNH

SEQ ID NO: 47525 - protein, 30 aa, Artificial Sequence
  Description of Artificial Sequence: Synthetic polypeptide
SEEEIACTNPVATEQYGSVATNLQAGNNAV

SEQ ID NO: 47526 - protein, 31 aa, Artificial Sequence
  Description of Artificial Sequence: Synthetic polypeptide
DEQEIATTNPVATEQYGSVATNGEQDRGNES

SEQ ID NO: 47527 - protein, 29 aa, Artificial Sequence
  Description of Artificial Sequence: Synthetic peptide
SEEEIACTNPVATEQYGSVATNLQGEGQD

SEQ ID NO: 47528 - protein, 30 aa, Artificial Sequence
  Description of Artificial Sequence: Synthetic polypeptide
DEQEIATTNPVATEQYGSVATNLQGANPDQ

SEQ ID NO: 47529 - protein, 31 aa, Artificial Sequence
  Description of Artificial Sequence: Synthetic polypeptide
DEQEIATTNPVATEQYGSVATNLQNDGNNMI

SEQ ID NO: 47530 - protein, 31 aa, Artificial Sequence
  Description of Artificial Sequence: Synthetic polypeptide
DEQEIATTNPVATEQYGSVATNLQQVGQDRE

SEQ ID NO: 47531 - protein, 31 aa, Artificial Sequence
  Description of Artificial Sequence: Synthetic polypeptide
DEVEIATTNPVAYEQWGSVSTNLQSGGGNTR

SEQ ID NO: 47532 - protein, 32 aa, Artificial Sequence
  Description of Artificial Sequence: Synthetic polypeptide
DEQEIATTNPVATEQYGSVCAATNLQEDGNRH

SEQ ID NO: 47533 - protein, 28 aa, Artificial Sequence
  Description of Artificial Sequence: Synthetic peptide
AENEIATTNPVATECYGATSENLQRGGR

SEQ ID NO: 47534 - protein, 30 aa, Artificial Sequence
  Description of Artificial Sequence: Synthetic polypeptide
DEQEIATTNPVATEQYGSVCATNLQDLNEE

SEQ ID NO: 47535 - protein, 31 aa, Artificial Sequence
  Description of Artificial Sequence: Synthetic polypeptide
SEEEIACTNPVATEQYGSVATNLQERGNDIS

SEQ ID NO: 47536 - protein, 30 aa, Artificial Sequence
  Description of Artificial Sequence: Synthetic polypeptide
DEVEIATTNPVAYEQWGSVSTNLQGTGNMP

SEQ ID NO: 47537 - protein, 30 aa, Artificial Sequence
  Description of Artificial Sequence: Synthetic polypeptide
SEEEIACTNPVATEQYGSVATNLQDAGNNH

SEQ ID NO: 47538 - protein, 29 aa, Artificial Sequence
  Description of Artificial Sequence: Synthetic peptide
SEEEIACTNPVATEQYGSVATNLQAPNNF

SEQ ID NO: 47539 - protein, 31 aa, Artificial Sequence
  Description of Artificial Sequence: Synthetic polypeptide
SEEEIACTNPVATEQYGSVATNLQAPGNNDR

SEQ ID NO: 47540 - protein, 31 aa, Artificial Sequence
  Description of Artificial Sequence: Synthetic polypeptide
SEEEIACTNPVATEQYGSVATNLQAGPNERP

SEQ ID NO: 47541 - protein, 31 aa, Artificial Sequence
  Description of Artificial Sequence: Synthetic polypeptide
DEQEIATTNPVATEQYGSVSANDLQDREGQL

SEQ ID NO: 47542 - protein, 32 aa, Artificial Sequence
  Description of Artificial Sequence: Synthetic polypeptide
AEEEIRTTNPVATEQYGSVSVTNQNQQQGGNE

SEQ ID NO: 47543 - protein, 29 aa, Artificial Sequence
  Description of Artificial Sequence: Synthetic peptide
DESEICTVNPVATEQYGSVSTALQRNQEL

SEQ ID NO: 47544 - protein, 33 aa, Artificial Sequence
  Description of Artificial Sequence: Synthetic polypeptide
AEEEIRTTNPVATEQYGSVSVTNNLNLQVEGND

SEQ ID NO: 47545 - protein, 30 aa, Artificial Sequence
  Description of Artificial Sequence: Synthetic polypeptide
DESEICTVNPVATEQYGSVSTNELTEGGND

SEQ ID NO: 47546 - protein, 28 aa, Artificial Sequence
  Description of Artificial Sequence: Synthetic peptide
DETAIRTTNPLATEQFGSVSWALQSGNQ

SEQ ID NO: 47547 - protein, 29 aa, Artificial Sequence
  Description of Artificial Sequence: Synthetic peptide
QEGEIATTNPCASEQYGSVSCNLQSGENR

SEQ ID NO: 47548 - protein, 33 aa, Artificial Sequence
  Description of Artificial Sequence: Synthetic polypeptide
AEEEIRTTNPVATEQYGSVSVTNLNQLGGNNAE

SEQ ID NO: 47549 - protein, 30 aa, Artificial Sequence
  Description of Artificial Sequence: Synthetic polypeptide
AESEIRCTNPVATECYGEVSCNLQDRGENR

SEQ ID NO: 47550 - protein, 29 aa, Artificial Sequence
  Description of Artificial Sequence: Synthetic peptide
AENEIRTTNPVATEQYGATSENLQRKGPI

SEQ ID NO: 47551 - protein, 28 aa, Artificial Sequence
  Description of Artificial Sequence: Synthetic peptide
DETCIRTTNPLATEQFGCVSSNLQSGQR

SEQ ID NO: 47552 - protein, 31 aa, Artificial Sequence
  Description of Artificial Sequence: Synthetic polypeptide
AEEEIRTTNPVATEQYGSVSVTNLLQQTQEN

SEQ ID NO: 47553 - protein, 28 aa, Artificial Sequence
  Description of Artificial Sequence: Synthetic peptide
AENEIRTTNPVATEQYGEASENLNRGGV

SEQ ID NO: 47554 - protein, 29 aa, Artificial Sequence
  Description of Artificial Sequence: Synthetic peptide
DETCIRTTNPLATEQFGSVSWALQSGSNR

SEQ ID NO: 47555 - protein, 31 aa, Artificial Sequence
  Description of Artificial Sequence: Synthetic polypeptide
DETEIRTTNPVAYEQYGTVSTNLGQGDGNQS

SEQ ID NO: 47556 - protein, 33 aa, Artificial Sequence
  Description of Artificial Sequence: Synthetic polypeptide
AEEEIRTTNPVATEQYGSVSVTNLLQNIGTNDE

SEQ ID NO: 47557 - protein, 30 aa, Artificial Sequence
  Description of Artificial Sequence: Synthetic polypeptide
AENEIRTTNPVATEQYGEASTENLNRGMNV

SEQ ID NO: 47558 - protein, 33 aa, Artificial Sequence
  Description of Artificial Sequence: Synthetic polypeptide
AEEEIRTTNPVATEQYGSVSVTNLLQGNLGINN

SEQ ID NO: 47559 - protein, 28 aa, Artificial Sequence
  Description of Artificial Sequence: Synthetic peptide
AENEIRTTNPVATEQYGEISMDLQQGNH

SEQ ID NO: 47560 - protein, 30 aa, Artificial Sequence
  Description of Artificial Sequence: Synthetic polypeptide
AESEIATTNPVATEQYGEVSCNLQDRGEGR

SEQ ID NO: 47561 - protein, 29 aa, Artificial Sequence
  Description of Artificial Sequence: Synthetic peptide
DETAIRTTNPLATEQFGSVCSSNLQSGNA

SEQ ID NO: 47562 - protein, 31 aa, Artificial Sequence
  Description of Artificial Sequence: Synthetic polypeptide
DETEIRTTNPVAYEQYGTVSTNLQGEGGDNP

SEQ ID NO: 47563 - protein, 30 aa, Artificial Sequence
  Description of Artificial Sequence: Synthetic polypeptide
DETAICTTNPVATEQYGSVSSTNQLIIGNQ

SEQ ID NO: 47564 - protein, 29 aa, Artificial Sequence
  Description of Artificial Sequence: Synthetic peptide
DETAICTTNPVATEQYGSTSTNLIIGNTD

SEQ ID NO: 47565 - protein, 30 aa, Artificial Sequence
  Description of Artificial Sequence: Synthetic polypeptide
AESEIRTTNPVATECYGEVSCNEQDRGENR

SEQ ID NO: 47566 - protein, 29 aa, Artificial Sequence
  Description of Artificial Sequence: Synthetic peptide
DESVIRTTNPVAYEQWGCVETLNDQRGNR

SEQ ID NO: 47567 - protein, 31 aa, Artificial Sequence
  Description of Artificial Sequence: Synthetic polypeptide
DETEIRTTNPVAYEQYGTVSTNLQPDGDNQS

SEQ ID NO: 47568 - protein, 31 aa, Artificial Sequence
  Description of Artificial Sequence: Synthetic polypeptide
DETEIRTTNPVAYEQYGTVSTNLQMGGNGDK

SEQ ID NO: 47569 - protein, 28 aa, Artificial Sequence
  Description of Artificial Sequence: Synthetic peptide
DESVIRTTNPVAYEQWGCVYTNPQRGNM

SEQ ID NO: 47570 - protein, 31 aa, Artificial Sequence
  Description of Artificial Sequence: Synthetic polypeptide
DETEIRTTNPVAYEQYGTVSTNLQGQGGDAR

SEQ ID NO: 47571 - protein, 29 aa, Artificial Sequence
  Description of Artificial Sequence: Synthetic peptide
DESVIRTTNPVAYEQYGCVETNPQGDGNR

SEQ ID NO: 47572 - protein, 29 aa, Artificial Sequence
  Description of Artificial Sequence: Synthetic peptide
AESEIATTNPVATEQYGEASENLQDRGNG

SEQ ID NO: 47573 - protein, 28 aa, Artificial Sequence
  Description of Artificial Sequence: Synthetic peptide
QEGEIATTNPCATEQYGIVSCNLQSGTR

SEQ ID NO: 47574 - protein, 28 aa, Artificial Sequence
  Description of Artificial Sequence: Synthetic peptide
DESVISTTNPVATEQYGCVETNPQEGNT

SEQ ID NO: 47575 - protein, 30 aa, Artificial Sequence
  Description of Artificial Sequence: Synthetic polypeptide
DETEIRTTNPVAYEQYGTVSTNLQGQGDDM

SEQ ID NO: 47576 - protein, 28 aa, Artificial Sequence
  Description of Artificial Sequence: Synthetic peptide
QEGEIATTNPCATEQYGIVSCNLQSGER

SEQ ID NO: 47577 - protein, 30 aa, Artificial Sequence
  Description of Artificial Sequence: Synthetic polypeptide
AEEEIRTTNPVATEQYGSVSVENGNDQGNQ

SEQ ID NO: 47578 - protein, 31 aa, Artificial Sequence
  Description of Artificial Sequence: Synthetic polypeptide
DETEIRTTNPVAYEQYGTVSTNLQGNGDNGD

SEQ ID NO: 47579 - protein, 28 aa, Artificial Sequence
  Description of Artificial Sequence: Synthetic peptide
QEGEIATTNPCATEQYGDVSCNLQSGTR

SEQ ID NO: 47580 - protein, 29 aa, Artificial Sequence
  Description of Artificial Sequence: Synthetic peptide
AESEIRCTNPVATEQYGEASENLQDRGNG

SEQ ID NO: 47581 - protein, 31 aa, Artificial Sequence
  Description of Artificial Sequence: Synthetic polypeptide
DESVISTTNPVATEQWGSVSTDELSQRVGNR

SEQ ID NO: 47582 - protein, 31 aa, Artificial Sequence
  Description of Artificial Sequence: Synthetic polypeptide
AESEIRTTNPVATECYGSVSENEPQDRGENR

SEQ ID NO: 47583 - protein, 31 aa, Artificial Sequence
  Description of Artificial Sequence: Synthetic polypeptide
QEEGIRTTNPVATEQYGSVSTNLDDGNGQNN

SEQ ID NO: 47584 - protein, 30 aa, Artificial Sequence
  Description of Artificial Sequence: Synthetic polypeptide
AEEEIRTTNPVATEQYGSVSVNGNDNGNQS

SEQ ID NO: 47585 - protein, 31 aa, Artificial Sequence
  Description of Artificial Sequence: Synthetic polypeptide
AEEEIRTTNPVATEQYGSVSVNNNQGNGNFN

SEQ ID NO: 47586 - protein, 31 aa, Artificial Sequence
  Description of Artificial Sequence: Synthetic polypeptide
DETEIRTTNPVAYEQYGNVSTNLQHDGGNQS

SEQ ID NO: 47587 - protein, 31 aa, Artificial Sequence
  Description of Artificial Sequence: Synthetic polypeptide
DETEIATTNPVATEQYGSVATNLQHGENAGE

SEQ ID NO: 47588 - protein, 31 aa, Artificial Sequence
  Description of Artificial Sequence: Synthetic polypeptide
DETEIATTNPVATEQYGSVATNLQPGNQEGN

SEQ ID NO: 47589 - protein, 31 aa, Artificial Sequence
  Description of Artificial Sequence: Synthetic polypeptide
DETEIATTNPVATEQYGSVATNLQQDGNDDF

SEQ ID NO: 47590 - protein, 31 aa, Artificial Sequence
  Description of Artificial Sequence: Synthetic polypeptide
DETEIATTNPVATEQYGSVSGTGNPQNGNEE

SEQ ID NO: 47591 - protein, 32 aa, Artificial Sequence
  Description of Artificial Sequence: Synthetic polypeptide
AEEEIRTTNPVATEQYGSVSVNNQLQEGTNPN

SEQ ID NO: 47592 - protein, 31 aa, Artificial Sequence
  Description of Artificial Sequence: Synthetic polypeptide
DETEIATTNPVATEQYGSVSTNLQGNMGDPK

SEQ ID NO: 47593 - protein, 32 aa, Artificial Sequence
  Description of Artificial Sequence: Synthetic polypeptide
DETEIATTNPVATEQYGSVSTNLQPNGGNEHQ

SEQ ID NO: 47594 - protein, 31 aa, Artificial Sequence
  Description of Artificial Sequence: Synthetic polypeptide
DETEIATTNPVATEQYGSVTTNHGQNDGNNR

SEQ ID NO: 47595 - protein, 31 aa, Artificial Sequence
  Description of Artificial Sequence: Synthetic polypeptide
AEEEIRTTNPVATEQYGSVSVTNLLGSGTET

SEQ ID NO: 47596 - protein, 28 aa, Artificial Sequence
  Description of Artificial Sequence: Synthetic peptide
QEGEIAPTNPVATEQYGEASENLQRGGR

SEQ ID NO: 47597 - protein, 33 aa, Artificial Sequence
  Description of Artificial Sequence: Synthetic polypeptide
AEEEIRTTNPVATEQYGSVSVTNLLGQNNGNNP

SEQ ID NO: 47598 - protein, 32 aa, Artificial Sequence
  Description of Artificial Sequence: Synthetic polypeptide
AEEEIRTTNPVATEQYGSVSVTNLGQNINNNT

SEQ ID NO: 47599 - protein, 31 aa, Artificial Sequence
  Description of Artificial Sequence: Synthetic polypeptide
DETEIATTNPVATETYGSVSTNLQGDHGNQG

SEQ ID NO: 47600 - protein, 30 aa, Artificial Sequence
  Description of Artificial Sequence: Synthetic polypeptide
DETEIATTNPVATEQYGSVAGTNDQDGNDH

SEQ ID NO: 47601 - protein, 30 aa, Artificial Sequence
  Description of Artificial Sequence: Synthetic polypeptide
DETEIATTNPVATEQYGSCSTNPQDEGGGR

SEQ ID NO: 47602 - protein, 31 aa, Artificial Sequence
  Description of Artificial Sequence: Synthetic polypeptide
DETEIATTNPVATEQYGCVSTNLQHDNGGMR

SEQ ID NO: 47603 - protein, 31 aa, Artificial Sequence
  Description of Artificial Sequence: Synthetic polypeptide
AEEEIRTTNPVATEQYGSVSVNNNQFGNQNT

SEQ ID NO: 47604 - protein, 29 aa, Artificial Sequence
  Description of Artificial Sequence: Synthetic peptide
AENEIRTTNPVATEQYGETSENLQRKGPI

SEQ ID NO: 47605 - protein, 29 aa, Artificial Sequence
  Description of Artificial Sequence: Synthetic peptide
AENEIRTTNPVATEQYGEVSENLQAAGDA

SEQ ID NO: 47606 - protein, 30 aa, Artificial Sequence
  Description of Artificial Sequence: Synthetic polypeptide
AEEEIRTTNPVATEQYGSVSVNNDEIGGNE

SEQ ID NO: 47607 - protein, 30 aa, Artificial Sequence
  Description of Artificial Sequence: Synthetic polypeptide
DETEIACTNPVATEQYGSVATNLQQDGNLN

SEQ ID NO: 47608 - protein, 30 aa, Artificial Sequence
  Description of Artificial Sequence: Synthetic polypeptide
DETEIRTTNPVAYEQYGSVSTNPQHDGMDQ

SEQ ID NO: 47609 - protein, 31 aa, Artificial Sequence
  Description of Artificial Sequence: Synthetic polypeptide
DETEIATTNPCATEQYGSVSTNLQGDMGNED

SEQ ID NO: 47610 - protein, 31 aa, Artificial Sequence
  Description of Artificial Sequence: Synthetic polypeptide
DETEIRTTNPVAYEQYGNVSTNLQQDGGNNA

SEQ ID NO: 47611 - protein, 29 aa, Artificial Sequence
  Description of Artificial Sequence: Synthetic peptide
DETEIACTNPVATEQYGSVATNLQADNEE

SEQ ID NO: 47612 - protein, 32 aa, Artificial Sequence
  Description of Artificial Sequence: Synthetic polypeptide
AENEIRTTNPVATEQYGSVSSTTNLNMRGMNV

SEQ ID NO: 47613 - protein, 30 aa, Artificial Sequence
  Description of Artificial Sequence: Synthetic polypeptide
DETEIATTNPVATEQWGEVSTNLQHDNGMR

SEQ ID NO: 47614 - protein, 30 aa, Artificial Sequence
  Description of Artificial Sequence: Synthetic polypeptide
DETEIATTNPVATEQWGSVAISANLQRSNS

SEQ ID NO: 47615 - protein, 29 aa, Artificial Sequence
  Description of Artificial Sequence: Synthetic peptide
DETEIATTNPVATEQWGSVAMNLQQGNPV

SEQ ID NO: 47616 - protein, 28 aa, Artificial Sequence
  Description of Artificial Sequence: Synthetic peptide
DETEIATTNPVATEQWGSVAMNLQQNNL

SEQ ID NO: 47617 - protein, 32 aa, Artificial Sequence
  Description of Artificial Sequence: Synthetic polypeptide
AEEEIRTTNPVATEQYGSVSVNNNLNQIGNQN

SEQ ID NO: 47618 - protein, 29 aa, Artificial Sequence
  Description of Artificial Sequence: Synthetic peptide
DETEIATTNPVATEQWGSVSENETNPGNR

SEQ ID NO: 47619 - protein, 30 aa, Artificial Sequence
  Description of Artificial Sequence: Synthetic polypeptide
DETEIRTTNPVAYEQYGNVSTNLQNGGDSS

SEQ ID NO: 47620 - protein, 28 aa, Artificial Sequence
  Description of Artificial Sequence: Synthetic peptide
QEGEIAPTNPVCTEQYGVVSDNLQSGNR

SEQ ID NO: 47621 - protein, 30 aa, Artificial Sequence
  Description of Artificial Sequence: Synthetic polypeptide
AESEIRTTNPVATECYGSVSENEQDRGEGR

SEQ ID NO: 47622 - protein, 30 aa, Artificial Sequence
  Description of Artificial Sequence: Synthetic polypeptide
AESEIRTTNPVATEQYGQVSTNTLQDTVNQ

SEQ ID NO: 47623 - protein, 30 aa, Artificial Sequence
  Description of Artificial Sequence: Synthetic polypeptide
DESVIRATNPVATEQYGCVATNDQRDGNDR

SEQ ID NO: 47624 - protein, 28 aa, Artificial Sequence
  Description of Artificial Sequence: Synthetic peptide
QEGEIATTNPVSTEQYGIVSCNLQSGTR

SEQ ID NO: 47625 - protein, 33 aa, Artificial Sequence
  Description of Artificial Sequence: Synthetic polypeptide
AEEEIRTTNPVATEQYGSVSVTNLQQANQGTNP

SEQ ID NO: 47626 - protein, 28 aa, Artificial Sequence
  Description of Artificial Sequence: Synthetic peptide
DESEIRTTNPVGTEGYGVVSSTLQRGDI

SEQ ID NO: 47627 - protein, 33 aa, Artificial Sequence
  Description of Artificial Sequence: Synthetic polypeptide
AEEEIRTTNPVATEQYGSVSVTNLQGQTGNNVQ

SEQ ID NO: 47628 - protein, 32 aa, Artificial Sequence
  Description of Artificial Sequence: Synthetic polypeptide
DESEIRTTNPVSTEQYGNVSTNTGQSRNGNPR

SEQ ID NO: 47629 - protein, 28 aa, Artificial Sequence
  Description of Artificial Sequence: Synthetic peptide
AENEIRCTNPVSTEQYGEASENLQRGGR

SEQ ID NO: 47630 - protein, 32 aa, Artificial Sequence
  Description of Artificial Sequence: Synthetic polypeptide
DESEIRTTNPVSTEQYGSVSTTTGQMRNGNPR

SEQ ID NO: 47631 - protein, 32 aa, Artificial Sequence
  Description of Artificial Sequence: Synthetic polypeptide
DESEIRTTNPVSTEQYGSVSTTTGQSRNGNPR

SEQ ID NO: 47632 - protein, 30 aa, Artificial Sequence
  Description of Artificial Sequence: Synthetic polypeptide
DESEIRTVNPVATEQYGSVSVTELQRNEQE

SEQ ID NO: 47633 - protein, 31 aa, Artificial Sequence
  Description of Artificial Sequence: Synthetic polypeptide
DESEISTTNPVAYEQYGSVATNLQRGDNTDQ

SEQ ID NO: 47634 - protein, 32 aa, Artificial Sequence
  Description of Artificial Sequence: Synthetic polypeptide
DESEISTTNPVAYEQYGSVVSCTNLSNRGNNR

SEQ ID NO: 47635 - protein, 33 aa, Artificial Sequence
  Description of Artificial Sequence: Synthetic polypeptide
AEEEIRTTNPVATEQYGSVSVTNLQGNLGIGNE

SEQ ID NO: 47636 - protein, 29 aa, Artificial Sequence
  Description of Artificial Sequence: Synthetic peptide
DETGIRTTNPCATEQWGSVSVNADQSGNR

SEQ ID NO: 47637 - protein, 33 aa, Artificial Sequence
  Description of Artificial Sequence: Synthetic polypeptide
AEEEIRTTNPVATEQYGSVSVTNLQGNLGGNQT

SEQ ID NO: 47638 - protein, 30 aa, Artificial Sequence
  Description of Artificial Sequence: Synthetic polypeptide
AENEIRTTNPVATECYGEVSEINEPQRGNR

SEQ ID NO: 47639 - protein, 33 aa, Artificial Sequence
  Description of Artificial Sequence: Synthetic polypeptide
AEEEIRTTNPVATEQYGSVSVTNLQQDEGGNTE

SEQ ID NO: 47640 - protein, 33 aa, Artificial Sequence
  Description of Artificial Sequence: Synthetic polypeptide
AEEEIRTTNPVATEQYGSVSVTNLQQGDEGNET

SEQ ID NO: 47641 - protein, 30 aa, Artificial Sequence
  Description of Artificial Sequence: Synthetic polypeptide
QEGEIATTNPVSTEQYGIVSTNLPQRNGTR

SEQ ID NO: 47642 - protein, 28 aa, Artificial Sequence
  Description of Artificial Sequence: Synthetic peptide
QEGEIRCTNPCATEQYGIVSENLQSGTR

SEQ ID NO: 47643 - protein, 31 aa, Artificial Sequence
  Description of Artificial Sequence: Synthetic polypeptide
AETEIRTTNPVATEQYGSVTSTNLQQVTNFY

SEQ ID NO: 47644 - protein, 33 aa, Artificial Sequence
  Description of Artificial Sequence: Synthetic polypeptide
DESEIRTTNPVAYEQYGSVSTLNALSQAGGNYR

SEQ ID NO: 47645 - protein, 33 aa, Artificial Sequence
  Description of Artificial Sequence: Synthetic polypeptide
DESEIRTTNPVAYEQYGSVSTNLSQTHGGNNRK

SEQ ID NO: 47646 - protein, 32 aa, Artificial Sequence
  Description of Artificial Sequence: Synthetic polypeptide
DESEIRTTNPVAYEQYGSVVSCTLNLSQAGER

SEQ ID NO: 47647 - protein, 33 aa, Artificial Sequence
  Description of Artificial Sequence: Synthetic polypeptide
AEEEIRTTNPVATEQYGSVSVTNLQQGTEGGNG

SEQ ID NO: 47648 - protein, 31 aa, Artificial Sequence
  Description of Artificial Sequence: Synthetic polypeptide
DESEIRTTNPVAYEQYGTVSTNLQDGGNGNA

SEQ ID NO: 47649 - protein, 31 aa, Artificial Sequence
  Description of Artificial Sequence: Synthetic polypeptide
DESEIRTTNPVAYEQYGTVSTNLQNGGDNDG

SEQ ID NO: 47650 - protein, 28 aa, Artificial Sequence
  Description of Artificial Sequence: Synthetic peptide
AETEIACTNPVATEQYGEASENLQRGGR

SEQ ID NO: 47651 - protein, 28 aa, Artificial Sequence
  Description of Artificial Sequence: Synthetic peptide
QEGEIRPTNPCATEQYGDVSCNLQSGTR

SEQ ID NO: 47652 - protein, 28 aa, Artificial Sequence
  Description of Artificial Sequence: Synthetic peptide
QEGEIRPTNPCATEQYGDVSCNLQSGDR

SEQ ID NO: 47653 - protein, 28 aa, Artificial Sequence
  Description of Artificial Sequence: Synthetic peptide
DESEIRTTNPVAYQHYGSVSTNGQGTNM

SEQ ID NO: 47654 - protein, 30 aa, Artificial Sequence
  Description of Artificial Sequence: Synthetic polypeptide
DESEIRTTNPVAYQQYGCVSCTNLGRVGNP

SEQ ID NO: 47655 - protein, 29 aa, Artificial Sequence
  Description of Artificial Sequence: Synthetic peptide
QEGEIRPTNPCATECWGSVSCNLQREGNR

SEQ ID NO: 47656 - protein, 28 aa, Artificial Sequence
  Description of Artificial Sequence: Synthetic peptide
QEGEIRCTNPISTEQYGSVSENLQSGTR

SEQ ID NO: 47657 - protein, 29 aa, Artificial Sequence
  Description of Artificial Sequence: Synthetic peptide
DESEIRTTNPVAYQQYGKVSTNLSERVNP

SEQ ID NO: 47658 - protein, 28 aa, Artificial Sequence
  Description of Artificial Sequence: Synthetic peptide
QEGEIRCTNPISTEQYGSVSENLMRGTR

SEQ ID NO: 47659 - protein, 29 aa, Artificial Sequence
  Description of Artificial Sequence: Synthetic peptide
DESEIRTTNPVAYMHYGSVSTNEQRTNDM

SEQ ID NO: 47660 - protein, 29 aa, Artificial Sequence
  Description of Artificial Sequence: Synthetic peptide
QEGEIATTNPVATEQYGTVSTNLEFEGND

SEQ ID NO: 47661 - protein, 32 aa, Artificial Sequence
  Description of Artificial Sequence: Synthetic polypeptide
DESIIRTTNPVATEQYGSTVSTGNLSQIGNET

SEQ ID NO: 47662 - protein, 29 aa, Artificial Sequence
  Description of Artificial Sequence: Synthetic peptide
AENEIRTTNPVATECYGEVSEINEQRGGR

SEQ ID NO: 47663 - protein, 30 aa, Artificial Sequence
  Description of Artificial Sequence: Synthetic polypeptide
DESTIRTTNPVAYEQWGESVSINLQDGDNR

SEQ ID NO: 47664 - protein, 29 aa, Artificial Sequence
  Description of Artificial Sequence: Synthetic peptide
DESVIATTNPVATAQWGSVSTDNLDNGNR

SEQ ID NO: 47665 - protein, 28 aa, Artificial Sequence
  Description of Artificial Sequence: Synthetic peptide
QEGEIATTNPVASEQYGDVSCNLQHGTR

SEQ ID NO: 47666 - protein, 30 aa, Artificial Sequence
  Description of Artificial Sequence: Synthetic polypeptide
DESVIATTNPVATAQWGSVSTDNLQRGPNQ

SEQ ID NO: 47667 - protein, 33 aa, Artificial Sequence
  Description of Artificial Sequence: Synthetic polypeptide
AEEEIRTTNPVATEQYGSVSVTNLNQNIGTNSA

SEQ ID NO: 47668 - protein, 30 aa, Artificial Sequence
  Description of Artificial Sequence: Synthetic polypeptide
DESVIATTNPVATEQDGKVSTDELQRGTNR

SEQ ID NO: 47669 - protein, 31 aa, Artificial Sequence
  Description of Artificial Sequence: Synthetic polypeptide
DESVIATTNPVATEQDGSTVSTDELQRTGNR

SEQ ID NO: 47670 - protein, 30 aa, Artificial Sequence
  Description of Artificial Sequence: Synthetic polypeptide
DESTIRTTNPVATEQYGCVGETNGDQRGNG

SEQ ID NO: 47671 - protein, 31 aa, Artificial Sequence
  Description of Artificial Sequence: Synthetic polypeptide
DESVIATTNPVATEQDGSVSTDSLSQRGTNR

SEQ ID NO: 47672 - protein, 31 aa, Artificial Sequence
  Description of Artificial Sequence: Synthetic polypeptide
DETEIRTTNPVAYEQYGTVSTTNGQMGGNSR

SEQ ID NO: 47673 - protein, 32 aa, Artificial Sequence
  Description of Artificial Sequence: Synthetic polypeptide
AEEEIRTTNPVATEQYGSVSVTNLNQLNINNG

SEQ ID NO: 47674 - protein, 28 aa, Artificial Sequence
  Description of Artificial Sequence: Synthetic peptide
AENEIRTTNPVATEQWGDASENLQRGDA

SEQ ID NO: 47675 - protein, 28 aa, Artificial Sequence
  Description of Artificial Sequence: Synthetic peptide
DESVIATTNPVAYEQWGCVYTNDQRGNR

SEQ ID NO: 47676 - protein, 30 aa, Artificial Sequence
  Description of Artificial Sequence: Synthetic polypeptide
DESVIGTTNPVATEQWGSVSTDELQRGSNQ

SEQ ID NO: 47677 - protein, 29 aa, Artificial Sequence
  Description of Artificial Sequence: Synthetic peptide
DESVIGTTNPVATEQWGSVSTDTLQDGNI

SEQ ID NO: 47678 - protein, 29 aa, Artificial Sequence
  Description of Artificial Sequence: Synthetic peptide
DESVIGTTNPVAYEQWGSVSTDDLQRGNF

SEQ ID NO: 47679 - protein, 29 aa, Artificial Sequence
  Description of Artificial Sequence: Synthetic peptide
DESVIATTNPVATEQWGSVSVDDLQRGNQ

SEQ ID NO: 47680 - protein, 31 aa, Artificial Sequence
  Description of Artificial Sequence: Synthetic polypeptide
DETEIATTNPVATETYGSVSTNLQSDGNGGA

SEQ ID NO: 47681 - protein, 28 aa, Artificial Sequence
  Description of Artificial Sequence: Synthetic peptide
QEGEIATTNPVASEQYGIVSCNLQHGTR

SEQ ID NO: 47682 - protein, 31 aa, Artificial Sequence
  Description of Artificial Sequence: Synthetic polypeptide
DETEIRTTNPVAYEQYGVVSTNLQRGGDGGS

SEQ ID NO: 47683 - protein, 28 aa, Artificial Sequence
  Description of Artificial Sequence: Synthetic peptide
AETEIACTNPVATEQYGEASANLQRGPR

SEQ ID NO: 47684 - protein, 28 aa, Artificial Sequence
  Description of Artificial Sequence: Synthetic peptide
AETEIACTNPVATEQYGEASANLQRGGR

SEQ ID NO: 47685 - protein, 30 aa, Artificial Sequence
  Description of Artificial Sequence: Synthetic polypeptide
DESNIRTTNPVATEQYGSVVSTNLNPDTNG

SEQ ID NO: 47686 - protein, 29 aa, Artificial Sequence
  Description of Artificial Sequence: Synthetic peptide
DESSIATTNPLATEQFGSVSYNLEQSGNR

SEQ ID NO: 47687 - protein, 29 aa, Artificial Sequence
  Description of Artificial Sequence: Synthetic peptide
QEGEIATTNPVATEQYGIVSTDLQSEGER

SEQ ID NO: 47688 - protein, 30 aa, Artificial Sequence
  Description of Artificial Sequence: Synthetic polypeptide
DESSIRTTNPLATEQWGSVPSFNELQSGNR

SEQ ID NO: 47689 - protein, 30 aa, Artificial Sequence
  Description of Artificial Sequence: Synthetic polypeptide
AENEIRTTNPVATECYGEVSEINLQRGEGR

SEQ ID NO: 47690 - protein, 30 aa, Artificial Sequence
  Description of Artificial Sequence: Synthetic polypeptide
DETEIRTTNPVAYEQYGTVSTTNQQDGGAR

SEQ ID NO: 47691 - protein, 29 aa, Artificial Sequence
  Description of Artificial Sequence: Synthetic peptide
AENEIRTTNPVATEPYGEASENIQRNGNR

SEQ ID NO: 47692 - protein, 28 aa, Artificial Sequence
  Description of Artificial Sequence: Synthetic peptide
QEGEIATTNPVATECWGSVSCNLQSGTR

SEQ ID NO: 47693 - protein, 29 aa, Artificial Sequence
  Description of Artificial Sequence: Synthetic peptide
AENEIRTTNPVATEPYGEASMNIQRNGNR

SEQ ID NO: 47694 - protein, 29 aa, Artificial Sequence
  Description of Artificial Sequence: Synthetic peptide
QEGEIATTNPVATECWGSVSCNLQRGETR

SEQ ID NO: 47695 - protein, 29 aa, Artificial Sequence
  Description of Artificial Sequence: Synthetic peptide
QEGEIATTNPVASEQYGTVSTNLESEGNR

SEQ ID NO: 47696 - protein, 30 aa, Artificial Sequence
  Description of Artificial Sequence: Synthetic polypeptide
DETEIRTTNPVAYQQYGCVSTNLEQHGDNP

SEQ ID NO: 47697 - protein, 28 aa, Artificial Sequence
  Description of Artificial Sequence: Synthetic peptide
QEGEIATTNPVASEQYGIVSCNLQSGTR

SEQ ID NO: 47698 - protein, 30 aa, Artificial Sequence
  Description of Artificial Sequence: Synthetic polypeptide
DETEIRTTNPVAYQQYGCVSTNLEQGGNEP

SEQ ID NO: 47699 - protein, 32 aa, Artificial Sequence
  Description of Artificial Sequence: Synthetic polypeptide
AEEEIRTTNPVATEQYGSVSVTNLQEQGEQGQ

SEQ ID NO: 47700 - protein, 33 aa, Artificial Sequence
  Description of Artificial Sequence: Synthetic polypeptide
AEEEIRTTNPVATEQYGSVSVTNLDNQQGENTE

SEQ ID NO: 47701 - protein, 32 aa, Artificial Sequence
  Description of Artificial Sequence: Synthetic polypeptide
AEEEIRTTNPVATEQYGSVSVTNLDEFGNQTQ

SEQ ID NO: 47702 - protein, 31 aa, Artificial Sequence
  Description of Artificial Sequence: Synthetic polypeptide
DETEIATTNPVATEVYGSVSTNLQHDNGDMR

SEQ ID NO: 47703 - protein, 32 aa, Artificial Sequence
  Description of Artificial Sequence: Synthetic polypeptide
AEEEIRTTNPVATEQYGSVSVTENGQNQGNND

SEQ ID NO: 47704 - protein, 33 aa, Artificial Sequence
  Description of Artificial Sequence: Synthetic polypeptide
DETEIRTTNPVATEQYGSVDSTNLFQNFSNIRE

SEQ ID NO: 47705 - protein, 28 aa, Artificial Sequence
  Description of Artificial Sequence: Synthetic peptide
AEQEIACTNPVATEQYGEVSTDLQHGGR

SEQ ID NO: 47706 - protein, 29 aa, Artificial Sequence
  Description of Artificial Sequence: Synthetic peptide
AEQEIACTNPVATEQYGEVSENLQRGGDR

SEQ ID NO: 47707 - protein, 31 aa, Artificial Sequence
  Description of Artificial Sequence: Synthetic polypeptide
DETEIRTTNPVATEQYGSVMSQNLFENGNGD

SEQ ID NO: 47708 - protein, 30 aa, Artificial Sequence
  Description of Artificial Sequence: Synthetic polypeptide
AEQEIACTNPVATEQYGEVSATNLQRGGDR

SEQ ID NO: 47709 - protein, 32 aa, Artificial Sequence
  Description of Artificial Sequence: Synthetic polypeptide
DETEIRTTNPVATEQYGSVQMTNNDQREGNSQ

SEQ ID NO: 47710 - protein, 33 aa, Artificial Sequence
  Description of Artificial Sequence: Synthetic polypeptide
DETEIRTTNPVATEQYGSVQSTTNLEQAGSNEG

SEQ ID NO: 47711 - protein, 28 aa, Artificial Sequence
  Description of Artificial Sequence: Synthetic peptide
AEQEIACTNPVATEQYGEASTNLERGER

SEQ ID NO: 47712 - protein, 28 aa, Artificial Sequence
  Description of Artificial Sequence: Synthetic peptide
AEQEIACTNPVATEQYGEASQNLQRGGR

SEQ ID NO: 47713 - protein, 28 aa, Artificial Sequence
  Description of Artificial Sequence: Synthetic peptide
AEQEIACTNPVATEQYGEASENLQRGGR

SEQ ID NO: 47714 - protein, 31 aa, Artificial Sequence
  Description of Artificial Sequence: Synthetic polypeptide
DETEIRTTNPVATEQYGSVQTGLIRGQGNTN

SEQ ID NO: 47715 - protein, 33 aa, Artificial Sequence
  Description of Artificial Sequence: Synthetic polypeptide
AEEEIRTTNPVATEQYGSVSVTENLGQNGNNEN

SEQ ID NO: 47716 - protein, 30 aa, Artificial Sequence
  Description of Artificial Sequence: Synthetic polypeptide
DETEIRTTNPVATEQYGSVSGMVQQLGNDQ

SEQ ID NO: 47717 - protein, 31 aa, Artificial Sequence
  Description of Artificial Sequence: Synthetic polypeptide
DETEIRTTNPVATEQYGSVSGTQELPQAPNF

SEQ ID NO: 47718 - protein, 34 aa, Artificial Sequence
  Description of Artificial Sequence: Synthetic polypeptide
DETEIRTTNPVATEQYGSVCSTNNLLQQRGDNLL

SEQ ID NO: 47719 - protein, 32 aa, Artificial Sequence
  Description of Artificial Sequence: Synthetic polypeptide
AEEEIRTTNPVATEQYGSVSVTENGQNNGNNV

SEQ ID NO: 47720 - protein, 31 aa, Artificial Sequence
  Description of Artificial Sequence: Synthetic polypeptide
DETEIRTTNPVATEQYGSVATNDQRNGDGDA

SEQ ID NO: 47721 - protein, 30 aa, Artificial Sequence
  Description of Artificial Sequence: Synthetic polypeptide
DETEIRTTNPVATEQYGSTSTNTNQQEGEQ

SEQ ID NO: 47722 - protein, 28 aa, Artificial Sequence
  Description of Artificial Sequence: Synthetic peptide
AEREIACTNPVATEQYGERSENLQRGGR

SEQ ID NO: 47723 - protein, 32 aa, Artificial Sequence
  Description of Artificial Sequence: Synthetic polypeptide
DETEIRTTNPVAYEAYGSTVSCTNSLSQRSNR

SEQ ID NO: 47724 - protein, 32 aa, Artificial Sequence
  Description of Artificial Sequence: Synthetic polypeptide
AEEEIRTTNPVATEQYGSVSVTNDGQGNGNTE

SEQ ID NO: 47725 - protein, 28 aa, Artificial Sequence
  Description of Artificial Sequence: Synthetic peptide
AEREIACTNPVATEQYGEASWNLQRGGR

SEQ ID NO: 47726 - protein, 28 aa, Artificial Sequence
  Description of Artificial Sequence: Synthetic peptide
AEREIACTNPVATEQYGEASENLQRGGR

SEQ ID NO: 47727 - protein, 32 aa, Artificial Sequence
  Description of Artificial Sequence: Synthetic polypeptide
AEEEIRTTNPVATEQYGSVSVTENGNQSGNNQ

SEQ ID NO: 47728 - protein, 31 aa, Artificial Sequence
  Description of Artificial Sequence: Synthetic polypeptide
DETEIRTTNPVAYEAWGSTVSVTNLSQRSNR

SEQ ID NO: 47729 - protein, 31 aa, Artificial Sequence
  Description of Artificial Sequence: Synthetic polypeptide
DETEIRTTNPVATEQYGSVSIVMTQRDGINK

SEQ ID NO: 47730 - protein, 29 aa, Artificial Sequence
  Description of Artificial Sequence: Synthetic peptide
AEQEIATTNPVATEQYGSVSEDLQRGGDL

SEQ ID NO: 47731 - protein, 32 aa, Artificial Sequence
  Description of Artificial Sequence: Synthetic polypeptide
DETEIRTTNPVATEQYGMSISTPNTQREGLNE

SEQ ID NO: 47732 - protein, 29 aa, Artificial Sequence
  Description of Artificial Sequence: Synthetic peptide
AEQEIATTNPVATEQYGSASENLQRGGDL

SEQ ID NO: 47733 - protein, 31 aa, Artificial Sequence
  Description of Artificial Sequence: Synthetic polypeptide
AEQEIATTNPVATEQYGEVSATNLQDRGEDR

SEQ ID NO: 47734 - protein, 31 aa, Artificial Sequence
  Description of Artificial Sequence: Synthetic polypeptide
DETEIRTTNPVATEQYGSATSTPNVNQTGNA

SEQ ID NO: 47735 - protein, 32 aa, Artificial Sequence
  Description of Artificial Sequence: Synthetic polypeptide
AEEEIRTTNPVATEQYGSVSVTENGQNGNNQQ

SEQ ID NO: 47736 - protein, 33 aa, Artificial Sequence
  Description of Artificial Sequence: Synthetic polypeptide
DETEIRTTNPVATEQYGSMSTELHQHRMGDNRQ

SEQ ID NO: 47737 - protein, 30 aa, Artificial Sequence
  Description of Artificial Sequence: Synthetic polypeptide
DETEIRTTNPVATEQYGSTSTNNTQQEGET

SEQ ID NO: 47738 - protein, 29 aa, Artificial Sequence
  Description of Artificial Sequence: Synthetic peptide
AEQEIATTNPVATEQYGSVSEDLQRGEDL

SEQ ID NO: 47739 - protein, 32 aa, Artificial Sequence
  Description of Artificial Sequence: Synthetic polypeptide
DETEIRTTNPVATEQYGSVSLNNAQRDGGLDR

SEQ ID NO: 47740 - protein, 32 aa, Artificial Sequence
  Description of Artificial Sequence: Synthetic polypeptide
DETEIRTTNPVAVEQYGSVISTNLQERNQNGQ

SEQ ID NO: 47741 - protein, 32 aa, Artificial Sequence
  Description of Artificial Sequence: Synthetic polypeptide
DETEIRTTNPVATEQYGSVSTAELEQVLENRV

SEQ ID NO: 47742 - protein, 31 aa, Artificial Sequence
  Description of Artificial Sequence: Synthetic polypeptide
DETEIRTTNPVATESYGAVSTALQMGTNDRV

SEQ ID NO: 47743 - protein, 32 aa, Artificial Sequence
  Description of Artificial Sequence: Synthetic polypeptide
AEEEIRTTNPVATEQYGSVSVTLLQQGQEINE

SEQ ID NO: 47744 - protein, 28 aa, Artificial Sequence
  Description of Artificial Sequence: Synthetic peptide
AENEIVCTNPVATEQYGEASENLQRGGR

SEQ ID NO: 47745 - protein, 29 aa, Artificial Sequence
  Description of Artificial Sequence: Synthetic peptide
DETEIRTTNPVATEWYGSVSTDVQLSVND

SEQ ID NO: 47746 - protein, 28 aa, Artificial Sequence
  Description of Artificial Sequence: Synthetic peptide
AENEITCTNPVATEQYGEASENLQRGGR

SEQ ID NO: 47747 - protein, 30 aa, Artificial Sequence
  Description of Artificial Sequence: Synthetic polypeptide
DETEIRTTNPVATQQYGTVSTNLEVRELNP

SEQ ID NO: 47748 - protein, 32 aa, Artificial Sequence
  Description of Artificial Sequence: Synthetic polypeptide
AEEEIRTTNPVATEQYGSVSVTLLQQGQNGNA

SEQ ID NO: 47749 - protein, 28 aa, Artificial Sequence
  Description of Artificial Sequence: Synthetic peptide
AENEIVTTNPVATEQYGEASENPQRGGR

SEQ ID NO: 47750 - protein, 32 aa, Artificial Sequence
  Description of Artificial Sequence: Synthetic polypeptide
AEEEIRTTNPVATEQYGSVSVTLNLQGQINTE

SEQ ID NO: 47751 - protein, 30 aa, Artificial Sequence
  Description of Artificial Sequence: Synthetic polypeptide
DETEIRTTNPVAVEQYGSISTNLEVEILNR

SEQ ID NO: 47752 - protein, 32 aa, Artificial Sequence
  Description of Artificial Sequence: Synthetic polypeptide
AEEEIRTTNPVATEQYGSVSVTLNQQQQGTNE

SEQ ID NO: 47753 - protein, 32 aa, Artificial Sequence
  Description of Artificial Sequence: Synthetic polypeptide
AEEEIRTTNPVATEQYGSVSVTNAGNQVGNNQ

SEQ ID NO: 47754 - protein, 31 aa, Artificial Sequence
  Description of Artificial Sequence: Synthetic polypeptide
DETEIRTTNPVAVEQYGSVINTNGQERGNNG

SEQ ID NO: 47755 - protein, 32 aa, Artificial Sequence
  Description of Artificial Sequence: Synthetic polypeptide
DETEIRTTNPVAVEQYGSVISNTNGLERGNNG

SEQ ID NO: 47756 - protein, 33 aa, Artificial Sequence
  Description of Artificial Sequence: Synthetic polypeptide
AEEEIRTTNPVATEQYGSVSVTNANLQQGENNA

SEQ ID NO: 47757 - protein, 32 aa, Artificial Sequence
  Description of Artificial Sequence: Synthetic polypeptide
AEEEIRTTNPVATEQYGSVSVTNANQLQGNDN

SEQ ID NO: 47758 - protein, 30 aa, Artificial Sequence
  Description of Artificial Sequence: Synthetic polypeptide
DETEIRTTNPVATYHYGSVSTNQQRTGGMS

SEQ ID NO: 47759 - protein, 28 aa, Artificial Sequence
  Description of Artificial Sequence: Synthetic peptide
AEREIACTNPVATEQYGFASENLQRGGR

SEQ ID NO: 47760 - protein, 32 aa, Artificial Sequence
  Description of Artificial Sequence: Synthetic polypeptide
AEEEIRTTNPVATEQYGSVSVTGNENQQGNNE

SEQ ID NO: 47761 - protein, 32 aa, Artificial Sequence
  Description of Artificial Sequence: Synthetic polypeptide
AEEEIRTTNPVATEQYGSVSVTNDEQGEGNNE

SEQ ID NO: 47762 - protein, 32 aa, Artificial Sequence
  Description of Artificial Sequence: Synthetic polypeptide
DETEIRTTNPVATEQYGSVSTGNLDNMNGNQD

SEQ ID NO: 47763 - protein, 32 aa, Artificial Sequence
  Description of Artificial Sequence: Synthetic polypeptide
DETEIRTTNPVATEQYGSVSTMNNLAEVVNSR

SEQ ID NO: 47764 - protein, 32 aa, Artificial Sequence
  Description of Artificial Sequence: Synthetic polypeptide
DETEIRTTNPVATEQYGSVSTNLQGEGGDGGS

SEQ ID NO: 47765 - protein, 28 aa, Artificial Sequence
  Description of Artificial Sequence: Synthetic peptide
AEPEIACTNPVATEQYGEASFNLQRGGR

SEQ ID NO: 47766 - protein, 28 aa, Artificial Sequence
  Description of Artificial Sequence: Synthetic peptide
AEPEIACTNPVATEQYGEASENLQRGYR

SEQ ID NO: 47767 - protein, 29 aa, Artificial Sequence
  Description of Artificial Sequence: Synthetic peptide
AEPEIACTNPVATEQYGEASENLQRGNGR

SEQ ID NO: 47768 - protein, 28 aa, Artificial Sequence
  Description of Artificial Sequence: Synthetic peptide
AEPEIACTNPVATEQYGEASENLQRGGR

SEQ ID NO: 47769 - protein, 28 aa, Artificial Sequence
  Description of Artificial Sequence: Synthetic peptide
AENEIWCTNPVATEQYGEASENLQRGGR

SEQ ID NO: 47770 - protein, 28 aa, Artificial Sequence
  Description of Artificial Sequence: Synthetic peptide
AENVIACTNPVATEQYGEVSENLQRGGR

SEQ ID NO: 47771 - protein, 32 aa, Artificial Sequence
  Description of Artificial Sequence: Synthetic polypeptide
DETEIRTTNPVATEQYGSVSTTGNGPQDGNPP

SEQ ID NO: 47772 - protein, 32 aa, Artificial Sequence
  Description of Artificial Sequence: Synthetic polypeptide
AEEEIRTTNPVATEQYGSVSVTENNQQGNNNS

SEQ ID NO: 47773 - protein, 31 aa, Artificial Sequence
  Description of Artificial Sequence: Synthetic polypeptide
DETEIRTTNPVATEQYGSVSYTLNQQLINNT

SEQ ID NO: 47774 - protein, 30 aa, Artificial Sequence
  Description of Artificial Sequence: Synthetic polypeptide
DETEIRTTNPVATEQYGSVVCENLQPGMGG

SEQ ID NO: 47775 - protein, 32 aa, Artificial Sequence
  Description of Artificial Sequence: Synthetic polypeptide
DETEIRTTNPVATEQYGTVSTNLQGDHGGNQS

SEQ ID NO: 47776 - protein, 28 aa, Artificial Sequence
  Description of Artificial Sequence: Synthetic peptide
AENEIYCTNPVATEQYGEASENLQRGGR

SEQ ID NO: 47777 - protein, 28 aa, Artificial Sequence
  Description of Artificial Sequence: Synthetic peptide
QEEVICTTNPVAYEQYGSVAMNDQRGNS

SEQ ID NO: 47778 - protein, 31 aa, Artificial Sequence
  Description of Artificial Sequence: Synthetic polypeptide
DETEIRTTNPVATEQYGSVSTQNPEQGMERE

SEQ ID NO: 47779 - protein, 31 aa, Artificial Sequence
  Description of Artificial Sequence: Synthetic polypeptide
DESEIRTTNPVAYEQYGSVSTDNGNQGQGDR

SEQ ID NO: 47780 - protein, 32 aa, Artificial Sequence
  Description of Artificial Sequence: Synthetic polypeptide
AEEEIRTTNPVATEQYGSVSVTANNEQGGNQE

SEQ ID NO: 47781 - protein, 28 aa, Artificial Sequence
  Description of Artificial Sequence: Synthetic peptide
QEGEIACTNPVATEQYGEASENLQRGGR

SEQ ID NO: 47782 - protein, 31 aa, Artificial Sequence
  Description of Artificial Sequence: Synthetic polypeptide
AEEEIRTTNPVATEQYGSVSVSNQQQQTGNQ

SEQ ID NO: 47783 - protein, 32 aa, Artificial Sequence
  Description of Artificial Sequence: Synthetic polypeptide
AEEEIRTTNPVATEQYGSVSVSTNANQQGNGT

SEQ ID NO: 47784 - protein, 29 aa, Artificial Sequence
  Description of Artificial Sequence: Synthetic peptide
DETEIRTTNPVAYEQWGSVSTNPQHDGEQ

SEQ ID NO: 47785 - protein, 30 aa, Artificial Sequence
  Description of Artificial Sequence: Synthetic polypeptide
DETEICTTNPVATEQYGSVSTNGGNEGNDH

SEQ ID NO: 47786 - protein, 31 aa, Artificial Sequence
  Description of Artificial Sequence: Synthetic polypeptide
DETEICTTNPVATEQYGSVSTNLGGNMGGND

SEQ ID NO: 47787 - protein, 31 aa, Artificial Sequence
  Description of Artificial Sequence: Synthetic polypeptide
DETEICTTNPVATEQYGSVSTNLGGNNGDND

SEQ ID NO: 47788 - protein, 31 aa, Artificial Sequence
  Description of Artificial Sequence: Synthetic polypeptide
DETEICTTNPVATEQYGSVSTNLGGNSGNQD

SEQ ID NO: 47789 - protein, 31 aa, Artificial Sequence
  Description of Artificial Sequence: Synthetic polypeptide
DETEICTTNPVATEQYGSVSTNLNGDNGGND

SEQ ID NO: 47790 - protein, 32 aa, Artificial Sequence
  Description of Artificial Sequence: Synthetic polypeptide
AEEEIRTTNPVATEQYGSVSVTNGNQQGNNVS

SEQ ID NO: 47791 - protein, 31 aa, Artificial Sequence
  Description of Artificial Sequence: Synthetic polypeptide
DETEICTTNPVATEQYGSVSTNLNGGNGNTD

SEQ ID NO: 47792 - protein, 31 aa, Artificial Sequence
  Description of Artificial Sequence: Synthetic polypeptide
AEEEIRTTNPVATEQYGSVSVSTNNDESGNP

SEQ ID NO: 47793 - protein, 32 aa, Artificial Sequence
  Description of Artificial Sequence: Synthetic polypeptide
AEEEIRTTNPVATEQYGSVSVTNGEQVGNNDI

SEQ ID NO: 47794 - protein, 31 aa, Artificial Sequence
  Description of Artificial Sequence: Synthetic polypeptide
AEEEIRTTNPVATEQYGSVSVTNDVQGTENE

SEQ ID NO: 47795 - protein, 32 aa, Artificial Sequence
  Description of Artificial Sequence: Synthetic polypeptide
AEEEIRTTNPVATEQYGSVSVTNDQQQQGNAE

SEQ ID NO: 47796 - protein, 31 aa, Artificial Sequence
  Description of Artificial Sequence: Synthetic polypeptide
DETEICTTNPVATEQYGSVSTNLNGNGNEDH

SEQ ID NO: 47797 - protein, 31 aa, Artificial Sequence
  Description of Artificial Sequence: Synthetic polypeptide
AEEEIRTTNPVATEQYGSVSVSNNQQTGNQQ

SEQ ID NO: 47798 - protein, 31 aa, Artificial Sequence
  Description of Artificial Sequence: Synthetic polypeptide
AEEEIRTTNPVATEQYGSVSVSNNQQTGNNQ

SEQ ID NO: 47799 - protein, 31 aa, Artificial Sequence
  Description of Artificial Sequence: Synthetic polypeptide
DETEIATTNPVAYEQYGTVSTNLQHNGNGDR

SEQ ID NO: 47800 - protein, 29 aa, Artificial Sequence
  Description of Artificial Sequence: Synthetic peptide
DETEIRTTNPVAYEQWGSVSTNPQHGEDQ

SEQ ID NO: 47801 - protein, 28 aa, Artificial Sequence
  Description of Artificial Sequence: Synthetic peptide
QEGEIAPTNPIASEQYGSVSCNLQRGTR

SEQ ID NO: 47802 - protein, 29 aa, Artificial Sequence
  Description of Artificial Sequence: Synthetic peptide
DETEIATTNPVAYEPYGSVATNLQDGNDF

SEQ ID NO: 47803 - protein, 29 aa, Artificial Sequence
  Description of Artificial Sequence: Synthetic peptide
DETEIATTNPVAYEPYGSVATNLQQGNDT

SEQ ID NO: 47804 - protein, 29 aa, Artificial Sequence
  Description of Artificial Sequence: Synthetic peptide
QEGEIAPTNPCSTEQYGSVSTNLQSGMNR

SEQ ID NO: 47805 - protein, 30 aa, Artificial Sequence
  Description of Artificial Sequence: Synthetic polypeptide
AEEEIRTTNPVATEQYGSVSVQNGNNDGNS

SEQ ID NO: 47806 - protein, 29 aa, Artificial Sequence
  Description of Artificial Sequence: Synthetic peptide
DETEIATTNPVAYEQWGSVSTNLQDDGDV

SEQ ID NO: 47807 - protein, 31 aa, Artificial Sequence
  Description of Artificial Sequence: Synthetic polypeptide
AEEEIRTTNPVATEQYGSVSVSNEQAGTNLI

SEQ ID NO: 47808 - protein, 28 aa, Artificial Sequence
  Description of Artificial Sequence: Synthetic peptide
AESEIACTNPVATEQYGEASYNLQRGGR

SEQ ID NO: 47809 - protein, 31 aa, Artificial Sequence
  Description of Artificial Sequence: Synthetic polypeptide
AEEEIRTTNPVATEQYGSVSVSNLQNQEGIG

SEQ ID NO: 47810 - protein, 28 aa, Artificial Sequence
  Description of Artificial Sequence: Synthetic peptide
QEGEIAPTNPCSTEQYGSVSCNLQSGNR

SEQ ID NO: 47811 - protein, 30 aa, Artificial Sequence
  Description of Artificial Sequence: Synthetic polypeptide
DETEIATTNPVAYEQYGNVSTNLQNGGNAS

SEQ ID NO: 47812 - protein, 29 aa, Artificial Sequence
  Description of Artificial Sequence: Synthetic peptide
DETEIATTNPVAYEQYGSVSTDNGQAGDV

SEQ ID NO: 47813 - protein, 31 aa, Artificial Sequence
  Description of Artificial Sequence: Synthetic polypeptide
DETEIATTNPVAYEQYGSVSTNLNGNDMGNR

SEQ ID NO: 47814 - protein, 31 aa, Artificial Sequence
  Description of Artificial Sequence: Synthetic polypeptide
AEEEIRTTNPVATEQYGSVSVSNNLDEFGNS

SEQ ID NO: 47815 - protein, 32 aa, Artificial Sequence
  Description of Artificial Sequence: Synthetic polypeptide
AEEEIRTTNPVATEQYGSVSVTNLDEFGNNTD

SEQ ID NO: 47816 - protein, 30 aa, Artificial Sequence
  Description of Artificial Sequence: Synthetic polypeptide
DETEIATTNPVAYEQYGTVSTNLQGDGNTS

SEQ ID NO: 47817 - protein, 30 aa, Artificial Sequence
  Description of Artificial Sequence: Synthetic polypeptide
DETEIATTNPVAYEQWGSVSTNLQHDGNTE

SEQ ID NO: 47818 - protein, 32 aa, Artificial Sequence
  Description of Artificial Sequence: Synthetic polypeptide
DETEICTTNPVATEQYGSVSTNLNGNMGNDDR

SEQ ID NO: 47819 - protein, 28 aa, Artificial Sequence
  Description of Artificial Sequence: Synthetic peptide
AESEIACTNPVATEQYGEASQNLQRGGR

SEQ ID NO: 47820 - protein, 28 aa, Artificial Sequence
  Description of Artificial Sequence: Synthetic peptide
AESEIACTNPVATEQYGEASENLQRGGR

SEQ ID NO: 47821 - protein, 33 aa, Artificial Sequence
  Description of Artificial Sequence: Synthetic polypeptide
AEEEIRTTNPVATEQYGSVSVSVTNLQQGSNQA

SEQ ID NO: 47822 - protein, 31 aa, Artificial Sequence
  Description of Artificial Sequence: Synthetic polypeptide
DETEIRTTNPVATDQYGSVNTEQLQRQGNQD

SEQ ID NO: 47823 - protein, 33 aa, Artificial Sequence
  Description of Artificial Sequence: Synthetic polypeptide
AEEEIRTTNPVATEQYGSVSVSVTNLQQGSNQE

SEQ ID NO: 47824 - protein, 30 aa, Artificial Sequence
  Description of Artificial Sequence: Synthetic polypeptide
DETEIRTTNPVATDQYGSVNTQLEQRQGTD

SEQ ID NO: 47825 - protein, 30 aa, Artificial Sequence
  Description of Artificial Sequence: Synthetic polypeptide
DETEIRTTNPVATDQYGSVNTQLQRNENVD

SEQ ID NO: 47826 - protein, 30 aa, Artificial Sequence
  Description of Artificial Sequence: Synthetic polypeptide
DETEIRTTNPVATDQYGSVNVMQLQRGNVD

SEQ ID NO: 47827 - protein, 31 aa, Artificial Sequence
  Description of Artificial Sequence: Synthetic polypeptide
DETEIRTTNPVATDQYGSVVNTGLQREGNND

SEQ ID NO: 47828 - protein, 30 aa, Artificial Sequence
  Description of Artificial Sequence: Synthetic polypeptide
QEENICTTNPVATEQYGSVSTMNSQSGNQS

SEQ ID NO: 47829 - protein, 28 aa, Artificial Sequence
  Description of Artificial Sequence: Synthetic peptide
AEREITCTNPVATEQYGEASENLQRGGR

SEQ ID NO: 47830 - protein, 30 aa, Artificial Sequence
  Description of Artificial Sequence: Synthetic polypeptide
DETEIRTTNPVATECYGSVSQSNLNLGGNP

SEQ ID NO: 47831 - protein, 31 aa, Artificial Sequence
  Description of Artificial Sequence: Synthetic polypeptide
DETEIRTTNPVAYEQWGNVSTNLQGDGGNER

SEQ ID NO: 47832 - protein, 32 aa, Artificial Sequence
  Description of Artificial Sequence: Synthetic polypeptide
AEEEIRTTNPVATEQYGSVSVTNDNQDGNGNQ

SEQ ID NO: 47833 - protein, 28 aa, Artificial Sequence
  Description of Artificial Sequence: Synthetic peptide
AENEISCTNPVATEQYGEASENLQRGGR

SEQ ID NO: 47834 - protein, 31 aa, Artificial Sequence
  Description of Artificial Sequence: Synthetic polypeptide
DETEIRTTNPVAYEHYGEVSTNLQNGGENDR

SEQ ID NO: 47835 - protein, 28 aa, Artificial Sequence
  Description of Artificial Sequence: Synthetic peptide
QEGEIACTNPVATEQYGIASENLQRGGR

SEQ ID NO: 47836 - protein, 28 aa, Artificial Sequence
  Description of Artificial Sequence: Synthetic peptide
QEGEIACTNPVATEQYGIASCNLQRGGR

SEQ ID NO: 47837 - protein, 32 aa, Artificial Sequence
  Description of Artificial Sequence: Synthetic polypeptide
AEEEIRTTNPVATEQYGSVSVTNDNQGNGNED

SEQ ID NO: 47838 - protein, 32 aa, Artificial Sequence
  Description of Artificial Sequence: Synthetic polypeptide
DETEIRTTNPVAYEAYGSVVSCTNMLSQRSNR

SEQ ID NO: 47839 - protein, 29 aa, Artificial Sequence
  Description of Artificial Sequence: Synthetic peptide
DETEICTVNPVATEQYGSVSTNDFNEGNH

SEQ ID NO: 47840 - protein, 28 aa, Artificial Sequence
  Description of Artificial Sequence: Synthetic peptide
QEGEIAPTNPCASEQYGSVSCNLQRGTR

SEQ ID NO: 47841 - protein, 33 aa, Artificial Sequence
  Description of Artificial Sequence: Synthetic polypeptide
AEEEIRTTNPVATEQYGSVSVSTNNQLQNGNAA

SEQ ID NO: 47842 - protein, 28 aa, Artificial Sequence
  Description of Artificial Sequence: Synthetic peptide
AESEIACTNPVATEQYGEASENLQRGDR

SEQ ID NO: 47843 - protein, 31 aa, Artificial Sequence
  Description of Artificial Sequence: Synthetic polypeptide
DETEICTTNPVATEQYGSVSTNLNGNNGNDD

SEQ ID NO: 47844 - protein, 32 aa, Artificial Sequence
  Description of Artificial Sequence: Synthetic polypeptide
DETEICTTNPVATEQYGSVSTNLQGNEGENDQ

SEQ ID NO: 47845 - protein, 29 aa, Artificial Sequence
  Description of Artificial Sequence: Synthetic peptide
AESEIACTNPVATEQYGEASENLQDRGNR

SEQ ID NO: 47846 - protein, 32 aa, Artificial Sequence
  Description of Artificial Sequence: Synthetic polypeptide
AEEEIRTTNPVATEQYGSVSVTNDQQGNGNQM

SEQ ID NO: 47847 - protein, 30 aa, Artificial Sequence
  Description of Artificial Sequence: Synthetic polypeptide
DETEIRTTNPVAYEQWGSVSTNLQHDNGDT

SEQ ID NO: 47848 - protein, 28 aa, Artificial Sequence
  Description of Artificial Sequence: Synthetic peptide
AENEIRTTNPVSTEQYGTISENLQRGGH

SEQ ID NO: 47849 - protein, 31 aa, Artificial Sequence
  Description of Artificial Sequence: Synthetic polypeptide
AEEEIRTTNPVATEQYGSVSVTNDQGNNNQV

SEQ ID NO: 47850 - protein, 32 aa, Artificial Sequence
  Description of Artificial Sequence: Synthetic polypeptide
AEEEIRTTNPVATEQYGSVSVTNDQGNGGNQS

SEQ ID NO: 47851 - protein, 32 aa, Artificial Sequence
  Description of Artificial Sequence: Synthetic polypeptide
AEEEIRTTNPVATEQYGSVSVTNDQGNGENDE

SEQ ID NO: 47852 - protein, 30 aa, Artificial Sequence
  Description of Artificial Sequence: Synthetic polypeptide
DETEICTTNPVAYEQYGSVSTNLGDNEGND

SEQ ID NO: 47853 - protein, 30 aa, Artificial Sequence
  Description of Artificial Sequence: Synthetic polypeptide
DETEIRTTNPVAYEQWGSVSTNLNDGNNEM

SEQ ID NO: 47854 - protein, 31 aa, Artificial Sequence
  Description of Artificial Sequence: Synthetic polypeptide
DETEIRTTNPVAYEQWGSVSTNLGGDGDNNR

SEQ ID NO: 47855 - protein, 32 aa, Artificial Sequence
  Description of Artificial Sequence: Synthetic polypeptide
AEEEIRTTNPVATEQYGSVSVTNDQGGNGNNP

SEQ ID NO: 47856 - protein, 32 aa, Artificial Sequence
  Description of Artificial Sequence: Synthetic polypeptide
AEEEIRTTNPVATEQYGSVSVTNDQGGNGNEA

SEQ ID NO: 47857 - protein, 32 aa, Artificial Sequence
  Description of Artificial Sequence: Synthetic polypeptide
AEEEIRTTNPVATEQYGSVSVTNDQGNGTNEM

SEQ ID NO: 47858 - protein, 33 aa, Artificial Sequence
  Description of Artificial Sequence: Synthetic polypeptide
AENEIRCTNPVATEQYGSVSTNLPQMRNGMNPR

SEQ ID NO: 47859 - protein, 30 aa, Artificial Sequence
  Description of Artificial Sequence: Synthetic polypeptide
QEGEIRPTNPVATEQWGSVSCNEQDREGNR

SEQ ID NO: 47860 - protein, 32 aa, Artificial Sequence
  Description of Artificial Sequence: Synthetic polypeptide
DESEIRTTNPVAYEQYGSVSCTNELSHNSGNR

SEQ ID NO: 47861 - protein, 30 aa, Artificial Sequence
  Description of Artificial Sequence: Synthetic polypeptide
DESEIRTTNPVATECWGSVSDNEPQDRGNG

SEQ ID NO: 47862 - protein, 29 aa, Artificial Sequence
  Description of Artificial Sequence: Synthetic peptide
DEVEIATTNPVATDQYGVVSTALQIGNDD

SEQ ID NO: 47863 - protein, 30 aa, Artificial Sequence
  Description of Artificial Sequence: Synthetic polypeptide
QEEGIRTTNPVATEQYGSVSTNGLEGFNIQ

SEQ ID NO: 47864 - protein, 32 aa, Artificial Sequence
  Description of Artificial Sequence: Synthetic polypeptide
AEEEIRTTNPVATEQYGSVSVTNNDQAGGNNI

SEQ ID NO: 47865 - protein, 29 aa, Artificial Sequence
  Description of Artificial Sequence: Synthetic peptide
DEVEIATTNPVATDQYGDVSTELQRGMGQ

SEQ ID NO: 47866 - protein, 28 aa, Artificial Sequence
  Description of Artificial Sequence: Synthetic peptide
DEVEIATTNPVATDQYGDVSTDGQDGNI

SEQ ID NO: 47867 - protein, 29 aa, Artificial Sequence
  Description of Artificial Sequence: Synthetic peptide
DEVEIATTNPVATDQYGDVSITAGQRGNI

SEQ ID NO: 47868 - protein, 30 aa, Artificial Sequence
  Description of Artificial Sequence: Synthetic polypeptide
QEEGIRTTNPVATEQYGSVSTNGLEGGLDG

SEQ ID NO: 47869 - protein, 28 aa, Artificial Sequence
  Description of Artificial Sequence: Synthetic peptide
QENEIATTNPVATECYGSVSECLQRENL

SEQ ID NO: 47870 - protein, 30 aa, Artificial Sequence
  Description of Artificial Sequence: Synthetic polypeptide
QEEGIRTTNPVATEQYGSVSTNGLEGMENV

SEQ ID NO: 47871 - protein, 32 aa, Artificial Sequence
  Description of Artificial Sequence: Synthetic polypeptide
AEEEIRTTNPVATEQYGSVSVTNNDEQVGNNI

SEQ ID NO: 47872 - protein, 30 aa, Artificial Sequence
  Description of Artificial Sequence: Synthetic polypeptide
DEVEIATTNPVATAQYGVVSTAGLQRGDNN

SEQ ID NO: 47873 - protein, 28 aa, Artificial Sequence
  Description of Artificial Sequence: Synthetic peptide
QENEIATTNPVATECYGEASENLQRGGR

SEQ ID NO: 47874 - protein, 31 aa, Artificial Sequence
  Description of Artificial Sequence: Synthetic polypeptide
DESEIRTTNPVATECYGSASCINEPQREGNR

SEQ ID NO: 47875 - protein, 28 aa, Artificial Sequence
  Description of Artificial Sequence: Synthetic peptide
QENEIATTNPVATECYGEASENLQRGER

SEQ ID NO: 47876 - protein, 31 aa, Artificial Sequence
  Description of Artificial Sequence: Synthetic polypeptide
DESEIRTTNPVATECWGSVSCNEPQREGENR

SEQ ID NO: 47877 - protein, 29 aa, Artificial Sequence
  Description of Artificial Sequence: Synthetic peptide
QEEGIRTTNPVATEQYGSVSTNGFEDLNA

SEQ ID NO: 47878 - protein, 29 aa, Artificial Sequence
  Description of Artificial Sequence: Synthetic peptide
DEVEIATTNPVATDQYGVVSTDLQDGGNT

SEQ ID NO: 47879 - protein, 28 aa, Artificial Sequence
  Description of Artificial Sequence: Synthetic peptide
QENEIATTNPVATEQYGDVSENLQHGEL

SEQ ID NO: 47880 - protein, 30 aa, Artificial Sequence
  Description of Artificial Sequence: Synthetic polypeptide
DESEIRTTNPVATEAYGSVSWNDLQDDGTA

SEQ ID NO: 47881 - protein, 33 aa, Artificial Sequence
  Description of Artificial Sequence: Synthetic polypeptide
DESEIRTTNPVATEAYGTVYSYTQNALQRGNRP

SEQ ID NO: 47882 - protein, 32 aa, Artificial Sequence
  Description of Artificial Sequence: Synthetic polypeptide
DEVEIATTNPVATECYGEVSTNLQRGGDNGDR

SEQ ID NO: 47883 - protein, 29 aa, Artificial Sequence
  Description of Artificial Sequence: Synthetic peptide
QEEGICTTNPVAYEQYGSVSMNDQRGNSL

SEQ ID NO: 47884 - protein, 28 aa, Artificial Sequence
  Description of Artificial Sequence: Synthetic peptide
QENEIATTNPVATEQYGSVSECLQHGEL

SEQ ID NO: 47885 - protein, 30 aa, Artificial Sequence
  Description of Artificial Sequence: Synthetic polypeptide
QEEGIRTTNPVATEQYGSVCTNGLEGEGNG

SEQ ID NO: 47886 - protein, 29 aa, Artificial Sequence
  Description of Artificial Sequence: Synthetic peptide
AENEICATNPVATEQYGSVASENLQDGLR

SEQ ID NO: 47887 - protein, 31 aa, Artificial Sequence
  Description of Artificial Sequence: Synthetic polypeptide
QEEGIRTTNPVATEQYGSVSTNGLEGQGNGE

SEQ ID NO: 47888 - protein, 28 aa, Artificial Sequence
  Description of Artificial Sequence: Synthetic peptide
QENEIATTNPVATEQYGEVSENLQREEL

SEQ ID NO: 47889 - protein, 32 aa, Artificial Sequence
  Description of Artificial Sequence: Synthetic polypeptide
AEEEIRTTNPVATEQYGSVSVTNNDQGNGNNQ

SEQ ID NO: 47890 - protein, 30 aa, Artificial Sequence
  Description of Artificial Sequence: Synthetic polypeptide
DESEIRTTNPVATECWGSVSCINEQRGENG

SEQ ID NO: 47891 - protein, 30 aa, Artificial Sequence
  Description of Artificial Sequence: Synthetic polypeptide
DESEIRTTNPVATECWGSVSCINEQRGENL

SEQ ID NO: 47892 - protein, 29 aa, Artificial Sequence
  Description of Artificial Sequence: Synthetic peptide
DESEIRTTNPVATECWGSVSCINEQRGGG

SEQ ID NO: 47893 - protein, 29 aa, Artificial Sequence
  Description of Artificial Sequence: Synthetic peptide
AENEICATNPVATEQYGSVASENLQRGVE

SEQ ID NO: 47894 - protein, 28 aa, Artificial Sequence
  Description of Artificial Sequence: Synthetic peptide
QENEIATTNPVATEQYGEASENCQRGGR

SEQ ID NO: 47895 - protein, 29 aa, Artificial Sequence
  Description of Artificial Sequence: Synthetic peptide
DEVEIATTNPVATDQYGVVSTDLQRGGDT

SEQ ID NO: 47896 - protein, 30 aa, Artificial Sequence
  Description of Artificial Sequence: Synthetic polypeptide
DESEIRTTNPVATECWGSVSCINEQDRGNG

SEQ ID NO: 47897 - protein, 32 aa, Artificial Sequence
  Description of Artificial Sequence: Synthetic polypeptide
AEEEIRTTNPVATEQYGSVSVTNLVQGTTNVE

SEQ ID NO: 47898 - protein, 32 aa, Artificial Sequence
  Description of Artificial Sequence: Synthetic polypeptide
AEEEIRTTNPVATEQYGSVSVTNLVNNGTNGN

SEQ ID NO: 47899 - protein, 31 aa, Artificial Sequence
  Description of Artificial Sequence: Synthetic polypeptide
DESEIRTTNPVATECYGSVSCINEQDREGNG

SEQ ID NO: 47900 - protein, 30 aa, Artificial Sequence
  Description of Artificial Sequence: Synthetic polypeptide
DESEIRTTNPVATEPYGSVAATNEQRPNAE

SEQ ID NO: 47901 - protein, 28 aa, Artificial Sequence
  Description of Artificial Sequence: Synthetic peptide
QENEIATTNPIATEQYGDVSENLQREER

SEQ ID NO: 47902 - protein, 28 aa, Artificial Sequence
  Description of Artificial Sequence: Synthetic peptide
AENEIDCTNPVATEQYGEASENLQRGGR

SEQ ID NO: 47903 - protein, 31 aa, Artificial Sequence
  Description of Artificial Sequence: Synthetic polypeptide
DESEIRTTNPVATEQWGEASCNLPQREGENR

SEQ ID NO: 47904 - protein, 28 aa, Artificial Sequence
  Description of Artificial Sequence: Synthetic peptide
AENEIECTNPVATEQYGEISENLQRGGR

SEQ ID NO: 47905 - protein, 33 aa, Artificial Sequence
  Description of Artificial Sequence: Synthetic polypeptide
DESEIRTTNPVATEQWGSTVSCTNLSQRTENPR

SEQ ID NO: 47906 - protein, 29 aa, Artificial Sequence
  Description of Artificial Sequence: Synthetic peptide
DETTIRGTNPVATEQYGSVSANNFQGGNT

SEQ ID NO: 47907 - protein, 30 aa, Artificial Sequence
  Description of Artificial Sequence: Synthetic polypeptide
DESEIRTTNPVATEPYGSVAATANEQRPNN

SEQ ID NO: 47908 - protein, 28 aa, Artificial Sequence
  Description of Artificial Sequence: Synthetic peptide
AENEIFCTNPVATEQYGEASENLQRGGR

SEQ ID NO: 47909 - protein, 28 aa, Artificial Sequence
  Description of Artificial Sequence: Synthetic peptide
AENEIGCTNPVATEQYGEASANLQRGGR

SEQ ID NO: 47910 - protein, 32 aa, Artificial Sequence
  Description of Artificial Sequence: Synthetic polypeptide
AEEEIRTTNPVATEQYGSVSTVVNQQVGEINT

SEQ ID NO: 47911 - protein, 28 aa, Artificial Sequence
  Description of Artificial Sequence: Synthetic peptide
AENEIGCTNPVATEQYGEASENLQRGGR

SEQ ID NO: 47912 - protein, 32 aa, Artificial Sequence
  Description of Artificial Sequence: Synthetic polypeptide
DESEIRTTNPVATEQWGSVSCINLPQDREGNG

SEQ ID NO: 47913 - protein, 32 aa, Artificial Sequence
  Description of Artificial Sequence: Synthetic polypeptide
DESEIRTTNPVATEQWGSVSCINLPQDRGENG

SEQ ID NO: 47914 - protein, 28 aa, Artificial Sequence
  Description of Artificial Sequence: Synthetic peptide
DETSIRTTNPTAYEQWGSVSFNWQDGNR

SEQ ID NO: 47915 - protein, 32 aa, Artificial Sequence
  Description of Artificial Sequence: Synthetic polypeptide
DESEIRTTNPVATEQWGSVSCNEPQDREGENR

SEQ ID NO: 47916 - protein, 28 aa, Artificial Sequence
  Description of Artificial Sequence: Synthetic peptide
QENEIASTNPVATEQYGEMSENLQRGGR

SEQ ID NO: 47917 - protein, 29 aa, Artificial Sequence
  Description of Artificial Sequence: Synthetic peptide
QENEIATTNPVATEQYGSVSTCLQHEGEL

SEQ ID NO: 47918 - protein, 29 aa, Artificial Sequence
  Description of Artificial Sequence: Synthetic peptide
DETTIRTTNPCATEQWGSVSNVNLQSGNI

SEQ ID NO: 47919 - protein, 29 aa, Artificial Sequence
  Description of Artificial Sequence: Synthetic peptide
DETTIRTTNPVATEQYGCVELNPDQRGNG

SEQ ID NO: 47920 - protein, 33 aa, Artificial Sequence
  Description of Artificial Sequence: Synthetic polypeptide
AEEEIRTTNPVATEQYGSVSVTNLTQNNGTNGN

SEQ ID NO: 47921 - protein, 28 aa, Artificial Sequence
  Description of Artificial Sequence: Synthetic peptide
QENEIATTNPVATECYGDVSENLQREER

SEQ ID NO: 47922 - protein, 28 aa, Artificial Sequence
  Description of Artificial Sequence: Synthetic peptide
DEVEIATTNPVATAQWGCVSTADQRGNQ

SEQ ID NO: 47923 - protein, 31 aa, Artificial Sequence
  Description of Artificial Sequence: Synthetic polypeptide
DESEIRTTNPVATECYGSVSCNEPQDRGENQ

SEQ ID NO: 47924 - protein, 30 aa, Artificial Sequence
  Description of Artificial Sequence: Synthetic polypeptide
DESEIRTTNPVATECYGSVSSITEQREGNG

SEQ ID NO: 47925 - protein, 30 aa, Artificial Sequence
  Description of Artificial Sequence: Synthetic polypeptide
DESEIRTTNPVATECYGSVSSITLQHEGNG

SEQ ID NO: 47926 - protein, 28 aa, Artificial Sequence
  Description of Artificial Sequence: Synthetic peptide
AENEICCTNPVATEQYGEASENLQRGGR

SEQ ID NO: 47927 - protein, 32 aa, Artificial Sequence
  Description of Artificial Sequence: Synthetic polypeptide
DESEIRTTNPVATEHYGSVPNQNLSQRGGNNR

SEQ ID NO: 47928 - protein, 33 aa, Artificial Sequence
  Description of Artificial Sequence: Synthetic polypeptide
AEEEIRTTNPVATEQYGSVSVTNLQSNEEGTNN

SEQ ID NO: 47929 - protein, 32 aa, Artificial Sequence
  Description of Artificial Sequence: Synthetic polypeptide
AEEEIRTTNPVATEQYGSVSVTNLQQVTGQGE

SEQ ID NO: 47930 - protein, 33 aa, Artificial Sequence
  Description of Artificial Sequence: Synthetic polypeptide
AEEEIRTTNPVATEQYGSVSVTNLQQQQSGTNQ

SEQ ID NO: 47931 - protein, 28 aa, Artificial Sequence
  Description of Artificial Sequence: Synthetic peptide
AENEICSTNPVATEQYGEASNNLQRGER

SEQ ID NO: 47932 - protein, 33 aa, Artificial Sequence
  Description of Artificial Sequence: Synthetic polypeptide
AEEEIRTTNPVATEQYGSVSVTNLQQQQQGNNE

SEQ ID NO: 47933 - protein, 29 aa, Artificial Sequence
  Description of Artificial Sequence: Synthetic peptide
DETTIRTTNPVATEQYGCVETNEDDRGNG

SEQ ID NO: 47934 - protein, 30 aa, Artificial Sequence
  Description of Artificial Sequence: Synthetic polypeptide
DESEIRTTNPVATEGYGVVSSNLPQRGEDI

SEQ ID NO: 47935 - protein, 29 aa, Artificial Sequence
  Description of Artificial Sequence: Synthetic peptide
DESEIRTTNPVATEGYGVVSSTLPQRGDI

SEQ ID NO: 47936 - protein, 29 aa, Artificial Sequence
  Description of Artificial Sequence: Synthetic peptide
DESEIRTTNPVATECYGSVSWNEQEDGTA

SEQ ID NO: 47937 - protein, 28 aa, Artificial Sequence
  Description of Artificial Sequence: Synthetic peptide
QENEIAPTNPVATEQYGIVSCNLQSGTR

SEQ ID NO: 47938 - protein, 31 aa, Artificial Sequence
  Description of Artificial Sequence: Synthetic polypeptide
DESEIRTTNPVATEAYGSVSNNALSQRGGTQ

SEQ ID NO: 47939 - protein, 31 aa, Artificial Sequence
  Description of Artificial Sequence: Synthetic polypeptide
AEEEIRTTNPVATEQYGSVSVTNNGTVGNNI

SEQ ID NO: 47940 - protein, 31 aa, Artificial Sequence
  Description of Artificial Sequence: Synthetic polypeptide
DESEIRCTNPVATEQYGSVSEINLPMRGENG

SEQ ID NO: 47941 - protein, 31 aa, Artificial Sequence
  Description of Artificial Sequence: Synthetic polypeptide
DESEIRCTNPVATEVYGQVVSTNLSQPAGNR

SEQ ID NO: 47942 - protein, 33 aa, Artificial Sequence
  Description of Artificial Sequence: Synthetic polypeptide
AEEEIRTTNPVATEQYGSVSTVVNLQQIGNQNT

SEQ ID NO: 47943 - protein, 31 aa, Artificial Sequence
  Description of Artificial Sequence: Synthetic polypeptide
DESEIRPTNPVATEQWGSVSCNEQDREGENR

SEQ ID NO: 47944 - protein, 29 aa, Artificial Sequence
  Description of Artificial Sequence: Synthetic peptide
DESEIRSTNPIATEQYGSVAAETIQRGNR

SEQ ID NO: 47945 - protein, 33 aa, Artificial Sequence
  Description of Artificial Sequence: Synthetic polypeptide
AEEEIRTTNPVATEQYGSVSVTNNLGQNQGTNP

SEQ ID NO: 47946 - protein, 30 aa, Artificial Sequence
  Description of Artificial Sequence: Synthetic polypeptide
DESEIRSTNPIATEQYGSVAANTIQRVGNR

SEQ ID NO: 47947 - protein, 33 aa, Artificial Sequence
  Description of Artificial Sequence: Synthetic polypeptide
AEEEIRTTNPVATEQYGSVSVTNNLGQNGNNPT

SEQ ID NO: 47948 - protein, 28 aa, Artificial Sequence
  Description of Artificial Sequence: Synthetic peptide
QENEIRTTNPVATECYGSVSENLMREEL

SEQ ID NO: 47949 - protein, 29 aa, Artificial Sequence
  Description of Artificial Sequence: Synthetic peptide
QENEIRTTNPVATECYGSVSEINLQHGEL

SEQ ID NO: 47950 - protein, 30 aa, Artificial Sequence
  Description of Artificial Sequence: Synthetic polypeptide
DESEIRSTNPVATEGYGSVSCTLQDRGENG

SEQ ID NO: 47951 - protein, 32 aa, Artificial Sequence
  Description of Artificial Sequence: Synthetic polypeptide
CEEAIRTTNPVATEQYGCVCSTNLQRFGSNAN

SEQ ID NO: 47952 - protein, 31 aa, Artificial Sequence
  Description of Artificial Sequence: Synthetic polypeptide
DESEIRSTNPVATEQWGSVSCINLPQDRGNG

SEQ ID NO: 47953 - protein, 32 aa, Artificial Sequence
  Description of Artificial Sequence: Synthetic polypeptide
QEEEVRTTNPVATEQYGVVSTMNLDQRIGNGQ

SEQ ID NO: 47954 - protein, 30 aa, Artificial Sequence
  Description of Artificial Sequence: Synthetic polypeptide
DESEIRSTNPVATEQYGSVCVNQDRGSNSR

SEQ ID NO: 47955 - protein, 29 aa, Artificial Sequence
  Description of Artificial Sequence: Synthetic peptide
DESEIRCTNPVATEQYGNVSNNIMSRGQR

SEQ ID NO: 47956 - protein, 30 aa, Artificial Sequence
  Description of Artificial Sequence: Synthetic polypeptide
DEVEIATTNPVATEHYGSVSTNLQGADDRQ

SEQ ID NO: 47957 - protein, 29 aa, Artificial Sequence
  Description of Artificial Sequence: Synthetic peptide
CEECICTTNPVATEPYGSVSWNEGQRGNS

SEQ ID NO: 47958 - protein, 31 aa, Artificial Sequence
  Description of Artificial Sequence: Synthetic polypeptide
DEVEIATTNPVATEHYGSVSTNLQLGGDNGK

SEQ ID NO: 47959 - protein, 29 aa, Artificial Sequence
  Description of Artificial Sequence: Synthetic peptide
QEQEIATTNPVATEQYGSVSATDLQHGEI

SEQ ID NO: 47960 - protein, 30 aa, Artificial Sequence
  Description of Artificial Sequence: Synthetic polypeptide
DEVEIATTNPVATEIYGEVSTNLQGQDDNR

SEQ ID NO: 47961 - protein, 31 aa, Artificial Sequence
  Description of Artificial Sequence: Synthetic polypeptide
DEVEIATTNPVATEIYGEVSTNLQGGADNDR

SEQ ID NO: 47962 - protein, 30 aa, Artificial Sequence
  Description of Artificial Sequence: Synthetic polypeptide
DESEIKTTNPVATEQYGYVDGVTNLQRTLR

SEQ ID NO: 47963 - protein, 32 aa, Artificial Sequence
  Description of Artificial Sequence: Synthetic polypeptide
DESEIRATNPSATEQYGSVCSNTNTQRGSNRV

SEQ ID NO: 47964 - protein, 33 aa, Artificial Sequence
  Description of Artificial Sequence: Synthetic polypeptide
QEEEVRTTNPVATEQYGSVSTENLDQRIGNDGQ

SEQ ID NO: 47965 - protein, 29 aa, Artificial Sequence
  Description of Artificial Sequence: Synthetic peptide
DESEIRCTNPIATEQYGNVSENIMSRGNR

SEQ ID NO: 47966 - protein, 28 aa, Artificial Sequence
  Description of Artificial Sequence: Synthetic peptide
QEEGICTTNPSATEQYGSVSMVIQRGNS

SEQ ID NO: 47967 - protein, 29 aa, Artificial Sequence
  Description of Artificial Sequence: Synthetic peptide
DESEIRCTNPIATEQYGSVSCNEPMRGNG

SEQ ID NO: 47968 - protein, 29 aa, Artificial Sequence
  Description of Artificial Sequence: Synthetic peptide
DESEIRCTNPIATEQYGSVSENEPMRGNG

SEQ ID NO: 47969 - protein, 30 aa, Artificial Sequence
  Description of Artificial Sequence: Synthetic polypeptide
CEECICTTNPVATEQYGSVSWNEGQRAGNQ

SEQ ID NO: 47970 - protein, 33 aa, Artificial Sequence
  Description of Artificial Sequence: Synthetic polypeptide
AEEEIRTTNPVATEQYGSVSVTNNLLQNGNEQV

SEQ ID NO: 47971 - protein, 31 aa, Artificial Sequence
  Description of Artificial Sequence: Synthetic polypeptide
DESEIRCTNPVATECYGSVSCINEQDREGNR

SEQ ID NO: 47972 - protein, 33 aa, Artificial Sequence
  Description of Artificial Sequence: Synthetic polypeptide
AEEEIRTTNPVATEQYGSVSVTNNLGQQNGNQT

SEQ ID NO: 47973 - protein, 30 aa, Artificial Sequence
  Description of Artificial Sequence: Synthetic polypeptide
DESEIRCTNPVATEQWGEASCNLQREGENR

SEQ ID NO: 47974 - protein, 30 aa, Artificial Sequence
  Description of Artificial Sequence: Synthetic polypeptide
DEVEIATTNPVATEHYGSVSTNQQDGQNNM

SEQ ID NO: 47975 - protein, 30 aa, Artificial Sequence
  Description of Artificial Sequence: Synthetic polypeptide
CEECICTTNPVATEQYGSVSWNEMQREGNS

SEQ ID NO: 47976 - protein, 33 aa, Artificial Sequence
  Description of Artificial Sequence: Synthetic polypeptide
AEEEIRTTNPVATEQYGSVSVTNNLEQNGNNII

SEQ ID NO: 47977 - protein, 33 aa, Artificial Sequence
  Description of Artificial Sequence: Synthetic polypeptide
AEEEIRTTNPVATEQYGSVSVTNNLEQIGNNII

SEQ ID NO: 47978 - protein, 29 aa, Artificial Sequence
  Description of Artificial Sequence: Synthetic peptide
DESEIRSTNPVCTEQWGVVSDNLPQRGNG

SEQ ID NO: 47979 - protein, 30 aa, Artificial Sequence
  Description of Artificial Sequence: Synthetic polypeptide
DESEIRTTNPVATDHYGSVPSTNLSQSVNM

SEQ ID NO: 47980 - protein, 28 aa, Artificial Sequence
  Description of Artificial Sequence: Synthetic peptide
QENEIATTNPVCTEQYGVVSDNLQSGNQ

SEQ ID NO: 47981 - protein, 31 aa, Artificial Sequence
  Description of Artificial Sequence: Synthetic polypeptide
DESEIRTTNPVATDQYGSVNTGLQREGGNDT

SEQ ID NO: 47982 - protein, 31 aa, Artificial Sequence
  Description of Artificial Sequence: Synthetic polypeptide
DEVEIATTNPVATECYGSVSTNLQEGGMNGA

SEQ ID NO: 47983 - protein, 28 aa, Artificial Sequence
  Description of Artificial Sequence: Synthetic peptide
QENEIATTNPVATEQYGVVSDNLQSENQ

SEQ ID NO: 47984 - protein, 28 aa, Artificial Sequence
  Description of Artificial Sequence: Synthetic peptide
QEEGICTTNPVAYEQYGSVSANSQDGNS

SEQ ID NO: 47985 - protein, 29 aa, Artificial Sequence
  Description of Artificial Sequence: Synthetic peptide
DESEIRTTNPVATDQYGVVNDTNGERGNP

SEQ ID NO: 47986 - protein, 31 aa, Artificial Sequence
  Description of Artificial Sequence: Synthetic polypeptide
DESEIRTTNPVATDHYGSVPSTNLSQRVNNQ

SEQ ID NO: 47987 - protein, 31 aa, Artificial Sequence
  Description of Artificial Sequence: Synthetic polypeptide
AEEEIRTTNPVATEQYGSVSVTNNGTVGNVE

SEQ ID NO: 47988 - protein, 29 aa, Artificial Sequence
  Description of Artificial Sequence: Synthetic peptide
DESEIRTTNPVATDSYGSVSTGLQGTNEM

SEQ ID NO: 47989 - protein, 31 aa, Artificial Sequence
  Description of Artificial Sequence: Synthetic polypeptide
DESEIRTTNPVATDSYGSVSTNGLQTGTNGM

SEQ ID NO: 47990 - protein, 30 aa, Artificial Sequence
  Description of Artificial Sequence: Synthetic polypeptide
DESEIRTTNPVATDSYGSVSTNLQGTGEMQ

SEQ ID NO: 47991 - protein, 30 aa, Artificial Sequence
  Description of Artificial Sequence: Synthetic polypeptide
DESEIRTTNPVATDSYGSVSTNLQGTNGGG

SEQ ID NO: 47992 - protein, 31 aa, Artificial Sequence
  Description of Artificial Sequence: Synthetic polypeptide
DESEIRTTNPVATDSYGSVSTNLQMTGNGDT

SEQ ID NO: 47993 - protein, 30 aa, Artificial Sequence
  Description of Artificial Sequence: Synthetic polypeptide
DESEIRTTNPVATDSYGSVSTNLQRDTDEM

SEQ ID NO: 47994 - protein, 33 aa, Artificial Sequence
  Description of Artificial Sequence: Synthetic polypeptide
DESEIRTTNPVATEAYGSTVSCTGNLSHNRGNR

SEQ ID NO: 47995 - protein, 29 aa, Artificial Sequence
  Description of Artificial Sequence: Synthetic peptide
AENEICATNPVATEQYGNVATENLQRGER

SEQ ID NO: 47996 - protein, 34 aa, Artificial Sequence
  Description of Artificial Sequence: Synthetic polypeptide
DESEIRTTNPVATEAYGSVSCTNMLSQTRGGNRM

SEQ ID NO: 47997 - protein, 32 aa, Artificial Sequence
  Description of Artificial Sequence: Synthetic polypeptide
DEVEIATTNPVATECYGSVSTNLQGDTGDNER

SEQ ID NO: 47998 - protein, 28 aa, Artificial Sequence
  Description of Artificial Sequence: Synthetic peptide
QENEIATTNPVSTEQYGIVSCNLQSGTR

SEQ ID NO: 47999 - protein, 28 aa, Artificial Sequence
  Description of Artificial Sequence: Synthetic peptide
QENEIRTTNPIATECYGSVSENLMRENL

SEQ ID NO: 48000 - protein, 28 aa, Artificial Sequence
  Description of Artificial Sequence: Synthetic peptide
AENEIAVTNPVATEQYGEASENLQRGGR

SEQ ID NO: 48001 - protein, 28 aa, Artificial Sequence
  Description of Artificial Sequence: Synthetic peptide
AENEIAVTNPVATEQYGECSENLQRGGR

SEQ ID NO: 48002 - protein, 33 aa, Artificial Sequence
  Description of Artificial Sequence: Synthetic polypeptide
DESEIRTTNPLATEQYGSVACTNLSQRPGGNNR

SEQ ID NO: 48003 - protein, 30 aa, Artificial Sequence
  Description of Artificial Sequence: Synthetic polypeptide
DESEIRTTNPVATAHWGSVSTNLDQHGTNM

SEQ ID NO: 48004 - protein, 30 aa, Artificial Sequence
  Description of Artificial Sequence: Synthetic polypeptide
DESEIRTTNPVATAHWGSVSTNLQDGTNDM

SEQ ID NO: 48005 - protein, 30 aa, Artificial Sequence
  Description of Artificial Sequence: Synthetic polypeptide
DESEIRTTNPVATAHWGSVSTNLQGGTGNM

SEQ ID NO: 48006 - protein, 32 aa, Artificial Sequence
  Description of Artificial Sequence: Synthetic polypeptide
DEVEIATTNPVATECYGSVSTNLQGNDAGNNR

SEQ ID NO: 48007 - protein, 30 aa, Artificial Sequence
  Description of Artificial Sequence: Synthetic polypeptide
DESEIRTTNPVATAHWGSVSTNLQGGTNGM

SEQ ID NO: 48008 - protein, 28 aa, Artificial Sequence
  Description of Artificial Sequence: Synthetic peptide
QENEIRPTNPCATEQYGDVSCNLQSGDR

SEQ ID NO: 48009 - protein, 29 aa, Artificial Sequence
  Description of Artificial Sequence: Synthetic peptide
DESEIRTTNPVATCHYGSVCSTELQYTNA

SEQ ID NO: 48010 - protein, 29 aa, Artificial Sequence
  Description of Artificial Sequence: Synthetic peptide
QEEGICTTNPVAYEQYGSVSANDQRGNES

SEQ ID NO: 48011 - protein, 31 aa, Artificial Sequence
  Description of Artificial Sequence: Synthetic polypeptide
DESEIRTTNPVATCHYGSVSNTNLQRTSNQS

SEQ ID NO: 48012 - protein, 28 aa, Artificial Sequence
  Description of Artificial Sequence: Synthetic peptide
DESEIRTTNPVATCHYGSVSTNHQNTQQ

SEQ ID NO: 48013 - protein, 30 aa, Artificial Sequence
  Description of Artificial Sequence: Synthetic polypeptide
DESEIRTTNPVATCHYGSVSTNLQFSTSNQ

SEQ ID NO: 48014 - protein, 30 aa, Artificial Sequence
  Description of Artificial Sequence: Synthetic polypeptide
DESEIRTTNPVATCHYGSVSTNLQHFTNQG

SEQ ID NO: 48015 - protein, 29 aa, Artificial Sequence
  Description of Artificial Sequence: Synthetic peptide
QEEGICTTNPVATEQYGSVAMNSQARGNS

SEQ ID NO: 48016 - protein, 33 aa, Artificial Sequence
  Description of Artificial Sequence: Synthetic polypeptide
DENEIRTTNPVAYEQYGSTVSCTGNALSQAGNR

SEQ ID NO: 48017 - protein, 28 aa, Artificial Sequence
  Description of Artificial Sequence: Synthetic peptide
AENEIGCTNPVATEQYGIASENLQRGGR

SEQ ID NO: 48018 - protein, 28 aa, Artificial Sequence
  Description of Artificial Sequence: Synthetic peptide
QENEIAPTNPVASEQYGIVSENLQRGTR

SEQ ID NO: 48019 - protein, 28 aa, Artificial Sequence
  Description of Artificial Sequence: Synthetic peptide
DESEIRTTNPVATKHYGVVSTELQRTDM

SEQ ID NO: 48020 - protein, 30 aa, Artificial Sequence
  Description of Artificial Sequence: Synthetic polypeptide
CAEEIATTNPVATEQYGVVSTNLQDGPNDM

SEQ ID NO: 48021 - protein, 29 aa, Artificial Sequence
  Description of Artificial Sequence: Synthetic peptide
CAEEIATTNPVATEQYGCVATNLQDGPNQ

SEQ ID NO: 48022 - protein, 29 aa, Artificial Sequence
  Description of Artificial Sequence: Synthetic peptide
DESEIRTTNPVATQQWGCVSTNLEGDGNP

SEQ ID NO: 48023 - protein, 30 aa, Artificial Sequence
  Description of Artificial Sequence: Synthetic polypeptide
DESEIRTTNPVATQQWGKVSTNLSERGGNP

SEQ ID NO: 48024 - protein, 29 aa, Artificial Sequence
  Description of Artificial Sequence: Synthetic peptide
DESEIRTTNPVATRHYGSVSTNLDERTGM

SEQ ID NO: 48025 - protein, 30 aa, Artificial Sequence
  Description of Artificial Sequence: Synthetic polypeptide
DESEIRTTNPVATTAYGSVSTNLNQETENM

SEQ ID NO: 48026 - protein, 30 aa, Artificial Sequence
  Description of Artificial Sequence: Synthetic polypeptide
DESEIRTTNPVATTAYGSVSTNLQEATNEM

SEQ ID NO: 48027 - protein, 30 aa, Artificial Sequence
  Description of Artificial Sequence: Synthetic polypeptide
DESEIRTTNPVATTAYGSVSTNLQENTTNM

SEQ ID NO: 48028 - protein, 30 aa, Artificial Sequence
  Description of Artificial Sequence: Synthetic polypeptide
DESEIRTTNPVATTAYGSVSTNLQQNETNM

SEQ ID NO: 48029 - protein, 29 aa, Artificial Sequence
  Description of Artificial Sequence: Synthetic peptide
DESEIRTTNPVATTAYGSVSTNLQQNTEM

SEQ ID NO: 48030 - protein, 29 aa, Artificial Sequence
  Description of Artificial Sequence: Synthetic peptide
AENEIRCTNPVATEQYGEASENLQDRGGR

SEQ ID NO: 48031 - protein, 29 aa, Artificial Sequence
  Description of Artificial Sequence: Synthetic peptide
AENEIRCTNPVATEQYGEASENLQREGGR

SEQ ID NO: 48032 - protein, 28 aa, Artificial Sequence
  Description of Artificial Sequence: Synthetic peptide
ATEEIACTNPVATEQYGEASENLQRGGR

SEQ ID NO: 48033 - protein, 29 aa, Artificial Sequence
  Description of Artificial Sequence: Synthetic peptide
AENEIRCTNPVATEQYGEASENLQRKGPR

SEQ ID NO: 48034 - protein, 31 aa, Artificial Sequence
  Description of Artificial Sequence: Synthetic polypeptide
DESEIRTTNPVATKHYGSVSTLNLTRGTNDM

SEQ ID NO: 48035 - protein, 29 aa, Artificial Sequence
  Description of Artificial Sequence: Synthetic peptide
AENEIRCTNPVATEQYGEASENLPQRGNG

SEQ ID NO: 48036 - protein, 29 aa, Artificial Sequence
  Description of Artificial Sequence: Synthetic peptide
DESEIRTTNPVATKHYGSVSENLTRTENM

SEQ ID NO: 48037 - protein, 28 aa, Artificial Sequence
  Description of Artificial Sequence: Synthetic peptide
DESEIRTTNPVATKHYGSVATNQERTNN

SEQ ID NO: 48038 - protein, 31 aa, Artificial Sequence
  Description of Artificial Sequence: Synthetic polypeptide
DESEIRTTNPVATEQYGVVSTDLQGGEDNGD

SEQ ID NO: 48039 - protein, 30 aa, Artificial Sequence
  Description of Artificial Sequence: Synthetic polypeptide
DESEIRTTNPVATEQYGVVSTDLQMEANID

SEQ ID NO: 48040 - protein, 31 aa, Artificial Sequence
  Description of Artificial Sequence: Synthetic polypeptide
DESEIRTTNPVATEQYGVVSTDLQRDEENGD

SEQ ID NO: 48041 - protein, 31 aa, Artificial Sequence
  Description of Artificial Sequence: Synthetic polypeptide
DESEIRTTNPVATEQYGVVSTDLQRIQNGDD

SEQ ID NO: 48042 - protein, 28 aa, Artificial Sequence
  Description of Artificial Sequence: Synthetic peptide
DETSIRTTNPLATEQFGSVSFNLQGGEG

SEQ ID NO: 48043 - protein, 32 aa, Artificial Sequence
  Description of Artificial Sequence: Synthetic polypeptide
DESEIRTTNPVATEQYGVVSTGDLQRGAGNED

SEQ ID NO: 48044 - protein, 29 aa, Artificial Sequence
  Description of Artificial Sequence: Synthetic peptide
DETSIRTTNPLATEQFGSVSFNEQGSGNR

SEQ ID NO: 48045 - protein, 29 aa, Artificial Sequence
  Description of Artificial Sequence: Synthetic peptide
QEMEIVTTNPVATEQYGTVSTNLEFEGND

SEQ ID NO: 48046 - protein, 30 aa, Artificial Sequence
  Description of Artificial Sequence: Synthetic polypeptide
DESEIRTTNPVATEQYGVVVTDLQREGEDQ

SEQ ID NO: 48047 - protein, 28 aa, Artificial Sequence
  Description of Artificial Sequence: Synthetic peptide
QENEIACTNPVATEQYGDASENLQRGGR

SEQ ID NO: 48048 - protein, 28 aa, Artificial Sequence
  Description of Artificial Sequence: Synthetic peptide
AENEIRCTNPVATEQYGDASENLQRGDA

SEQ ID NO: 48049 - protein, 28 aa, Artificial Sequence
  Description of Artificial Sequence: Synthetic peptide
QENEIACTNPVATECYGSVSENLMHGNR

SEQ ID NO: 48050 - protein, 29 aa, Artificial Sequence
  Description of Artificial Sequence: Synthetic peptide
DETSIRTTNPLATEQFGSVSCNQQNGGNR

SEQ ID NO: 48051 - protein, 28 aa, Artificial Sequence
  Description of Artificial Sequence: Synthetic peptide
DETSIRTTNPLATEQFGSVAFNDQDGNR

SEQ ID NO: 48052 - protein, 31 aa, Artificial Sequence
  Description of Artificial Sequence: Synthetic polypeptide
DESEIRTTNPVATEVYGSVSQGNAPQDNGNR

SEQ ID NO: 48053 - protein, 31 aa, Artificial Sequence
  Description of Artificial Sequence: Synthetic polypeptide
QEEGIRTTNPVATEQYGSVSTNGLENGLNEF

SEQ ID NO: 48054 - protein, 31 aa, Artificial Sequence
  Description of Artificial Sequence: Synthetic polypeptide
DESEIRTTNPVATEQYGVVVTDLQREGNEDD

SEQ ID NO: 48055 - protein, 31 aa, Artificial Sequence
  Description of Artificial Sequence: Synthetic polypeptide
DESEIRTTNPVAYDHYGSVSTGNLQRVGNNM

SEQ ID NO: 48056 - protein, 30 aa, Artificial Sequence
  Description of Artificial Sequence: Synthetic polypeptide
DESEIRTTNPVAYDHYGSVSTNLQRTPNDM

SEQ ID NO: 48057 - protein, 31 aa, Artificial Sequence
  Description of Artificial Sequence: Synthetic polypeptide
DESEIRTTNPVAYDHYGSVSTNLSQRAVGNM

SEQ ID NO: 48058 - protein, 28 aa, Artificial Sequence
  Description of Artificial Sequence: Synthetic peptide
AEYEIACTNPVATEQYGETSENLQRGGR

SEQ ID NO: 48059 - protein, 32 aa, Artificial Sequence
  Description of Artificial Sequence: Synthetic polypeptide
DESEIRTTNPVAYEQYGKLVSCTNLAQTGGNR

SEQ ID NO: 48060 - protein, 28 aa, Artificial Sequence
  Description of Artificial Sequence: Synthetic peptide
AEYEIACTNPVATEQYGEASENLQRGLR

SEQ ID NO: 48061 - protein, 28 aa, Artificial Sequence
  Description of Artificial Sequence: Synthetic peptide
AEYEIACTNPVATEQYGEASENLQRGGR

SEQ ID NO: 48062 - protein, 32 aa, Artificial Sequence
  Description of Artificial Sequence: Synthetic polypeptide
DESEIRTTNPVAYEQYGKVSCTLNALSQAGNR

SEQ ID NO: 48063 - protein, 28 aa, Artificial Sequence
  Description of Artificial Sequence: Synthetic peptide
AEWEIACTNPVATEQYGEASENLQRGGR

SEQ ID NO: 48064 - protein, 30 aa, Artificial Sequence
  Description of Artificial Sequence: Synthetic polypeptide
DETSIRTTNPCATEQWGSVSFNLQDSGNNR

SEQ ID NO: 48065 - protein, 29 aa, Artificial Sequence
  Description of Artificial Sequence: Synthetic peptide
DETSIRTTNPCATEQWGSVSNENLQSGNE

SEQ ID NO: 48066 - protein, 30 aa, Artificial Sequence
  Description of Artificial Sequence: Synthetic polypeptide
DETSIRTTNPCATEQFGSVSIFNLAQSGNR

SEQ ID NO: 48067 - protein, 32 aa, Artificial Sequence
  Description of Artificial Sequence: Synthetic polypeptide
AENEIRCTNPVATEQYGSASTNLPQMRGMNPR

SEQ ID NO: 48068 - protein, 31 aa, Artificial Sequence
  Description of Artificial Sequence: Synthetic polypeptide
DESEIRTTNPVAYEQYGSISCTNHQREGGSR

SEQ ID NO: 48069 - protein, 31 aa, Artificial Sequence
  Description of Artificial Sequence: Synthetic polypeptide
DESEIRTTNPVAYEQYGSISTNSHSQREGSR

SEQ ID NO: 48070 - protein, 32 aa, Artificial Sequence
  Description of Artificial Sequence: Synthetic polypeptide
DESEIRTTNPVAYEQYGSTVSTNLSQMSGARF

SEQ ID NO: 48071 - protein, 33 aa, Artificial Sequence
  Description of Artificial Sequence: Synthetic polypeptide
DESEIRTTNPVAYEQYGSTVSTVNSLSQRGGNS

SEQ ID NO: 48072 - protein, 32 aa, Artificial Sequence
  Description of Artificial Sequence: Synthetic polypeptide
DESEIRTTNPVAYEQYGSVPSQNLSTRTNGNR

SEQ ID NO: 48073 - protein, 28 aa, Artificial Sequence
  Description of Artificial Sequence: Synthetic peptide
AEVEIACTNPVATEQYGEASENLQRGGR

SEQ ID NO: 48074 - protein, 28 aa, Artificial Sequence
  Description of Artificial Sequence: Synthetic peptide
AEVEICCTNPVATEQYGEASENLQRGER

SEQ ID NO: 48075 - protein, 32 aa, Artificial Sequence
  Description of Artificial Sequence: Synthetic polypeptide
DESEIRTTNPVATEQYGVVSCNLPQDREGENQ

SEQ ID NO: 48076 - protein, 29 aa, Artificial Sequence
  Description of Artificial Sequence: Synthetic peptide
AENEIRCTNPVATEQYGSASENEQDRGGR

SEQ ID NO: 48077 - protein, 29 aa, Artificial Sequence
  Description of Artificial Sequence: Synthetic peptide
DETSIRTTNPCATEQWGSVSNNLQSGNIT

SEQ ID NO: 48078 - protein, 29 aa, Artificial Sequence
  Description of Artificial Sequence: Synthetic peptide
AENEIRCTNPVATEQYGEASENLQRNGGR

SEQ ID NO: 48079 - protein, 30 aa, Artificial Sequence
  Description of Artificial Sequence: Synthetic polypeptide
DESEIRTTNPVAYDQYGKVSTNLSERGGNP

SEQ ID NO: 48080 - protein, 30 aa, Artificial Sequence
  Description of Artificial Sequence: Synthetic polypeptide
DESEIRTTNPVAYDQYGSVNTGALQRGGND

SEQ ID NO: 48081 - protein, 28 aa, Artificial Sequence
  Description of Artificial Sequence: Synthetic peptide
AENEIRCTNPVATEQYGEISMDLQRGNH

SEQ ID NO: 48082 - protein, 29 aa, Artificial Sequence
  Description of Artificial Sequence: Synthetic peptide
QEMEIATTNPVATEQYGTVSTNLEFEGND

SEQ ID NO: 48083 - protein, 32 aa, Artificial Sequence
  Description of Artificial Sequence: Synthetic polypeptide
DESEIRTTNPVAYEPYGSVSTLNLSQAPGGNR

SEQ ID NO: 48084 - protein, 30 aa, Artificial Sequence
  Description of Artificial Sequence: Synthetic polypeptide
DESEIRTTNPVAYEQWGEVSTNDSQRGGNT

SEQ ID NO: 48085 - protein, 30 aa, Artificial Sequence
  Description of Artificial Sequence: Synthetic polypeptide
QEGEIRTTNPCATEQYGSVSCNLNMRGNPV

SEQ ID NO: 48086 - protein, 31 aa, Artificial Sequence
  Description of Artificial Sequence: Synthetic polypeptide
DESEIRTTNPVAYEQWGKVSCTNLTQRGGNS

SEQ ID NO: 48087 - protein, 29 aa, Artificial Sequence
  Description of Artificial Sequence: Synthetic peptide
DETSIRTTNPCATQQFGSVSFNLQSGDNR

SEQ ID NO: 48088 - protein, 28 aa, Artificial Sequence
  Description of Artificial Sequence: Synthetic peptide
DETSIRTTNPCATEQWGVVSNNLQSGNG

SEQ ID NO: 48089 - protein, 33 aa, Artificial Sequence
  Description of Artificial Sequence: Synthetic polypeptide
AEEEIRTTNPVATEQYGSVSVTNLQQNDEGNGG

SEQ ID NO: 48090 - protein, 31 aa, Artificial Sequence
  Description of Artificial Sequence: Synthetic polypeptide
DESEIRTTNPVAYEQWGSVSTNLQGGGNNNS

SEQ ID NO: 48091 - protein, 29 aa, Artificial Sequence
  Description of Artificial Sequence: Synthetic peptide
DETSIRTTNPCATEQWGSVSNNLQSGNTN

SEQ ID NO: 48092 - protein, 28 aa, Artificial Sequence
  Description of Artificial Sequence: Synthetic peptide
AINEIACTNPVATEQYGSASENLQRGGR

SEQ ID NO: 48093 - protein, 31 aa, Artificial Sequence
  Description of Artificial Sequence: Synthetic polypeptide
DESEIRTTNPVAYEQWGSVSTNLQSGGNGDN

SEQ ID NO: 48094 - protein, 30 aa, Artificial Sequence
  Description of Artificial Sequence: Synthetic polypeptide
DESEIRTTNPVAYEQWGSVSTNGQGDGDDR

SEQ ID NO: 48095 - protein, 32 aa, Artificial Sequence
  Description of Artificial Sequence: Synthetic polypeptide
DESEIRTTNPVATEQWGSVSTNEPQDREGENG

SEQ ID NO: 48096 - protein, 28 aa, Artificial Sequence
  Description of Artificial Sequence: Synthetic peptide
QENEIACTNPVATEQYGDVSENLQREER

SEQ ID NO: 48097 - protein, 32 aa, Artificial Sequence
  Description of Artificial Sequence: Synthetic polypeptide
DESEIRTTNPVATEQYGSVYTAVLQERTGSQR

SEQ ID NO: 48098 - protein, 32 aa, Artificial Sequence
  Description of Artificial Sequence: Synthetic polypeptide
DESEIRTTNPVATEQYGSVACQGNLSQSTGNR

SEQ ID NO: 48099 - protein, 32 aa, Artificial Sequence
  Description of Artificial Sequence: Synthetic polypeptide
DESEIRTTNPVATEQYGSVACTPHSQRTGGNR

SEQ ID NO: 48100 - protein, 28 aa, Artificial Sequence
  Description of Artificial Sequence: Synthetic peptide
QENEIACTNPVATEQYGSVSECLMRGER

SEQ ID NO: 48101 - protein, 28 aa, Artificial Sequence
  Description of Artificial Sequence: Synthetic peptide
QENEIACTNPVATEQYGIVSCNLQSGTR

SEQ ID NO: 48102 - protein, 32 aa, Artificial Sequence
  Description of Artificial Sequence: Synthetic polypeptide
DESEIRTTNPVATEQYGSVCSTNDHQERDMER

SEQ ID NO: 48103 - protein, 28 aa, Artificial Sequence
  Description of Artificial Sequence: Synthetic peptide
QENEIACTNPVATEQYGEVSENLQREGR

SEQ ID NO: 48104 - protein, 29 aa, Artificial Sequence
  Description of Artificial Sequence: Synthetic peptide
DESEIRTTNPVATEQYGSVETNVHREETQ

SEQ ID NO: 48105 - protein, 31 aa, Artificial Sequence
  Description of Artificial Sequence: Synthetic polypeptide
DESEIRTTNPVATEQYGSVISTYLIQNRVDV

SEQ ID NO: 48106 - protein, 31 aa, Artificial Sequence
  Description of Artificial Sequence: Synthetic polypeptide
DESEIRTTNPVATEQYGSVLSTTDTRGGNNY

SEQ ID NO: 48107 - protein, 28 aa, Artificial Sequence
  Description of Artificial Sequence: Synthetic peptide
QENEIACTNPVATEQYGEVSCNLQSGTR

SEQ ID NO: 48108 - protein, 28 aa, Artificial Sequence
  Description of Artificial Sequence: Synthetic peptide
QENEIACTNPVATEQYGEMSENLQRGGR

SEQ ID NO: 48109 - protein, 29 aa, Artificial Sequence
  Description of Artificial Sequence: Synthetic peptide
DESEIRTTNPVATEQYGSVNQNLFENMND

SEQ ID NO: 48110 - protein, 33 aa, Artificial Sequence
  Description of Artificial Sequence: Synthetic polypeptide
DESEIRTTNPVATEQYGSVPSTGGLSQRGGNNA

SEQ ID NO: 48111 - protein, 29 aa, Artificial Sequence
  Description of Artificial Sequence: Synthetic peptide
DETSIRTTNPLATEQWGSVSFNLQSGGNE

SEQ ID NO: 48112 - protein, 28 aa, Artificial Sequence
  Description of Artificial Sequence: Synthetic peptide
AENEIMCTNPVATEQYGEASENLQRGGR

SEQ ID NO: 48113 - protein, 33 aa, Artificial Sequence
  Description of Artificial Sequence: Synthetic polypeptide
DESEIRTTNPVATEQYGSTVSYTILQRGTNTGD

SEQ ID NO: 48114 - protein, 28 aa, Artificial Sequence
  Description of Artificial Sequence: Synthetic peptide
AENEIKCTNPVATEQYGEASENLQRGGR

SEQ ID NO: 48115 - protein, 28 aa, Artificial Sequence
  Description of Artificial Sequence: Synthetic peptide
QENEIACTNPVATEQYGVASENLQRGDR

SEQ ID NO: 48116 - protein, 34 aa, Artificial Sequence
  Description of Artificial Sequence: Synthetic polypeptide
DESEIRTTNPVATEQYGSIVPSCTGLSQRGTNNR

SEQ ID NO: 48117 - protein, 30 aa, Artificial Sequence
  Description of Artificial Sequence: Synthetic polypeptide
DESEIRTTNPVATEQYGCVSNTELQNGSEQ

SEQ ID NO: 48118 - protein, 33 aa, Artificial Sequence
  Description of Artificial Sequence: Synthetic polypeptide
AEEEIRTTNPVATEQYGSVSVTNLQQQQGNNQE

SEQ ID NO: 48119 - protein, 28 aa, Artificial Sequence
  Description of Artificial Sequence: Synthetic peptide
AENEIHCTNPVATEQYGEASENLQRGGR

SEQ ID NO: 48120 - protein, 31 aa, Artificial Sequence
  Description of Artificial Sequence: Synthetic polypeptide
DESEIRTTNPVATEQYGCVSTNELQIIGEIT

SEQ ID NO: 48121 - protein, 30 aa, Artificial Sequence
  Description of Artificial Sequence: Synthetic polypeptide
DESEIRTTNPVATEQYGCVSTNHQNNSNQS

SEQ ID NO: 48122 - protein, 28 aa, Artificial Sequence
  Description of Artificial Sequence: Synthetic peptide
AENEIICTNPVATEQYGEASENLQRGGR

SEQ ID NO: 48123 - protein, 28 aa, Artificial Sequence
  Description of Artificial Sequence: Synthetic peptide
QENEIACTNPVATEQYGVMSSNLQRGGR

SEQ ID NO: 48124 - protein, 30 aa, Artificial Sequence
  Description of Artificial Sequence: Synthetic polypeptide
DESEIRTTNPVATEQYGSVSAVLERGDGQD

SEQ ID NO: 48125 - protein, 32 aa, Artificial Sequence
  Description of Artificial Sequence: Synthetic polypeptide
DESEIRTTNPVATEQYGEVSCINEQDREGENR

SEQ ID NO: 48126 - protein, 28 aa, Artificial Sequence
  Description of Artificial Sequence: Synthetic peptide
QENEIACTNPVATEQYGVMSENLQRGGR

SEQ ID NO: 48127 - protein, 31 aa, Artificial Sequence
  Description of Artificial Sequence: Synthetic polypeptide
AEEEIRTTNPVATEQYGSVSTVVQQQGTNNE

SEQ ID NO: 48128 - protein, 28 aa, Artificial Sequence
  Description of Artificial Sequence: Synthetic peptide
QENEIACTNPVATEQYGVASSNLQRGGR

SEQ ID NO: 48129 - protein, 33 aa, Artificial Sequence
  Description of Artificial Sequence: Synthetic polypeptide
DESEIRTTNPVATEQYGKLVSTGNLSQTTGGNR

SEQ ID NO: 48130 - protein, 33 aa, Artificial Sequence
  Description of Artificial Sequence: Synthetic polypeptide
AEEEIRTTNPVATEQYGSVSVTNLQQQDNGNNT

SEQ ID NO: 48131 - protein, 28 aa, Artificial Sequence
  Description of Artificial Sequence: Synthetic peptide
QENEIACTNPVATEQYGVASENLQRGGR

SEQ ID NO: 48132 - protein, 31 aa, Artificial Sequence
  Description of Artificial Sequence: Synthetic polypeptide
DESEIRTTNPVATEQYGSARSDPNDQRGIRD

SEQ ID NO: 48133 - protein, 32 aa, Artificial Sequence
  Description of Artificial Sequence: Synthetic polypeptide
DESEIRTTNPVATEQYGEVTSTNLSQRGGDYS

SEQ ID NO: 48134 - protein, 28 aa, Artificial Sequence
  Description of Artificial Sequence: Synthetic peptide
AENEIMCTNPVATEQYGEASSNLQRGLR

SEQ ID NO: 48135 - protein, 28 aa, Artificial Sequence
  Description of Artificial Sequence: Synthetic peptide
AENEINCTNPVATEQYGEASENLQRGGR

SEQ ID NO: 48136 - protein, 31 aa, Artificial Sequence
  Description of Artificial Sequence: Synthetic polypeptide
DESEIRTTNPVATEQYGSVSCINEPMDRGNG

SEQ ID NO: 48137 - protein, 28 aa, Artificial Sequence
  Description of Artificial Sequence: Synthetic peptide
AENEIRCTNPVATECYGEVSENEQRGGR

SEQ ID NO: 48138 - protein, 28 aa, Artificial Sequence
  Description of Artificial Sequence: Synthetic peptide
QENEIACTNPVATEQYGEASENLQRGDR

SEQ ID NO: 48139 - protein, 31 aa, Artificial Sequence
  Description of Artificial Sequence: Synthetic polypeptide
DESEIRTTNPVATEQYGSVSTIMTEGNNNRN

SEQ ID NO: 48140 - protein, 33 aa, Artificial Sequence
  Description of Artificial Sequence: Synthetic polypeptide
DESEIRTTNPVATEQYGSVSTINGPQMREGENG

SEQ ID NO: 48141 - protein, 31 aa, Artificial Sequence
  Description of Artificial Sequence: Synthetic polypeptide
CEAEIATTNPVAYEQYGSVSTNLQRGPNDQV

SEQ ID NO: 48142 - protein, 28 aa, Artificial Sequence
  Description of Artificial Sequence: Synthetic peptide
CEAEIACTNPVATEQYGEASENLQRGGR

SEQ ID NO: 48143 - protein, 32 aa, Artificial Sequence
  Description of Artificial Sequence: Synthetic polypeptide
DESEIRTTNPVATEQYGSVSTTNGGQGQGDER

SEQ ID NO: 48144 - protein, 28 aa, Artificial Sequence
  Description of Artificial Sequence: Synthetic peptide
AENEIRCTNPVATECYGEASENLQRGGR

SEQ ID NO: 48145 - protein, 30 aa, Artificial Sequence
  Description of Artificial Sequence: Synthetic polypeptide
DETSIRTTNPLATEQFGSVSSNLQSSGSNR

SEQ ID NO: 48146 - protein, 31 aa, Artificial Sequence
  Description of Artificial Sequence: Synthetic polypeptide
DESEIRTTNPVATEQYGSVSWNLEDIGDNQI

SEQ ID NO: 48147 - protein, 30 aa, Artificial Sequence
  Description of Artificial Sequence: Synthetic polypeptide
DETSIRTTNPLATEQFGSVSINMLSQSGNR

SEQ ID NO: 48148 - protein, 31 aa, Artificial Sequence
  Description of Artificial Sequence: Synthetic polypeptide
DESEIRTTNPVATEQYGSVTSLNAQRQINSQ

SEQ ID NO: 48149 - protein, 33 aa, Artificial Sequence
  Description of Artificial Sequence: Synthetic polypeptide
DESEIRTTNPVATEQYGSVVPSTNDSQTPGGNR

SEQ ID NO: 48150 - protein, 32 aa, Artificial Sequence
  Description of Artificial Sequence: Synthetic polypeptide
AEEEIRTTNPVATEQYGSVSVTNLQQNEDENG

SEQ ID NO: 48151 - protein, 33 aa, Artificial Sequence
  Description of Artificial Sequence: Synthetic polypeptide
AEEEIRTTNPVATEQYGSVSVTNLQQNDNGNQT

SEQ ID NO: 48152 - protein, 29 aa, Artificial Sequence
  Description of Artificial Sequence: Synthetic peptide
DETSIRTTNPLATEQFGSVSFNLQIGNNE

SEQ ID NO: 48153 - protein, 31 aa, Artificial Sequence
  Description of Artificial Sequence: Synthetic polypeptide
DESEIRTTNPVATEQYGSVSVSFNLQDDVNI

SEQ ID NO: 48154 - protein, 33 aa, Artificial Sequence
  Description of Artificial Sequence: Synthetic polypeptide
DESEIRTTNPVATEQYGTVCSYTNLSQRTGGNP

SEQ ID NO: 48155 - protein, 28 aa, Artificial Sequence
  Description of Artificial Sequence: Synthetic peptide
AENEIRCTNPIATEQYGSASENLMRGGR

SEQ ID NO: 48156 - protein, 28 aa, Artificial Sequence
  Description of Artificial Sequence: Synthetic peptide
AENEIRCTNPIATEQYGEASENLQRGGR

SEQ ID NO: 48157 - protein, 33 aa, Artificial Sequence
  Description of Artificial Sequence: Synthetic polypeptide
DESEIRTTNPVATEQYGSVSCINEPQDREGENR

SEQ ID NO: 48158 - protein, 28 aa, Artificial Sequence
  Description of Artificial Sequence: Synthetic peptide
QENEIACTNPVATEQYGEASENLQRGGR

SEQ ID NO: 48159 - protein, 32 aa, Artificial Sequence
  Description of Artificial Sequence: Synthetic polypeptide
DESEIRTTNPVATEQYGSVSCINEQDREGENG

SEQ ID NO: 48160 - protein, 28 aa, Artificial Sequence
  Description of Artificial Sequence: Synthetic peptide
AENEIQCTNPVATEQYGEASENLQRGGR

SEQ ID NO: 48161 - protein, 33 aa, Artificial Sequence
  Description of Artificial Sequence: Synthetic polypeptide
DESEIRTTNPVATEQYGSVSCINLPQDREGENQ

SEQ ID NO: 48162 - protein, 31 aa, Artificial Sequence
  Description of Artificial Sequence: Synthetic polypeptide
DESEIRTTNPVATEQYGSVSCNEQDREGEEG

SEQ ID NO: 48163 - protein, 33 aa, Artificial Sequence
  Description of Artificial Sequence: Synthetic polypeptide
DESEIRTTNPVATEQYGSVSCTNGSQRTGTTNT

SEQ ID NO: 48164 - protein, 31 aa, Artificial Sequence
  Description of Artificial Sequence: Synthetic polypeptide
DESEIRTTNPVATEQYGSVSQDNLQTGSQQD

SEQ ID NO: 48165 - protein, 34 aa, Artificial Sequence
  Description of Artificial Sequence: Synthetic polypeptide
DESEIRTTNPVATEQYGSVSCTNLSQTRTGGNEK

SEQ ID NO: 48166 - protein, 31 aa, Artificial Sequence
  Description of Artificial Sequence: Synthetic polypeptide
DESEIRTTNPVATEQYGSVSDTEDLQEGIQE

SEQ ID NO: 48167 - protein, 33 aa, Artificial Sequence
  Description of Artificial Sequence: Synthetic polypeptide
AEEEIRTTNPVATEQYGSVSVTNLQQNGTNSVN

SEQ ID NO: 48168 - protein, 32 aa, Artificial Sequence
  Description of Artificial Sequence: Synthetic polypeptide
DESEIRTTNPVATEQYGSVSNDVNLQHEDNRR

SEQ ID NO: 48169 - protein, 32 aa, Artificial Sequence
  Description of Artificial Sequence: Synthetic polypeptide
DESEIRTTNPVATEQYGSVSNTNHLQNGDIQD

SEQ ID NO: 48170 - protein, 31 aa, Artificial Sequence
  Description of Artificial Sequence: Synthetic polypeptide
DESEIRTTNPVATEQYGSVSPTDGERGSQND

SEQ ID NO: 48171 - protein, 32 aa, Artificial Sequence
  Description of Artificial Sequence: Synthetic polypeptide
DESEIRTTNPVATEQYGSVSPTDNLDRGGAMD

SEQ ID NO: 48172 - protein, 28 aa, Artificial Sequence
  Description of Artificial Sequence: Synthetic peptide
QENEIACTNPVATEQYGEASENLQRGER

SEQ ID NO: 48173 - protein, 34 aa, Artificial Sequence
  Description of Artificial Sequence: Synthetic polypeptide
DESEIRTTNPVATEQYGSVSCTPLSQERGGNNRK

SEQ ID NO: 48174 - protein, 31 aa, Artificial Sequence
  Description of Artificial Sequence: Synthetic polypeptide
SEEEIATTNPVATEQYGSVATNLMREGSNDD

SEQ ID NO: 48175 - protein, 28 aa, Artificial Sequence
  Description of Artificial Sequence: Synthetic peptide
AENEIAPTNPVATEQYGEASENLQRGGR

SEQ ID NO: 48176 - protein, 32 aa, Artificial Sequence
  Description of Artificial Sequence: Synthetic polypeptide
DENEIRTTNPVAYEAYGSVSTCKNMLQRGGNK

SEQ ID NO: 48177 - protein, 30 aa, Artificial Sequence
  Description of Artificial Sequence: Synthetic polypeptide
DEMEIRTTNPVATEQYGSVSTNNNDNEGEQ

SEQ ID NO: 48178 - protein, 32 aa, Artificial Sequence
  Description of Artificial Sequence: Synthetic polypeptide
AEEEIRTTNPVATEQYGSVSTTNQQQSEGNNG

SEQ ID NO: 48179 - protein, 31 aa, Artificial Sequence
  Description of Artificial Sequence: Synthetic polypeptide
AEEEIRTTNPVATEQYGSVSTTNQQQTANDE

SEQ ID NO: 48180 - protein, 32 aa, Artificial Sequence
  Description of Artificial Sequence: Synthetic polypeptide
AEEEIRTTNPVATEQYGSVSTTNQQQTDGNGE

SEQ ID NO: 48181 - protein, 32 aa, Artificial Sequence
  Description of Artificial Sequence: Synthetic polypeptide
AEEEIRTTNPVATEQYGSVSTTNQQQTGNQET

SEQ ID NO: 48182 - protein, 31 aa, Artificial Sequence
  Description of Artificial Sequence: Synthetic polypeptide
AEEEIRTTNPVATEQYGSVSTTNQQQTNNED

SEQ ID NO: 48183 - protein, 31 aa, Artificial Sequence
  Description of Artificial Sequence: Synthetic polypeptide
DEMEIRTTNPVATEQYGSVSTPNEDQEGEIA

SEQ ID NO: 48184 - protein, 30 aa, Artificial Sequence
  Description of Artificial Sequence: Synthetic polypeptide
DEMEIRTTNPVATEQYGSVSTPVEQYTAPR

SEQ ID NO: 48185 - protein, 32 aa, Artificial Sequence
  Description of Artificial Sequence: Synthetic polypeptide
AEEEIRTTNPVATEQYGSVSTTNQQQTQGNEN

SEQ ID NO: 48186 - protein, 31 aa, Artificial Sequence
  Description of Artificial Sequence: Synthetic polypeptide
AEEEIRTTNPVATEQYGSVSTTNQQSIENSE

SEQ ID NO: 48187 - protein, 29 aa, Artificial Sequence
  Description of Artificial Sequence: Synthetic peptide
DAAEIAATNPVATEQYGSVCATNLQNGTR

SEQ ID NO: 48188 - protein, 32 aa, Artificial Sequence
  Description of Artificial Sequence: Synthetic polypeptide
AEEEIRTTNPVATEQYGSVSTTNQQSNEGNQS

SEQ ID NO: 48189 - protein, 32 aa, Artificial Sequence
  Description of Artificial Sequence: Synthetic polypeptide
AEEEIRTTNPVATEQYGSVSTTNTLGVEGNGN

SEQ ID NO: 48190 - protein, 32 aa, Artificial Sequence
  Description of Artificial Sequence: Synthetic polypeptide
AEEEIRTTNPVATEQYGSVSTTNTNNQQGNEF

SEQ ID NO: 48191 - protein, 31 aa, Artificial Sequence
  Description of Artificial Sequence: Synthetic polypeptide
AEEEIRTTNPVATEQYGSVSTTNTNQGQGTI

SEQ ID NO: 48192 - protein, 32 aa, Artificial Sequence
  Description of Artificial Sequence: Synthetic polypeptide
AEEEIRTTNPVATEQYGSVSTTNQQQQQGNDN

SEQ ID NO: 48193 - protein, 30 aa, Artificial Sequence
  Description of Artificial Sequence: Synthetic polypeptide
DEMEIRTTNPVATEQYGSVSTNMNQETEQN

SEQ ID NO: 48194 - protein, 30 aa, Artificial Sequence
  Description of Artificial Sequence: Synthetic polypeptide
SEEEIRCTNPIATEQYGSVSENLMSGGNNR

SEQ ID NO: 48195 - protein, 29 aa, Artificial Sequence
  Description of Artificial Sequence: Synthetic peptide
DAAEIATTNPVATEQWGSVATNLERGNDQ

SEQ ID NO: 48196 - protein, 30 aa, Artificial Sequence
  Description of Artificial Sequence: Synthetic polypeptide
DAAEIATTNPVATEQYGSVATNLERGNVDV

SEQ ID NO: 48197 - protein, 31 aa, Artificial Sequence
  Description of Artificial Sequence: Synthetic polypeptide
SEEEIRCTNPIATEQYGSVSENLSMRGGNRA

SEQ ID NO: 48198 - protein, 31 aa, Artificial Sequence
  Description of Artificial Sequence: Synthetic polypeptide
AEEEIRTTNPVATEQYGSVSTTNQQQEENAG

SEQ ID NO: 48199 - protein, 28 aa, Artificial Sequence
  Description of Artificial Sequence: Synthetic peptide
AENEIACTNPVATEQYGEMSENLQRGGR

SEQ ID NO: 48200 - protein, 32 aa, Artificial Sequence
  Description of Artificial Sequence: Synthetic polypeptide
AEEEIRTTNPVATEQYGSVSTTNQQQEGNLGE

SEQ ID NO: 48201 - protein, 32 aa, Artificial Sequence
  Description of Artificial Sequence: Synthetic polypeptide
AEEEIRTTNPVATEQYGSVSTTNQQQGVVNVD

SEQ ID NO: 48202 - protein, 30 aa, Artificial Sequence
  Description of Artificial Sequence: Synthetic polypeptide
SEEEIRCTNPIATEQYGSVSENLNMPGDNR

SEQ ID NO: 48203 - protein, 33 aa, Artificial Sequence
  Description of Artificial Sequence: Synthetic polypeptide
AEEEIRTTNPVATEQYGSVSTTNTNQLQEGNTN

SEQ ID NO: 48204 - protein, 32 aa, Artificial Sequence
  Description of Artificial Sequence: Synthetic polypeptide
DEMEIRTTNPVATEQYGSVSTLNTLDRGQDIQ

SEQ ID NO: 48205 - protein, 28 aa, Artificial Sequence
  Description of Artificial Sequence: Synthetic peptide
DAAEIATTNPVATEQYGCCSTVLQHGNS

SEQ ID NO: 48206 - protein, 30 aa, Artificial Sequence
  Description of Artificial Sequence: Synthetic polypeptide
DAAEIATTNPVATEQWGSVTSTDLQRGEGR

SEQ ID NO: 48207 - protein, 31 aa, Artificial Sequence
  Description of Artificial Sequence: Synthetic polypeptide
DEMEIRTTNPVATEQYGSVSTNDLETGSVQG

SEQ ID NO: 48208 - protein, 31 aa, Artificial Sequence
  Description of Artificial Sequence: Synthetic polypeptide
AEEEIRTTNPVATEQYGSVSTTNQQQQGEDN

SEQ ID NO: 48209 - protein, 33 aa, Artificial Sequence
  Description of Artificial Sequence: Synthetic polypeptide
DEMEIRTTNPVATEQYGSVSTNDPDQRSGEERN

SEQ ID NO: 48210 - protein, 30 aa, Artificial Sequence
  Description of Artificial Sequence: Synthetic polypeptide
DAAEIATTNPVATEQWGSVSENLQQGNPRE

SEQ ID NO: 48211 - protein, 32 aa, Artificial Sequence
  Description of Artificial Sequence: Synthetic polypeptide
DEMEIRTTNPVATEQYGSVSTNGLQNSGQDSI

SEQ ID NO: 48212 - protein, 31 aa, Artificial Sequence
  Description of Artificial Sequence: Synthetic polypeptide
DEMEIRTTNPVATEQYGSVSTNALTRPEEMD

SEQ ID NO: 48213 - protein, 30 aa, Artificial Sequence
  Description of Artificial Sequence: Synthetic polypeptide
DEMEIRTTNPVATEQYGSVSTDNQDNEGDQ

SEQ ID NO: 48214 - protein, 31 aa, Artificial Sequence
  Description of Artificial Sequence: Synthetic polypeptide
AEEEIRTTNPVATEQYGSVSTTQLGQTIGIG

SEQ ID NO: 48215 - protein, 31 aa, Artificial Sequence
  Description of Artificial Sequence: Synthetic polypeptide
DEMEIRTTNPVATEQYGSVSTTTLEGGNETF

SEQ ID NO: 48216 - protein, 31 aa, Artificial Sequence
  Description of Artificial Sequence: Synthetic polypeptide
AEEEIRTTNPVATEQYGSVSTTQQLNQQENS

SEQ ID NO: 48217 - protein, 31 aa, Artificial Sequence
  Description of Artificial Sequence: Synthetic polypeptide
AEEEIRTTNPVATEQYGSVSTTQQQGIENNE

SEQ ID NO: 48218 - protein, 30 aa, Artificial Sequence
  Description of Artificial Sequence: Synthetic polypeptide
DEMEIRTTNPVATEQYGSVSWNLARNSDQA

SEQ ID NO: 48219 - protein, 29 aa, Artificial Sequence
  Description of Artificial Sequence: Synthetic peptide
DEMEIRTTNPVATEQYGSVSWNNDNEGDN

SEQ ID NO: 48220 - protein, 31 aa, Artificial Sequence
  Description of Artificial Sequence: Synthetic polypeptide
CTEEIRATNPVATEQYGSVVSTNLQNMGTRG

SEQ ID NO: 48221 - protein, 33 aa, Artificial Sequence
  Description of Artificial Sequence: Synthetic polypeptide
DEMEIRTTNPVATEQYGSVSWNNMEQREGNERI

SEQ ID NO: 48222 - protein, 31 aa, Artificial Sequence
  Description of Artificial Sequence: Synthetic polypeptide
AEEEIRTTNPVATEQYGSVSTTQQQGIENNQ

SEQ ID NO: 48223 - protein, 30 aa, Artificial Sequence
  Description of Artificial Sequence: Synthetic polypeptide
DEMEIRTTNPVATEQYGSVTTNHQLTSDER

SEQ ID NO: 48224 - protein, 31 aa, Artificial Sequence
  Description of Artificial Sequence: Synthetic polypeptide
DEMEIRTTNPVATEQYGSVTTPLQNFGEDRF

SEQ ID NO: 48225 - protein, 32 aa, Artificial Sequence
  Description of Artificial Sequence: Synthetic polypeptide
DEMEIRTTNPVATEQYGSVTTQSLQRGNDQVN

SEQ ID NO: 48226 - protein, 30 aa, Artificial Sequence
  Description of Artificial Sequence: Synthetic polypeptide
DEMEIRTTNPVATEQYGSVVSTNLFDTQFT

SEQ ID NO: 48227 - protein, 31 aa, Artificial Sequence
  Description of Artificial Sequence: Synthetic polypeptide
AEEEIRTTNPVATEQYGSVSTTQQQGNEENQ

SEQ ID NO: 48228 - protein, 31 aa, Artificial Sequence
  Description of Artificial Sequence: Synthetic polypeptide
AEEEIRTTNPVATEQYGSVSTTQQQGQENQD

SEQ ID NO: 48229 - protein, 30 aa, Artificial Sequence
  Description of Artificial Sequence: Synthetic polypeptide
DEMEIRTTNPVATEQYGTVCSEGLMREGND

SEQ ID NO: 48230 - protein, 29 aa, Artificial Sequence
  Description of Artificial Sequence: Synthetic peptide
SEEEIRCTNPIATEQYGSVSENLMNYGGR

SEQ ID NO: 48231 - protein, 31 aa, Artificial Sequence
  Description of Artificial Sequence: Synthetic polypeptide
AEEEIRTTNPVATEQYGSVSTTQQLGGIENN

SEQ ID NO: 48232 - protein, 30 aa, Artificial Sequence
  Description of Artificial Sequence: Synthetic polypeptide
AEEEIRTTNPVATEQYGSVSTTQQGQIENQ

SEQ ID NO: 48233 - protein, 31 aa, Artificial Sequence
  Description of Artificial Sequence: Synthetic polypeptide
AEEEIRTTNPVATEQYGSVSTTQQGGIENTN

SEQ ID NO: 48234 - protein, 31 aa, Artificial Sequence
  Description of Artificial Sequence: Synthetic polypeptide
DEMEIRTTNPVATEQYGSVSVTNHQDRDDEF

SEQ ID NO: 48235 - protein, 32 aa, Artificial Sequence
  Description of Artificial Sequence: Synthetic polypeptide
DEMEIRTTNPVATEQYGSVSTVMNHQEIQENR

SEQ ID NO: 48236 - protein, 31 aa, Artificial Sequence
  Description of Artificial Sequence: Synthetic polypeptide
DEMEIRTTNPVATEQYGSVSTYLDETGSEQR

SEQ ID NO: 48237 - protein, 32 aa, Artificial Sequence
  Description of Artificial Sequence: Synthetic polypeptide
AEEEIRTTNPVATEQYGSVSTTQLQGTQIGNE

SEQ ID NO: 48238 - protein, 31 aa, Artificial Sequence
  Description of Artificial Sequence: Synthetic polypeptide
AEEEIRTTNPVATEQYGSVSTTQLQTINGGG

SEQ ID NO: 48239 - protein, 30 aa, Artificial Sequence
  Description of Artificial Sequence: Synthetic polypeptide
AEEEIRTTNPVATEQYGSVSTTQLQTIQEG

SEQ ID NO: 48240 - protein, 30 aa, Artificial Sequence
  Description of Artificial Sequence: Synthetic polypeptide
AEEEIRTTNPVATEQYGSVSTTQLQTNTGG

SEQ ID NO: 48241 - protein, 29 aa, Artificial Sequence
  Description of Artificial Sequence: Synthetic peptide
DEMEIRTTNPVATEQYGSVSVLLQELEQL

SEQ ID NO: 48242 - protein, 30 aa, Artificial Sequence
  Description of Artificial Sequence: Synthetic polypeptide
CTGEIRTTNPVATEQYGSVSTQNNLQYGMQ

SEQ ID NO: 48243 - protein, 30 aa, Artificial Sequence
  Description of Artificial Sequence: Synthetic polypeptide
DEMEIRTTNPVATEQYGSVSVNDLFGNMNH

SEQ ID NO: 48244 - protein, 32 aa, Artificial Sequence
  Description of Artificial Sequence: Synthetic polypeptide
AEEEIRTTNPVATEQYGSVSTTQLQTTNIGNG

SEQ ID NO: 48245 - protein, 33 aa, Artificial Sequence
  Description of Artificial Sequence: Synthetic polypeptide
AEEEIRTTNPVATEQYGSVSTTQNLQNNGNNQN

SEQ ID NO: 48246 - protein, 29 aa, Artificial Sequence
  Description of Artificial Sequence: Synthetic peptide
DEMEIRTTNPVATEQYGSVSVPLNTDDQR

SEQ ID NO: 48247 - protein, 32 aa, Artificial Sequence
  Description of Artificial Sequence: Synthetic polypeptide
DEMEIRTTNPVATEQYGSVSVSYNLQRVENIE

SEQ ID NO: 48248 - protein, 32 aa, Artificial Sequence
  Description of Artificial Sequence: Synthetic polypeptide
AEEEIRTTNPVATEQYGSVSTTQNNEQIGENE

SEQ ID NO: 48249 - protein, 30 aa, Artificial Sequence
  Description of Artificial Sequence: Synthetic polypeptide
SEEEIRCTNPIATEQYGSVSENLMRGMNPV

SEQ ID NO: 48250 - protein, 33 aa, Artificial Sequence
  Description of Artificial Sequence: Synthetic polypeptide
DEMEIRTTNPVATEQYGSVSVTNDLTTGMENQR

SEQ ID NO: 48251 - protein, 30 aa, Artificial Sequence
  Description of Artificial Sequence: Synthetic polypeptide
CTGEIRTTNPVATEQYGSVSTLNNLQLGEG

SEQ ID NO: 48252 - protein, 33 aa, Artificial Sequence
  Description of Artificial Sequence: Synthetic polypeptide
AEEEIRTTNPVATEQYGSVSTTNQQLQQIGNNS

SEQ ID NO: 48253 - protein, 33 aa, Artificial Sequence
  Description of Artificial Sequence: Synthetic polypeptide
DEMEIRTTNPVATEQYGSVSTDNLEQEGDEDRP

SEQ ID NO: 48254 - protein, 31 aa, Artificial Sequence
  Description of Artificial Sequence: Synthetic polypeptide
DEMEIRTTNPVATEQYGSVSTDLTNEGGDNE

SEQ ID NO: 48255 - protein, 32 aa, Artificial Sequence
  Description of Artificial Sequence: Synthetic polypeptide
DEMEIRTTNPVATEQYGSVCSTNHQRFGSEAL

SEQ ID NO: 48256 - protein, 31 aa, Artificial Sequence
  Description of Artificial Sequence: Synthetic polypeptide
AEEEIRTTNPVATEQYGSVSTTNQLINENGD

SEQ ID NO: 48257 - protein, 31 aa, Artificial Sequence
  Description of Artificial Sequence: Synthetic polypeptide
DEMEIRTTNPVATEQYGSVETNALQIGEEPD

SEQ ID NO: 48258 - protein, 32 aa, Artificial Sequence
  Description of Artificial Sequence: Synthetic polypeptide
DEMEIRTTNPVATEQYGSVFSTDNMLDMENNR

SEQ ID NO: 48259 - protein, 31 aa, Artificial Sequence
  Description of Artificial Sequence: Synthetic polypeptide
DEMEIRTTNPVATEQYGSVNTNLQETENVEN

SEQ ID NO: 48260 - protein, 30 aa, Artificial Sequence
  Description of Artificial Sequence: Synthetic polypeptide
DEMEIRTTNPVATEQYGSVPTDLNNREDQR

SEQ ID NO: 48261 - protein, 32 aa, Artificial Sequence
  Description of Artificial Sequence: Synthetic polypeptide
AEEEIRTTNPVATEQYGSVSTTNQLNEVNGNS

SEQ ID NO: 48262 - protein, 30 aa, Artificial Sequence
  Description of Artificial Sequence: Synthetic polypeptide
DEMEIRTTNPVATEQYGSVQTALIRMSNAG

SEQ ID NO: 48263 - protein, 32 aa, Artificial Sequence
  Description of Artificial Sequence: Synthetic polypeptide
AEEEIRTTNPVATEQYGSVSTTNQLNLGNNTQ

SEQ ID NO: 48264 - protein, 31 aa, Artificial Sequence
  Description of Artificial Sequence: Synthetic polypeptide
QEEEIRTTNPVATEQYGSVATNLERDGDTLI

SEQ ID NO: 48265 - protein, 28 aa, Artificial Sequence
  Description of Artificial Sequence: Synthetic peptide
AENEIACTNPVATEQYGELSENLQRGGR

SEQ ID NO: 48266 - protein, 33 aa, Artificial Sequence
  Description of Artificial Sequence: Synthetic polypeptide
AEEEIRTTNPVATEQYGSVSTTNQLNQDNGTNI

SEQ ID NO: 48267 - protein, 31 aa, Artificial Sequence
  Description of Artificial Sequence: Synthetic polypeptide
DEMEIRTTNPVATEQYGSVSCTMNGGQEGEF

SEQ ID NO: 48268 - protein, 33 aa, Artificial Sequence
  Description of Artificial Sequence: Synthetic polypeptide
AEEEIRTTNPVATEQYGSVSTTNQLQENQGINE

SEQ ID NO: 48269 - protein, 30 aa, Artificial Sequence
  Description of Artificial Sequence: Synthetic polypeptide
DEMEIRTTNPVATEQYGSVSDNNQEGEEGD

SEQ ID NO: 48270 - protein, 32 aa, Artificial Sequence
  Description of Artificial Sequence: Synthetic polypeptide
DEMEIRTTNPVATEQYGSVCSTDNPAQHGNTT

SEQ ID NO: 48271 - protein, 32 aa, Artificial Sequence
  Description of Artificial Sequence: Synthetic polypeptide
DEMEIRTTNPVATEQYGSVCSTDGPVQREGNG

SEQ ID NO: 48272 - protein, 33 aa, Artificial Sequence
  Description of Artificial Sequence: Synthetic polypeptide
AEEEIRTTNPVATEQYGSVSTTNQLGQTGNSTT

SEQ ID NO: 48273 - protein, 28 aa, Artificial Sequence
  Description of Artificial Sequence: Synthetic peptide
DAAEIATTNPVAYEQYGSVATNDDRGND

SEQ ID NO: 48274 - protein, 32 aa, Artificial Sequence
  Description of Artificial Sequence: Synthetic polypeptide
AEEEIRTTNPVATEQYGSVSTTNQLENQGNNQ

SEQ ID NO: 48275 - protein, 31 aa, Artificial Sequence
  Description of Artificial Sequence: Synthetic polypeptide
DEMEIRTTNPVATEQYGSSSTLDQQIEGNSR

SEQ ID NO: 48276 - protein, 29 aa, Artificial Sequence
  Description of Artificial Sequence: Synthetic peptide
DEMEIRTTNPVATEQYGSSSTNEQETEQN

SEQ ID NO: 48277 - protein, 33 aa, Artificial Sequence
  Description of Artificial Sequence: Synthetic polypeptide
DEVEIRTTNPVATEQYGSVTSTNLQFNEGGNDE

SEQ ID NO: 48278 - protein, 32 aa, Artificial Sequence
  Description of Artificial Sequence: Synthetic polypeptide
DEMEIRTTNPVATEQYGSTSMTENLSQEIGNP

SEQ ID NO: 48279 - protein, 29 aa, Artificial Sequence
  Description of Artificial Sequence: Synthetic peptide
SEEEIRCTNPIATEQYGSVSFENDMHGNR

SEQ ID NO: 48280 - protein, 33 aa, Artificial Sequence
  Description of Artificial Sequence: Synthetic polypeptide
AEEEIRTTNPVATEQYGSVSTTNQLEQQGNQNG

SEQ ID NO: 48281 - protein, 33 aa, Artificial Sequence
  Description of Artificial Sequence: Synthetic polypeptide
AEEEIRTTNPVATEQYGSVSTTNQLQEQIGNNV

SEQ ID NO: 48282 - protein, 28 aa, Artificial Sequence
  Description of Artificial Sequence: Synthetic peptide
AENEIACTNPVATEQYGEISENLQRGGR

SEQ ID NO: 48283 - protein, 32 aa, Artificial Sequence
  Description of Artificial Sequence: Synthetic polypeptide
AEEEIRTTNPVATEQYGSVSTTNQLGEEGGND

SEQ ID NO: 48284 - protein, 33 aa, Artificial Sequence
  Description of Artificial Sequence: Synthetic polypeptide
DEVEIRTTNPVATEQYGSVTSTNLQFNEGENIE

SEQ ID NO: 48285 - protein, 33 aa, Artificial Sequence
  Description of Artificial Sequence: Synthetic polypeptide
AEEEIRTTNPVATEQYGSVSTTNQLGEQQGNTN

SEQ ID NO: 48286 - protein, 30 aa, Artificial Sequence
  Description of Artificial Sequence: Synthetic polypeptide
DAAEIATTNPVAYEQYGSVATNLQRGDNDQ

SEQ ID NO: 48287 - protein, 33 aa, Artificial Sequence
  Description of Artificial Sequence: Synthetic polypeptide
DEMEIRTTNPVATEQYGSVCSENSLERSGENRD

SEQ ID NO: 48288 - protein, 31 aa, Artificial Sequence
  Description of Artificial Sequence: Synthetic polypeptide
DEMEIRTTNPVATEQYGSVCSEVLQGGIDRQ

SEQ ID NO: 48289 - protein, 33 aa, Artificial Sequence
  Description of Artificial Sequence: Synthetic polypeptide
DEMEIRTTNPVATEQYGSVCSFTDNLERFGDNQ

SEQ ID NO: 48290 - protein, 29 aa, Artificial Sequence
  Description of Artificial Sequence: Synthetic peptide
DAAEIATTNPVAYEQYGSVSTNPLQSMMR

SEQ ID NO: 48291 - protein, 32 aa, Artificial Sequence
  Description of Artificial Sequence: Synthetic polypeptide
DEMEIRTTNPVATEQYGSVSDTNLVRNGQQQE

SEQ ID NO: 48292 - protein, 32 aa, Artificial Sequence
  Description of Artificial Sequence: Synthetic polypeptide
AEEEIRTTNPVATEQYGSVSTTNQLQGNGTEL

SEQ ID NO: 48293 - protein, 33 aa, Artificial Sequence
  Description of Artificial Sequence: Synthetic polypeptide
AEEEIRTTNPVATEQYGSVSTTNQLQGQGTTNE

SEQ ID NO: 48294 - protein, 32 aa, Artificial Sequence
  Description of Artificial Sequence: Synthetic polypeptide
DEMEIRTTNPVATEQYGSVSPTLLEFRTGEQR

SEQ ID NO: 48295 - protein, 32 aa, Artificial Sequence
  Description of Artificial Sequence: Synthetic polypeptide
AEEEIRTTNPVATEQYGSVSTTNQNQQTGNNL

SEQ ID NO: 48296 - protein, 32 aa, Artificial Sequence
  Description of Artificial Sequence: Synthetic polypeptide
AEEEIRTTNPVATEQYGSVSTTNQQAGVNNVD

SEQ ID NO: 48297 - protein, 31 aa, Artificial Sequence
  Description of Artificial Sequence: Synthetic polypeptide
DEMEIRTTNPVATEQYGSVSPTNHQETFENN

SEQ ID NO: 48298 - protein, 31 aa, Artificial Sequence
  Description of Artificial Sequence: Synthetic polypeptide
DEMEIRTTNPVATEQYGSVSPTNLDNGSPQF

SEQ ID NO: 48299 - protein, 32 aa, Artificial Sequence
  Description of Artificial Sequence: Synthetic polypeptide
AEEEIRTTNPVATEQYGSVSTTNQQAINGNQD

SEQ ID NO: 48300 - protein, 32 aa, Artificial Sequence
  Description of Artificial Sequence: Synthetic polypeptide
DEMEIRTTNPVATEQYGSVSPTNLERTGEQVM

SEQ ID NO: 48301 - protein, 32 aa, Artificial Sequence
  Description of Artificial Sequence: Synthetic polypeptide
AEEEIRTTNPVATEQYGSVSTTNQNQQIGNGT

SEQ ID NO: 48302 - protein, 32 aa, Artificial Sequence
  Description of Artificial Sequence: Synthetic polypeptide
AEEEIRTTNPVATEQYGSVSTTNQQEQQGNND

SEQ ID NO: 48303 - protein, 32 aa, Artificial Sequence
  Description of Artificial Sequence: Synthetic polypeptide
AEEEIRTTNPVATEQYGSVSTTNQQFGTNENS

SEQ ID NO: 48304 - protein, 31 aa, Artificial Sequence
  Description of Artificial Sequence: Synthetic polypeptide
AEEEIRTTNPVATEQYGSVSTTNQQGIENNQ

SEQ ID NO: 48305 - protein, 32 aa, Artificial Sequence
  Description of Artificial Sequence: Synthetic polypeptide
AEEEIRTTNPVATEQYGSVSTTNQQLNGGNSG

SEQ ID NO: 48306 - protein, 30 aa, Artificial Sequence
  Description of Artificial Sequence: Synthetic polypeptide
SEEEIRCTNPIATEQYGSVSENLVEREGND

SEQ ID NO: 48307 - protein, 30 aa, Artificial Sequence
  Description of Artificial Sequence: Synthetic polypeptide
DEMEIRTTNPVATEQYGSVSTDDHQGGEHN

SEQ ID NO: 48308 - protein, 33 aa, Artificial Sequence
  Description of Artificial Sequence: Synthetic polypeptide
AEEEIRTTNPVATEQYGSVSVTTNLQQQDTGNG

SEQ ID NO: 48309 - protein, 32 aa, Artificial Sequence
  Description of Artificial Sequence: Synthetic polypeptide
DEMEIRTTNPVATEQYGSVSTDLDQQRDEERD

SEQ ID NO: 48310 - protein, 32 aa, Artificial Sequence
  Description of Artificial Sequence: Synthetic polypeptide
AEEEIRTTNPVATEQYGSVSTTNQQEQQTGNE

SEQ ID NO: 48311 - protein, 29 aa, Artificial Sequence
  Description of Artificial Sequence: Synthetic peptide
SEEEIRCTNPIATEQYGSVSENLMNREDR

SEQ ID NO: 48312 - protein, 31 aa, Artificial Sequence
  Description of Artificial Sequence: Synthetic polypeptide
DEMEIRTTNPVATEQYGSVSPSLEQRDDDRQ

SEQ ID NO: 48313 - protein, 30 aa, Artificial Sequence
  Description of Artificial Sequence: Synthetic polypeptide
DEMEIRTTNPVATEQYGSVSPHLQNGDEDI

SEQ ID NO: 48314 - protein, 32 aa, Artificial Sequence
  Description of Artificial Sequence: Synthetic polypeptide
DEMEIRTTNPVATEQYGSVSDTWLEQRSQNME

SEQ ID NO: 48315 - protein, 31 aa, Artificial Sequence
  Description of Artificial Sequence: Synthetic polypeptide
DEMEIRTTNPVATEQYGSVSDWNLVRNGDQE

SEQ ID NO: 48316 - protein, 28 aa, Artificial Sequence
  Description of Artificial Sequence: Synthetic peptide
SEEEIRCTNPIATEQYGSVSETLMRGDI

SEQ ID NO: 48317 - protein, 32 aa, Artificial Sequence
  Description of Artificial Sequence: Synthetic polypeptide
DEMEIRTTNPVATEQYGSVSMDLEQRTGEDRQ

SEQ ID NO: 48318 - protein, 32 aa, Artificial Sequence
  Description of Artificial Sequence: Synthetic polypeptide
AEEEIRTTNPVATEQYGSVSTTNQLQNNNANN

SEQ ID NO: 48319 - protein, 28 aa, Artificial Sequence
  Description of Artificial Sequence: Synthetic peptide
SEEEIRCTNPIATEQYGSVSETLMHGDR

SEQ ID NO: 48320 - protein, 33 aa, Artificial Sequence
  Description of Artificial Sequence: Synthetic polypeptide
AEEEIRTTNPVATEQYGSVSTTNQLQQGNGNNF

SEQ ID NO: 48321 - protein, 31 aa, Artificial Sequence
  Description of Artificial Sequence: Synthetic polypeptide
AEEEIRTTNPVATEQYGSVSTTNQNGTVGNF

SEQ ID NO: 48322 - protein, 31 aa, Artificial Sequence
  Description of Artificial Sequence: Synthetic polypeptide
DEMEIRTTNPVATEQYGSVSMNLQRSDDVEE

SEQ ID NO: 48323 - protein, 33 aa, Artificial Sequence
  Description of Artificial Sequence: Synthetic polypeptide
AEEEIRTTNPVATEQYGSVSTTNQLQQGNNNTE

SEQ ID NO: 48324 - protein, 33 aa, Artificial Sequence
  Description of Artificial Sequence: Synthetic polypeptide
AEEEIRTTNPVATEQYGSVSTTNQLQQQEGNNE

SEQ ID NO: 48325 - protein, 33 aa, Artificial Sequence
  Description of Artificial Sequence: Synthetic polypeptide
AEEEIRTTNPVATEQYGSVSTTNQLQTGNGGTT

SEQ ID NO: 48326 - protein, 31 aa, Artificial Sequence
  Description of Artificial Sequence: Synthetic polypeptide
DEMEIRTTNPVATEQYGSVSNTNLEGGSDQD

SEQ ID NO: 48327 - protein, 32 aa, Artificial Sequence
  Description of Artificial Sequence: Synthetic polypeptide
AEEEIRTTNPVATEQYGSVSTTNQLQVNNGTI

SEQ ID NO: 48328 - protein, 32 aa, Artificial Sequence
  Description of Artificial Sequence: Synthetic polypeptide
AEEEIRTTNPVATEQYGSVSTTNQLTEQGNNG

SEQ ID NO: 48329 - protein, 29 aa, Artificial Sequence
  Description of Artificial Sequence: Synthetic peptide
DAAEIATTNPVATEQYGSVSANPLQEMMR

SEQ ID NO: 48330 - protein, 29 aa, Artificial Sequence
  Description of Artificial Sequence: Synthetic peptide
DAAEIATTNPVATEQYGSVSTNPLQSDMM

SEQ ID NO: 48331 - protein, 33 aa, Artificial Sequence
  Description of Artificial Sequence: Synthetic polypeptide
DEVEIRTTNPVATEQYGSVSTVNLQFNVGNEDQ

SEQ ID NO: 48332 - protein, 30 aa, Artificial Sequence
  Description of Artificial Sequence: Synthetic polypeptide
DEMEIRTTNPVATEQYGTVCSTDNPEFGND

SEQ ID NO: 48333 - protein, 31 aa, Artificial Sequence
  Description of Artificial Sequence: Synthetic polypeptide
AEEEIRTTNPVATEQYGSVSTTSNEQNETNV

SEQ ID NO: 48334 - protein, 29 aa, Artificial Sequence
  Description of Artificial Sequence: Synthetic peptide
DENEIACTNPVATEQYGDVSENLMNRGDR

SEQ ID NO: 48335 - protein, 33 aa, Artificial Sequence
  Description of Artificial Sequence: Synthetic polypeptide
AEEEIRTTNPVATEQYGSVSVTTNLQQGDNGNV

SEQ ID NO: 48336 - protein, 28 aa, Artificial Sequence
  Description of Artificial Sequence: Synthetic peptide
DENEIACTNPVATEQYGEASENLERGGR

SEQ ID NO: 48337 - protein, 30 aa, Artificial Sequence
  Description of Artificial Sequence: Synthetic polypeptide
SEEEIRCTNPIATEQYGSVSEDNLMRIGFR

SEQ ID NO: 48338 - protein, 33 aa, Artificial Sequence
  Description of Artificial Sequence: Synthetic polypeptide
DEVEIRTTNPVATEQYGSVSTQNGDDERGGNSR

SEQ ID NO: 48339 - protein, 32 aa, Artificial Sequence
  Description of Artificial Sequence: Synthetic polypeptide
AEEEIRTTNPVATEQYGSVSTTTNQQLGIENV

SEQ ID NO: 48340 - protein, 29 aa, Artificial Sequence
  Description of Artificial Sequence: Synthetic peptide
DENEIACTNPVATEQYGEASENLQNRGGR

SEQ ID NO: 48341 - protein, 28 aa, Artificial Sequence
  Description of Artificial Sequence: Synthetic peptide
DENEIACTNPVATEQYGEASENLQQGGR

SEQ ID NO: 48342 - protein, 30 aa, Artificial Sequence
  Description of Artificial Sequence: Synthetic polypeptide
SEEEIRCTNPIATEQYGSVSCINLPMRGNG

SEQ ID NO: 48343 - protein, 33 aa, Artificial Sequence
  Description of Artificial Sequence: Synthetic polypeptide
DEVEIRTTNPVATEQYGSVSTPNLQTSGNNQEV

SEQ ID NO: 48344 - protein, 28 aa, Artificial Sequence
  Description of Artificial Sequence: Synthetic peptide
DENEIACTNPVATEQYGEASENLQRGGH

SEQ ID NO: 48345 - protein, 29 aa, Artificial Sequence
  Description of Artificial Sequence: Synthetic peptide
DENEIACTNPVATEQYGEASENLQRNGGR

SEQ ID NO: 48346 - protein, 28 aa, Artificial Sequence
  Description of Artificial Sequence: Synthetic peptide
DENEIACTNPVATEQYGEASENWQRGGR

SEQ ID NO: 48347 - protein, 30 aa, Artificial Sequence
  Description of Artificial Sequence: Synthetic polypeptide
DENEIACTNPVATEQYGEASEPNLPQRGNR

SEQ ID NO: 48348 - protein, 28 aa, Artificial Sequence
  Description of Artificial Sequence: Synthetic peptide
DENEIACTNPVATEQYGEASMNIQRGGR

SEQ ID NO: 48349 - protein, 30 aa, Artificial Sequence
  Description of Artificial Sequence: Synthetic polypeptide
SEEEIRCTNPIATEQYGSVSEDNPMREGNR

SEQ ID NO: 48350 - protein, 28 aa, Artificial Sequence
  Description of Artificial Sequence: Synthetic peptide
DENEIACTNPVATEQYGDASENLQREGR

SEQ ID NO: 48351 - protein, 28 aa, Artificial Sequence
  Description of Artificial Sequence: Synthetic peptide
DENEIACTNPVATEQYGDASENLQREDR

SEQ ID NO: 48352 - protein, 32 aa, Artificial Sequence
  Description of Artificial Sequence: Synthetic polypeptide
AEEEIRTTNPVATEQYGSVSVTTNLQQGGGMG

SEQ ID NO: 48353 - protein, 29 aa, Artificial Sequence
  Description of Artificial Sequence: Synthetic peptide
DENAIRTTNPVATEQYGCFSTNLINGNQF

SEQ ID NO: 48354 - protein, 28 aa, Artificial Sequence
  Description of Artificial Sequence: Synthetic peptide
AENEIACTNPVATEQYGEQSENLQRGGR

SEQ ID NO: 48355 - protein, 28 aa, Artificial Sequence
  Description of Artificial Sequence: Synthetic peptide
AENEIACTNPVATEQYGERSENLQRGGR

SEQ ID NO: 48356 - protein, 33 aa, Artificial Sequence
  Description of Artificial Sequence: Synthetic polypeptide
DENEAEIRTTNPVAYEHYGSVSTNLQGEGQNDR

SEQ ID NO: 48357 - protein, 29 aa, Artificial Sequence
  Description of Artificial Sequence: Synthetic peptide
SEEEIRCTNPIATEQYGSVSEMNLMRGGG

SEQ ID NO: 48358 - protein, 31 aa, Artificial Sequence
  Description of Artificial Sequence: Synthetic polypeptide
SEEEIRCTNPIATEQYGSVSEMNLEMRGNFR

SEQ ID NO: 48359 - protein, 31 aa, Artificial Sequence
  Description of Artificial Sequence: Synthetic polypeptide
SEEEIRCTNPIATEQYGSVSELNLMPRGDNR

SEQ ID NO: 48360 - protein, 28 aa, Artificial Sequence
  Description of Artificial Sequence: Synthetic peptide
DENEIACTNPVATEQYGEISMNIQRGGR

SEQ ID NO: 48361 - protein, 30 aa, Artificial Sequence
  Description of Artificial Sequence: Synthetic polypeptide
DENEIACTNPVATECYGEVSENLPQREGNR

SEQ ID NO: 48362 - protein, 31 aa, Artificial Sequence
  Description of Artificial Sequence: Synthetic polypeptide
SEEEIRCTNPIATEQYGSVSEINLPMRGENR

SEQ ID NO: 48363 - protein, 33 aa, Artificial Sequence
  Description of Artificial Sequence: Synthetic polypeptide
AEEEIRTTNPVATEQYGSVSTTTNNQLQQGNDG

SEQ ID NO: 48364 - protein, 32 aa, Artificial Sequence
  Description of Artificial Sequence: Synthetic polypeptide
DEVEIRTTNPVATEQYGSVSTTDNGNHGDNSR

SEQ ID NO: 48365 - protein, 31 aa, Artificial Sequence
  Description of Artificial Sequence: Synthetic polypeptide
SEEEIRCTNPIATEQYGSVSEGNHLMRMGNR

SEQ ID NO: 48366 - protein, 28 aa, Artificial Sequence
  Description of Artificial Sequence: Synthetic peptide
DENEIACTNPVATEQWGEASENLQRGGR

SEQ ID NO: 48367 - protein, 29 aa, Artificial Sequence
  Description of Artificial Sequence: Synthetic peptide
DENEIACTNPVATEQWGSASEINEQRGNR

SEQ ID NO: 48368 - protein, 31 aa, Artificial Sequence
  Description of Artificial Sequence: Synthetic polypeptide
DEVEIRTTNPVATEQYGSVSTTDLQNFGGEQ

SEQ ID NO: 48369 - protein, 29 aa, Artificial Sequence
  Description of Artificial Sequence: Synthetic peptide
DENEIACTNPVATECYGSVSCNEPQRGGR

SEQ ID NO: 48370 - protein, 28 aa, Artificial Sequence
  Description of Artificial Sequence: Synthetic peptide
DENEIACTNPVATEQYGETSENWQRGPR

SEQ ID NO: 48371 - protein, 30 aa, Artificial Sequence
  Description of Artificial Sequence: Synthetic polypeptide
SEEEIRCTNPIATEQYGSVSCENLVRSGNQ

SEQ ID NO: 48372 - protein, 30 aa, Artificial Sequence
  Description of Artificial Sequence: Synthetic polypeptide
SEEEIRCTNPIATEQYGSVSCENLSMRGNP

SEQ ID NO: 48373 - protein, 30 aa, Artificial Sequence
  Description of Artificial Sequence: Synthetic polypeptide
SEEEIRCTNPIATEQYGSVPSEPSLMRGNR

SEQ ID NO: 48374 - protein, 33 aa, Artificial Sequence
  Description of Artificial Sequence: Synthetic polypeptide
AEEEIRTTNPVATEQYGSVSVTTNLQQDEGNND

SEQ ID NO: 48375 - protein, 31 aa, Artificial Sequence
  Description of Artificial Sequence: Synthetic polypeptide
SEEEIRCTNPIATEQYGSVPSEFNLMYRGNR

SEQ ID NO: 48376 - protein, 28 aa, Artificial Sequence
  Description of Artificial Sequence: Synthetic peptide
SEEEIRCTNPIATEQYGSVPEVLMHGNR

SEQ ID NO: 48377 - protein, 28 aa, Artificial Sequence
  Description of Artificial Sequence: Synthetic peptide
SEEEIRCTNPIATEQYGSVPENCMRGER

SEQ ID NO: 48378 - protein, 33 aa, Artificial Sequence
  Description of Artificial Sequence: Synthetic polypeptide
DEVEIRTTNPVATEQYGSVSTPNLQFNVGNNTN

SEQ ID NO: 48379 - protein, 33 aa, Artificial Sequence
  Description of Artificial Sequence: Synthetic polypeptide
AEEEIRTTNPVATEQYGSVSVTTNLQQDEGNED

SEQ ID NO: 48380 - protein, 33 aa, Artificial Sequence
  Description of Artificial Sequence: Synthetic polypeptide
AEEEIRTTNPVATEQYGSVSVTTNLQQFGNQNN

SEQ ID NO: 48381 - protein, 29 aa, Artificial Sequence
  Description of Artificial Sequence: Synthetic peptide
DENEIACTNPVATEQYGTISMNLQQRGGR

SEQ ID NO: 48382 - protein, 29 aa, Artificial Sequence
  Description of Artificial Sequence: Synthetic peptide
DENEIACTNPVATEQYGTVSAENPQFGNR

SEQ ID NO: 48383 - protein, 33 aa, Artificial Sequence
  Description of Artificial Sequence: Synthetic polypeptide
AEEEIRTTNPVATEQYGSVSVTTNLQQDEGNDG

SEQ ID NO: 48384 - protein, 28 aa, Artificial Sequence
  Description of Artificial Sequence: Synthetic peptide
DENEIACTNPVSTEQYGEASENLQRGGR

SEQ ID NO: 48385 - protein, 32 aa, Artificial Sequence
  Description of Artificial Sequence: Synthetic polypeptide
AEEEIRTTNPVATEQYGSVSTTVNLNENNGNQ

SEQ ID NO: 48386 - protein, 32 aa, Artificial Sequence
  Description of Artificial Sequence: Synthetic polypeptide
AEEEIRTTNPVATEQYGSVSTTVNLQQDEGIA

SEQ ID NO: 48387 - protein, 33 aa, Artificial Sequence
  Description of Artificial Sequence: Synthetic polypeptide
AEEEIRTTNPVATEQYGSVSTTVNLQSNEEGNN

SEQ ID NO: 48388 - protein, 32 aa, Artificial Sequence
  Description of Artificial Sequence: Synthetic polypeptide
AEEEIRTTNPVATEQYGSVSVTTNLQNGQGTN

SEQ ID NO: 48389 - protein, 32 aa, Artificial Sequence
  Description of Artificial Sequence: Synthetic polypeptide
AEEEIRTTNPVATEQYGSVSTTVNGEQEGNNN

SEQ ID NO: 48390 - protein, 30 aa, Artificial Sequence
  Description of Artificial Sequence: Synthetic polypeptide
DENAICTTNPVATEQYGSVSTSTNLIIGNM

SEQ ID NO: 48391 - protein, 29 aa, Artificial Sequence
  Description of Artificial Sequence: Synthetic peptide
DENEIACTNPVATEQYGTASENLQREGGR

SEQ ID NO: 48392 - protein, 33 aa, Artificial Sequence
  Description of Artificial Sequence: Synthetic polypeptide
DEVEIRTTNPVATEQYGSVSTPNLQTGGGNIET

SEQ ID NO: 48393 - protein, 29 aa, Artificial Sequence
  Description of Artificial Sequence: Synthetic peptide
DENEIACTNPVATEQYGEVSENLQRGGPV

SEQ ID NO: 48394 - protein, 30 aa, Artificial Sequence
  Description of Artificial Sequence: Synthetic polypeptide
DENEIACTNPVATEQYGEVSEPNLPQRGNV

SEQ ID NO: 48395 - protein, 30 aa, Artificial Sequence
  Description of Artificial Sequence: Synthetic polypeptide
SEEEIRCTNPIATEQYGSVSCENLMEGGNR

SEQ ID NO: 48396 - protein, 31 aa, Artificial Sequence
  Description of Artificial Sequence: Synthetic polypeptide
DENEIACTNPVATEQYGEVSTEPNLPQRGNV

SEQ ID NO: 48397 - protein, 30 aa, Artificial Sequence
  Description of Artificial Sequence: Synthetic polypeptide
SEEEIRCTNPIATEQYGSVSCENDMRGNDR

SEQ ID NO: 48398 - protein, 30 aa, Artificial Sequence
  Description of Artificial Sequence: Synthetic polypeptide
SEEEIRCTNPIATEQYGSVSATNLMHGEDR

SEQ ID NO: 48399 - protein, 30 aa, Artificial Sequence
  Description of Artificial Sequence: Synthetic polypeptide
DENEIACTNPVATEQYGSASAENLQRGEDR

SEQ ID NO: 48400 - protein, 33 aa, Artificial Sequence
  Description of Artificial Sequence: Synthetic polypeptide
AEEEIRTTNPVATEQYGSVSTTTTNLQQGTNDN

SEQ ID NO: 48401 - protein, 28 aa, Artificial Sequence
  Description of Artificial Sequence: Synthetic peptide
DENEIACTNPVATEQYGSASEALQRGGV

SEQ ID NO: 48402 - protein, 33 aa, Artificial Sequence
  Description of Artificial Sequence: Synthetic polypeptide
DEVEIRTTNPVATEQYGSVSTPNLQTNGGNDEV

SEQ ID NO: 48403 - protein, 31 aa, Artificial Sequence
  Description of Artificial Sequence: Synthetic polypeptide
AEEEIRTTNPVATEQYGSVSTTTQQLGIENQ

SEQ ID NO: 48404 - protein, 30 aa, Artificial Sequence
  Description of Artificial Sequence: Synthetic polypeptide
DENEIACTNPVATEQYGSVSENLQMRGGPV

SEQ ID NO: 48405 - protein, 30 aa, Artificial Sequence
  Description of Artificial Sequence: Synthetic polypeptide
SEEEIRCTNPIATEQYGSVSAENLMHGNDR

SEQ ID NO: 48406 - protein, 28 aa, Artificial Sequence
  Description of Artificial Sequence: Synthetic peptide
AENEIACTNPVATEQYGESSENLQRGGR

SEQ ID NO: 48407 - protein, 31 aa, Artificial Sequence
  Description of Artificial Sequence: Synthetic polypeptide
DENEIACTNPVATEQYGSVSTNGPQMRGGPR

SEQ ID NO: 48408 - protein, 30 aa, Artificial Sequence
  Description of Artificial Sequence: Synthetic polypeptide
DENEIACTNPVATEQYGSVSTNLEDHEGER

SEQ ID NO: 48409 - protein, 31 aa, Artificial Sequence
  Description of Artificial Sequence: Synthetic polypeptide
AEEEIRTTNPVATEQYGSVSTTTQQGIENND

SEQ ID NO: 48410 - protein, 29 aa, Artificial Sequence
  Description of Artificial Sequence: Synthetic peptide
DAEEIAATNPVATEQYGSVVATNLQAGTE

SEQ ID NO: 48411 - protein, 30 aa, Artificial Sequence
  Description of Artificial Sequence: Synthetic polypeptide
DENAICTTNPVATEQYGSVNSTNLIIGTNP

SEQ ID NO: 48412 - protein, 29 aa, Artificial Sequence
  Description of Artificial Sequence: Synthetic peptide
DEMVIRTTNPVATEQYGCVETEPQYGSNR

SEQ ID NO: 48413 - protein, 31 aa, Artificial Sequence
  Description of Artificial Sequence: Synthetic polypeptide
DEVEIRTTNPVATEQYGSVSTVDGNHGGGNQ

SEQ ID NO: 48414 - protein, 28 aa, Artificial Sequence
  Description of Artificial Sequence: Synthetic peptide
CEVEIACTNPVATEQYGEASENLQRGGR

SEQ ID NO: 48415 - protein, 30 aa, Artificial Sequence
  Description of Artificial Sequence: Synthetic polypeptide
DEMEIRTTNPVATQQYGCVSTRNLERGEPA

SEQ ID NO: 48416 - protein, 30 aa, Artificial Sequence
  Description of Artificial Sequence: Synthetic polypeptide
DEMEIRTTNPVATQQYGTVSTNLEEVRLNE

SEQ ID NO: 48417 - protein, 32 aa, Artificial Sequence
  Description of Artificial Sequence: Synthetic polypeptide
AEEEIRTTNPVATEQYGSVSTTSNLQNVNNTN

SEQ ID NO: 48418 - protein, 30 aa, Artificial Sequence
  Description of Artificial Sequence: Synthetic polypeptide
DEMEIRTTNPVATQQYGTVSTPTLEREGNP

SEQ ID NO: 48419 - protein, 29 aa, Artificial Sequence
  Description of Artificial Sequence: Synthetic peptide
DEMEIRTTNPVSTEQYGSVTFNLQGGQQT

SEQ ID NO: 48420 - protein, 30 aa, Artificial Sequence
  Description of Artificial Sequence: Synthetic polypeptide
DEMEIRYTNPVATEQYGSVSVNADRGSNSE

SEQ ID NO: 48421 - protein, 32 aa, Artificial Sequence
  Description of Artificial Sequence: Synthetic polypeptide
AEEEIRTTNPVATEQYGSVSTTSNLQNVTNNT

SEQ ID NO: 48422 - protein, 33 aa, Artificial Sequence
  Description of Artificial Sequence: Synthetic polypeptide
AEEEIRTTNPVATEQYGSVSTTSNLQQEGEENN

SEQ ID NO: 48423 - protein, 30 aa, Artificial Sequence
  Description of Artificial Sequence: Synthetic polypeptide
SEEEIRCTNPIATEQYGSVSENLMDHEGNR

SEQ ID NO: 48424 - protein, 31 aa, Artificial Sequence
  Description of Artificial Sequence: Synthetic polypeptide
DEMEIRYTNPVATEQYGSVSVNVDRPGSNSR

SEQ ID NO: 48425 - protein, 29 aa, Artificial Sequence
  Description of Artificial Sequence: Synthetic peptide
SEEEIRCTNPIATEQYGSVSENLMAGNTD

SEQ ID NO: 48426 - protein, 29 aa, Artificial Sequence
  Description of Artificial Sequence: Synthetic peptide
SEEEIRCTNPIATEQYGSVSENLMAGDQR

SEQ ID NO: 48427 - protein, 32 aa, Artificial Sequence
  Description of Artificial Sequence: Synthetic polypeptide
AEEEIRTTNPVATEQYGSVSTTSNQQQTNGNE

SEQ ID NO: 48428 - protein, 28 aa, Artificial Sequence
  Description of Artificial Sequence: Synthetic peptide
CEVEIACTNPVATEQYGEFSENLQRGGR

SEQ ID NO: 48429 - protein, 30 aa, Artificial Sequence
  Description of Artificial Sequence: Synthetic polypeptide
DEMEIRTTNPVATQQYGCVSTNLENGSNAF

SEQ ID NO: 48430 - protein, 30 aa, Artificial Sequence
  Description of Artificial Sequence: Synthetic polypeptide
DEMEIRTTNPVATQQYGCVSTNLEGFGSNA

SEQ ID NO: 48431 - protein, 32 aa, Artificial Sequence
  Description of Artificial Sequence: Synthetic polypeptide
CNEEIRTTNPVATEQYGSVSTTPLTRFGNSRS

SEQ ID NO: 48432 - protein, 32 aa, Artificial Sequence
  Description of Artificial Sequence: Synthetic polypeptide
AEEEIRTTNPVATEQYGSVSTTSNGEQNGGNT

SEQ ID NO: 48433 - protein, 33 aa, Artificial Sequence
  Description of Artificial Sequence: Synthetic polypeptide
AEEEIRTTNPVATEQYGSVSTTSNLENQEGGNV

SEQ ID NO: 48434 - protein, 29 aa, Artificial Sequence
  Description of Artificial Sequence: Synthetic peptide
SEEEIRCTNPIATEQYGSVSENLMIGGNS

SEQ ID NO: 48435 - protein, 29 aa, Artificial Sequence
  Description of Artificial Sequence: Synthetic peptide
DEMEIRTTNPVATHHYGAVSTNLERGEPT

SEQ ID NO: 48436 - protein, 29 aa, Artificial Sequence
  Description of Artificial Sequence: Synthetic peptide
SEEEIRCTNPIATEQYGSVSENLMHGGNS

SEQ ID NO: 48437 - protein, 32 aa, Artificial Sequence
  Description of Artificial Sequence: Synthetic polypeptide
AEEEIRTTNPVATEQYGSVSTTSNLNEQAENV

SEQ ID NO: 48438 - protein, 28 aa, Artificial Sequence
  Description of Artificial Sequence: Synthetic peptide
SEEEIRCTNPIATEQYGSVSENLMHGEL

SEQ ID NO: 48439 - protein, 30 aa, Artificial Sequence
  Description of Artificial Sequence: Synthetic polypeptide
DEMEISTTNPVATQQYGCVCSTNLERGSNA

SEQ ID NO: 48440 - protein, 33 aa, Artificial Sequence
  Description of Artificial Sequence: Synthetic polypeptide
AEEEIRTTNPVATEQYGSVSTTSNLNNQEAGNV

SEQ ID NO: 48441 - protein, 33 aa, Artificial Sequence
  Description of Artificial Sequence: Synthetic polypeptide
AEEEIRTTNPVATEQYGSVSTTSNLQNDEGNNE

SEQ ID NO: 48442 - protein, 32 aa, Artificial Sequence
  Description of Artificial Sequence: Synthetic polypeptide
AEEEIRTTNPVATEQYGSVSTTSNLQNEANVT

SEQ ID NO: 48443 - protein, 33 aa, Artificial Sequence
  Description of Artificial Sequence: Synthetic polypeptide
DEVEIRTTNPVATEQYGSVSTVNLQFNEGENDG

SEQ ID NO: 48444 - protein, 29 aa, Artificial Sequence
  Description of Artificial Sequence: Synthetic peptide
SEEEIRCTNPIATEQYGSVSENLMGEGNQ

SEQ ID NO: 48445 - protein, 29 aa, Artificial Sequence
  Description of Artificial Sequence: Synthetic peptide
DEMEIRTTNPVATQQYGCVSTFLERGEPM

SEQ ID NO: 48446 - protein, 31 aa, Artificial Sequence
  Description of Artificial Sequence: Synthetic polypeptide
DEMEIRTTNPVATQQYGCVSTNELAERQGNP

SEQ ID NO: 48447 - protein, 32 aa, Artificial Sequence
  Description of Artificial Sequence: Synthetic polypeptide
AEEEIRTTNPVATEQYGSVSTTSNLQNVETNE

SEQ ID NO: 48448 - protein, 33 aa, Artificial Sequence
  Description of Artificial Sequence: Synthetic polypeptide
AEEEIRTTNPVATEQYGSVSTTSNLQEQQGNNA

SEQ ID NO: 48449 - protein, 31 aa, Artificial Sequence
  Description of Artificial Sequence: Synthetic polypeptide
QEEEIRTTNPVATEQYGSVATNLQAAEDTNN

SEQ ID NO: 48450 - protein, 29 aa, Artificial Sequence
  Description of Artificial Sequence: Synthetic peptide
DEMEISTTNPVATQQYGCVSTNHERGSNQ

SEQ ID NO: 48451 - protein, 32 aa, Artificial Sequence
  Description of Artificial Sequence: Synthetic polypeptide
AEEEIRTTNPVATEQYGSVSTTTNLEQGNTTA

SEQ ID NO: 48452 - protein, 28 aa, Artificial Sequence
  Description of Artificial Sequence: Synthetic peptide
SEEEIRCTNPIATEQYGSVSENIMGGTR

SEQ ID NO: 48453 - protein, 30 aa, Artificial Sequence
  Description of Artificial Sequence: Synthetic polypeptide
DEMEIVTTNPVATEQYGTVCSTGLMREGND

SEQ ID NO: 48454 - protein, 32 aa, Artificial Sequence
  Description of Artificial Sequence: Synthetic polypeptide
AEEEIRTTNPVATEQYGSVSTTTNLQQQNNDN

SEQ ID NO: 48455 - protein, 33 aa, Artificial Sequence
  Description of Artificial Sequence: Synthetic polypeptide
DEVEIRTTNPVATEQYGSVSTTNGNQNMGDNGR

SEQ ID NO: 48456 - protein, 33 aa, Artificial Sequence
  Description of Artificial Sequence: Synthetic polypeptide
AEEEIRTTNPVATEQYGSVSTTTNLQQQQGTNE

SEQ ID NO: 48457 - protein, 33 aa, Artificial Sequence
  Description of Artificial Sequence: Synthetic polypeptide
AEEEIRTTNPVATEQYGSVSTTTNLQSGNINEN

SEQ ID NO: 48458 - protein, 32 aa, Artificial Sequence
  Description of Artificial Sequence: Synthetic polypeptide
AEEEIRTTNPVATEQYGSVSTTTNLQVIGETI

SEQ ID NO: 48459 - protein, 28 aa, Artificial Sequence
  Description of Artificial Sequence: Synthetic peptide
SEEEIRCTNPIATEQYGSVSENIMQGNH

SEQ ID NO: 48460 - protein, 33 aa, Artificial Sequence
  Description of Artificial Sequence: Synthetic polypeptide
AEEEIRTTNPVATEQYGSVSTTTNLQYGNNIIN

SEQ ID NO: 48461 - protein, 28 aa, Artificial Sequence
  Description of Artificial Sequence: Synthetic peptide
SEEEIRCTNPIATEQYGSVSENCMHGNK

SEQ ID NO: 48462 - protein, 28 aa, Artificial Sequence
  Description of Artificial Sequence: Synthetic peptide
DEMEIVTTNPVATEQYGTVSTGPEFGND

SEQ ID NO: 48463 - protein, 33 aa, Artificial Sequence
  Description of Artificial Sequence: Synthetic polypeptide
AEEEIRTTNPVATEQYGSVSTTTNNLQQQGNET

SEQ ID NO: 48464 - protein, 32 aa, Artificial Sequence
  Description of Artificial Sequence: Synthetic polypeptide
DEVEIRTTNPVATEQYGSVSTTNGGNHGDNGR

SEQ ID NO: 48465 - protein, 30 aa, Artificial Sequence
  Description of Artificial Sequence: Synthetic polypeptide
DEMVIGTTNPVATEQWGSVSTDGLQRGNQP

SEQ ID NO: 48466 - protein, 28 aa, Artificial Sequence
  Description of Artificial Sequence: Synthetic peptide
SEEEIRCTNPIATEQYGSVSENAHHGNY

SEQ ID NO: 48467 - protein, 30 aa, Artificial Sequence
  Description of Artificial Sequence: Synthetic polypeptide
DEMVIRTTNPVATEQYGCVETAPQRFGSNR

SEQ ID NO: 48468 - protein, 31 aa, Artificial Sequence
  Description of Artificial Sequence: Synthetic polypeptide
SEEEIRCTNPIATEQYGSVSENELSTRVGNR

SEQ ID NO: 48469 - protein, 29 aa, Artificial Sequence
  Description of Artificial Sequence: Synthetic peptide
DENAICTTNPVATEQYGSTSTNNLIIGNT

SEQ ID NO: 48470 - protein, 33 aa, Artificial Sequence
  Description of Artificial Sequence: Synthetic polypeptide
AEEEIRTTNPVATEQYGSVSTTTNLQQGVNNVD

SEQ ID NO: 48471 - protein, 32 aa, Artificial Sequence
  Description of Artificial Sequence: Synthetic polypeptide
DEMEIVTTNPVATEQYGSVCSATDNLMFEGNR

SEQ ID NO: 48472 - protein, 33 aa, Artificial Sequence
  Description of Artificial Sequence: Synthetic polypeptide
AEEEIRTTNPVATEQYGSVSTTTNLGQGGNNTN

SEQ ID NO: 48473 - protein, 28 aa, Artificial Sequence
  Description of Artificial Sequence: Synthetic peptide
AENEIACTNPVATEQYGENSENLQRGGR

SEQ ID NO: 48474 - protein, 29 aa, Artificial Sequence
  Description of Artificial Sequence: Synthetic peptide
SEEEIRCTNPIATEQYGSVSENLGMSGNT

SEQ ID NO: 48475 - protein, 28 aa, Artificial Sequence
  Description of Artificial Sequence: Synthetic peptide
DEMEIVCTNPVATEQYGEASENLQFGGR

SEQ ID NO: 48476 - protein, 29 aa, Artificial Sequence
  Description of Artificial Sequence: Synthetic peptide
DEMEIVCTNPVATEQYGSVCSEGLMFGNR

SEQ ID NO: 48477 - protein, 32 aa, Artificial Sequence
  Description of Artificial Sequence: Synthetic polypeptide
AEEEIRTTNPVATEQYGSVSTTTNLNGNQGNV

SEQ ID NO: 48478 - protein, 31 aa, Artificial Sequence
  Description of Artificial Sequence: Synthetic polypeptide
DEMEIVCTNPVATEQYGSVCSTDNPVERGNR

SEQ ID NO: 48479 - protein, 33 aa, Artificial Sequence
  Description of Artificial Sequence: Synthetic polypeptide
AEEEIRTTNPVATEQYGSVSVTTNLQQGNQGNP

SEQ ID NO: 48480 - protein, 30 aa, Artificial Sequence
  Description of Artificial Sequence: Synthetic polypeptide
SEEEIRCTNPIATEQYGSVSENLEERGLRD

SEQ ID NO: 48481 - protein, 30 aa, Artificial Sequence
  Description of Artificial Sequence: Synthetic polypeptide
SEEEIRCTNPIATEQYGSVSENLEDREGER

SEQ ID NO: 48482 - protein, 33 aa, Artificial Sequence
  Description of Artificial Sequence: Synthetic polypeptide
AEEEIRTTNPVATEQYGSVSTTTNLNQQIGNQN

SEQ ID NO: 48483 - protein, 32 aa, Artificial Sequence
  Description of Artificial Sequence: Synthetic polypeptide
AEEEIRTTNPVATEQYGSVSTTTNLQAGGGGE

SEQ ID NO: 48484 - protein, 30 aa, Artificial Sequence
  Description of Artificial Sequence: Synthetic polypeptide
SEEEIRCTNPIATEQYGSVSENLDMGMGNR

SEQ ID NO: 48485 - protein, 32 aa, Artificial Sequence
  Description of Artificial Sequence: Synthetic polypeptide
AEEEIRTTNPVATEQYGSVSTTTNLQDEDTNG

SEQ ID NO: 48486 - protein, 31 aa, Artificial Sequence
  Description of Artificial Sequence: Synthetic polypeptide
SEEEIRCTNPIATEQYGSVSENLCMRGSNRQ

SEQ ID NO: 48487 - protein, 33 aa, Artificial Sequence
  Description of Artificial Sequence: Synthetic polypeptide
AEEEIRTTNPVATEQYGSVSTTTNLQQGENNNA

SEQ ID NO: 48488 - protein, 33 aa, Artificial Sequence
  Description of Artificial Sequence: Synthetic polypeptide
AEEEIRTTNPVATEQYGSVSTTTNLNQENGTNS

SEQ ID NO: 48489 - protein, 30 aa, Artificial Sequence
  Description of Artificial Sequence: Synthetic polypeptide
SEEEIRCTNPIATEQYGSVSGDNQDMRGNR

SEQ ID NO: 48490 - protein, 30 aa, Artificial Sequence
  Description of Artificial Sequence: Synthetic polypeptide
DEMEIRTTNPVATEQYGSISTNTQGEGSDA

SEQ ID NO: 48491 - protein, 30 aa, Artificial Sequence
  Description of Artificial Sequence: Synthetic polypeptide
SEEEIRCTNPIATEQYGSVSGEGQDMRGNR

SEQ ID NO: 48492 - protein, 32 aa, Artificial Sequence
  Description of Artificial Sequence: Synthetic polypeptide
DEYEIGTTNPVATEQYGSVSTQNGLQEEMGNT

SEQ ID NO: 48493 - protein, 31 aa, Artificial Sequence
  Description of Artificial Sequence: Synthetic polypeptide
AEEEIRTTNPVATEQYGSVSTTNNNQEEAND

SEQ ID NO: 48494 - protein, 32 aa, Artificial Sequence
  Description of Artificial Sequence: Synthetic polypeptide
DEHEIRTTNPVAYEQWGSVSTNLQLGEDNGSR

SEQ ID NO: 48495 - protein, 32 aa, Artificial Sequence
  Description of Artificial Sequence: Synthetic polypeptide
DAEEIRSTNPVATEQYGSVCSTNDGQAGNGQR

SEQ ID NO: 48496 - protein, 33 aa, Artificial Sequence
  Description of Artificial Sequence: Synthetic polypeptide
DAEEIRSTNPVATEQYGSMVSTNLQTGNGPARE

SEQ ID NO: 48497 - protein, 30 aa, Artificial Sequence
  Description of Artificial Sequence: Synthetic polypeptide
DAEEIRSTNPVATEQYGEVSTNLEARNGQQ

SEQ ID NO: 48498 - protein, 29 aa, Artificial Sequence
  Description of Artificial Sequence: Synthetic peptide
DAEEIRATNPVAYEQYGSTVATNLQNGTE

SEQ ID NO: 48499 - protein, 31 aa, Artificial Sequence
  Description of Artificial Sequence: Synthetic polypeptide
DAEEIRATNPVATEQYGSVATNLQDQGGQDR

SEQ ID NO: 48500 - protein, 31 aa, Artificial Sequence
  Description of Artificial Sequence: Synthetic polypeptide
DAEEIRATNPVATEQYGSVATNLQARGGQEM

SEQ ID NO: 48501 - protein, 30 aa, Artificial Sequence
  Description of Artificial Sequence: Synthetic polypeptide
DAEEIRATNPVATEQYGSCSTNQQERDNDN

SEQ ID NO: 48502 - protein, 32 aa, Artificial Sequence
  Description of Artificial Sequence: Synthetic polypeptide
AEEEIRTTNPVATEQYGSVSTTNNNQEIGNQQ

SEQ ID NO: 48503 - protein, 30 aa, Artificial Sequence
  Description of Artificial Sequence: Synthetic polypeptide
DAEEIRATNPVATEQYGSCSTNHQERDDNN

SEQ ID NO: 48504 - protein, 29 aa, Artificial Sequence
  Description of Artificial Sequence: Synthetic peptide
SEEEIRCTNPISTEHYGSVWSENLMRGNR

SEQ ID NO: 48505 - protein, 31 aa, Artificial Sequence
  Description of Artificial Sequence: Synthetic polypeptide
DEHEIRTTNPVAYEQWGSVSTNLQLGGDNSQ

SEQ ID NO: 48506 - protein, 28 aa, Artificial Sequence
  Description of Artificial Sequence: Synthetic peptide
SEEEIRCTNPISSEQYGSVSENLMSGNR

SEQ ID NO: 48507 - protein, 32 aa, Artificial Sequence
  Description of Artificial Sequence: Synthetic polypeptide
AEEEIRTTNPVATEQYGSVSTTNNNQAIGNDG

SEQ ID NO: 48508 - protein, 32 aa, Artificial Sequence
  Description of Artificial Sequence: Synthetic polypeptide
DEHEIRTTNPVAYEQWGSVSTNLQGNMGNTDR

SEQ ID NO: 48509 - protein, 30 aa, Artificial Sequence
  Description of Artificial Sequence: Synthetic polypeptide
AENEIACTNPVATEQYGEASSTPNLQRGNR

SEQ ID NO: 48510 - protein, 32 aa, Artificial Sequence
  Description of Artificial Sequence: Synthetic polypeptide
DAEEIRSTNPVATEQYGSVSTNQQAGNGQARE

SEQ ID NO: 48511 - protein, 30 aa, Artificial Sequence
  Description of Artificial Sequence: Synthetic polypeptide
DAGEIATTNPVATEQYGSVATNDLQNGPLR

SEQ ID NO: 48512 - protein, 31 aa, Artificial Sequence
  Description of Artificial Sequence: Synthetic polypeptide
DEHEIRTTNPVAYEQWGSVSTNLQADGNNDQ

SEQ ID NO: 48513 - protein, 31 aa, Artificial Sequence
  Description of Artificial Sequence: Synthetic polypeptide
DEHEIRTTNPVAYEQWGSVSTNLQANGDNGM

SEQ ID NO: 48514 - protein, 31 aa, Artificial Sequence
  Description of Artificial Sequence: Synthetic polypeptide
DEHEIRTTNPVAYEQWGSVSTNLQDGGGNAQ

SEQ ID NO: 48515 - protein, 29 aa, Artificial Sequence
  Description of Artificial Sequence: Synthetic peptide
DAEEIRTTNPVGTEQWGTVSTNLQHGDAL

SEQ ID NO: 48516 - protein, 31 aa, Artificial Sequence
  Description of Artificial Sequence: Synthetic polypeptide
DEHEIRTTNPVAYEQWGSVSTNLQGDHGNEA

SEQ ID NO: 48517 - protein, 32 aa, Artificial Sequence
  Description of Artificial Sequence: Synthetic polypeptide
DAEEIRTTNPVAYEQYGSVTSTNLQNEGTDRQ

SEQ ID NO: 48518 - protein, 30 aa, Artificial Sequence
  Description of Artificial Sequence: Synthetic polypeptide
DEHEIRTTNPVAYEQWGSVSTNLQMGGDQS

SEQ ID NO: 48519 - protein, 31 aa, Artificial Sequence
  Description of Artificial Sequence: Synthetic polypeptide
DEHEIRTTNPVAYEQWGSVSTNLQGEGGSGR

SEQ ID NO: 48520 - protein, 32 aa, Artificial Sequence
  Description of Artificial Sequence: Synthetic polypeptide
DEHEIRTTNPVAYEQWGSVSTNLQGGEQGNER

SEQ ID NO: 48521 - protein, 31 aa, Artificial Sequence
  Description of Artificial Sequence: Synthetic polypeptide
DEHEIRTTNPVAYEQWGSVSTNLQGGGDNNS

SEQ ID NO: 48522 - protein, 30 aa, Artificial Sequence
  Description of Artificial Sequence: Synthetic polypeptide
AENEIACTNPVATEQYGEASSTENLQRGNR

SEQ ID NO: 48523 - protein, 30 aa, Artificial Sequence
  Description of Artificial Sequence: Synthetic polypeptide
DEYEIRTTNPVATEQYGCVCSTELQNGSEQ

SEQ ID NO: 48524 - protein, 28 aa, Artificial Sequence
  Description of Artificial Sequence: Synthetic peptide
DAEEIRTTNPFATEQYGSVDTGDDPGND

SEQ ID NO: 48525 - protein, 29 aa, Artificial Sequence
  Description of Artificial Sequence: Synthetic peptide
SEEEIRCTNPISTEQYGSVSENLQQQGNH

SEQ ID NO: 48526 - protein, 31 aa, Artificial Sequence
  Description of Artificial Sequence: Synthetic polypeptide
DEHEIRTTNPVAYEQWGSVSTNLQGNEGDMR

SEQ ID NO: 48527 - protein, 31 aa, Artificial Sequence
  Description of Artificial Sequence: Synthetic polypeptide
DEHEIRTTNPVAYEQWGSVSTNLQGEHGGGR

SEQ ID NO: 48528 - protein, 28 aa, Artificial Sequence
  Description of Artificial Sequence: Synthetic peptide
SEEEIRCTNPISSEQYGSVSCNLMSGNR

SEQ ID NO: 48529 - protein, 31 aa, Artificial Sequence
  Description of Artificial Sequence: Synthetic polypeptide
DEHEIRTTNPVAYEQWGSVSTNLQNGGDNDD

SEQ ID NO: 48530 - protein, 31 aa, Artificial Sequence
  Description of Artificial Sequence: Synthetic polypeptide
DEHEIRTTNPVAYEQWGSVSTNLQNGQDNDA

SEQ ID NO: 48531 - protein, 28 aa, Artificial Sequence
  Description of Artificial Sequence: Synthetic peptide
AENEIACTNPVATEQYGEASTNLERGER

SEQ ID NO: 48532 - protein, 31 aa, Artificial Sequence
  Description of Artificial Sequence: Synthetic polypeptide
DEHEIRTTNPVAYEQYGNVSTNLQQGGNGNA

SEQ ID NO: 48533 - protein, 30 aa, Artificial Sequence
  Description of Artificial Sequence: Synthetic polypeptide
DEHEIRTTNPVAYEQYGNVSWQLQENRGNE

SEQ ID NO: 48534 - protein, 31 aa, Artificial Sequence
  Description of Artificial Sequence: Synthetic polypeptide
AEEEIRTTNPVATEQYGSVSTTNNNQQTANL

SEQ ID NO: 48535 - protein, 32 aa, Artificial Sequence
  Description of Artificial Sequence: Synthetic polypeptide
DEHEIRTTNPVAYEQYGSVPSQNLSGRNGNNR

SEQ ID NO: 48536 - protein, 32 aa, Artificial Sequence
  Description of Artificial Sequence: Synthetic polypeptide
DEHEIRTTNPVAYEQYGSVSCQNLSTRNGHNR

SEQ ID NO: 48537 - protein, 32 aa, Artificial Sequence
  Description of Artificial Sequence: Synthetic polypeptide
DEHEIRTTNPVAYEQYGSVSCTNLSHNNGGNR

SEQ ID NO: 48538 - protein, 29 aa, Artificial Sequence
  Description of Artificial Sequence: Synthetic peptide
SEEEIRCTNPIAWEQYGSVSENLMFGSNR

SEQ ID NO: 48539 - protein, 32 aa, Artificial Sequence
  Description of Artificial Sequence: Synthetic polypeptide
DEHEIRTTNPVAYEQYGSVSQNLSTRTNGNNR

SEQ ID NO: 48540 - protein, 32 aa, Artificial Sequence
  Description of Artificial Sequence: Synthetic polypeptide
AEEEIRTTNPVATEQYGSVSTTNNQEQGGNFN

SEQ ID NO: 48541 - protein, 31 aa, Artificial Sequence
  Description of Artificial Sequence: Synthetic polypeptide
DEHEIRTTNPVAYEQYGSVVSTDNLGHQGER

SEQ ID NO: 48542 - protein, 31 aa, Artificial Sequence
  Description of Artificial Sequence: Synthetic polypeptide
DEHEIRTTNPVAYEQYGSVVSTNLGGNQGER

SEQ ID NO: 48543 - protein, 31 aa, Artificial Sequence
  Description of Artificial Sequence: Synthetic polypeptide
DEHEIRTTNPVAYEQYGTVSTNLQGDGNGQS

SEQ ID NO: 48544 - protein, 31 aa, Artificial Sequence
  Description of Artificial Sequence: Synthetic polypeptide
DEHEIRTTNPVAYEQYGTVSTNLQGDHGNTS

SEQ ID NO: 48545 - protein, 31 aa, Artificial Sequence
  Description of Artificial Sequence: Synthetic polypeptide
DEHEIRTTNPVAYEQYGTVSTNLQGDQGNPN

SEQ ID NO: 48546 - protein, 30 aa, Artificial Sequence
  Description of Artificial Sequence: Synthetic polypeptide
SEEEIRCTNPIATEQYGYVSEMNLIRGNDR

SEQ ID NO: 48547 - protein, 31 aa, Artificial Sequence
  Description of Artificial Sequence: Synthetic polypeptide
DEYEICTVNPVATEQYGSVSTNLQFGEGNVT

SEQ ID NO: 48548 - protein, 31 aa, Artificial Sequence
  Description of Artificial Sequence: Synthetic polypeptide
DEHEIRTTNPVAYEQWGSVSTNLNQGEGGER

SEQ ID NO: 48549 - protein, 32 aa, Artificial Sequence
  Description of Artificial Sequence: Synthetic polypeptide
AEEEIRTTNPVATEQYGSVSVTTNNLTTGNEG

SEQ ID NO: 48550 - protein, 29 aa, Artificial Sequence
  Description of Artificial Sequence: Synthetic peptide
SEEEIRCTNPIAYEQYGSVSEHLSMRGNR

SEQ ID NO: 48551 - protein, 32 aa, Artificial Sequence
  Description of Artificial Sequence: Synthetic polypeptide
AEEEIRTTNPVATEQYGSVSTTNNNQNIGNGQ

SEQ ID NO: 48552 - protein, 29 aa, Artificial Sequence
  Description of Artificial Sequence: Synthetic peptide
DEYEIGTTNPVATEQYGSVSTGGNEGGNT

SEQ ID NO: 48553 - protein, 29 aa, Artificial Sequence
  Description of Artificial Sequence: Synthetic peptide
DEYEIGTTNPVATEQYGSVSTGGMGEGNT

SEQ ID NO: 48554 - protein, 28 aa, Artificial Sequence
  Description of Artificial Sequence: Synthetic peptide
SEEEIRCTNPICTEQYGSVSENQMFGNR

SEQ ID NO: 48555 - protein, 32 aa, Artificial Sequence
  Description of Artificial Sequence: Synthetic polypeptide
AEEEIRTTNPVATEQYGSVSTTNNNQQIGNTQ

SEQ ID NO: 48556 - protein, 28 aa, Artificial Sequence
  Description of Artificial Sequence: Synthetic peptide
QEEEIRTTNPVATEQYGEASENCMRENK

SEQ ID NO: 48557 - protein, 32 aa, Artificial Sequence
  Description of Artificial Sequence: Synthetic polypeptide
AEEEIRTTNPVATEQYGSVSTTNNNQQIGNTT

SEQ ID NO: 48558 - protein, 28 aa, Artificial Sequence
  Description of Artificial Sequence: Synthetic peptide
SEEEIRCTNPIAYEQYGSVAENLMRGNM

SEQ ID NO: 48559 - protein, 28 aa, Artificial Sequence
  Description of Artificial Sequence: Synthetic peptide
SEEEIRCTNPICTEQYGSVSENLMSGNQ

SEQ ID NO: 48560 - protein, 28 aa, Artificial Sequence
  Description of Artificial Sequence: Synthetic peptide
SEEEIRCTNPIAYEQYGSWSENLERGNA

SEQ ID NO: 48561 - protein, 30 aa, Artificial Sequence
  Description of Artificial Sequence: Synthetic polypeptide
DEHEIRTTNPVAYEQWGTVSTNHGQDGNGR

SEQ ID NO: 48562 - protein, 32 aa, Artificial Sequence
  Description of Artificial Sequence: Synthetic polypeptide
AEEEIRTTNPVATEQYGSVSTTNNNQQNIGNG

SEQ ID NO: 48563 - protein, 28 aa, Artificial Sequence
  Description of Artificial Sequence: Synthetic peptide
QEEEIRTTNPVATEQYGEASEVLQREEK

SEQ ID NO: 48564 - protein, 28 aa, Artificial Sequence
  Description of Artificial Sequence: Synthetic peptide
SEEEIRCTNPIAYEQYGSVSENLMDGNQ

SEQ ID NO: 48565 - protein, 30 aa, Artificial Sequence
  Description of Artificial Sequence: Synthetic polypeptide
DEYEIGTTNPVATEQYGSVSTGDQMEGGNT

SEQ ID NO: 48566 - protein, 30 aa, Artificial Sequence
  Description of Artificial Sequence: Synthetic polypeptide
DEHEIRTTNPVAYEQWGVVSTNLQDGGNPN

SEQ ID NO: 48567 - protein, 28 aa, Artificial Sequence
  Description of Artificial Sequence: Synthetic peptide
SEEEIRCTNPICTEQYGSVSDNLMSGNQ

SEQ ID NO: 48568 - protein, 30 aa, Artificial Sequence
  Description of Artificial Sequence: Synthetic polypeptide
DEHEIRTTNPVAYEQYGTVSTNNQAGGNDS

SEQ ID NO: 48569 - protein, 30 aa, Artificial Sequence
  Description of Artificial Sequence: Synthetic polypeptide
DAGEIATTNPVATEQYGSVSTNDNDQLGMR

SEQ ID NO: 48570 - protein, 29 aa, Artificial Sequence
  Description of Artificial Sequence: Synthetic peptide
SEEEIRCTNPTATEQYGSVAENLMGDGNR

SEQ ID NO: 48571 - protein, 32 aa, Artificial Sequence
  Description of Artificial Sequence: Synthetic polypeptide
DEHEIRTTNPVATEQYGVVSTNLQGNQGNDNQ

SEQ ID NO: 48572 - protein, 30 aa, Artificial Sequence
  Description of Artificial Sequence: Synthetic polypeptide
DEHEIRTTNPVATEQYGVVSTPAVNPEGNR

SEQ ID NO: 48573 - protein, 31 aa, Artificial Sequence
  Description of Artificial Sequence: Synthetic polypeptide
DEHEIRTTNPVATEQYGVVSTTNGGQGEGAR

SEQ ID NO: 48574 - protein, 29 aa, Artificial Sequence
  Description of Artificial Sequence: Synthetic peptide
DCAEIATTNPVATEQYGCCSTVLDQHGNR

SEQ ID NO: 48575 - protein, 31 aa, Artificial Sequence
  Description of Artificial Sequence: Synthetic polypeptide
DEHEIRTTNPVATESYGSVSTNNGGDLGGNR

SEQ ID NO: 48576 - protein, 31 aa, Artificial Sequence
  Description of Artificial Sequence: Synthetic polypeptide
SEEEIRCTNPVATEQYGSVATNLQDPGNAEE

SEQ ID NO: 48577 - protein, 32 aa, Artificial Sequence
  Description of Artificial Sequence: Synthetic polypeptide
DEHEIRTTNPVATETYGSVSTNLQGNEGNDSK

SEQ ID NO: 48578 - protein, 31 aa, Artificial Sequence
  Description of Artificial Sequence: Synthetic polypeptide
DEHEIRTTNPVATETYGSVSTNLQNNGDEGK

SEQ ID NO: 48579 - protein, 30 aa, Artificial Sequence
  Description of Artificial Sequence: Synthetic polypeptide
SEEEIRCTNPVATEQYGSVATNLENSGENY

SEQ ID NO: 48580 - protein, 31 aa, Artificial Sequence
  Description of Artificial Sequence: Synthetic polypeptide
DEHEIRTTNPVATEWWGSVSTNLQLGGDNGS

SEQ ID NO: 48581 - protein, 31 aa, Artificial Sequence
  Description of Artificial Sequence: Synthetic polypeptide
DEHEIRTTNPVATEWYGVVSTNLQLGGDNDS

SEQ ID NO: 48582 - protein, 30 aa, Artificial Sequence
  Description of Artificial Sequence: Synthetic polypeptide
SEEEIRCTNPVATEQYGNVSETIMSRVGNR

SEQ ID NO: 48583 - protein, 28 aa, Artificial Sequence
  Description of Artificial Sequence: Synthetic peptide
SEEEIRCTNPVATEQYGEVSEVLMHGER

SEQ ID NO: 48584 - protein, 29 aa, Artificial Sequence
  Description of Artificial Sequence: Synthetic peptide
DEHEIRTTNPVAYDQYGSVATQLQGGNDS

SEQ ID NO: 48585 - protein, 33 aa, Artificial Sequence
  Description of Artificial Sequence: Synthetic polypeptide
AEEEIRTTNPVATEQYGSVSTTNNNLQNQIGNG

SEQ ID NO: 48586 - protein, 32 aa, Artificial Sequence
  Description of Artificial Sequence: Synthetic polypeptide
DEHEIRTTNPVATEQYGVVSTNLQGNQGDPNM

SEQ ID NO: 48587 - protein, 31 aa, Artificial Sequence
  Description of Artificial Sequence: Synthetic polypeptide
DEHEIRTTNPVATEQYGVVSTNLQGNDQNNH

SEQ ID NO: 48588 - protein, 29 aa, Artificial Sequence
  Description of Artificial Sequence: Synthetic peptide
DCEEIRATNPVATEQWGSSSTNMQDGNND

SEQ ID NO: 48589 - protein, 31 aa, Artificial Sequence
  Description of Artificial Sequence: Synthetic polypeptide
DEHEIRTTNPVATEQYGVVSTNLNHDGDNGQ

SEQ ID NO: 48590 - protein, 32 aa, Artificial Sequence
  Description of Artificial Sequence: Synthetic polypeptide
DEHEIRTTNPVATEQYGSVSTTQGQGMGNNDR

SEQ ID NO: 48591 - protein, 32 aa, Artificial Sequence
  Description of Artificial Sequence: Synthetic polypeptide
DEHEIRTTNPVATEQYGSVSTTQGQNEGNNDR

SEQ ID NO: 48592 - protein, 31 aa, Artificial Sequence
  Description of Artificial Sequence: Synthetic polypeptide
DCEEIRSTNPVATEQYGSVSTNLIIARNTQR

SEQ ID NO: 48593 - protein, 29 aa, Artificial Sequence
  Description of Artificial Sequence: Synthetic peptide
DCEEIRSTNPVATEQYGSSTTNMQGEGNN

SEQ ID NO: 48594 - protein, 30 aa, Artificial Sequence
  Description of Artificial Sequence: Synthetic polypeptide
SEEEIRCTNPVATEQYGSVSENEPMRGENG

SEQ ID NO: 48595 - protein, 30 aa, Artificial Sequence
  Description of Artificial Sequence: Synthetic polypeptide
SEEEIRCTNPVATEQYGSVSEDNPMREGND

SEQ ID NO: 48596 - protein, 31 aa, Artificial Sequence
  Description of Artificial Sequence: Synthetic polypeptide
DEHEIRTTNPVATEQYGSVSYQNLGENMNSR

SEQ ID NO: 48597 - protein, 28 aa, Artificial Sequence
  Description of Artificial Sequence: Synthetic peptide
AENEIACTNPVATEQYGEASQNLQRGGR

SEQ ID NO: 48598 - protein, 31 aa, Artificial Sequence
  Description of Artificial Sequence: Synthetic polypeptide
SEEEIRCTNPVATEQYGSVSCNEPQDRGENG

SEQ ID NO: 48599 - protein, 31 aa, Artificial Sequence
  Description of Artificial Sequence: Synthetic polypeptide
DEHEIRTTNPVATEQYGSVVSTGDSQGGDSR

SEQ ID NO: 48600 - protein, 32 aa, Artificial Sequence
  Description of Artificial Sequence: Synthetic polypeptide
DEHEIRTTNPVATEQYGSVVSTNLDGDEGNTD

SEQ ID NO: 48601 - protein, 33 aa, Artificial Sequence
  Description of Artificial Sequence: Synthetic polypeptide
DEHEIRTTNPVATEQYGSVVSTNLQNQAGDNSS

SEQ ID NO: 48602 - protein, 31 aa, Artificial Sequence
  Description of Artificial Sequence: Synthetic polypeptide
DEHEIRTTNPVATEQYGSVVTALTMGVGNGR

SEQ ID NO: 48603 - protein, 31 aa, Artificial Sequence
  Description of Artificial Sequence: Synthetic polypeptide
SEEEIRCTNPVATEQYGSVATNLQRQDNDID

SEQ ID NO: 48604 - protein, 33 aa, Artificial Sequence
  Description of Artificial Sequence: Synthetic polypeptide
DEHEIRTTNPVATEQYGSVYSTENLQMPGDLRT

SEQ ID NO: 48605 - protein, 28 aa, Artificial Sequence
  Description of Artificial Sequence: Synthetic peptide
DCEEIRATNPVAYEQWGSSSTNMQHGNA

SEQ ID NO: 48606 - protein, 33 aa, Artificial Sequence
  Description of Artificial Sequence: Synthetic polypeptide
DEHEIRTTNPVATEQYGSVVSTENLGHDGDNNR

SEQ ID NO: 48607 - protein, 28 aa, Artificial Sequence
  Description of Artificial Sequence: Synthetic peptide
SEEEIRCTNPVATEQYGEASENLMRENK

SEQ ID NO: 48608 - protein, 28 aa, Artificial Sequence
  Description of Artificial Sequence: Synthetic peptide
SEEEIRCTNPVATEQYGEAPEVLMRGNR

SEQ ID NO: 48609 - protein, 32 aa, Artificial Sequence
  Description of Artificial Sequence: Synthetic polypeptide
AEEEIRTTNPVATEQYGSVSVTTNNQEQGNNS

SEQ ID NO: 48610 - protein, 28 aa, Artificial Sequence
  Description of Artificial Sequence: Synthetic peptide
SEEEIRCTNPVATEQWGDVSEIEMRGNR

SEQ ID NO: 48611 - protein, 33 aa, Artificial Sequence
  Description of Artificial Sequence: Synthetic polypeptide
AEEEIRTTNPVATEQYGSVSTTNNNLQQIGNGE

SEQ ID NO: 48612 - protein, 30 aa, Artificial Sequence
  Description of Artificial Sequence: Synthetic polypeptide
DEHEIRTTNPVAYEQWGSVATNLQGEGDSR

SEQ ID NO: 48613 - protein, 31 aa, Artificial Sequence
  Description of Artificial Sequence: Synthetic polypeptide
DEYEIRTTNPVATEQYGSVISTNGQGEGGED

SEQ ID NO: 48614 - protein, 28 aa, Artificial Sequence
  Description of Artificial Sequence: Synthetic peptide
AENEIACTNPVATEQYGEASSNLQRGGR

SEQ ID NO: 48615 - protein, 29 aa, Artificial Sequence
  Description of Artificial Sequence: Synthetic peptide
SEEEIRCTNPVATEAYGSVATNLQEGDEE

SEQ ID NO: 48616 - protein, 29 aa, Artificial Sequence
  Description of Artificial Sequence: Synthetic peptide
SEEEIRCTNPTAYEQYGSVSENLMRGNEQ

SEQ ID NO: 48617 - protein, 32 aa, Artificial Sequence
  Description of Artificial Sequence: Synthetic polypeptide
SEEEIRCTNPVATEQWGSVSCINLPQREGENR

SEQ ID NO: 48618 - protein, 31 aa, Artificial Sequence
  Description of Artificial Sequence: Synthetic polypeptide
DEYEIRTTNPVATEQYGSVISTNGQDEGQGD

SEQ ID NO: 48619 - protein, 29 aa, Artificial Sequence
  Description of Artificial Sequence: Synthetic peptide
SEEEIRCTNPTATEQYGSVSENLMDGNGQ

SEQ ID NO: 48620 - protein, 29 aa, Artificial Sequence
  Description of Artificial Sequence: Synthetic peptide
SEEEIRCTNPTATEQYGSVAENLMRGNMD

SEQ ID NO: 48621 - protein, 29 aa, Artificial Sequence
  Description of Artificial Sequence: Synthetic peptide
SEEEIRCTNPTATEQYGSVAENLMRGNES

SEQ ID NO: 48622 - protein, 29 aa, Artificial Sequence
  Description of Artificial Sequence: Synthetic peptide
SEEEIRCTNPTATEQYGSVAENLMRGGNA

SEQ ID NO: 48623 - protein, 32 aa, Artificial Sequence
  Description of Artificial Sequence: Synthetic polypeptide
DEHEIRTTNPVAYEQWGSVSTNLEQPGGENSR

SEQ ID NO: 48624 - protein, 30 aa, Artificial Sequence
  Description of Artificial Sequence: Synthetic polypeptide
DAGEIATTNPVATEQYGSVSWNDLQEMGMR

SEQ ID NO: 48625 - protein, 29 aa, Artificial Sequence
  Description of Artificial Sequence: Synthetic peptide
SEEEIRCTNPTATEQYGSVAENLMRGEGR

SEQ ID NO: 48626 - protein, 33 aa, Artificial Sequence
  Description of Artificial Sequence: Synthetic polypeptide
AEEEIRTTNPVATEQYGSVSTTNNNLQTGNISG

SEQ ID NO: 48627 - protein, 31 aa, Artificial Sequence
  Description of Artificial Sequence: Synthetic polypeptide
DEYEIRTTNPVATEQYGSVISTNGQAEGGDT

SEQ ID NO: 48628 - protein, 30 aa, Artificial Sequence
  Description of Artificial Sequence: Synthetic polypeptide
SEEEIRCTNPVATEQWGSVSCNEMREGENR

SEQ ID NO: 48629 - protein, 33 aa, Artificial Sequence
  Description of Artificial Sequence: Synthetic polypeptide
DEHEIRTTNPVAYEIYGSVSATNLSQRDGENTR

SEQ ID NO: 48630 - protein, 32 aa, Artificial Sequence
  Description of Artificial Sequence: Synthetic polypeptide
DAPEIRTTNPVATEQYGSVSTVNTLQQGVMRN

SEQ ID NO: 48631 - protein, 28 aa, Artificial Sequence
  Description of Artificial Sequence: Synthetic peptide
AENEIACTNPVATEQYGEASRNLQRGGR

SEQ ID NO: 48632 - protein, 30 aa, Artificial Sequence
  Description of Artificial Sequence: Synthetic polypeptide
DEHEIRTTNPVAYECYGSVTTNLQGGDNEE

SEQ ID NO: 48633 - protein, 33 aa, Artificial Sequence
  Description of Artificial Sequence: Synthetic polypeptide
AEEEIRTTNPVATEQYGSVSTTNNNLQQGENNM

SEQ ID NO: 48634 - protein, 30 aa, Artificial Sequence
  Description of Artificial Sequence: Synthetic polypeptide
SEEEIRCTNPVATEQYGDVSENLMNRAENR

SEQ ID NO: 48635 - protein, 31 aa, Artificial Sequence
  Description of Artificial Sequence: Synthetic polypeptide
DEYEIRTTNPVATEQYGSVSTDLVQRTSDQD

SEQ ID NO: 48636 - protein, 28 aa, Artificial Sequence
  Description of Artificial Sequence: Synthetic peptide
SEEEIRCTNPVATEQWGSVSENEMRGDA

SEQ ID NO: 48637 - protein, 30 aa, Artificial Sequence
  Description of Artificial Sequence: Synthetic polypeptide
DEHEIRTTNPVAYEPYGEVSTNLSQGGGSR

SEQ ID NO: 48638 - protein, 30 aa, Artificial Sequence
  Description of Artificial Sequence: Synthetic polypeptide
DEHEIRTTNPVAYEHWGSVSTNLQDGDNQH

SEQ ID NO: 48639 - protein, 31 aa, Artificial Sequence
  Description of Artificial Sequence: Synthetic polypeptide
DAGEIRTTNPVATEQYGSVSYTNPWQNGEIR

SEQ ID NO: 48640 - protein, 30 aa, Artificial Sequence
  Description of Artificial Sequence: Synthetic polypeptide
DAGEIRTTNPVATEQYGSVSTNNGDDLGMR

SEQ ID NO: 48641 - protein, 31 aa, Artificial Sequence
  Description of Artificial Sequence: Synthetic polypeptide
DAGEIRTTNPVATEQYGSVSTNDGQDTGDMR

SEQ ID NO: 48642 - protein, 32 aa, Artificial Sequence
  Description of Artificial Sequence: Synthetic polypeptide
SEEEIRCTNPVATEQWGSVSEINLPQREGENR

SEQ ID NO: 48643 - protein, 29 aa, Artificial Sequence
  Description of Artificial Sequence: Synthetic peptide
DAGEIATTNPVAYEQYGSVSTNGLQLHMR

SEQ ID NO: 48644 - protein, 30 aa, Artificial Sequence
  Description of Artificial Sequence: Synthetic polypeptide
DEHEIRTTNPVAYEHYGSVATNLQDGNNDG

SEQ ID NO: 48645 - protein, 30 aa, Artificial Sequence
  Description of Artificial Sequence: Synthetic polypeptide
DEHEIRTTNPVAYEHYGSVSTNMQDGNNDD

SEQ ID NO: 48646 - protein, 32 aa, Artificial Sequence
  Description of Artificial Sequence: Synthetic polypeptide
DEYEIRTTNPVATEQYGSVSTDLTQRGTEDDG

SEQ ID NO: 48647 - protein, 33 aa, Artificial Sequence
  Description of Artificial Sequence: Synthetic polypeptide
DEVEIRTTNPVATEQYGSVSTPNLQFNGGENED

SEQ ID NO: 48648 - protein, 31 aa, Artificial Sequence
  Description of Artificial Sequence: Synthetic polypeptide
SEEEIRCTNPIATEQYGTVSMENLQMRNGNR

SEQ ID NO: 48649 - protein, 30 aa, Artificial Sequence
  Description of Artificial Sequence: Synthetic polypeptide
DEHEIRTTNPVAYERYGEVSTNLQEGGDNG

SEQ ID NO: 48650 - protein, 30 aa, Artificial Sequence
  Description of Artificial Sequence: Synthetic polypeptide
DAEEIATTNPVATEQWGSVTSTALQRGDTA

SEQ ID NO: 48651 - protein, 30 aa, Artificial Sequence
  Description of Artificial Sequence: Synthetic polypeptide
DAEEIATTNPVATEQWGSVTSTALQRDGDL

SEQ ID NO: 48652 - protein, 28 aa, Artificial Sequence
  Description of Artificial Sequence: Synthetic peptide
AENEIACTNPVATEQYGEFSFNLQRGGR

SEQ ID NO: 48653 - protein, 30 aa, Artificial Sequence
  Description of Artificial Sequence: Synthetic polypeptide
DEMEIRTTNPVATEQYGCTSTNHQRFGDQS

SEQ ID NO: 48654 - protein, 29 aa, Artificial Sequence
  Description of Artificial Sequence: Synthetic peptide
DEMEIRTTNPVATEQYGCVATVQLERGDE

SEQ ID NO: 48655 - protein, 32 aa, Artificial Sequence
  Description of Artificial Sequence: Synthetic polypeptide
DEVEIRTTNPVATEQYGTVSTNLQGEDGGNGS

SEQ ID NO: 48656 - protein, 32 aa, Artificial Sequence
  Description of Artificial Sequence: Synthetic polypeptide
DEMEIRTTNPVATEQYGCVCSTELQRFGSNII

SEQ ID NO: 48657 - protein, 31 aa, Artificial Sequence
  Description of Artificial Sequence: Synthetic polypeptide
DEMEIRTTNPVATEQYGCVCSTNLQNFGSDQ

SEQ ID NO: 48658 - protein, 30 aa, Artificial Sequence
  Description of Artificial Sequence: Synthetic polypeptide
SEEEIRCTNPIATEQYGSVSSENGNRGNPR

SEQ ID NO: 48659 - protein, 30 aa, Artificial Sequence
  Description of Artificial Sequence: Synthetic polypeptide
SEEEIRCTNPIATEQYGSVSSENGMRGNPR

SEQ ID NO: 48660 - protein, 30 aa, Artificial Sequence
  Description of Artificial Sequence: Synthetic polypeptide
SEEEIRCTNPIATEQYGSVSSEALMMRGNR

SEQ ID NO: 48661 - protein, 30 aa, Artificial Sequence
  Description of Artificial Sequence: Synthetic polypeptide
DEMEIRTTNPVATEQYGCVSTEHQNFGSNA

SEQ ID NO: 48662 - protein, 31 aa, Artificial Sequence
  Description of Artificial Sequence: Synthetic polypeptide
DEMEIRTTNPVATEQYGCVSTELQRGSDQDG

SEQ ID NO: 48663 - protein, 30 aa, Artificial Sequence
  Description of Artificial Sequence: Synthetic polypeptide
SEEEIRCTNPIATEQYGSVSQEWLMRGNFR

SEQ ID NO: 48664 - protein, 30 aa, Artificial Sequence
  Description of Artificial Sequence: Synthetic polypeptide
SEEEIRCTNPIATEQYGSVSNENWMERGNR

SEQ ID NO: 48665 - protein, 30 aa, Artificial Sequence
  Description of Artificial Sequence: Synthetic polypeptide
DAEEIATTNPVATEQWGSVTSTDLQDGGRM

SEQ ID NO: 48666 - protein, 31 aa, Artificial Sequence
  Description of Artificial Sequence: Synthetic polypeptide
DAEEIATTNPVATEQWGSVTSTDLQRGGMTR

SEQ ID NO: 48667 - protein, 30 aa, Artificial Sequence
  Description of Artificial Sequence: Synthetic polypeptide
DEMEIRTTNPVATEQYGCTCSTNLQHGDQF

SEQ ID NO: 48668 - protein, 30 aa, Artificial Sequence
  Description of Artificial Sequence: Synthetic polypeptide
DAEEIATTNPVATEQWGSVTSTGLDQGGER

SEQ ID NO: 48669 - protein, 30 aa, Artificial Sequence
  Description of Artificial Sequence: Synthetic polypeptide
SEEEIRCTNPIATEQYGSVSSNLMESGSNR

SEQ ID NO: 48670 - protein, 29 aa, Artificial Sequence
  Description of Artificial Sequence: Synthetic peptide
SEEEIRCTNPIATEQYGSVSSNLISGSNQ

SEQ ID NO: 48671 - protein, 31 aa, Artificial Sequence
  Description of Artificial Sequence: Synthetic polypeptide
DEVEIRTTNPVAYEQWGSVSTNLQQMGDNGT

SEQ ID NO: 48672 - protein, 30 aa, Artificial Sequence
  Description of Artificial Sequence: Synthetic polypeptide
DEMEIRTTNPVATDQYGCVSTVLERGNNPE

SEQ ID NO: 48673 - protein, 30 aa, Artificial Sequence
  Description of Artificial Sequence: Synthetic polypeptide
DEVEIRTTNPVAYECWGSVSTNLQEGGNGE

SEQ ID NO: 48674 - protein, 30 aa, Artificial Sequence
  Description of Artificial Sequence: Synthetic polypeptide
DAEEIATTNPVATEQYGSVATNLQESNDDL

SEQ ID NO: 48675 - protein, 32 aa, Artificial Sequence
  Description of Artificial Sequence: Synthetic polypeptide
DEVEIRTTNPVATEWYGSVSTGNGLQDGGTNE

SEQ ID NO: 48676 - protein, 31 aa, Artificial Sequence
  Description of Artificial Sequence: Synthetic polypeptide
SEEEIRCTNPIATEQYGSVSINLSMRGGNNR

SEQ ID NO: 48677 - protein, 30 aa, Artificial Sequence
  Description of Artificial Sequence: Synthetic polypeptide
SEEEIRCTNPIATEQYGSVSSENTLMRGNE

SEQ ID NO: 48678 - protein, 28 aa, Artificial Sequence
  Description of Artificial Sequence: Synthetic peptide
QEEEIRTTNPVATEQYGSASEVCQREEK

SEQ ID NO: 48679 - protein, 28 aa, Artificial Sequence
  Description of Artificial Sequence: Synthetic peptide
AENEIACTNPVATEQYGEFSENLQRGGR

SEQ ID NO: 48680 - protein, 32 aa, Artificial Sequence
  Description of Artificial Sequence: Synthetic polypeptide
AEEEIRTTNPVATEQYGSVSTTNNQQQQGDND

SEQ ID NO: 48681 - protein, 31 aa, Artificial Sequence
  Description of Artificial Sequence: Synthetic polypeptide
DEMEIRTTNPVATEQYGCISTGNTQREGSDR

SEQ ID NO: 48682 - protein, 31 aa, Artificial Sequence
  Description of Artificial Sequence: Synthetic polypeptide
DEMEIRTTNPVATEQYGCISTNTQRFGSDRA

SEQ ID NO: 48683 - protein, 30 aa, Artificial Sequence
  Description of Artificial Sequence: Synthetic polypeptide
DAEEIATTNPVATEQWGSVTSTGLQEQGER

SEQ ID NO: 48684 - protein, 31 aa, Artificial Sequence
  Description of Artificial Sequence: Synthetic polypeptide
SEEEIRCTNPIATEQYGSVSSENLMRGMNPR

SEQ ID NO: 48685 - protein, 28 aa, Artificial Sequence
  Description of Artificial Sequence: Synthetic peptide
AENEIACTNPVATEQYGECSENLQRGGR

SEQ ID NO: 48686 - protein, 31 aa, Artificial Sequence
  Description of Artificial Sequence: Synthetic polypeptide
DEMEIRTTNPVATEQYGCVSTNFLERFGVEQ

SEQ ID NO: 48687 - protein, 32 aa, Artificial Sequence
  Description of Artificial Sequence: Synthetic polypeptide
AEEEIRTTNPVATEQYGSVSTTNNQQQTGNPE

SEQ ID NO: 48688 - protein, 30 aa, Artificial Sequence
  Description of Artificial Sequence: Synthetic polypeptide
DEMEIRTTNPVATEQYGCVSTNLENDDNIF

SEQ ID NO: 48689 - protein, 28 aa, Artificial Sequence
  Description of Artificial Sequence: Synthetic peptide
DAEEIATTNPVATAQWGSVSANPDRGNN

SEQ ID NO: 48690 - protein, 31 aa, Artificial Sequence
  Description of Artificial Sequence: Synthetic polypeptide
AEEEIRTTNPVATEQYGSVSTTNNTGTVGNA

SEQ ID NO: 48691 - protein, 31 aa, Artificial Sequence
  Description of Artificial Sequence: Synthetic polypeptide
DEMEIRTTNPVATEQYGQSVSTNHQNFGSEQ

SEQ ID NO: 48692 - protein, 30 aa, Artificial Sequence
  Description of Artificial Sequence: Synthetic polypeptide
DEMEIRTTNPVATEQYGSCSANLNQGNEND

SEQ ID NO: 48693 - protein, 28 aa, Artificial Sequence
  Description of Artificial Sequence: Synthetic peptide
AENEIACTNPVATEQYGEHSENLQRGGR

SEQ ID NO: 48694 - protein, 30 aa, Artificial Sequence
  Description of Artificial Sequence: Synthetic polypeptide
DEVEIRTTNPVATEQYGSVYMNLQDRQIDI

SEQ ID NO: 48695 - protein, 29 aa, Artificial Sequence
  Description of Artificial Sequence: Synthetic peptide
SEEEIRCTNPIATEQYGSVSGENDMRGNT

SEQ ID NO: 48696 - protein, 30 aa, Artificial Sequence
  Description of Artificial Sequence: Synthetic polypeptide
DEMEIRTTNPVATEQYGCVSWNLFNNSNRM

SEQ ID NO: 48697 - protein, 30 aa, Artificial Sequence
  Description of Artificial Sequence: Synthetic polypeptide
QEEEIRTTNPVATEQYGSVATADNQNGDFR

SEQ ID NO: 48698 - protein, 30 aa, Artificial Sequence
  Description of Artificial Sequence: Synthetic polypeptide
DAEEIASTNPVATEQYGSVATNLQARGGED

SEQ ID NO: 48699 - protein, 30 aa, Artificial Sequence
  Description of Artificial Sequence: Synthetic polypeptide
DAEEIASTNPVATEQYGEVSTNLQADNGQR

SEQ ID NO: 48700 - protein, 29 aa, Artificial Sequence
  Description of Artificial Sequence: Synthetic peptide
DAEEIASTNPVATEQWGSSSTNQQRDGNN

SEQ ID NO: 48701 - protein, 33 aa, Artificial Sequence
  Description of Artificial Sequence: Synthetic polypeptide
AEEEIRTTNPVATEQYGSVSVTTNLQQQQGNTE

SEQ ID NO: 48702 - protein, 31 aa, Artificial Sequence
  Description of Artificial Sequence: Synthetic polypeptide
DEMEIRTTNPVATEQYGSCSTTNLQTRVDVG

SEQ ID NO: 48703 - protein, 30 aa, Artificial Sequence
  Description of Artificial Sequence: Synthetic polypeptide
SEEEIRCTNPIATEQYGSVSGENDERGPNR

SEQ ID NO: 48704 - protein, 31 aa, Artificial Sequence
  Description of Artificial Sequence: Synthetic polypeptide
DEMEIRTTNPVATEQYGSICSTNTQRFGDAA

SEQ ID NO: 48705 - protein, 30 aa, Artificial Sequence
  Description of Artificial Sequence: Synthetic polypeptide
DAEEIASTNPVATEQYGSVATNLQTRPGQS

SEQ ID NO: 48706 - protein, 30 aa, Artificial Sequence
  Description of Artificial Sequence: Synthetic polypeptide
DEMEIRTTNPVATDQYGCVSTNLERNNEPM

SEQ ID NO: 48707 - protein, 31 aa, Artificial Sequence
  Description of Artificial Sequence: Synthetic polypeptide
AEEEIRTTNPVATEQYGSVSTTNNSSTQGNI

SEQ ID NO: 48708 - protein, 31 aa, Artificial Sequence
  Description of Artificial Sequence: Synthetic polypeptide
AEEEIRTTNPVATEQYGSVSTTNNSEGGNQQ

SEQ ID NO: 48709 - protein, 31 aa, Artificial Sequence
  Description of Artificial Sequence: Synthetic polypeptide
DEMEIRTTNPVATEQYGCVSTNLENFGDNII

SEQ ID NO: 48710 - protein, 31 aa, Artificial Sequence
  Description of Artificial Sequence: Synthetic polypeptide
DEMEIRTTNPVATEQYGCVSTNLENGDNIPF

SEQ ID NO: 48711 - protein, 32 aa, Artificial Sequence
  Description of Artificial Sequence: Synthetic polypeptide
AEEEIRTTNPVATEQYGSVSTTNNQQQTGNQD

SEQ ID NO: 48712 - protein, 31 aa, Artificial Sequence
  Description of Artificial Sequence: Synthetic polypeptide
DEMEIRTTNPVATEQYGCVSTNLLQNGLIDM

SEQ ID NO: 48713 - protein, 31 aa, Artificial Sequence
  Description of Artificial Sequence: Synthetic polypeptide
DEMEIRTTNPVATEQYGCVSTNLLQNLEGDQ

SEQ ID NO: 48714 - protein, 32 aa, Artificial Sequence
  Description of Artificial Sequence: Synthetic polypeptide
DEMEIRTTNPVATEQYGCVSTNLLQRSVQDRQ

SEQ ID NO: 48715 - protein, 28 aa, Artificial Sequence
  Description of Artificial Sequence: Synthetic peptide
AENEIACTNPVATEQYGEGSENLQRGGR

SEQ ID NO: 48716 - protein, 30 aa, Artificial Sequence
  Description of Artificial Sequence: Synthetic polypeptide
QEEEIRTTNPVATEQYGSMSTTALPNHGNV

SEQ ID NO: 48717 - protein, 32 aa, Artificial Sequence
  Description of Artificial Sequence: Synthetic polypeptide
DEMEIRTTNPVATEQYGCVSTNLLTQNGLDDR

SEQ ID NO: 48718 - protein, 28 aa, Artificial Sequence
  Description of Artificial Sequence: Synthetic peptide
SEEEIRCTNPIATEQYGSVSHNQMRMNE

SEQ ID NO: 48719 - protein, 32 aa, Artificial Sequence
  Description of Artificial Sequence: Synthetic polypeptide
DEMEIRTTNPVATEQYGCVSTNNQIGMNQQRE

SEQ ID NO: 48720 - protein, 29 aa, Artificial Sequence
  Description of Artificial Sequence: Synthetic peptide
DAEEIATTNPVATAQWGSVSTNPDRNGNQ

SEQ ID NO: 48721 - protein, 29 aa, Artificial Sequence
  Description of Artificial Sequence: Synthetic peptide
DAEEIATTNPVATAQWGSVSTNPDRGNDS

SEQ ID NO: 48722 - protein, 30 aa, Artificial Sequence
  Description of Artificial Sequence: Synthetic polypeptide
DEMEIRTTNPVATEQYGCVSTNTDQHNGEV

SEQ ID NO: 48723 - protein, 30 aa, Artificial Sequence
  Description of Artificial Sequence: Synthetic polypeptide
DEMEIRTTNPVATEQYGCVSTVFLERGDEQ

SEQ ID NO: 48724 - protein, 30 aa, Artificial Sequence
  Description of Artificial Sequence: Synthetic polypeptide
SEEEIRCTNPIATEQYGSVSHNLVMHGNFR

SEQ ID NO: 48725 - protein, 28 aa, Artificial Sequence
  Description of Artificial Sequence: Synthetic peptide
AENEIACTNPVATEQYGEGSYNLQRGGR

SEQ ID NO: 48726 - protein, 29 aa, Artificial Sequence
  Description of Artificial Sequence: Synthetic peptide
SEEEIRCTNPIATEQYGTVSMDLMQNGNR

SEQ ID NO: 48727 - protein, 30 aa, Artificial Sequence
  Description of Artificial Sequence: Synthetic polypeptide
DEMEIRTTNPVATDQYGCVSTNLERGEDIP

SEQ ID NO: 48728 - protein, 29 aa, Artificial Sequence
  Description of Artificial Sequence: Synthetic peptide
DEMEIRTTNPVATDQYGCVGTELQNGSNQ

SEQ ID NO: 48729 - protein, 29 aa, Artificial Sequence
  Description of Artificial Sequence: Synthetic peptide
SEEEIRCTNPIATEQYGTVSEDLQQQGNR

SEQ ID NO: 48730 - protein, 33 aa, Artificial Sequence
  Description of Artificial Sequence: Synthetic polypeptide
AEEEIRTTNPVATEQYGSVSTTNNQLQQGNEDN

SEQ ID NO: 48731 - protein, 30 aa, Artificial Sequence
  Description of Artificial Sequence: Synthetic polypeptide
DEIEICTVNPVATEQYGSVSTNLEFQGNEI

SEQ ID NO: 48732 - protein, 29 aa, Artificial Sequence
  Description of Artificial Sequence: Synthetic peptide
DEIEICTVNPVATEQYGSVSTNLEVEGTE

SEQ ID NO: 48733 - protein, 29 aa, Artificial Sequence
  Description of Artificial Sequence: Synthetic peptide
DEIEICTVNPVATEQYGSVSTNLQFEVTE

SEQ ID NO: 48734 - protein, 28 aa, Artificial Sequence
  Description of Artificial Sequence: Synthetic peptide
AENEIACTNPVATEQYGEASVNLQRGGR

SEQ ID NO: 48735 - protein, 30 aa, Artificial Sequence
  Description of Artificial Sequence: Synthetic polypeptide
SEEEIRCTNPIATEQYGTSVSENKLMRGVR

SEQ ID NO: 48736 - protein, 29 aa, Artificial Sequence
  Description of Artificial Sequence: Synthetic peptide
SEEEIRCTNPIATEQYGTSVNENLMRSNR

SEQ ID NO: 48737 - protein, 30 aa, Artificial Sequence
  Description of Artificial Sequence: Synthetic polypeptide
DEIVIGTTNPVATEQWGTVSQTDELQRGNR

SEQ ID NO: 48738 - protein, 29 aa, Artificial Sequence
  Description of Artificial Sequence: Synthetic peptide
DEIVIGTTNPVATEQWGTVSTDFLQRGER

SEQ ID NO: 48739 - protein, 30 aa, Artificial Sequence
  Description of Artificial Sequence: Synthetic polypeptide
DEIVIGTTNPVATEQWGTVSTDGLQRGNER

SEQ ID NO: 48740 - protein, 28 aa, Artificial Sequence
  Description of Artificial Sequence: Synthetic peptide
SEEEIRCTNPIATEQYGTISENIQQGNR

SEQ ID NO: 48741 - protein, 29 aa, Artificial Sequence
  Description of Artificial Sequence: Synthetic peptide
DAEEIATTNPVAYEPYGSVATNLQDGNDD

SEQ ID NO: 48742 - protein, 29 aa, Artificial Sequence
  Description of Artificial Sequence: Synthetic peptide
QEEEIRTTNPVATEQYGEVSEVCPQRENG

SEQ ID NO: 48743 - protein, 30 aa, Artificial Sequence
  Description of Artificial Sequence: Synthetic polypeptide
DELAIRGTNPVATEQYGSASTNLIEVGNRD

SEQ ID NO: 48744 - protein, 31 aa, Artificial Sequence
  Description of Artificial Sequence: Synthetic polypeptide
DEIEICTVNPVATEQYGSVSPTNLQFEVGNE

SEQ ID NO: 48745 - protein, 30 aa, Artificial Sequence
  Description of Artificial Sequence: Synthetic polypeptide
DEIEICTVNPVATEQYGSVSPTNLEEGNEN

SEQ ID NO: 48746 - protein, 31 aa, Artificial Sequence
  Description of Artificial Sequence: Synthetic polypeptide
SEEEIRCTNPIATEQYGTVSEENLQMRNGNR

SEQ ID NO: 48747 - protein, 31 aa, Artificial Sequence
  Description of Artificial Sequence: Synthetic polypeptide
DEIEEIATTNPVAYEQWGSVSTNLQGENGNT

SEQ ID NO: 48748 - protein, 32 aa, Artificial Sequence
  Description of Artificial Sequence: Synthetic polypeptide
AEEEIRTTNPVATEQYGSVSTTNNQLQGDNQN

SEQ ID NO: 48749 - protein, 32 aa, Artificial Sequence
  Description of Artificial Sequence: Synthetic polypeptide
DEHEIRTTNPVAYERYGSVSTNLQDDGGGNTR

SEQ ID NO: 48750 - protein, 33 aa, Artificial Sequence
  Description of Artificial Sequence: Synthetic polypeptide
AEEEIRTTNPVATEQYGSVSTTNNQLQGGNDTN

SEQ ID NO: 48751 - protein, 29 aa, Artificial Sequence
  Description of Artificial Sequence: Synthetic peptide
SEEEIRCTNPIATEQYGTVSENLEREGND

SEQ ID NO: 48752 - protein, 29 aa, Artificial Sequence
  Description of Artificial Sequence: Synthetic peptide
DEHEIRTTNPVAYQQYGCVSTNLEHGNEQ

SEQ ID NO: 48753 - protein, 30 aa, Artificial Sequence
  Description of Artificial Sequence: Synthetic polypeptide
DEHEIRTTNPVAYQQYGCVSTNLERGENDQ

SEQ ID NO: 48754 - protein, 30 aa, Artificial Sequence
  Description of Artificial Sequence: Synthetic polypeptide
DAEEIATTNPVAYEQYGSVATNLQRPGEGM

SEQ ID NO: 48755 - protein, 30 aa, Artificial Sequence
  Description of Artificial Sequence: Synthetic polypeptide
DAEEIATTNPVAYAQYGSVSTGNPDRDGNR

SEQ ID NO: 48756 - protein, 30 aa, Artificial Sequence
  Description of Artificial Sequence: Synthetic polypeptide
DAEEIATTNPVAYEQYGSVATNLQRDDNDN

SEQ ID NO: 48757 - protein, 28 aa, Artificial Sequence
  Description of Artificial Sequence: Synthetic peptide
DEHEIVSTNPVASEVYGSVSTELQVGNS

SEQ ID NO: 48758 - protein, 29 aa, Artificial Sequence
  Description of Artificial Sequence: Synthetic peptide
DEHNIRTTNPVATDQYGSVNNWQLQRGND

SEQ ID NO: 48759 - protein, 30 aa, Artificial Sequence
  Description of Artificial Sequence: Synthetic polypeptide
DEHVIGTTNPVATEQFGTVSTMDLLQRGNR

SEQ ID NO: 48760 - protein, 29 aa, Artificial Sequence
  Description of Artificial Sequence: Synthetic peptide
SEEEIRCTNPIATEQYGTVSEGLVERGNR

SEQ ID NO: 48761 - protein, 28 aa, Artificial Sequence
  Description of Artificial Sequence: Synthetic peptide
AENEIACTNPVATEQYGEASTNLQRGGL

SEQ ID NO: 48762 - protein, 30 aa, Artificial Sequence
  Description of Artificial Sequence: Synthetic polypeptide
DEHYIRTTNPVATEQYGSISTNIQGEGQLR

SEQ ID NO: 48763 - protein, 31 aa, Artificial Sequence
  Description of Artificial Sequence: Synthetic polypeptide
DEIAEIRTTNPVAYEQWGSVSTNLQNGDNNM

SEQ ID NO: 48764 - protein, 28 aa, Artificial Sequence
  Description of Artificial Sequence: Synthetic peptide
SEEEIRCTNPIATEQYGTVSENIMQGNR

SEQ ID NO: 48765 - protein, 32 aa, Artificial Sequence
  Description of Artificial Sequence: Synthetic polypeptide
DELEIRTTNPVATEQYGSFSTDNTQEYDGNGR

SEQ ID NO: 48766 - protein, 31 aa, Artificial Sequence
  Description of Artificial Sequence: Synthetic polypeptide
DELEIRTTNPVATEQYGSVSTNHNQNDGEEE

SEQ ID NO: 48767 - protein, 33 aa, Artificial Sequence
  Description of Artificial Sequence: Synthetic polypeptide
DELEIRTTNPVATEQYGSVSVTTGSNVQRGNQI

SEQ ID NO: 48768 - protein, 32 aa, Artificial Sequence
  Description of Artificial Sequence: Synthetic polypeptide
DEMEIRATNPVATEQYGEVSTGNLGQTGGNQR

SEQ ID NO: 48769 - protein, 30 aa, Artificial Sequence
  Description of Artificial Sequence: Synthetic polypeptide
SEEEIRCTNPIATEQYGSVSYGENDMRGNR

SEQ ID NO: 48770 - protein, 31 aa, Artificial Sequence
  Description of Artificial Sequence: Synthetic polypeptide
DEMEIRCTNPVATEQYGSVSVNQDRIGSNSR

SEQ ID NO: 48771 - protein, 33 aa, Artificial Sequence
  Description of Artificial Sequence: Synthetic polypeptide
AEEEIRTTNPVATEQYGSVSVTTNNLQAGINAT

SEQ ID NO: 48772 - protein, 32 aa, Artificial Sequence
  Description of Artificial Sequence: Synthetic polypeptide
AEEEIRTTNPVATEQYGSVSTTNNQQLQGNPN

SEQ ID NO: 48773 - protein, 30 aa, Artificial Sequence
  Description of Artificial Sequence: Synthetic polypeptide
DEMEIRSTNPVATEQYGSVSVNQDRGSNSD

SEQ ID NO: 48774 - protein, 29 aa, Artificial Sequence
  Description of Artificial Sequence: Synthetic peptide
AENEIACTNPVATEQYGEAWSTNLQRGGR

SEQ ID NO: 48775 - protein, 31 aa, Artificial Sequence
  Description of Artificial Sequence: Synthetic polypeptide
DEMEIKTTNPVAYEQYGSVSTGNPQRGFNQM

SEQ ID NO: 48776 - protein, 29 aa, Artificial Sequence
  Description of Artificial Sequence: Synthetic peptide
QEEEIRTTNPVATEQYGMVVVNLQAQNTV

SEQ ID NO: 48777 - protein, 31 aa, Artificial Sequence
  Description of Artificial Sequence: Synthetic polypeptide
DEVEIRTTNPVAYEQWGSVSTNLQSGGQNDQ

SEQ ID NO: 48778 - protein, 31 aa, Artificial Sequence
  Description of Artificial Sequence: Synthetic polypeptide
SEEEIRCTNPIATEQYGSVSTEALMMRGNPR

SEQ ID NO: 48779 - protein, 28 aa, Artificial Sequence
  Description of Artificial Sequence: Synthetic peptide
SEEEIRCTNPIATEQYGSVSTDLMHGEL

SEQ ID NO: 48780 - protein, 30 aa, Artificial Sequence
  Description of Artificial Sequence: Synthetic polypeptide
DEMEIRTTNPVATCQYGCVNTELQRGSNDG

SEQ ID NO: 48781 - protein, 29 aa, Artificial Sequence
  Description of Artificial Sequence: Synthetic peptide
DEMEIRTTNPVATCQYGCVSSNLERGGQD

SEQ ID NO: 48782 - protein, 31 aa, Artificial Sequence
  Description of Artificial Sequence: Synthetic polypeptide
DEVEIRTTNPVAYEQWGSVSTNLQSGGDNAN

SEQ ID NO: 48783 - protein, 31 aa, Artificial Sequence
  Description of Artificial Sequence: Synthetic polypeptide
DEMEIRTTNPVATCQYGSVCNTELQRGSNQA

SEQ ID NO: 48784 - protein, 28 aa, Artificial Sequence
  Description of Artificial Sequence: Synthetic peptide
QEEEIRTTNPVATEQYGSAPENLQHEEK

SEQ ID NO: 48785 - protein, 29 aa, Artificial Sequence
  Description of Artificial Sequence: Synthetic peptide
SEEEIRCTNPIATEQYGSVSSNLMNGNQI

SEQ ID NO: 48786 - protein, 32 aa, Artificial Sequence
  Description of Artificial Sequence: Synthetic polypeptide
AEEEIRTTNPVATEQYGSVSTTNNQQANGVNP

SEQ ID NO: 48787 - protein, 32 aa, Artificial Sequence
  Description of Artificial Sequence: Synthetic polypeptide
AEEEIRTTNPVATEQYGSVSTTNNQNQTGNSD

SEQ ID NO: 48788 - protein, 31 aa, Artificial Sequence
  Description of Artificial Sequence: Synthetic polypeptide
DELEIRTTNPVATEQYGSVSWNLNQNDGEEQ

SEQ ID NO: 48789 - protein, 29 aa, Artificial Sequence
  Description of Artificial Sequence: Synthetic peptide
DEMAIRTTNPVATEQYGCFSTNLINGSDR

SEQ ID NO: 48790 - protein, 29 aa, Artificial Sequence
  Description of Artificial Sequence: Synthetic peptide
DEYEIATTNPVATCQYGCVSTALQRGSDQ

SEQ ID NO: 48791 - protein, 29 aa, Artificial Sequence
  Description of Artificial Sequence: Synthetic peptide
DEMCIRTTNPVATQQYGCVSTNLERGEPP

SEQ ID NO: 48792 - protein, 30 aa, Artificial Sequence
  Description of Artificial Sequence: Synthetic polypeptide
DEMEIATTNPVATCQYGCVSTADLQRGSNQ

SEQ ID NO: 48793 - protein, 28 aa, Artificial Sequence
  Description of Artificial Sequence: Synthetic peptide
AENEIACTNPVATEQYGEASWNLQRGGR

SEQ ID NO: 48794 - protein, 28 aa, Artificial Sequence
  Description of Artificial Sequence: Synthetic peptide
AENEIACTNPVATEQYGEASYNLQRGGR

SEQ ID NO: 48795 - protein, 31 aa, Artificial Sequence
  Description of Artificial Sequence: Synthetic polypeptide
QEEEIRTTNPVATEQYGIVSTNPGGDGANDR

SEQ ID NO: 48796 - protein, 33 aa, Artificial Sequence
  Description of Artificial Sequence: Synthetic polypeptide
AEEEIRTTNPVATEQYGSVSTTNNQLQTGNSNT

SEQ ID NO: 48797 - protein, 32 aa, Artificial Sequence
  Description of Artificial Sequence: Synthetic polypeptide
AEEEIRTTNPVATEQYGSVSTTNNQNNQDGNL

SEQ ID NO: 48798 - protein, 30 aa, Artificial Sequence
  Description of Artificial Sequence: Synthetic polypeptide
DEVVIRTTNPLATEQFGSVSFNLQTSGNQR

SEQ ID NO: 48799 - protein, 31 aa, Artificial Sequence
  Description of Artificial Sequence: Synthetic polypeptide
SEEEIRCTNPIATEQYGSVVSENELSMRGNR

SEQ ID NO: 48800 - protein, 29 aa, Artificial Sequence
  Description of Artificial Sequence: Synthetic peptide
QEEEIRTTNPVATEQYGEVSEVCPQRENK

SEQ ID NO: 48801 - protein, 29 aa, Artificial Sequence
  Description of Artificial Sequence: Synthetic peptide
DEMEIATTNPVATEQYGTVSECLVQFGNL

SEQ ID NO: 48802 - protein, 30 aa, Artificial Sequence
  Description of Artificial Sequence: Synthetic polypeptide
DEVVIGTTNPVATEQFGTVSTDGLQRGENR

SEQ ID NO: 48803 - protein, 31 aa, Artificial Sequence
  Description of Artificial Sequence: Synthetic polypeptide
QEEEIRTTNPVATEQYGHVSWTGLNRGANDE

SEQ ID NO: 48804 - protein, 29 aa, Artificial Sequence
  Description of Artificial Sequence: Synthetic peptide
SEEEIRCTNPIATEQYGSVWSEVWMRGNR

SEQ ID NO: 48805 - protein, 30 aa, Artificial Sequence
  Description of Artificial Sequence: Synthetic polypeptide
DTEEIRTTNPCATEAYGSVSVTNLQGTENQ

SEQ ID NO: 48806 - protein, 29 aa, Artificial Sequence
  Description of Artificial Sequence: Synthetic peptide
DENEIATTNPCATEQYGSVASNDQRDNRD

SEQ ID NO: 48807 - protein, 28 aa, Artificial Sequence
  Description of Artificial Sequence: Synthetic peptide
DENEIATTNPVATAQWGSVATADQRGND

SEQ ID NO: 48808 - protein, 33 aa, Artificial Sequence
  Description of Artificial Sequence: Synthetic polypeptide
DEVEIRTTNPVATEQYGEVSTGNPLQGEDGDNR

SEQ ID NO: 48809 - protein, 32 aa, Artificial Sequence
  Description of Artificial Sequence: Synthetic polypeptide
DENEIRTTNPVATEQYGSVCSTEDQNFGSNRM

SEQ ID NO: 48810 - protein, 30 aa, Artificial Sequence
  Description of Artificial Sequence: Synthetic polypeptide
SEEEICTTNPVATEQYGSVATNLQGPGEEE

SEQ ID NO: 48811 - protein, 31 aa, Artificial Sequence
  Description of Artificial Sequence: Synthetic polypeptide
AEEEIRTTNPVATEQYGSVSVTSTGNQGGNQ

SEQ ID NO: 48812 - protein, 32 aa, Artificial Sequence
  Description of Artificial Sequence: Synthetic polypeptide
DENEIRTTNPVATEQYGSVCSTNLERGEDEHI

SEQ ID NO: 48813 - protein, 32 aa, Artificial Sequence
  Description of Artificial Sequence: Synthetic polypeptide
AEEEIRTTNPVATEQYGSVSTVNQLENNGNQI

SEQ ID NO: 48814 - protein, 30 aa, Artificial Sequence
  Description of Artificial Sequence: Synthetic polypeptide
DEVEIRTTNPVATEQYGEVCTNPDQPGNMD

SEQ ID NO: 48815 - protein, 33 aa, Artificial Sequence
  Description of Artificial Sequence: Synthetic polypeptide
DENEIRTTNPVATEQYGSVCSTTNLQRGEDEYI

SEQ ID NO: 48816 - protein, 30 aa, Artificial Sequence
  Description of Artificial Sequence: Synthetic polypeptide
SEEEICTTNPVATEQYGSVATNLQDGEHGD

SEQ ID NO: 48817 - protein, 32 aa, Artificial Sequence
  Description of Artificial Sequence: Synthetic polypeptide
AEEEIRTTNPVATEQYGSVSTVNQLGQTGGTT

SEQ ID NO: 48818 - protein, 29 aa, Artificial Sequence
  Description of Artificial Sequence: Synthetic peptide
SEEEICTTNPVATEQYGSVATNLMAGPQD

SEQ ID NO: 48819 - protein, 30 aa, Artificial Sequence
  Description of Artificial Sequence: Synthetic polypeptide
SEEEICTTNPVATEQYGSVATNDQRNPNEA

SEQ ID NO: 48820 - protein, 31 aa, Artificial Sequence
  Description of Artificial Sequence: Synthetic polypeptide
DENEIRTTNPVATEQYGSVMSQNLFEMNMNR

SEQ ID NO: 48821 - protein, 31 aa, Artificial Sequence
  Description of Artificial Sequence: Synthetic polypeptide
DENEIRTTNPVATEQYGSVMSQNLFENGNIG

SEQ ID NO: 48822 - protein, 33 aa, Artificial Sequence
  Description of Artificial Sequence: Synthetic polypeptide
AEEEIRTTNPVATEQYGSVSTVNQLQENNGTNG

SEQ ID NO: 48823 - protein, 32 aa, Artificial Sequence
  Description of Artificial Sequence: Synthetic polypeptide
SEEEICTTNPVATEQYGSVATNLQNRDGNEAM

SEQ ID NO: 48824 - protein, 29 aa, Artificial Sequence
  Description of Artificial Sequence: Synthetic peptide
DEVEIRTTNPVATEQYGMVDTSDDQEGIR

SEQ ID NO: 48825 - protein, 32 aa, Artificial Sequence
  Description of Artificial Sequence: Synthetic polypeptide
AEEEIRTTNPVATEQYGSVSTVNNQQTQGNVD

SEQ ID NO: 48826 - protein, 30 aa, Artificial Sequence
  Description of Artificial Sequence: Synthetic polypeptide
SEEEICTTNPVATEQYGSVATNLQPPGEEM

SEQ ID NO: 48827 - protein, 32 aa, Artificial Sequence
  Description of Artificial Sequence: Synthetic polypeptide
DEVEIRTTNPVATEQYGSVCSTELQHFGSNQI

SEQ ID NO: 48828 - protein, 30 aa, Artificial Sequence
  Description of Artificial Sequence: Synthetic polypeptide
SEEEICTTNPVATESYGSVATNLQDPGNEH

SEQ ID NO: 48829 - protein, 31 aa, Artificial Sequence
  Description of Artificial Sequence: Synthetic polypeptide
AEEEIRTTNPVATEQYGSVSVTTEGQEGGNQ

SEQ ID NO: 48830 - protein, 32 aa, Artificial Sequence
  Description of Artificial Sequence: Synthetic polypeptide
DEVEIRTTNPVATEQYGSVATNPNQGEDGDNR

SEQ ID NO: 48831 - protein, 32 aa, Artificial Sequence
  Description of Artificial Sequence: Synthetic polypeptide
DENEIRTTNPVATEQYGSCSTTNLQTRGQDEG

SEQ ID NO: 48832 - protein, 31 aa, Artificial Sequence
  Description of Artificial Sequence: Synthetic polypeptide
AEEEIRTTNPVATEQYGSVSVTTDGQGGGND

SEQ ID NO: 48833 - protein, 31 aa, Artificial Sequence
  Description of Artificial Sequence: Synthetic polypeptide
AEEEIRTTNPVATEQYGSVSVTSTGQGGNDT

SEQ ID NO: 48834 - protein, 30 aa, Artificial Sequence
  Description of Artificial Sequence: Synthetic polypeptide
SEEEICTTNPVATEQYGSVATNDQRMPPER

SEQ ID NO: 48835 - protein, 31 aa, Artificial Sequence
  Description of Artificial Sequence: Synthetic polypeptide
DENEIRTTNPVATEQYGSISTNTQQREGLIE

SEQ ID NO: 48836 - protein, 30 aa, Artificial Sequence
  Description of Artificial Sequence: Synthetic polypeptide
SEEEICTTNPVATEQYGSVATTLQEGDNDE

SEQ ID NO: 48837 - protein, 30 aa, Artificial Sequence
  Description of Artificial Sequence: Synthetic polypeptide
DENEIRTTNPVATEQYGSVAQNLFNENMNR

SEQ ID NO: 48838 - protein, 31 aa, Artificial Sequence
  Description of Artificial Sequence: Synthetic polypeptide
SEEEICTTNPVATEQYGSVATNLQRVGEDEE

SEQ ID NO: 48839 - protein, 30 aa, Artificial Sequence
  Description of Artificial Sequence: Synthetic polypeptide
SEEEICTTNPVATEQYGSVATNLQQGPSMD

SEQ ID NO: 48840 - protein, 31 aa, Artificial Sequence
  Description of Artificial Sequence: Synthetic polypeptide
SEEEICTTNPVATEQYGSVATNLQQGPESRD

SEQ ID NO: 48841 - protein, 33 aa, Artificial Sequence
  Description of Artificial Sequence: Synthetic polypeptide
DEVEIRTTNPVATEQYGNVCSTGNLQHRNSNDR

SEQ ID NO: 48842 - protein, 31 aa, Artificial Sequence
  Description of Artificial Sequence: Synthetic polypeptide
SEEEICTTNPVATEQYGSVATNLQPPGENDE

SEQ ID NO: 48843 - protein, 31 aa, Artificial Sequence
  Description of Artificial Sequence: Synthetic polypeptide
DENEIRTTNPVATEQYGSISTSLTIREGQLR

SEQ ID NO: 48844 - protein, 31 aa, Artificial Sequence
  Description of Artificial Sequence: Synthetic polypeptide
DENEIRTTNPVATEQYGSCSTPLQNGFEERM

SEQ ID NO: 48845 - protein, 32 aa, Artificial Sequence
  Description of Artificial Sequence: Synthetic polypeptide
AEEEIRTTNPVATEQYGSVSTVNQLQQNNTTD

SEQ ID NO: 48846 - protein, 33 aa, Artificial Sequence
  Description of Artificial Sequence: Synthetic polypeptide
AEEEIRTTNPVATEQYGSVSVTSNLTQTGENYT

SEQ ID NO: 48847 - protein, 31 aa, Artificial Sequence
  Description of Artificial Sequence: Synthetic polypeptide
SEEEICTTNPVATEPYGSVATNLQTRGGNEH

SEQ ID NO: 48848 - protein, 31 aa, Artificial Sequence
  Description of Artificial Sequence: Synthetic polypeptide
SEEEICTTNPVATEPYGSVATNLQTRDGNNN

SEQ ID NO: 48849 - protein, 30 aa, Artificial Sequence
  Description of Artificial Sequence: Synthetic polypeptide
DEVEIRTTNPVATEQYGCVSTILDPFRLDR

SEQ ID NO: 48850 - protein, 30 aa, Artificial Sequence
  Description of Artificial Sequence: Synthetic polypeptide
SEEEICTTNPVATEPYGSVATNLQSDGNGN

SEQ ID NO: 48851 - protein, 32 aa, Artificial Sequence
  Description of Artificial Sequence: Synthetic polypeptide
DEVEIRTTNPVATEQYGCVSTGNMLGDTGNER

SEQ ID NO: 48852 - protein, 32 aa, Artificial Sequence
  Description of Artificial Sequence: Synthetic polypeptide
AEEEIRTTNPVATEQYGSVSVTSNEQQGGNEV

SEQ ID NO: 48853 - protein, 29 aa, Artificial Sequence
  Description of Artificial Sequence: Synthetic peptide
DENEIRTTNPVATEQYGSVSMDLNREQDT

SEQ ID NO: 48854 - protein, 32 aa, Artificial Sequence
  Description of Artificial Sequence: Synthetic polypeptide
AEEEIRTTNPVATEQYGSVSVTSNEQGQGNNV

SEQ ID NO: 48855 - protein, 31 aa, Artificial Sequence
  Description of Artificial Sequence: Synthetic polypeptide
DENEIRTTNPVATEQYGSVSNNLEGIGNVEQ

SEQ ID NO: 48856 - protein, 30 aa, Artificial Sequence
  Description of Artificial Sequence: Synthetic polypeptide
SEEEICTTNPVATEPYGSVATNLQQGDSRA

SEQ ID NO: 48857 - protein, 29 aa, Artificial Sequence
  Description of Artificial Sequence: Synthetic peptide
SEEEICTTNPVATEPYGSVATNLQIDDNN

SEQ ID NO: 48858 - protein, 30 aa, Artificial Sequence
  Description of Artificial Sequence: Synthetic polypeptide
CEEEIRTTNPVAYEAYGKVSTYLSQEGGNR

SEQ ID NO: 48859 - protein, 32 aa, Artificial Sequence
  Description of Artificial Sequence: Synthetic polypeptide
AEEEIRTTNPVATEQYGSVSVTSNEQGGTNQV

SEQ ID NO: 48860 - protein, 31 aa, Artificial Sequence
  Description of Artificial Sequence: Synthetic polypeptide
DENEIRTTNPVATEQYGSVSPTNLEIRIEDI

SEQ ID NO: 48861 - protein, 32 aa, Artificial Sequence
  Description of Artificial Sequence: Synthetic polypeptide
AEEEIRTTNPVATEQYGSVSVTSNENQQQGND

SEQ ID NO: 48862 - protein, 31 aa, Artificial Sequence
  Description of Artificial Sequence: Synthetic polypeptide
DEVEIRTTNPVATEQYGCVSTNGGDAGNNDR

SEQ ID NO: 48863 - protein, 32 aa, Artificial Sequence
  Description of Artificial Sequence: Synthetic polypeptide
DEVEIRTTNPVATEQYGCVSTNGNGDDRGNER

SEQ ID NO: 48864 - protein, 32 aa, Artificial Sequence
  Description of Artificial Sequence: Synthetic polypeptide
QEEEIRTTNPVATEQYGSVSCVNLSGRGGPND

SEQ ID NO: 48865 - protein, 31 aa, Artificial Sequence
  Description of Artificial Sequence: Synthetic polypeptide
DEVEIRTTNPVATEQYGCVSTNPGGDTGNER

SEQ ID NO: 48866 - protein, 32 aa, Artificial Sequence
  Description of Artificial Sequence: Synthetic polypeptide
AEEEIRTTNPVATEQYGSVSTVNQLTENNGNI

SEQ ID NO: 48867 - protein, 31 aa, Artificial Sequence
  Description of Artificial Sequence: Synthetic polypeptide
DENEIRTTNPVATEQYGSVMTGLIRGMGNGI

SEQ ID NO: 48868 - protein, 30 aa, Artificial Sequence
  Description of Artificial Sequence: Synthetic polypeptide
DENEIRTTNPVATEQYGSVNTPLQNPQEDR

SEQ ID NO: 48869 - protein, 30 aa, Artificial Sequence
  Description of Artificial Sequence: Synthetic polypeptide
DENEIRTTNPVATEQYGSVPTNLTETENDQ

SEQ ID NO: 48870 - protein, 31 aa, Artificial Sequence
  Description of Artificial Sequence: Synthetic polypeptide
DENEIRTTNPVATEQYGSVQSQNNLFENMNR

SEQ ID NO: 48871 - protein, 33 aa, Artificial Sequence
  Description of Artificial Sequence: Synthetic polypeptide
DENEIRTTNPVATEQYGSVQSTTNLQNGVDEDR

SEQ ID NO: 48872 - protein, 33 aa, Artificial Sequence
  Description of Artificial Sequence: Synthetic polypeptide
AEEEIRTTNPVATEQYGSVSVTSNLQQNGTNSN

SEQ ID NO: 48873 - protein, 32 aa, Artificial Sequence
  Description of Artificial Sequence: Synthetic polypeptide
AEEEIRTTNPVATEQYGSVSVTSNNQQAGNNS

SEQ ID NO: 48874 - protein, 31 aa, Artificial Sequence
  Description of Artificial Sequence: Synthetic polypeptide
DENEIRTTNPVATEQYGSVQTGLIREGNQGN

SEQ ID NO: 48875 - protein, 31 aa, Artificial Sequence
  Description of Artificial Sequence: Synthetic polypeptide
DEVEIRTTNPVATEQYGCVSTPNGNGDGNER

SEQ ID NO: 48876 - protein, 29 aa, Artificial Sequence
  Description of Artificial Sequence: Synthetic peptide
DENEIRTTNPVATEQYGSVQTYLIQMERI

SEQ ID NO: 48877 - protein, 31 aa, Artificial Sequence
  Description of Artificial Sequence: Synthetic polypeptide
SEEEICTTNPVATEPYGSVSTNLQQDGNMIF

SEQ ID NO: 48878 - protein, 32 aa, Artificial Sequence
  Description of Artificial Sequence: Synthetic polypeptide
DENEIRTTNPVATEQYGSVSCTNALTQETQDR

SEQ ID NO: 48879 - protein, 32 aa, Artificial Sequence
  Description of Artificial Sequence: Synthetic polypeptide
DENEIRTTNPVATEQYGSVSDTCWLEQNSQNR

SEQ ID NO: 48880 - protein, 31 aa, Artificial Sequence
  Description of Artificial Sequence: Synthetic polypeptide
DENEIRTTNPVATEQYGSVSDTEDLTEGNIQ

SEQ ID NO: 48881 - protein, 31 aa, Artificial Sequence
  Description of Artificial Sequence: Synthetic polypeptide
DENEIRTTNPVATEQYGSVSDTWLEQFSQNF

SEQ ID NO: 48882 - protein, 31 aa, Artificial Sequence
  Description of Artificial Sequence: Synthetic polypeptide
DENEIRTTNPVATEQYGSVQTGLIRGMENIT

SEQ ID NO: 48883 - protein, 32 aa, Artificial Sequence
  Description of Artificial Sequence: Synthetic polypeptide
DEVEIRTTNPVATEQYGSVCTTLTERLNGNER

SEQ ID NO: 48884 - protein, 31 aa, Artificial Sequence
  Description of Artificial Sequence: Synthetic polypeptide
DENEIRTTNPVATEQYGSCSTGPLQRGVEQD

SEQ ID NO: 48885 - protein, 29 aa, Artificial Sequence
  Description of Artificial Sequence: Synthetic peptide
SEEEICTTNPVATESYGSVATNLQIDGDD

SEQ ID NO: 48886 - protein, 28 aa, Artificial Sequence
  Description of Artificial Sequence: Synthetic peptide
DENEIRTTNPVATEQWGDVSEILMREDR

SEQ ID NO: 48887 - protein, 29 aa, Artificial Sequence
  Description of Artificial Sequence: Synthetic peptide
SEEEIRATNPCATEQYGSVSENLMEQGNM

SEQ ID NO: 48888 - protein, 29 aa, Artificial Sequence
  Description of Artificial Sequence: Synthetic peptide
DENEIRTTNPVATEQWGDVSENEMNRGNA

SEQ ID NO: 48889 - protein, 29 aa, Artificial Sequence
  Description of Artificial Sequence: Synthetic peptide
SEEEIRATNPCATEQYGSVSENLMAGNQM

SEQ ID NO: 48890 - protein, 29 aa, Artificial Sequence
  Description of Artificial Sequence: Synthetic peptide
SEEEIRATNPCATEQYGSVSENLLMIGNM

SEQ ID NO: 48891 - protein, 31 aa, Artificial Sequence
  Description of Artificial Sequence: Synthetic polypeptide
DENEIRTTNPVATEQWGEVSCNLPQREGENG

SEQ ID NO: 48892 - protein, 30 aa, Artificial Sequence
  Description of Artificial Sequence: Synthetic polypeptide
DENEIRTTNPVATEQWGKVSCTLDQMGGNR

SEQ ID NO: 48893 - protein, 28 aa, Artificial Sequence
  Description of Artificial Sequence: Synthetic peptide
AENEIACTNPVATEQYGWASENLQRGGR

SEQ ID NO: 48894 - protein, 30 aa, Artificial Sequence
  Description of Artificial Sequence: Synthetic polypeptide
DENEIRTTNPVATEQWGSVSCIEQDREGNG

SEQ ID NO: 48895 - protein, 31 aa, Artificial Sequence
  Description of Artificial Sequence: Synthetic polypeptide
SEEEIMTTNPVATEQYGNVSVTMLVQGGNER

SEQ ID NO: 48896 - protein, 31 aa, Artificial Sequence
  Description of Artificial Sequence: Synthetic polypeptide
AEEEIRTTNPVATEQYGSVSVTTGEQLGGNQ

SEQ ID NO: 48897 - protein, 33 aa, Artificial Sequence
  Description of Artificial Sequence: Synthetic polypeptide
SEEEIKTTNPVATEQYGSVSCINLSQERVGNNR

SEQ ID NO: 48898 - protein, 29 aa, Artificial Sequence
  Description of Artificial Sequence: Synthetic peptide
SEEEIKCTNPIATEQYGSVSENDAMRGNR

SEQ ID NO: 48899 - protein, 33 aa, Artificial Sequence
  Description of Artificial Sequence: Synthetic polypeptide
AEEEIRTTNPVATEQYGSVSTVNNNLQLTGTNI

SEQ ID NO: 48900 - protein, 29 aa, Artificial Sequence
  Description of Artificial Sequence: Synthetic peptide
SEEEIGCTNPIATEQYGSVSEGNLMGGNR

SEQ ID NO: 48901 - protein, 33 aa, Artificial Sequence
  Description of Artificial Sequence: Synthetic polypeptide
AEEEIRTTNPVATEQYGSVSTVNNLQSGVNTNA

SEQ ID NO: 48902 - protein, 31 aa, Artificial Sequence
  Description of Artificial Sequence: Synthetic polypeptide
AEEEIRTTNPVATEQYGSVSVTTGTQGGNDE

SEQ ID NO: 48903 - protein, 33 aa, Artificial Sequence
  Description of Artificial Sequence: Synthetic polypeptide
AEEEIRTTNPVATEQYGSVSTVNNLQQQNGNTQ

SEQ ID NO: 48904 - protein, 29 aa, Artificial Sequence
  Description of Artificial Sequence: Synthetic peptide
SEEEIRATNPCATEQYGSVSENLMQGNVA

SEQ ID NO: 48905 - protein, 30 aa, Artificial Sequence
  Description of Artificial Sequence: Synthetic polypeptide
DENEIRTTNPVATEIYGSVSWELQRFGSDA

SEQ ID NO: 48906 - protein, 30 aa, Artificial Sequence
  Description of Artificial Sequence: Synthetic polypeptide
DENEIRTTNPVATEIYGSVSWNLQHGSDQS

SEQ ID NO: 48907 - protein, 32 aa, Artificial Sequence
  Description of Artificial Sequence: Synthetic polypeptide
AEEEIRTTNPVATEQYGSVSTVNLTENNGENG

SEQ ID NO: 48908 - protein, 32 aa, Artificial Sequence
  Description of Artificial Sequence: Synthetic polypeptide
DENEIRTTNPVATEIYGSVVYSTNVLQEGNEK

SEQ ID NO: 48909 - protein, 31 aa, Artificial Sequence
  Description of Artificial Sequence: Synthetic polypeptide
DENEIRTTNPVATEIYGSVWFNVLQRGNEQQ

SEQ ID NO: 48910 - protein, 30 aa, Artificial Sequence
  Description of Artificial Sequence: Synthetic polypeptide
SEEEIRATNPVATEQWGSVATNDQRGNTAP

SEQ ID NO: 48911 - protein, 33 aa, Artificial Sequence
  Description of Artificial Sequence: Synthetic polypeptide
AEEEIRTTNPVATEQYGSVSTVNLVQTGTNNNG

SEQ ID NO: 48912 - protein, 28 aa, Artificial Sequence
  Description of Artificial Sequence: Synthetic peptide
DENEIRTTNPVATEQWGSVSEILMAGDA

SEQ ID NO: 48913 - protein, 32 aa, Artificial Sequence
  Description of Artificial Sequence: Synthetic polypeptide
DENEIRTTNPVATEPYGSVCFTNDLTRGGNER

SEQ ID NO: 48914 - protein, 31 aa, Artificial Sequence
  Description of Artificial Sequence: Synthetic polypeptide
DENEIRTTNPVATEPYGSVCFTNLTRGGMNQ

SEQ ID NO: 48915 - protein, 28 aa, Artificial Sequence
  Description of Artificial Sequence: Synthetic peptide
SEEEIRATNPCATEQYGVVSENLMPGNM

SEQ ID NO: 48916 - protein, 29 aa, Artificial Sequence
  Description of Artificial Sequence: Synthetic peptide
SEEEIRATNPCATEQYGSVSVENLMLGNP

SEQ ID NO: 48917 - protein, 32 aa, Artificial Sequence
  Description of Artificial Sequence: Synthetic polypeptide
AEEEIRTTNPVATEQYGSVSTVNNLNGGINST

SEQ ID NO: 48918 - protein, 31 aa, Artificial Sequence
  Description of Artificial Sequence: Synthetic polypeptide
DENEIRTTNPVATEQFGTSVSTYLLRGNESQ

SEQ ID NO: 48919 - protein, 28 aa, Artificial Sequence
  Description of Artificial Sequence: Synthetic peptide
SEEEIRATNPCATEQYGSVSEQLMSGNM

SEQ ID NO: 48920 - protein, 29 aa, Artificial Sequence
  Description of Artificial Sequence: Synthetic peptide
SEEEIRATNPCATEQYGSVSENLMQGSNM

SEQ ID NO: 48921 - protein, 30 aa, Artificial Sequence
  Description of Artificial Sequence: Synthetic polypeptide
SEEEIRATNPIATEQYGSVSVNDAMVRGNR

SEQ ID NO: 48922 - protein, 30 aa, Artificial Sequence
  Description of Artificial Sequence: Synthetic polypeptide
DENEIRTTNPVATEQWGSVSENLMNAAGDR

SEQ ID NO: 48923 - protein, 32 aa, Artificial Sequence
  Description of Artificial Sequence: Synthetic polypeptide
DENEIRTTNPVATEQWGSVVPSCTNLSTGGNR

SEQ ID NO: 48924 - protein, 30 aa, Artificial Sequence
  Description of Artificial Sequence: Synthetic polypeptide
DENEIRTTNPVATEQYGATTSENLQRKGPI

SEQ ID NO: 48925 - protein, 31 aa, Artificial Sequence
  Description of Artificial Sequence: Synthetic polypeptide
DEVEIRTTNPVATEQYGSVITVDGNQRTGNS

SEQ ID NO: 48926 - protein, 31 aa, Artificial Sequence
  Description of Artificial Sequence: Synthetic polypeptide
DENEIRTTNPVATEQYGCVVPWTNLTRGMNQ

SEQ ID NO: 48927 - protein, 32 aa, Artificial Sequence
  Description of Artificial Sequence: Synthetic polypeptide
AEEEIRTTNPVATEQYGSVSTVNNNQNIGTNE

SEQ ID NO: 48928 - protein, 30 aa, Artificial Sequence
  Description of Artificial Sequence: Synthetic polypeptide
SEEEICTTNPVAYEQYGSVATNLQDGNEQA

SEQ ID NO: 48929 - protein, 31 aa, Artificial Sequence
  Description of Artificial Sequence: Synthetic polypeptide
SEEEICTTNPVAYEQYGSVAATANLQRGNES

SEQ ID NO: 48930 - protein, 32 aa, Artificial Sequence
  Description of Artificial Sequence: Synthetic polypeptide
AEEEIRTTNPVATEQYGSVSTVNNNQQEIGNQ

SEQ ID NO: 48931 - protein, 30 aa, Artificial Sequence
  Description of Artificial Sequence: Synthetic polypeptide
SEEEICTTNPVAYEPYGSVATNLQERGNPQ

SEQ ID NO: 48932 - protein, 30 aa, Artificial Sequence
  Description of Artificial Sequence: Synthetic polypeptide
DENEIRTTNPVATEQYGCVSWTNLTNGMGQ

SEQ ID NO: 48933 - protein, 31 aa, Artificial Sequence
  Description of Artificial Sequence: Synthetic polypeptide
AEEEIRTTNPVATEQYGSVSVTTGDQGNGND

SEQ ID NO: 48934 - protein, 30 aa, Artificial Sequence
  Description of Artificial Sequence: Synthetic polypeptide
DENEIRTTNPVATEQYGEASSEPNGQRGGR

SEQ ID NO: 48935 - protein, 30 aa, Artificial Sequence
  Description of Artificial Sequence: Synthetic polypeptide
SEEEICTTNPVATEVYGSVATNLQIDGNVE

SEQ ID NO: 48936 - protein, 31 aa, Artificial Sequence
  Description of Artificial Sequence: Synthetic polypeptide
DEVEIRTTNPVATEQYGSVISTNTGQDEGLQ

SEQ ID NO: 48937 - protein, 30 aa, Artificial Sequence
  Description of Artificial Sequence: Synthetic polypeptide
DENEIRTTNPVATEQYGEVSENLMNRAEGR

SEQ ID NO: 48938 - protein, 33 aa, Artificial Sequence
  Description of Artificial Sequence: Synthetic polypeptide
DEVEIRTTNPVATEQYGSVGSTNLQFNEGGNEG

SEQ ID NO: 48939 - protein, 30 aa, Artificial Sequence
  Description of Artificial Sequence: Synthetic polypeptide
DENEIRTTNPVATEQYGHVEWTNLNRGQQD

SEQ ID NO: 48940 - protein, 30 aa, Artificial Sequence
  Description of Artificial Sequence: Synthetic polypeptide
SEEEICTTNPVATESYGSVATNLQIDGNEE

SEQ ID NO: 48941 - protein, 30 aa, Artificial Sequence
  Description of Artificial Sequence: Synthetic polypeptide
DENEIRTTNPVATEQYGDVSENLMNRAEGR

SEQ ID NO: 48942 - protein, 32 aa, Artificial Sequence
  Description of Artificial Sequence: Synthetic polypeptide
DEVEIRTTNPVATEQYGAVSTNLQQTGGTNDQ

SEQ ID NO: 48943 - protein, 29 aa, Artificial Sequence
  Description of Artificial Sequence: Synthetic peptide
DEVEIRTTNPVATEQYGSVSCEEVQYGDD

SEQ ID NO: 48944 - protein, 31 aa, Artificial Sequence
  Description of Artificial Sequence: Synthetic polypeptide
DENEIRTTNPVATEQYGCVSTNWGDERENQR

SEQ ID NO: 48945 - protein, 33 aa, Artificial Sequence
  Description of Artificial Sequence: Synthetic polypeptide
DENEIRTTNPVATEQYGCTISTNELTQRGQNER

SEQ ID NO: 48946 - protein, 31 aa, Artificial Sequence
  Description of Artificial Sequence: Synthetic polypeptide
DENEIRTTNPVATEQYGCVCSNTNLQNFGEQ

SEQ ID NO: 48947 - protein, 30 aa, Artificial Sequence
  Description of Artificial Sequence: Synthetic polypeptide
DENEIRTTNPVATEQYGCVCSQNLIRNSNQ

SEQ ID NO: 48948 - protein, 28 aa, Artificial Sequence
  Description of Artificial Sequence: Synthetic peptide
SEEEIECTNPIATEQYGSVSENLMRENG

SEQ ID NO: 48949 - protein, 28 aa, Artificial Sequence
  Description of Artificial Sequence: Synthetic peptide
AENEIACTNPVATEQYGWASMNLQRGGR

SEQ ID NO: 48950 - protein, 31 aa, Artificial Sequence
  Description of Artificial Sequence: Synthetic polypeptide
DENEIRTTNPVATEQYGCVHSTGNTQHDQNR

SEQ ID NO: 48951 - protein, 30 aa, Artificial Sequence
  Description of Artificial Sequence: Synthetic polypeptide
SEEEICTTNPVAYEQYGSVATNLQRNNTLA

SEQ ID NO: 48952 - protein, 28 aa, Artificial Sequence
  Description of Artificial Sequence: Synthetic peptide
AENEIACTNPVATEQYGYASENLQRGGR

SEQ ID NO: 48953 - protein, 31 aa, Artificial Sequence
  Description of Artificial Sequence: Synthetic polypeptide
DENEIRTTNPVATEQYGCVSGTNLTEGMNQY

SEQ ID NO: 48954 - protein, 32 aa, Artificial Sequence
  Description of Artificial Sequence: Synthetic polypeptide
AEEEIRTTNPVATEQYGSVSTVNNNQEGNAQG

SEQ ID NO: 48955 - protein, 30 aa, Artificial Sequence
  Description of Artificial Sequence: Synthetic polypeptide
DENEIRTTNPVATEQYGCVSTNHQNFGEQA

SEQ ID NO: 48956 - protein, 30 aa, Artificial Sequence
  Description of Artificial Sequence: Synthetic polypeptide
DENEIRTTNPVATEQYGCVSTNLDQDTQDN

SEQ ID NO: 48957 - protein, 31 aa, Artificial Sequence
  Description of Artificial Sequence: Synthetic polypeptide
DENEIRTTNPVATEQYGCVSTNLDQETQDRV

SEQ ID NO: 48958 - protein, 30 aa, Artificial Sequence
  Description of Artificial Sequence: Synthetic polypeptide
SEEEICTTNPVAYEQYGSVATNLQHGNDSV

SEQ ID NO: 48959 - protein, 31 aa, Artificial Sequence
  Description of Artificial Sequence: Synthetic polypeptide
DENEIRTTNPVATEQYGCVSTNNLQDGMDQD

SEQ ID NO: 48960 - protein, 31 aa, Artificial Sequence
  Description of Artificial Sequence: Synthetic polypeptide
DENEIRTTNPVATEQYGCVSTNNQEGGNDIE

SEQ ID NO: 48961 - protein, 30 aa, Artificial Sequence
  Description of Artificial Sequence: Synthetic polypeptide
DENEIRTTNPVATEQYGCVSPNLQDFEDQR

SEQ ID NO: 48962 - protein, 32 aa, Artificial Sequence
  Description of Artificial Sequence: Synthetic polypeptide
DENEIRTTNPVATEQYGSVSSTPAGPNRGMNR

SEQ ID NO: 48963 - protein, 30 aa, Artificial Sequence
  Description of Artificial Sequence: Synthetic polypeptide
SEEEICTTNPVATEPYGNVATNLQERGNTA

SEQ ID NO: 48964 - protein, 31 aa, Artificial Sequence
  Description of Artificial Sequence: Synthetic polypeptide
SEEEICTTNPVATEMYGSVATNLQRDGNDSE

SEQ ID NO: 48965 - protein, 32 aa, Artificial Sequence
  Description of Artificial Sequence: Synthetic polypeptide
CEEEIRTTNPVATEQYGSVCSTNLQHFNSNQL

SEQ ID NO: 48966 - protein, 29 aa, Artificial Sequence
  Description of Artificial Sequence: Synthetic peptide
QEEEIRTTNPVATEQYGSVSEVCPNRENV

SEQ ID NO: 48967 - protein, 28 aa, Artificial Sequence
  Description of Artificial Sequence: Synthetic peptide
AENEIACTNPVSTEQYGEVSCNLQRGTR

SEQ ID NO: 48968 - protein, 31 aa, Artificial Sequence
  Description of Artificial Sequence: Synthetic polypeptide
DENEIRTTNPVATEQYGSVTTTNMLEGGTER

SEQ ID NO: 48969 - protein, 30 aa, Artificial Sequence
  Description of Artificial Sequence: Synthetic polypeptide
DENEIRTTNPVATEQYGSVVDQNLFENMNR

SEQ ID NO: 48970 - protein, 33 aa, Artificial Sequence
  Description of Artificial Sequence: Synthetic polypeptide
QEEEIRTTNPVATEQYGSVSGTSNEGQGGENGR

SEQ ID NO: 48971 - protein, 33 aa, Artificial Sequence
  Description of Artificial Sequence: Synthetic polypeptide
QEEEIRTTNPVATEQYGSVSGTVNLIIPGTNPR

SEQ ID NO: 48972 - protein, 29 aa, Artificial Sequence
  Description of Artificial Sequence: Synthetic peptide
DENEIRTTNPVATEQYGSVWVDEQEGDRL

SEQ ID NO: 48973 - protein, 32 aa, Artificial Sequence
  Description of Artificial Sequence: Synthetic polypeptide
DENEIRTTNPVATEQYGSVYSPVNPQDEGNSR

SEQ ID NO: 48974 - protein, 31 aa, Artificial Sequence
  Description of Artificial Sequence: Synthetic polypeptide
SEEEIATTNPVATEQYGSVATNPLQAEMGNL

SEQ ID NO: 48975 - protein, 31 aa, Artificial Sequence
  Description of Artificial Sequence: Synthetic polypeptide
DENEIRTTNPVATEQYGSWSVPNMLQRDFNE

SEQ ID NO: 48976 - protein, 30 aa, Artificial Sequence
  Description of Artificial Sequence: Synthetic polypeptide
SEEEIATTNPVATEQYGSVATNLQRADLTE

SEQ ID NO: 48977 - protein, 29 aa, Artificial Sequence
  Description of Artificial Sequence: Synthetic peptide
DEVEICTTNPVATDQYGVVSTALQIGNDD

SEQ ID NO: 48978 - protein, 32 aa, Artificial Sequence
  Description of Artificial Sequence: Synthetic polypeptide
DENEIRTTNPVATEQYGVVCSTEELQRGSNQS

SEQ ID NO: 48979 - protein, 31 aa, Artificial Sequence
  Description of Artificial Sequence: Synthetic polypeptide
DENEIRTTNPVATEQYGVVSAELQRGPQNLG

SEQ ID NO: 48980 - protein, 33 aa, Artificial Sequence
  Description of Artificial Sequence: Synthetic polypeptide
DENEIRTTNPVATEQYGSVSWTLNLERGGDNNE

SEQ ID NO: 48981 - protein, 30 aa, Artificial Sequence
  Description of Artificial Sequence: Synthetic polypeptide
CEEEIRTTNPVATEQYGSVCTNLLNGVSYQ

SEQ ID NO: 48982 - protein, 29 aa, Artificial Sequence
  Description of Artificial Sequence: Synthetic peptide
SEEEIATTNPVATEQYGSVCATNDQGGDP

SEQ ID NO: 48983 - protein, 30 aa, Artificial Sequence
  Description of Artificial Sequence: Synthetic polypeptide
SEEEIATTNPVATEQYGSVCSTPDQDGEHR

SEQ ID NO: 48984 - protein, 30 aa, Artificial Sequence
  Description of Artificial Sequence: Synthetic polypeptide
DENEIRTTNPVATEQYGSVSVTDMIERGEE

SEQ ID NO: 48985 - protein, 32 aa, Artificial Sequence
  Description of Artificial Sequence: Synthetic polypeptide
SEEEIATTNPVATEQYGTVSYTNLSQRTGGNP

SEQ ID NO: 48986 - protein, 31 aa, Artificial Sequence
  Description of Artificial Sequence: Synthetic polypeptide
DENEIRTTNPVATEQYGSVSVTDMIQNGNEE

SEQ ID NO: 48987 - protein, 31 aa, Artificial Sequence
  Description of Artificial Sequence: Synthetic polypeptide
DENEIRTTNPVATEQYGSVSVTLLDQETQGR

SEQ ID NO: 48988 - protein, 32 aa, Artificial Sequence
  Description of Artificial Sequence: Synthetic polypeptide
DENEIRTTNPVATEQYGSVSVTTNLEGGNGNE

SEQ ID NO: 48989 - protein, 33 aa, Artificial Sequence
  Description of Artificial Sequence: Synthetic polypeptide
DENEIRTTNPVATEQYGSVSVVTLMLQRGEDRY

SEQ ID NO: 48990 - protein, 32 aa, Artificial Sequence
  Description of Artificial Sequence: Synthetic polypeptide
AEEEIRTTNPVATEQYGSVSTVNTNQAIGNNE

SEQ ID NO: 48991 - protein, 28 aa, Artificial Sequence
  Description of Artificial Sequence: Synthetic peptide
AENEIACVNPVATEQYGEVSDNLQRGGR

SEQ ID NO: 48992 - protein, 32 aa, Artificial Sequence
  Description of Artificial Sequence: Synthetic polypeptide
QEEEIRTTNPVATEQYGSVSETVLQRNENTYS

SEQ ID NO: 48993 - protein, 33 aa, Artificial Sequence
  Description of Artificial Sequence: Synthetic polypeptide
CEEEIRTTNPVATEQYGSVISTGDLQRNGNEGE

SEQ ID NO: 48994 - protein, 31 aa, Artificial Sequence
  Description of Artificial Sequence: Synthetic polypeptide
SEEEIATTNPVATEQYGSVSATDLEDHEGNR

SEQ ID NO: 48995 - protein, 33 aa, Artificial Sequence
  Description of Artificial Sequence: Synthetic polypeptide
DENEIRTTNPVATEQYGSVSWNLQDQRGGDNQE

SEQ ID NO: 48996 - protein, 32 aa, Artificial Sequence
  Description of Artificial Sequence: Synthetic polypeptide
CEEEIRTTNPVATEQYGSVFTNLQNAGAEANV

SEQ ID NO: 48997 - protein, 31 aa, Artificial Sequence
  Description of Artificial Sequence: Synthetic polypeptide
SEEEIATTNPVATEQYGSVSANLQDQGNEQF

SEQ ID NO: 48998 - protein, 28 aa, Artificial Sequence
  Description of Artificial Sequence: Synthetic peptide
AENEIACTNPVSTEQYGEVSCNLQRGGR

SEQ ID NO: 48999 - protein, 29 aa, Artificial Sequence
  Description of Artificial Sequence: Synthetic peptide
DENEIRTTNPVATEQYGSVSWPNDQESEG

SEQ ID NO: 49000 - protein, 30 aa, Artificial Sequence
  Description of Artificial Sequence: Synthetic polypeptide
DENEIRTTNPVATEQYGSVSWNDERGDGDQ

SEQ ID NO: 49001 - protein, 29 aa, Artificial Sequence
  Description of Artificial Sequence: Synthetic peptide
DENEIRTTNPVATEQYGVVSSVLQREEQD

SEQ ID NO: 49002 - protein, 30 aa, Artificial Sequence
  Description of Artificial Sequence: Synthetic polypeptide
DENEIRTTNPVATEQYGVVSSVLQRNENED

SEQ ID NO: 49003 - protein, 28 aa, Artificial Sequence
  Description of Artificial Sequence: Synthetic peptide
AENEIACVNPVATEQYGEVSENLQRGGR

SEQ ID NO: 49004 - protein, 30 aa, Artificial Sequence
  Description of Artificial Sequence: Synthetic polypeptide
DEVEIATTNPVAYEQYGTVSTNLQMGGNGG

SEQ ID NO: 49005 - protein, 28 aa, Artificial Sequence
  Description of Artificial Sequence: Synthetic peptide
AENEIAPTNPCATEQYGEVSENLQRGGR

SEQ ID NO: 49006 - protein, 31 aa, Artificial Sequence
  Description of Artificial Sequence: Synthetic polypeptide
QEEEIRTTNPVATEQYGSVSLSNNIQDGNYA

SEQ ID NO: 49007 - protein, 30 aa, Artificial Sequence
  Description of Artificial Sequence: Synthetic polypeptide
SEEEIATTNPVATEQYGSVATNLQDPGEDH

SEQ ID NO: 49008 - protein, 30 aa, Artificial Sequence
  Description of Artificial Sequence: Synthetic polypeptide
SEEEIATTNPVATEQYGSVATNLQAPNEIA

SEQ ID NO: 49009 - protein, 31 aa, Artificial Sequence
  Description of Artificial Sequence: Synthetic polypeptide
SEEEIATTNPVATEQYGSVATNLQANGDNNP

SEQ ID NO: 49010 - protein, 30 aa, Artificial Sequence
  Description of Artificial Sequence: Synthetic polypeptide
DENEIRTTNPVAVEQYGSVTTTNLEDENRT

SEQ ID NO: 49011 - protein, 29 aa, Artificial Sequence
  Description of Artificial Sequence: Synthetic peptide
DENEIRTTNPVAVEQYGSVNTTNLEEENS

SEQ ID NO: 49012 - protein, 31 aa, Artificial Sequence
  Description of Artificial Sequence: Synthetic polypeptide
SEEEIATTNPVATEQYGSVATNLQADNQDRN

SEQ ID NO: 49013 - protein, 31 aa, Artificial Sequence
  Description of Artificial Sequence: Synthetic polypeptide
CEEEIRTTNPVATEQYGHVSWTVLNRGSNDE

SEQ ID NO: 49014 - protein, 31 aa, Artificial Sequence
  Description of Artificial Sequence: Synthetic polypeptide
CEEEIRTTNPVATEQYGHVSWPNLNRGMNPE

SEQ ID NO: 49015 - protein, 30 aa, Artificial Sequence
  Description of Artificial Sequence: Synthetic polypeptide
DENEIRTTNPVAYEAYGSVPSNNLSQRGTQ

SEQ ID NO: 49016 - protein, 32 aa, Artificial Sequence
  Description of Artificial Sequence: Synthetic polypeptide
AEEEIRTTNPVATEQYGSVSTVQNLDEFGNVE

SEQ ID NO: 49017 - protein, 28 aa, Artificial Sequence
  Description of Artificial Sequence: Synthetic peptide
AENEIAPTNPVASEQYGEVSENLQRGTR

SEQ ID NO: 49018 - protein, 31 aa, Artificial Sequence
  Description of Artificial Sequence: Synthetic polypeptide
SEEEIATTNPVATEQYGSVATNLNRNNDERT

SEQ ID NO: 49019 - protein, 30 aa, Artificial Sequence
  Description of Artificial Sequence: Synthetic polypeptide
DENEIRTTNPVAYEAYGSVSQNELSQRGTQ

SEQ ID NO: 49020 - protein, 28 aa, Artificial Sequence
  Description of Artificial Sequence: Synthetic peptide
AENEIAPTNPVASEQYGEVSENLQRGGR

SEQ ID NO: 49021 - protein, 30 aa, Artificial Sequence
  Description of Artificial Sequence: Synthetic polypeptide
DENEIRTTNPVATEQYGSVSVPNLDHTGEI

SEQ ID NO: 49022 - protein, 32 aa, Artificial Sequence
  Description of Artificial Sequence: Synthetic polypeptide
CEEEIRTTNPVATEQYGQCVCSNTNLQHGSNQ

SEQ ID NO: 49023 - protein, 28 aa, Artificial Sequence
  Description of Artificial Sequence: Synthetic peptide
DENEIRTTNPVAVEQYGSTSTNLEGTTA

SEQ ID NO: 49024 - protein, 32 aa, Artificial Sequence
  Description of Artificial Sequence: Synthetic polypeptide
QEEEIRTTNPVATEQYGSVSITINPQTMGNNY

SEQ ID NO: 49025 - protein, 30 aa, Artificial Sequence
  Description of Artificial Sequence: Synthetic polypeptide
DENEIRTTNPVATEQYGVVSTVLTIGPNDL

SEQ ID NO: 49026 - protein, 28 aa, Artificial Sequence
  Description of Artificial Sequence: Synthetic peptide
AENEIAGTNPVATEQYGEASENLQRGGR

SEQ ID NO: 49027 - protein, 29 aa, Artificial Sequence
  Description of Artificial Sequence: Synthetic peptide
DENEIRTTNPVATEQYGVVSTVQQIPNMD

SEQ ID NO: 49028 - protein, 30 aa, Artificial Sequence
  Description of Artificial Sequence: Synthetic polypeptide
SEEEIATTNPVATEQYGSVATNLQNNSNEN

SEQ ID NO: 49029 - protein, 28 aa, Artificial Sequence
  Description of Artificial Sequence: Synthetic peptide
AENEIAMTNPVATEQYGEASENLQRGGR

SEQ ID NO: 49030 - protein, 31 aa, Artificial Sequence
  Description of Artificial Sequence: Synthetic polypeptide
AEEEIRTTNPVATEQYGSVSTVQLQQTNENE

SEQ ID NO: 49031 - protein, 29 aa, Artificial Sequence
  Description of Artificial Sequence: Synthetic peptide
DENEIRTTNPVAVEQYGSVCTTNLEDEND

SEQ ID NO: 49032 - protein, 30 aa, Artificial Sequence
  Description of Artificial Sequence: Synthetic polypeptide
DENEIRTTNPVATETYGSVSNNLQPRFATP

SEQ ID NO: 49033 - protein, 29 aa, Artificial Sequence
  Description of Artificial Sequence: Synthetic peptide
DENEIRTTNPVATWHYGSVSTNLEQLTED

SEQ ID NO: 49034 - protein, 31 aa, Artificial Sequence
  Description of Artificial Sequence: Synthetic polypeptide
DENEIRTTNPVATWHYGSVSTNLEQRTEGDI

SEQ ID NO: 49035 - protein, 32 aa, Artificial Sequence
  Description of Artificial Sequence: Synthetic polypeptide
SEEEIATTNPVATEQYGSVATNLQEANGVNDR

SEQ ID NO: 49036 - protein, 30 aa, Artificial Sequence
  Description of Artificial Sequence: Synthetic polypeptide
DENEIRTTNPVAVEQYGSCSTWNLEVELNR

SEQ ID NO: 49037 - protein, 28 aa, Artificial Sequence
  Description of Artificial Sequence: Synthetic peptide
AENEIAMTNPVATEQYGTASENLQRGGR

SEQ ID NO: 49038 - protein, 31 aa, Artificial Sequence
  Description of Artificial Sequence: Synthetic polypeptide
SEEEIATTNPVATEQYGSVATNLQDRADPRE

SEQ ID NO: 49039 - protein, 29 aa, Artificial Sequence
  Description of Artificial Sequence: Synthetic peptide
DENEIRTTNPVAVEQYGSTSTNLEGTNNE

SEQ ID NO: 49040 - protein, 31 aa, Artificial Sequence
  Description of Artificial Sequence: Synthetic polypeptide
SEEEIATTNPVATEQYGSVATNLQENNGENH

SEQ ID NO: 49041 - protein, 32 aa, Artificial Sequence
  Description of Artificial Sequence: Synthetic polypeptide
AEEEIRTTNPVATEQYGSVSTVNLSENNGNIG

SEQ ID NO: 49042 - protein, 31 aa, Artificial Sequence
  Description of Artificial Sequence: Synthetic polypeptide
DENEIRTTNPVATEQYGSVSVNLNQGNDGEE

SEQ ID NO: 49043 - protein, 32 aa, Artificial Sequence
  Description of Artificial Sequence: Synthetic polypeptide
DENEIRTTNPVATEQYGSVSVMVDLDQEGENR

SEQ ID NO: 49044 - protein, 32 aa, Artificial Sequence
  Description of Artificial Sequence: Synthetic polypeptide
AEEEIRTTNPVATEQYGSVSTVNQQQGNNQTE

SEQ ID NO: 49045 - protein, 32 aa, Artificial Sequence
  Description of Artificial Sequence: Synthetic polypeptide
AEEEIRTTNPVATEQYGSVSVTSNDEQGGNNV

SEQ ID NO: 49046 - protein, 31 aa, Artificial Sequence
  Description of Artificial Sequence: Synthetic polypeptide
DENEIRTTNPVATEQYGSVSTLLERFGSVQG

SEQ ID NO: 49047 - protein, 32 aa, Artificial Sequence
  Description of Artificial Sequence: Synthetic polypeptide
CEEEIRTTNPVATEQYGTVSCTNGSQRTGGNP

SEQ ID NO: 49048 - protein, 33 aa, Artificial Sequence
  Description of Artificial Sequence: Synthetic polypeptide
AEEEIRTTNPVATEQYGSVSVTQNLQNNLGNND

SEQ ID NO: 49049 - protein, 31 aa, Artificial Sequence
  Description of Artificial Sequence: Synthetic polypeptide
DENEIRTTNPVATEQYGSVSTLNMQETEGVN

SEQ ID NO: 49050 - protein, 31 aa, Artificial Sequence
  Description of Artificial Sequence: Synthetic polypeptide
AEEEIRTTNPVATEQYGSVSVTNVNTTGNEG

SEQ ID NO: 49051 - protein, 33 aa, Artificial Sequence
  Description of Artificial Sequence: Synthetic polypeptide
DENEIRTTNPVATEQYGSVSTLPNLDTRGQNEN

SEQ ID NO: 49052 - protein, 31 aa, Artificial Sequence
  Description of Artificial Sequence: Synthetic polypeptide
DEVEIRTTNPVATECWGSVSTNLQSGDGNDN

SEQ ID NO: 49053 - protein, 32 aa, Artificial Sequence
  Description of Artificial Sequence: Synthetic polypeptide
AEEEIRTTNPVATEQYGSVSTVNQQQGVNNVD

SEQ ID NO: 49054 - protein, 32 aa, Artificial Sequence
  Description of Artificial Sequence: Synthetic polypeptide
AEEEIRTTNPVATEQYGSVSVTNVNQLQGNVN

SEQ ID NO: 49055 - protein, 30 aa, Artificial Sequence
  Description of Artificial Sequence: Synthetic polypeptide
DEVEIRTTNPVATDQYGSVNDQLDQERGND

SEQ ID NO: 49056 - protein, 31 aa, Artificial Sequence
  Description of Artificial Sequence: Synthetic polypeptide
AEEEIRTTNPVATEQYGSVSVTNVNQDEEND

SEQ ID NO: 49057 - protein, 28 aa, Artificial Sequence
  Description of Artificial Sequence: Synthetic peptide
SEEEICCTNPTATEQYGSVSENLMHGNQ

SEQ ID NO: 49058 - protein, 30 aa, Artificial Sequence
  Description of Artificial Sequence: Synthetic polypeptide
CEEEIRTTNPVATEQYGSVVTALQGNGEFT

SEQ ID NO: 49059 - protein, 32 aa, Artificial Sequence
  Description of Artificial Sequence: Synthetic polypeptide
AEEEIRTTNPVATEQYGSVSTVNQQQEQGNNN

SEQ ID NO: 49060 - protein, 29 aa, Artificial Sequence
  Description of Artificial Sequence: Synthetic peptide
SEEEICCTNPTATEQYGSVSSNLMTRGNQ

SEQ ID NO: 49061 - protein, 31 aa, Artificial Sequence
  Description of Artificial Sequence: Synthetic polypeptide
DEVEIRTTNPVATECYGSVSTNLNGMGGDGR

SEQ ID NO: 49062 - protein, 32 aa, Artificial Sequence
  Description of Artificial Sequence: Synthetic polypeptide
DENEIRTTNPVATEQYGSVSTGNLQNFGSEQA

SEQ ID NO: 49063 - protein, 31 aa, Artificial Sequence
  Description of Artificial Sequence: Synthetic polypeptide
DENEIRTTNPVATEQYGSVSTAGNMRNGMNV

SEQ ID NO: 49064 - protein, 32 aa, Artificial Sequence
  Description of Artificial Sequence: Synthetic polypeptide
DEVEIRTTNPVATEQYGAVSTGNLGQTGTNDQ

SEQ ID NO: 49065 - protein, 31 aa, Artificial Sequence
  Description of Artificial Sequence: Synthetic polypeptide
DEVEIRTTNPVATEQWGEVSTNLQGEDGNGE

SEQ ID NO: 49066 - protein, 31 aa, Artificial Sequence
  Description of Artificial Sequence: Synthetic polypeptide
DENEIRTTNPVATEQYGSVSTANLENFGDEQ

SEQ ID NO: 49067 - protein, 29 aa, Artificial Sequence
  Description of Artificial Sequence: Synthetic peptide
DENEIRTTNPVATEQYGSVSTCAQELTGA

SEQ ID NO: 49068 - protein, 32 aa, Artificial Sequence
  Description of Artificial Sequence: Synthetic polypeptide
DENEIRTTNPVATEQYGSVSTDALQEGGNEIT

SEQ ID NO: 49069 - protein, 30 aa, Artificial Sequence
  Description of Artificial Sequence: Synthetic polypeptide
SEEEICTTNPVATEMYGSVATNLQEAGNPD

SEQ ID NO: 49070 - protein, 31 aa, Artificial Sequence
  Description of Artificial Sequence: Synthetic polypeptide
DENEIRTTNPVATEQYGSVSTNDDEGLNEHT

SEQ ID NO: 49071 - protein, 32 aa, Artificial Sequence
  Description of Artificial Sequence: Synthetic polypeptide
DENEIRTTNPVATEQYGSVSTDDLSRGGEDRN

SEQ ID NO: 49072 - protein, 30 aa, Artificial Sequence
  Description of Artificial Sequence: Synthetic polypeptide
SEEEICTTNPVATEAYGSVATNLQEAGNEQ

SEQ ID NO: 49073 - protein, 31 aa, Artificial Sequence
  Description of Artificial Sequence: Synthetic polypeptide
SEEEICTTNPTAYEQYGSVATNLQHRGENDR

SEQ ID NO: 49074 - protein, 32 aa, Artificial Sequence
  Description of Artificial Sequence: Synthetic polypeptide
DEVEIRTTNPVATEPYGSVSFTMNGLSQYVNR

SEQ ID NO: 49075 - protein, 32 aa, Artificial Sequence
  Description of Artificial Sequence: Synthetic polypeptide
AEEEIRTTNPVATEQYGSVSVTSNDQGNGNQN

SEQ ID NO: 49076 - protein, 32 aa, Artificial Sequence
  Description of Artificial Sequence: Synthetic polypeptide
DEVEIRTTNPVATECYGSVSTNLQNMGQNGDA

SEQ ID NO: 49077 - protein, 32 aa, Artificial Sequence
  Description of Artificial Sequence: Synthetic polypeptide
DEVEIRTTNPVATECYGSVSTNLQGGAGDNEK

SEQ ID NO: 49078 - protein, 31 aa, Artificial Sequence
  Description of Artificial Sequence: Synthetic polypeptide
DENEIRTTNPVATEQYGSVSTGEHQRGSEQS

SEQ ID NO: 49079 - protein, 32 aa, Artificial Sequence
  Description of Artificial Sequence: Synthetic polypeptide
DEVEIRTTNPVATEPYGSVSTNLGGEDAGNNR

SEQ ID NO: 49080 - protein, 29 aa, Artificial Sequence
  Description of Artificial Sequence: Synthetic peptide
SEEEICCTNPTATEQYGSVASNLMRGNDR

SEQ ID NO: 49081 - protein, 31 aa, Artificial Sequence
  Description of Artificial Sequence: Synthetic polypeptide
DENEIRTTNPVATEQYGSVSTNDDQEGQIDG

SEQ ID NO: 49082 - protein, 33 aa, Artificial Sequence
  Description of Artificial Sequence: Synthetic polypeptide
DENEIRTTNPVATEQYGSVSTNDNLWERGEDRN

SEQ ID NO: 49083 - protein, 32 aa, Artificial Sequence
  Description of Artificial Sequence: Synthetic polypeptide
AEEEIRTTNPVATEQYGSVSVTNTLLGNGGNG

SEQ ID NO: 49084 - protein, 29 aa, Artificial Sequence
  Description of Artificial Sequence: Synthetic peptide
SEEEIATTNPVAYEQYGSVATNLQDGPQN

SEQ ID NO: 49085 - protein, 32 aa, Artificial Sequence
  Description of Artificial Sequence: Synthetic polypeptide
DEVEICTTNPVATEQYGSVSTNLQGNDGNGMS

SEQ ID NO: 49086 - protein, 29 aa, Artificial Sequence
  Description of Artificial Sequence: Synthetic peptide
SEEEIATTNPVAYEQYGSVATNLQAGVPN

SEQ ID NO: 49087 - protein, 31 aa, Artificial Sequence
  Description of Artificial Sequence: Synthetic polypeptide
AEEEIRTTNPVATEQYGSVSTVNQQQTQNDN

SEQ ID NO: 49088 - protein, 32 aa, Artificial Sequence
  Description of Artificial Sequence: Synthetic polypeptide
AEEEIRTTNPVATEQYGSVSTVNQQVTGNQGE

SEQ ID NO: 49089 - protein, 31 aa, Artificial Sequence
  Description of Artificial Sequence: Synthetic polypeptide
DENEIRTTNPVATEQYGSVSTWNDERGDGLQ

SEQ ID NO: 49090 - protein, 32 aa, Artificial Sequence
  Description of Artificial Sequence: Synthetic polypeptide
AEEEIRTTNPVATEQYGSVSVTNTLTTGNEGN

SEQ ID NO: 49091 - protein, 31 aa, Artificial Sequence
  Description of Artificial Sequence: Synthetic polypeptide
SEEEIATTNPVAYEQYGSVATNLQAGNPPRD

SEQ ID NO: 49092 - protein, 31 aa, Artificial Sequence
  Description of Artificial Sequence: Synthetic polypeptide
DEVEICTTNPVATEQYGSVSTNGNQGNGNDL

SEQ ID NO: 49093 - protein, 30 aa, Artificial Sequence
  Description of Artificial Sequence: Synthetic polypeptide
SEEEIATTNPVATESYGSVATNLQDQGDRH

SEQ ID NO: 49094 - protein, 30 aa, Artificial Sequence
  Description of Artificial Sequence: Synthetic polypeptide
SEEEIATTNPVATESYGSVANTNLVRGEQR

SEQ ID NO: 49095 - protein, 32 aa, Artificial Sequence
  Description of Artificial Sequence: Synthetic polypeptide
DEVEICTTNPVATEQYGSVSTNGGDGERGGNR

SEQ ID NO: 49096 - protein, 30 aa, Artificial Sequence
  Description of Artificial Sequence: Synthetic polypeptide
DENEIRTTNPVATEQYGSVSVHALQEQVNG

SEQ ID NO: 49097 - protein, 32 aa, Artificial Sequence
  Description of Artificial Sequence: Synthetic polypeptide
AEEEIRTTNPVATEQYGSVSVTNTDQGNGNET

SEQ ID NO: 49098 - protein, 31 aa, Artificial Sequence
  Description of Artificial Sequence: Synthetic polypeptide
QEEEIRTTNPVATEQYGSVSEINCPQDHGNK

SEQ ID NO: 49099 - protein, 31 aa, Artificial Sequence
  Description of Artificial Sequence: Synthetic polypeptide
DEVEICTTNPVATEQYGSVSTNLQGGDGGMV

SEQ ID NO: 49100 - protein, 31 aa, Artificial Sequence
  Description of Artificial Sequence: Synthetic polypeptide
DENEIRTTNPVATEQYGSVSVNLNQFDGEEQ

SEQ ID NO: 49101 - protein, 31 aa, Artificial Sequence
  Description of Artificial Sequence: Synthetic polypeptide
DEVEICTTNPVAYEQWGSVSTNLQSGGNEDR

SEQ ID NO: 49102 - protein, 31 aa, Artificial Sequence
  Description of Artificial Sequence: Synthetic polypeptide
DENEIRTTNPVATEQYGSVSTTNDEETGGNQ

SEQ ID NO: 49103 - protein, 28 aa, Artificial Sequence
  Description of Artificial Sequence: Synthetic peptide
DEVEIRTTNPCATELYGWVSTNECTGNF

SEQ ID NO: 49104 - protein, 33 aa, Artificial Sequence
  Description of Artificial Sequence: Synthetic polypeptide
CEEEIRTTNPVATEQYGSVSVTDEELQRGSNVH

SEQ ID NO: 49105 - protein, 31 aa, Artificial Sequence
  Description of Artificial Sequence: Synthetic polypeptide
CEEEIRTTNPVATEQYGSVSVDFNLQEVNEI

SEQ ID NO: 49106 - protein, 31 aa, Artificial Sequence
  Description of Artificial Sequence: Synthetic polypeptide
CEEEIRTTNPVATEQYGSVSTNLDNNFEDRI

SEQ ID NO: 49107 - protein, 32 aa, Artificial Sequence
  Description of Artificial Sequence: Synthetic polypeptide
CEEEIRTTNPVATEQYGSVSTGNLQNFGSEQS

SEQ ID NO: 49108 - protein, 28 aa, Artificial Sequence
  Description of Artificial Sequence: Synthetic peptide
AENEIACTNPVNTEQYGEVSENLQRGGR

SEQ ID NO: 49109 - protein, 32 aa, Artificial Sequence
  Description of Artificial Sequence: Synthetic polypeptide
AEEEIRTTNPVATEQYGSVSVTNVNDQIGNVN

SEQ ID NO: 49110 - protein, 34 aa, Artificial Sequence
  Description of Artificial Sequence: Synthetic polypeptide
DENEIRTTNPVATEQYGSVSTTNLPQMRNGMNPV

SEQ ID NO: 49111 - protein, 32 aa, Artificial Sequence
  Description of Artificial Sequence: Synthetic polypeptide
CEEEIRTTNPVATEQYGSVSTGLQQRNANEGD

SEQ ID NO: 49112 - protein, 32 aa, Artificial Sequence
  Description of Artificial Sequence: Synthetic polypeptide
AEEEIRTTNPVATEQYGSVSVTNTQQQGTNNT

SEQ ID NO: 49113 - protein, 32 aa, Artificial Sequence
  Description of Artificial Sequence: Synthetic polypeptide
CEEEIRTTNPVATEQYGSVSSEVVTLQFTGNR

SEQ ID NO: 49114 - protein, 32 aa, Artificial Sequence
  Description of Artificial Sequence: Synthetic polypeptide
DENEIRTTNPVATEQYGSVSTPNADQEGNDGV

SEQ ID NO: 49115 - protein, 30 aa, Artificial Sequence
  Description of Artificial Sequence: Synthetic polypeptide
QEEEIRTTNPVATEQYGSVSEACPNRNGNV

SEQ ID NO: 49116 - protein, 32 aa, Artificial Sequence
  Description of Artificial Sequence: Synthetic polypeptide
AEEEIRTTNPVATEQYGSVSTVNQQQQANGNS

SEQ ID NO: 49117 - protein, 30 aa, Artificial Sequence
  Description of Artificial Sequence: Synthetic polypeptide
CEEEIRTTNPVATEQYGSVSDTNQGNGTFP

SEQ ID NO: 49118 - protein, 30 aa, Artificial Sequence
  Description of Artificial Sequence: Synthetic polypeptide
DENEIRTTNPVATEQYGSVSTSWDQEGEDQ

SEQ ID NO: 49119 - protein, 32 aa, Artificial Sequence
  Description of Artificial Sequence: Synthetic polypeptide
DENEIRTTNPVATEQYGSVSTNNDNQRGQEDG

SEQ ID NO: 49120 - protein, 32 aa, Artificial Sequence
  Description of Artificial Sequence: Synthetic polypeptide
SEEEIRATNPVATEQYGFVSMTNLFQGGENRG

SEQ ID NO: 49121 - protein, 33 aa, Artificial Sequence
  Description of Artificial Sequence: Synthetic polypeptide
AEEEIRTTNPVATEQYGSVSTVNLQSGVTTNAT

SEQ ID NO: 49122 - protein, 31 aa, Artificial Sequence
  Description of Artificial Sequence: Synthetic polypeptide
DENEIRTTNPVATEIYGSVSTNNLQQGSTTT

SEQ ID NO: 49123 - protein, 32 aa, Artificial Sequence
  Description of Artificial Sequence: Synthetic polypeptide
AEEEIRTTNPVATEQYGSVSVTTNGQEQGNND

SEQ ID NO: 49124 - protein, 28 aa, Artificial Sequence
  Description of Artificial Sequence: Synthetic peptide
AENEIACTNPVATEQYGQASENLQRGGR

SEQ ID NO: 49125 - protein, 32 aa, Artificial Sequence
  Description of Artificial Sequence: Synthetic polypeptide
DEVEIRTTNPVATEQYGSVSTNGDDERGGNQH

SEQ ID NO: 49126 - protein, 29 aa, Artificial Sequence
  Description of Artificial Sequence: Synthetic peptide
SEEEIRCTNPIATEQWGSVSAENMMRGNR

SEQ ID NO: 49127 - protein, 29 aa, Artificial Sequence
  Description of Artificial Sequence: Synthetic peptide
SEEEIRCTNPIATEQWGSVCSENDMRGNR

SEQ ID NO: 49128 - protein, 28 aa, Artificial Sequence
  Description of Artificial Sequence: Synthetic peptide
SEEEIRCTNPIATEQWGDVSEILMRGNR

SEQ ID NO: 49129 - protein, 30 aa, Artificial Sequence
  Description of Artificial Sequence: Synthetic polypeptide
AEEEIRTTNPVATEQYGSVSTVGQQQTNNT

SEQ ID NO: 49130 - protein, 28 aa, Artificial Sequence
  Description of Artificial Sequence: Synthetic peptide
DENEIATTNPVATEQYGSVSEDLQHEEL

SEQ ID NO: 49131 - protein, 31 aa, Artificial Sequence
  Description of Artificial Sequence: Synthetic polypeptide
AEEEIRTTNPVATEQYGSVSTVLNGNNDGNS

SEQ ID NO: 49132 - protein, 29 aa, Artificial Sequence
  Description of Artificial Sequence: Synthetic peptide
DENEIATTNPVATEQYGSVSEPAGQHGNL

SEQ ID NO: 49133 - protein, 29 aa, Artificial Sequence
  Description of Artificial Sequence: Synthetic peptide
DENEIATTNPVATEQYGSVSEPALQHGEL

SEQ ID NO: 49134 - protein, 28 aa, Artificial Sequence
  Description of Artificial Sequence: Synthetic peptide
SEEEIRCTNPIATEPYGSVSEDLMQGNR

SEQ ID NO: 49135 - protein, 29 aa, Artificial Sequence
  Description of Artificial Sequence: Synthetic peptide
DENEIATTNPVATEQYGSVSEPCLQHGEL

SEQ ID NO: 49136 - protein, 31 aa, Artificial Sequence
  Description of Artificial Sequence: Synthetic polypeptide
DENEIATTNPVATEQYGSVSMTNPQDGQNPP

SEQ ID NO: 49137 - protein, 31 aa, Artificial Sequence
  Description of Artificial Sequence: Synthetic polypeptide
AEEEIRTTNPVATEQYGSVSTVLQQENGIQN

SEQ ID NO: 49138 - protein, 32 aa, Artificial Sequence
  Description of Artificial Sequence: Synthetic polypeptide
DEVEIRTTNPVATEQYGSVSTNGDQHQNGGER

SEQ ID NO: 49139 - protein, 29 aa, Artificial Sequence
  Description of Artificial Sequence: Synthetic peptide
SEEEIRCTNPIATEQWGSVSENLMAGDNR

SEQ ID NO: 49140 - protein, 31 aa, Artificial Sequence
  Description of Artificial Sequence: Synthetic polypeptide
DEVEIRTTNPVATEQYGSVSTNGGNAGDNSH

SEQ ID NO: 49141 - protein, 28 aa, Artificial Sequence
  Description of Artificial Sequence: Synthetic peptide
SEEEIRCTNPIATEQWGSVSENLMAGDR

SEQ ID NO: 49142 - protein, 32 aa, Artificial Sequence
  Description of Artificial Sequence: Synthetic polypeptide
AEEEIRTTNPVATEQYGSVSTVELQQGQNNAT

SEQ ID NO: 49143 - protein, 28 aa, Artificial Sequence
  Description of Artificial Sequence: Synthetic peptide
AENEIACTNPVATEQYGMASENLQRGGR

SEQ ID NO: 49144 - protein, 28 aa, Artificial Sequence
  Description of Artificial Sequence: Synthetic peptide
AENEIACTNPVATEQYGMSSENLQRGGR

SEQ ID NO: 49145 - protein, 29 aa, Artificial Sequence
  Description of Artificial Sequence: Synthetic peptide
SEEEIRCTNPIATEQYGATSENLMERGNR

SEQ ID NO: 49146 - protein, 29 aa, Artificial Sequence
  Description of Artificial Sequence: Synthetic peptide
DENEIATTNPVATEQYGSVAMNLQQNNPP

SEQ ID NO: 49147 - protein, 32 aa, Artificial Sequence
  Description of Artificial Sequence: Synthetic polypeptide
DEVEIRTTNPVATEQYGSVSTNGVEQGNGNND

SEQ ID NO: 49148 - protein, 31 aa, Artificial Sequence
  Description of Artificial Sequence: Synthetic polypeptide
DENEIATTNPVATEQYGSVATNLQDDPGNQD

SEQ ID NO: 49149 - protein, 30 aa, Artificial Sequence
  Description of Artificial Sequence: Synthetic polypeptide
SEEEIRCTNPIATEPYGSVSCENLMRGNNR

SEQ ID NO: 49150 - protein, 28 aa, Artificial Sequence
  Description of Artificial Sequence: Synthetic peptide
SEEEIRCTNPIATEQYGATAENLMRGNR

SEQ ID NO: 49151 - protein, 31 aa, Artificial Sequence
  Description of Artificial Sequence: Synthetic polypeptide
SEEEIRCTNPIATEQYGASVSSNLMRGGNRQ

SEQ ID NO: 49152 - protein, 28 aa, Artificial Sequence
  Description of Artificial Sequence: Synthetic peptide
AENEIACTNPVATEQYGNASENLQRGGR

SEQ ID NO: 49153 - protein, 31 aa, Artificial Sequence
  Description of Artificial Sequence: Synthetic polypeptide
DENEIATTNPVATEQYGSVATNLQNGDNNDV

SEQ ID NO: 49154 - protein, 29 aa, Artificial Sequence
  Description of Artificial Sequence: Synthetic peptide
AENEIACTNPVATEQYGNVSAENLQRGQR

SEQ ID NO: 49155 - protein, 30 aa, Artificial Sequence
  Description of Artificial Sequence: Synthetic polypeptide
SEEEIRCTNPIATEQWGSVSENLQDREGNG

SEQ ID NO: 49156 - protein, 29 aa, Artificial Sequence
  Description of Artificial Sequence: Synthetic peptide
SEEEIRCTNPIATEQWGSVSENLMRNGNM

SEQ ID NO: 49157 - protein, 31 aa, Artificial Sequence
  Description of Artificial Sequence: Synthetic polypeptide
DENEIATTNPVATEQYGSVCATPNLQQGNDT

SEQ ID NO: 49158 - protein, 30 aa, Artificial Sequence
  Description of Artificial Sequence: Synthetic polypeptide
DENEIATTNPVATEQYGSVATNLQDNPENP

SEQ ID NO: 49159 - protein, 32 aa, Artificial Sequence
  Description of Artificial Sequence: Synthetic polypeptide
AEEEIRTTNPVATEQYGSVSTVLQQQIGGGNT

SEQ ID NO: 49160 - protein, 28 aa, Artificial Sequence
  Description of Artificial Sequence: Synthetic peptide
SEEEIRCTNPIATEPWGSVSENLMRGNQ

SEQ ID NO: 49161 - protein, 30 aa, Artificial Sequence
  Description of Artificial Sequence: Synthetic polypeptide
DENEIATTNPVATEQYGSVSTDLEREGEDL

SEQ ID NO: 49162 - protein, 30 aa, Artificial Sequence
  Description of Artificial Sequence: Synthetic polypeptide
SEEEIRCTNPIATEAYGSVSENLTRTGGNR

SEQ ID NO: 49163 - protein, 32 aa, Artificial Sequence
  Description of Artificial Sequence: Synthetic polypeptide
AEEEIRTTNPVATEQYGSVSTVNGNQQTGNLE

SEQ ID NO: 49164 - protein, 32 aa, Artificial Sequence
  Description of Artificial Sequence: Synthetic polypeptide
QEEEIRTTNPVATEQYGSVISTPLQQSGNPEV

SEQ ID NO: 49165 - protein, 32 aa, Artificial Sequence
  Description of Artificial Sequence: Synthetic polypeptide
AEEEIRTTNPVATEQYGSVSTVNLDENNGTNI

SEQ ID NO: 49166 - protein, 32 aa, Artificial Sequence
  Description of Artificial Sequence: Synthetic polypeptide
AEEEIRTTNPVATEQYGSVSTVNLENNDGGNG

SEQ ID NO: 49167 - protein, 32 aa, Artificial Sequence
  Description of Artificial Sequence: Synthetic polypeptide
DEVEIRTTNPVATEQYGSVSTGNGEQNGNLDS

SEQ ID NO: 49168 - protein, 29 aa, Artificial Sequence
  Description of Artificial Sequence: Synthetic peptide
DENEIATVNPVATEQYGDVSENLQSAGNQ

SEQ ID NO: 49169 - protein, 33 aa, Artificial Sequence
  Description of Artificial Sequence: Synthetic polypeptide
DEVEIRTTNPVATEQYGSVSTGNGLQDEGENHQ

SEQ ID NO: 49170 - protein, 32 aa, Artificial Sequence
  Description of Artificial Sequence: Synthetic polypeptide
AEEEIRTTNPVATEQYGSVSTVNLENNEGNEV

SEQ ID NO: 49171 - protein, 30 aa, Artificial Sequence
  Description of Artificial Sequence: Synthetic polypeptide
DENEICTTNPMATETYGSVPTNLEHRGNGR

SEQ ID NO: 49172 - protein, 29 aa, Artificial Sequence
  Description of Artificial Sequence: Synthetic peptide
DENEICTTNPVATEAYGSVSNNLQHGTQV

SEQ ID NO: 49173 - protein, 31 aa, Artificial Sequence
  Description of Artificial Sequence: Synthetic polypeptide
DENEICTTNPVATEPYGSVAATNLQQGNDRF

SEQ ID NO: 49174 - protein, 30 aa, Artificial Sequence
  Description of Artificial Sequence: Synthetic polypeptide
DENEICTTNPVATEPYGSVAATNLQQGNPM

SEQ ID NO: 49175 - protein, 29 aa, Artificial Sequence
  Description of Artificial Sequence: Synthetic peptide
DENEICTVNPVATEQYGCVSTNLFEGGNH

SEQ ID NO: 49176 - protein, 28 aa, Artificial Sequence
  Description of Artificial Sequence: Synthetic peptide
AENEIACTNPVATEQYGSASENGQRGGR

SEQ ID NO: 49177 - protein, 32 aa, Artificial Sequence
  Description of Artificial Sequence: Synthetic polypeptide
DENEIGTTNPVATEQYGSVITNILQQARMGNL

SEQ ID NO: 49178 - protein, 32 aa, Artificial Sequence
  Description of Artificial Sequence: Synthetic polypeptide
DEVEIRTTNPVATEQYGSVSTGLQENGGGENG

SEQ ID NO: 49179 - protein, 28 aa, Artificial Sequence
  Description of Artificial Sequence: Synthetic peptide
AENEIACTNPVATEQYGLASENLQRGGR

SEQ ID NO: 49180 - protein, 29 aa, Artificial Sequence
  Description of Artificial Sequence: Synthetic peptide
AENEIACTNPVATEQYGSAMSENLQRGGR

SEQ ID NO: 49181 - protein, 28 aa, Artificial Sequence
  Description of Artificial Sequence: Synthetic peptide
AENEIACTNPVATEQYGRASENLQRGGR

SEQ ID NO: 49182 - protein, 31 aa, Artificial Sequence
  Description of Artificial Sequence: Synthetic polypeptide
AEEEIRTTNPVATEQYGSVSTVLQQQQTNGN

SEQ ID NO: 49183 - protein, 32 aa, Artificial Sequence
  Description of Artificial Sequence: Synthetic polypeptide
AEEEIRTTNPVATEQYGSVSTVNDEQEEGNNN

SEQ ID NO: 49184 - protein, 32 aa, Artificial Sequence
  Description of Artificial Sequence: Synthetic polypeptide
DEVEIRTTNPVATEQYGSVSTNDIQAESGNVD

SEQ ID NO: 49185 - protein, 32 aa, Artificial Sequence
  Description of Artificial Sequence: Synthetic polypeptide
DENEIATTNPVATEQYGSVSTNLQNRDGDTEA

SEQ ID NO: 49186 - protein, 32 aa, Artificial Sequence
  Description of Artificial Sequence: Synthetic polypeptide
AEEEIRTTNPVATEQYGSVSTVNDQQGNANFY

SEQ ID NO: 49187 - protein, 31 aa, Artificial Sequence
  Description of Artificial Sequence: Synthetic polypeptide
DENEIATTNPVATEQYGSVSTPNLERNGGEN

SEQ ID NO: 49188 - protein, 30 aa, Artificial Sequence
  Description of Artificial Sequence: Synthetic polypeptide
DENEIATTNPVATEQYGSYSWNDLQNGDNA

SEQ ID NO: 49189 - protein, 29 aa, Artificial Sequence
  Description of Artificial Sequence: Synthetic peptide
SEEEIRCTNPIATECYGSTVAENLMRGNR

SEQ ID NO: 49190 - protein, 32 aa, Artificial Sequence
  Description of Artificial Sequence: Synthetic polypeptide
AEEEIRTTNPVATEQYGSVSTVNENQQAGNNN

SEQ ID NO: 49191 - protein, 32 aa, Artificial Sequence
  Description of Artificial Sequence: Synthetic polypeptide
AEEEIRTTNPVATEQYGSVSTVNEQEGNNENN

SEQ ID NO: 49192 - protein, 30 aa, Artificial Sequence
  Description of Artificial Sequence: Synthetic polypeptide
DENEIATTNPVATESYGSVSNPNLGQRGTD

SEQ ID NO: 49193 - protein, 33 aa, Artificial Sequence
  Description of Artificial Sequence: Synthetic polypeptide
QEEEIRTTNPVATEQYGSVIETSNLVQRGENEP

SEQ ID NO: 49194 - protein, 28 aa, Artificial Sequence
  Description of Artificial Sequence: Synthetic peptide
SEEEIRCTNPIATECYGSVSENLMRENL

SEQ ID NO: 49195 - protein, 28 aa, Artificial Sequence
  Description of Artificial Sequence: Synthetic peptide
SEEEIRCTNPIATECYGSVSENLMLGDR

SEQ ID NO: 49196 - protein, 28 aa, Artificial Sequence
  Description of Artificial Sequence: Synthetic peptide
SEEEIRCTNPIATECYGSVSENLMAGNM

SEQ ID NO: 49197 - protein, 32 aa, Artificial Sequence
  Description of Artificial Sequence: Synthetic polypeptide
AEEEIRTTNPVATEQYGSVSTVNGNNQEGNSD

SEQ ID NO: 49198 - protein, 29 aa, Artificial Sequence
  Description of Artificial Sequence: Synthetic peptide
DENEIATTNPVATESYGSVANPNLQRGSD

SEQ ID NO: 49199 - protein, 28 aa, Artificial Sequence
  Description of Artificial Sequence: Synthetic peptide
AENEIACTNPVATEQYGSASENLERGGR

SEQ ID NO: 49200 - protein, 28 aa, Artificial Sequence
  Description of Artificial Sequence: Synthetic peptide
AENEIACTNPVATEQYGKASENLQRGGR

SEQ ID NO: 49201 - protein, 28 aa, Artificial Sequence
  Description of Artificial Sequence: Synthetic peptide
AENEIACTNPVATEQYGIASENLQRGGR

SEQ ID NO: 49202 - protein, 28 aa, Artificial Sequence
  Description of Artificial Sequence: Synthetic peptide
SEEEIRCTNPIATEQYGSVAENIMRGQR

SEQ ID NO: 49203 - protein, 30 aa, Artificial Sequence
  Description of Artificial Sequence: Synthetic polypeptide
SEEEIRCTNPIATEQYGSVAEENLMRGNYR

SEQ ID NO: 49204 - protein, 33 aa, Artificial Sequence
  Description of Artificial Sequence: Synthetic polypeptide
AEEEIRTTNPVATEQYGSVSVTTNLNLQVGEND

SEQ ID NO: 49205 - protein, 32 aa, Artificial Sequence
  Description of Artificial Sequence: Synthetic polypeptide
DENEIATTNPVATECYGSVSENLPQDREGENR

SEQ ID NO: 49206 - protein, 29 aa, Artificial Sequence
  Description of Artificial Sequence: Synthetic peptide
SEEEIRCTNPIATEQYGSTWSENLMRGNI

SEQ ID NO: 49207 - protein, 28 aa, Artificial Sequence
  Description of Artificial Sequence: Synthetic peptide
AENEIACTNPVATEQYGETSENLQRGGR

SEQ ID NO: 49208 - protein, 31 aa, Artificial Sequence
  Description of Artificial Sequence: Synthetic polypeptide
SEEEIRCTNPIATEQYGSTVWSNENLMRGNR

SEQ ID NO: 49209 - protein, 30 aa, Artificial Sequence
  Description of Artificial Sequence: Synthetic polypeptide
SEEEIRCTNPIATEQYGSTVWSENLMRGPR

SEQ ID NO: 49210 - protein, 30 aa, Artificial Sequence
  Description of Artificial Sequence: Synthetic polypeptide
SEEEIRCTNPIATEQYGSTVSANWMERGNR

SEQ ID NO: 49211 - protein, 30 aa, Artificial Sequence
  Description of Artificial Sequence: Synthetic polypeptide
SEEEIRCTNPIATEQYGSSVVENLMLRGNR

SEQ ID NO: 49212 - protein, 28 aa, Artificial Sequence
  Description of Artificial Sequence: Synthetic peptide
AENEIACTNPVATEQYGETSENLQRGTR

SEQ ID NO: 49213 - protein, 31 aa, Artificial Sequence
  Description of Artificial Sequence: Synthetic polypeptide
AEEEIRTTNPVATEQYGSVSTTVNQNTGGNE

SEQ ID NO: 49214 - protein, 31 aa, Artificial Sequence
  Description of Artificial Sequence: Synthetic polypeptide
SEEEIRCTNPIATEQYGSIVSENALMRGNRQ

SEQ ID NO: 49215 - protein, 34 aa, Artificial Sequence
  Description of Artificial Sequence: Synthetic polypeptide
QEEEIRTTNPVATEQYGSVETSNLVQRIGENERM

SEQ ID NO: 49216 - protein, 28 aa, Artificial Sequence
  Description of Artificial Sequence: Synthetic peptide
SEEEIRCTNPIATEQYGSISENIMRGNH

SEQ ID NO: 49217 - protein, 31 aa, Artificial Sequence
  Description of Artificial Sequence: Synthetic polypeptide
DENEIATTNPVATECYGSASEINLQREGENR

SEQ ID NO: 49218 - protein, 32 aa, Artificial Sequence
  Description of Artificial Sequence: Synthetic polypeptide
DEVEIRTTNPVATEQYGSVSTNPGDDERGGNA

SEQ ID NO: 49219 - protein, 28 aa, Artificial Sequence
  Description of Artificial Sequence: Synthetic peptide
AENEIACTNPVATEQYGETSENLQRGDR

SEQ ID NO: 49220 - protein, 30 aa, Artificial Sequence
  Description of Artificial Sequence: Synthetic polypeptide
DENEIATTNPVATECYGEASEINLQREGNR

SEQ ID NO: 49221 - protein, 30 aa, Artificial Sequence
  Description of Artificial Sequence: Synthetic polypeptide
DENEIATTNPVATCQYGCVCSTALQRGNQS

SEQ ID NO: 49222 - protein, 33 aa, Artificial Sequence
  Description of Artificial Sequence: Synthetic polypeptide
DEVEIRTTNPVATEQYGSVSTPNLNQTGGNIEV

SEQ ID NO: 49223 - protein, 29 aa, Artificial Sequence
  Description of Artificial Sequence: Synthetic peptide
SEEEIRCTNPIATEQYGSVFENLMRANTR

SEQ ID NO: 49224 - protein, 30 aa, Artificial Sequence
  Description of Artificial Sequence: Synthetic polypeptide
SEEEIRCTNPIATEQYGSVCSSNLMRGSNL

SEQ ID NO: 49225 - protein, 28 aa, Artificial Sequence
  Description of Artificial Sequence: Synthetic peptide
DENEIATTNPVATECYGATSEDLQRGGR

SEQ ID NO: 49226 - protein, 30 aa, Artificial Sequence
  Description of Artificial Sequence: Synthetic polypeptide
SEEEIRCTNPIATEQYGSVCSSNLMRGNVA

SEQ ID NO: 49227 - protein, 32 aa, Artificial Sequence
  Description of Artificial Sequence: Synthetic polypeptide
AEEEIRTTNPVATEQYGSVSVTTNLNQDENVS

SEQ ID NO: 49228 - protein, 31 aa, Artificial Sequence
  Description of Artificial Sequence: Synthetic polypeptide
AEEEIRTTNPVATEQYGSVSTTVNQQQQTNN

SEQ ID NO: 49229 - protein, 32 aa, Artificial Sequence
  Description of Artificial Sequence: Synthetic polypeptide
DEVEIRTTNPVATEQYGSVSTPNHDQEGINDG

SEQ ID NO: 49230 - protein, 30 aa, Artificial Sequence
  Description of Artificial Sequence: Synthetic polypeptide
SEEEIRCTNPIATEQYGSVCSSGNLARGNQ

SEQ ID NO: 49231 - protein, 32 aa, Artificial Sequence
  Description of Artificial Sequence: Synthetic polypeptide
DEVEIRTTNPVATEQYGSVSTPLLEQVFGNGF

SEQ ID NO: 49232 - protein, 30 aa, Artificial Sequence
  Description of Artificial Sequence: Synthetic polypeptide
SEEEIRCTNPIATEQYGSVCSSELARGSNR

SEQ ID NO: 49233 - protein, 30 aa, Artificial Sequence
  Description of Artificial Sequence: Synthetic polypeptide
SEEEIRCTNPIATEQYGSVCSNNDMRGNER

SEQ ID NO: 49234 - protein, 32 aa, Artificial Sequence
  Description of Artificial Sequence: Synthetic polypeptide
DEVEIRTTNPVATEQYGSVSTNSIQATSGNVD

SEQ ID NO: 49235 - protein, 34 aa, Artificial Sequence
  Description of Artificial Sequence: Synthetic polypeptide
DEVEIRTTNPVATEQYGSVSTNPGDQERNGGNTR

SEQ ID NO: 49236 - protein, 28 aa, Artificial Sequence
  Description of Artificial Sequence: Synthetic peptide
DENEIATTNPVATECYGDVSECLQHGNL

SEQ ID NO: 49237 - protein, 29 aa, Artificial Sequence
  Description of Artificial Sequence: Synthetic peptide
SEEEIRCTNPIATEQYGSVCSSNDMRGNA

SEQ ID NO: 49238 - protein, 29 aa, Artificial Sequence
  Description of Artificial Sequence: Synthetic peptide
DENEIATTNPVATEPYGSTAATNLQQGNL

SEQ ID NO: 49239 - protein, 28 aa, Artificial Sequence
  Description of Artificial Sequence: Synthetic peptide
SEEEIRCTNPIATEQYGSASENLMRGEK

SEQ ID NO: 49240 - protein, 30 aa, Artificial Sequence
  Description of Artificial Sequence: Synthetic polypeptide
DENEIATTNPVATEPYGSVAATNLQQGNDT

SEQ ID NO: 49241 - protein, 28 aa, Artificial Sequence
  Description of Artificial Sequence: Synthetic peptide
AENEIACTNPVATEQYGFASENLQRGGR

SEQ ID NO: 49242 - protein, 28 aa, Artificial Sequence
  Description of Artificial Sequence: Synthetic peptide
SEEEIRCTNPIATEQYGCVSWYLTRGNQ

SEQ ID NO: 49243 - protein, 28 aa, Artificial Sequence
  Description of Artificial Sequence: Synthetic peptide
AENEIACTNPVATEQYGFASYNLQRGGR

SEQ ID NO: 49244 - protein, 28 aa, Artificial Sequence
  Description of Artificial Sequence: Synthetic peptide
CENEIACTNPVATEQYGEHSENLQRGGR

SEQ ID NO: 49245 - protein, 28 aa, Artificial Sequence
  Description of Artificial Sequence: Synthetic peptide
SEEEIRCTNPIATEQYGCVSWNLMGGNV

SEQ ID NO: 49246 - protein, 28 aa, Artificial Sequence
  Description of Artificial Sequence: Synthetic peptide
AENEIACTNPVATEQYGGASENLQRGGR

SEQ ID NO: 49247 - protein, 28 aa, Artificial Sequence
  Description of Artificial Sequence: Synthetic peptide
CENEIACTNPVATEQYGEASENLQRGGR

SEQ ID NO: 49248 - protein, 28 aa, Artificial Sequence
  Description of Artificial Sequence: Synthetic peptide
AENEIACTNPVATEQYGEYSENLQRGGR

SEQ ID NO: 49249 - protein, 29 aa, Artificial Sequence
  Description of Artificial Sequence: Synthetic peptide
DENEIATTNPVATEQYGEASNENLARGPR

SEQ ID NO: 49250 - protein, 29 aa, Artificial Sequence
  Description of Artificial Sequence: Synthetic peptide
DENEIATTNPVATEQYGEVSTLLTMIGNQ

SEQ ID NO: 49251 - protein, 28 aa, Artificial Sequence
  Description of Artificial Sequence: Synthetic peptide
SEEEIRCTNPIATEQYGCVSWNLDYGNQ

SEQ ID NO: 49252 - protein, 28 aa, Artificial Sequence
  Description of Artificial Sequence: Synthetic peptide
AENEIACTNPVATEQYGHASENLQRGGR

SEQ ID NO: 49253 - protein, 29 aa, Artificial Sequence
  Description of Artificial Sequence: Synthetic peptide
DENEIATTNPVATEQYGSVAAANDDRGND

SEQ ID NO: 49254 - protein, 29 aa, Artificial Sequence
  Description of Artificial Sequence: Synthetic peptide
SEEEIRCTNPIATEQYGCVSSNHMRGSNR

SEQ ID NO: 49255 - protein, 28 aa, Artificial Sequence
  Description of Artificial Sequence: Synthetic peptide
AENEIACTNPVATEQYGIASCNLQRGGR

SEQ ID NO: 49256 - protein, 28 aa, Artificial Sequence
  Description of Artificial Sequence: Synthetic peptide
SEEEIRCTNPIATEQYGCVSENLANGNQ

SEQ ID NO: 49257 - protein, 28 aa, Artificial Sequence
  Description of Artificial Sequence: Synthetic peptide
AENEIACTNPVATEQYGGASENLQRGHR

SEQ ID NO: 49258 - protein, 28 aa, Artificial Sequence
  Description of Artificial Sequence: Synthetic peptide
AENEIACTNPVATEQYGIVSCNLQSGTR

SEQ ID NO: 49259 - protein, 28 aa, Artificial Sequence
  Description of Artificial Sequence: Synthetic peptide
SEEEIRCTNPIATEQYGEASENLMRENR

SEQ ID NO: 49260 - protein, 28 aa, Artificial Sequence
  Description of Artificial Sequence: Synthetic peptide
AENEIACTNPVATEQYGEVSENPQRGGR

SEQ ID NO: 49261 - protein, 32 aa, Artificial Sequence
  Description of Artificial Sequence: Synthetic polypeptide
DEVEIRTTNPVATEQYGSVSTNNDQNDGNNDG

SEQ ID NO: 49262 - protein, 30 aa, Artificial Sequence
  Description of Artificial Sequence: Synthetic polypeptide
DENEIATTNPVATEPYGSVAATNLQQNNGR

SEQ ID NO: 49263 - protein, 29 aa, Artificial Sequence
  Description of Artificial Sequence: Synthetic peptide
DENEIATTNPVATEPYGSVSNNLNRGPEQ

SEQ ID NO: 49264 - protein, 30 aa, Artificial Sequence
  Description of Artificial Sequence: Synthetic polypeptide
AEEEIRTTNPVATEQYGSVSTTVQQQTNNQ

SEQ ID NO: 49265 - protein, 28 aa, Artificial Sequence
  Description of Artificial Sequence: Synthetic peptide
SEEEIRCTNPIATEQYGSASENLMHENR

SEQ ID NO: 49266 - protein, 28 aa, Artificial Sequence
  Description of Artificial Sequence: Synthetic peptide
SEEEIRCTNPIATEQYGSAPENCQRGER

SEQ ID NO: 49267 - protein, 30 aa, Artificial Sequence
  Description of Artificial Sequence: Synthetic polypeptide
DENEIATTNPVATEQWGSVSMNLQDQGDRL

SEQ ID NO: 49268 - protein, 28 aa, Artificial Sequence
  Description of Artificial Sequence: Synthetic peptide
AENEIACTNPVATEQYGEWSENLQRGGR

SEQ ID NO: 49269 - protein, 30 aa, Artificial Sequence
  Description of Artificial Sequence: Synthetic polypeptide
QEEEIRTTNPVATEQYGSVEYTNQSMEENR

SEQ ID NO: 49270 - protein, 28 aa, Artificial Sequence
  Description of Artificial Sequence: Synthetic peptide
AENEIACTNPVATEQYGEVSCNLQSGGR

SEQ ID NO: 49271 - protein, 28 aa, Artificial Sequence
  Description of Artificial Sequence: Synthetic peptide
AENEIACTNPVATEQYGEVSENLQFGGR

SEQ ID NO: 49272 - protein, 29 aa, Artificial Sequence
  Description of Artificial Sequence: Synthetic peptide
AENEIACTNPVATEQYGEVSENLQRAGDR

SEQ ID NO: 49273 - protein, 28 aa, Artificial Sequence
  Description of Artificial Sequence: Synthetic peptide
SEEEIRCTNPIATEQYGNVAENIQRGQR

SEQ ID NO: 49274 - protein, 28 aa, Artificial Sequence
  Description of Artificial Sequence: Synthetic peptide
AENEIACTNPVATEQYGEVSENLQRDGR

SEQ ID NO: 49275 - protein, 28 aa, Artificial Sequence
  Description of Artificial Sequence: Synthetic peptide
AENEIACTNPVATEQYGEVSENLQREGR

SEQ ID NO: 49276 - protein, 28 aa, Artificial Sequence
  Description of Artificial Sequence: Synthetic peptide
AENEIACTNPVATEQYGEVSENLQRGEL

SEQ ID NO: 49277 - protein, 33 aa, Artificial Sequence
  Description of Artificial Sequence: Synthetic polypeptide
DEVEIRTTNPVATEQYGSVSTNLQQGQGGNNED

SEQ ID NO: 49278 - protein, 28 aa, Artificial Sequence
  Description of Artificial Sequence: Synthetic peptide
DENEIATTNPVATAQWGCVATNLERGNP

SEQ ID NO: 49279 - protein, 32 aa, Artificial Sequence
  Description of Artificial Sequence: Synthetic polypeptide
AEEEIRTTNPVATEQYGSVSTVNLENNGGNVT

SEQ ID NO: 49280 - protein, 28 aa, Artificial Sequence
  Description of Artificial Sequence: Synthetic peptide
DENEIRCTNPVATEQWGDASENLQREDR

SEQ ID NO: 49281 - protein, 33 aa, Artificial Sequence
  Description of Artificial Sequence: Synthetic polypeptide
AEEEIRTTNPVATEQYGSVSTVNLQNGNGINNV

SEQ ID NO: 49282 - protein, 33 aa, Artificial Sequence
  Description of Artificial Sequence: Synthetic polypeptide
AEEEIRTTNPVATEQYGSVSTVNLQNNNGTNVE

SEQ ID NO: 49283 - protein, 33 aa, Artificial Sequence
  Description of Artificial Sequence: Synthetic polypeptide
AEEEIRTTNPVATEQYGSVSTVNLQNSNGNNVE

SEQ ID NO: 49284 - protein, 29 aa, Artificial Sequence
  Description of Artificial Sequence: Synthetic peptide
DENEIRTTNPVATECYGTVSMCLQQHGNH

SEQ ID NO: 49285 - protein, 29 aa, Artificial Sequence
  Description of Artificial Sequence: Synthetic peptide
SEEEIRCTNPAATEQYGSVSENGMRGSNN

SEQ ID NO: 49286 - protein, 29 aa, Artificial Sequence
  Description of Artificial Sequence: Synthetic peptide
DENEIRTTNPVATEGYGCVSWNLQHGSDQ

SEQ ID NO: 49287 - protein, 31 aa, Artificial Sequence
  Description of Artificial Sequence: Synthetic polypeptide
DENEIRTTNPVATEGYGSVCSWNLQRFGSDQ

SEQ ID NO: 49288 - protein, 29 aa, Artificial Sequence
  Description of Artificial Sequence: Synthetic peptide
SEEEIRCTNPAATEQYGSVSENGMRGQQR

SEQ ID NO: 49289 - protein, 32 aa, Artificial Sequence
  Description of Artificial Sequence: Synthetic polypeptide
AEEEIRTTNPVATEQYGSVSTVNLQQIAEGGV

SEQ ID NO: 49290 - protein, 31 aa, Artificial Sequence
  Description of Artificial Sequence: Synthetic polypeptide
AEEEIRTTNPVATEQYGSVSTVNLQQIDEGQ

SEQ ID NO: 49291 - protein, 28 aa, Artificial Sequence
  Description of Artificial Sequence: Synthetic peptide
SEEEIRCTNPAATEQYGSVSENGMRGGG

SEQ ID NO: 49292 - protein, 33 aa, Artificial Sequence
  Description of Artificial Sequence: Synthetic polypeptide
AEEEIRTTNPVATEQYGSVSTVNLQQIGNQNND

SEQ ID NO: 49293 - protein, 29 aa, Artificial Sequence
  Description of Artificial Sequence: Synthetic peptide
AENEIACTNPVATEQYGTVASENLQRGGR

SEQ ID NO: 49294 - protein, 28 aa, Artificial Sequence
  Description of Artificial Sequence: Synthetic peptide
DENEIRTTNPVATEIYGCVSWELQGGEQ

SEQ ID NO: 49295 - protein, 31 aa, Artificial Sequence
  Description of Artificial Sequence: Synthetic polypeptide
DEVEIRTTNPVATEQYGSVSPTDLESENQRL

SEQ ID NO: 49296 - protein, 33 aa, Artificial Sequence
  Description of Artificial Sequence: Synthetic polypeptide
AEEEIRTTNPVATEQYGSVSTVNLQNDNGNQQE

SEQ ID NO: 49297 - protein, 33 aa, Artificial Sequence
  Description of Artificial Sequence: Synthetic polypeptide
CEEEISTTNPVATEQYGTSVYTTNPLNQRGNRM

SEQ ID NO: 49298 - protein, 30 aa, Artificial Sequence
  Description of Artificial Sequence: Synthetic polypeptide
DENEIRTTNPVATECYGSVSNNLQHDGDTS

SEQ ID NO: 49299 - protein, 29 aa, Artificial Sequence
  Description of Artificial Sequence: Synthetic peptide
DENEIRTTNPVATECYGSVSEINEQHGEL

SEQ ID NO: 49300 - protein, 31 aa, Artificial Sequence
  Description of Artificial Sequence: Synthetic polypeptide
AENEIACTNPVATEQYGSVSTNLPQRNGMGR

SEQ ID NO: 49301 - protein, 28 aa, Artificial Sequence
  Description of Artificial Sequence: Synthetic peptide
SEEEIRCTNPCATEQYGCVSWNLMRGQQ

SEQ ID NO: 49302 - protein, 31 aa, Artificial Sequence
  Description of Artificial Sequence: Synthetic polypeptide
DEVEIRTTNPVATEQYGSVSTDNHGGAGGNS

SEQ ID NO: 49303 - protein, 29 aa, Artificial Sequence
  Description of Artificial Sequence: Synthetic peptide
DENEIRTTNPVATECYGATSEDLQRGGYR

SEQ ID NO: 49304 - protein, 29 aa, Artificial Sequence
  Description of Artificial Sequence: Synthetic peptide
SEEEIRCTNPCATEQYGCVNSENLHRGNQ

SEQ ID NO: 49305 - protein, 28 aa, Artificial Sequence
  Description of Artificial Sequence: Synthetic peptide
DENEIRTTNPVATECYGDVSECLQHENL

SEQ ID NO: 49306 - protein, 30 aa, Artificial Sequence
  Description of Artificial Sequence: Synthetic polypeptide
QEEEIRTTNPVATEQYGSVMATALQNEGFD

SEQ ID NO: 49307 - protein, 33 aa, Artificial Sequence
  Description of Artificial Sequence: Synthetic polypeptide
AEEEIRTTNPVATEQYGSVSTVNLQQNDEGNNQ

SEQ ID NO: 49308 - protein, 34 aa, Artificial Sequence
  Description of Artificial Sequence: Synthetic polypeptide
DEVEIRTTNPVATEQYGSVSTDNGLGQDNGNNMR

SEQ ID NO: 49309 - protein, 29 aa, Artificial Sequence
  Description of Artificial Sequence: Synthetic peptide
DENEIRTTNPVATECYGDVSENLPQHGEL

SEQ ID NO: 49310 - protein, 30 aa, Artificial Sequence
  Description of Artificial Sequence: Synthetic polypeptide
DEVEIRTTNPVATEQYGSVSTDDGDVENQR

SEQ ID NO: 49311 - protein, 29 aa, Artificial Sequence
  Description of Artificial Sequence: Synthetic peptide
SEEEIRCTNPAATEQYGSVYENLERGGQR

SEQ ID NO: 49312 - protein, 28 aa, Artificial Sequence
  Description of Artificial Sequence: Synthetic peptide
AENEIACTNPVATEQYGTASTGLQRGGR

SEQ ID NO: 49313 - protein, 31 aa, Artificial Sequence
  Description of Artificial Sequence: Synthetic polypeptide
DEVEIRTTNPVATEQYGSVSTADDQHGGGNE

SEQ ID NO: 49314 - protein, 30 aa, Artificial Sequence
  Description of Artificial Sequence: Synthetic polypeptide
DENEIRTTNPVATECYGSVSEALQHGMNPV

SEQ ID NO: 49315 - protein, 32 aa, Artificial Sequence
  Description of Artificial Sequence: Synthetic polypeptide
AEEEIRTTNPVATEQYGSVSVTTNEQEGTNNN

SEQ ID NO: 49316 - protein, 28 aa, Artificial Sequence
  Description of Artificial Sequence: Synthetic peptide
AENEIACTNPVATEQYGTASENLQRGGR

SEQ ID NO: 49317 - protein, 30 aa, Artificial Sequence
  Description of Artificial Sequence: Synthetic polypeptide
DEVEIRTTNPVATEQYGSVSPLNQDRGLMY

SEQ ID NO: 49318 - protein, 33 aa, Artificial Sequence
  Description of Artificial Sequence: Synthetic polypeptide
AEEEIRTTNPVATEQYGSVSTVNLQQNNGINNV

SEQ ID NO: 49319 - protein, 30 aa, Artificial Sequence
  Description of Artificial Sequence: Synthetic polypeptide
DENEIRTTNPVATEIYGSVDDNNLQRGTQE

SEQ ID NO: 49320 - protein, 30 aa, Artificial Sequence
  Description of Artificial Sequence: Synthetic polypeptide
DENEIRTTNPVATEIYGSVSNNLQQQGTTN

SEQ ID NO: 49321 - protein, 30 aa, Artificial Sequence
  Description of Artificial Sequence: Synthetic polypeptide
DENEIRTTNPVATEIYGSVSNNLQSGTETG

SEQ ID NO: 49322 - protein, 30 aa, Artificial Sequence
  Description of Artificial Sequence: Synthetic polypeptide
DENEIRTTNPVATEIYGSVSNNLVRVGETV

SEQ ID NO: 49323 - protein, 31 aa, Artificial Sequence
  Description of Artificial Sequence: Synthetic polypeptide
DENEIRTTNPVATEIYGSVSNNNDQRGQTNQ

SEQ ID NO: 49324 - protein, 30 aa, Artificial Sequence
  Description of Artificial Sequence: Synthetic polypeptide
DENEIRTTNPVATEIYGSVSNNNLQIGTTE

SEQ ID NO: 49325 - protein, 32 aa, Artificial Sequence
  Description of Artificial Sequence: Synthetic polypeptide
AEEEIRTTNPVATEQYGSVSTVNLQQSNANFG

SEQ ID NO: 49326 - protein, 32 aa, Artificial Sequence
  Description of Artificial Sequence: Synthetic polypeptide
AEEEIRTTNPVATEQYGSVSTVNLQQTGIGTT

SEQ ID NO: 49327 - protein, 31 aa, Artificial Sequence
  Description of Artificial Sequence: Synthetic polypeptide
DENEIRTTNPVATEIYGSVSNNLQQGSTNTG

SEQ ID NO: 49328 - protein, 31 aa, Artificial Sequence
  Description of Artificial Sequence: Synthetic polypeptide
DENEIRTTNPVATEIYGSVSNQNLQREGQTG

SEQ ID NO: 49329 - protein, 31 aa, Artificial Sequence
  Description of Artificial Sequence: Synthetic polypeptide
AEEEIRTTNPVATEQYGSVSVTTGTQGQGNQ

SEQ ID NO: 49330 - protein, 32 aa, Artificial Sequence
  Description of Artificial Sequence: Synthetic polypeptide
DENEIRTTNPVATEIYGSVSNTNLQSGNTETN

SEQ ID NO: 49331 - protein, 33 aa, Artificial Sequence
  Description of Artificial Sequence: Synthetic polypeptide
AEEEIRTTNPVATEQYGSVSTVNLQSGTVNTEA

SEQ ID NO: 49332 - protein, 33 aa, Artificial Sequence
  Description of Artificial Sequence: Synthetic polypeptide
AEEEIRTTNPVATEQYGSVSTVNLQSGVNTTEG

SEQ ID NO: 49333 - protein, 31 aa, Artificial Sequence
  Description of Artificial Sequence: Synthetic polypeptide
DEVEIRTTNPVATEQYGSVSMNDQMNGEDRI

SEQ ID NO: 49334 - protein, 31 aa, Artificial Sequence
  Description of Artificial Sequence: Synthetic polypeptide
DENEIRTTNPVATEIYGSVSPNNLQRFGTQE

SEQ ID NO: 49335 - protein, 31 aa, Artificial Sequence
  Description of Artificial Sequence: Synthetic polypeptide
DENEIRTTNPVATEIYGSVSPNNLQRVGTWQ

SEQ ID NO: 49336 - protein, 31 aa, Artificial Sequence
  Description of Artificial Sequence: Synthetic polypeptide
DENEIRTTNPVATEIYGSVSNTLDQRGGNDD

SEQ ID NO: 49337 - protein, 29 aa, Artificial Sequence
  Description of Artificial Sequence: Synthetic peptide
AENEIACTNPVATEQYGSVSTDLQDHGER

SEQ ID NO: 49338 - protein, 32 aa, Artificial Sequence
  Description of Artificial Sequence: Synthetic polypeptide
AEEEIRTTNPVATEQYGSVSTVNLQQQTAENT

SEQ ID NO: 49339 - protein, 31 aa, Artificial Sequence
  Description of Artificial Sequence: Synthetic polypeptide
DENEIRTTNPVATEIYGSVSNNLQQGNTTTN

SEQ ID NO: 49340 - protein, 31 aa, Artificial Sequence
  Description of Artificial Sequence: Synthetic polypeptide
DENEIRTTNPVATEIYGSVSDNNDLQRGTQQ

SEQ ID NO: 49341 - protein, 31 aa, Artificial Sequence
  Description of Artificial Sequence: Synthetic polypeptide
DENEIRTTNPVATEIYGSVSFNVLQRGFEFQ

SEQ ID NO: 49342 - protein, 32 aa, Artificial Sequence
  Description of Artificial Sequence: Synthetic polypeptide
DENEIRTTNPVATEIYGSVSFNVLQRGNEEFY

SEQ ID NO: 49343 - protein, 30 aa, Artificial Sequence
  Description of Artificial Sequence: Synthetic polypeptide
DENEIRTTNPVATEIYGSVSFNVLTIGNEF

SEQ ID NO: 49344 - protein, 30 aa, Artificial Sequence
  Description of Artificial Sequence: Synthetic polypeptide
DENEIRTTNPVATEIYGSVSNGLLQRGTQM

SEQ ID NO: 49345 - protein, 33 aa, Artificial Sequence
  Description of Artificial Sequence: Synthetic polypeptide
AEEEIRTTNPVATEQYGSVSTVNLQQQEGEANT

SEQ ID NO: 49346 - protein, 30 aa, Artificial Sequence
  Description of Artificial Sequence: Synthetic polypeptide
SEEEIRCTNPAATEQYGSVSAENFLMRGNG

SEQ ID NO: 49347 - protein, 28 aa, Artificial Sequence
  Description of Artificial Sequence: Synthetic peptide
AENEIACTNPVATEQYGVASENLQRGNQ

SEQ ID NO: 49348 - protein, 32 aa, Artificial Sequence
  Description of Artificial Sequence: Synthetic polypeptide
AEEEIRTTNPVATEQYGSVSTVNLQQQEQGVG

SEQ ID NO: 49349 - protein, 29 aa, Artificial Sequence
  Description of Artificial Sequence: Synthetic peptide
SEEEIRCTNPAATEQYGSVCVENLERGNE

SEQ ID NO: 49350 - protein, 29 aa, Artificial Sequence
  Description of Artificial Sequence: Synthetic peptide
SEEEIRCTNPAATEQYGSVCSEPLMRENR

SEQ ID NO: 49351 - protein, 30 aa, Artificial Sequence
  Description of Artificial Sequence: Synthetic polypeptide
SEEEIRCTNPAATEQYGSVCSENLERGNNQ

SEQ ID NO: 49352 - protein, 30 aa, Artificial Sequence
  Description of Artificial Sequence: Synthetic polypeptide
DENEIRTTNPVATEIYGSVSNNLDQGEGTQ

SEQ ID NO: 49353 - protein, 30 aa, Artificial Sequence
  Description of Artificial Sequence: Synthetic polypeptide
DENEIRTTNPVATEIYGSVSNNLDQGGGTQ

SEQ ID NO: 49354 - protein, 31 aa, Artificial Sequence
  Description of Artificial Sequence: Synthetic polypeptide
DENEIRTTNPVATEIYGSVSNNLDQSGGNEQ

SEQ ID NO: 49355 - protein, 28 aa, Artificial Sequence
  Description of Artificial Sequence: Synthetic peptide
AENEIACTNPVATEQYGVASENLQRGGR

SEQ ID NO: 49356 - protein, 33 aa, Artificial Sequence
  Description of Artificial Sequence: Synthetic polypeptide
DEVEIRTTNPVATEQYGSVSNTNLQFNEGGNDT

SEQ ID NO: 49357 - protein, 32 aa, Artificial Sequence
  Description of Artificial Sequence: Synthetic polypeptide
AEEEIRTTNPVATEQYGSVSTVNLENNGNIIV

SEQ ID NO: 49358 - protein, 30 aa, Artificial Sequence
  Description of Artificial Sequence: Synthetic polypeptide
SEEEIRCTNPCATEQYGSVCSENLERGSNQ

SEQ ID NO: 49359 - protein, 31 aa, Artificial Sequence
  Description of Artificial Sequence: Synthetic polypeptide
DEVEIRTTNPVATEQYGSVSTGDDHQNGGNV

SEQ ID NO: 49360 - protein, 30 aa, Artificial Sequence
  Description of Artificial Sequence: Synthetic polypeptide
DENEIRGTNPVATEIYGSVSNQNLQREGDG

SEQ ID NO: 49361 - protein, 33 aa, Artificial Sequence
  Description of Artificial Sequence: Synthetic polypeptide
AEEEIRTTNPVATEQYGSVSTVNLLQNNGNNQG

SEQ ID NO: 49362 - protein, 32 aa, Artificial Sequence
  Description of Artificial Sequence: Synthetic polypeptide
AEEEIRTTNPVATEQYGSVSTVNLLQNNQNQG

SEQ ID NO: 49363 - protein, 33 aa, Artificial Sequence
  Description of Artificial Sequence: Synthetic polypeptide
AEEEIRTTNPVATEQYGSVSTVNLLQQNGENQG

SEQ ID NO: 49364 - protein, 28 aa, Artificial Sequence
  Description of Artificial Sequence: Synthetic peptide
DENEIRPTNPVASEQYGIVSCNLQAGTA

SEQ ID NO: 49365 - protein, 32 aa, Artificial Sequence
  Description of Artificial Sequence: Synthetic polypeptide
AEEEIRTTNPVATEQYGSVSTVNLLQQNNNVD

SEQ ID NO: 49366 - protein, 28 aa, Artificial Sequence
  Description of Artificial Sequence: Synthetic peptide
AENEIACTNPVATEQYGSASENLQFGGR

SEQ ID NO: 49367 - protein, 33 aa, Artificial Sequence
  Description of Artificial Sequence: Synthetic polypeptide
DENEIRTTNPCATEQYGSVQSTNDLQERGNPNS

SEQ ID NO: 49368 - protein, 32 aa, Artificial Sequence
  Description of Artificial Sequence: Synthetic polypeptide
AEEEIRTTNPVATEQYGSVSTVNLNENNQGNI

SEQ ID NO: 49369 - protein, 28 aa, Artificial Sequence
  Description of Artificial Sequence: Synthetic peptide
SEEEIRCTNPCSSEQYGSVSCNLMSGNR

SEQ ID NO: 49370 - protein, 29 aa, Artificial Sequence
  Description of Artificial Sequence: Synthetic peptide
DENEIRTTNPIATEQWGSVSEILMNRENR

SEQ ID NO: 49371 - protein, 32 aa, Artificial Sequence
  Description of Artificial Sequence: Synthetic polypeptide
DEVEIRTTNPVATEQYGSVSTGGLGQDDGNVS

SEQ ID NO: 49372 - protein, 29 aa, Artificial Sequence
  Description of Artificial Sequence: Synthetic peptide
AENEIACTNPVATEQYGSASENLQRGGDR

SEQ ID NO: 49373 - protein, 29 aa, Artificial Sequence
  Description of Artificial Sequence: Synthetic peptide
AENEIACTNPVATEQYGSASENVLQRGGR

SEQ ID NO: 49374 - protein, 31 aa, Artificial Sequence
  Description of Artificial Sequence: Synthetic polypeptide
DEVEIRTTNPVATEQYGSVSTGGGQQNGGNM

SEQ ID NO: 49375 - protein, 30 aa, Artificial Sequence
  Description of Artificial Sequence: Synthetic polypeptide
DENEIRGTNPVATDQYGSVNTGLQRNGNED

SEQ ID NO: 49376 - protein, 32 aa, Artificial Sequence
  Description of Artificial Sequence: Synthetic polypeptide
AEEEIRTTNPVATEQYGSVSTVNLLQIGEEGG

SEQ ID NO: 49377 - protein, 32 aa, Artificial Sequence
  Description of Artificial Sequence: Synthetic polypeptide
AEEEIRTTNPVATEQYGSVSTVNLLENNEGNI

SEQ ID NO: 49378 - protein, 33 aa, Artificial Sequence
  Description of Artificial Sequence: Synthetic polypeptide
AEEEIRTTNPVATEQYGSVSTVNLGQQIGNNET

SEQ ID NO: 49379 - protein, 32 aa, Artificial Sequence
  Description of Artificial Sequence: Synthetic polypeptide
DEVEIRTTNPVATEQYGSVSTGGQLGQDGGNV

SEQ ID NO: 49380 - protein, 28 aa, Artificial Sequence
  Description of Artificial Sequence: Synthetic peptide
DENEIRCTNPVATEQWGDVSEILQREDR

SEQ ID NO: 49381 - protein, 32 aa, Artificial Sequence
  Description of Artificial Sequence: Synthetic polypeptide
AEEEIRTTNPVATEQYGSVSTVNLENNGNNIQ

SEQ ID NO: 49382 - protein, 29 aa, Artificial Sequence
  Description of Artificial Sequence: Synthetic peptide
DENEIRCTNPVATEQYGDVSENLMNRGDA

SEQ ID NO: 49383 - protein, 32 aa, Artificial Sequence
  Description of Artificial Sequence: Synthetic polypeptide
AEEEIRTTNPVATEQYGSVSTVNLENNGNNQV

SEQ ID NO: 49384 - protein, 30 aa, Artificial Sequence
  Description of Artificial Sequence: Synthetic polypeptide
DENEIRCTNPVATEQYGEASEINLQREGGR

SEQ ID NO: 49385 - protein, 32 aa, Artificial Sequence
  Description of Artificial Sequence: Synthetic polypeptide
AEEEIRTTNPVATEQYGSVSTVNLENNGTNGN

SEQ ID NO: 49386 - protein, 29 aa, Artificial Sequence
  Description of Artificial Sequence: Synthetic peptide
DENEIRTTNPIATEQWGSVSENLMNAGDR

SEQ ID NO: 49387 - protein, 28 aa, Artificial Sequence
  Description of Artificial Sequence: Synthetic peptide
SEEEIRCTNPIAMEQYGSVSENLMVGGR

SEQ ID NO: 49388 - protein, 30 aa, Artificial Sequence
  Description of Artificial Sequence: Synthetic polypeptide
DENEIRCTNPVATEQYGSISEEDLQMQGNR

SEQ ID NO: 49389 - protein, 29 aa, Artificial Sequence
  Description of Artificial Sequence: Synthetic peptide
AENEIACTNPVATEQYGSASENLQDRGGR

SEQ ID NO: 49390 - protein, 32 aa, Artificial Sequence
  Description of Artificial Sequence: Synthetic polypeptide
AEEEIRTTNPVATEQYGSVSTVNLENNTGNQN

SEQ ID NO: 49391 - protein, 31 aa, Artificial Sequence
  Description of Artificial Sequence: Synthetic polypeptide
DENEIRCTNPVATEQYGSVSEPNGQMRGNPV

SEQ ID NO: 49392 - protein, 33 aa, Artificial Sequence
  Description of Artificial Sequence: Synthetic polypeptide
DENEIRCTNPVATEQYGSVSTNLPQMRNGMNPV

SEQ ID NO: 49393 - protein, 32 aa, Artificial Sequence
  Description of Artificial Sequence: Synthetic polypeptide
DENEIRCTNPVATEQYGSVSTPNDQEGNDERQ

SEQ ID NO: 49394 - protein, 33 aa, Artificial Sequence
  Description of Artificial Sequence: Synthetic polypeptide
AEEEIRTTNPVATEQYGSVSTVNLEQGEGNNEN

SEQ ID NO: 49395 - protein, 32 aa, Artificial Sequence
  Description of Artificial Sequence: Synthetic polypeptide
AEEEIRTTNPVATEQYGSVSTVNLENNNGNID

SEQ ID NO: 49396 - protein, 28 aa, Artificial Sequence
  Description of Artificial Sequence: Synthetic peptide
DENEIRTTNPIATEQYGDVSEILMAGNA

SEQ ID NO: 49397 - protein, 30 aa, Artificial Sequence
  Description of Artificial Sequence: Synthetic polypeptide
SEEEIRCTNPCATEQYGSVTSSNLARGSNQ

SEQ ID NO: 49398 - protein, 31 aa, Artificial Sequence
  Description of Artificial Sequence: Synthetic polypeptide
DENEIRTTNPIATEQYGTVSEENLQMRNGNH

SEQ ID NO: 49399 - protein, 29 aa, Artificial Sequence
  Description of Artificial Sequence: Synthetic peptide
AENEIACTNPVATEQYGSASTNLEDRGGR

SEQ ID NO: 49400 - protein, 30 aa, Artificial Sequence
  Description of Artificial Sequence: Synthetic polypeptide
CEEEIYTTNPVATEQYGNVSVTSMLQQGNE

SEQ ID NO: 49401 - protein, 33 aa, Artificial Sequence
  Description of Artificial Sequence: Synthetic polypeptide
AEEEIRTTNPVATEQYGSVSTVNLNQQNGENVE

SEQ ID NO: 49402 - protein, 32 aa, Artificial Sequence
  Description of Artificial Sequence: Synthetic polypeptide
DEVEIRTTNPVATEQYGSVSTGGDNQNGGNHR

SEQ ID NO: 49403 - protein, 33 aa, Artificial Sequence
  Description of Artificial Sequence: Synthetic polypeptide
AEEEIRTTNPVATEQYGSVSTVNLNVQTGNNNT

SEQ ID NO: 49404 - protein, 29 aa, Artificial Sequence
  Description of Artificial Sequence: Synthetic peptide
SEEEIRCTNPCATEQYGSVNSEVLMRGNQ

SEQ ID NO: 49405 - protein, 33 aa, Artificial Sequence
  Description of Artificial Sequence: Synthetic polypeptide
AEEEIRTTNPVATEQYGSVSTVNLQENNEGNNG

SEQ ID NO: 49406 - protein, 33 aa, Artificial Sequence
  Description of Artificial Sequence: Synthetic polypeptide
AEEEIRTTNPVATEQYGSVSTVNLNQQGTENTA

SEQ ID NO: 49407 - protein, 32 aa, Artificial Sequence
  Description of Artificial Sequence: Synthetic polypeptide
AEEEIRTTNPVATEQYGSVSTVNLQENNENQQ

SEQ ID NO: 49408 - protein, 32 aa, Artificial Sequence
  Description of Artificial Sequence: Synthetic polypeptide
AEEEIRTTNPVATEQYGSVSVTTNGEQGGNQT

SEQ ID NO: 49409 - protein, 29 aa, Artificial Sequence
  Description of Artificial Sequence: Synthetic peptide
SEEEIRCTNPCATEQYGSVNSENLMNGER

SEQ ID NO: 49410 - protein, 29 aa, Artificial Sequence
  Description of Artificial Sequence: Synthetic peptide
AENEIACTNPVATEQYGSEASENLQRGGR

SEQ ID NO: 49411 - protein, 29 aa, Artificial Sequence
  Description of Artificial Sequence: Synthetic peptide
SEEEIRCTNPCATEQYGSVNSENLIRGEF

SEQ ID NO: 49412 - protein, 31 aa, Artificial Sequence
  Description of Artificial Sequence: Synthetic polypeptide
DENEIRTTNPVATECWGSVSCNEPQREGENR

SEQ ID NO: 49413 - protein, 29 aa, Artificial Sequence
  Description of Artificial Sequence: Synthetic peptide
AENEIACTNPVATEQYGSEATENLQRGGR

SEQ ID NO: 49414 - protein, 30 aa, Artificial Sequence
  Description of Artificial Sequence: Synthetic polypeptide
SEEEIRCTNPCATEQYGSVLSNENLERGNE

SEQ ID NO: 49415 - protein, 29 aa, Artificial Sequence
  Description of Artificial Sequence: Synthetic peptide
AENEIACTNPVATEQYGSASTNLQDHGER

SEQ ID NO: 49416 - protein, 32 aa, Artificial Sequence
  Description of Artificial Sequence: Synthetic polypeptide
AEEEIRTTNPVATEQYGSVSTVNLQETAEGGV

SEQ ID NO: 49417 - protein, 32 aa, Artificial Sequence
  Description of Artificial Sequence: Synthetic polypeptide
CEEEVRTTNPVATEQYGSVCSTENLDQRIGDQ

SEQ ID NO: 49418 - protein, 28 aa, Artificial Sequence
  Description of Artificial Sequence: Synthetic peptide
AENEIACTNPVATEQYGSASTDLERGGR

SEQ ID NO: 49419 - protein, 30 aa, Artificial Sequence
  Description of Artificial Sequence: Synthetic polypeptide
SEEEIRCTNPCATEQYGSVSPENLHRGTRD

SEQ ID NO: 49420 - protein, 30 aa, Artificial Sequence
  Description of Artificial Sequence: Synthetic polypeptide
DENEIRTTNPLATEQYGSVSQNLSFRNMNV

SEQ ID NO: 49421 - protein, 30 aa, Artificial Sequence
  Description of Artificial Sequence: Synthetic polypeptide
SEEEIRCTNPCATEQYGSVSNEVLERGNQR

SEQ ID NO: 49422 - protein, 33 aa, Artificial Sequence
  Description of Artificial Sequence: Synthetic polypeptide
AEEEIRTTNPVATEQYGSVSTVNLNQEDEGNIA

SEQ ID NO: 49423 - protein, 33 aa, Artificial Sequence
  Description of Artificial Sequence: Synthetic polypeptide
AEEEIRTTNPVATEQYGSVSTVNLNQEGNQQGT

SEQ ID NO: 49424 - protein, 32 aa, Artificial Sequence
  Description of Artificial Sequence: Synthetic polypeptide
AEEEIRTTNPVATEQYGSVSTVNLNQGEGIQN

SEQ ID NO: 49425 - protein, 30 aa, Artificial Sequence
  Description of Artificial Sequence: Synthetic polypeptide
DENEIRTTNPVATDQYGSVNTQQLQEGNQD

SEQ ID NO: 49426 - protein, 31 aa, Artificial Sequence
  Description of Artificial Sequence: Synthetic polypeptide
DENEIRTTNPVATEAYGSVSQNGLSFRNMNR

SEQ ID NO: 49427 - protein, 30 aa, Artificial Sequence
  Description of Artificial Sequence: Synthetic polypeptide
DENEIRTTNPVATDQYGSVNTTQLQEGNVD

SEQ ID NO: 49428 - protein, 31 aa, Artificial Sequence
  Description of Artificial Sequence: Synthetic polypeptide
QEEEIRTTNPVATEQYGSVITLYDQGSVGNR

SEQ ID NO: 49429 - protein, 31 aa, Artificial Sequence
  Description of Artificial Sequence: Synthetic polypeptide
DENEIRTTNPVATEAYGISVSNNLSQRGGTQ

SEQ ID NO: 49430 - protein, 30 aa, Artificial Sequence
  Description of Artificial Sequence: Synthetic polypeptide
SEEEIRCTNPCATEQYGSVSNENLERGSYR

SEQ ID NO: 49431 - protein, 30 aa, Artificial Sequence
  Description of Artificial Sequence: Synthetic polypeptide
CEETISTTNPVATECYGSVNTNTLQRGNNE

SEQ ID NO: 49432 - protein, 31 aa, Artificial Sequence
  Description of Artificial Sequence: Synthetic polypeptide
DENEIRTTNPVATEAYGSVSCNNLSQRGTTP

SEQ ID NO: 49433 - protein, 30 aa, Artificial Sequence
  Description of Artificial Sequence: Synthetic polypeptide
SEEEIRCTNPCATEQYGSVSNENLENRENR

SEQ ID NO: 49434 - protein, 31 aa, Artificial Sequence
  Description of Artificial Sequence: Synthetic polypeptide
DENEIRTTNPVATEAYGSVSNENLQPRGTPV

SEQ ID NO: 49435 - protein, 32 aa, Artificial Sequence
  Description of Artificial Sequence: Synthetic polypeptide
AEEEIRTTNPVATEQYGSVSTVNLNQGVNTEA

SEQ ID NO: 49436 - protein, 33 aa, Artificial Sequence
  Description of Artificial Sequence: Synthetic polypeptide
DEEEIRTTNPVAVEQYGVVVSQTNNLLQGGNIR

SEQ ID NO: 49437 - protein, 29 aa, Artificial Sequence
  Description of Artificial Sequence: Synthetic peptide
DEEEIRTTNPVAYECYGKISTNESQRVNN

SEQ ID NO: 49438 - protein, 30 aa, Artificial Sequence
  Description of Artificial Sequence: Synthetic polypeptide
DEEEIRTTNPVAVEQYGSVVTTNLQVNDEV

SEQ ID NO: 49439 - protein, 32 aa, Artificial Sequence
  Description of Artificial Sequence: Synthetic polypeptide
DEEEIRTTNPVATEQYGSVSTMNGGEFGNGNQ

SEQ ID NO: 49440 - protein, 29 aa, Artificial Sequence
  Description of Artificial Sequence: Synthetic peptide
YAEEISATNPVATEQYGQVSTLLQLRGNG

SEQ ID NO: 49441 - protein, 28 aa, Artificial Sequence
  Description of Artificial Sequence: Synthetic peptide
WETDIRTTNPCATEQWGSVSVNAQVGNR

SEQ ID NO: 49442 - protein, 28 aa, Artificial Sequence
  Description of Artificial Sequence: Synthetic peptide
WENEIACTNPVATEQYGEASYNLQRGGR

SEQ ID NO: 49443 - protein, 33 aa, Artificial Sequence
  Description of Artificial Sequence: Synthetic polypeptide
DEEEIRTTNPVATEQYGSVSTMNGGQTGEGENV

SEQ ID NO: 49444 - protein, 29 aa, Artificial Sequence
  Description of Artificial Sequence: Synthetic peptide
WENEIACTNPVATEQYGEASENLQRGNGR

SEQ ID NO: 49445 - protein, 33 aa, Artificial Sequence
  Description of Artificial Sequence: Synthetic polypeptide
DEEEIRTTNPVATEQYGSVSTMNGIIQDRVNEI

SEQ ID NO: 49446 - protein, 28 aa, Artificial Sequence
  Description of Artificial Sequence: Synthetic peptide
WENEIACTNPVATEQYGEASENLQRGGR

SEQ ID NO: 49447 - protein, 33 aa, Artificial Sequence
  Description of Artificial Sequence: Synthetic polypeptide
DEEEIRTTNPVATEQYGSVSTMNGIQGEGGNEG

SEQ ID NO: 49448 - protein, 29 aa, Artificial Sequence
  Description of Artificial Sequence: Synthetic peptide
MEEEIRTTNPVATEQYGSVHSEQDQGSPR

SEQ ID NO: 49449 - protein, 31 aa, Artificial Sequence
  Description of Artificial Sequence: Synthetic polypeptide
MEEEIRTTNPVATEQYGSVGVTANVQSGGGR

SEQ ID NO: 49450 - protein, 33 aa, Artificial Sequence
  Description of Artificial Sequence: Synthetic polypeptide
DEEEIRTTNPVATEQYGSVSTMNGLDEMGENTG

SEQ ID NO: 49451 - protein, 29 aa, Artificial Sequence
  Description of Artificial Sequence: Synthetic peptide
AEEAICTTNPVATEQYGSVSMNSQTGNQS

SEQ ID NO: 49452 - protein, 33 aa, Artificial Sequence
  Description of Artificial Sequence: Synthetic polypeptide
DEEEIRTTNPVATEQYGSVSTMNGLEDGNGQNI

SEQ ID NO: 49453 - protein, 33 aa, Artificial Sequence
  Description of Artificial Sequence: Synthetic polypeptide
DEEEIRTTNPVATEQYGSVSTMNGLEEGGNTIT

SEQ ID NO: 49454 - protein, 31 aa, Artificial Sequence
  Description of Artificial Sequence: Synthetic polypeptide
MEEEIRTTNPVATEQYGSVSAGNLDEFGNGQ

SEQ ID NO: 49455 - protein, 29 aa, Artificial Sequence
  Description of Artificial Sequence: Synthetic peptide
AEEAICTTNPVATEQYGSVSNMNSQIGNS

SEQ ID NO: 49456 - protein, 31 aa, Artificial Sequence
  Description of Artificial Sequence: Synthetic polypeptide
YDEEISTTNPVATEQYGSVPSTNLIRSDNRS

SEQ ID NO: 49457 - protein, 31 aa, Artificial Sequence
  Description of Artificial Sequence: Synthetic polypeptide
MEEEIRTTNPVATEQYGSVSAGNLDEFGNNI

SEQ ID NO: 49458 - protein, 31 aa, Artificial Sequence
  Description of Artificial Sequence: Synthetic polypeptide
YEEAISTTNPVATEQYGSVPSQTNLERDNRS

SEQ ID NO: 49459 - protein, 32 aa, Artificial Sequence
  Description of Artificial Sequence: Synthetic polypeptide
DEEEIRTTNPVATEQYGSVSTMNDMQQSTNDN

SEQ ID NO: 49460 - protein, 33 aa, Artificial Sequence
  Description of Artificial Sequence: Synthetic polypeptide
DEEEIRTTNPVATEQYGSVSTMNDQAGNGNGNG

SEQ ID NO: 49461 - protein, 33 aa, Artificial Sequence
  Description of Artificial Sequence: Synthetic polypeptide
DEEEIRTTNPVATEQYGSVSTMNDQGDELAGNQ

SEQ ID NO: 49462 - protein, 33 aa, Artificial Sequence
  Description of Artificial Sequence: Synthetic polypeptide
DEEEIRTTNPVATEQYGSVSTMNDQTGGGNGDQ

SEQ ID NO: 49463 - protein, 33 aa, Artificial Sequence
  Description of Artificial Sequence: Synthetic polypeptide
MEEEIRTTNPVATEQYGSVSPTSNLFQRSENYD

SEQ ID NO: 49464 - protein, 33 aa, Artificial Sequence
  Description of Artificial Sequence: Synthetic polypeptide
MEEEIRTTNPVATEQYGSVSPTSMLQERGEAYR

SEQ ID NO: 49465 - protein, 33 aa, Artificial Sequence
  Description of Artificial Sequence: Synthetic polypeptide
DEEEIRTTNPVATEQYGSVSTMNEGIQEGGGNT

SEQ ID NO: 49466 - protein, 31 aa, Artificial Sequence
  Description of Artificial Sequence: Synthetic polypeptide
YEDEISTTNPVATEQYGSVSYTWNSLQRPNT

SEQ ID NO: 49467 - protein, 34 aa, Artificial Sequence
  Description of Artificial Sequence: Synthetic polypeptide
DEEEIRTTNPVATEQYGSVSTMNELQDTGGNEEI

SEQ ID NO: 49468 - protein, 33 aa, Artificial Sequence
  Description of Artificial Sequence: Synthetic polypeptide
DEEEIRTTNPVATEQYGSVSTMNGDQEGGNEHL

SEQ ID NO: 49469 - protein, 31 aa, Artificial Sequence
  Description of Artificial Sequence: Synthetic polypeptide
YEDEISTTNPVATEQYGSVQSTNIQRGNQPM

SEQ ID NO: 49470 - protein, 30 aa, Artificial Sequence
  Description of Artificial Sequence: Synthetic polypeptide
AEDEIRTTNPVATEQYGSVTTVNLEQIGSV

SEQ ID NO: 49471 - protein, 30 aa, Artificial Sequence
  Description of Artificial Sequence: Synthetic polypeptide
AEDEIRTTNPVATEQYGSVVTTNLQIGSVI

SEQ ID NO: 49472 - protein, 30 aa, Artificial Sequence
  Description of Artificial Sequence: Synthetic polypeptide
MEEEIRTTNPVATEQYGSVSLNNTEPINNR

SEQ ID NO: 49473 - protein, 33 aa, Artificial Sequence
  Description of Artificial Sequence: Synthetic polypeptide
DEEEIRTTNPVATEQYGSVSTMNGFEQDEGNTI

SEQ ID NO: 49474 - protein, 30 aa, Artificial Sequence
  Description of Artificial Sequence: Synthetic polypeptide
AEEAICTTNPVATEQYGSVSTMNNSQFGNS

SEQ ID NO: 49475 - protein, 30 aa, Artificial Sequence
  Description of Artificial Sequence: Synthetic polypeptide
AEEAICTTNPVATEQYGSVSTMNSQTGNSD

SEQ ID NO: 49476 - protein, 33 aa, Artificial Sequence
  Description of Artificial Sequence: Synthetic polypeptide
DEEEIRTTNPVATEQYGSVSTMNGLEQEGGTIT

SEQ ID NO: 49477 - protein, 30 aa, Artificial Sequence
  Description of Artificial Sequence: Synthetic polypeptide
QAEEIATTNPVATEQYGSVATNLQEAGNVD

SEQ ID NO: 49478 - protein, 31 aa, Artificial Sequence
  Description of Artificial Sequence: Synthetic polypeptide
VESVVATTNPVATEQYGSVSTGNLDQRDGNR

SEQ ID NO: 49479 - protein, 30 aa, Artificial Sequence
  Description of Artificial Sequence: Synthetic polypeptide
DEDEIATTNPVATEQWGSVATNLQGGNPDQ

SEQ ID NO: 49480 - protein, 30 aa, Artificial Sequence
  Description of Artificial Sequence: Synthetic polypeptide
MEEEIRTTNPVATEQYGCVSTEHQGGSNQM

SEQ ID NO: 49481 - protein, 34 aa, Artificial Sequence
  Description of Artificial Sequence: Synthetic polypeptide
DEEEIRTTNPVATEQYGSVSTMNLDLIQNGGNPG

SEQ ID NO: 49482 - protein, 34 aa, Artificial Sequence
  Description of Artificial Sequence: Synthetic polypeptide
DEEEIRTTNPVATEQYGSVSTMNLDQDQGENTTD

SEQ ID NO: 49483 - protein, 34 aa, Artificial Sequence
  Description of Artificial Sequence: Synthetic polypeptide
DEEEIRTTNPVATEQYGSVSTMNLDQEGGGNDEI

SEQ ID NO: 49484 - protein, 34 aa, Artificial Sequence
  Description of Artificial Sequence: Synthetic polypeptide
DEEEIRTTNPVATEQYGSVSTMNLDQIDQGNGDG

SEQ ID NO: 49485 - protein, 34 aa, Artificial Sequence
  Description of Artificial Sequence: Synthetic polypeptide
DEEEIRTTNPVATEQYGSVSTMNLDQPEMGDNEQ

SEQ ID NO: 49486 - protein, 30 aa, Artificial Sequence
  Description of Artificial Sequence: Synthetic polypeptide
QAEEIATTNPVATEQYGSVATNLQNNGDNE

SEQ ID NO: 49487 - protein, 34 aa, Artificial Sequence
  Description of Artificial Sequence: Synthetic polypeptide
DEEEIRTTNPVATEQYGSVSTMNLDQSGGNNDEV

SEQ ID NO: 49488 - protein, 33 aa, Artificial Sequence
  Description of Artificial Sequence: Synthetic polypeptide
DEEEIRTTNPVATEQYGSVSTMNLDQTGEGEIV

SEQ ID NO: 49489 - protein, 34 aa, Artificial Sequence
  Description of Artificial Sequence: Synthetic polypeptide
DEEEIRTTNPVATEQYGSVSTMNLDQTGGGENDQ

SEQ ID NO: 49490 - protein, 34 aa, Artificial Sequence
  Description of Artificial Sequence: Synthetic polypeptide
DEEEIRTTNPVATEQYGSVSTMNLEQGIGFNQGT

SEQ ID NO: 49491 - protein, 33 aa, Artificial Sequence
  Description of Artificial Sequence: Synthetic polypeptide
DEEEIRTTNPVATEQYGSVSTMNLEQGIGFTEE

SEQ ID NO: 49492 - protein, 31 aa, Artificial Sequence
  Description of Artificial Sequence: Synthetic polypeptide
MEEEIRTTNPVATEQYGSCSTTNLETQPGVQ

SEQ ID NO: 49493 - protein, 30 aa, Artificial Sequence
  Description of Artificial Sequence: Synthetic polypeptide
MEEEIRTTNPVATEQYGSVATTAQLQNGFN

SEQ ID NO: 49494 - protein, 33 aa, Artificial Sequence
  Description of Artificial Sequence: Synthetic polypeptide
DEEEIRTTNPVATEQYGSVSTMNGVQQEIGQNQ

SEQ ID NO: 49495 - protein, 32 aa, Artificial Sequence
  Description of Artificial Sequence: Synthetic polypeptide
DEEEIRTTNPVATEQYGSVSTMNGTDGNGQNV

SEQ ID NO: 49496 - protein, 34 aa, Artificial Sequence
  Description of Artificial Sequence: Synthetic polypeptide
DEEEIRTTNPVATEQYGSVSTMNGLEQGGGTNLA

SEQ ID NO: 49497 - protein, 34 aa, Artificial Sequence
  Description of Artificial Sequence: Synthetic polypeptide
DEEEIRTTNPVATEQYGSVSTMNGLETREGGNTF

SEQ ID NO: 49498 - protein, 34 aa, Artificial Sequence
  Description of Artificial Sequence: Synthetic polypeptide
DEEEIRTTNPVATEQYGSVSTMNGLGQNEGGENQ

SEQ ID NO: 49499 - protein, 32 aa, Artificial Sequence
  Description of Artificial Sequence: Synthetic polypeptide
WEEEIRTTNPVATEQYGSVNTSNLIQGNENYR

SEQ ID NO: 49500 - protein, 33 aa, Artificial Sequence
  Description of Artificial Sequence: Synthetic polypeptide
WEEEIRTTNPVATEQYGSVCSTSNQKERGENYR

SEQ ID NO: 49501 - protein, 34 aa, Artificial Sequence
  Description of Artificial Sequence: Synthetic polypeptide
DEEEIRTTNPVATEQYGSVSTMNGLQVEGGGNQG

SEQ ID NO: 49502 - protein, 30 aa, Artificial Sequence
  Description of Artificial Sequence: Synthetic polypeptide
AEEAIRTTNPVATESYGNVSTELQHGNNRT

SEQ ID NO: 49503 - protein, 32 aa, Artificial Sequence
  Description of Artificial Sequence: Synthetic polypeptide
DEEEIRTTNPVATEQYGSVSTMNDMQQSINSS

SEQ ID NO: 49504 - protein, 34 aa, Artificial Sequence
  Description of Artificial Sequence: Synthetic polypeptide
DEEEIRTTNPVATEQYGSVSTMNGLTGQGGQNIS

SEQ ID NO: 49505 - protein, 33 aa, Artificial Sequence
  Description of Artificial Sequence: Synthetic polypeptide
DEEEIRTTNPVATEQYGSVSTMNGPQEGGGGNT

SEQ ID NO: 49506 - protein, 33 aa, Artificial Sequence
  Description of Artificial Sequence: Synthetic polypeptide
DEEEIRTTNPVATEQYGSVSTMNGQAGGGNEQE

SEQ ID NO: 49507 - protein, 30 aa, Artificial Sequence
  Description of Artificial Sequence: Synthetic polypeptide
MEEEIRTTNPVATEQYGSVATTWLENGLRL

SEQ ID NO: 49508 - protein, 33 aa, Artificial Sequence
  Description of Artificial Sequence: Synthetic polypeptide
DEEEIRTTNPVATEQYGSVSTMNGQGEFGNPGD

SEQ ID NO: 49509 - protein, 33 aa, Artificial Sequence
  Description of Artificial Sequence: Synthetic polypeptide
WEEEIATTNPVATEQYGSVATGNLPQDRGENPR

SEQ ID NO: 49510 - protein, 33 aa, Artificial Sequence
  Description of Artificial Sequence: Synthetic polypeptide
DEEEIRTTNPVATEQYGSVSTMNGQQDEGNNED

SEQ ID NO: 49511 - protein, 32 aa, Artificial Sequence
  Description of Artificial Sequence: Synthetic polypeptide
DEEEIRTTNPVATEQYGSVSTMNGQTGGGGEQ

SEQ ID NO: 49512 - protein, 32 aa, Artificial Sequence
  Description of Artificial Sequence: Synthetic polypeptide
WEEEIATTNPVATEQYGSVATSNLVERGENPR

SEQ ID NO: 49513 - protein, 32 aa, Artificial Sequence
  Description of Artificial Sequence: Synthetic polypeptide
AEEEIRTTNPVATEQYGSVVVSVTNNQQGNNN

SEQ ID NO: 49514 - protein, 34 aa, Artificial Sequence
  Description of Artificial Sequence: Synthetic polypeptide
DEEEIRTTNPVATEQYGSVSTMNDLQRENSENTG

SEQ ID NO: 49515 - protein, 33 aa, Artificial Sequence
  Description of Artificial Sequence: Synthetic polypeptide
DEEEIRTTNPVATEQYGSVSTMNDLQFVMESRI

SEQ ID NO: 49516 - protein, 33 aa, Artificial Sequence
  Description of Artificial Sequence: Synthetic polypeptide
DEEEIRTTNPVATEQYGSVSTMLLDQVEGGNED

SEQ ID NO: 49517 - protein, 33 aa, Artificial Sequence
  Description of Artificial Sequence: Synthetic polypeptide
MEEEIRTTNPVATEQYGSVSVTSNLEQLGENYE

SEQ ID NO: 49518 - protein, 32 aa, Artificial Sequence
  Description of Artificial Sequence: Synthetic polypeptide
MEEEIRTTNPVATEQYGSVSVSYNLQRGVEEI

SEQ ID NO: 49519 - protein, 33 aa, Artificial Sequence
  Description of Artificial Sequence: Synthetic polypeptide
DEEEIRTTNPVATEQYGSVSTMLLQDVEGGNEG

SEQ ID NO: 49520 - protein, 28 aa, Artificial Sequence
  Description of Artificial Sequence: Synthetic peptide
YEEEIACTNPVCTEQYGVVSENLQSGGR

SEQ ID NO: 49521 - protein, 28 aa, Artificial Sequence
  Description of Artificial Sequence: Synthetic peptide
YEEEIACTNPVCTEQYGVVSENLMSGNR

SEQ ID NO: 49522 - protein, 30 aa, Artificial Sequence
  Description of Artificial Sequence: Synthetic polypeptide
AEDEIRTTNPVATEQYGSVATTNLQIGSTD

SEQ ID NO: 49523 - protein, 33 aa, Artificial Sequence
  Description of Artificial Sequence: Synthetic polypeptide
DEEEIRTTNPVATEQYGSVSTMLNMEQGGGNDG

SEQ ID NO: 49524 - protein, 30 aa, Artificial Sequence
  Description of Artificial Sequence: Synthetic polypeptide
DEDEIATTNPVATEQYGSVAATANLMAGNT

SEQ ID NO: 49525 - protein, 33 aa, Artificial Sequence
  Description of Artificial Sequence: Synthetic polypeptide
MEEEIRTTNPVATEQYGSVSTSNNLEQLGENYN

SEQ ID NO: 49526 - protein, 33 aa, Artificial Sequence
  Description of Artificial Sequence: Synthetic polypeptide
DEEEIRTTNPVATEQYGSVSTMLPNQESGGNQV

SEQ ID NO: 49527 - protein, 32 aa, Artificial Sequence
  Description of Artificial Sequence: Synthetic polypeptide
DEEEIRTTNPVATEQYGSVSTMLPTNDGNTDN

SEQ ID NO: 49528 - protein, 32 aa, Artificial Sequence
  Description of Artificial Sequence: Synthetic polypeptide
DEEEIRTTNPVATEQYGSVSTMLQDGGGEEQE

SEQ ID NO: 49529 - protein, 33 aa, Artificial Sequence
  Description of Artificial Sequence: Synthetic polypeptide
DEEEIRTTNPVATEQYGSVSTMLQFEFGENQIN

SEQ ID NO: 49530 - protein, 32 aa, Artificial Sequence
  Description of Artificial Sequence: Synthetic polypeptide
DEEEIRTTNPVATEQYGSVSTMLQFQEGGGEE

SEQ ID NO: 49531 - protein, 28 aa, Artificial Sequence
  Description of Artificial Sequence: Synthetic peptide
YEEEIACVNPVATEQYGVASENLQSGNR

SEQ ID NO: 49532 - protein, 31 aa, Artificial Sequence
  Description of Artificial Sequence: Synthetic polypeptide
DEDEIATTNPVATEQYGSVAITNLQQGNDQD

SEQ ID NO: 49533 - protein, 28 aa, Artificial Sequence
  Description of Artificial Sequence: Synthetic peptide
YEEEIACVNPVATEQYGVVSDNLMRGNQ

SEQ ID NO: 49534 - protein, 28 aa, Artificial Sequence
  Description of Artificial Sequence: Synthetic peptide
YEEEIACVNPVATEQYGVVSDNLQSGNQ

SEQ ID NO: 49535 - protein, 32 aa, Artificial Sequence
  Description of Artificial Sequence: Synthetic polypeptide
DEEEIRTTNPVATEQYGSVSTMLFQEFGGEIP

SEQ ID NO: 49536 - protein, 31 aa, Artificial Sequence
  Description of Artificial Sequence: Synthetic polypeptide
DEDEIATTNPVATEQYGSVATNLDRGPNPQP

SEQ ID NO: 49537 - protein, 33 aa, Artificial Sequence
  Description of Artificial Sequence: Synthetic polypeptide
DEEEIRTTNPVATEQYGSVSTMLFQNQGGNGEG

SEQ ID NO: 49538 - protein, 31 aa, Artificial Sequence
  Description of Artificial Sequence: Synthetic polypeptide
DEDEIATTNPVATEQYGSVATNDQRGPNTES

SEQ ID NO: 49539 - protein, 30 aa, Artificial Sequence
  Description of Artificial Sequence: Synthetic polypeptide
DEDEIATTNPVATEQYGSVATNDQRDNTDN

SEQ ID NO: 49540 - protein, 29 aa, Artificial Sequence
  Description of Artificial Sequence: Synthetic peptide
DEDEIATTNPVATEQYGSVATNDERPNPV

SEQ ID NO: 49541 - protein, 32 aa, Artificial Sequence
  Description of Artificial Sequence: Synthetic polypeptide
DEEEIRTTNPVATEQYGSVSTMLFTNEGNTDQ

SEQ ID NO: 49542 - protein, 32 aa, Artificial Sequence
  Description of Artificial Sequence: Synthetic polypeptide
DEEEIRTTNPVATEQYGSVSTMLQGGGGGEEM

SEQ ID NO: 49543 - protein, 28 aa, Artificial Sequence
  Description of Artificial Sequence: Synthetic peptide
YEEEIAPTNPVCTEQYGVVSDNLQSGNQ

SEQ ID NO: 49544 - protein, 29 aa, Artificial Sequence
  Description of Artificial Sequence: Synthetic peptide
DEDEIATTNPVATEQYGSVATANLMDGHT

SEQ ID NO: 49545 - protein, 29 aa, Artificial Sequence
  Description of Artificial Sequence: Synthetic peptide
DEDEIATTNPVATEQYGSVASNDQQGNQV

SEQ ID NO: 49546 - protein, 33 aa, Artificial Sequence
  Description of Artificial Sequence: Synthetic polypeptide
DEEEIRTTNPVATEQYGSVSTMLGQMEGGNGDD

SEQ ID NO: 49547 - protein, 30 aa, Artificial Sequence
  Description of Artificial Sequence: Synthetic polypeptide
MEEEIRTTNPVATEQYGYVSTENLFTIGPS

SEQ ID NO: 49548 - protein, 32 aa, Artificial Sequence
  Description of Artificial Sequence: Synthetic polypeptide
YEEEIAGTNPVATEQYGSVKSGTHNQQRGLNR

SEQ ID NO: 49549 - protein, 32 aa, Artificial Sequence
  Description of Artificial Sequence: Synthetic polypeptide
MEEEIRTTNPVATEQYGSVWPTNSLERNGEER

SEQ ID NO: 49550 - protein, 28 aa, Artificial Sequence
  Description of Artificial Sequence: Synthetic peptide
YEEEIACVNPVATEQYGVVSENLQSGNQ

SEQ ID NO: 49551 - protein, 33 aa, Artificial Sequence
  Description of Artificial Sequence: Synthetic polypeptide
DEEEIRTTNPVATEQYGSVSTMLGQEQGDNGEL

SEQ ID NO: 49552 - protein, 29 aa, Artificial Sequence
  Description of Artificial Sequence: Synthetic peptide
DEDEIATTNPVATEQWGCVATNLERGNDQ

SEQ ID NO: 49553 - protein, 32 aa, Artificial Sequence
  Description of Artificial Sequence: Synthetic polypeptide
AEDEIRTTNPVATEQYGSVSTTNNLQIGSNVQ

SEQ ID NO: 49554 - protein, 33 aa, Artificial Sequence
  Description of Artificial Sequence: Synthetic polypeptide
DEEEIRTTNPVATEQYGSVSTMLQLQGEGENEI

SEQ ID NO: 49555 - protein, 32 aa, Artificial Sequence
  Description of Artificial Sequence: Synthetic polypeptide
DEEEIRTTNPVATEQYGSVSTMLQSNGGGEEQ

SEQ ID NO: 49556 - protein, 33 aa, Artificial Sequence
  Description of Artificial Sequence: Synthetic polypeptide
DEEEIRTTNPVATEQYGSVSTMLQTNGGQNTDQ

SEQ ID NO: 49557 - protein, 33 aa, Artificial Sequence
  Description of Artificial Sequence: Synthetic polypeptide
DEEEIRTTNPVATEQYGSVSTMLSFTRSDQNNR

SEQ ID NO: 49558 - protein, 32 aa, Artificial Sequence
  Description of Artificial Sequence: Synthetic polypeptide
DEEEIRTTNPVATEQYGSVSTMLSIRSDENNI

SEQ ID NO: 49559 - protein, 31 aa, Artificial Sequence
  Description of Artificial Sequence: Synthetic polypeptide
AEEEIRTTNPVATEQYGVVSTVNQNQNQGNP

SEQ ID NO: 49560 - protein, 32 aa, Artificial Sequence
  Description of Artificial Sequence: Synthetic polypeptide
AEDEIRTTNPVATEQYGSVSTTTNLQQIGSNV

SEQ ID NO: 49561 - protein, 32 aa, Artificial Sequence
  Description of Artificial Sequence: Synthetic polypeptide
DEEEIRTTNPVATEQYGSVSTMNDGQGEGEGE

SEQ ID NO: 49562 - protein, 33 aa, Artificial Sequence
  Description of Artificial Sequence: Synthetic polypeptide
DEEEIRTTNPVATEQYGSVSTMNDGQTEGGNNP

SEQ ID NO: 49563 - protein, 28 aa, Artificial Sequence
  Description of Artificial Sequence: Synthetic peptide
YEEEIACTNPICTEQYGSVSENLQSGNQ

SEQ ID NO: 49564 - protein, 33 aa, Artificial Sequence
  Description of Artificial Sequence: Synthetic polypeptide
DEEEIRTTNPVATEQYGSVSTMNDGVQQEGNNQ

SEQ ID NO: 49565 - protein, 32 aa, Artificial Sequence
  Description of Artificial Sequence: Synthetic polypeptide
DEEEIRTTNPVATEQYGSVSTMNDIGNEGNGD

SEQ ID NO: 49566 - protein, 28 aa, Artificial Sequence
  Description of Artificial Sequence: Synthetic peptide
YEEEIACTNPIATEQYGVVSENLMRGNQ

SEQ ID NO: 49567 - protein, 28 aa, Artificial Sequence
  Description of Artificial Sequence: Synthetic peptide
YEEEIACTNPIATEQYGVVSDNLMRGNQ

SEQ ID NO: 49568 - protein, 34 aa, Artificial Sequence
  Description of Artificial Sequence: Synthetic polypeptide
DEEEIRTTNPVATEQYGSVSTMNDLEQTGGGNDQ

SEQ ID NO: 49569 - protein, 33 aa, Artificial Sequence
  Description of Artificial Sequence: Synthetic polypeptide
DEEEIRTTNPVATEQYGSVSTMNDLGFGGNETN

SEQ ID NO: 49570 - protein, 33 aa, Artificial Sequence
  Description of Artificial Sequence: Synthetic polypeptide
DEEEIRTTNPVATEQYGSVSTMLQQTNGMNTDQ

SEQ ID NO: 49571 - protein, 33 aa, Artificial Sequence
  Description of Artificial Sequence: Synthetic polypeptide
DEEEIRTTNPVATEQYGSVSTMLQQPEGGNIET

SEQ ID NO: 49572 - protein, 33 aa, Artificial Sequence
  Description of Artificial Sequence: Synthetic polypeptide
DEEEIRTTNPVATEQYGSVSTMLQQNEGGNDEG

SEQ ID NO: 49573 - protein, 30 aa, Artificial Sequence
  Description of Artificial Sequence: Synthetic polypeptide
DEDEIATTNPVATEQYGCVATNLERGDNDF

SEQ ID NO: 49574 - protein, 32 aa, Artificial Sequence
  Description of Artificial Sequence: Synthetic polypeptide
DEEEIRTTNPVATEQYGSVSTMLQMEGGGEEF

SEQ ID NO: 49575 - protein, 31 aa, Artificial Sequence
  Description of Artificial Sequence: Synthetic polypeptide
AEDEIRTTNPVATEQYGSVSTTNNLQIGSVI

SEQ ID NO: 49576 - protein, 28 aa, Artificial Sequence
  Description of Artificial Sequence: Synthetic peptide
YEEEIACTNPVCTEQYGVVSDNLQSGGR

SEQ ID NO: 49577 - protein, 31 aa, Artificial Sequence
  Description of Artificial Sequence: Synthetic polypeptide
AEEEIRTTNPVATEQYGVVSTVNNQQTGNQL

SEQ ID NO: 49578 - protein, 31 aa, Artificial Sequence
  Description of Artificial Sequence: Synthetic polypeptide
DEDEIATTNPVATEQYGFVSTPNLSDRGGND

SEQ ID NO: 49579 - protein, 30 aa, Artificial Sequence
  Description of Artificial Sequence: Synthetic polypeptide
DEDEIATTNPVATEQYGETSTNALSQRGDS

SEQ ID NO: 49580 - protein, 33 aa, Artificial Sequence
  Description of Artificial Sequence: Synthetic polypeptide
DEEEIRTTNPVATEQYGSVSTMLQNVGGGNQGE

SEQ ID NO: 49581 - protein, 33 aa, Artificial Sequence
  Description of Artificial Sequence: Synthetic polypeptide
DEEEIRTTNPVATEQYGSVSTMLQLQGEFGNGE

SEQ ID NO: 49582 - protein, 28 aa, Artificial Sequence
  Description of Artificial Sequence: Synthetic peptide
YEEEIACTNPVCTEQYGVASENLQSGNR

SEQ ID NO: 49583 - protein, 29 aa, Artificial Sequence
  Description of Artificial Sequence: Synthetic peptide
MEEEIRTTNPVATEQYGSVSTSNFSGVFP

SEQ ID NO: 49584 - protein, 30 aa, Artificial Sequence
  Description of Artificial Sequence: Synthetic polypeptide
DEDEIATTNPVATEQYGCVATNLQRENNSE

SEQ ID NO: 49585 - protein, 30 aa, Artificial Sequence
  Description of Artificial Sequence: Synthetic polypeptide
DEDEIATTNPVATEQYGCVATNLQRADNTE

SEQ ID NO: 49586 - protein, 33 aa, Artificial Sequence
  Description of Artificial Sequence: Synthetic polypeptide
MEEEIRTTNPVATEQYGSVSTSNEGQGGGENGR

SEQ ID NO: 49587 - protein, 31 aa, Artificial Sequence
  Description of Artificial Sequence: Synthetic polypeptide
DEDEIATTNPVATEQYGCVATNLQDGNPERE

SEQ ID NO: 49588 - protein, 29 aa, Artificial Sequence
  Description of Artificial Sequence: Synthetic peptide
DEDEIATTNPVATEQYGCVATNLQAPNDN

SEQ ID NO: 49589 - protein, 30 aa, Artificial Sequence
  Description of Artificial Sequence: Synthetic polypeptide
DEDEIATTNPVATEQYGCVATNLQAGDNDF

SEQ ID NO: 49590 - protein, 29 aa, Artificial Sequence
  Description of Artificial Sequence: Synthetic peptide
DEDEIATTNPVATEQYGCVSTTLQDDNDN

SEQ ID NO: 49591 - protein, 32 aa, Artificial Sequence
  Description of Artificial Sequence: Synthetic polypeptide
DEEEIRTTNPVATEQYGSVSTMLFEVGGNEEQ

SEQ ID NO: 49592 - protein, 34 aa, Artificial Sequence
  Description of Artificial Sequence: Synthetic polypeptide
DEEEIRTTNPVATEQYGSVSTMNLEQGTGGNGQE

SEQ ID NO: 49593 - protein, 34 aa, Artificial Sequence
  Description of Artificial Sequence: Synthetic polypeptide
DEEEIRTTNPVATEQYGSVSTMNLEQNGGGNGQE

SEQ ID NO: 49594 - protein, 32 aa, Artificial Sequence
  Description of Artificial Sequence: Synthetic polypeptide
DEEEIRTTNPVATEQYGSVSTNALQQSTQDDN

SEQ ID NO: 49595 - protein, 32 aa, Artificial Sequence
  Description of Artificial Sequence: Synthetic polypeptide
DEEEIRTTNPVATEQYGSVSTNALVVINIEDQ

SEQ ID NO: 49596 - protein, 32 aa, Artificial Sequence
  Description of Artificial Sequence: Synthetic polypeptide
DEEEIRTTNPVATEQYGSVSTNAMIVGSEFRT

SEQ ID NO: 49597 - protein, 32 aa, Artificial Sequence
  Description of Artificial Sequence: Synthetic polypeptide
DEEEIRTTNPVATEQYGSVSTNAPQNLGSQQN

SEQ ID NO: 49598 - protein, 31 aa, Artificial Sequence
  Description of Artificial Sequence: Synthetic polypeptide
MEEEIMTTNPVATEQYGNVSVTMLQGGENRI

SEQ ID NO: 49599 - protein, 31 aa, Artificial Sequence
  Description of Artificial Sequence: Synthetic polypeptide
DEEEIRTTNPVATEQYGSVSTNDDPGGGEES

SEQ ID NO: 49600 - protein, 29 aa, Artificial Sequence
  Description of Artificial Sequence: Synthetic peptide
MEEEIMTTNPVATEQYGNVSVTMLQEGEI

SEQ ID NO: 49601 - protein, 31 aa, Artificial Sequence
  Description of Artificial Sequence: Synthetic polypeptide
DEEEIRTTNPVATEQYGSVSTNDDTGEQEHT

SEQ ID NO: 49602 - protein, 32 aa, Artificial Sequence
  Description of Artificial Sequence: Synthetic polypeptide
VEEEIRTTNPVATEQYGSVTSTDGLNLSGNDR

SEQ ID NO: 49603 - protein, 32 aa, Artificial Sequence
  Description of Artificial Sequence: Synthetic polypeptide
DEEEIRTTNPVATEQYGSVSTNDITQTIEDNQ

SEQ ID NO: 49604 - protein, 33 aa, Artificial Sequence
  Description of Artificial Sequence: Synthetic polypeptide
DEEEIRTTNPVATEQYGSVSTNDLDFASGGDPR

SEQ ID NO: 49605 - protein, 33 aa, Artificial Sequence
  Description of Artificial Sequence: Synthetic polypeptide
DEEEIRTTNPVATEQYGSVSTNDLDQLGGEEEG

SEQ ID NO: 49606 - protein, 35 aa, Artificial Sequence
  Description of Artificial Sequence: Synthetic polypeptide
DEEEIRTTNPVATEQYGSVSTNDLDQLRNGENEQN

SEQ ID NO: 49607 - protein, 33 aa, Artificial Sequence
  Description of Artificial Sequence: Synthetic polypeptide
VEEEIRTTNPVATEQYGSVSTVNLQIVGGNGGT

SEQ ID NO: 49608 - protein, 33 aa, Artificial Sequence
  Description of Artificial Sequence: Synthetic polypeptide
VEEEIRTTNPVATEQYGSVSTVNLQFNNGNGQG

SEQ ID NO: 49609 - protein, 33 aa, Artificial Sequence
  Description of Artificial Sequence: Synthetic polypeptide
DEEEIRTTNPVATEQYGSVSTNALNQRDVIVVD

SEQ ID NO: 49610 - protein, 29 aa, Artificial Sequence
  Description of Artificial Sequence: Synthetic peptide
DEDEIACTNPVATEQYGSVATNLQVNNDH

SEQ ID NO: 49611 - protein, 32 aa, Artificial Sequence
  Description of Artificial Sequence: Synthetic polypeptide
DEEEIRTTNPVATEQYGSVSTMYDQRQGDEEG

SEQ ID NO: 49612 - protein, 32 aa, Artificial Sequence
  Description of Artificial Sequence: Synthetic polypeptide
VEEEIRTTNPVAYEPYGSVNTGNLSQRGGNYR

SEQ ID NO: 49613 - protein, 33 aa, Artificial Sequence
  Description of Artificial Sequence: Synthetic polypeptide
VEEELRTTNPVATEQYGSVSTWNGEDQRIGNQR

SEQ ID NO: 49614 - protein, 30 aa, Artificial Sequence
  Description of Artificial Sequence: Synthetic polypeptide
VEEEISTTNPVALEQYGSVSTGNLQTEANG

SEQ ID NO: 49615 - protein, 30 aa, Artificial Sequence
  Description of Artificial Sequence: Synthetic polypeptide
DEDEIATTNPVATAQYGCVSTGALQRGDNQ

SEQ ID NO: 49616 - protein, 29 aa, Artificial Sequence
  Description of Artificial Sequence: Synthetic peptide
DEDEIATTNPVATAQYGCVSTALQNHGNQ

SEQ ID NO: 49617 - protein, 29 aa, Artificial Sequence
  Description of Artificial Sequence: Synthetic peptide
DEDEIATTNPVATAQYGCVATNLERGDNQ

SEQ ID NO: 49618 - protein, 28 aa, Artificial Sequence
  Description of Artificial Sequence: Synthetic peptide
DEDEIATTNPVATAQYGCVATALQQGNQ

SEQ ID NO: 49619 - protein, 28 aa, Artificial Sequence
  Description of Artificial Sequence: Synthetic peptide
VEEEISCTNPNATEQYGSVSEELMRQNR

SEQ ID NO: 49620 - protein, 34 aa, Artificial Sequence
  Description of Artificial Sequence: Synthetic polypeptide
DEEEIRTTNPVATEQYGSVSTMQNLGQNSGNEGG

SEQ ID NO: 49621 - protein, 31 aa, Artificial Sequence
  Description of Artificial Sequence: Synthetic polypeptide
DEEEIRTTNPVATEQYGSVSTMQNNGGNGGE

SEQ ID NO: 49622 - protein, 29 aa, Artificial Sequence
  Description of Artificial Sequence: Synthetic peptide
MEEEIRATNPCATEQYGSVSENLMLGNNP

SEQ ID NO: 49623 - protein, 32 aa, Artificial Sequence
  Description of Artificial Sequence: Synthetic polypeptide
DEEEIRTTNPVATEQYGSVSTMTDPQRAVLRS

SEQ ID NO: 49624 - protein, 31 aa, Artificial Sequence
  Description of Artificial Sequence: Synthetic polypeptide
VEEEIRTTNPVAYERYGSVSANLSQRTVGNA

SEQ ID NO: 49625 - protein, 33 aa, Artificial Sequence
  Description of Artificial Sequence: Synthetic polypeptide
DEEEIRTTNPVATEQYGSVSTMTLDQEEGGNTT

SEQ ID NO: 49626 - protein, 32 aa, Artificial Sequence
  Description of Artificial Sequence: Synthetic polypeptide
DEEEIRTTNPVATEQYGSVSTMTLETGGNGNE

SEQ ID NO: 49627 - protein, 30 aa, Artificial Sequence
  Description of Artificial Sequence: Synthetic polypeptide
MEEEIMTTNPVATEQYGNVSVTMTQGGNIR

SEQ ID NO: 49628 - protein, 31 aa, Artificial Sequence
  Description of Artificial Sequence: Synthetic polypeptide
MEEEIMTTNPVATEQYGNVSVTMLQGNGNNR

SEQ ID NO: 49629 - protein, 33 aa, Artificial Sequence
  Description of Artificial Sequence: Synthetic polypeptide
VEEEIRTTNPVATEQYGSVSTVNLNQNGGGNIE

SEQ ID NO: 49630 - protein, 29 aa, Artificial Sequence
  Description of Artificial Sequence: Synthetic peptide
DEDEIACTNPVATEQYGSVATNLQSGGDV

SEQ ID NO: 49631 - protein, 34 aa, Artificial Sequence
  Description of Artificial Sequence: Synthetic polypeptide
DEEEIRTTNPVATEQYGSVSTNDLEHQDGQNHEY

SEQ ID NO: 49632 - protein, 32 aa, Artificial Sequence
  Description of Artificial Sequence: Synthetic polypeptide
DEEEIRTTNPVATEQYGSVSTNDNPRSVNDFF

SEQ ID NO: 49633 - protein, 33 aa, Artificial Sequence
  Description of Artificial Sequence: Synthetic polypeptide
DEEEIRTTNPVATEQYGSVSTNDNQVRDSIQRV

SEQ ID NO: 49634 - protein, 32 aa, Artificial Sequence
  Description of Artificial Sequence: Synthetic polypeptide
DEEEIRTTNPVATEQYGSVSTNDNYQRVETQQ

SEQ ID NO: 49635 - protein, 32 aa, Artificial Sequence
  Description of Artificial Sequence: Synthetic polypeptide
AEEEIRTTNPVATEQYGVVSVTNLQQQQGNEE

SEQ ID NO: 49636 - protein, 30 aa, Artificial Sequence
  Description of Artificial Sequence: Synthetic polypeptide
AEEEIRTTNPVATEQYGVVSVTNNLIQGED

SEQ ID NO: 49637 - protein, 32 aa, Artificial Sequence
  Description of Artificial Sequence: Synthetic polypeptide
DEEEIRTTNPVATEQYGSVSTNDPQYNSGDVE

SEQ ID NO: 49638 - protein, 32 aa, Artificial Sequence
  Description of Artificial Sequence: Synthetic polypeptide
DEEEIRTTNPVATEQYGSVSTNDQAPSGMEEG

SEQ ID NO: 49639 - protein, 29 aa, Artificial Sequence
  Description of Artificial Sequence: Synthetic peptide
DEDEIACTNPVATEQWGSVATNLQTPGNE

SEQ ID NO: 49640 - protein, 33 aa, Artificial Sequence
  Description of Artificial Sequence: Synthetic polypeptide
DEEEIRTTNPVATEQYGSVSTNDQTGDSGQNNT

SEQ ID NO: 49641 - protein, 29 aa, Artificial Sequence
  Description of Artificial Sequence: Synthetic peptide
QAEEIATTNPVAYEQYGSVATNLQNNGNV

SEQ ID NO: 49642 - protein, 33 aa, Artificial Sequence
  Description of Artificial Sequence: Synthetic polypeptide
DEEEIRTTNPVATEQYGSVSTNDVDRGLNEEHS

SEQ ID NO: 49643 - protein, 32 aa, Artificial Sequence
  Description of Artificial Sequence: Synthetic polypeptide
DEEEIRTTNPVATEQYGSVSTNDVDTGLNEHT

SEQ ID NO: 49644 - protein, 30 aa, Artificial Sequence
  Description of Artificial Sequence: Synthetic polypeptide
MEEEIKTTNPVATEQYGNVSVTMEQGGNNR

SEQ ID NO: 49645 - protein, 33 aa, Artificial Sequence
  Description of Artificial Sequence: Synthetic polypeptide
VEEEIRTTNPVATEQYGSVSTQNLQSGTGNQGE

SEQ ID NO: 49646 - protein, 32 aa, Artificial Sequence
  Description of Artificial Sequence: Synthetic polypeptide
VEEEIRTTNPVATEQYGSVSTQNGNQGNGNEG

SEQ ID NO: 49647 - protein, 33 aa, Artificial Sequence
  Description of Artificial Sequence: Synthetic polypeptide
DEEEIRTTNPVATEQYGSVSTNDNLENEGEDRN

SEQ ID NO: 49648 - protein, 34 aa, Artificial Sequence
  Description of Artificial Sequence: Synthetic polypeptide
DEEEIRTTNPVATEQYGSVSTNDNLEFRGGEDRN

SEQ ID NO: 49649 - protein, 33 aa, Artificial Sequence
  Description of Artificial Sequence: Synthetic polypeptide
VEEEIRTTNPVATEQYGSVSTTNLQFGGGNEQG

SEQ ID NO: 49650 - protein, 32 aa, Artificial Sequence
  Description of Artificial Sequence: Synthetic polypeptide
DEEEIRTTNPVATEQYGSVSTNDLVRDQIDVV

SEQ ID NO: 49651 - protein, 30 aa, Artificial Sequence
  Description of Artificial Sequence: Synthetic polypeptide
DEDEIACTNPVATEQYGSVATNLQRPDNDN

SEQ ID NO: 49652 - protein, 30 aa, Artificial Sequence
  Description of Artificial Sequence: Synthetic polypeptide
DEDEIACTNPVATEQYGSVATNLQREDNSN

SEQ ID NO: 49653 - protein, 30 aa, Artificial Sequence
  Description of Artificial Sequence: Synthetic polypeptide
DEDEIACTNPVATEQYGSVATNLQQGNPVV

SEQ ID NO: 49654 - protein, 30 aa, Artificial Sequence
  Description of Artificial Sequence: Synthetic polypeptide
DEDEIACTNPVATEQYGSVATNLQQGNLQE

SEQ ID NO: 49655 - protein, 33 aa, Artificial Sequence
  Description of Artificial Sequence: Synthetic polypeptide
DEEEIRTTNPVATEQYGSVSTNDLGDTGNNEEG

SEQ ID NO: 49656 - protein, 32 aa, Artificial Sequence
  Description of Artificial Sequence: Synthetic polypeptide
DEEEIRTTNPVATEQYGSVSTNDLHADGQEEY

SEQ ID NO: 49657 - protein, 33 aa, Artificial Sequence
  Description of Artificial Sequence: Synthetic polypeptide
DEEEIRTTNPVATEQYGSVSTNDLLADGQNEEF

SEQ ID NO: 49658 - protein, 33 aa, Artificial Sequence
  Description of Artificial Sequence: Synthetic polypeptide
DEEEIRTTNPVATEQYGSVSTMNVIQGGGQNGD

SEQ ID NO: 49659 - protein, 32 aa, Artificial Sequence
  Description of Artificial Sequence: Synthetic polypeptide
VEEEIRTTNPVATEQYGSVSTVLQGMEGGNQS

SEQ ID NO: 49660 - protein, 31 aa, Artificial Sequence
  Description of Artificial Sequence: Synthetic polypeptide
DEDEIACTNPVATEQYGSVATNLQDRGNPDA

SEQ ID NO: 49661 - protein, 30 aa, Artificial Sequence
  Description of Artificial Sequence: Synthetic polypeptide
DEDEIACTNPVATEQYGSVATNLERPNDRN

SEQ ID NO: 49662 - protein, 30 aa, Artificial Sequence
  Description of Artificial Sequence: Synthetic polypeptide
DEDEIACTNPVATEQYGSVATNLERGNEKD

SEQ ID NO: 49663 - protein, 29 aa, Artificial Sequence
  Description of Artificial Sequence: Synthetic peptide
DEDEIACTNPVATEQYGSVATNLERGEMD

SEQ ID NO: 49664 - protein, 32 aa, Artificial Sequence
  Description of Artificial Sequence: Synthetic polypeptide
DEEEIRTTNPVATEQYGSVSTNDLQNFLDQLF

SEQ ID NO: 49665 - protein, 32 aa, Artificial Sequence
  Description of Artificial Sequence: Synthetic polypeptide
DEEEIRTTNPVATEQYGSVSTNDLTQNSDQTH

SEQ ID NO: 49666 - protein, 34 aa, Artificial Sequence
  Description of Artificial Sequence: Synthetic polypeptide
DEEEIRTTNPVATEQYGSVSTNDLTQVTGENDGD

SEQ ID NO: 49667 - protein, 29 aa, Artificial Sequence
  Description of Artificial Sequence: Synthetic peptide
QAEEIATTNPVAYEQYGSVATNLQNGNEE

SEQ ID NO: 49668 - protein, 33 aa, Artificial Sequence
  Description of Artificial Sequence: Synthetic polypeptide
DEEEIRTTNPVATEQYGSVSTMNVIQGGGNDDD

SEQ ID NO: 49669 - protein, 33 aa, Artificial Sequence
  Description of Artificial Sequence: Synthetic polypeptide
DEEEIRTTNPVATEQYGSVSTMNVIQGEGNQDI

SEQ ID NO: 49670 - protein, 33 aa, Artificial Sequence
  Description of Artificial Sequence: Synthetic polypeptide
DEEEIRTTNPVATEQYGSVSTMNVIQGEGDNDG

SEQ ID NO: 49671 - protein, 29 aa, Artificial Sequence
  Description of Artificial Sequence: Synthetic peptide
AEECIATTNPVATEQYGSVCSSNHQGGNQ

SEQ ID NO: 49672 - protein, 33 aa, Artificial Sequence
  Description of Artificial Sequence: Synthetic polypeptide
DEEEIRTTNPVATEQYGSVSTMNLNQNRILPDD

SEQ ID NO: 49673 - protein, 33 aa, Artificial Sequence
  Description of Artificial Sequence: Synthetic polypeptide
DEEEIRTTNPVATEQYGSVSTMNLPGQGENTTD

SEQ ID NO: 49674 - protein, 34 aa, Artificial Sequence
  Description of Artificial Sequence: Synthetic polypeptide
DEEEIRTTNPVATEQYGSVSTMNLPQNIGENIST

SEQ ID NO: 49675 - protein, 33 aa, Artificial Sequence
  Description of Artificial Sequence: Synthetic polypeptide
DEEEIRTTNPVATEQYGSVSTMNLQAQTQEVRQ

SEQ ID NO: 49676 - protein, 31 aa, Artificial Sequence
  Description of Artificial Sequence: Synthetic polypeptide
DEDEIATTNPVATEPYGSVCATNLTRGGNER

SEQ ID NO: 49677 - protein, 30 aa, Artificial Sequence
  Description of Artificial Sequence: Synthetic polypeptide
DEDEIATTNPVATEPYGSVCATNLARGGNQ

SEQ ID NO: 49678 - protein, 33 aa, Artificial Sequence
  Description of Artificial Sequence: Synthetic polypeptide
DEEEIRTTNPVATEQYGSVSTMNLQGESGEIGQ

SEQ ID NO: 49679 - protein, 29 aa, Artificial Sequence
  Description of Artificial Sequence: Synthetic peptide
DEDEIATTNPVATEPYGSVATNLQQADDR

SEQ ID NO: 49680 - protein, 31 aa, Artificial Sequence
  Description of Artificial Sequence: Synthetic polypeptide
DEDEIATTNPVATEPYGSVAATNLQQGNDRT

SEQ ID NO: 49681 - protein, 31 aa, Artificial Sequence
  Description of Artificial Sequence: Synthetic polypeptide
DEDEIATTNPVATEPYGSVAATNLQQGDNTR

SEQ ID NO: 49682 - protein, 30 aa, Artificial Sequence
  Description of Artificial Sequence: Synthetic polypeptide
DEDEIATTNPVATEMYGSVATNLERGDNTD

SEQ ID NO: 49683 - protein, 29 aa, Artificial Sequence
  Description of Artificial Sequence: Synthetic peptide
DEDEIATTNPVATEMYGSVATNDQEGNQM

SEQ ID NO: 49684 - protein, 30 aa, Artificial Sequence
  Description of Artificial Sequence: Synthetic polypeptide
DEDEIATTNPVATEHYGSVSTNLQQGDSQN

SEQ ID NO: 49685 - protein, 31 aa, Artificial Sequence
  Description of Artificial Sequence: Synthetic polypeptide
DEDEIATTNPVATEGYGSVSTNLGQGDGNVN

SEQ ID NO: 49686 - protein, 34 aa, Artificial Sequence
  Description of Artificial Sequence: Synthetic polypeptide
DEEEIRTTNPVATEQYGSVSTMNLNQFEQGINEQ

SEQ ID NO: 49687 - protein, 33 aa, Artificial Sequence
  Description of Artificial Sequence: Synthetic polypeptide
VEEEVRTTNPVATEQYGSVSTWNGEDQRQGNNR

SEQ ID NO: 49688 - protein, 33 aa, Artificial Sequence
  Description of Artificial Sequence: Synthetic polypeptide
VEEEVRTTNPVATEQYGSVSTWNLDQRIGDNNQ

SEQ ID NO: 49689 - protein, 33 aa, Artificial Sequence
  Description of Artificial Sequence: Synthetic polypeptide
DEEEIRTTNPVATEQYGSVSTMNLNEVEGGNDQ

SEQ ID NO: 49690 - protein, 33 aa, Artificial Sequence
  Description of Artificial Sequence: Synthetic polypeptide
DEEEIRTTNPVATEQYGSVSTMNLEVGGGNNPQ

SEQ ID NO: 49691 - protein, 28 aa, Artificial Sequence
  Description of Artificial Sequence: Synthetic peptide
VENEIACTNPVATEQYGENSENLQRGGR

SEQ ID NO: 49692 - protein, 30 aa, Artificial Sequence
  Description of Artificial Sequence: Synthetic polypeptide
QAEEIATTNPVATEQYGVVSTNLQDQGPNQ

SEQ ID NO: 49693 - protein, 34 aa, Artificial Sequence
  Description of Artificial Sequence: Synthetic polypeptide
DEEEIRTTNPVATEQYGSVSTMNLFQTGGGNIGG

SEQ ID NO: 49694 - protein, 33 aa, Artificial Sequence
  Description of Artificial Sequence: Synthetic polypeptide
DEEEIRTTNPVATEQYGSVSTMNLFTNGGGNQG

SEQ ID NO: 49695 - protein, 33 aa, Artificial Sequence
  Description of Artificial Sequence: Synthetic polypeptide
DEEEIRTTNPVATEQYGSVSTMNLGPETGNNDQ

SEQ ID NO: 49696 - protein, 34 aa, Artificial Sequence
  Description of Artificial Sequence: Synthetic polypeptide
DEEEIRTTNPVATEQYGSVSTMNLGQQGEGQNEN

SEQ ID NO: 49697 - protein, 34 aa, Artificial Sequence
  Description of Artificial Sequence: Synthetic polypeptide
DEEEIRTTNPVATEQYGSVSTMNLQQDEGGNDEI

SEQ ID NO: 49698 - protein, 28 aa, Artificial Sequence
  Description of Artificial Sequence: Synthetic peptide
VENEIACTNPVATEQYGEASENLQRGGR

SEQ ID NO: 49699 - protein, 29 aa, Artificial Sequence
  Description of Artificial Sequence: Synthetic peptide
VEGAIKTTNPVATEQYGSFSTNLIGGNER

SEQ ID NO: 49700 - protein, 34 aa, Artificial Sequence
  Description of Artificial Sequence: Synthetic polypeptide
DEEEIRTTNPVATEQYGSVSTMNLIQTGGGNEDQ

SEQ ID NO: 49701 - protein, 33 aa, Artificial Sequence
  Description of Artificial Sequence: Synthetic polypeptide
VEEEVRTTNPVAYEQYGSVVSTGNLSQRTGNNR

SEQ ID NO: 49702 - protein, 33 aa, Artificial Sequence
  Description of Artificial Sequence: Synthetic polypeptide
DEEEIRTTNPVATEQYGSVSTMNLLQNRSMIVN

SEQ ID NO: 49703 - protein, 32 aa, Artificial Sequence
  Description of Artificial Sequence: Synthetic polypeptide
MEEEIRTTNPVATDQYGSVSTYDNLDNRNDNR

SEQ ID NO: 49704 - protein, 33 aa, Artificial Sequence
  Description of Artificial Sequence: Synthetic polypeptide
DEEEIRTTNPVATEQYGSVSTMNLNEMGGNNID

SEQ ID NO: 49705 - protein, 32 aa, Artificial Sequence
  Description of Artificial Sequence: Synthetic polypeptide
VEEEVRTTNPVATEQYGSVSTWNLDTRIGDNE

SEQ ID NO: 49706 - protein, 31 aa, Artificial Sequence
  Description of Artificial Sequence: Synthetic polypeptide
VEGEVATTNPVATEQYGSCSTGNLDQRDGNR

SEQ ID NO: 49707 - protein, 34 aa, Artificial Sequence
  Description of Artificial Sequence: Synthetic polypeptide
DEEEIRTTNPVATEQYGSVSTMNLEQLIGFNGEG

SEQ ID NO: 49708 - protein, 33 aa, Artificial Sequence
  Description of Artificial Sequence: Synthetic polypeptide
DEEEIRTTNPVATEQYGSVSTMNLSNENGNNGQ

SEQ ID NO: 49709 - protein, 34 aa, Artificial Sequence
  Description of Artificial Sequence: Synthetic polypeptide
DEEEIRTTNPVATEQYGSVSTMNLSQDGGGNDEG

SEQ ID NO: 49710 - protein, 33 aa, Artificial Sequence
  Description of Artificial Sequence: Synthetic polypeptide
DEEEIRTTNPVATEQYGSVSTMNQDQNGGENIV

SEQ ID NO: 49711 - protein, 33 aa, Artificial Sequence
  Description of Artificial Sequence: Synthetic polypeptide
DEEEIRTTNPVATEQYGSVSTMNQGGQNGGGNQ

SEQ ID NO: 49712 - protein, 33 aa, Artificial Sequence
  Description of Artificial Sequence: Synthetic polypeptide
DEEEIRTTNPVATEQYGSVSTMNQGQNGGNNDV

SEQ ID NO: 49713 - protein, 34 aa, Artificial Sequence
  Description of Artificial Sequence: Synthetic polypeptide
DEEEIRTTNPVATEQYGSVSTMNQLNQNIGGGNV

SEQ ID NO: 49714 - protein, 32 aa, Artificial Sequence
  Description of Artificial Sequence: Synthetic polypeptide
DEEEIRTTNPVATEQYGSVSTMNTDGEGNNDV

SEQ ID NO: 49715 - protein, 33 aa, Artificial Sequence
  Description of Artificial Sequence: Synthetic polypeptide
DEEEIRTTNPVATEQYGSVSTMNTGGQEGGNEE

SEQ ID NO: 49716 - protein, 31 aa, Artificial Sequence
  Description of Artificial Sequence: Synthetic polypeptide
VEEEVATTNPVATEQYGSVSTGPLDQDNGNR

SEQ ID NO: 49717 - protein, 33 aa, Artificial Sequence
  Description of Artificial Sequence: Synthetic polypeptide
DEEEIRTTNPVATEQYGSVSTMNTLEMGGNEDI

SEQ ID NO: 49718 - protein, 33 aa, Artificial Sequence
  Description of Artificial Sequence: Synthetic polypeptide
DEEEIRTTNPVATEQYGSVSTMNTLEMNGGNQD

SEQ ID NO: 49719 - protein, 31 aa, Artificial Sequence
  Description of Artificial Sequence: Synthetic polypeptide
MEEEIRTTNPAATEGYGSVCSTNLARGNDDQ

SEQ ID NO: 49720 - protein, 34 aa, Artificial Sequence
  Description of Artificial Sequence: Synthetic polypeptide
DEEEIRTTNPVATEQYGSVSTMNTLGQNGGNGEE

SEQ ID NO: 49721 - protein, 33 aa, Artificial Sequence
  Description of Artificial Sequence: Synthetic polypeptide
VEEEVATTNPVATEQYGSVSMTGNLDQPRDGNR

SEQ ID NO: 49722 - protein, 33 aa, Artificial Sequence
  Description of Artificial Sequence: Synthetic polypeptide
DEEEIRTTNPVATEQYGSVSTMNTVIQDEGFND

SEQ ID NO: 49723 - protein, 31 aa, Artificial Sequence
  Description of Artificial Sequence: Synthetic polypeptide
VEEEVACTNPVATEQYGSVSTGNLDQRDGER

SEQ ID NO: 49724 - protein, 33 aa, Artificial Sequence
  Description of Artificial Sequence: Synthetic polypeptide
DEEEIRTTNPVATEQYGSVSTMNVIQENGQNED

SEQ ID NO: 49725 - protein, 33 aa, Artificial Sequence
  Description of Artificial Sequence: Synthetic polypeptide
DEEEIRTTNPVATEQYGSVSTMNNVIQGGGNDG

SEQ ID NO: 49726 - protein, 32 aa, Artificial Sequence
  Description of Artificial Sequence: Synthetic polypeptide
DEEEIRTTNPVATEQYGSVSTMNNVIGGGNGD

SEQ ID NO: 49727 - protein, 33 aa, Artificial Sequence
  Description of Artificial Sequence: Synthetic polypeptide
DEEEIRTTNPVATEQYGSVSTMNNTEGQTGNED

SEQ ID NO: 49728 - protein, 33 aa, Artificial Sequence
  Description of Artificial Sequence: Synthetic polypeptide
VEEEVRTTNPVATEQYGCVSTWNLDQRIGHNRN

SEQ ID NO: 49729 - protein, 29 aa, Artificial Sequence
  Description of Artificial Sequence: Synthetic peptide
AEECIGTTNPVATEQYGSVSWNHQRFGDQ

SEQ ID NO: 49730 - protein, 33 aa, Artificial Sequence
  Description of Artificial Sequence: Synthetic polypeptide
DEEEIRTTNPVATEQYGSVSTMNLTDTGGNNGD

SEQ ID NO: 49731 - protein, 33 aa, Artificial Sequence
  Description of Artificial Sequence: Synthetic polypeptide
DEEEIRTTNPVATEQYGSVSTMNLVGEGGNLEI

SEQ ID NO: 49732 - protein, 33 aa, Artificial Sequence
  Description of Artificial Sequence: Synthetic polypeptide
DEEEIRTTNPVATEQYGSVSTMNLVNTGGENGI

SEQ ID NO: 49733 - protein, 32 aa, Artificial Sequence
  Description of Artificial Sequence: Synthetic polypeptide
VEEEVRTTNPVATEQYGSVSTWNELDERIGNQ

SEQ ID NO: 49734 - protein, 32 aa, Artificial Sequence
  Description of Artificial Sequence: Synthetic polypeptide
DEEEIRTTNPVATEQYGSVSTMNNEMGGGNQD

SEQ ID NO: 49735 - protein, 33 aa, Artificial Sequence
  Description of Artificial Sequence: Synthetic polypeptide
DEEEIRTTNPVATEQYGSVSTMNNGIQDEGGND

SEQ ID NO: 49736 - protein, 33 aa, Artificial Sequence
  Description of Artificial Sequence: Synthetic polypeptide
DEEEIRTTNPVATEQYGSVSTMNLSNNGNGNEQ

SEQ ID NO: 49737 - protein, 32 aa, Artificial Sequence
  Description of Artificial Sequence: Synthetic polypeptide
VEEEVRTTNPVATEQYGSVSLTPNLDQAIGER

SEQ ID NO: 49738 - protein, 33 aa, Artificial Sequence
  Description of Artificial Sequence: Synthetic polypeptide
VEEEVRTTNPVATEQYGSVCSTWNGEDQREGNR

SEQ ID NO: 49739 - protein, 32 aa, Artificial Sequence
  Description of Artificial Sequence: Synthetic polypeptide
DEEEIRTTNPVATEQYGSVSTMNNHQEKDMIR

SEQ ID NO: 49740 - protein, 33 aa, Artificial Sequence
  Description of Artificial Sequence: Synthetic polypeptide
DEEEIRTTNPVATEQYGSVSTMNNLDFEGNNNE

SEQ ID NO: 49741 - protein, 33 aa, Artificial Sequence
  Description of Artificial Sequence: Synthetic polypeptide
DEEEIRTTNPVATEQYGSVSTMNNLITGGGNEQ

SEQ ID NO: 49742 - protein, 34 aa, Artificial Sequence
  Description of Artificial Sequence: Synthetic polypeptide
DEEEIRTTNPVATEQYGSVSTMNNLQGSGGQNIQ

SEQ ID NO: 49743 - protein, 33 aa, Artificial Sequence
  Description of Artificial Sequence: Synthetic polypeptide
DEEEIRTTNPVATEQYGSVSTMNNLQGSGQQIN

SEQ ID NO: 49744 - protein, 33 aa, Artificial Sequence
  Description of Artificial Sequence: Synthetic polypeptide
DEEEIRTTNPVATEQYGSVSTMNNLQNVGFEEG

SEQ ID NO: 49745 - protein, 33 aa, Artificial Sequence
  Description of Artificial Sequence: Synthetic polypeptide
DEEEIRTTNPVATEQYGSVSTMNNGQGGGNDEV

SEQ ID NO: 49746 - protein, 32 aa, Artificial Sequence
  Description of Artificial Sequence: Synthetic polypeptide
MEEEIRTTNPVATESYGSVSETNLQHRGEGQG

SEQ ID NO: 49747 - protein, 30 aa, Artificial Sequence
  Description of Artificial Sequence: Synthetic polypeptide
DEDEIATTNPVATEQYGSVATNLERGDPDA

SEQ ID NO: 49748 - protein, 28 aa, Artificial Sequence
  Description of Artificial Sequence: Synthetic peptide
YEEEIAPTNPVSSEQYGVVSCNLQSGNR

SEQ ID NO: 49749 - protein, 29 aa, Artificial Sequence
  Description of Artificial Sequence: Synthetic peptide
NDESIRTTNPVATEQYGAVSTNHQRENGL

SEQ ID NO: 49750 - protein, 32 aa, Artificial Sequence
  Description of Artificial Sequence: Synthetic polypeptide
AEEEIRTTNPVATEQYGSVVVTNNLQQGGNDN

SEQ ID NO: 49751 - protein, 31 aa, Artificial Sequence
  Description of Artificial Sequence: Synthetic polypeptide
AEEEIRTTNPVATEQYGVVSTTNNQQAGNVE

SEQ ID NO: 49752 - protein, 32 aa, Artificial Sequence
  Description of Artificial Sequence: Synthetic polypeptide
DEEEIRTTNPVATEQYGSVSTGLDVTGGGNEE

SEQ ID NO: 49753 - protein, 32 aa, Artificial Sequence
  Description of Artificial Sequence: Synthetic polypeptide
DEEEIRTTNPVATEQYGSVSTGLEQLIMTGQE

SEQ ID NO: 49754 - protein, 32 aa, Artificial Sequence
  Description of Artificial Sequence: Synthetic polypeptide
AEEEIRTTNPVATEQYGSVVVTNNLQNGNNAA

SEQ ID NO: 49755 - protein, 33 aa, Artificial Sequence
  Description of Artificial Sequence: Synthetic polypeptide
DEEEIRTTNPVATEQYGSVSTGLIGQGGQEENI

SEQ ID NO: 49756 - protein, 32 aa, Artificial Sequence
  Description of Artificial Sequence: Synthetic polypeptide
AEEEIRTTNPVATEQYGSVVVTNNLQDSNGNT

SEQ ID NO: 49757 - protein, 31 aa, Artificial Sequence
  Description of Artificial Sequence: Synthetic polypeptide
DEEEIRTTNPVATEQYGSVSTGLNMPGVEEI

SEQ ID NO: 49758 - protein, 33 aa, Artificial Sequence
  Description of Artificial Sequence: Synthetic polypeptide
DEEEIRTTNPVATEQYGSVSTGLQSPANAEDRD

SEQ ID NO: 49759 - protein, 31 aa, Artificial Sequence
  Description of Artificial Sequence: Synthetic polypeptide
DEEEIRTTNPVATEQYGSVSTGLSPPGVEQI

SEQ ID NO: 49760 - protein, 32 aa, Artificial Sequence
  Description of Artificial Sequence: Synthetic polypeptide
AEEEIRTTNPVATEQYGSVVVTNNLQDNGNNG

SEQ ID NO: 49761 - protein, 31 aa, Artificial Sequence
  Description of Artificial Sequence: Synthetic polypeptide
NDEEIRTTNPVATEQYGVVSNTNLQENGSNQ

SEQ ID NO: 49762 - protein, 29 aa, Artificial Sequence
  Description of Artificial Sequence: Synthetic peptide
DEDEIATTNPVAYEQWGSVSTNLQHGDAG

SEQ ID NO: 49763 - protein, 31 aa, Artificial Sequence
  Description of Artificial Sequence: Synthetic polypeptide
DEEEIRTTNPVATEQYGSVSTGLVNIAQNMT

SEQ ID NO: 49764 - protein, 30 aa, Artificial Sequence
  Description of Artificial Sequence: Synthetic polypeptide
NEAEIATTNPVATEQYGSVSTNLQGDGDDQ

SEQ ID NO: 49765 - protein, 31 aa, Artificial Sequence
  Description of Artificial Sequence: Synthetic polypeptide
NDEEIRTTNPVATEQYGQVVSTNLNQNGSNQ

SEQ ID NO: 49766 - protein, 30 aa, Artificial Sequence
  Description of Artificial Sequence: Synthetic polypeptide
DEEEIRTTNPVATEQYGSVSTGGGVVTNLY

SEQ ID NO: 49767 - protein, 32 aa, Artificial Sequence
  Description of Artificial Sequence: Synthetic polypeptide
DEEEIRTTNPVATEQYGSVSTGELQGFGSQQN

SEQ ID NO: 49768 - protein, 33 aa, Artificial Sequence
  Description of Artificial Sequence: Synthetic polypeptide
DEEEIRTTNPVATEQYGSVSTFNQQAGNGGGNG

SEQ ID NO: 49769 - protein, 30 aa, Artificial Sequence
  Description of Artificial Sequence: Synthetic polypeptide
NNEEIRTTNPVATEQYGVVSTNGQDEGGNT

SEQ ID NO: 49770 - protein, 31 aa, Artificial Sequence
  Description of Artificial Sequence: Synthetic polypeptide
NEAEIRTTNPVATEEYGSVSTNLQGNEGNDG

SEQ ID NO: 49771 - protein, 28 aa, Artificial Sequence
  Description of Artificial Sequence: Synthetic peptide
YEEEIASVNPVCTEQYGSVSTNLQSGEQ

SEQ ID NO: 49772 - protein, 28 aa, Artificial Sequence
  Description of Artificial Sequence: Synthetic peptide
YEEEIASVNPVCTEQYGSVSDNLQSGNQ

SEQ ID NO: 49773 - protein, 29 aa, Artificial Sequence
  Description of Artificial Sequence: Synthetic peptide
DEDEIATTNPVAYEQYGSCSTNLDAPNER

SEQ ID NO: 49774 - protein, 32 aa, Artificial Sequence
  Description of Artificial Sequence: Synthetic polypeptide
DEEEIRTTNPVATEQYGSVSTFNVNEGGGNIT

SEQ ID NO: 49775 - protein, 31 aa, Artificial Sequence
  Description of Artificial Sequence: Synthetic polypeptide
NEAEIRTTNPCATEQYGSVSTNLQGDGQNQQ

SEQ ID NO: 49776 - protein, 32 aa, Artificial Sequence
  Description of Artificial Sequence: Synthetic polypeptide
DEEEIRTTNPVATEQYGSVSTGAHQGFGSNIA

SEQ ID NO: 49777 - protein, 31 aa, Artificial Sequence
  Description of Artificial Sequence: Synthetic polypeptide
NEAEIATTNPVATEQYGSVSTNLQMGDGMNQ

SEQ ID NO: 49778 - protein, 31 aa, Artificial Sequence
  Description of Artificial Sequence: Synthetic polypeptide
NEAEIATTNPVATEQYGSVSTNLQGDGDNEQ

SEQ ID NO: 49779 - protein, 28 aa, Artificial Sequence
  Description of Artificial Sequence: Synthetic peptide
YEEEIASVNPVCTEQYGNVSDNLQSGNR

SEQ ID NO: 49780 - protein, 32 aa, Artificial Sequence
  Description of Artificial Sequence: Synthetic polypeptide
DEEEIRTTNPVATEQYGSVSTGELQAFGSDQF

SEQ ID NO: 49781 - protein, 32 aa, Artificial Sequence
  Description of Artificial Sequence: Synthetic polypeptide
DEEEIRTTNPVATEQYGSVSTGELQFFNSNQE

SEQ ID NO: 49782 - protein, 32 aa, Artificial Sequence
  Description of Artificial Sequence: Synthetic polypeptide
DEEEIRTTNPVATEQYGSVSTGELQGFGSDQM

SEQ ID NO: 49783 - protein, 33 aa, Artificial Sequence
  Description of Artificial Sequence: Synthetic polypeptide
DEEEIRTTNPVATEQYGSVSTGELQHFGSENQM

SEQ ID NO: 49784 - protein, 31 aa, Artificial Sequence
  Description of Artificial Sequence: Synthetic polypeptide
DEEEIRTTNPVATEQYGSVSTGLWVDIENEM

SEQ ID NO: 49785 - protein, 32 aa, Artificial Sequence
  Description of Artificial Sequence: Synthetic polypeptide
DEEEIRTTNPVATEQYGSVSTGMGGQTGNGEI

SEQ ID NO: 49786 - protein, 32 aa, Artificial Sequence
  Description of Artificial Sequence: Synthetic polypeptide
DEEEIRTTNPVATEQYGSVSTGMGQAGANHGH

SEQ ID NO: 49787 - protein, 33 aa, Artificial Sequence
  Description of Artificial Sequence: Synthetic polypeptide
DEEEIRTTNPVATEQYGSVSTGNNDGQTGGNQG

SEQ ID NO: 49788 - protein, 32 aa, Artificial Sequence
  Description of Artificial Sequence: Synthetic polypeptide
AEEEIRTTNPVATEQYGSVVVTNLQQGIGNQN

SEQ ID NO: 49789 - protein, 29 aa, Artificial Sequence
  Description of Artificial Sequence: Synthetic peptide
NAEEIATTNPVATEQWGVVSTNLQDGPNN

SEQ ID NO: 49790 - protein, 32 aa, Artificial Sequence
  Description of Artificial Sequence: Synthetic polypeptide
AEEEIRTTNPVATEQYGSVVVTNLQQGGNNTT

SEQ ID NO: 49791 - protein, 32 aa, Artificial Sequence
  Description of Artificial Sequence: Synthetic polypeptide
DEEEIRTTNPVATEQYGSVSTGNVTDGEGNNA

SEQ ID NO: 49792 - protein, 32 aa, Artificial Sequence
  Description of Artificial Sequence: Synthetic polypeptide
AEEEIRTTNPVATEQYGSVVVTNLQNGNQNTA

SEQ ID NO: 49793 - protein, 32 aa, Artificial Sequence
  Description of Artificial Sequence: Synthetic polypeptide
AEEEIRTTNPVATEQYGSVVVTNLQNGNNNAQ

SEQ ID NO: 49794 - protein, 32 aa, Artificial Sequence
  Description of Artificial Sequence: Synthetic polypeptide
DEEEIRTTNPVATEQYGSVSTGVGQTGDENEG

SEQ ID NO: 49795 - protein, 32 aa, Artificial Sequence
  Description of Artificial Sequence: Synthetic polypeptide
AEEEIRTTNPVATEQYGSVVVTNLQLGNGNST

SEQ ID NO: 49796 - protein, 31 aa, Artificial Sequence
  Description of Artificial Sequence: Synthetic polypeptide
DEEEIRTTNPVATEQYGSVSTGVPEQERTGS

SEQ ID NO: 49797 - protein, 30 aa, Artificial Sequence
  Description of Artificial Sequence: Synthetic polypeptide
MTEEIRTTNPVATTQYGSVSTTALQYGNEF

SEQ ID NO: 49798 - protein, 30 aa, Artificial Sequence
  Description of Artificial Sequence: Synthetic polypeptide
MTEEIRTTNPVATTQYGSVSTTALQQYGNF

SEQ ID NO: 49799 - protein, 29 aa, Artificial Sequence
  Description of Artificial Sequence: Synthetic peptide
DEDEIATTNPVAYEPYGSVATNLQQGNDD

SEQ ID NO: 49800 - protein, 30 aa, Artificial Sequence
  Description of Artificial Sequence: Synthetic polypeptide
MTEEIRTTNPVATTQYGSVSTALQYGNNFE

SEQ ID NO: 49801 - protein, 31 aa, Artificial Sequence
  Description of Artificial Sequence: Synthetic polypeptide
DEEEIRTTNPVATEQYGSVSTIADNAAGIRA

SEQ ID NO: 49802 - protein, 34 aa, Artificial Sequence
  Description of Artificial Sequence: Synthetic polypeptide
DEEEIRTTNPVATEQYGSVSTGNLTQGFGGNNEF

SEQ ID NO: 49803 - protein, 33 aa, Artificial Sequence
  Description of Artificial Sequence: Synthetic polypeptide
DEEEIRTTNPVATEQYGSVSTGNLTGGGNNEFD

SEQ ID NO: 49804 - protein, 34 aa, Artificial Sequence
  Description of Artificial Sequence: Synthetic polypeptide
DEEEIRTTNPVATEQYGSVSTGNLNQQEDGDNGN

SEQ ID NO: 49805 - protein, 32 aa, Artificial Sequence
  Description of Artificial Sequence: Synthetic polypeptide
DEEEIRTTNPVATEQYGSVSTGNLESFGSDDP

SEQ ID NO: 49806 - protein, 33 aa, Artificial Sequence
  Description of Artificial Sequence: Synthetic polypeptide
DEEEIRTTNPVATEQYGSVSTGNDGQGEQGNGE

SEQ ID NO: 49807 - protein, 32 aa, Artificial Sequence
  Description of Artificial Sequence: Synthetic polypeptide
DEEEIRTTNPVATEQYGSVSTGNDGQNQGGEG

SEQ ID NO: 49808 - protein, 32 aa, Artificial Sequence
  Description of Artificial Sequence: Synthetic polypeptide
DEEEIRTTNPVATEQYGSVSTGNDGQNQGGGI

SEQ ID NO: 49809 - protein, 32 aa, Artificial Sequence
  Description of Artificial Sequence: Synthetic polypeptide
DEEEIRTTNPVATEQYGSVSTGNDNTGGGNDD

SEQ ID NO: 49810 - protein, 32 aa, Artificial Sequence
  Description of Artificial Sequence: Synthetic polypeptide
DEEEIRTTNPVATEQYGSVSTGNGESGDGNNN

SEQ ID NO: 49811 - protein, 32 aa, Artificial Sequence
  Description of Artificial Sequence: Synthetic polypeptide
DEEEIRTTNPVATEQYGSVSTGNGGIGGNTQT

SEQ ID NO: 49812 - protein, 32 aa, Artificial Sequence
  Description of Artificial Sequence: Synthetic polypeptide
AEEEIRTTNPVATEQYGSVVVTNNLGQDNGNG

SEQ ID NO: 49813 - protein, 31 aa, Artificial Sequence
  Description of Artificial Sequence: Synthetic polypeptide
NEAEIRTTNPVATEPWGSVSTNLQGEDGNTR

SEQ ID NO: 49814 - protein, 33 aa, Artificial Sequence
  Description of Artificial Sequence: Synthetic polypeptide
DEEEIRTTNPVATEQYGSVSTGNGGQGEDGNEG

SEQ ID NO: 49815 - protein, 32 aa, Artificial Sequence
  Description of Artificial Sequence: Synthetic polypeptide
AEEEIRTTNPVATEQYGSVVVTNLQQNGNNAV

SEQ ID NO: 49816 - protein, 32 aa, Artificial Sequence
  Description of Artificial Sequence: Synthetic polypeptide
AEEEIRTTNPVATEQYGSVVVTNLQQGTGNTE

SEQ ID NO: 49817 - protein, 32 aa, Artificial Sequence
  Description of Artificial Sequence: Synthetic polypeptide
AEEEIRTTNPVATEQYGSVVVTNLQQGNGNNG

SEQ ID NO: 49818 - protein, 33 aa, Artificial Sequence
  Description of Artificial Sequence: Synthetic polypeptide
DEEEIRTTNPVATEQYGSVSTGNGHQMRDMIRY

SEQ ID NO: 49819 - protein, 32 aa, Artificial Sequence
  Description of Artificial Sequence: Synthetic polypeptide
DEEEIRTTNPVATEQYGSVSTGNGQGNITNDS

SEQ ID NO: 49820 - protein, 31 aa, Artificial Sequence
  Description of Artificial Sequence: Synthetic polypeptide
NAEEIRTTNPVATEQYGVVSTMNLQQDNPNR

SEQ ID NO: 49821 - protein, 33 aa, Artificial Sequence
  Description of Artificial Sequence: Synthetic polypeptide
DEEEIRTTNPVATEQYGSVSTGNLDEFGGNEEA

SEQ ID NO: 49822 - protein, 32 aa, Artificial Sequence
  Description of Artificial Sequence: Synthetic polypeptide
AEEEIRTTNPVATEQYGSVVVTNLQSNEGNGN

SEQ ID NO: 49823 - protein, 32 aa, Artificial Sequence
  Description of Artificial Sequence: Synthetic polypeptide
DEEEIRTTNPVATEQYGSVSTFNNGGEGGGNI

SEQ ID NO: 49824 - protein, 32 aa, Artificial Sequence
  Description of Artificial Sequence: Synthetic polypeptide
AEEEIRTTNPVATEQYGSVVVTNNLQQGNGNT

SEQ ID NO: 49825 - protein, 33 aa, Artificial Sequence
  Description of Artificial Sequence: Synthetic polypeptide
DEEEIRTTNPVATEQYGSVSTFNNDGQGEGNDN

SEQ ID NO: 49826 - protein, 34 aa, Artificial Sequence
  Description of Artificial Sequence: Synthetic polypeptide
DEEEIRTTNPVATEQYGSVSTENGPNMRNGMNPR

SEQ ID NO: 49827 - protein, 28 aa, Artificial Sequence
  Description of Artificial Sequence: Synthetic peptide
NEDEIATTNPVAYEQYGSVATNLQSGSQ

SEQ ID NO: 49828 - protein, 33 aa, Artificial Sequence
  Description of Artificial Sequence: Synthetic polypeptide
DEEEIRTTNPVATEQYGSVSTENGVQTGGGNET

SEQ ID NO: 49829 - protein, 29 aa, Artificial Sequence
  Description of Artificial Sequence: Synthetic peptide
DEDEIATTNPVAYEQYGSVATNLETGTDR

SEQ ID NO: 49830 - protein, 30 aa, Artificial Sequence
  Description of Artificial Sequence: Synthetic polypeptide
DEDEIATTNPVAYEQYGSVATNLETGNERD

SEQ ID NO: 49831 - protein, 33 aa, Artificial Sequence
  Description of Artificial Sequence: Synthetic polypeptide
DEEEIRTTNPVATEQYGSVSTENLDVTGGGNES

SEQ ID NO: 49832 - protein, 31 aa, Artificial Sequence
  Description of Artificial Sequence: Synthetic polypeptide
DEDEIATTNPVAYEQYGSVATNLDQPRGERQ

SEQ ID NO: 49833 - protein, 34 aa, Artificial Sequence
  Description of Artificial Sequence: Synthetic polypeptide
DEEEIRTTNPVATEQYGSVSTENLNQRQLLSNEF

SEQ ID NO: 49834 - protein, 30 aa, Artificial Sequence
  Description of Artificial Sequence: Synthetic polypeptide
DEDEIATTNPVAYEQYGSVATNDQRGPNEQ

SEQ ID NO: 49835 - protein, 30 aa, Artificial Sequence
  Description of Artificial Sequence: Synthetic polypeptide
DEDEIATTNPVAYEQYGSVATNDQRGNDTW

SEQ ID NO: 49836 - protein, 30 aa, Artificial Sequence
  Description of Artificial Sequence: Synthetic polypeptide
DEDEIATTNPVAYEQYGSVATNDQQGNDRG

SEQ ID NO: 49837 - protein, 28 aa, Artificial Sequence
  Description of Artificial Sequence: Synthetic peptide
DEDEIATTNPVAYEQYGSVATNDDNGNA

SEQ ID NO: 49838 - protein, 34 aa, Artificial Sequence
  Description of Artificial Sequence: Synthetic polypeptide
DEEEIRTTNPVATEQYGSVSTENLQQNEGENENE

SEQ ID NO: 49839 - protein, 30 aa, Artificial Sequence
  Description of Artificial Sequence: Synthetic polypeptide
DEDEIATTNPVAYEQYGSVATALQRDGDND

SEQ ID NO: 49840 - protein, 29 aa, Artificial Sequence
  Description of Artificial Sequence: Synthetic peptide
NNEEIRTTNPVATEQYGVVATLLQVGPNG

SEQ ID NO: 49841 - protein, 34 aa, Artificial Sequence
  Description of Artificial Sequence: Synthetic polypeptide
DEEEIRTTNPVATEQYGSVSTENGPMMRNGMNPR

SEQ ID NO: 49842 - protein, 34 aa, Artificial Sequence
  Description of Artificial Sequence: Synthetic polypeptide
DEEEIRTTNPVATEQYGSVSTENGLSQAVGEGRA

SEQ ID NO: 49843 - protein, 30 aa, Artificial Sequence
  Description of Artificial Sequence: Synthetic polypeptide
NEDEIRTTNPVATEQYGSVDDTNLQIGGQG

SEQ ID NO: 49844 - protein, 30 aa, Artificial Sequence
  Description of Artificial Sequence: Synthetic polypeptide
DEDEIATTNPVAYEQYGSVATNLQDDSGNH

SEQ ID NO: 49845 - protein, 31 aa, Artificial Sequence
  Description of Artificial Sequence: Synthetic polypeptide
NNEEIRTTNPVATEQYGVSCSTNLQDGPNSN

SEQ ID NO: 49846 - protein, 31 aa, Artificial Sequence
  Description of Artificial Sequence: Synthetic polypeptide
DEDEIATTNPVAYEQYGSVATNLQQRGDNSM

SEQ ID NO: 49847 - protein, 31 aa, Artificial Sequence
  Description of Artificial Sequence: Synthetic polypeptide
DEEEIRTTNPVATEQYGSVSTENDDSADGDS

SEQ ID NO: 49848 - protein, 30 aa, Artificial Sequence
  Description of Artificial Sequence: Synthetic polypeptide
NEDEIRTTNPVATEQYGSVDTNLQIGGQGF

SEQ ID NO: 49849 - protein, 29 aa, Artificial Sequence
  Description of Artificial Sequence: Synthetic peptide
NEDEIRTTNPVATEQYGSVDTNDQIGGGI

SEQ ID NO: 49850 - protein, 28 aa, Artificial Sequence
  Description of Artificial Sequence: Synthetic peptide
YEEEIASVNPVCTEQYGVVSDNLQRGNQ

SEQ ID NO: 49851 - protein, 34 aa, Artificial Sequence
  Description of Artificial Sequence: Synthetic polypeptide
DEEEIRTTNPVATEQYGSVSTENDLTTRSGNPQI

SEQ ID NO: 49852 - protein, 29 aa, Artificial Sequence
  Description of Artificial Sequence: Synthetic peptide
DEDEIATTNPVAYEQYGSVANTNDDRGND

SEQ ID NO: 49853 - protein, 33 aa, Artificial Sequence
  Description of Artificial Sequence: Synthetic polypeptide
DEEEIRTTNPVATEQYGSVSTENDMQRSSENDS

SEQ ID NO: 49854 - protein, 32 aa, Artificial Sequence
  Description of Artificial Sequence: Synthetic polypeptide
DEEEIRTTNPVATEQYGSVSTENDPQADYGDS

SEQ ID NO: 49855 - protein, 30 aa, Artificial Sequence
  Description of Artificial Sequence: Synthetic polypeptide
NEDEIRTTNPVATEQYGSVDTDNLQIGGGT

SEQ ID NO: 49856 - protein, 31 aa, Artificial Sequence
  Description of Artificial Sequence: Synthetic polypeptide
DEDEIATTNPVAYEQYGSVATNLQDRGNALM

SEQ ID NO: 49857 - protein, 31 aa, Artificial Sequence
  Description of Artificial Sequence: Synthetic polypeptide
DEDEIATTNPVAYEQYGSVATNLQDRGGNAM

SEQ ID NO: 49858 - protein, 32 aa, Artificial Sequence
  Description of Artificial Sequence: Synthetic polypeptide
DEDEIATTNPVAYEQYGSVATNLQDRGDNMRM

SEQ ID NO: 49859 - protein, 31 aa, Artificial Sequence
  Description of Artificial Sequence: Synthetic polypeptide
DEDEIATTNPVAYEQYGSVATNLQDRGDNDA

SEQ ID NO: 49860 - protein, 34 aa, Artificial Sequence
  Description of Artificial Sequence: Synthetic polypeptide
DEEEIRTTNPVATEQYGSVSTENDTQRQGDENEE

SEQ ID NO: 49861 - protein, 33 aa, Artificial Sequence
  Description of Artificial Sequence: Synthetic polypeptide
DEEEIRTTNPVATEQYGSVSTENDMQRSTNEPS

SEQ ID NO: 49862 - protein, 28 aa, Artificial Sequence
  Description of Artificial Sequence: Synthetic peptide
YEEEIASVNPVATEQYGVVSTALQSGNQ

SEQ ID NO: 49863 - protein, 30 aa, Artificial Sequence
  Description of Artificial Sequence: Synthetic polypeptide
NEDEIATTNPVATEQYGSVATNLQDNGEGR

SEQ ID NO: 49864 - protein, 31 aa, Artificial Sequence
  Description of Artificial Sequence: Synthetic polypeptide
DEEEIRTTNPVATEQYGSVSTENPGVSINQD

SEQ ID NO: 49865 - protein, 34 aa, Artificial Sequence
  Description of Artificial Sequence: Synthetic polypeptide
DEEEIRTTNPVATEQYGSVSTFNDLEQGGGNNEV

SEQ ID NO: 49866 - protein, 32 aa, Artificial Sequence
  Description of Artificial Sequence: Synthetic polypeptide
AEEEIRTTNPVATEQYGSVVVTNNLQTGQEND

SEQ ID NO: 49867 - protein, 31 aa, Artificial Sequence
  Description of Artificial Sequence: Synthetic polypeptide
NEAEIRTTNPVATEQYGCVSTNLQHAGDNSA

SEQ ID NO: 49868 - protein, 33 aa, Artificial Sequence
  Description of Artificial Sequence: Synthetic polypeptide
DEEEIRTTNPVATEQYGSVSTFNLDNDEGGNII

SEQ ID NO: 49869 - protein, 33 aa, Artificial Sequence
  Description of Artificial Sequence: Synthetic polypeptide
DEEEIRTTNPVATEQYGSVSTFNLEEMRQGEQY

SEQ ID NO: 49870 - protein, 33 aa, Artificial Sequence
  Description of Artificial Sequence: Synthetic polypeptide
DEEEIRTTNPVATEQYGSVSTFNLFENSGNIQG

SEQ ID NO: 49871 - protein, 29 aa, Artificial Sequence
  Description of Artificial Sequence: Synthetic peptide
DEDEIATTNPVAYEQYGSVAANTDQRGND

SEQ ID NO: 49872 - protein, 31 aa, Artificial Sequence
  Description of Artificial Sequence: Synthetic polypeptide
AEEEIRTTNPVATEQYGSVVVTNNLQQIQNV

SEQ ID NO: 49873 - protein, 33 aa, Artificial Sequence
  Description of Artificial Sequence: Synthetic polypeptide
DEEEIRTTNPVATEQYGSVSTFNLFTNSGNNQG

SEQ ID NO: 49874 - protein, 33 aa, Artificial Sequence
  Description of Artificial Sequence: Synthetic polypeptide
DEEEIRTTNPVATEQYGSVSTFNLGGMEGGNEQ

SEQ ID NO: 49875 - protein, 33 aa, Artificial Sequence
  Description of Artificial Sequence: Synthetic polypeptide
DEEEIRTTNPVATEQYGSVSTFNLGQQGEQGEF

SEQ ID NO: 49876 - protein, 30 aa, Artificial Sequence
  Description of Artificial Sequence: Synthetic polypeptide
NEAEIRTTNPVATEQYGAVSTNLQHQGGDA

SEQ ID NO: 49877 - protein, 33 aa, Artificial Sequence
  Description of Artificial Sequence: Synthetic polypeptide
DEEEIRTTNPVATEQYGSVSTFNLNTGPGGNGG

SEQ ID NO: 49878 - protein, 34 aa, Artificial Sequence
  Description of Artificial Sequence: Synthetic polypeptide
DEEEIRTTNPVATEQYGSVSTFNLQNGMEGGNIE

SEQ ID NO: 49879 - protein, 32 aa, Artificial Sequence
  Description of Artificial Sequence: Synthetic polypeptide
AEEEIRTTNPVATEQYGSVVVTNNLQQIGNDN

SEQ ID NO: 49880 - protein, 32 aa, Artificial Sequence
  Description of Artificial Sequence: Synthetic polypeptide
DEEEIRTTNPVATEQYGSVSTFNDDNGDGNED

SEQ ID NO: 49881 - protein, 29 aa, Artificial Sequence
  Description of Artificial Sequence: Synthetic peptide
DEDEIATTNPVAYEQYGSVAATNDQRANM

SEQ ID NO: 49882 - protein, 30 aa, Artificial Sequence
  Description of Artificial Sequence: Synthetic polypeptide
DEDEIATTNPVAYEQYGSVAATNDQRGNDV

SEQ ID NO: 49883 - protein, 30 aa, Artificial Sequence
  Description of Artificial Sequence: Synthetic polypeptide
DEDEIATTNPVAYEQYGSVAATNDQRGNIQ

SEQ ID NO: 49884 - protein, 29 aa, Artificial Sequence
  Description of Artificial Sequence: Synthetic peptide
DEDEIATTNPVAYEQYGSVAITNDQNGND

SEQ ID NO: 49885 - protein, 28 aa, Artificial Sequence
  Description of Artificial Sequence: Synthetic peptide
NEDEIACTNPVATEQYGSVATNLQSGSD

SEQ ID NO: 49886 - protein, 32 aa, Artificial Sequence
  Description of Artificial Sequence: Synthetic polypeptide
DEEEIRTTNPVATEQYGSVSTEPLNQREDSID

SEQ ID NO: 49887 - protein, 32 aa, Artificial Sequence
  Description of Artificial Sequence: Synthetic polypeptide
DEEEIRTTNPVATEQYGSVSTEPQNFGSENQS

SEQ ID NO: 49888 - protein, 31 aa, Artificial Sequence
  Description of Artificial Sequence: Synthetic polypeptide
DEEEIRTTNPVATEQYGSVSTESDLGRSFSQ

SEQ ID NO: 49889 - protein, 31 aa, Artificial Sequence
  Description of Artificial Sequence: Synthetic polypeptide
NNEEIRTTNPVATEQYGVVSTMELQQPGNNR

SEQ ID NO: 49890 - protein, 32 aa, Artificial Sequence
  Description of Artificial Sequence: Synthetic polypeptide
DEEEIRTTNPVATEQYGSVSTEVGPQVGEDRD

SEQ ID NO: 49891 - protein, 29 aa, Artificial Sequence
  Description of Artificial Sequence: Synthetic peptide
NEDEIATTNPVATEQYGSVATNLQDGEDN

SEQ ID NO: 49892 - protein, 28 aa, Artificial Sequence
  Description of Artificial Sequence: Synthetic peptide
NEDEIACTNPVATEQYGEASENLQRGGR

SEQ ID NO: 49893 - protein, 33 aa, Artificial Sequence
  Description of Artificial Sequence: Synthetic polypeptide
DEEEIRTTNPVATEQYGSVSTFDLDQSGGGNEG

SEQ ID NO: 49894 - protein, 29 aa, Artificial Sequence
  Description of Artificial Sequence: Synthetic peptide
NEAEIRTTNPVAYEQWGSVTTNQQDGNAR

SEQ ID NO: 49895 - protein, 31 aa, Artificial Sequence
  Description of Artificial Sequence: Synthetic polypeptide
NNEEIRTTNPVATEQYGVVSTMVLQQDGNIR

SEQ ID NO: 49896 - protein, 30 aa, Artificial Sequence
  Description of Artificial Sequence: Synthetic polypeptide
NEAEIRTTNPVAYECYGSVSTNLQMGGDER

SEQ ID NO: 49897 - protein, 31 aa, Artificial Sequence
  Description of Artificial Sequence: Synthetic polypeptide
NEAEIRTTNPVATESYGSVSTNLQGNEGNGD

SEQ ID NO: 49898 - protein, 31 aa, Artificial Sequence
  Description of Artificial Sequence: Synthetic polypeptide
NNEEIRTTNPVATEQYGVVSTNDLQDGPNYD

SEQ ID NO: 49899 - protein, 30 aa, Artificial Sequence
  Description of Artificial Sequence: Synthetic polypeptide
DEDEIATTNPVAYEQYGSVAATNDQRGNPL

SEQ ID NO: 49900 - protein, 32 aa, Artificial Sequence
  Description of Artificial Sequence: Synthetic polypeptide
NNEEIRTTNPVATEQYGVVSTMNLQQEDGNNR

SEQ ID NO: 49901 - protein, 33 aa, Artificial Sequence
  Description of Artificial Sequence: Synthetic polypeptide
DEEEIRTTNPVATEQYGSVSTIAEPQMREGENV

SEQ ID NO: 49902 - protein, 32 aa, Artificial Sequence
  Description of Artificial Sequence: Synthetic polypeptide
AEEEIRTTNPVATEQYGSVVVTNLQLGGNNES

SEQ ID NO: 49903 - protein, 30 aa, Artificial Sequence
  Description of Artificial Sequence: Synthetic polypeptide
MTEEIRTTNPVATEQWGTVSTTNNLQEGNN

SEQ ID NO: 49904 - protein, 32 aa, Artificial Sequence
  Description of Artificial Sequence: Synthetic polypeptide
MEEEVRTTNPVATEQYGSVCSTGNLDQNIGNQ

SEQ ID NO: 49905 - protein, 28 aa, Artificial Sequence
  Description of Artificial Sequence: Synthetic peptide
YEEEIASTNPVCTEQYGVASENLQSGNR

SEQ ID NO: 49906 - protein, 28 aa, Artificial Sequence
  Description of Artificial Sequence: Synthetic peptide
YEEEIASTNPVCTEQYGVASDNLQSGNR

SEQ ID NO: 49907 - protein, 29 aa, Artificial Sequence
  Description of Artificial Sequence: Synthetic peptide
MEEEITTTNPVATEQYGTVSVTGGQGGNP

SEQ ID NO: 49908 - protein, 31 aa, Artificial Sequence
  Description of Artificial Sequence: Synthetic polypeptide
DEEEIRTTNPVATEQYGSVSTMGFGGNGQGQ

SEQ ID NO: 49909 - protein, 31 aa, Artificial Sequence
  Description of Artificial Sequence: Synthetic polypeptide
NPEEIATTNPVATEQYGSVSTNMQGGGDDNR

SEQ ID NO: 49910 - protein, 33 aa, Artificial Sequence
  Description of Artificial Sequence: Synthetic polypeptide
DEEEIRTTNPVATEQYGSVSTMGLDQGNGNTDT

SEQ ID NO: 49911 - protein, 30 aa, Artificial Sequence
  Description of Artificial Sequence: Synthetic polypeptide
NQEEIRTTNPVATEQYGVVSTNLQNGSDQI

SEQ ID NO: 49912 - protein, 32 aa, Artificial Sequence
  Description of Artificial Sequence: Synthetic polypeptide
DEEEIRTTNPVATEQYGSVSTMGLGDNGGGNG

SEQ ID NO: 49913 - protein, 28 aa, Artificial Sequence
  Description of Artificial Sequence: Synthetic peptide
YEEEIASTNPVCTEQYGDVSDNLQSGNQ

SEQ ID NO: 49914 - protein, 32 aa, Artificial Sequence
  Description of Artificial Sequence: Synthetic polypeptide
DEEEIRTTNPVATEQYGSVSTMGLNFNEGGNT

SEQ ID NO: 49915 - protein, 33 aa, Artificial Sequence
  Description of Artificial Sequence: Synthetic polypeptide
DEEEIRTTNPVATEQYGSVSTMGLQFNGGGEER

SEQ ID NO: 49916 - protein, 31 aa, Artificial Sequence
  Description of Artificial Sequence: Synthetic polypeptide
NSEEIRTTNPVATEQWGCVSCTNLSQDGGNR

SEQ ID NO: 49917 - protein, 28 aa, Artificial Sequence
  Description of Artificial Sequence: Synthetic peptide
YEEEIASTNPVATEQYGVVSDNLQSGPQ

SEQ ID NO: 49918 - protein, 30 aa, Artificial Sequence
  Description of Artificial Sequence: Synthetic polypeptide
MEEEISTTNPVATEQYGVVTSVTELQGGNQ

SEQ ID NO: 49919 - protein, 32 aa, Artificial Sequence
  Description of Artificial Sequence: Synthetic polypeptide
DEEEIRTTNPVATEQYGSVSTMEPGQSGNQGQ

SEQ ID NO: 49920 - protein, 31 aa, Artificial Sequence
  Description of Artificial Sequence: Synthetic polypeptide
DEEEIRTTNPVATEQYGSVSTMEMGQDGEQS

SEQ ID NO: 49921 - protein, 33 aa, Artificial Sequence
  Description of Artificial Sequence: Synthetic polypeptide
MEEEVRTTNPVATEQYGSVCSTWNLDQNIGSNR

SEQ ID NO: 49922 - protein, 32 aa, Artificial Sequence
  Description of Artificial Sequence: Synthetic polypeptide
MEEEVRTTNPVATEQYGSVSTWNLDQDTIDNR

SEQ ID NO: 49923 - protein, 33 aa, Artificial Sequence
  Description of Artificial Sequence: Synthetic polypeptide
DEEEIRTTNPVATEQYGSVSTMDNFDQELAGND

SEQ ID NO: 49924 - protein, 31 aa, Artificial Sequence
  Description of Artificial Sequence: Synthetic polypeptide
MEGEIRTTNPVATEQYGSVSTNDLERNANFE

SEQ ID NO: 49925 - protein, 32 aa, Artificial Sequence
  Description of Artificial Sequence: Synthetic polypeptide
MEGEIRTTNPVATEQYGSVSASNLDQRGENNQ

SEQ ID NO: 49926 - protein, 32 aa, Artificial Sequence
  Description of Artificial Sequence: Synthetic polypeptide
DEEEIRTTNPVATEQYGSVSTMDNFNGGNGQG

SEQ ID NO: 49927 - protein, 28 aa, Artificial Sequence
  Description of Artificial Sequence: Synthetic peptide
YEEEIASTNPVCTEQYGVVSDNLQSGNQ

SEQ ID NO: 49928 - protein, 30 aa, Artificial Sequence
  Description of Artificial Sequence: Synthetic polypeptide
NNPEIATTNPVATEQYGVVSTNLEQQGPNR

SEQ ID NO: 49929 - protein, 32 aa, Artificial Sequence
  Description of Artificial Sequence: Synthetic polypeptide
DEEEIRTTNPVATEQYGSVSTMDQNTGIEGNE

SEQ ID NO: 49930 - protein, 33 aa, Artificial Sequence
  Description of Artificial Sequence: Synthetic polypeptide
DEEEIRTTNPVATEQYGSVSTMGLQTEGGNGDD

SEQ ID NO: 49931 - protein, 31 aa, Artificial Sequence
  Description of Artificial Sequence: Synthetic polypeptide
DEEEIRTTNPVATEQYGSVSTMDQQGIGGEG

SEQ ID NO: 49932 - protein, 32 aa, Artificial Sequence
  Description of Artificial Sequence: Synthetic polypeptide
DEEEIRTTNPVATEQYGSVSTMDQQNGINGEI

SEQ ID NO: 49933 - protein, 31 aa, Artificial Sequence
  Description of Artificial Sequence: Synthetic polypeptide
NNPEIRTTNPVATEQYGSVVSTNLEQQGPER

SEQ ID NO: 49934 - protein, 33 aa, Artificial Sequence
  Description of Artificial Sequence: Synthetic polypeptide
DEEEIRTTNPVATEQYGSVSTMELEQGEGENTS

SEQ ID NO: 49935 - protein, 28 aa, Artificial Sequence
  Description of Artificial Sequence: Synthetic peptide
YEEEIASTNPVCTEQYGVVSDNLQHGNQ

SEQ ID NO: 49936 - protein, 33 aa, Artificial Sequence
  Description of Artificial Sequence: Synthetic polypeptide
DEEEIRTTNPVATEQYGSVSTMELQGGGENDGE

SEQ ID NO: 49937 - protein, 32 aa, Artificial Sequence
  Description of Artificial Sequence: Synthetic polypeptide
DEEEIRTTNPVATEQYGSVSTMELQNFGSQQT

SEQ ID NO: 49938 - protein, 31 aa, Artificial Sequence
  Description of Artificial Sequence: Synthetic polypeptide
AEEEIRTTNPVATEQYGSVVVTNAQEQEGNG

SEQ ID NO: 49939 - protein, 30 aa, Artificial Sequence
  Description of Artificial Sequence: Synthetic polypeptide
MEGEIRTTNPVATEQYGSVNTALIERMNRV

SEQ ID NO: 49940 - protein, 32 aa, Artificial Sequence
  Description of Artificial Sequence: Synthetic polypeptide
AEEEIRTTNPVATEQYGVVSTTTNLQNNDGNY

SEQ ID NO: 49941 - protein, 33 aa, Artificial Sequence
  Description of Artificial Sequence: Synthetic polypeptide
DEEEIRTTNPVATEQYGSVSTMGLQTNGGNNGD

SEQ ID NO: 49942 - protein, 32 aa, Artificial Sequence
  Description of Artificial Sequence: Synthetic polypeptide
NSEEIRTTNPVATEQYGVTVSCTNLSQGVGNR

SEQ ID NO: 49943 - protein, 32 aa, Artificial Sequence
  Description of Artificial Sequence: Synthetic polypeptide
DEDEIATTNPVATEQYGSVATNLQARANENDR

SEQ ID NO: 49944 - protein, 30 aa, Artificial Sequence
  Description of Artificial Sequence: Synthetic polypeptide
MEEEIRTTNPVGTEQYGSVSATDFLGRGLP

SEQ ID NO: 49945 - protein, 31 aa, Artificial Sequence
  Description of Artificial Sequence: Synthetic polypeptide
DEDEIATTNPVATEQYGSVATNLQADGNGTE

SEQ ID NO: 49946 - protein, 29 aa, Artificial Sequence
  Description of Artificial Sequence: Synthetic peptide
NTAEIRTTNPVATEQYGTTTSTVLQHGNR

SEQ ID NO: 49947 - protein, 32 aa, Artificial Sequence
  Description of Artificial Sequence: Synthetic polypeptide
DEEEIRTTNPVATEQYGSVSTMLDGTGGGNES

SEQ ID NO: 49948 - protein, 32 aa, Artificial Sequence
  Description of Artificial Sequence: Synthetic polypeptide
DEEEIRTTNPVATEQYGSVSTMLDNMNGGNGD

SEQ ID NO: 49949 - protein, 32 aa, Artificial Sequence
  Description of Artificial Sequence: Synthetic polypeptide
DEDEIATTNPVATEQYGSVATNLQAAAGSNDR

SEQ ID NO: 49950 - protein, 31 aa, Artificial Sequence
  Description of Artificial Sequence: Synthetic polypeptide
DEDEIATTNPVATEQYGSVATNLETRGDNDT

SEQ ID NO: 49951 - protein, 30 aa, Artificial Sequence
  Description of Artificial Sequence: Synthetic polypeptide
DEDEIATTNPVATEQYGSVATNLERSNPEQ

SEQ ID NO: 49952 - protein, 31 aa, Artificial Sequence
  Description of Artificial Sequence: Synthetic polypeptide
DEDEIATTNPVATEQYGSVATNLERPGENPE

SEQ ID NO: 49953 - protein, 31 aa, Artificial Sequence
  Description of Artificial Sequence: Synthetic polypeptide
DEDEIATTNPVATEQYGSVATNLERPGEENN

SEQ ID NO: 49954 - protein, 33 aa, Artificial Sequence
  Description of Artificial Sequence: Synthetic polypeptide
DEEEIRTTNPVATEQYGSVSTMLDQQEGDNGEL

SEQ ID NO: 49955 - protein, 29 aa, Artificial Sequence
  Description of Artificial Sequence: Synthetic peptide
DEDEIATTNPVATEQYGSVATNLERNHTS

SEQ ID NO: 49956 - protein, 32 aa, Artificial Sequence
  Description of Artificial Sequence: Synthetic polypeptide
DEDEIATTNPVATEQYGSVATNLERNGDNPRM

SEQ ID NO: 49957 - protein, 28 aa, Artificial Sequence
  Description of Artificial Sequence: Synthetic peptide
YEEEIAPTNPVSTEQYGVVSCNLQSGNQ

SEQ ID NO: 49958 - protein, 32 aa, Artificial Sequence
  Description of Artificial Sequence: Synthetic polypeptide
DEEEIRTTNPVATEQYGSVSTMLDGMQGEGGT

SEQ ID NO: 49959 - protein, 31 aa, Artificial Sequence
  Description of Artificial Sequence: Synthetic polypeptide
DEDEIATTNPVATEQYGSVATNLQDQGGNES

SEQ ID NO: 49960 - protein, 32 aa, Artificial Sequence
  Description of Artificial Sequence: Synthetic polypeptide
DEDEIATTNPVATEQYGSVATNLQDRGDNNEN

SEQ ID NO: 49961 - protein, 31 aa, Artificial Sequence
  Description of Artificial Sequence: Synthetic polypeptide
DEDEIATTNPVATEQYGSVATNLQGNGNPED

SEQ ID NO: 49962 - protein, 31 aa, Artificial Sequence
  Description of Artificial Sequence: Synthetic polypeptide
DEDEIATTNPVATEQYGSVATPNLQDGNEDD

SEQ ID NO: 49963 - protein, 31 aa, Artificial Sequence
  Description of Artificial Sequence: Synthetic polypeptide
MEEEISTTNPVATEQYGCVSVTELQGGNNRM

SEQ ID NO: 49964 - protein, 33 aa, Artificial Sequence
  Description of Artificial Sequence: Synthetic polypeptide
DEEEIRTTNPVATEQYGSVSTMGLTGQGGGNVT

SEQ ID NO: 49965 - protein, 31 aa, Artificial Sequence
  Description of Artificial Sequence: Synthetic polypeptide
DEDEIATTNPVATEQYGSVATNPLDERNGNV

SEQ ID NO: 49966 - protein, 30 aa, Artificial Sequence
  Description of Artificial Sequence: Synthetic polypeptide
MEEEISTTNPVATEQYGCVSTTMLQGGNQM

SEQ ID NO: 49967 - protein, 32 aa, Artificial Sequence
  Description of Artificial Sequence: Synthetic polypeptide
NSEEIRTTNPVATEQYGVVSCTNLSQDGGNYR

SEQ ID NO: 49968 - protein, 31 aa, Artificial Sequence
  Description of Artificial Sequence: Synthetic polypeptide
DEDEIATTNPVATEQYGSVATNLQRNPENDN

SEQ ID NO: 49969 - protein, 33 aa, Artificial Sequence
  Description of Artificial Sequence: Synthetic polypeptide
DEEEIRTTNPVATEQYGSVSTMGLQTNIGNGDV

SEQ ID NO: 49970 - protein, 30 aa, Artificial Sequence
  Description of Artificial Sequence: Synthetic polypeptide
DEDEIATTNPVATEQYGSVATNLQREAPEE

SEQ ID NO: 49971 - protein, 31 aa, Artificial Sequence
  Description of Artificial Sequence: Synthetic polypeptide
DEDEIATTNPVATEQYGSVATNLQRDGGEGN

SEQ ID NO: 49972 - protein, 30 aa, Artificial Sequence
  Description of Artificial Sequence: Synthetic polypeptide
DEDEIATTNPVATEQYGSVATNLQQPNPVD

SEQ ID NO: 49973 - protein, 29 aa, Artificial Sequence
  Description of Artificial Sequence: Synthetic peptide
DEDEIATTNPVATEQYGSVATNLQQPDVS

SEQ ID NO: 49974 - protein, 31 aa, Artificial Sequence
  Description of Artificial Sequence: Synthetic polypeptide
DEDEIATTNPVATEQYGSVATNLQQGGNVTD

SEQ ID NO: 49975 - protein, 31 aa, Artificial Sequence
  Description of Artificial Sequence: Synthetic polypeptide
DEDEIATTNPVATEQYGSVATNLQQGGNNQV

SEQ ID NO: 49976 - protein, 31 aa, Artificial Sequence
  Description of Artificial Sequence: Synthetic polypeptide
DEDEIATTNPVATEQYGSVATNLQNGDNNEM

SEQ ID NO: 49977 - protein, 30 aa, Artificial Sequence
  Description of Artificial Sequence: Synthetic polypeptide
DEDEIATTNPVATEQYGSVATNLQHADNEE

SEQ ID NO: 49978 - protein, 30 aa, Artificial Sequence
  Description of Artificial Sequence: Synthetic polypeptide
DEDEIATTNPVATEQYGSVATNLQRDSDDD

SEQ ID NO: 49979 - protein, 33 aa, Artificial Sequence
  Description of Artificial Sequence: Synthetic polypeptide
DEEEIRTTNPVATEQYGSVSTNEHSNDRVPNRY

SEQ ID NO: 49980 - protein, 29 aa, Artificial Sequence
  Description of Artificial Sequence: Synthetic peptide
YEEEIASTNPVCTEQYGVVSDNLQSSGNR

SEQ ID NO: 49981 - protein, 33 aa, Artificial Sequence
  Description of Artificial Sequence: Synthetic polypeptide
DEEEIRTTNPVATEQYGSVSTMDLGQGEGENVQ

SEQ ID NO: 49982 - protein, 31 aa, Artificial Sequence
  Description of Artificial Sequence: Synthetic polypeptide
DEDEIATTNPVATEWYGSVSTNLQPQGDNDG

SEQ ID NO: 49983 - protein, 33 aa, Artificial Sequence
  Description of Artificial Sequence: Synthetic polypeptide
DEEEIRTTNPVATEQYGSVSTLLNQLEQGEDNQ

SEQ ID NO: 49984 - protein, 30 aa, Artificial Sequence
  Description of Artificial Sequence: Synthetic polypeptide
MQEEISTTNPVATEQYGSVPSTNLIRDNHS

SEQ ID NO: 49985 - protein, 31 aa, Artificial Sequence
  Description of Artificial Sequence: Synthetic polypeptide
AEEEIRTTNPVATEQYGVVSTTNSNQEGNNQ

SEQ ID NO: 49986 - protein, 32 aa, Artificial Sequence
  Description of Artificial Sequence: Synthetic polypeptide
DEEEIRTTNPVATEQYGSVSTLLQEDGVSQEA

SEQ ID NO: 49987 - protein, 32 aa, Artificial Sequence
  Description of Artificial Sequence: Synthetic polypeptide
DEEEIRTTNPVATEQYGSVSTLLQGTMNNEGG

SEQ ID NO: 49988 - protein, 28 aa, Artificial Sequence
  Description of Artificial Sequence: Synthetic peptide
YEEEIASVNPVATEQYGVASENLQSGNR

SEQ ID NO: 49989 - protein, 33 aa, Artificial Sequence
  Description of Artificial Sequence: Synthetic polypeptide
DEEEIRTTNPVATEQYGSVSTLLQNVGMNEGET

SEQ ID NO: 49990 - protein, 32 aa, Artificial Sequence
  Description of Artificial Sequence: Synthetic polypeptide
DEDEIATTNPVATESYGSVSTNLQGEHGNNDR

SEQ ID NO: 49991 - protein, 31 aa, Artificial Sequence
  Description of Artificial Sequence: Synthetic polypeptide
MESEIRTTNPVATEQYGSVSTLNLEDRGEDI

SEQ ID NO: 49992 - protein, 30 aa, Artificial Sequence
  Description of Artificial Sequence: Synthetic polypeptide
DEDEIATTNPVATEQYGTVSTNDQGAGNTT

SEQ ID NO: 49993 - protein, 29 aa, Artificial Sequence
  Description of Artificial Sequence: Synthetic peptide
YEEEIASVNPVATEQYGSVSADNLQSGNL

SEQ ID NO: 49994 - protein, 32 aa, Artificial Sequence
  Description of Artificial Sequence: Synthetic polypeptide
DEEEIRTTNPVATEQYGSVSTLNAGDNHGRDR

SEQ ID NO: 49995 - protein, 32 aa, Artificial Sequence
  Description of Artificial Sequence: Synthetic polypeptide
DEDEIATTNPVATEQYGSVVATNLQERGTDRE

SEQ ID NO: 49996 - protein, 30 aa, Artificial Sequence
  Description of Artificial Sequence: Synthetic polypeptide
DEDEIATTNPVATEQYGSVSWNELVDGNTQ

SEQ ID NO: 49997 - protein, 33 aa, Artificial Sequence
  Description of Artificial Sequence: Synthetic polypeptide
DEEEIRTTNPVATEQYGSVSTLLLEQAQSGDER

SEQ ID NO: 49998 - protein, 32 aa, Artificial Sequence
  Description of Artificial Sequence: Synthetic polypeptide
DEEEIRTTNPVATEQYGSVSTLLGGTQGGEEN

SEQ ID NO: 49999 - protein, 31 aa, Artificial Sequence
  Description of Artificial Sequence: Synthetic polypeptide
DEEEIRTTNPVATEQYGSVSTLLETSENSLF

SEQ ID NO: 50000 - protein, 28 aa, Artificial Sequence
  Description of Artificial Sequence: Synthetic peptide
YEEEIASVNPVATEQYGVVSDNLMRGNQ

SEQ ID NO: 50001 - protein, 33 aa, Artificial Sequence
  Description of Artificial Sequence: Synthetic polypeptide
DEEEIRTTNPVATEQYGSVSTINLQQETVLNAV

SEQ ID NO: 50002 - protein, 28 aa, Artificial Sequence
  Description of Artificial Sequence: Synthetic peptide
YEEEIASVNPVATEQYGVVSENLQSGNQ

SEQ ID NO: 50003 - protein, 32 aa, Artificial Sequence
  Description of Artificial Sequence: Synthetic polypeptide
AEEEIRTTNPVATEQYGSVVVTNLQDNEGNTG

SEQ ID NO: 50004 - protein, 28 aa, Artificial Sequence
  Description of Artificial Sequence: Synthetic peptide
YEEEIASVNPVATEQYGVVSENLQSGGR

SEQ ID NO: 50005 - protein, 32 aa, Artificial Sequence
  Description of Artificial Sequence: Synthetic polypeptide
DEEEIRTTNPVATEQYGSVSTLDDQAQSGDER

SEQ ID NO: 50006 - protein, 31 aa, Artificial Sequence
  Description of Artificial Sequence: Synthetic polypeptide
AEEEIRTTNPVATEQYGSVVVTNLNQIQNNV

SEQ ID NO: 50007 - protein, 30 aa, Artificial Sequence
  Description of Artificial Sequence: Synthetic polypeptide
MTEEIRTTNPVATEQWGTVSTTNLQEGGNN

SEQ ID NO: 50008 - protein, 32 aa, Artificial Sequence
  Description of Artificial Sequence: Synthetic polypeptide
AEEEIRTTNPVATEQYGSVVVTNLLQEEGTNG

SEQ ID NO: 50009 - protein, 30 aa, Artificial Sequence
  Description of Artificial Sequence: Synthetic polypeptide
MTEEIRTTNPVATEQWGTVSTNLQNETGNN

SEQ ID NO: 50010 - protein, 32 aa, Artificial Sequence
  Description of Artificial Sequence: Synthetic polypeptide
AEEEIRTTNPVATEQYGSVVVTNLNEQGGNQE

SEQ ID NO: 50011 - protein, 33 aa, Artificial Sequence
  Description of Artificial Sequence: Synthetic polypeptide
DEEEIRTTNPVATEQYGSVSTLGLAQNSGNGNG

SEQ ID NO: 50012 - protein, 30 aa, Artificial Sequence
  Description of Artificial Sequence: Synthetic polypeptide
MTEEIRTTNPVATEQWGTVSTNLQEGNNDT

SEQ ID NO: 50013 - protein, 28 aa, Artificial Sequence
  Description of Artificial Sequence: Synthetic peptide
YEEEIASVNPVATEQYGVVSDNLQSGNQ

SEQ ID NO: 50014 - protein, 33 aa, Artificial Sequence
  Description of Artificial Sequence: Synthetic polypeptide
DEEEIRTTNPVATEQYGSVSTLGLPIINGSNQR

SEQ ID NO: 50015 - protein, 28 aa, Artificial Sequence
  Description of Artificial Sequence: Synthetic peptide
YEEEIASVNPVATEQYGVVSDNLQSGNG

SEQ ID NO: 50016 - protein, 30 aa, Artificial Sequence
  Description of Artificial Sequence: Synthetic polypeptide
MTEEIRTTNPVATEQWGTVSTNLGQEGGNN

SEQ ID NO: 50017 - protein, 33 aa, Artificial Sequence
  Description of Artificial Sequence: Synthetic polypeptide
DEEEIRTTNPVATEQYGSVSTLEDLETERGDRQ

SEQ ID NO: 50018 - protein, 29 aa, Artificial Sequence
  Description of Artificial Sequence: Synthetic peptide
MEGEIRTTNPVATEQYGSVWTDLIEMNNR

SEQ ID NO: 50019 - protein, 28 aa, Artificial Sequence
  Description of Artificial Sequence: Synthetic peptide
YEEEIASVNPVATEQYGEVSENLQSGNQ

SEQ ID NO: 50020 - protein, 31 aa, Artificial Sequence
  Description of Artificial Sequence: Synthetic polypeptide
DEDEIATTNPVATEQYGSVSTNLQMGDSQGM

SEQ ID NO: 50021 - protein, 28 aa, Artificial Sequence
  Description of Artificial Sequence: Synthetic peptide
MENEIACTNPVATEQYGEASENLQRGSR

SEQ ID NO: 50022 - protein, 28 aa, Artificial Sequence
  Description of Artificial Sequence: Synthetic peptide
MENEIACTNPVATEQYGEASENLQRGGR

SEQ ID NO: 50023 - protein, 32 aa, Artificial Sequence
  Description of Artificial Sequence: Synthetic polypeptide
AEEEIRTTNPVATEQYGSVVVTNELQQQGNED

SEQ ID NO: 50024 - protein, 28 aa, Artificial Sequence
  Description of Artificial Sequence: Synthetic peptide
YEEEIASTNPVSTEQYGVVSCNLQSGTR

SEQ ID NO: 50025 - protein, 32 aa, Artificial Sequence
  Description of Artificial Sequence: Synthetic polypeptide
AEEEIRTTNPVATEQYGSVVVTNELQQGGNDI

SEQ ID NO: 50026 - protein, 29 aa, Artificial Sequence
  Description of Artificial Sequence: Synthetic peptide
YEEEIASTNPVCTEQYGVVSTNLQSEGNQ

SEQ ID NO: 50027 - protein, 31 aa, Artificial Sequence
  Description of Artificial Sequence: Synthetic polypeptide
NNEEIRTTNPVATEQYGYVVSTNEQPDGPNR

SEQ ID NO: 50028 - protein, 28 aa, Artificial Sequence
  Description of Artificial Sequence: Synthetic peptide
YEEEIASTNPVCTEQYGVVSENLQSGNQ

SEQ ID NO: 50029 - protein, 30 aa, Artificial Sequence
  Description of Artificial Sequence: Synthetic polypeptide
NNEEIRTTNPVATEYYGVVSTNLNENGDNR

SEQ ID NO: 50030 - protein, 33 aa, Artificial Sequence
  Description of Artificial Sequence: Synthetic polypeptide
DEEEIRTTNPVATEQYGSVSTMDGLGQEGGGNT

SEQ ID NO: 50031 - protein, 29 aa, Artificial Sequence
  Description of Artificial Sequence: Synthetic peptide
MEGTIRTTNPVATEQYGESTSTNLIIGNE

SEQ ID NO: 50032 - protein, 30 aa, Artificial Sequence
  Description of Artificial Sequence: Synthetic polypeptide
MEGEIRTTNPVATEQYGSVWVTNLQEIGSG

SEQ ID NO: 50033 - protein, 33 aa, Artificial Sequence
  Description of Artificial Sequence: Synthetic polypeptide
DEEEIRTTNPVATEQYGSVSTMDINQRTGNIQQ

SEQ ID NO: 50034 - protein, 30 aa, Artificial Sequence
  Description of Artificial Sequence: Synthetic polypeptide
MEGEIRTTNPVATEQYGSVWTNLQIGFSEN

SEQ ID NO: 50035 - protein, 32 aa, Artificial Sequence
  Description of Artificial Sequence: Synthetic polypeptide
DEEEIRTTNPVATEQYGSVSTMDLEANQGENQ

SEQ ID NO: 50036 - protein, 31 aa, Artificial Sequence
  Description of Artificial Sequence: Synthetic polypeptide
AEEEIRTTNPVATEQYGSVVVTNEQQQGGNI

SEQ ID NO: 50037 - protein, 30 aa, Artificial Sequence
  Description of Artificial Sequence: Synthetic polypeptide
NNEEIRTTNPVATEQYGVVSTVLQDGGPND

SEQ ID NO: 50038 - protein, 28 aa, Artificial Sequence
  Description of Artificial Sequence: Synthetic peptide
YEEEIASVNPVATEQYGAVSDNLQSGNQ

SEQ ID NO: 50039 - protein, 31 aa, Artificial Sequence
  Description of Artificial Sequence: Synthetic polypeptide
AEEEIRTTNPVATEQYGSVVVTNGLGREFTR

SEQ ID NO: 50040 - protein, 28 aa, Artificial Sequence
  Description of Artificial Sequence: Synthetic peptide
YEEEIASVNPVATEQYGEVSENLQSGGR

SEQ ID NO: 50041 - protein, 32 aa, Artificial Sequence
  Description of Artificial Sequence: Synthetic polypeptide
DEDEIATTNPVATEQYGSVSTNLQHNGPNDTN

SEQ ID NO: 50042 - protein, 28 aa, Artificial Sequence
  Description of Artificial Sequence: Synthetic peptide
YEEEIASVNPVATEQYGEVSDNLQSGNQ

SEQ ID NO: 50043 - protein, 29 aa, Artificial Sequence
  Description of Artificial Sequence: Synthetic peptide
DEDEIATTNPVATEQYGSVSNNPQNNGPE

SEQ ID NO: 50044 - protein, 28 aa, Artificial Sequence
  Description of Artificial Sequence: Synthetic peptide
YEEEIASVNPVATEQYGEASENLQSGNR

SEQ ID NO: 50045 - protein, 33 aa, Artificial Sequence
  Description of Artificial Sequence: Synthetic polypeptide
DEEEIRTTNPVATEQYGSVSTLNIDQNGGGNEA

SEQ ID NO: 50046 - protein, 32 aa, Artificial Sequence
  Description of Artificial Sequence: Synthetic polypeptide
DEEEIRTTNPVATEQYGSVSTLNLDDPGAEEI

SEQ ID NO: 50047 - protein, 32 aa, Artificial Sequence
  Description of Artificial Sequence: Synthetic polypeptide
DEDEIATTNPVATEQYGSVSTNLQPQGDNDDA

SEQ ID NO: 50048 - protein, 30 aa, Artificial Sequence
  Description of Artificial Sequence: Synthetic polypeptide
AEEEIRTTNPVATEQYGSVVVTNLGGTQNG

SEQ ID NO: 50049 - protein, 32 aa, Artificial Sequence
  Description of Artificial Sequence: Synthetic polypeptide
AEEEIRTTNPVATEQYGSVVVTNLEQQGGNQV

SEQ ID NO: 50050 - protein, 33 aa, Artificial Sequence
  Description of Artificial Sequence: Synthetic polypeptide
DEEEIRTTNPVATEQYGSVSTLNVDQGEMGNNV

SEQ ID NO: 50051 - protein, 29 aa, Artificial Sequence
  Description of Artificial Sequence: Synthetic peptide
NNEEIRTTNPVATEQYGVVSTNTQDPQNE

SEQ ID NO: 50052 - protein, 32 aa, Artificial Sequence
  Description of Artificial Sequence: Synthetic polypeptide
DEEEIRTTNPVATEQYGSVSTLPNQLQLEDEQ

SEQ ID NO: 50053 - protein, 32 aa, Artificial Sequence
  Description of Artificial Sequence: Synthetic polypeptide
DEEEIRTTNPVATEQYGSVSTLQIQEGNNEHN

SEQ ID NO: 50054 - protein, 32 aa, Artificial Sequence
  Description of Artificial Sequence: Synthetic polypeptide
DEEEIRTTNPVATEQYGSVSTLTLQQSTQIER

SEQ ID NO: 50055 - protein, 30 aa, Artificial Sequence
  Description of Artificial Sequence: Synthetic polypeptide
DEDEIATTNPVATEQYGSVCATNLQDLNDN

SEQ ID NO: 50056 - protein, 29 aa, Artificial Sequence
  Description of Artificial Sequence: Synthetic peptide
NNEEIRTTNPVATEQYGVVSTNQVDGPNI

SEQ ID NO: 50057 - protein, 31 aa, Artificial Sequence
  Description of Artificial Sequence: Synthetic polypeptide
DEEEIRTTNPVATEQYGSVSTENDDNARSQE

SEQ ID NO: 50058 - protein, 32 aa, Artificial Sequence
  Description of Artificial Sequence: Synthetic polypeptide
DEEEIRTTNPVATEQYGSVSTNEQQSDDNEPV

SEQ ID NO: 50059 - protein, 33 aa, Artificial Sequence
  Description of Artificial Sequence: Synthetic polypeptide
DEEEIRTTNPVATEQYGSVSTNEQQSGDNNDPV

SEQ ID NO: 50060 - protein, 31 aa, Artificial Sequence
  Description of Artificial Sequence: Synthetic polypeptide
DEAEIRTTNPVAYEQYGSISCTNLSERTVNR

SEQ ID NO: 50061 - protein, 30 aa, Artificial Sequence
  Description of Artificial Sequence: Synthetic polypeptide
DEAEIRTTNPVAYEQYGSICSTNTERFPNR

SEQ ID NO: 50062 - protein, 30 aa, Artificial Sequence
  Description of Artificial Sequence: Synthetic polypeptide
DEAEIRTTNPVAYEQYGSICSTNLENPNRN

SEQ ID NO: 50063 - protein, 31 aa, Artificial Sequence
  Description of Artificial Sequence: Synthetic polypeptide
DEAEIRTTNPVAYEQYGQVSCTTLSARGGNR

SEQ ID NO: 50064 - protein, 33 aa, Artificial Sequence
  Description of Artificial Sequence: Synthetic polypeptide
HEEEIRTTNPVAYEQYGSVQSTSNALSQRVSNR

SEQ ID NO: 50065 - protein, 31 aa, Artificial Sequence
  Description of Artificial Sequence: Synthetic polypeptide
DEAEIRTTNPVAYEQYGQVSCTTLGRGGNNR

SEQ ID NO: 50066 - protein, 32 aa, Artificial Sequence
  Description of Artificial Sequence: Synthetic polypeptide
DEAEIRTTNPVAYEQYGQVSCTPLSQRGGNRS

SEQ ID NO: 50067 - protein, 29 aa, Artificial Sequence
  Description of Artificial Sequence: Synthetic peptide
TTAEIRTTNPVATEQYGAMTSTDLQHGNR

SEQ ID NO: 50068 - protein, 31 aa, Artificial Sequence
  Description of Artificial Sequence: Synthetic polypeptide
DEAEIRTTNPVAYEQYGQVSCTELSQRGGND

SEQ ID NO: 50069 - protein, 32 aa, Artificial Sequence
  Description of Artificial Sequence: Synthetic polypeptide
AEEEIRTTNPVATESYGSVSNTNLNQNGNDQD

SEQ ID NO: 50070 - protein, 31 aa, Artificial Sequence
  Description of Artificial Sequence: Synthetic polypeptide
DEAEIRTTNPVAYEQYGQVSCQNALQSGGNR

SEQ ID NO: 50071 - protein, 33 aa, Artificial Sequence
  Description of Artificial Sequence: Synthetic polypeptide
DEEEIRTTNPVATEQYGSVSTPNLQFNEGQEDE

SEQ ID NO: 50072 - protein, 33 aa, Artificial Sequence
  Description of Artificial Sequence: Synthetic polypeptide
DEEEIRTTNPVATEQYGSVSTPNLQFNFGGQEE

SEQ ID NO: 50073 - protein, 34 aa, Artificial Sequence
  Description of Artificial Sequence: Synthetic polypeptide
DEEEIRTTNPVATEQYGSVSTPNLQFNFGNNQEQ

SEQ ID NO: 50074 - protein, 34 aa, Artificial Sequence
  Description of Artificial Sequence: Synthetic polypeptide
DEEEIRTTNPVATEQYGSVSTPNLQFNGGNNQNG

SEQ ID NO: 50075 - protein, 30 aa, Artificial Sequence
  Description of Artificial Sequence: Synthetic polypeptide
DEAEIRTTNPVAYEQYGSISSNLERPSNRS

SEQ ID NO: 50076 - protein, 31 aa, Artificial Sequence
  Description of Artificial Sequence: Synthetic polypeptide
AEEEIRTTNPVATESYGSVSNTNLNSNGDER

SEQ ID NO: 50077 - protein, 30 aa, Artificial Sequence
  Description of Artificial Sequence: Synthetic polypeptide
DEAEIRTTNPVAYEQYGSISTNLERFPERG

SEQ ID NO: 50078 - protein, 34 aa, Artificial Sequence
  Description of Artificial Sequence: Synthetic polypeptide
DEAEIRTTNPVAYEQYGSIVPSTNMLSQRGTNNR

SEQ ID NO: 50079 - protein, 31 aa, Artificial Sequence
  Description of Artificial Sequence: Synthetic polypeptide
DEAEIRTTNPVAYEQYGTVSTNLQGDGGNQS

SEQ ID NO: 50080 - protein, 31 aa, Artificial Sequence
  Description of Artificial Sequence: Synthetic polypeptide
DEAEIRTTNPVAYEQYGTVSTNLNQGGGNGQ

SEQ ID NO: 50081 - protein, 30 aa, Artificial Sequence
  Description of Artificial Sequence: Synthetic polypeptide
DEAEIRTTNPVAYEQYGTVSTNGQHDGDSR

SEQ ID NO: 50082 - protein, 31 aa, Artificial Sequence
  Description of Artificial Sequence: Synthetic polypeptide
DEAEIRTTNPVAYEQYGTVSTGNLQMGGNEA

SEQ ID NO: 50083 - protein, 31 aa, Artificial Sequence
  Description of Artificial Sequence: Synthetic polypeptide
DEAEIRTTNPVAYEQYGTVSCTTLSQSGGNR

SEQ ID NO: 50084 - protein, 32 aa, Artificial Sequence
  Description of Artificial Sequence: Synthetic polypeptide
DEAEIRTTNPVAYEQYGTVSCTTLAQRTGGNR

SEQ ID NO: 50085 - protein, 29 aa, Artificial Sequence
  Description of Artificial Sequence: Synthetic peptide
DEAEIRTTNPVAYEQYGTVATNQQDGNES

SEQ ID NO: 50086 - protein, 34 aa, Artificial Sequence
  Description of Artificial Sequence: Synthetic polypeptide
DEEEIRTTNPVATEQYGSVSTPNLIQVNGGGQNG

SEQ ID NO: 50087 - protein, 34 aa, Artificial Sequence
  Description of Artificial Sequence: Synthetic polypeptide
DEEEIRTTNPVATEQYGSVSTPNLLIQRTISENI

SEQ ID NO: 50088 - protein, 32 aa, Artificial Sequence
  Description of Artificial Sequence: Synthetic polypeptide
DEAEIRTTNPVAYEQYGSVVSYTNLSGSAGNR

SEQ ID NO: 50089 - protein, 32 aa, Artificial Sequence
  Description of Artificial Sequence: Synthetic polypeptide
DEAEIRTTNPVAYEQYGSVVFTLNLSQAGGNR

SEQ ID NO: 50090 - protein, 31 aa, Artificial Sequence
  Description of Artificial Sequence: Synthetic polypeptide
DEAEIRTTNPVAYEQYGSVSTNAGNQGEANR

SEQ ID NO: 50091 - protein, 29 aa, Artificial Sequence
  Description of Artificial Sequence: Synthetic peptide
DEAEIRTTNPVAYEQYGSVSTDMEGNGNM

SEQ ID NO: 50092 - protein, 32 aa, Artificial Sequence
  Description of Artificial Sequence: Synthetic polypeptide
DEAEIRTTNPVAYEQYGSVQAYTHLSQRSGNR

SEQ ID NO: 50093 - protein, 30 aa, Artificial Sequence
  Description of Artificial Sequence: Synthetic polypeptide
DEAEIRTTNPVAYEQYGSVATNDQRSNDQG

SEQ ID NO: 50094 - protein, 33 aa, Artificial Sequence
  Description of Artificial Sequence: Synthetic polypeptide
DEAEIRTTNPVAYEQYGSIVPSTNLSFRTGGNR

SEQ ID NO: 50095 - protein, 33 aa, Artificial Sequence
  Description of Artificial Sequence: Synthetic polypeptide
DEEEIRTTNPVATEQYGSVSTPNLQFTEIINET

SEQ ID NO: 50096 - protein, 29 aa, Artificial Sequence
  Description of Artificial Sequence: Synthetic peptide
DEAEIRTTNPVAYEQYGNVSTPDDQHGNA

SEQ ID NO: 50097 - protein, 31 aa, Artificial Sequence
  Description of Artificial Sequence: Synthetic polypeptide
DEAEIRTTNPVAYEQYGKVSCTTLDRTGGNR

SEQ ID NO: 50098 - protein, 31 aa, Artificial Sequence
  Description of Artificial Sequence: Synthetic polypeptide
DEEEIRTTNPVATEQYGSVSTPNNQLMEIIA

SEQ ID NO: 50099 - protein, 30 aa, Artificial Sequence
  Description of Artificial Sequence: Synthetic polypeptide
AEEEIACTNPVATEQYGSVATNLQDSGPND

SEQ ID NO: 50100 - protein, 30 aa, Artificial Sequence
  Description of Artificial Sequence: Synthetic polypeptide
AEEEIACTNPVATEQYGSVATNLQEAGNNP

SEQ ID NO: 50101 - protein, 33 aa, Artificial Sequence
  Description of Artificial Sequence: Synthetic polypeptide
AEEEIRTTNPVATEQYGSVVVSTTNLQNGNANM

SEQ ID NO: 50102 - protein, 31 aa, Artificial Sequence
  Description of Artificial Sequence: Synthetic polypeptide
TSEEIRTTNPVAYEQYGVVSTNELQEDGGNR

SEQ ID NO: 50103 - protein, 33 aa, Artificial Sequence
  Description of Artificial Sequence: Synthetic polypeptide
DEEEIRTTNPVATEQYGSVSTPNVIQTGGNDGE

SEQ ID NO: 50104 - protein, 31 aa, Artificial Sequence
  Description of Artificial Sequence: Synthetic polypeptide
DEEEIRTTNPVATEQYGSVSTPPIEQTGVQD

SEQ ID NO: 50105 - protein, 33 aa, Artificial Sequence
  Description of Artificial Sequence: Synthetic polypeptide
AEEEIRTTNPVATEQYGSVVVSTTNLQIGNANG

SEQ ID NO: 50106 - protein, 31 aa, Artificial Sequence
  Description of Artificial Sequence: Synthetic polypeptide
AEEEIACTNPVATEQYGSVATNLQERGNHVS

SEQ ID NO: 50107 - protein, 33 aa, Artificial Sequence
  Description of Artificial Sequence: Synthetic polypeptide
AEEEIRTTNPVATEQYGSVVVSTTNLQGDEGNG

SEQ ID NO: 50108 - protein, 33 aa, Artificial Sequence
  Description of Artificial Sequence: Synthetic polypeptide
DEEEIRTTNPVATEQYGSVSTPSNLQRNVPDFI

SEQ ID NO: 50109 - protein, 32 aa, Artificial Sequence
  Description of Artificial Sequence: Synthetic polypeptide
HEEEIRTTNPVATEQYGSVSETELQRNENVYP

SEQ ID NO: 50110 - protein, 32 aa, Artificial Sequence
  Description of Artificial Sequence: Synthetic polypeptide
HEEEIRTTNPVATEQYGSVNTSNLNQNGENGD

SEQ ID NO: 50111 - protein, 31 aa, Artificial Sequence
  Description of Artificial Sequence: Synthetic polypeptide
DEEEIRTTNPVATEQYGSVSTPTNQQDMEIA

SEQ ID NO: 50112 - protein, 31 aa, Artificial Sequence
  Description of Artificial Sequence: Synthetic polypeptide
TSEEIRTTNPVATHQYGSTVSTVLSQRGGNF

SEQ ID NO: 50113 - protein, 32 aa, Artificial Sequence
  Description of Artificial Sequence: Synthetic polypeptide
HEEEIRTTNPVATEQYGSVSTGLQRDNANEGI

SEQ ID NO: 50114 - protein, 32 aa, Artificial Sequence
  Description of Artificial Sequence: Synthetic polypeptide
DEEEIRTTNPVATEQYGSVSTPNNPIQGEDER

SEQ ID NO: 50115 - protein, 32 aa, Artificial Sequence
  Description of Artificial Sequence: Synthetic polypeptide
AEEEIACTNPVATEQYGSVATNLQDRDGDNTR

SEQ ID NO: 50116 - protein, 31 aa, Artificial Sequence
  Description of Artificial Sequence: Synthetic polypeptide
AEEEIRTTNPVATESYGSVSTTNQLNDGDQR

SEQ ID NO: 50117 - protein, 32 aa, Artificial Sequence
  Description of Artificial Sequence: Synthetic polypeptide
DEAEIRTTNPVAYEQYGKVQSCTTELQRGGNR

SEQ ID NO: 50118 - protein, 32 aa, Artificial Sequence
  Description of Artificial Sequence: Synthetic polypeptide
AEEEIRTTNPVATESYGSVSTNLQNTNGTNTG

SEQ ID NO: 50119 - protein, 31 aa, Artificial Sequence
  Description of Artificial Sequence: Synthetic polypeptide
DEAEIRTTNPVAYEQYGKVPCTNLSQRGNNT

SEQ ID NO: 50120 - protein, 32 aa, Artificial Sequence
  Description of Artificial Sequence: Synthetic polypeptide
DEAEIRTTNPVAYEQYGIVSCTTLSQRGGNYR

SEQ ID NO: 50121 - protein, 31 aa, Artificial Sequence
  Description of Artificial Sequence: Synthetic polypeptide
DEAEIRTTNPVAYEQYGEVVSTNLDQGGNTE

SEQ ID NO: 50122 - protein, 32 aa, Artificial Sequence
  Description of Artificial Sequence: Synthetic polypeptide
DEEEIRTTNPVATEQYGSVSTPNLQQPTVLEL

SEQ ID NO: 50123 - protein, 30 aa, Artificial Sequence
  Description of Artificial Sequence: Synthetic polypeptide
AEEEIACTNPVATEQYGSVATNLQDGNEAH

SEQ ID NO: 50124 - protein, 31 aa, Artificial Sequence
  Description of Artificial Sequence: Synthetic polypeptide
DEAEIRTTNPVAYEQYGTVSTNLQGGGDNQP

SEQ ID NO: 50125 - protein, 33 aa, Artificial Sequence
  Description of Artificial Sequence: Synthetic polypeptide
DEEEIRTTNPVATEQYGSVSTPNLQRELVLWDQ

SEQ ID NO: 50126 - protein, 33 aa, Artificial Sequence
  Description of Artificial Sequence: Synthetic polypeptide
DEEEIRTTNPVATEQYGSVSTPNLSQTGEEPSE

SEQ ID NO: 50127 - protein, 34 aa, Artificial Sequence
  Description of Artificial Sequence: Synthetic polypeptide
DEEEIRTTNPVATEQYGSVSTPNLSQTLGENPSL

SEQ ID NO: 50128 - protein, 32 aa, Artificial Sequence
  Description of Artificial Sequence: Synthetic polypeptide
DEEEIRTTNPVATEQYGSVSTPNMQPVGMVEE

SEQ ID NO: 50129 - protein, 33 aa, Artificial Sequence
  Description of Artificial Sequence: Synthetic polypeptide
DEEEIRTTNPVATEQYGSVSTPNMVPRGQMVRE

SEQ ID NO: 50130 - protein, 31 aa, Artificial Sequence
  Description of Artificial Sequence: Synthetic polypeptide
DEEEIRTTNPVATEQYGSVSTPNNHNQTVEN

SEQ ID NO: 50131 - protein, 32 aa, Artificial Sequence
  Description of Artificial Sequence: Synthetic polypeptide
DEEEIRTTNPVATEQYGSVSTPNNIIEDGGNE

SEQ ID NO: 50132 - protein, 33 aa, Artificial Sequence
  Description of Artificial Sequence: Synthetic polypeptide
DEEEIRTTNPVATEQYGSVSTPNNLDVEGENVG

SEQ ID NO: 50133 - protein, 33 aa, Artificial Sequence
  Description of Artificial Sequence: Synthetic polypeptide
DEEEIRTTNPVATEQYGSVSTPNLSQNDQNEGG

SEQ ID NO: 50134 - protein, 30 aa, Artificial Sequence
  Description of Artificial Sequence: Synthetic polypeptide
DEAEIRTTNPVAYEQYGTVSTNLQGGMGEA

SEQ ID NO: 50135 - protein, 33 aa, Artificial Sequence
  Description of Artificial Sequence: Synthetic polypeptide
DEEEIRTTNPVATEQYGSVSTPNLIQQVTIDNN

SEQ ID NO: 50136 - protein, 30 aa, Artificial Sequence
  Description of Artificial Sequence: Synthetic polypeptide
DEAEIRTTNPVAYEQYGTVSTNLQHNGGEA

SEQ ID NO: 50137 - protein, 28 aa, Artificial Sequence
  Description of Artificial Sequence: Synthetic peptide
HENEIACTNPVATEQYGEASVNLQRGGR

SEQ ID NO: 50138 - protein, 32 aa, Artificial Sequence
  Description of Artificial Sequence: Synthetic polypeptide
DEEEIRTTNPVATEQYGSVSTPNDDEFGGNIG

SEQ ID NO: 50139 - protein, 32 aa, Artificial Sequence
  Description of Artificial Sequence: Synthetic polypeptide
DEEEIRTTNPVATEQYGSVSTPNDDNGEGGNV

SEQ ID NO: 50140 - protein, 28 aa, Artificial Sequence
  Description of Artificial Sequence: Synthetic peptide
HENEIACTNPVATEQYGEASENLQRGGR

SEQ ID NO: 50141 - protein, 33 aa, Artificial Sequence
  Description of Artificial Sequence: Synthetic polypeptide
DEEEIRTTNPVATEQYGSVSTPNDLFEVGGNEQ

SEQ ID NO: 50142 - protein, 33 aa, Artificial Sequence
  Description of Artificial Sequence: Synthetic polypeptide
AEEEIRTTNPVATEQYGSVVVSTTNLQQGANVD

SEQ ID NO: 50143 - protein, 32 aa, Artificial Sequence
  Description of Artificial Sequence: Synthetic polypeptide
DEEEIRTTNPVATEQYGSVSTPNDPGTIGNES

SEQ ID NO: 50144 - protein, 31 aa, Artificial Sequence
  Description of Artificial Sequence: Synthetic polypeptide
HEGEIRTTNPVATEQYGSVSTYNLQENENPY

SEQ ID NO: 50145 - protein, 32 aa, Artificial Sequence
  Description of Artificial Sequence: Synthetic polypeptide
DEEEIRTTNPVATEQYGSVSTPNDQLSGSEVH

SEQ ID NO: 50146 - protein, 33 aa, Artificial Sequence
  Description of Artificial Sequence: Synthetic polypeptide
DEEEIRTTNPVATEQYGSVSTPNDVQVRDNQFV

SEQ ID NO: 50147 - protein, 33 aa, Artificial Sequence
  Description of Artificial Sequence: Synthetic polypeptide
DEEEIRTTNPVATEQYGSVSTPNEIQTEGNLFQ

SEQ ID NO: 50148 - protein, 33 aa, Artificial Sequence
  Description of Artificial Sequence: Synthetic polypeptide
DEEEIRTTNPVATEQYGSVSTPNELGFGGNNTN

SEQ ID NO: 50149 - protein, 31 aa, Artificial Sequence
  Description of Artificial Sequence: Synthetic polypeptide
DEEEIRTTNPVATEQYGSVSTPNEQAEILDI

SEQ ID NO: 50150 - protein, 29 aa, Artificial Sequence
  Description of Artificial Sequence: Synthetic peptide
TTAEIRTTNPVATEQYGTTSTVLQFDGNR

SEQ ID NO: 50151 - protein, 31 aa, Artificial Sequence
  Description of Artificial Sequence: Synthetic polypeptide
HEGEIRTTNPVATEQYGSVSTNDLQRNAVFE

SEQ ID NO: 50152 - protein, 30 aa, Artificial Sequence
  Description of Artificial Sequence: Synthetic polypeptide
HETEIRTTNPVATEQYGSVSTANDDRANGI

SEQ ID NO: 50153 - protein, 33 aa, Artificial Sequence
  Description of Artificial Sequence: Synthetic polypeptide
AEEEIRTTNPVATEQYGSVVVSTTNLQQGANVN

SEQ ID NO: 50154 - protein, 31 aa, Artificial Sequence
  Description of Artificial Sequence: Synthetic polypeptide
DEEEIRTTNPVATEQYGSVSTPLTQTSIESN

SEQ ID NO: 50155 - protein, 32 aa, Artificial Sequence
  Description of Artificial Sequence: Synthetic polypeptide
DEEEIRTTNPVATEQYGSVSTPLQTDTIVEQR

SEQ ID NO: 50156 - protein, 29 aa, Artificial Sequence
  Description of Artificial Sequence: Synthetic peptide
QEEEIACTNPVATEPYGSVATNLQENGVR

SEQ ID NO: 50157 - protein, 33 aa, Artificial Sequence
  Description of Artificial Sequence: Synthetic polypeptide
DEEEIRTTNPVATEQYGSVSTPGNIDQNEGGNE

SEQ ID NO: 50158 - protein, 30 aa, Artificial Sequence
  Description of Artificial Sequence: Synthetic polypeptide
IEAEIATTNPVATEQYGSVATNLQAGNPEE

SEQ ID NO: 50159 - protein, 31 aa, Artificial Sequence
  Description of Artificial Sequence: Synthetic polypeptide
DEEEIRTTNPVATEQYGSVSTPLDNMGGEID

SEQ ID NO: 50160 - protein, 28 aa, Artificial Sequence
  Description of Artificial Sequence: Synthetic peptide
HEYEIACTNPVATEQYGEASENLQRGGR

SEQ ID NO: 50161 - protein, 30 aa, Artificial Sequence
  Description of Artificial Sequence: Synthetic polypeptide
TTEEIRSTNPVATEQYGSVVSTNLQNGGGG

SEQ ID NO: 50162 - protein, 30 aa, Artificial Sequence
  Description of Artificial Sequence: Synthetic polypeptide
TTEEIRSTNPVATEQYGSVVSTNLQANGTT

SEQ ID NO: 50163 - protein, 33 aa, Artificial Sequence
  Description of Artificial Sequence: Synthetic polypeptide
DEEEIRTTNPVATEQYGSVSTPNFVQAMLDNER

SEQ ID NO: 50164 - protein, 31 aa, Artificial Sequence
  Description of Artificial Sequence: Synthetic polypeptide
TTEEIRSTNPVATEQYGSTVSCTNLQNGGSR

SEQ ID NO: 50165 - protein, 33 aa, Artificial Sequence
  Description of Artificial Sequence: Synthetic polypeptide
DEEEIRTTNPVATEQYGSVSTPLQETMGENSID

SEQ ID NO: 50166 - protein, 32 aa, Artificial Sequence
  Description of Artificial Sequence: Synthetic polypeptide
DEEEIRTTNPVATEQYGSVSTPLQETNLENDI

SEQ ID NO: 50167 - protein, 33 aa, Artificial Sequence
  Description of Artificial Sequence: Synthetic polypeptide
DEEEIRTTNPVATEQYGSVSTPLQMVGGNNEQQ

SEQ ID NO: 50168 - protein, 33 aa, Artificial Sequence
  Description of Artificial Sequence: Synthetic polypeptide
DEEEIRTTNPVATEQYGSVSTPLQNVEGENNDG

SEQ ID NO: 50169 - protein, 32 aa, Artificial Sequence
  Description of Artificial Sequence: Synthetic polypeptide
DEEEIRTTNPVATEQYGSVSTPLQRSFFDQDL

SEQ ID NO: 50170 - protein, 30 aa, Artificial Sequence
  Description of Artificial Sequence: Synthetic polypeptide
DEAEIRTVNPVATEQYGCVSTYPLQEGNQE

SEQ ID NO: 50171 - protein, 31 aa, Artificial Sequence
  Description of Artificial Sequence: Synthetic polypeptide
DEAEIRTTNSVAYDQYGSVVSTNLSQRVDNR

SEQ ID NO: 50172 - protein, 33 aa, Artificial Sequence
  Description of Artificial Sequence: Synthetic polypeptide
DEEEIRTTNPVATEQYGSVSTPLQARSDQNEQL

SEQ ID NO: 50173 - protein, 30 aa, Artificial Sequence
  Description of Artificial Sequence: Synthetic polypeptide
AEEEIACTNPVATEQYGSVATNLQQGNDDY

SEQ ID NO: 50174 - protein, 30 aa, Artificial Sequence
  Description of Artificial Sequence: Synthetic polypeptide
AEEEIACTNPVATEQYGSVATNLQAEDDNR

SEQ ID NO: 50175 - protein, 33 aa, Artificial Sequence
  Description of Artificial Sequence: Synthetic polypeptide
AEEEIRTTNPVATEQYGSVVVSTTNLQNGNNVA

SEQ ID NO: 50176 - protein, 32 aa, Artificial Sequence
  Description of Artificial Sequence: Synthetic polypeptide
DEAEIRTTNPVAYEQYGVVVSTNLQHDGNEGR

SEQ ID NO: 50177 - protein, 31 aa, Artificial Sequence
  Description of Artificial Sequence: Synthetic polypeptide
DEAEIRTTNPVAYEQYGVVVSTNLQHDGDER

SEQ ID NO: 50178 - protein, 29 aa, Artificial Sequence
  Description of Artificial Sequence: Synthetic peptide
TTAEIRTTNPVATEQYGTASTVNDQHGNR

SEQ ID NO: 50179 - protein, 33 aa, Artificial Sequence
  Description of Artificial Sequence: Synthetic polypeptide
DEEEIRTTNPVATEQYGSVSTPNLFETEGGNIQ

SEQ ID NO: 50180 - protein, 30 aa, Artificial Sequence
  Description of Artificial Sequence: Synthetic polypeptide
AEEEIRTTNPVATESYGSVSNTNLDTGDQD

SEQ ID NO: 50181 - protein, 31 aa, Artificial Sequence
  Description of Artificial Sequence: Synthetic polypeptide
DEAEIRTTNPVAYEQYGVVVSTNDQHMGNER

SEQ ID NO: 50182 - protein, 31 aa, Artificial Sequence
  Description of Artificial Sequence: Synthetic polypeptide
DEAEIRTTNPVAYEQYGVVSTVLSQRPGNND

SEQ ID NO: 50183 - protein, 30 aa, Artificial Sequence
  Description of Artificial Sequence: Synthetic polypeptide
DEAEIRTTNPVAYEQYGVVSTSLSQRTPND

SEQ ID NO: 50184 - protein, 30 aa, Artificial Sequence
  Description of Artificial Sequence: Synthetic polypeptide
DEAEIRTTNPVAYEQYGVVSTSLSQRPGSD

SEQ ID NO: 50185 - protein, 33 aa, Artificial Sequence
  Description of Artificial Sequence: Synthetic polypeptide
DEEEIRTTNPVATEQYGSVSTPNLFQSEENNQV

SEQ ID NO: 50186 - protein, 31 aa, Artificial Sequence
  Description of Artificial Sequence: Synthetic polypeptide
DEAEIRTTNPVAYEQYGVVSTGTLSQRPGND

SEQ ID NO: 50187 - protein, 33 aa, Artificial Sequence
  Description of Artificial Sequence: Synthetic polypeptide
DEEEIRTTNPVATEQYGSVSTPNLGDVEGENDT

SEQ ID NO: 50188 - protein, 33 aa, Artificial Sequence
  Description of Artificial Sequence: Synthetic polypeptide
DEEEIRTTNPVATEQYGSVSTPNLGDVEGENNI

SEQ ID NO: 50189 - protein, 33 aa, Artificial Sequence
  Description of Artificial Sequence: Synthetic polypeptide
DEEEIRTTNPVATEQYGSVSTPNLIQNDENEMT

SEQ ID NO: 50190 - protein, 31 aa, Artificial Sequence
  Description of Artificial Sequence: Synthetic polypeptide
DEAEIRTTNPVAYEQYGTVSTNLQPQGGNNA

SEQ ID NO: 50191 - protein, 31 aa, Artificial Sequence
  Description of Artificial Sequence: Synthetic polypeptide
DEAEIRTTNPVAYEQYGVVVSTNLQHEGNEN

SEQ ID NO: 50192 - protein, 31 aa, Artificial Sequence
  Description of Artificial Sequence: Synthetic polypeptide
DEAEIRTTNPVAYEQYGVVVSTNLQHGGNEG

SEQ ID NO: 50193 - protein, 32 aa, Artificial Sequence
  Description of Artificial Sequence: Synthetic polypeptide
DEAEIRTTNPVAYEQYGVVVSTNLQHNGENER

SEQ ID NO: 50194 - protein, 33 aa, Artificial Sequence
  Description of Artificial Sequence: Synthetic polypeptide
DEEEIRTTNPVATEQYGSVSTPNLDVNFGNENQ

SEQ ID NO: 50195 - protein, 33 aa, Artificial Sequence
  Description of Artificial Sequence: Synthetic polypeptide
DEEEIRTTNPVATEQYGSVSTPNIQLSDGNTLF

SEQ ID NO: 50196 - protein, 30 aa, Artificial Sequence
  Description of Artificial Sequence: Synthetic polypeptide
DEAEIRTTNPVAYQQYGCVSTNLERDGNES

SEQ ID NO: 50197 - protein, 29 aa, Artificial Sequence
  Description of Artificial Sequence: Synthetic peptide
DEAEIRTTNPVAYQQYGCVSTNLEDHGNE

SEQ ID NO: 50198 - protein, 33 aa, Artificial Sequence
  Description of Artificial Sequence: Synthetic polypeptide
DEEEIRTTNPVATEQYGSVSTPNLDEFGGNDEE

SEQ ID NO: 50199 - protein, 33 aa, Artificial Sequence
  Description of Artificial Sequence: Synthetic polypeptide
DEEEIRTTNPVATEQYGSVSTPNLDIEGENFGT

SEQ ID NO: 50200 - protein, 33 aa, Artificial Sequence
  Description of Artificial Sequence: Synthetic polypeptide
DEEEIRTTNPVATEQYGSVSTPNLDLVEGENGD

SEQ ID NO: 50201 - protein, 33 aa, Artificial Sequence
  Description of Artificial Sequence: Synthetic polypeptide
AEEEIRTTNPVATEQYGSVVVSTTNLQNGNNEA

SEQ ID NO: 50202 - protein, 30 aa, Artificial Sequence
  Description of Artificial Sequence: Synthetic polypeptide
DEAEIRTTNPVCTEGYGSVSMPNLQRGDFD

SEQ ID NO: 50203 - protein, 30 aa, Artificial Sequence
  Description of Artificial Sequence: Synthetic polypeptide
DEAEIRTTNPVAYERYGSVSTNLQSGGGEA

SEQ ID NO: 50204 - protein, 34 aa, Artificial Sequence
  Description of Artificial Sequence: Synthetic polypeptide
DEEEIRTTNPVATEQYGSVSTPNLDQFEFGGQND

SEQ ID NO: 50205 - protein, 31 aa, Artificial Sequence
  Description of Artificial Sequence: Synthetic polypeptide
DEAEIRTTNPVAYERYGSVSTGNDQGNGNDR

SEQ ID NO: 50206 - protein, 30 aa, Artificial Sequence
  Description of Artificial Sequence: Synthetic polypeptide
DEAEIRTTNPVAYERYGSVSTGDQDHGNDR

SEQ ID NO: 50207 - protein, 30 aa, Artificial Sequence
  Description of Artificial Sequence: Synthetic polypeptide
DEAEIRTTNPVAYERYGEVSTNLQNGDNNM

SEQ ID NO: 50208 - protein, 29 aa, Artificial Sequence
  Description of Artificial Sequence: Synthetic peptide
AEEEIRTTNPVATESYGCIAINDQREGNR

SEQ ID NO: 50209 - protein, 33 aa, Artificial Sequence
  Description of Artificial Sequence: Synthetic polypeptide
DEEEIRTTNPVATEQYGSVSTPNLDVEGGNIQE

SEQ ID NO: 50210 - protein, 31 aa, Artificial Sequence
  Description of Artificial Sequence: Synthetic polypeptide
AEEEIRTTNPVATESYGSVCSVTNLNQGDGR

SEQ ID NO: 50211 - protein, 30 aa, Artificial Sequence
  Description of Artificial Sequence: Synthetic polypeptide
DEAEIRTTNPVAYERYGSVSTNLQNGDGEA

SEQ ID NO: 50212 - protein, 33 aa, Artificial Sequence
  Description of Artificial Sequence: Synthetic polypeptide
DEEEIRTTNPVATEQYGSVSTPGLQEVGGNAFG

SEQ ID NO: 50213 - protein, 31 aa, Artificial Sequence
  Description of Artificial Sequence: Synthetic polypeptide
AEEEIACTNPVATEQYGSVATNLQRDGDTRA

SEQ ID NO: 50214 - protein, 33 aa, Artificial Sequence
  Description of Artificial Sequence: Synthetic polypeptide
HEEEIRTTNPVATEQYGSVNETSNLDQRGENYV

SEQ ID NO: 50215 - protein, 30 aa, Artificial Sequence
  Description of Artificial Sequence: Synthetic polypeptide
TQEEIRTTNPVAYEQWGTVVSTNLQEGGNR

SEQ ID NO: 50216 - protein, 33 aa, Artificial Sequence
  Description of Artificial Sequence: Synthetic polypeptide
DEEEIRTTNPVATEQYGSVSTSNDQVGIGENDD

SEQ ID NO: 50217 - protein, 30 aa, Artificial Sequence
  Description of Artificial Sequence: Synthetic polypeptide
TQEEIRTTNPVAYEQWGTVSCTNLQEGTNR

SEQ ID NO: 50218 - protein, 32 aa, Artificial Sequence
  Description of Artificial Sequence: Synthetic polypeptide
AEEEIRTTNPVATETYGSVSTNLQQAGENIGE

SEQ ID NO: 50219 - protein, 33 aa, Artificial Sequence
  Description of Artificial Sequence: Synthetic polypeptide
DEEEIRTTNPVATEQYGSVSTSNDQVGIGTNIN

SEQ ID NO: 50220 - protein, 30 aa, Artificial Sequence
  Description of Artificial Sequence: Synthetic polypeptide
TQEEIRTTNPVAYEQWGTTVSTNLSQEGNR

SEQ ID NO: 50221 - protein, 31 aa, Artificial Sequence
  Description of Artificial Sequence: Synthetic polypeptide
TQEEIRTTNPVAYEQWGSVSCTGNLGRGGNR

SEQ ID NO: 50222 - protein, 33 aa, Artificial Sequence
  Description of Artificial Sequence: Synthetic polypeptide
DEEEIRTTNPVATEQYGSVSTSNLDDGPEGNQQ

SEQ ID NO: 50223 - protein, 33 aa, Artificial Sequence
  Description of Artificial Sequence: Synthetic polypeptide
DEEEIRTTNPVATEQYGSVSTSNLDDPEGENNG

SEQ ID NO: 50224 - protein, 32 aa, Artificial Sequence
  Description of Artificial Sequence: Synthetic polypeptide
TQEEIRTTNPVATEQYGVVSTNSQSQRPVGNR

SEQ ID NO: 50225 - protein, 33 aa, Artificial Sequence
  Description of Artificial Sequence: Synthetic polypeptide
DEEEIRTTNPVATEQYGSVSTSNLDDPEGNNDQ

SEQ ID NO: 50226 - protein, 34 aa, Artificial Sequence
  Description of Artificial Sequence: Synthetic polypeptide
DEEEIRTTNPVATEQYGSVSTSNLLQGEGNNATE

SEQ ID NO: 50227 - protein, 32 aa, Artificial Sequence
  Description of Artificial Sequence: Synthetic polypeptide
TQEEIRTTNPVATEQYGSVSTGNELSHRGGDR

SEQ ID NO: 50228 - protein, 33 aa, Artificial Sequence
  Description of Artificial Sequence: Synthetic polypeptide
DEEEIRTTNPVATEQYGSVSTSNNLDDPEGGNT

SEQ ID NO: 50229 - protein, 34 aa, Artificial Sequence
  Description of Artificial Sequence: Synthetic polypeptide
DEEEIRTTNPVATEQYGSVSTSNNLGQDQGGNEP

SEQ ID NO: 50230 - protein, 32 aa, Artificial Sequence
  Description of Artificial Sequence: Synthetic polypeptide
DEEEIRTTNPVATEQYGSVSTSLTGMGEVNIG

SEQ ID NO: 50231 - protein, 32 aa, Artificial Sequence
  Description of Artificial Sequence: Synthetic polypeptide
TQEEIRTTNPVATEQYGSVSCTGNLSHTGGNR

SEQ ID NO: 50232 - protein, 30 aa, Artificial Sequence
  Description of Artificial Sequence: Synthetic polypeptide
TQEEISTTNPVATEQYGSVPSTNLIVDNRS

SEQ ID NO: 50233 - protein, 30 aa, Artificial Sequence
  Description of Artificial Sequence: Synthetic polypeptide
QEEEIACTNPVATEQYGCVATNLQRGENSV

SEQ ID NO: 50234 - protein, 34 aa, Artificial Sequence
  Description of Artificial Sequence: Synthetic polypeptide
DEEEIRTTNPVATEQYGSVSTQNLQGIGDQNGQG

SEQ ID NO: 50235 - protein, 33 aa, Artificial Sequence
  Description of Artificial Sequence: Synthetic polypeptide
DEEEIRTTNPVATEQYGSVSTQNLQGSGTQGQI

SEQ ID NO: 50236 - protein, 33 aa, Artificial Sequence
  Description of Artificial Sequence: Synthetic polypeptide
DEEEIRTTNPVATEQYGSVSTQNLSGFGGNQEG

SEQ ID NO: 50237 - protein, 33 aa, Artificial Sequence
  Description of Artificial Sequence: Synthetic polypeptide
DEEEIRTTNPVATEQYGSVSTQNLSGFTGGNEE

SEQ ID NO: 50238 - protein, 28 aa, Artificial Sequence
  Description of Artificial Sequence: Synthetic peptide
AEEEIASTNPVCTEQYGVVSDNLQSGNQ

SEQ ID NO: 50239 - protein, 28 aa, Artificial Sequence
  Description of Artificial Sequence: Synthetic peptide
AEEEIASTNPVCTEQYGVVSENLQSGNQ

SEQ ID NO: 50240 - protein, 33 aa, Artificial Sequence
  Description of Artificial Sequence: Synthetic polypeptide
DEEEIRTTNPVATEQYGSVSTQNVEQGMGGNDG

SEQ ID NO: 50241 - protein, 32 aa, Artificial Sequence
  Description of Artificial Sequence: Synthetic polypeptide
DEEEIRTTNPVATEQYGSVSTQNVGFGENGQI

SEQ ID NO: 50242 - protein, 32 aa, Artificial Sequence
  Description of Artificial Sequence: Synthetic polypeptide
DEEEIRTTNPVATEQYGSVSTQNVGVGGNGQT

SEQ ID NO: 50243 - protein, 32 aa, Artificial Sequence
  Description of Artificial Sequence: Synthetic polypeptide
TSEEIRTTNPVATEAYGSVSCTNALQDRGGNE

SEQ ID NO: 50244 - protein, 28 aa, Artificial Sequence
  Description of Artificial Sequence: Synthetic peptide
AEEEIASVNPVATEQYGEVSDNLQSGNQ

SEQ ID NO: 50245 - protein, 28 aa, Artificial Sequence
  Description of Artificial Sequence: Synthetic peptide
AEEEIASVNPVATEQYGVVSDNLQSGGR

SEQ ID NO: 50246 - protein, 33 aa, Artificial Sequence
  Description of Artificial Sequence: Synthetic polypeptide
DEEEIRTTNPVATEQYGSVSTQVLQTEMGTNED

SEQ ID NO: 50247 - protein, 28 aa, Artificial Sequence
  Description of Artificial Sequence: Synthetic peptide
AEEEIASVNPVATEQYGVVSDNLQSGNQ

SEQ ID NO: 50248 - protein, 33 aa, Artificial Sequence
  Description of Artificial Sequence: Synthetic polypeptide
AEEEIRTTNPVATEQYGSVVVSTNQLGQETGNT

SEQ ID NO: 50249 - protein, 31 aa, Artificial Sequence
  Description of Artificial Sequence: Synthetic polypeptide
TSEEIRATNPVATEQYGSTVSCTNLQNGGTR

SEQ ID NO: 50250 - protein, 33 aa, Artificial Sequence
  Description of Artificial Sequence: Synthetic polypeptide
TQEEIRTTNPVATEQYGSVSCTGNALHRGGNNR

SEQ ID NO: 50251 - protein, 30 aa, Artificial Sequence
  Description of Artificial Sequence: Synthetic polypeptide
QEEEIACTNPVATEQYGCVATNLQRNGNPE

SEQ ID NO: 50252 - protein, 32 aa, Artificial Sequence
  Description of Artificial Sequence: Synthetic polypeptide
DEEEIRTTNPVATEQYGSVSTSNQDGPMEDRG

SEQ ID NO: 50253 - protein, 31 aa, Artificial Sequence
  Description of Artificial Sequence: Synthetic polypeptide
TNEEIRTTNPVATEQYGSVSTGGNQTGGENR

SEQ ID NO: 50254 - protein, 28 aa, Artificial Sequence
  Description of Artificial Sequence: Synthetic peptide
QEEEIACTNPVATEQYGDVSECLQHENR

SEQ ID NO: 50255 - protein, 33 aa, Artificial Sequence
  Description of Artificial Sequence: Synthetic polypeptide
DEEEIRTTNPVATEQYGSVSTSNVQQGGNNGTE

SEQ ID NO: 50256 - protein, 33 aa, Artificial Sequence
  Description of Artificial Sequence: Synthetic polypeptide
DEEEIRTTNPVATEQYGSVSTSNVTGQGGNNTE

SEQ ID NO: 50257 - protein, 30 aa, Artificial Sequence
  Description of Artificial Sequence: Synthetic polypeptide
FEETITTTNPVATEQYGSVSANSQRGENSF

SEQ ID NO: 50258 - protein, 30 aa, Artificial Sequence
  Description of Artificial Sequence: Synthetic polypeptide
FEETIRTTNPVATEQYGSVSTNLEDYGMEI

SEQ ID NO: 50259 - protein, 28 aa, Artificial Sequence
  Description of Artificial Sequence: Synthetic peptide
QEEEIACTNPVATEQYGDVSENLQREEL

SEQ ID NO: 50260 - protein, 32 aa, Artificial Sequence
  Description of Artificial Sequence: Synthetic polypeptide
TNEEIRTTNPVATEQWGSVSTDNLPPERGSNR

SEQ ID NO: 50261 - protein, 32 aa, Artificial Sequence
  Description of Artificial Sequence: Synthetic polypeptide
TNEEIRTTNPVATECYGSVSTNLQGNGGENNR

SEQ ID NO: 50262 - protein, 32 aa, Artificial Sequence
  Description of Artificial Sequence: Synthetic polypeptide
DEEEIRTTNPVATEQYGSVSTSPLQNTGDSQN

SEQ ID NO: 50263 - protein, 33 aa, Artificial Sequence
  Description of Artificial Sequence: Synthetic polypeptide
DEEEIRTTNPVATEQYGSVSTSTLGQEVGEGNI

SEQ ID NO: 50264 - protein, 33 aa, Artificial Sequence
  Description of Artificial Sequence: Synthetic polypeptide
AEEEIRTTNPVATEQYGSVVVSTNNLQQGTNVE

SEQ ID NO: 50265 - protein, 29 aa, Artificial Sequence
  Description of Artificial Sequence: Synthetic peptide
DEAEIRTTNPVAYEQWGSISTNLERPNMG

SEQ ID NO: 50266 - protein, 29 aa, Artificial Sequence
  Description of Artificial Sequence: Synthetic peptide
DEAEIRTTNPVAYEQWGSISTNLEPPDNR

SEQ ID NO: 50267 - protein, 28 aa, Artificial Sequence
  Description of Artificial Sequence: Synthetic peptide
DEAEIRTTNPVAYEQWGSISTNLEHPNE

SEQ ID NO: 50268 - protein, 31 aa, Artificial Sequence
  Description of Artificial Sequence: Synthetic polypeptide
TNEEIRTTNPVATEQYGSVSTQLQGEGGNDE

SEQ ID NO: 50269 - protein, 33 aa, Artificial Sequence
  Description of Artificial Sequence: Synthetic polypeptide
DEEEIRTTNPVATEQYGSVSTSNVLVGMGNNGE

SEQ ID NO: 50270 - protein, 34 aa, Artificial Sequence
  Description of Artificial Sequence: Synthetic polypeptide
DEEEIRTTNPVATEQYGSVSTSNVLQGLGNNETE

SEQ ID NO: 50271 - protein, 28 aa, Artificial Sequence
  Description of Artificial Sequence: Synthetic peptide
FEHEIACTNPVATEQYGEASENLQRGGR

SEQ ID NO: 50272 - protein, 32 aa, Artificial Sequence
  Description of Artificial Sequence: Synthetic polypeptide
DEEEIRTTNPVATEQYGSVSTSNQTGPMEDRQ

SEQ ID NO: 50273 - protein, 31 aa, Artificial Sequence
  Description of Artificial Sequence: Synthetic polypeptide
TQEEIRTTNPVATEQWGTVSCTNELQEGGNR

SEQ ID NO: 50274 - protein, 33 aa, Artificial Sequence
  Description of Artificial Sequence: Synthetic polypeptide
DEEEIRTTNPVATEQYGSVSTSNTDDQGGNNGE

SEQ ID NO: 50275 - protein, 33 aa, Artificial Sequence
  Description of Artificial Sequence: Synthetic polypeptide
DEEEIRTTNPVATEQYGSVSTSNVAQGPGNNTE

SEQ ID NO: 50276 - protein, 32 aa, Artificial Sequence
  Description of Artificial Sequence: Synthetic polypeptide
FESEIRTTNPVATEQYGSVPSTNALTDRVVNR

SEQ ID NO: 50277 - protein, 33 aa, Artificial Sequence
  Description of Artificial Sequence: Synthetic polypeptide
DEEEIRTTNPVATEQYGSVSTSNVDDQGGNFTE

SEQ ID NO: 50278 - protein, 29 aa, Artificial Sequence
  Description of Artificial Sequence: Synthetic peptide
TQEEIATTNPVAYEQWGTVSTNLQEGMNR

SEQ ID NO: 50279 - protein, 33 aa, Artificial Sequence
  Description of Artificial Sequence: Synthetic polypeptide
DEEEIRTTNPVATEQYGSVSTQNLQANGPQMQL

SEQ ID NO: 50280 - protein, 33 aa, Artificial Sequence
  Description of Artificial Sequence: Synthetic polypeptide
DEEEIRTTNPVATEQYGSVSTSNVDGQQGENEF

SEQ ID NO: 50281 - protein, 33 aa, Artificial Sequence
  Description of Artificial Sequence: Synthetic polypeptide
DEEEIRTTNPVATEQYGSVSTSNVEQGMGNGTE

SEQ ID NO: 50282 - protein, 28 aa, Artificial Sequence
  Description of Artificial Sequence: Synthetic peptide
FENEIACTNPVATEQYGEASENLQRGGR

SEQ ID NO: 50283 - protein, 29 aa, Artificial Sequence
  Description of Artificial Sequence: Synthetic peptide
TNEEISTTNPVATTQYGSVSTNPMGGNSR

SEQ ID NO: 50284 - protein, 33 aa, Artificial Sequence
  Description of Artificial Sequence: Synthetic polypeptide
DEEEIRTTNPVATEQYGSVSTSNVLDDPEGENQ

SEQ ID NO: 50285 - protein, 34 aa, Artificial Sequence
  Description of Artificial Sequence: Synthetic polypeptide
DEEEIRTTNPVATEQYGSVSTSNVLGQGGNNGQE

SEQ ID NO: 50286 - protein, 34 aa, Artificial Sequence
  Description of Artificial Sequence: Synthetic polypeptide
DEEEIRTTNPVATEQYGSVSTSNVLQFGGNNDGE

SEQ ID NO: 50287 - protein, 34 aa, Artificial Sequence
  Description of Artificial Sequence: Synthetic polypeptide
DEEEIRTTNPVATEQYGSVSTSNVLQGEGGNDTE

SEQ ID NO: 50288 - protein, 33 aa, Artificial Sequence
  Description of Artificial Sequence: Synthetic polypeptide
DEEEIRTTNPVATEQYGSVSTSNVDQEGGNNTE

SEQ ID NO: 50289 - protein, 31 aa, Artificial Sequence
  Description of Artificial Sequence: Synthetic polypeptide
DEAEIRTTNPVAYEQWGSVSTELQEGSGDNR

SEQ ID NO: 50290 - protein, 30 aa, Artificial Sequence
  Description of Artificial Sequence: Synthetic polypeptide
DEAEIRTTNPVAYEQWGSVSTNADQGEDNR

SEQ ID NO: 50291 - protein, 28 aa, Artificial Sequence
  Description of Artificial Sequence: Synthetic peptide
AEEEIASTNPVATEQYGEASDNLQSGGR

SEQ ID NO: 50292 - protein, 32 aa, Artificial Sequence
  Description of Artificial Sequence: Synthetic polypeptide
DEEEIRTTNPVATEQYGSVSTQLFEIGGNVTD

SEQ ID NO: 50293 - protein, 28 aa, Artificial Sequence
  Description of Artificial Sequence: Synthetic peptide
AEEEIACTNPVATEQYGVASENLQSGGR

SEQ ID NO: 50294 - protein, 29 aa, Artificial Sequence
  Description of Artificial Sequence: Synthetic peptide
AEEEIACTNPVAYEHYGSVATNLQRGNSM

SEQ ID NO: 50295 - protein, 32 aa, Artificial Sequence
  Description of Artificial Sequence: Synthetic polypeptide
DEEEIRTTNPVATEQYGSVSTQLIGFGNNEEI

SEQ ID NO: 50296 - protein, 33 aa, Artificial Sequence
  Description of Artificial Sequence: Synthetic polypeptide
DEEEIRTTNPVATEQYGSVSTQLQDEGGNNATD

SEQ ID NO: 50297 - protein, 30 aa, Artificial Sequence
  Description of Artificial Sequence: Synthetic polypeptide
QEEEIACTNPVATEQYGCVATNLQARGNDE

SEQ ID NO: 50298 - protein, 33 aa, Artificial Sequence
  Description of Artificial Sequence: Synthetic polypeptide
DEEEIRTTNPVATEQYGSVSTQLQGEIGNNVTD

SEQ ID NO: 50299 - protein, 33 aa, Artificial Sequence
  Description of Artificial Sequence: Synthetic polypeptide
DEEEIRTTNPVATEQYGSVSTQLQGPNGNNGEG

SEQ ID NO: 50300 - protein, 31 aa, Artificial Sequence
  Description of Artificial Sequence: Synthetic polypeptide
DEAEIRTTNPVAYEQWGSVSTSNLQGNDGNL

SEQ ID NO: 50301 - protein, 30 aa, Artificial Sequence
  Description of Artificial Sequence: Synthetic polypeptide
DTEEIRTTNPCATEHWGSVSFNPLDQRENR

SEQ ID NO: 50302 - protein, 32 aa, Artificial Sequence
  Description of Artificial Sequence: Synthetic polypeptide
DEEEIRTTNPVATEQYGSVSTQNAIGGDGNQD

SEQ ID NO: 50303 - protein, 32 aa, Artificial Sequence
  Description of Artificial Sequence: Synthetic polypeptide
DEEEIRTTNPVATEQYGSVSTQNDNLDGNGDT

SEQ ID NO: 50304 - protein, 31 aa, Artificial Sequence
  Description of Artificial Sequence: Synthetic polypeptide
DEAEIRTTNPVAYEQWGSVSTNLQSGGGNAN

SEQ ID NO: 50305 - protein, 31 aa, Artificial Sequence
  Description of Artificial Sequence: Synthetic polypeptide
DEAEIRTTNPVAYEQWGSVSTNLQQSGGDDR

SEQ ID NO: 50306 - protein, 31 aa, Artificial Sequence
  Description of Artificial Sequence: Synthetic polypeptide
DEAEIRTTNPVAYEQWGSVSTNLQQNGDNNH

SEQ ID NO: 50307 - protein, 33 aa, Artificial Sequence
  Description of Artificial Sequence: Synthetic polypeptide
DEEEIRTTNPVATEQYGSVSTQLDQQEIGNEQD

SEQ ID NO: 50308 - protein, 32 aa, Artificial Sequence
  Description of Artificial Sequence: Synthetic polypeptide
DEEEIRTTNPVATEQYGSVSTQHITEGNNERN

SEQ ID NO: 50309 - protein, 32 aa, Artificial Sequence
  Description of Artificial Sequence: Synthetic polypeptide
DEEEIRTTNPVATEQYGSVSTQGVGNQNNGNA

SEQ ID NO: 50310 - protein, 31 aa, Artificial Sequence
  Description of Artificial Sequence: Synthetic polypeptide
DEEEIRTTNPVATEQYGSVSTQGVGNGQNGE

SEQ ID NO: 50311 - protein, 32 aa, Artificial Sequence
  Description of Artificial Sequence: Synthetic polypeptide
AEEEIACTNPVATEQYGSVATNLQRDGQNTRI

SEQ ID NO: 50312 - protein, 31 aa, Artificial Sequence
  Description of Artificial Sequence: Synthetic polypeptide
TSEEIRTTNPVATEQYGVVSCTNLSQDGGDR

SEQ ID NO: 50313 - protein, 32 aa, Artificial Sequence
  Description of Artificial Sequence: Synthetic polypeptide
DEEEIRTTNPVATEQYGSVSTPVLSRQGLMIE

SEQ ID NO: 50314 - protein, 31 aa, Artificial Sequence
  Description of Artificial Sequence: Synthetic polypeptide
AEEEIACTNPVATEQYGSVATNLQRDQNTRP

SEQ ID NO: 50315 - protein, 32 aa, Artificial Sequence
  Description of Artificial Sequence: Synthetic polypeptide
HEEEIRTTNPVATEQYGSVISTGLQRNANFGD

SEQ ID NO: 50316 - protein, 33 aa, Artificial Sequence
  Description of Artificial Sequence: Synthetic polypeptide
TSEEIRTTNPVATEQYGSTVSVTNALQHGGNQR

SEQ ID NO: 50317 - protein, 32 aa, Artificial Sequence
  Description of Artificial Sequence: Synthetic polypeptide
DEEEIRTTNPVATEQYGSVSTQDLGNGQGNIE

SEQ ID NO: 50318 - protein, 32 aa, Artificial Sequence
  Description of Artificial Sequence: Synthetic polypeptide
AEEEIRTTNPVATEQYGSVVVSTTNLGETGNT

SEQ ID NO: 50319 - protein, 32 aa, Artificial Sequence
  Description of Artificial Sequence: Synthetic polypeptide
DEEEIRTTNPVATEQYGSVSTQDQNRNMSNDH

SEQ ID NO: 50320 - protein, 30 aa, Artificial Sequence
  Description of Artificial Sequence: Synthetic polypeptide
HEEEIRTTNPDATEQYGSVSSNLQENANFY

SEQ ID NO: 50321 - protein, 32 aa, Artificial Sequence
  Description of Artificial Sequence: Synthetic polypeptide
TSEEIRTTNPVATEQYGSTVSTNLSQRVINND

SEQ ID NO: 50322 - protein, 31 aa, Artificial Sequence
  Description of Artificial Sequence: Synthetic polypeptide
AEEEIACTNPVATEQYGSVSTALPQRNGMGR

SEQ ID NO: 50323 - protein, 31 aa, Artificial Sequence
  Description of Artificial Sequence: Synthetic polypeptide
TSEEIRTTNPVATEQYGKVPSCTNALQNVNR

SEQ ID NO: 50324 - protein, 30 aa, Artificial Sequence
  Description of Artificial Sequence: Synthetic polypeptide
DEAEIRTTNPVAYEQWGTVSTNLQNGGNEA

SEQ ID NO: 50325 - protein, 31 aa, Artificial Sequence
  Description of Artificial Sequence: Synthetic polypeptide
TSEEIRTTNPVATEQYGHVSCTNLSQQGGNS

SEQ ID NO: 50326 - protein, 32 aa, Artificial Sequence
  Description of Artificial Sequence: Synthetic polypeptide
DEEEIRTTNPVATEQYGSVSTQGMGQSGGNNG

SEQ ID NO: 50327 - protein, 33 aa, Artificial Sequence
  Description of Artificial Sequence: Synthetic polypeptide
DEEEIRTTNPVATEQYGSVSTQDSLVQEGGERI

SEQ ID NO: 50328 - protein, 31 aa, Artificial Sequence
  Description of Artificial Sequence: Synthetic polypeptide
DEEEIRTTNPVATEQYGSVSTPTNQRMEDIA

SEQ ID NO: 50329 - protein, 33 aa, Artificial Sequence
  Description of Artificial Sequence: Synthetic polypeptide
AEEEIRTTNPVATEQYGSVVVSTTNLEQGGNDT

SEQ ID NO: 50330 - protein, 31 aa, Artificial Sequence
  Description of Artificial Sequence: Synthetic polypeptide
DEAEIRTTNPVAYEQWGSVSTNLQPGGDNAS

SEQ ID NO: 50331 - protein, 28 aa, Artificial Sequence
  Description of Artificial Sequence: Synthetic peptide
AEEEIACVNPVCTEQYGVVSDNLQSGNR

SEQ ID NO: 50332 - protein, 30 aa, Artificial Sequence
  Description of Artificial Sequence: Synthetic polypeptide
DEAEIRTTNPVAYEQWGSVSTNLQGDGDTS

SEQ ID NO: 50333 - protein, 32 aa, Artificial Sequence
  Description of Artificial Sequence: Synthetic polypeptide
DEEEIRTTNPVATEQYGSVSTQNGNGNNGGNG

SEQ ID NO: 50334 - protein, 32 aa, Artificial Sequence
  Description of Artificial Sequence: Synthetic polypeptide
DEEEIRTTNPVATEQYGSVSTQNGNNGNGNGE

SEQ ID NO: 50335 - protein, 33 aa, Artificial Sequence
  Description of Artificial Sequence: Synthetic polypeptide
DEEEIRTTNPVATEQYGSVSTQNGNQNNGMNED

SEQ ID NO: 50336 - protein, 28 aa, Artificial Sequence
  Description of Artificial Sequence: Synthetic peptide
GENEIACTNPVATEQYGEASENLQRGGR

SEQ ID NO: 50337 - protein, 28 aa, Artificial Sequence
  Description of Artificial Sequence: Synthetic peptide
AEEEIACVNPVCTEQYGVVSENLQSGNR

SEQ ID NO: 50338 - protein, 34 aa, Artificial Sequence
  Description of Artificial Sequence: Synthetic polypeptide
DEEEIRTTNPVATEQYGSVSTQNIGLQVEGGNEG

SEQ ID NO: 50339 - protein, 32 aa, Artificial Sequence
  Description of Artificial Sequence: Synthetic polypeptide
DEEEIRTTNPVATEQYGSVSTQNIIGDGGNQV

SEQ ID NO: 50340 - protein, 32 aa, Artificial Sequence
  Description of Artificial Sequence: Synthetic polypeptide
DEEEIRTTNPVATEQYGSVSTQNIIGDGNIVG

SEQ ID NO: 50341 - protein, 29 aa, Artificial Sequence
  Description of Artificial Sequence: Synthetic peptide
QEEEIACTNPVATEQYGCVATNLQNNGND

SEQ ID NO: 50342 - protein, 30 aa, Artificial Sequence
  Description of Artificial Sequence: Synthetic polypeptide
DEAEIRTTNPVAYEQWGSVSTNLEMGGNTQ

SEQ ID NO: 50343 - protein, 29 aa, Artificial Sequence
  Description of Artificial Sequence: Synthetic peptide
DEAEIRTTNPVAYEQWGSVSTNGQGGMSG

SEQ ID NO: 50344 - protein, 31 aa, Artificial Sequence
  Description of Artificial Sequence: Synthetic polypeptide
DEAEIRTTNPVAYEQWGSVSTNGGQDNGNVR

SEQ ID NO: 50345 - protein, 31 aa, Artificial Sequence
  Description of Artificial Sequence: Synthetic polypeptide
DEAEIRTTNPVAYEQWGSVSTNAGQGNEGNR

SEQ ID NO: 50346 - protein, 32 aa, Artificial Sequence
  Description of Artificial Sequence: Synthetic polypeptide
DEAEIRTTNPVAYEQWGSVSTNLQGDVGGNDR

SEQ ID NO: 50347 - protein, 30 aa, Artificial Sequence
  Description of Artificial Sequence: Synthetic polypeptide
DEAEIRTTNPVAYEQWGSVSTNLQGGDGSG

SEQ ID NO: 50348 - protein, 33 aa, Artificial Sequence
  Description of Artificial Sequence: Synthetic polypeptide
DEEEIRTTNPVATEQYGSVSTQNGGQGRTGEVD

SEQ ID NO: 50349 - protein, 28 aa, Artificial Sequence
  Description of Artificial Sequence: Synthetic peptide
AEEEIACVNPVATEQYGVVSENLQSGGR

SEQ ID NO: 50350 - protein, 31 aa, Artificial Sequence
  Description of Artificial Sequence: Synthetic polypeptide
DEAEIRTTNPVAYEQWGSVSTNLQNGGDNGM

SEQ ID NO: 50351 - protein, 31 aa, Artificial Sequence
  Description of Artificial Sequence: Synthetic polypeptide
DEAEIRTTNPVAYEQWGSVSTNLQNGDPNMD

SEQ ID NO: 50352 - protein, 28 aa, Artificial Sequence
  Description of Artificial Sequence: Synthetic peptide
AEEEIACTNPVCTEQYGVASDNLQRGGR

SEQ ID NO: 50353 - protein, 31 aa, Artificial Sequence
  Description of Artificial Sequence: Synthetic polypeptide
DEAEIRTTNPVAYEQWGSVSTNLQNEGDNSM

SEQ ID NO: 50354 - protein, 32 aa, Artificial Sequence
  Description of Artificial Sequence: Synthetic polypeptide
DEAEIRTTNPVAYEQWGSVSTNLQMNGDNGMR

SEQ ID NO: 50355 - protein, 28 aa, Artificial Sequence
  Description of Artificial Sequence: Synthetic peptide
AEEEIACTNPVCTEQYGVASENLQRGGR

SEQ ID NO: 50356 - protein, 31 aa, Artificial Sequence
  Description of Artificial Sequence: Synthetic polypeptide
DEAEIRTTNPVAYEQWGSVSTNLQLGGDNNN

SEQ ID NO: 50357 - protein, 31 aa, Artificial Sequence
  Description of Artificial Sequence: Synthetic polypeptide
DEAEIRTTNPVAYEQWGSVSTNLQPMGDNNM

SEQ ID NO: 50358 - protein, 31 aa, Artificial Sequence
  Description of Artificial Sequence: Synthetic polypeptide
DEAEIRTTNPVAYEQWGSVSTNLQHQGGDMR

SEQ ID NO: 50359 - protein, 32 aa, Artificial Sequence
  Description of Artificial Sequence: Synthetic polypeptide
DEAEIRTTNPVAYEQWGSVSTNLQHDQGNNNR

SEQ ID NO: 50360 - protein, 32 aa, Artificial Sequence
  Description of Artificial Sequence: Synthetic polypeptide
DEEEIRTTNPVATEQYGSVSTQNDNTLEQEDN

SEQ ID NO: 50361 - protein, 30 aa, Artificial Sequence
  Description of Artificial Sequence: Synthetic polypeptide
DEAEIRTTNPVAYEQWGSVSTNLQGQGDET

SEQ ID NO: 50362 - protein, 33 aa, Artificial Sequence
  Description of Artificial Sequence: Synthetic polypeptide
DEEEIRTTNPVATEQYGSVSTQNGDQGEGGNDE

SEQ ID NO: 50363 - protein, 28 aa, Artificial Sequence
  Description of Artificial Sequence: Synthetic peptide
AEEEIACVNPVATEQYGEASENLQRGGR

SEQ ID NO: 50364 - protein, 28 aa, Artificial Sequence
  Description of Artificial Sequence: Synthetic peptide
AEEEIACVNPVATEQYGEVSDNLQSGNQ

SEQ ID NO: 50365 - protein, 31 aa, Artificial Sequence
  Description of Artificial Sequence: Synthetic polypeptide
DEAEIRTTNPVAYEQWGSVSTNLQGMQGNQG

SEQ ID NO: 50366 - protein, 32 aa, Artificial Sequence
  Description of Artificial Sequence: Synthetic polypeptide
DEEEIRTTNPVATEQYGSVSTQNDNTGGGGND

SEQ ID NO: 50367 - protein, 33 aa, Artificial Sequence
  Description of Artificial Sequence: Synthetic polypeptide
DEEEIRTTNPVATEQYGSVSTPGLQEVGGGNIG

SEQ ID NO: 50368 - protein, 33 aa, Artificial Sequence
  Description of Artificial Sequence: Synthetic polypeptide
DEEEIRTTNPVATEQYGSVSTPGLDQGEGEGNN

SEQ ID NO: 50369 - protein, 29 aa, Artificial Sequence
  Description of Artificial Sequence: Synthetic peptide
TTEEIRTTNPVATEQWGAVSTNGQGGGNG

SEQ ID NO: 50370 - protein, 30 aa, Artificial Sequence
  Description of Artificial Sequence: Synthetic polypeptide
DECEICTVNPVATEQYGSVSTNLEEGENAQ

SEQ ID NO: 50371 - protein, 33 aa, Artificial Sequence
  Description of Artificial Sequence: Synthetic polypeptide
AEEEIRTTNPVATEQYGSVVVSVTNLDEQGGND

SEQ ID NO: 50372 - protein, 29 aa, Artificial Sequence
  Description of Artificial Sequence: Synthetic peptide
MEEAIMTTNPVATEQYGNVEYTMLQGGNR

SEQ ID NO: 50373 - protein, 29 aa, Artificial Sequence
  Description of Artificial Sequence: Synthetic peptide
MEDEIRTTNPVATEQYGSVATTALENGYR

SEQ ID NO: 50374 - protein, 32 aa, Artificial Sequence
  Description of Artificial Sequence: Synthetic polypeptide
MEAEVRTTNPVATEQYGSVSTENGLDQDIGNR

SEQ ID NO: 50375 - protein, 30 aa, Artificial Sequence
  Description of Artificial Sequence: Synthetic polypeptide
DECEICTVNPVATEQYGSVSTNLDEEGENT

SEQ ID NO: 50376 - protein, 33 aa, Artificial Sequence
  Description of Artificial Sequence: Synthetic polypeptide
DEEEIRTTNPVATEQYGSVSTNLFGEFGGNGGT

SEQ ID NO: 50377 - protein, 33 aa, Artificial Sequence
  Description of Artificial Sequence: Synthetic polypeptide
DEEEIRTTNPVATEQYGSVSTNLFLEFNGGNGG

SEQ ID NO: 50378 - protein, 32 aa, Artificial Sequence
  Description of Artificial Sequence: Synthetic polypeptide
VEEEIRTTNPVATEQYGSVNTVNLDQRGEGGD

SEQ ID NO: 50379 - protein, 32 aa, Artificial Sequence
  Description of Artificial Sequence: Synthetic polypeptide
DEEEIRTTNPVATEQYGSVSTNLFNVGEEMVD

SEQ ID NO: 50380 - protein, 32 aa, Artificial Sequence
  Description of Artificial Sequence: Synthetic polypeptide
VEEEIRTTNPVATEQYGSVNTSNLNQRGEMDD

SEQ ID NO: 50381 - protein, 31 aa, Artificial Sequence
  Description of Artificial Sequence: Synthetic polypeptide
AEEEIRTTNPVATEQYGVVVSTNLGGNNGND

SEQ ID NO: 50382 - protein, 34 aa, Artificial Sequence
  Description of Artificial Sequence: Synthetic polypeptide
DEEEIRTTNPVATEQYGSVSTNLGEPRSGNEFFN

SEQ ID NO: 50383 - protein, 32 aa, Artificial Sequence
  Description of Artificial Sequence: Synthetic polypeptide
AEEEIRTTNPVATEQYGVVVSTNNNLNQNGNL

SEQ ID NO: 50384 - protein, 28 aa, Artificial Sequence
  Description of Artificial Sequence: Synthetic peptide
QEECIACTNPVATEQYGSVAMNFQRGNL

SEQ ID NO: 50385 - protein, 33 aa, Artificial Sequence
  Description of Artificial Sequence: Synthetic polypeptide
VEEEIRTTNPVATEQYGSVSGTNLQMEEGNNNG

SEQ ID NO: 50386 - protein, 33 aa, Artificial Sequence
  Description of Artificial Sequence: Synthetic polypeptide
DEEEIRTTNPVATEQYGSVSTNLGLSQPPFFNP

SEQ ID NO: 50387 - protein, 30 aa, Artificial Sequence
  Description of Artificial Sequence: Synthetic polypeptide
DECEICTVNPVATEQYGSVSTNLEEGGNDL

SEQ ID NO: 50388 - protein, 31 aa, Artificial Sequence
  Description of Artificial Sequence: Synthetic polypeptide
DECEICTVNPVATEQYGSVSTTNLQEEQGNP

SEQ ID NO: 50389 - protein, 32 aa, Artificial Sequence
  Description of Artificial Sequence: Synthetic polypeptide
DECEIRTTNPVATEQYGCVSTNLQGQDGNNNS

SEQ ID NO: 50390 - protein, 33 aa, Artificial Sequence
  Description of Artificial Sequence: Synthetic polypeptide
DEEEIRTTNPVATEQYGSVSTNLDNFEGGNNEE

SEQ ID NO: 50391 - protein, 32 aa, Artificial Sequence
  Description of Artificial Sequence: Synthetic polypeptide
DEEEIRTTNPVATEQYGSVSTNLDNQETDEIG

SEQ ID NO: 50392 - protein, 33 aa, Artificial Sequence
  Description of Artificial Sequence: Synthetic polypeptide
VEEEIRTTNPVATEQYGSVSLTNGLGQVISNER

SEQ ID NO: 50393 - protein, 32 aa, Artificial Sequence
  Description of Artificial Sequence: Synthetic polypeptide
QEDEVRTTNPVATEQYGSVSTQNLDQRIGNDD

SEQ ID NO: 50394 - protein, 33 aa, Artificial Sequence
  Description of Artificial Sequence: Synthetic polypeptide
VEEEIRTTNPVATEQYGSVSITNLQQNGGNENE

SEQ ID NO: 50395 - protein, 33 aa, Artificial Sequence
  Description of Artificial Sequence: Synthetic polypeptide
VEEEIRTTNPVATEQYGSVSITNLQGSGGENIG

SEQ ID NO: 50396 - protein, 31 aa, Artificial Sequence
  Description of Artificial Sequence: Synthetic polypeptide
DECEIRTTNPVATEPWGSSVPTNLQIGGNDR

SEQ ID NO: 50397 - protein, 29 aa, Artificial Sequence
  Description of Artificial Sequence: Synthetic peptide
DECEIGTTNPVATEQYGSVSTNMMGENTD

SEQ ID NO: 50398 - protein, 33 aa, Artificial Sequence
  Description of Artificial Sequence: Synthetic polypeptide
VEEEIRTTNPVATEQYGSVSGTNLQVEGGTNIA

SEQ ID NO: 50399 - protein, 30 aa, Artificial Sequence
  Description of Artificial Sequence: Synthetic polypeptide
DECEIGTTNPVATEQYGSVSTNLMYFENQT

SEQ ID NO: 50400 - protein, 32 aa, Artificial Sequence
  Description of Artificial Sequence: Synthetic polypeptide
DECEIGTTNPVATEQYGSVSTNLLQERMGSED

SEQ ID NO: 50401 - protein, 32 aa, Artificial Sequence
  Description of Artificial Sequence: Synthetic polypeptide
DEEEIRTTNPVATEQYGSVSTNLDSYMQSNGQ

SEQ ID NO: 50402 - protein, 31 aa, Artificial Sequence
  Description of Artificial Sequence: Synthetic polypeptide
DEEEIRTTNPVATEQYGSVSTNLDTTSVEID

SEQ ID NO: 50403 - protein, 30 aa, Artificial Sequence
  Description of Artificial Sequence: Synthetic polypeptide
DECEICTVNPVATEQYGSVSTTVNLEEGNL

SEQ ID NO: 50404 - protein, 30 aa, Artificial Sequence
  Description of Artificial Sequence: Synthetic polypeptide
DECEICTVNPVATEQYGSVSTNLGEEGNDA

SEQ ID NO: 50405 - protein, 33 aa, Artificial Sequence
  Description of Artificial Sequence: Synthetic polypeptide
VEEEIRTTNPVATEQYGSVNQTSNLNQRGENGT

SEQ ID NO: 50406 - protein, 31 aa, Artificial Sequence
  Description of Artificial Sequence: Synthetic polypeptide
MDEEIRTTNPVATDQYGSVSVTTLQRGNGFV

SEQ ID NO: 50407 - protein, 32 aa, Artificial Sequence
  Description of Artificial Sequence: Synthetic polypeptide
DEEEIRTTNPVATEQYGSVSTNLIGADENDAN

SEQ ID NO: 50408 - protein, 32 aa, Artificial Sequence
  Description of Artificial Sequence: Synthetic polypeptide
DECEICTTNPVATEQYGSVSTNLLNQVNGENF

SEQ ID NO: 50409 - protein, 31 aa, Artificial Sequence
  Description of Artificial Sequence: Synthetic polypeptide
DECEICTTNPVATEQYGSVSTNLLNQVEGEE

SEQ ID NO: 50410 - protein, 32 aa, Artificial Sequence
  Description of Artificial Sequence: Synthetic polypeptide
DECEICTTNPVATEQYGSVSTDNQLQEQNGNL

SEQ ID NO: 50411 - protein, 29 aa, Artificial Sequence
  Description of Artificial Sequence: Synthetic peptide
DECEICTTNPVATDQYGVVSTALQDGGND

SEQ ID NO: 50412 - protein, 28 aa, Artificial Sequence
  Description of Artificial Sequence: Synthetic peptide
DECEICTTNPVATDQYGVVSTALEFGND

SEQ ID NO: 50413 - protein, 31 aa, Artificial Sequence
  Description of Artificial Sequence: Synthetic polypeptide
DECEIATTNPVAYEQYGSVSTNLQNGGGNTI

SEQ ID NO: 50414 - protein, 31 aa, Artificial Sequence
  Description of Artificial Sequence: Synthetic polypeptide
DECEIATTNPVAYEQYGSVSTNLQGNMGDQR

SEQ ID NO: 50415 - protein, 31 aa, Artificial Sequence
  Description of Artificial Sequence: Synthetic polypeptide
DECEIATTNPVAYEQYGSVSTNLQGDQGNDE

SEQ ID NO: 50416 - protein, 31 aa, Artificial Sequence
  Description of Artificial Sequence: Synthetic polypeptide
DECEIATTNPVAYEQYGSVSTNLNGDMGGNR

SEQ ID NO: 50417 - protein, 31 aa, Artificial Sequence
  Description of Artificial Sequence: Synthetic polypeptide
DECEIATTNPVAYEQYGSVSTGNLGQNDGDR

SEQ ID NO: 50418 - protein, 30 aa, Artificial Sequence
  Description of Artificial Sequence: Synthetic polypeptide
DECEIATTNPVAYEQWGSVSTNLQNDGNVD

SEQ ID NO: 50419 - protein, 30 aa, Artificial Sequence
  Description of Artificial Sequence: Synthetic polypeptide
DECEIATTNPVAYEQWGSVSTNLQGDLGNQ

SEQ ID NO: 50420 - protein, 30 aa, Artificial Sequence
  Description of Artificial Sequence: Synthetic polypeptide
DECEIATTNPVATETYGVVSTNLQSGGDNH

SEQ ID NO: 50421 - protein, 33 aa, Artificial Sequence
  Description of Artificial Sequence: Synthetic polypeptide
VEEEIRTTNPVATEQYGSVGSTVNLQEGGGENI

SEQ ID NO: 50422 - protein, 28 aa, Artificial Sequence
  Description of Artificial Sequence: Synthetic peptide
LTEEIRTTNPCATEMYGSVSVNAQAENR

SEQ ID NO: 50423 - protein, 32 aa, Artificial Sequence
  Description of Artificial Sequence: Synthetic polypeptide
DECEICTTNPVATEQYGSVSTNLNMNQQGNDT

SEQ ID NO: 50424 - protein, 32 aa, Artificial Sequence
  Description of Artificial Sequence: Synthetic polypeptide
DECEICTTNPVATEQYGSVSTNLQGDAGNGES

SEQ ID NO: 50425 - protein, 32 aa, Artificial Sequence
  Description of Artificial Sequence: Synthetic polypeptide
DECEICTTNPVATEQYGSVSTNLQMQQGNNDT

SEQ ID NO: 50426 - protein, 32 aa, Artificial Sequence
  Description of Artificial Sequence: Synthetic polypeptide
DECEICTTNPVATEQYGSVSTNNQLQENMGNL

SEQ ID NO: 50427 - protein, 33 aa, Artificial Sequence
  Description of Artificial Sequence: Synthetic polypeptide
DEEEIRTTNPVATEQYGSVSTNLIMNGGSNDGT

SEQ ID NO: 50428 - protein, 31 aa, Artificial Sequence
  Description of Artificial Sequence: Synthetic polypeptide
DEEEIRTTNPVATEQYGSVSTNLIMTISEEP

SEQ ID NO: 50429 - protein, 32 aa, Artificial Sequence
  Description of Artificial Sequence: Synthetic polypeptide
DEEEIRTTNPVATEQYGSVSTNLLGGEHPAIV

SEQ ID NO: 50430 - protein, 33 aa, Artificial Sequence
  Description of Artificial Sequence: Synthetic polypeptide
DEEEIRTTNPVATEQYGSVSTNLMQTIIDSNQD

SEQ ID NO: 50431 - protein, 32 aa, Artificial Sequence
  Description of Artificial Sequence: Synthetic polypeptide
DEEEIRTTNPVATEQYGSVSTNLNQNSQLEDD

SEQ ID NO: 50432 - protein, 33 aa, Artificial Sequence
  Description of Artificial Sequence: Synthetic polypeptide
DEEEIRTTNPVATEQYGSVSTNLNTDGEMNEGT

SEQ ID NO: 50433 - protein, 33 aa, Artificial Sequence
  Description of Artificial Sequence: Synthetic polypeptide
VEEEIRTTNPVATEQYGSVGSTVNLQETGENID

SEQ ID NO: 50434 - protein, 32 aa, Artificial Sequence
  Description of Artificial Sequence: Synthetic polypeptide
VEEEIRTTNPVATEQYGSVSLTPNNLQRPEEI

SEQ ID NO: 50435 - protein, 29 aa, Artificial Sequence
  Description of Artificial Sequence: Synthetic peptide
DECEICTTNPVATEQYGVVSTELQEPNDD

SEQ ID NO: 50436 - protein, 33 aa, Artificial Sequence
  Description of Artificial Sequence: Synthetic polypeptide
DEEEIRTTNPVATEQYGSVSTNLPQAGGQEFGD

SEQ ID NO: 50437 - protein, 33 aa, Artificial Sequence
  Description of Artificial Sequence: Synthetic polypeptide
DEEEIRTTNPVATEQYGSVSTNLPQNVGFDPGP

SEQ ID NO: 50438 - protein, 31 aa, Artificial Sequence
  Description of Artificial Sequence: Synthetic polypeptide
DECEICTTNPVATEQYGSVSVTTNLMQGNTQ

SEQ ID NO: 50439 - protein, 32 aa, Artificial Sequence
  Description of Artificial Sequence: Synthetic polypeptide
DEEEIRTTNPVATEQYGSVSTNLQEEIVDAEA

SEQ ID NO: 50440 - protein, 31 aa, Artificial Sequence
  Description of Artificial Sequence: Synthetic polypeptide
DECEICTTNPVATEQYGSVSTTTNLMTGNTE

SEQ ID NO: 50441 - protein, 32 aa, Artificial Sequence
  Description of Artificial Sequence: Synthetic polypeptide
DECEICTTNPVATEQYGSVSTTNLMNQQGNTQ

SEQ ID NO: 50442 - protein, 31 aa, Artificial Sequence
  Description of Artificial Sequence: Synthetic polypeptide
DECEICTTNPVATEQYGSVSTNQQQEEMGNL

SEQ ID NO: 50443 - protein, 29 aa, Artificial Sequence
  Description of Artificial Sequence: Synthetic peptide
DECEICTTNPVATEQYGVVSTALVQNDND

SEQ ID NO: 50444 - protein, 32 aa, Artificial Sequence
  Description of Artificial Sequence: Synthetic polypeptide
VEEEIRTTNPVATEQYGSVSNTNDQEEGNNGN

SEQ ID NO: 50445 - protein, 30 aa, Artificial Sequence
  Description of Artificial Sequence: Synthetic polypeptide
DECEIRTTNPVATEQYGEVSTGNDGMNGDR

SEQ ID NO: 50446 - protein, 33 aa, Artificial Sequence
  Description of Artificial Sequence: Synthetic polypeptide
DECEIRTTNPVATEQYGSVATTNLGQGEGQNNR

SEQ ID NO: 50447 - protein, 34 aa, Artificial Sequence
  Description of Artificial Sequence: Synthetic polypeptide
DEEEIRTTNPVATEQYGSVSTNHLGEPSGNEFRP

SEQ ID NO: 50448 - protein, 32 aa, Artificial Sequence
  Description of Artificial Sequence: Synthetic polypeptide
DEEEIRTTNPVATEQYGSVSTNHQDSTSEDRF

SEQ ID NO: 50449 - protein, 32 aa, Artificial Sequence
  Description of Artificial Sequence: Synthetic polypeptide
DEEEIRTTNPVATEQYGSVSTNHQENSGSDAP

SEQ ID NO: 50450 - protein, 30 aa, Artificial Sequence
  Description of Artificial Sequence: Synthetic polypeptide
DECSIMTTNPVATECYGSVNTNTLQRGQNM

SEQ ID NO: 50451 - protein, 31 aa, Artificial Sequence
  Description of Artificial Sequence: Synthetic polypeptide
DEEEIRTTNPVATEQYGSVSTNHQVSLEDTS

SEQ ID NO: 50452 - protein, 31 aa, Artificial Sequence
  Description of Artificial Sequence: Synthetic polypeptide
DEEEIRTTNPVATEQYGSVSTNIDVTIGVQG

SEQ ID NO: 50453 - protein, 32 aa, Artificial Sequence
  Description of Artificial Sequence: Synthetic polypeptide
MEEEICTTNPVATEQYGSVVCSTNDIQWGSNR

SEQ ID NO: 50454 - protein, 29 aa, Artificial Sequence
  Description of Artificial Sequence: Synthetic peptide
DECEIYTTNPVATEQYGSVSTPLMYEVNT

SEQ ID NO: 50455 - protein, 31 aa, Artificial Sequence
  Description of Artificial Sequence: Synthetic polypeptide
DECEIYTTNPVATEQYGSVSTNLNNGGGQNT

SEQ ID NO: 50456 - protein, 31 aa, Artificial Sequence
  Description of Artificial Sequence: Synthetic polypeptide
MEEEIATTNPVATEQYGNVSVTMDLQGAGNR

SEQ ID NO: 50457 - protein, 33 aa, Artificial Sequence
  Description of Artificial Sequence: Synthetic polypeptide
AEEEIRTTNPVATEQYGSVVVSVTNNLQTGNAA

SEQ ID NO: 50458 - protein, 30 aa, Artificial Sequence
  Description of Artificial Sequence: Synthetic polypeptide
QEAEIATTNPVATEQYGSVVATNLERGNES

SEQ ID NO: 50459 - protein, 30 aa, Artificial Sequence
  Description of Artificial Sequence: Synthetic polypeptide
MEEEIATTNPVATEQYGNVSHTDQHQGGNR

SEQ ID NO: 50460 - protein, 30 aa, Artificial Sequence
  Description of Artificial Sequence: Synthetic polypeptide
DECEIYTTNPVATEQYGSVSTNILMYGGET

SEQ ID NO: 50461 - protein, 29 aa, Artificial Sequence
  Description of Artificial Sequence: Synthetic peptide
DECEIYTTNPVATEQYGSVSTNDMMYGQT

SEQ ID NO: 50462 - protein, 31 aa, Artificial Sequence
  Description of Artificial Sequence: Synthetic polypeptide
DEEEIRTTNPVATEQYGSVSTNHGDDGIFSE

SEQ ID NO: 50463 - protein, 32 aa, Artificial Sequence
  Description of Artificial Sequence: Synthetic polypeptide
VEEEIRTTNPVATEQYGSVSTDNGQTGTNNGQ

SEQ ID NO: 50464 - protein, 30 aa, Artificial Sequence
  Description of Artificial Sequence: Synthetic polypeptide
DECTICTTNPVATEQYGSVSVTNLIIGNLQ

SEQ ID NO: 50465 - protein, 28 aa, Artificial Sequence
  Description of Artificial Sequence: Synthetic peptide
AEECISTTNPVATEQYGCVSSNDQRGDQ

SEQ ID NO: 50466 - protein, 29 aa, Artificial Sequence
  Description of Artificial Sequence: Synthetic peptide
DEDCIETVNPVATEWYGSVSDNNLERGNR

SEQ ID NO: 50467 - protein, 30 aa, Artificial Sequence
  Description of Artificial Sequence: Synthetic polypeptide
MEEEIKTTNPVATEQYGNVSVTDLQGGGNT

SEQ ID NO: 50468 - protein, 32 aa, Artificial Sequence
  Description of Artificial Sequence: Synthetic polypeptide
VEEEIRTTNPVATEQYGSVSTNLQQIGTGEGG

SEQ ID NO: 50469 - protein, 32 aa, Artificial Sequence
  Description of Artificial Sequence: Synthetic polypeptide
AEEEIRTTNPVATEQYGVVSVTTNLGQNQGND

SEQ ID NO: 50470 - protein, 32 aa, Artificial Sequence
  Description of Artificial Sequence: Synthetic polypeptide
DEEEIRTTNPVATEQYGSVSTNGGQGRTQEVD

SEQ ID NO: 50471 - protein, 32 aa, Artificial Sequence
  Description of Artificial Sequence: Synthetic polypeptide
DEEEIRTTNPVATEQYGSVSTNGGQRVIVATV

SEQ ID NO: 50472 - protein, 33 aa, Artificial Sequence
  Description of Artificial Sequence: Synthetic polypeptide
VEEEIRTTNPVATEQYGSVSTNLQDGNGNNTTT

SEQ ID NO: 50473 - protein, 30 aa, Artificial Sequence
  Description of Artificial Sequence: Synthetic polypeptide
DECEIYTTNPVATEQYGSVSTDLNGEGGNT

SEQ ID NO: 50474 - protein, 32 aa, Artificial Sequence
  Description of Artificial Sequence: Synthetic polypeptide
DEEEIRTTNPVATEQYGSVSTNGHQERDMSEQ

SEQ ID NO: 50475 - protein, 32 aa, Artificial Sequence
  Description of Artificial Sequence: Synthetic polypeptide
DEEEIRTTNPVATEQYGSVSTNGLIETGELEW

SEQ ID NO: 50476 - protein, 32 aa, Artificial Sequence
  Description of Artificial Sequence: Synthetic polypeptide
AEEEIRTTNPVATEQYGVVSVTTNLQNQGNQQ

SEQ ID NO: 50477 - protein, 32 aa, Artificial Sequence
  Description of Artificial Sequence: Synthetic polypeptide
DEEEIRTTNPVATEQYGSVSTNGLQNAMSQFD

SEQ ID NO: 50478 - protein, 32 aa, Artificial Sequence
  Description of Artificial Sequence: Synthetic polypeptide
DEEEIRTTNPVATEQYGSVSTNGLTNTGDSQN

SEQ ID NO: 50479 - protein, 33 aa, Artificial Sequence
  Description of Artificial Sequence: Synthetic polypeptide
DEEEIRTTNPVATEQYGSVSTNGPEQVGSNDDF

SEQ ID NO: 50480 - protein, 31 aa, Artificial Sequence
  Description of Artificial Sequence: Synthetic polypeptide
MEEEIGTTNPVATEQYGMVNSVTMLVQGGNR

SEQ ID NO: 50481 - protein, 32 aa, Artificial Sequence
  Description of Artificial Sequence: Synthetic polypeptide
MEEEICTTNPVATEQYGVVSTNSLQERQGNDN

SEQ ID NO: 50482 - protein, 32 aa, Artificial Sequence
  Description of Artificial Sequence: Synthetic polypeptide
VEEEIRTTNPVATEQYGSVSTNLGQNRVFLEE

SEQ ID NO: 50483 - protein, 31 aa, Artificial Sequence
  Description of Artificial Sequence: Synthetic polypeptide
DECEIATTNPVATESYGEVSTNLQGEHGNDR

SEQ ID NO: 50484 - protein, 30 aa, Artificial Sequence
  Description of Artificial Sequence: Synthetic polypeptide
DECEIYTTNPVATEQYGSVSPTNLMYMGEV

SEQ ID NO: 50485 - protein, 33 aa, Artificial Sequence
  Description of Artificial Sequence: Synthetic polypeptide
VEEEIRTTNPVATEQYGSVSSTNLQVGGGNTEI

SEQ ID NO: 50486 - protein, 31 aa, Artificial Sequence
  Description of Artificial Sequence: Synthetic polypeptide
MEEEIATTNPVATEQYGCVSVTEELQGGSNR

SEQ ID NO: 50487 - protein, 30 aa, Artificial Sequence
  Description of Artificial Sequence: Synthetic polypeptide
DECEIRTTNPVATEQYGVVSTKGQDRQPND

SEQ ID NO: 50488 - protein, 29 aa, Artificial Sequence
  Description of Artificial Sequence: Synthetic peptide
MEEEIATTNPVATEQYGCVSATHLQADNP

SEQ ID NO: 50489 - protein, 30 aa, Artificial Sequence
  Description of Artificial Sequence: Synthetic polypeptide
DECEIRTTNPVATEQYGVVSTALQNPNNTD

SEQ ID NO: 50490 - protein, 33 aa, Artificial Sequence
  Description of Artificial Sequence: Synthetic polypeptide
AEEEIRTTNPVATEQYGSVVVSVTNLQQNGNNA

SEQ ID NO: 50491 - protein, 30 aa, Artificial Sequence
  Description of Artificial Sequence: Synthetic polypeptide
DECEIRTTNPVATEQYGVVSPTKLQRPTDD

SEQ ID NO: 50492 - protein, 30 aa, Artificial Sequence
  Description of Artificial Sequence: Synthetic polypeptide
DECEIRTTNPVATEQYGVVSHDLEQRPNDV

SEQ ID NO: 50493 - protein, 32 aa, Artificial Sequence
  Description of Artificial Sequence: Synthetic polypeptide
VEEEIRTTNPVATEQYGSVSPTSLPQRQLENL

SEQ ID NO: 50494 - protein, 33 aa, Artificial Sequence
  Description of Artificial Sequence: Synthetic polypeptide
QEAEIRTTNPVATEQYGSTVSTQNELSQNVGNR

SEQ ID NO: 50495 - protein, 30 aa, Artificial Sequence
  Description of Artificial Sequence: Synthetic polypeptide
DECEIRTTNPVATEQYGVVCSTKEQDRPND

SEQ ID NO: 50496 - protein, 32 aa, Artificial Sequence
  Description of Artificial Sequence: Synthetic polypeptide
DECEIRTTNPVATEQYGSVSTVNDNERTGEVR

SEQ ID NO: 50497 - protein, 31 aa, Artificial Sequence
  Description of Artificial Sequence: Synthetic polypeptide
DECEIRTTNPVATEQYGSVSTNDMERTDEQR

SEQ ID NO: 50498 - protein, 33 aa, Artificial Sequence
  Description of Artificial Sequence: Synthetic polypeptide
VEEEIRTTNPVATEQYGSVSNTNLQNGGGNNGD

SEQ ID NO: 50499 - protein, 32 aa, Artificial Sequence
  Description of Artificial Sequence: Synthetic polypeptide
DECEIRTTNPVATEQYGSVSTGGDQQQGGDNR

SEQ ID NO: 50500 - protein, 32 aa, Artificial Sequence
  Description of Artificial Sequence: Synthetic polypeptide
DECEIRTTNPVATEQYGSVSPTDTDLQSIGND

SEQ ID NO: 50501 - protein, 29 aa, Artificial Sequence
  Description of Artificial Sequence: Synthetic peptide
DECEIRTTNPVATEQYGVVSTKLENRPSD

SEQ ID NO: 50502 - protein, 30 aa, Artificial Sequence
  Description of Artificial Sequence: Synthetic polypeptide
DECEIRTTNPVATEQYGVVSTKLQDPNDDA

SEQ ID NO: 50503 - protein, 32 aa, Artificial Sequence
  Description of Artificial Sequence: Synthetic polypeptide
DECEIRTTNPVATEQYGVVSTVLQRGPGNIDG

SEQ ID NO: 50504 - protein, 30 aa, Artificial Sequence
  Description of Artificial Sequence: Synthetic polypeptide
DECEIRTTNPVATEQYGVVSTVLQRPEESD

SEQ ID NO: 50505 - protein, 32 aa, Artificial Sequence
  Description of Artificial Sequence: Synthetic polypeptide
DEEEIRTTNPVATEQYGSVSTNKHDETDMINR

SEQ ID NO: 50506 - protein, 29 aa, Artificial Sequence
  Description of Artificial Sequence: Synthetic peptide
MEEEIATTNPVATEQYGCVSVTVGQPDNR

SEQ ID NO: 50507 - protein, 31 aa, Artificial Sequence
  Description of Artificial Sequence: Synthetic polypeptide
DEEEIRTTNPVATEQYGSVSTNKHNERDMIS

SEQ ID NO: 50508 - protein, 33 aa, Artificial Sequence
  Description of Artificial Sequence: Synthetic polypeptide
VEEEIRTTNPVATEQYGSVSSTNLQQVEGGGNI

SEQ ID NO: 50509 - protein, 33 aa, Artificial Sequence
  Description of Artificial Sequence: Synthetic polypeptide
VEEEIRTTNPVATEQYGSVSSTNLQQEEGNNGN

SEQ ID NO: 50510 - protein, 33 aa, Artificial Sequence
  Description of Artificial Sequence: Synthetic polypeptide
VEEEIRTTNPVATEQYGSVSSTNLQMEEGNNGQ

SEQ ID NO: 50511 - protein, 33 aa, Artificial Sequence
  Description of Artificial Sequence: Synthetic polypeptide
VEEEIRTTNPVATEQYGSVSSTNLQLEEGNNSN

SEQ ID NO: 50512 - protein, 33 aa, Artificial Sequence
  Description of Artificial Sequence: Synthetic polypeptide
DEEEIRTTNPVATEQYGSVSTNINQETGENIQQ

SEQ ID NO: 50513 - protein, 33 aa, Artificial Sequence
  Description of Artificial Sequence: Synthetic polypeptide
VEEEIRTTNPVATEQYGSVSSTNLDQEEGNNNS

SEQ ID NO: 50514 - protein, 29 aa, Artificial Sequence
  Description of Artificial Sequence: Synthetic peptide
QEAEIATTNPVAYEQYGSVATNLQHGNAN

SEQ ID NO: 50515 - protein, 30 aa, Artificial Sequence
  Description of Artificial Sequence: Synthetic polypeptide
QEAEIATTNPVAYEQYGSVSTNLQHGNDQG

SEQ ID NO: 50516 - protein, 31 aa, Artificial Sequence
  Description of Artificial Sequence: Synthetic polypeptide
DECEIRTTNPVAYEQWGSVSTNLQPGGNVDG

SEQ ID NO: 50517 - protein, 30 aa, Artificial Sequence
  Description of Artificial Sequence: Synthetic polypeptide
DECEIRTTNPVAYECWGSVSTNLQDGNNQH

SEQ ID NO: 50518 - protein, 30 aa, Artificial Sequence
  Description of Artificial Sequence: Synthetic polypeptide
DECEIRTTNPVATEQYGYVVYTKLQRPNDT

SEQ ID NO: 50519 - protein, 30 aa, Artificial Sequence
  Description of Artificial Sequence: Synthetic polypeptide
DECEIRTTNPVATEQYGYVVSPYKLQRPND

SEQ ID NO: 50520 - protein, 31 aa, Artificial Sequence
  Description of Artificial Sequence: Synthetic polypeptide
DECEIRTTNPVATEQYGYVVSDTKLQRPDND

SEQ ID NO: 50521 - protein, 30 aa, Artificial Sequence
  Description of Artificial Sequence: Synthetic polypeptide
AEECISTTNPVATEQYGSVSWNPQRGSNQA

SEQ ID NO: 50522 - protein, 32 aa, Artificial Sequence
  Description of Artificial Sequence: Synthetic polypeptide
LNPEIRTTNPVATEQYGSVVSTNLEQQGPNRF

SEQ ID NO: 50523 - protein, 33 aa, Artificial Sequence
  Description of Artificial Sequence: Synthetic polypeptide
DECEIATTNPVATEQYGSVVSTGNNLQAGENHR

SEQ ID NO: 50524 - protein, 33 aa, Artificial Sequence
  Description of Artificial Sequence: Synthetic polypeptide
DECEIATTNPVATEQYGSVSTTNLGQGNGENDR

SEQ ID NO: 50525 - protein, 33 aa, Artificial Sequence
  Description of Artificial Sequence: Synthetic polypeptide
DEEEIRTTNPVATEQYGSVSTNNTMQEDFGNQF

SEQ ID NO: 50526 - protein, 31 aa, Artificial Sequence
  Description of Artificial Sequence: Synthetic polypeptide
VEECIRTTNPVATEQYGSVSTTNGNDAAGNR

SEQ ID NO: 50527 - protein, 31 aa, Artificial Sequence
  Description of Artificial Sequence: Synthetic polypeptide
AEEEIRTTNPVATEQYGSVVVSTTNQIGTNG

SEQ ID NO: 50528 - protein, 32 aa, Artificial Sequence
  Description of Artificial Sequence: Synthetic polypeptide
DEEEIRTTNPVATEQYGSVSTNNVQPNENPTI

SEQ ID NO: 50529 - protein, 29 aa, Artificial Sequence
  Description of Artificial Sequence: Synthetic peptide
AEEEIACTNPVATEQYGEAMSENLQRGGR

SEQ ID NO: 50530 - protein, 31 aa, Artificial Sequence
  Description of Artificial Sequence: Synthetic polypeptide
VEDEVRTTNPVATEQYGSVSTWNLDHDQGNR

SEQ ID NO: 50531 - protein, 32 aa, Artificial Sequence
  Description of Artificial Sequence: Synthetic polypeptide
VEDEVRTTNPVATEQYGSVSTWNGDQRKGENR

SEQ ID NO: 50532 - protein, 33 aa, Artificial Sequence
  Description of Artificial Sequence: Synthetic polypeptide
DEEEIRTTNPVATEQYGSVSTNPIAERNGNNDP

SEQ ID NO: 50533 - protein, 33 aa, Artificial Sequence
  Description of Artificial Sequence: Synthetic polypeptide
DEEEIRTTNPVATEQYGSVSTNPLQARSDQEEH

SEQ ID NO: 50534 - protein, 32 aa, Artificial Sequence
  Description of Artificial Sequence: Synthetic polypeptide
DEEEIRTTNPVATEQYGSVSTNPLQNATTLHE

SEQ ID NO: 50535 - protein, 31 aa, Artificial Sequence
  Description of Artificial Sequence: Synthetic polypeptide
DEEEIRTTNPVATEQYGSVSTNPQHTVETQQ

SEQ ID NO: 50536 - protein, 28 aa, Artificial Sequence
  Description of Artificial Sequence: Synthetic peptide
IENEIACTNPVATEQYGEHSENLQRGGR

SEQ ID NO: 50537 - protein, 32 aa, Artificial Sequence
  Description of Artificial Sequence: Synthetic polypeptide
DEEEIRTTNPVATEQYGSVSTNPQRFSDEQQE

SEQ ID NO: 50538 - protein, 31 aa, Artificial Sequence
  Description of Artificial Sequence: Synthetic polypeptide
DEEEIRTTNPVATEQYGSVSTNPQTMEMTQQ

SEQ ID NO: 50539 - protein, 32 aa, Artificial Sequence
  Description of Artificial Sequence: Synthetic polypeptide
DEEEIRTTNPVATEQYGSVSTNPQVEGGEQDQ

SEQ ID NO: 50540 - protein, 34 aa, Artificial Sequence
  Description of Artificial Sequence: Synthetic polypeptide
DEEEIRTTNPVATEQYGSVSTNNTLENQNGGNEN

SEQ ID NO: 50541 - protein, 34 aa, Artificial Sequence
  Description of Artificial Sequence: Synthetic polypeptide
DEEEIRTTNPVATEQYGSVSTNNTLENQNGGNEG

SEQ ID NO: 50542 - protein, 34 aa, Artificial Sequence
  Description of Artificial Sequence: Synthetic polypeptide
DEEEIRTTNPVATEQYGSVSTNNTLENQDGENGD

SEQ ID NO: 50543 - protein, 29 aa, Artificial Sequence
  Description of Artificial Sequence: Synthetic peptide
QEEEIACTNPVATEGYGSVSTNLQGGAES

SEQ ID NO: 50544 - protein, 33 aa, Artificial Sequence
  Description of Artificial Sequence: Synthetic polypeptide
DEEEIRTTNPVATEQYGSVSTNNLHQHFDEDSR

SEQ ID NO: 50545 - protein, 32 aa, Artificial Sequence
  Description of Artificial Sequence: Synthetic polypeptide
DEEEIRTTNPVATEQYGSVSTNNLHRTEEDVD

SEQ ID NO: 50546 - protein, 33 aa, Artificial Sequence
  Description of Artificial Sequence: Synthetic polypeptide
AEEEIRTTNPVATEQYGSVVVSTTTNLQNGNNG

SEQ ID NO: 50547 - protein, 30 aa, Artificial Sequence
  Description of Artificial Sequence: Synthetic polypeptide
AEEEIACTNPVATEQYGCVATNLQRENTRD

SEQ ID NO: 50548 - protein, 33 aa, Artificial Sequence
  Description of Artificial Sequence: Synthetic polypeptide
DEEEIRTTNPVATEQYGSVSTNNLPQNVEGEEG

SEQ ID NO: 50549 - protein, 34 aa, Artificial Sequence
  Description of Artificial Sequence: Synthetic polypeptide
DEEEIRTTNPVATEQYGSVSTNNLQGREGQEQLG

SEQ ID NO: 50550 - protein, 33 aa, Artificial Sequence
  Description of Artificial Sequence: Synthetic polypeptide
DEEEIRTTNPVATEQYGSVSTNNLQIEMVNEQY

SEQ ID NO: 50551 - protein, 33 aa, Artificial Sequence
  Description of Artificial Sequence: Synthetic polypeptide
DEEEIRTTNPVATEQYGSVSTNPQVREGDSQQE

SEQ ID NO: 50552 - protein, 34 aa, Artificial Sequence
  Description of Artificial Sequence: Synthetic polypeptide
DEEEIRTTNPVATEQYGSVSTNNLQQNEMGNNED

SEQ ID NO: 50553 - protein, 33 aa, Artificial Sequence
  Description of Artificial Sequence: Synthetic polypeptide
DEEEIRTTNPVATEQYGSVSTNNLQRELEQPVT

SEQ ID NO: 50554 - protein, 30 aa, Artificial Sequence
  Description of Artificial Sequence: Synthetic polypeptide
DEAEISTTNPVATEQYGSVCSTNLMYFGDT

SEQ ID NO: 50555 - protein, 31 aa, Artificial Sequence
  Description of Artificial Sequence: Synthetic polypeptide
DEEEIRTTNPVATEQYGSVSTNNLSSFEQVT

SEQ ID NO: 50556 - protein, 29 aa, Artificial Sequence
  Description of Artificial Sequence: Synthetic peptide
INEEIRTTNPVATEQYGDVSTGGQGGGNG

SEQ ID NO: 50557 - protein, 30 aa, Artificial Sequence
  Description of Artificial Sequence: Synthetic polypeptide
VEEEIACTNPVATEQYGSVATNLQQGNTPE

SEQ ID NO: 50558 - protein, 30 aa, Artificial Sequence
  Description of Artificial Sequence: Synthetic polypeptide
INEEIRTTNPVATEQYGAVVSTGLQDGGNG

SEQ ID NO: 50559 - protein, 32 aa, Artificial Sequence
  Description of Artificial Sequence: Synthetic polypeptide
DEEEIRTTNPVATEQYGSVSTNNNGQEGMEDH

SEQ ID NO: 50560 - protein, 30 aa, Artificial Sequence
  Description of Artificial Sequence: Synthetic polypeptide
INEEIRTTNPVATEQYGDVSTNGQDGGNQG

SEQ ID NO: 50561 - protein, 33 aa, Artificial Sequence
  Description of Artificial Sequence: Synthetic polypeptide
DEEEIRTTNPVATEQYGSVSTNNLGQRVMVPIE

SEQ ID NO: 50562 - protein, 31 aa, Artificial Sequence
  Description of Artificial Sequence: Synthetic polypeptide
DEEEIRTTNPVATEQYGSVSTNQDQMNSDTF

SEQ ID NO: 50563 - protein, 28 aa, Artificial Sequence
  Description of Artificial Sequence: Synthetic peptide
AEEEIACTNPVATEQYGEASDNLQSGGR

SEQ ID NO: 50564 - protein, 32 aa, Artificial Sequence
  Description of Artificial Sequence: Synthetic polypeptide
DEEEIRTTNPVATEQYGSVSTNWGQVTVENQE

SEQ ID NO: 50565 - protein, 32 aa, Artificial Sequence
  Description of Artificial Sequence: Synthetic polypeptide
DEEEIRTTNPVATEQYGSVSTNWLVPAGLVVA

SEQ ID NO: 50566 - protein, 33 aa, Artificial Sequence
  Description of Artificial Sequence: Synthetic polypeptide
IEEEIRTTNPVATEQYGSVSPTSNLEQRGEGSE

SEQ ID NO: 50567 - protein, 29 aa, Artificial Sequence
  Description of Artificial Sequence: Synthetic peptide
AEEEIACTNPVATEQYGSASENGPQRGGR

SEQ ID NO: 50568 - protein, 29 aa, Artificial Sequence
  Description of Artificial Sequence: Synthetic peptide
AEEEIACTNPVATEQYGSASSEALQRGGR

SEQ ID NO: 50569 - protein, 31 aa, Artificial Sequence
  Description of Artificial Sequence: Synthetic polypeptide
IEEEIRTTNPVATEQYGSCCTNLGQRNEVRD

SEQ ID NO: 50570 - protein, 31 aa, Artificial Sequence
  Description of Artificial Sequence: Synthetic polypeptide
DEEEIRTTNPVATEQYGSVSTPDHQELVSFR

SEQ ID NO: 50571 - protein, 29 aa, Artificial Sequence
  Description of Artificial Sequence: Synthetic peptide
TTEEIRTTNPVATEQWGTVSTNGQEGGNV

SEQ ID NO: 50572 - protein, 29 aa, Artificial Sequence
  Description of Artificial Sequence: Synthetic peptide
TTEEIRTTNPVATEQWGTVSTNGGQEGNI

SEQ ID NO: 50573 - protein, 32 aa, Artificial Sequence
  Description of Artificial Sequence: Synthetic polypeptide
DEEEIRTTNPVATEQYGSVSTPDLNQGTDNQN

SEQ ID NO: 50574 - protein, 32 aa, Artificial Sequence
  Description of Artificial Sequence: Synthetic polypeptide
DEEEIRTTNPVATEQYGSVSTPDLQENQNDHN

SEQ ID NO: 50575 - protein, 30 aa, Artificial Sequence
  Description of Artificial Sequence: Synthetic polypeptide
AEEEIACTNPVATEQYGSASTENGPQRGGR

SEQ ID NO: 50576 - protein, 33 aa, Artificial Sequence
  Description of Artificial Sequence: Synthetic polypeptide
DEEEIRTTNPVATEQYGSVSTPDLQETNGENIL

SEQ ID NO: 50577 - protein, 33 aa, Artificial Sequence
  Description of Artificial Sequence: Synthetic polypeptide
DEEEIRTTNPVATEQYGSVSTPDLQNQGGENIG

SEQ ID NO: 50578 - protein, 31 aa, Artificial Sequence
  Description of Artificial Sequence: Synthetic polypeptide
AEEEIACTNPVATEQYGSVAATNLQRDDNRL

SEQ ID NO: 50579 - protein, 32 aa, Artificial Sequence
  Description of Artificial Sequence: Synthetic polypeptide
DEEEIRTTNPVATEQYGSVSTNVNQTMGEDEG

SEQ ID NO: 50580 - protein, 30 aa, Artificial Sequence
  Description of Artificial Sequence: Synthetic polypeptide
TTEEIRTTNPVATEQWGVVSTNLQFEGGNI

SEQ ID NO: 50581 - protein, 33 aa, Artificial Sequence
  Description of Artificial Sequence: Synthetic polypeptide
DEEEIRTTNPVATEQYGSVSTNVLGPVGGNEFT

SEQ ID NO: 50582 - protein, 31 aa, Artificial Sequence
  Description of Artificial Sequence: Synthetic polypeptide
DEEEIRTTNPVATEQYGSVSTNTTTESTNPA

SEQ ID NO: 50583 - protein, 32 aa, Artificial Sequence
  Description of Artificial Sequence: Synthetic polypeptide
DEEEIRTTNPVATEQYGSVSTNQQMNSDNTFP

SEQ ID NO: 50584 - protein, 28 aa, Artificial Sequence
  Description of Artificial Sequence: Synthetic peptide
IENEIACTNPVATEQYGEASENLQRGGR

SEQ ID NO: 50585 - protein, 30 aa, Artificial Sequence
  Description of Artificial Sequence: Synthetic polypeptide
DEAEISTTNPVATEQYGCVCSTNLAYGNTN

SEQ ID NO: 50586 - protein, 28 aa, Artificial Sequence
  Description of Artificial Sequence: Synthetic peptide
AEEEIACTNPVATEQYGEASENLQHGER

SEQ ID NO: 50587 - protein, 33 aa, Artificial Sequence
  Description of Artificial Sequence: Synthetic polypeptide
DEEEIRTTNPVATEQYGSVSTNTDDQNEGGNET

SEQ ID NO: 50588 - protein, 28 aa, Artificial Sequence
  Description of Artificial Sequence: Synthetic peptide
AEEEIACTNPVATEQYGEASENLQHGGR

SEQ ID NO: 50589 - protein, 32 aa, Artificial Sequence
  Description of Artificial Sequence: Synthetic polypeptide
DEEEIRTTNPVATEQYGSVSTNTDMADGLNSL

SEQ ID NO: 50590 - protein, 33 aa, Artificial Sequence
  Description of Artificial Sequence: Synthetic polypeptide
DEEEIRTTNPVATEQYGSVSTNQNMDDRGNNMN

SEQ ID NO: 50591 - protein, 28 aa, Artificial Sequence
  Description of Artificial Sequence: Synthetic peptide
AEEEIACTNPVATEQYGEASENLQRGGV

SEQ ID NO: 50592 - protein, 30 aa, Artificial Sequence
  Description of Artificial Sequence: Synthetic polypeptide
VEDEIATTNPVAYEQYGSVATNLQRGNDQF

SEQ ID NO: 50593 - protein, 32 aa, Artificial Sequence
  Description of Artificial Sequence: Synthetic polypeptide
IEGEIRTTNPVATEQYGSVSTNDLQRNQNEPG

SEQ ID NO: 50594 - protein, 33 aa, Artificial Sequence
  Description of Artificial Sequence: Synthetic polypeptide
DEEEIRTTNPVATEQYGSVSTNTLQDEVGTGTS

SEQ ID NO: 50595 - protein, 34 aa, Artificial Sequence
  Description of Artificial Sequence: Synthetic polypeptide
DEEEIRTTNPVATEQYGSVSTNTLQEAVGGNGGQ

SEQ ID NO: 50596 - protein, 29 aa, Artificial Sequence
  Description of Artificial Sequence: Synthetic peptide
IEEVIRTTNPVATEQYGSVCTPDQRENEN

SEQ ID NO: 50597 - protein, 29 aa, Artificial Sequence
  Description of Artificial Sequence: Synthetic peptide
VEDEIATTNPVATEQYGCVATNLQMGERD

SEQ ID NO: 50598 - protein, 31 aa, Artificial Sequence
  Description of Artificial Sequence: Synthetic polypeptide
DEEEIRTTNPVATEQYGSVSTNTQQETDEID

SEQ ID NO: 50599 - protein, 28 aa, Artificial Sequence
  Description of Artificial Sequence: Synthetic peptide
AEEEIACTNPVATEQYGEASENLQSGGR

SEQ ID NO: 50600 - protein, 30 aa, Artificial Sequence
  Description of Artificial Sequence: Synthetic polypeptide
MEEEIKTTNPVATEQYGNVSVTGLQGEGNA

SEQ ID NO: 50601 - protein, 30 aa, Artificial Sequence
  Description of Artificial Sequence: Synthetic polypeptide
VEEEIATTNPVATEPYGSVSANLQDQGNQH

SEQ ID NO: 50602 - protein, 34 aa, Artificial Sequence
  Description of Artificial Sequence: Synthetic polypeptide
DEEEIRTTNPVATEQYGSVSTNNLEQDITGNEQE

SEQ ID NO: 50603 - protein, 31 aa, Artificial Sequence
  Description of Artificial Sequence: Synthetic polypeptide
DECEIATTNPVATEQYGEVSTNLQLGDNGMP

SEQ ID NO: 50604 - protein, 30 aa, Artificial Sequence
  Description of Artificial Sequence: Synthetic polypeptide
AEEEIACTNPVATEPYGSVSTNLQQPDNRA

SEQ ID NO: 50605 - protein, 32 aa, Artificial Sequence
  Description of Artificial Sequence: Synthetic polypeptide
VEEEIRTTNPVATEAYGSVSANLSQRTGGSNA

SEQ ID NO: 50606 - protein, 31 aa, Artificial Sequence
  Description of Artificial Sequence: Synthetic polypeptide
AEEEIRTTNPVATEQYGVVVVSTNLGGNGNE

SEQ ID NO: 50607 - protein, 33 aa, Artificial Sequence
  Description of Artificial Sequence: Synthetic polypeptide
VEEEIRTTNPVATEAYGSVNCTGNLSQRGGNYR

SEQ ID NO: 50608 - protein, 33 aa, Artificial Sequence
  Description of Artificial Sequence: Synthetic polypeptide
VEEEIRTTNPVATEAYGSTVSCTNLQRVGNNYQ

SEQ ID NO: 50609 - protein, 31 aa, Artificial Sequence
  Description of Artificial Sequence: Synthetic polypeptide
DECEIATTNPVATECYGSVSTNLQQSGGDNH

SEQ ID NO: 50610 - protein, 29 aa, Artificial Sequence
  Description of Artificial Sequence: Synthetic peptide
DECEIATTNPVATDQYGVVSTALQEGNTD

SEQ ID NO: 50611 - protein, 29 aa, Artificial Sequence
  Description of Artificial Sequence: Synthetic peptide
DEAVIRTTNPVATEQYGCVCETNPQFGNA

SEQ ID NO: 50612 - protein, 32 aa, Artificial Sequence
  Description of Artificial Sequence: Synthetic polypeptide
VEEEIRATNPVATEQYGSVSTGDLGQHGENGR

SEQ ID NO: 50613 - protein, 29 aa, Artificial Sequence
  Description of Artificial Sequence: Synthetic peptide
DEAVIGTTNPVATEQWGSVSTDELQQGND

SEQ ID NO: 50614 - protein, 29 aa, Artificial Sequence
  Description of Artificial Sequence: Synthetic peptide
DEAVIATTNPVATEQWGSVSADDLQRGNS

SEQ ID NO: 50615 - protein, 31 aa, Artificial Sequence
  Description of Artificial Sequence: Synthetic polypeptide
DEAVIATTNPVATEQDGSTVPSTDELQRGNR

SEQ ID NO: 50616 - protein, 30 aa, Artificial Sequence
  Description of Artificial Sequence: Synthetic polypeptide
VEEEICTTNPVATEQYGSVATNLTAGNDQG

SEQ ID NO: 50617 - protein, 33 aa, Artificial Sequence
  Description of Artificial Sequence: Synthetic polypeptide
DEEEIRTTNPVATEQYGSVSTNLQWDFGDDQDD

SEQ ID NO: 50618 - protein, 29 aa, Artificial Sequence
  Description of Artificial Sequence: Synthetic peptide
DECEIATTNPVATEQYGSVSKNEDAEGNT

SEQ ID NO: 50619 - protein, 32 aa, Artificial Sequence
  Description of Artificial Sequence: Synthetic polypeptide
DECEIATTNPVATEQYGSVSTANGQQMEGGNR

SEQ ID NO: 50620 - protein, 31 aa, Artificial Sequence
  Description of Artificial Sequence: Synthetic polypeptide
DECEIATTNPVATEQYGSVSTANQGMEGNNR

SEQ ID NO: 50621 - protein, 28 aa, Artificial Sequence
  Description of Artificial Sequence: Synthetic peptide
LENEIACTNPVATEQYGEASENLQRGGR

SEQ ID NO: 50622 - protein, 31 aa, Artificial Sequence
  Description of Artificial Sequence: Synthetic polypeptide
DECEIATTNPVATEQYGSVSTNLQQGDAGEE

SEQ ID NO: 50623 - protein, 32 aa, Artificial Sequence
  Description of Artificial Sequence: Synthetic polypeptide
DECEIATTNPVATEQYGSVSTNLQGDVQNGER

SEQ ID NO: 50624 - protein, 32 aa, Artificial Sequence
  Description of Artificial Sequence: Synthetic polypeptide
DECEIATTNPVATEQYGSVSTNLQGDVGNNEM

SEQ ID NO: 50625 - protein, 31 aa, Artificial Sequence
  Description of Artificial Sequence: Synthetic polypeptide
DECEIATTNPVATEQYGSVSTNLQGDVGDGE

SEQ ID NO: 50626 - protein, 33 aa, Artificial Sequence
  Description of Artificial Sequence: Synthetic polypeptide
VEEEIRTTNPVATEQYGSVDNTSNLDQRGENDD

SEQ ID NO: 50627 - protein, 30 aa, Artificial Sequence
  Description of Artificial Sequence: Synthetic polypeptide
VEEEIRTTNPVATEQYGSVAVANETRSNPR

SEQ ID NO: 50628 - protein, 29 aa, Artificial Sequence
  Description of Artificial Sequence: Synthetic peptide
VEEEIRTTNPVATEQYGSVATAGQGNGFE

SEQ ID NO: 50629 - protein, 28 aa, Artificial Sequence
  Description of Artificial Sequence: Synthetic peptide
DEASIATVNPVATEPYGSVSANLDRGNY

SEQ ID NO: 50630 - protein, 33 aa, Artificial Sequence
  Description of Artificial Sequence: Synthetic polypeptide
DECEIATTNPVATEQYGSVSTNLQGDRAGNNEQ

SEQ ID NO: 50631 - protein, 31 aa, Artificial Sequence
  Description of Artificial Sequence: Synthetic polypeptide
DECEIATTNPVATEQYGSVSTNLNGDAGNEQ

SEQ ID NO: 50632 - protein, 32 aa, Artificial Sequence
  Description of Artificial Sequence: Synthetic polypeptide
LEREIRTTNPVATEQYGSVCSTMNLQNGNFIP

SEQ ID NO: 50633 - protein, 31 aa, Artificial Sequence
  Description of Artificial Sequence: Synthetic polypeptide
DECEIATTNPVATEQYGSVSTNLMMEEGNTQ

SEQ ID NO: 50634 - protein, 31 aa, Artificial Sequence
  Description of Artificial Sequence: Synthetic polypeptide
DECEIATTNPVATEQYGSVSTNLGMDHGNTH

SEQ ID NO: 50635 - protein, 31 aa, Artificial Sequence
  Description of Artificial Sequence: Synthetic polypeptide
DECEIATTNPVATEQYGSVSTNLDGNGGNED

SEQ ID NO: 50636 - protein, 35 aa, Artificial Sequence
  Description of Artificial Sequence: Synthetic polypeptide
VEEEIRTTNPVATEQYGSIVPSTENALQQRGGNER

SEQ ID NO: 50637 - protein, 33 aa, Artificial Sequence
  Description of Artificial Sequence: Synthetic polypeptide
VEEEIRTTNPVATEQWGSTVNTGNLSQRGGNYR

SEQ ID NO: 50638 - protein, 31 aa, Artificial Sequence
  Description of Artificial Sequence: Synthetic polypeptide
DECEIATTNPVATEQYGSVSTNLQGDAGQEN

SEQ ID NO: 50639 - protein, 34 aa, Artificial Sequence
  Description of Artificial Sequence: Synthetic polypeptide
DEEEIRTTNPVATEQYGSVSTNNLEQITGGNEGE

SEQ ID NO: 50640 - protein, 29 aa, Artificial Sequence
  Description of Artificial Sequence: Synthetic peptide
DEASIATTNPVATECYGSVATNELQDGNM

SEQ ID NO: 50641 - protein, 29 aa, Artificial Sequence
  Description of Artificial Sequence: Synthetic peptide
DEASIATTNPCATEQFGSVSCNLQSGDNR

SEQ ID NO: 50642 - protein, 31 aa, Artificial Sequence
  Description of Artificial Sequence: Synthetic polypeptide
DEEEIRTTNPVATEQYGSVSTNMTEIRLDEI

SEQ ID NO: 50643 - protein, 28 aa, Artificial Sequence
  Description of Artificial Sequence: Synthetic peptide
KENEIACTNPVATEQYGVASENLQRGGR

SEQ ID NO: 50644 - protein, 32 aa, Artificial Sequence
  Description of Artificial Sequence: Synthetic polypeptide
DEEEIRTTNPVATEQYGSVSTNMTQESTNNFD

SEQ ID NO: 50645 - protein, 33 aa, Artificial Sequence
  Description of Artificial Sequence: Synthetic polypeptide
DEEEIRTTNPVATEQYGSVSTNNAEQNDENLRV

SEQ ID NO: 50646 - protein, 33 aa, Artificial Sequence
  Description of Artificial Sequence: Synthetic polypeptide
DEEEIRTTNPVATEQYGSVSTNNDGQGEGGNES

SEQ ID NO: 50647 - protein, 28 aa, Artificial Sequence
  Description of Artificial Sequence: Synthetic peptide
KENEIACTNPVATEQYGEASENLQRGGR

SEQ ID NO: 50648 - protein, 33 aa, Artificial Sequence
  Description of Artificial Sequence: Synthetic polypeptide
DEEEIRTTNPVATEQYGSVSTNNDGQNTGGNNT

SEQ ID NO: 50649 - protein, 33 aa, Artificial Sequence
  Description of Artificial Sequence: Synthetic polypeptide
DEEEIRTTNPVATEQYGSVSTNNDGQQNGGNNQ

SEQ ID NO: 50650 - protein, 33 aa, Artificial Sequence
  Description of Artificial Sequence: Synthetic polypeptide
DEEEIRTTNPVATEQYGSVSTNNDGQSNEGGNV

SEQ ID NO: 50651 - protein, 31 aa, Artificial Sequence
  Description of Artificial Sequence: Synthetic polypeptide
AEEEIRTTNPVATEQYGVVVVTNLQQQGNQG

SEQ ID NO: 50652 - protein, 34 aa, Artificial Sequence
  Description of Artificial Sequence: Synthetic polypeptide
DEEEIRTTNPVATEQYGSVSTNNGLQPDGNFSDQ

SEQ ID NO: 50653 - protein, 28 aa, Artificial Sequence
  Description of Artificial Sequence: Synthetic peptide
QEEEIACTNPIATEQYGVVASNLQRGDR

SEQ ID NO: 50654 - protein, 33 aa, Artificial Sequence
  Description of Artificial Sequence: Synthetic polypeptide
DEEEIRTTNPVATEQYGSVSTNNGLQQVNGDIQ

SEQ ID NO: 50655 - protein, 32 aa, Artificial Sequence
  Description of Artificial Sequence: Synthetic polypeptide
DEEEIRTTNPVATEQYGSVSTNNHDEPGELRD

SEQ ID NO: 50656 - protein, 33 aa, Artificial Sequence
  Description of Artificial Sequence: Synthetic polypeptide
DEEEIRTTNPVATEQYGSVSTNNLDIFGGNEEA

SEQ ID NO: 50657 - protein, 31 aa, Artificial Sequence
  Description of Artificial Sequence: Synthetic polypeptide
DEEEIRTTNPVATEQYGSVSTNMTEIILNDI

SEQ ID NO: 50658 - protein, 30 aa, Artificial Sequence
  Description of Artificial Sequence: Synthetic polypeptide
VEEEIATTNPVATEQWGSVSENLQHGDNQS

SEQ ID NO: 50659 - protein, 30 aa, Artificial Sequence
  Description of Artificial Sequence: Synthetic polypeptide
VEEEIATTNPVATEQWGTVSTNLQNGGNDQ

SEQ ID NO: 50660 - protein, 33 aa, Artificial Sequence
  Description of Artificial Sequence: Synthetic polypeptide
DEEEIRTTNPVATEQYGSVSTNMLQQNRASDDN

SEQ ID NO: 50661 - protein, 29 aa, Artificial Sequence
  Description of Artificial Sequence: Synthetic peptide
DEAPIATTNPVATEPYSEEVSTNLQHGNR

SEQ ID NO: 50662 - protein, 29 aa, Artificial Sequence
  Description of Artificial Sequence: Synthetic peptide
DEAHIRTTNGVAYCQYGSVSTMNLQHGER

SEQ ID NO: 50663 - protein, 30 aa, Artificial Sequence
  Description of Artificial Sequence: Synthetic polypeptide
DEAEIYTTNPVATEQYGSVSTNHAYFGSNQ

SEQ ID NO: 50664 - protein, 29 aa, Artificial Sequence
  Description of Artificial Sequence: Synthetic peptide
DEAEIYTTNPVATEQYGSVNTNLMYGGET

SEQ ID NO: 50665 - protein, 31 aa, Artificial Sequence
  Description of Artificial Sequence: Synthetic polypeptide
DEAEIYTTNPVATEQYGSVCSTNLAYFGNQS

SEQ ID NO: 50666 - protein, 31 aa, Artificial Sequence
  Description of Artificial Sequence: Synthetic polypeptide
DEAEIYTTNPVATEAYGSVSTNDLTPQSGNT

SEQ ID NO: 50667 - protein, 29 aa, Artificial Sequence
  Description of Artificial Sequence: Synthetic peptide
DEAEIVTVNPVATEQYGCVSTNLAEFGNQ

SEQ ID NO: 50668 - protein, 29 aa, Artificial Sequence
  Description of Artificial Sequence: Synthetic peptide
DEASIATTNPLATEQFGSVSQNLQSDGNR

SEQ ID NO: 50669 - protein, 30 aa, Artificial Sequence
  Description of Artificial Sequence: Synthetic polypeptide
DEAEISTVNPVATEQYGSVSTNLAEFGGNQ

SEQ ID NO: 50670 - protein, 32 aa, Artificial Sequence
  Description of Artificial Sequence: Synthetic polypeptide
DEEEIRTTNPVATEQYGSVSTNLTTTIEEDNQ

SEQ ID NO: 50671 - protein, 32 aa, Artificial Sequence
  Description of Artificial Sequence: Synthetic polypeptide
DEEEIRTTNPVATEQYGSVSTNLTYNTIEDNQ

SEQ ID NO: 50672 - protein, 31 aa, Artificial Sequence
  Description of Artificial Sequence: Synthetic polypeptide
DEEEIRTTNPVATEQYGSVSTNMDEHRLEDI

SEQ ID NO: 50673 - protein, 29 aa, Artificial Sequence
  Description of Artificial Sequence: Synthetic peptide
VEEEIATTNPVCTETYGSVSNPNLQDGNL

SEQ ID NO: 50674 - protein, 28 aa, Artificial Sequence
  Description of Artificial Sequence: Synthetic peptide
QEEEIACTNPIATEQYGDVSENLMRGER

SEQ ID NO: 50675 - protein, 30 aa, Artificial Sequence
  Description of Artificial Sequence: Synthetic polypeptide
VEEEIATTNPVATEQYGSVATNLQDGPTDQ

SEQ ID NO: 50676 - protein, 32 aa, Artificial Sequence
  Description of Artificial Sequence: Synthetic polypeptide
AEEEIRTTNPVATEQYGSVVVSVNLNQQGNQG

SEQ ID NO: 50677 - protein, 33 aa, Artificial Sequence
  Description of Artificial Sequence: Synthetic polypeptide
DEEEIRTTNPVATEQYGSVSTNLTSGMGGNETN

SEQ ID NO: 50678 - protein, 31 aa, Artificial Sequence
  Description of Artificial Sequence: Synthetic polypeptide
DEDEIATTNPVAYEQYGSVATNLQQRGNQDT

SEQ ID NO: 50679 - protein, 30 aa, Artificial Sequence
  Description of Artificial Sequence: Synthetic polypeptide
DEDEIATTNPVAYEQYGSVATNLQRGQDDI

SEQ ID NO: 50680 - protein, 32 aa, Artificial Sequence
  Description of Artificial Sequence: Synthetic polypeptide
DEEEIRTTNPVATEQYGSVSTELQEGFGSQIS

SEQ ID NO: 50681 - protein, 32 aa, Artificial Sequence
  Description of Artificial Sequence: Synthetic polypeptide
YEEEISTTNPVATEQYGSVSYTQNSLQRPNII

SEQ ID NO: 50682 - protein, 33 aa, Artificial Sequence
  Description of Artificial Sequence: Synthetic polypeptide
DEEEIRTTNPVATEQYGSVSPTNDLTTSMNERM

SEQ ID NO: 50683 - protein, 31 aa, Artificial Sequence
  Description of Artificial Sequence: Synthetic polypeptide
DEDEIRTTNPVAYEQWGEVSTNLQGEDGNER

SEQ ID NO: 50684 - protein, 30 aa, Artificial Sequence
  Description of Artificial Sequence: Synthetic polypeptide
DEEEIRTTNPVATEQYGSVSPTNEDENIQE

SEQ ID NO: 50685 - protein, 33 aa, Artificial Sequence
  Description of Artificial Sequence: Synthetic polypeptide
DEEEIRTTNPVATEQYGSVSPTNEIQRQPEERY

SEQ ID NO: 50686 - protein, 33 aa, Artificial Sequence
  Description of Artificial Sequence: Synthetic polypeptide
DEEEIRTTNPVATEQYGSVSPTNEQARGMVQQD

SEQ ID NO: 50687 - protein, 31 aa, Artificial Sequence
  Description of Artificial Sequence: Synthetic polypeptide
DEDEIRTTNPVAYEQWGEVSTNLGQDHGNNR

SEQ ID NO: 50688 - protein, 32 aa, Artificial Sequence
  Description of Artificial Sequence: Synthetic polypeptide
DEEEIRTTNPVATEQYGSVSPTNFLNIGVELD

SEQ ID NO: 50689 - protein, 31 aa, Artificial Sequence
  Description of Artificial Sequence: Synthetic polypeptide
DEEEIRTTNPVATEQYGSVSPTNGEETNQDN

SEQ ID NO: 50690 - protein, 32 aa, Artificial Sequence
  Description of Artificial Sequence: Synthetic polypeptide
YEEEISTTNPVATEQYGSVSYTQNSLQRPNDS

SEQ ID NO: 50691 - protein, 31 aa, Artificial Sequence
  Description of Artificial Sequence: Synthetic polypeptide
YEEEISTTNPVATEQYGSVSYTNSLYQRPMT

SEQ ID NO: 50692 - protein, 31 aa, Artificial Sequence
  Description of Artificial Sequence: Synthetic polypeptide
YEEEISTTNPVATEQYGSVSYTNSLQVPNCA

SEQ ID NO: 50693 - protein, 34 aa, Artificial Sequence
  Description of Artificial Sequence: Synthetic polypeptide
DEEEIRTTNPVATEQYGSVSPTNGLDTERGENNN

SEQ ID NO: 50694 - protein, 32 aa, Artificial Sequence
  Description of Artificial Sequence: Synthetic polypeptide
DEEEIRTTNPVATEQYGSVSPTNGLIETGQLE

SEQ ID NO: 50695 - protein, 30 aa, Artificial Sequence
  Description of Artificial Sequence: Synthetic polypeptide
YEEEISTTNPVATEQYGSVSYTNSLQVDFT

SEQ ID NO: 50696 - protein, 33 aa, Artificial Sequence
  Description of Artificial Sequence: Synthetic polypeptide
DEEEIRTTNPVATEQYGSVSPTNDLLMHNGEDR

SEQ ID NO: 50697 - protein, 33 aa, Artificial Sequence
  Description of Artificial Sequence: Synthetic polypeptide
DEEEIRTTNPVATEQYGSVSPTNGLQTSNSEEM

SEQ ID NO: 50698 - protein, 34 aa, Artificial Sequence
  Description of Artificial Sequence: Synthetic polypeptide
DEEEIRTTNPVATEQYGSVSPTNDLGERTNMERD

SEQ ID NO: 50699 - protein, 31 aa, Artificial Sequence
  Description of Artificial Sequence: Synthetic polypeptide
YEEEISTTNPVATEQYGSVSYTTSLQMRPNT

SEQ ID NO: 50700 - protein, 32 aa, Artificial Sequence
  Description of Artificial Sequence: Synthetic polypeptide
YEEEISTTNPVATEQYGSVYTTDPLNQQRGNR

SEQ ID NO: 50701 - protein, 32 aa, Artificial Sequence
  Description of Artificial Sequence: Synthetic polypeptide
YEEEISTTNPVATEQYGSVYGTTNPLSARGNR

SEQ ID NO: 50702 - protein, 30 aa, Artificial Sequence
  Description of Artificial Sequence: Synthetic polypeptide
NEEEIRTTNPVATEQYGSLPETVLQRQQGR

SEQ ID NO: 50703 - protein, 31 aa, Artificial Sequence
  Description of Artificial Sequence: Synthetic polypeptide
NEEEIRTTNPVATEQYGSLCSTHLQRPEGQE

SEQ ID NO: 50704 - protein, 35 aa, Artificial Sequence
  Description of Artificial Sequence: Synthetic polypeptide
DEEEIRTTNPVATEQYGSVSPTMNLEQARDPMNRD

SEQ ID NO: 50705 - protein, 32 aa, Artificial Sequence
  Description of Artificial Sequence: Synthetic polypeptide
NEEEIRTTNPVATEQYGSIVTSIWNLEEFGNR

SEQ ID NO: 50706 - protein, 33 aa, Artificial Sequence
  Description of Artificial Sequence: Synthetic polypeptide
DEEEIRTTNPVATEQYGSVSPTMNLTVRGLEQN

SEQ ID NO: 50707 - protein, 32 aa, Artificial Sequence
  Description of Artificial Sequence: Synthetic polypeptide
YEEEISTTNPVATEQYGSVYDTTNPQNQRGNR

SEQ ID NO: 50708 - protein, 33 aa, Artificial Sequence
  Description of Artificial Sequence: Synthetic polypeptide
DEEEIRTTNPVATEQYGSVSPTMNQQLVGNFDV

SEQ ID NO: 50709 - protein, 33 aa, Artificial Sequence
  Description of Artificial Sequence: Synthetic polypeptide
YEEEISTTNPVATEQYGSVVSGTNNQQRGLNTR

SEQ ID NO: 50710 - protein, 32 aa, Artificial Sequence
  Description of Artificial Sequence: Synthetic polypeptide
YEEEISTTNPVATEQYGSVVGSTNINQRGNPE

SEQ ID NO: 50711 - protein, 32 aa, Artificial Sequence
  Description of Artificial Sequence: Synthetic polypeptide
YEEEISTTNPVATEQYGSVVGSFTNIQRGNYM

SEQ ID NO: 50712 - protein, 34 aa, Artificial Sequence
  Description of Artificial Sequence: Synthetic polypeptide
DEEEIRTTNPVATEQYGSVSPTNALQAGVVNEPL

SEQ ID NO: 50713 - protein, 32 aa, Artificial Sequence
  Description of Artificial Sequence: Synthetic polypeptide
YEEEISTTNPVATEQYGSVTSYTNSLQRMPNT

SEQ ID NO: 50714 - protein, 32 aa, Artificial Sequence
  Description of Artificial Sequence: Synthetic polypeptide
YEEEISTTNPVATEQYGSVSYTVNSLQRPANT

SEQ ID NO: 50715 - protein, 31 aa, Artificial Sequence
  Description of Artificial Sequence: Synthetic polypeptide
YEEEISTTNPVATEQYGSVSYTQPFLQRPNT

SEQ ID NO: 50716 - protein, 32 aa, Artificial Sequence
  Description of Artificial Sequence: Synthetic polypeptide
YEEEISTTNPVATEQYGSVSYTNSLQRPNNPA

SEQ ID NO: 50717 - protein, 33 aa, Artificial Sequence
  Description of Artificial Sequence: Synthetic polypeptide
DEEEIRTTNPVATEQYGSVSPTNGMQSVGENFD

SEQ ID NO: 50718 - protein, 31 aa, Artificial Sequence
  Description of Artificial Sequence: Synthetic polypeptide
YEEEISTTNPVATEQYGSVSYTNSLQRPHST

SEQ ID NO: 50719 - protein, 30 aa, Artificial Sequence
  Description of Artificial Sequence: Synthetic polypeptide
DEDEIRTTNPVAYEGWGSVSTNLQGGNEVN

SEQ ID NO: 50720 - protein, 33 aa, Artificial Sequence
  Description of Artificial Sequence: Synthetic polypeptide
DEEEIRTTNPVATEQYGSVSPTNLFRGTEEMDD

SEQ ID NO: 50721 - protein, 29 aa, Artificial Sequence
  Description of Artificial Sequence: Synthetic peptide
DEDEIRTTNPVAYEGWGSVSTNEQGGNAN

SEQ ID NO: 50722 - protein, 33 aa, Artificial Sequence
  Description of Artificial Sequence: Synthetic polypeptide
DEEEIRTTNPVATEQYGSVSPTNLGQAVPEQRE

SEQ ID NO: 50723 - protein, 32 aa, Artificial Sequence
  Description of Artificial Sequence: Synthetic polypeptide
DEEEIRTTNPVATEQYGSVSPTNLGQGLIPEI

SEQ ID NO: 50724 - protein, 33 aa, Artificial Sequence
  Description of Artificial Sequence: Synthetic polypeptide
DEEEIRTTNPVATEQYGSVSPTNLGQRLLVTEI

SEQ ID NO: 50725 - protein, 33 aa, Artificial Sequence
  Description of Artificial Sequence: Synthetic polypeptide
DEEEIRTTNPVATEQYGSVSPTNLGQRQEELID

SEQ ID NO: 50726 - protein, 32 aa, Artificial Sequence
  Description of Artificial Sequence: Synthetic polypeptide
DEEEIRTTNPVATEQYGSVSPTNLGRQLVEDV

SEQ ID NO: 50727 - protein, 31 aa, Artificial Sequence
  Description of Artificial Sequence: Synthetic polypeptide
YEEEISTTNPVATEQYGSVQTTNPIQRGNPP

SEQ ID NO: 50728 - protein, 33 aa, Artificial Sequence
  Description of Artificial Sequence: Synthetic polypeptide
DEEEIRTTNPVATEQYGSVSPTNLLQNRIPITN

SEQ ID NO: 50729 - protein, 31 aa, Artificial Sequence
  Description of Artificial Sequence: Synthetic polypeptide
YEEEISTTNPVATEQYGSVQSYNIQRGVNPM

SEQ ID NO: 50730 - protein, 30 aa, Artificial Sequence
  Description of Artificial Sequence: Synthetic polypeptide
YEEEISTTNPVATEQYGSVQSVNIQDGNPM

SEQ ID NO: 50731 - protein, 32 aa, Artificial Sequence
  Description of Artificial Sequence: Synthetic polypeptide
YEEEISTTNPVATEQYGSVQSTSNIQRGNEPM

SEQ ID NO: 50732 - protein, 30 aa, Artificial Sequence
  Description of Artificial Sequence: Synthetic polypeptide
YEEEISTTNPVATEQYGSVQSTNIVRGDPM

SEQ ID NO: 50733 - protein, 32 aa, Artificial Sequence
  Description of Artificial Sequence: Synthetic polypeptide
YEEEISTTNPVATEQYGSVQSTNITQRGHNPM

SEQ ID NO: 50734 - protein, 33 aa, Artificial Sequence
  Description of Artificial Sequence: Synthetic polypeptide
DEEEIRTTNPVATEQYGSVSPTNLEVTEGENNQ

SEQ ID NO: 50735 - protein, 31 aa, Artificial Sequence
  Description of Artificial Sequence: Synthetic polypeptide
YEEEISTTNPVATEQYGSVQYTNSLQRPNLT

SEQ ID NO: 50736 - protein, 30 aa, Artificial Sequence
  Description of Artificial Sequence: Synthetic polypeptide
YEEEISTTNPVATEQYGSVRMTNPDQRGLQ

SEQ ID NO: 50737 - protein, 33 aa, Artificial Sequence
  Description of Artificial Sequence: Synthetic polypeptide
DEEEIRTTNPVATEQYGSVSPTNLEDVNIENRQ

SEQ ID NO: 50738 - protein, 33 aa, Artificial Sequence
  Description of Artificial Sequence: Synthetic polypeptide
DEEEIRTTNPVATEQYGSVSPTNGVIRNGVVRD

SEQ ID NO: 50739 - protein, 31 aa, Artificial Sequence
  Description of Artificial Sequence: Synthetic polypeptide
DEEEIRTTNPVATEQYGSVSPTNHANSGTEM

SEQ ID NO: 50740 - protein, 31 aa, Artificial Sequence
  Description of Artificial Sequence: Synthetic polypeptide
DEEEIRTTNPVATEQYGSVSPTNHDRNEIED

SEQ ID NO: 50741 - protein, 32 aa, Artificial Sequence
  Description of Artificial Sequence: Synthetic polypeptide
DEEEIRTTNPVATEQYGSVSPTNHHQEMNEDN

SEQ ID NO: 50742 - protein, 32 aa, Artificial Sequence
  Description of Artificial Sequence: Synthetic polypeptide
YEEEISTTNPVATEQYGSVSYTNSLQRPDNDT

SEQ ID NO: 50743 - protein, 29 aa, Artificial Sequence
  Description of Artificial Sequence: Synthetic peptide
DEDEIRTTNPVAYEQWGAVATNLQHGGND

SEQ ID NO: 50744 - protein, 32 aa, Artificial Sequence
  Description of Artificial Sequence: Synthetic polypeptide
DEEEIRTTNPVATEQYGSVSPTNIERNMDIND

SEQ ID NO: 50745 - protein, 33 aa, Artificial Sequence
  Description of Artificial Sequence: Synthetic polypeptide
DEEEIRTTNPVATEQYGSVSPTMLNMIRVVNRE

SEQ ID NO: 50746 - protein, 32 aa, Artificial Sequence
  Description of Artificial Sequence: Synthetic polypeptide
DEEEIRTTNPVATEQYGSVSPTNIESNGDIRG

SEQ ID NO: 50747 - protein, 31 aa, Artificial Sequence
  Description of Artificial Sequence: Synthetic polypeptide
DEEEIRTTNPVATEQYGSVSPTNIVNELNEQ

SEQ ID NO: 50748 - protein, 33 aa, Artificial Sequence
  Description of Artificial Sequence: Synthetic polypeptide
DEEEIRTTNPVATEQYGSVSPTNLDFPGNEEHD

SEQ ID NO: 50749 - protein, 32 aa, Artificial Sequence
  Description of Artificial Sequence: Synthetic polypeptide
YEEEISTTNPVATEQYGSVSYTNSLQQRSPNT

SEQ ID NO: 50750 - protein, 31 aa, Artificial Sequence
  Description of Artificial Sequence: Synthetic polypeptide
YEEEISTTNPVATEQYGSVSYTNSLNRPNTN

SEQ ID NO: 50751 - protein, 33 aa, Artificial Sequence
  Description of Artificial Sequence: Synthetic polypeptide
DEEEIRTTNPVATEQYGSVSPTNLDQVINLEVI

SEQ ID NO: 50752 - protein, 31 aa, Artificial Sequence
  Description of Artificial Sequence: Synthetic polypeptide
YEEEISTTNPVATEQYGSVSYLNSLQGRPNT

SEQ ID NO: 50753 - protein, 33 aa, Artificial Sequence
  Description of Artificial Sequence: Synthetic polypeptide
DEEEIRTTNPVATEQYGSVSPTNLDTTRVENQM

SEQ ID NO: 50754 - protein, 31 aa, Artificial Sequence
  Description of Artificial Sequence: Synthetic polypeptide
YEEEISTTNPVATEQYGSVSYTNSLQRPATF

SEQ ID NO: 50755 - protein, 31 aa, Artificial Sequence
  Description of Artificial Sequence: Synthetic polypeptide
YEEEISTTNPVATEQYGSVYTTGPLNQRGNY

SEQ ID NO: 50756 - protein, 32 aa, Artificial Sequence
  Description of Artificial Sequence: Synthetic polypeptide
DEEEIRTTNPVATEQYGSVSPTMELNRDLLNT

SEQ ID NO: 50757 - protein, 33 aa, Artificial Sequence
  Description of Artificial Sequence: Synthetic polypeptide
DEEEIRTTNPVATEQYGSVSPTMELIQRDLIND

SEQ ID NO: 50758 - protein, 31 aa, Artificial Sequence
  Description of Artificial Sequence: Synthetic polypeptide
YEEEISTTNPVSTEQYGSVGSTGVLQEGVNR

SEQ ID NO: 50759 - protein, 33 aa, Artificial Sequence
  Description of Artificial Sequence: Synthetic polypeptide
DEEEIRTTNPVATEQYGSVSPTENLQRDDELTE

SEQ ID NO: 50760 - protein, 34 aa, Artificial Sequence
  Description of Artificial Sequence: Synthetic polypeptide
DEEEIRTTNPVATEQYGSVSPTENMLQEMNVDRS

SEQ ID NO: 50761 - protein, 31 aa, Artificial Sequence
  Description of Artificial Sequence: Synthetic polypeptide
YEEEISTTNPVGTEQYGSVGSTNIQRGNSFM

SEQ ID NO: 50762 - protein, 30 aa, Artificial Sequence
  Description of Artificial Sequence: Synthetic polypeptide
YEEEISTTNPVGTEQYGSVFCTNIQRGNPM

SEQ ID NO: 50763 - protein, 32 aa, Artificial Sequence
  Description of Artificial Sequence: Synthetic polypeptide
YEEEISTTNPVCTEQYGQSVGSTGNLQEGVNR

SEQ ID NO: 50764 - protein, 31 aa, Artificial Sequence
  Description of Artificial Sequence: Synthetic polypeptide
YEEEISTTNPVAYEQYGSVGSTNIQTRGNFM

SEQ ID NO: 50765 - protein, 32 aa, Artificial Sequence
  Description of Artificial Sequence: Synthetic polypeptide
YEEEISTTNPVAWEQYGSVGSTGNLQSVGVNR

SEQ ID NO: 50766 - protein, 28 aa, Artificial Sequence
  Description of Artificial Sequence: Synthetic peptide
YEEEISTTNPVAVEQGGSVSTDDQRTNQ

SEQ ID NO: 50767 - protein, 31 aa, Artificial Sequence
  Description of Artificial Sequence: Synthetic polypeptide
YEEEISTTNPVATTQYGSVGSTGNLQEGVDR

SEQ ID NO: 50768 - protein, 31 aa, Artificial Sequence
  Description of Artificial Sequence: Synthetic polypeptide
YEEEISTTNPVATTEGYGSFVITNLQRGERT

SEQ ID NO: 50769 - protein, 29 aa, Artificial Sequence
  Description of Artificial Sequence: Synthetic peptide
YEEEISTTNPVATRQYGQVSTLTQLRGNG

SEQ ID NO: 50770 - protein, 30 aa, Artificial Sequence
  Description of Artificial Sequence: Synthetic polypeptide
YEEEISTTNPVATHQLGSVESTNIYQRGNQ

SEQ ID NO: 50771 - protein, 31 aa, Artificial Sequence
  Description of Artificial Sequence: Synthetic polypeptide
YEEEISTTNPVATGQYGSVNSTNLEYQGNIR

SEQ ID NO: 50772 - protein, 29 aa, Artificial Sequence
  Description of Artificial Sequence: Synthetic peptide
YEEEISTTNPVATEYGGSVSTHDDQRGNQ

SEQ ID NO: 50773 - protein, 30 aa, Artificial Sequence
  Description of Artificial Sequence: Synthetic polypeptide
YEEEISTTNPYALEQYGDVSTGNLQREVNR

SEQ ID NO: 50774 - protein, 31 aa, Artificial Sequence
  Description of Artificial Sequence: Synthetic polypeptide
YEEEISTTNPYVATEQYGSVNHTNLEQGNNR

SEQ ID NO: 50775 - protein, 31 aa, Artificial Sequence
  Description of Artificial Sequence: Synthetic polypeptide
YEEEISTTNPYVATWQYGSVNSTNLEVGNIR

SEQ ID NO: 50776 - protein, 35 aa, Artificial Sequence
  Description of Artificial Sequence: Synthetic polypeptide
DEEEIRTTNPVATEQYGSVSPTENELQQARGQLRD

SEQ ID NO: 50777 - protein, 30 aa, Artificial Sequence
  Description of Artificial Sequence: Synthetic polypeptide
YEEEVSTTNPVATEQYGCVFSTNIQRGNPM

SEQ ID NO: 50778 - protein, 32 aa, Artificial Sequence
  Description of Artificial Sequence: Synthetic polypeptide
DEEEIRTTNPVATEQYGSVSPTDNIVFNSNIR

SEQ ID NO: 50779 - protein, 34 aa, Artificial Sequence
  Description of Artificial Sequence: Synthetic polypeptide
DEEEIRTTNPVATEQYGSVSPTDNLTQTFNSDRG

SEQ ID NO: 50780 - protein, 30 aa, Artificial Sequence
  Description of Artificial Sequence: Synthetic polypeptide
NEEEIRTTNPVATEQYGSLSTHLQERQEET

SEQ ID NO: 50781 - protein, 28 aa, Artificial Sequence
  Description of Artificial Sequence: Synthetic peptide
ADNEIASTNPVATEQYGNVSENLQRGQR

SEQ ID NO: 50782 - protein, 29 aa, Artificial Sequence
  Description of Artificial Sequence: Synthetic peptide
YEEELSTTNPGATEQYGQVSTLLQLRGNG

SEQ ID NO: 50783 - protein, 31 aa, Artificial Sequence
  Description of Artificial Sequence: Synthetic polypeptide
YEEEIVTTNPVATEQYGSVVESTNPYQKGNQ

SEQ ID NO: 50784 - protein, 35 aa, Artificial Sequence
  Description of Artificial Sequence: Synthetic polypeptide
DEEEIRTTNPVATEQYGSVSPTFNLLQQRGDNNEE

SEQ ID NO: 50785 - protein, 30 aa, Artificial Sequence
  Description of Artificial Sequence: Synthetic polypeptide
NESEIRTTNPVATEAYGSVWTNLSQTVGSR

SEQ ID NO: 50786 - protein, 30 aa, Artificial Sequence
  Description of Artificial Sequence: Synthetic polypeptide
NEEEIRTTNPVATEQYGSLSTHLERQEGRE

SEQ ID NO: 50787 - protein, 30 aa, Artificial Sequence
  Description of Artificial Sequence: Synthetic polypeptide
NEEEIRTTNPVATEQYGSLSTHLEREDGQE

SEQ ID NO: 50788 - protein, 30 aa, Artificial Sequence
  Description of Artificial Sequence: Synthetic polypeptide
NEEEIRTTNPVATEQYGSLSTELQRFQSEQ

SEQ ID NO: 50789 - protein, 34 aa, Artificial Sequence
  Description of Artificial Sequence: Synthetic polypeptide
DEEEIRTTNPVATEQYGSVSPTDSLQERQGNVND

SEQ ID NO: 50790 - protein, 32 aa, Artificial Sequence
  Description of Artificial Sequence: Synthetic polypeptide
DEEEIRTTNPVATEQYGSVSPTELTLQQMVND

SEQ ID NO: 50791 - protein, 29 aa, Artificial Sequence
  Description of Artificial Sequence: Synthetic peptide
NEEEIRTTNPVATEQYGSLSLTHQQRQGQ

SEQ ID NO: 50792 - protein, 32 aa, Artificial Sequence
  Description of Artificial Sequence: Synthetic polypeptide
YEEEISTVNPVATEQYGSVWSGTNQQRGLNTR

SEQ ID NO: 50793 - protein, 34 aa, Artificial Sequence
  Description of Artificial Sequence: Synthetic polypeptide
DEEEIRTTNPVATEQYGSVSPTDNNIQRLNSNIR

SEQ ID NO: 50794 - protein, 30 aa, Artificial Sequence
  Description of Artificial Sequence: Synthetic polypeptide
YEEEISTTNPVATEQYGSVQSTNIQRPMPM

SEQ ID NO: 50795 - protein, 31 aa, Artificial Sequence
  Description of Artificial Sequence: Synthetic polypeptide
YEEEISTTNPVATEWYGSVGSTGPLQEGVNR

SEQ ID NO: 50796 - protein, 31 aa, Artificial Sequence
  Description of Artificial Sequence: Synthetic polypeptide
YEEEISTTNPVATETYGSVPSQTNLIRDNRS

SEQ ID NO: 50797 - protein, 33 aa, Artificial Sequence
  Description of Artificial Sequence: Synthetic polypeptide
DEEEIRTTNPVATEQYGSVSPTLLQVRDLNSGE

SEQ ID NO: 50798 - protein, 32 aa, Artificial Sequence
  Description of Artificial Sequence: Synthetic polypeptide
YEEEISTTNPVATEQYGTSVPSTNLIRDNPRS

SEQ ID NO: 50799 - protein, 31 aa, Artificial Sequence
  Description of Artificial Sequence: Synthetic polypeptide
YEEEISTTNPVATEQYGSVYTWNPLNAHGNR

SEQ ID NO: 50800 - protein, 32 aa, Artificial Sequence
  Description of Artificial Sequence: Synthetic polypeptide
YEEEISTTNPVATEQYGSVYTVNPLNARGNGR

SEQ ID NO: 50801 - protein, 31 aa, Artificial Sequence
  Description of Artificial Sequence: Synthetic polypeptide
YEEEISTTNPVATEQYGSVYTTPVLNARGNR

SEQ ID NO: 50802 - protein, 31 aa, Artificial Sequence
  Description of Artificial Sequence: Synthetic polypeptide
YEEEISTTNPVATEQYGSVYTTNPLYARGDR

SEQ ID NO: 50803 - protein, 31 aa, Artificial Sequence
  Description of Artificial Sequence: Synthetic polypeptide
DEEEIRTTNPVATEQYGSVSPTLLSQVEEEG

SEQ ID NO: 50804 - protein, 32 aa, Artificial Sequence
  Description of Artificial Sequence: Synthetic polypeptide
YEEEISTTNPVATEQYGSVYTTNPLNQRGPTR

SEQ ID NO: 50805 - protein, 32 aa, Artificial Sequence
  Description of Artificial Sequence: Synthetic polypeptide
YEEEISTTNPVATEQYGSVYTTNPLNQRGANF

SEQ ID NO: 50806 - protein, 32 aa, Artificial Sequence
  Description of Artificial Sequence: Synthetic polypeptide
YEEEISTTNPVATEQYGSVYTTNPLNQRAGLR

SEQ ID NO: 50807 - protein, 32 aa, Artificial Sequence
  Description of Artificial Sequence: Synthetic polypeptide
YEEEISTTNPVATEQYGSVYTTNPLNQPRGNH

SEQ ID NO: 50808 - protein, 33 aa, Artificial Sequence
  Description of Artificial Sequence: Synthetic polypeptide
YEEEISTTNPVATEQYGSVYTTNPLNQLRGNRM

SEQ ID NO: 50809 - protein, 32 aa, Artificial Sequence
  Description of Artificial Sequence: Synthetic polypeptide
YEEEISTTNPVATEQYGSVYTTNPLNQAVGNR

SEQ ID NO: 50810 - protein, 31 aa, Artificial Sequence
  Description of Artificial Sequence: Synthetic polypeptide
DEEEIRTTNPVATEQYGSVSPTLQRVMVPEI

SEQ ID NO: 50811 - protein, 33 aa, Artificial Sequence
  Description of Artificial Sequence: Synthetic polypeptide
DEEEIRTTNPVATEQYGSVSPTMDEQRVGPNIE

SEQ ID NO: 50812 - protein, 31 aa, Artificial Sequence
  Description of Artificial Sequence: Synthetic polypeptide
YEEEISTTNPVATEQYGTVYTTNPLNMRGNR

SEQ ID NO: 50813 - protein, 32 aa, Artificial Sequence
  Description of Artificial Sequence: Synthetic polypeptide
YEEEISTTNPVATEQYGVSVNSTCNLEQGNIR

SEQ ID NO: 50814 - protein, 32 aa, Artificial Sequence
  Description of Artificial Sequence: Synthetic polypeptide
DEEEIRTTNPVATEQYGSVSPTLLQDDLNAQE

SEQ ID NO: 50815 - protein, 31 aa, Artificial Sequence
  Description of Artificial Sequence: Synthetic polypeptide
YEEEISTTNPVATEQYGVVQSTTNIQRGNPM

SEQ ID NO: 50816 - protein, 32 aa, Artificial Sequence
  Description of Artificial Sequence: Synthetic polypeptide
DEEEIRTTNPVATEQYGSVSPTFSMQNRGVEL

SEQ ID NO: 50817 - protein, 33 aa, Artificial Sequence
  Description of Artificial Sequence: Synthetic polypeptide
DEEEIRTTNPVATEQYGSVSPTGLHRVDPNLRD

SEQ ID NO: 50818 - protein, 31 aa, Artificial Sequence
  Description of Artificial Sequence: Synthetic polypeptide
DEEEIRTTNPVATEQYGSVSPTGLMPGVEDF

SEQ ID NO: 50819 - protein, 30 aa, Artificial Sequence
  Description of Artificial Sequence: Synthetic polypeptide
YEEEISTTNPVATESYGSCSYTNSLQRPNT

SEQ ID NO: 50820 - protein, 32 aa, Artificial Sequence
  Description of Artificial Sequence: Synthetic polypeptide
DEEEIRTTNPVATEQYGSVSPTGNLARDVLEA

SEQ ID NO: 50821 - protein, 30 aa, Artificial Sequence
  Description of Artificial Sequence: Synthetic polypeptide
YEEEISTTNPVATERYGSVPSTNLIRDIRS

SEQ ID NO: 50822 - protein, 31 aa, Artificial Sequence
  Description of Artificial Sequence: Synthetic polypeptide
DEEEIRTTNPVATEQYGSVSPTGPIQQLGVE

SEQ ID NO: 50823 - protein, 33 aa, Artificial Sequence
  Description of Artificial Sequence: Synthetic polypeptide
DEEEIRTTNPVATEQYGSVSPTFQGIQRVTNRM

SEQ ID NO: 50824 - protein, 33 aa, Artificial Sequence
  Description of Artificial Sequence: Synthetic polypeptide
DEEEIRTTNPVATEQYGSVSPTGPLHRGENETL

SEQ ID NO: 50825 - protein, 31 aa, Artificial Sequence
  Description of Artificial Sequence: Synthetic polypeptide
YEEEISTTNPVATERYGSVESTNPYQRGNQN

SEQ ID NO: 50826 - protein, 31 aa, Artificial Sequence
  Description of Artificial Sequence: Synthetic polypeptide
DEEEIRTTNPVATEQYGSVSPTIGQEREEVL

SEQ ID NO: 50827 - protein, 32 aa, Artificial Sequence
  Description of Artificial Sequence: Synthetic polypeptide
YEEEISTTNPVATEQYWGGSVESTNPYQRGNQ

SEQ ID NO: 50828 - protein, 32 aa, Artificial Sequence
  Description of Artificial Sequence: Synthetic polypeptide
YEEEISTTNPVATEQYSSVGSTGNLQENGFNR

SEQ ID NO: 50829 - protein, 30 aa, Artificial Sequence
  Description of Artificial Sequence: Synthetic polypeptide
YEEEISTTNPVATEQYGYVESTYPYQRGNQ

SEQ ID NO: 50830 - protein, 32 aa, Artificial Sequence
  Description of Artificial Sequence: Synthetic polypeptide
DEEEIRTTNPVATEQYGSVSPTLGPQRDEVRV

SEQ ID NO: 50831 - protein, 31 aa, Artificial Sequence
  Description of Artificial Sequence: Synthetic polypeptide
YEEEISTTNPVATEQYGWVYTTNPLNQRINR

SEQ ID NO: 50832 - protein, 32 aa, Artificial Sequence
  Description of Artificial Sequence: Synthetic polypeptide
DEEEIRTTNPVATEQYGSVSPTGVLEMGEIRI

SEQ ID NO: 50833 - protein, 31 aa, Artificial Sequence
  Description of Artificial Sequence: Synthetic polypeptide
DEEEIRTTNPVATEQYGSVSPTDMIQNGEIE

SEQ ID NO: 50834 - protein, 31 aa, Artificial Sequence
  Description of Artificial Sequence: Synthetic polypeptide
YEEEISTTNPVATEQYGSVQSTNIQHGNIPM

SEQ ID NO: 50835 - protein, 33 aa, Artificial Sequence
  Description of Artificial Sequence: Synthetic polypeptide
DEEEIRTTNPVATEQYGSVSPTNLPGVEVLNRV

SEQ ID NO: 50836 - protein, 30 aa, Artificial Sequence
  Description of Artificial Sequence: Synthetic polypeptide
NESEIRTTNPVATEQYGSLSTHLQRQGDQE

SEQ ID NO: 50837 - protein, 31 aa, Artificial Sequence
  Description of Artificial Sequence: Synthetic polypeptide
YEEEISTTNPVATEQYGSVESTNPQQRGLAQ

SEQ ID NO: 50838 - protein, 31 aa, Artificial Sequence
  Description of Artificial Sequence: Synthetic polypeptide
YEEEISTTNPVATEQYGSVESTNFPEQRGLQ

SEQ ID NO: 50839 - protein, 31 aa, Artificial Sequence
  Description of Artificial Sequence: Synthetic polypeptide
YEEEISTTNPVATEQYGSVESDTNPYQRANQ

SEQ ID NO: 50840 - protein, 30 aa, Artificial Sequence
  Description of Artificial Sequence: Synthetic polypeptide
YEEEISTTNPVATEQYGSVEMTNPYPRGNQ

SEQ ID NO: 50841 - protein, 31 aa, Artificial Sequence
  Description of Artificial Sequence: Synthetic polypeptide
YEEEISTTNPVATEQYGSVDTTNPLNARGIR

SEQ ID NO: 50842 - protein, 30 aa, Artificial Sequence
  Description of Artificial Sequence: Synthetic polypeptide
YEEEISTTNPVATEQYGSVAMTNPYQRGLI

SEQ ID NO: 50843 - protein, 31 aa, Artificial Sequence
  Description of Artificial Sequence: Synthetic polypeptide
YEEEISTTNPVATEQYGSTVPSTNLIEDNRS

SEQ ID NO: 50844 - protein, 31 aa, Artificial Sequence
  Description of Artificial Sequence: Synthetic polypeptide
YEEEISTTNPVATEQYGSTVEATNIYQRGNQ

SEQ ID NO: 50845 - protein, 31 aa, Artificial Sequence
  Description of Artificial Sequence: Synthetic polypeptide
YEEEISTTNPVATEQYGSTGSTNIQRGDNFM

SEQ ID NO: 50846 - protein, 33 aa, Artificial Sequence
  Description of Artificial Sequence: Synthetic polypeptide
DEEEIRTTNPVATEQYGSVSPTPHDLQRDNIEG

SEQ ID NO: 50847 - protein, 32 aa, Artificial Sequence
  Description of Artificial Sequence: Synthetic polypeptide
YEEEISTTNPVATEQYGSMVKSGTNQQRGLDR

SEQ ID NO: 50848 - protein, 31 aa, Artificial Sequence
  Description of Artificial Sequence: Synthetic polypeptide
YEEEISTTNPVATEQYGSEPSTNLIRDNGRS

SEQ ID NO: 50849 - protein, 30 aa, Artificial Sequence
  Description of Artificial Sequence: Synthetic polypeptide
DEEEIRTTNPVATEQYGSVSPTPLESIDFS

SEQ ID NO: 50850 - protein, 32 aa, Artificial Sequence
  Description of Artificial Sequence: Synthetic polypeptide
YEEEISTTNPVATEQYGSDVNSTNLETQGNIR

SEQ ID NO: 50851 - protein, 32 aa, Artificial Sequence
  Description of Artificial Sequence: Synthetic polypeptide
YEEEISTTNPVATEQYGSVESTNPYQRDGNTQ

SEQ ID NO: 50852 - protein, 31 aa, Artificial Sequence
  Description of Artificial Sequence: Synthetic polypeptide
YEEEISTTNPVATEQYGQVSTWLLQLRGNGN

SEQ ID NO: 50853 - protein, 34 aa, Artificial Sequence
  Description of Artificial Sequence: Synthetic polypeptide
DEEEIRTTNPVATEQYGSVSPTNVVLQRMVENED

SEQ ID NO: 50854 - protein, 33 aa, Artificial Sequence
  Description of Artificial Sequence: Synthetic polypeptide
DEEEIRTTNPVATEQYGSVSPTNVQVRDNDDEE

SEQ ID NO: 50855 - protein, 31 aa, Artificial Sequence
  Description of Artificial Sequence: Synthetic polypeptide
YEEEISTTNPVATEQYGSVGNTSNIQRGNPM

SEQ ID NO: 50856 - protein, 32 aa, Artificial Sequence
  Description of Artificial Sequence: Synthetic polypeptide
NEEEIRTTNPVATEQYGSISCTHLSQRVTGNQ

SEQ ID NO: 50857 - protein, 32 aa, Artificial Sequence
  Description of Artificial Sequence: Synthetic polypeptide
NEEEIRTTNPVATEQYGSISCTHHQRTVGENR

SEQ ID NO: 50858 - protein, 30 aa, Artificial Sequence
  Description of Artificial Sequence: Synthetic polypeptide
YEEEISTTNPVATEQYGSVFSVNIQRGEPM

SEQ ID NO: 50859 - protein, 30 aa, Artificial Sequence
  Description of Artificial Sequence: Synthetic polypeptide
NEEEIRTTNPVATEQYGSICSTELQRQSGA

SEQ ID NO: 50860 - protein, 33 aa, Artificial Sequence
  Description of Artificial Sequence: Synthetic polypeptide
DEEEIRTTNPVATEQYGSVSPTNVDSYGNTQRG

SEQ ID NO: 50861 - protein, 31 aa, Artificial Sequence
  Description of Artificial Sequence: Synthetic polypeptide
YEEEISTTNPVATEQYGSVFSTVIQPRGNPM

SEQ ID NO: 50862 - protein, 31 aa, Artificial Sequence
  Description of Artificial Sequence: Synthetic polypeptide
YEEEISTTNPVATEQYGSVFSTNIQRANDPM

SEQ ID NO: 50863 - protein, 32 aa, Artificial Sequence
  Description of Artificial Sequence: Synthetic polypeptide
DEEEIRTTNPVATEQYGSVSPTNVNDYGNTSQ

SEQ ID NO: 50864 - protein, 31 aa, Artificial Sequence
  Description of Artificial Sequence: Synthetic polypeptide
DEDEIRTTNPVATQQYGCVSCTNLSTRGNNP

SEQ ID NO: 50865 - protein, 31 aa, Artificial Sequence
  Description of Artificial Sequence: Synthetic polypeptide
DEEEIRTTNPVATEQYGSVSPTNVQFNDDEE

SEQ ID NO: 50866 - protein, 31 aa, Artificial Sequence
  Description of Artificial Sequence: Synthetic polypeptide
YEEEISTTNPVATEQYGSVFSTNIQLRGFPM

SEQ ID NO: 50867 - protein, 32 aa, Artificial Sequence
  Description of Artificial Sequence: Synthetic polypeptide
DEEEIRTTNPVATEQYGSVSPTNVQIQGSQDI

SEQ ID NO: 50868 - protein, 32 aa, Artificial Sequence
  Description of Artificial Sequence: Synthetic polypeptide
YEEEISTTNPVATEQYGSVFSTNIDQRGINPM

SEQ ID NO: 50869 - protein, 30 aa, Artificial Sequence
  Description of Artificial Sequence: Synthetic polypeptide
YEEEISTTNPVATEQYGSVESVNPYQHGNQ

SEQ ID NO: 50870 - protein, 31 aa, Artificial Sequence
  Description of Artificial Sequence: Synthetic polypeptide
YEEEISTTNPVATEQYGSVESTNPYQYGNIQ

SEQ ID NO: 50871 - protein, 33 aa, Artificial Sequence
  Description of Artificial Sequence: Synthetic polypeptide
DEEEIRTTNPVATEQYGSVSPTPLPQGGEMPNT

SEQ ID NO: 50872 - protein, 31 aa, Artificial Sequence
  Description of Artificial Sequence: Synthetic polypeptide
DEDEIRTTNPVATESWGSVSTNLQLGGDNNQ

SEQ ID NO: 50873 - protein, 32 aa, Artificial Sequence
  Description of Artificial Sequence: Synthetic polypeptide
DEEEIRTTNPVATEQYGSVSPTPLQHIVENLA

SEQ ID NO: 50874 - protein, 31 aa, Artificial Sequence
  Description of Artificial Sequence: Synthetic polypeptide
DEEEIRTTNPVATEQYGSVSPTQLESEEFNF

SEQ ID NO: 50875 - protein, 30 aa, Artificial Sequence
  Description of Artificial Sequence: Synthetic polypeptide
YEEEISTTNPVATEQYGEVSYVNSLQRPNT

SEQ ID NO: 50876 - protein, 32 aa, Artificial Sequence
  Description of Artificial Sequence: Synthetic polypeptide
DEEEIRTTNPVATEQYGSVSPTQVQRTLETMR

SEQ ID NO: 50877 - protein, 30 aa, Artificial Sequence
  Description of Artificial Sequence: Synthetic polypeptide
YEEEISTTNPVATEQYGDGGSTNIQRGNPM

SEQ ID NO: 50878 - protein, 32 aa, Artificial Sequence
  Description of Artificial Sequence: Synthetic polypeptide
DEEEIRTTNPVATEQYGSVSPTSFLQQINENS

SEQ ID NO: 50879 - protein, 32 aa, Artificial Sequence
  Description of Artificial Sequence: Synthetic polypeptide
DEEEIRTTNPVATEQYGSVSPTSLERVGVTEA

SEQ ID NO: 50880 - protein, 34 aa, Artificial Sequence
  Description of Artificial Sequence: Synthetic polypeptide
DEEEIRTTNPVATEQYGSVSPTSNDLQAQGENTD

SEQ ID NO: 50881 - protein, 31 aa, Artificial Sequence
  Description of Artificial Sequence: Synthetic polypeptide
YEEEISTTNPVATEQYGCVSYTQNSLQRFNT

SEQ ID NO: 50882 - protein, 32 aa, Artificial Sequence
  Description of Artificial Sequence: Synthetic polypeptide
DEEEIRTTNPVATEQYGSVSPTSNSSQTGVEL

SEQ ID NO: 50883 - protein, 30 aa, Artificial Sequence
  Description of Artificial Sequence: Synthetic polypeptide
DEEEIRTTNPVATEQYGSVSPTSSQINVEL

SEQ ID NO: 50884 - protein, 32 aa, Artificial Sequence
  Description of Artificial Sequence: Synthetic polypeptide
YEEEISTTNPVATEQYGCSVESTNPYQRFGNQ

SEQ ID NO: 50885 - protein, 30 aa, Artificial Sequence
  Description of Artificial Sequence: Synthetic polypeptide
YEEEISTTNPVATEQYGAVSYTNSLVRPNT

SEQ ID NO: 50886 - protein, 30 aa, Artificial Sequence
  Description of Artificial Sequence: Synthetic polypeptide
YEEEISTTNPVATEQYGAVGSTNIQAGNPM

SEQ ID NO: 50887 - protein, 32 aa, Artificial Sequence
  Description of Artificial Sequence: Synthetic polypeptide
DEEEIRTTNPVATEQYGSVSPTSVQIGENGLD

SEQ ID NO: 50888 - protein, 32 aa, Artificial Sequence
  Description of Artificial Sequence: Synthetic polypeptide
YEEEISTTNPVATEQYGASVSYTHNSLQRPNT

SEQ ID NO: 50889 - protein, 30 aa, Artificial Sequence
  Description of Artificial Sequence: Synthetic polypeptide
YEEEISTTNPVATEQYGIVNSTNSEQGNIR

SEQ ID NO: 50890 - protein, 30 aa, Artificial Sequence
  Description of Artificial Sequence: Synthetic polypeptide
YEEEISTTNPVATEQYGIVQSTNIGRGNPM

SEQ ID NO: 50891 - protein, 30 aa, Artificial Sequence
  Description of Artificial Sequence: Synthetic polypeptide
DEEEIRTTNPVATEQYGSVSPTQLESDEDQ

SEQ ID NO: 50892 - protein, 31 aa, Artificial Sequence
  Description of Artificial Sequence: Synthetic polypeptide
YEEEISTTNPVATEQYGIVSPTNSLQRPNTA

SEQ ID NO: 50893 - protein, 32 aa, Artificial Sequence
  Description of Artificial Sequence: Synthetic polypeptide
DEEEIRTTNPVATEQYGSVSPTPLQIVENQLT

SEQ ID NO: 50894 - protein, 30 aa, Artificial Sequence
  Description of Artificial Sequence: Synthetic polypeptide
YEEEISTTNPVATEQYGQVSTLVEQLRGNG

SEQ ID NO: 50895 - protein, 29 aa, Artificial Sequence
  Description of Artificial Sequence: Synthetic peptide
YEEEISTTNPVATEQYGQVSTLLQLEDNG

SEQ ID NO: 50896 - protein, 30 aa, Artificial Sequence
  Description of Artificial Sequence: Synthetic polypeptide
YEEEISTTNPVATEQYGQVSTLLMLRTGNG

SEQ ID NO: 50897 - protein, 31 aa, Artificial Sequence
  Description of Artificial Sequence: Synthetic polypeptide
DEDEIRTTNPVATEQYGVVTVSTVNLQAGTS

SEQ ID NO: 50898 - protein, 31 aa, Artificial Sequence
  Description of Artificial Sequence: Synthetic polypeptide
DEDEIRTTNPVATEQYGVVTTSTNLQAGVTS

SEQ ID NO: 50899 - protein, 31 aa, Artificial Sequence
  Description of Artificial Sequence: Synthetic polypeptide
DEDEIRTTNPVATEQYGVVTSTTNLQAGTSG

SEQ ID NO: 50900 - protein, 32 aa, Artificial Sequence
  Description of Artificial Sequence: Synthetic polypeptide
DEEEIRTTNPVATEQYGSVSPTNTQQEVVFRT

SEQ ID NO: 50901 - protein, 30 aa, Artificial Sequence
  Description of Artificial Sequence: Synthetic polypeptide
YEEEISTTNPVATEQYGQVSTLLHVLRGNG

SEQ ID NO: 50902 - protein, 31 aa, Artificial Sequence
  Description of Artificial Sequence: Synthetic polypeptide
DEEEIRTTNPVATEQYGSVSPTPVHQRLESE

SEQ ID NO: 50903 - protein, 30 aa, Artificial Sequence
  Description of Artificial Sequence: Synthetic polypeptide
YEEEISTTNPVATEQYGQVSTCLLGLRGNG

SEQ ID NO: 50904 - protein, 28 aa, Artificial Sequence
  Description of Artificial Sequence: Synthetic peptide
AEAEIACTNPVATEQYGEASENLQRGGR

SEQ ID NO: 50905 - protein, 32 aa, Artificial Sequence
  Description of Artificial Sequence: Synthetic polypeptide
YEEEISTTNPVATEQYGMVYTTNPLNQRGNGR

SEQ ID NO: 50906 - protein, 32 aa, Artificial Sequence
  Description of Artificial Sequence: Synthetic polypeptide
DEEEIRTTNPVATEQYGSVSPTQLEESEGDQR

SEQ ID NO: 50907 - protein, 28 aa, Artificial Sequence
  Description of Artificial Sequence: Synthetic peptide
AEAEIACTNPVATEQYGECSENLQRGGR

SEQ ID NO: 50908 - protein, 33 aa, Artificial Sequence
  Description of Artificial Sequence: Synthetic polypeptide
YEEEISTTNPVATEQYGLSVGSTGNLQEGVNDR

SEQ ID NO: 50909 - protein, 31 aa, Artificial Sequence
  Description of Artificial Sequence: Synthetic polypeptide
YEEEISTTNPVATEQYGQVSTDLLQLRGENG

SEQ ID NO: 50910 - protein, 33 aa, Artificial Sequence
  Description of Artificial Sequence: Synthetic polypeptide
DEEEIRTTNPVATEQYGSVSPTNTPQRNMENAE

SEQ ID NO: 50911 - protein, 32 aa, Artificial Sequence
  Description of Artificial Sequence: Synthetic polypeptide
DEEEIRTTNPVATEQYGSVSPTNTNSGGDNDP

SEQ ID NO: 50912 - protein, 32 aa, Artificial Sequence
  Description of Artificial Sequence: Synthetic polypeptide
DEEEIRTTNPVATEQYGSVSPTNTNQRNMEFE

SEQ ID NO: 50913 - protein, 33 aa, Artificial Sequence
  Description of Artificial Sequence: Synthetic polypeptide
DEEEIRTTNPVATEQYGSVSPTNMNQRTGEVAQ

SEQ ID NO: 50914 - protein, 32 aa, Artificial Sequence
  Description of Artificial Sequence: Synthetic polypeptide
DEEEIRTTNPVATEQYGSVSPTNMQRQDEEME

SEQ ID NO: 50915 - protein, 32 aa, Artificial Sequence
  Description of Artificial Sequence: Synthetic polypeptide
YEEEISTTNPVATEQYGSVPSTNLIERTDNRS

SEQ ID NO: 50916 - protein, 32 aa, Artificial Sequence
  Description of Artificial Sequence: Synthetic polypeptide
YEEEISTTNPVATEQYGSVPSTNLGIRDNLRS

SEQ ID NO: 50917 - protein, 30 aa, Artificial Sequence
  Description of Artificial Sequence: Synthetic polypeptide
YEEEISTTNPVATEQYGSVPSTCNIRDNRS

SEQ ID NO: 50918 - protein, 32 aa, Artificial Sequence
  Description of Artificial Sequence: Synthetic polypeptide
DEEEIRTTNPVATEQYGSVSPTNNDRQLEEPR

SEQ ID NO: 50919 - protein, 32 aa, Artificial Sequence
  Description of Artificial Sequence: Synthetic polypeptide
DEDEIRTTNPVATTQYGSVSTTQQNLQTGNDE

SEQ ID NO: 50920 - protein, 31 aa, Artificial Sequence
  Description of Artificial Sequence: Synthetic polypeptide
DEDEIRTTNPVATTQYGSVSTTQQLQTGGND

SEQ ID NO: 50921 - protein, 32 aa, Artificial Sequence
  Description of Artificial Sequence: Synthetic polypeptide
YEEEISTTNPVATEQYGSVNSTWNLPEFGNIR

SEQ ID NO: 50922 - protein, 31 aa, Artificial Sequence
  Description of Artificial Sequence: Synthetic polypeptide
YEEEISTTNPVATEQYGSVNSTNMLEQGNIS

SEQ ID NO: 50923 - protein, 33 aa, Artificial Sequence
  Description of Artificial Sequence: Synthetic polypeptide
DEEEIRTTNPVATEQYGSVSPTNNEQPNGELRY

SEQ ID NO: 50924 - protein, 32 aa, Artificial Sequence
  Description of Artificial Sequence: Synthetic polypeptide
DEDEIRTTNPVATTQYGSVSTTQNLQTGNNDM

SEQ ID NO: 50925 - protein, 31 aa, Artificial Sequence
  Description of Artificial Sequence: Synthetic polypeptide
YEEEISTTNPVATEQYGSVNSTNLEQGHEIR

SEQ ID NO: 50926 - protein, 31 aa, Artificial Sequence
  Description of Artificial Sequence: Synthetic polypeptide
DEDEIRTTNPVATTQYGSVSTTQLQQGNGND

SEQ ID NO: 50927 - protein, 31 aa, Artificial Sequence
  Description of Artificial Sequence: Synthetic polypeptide
YEEEISTTNPVATEQYGSVNSTNLELQGNIV

SEQ ID NO: 50928 - protein, 32 aa, Artificial Sequence
  Description of Artificial Sequence: Synthetic polypeptide
YEEEISTTNPVATEQYGSVPSTNLIIRDQNRS

SEQ ID NO: 50929 - protein, 31 aa, Artificial Sequence
  Description of Artificial Sequence: Synthetic polypeptide
YEEEISTTNPVATEQYGSVPSTNLILDNERS

SEQ ID NO: 50930 - protein, 31 aa, Artificial Sequence
  Description of Artificial Sequence: Synthetic polypeptide
DEEEIRTTNPVATEQYGSVSPTNMIDNLEIR

SEQ ID NO: 50931 - protein, 31 aa, Artificial Sequence
  Description of Artificial Sequence: Synthetic polypeptide
YEEEISTTNPVATEQYGSVPSTNLVIRDVRS

SEQ ID NO: 50932 - protein, 30 aa, Artificial Sequence
  Description of Artificial Sequence: Synthetic polypeptide
DEDEIRTTNPVAYECWGSVSTNLQDGGNVN

SEQ ID NO: 50933 - protein, 32 aa, Artificial Sequence
  Description of Artificial Sequence: Synthetic polypeptide
DEEEIRTTNPVATEQYGSVSPTNLPPHQEEVD

SEQ ID NO: 50934 - protein, 33 aa, Artificial Sequence
  Description of Artificial Sequence: Synthetic polypeptide
DEEEIRTTNPVATEQYGSVSPTNLPQNITQEVR

SEQ ID NO: 50935 - protein, 32 aa, Artificial Sequence
  Description of Artificial Sequence: Synthetic polypeptide
YEEEISTTNPVATEQYGSVQSTGNIDQRGNPM

SEQ ID NO: 50936 - protein, 32 aa, Artificial Sequence
  Description of Artificial Sequence: Synthetic polypeptide
DEEEIRTTNPVATEQYGSVSPTNLQGLLTEMD

SEQ ID NO: 50937 - protein, 32 aa, Artificial Sequence
  Description of Artificial Sequence: Synthetic polypeptide
DEEEIRTTNPVATEQYGSVSPTNLQHALQIQD

SEQ ID NO: 50938 - protein, 30 aa, Artificial Sequence
  Description of Artificial Sequence: Synthetic polypeptide
YEEEISTTNPVATEQYGSVQSSNIQRGIPM

SEQ ID NO: 50939 - protein, 31 aa, Artificial Sequence
  Description of Artificial Sequence: Synthetic polypeptide
YEEEISTTNPVATEQYGSVLSYTNSLQNPNT

SEQ ID NO: 50940 - protein, 31 aa, Artificial Sequence
  Description of Artificial Sequence: Synthetic polypeptide
YEEEISTTNPVATEQYGSVQSEYNGQRGNPM

SEQ ID NO: 50941 - protein, 29 aa, Artificial Sequence
  Description of Artificial Sequence: Synthetic peptide
DEDEIRTTNPVATTQYGVVSTNLEETNNP

SEQ ID NO: 50942 - protein, 30 aa, Artificial Sequence
  Description of Artificial Sequence: Synthetic polypeptide
DEDEIRTTNPVATTQYGVVSTNLEEGNNVD

SEQ ID NO: 50943 - protein, 30 aa, Artificial Sequence
  Description of Artificial Sequence: Synthetic polypeptide
DEDEIRTTNPVATTQYGVVSTNLEEGNNNM

SEQ ID NO: 50944 - protein, 30 aa, Artificial Sequence
  Description of Artificial Sequence: Synthetic polypeptide
DEDEIRTTNPVATTQYGVVSTNLEEGGNQD

SEQ ID NO: 50945 - protein, 30 aa, Artificial Sequence
  Description of Artificial Sequence: Synthetic polypeptide
DEDEIRTTNPVATTQYGVVSTNLEEGENGS

SEQ ID NO: 50946 - protein, 32 aa, Artificial Sequence
  Description of Artificial Sequence: Synthetic polypeptide
DEEEIRTTNPVATEQYGSVSPTNMDQDMENME

SEQ ID NO: 50947 - protein, 31 aa, Artificial Sequence
  Description of Artificial Sequence: Synthetic polypeptide
YEEEISTTNPVATEQYGSVQMTNIQRGNMPM

SEQ ID NO: 50948 - protein, 33 aa, Artificial Sequence
  Description of Artificial Sequence: Synthetic polypeptide
DEEEIRTTNPVATEQYGSVSPTNLVQSVGEQQE

SEQ ID NO: 50949 - protein, 32 aa, Artificial Sequence
  Description of Artificial Sequence: Synthetic polypeptide
DEEEIRTTNPVATEQYGSVSPTNLPDGLEIEV

SEQ ID NO: 50950 - protein, 32 aa, Artificial Sequence
  Description of Artificial Sequence: Synthetic polypeptide
YEEEISTTNPVATEQYGSVKSRTNQQRGLNTD

SEQ ID NO: 50951 - protein, 30 aa, Artificial Sequence
  Description of Artificial Sequence: Synthetic polypeptide
NEEEIRTTNPVATEQYGSISTMELQRQSGQ

SEQ ID NO: 50952 - protein, 33 aa, Artificial Sequence
  Description of Artificial Sequence: Synthetic polypeptide
YEEEISTTNPVATEQYGSVGSTGNLLQEGVNRQ

SEQ ID NO: 50953 - protein, 33 aa, Artificial Sequence
  Description of Artificial Sequence: Synthetic polypeptide
DEEEIRTTNPVATEQYGSVSPTNPLPYGENETL

SEQ ID NO: 50954 - protein, 30 aa, Artificial Sequence
  Description of Artificial Sequence: Synthetic polypeptide
DEDEIRTTNPVATTAYGSVSTNLQYGTDEM

SEQ ID NO: 50955 - protein, 32 aa, Artificial Sequence
  Description of Artificial Sequence: Synthetic polypeptide
YEEEISTTNPVATEQYGSVGSTGCLQEGVNQR

SEQ ID NO: 50956 - protein, 34 aa, Artificial Sequence
  Description of Artificial Sequence: Synthetic polypeptide
DEEEIRTTNPVATEQYGSVSPTNPLQPRGEAETL

SEQ ID NO: 50957 - protein, 33 aa, Artificial Sequence
  Description of Artificial Sequence: Synthetic polypeptide
DEEEIRTTNPVATEQYGSVSPTNPVSVRGLVRD

SEQ ID NO: 50958 - protein, 32 aa, Artificial Sequence
  Description of Artificial Sequence: Synthetic polypeptide
DEEEIRTTNPVATEQYGSVSPTNQIEVGVNEE

SEQ ID NO: 50959 - protein, 31 aa, Artificial Sequence
  Description of Artificial Sequence: Synthetic polypeptide
YEEEISTTNPVATEQYGSVGSSNIQRGNCFM

SEQ ID NO: 50960 - protein, 32 aa, Artificial Sequence
  Description of Artificial Sequence: Synthetic polypeptide
YEEEISTTNPVATEQYGSVGSQTGNLQEGVER

SEQ ID NO: 50961 - protein, 33 aa, Artificial Sequence
  Description of Artificial Sequence: Synthetic polypeptide
YEEEISTTNPVATEQYGSVGSPTGNFLQEGVNR

SEQ ID NO: 50962 - protein, 33 aa, Artificial Sequence
  Description of Artificial Sequence: Synthetic polypeptide
YEEEISTTNPVATEQYGSVGSGTGNLQEGVNRN

SEQ ID NO: 50963 - protein, 33 aa, Artificial Sequence
  Description of Artificial Sequence: Synthetic polypeptide
DEEEIRTTNPVATEQYGSVSPTNSERGNNEQEQ

SEQ ID NO: 50964 - protein, 31 aa, Artificial Sequence
  Description of Artificial Sequence: Synthetic polypeptide
YEEEISTTNPVATEQYGSVGSCNIQQRGNPM

SEQ ID NO: 50965 - protein, 32 aa, Artificial Sequence
  Description of Artificial Sequence: Synthetic polypeptide
DEEEIRTTNPVATEQYGSVSPTNSSQTGVVEL

SEQ ID NO: 50966 - protein, 32 aa, Artificial Sequence
  Description of Artificial Sequence: Synthetic polypeptide
YEEEISTTNPVATEQYGSVGQMTGNLQEGVNR

SEQ ID NO: 50967 - protein, 32 aa, Artificial Sequence
  Description of Artificial Sequence: Synthetic polypeptide
YEEEISTTNPVATEQYGSVGSTGNLMEIGVNR

SEQ ID NO: 50968 - protein, 32 aa, Artificial Sequence
  Description of Artificial Sequence: Synthetic polypeptide
YEEEISTTNPVATEQYGSVGSTGNLQELGVSR

SEQ ID NO: 50969 - protein, 32 aa, Artificial Sequence
  Description of Artificial Sequence: Synthetic polypeptide
YEEEISTTNPVATEQYGSVGSTGNLQEPGVNI

SEQ ID NO: 50970 - protein, 31 aa, Artificial Sequence
  Description of Artificial Sequence: Synthetic polypeptide
YEEEISTTNPVATEQYGSVGSTGQLQEGVNC

SEQ ID NO: 50971 - protein, 32 aa, Artificial Sequence
  Description of Artificial Sequence: Synthetic polypeptide
DEEEIRTTNPVATEQYGSVSPTNNLMVNEPRN

SEQ ID NO: 50972 - protein, 33 aa, Artificial Sequence
  Description of Artificial Sequence: Synthetic polypeptide
DEEEIRTTNPVATEQYGSVSPTNNNAVQRGEVM

SEQ ID NO: 50973 - protein, 33 aa, Artificial Sequence
  Description of Artificial Sequence: Synthetic polypeptide
DEEEIRTTNPVATEQYGSVSPTNNPDTRDNTNR

SEQ ID NO: 50974 - protein, 32 aa, Artificial Sequence
  Description of Artificial Sequence: Synthetic polypeptide
YEEEISTTNPVATEQYGSVKSGTNMQQGGLNR

SEQ ID NO: 50975 - protein, 31 aa, Artificial Sequence
  Description of Artificial Sequence: Synthetic polypeptide
YEEEISTTNPVATEQYGSVKDGTNQQHGLNR

SEQ ID NO: 50976 - protein, 33 aa, Artificial Sequence
  Description of Artificial Sequence: Synthetic polypeptide
DEEEIRTTNPVATEQYGSVSPTNNQPRQNEEPE

SEQ ID NO: 50977 - protein, 31 aa, Artificial Sequence
  Description of Artificial Sequence: Synthetic polypeptide
YEEEISTTNPVATEQYGSVITTNPLNAMGNR

SEQ ID NO: 50978 - protein, 31 aa, Artificial Sequence
  Description of Artificial Sequence: Synthetic polypeptide
YEEEISTTNPVATEQYGSVKSGTTQQRGLNG

SEQ ID NO: 50979 - protein, 33 aa, Artificial Sequence
  Description of Artificial Sequence: Synthetic polypeptide
DEEEIRTTNPVATEQYGSVSPTNNQQQRGPIDF

SEQ ID NO: 50980 - protein, 32 aa, Artificial Sequence
  Description of Artificial Sequence: Synthetic polypeptide
DEEEIRTTNPVATEQYGSVSPTNNQRQMEEDG

SEQ ID NO: 50981 - protein, 33 aa, Artificial Sequence
  Description of Artificial Sequence: Synthetic polypeptide
YEEEISTTNPVATEQYGSVISGTNQQRGLNTRI

SEQ ID NO: 50982 - protein, 31 aa, Artificial Sequence
  Description of Artificial Sequence: Synthetic polypeptide
YEEEISTTNPVATEQYGSVGSTTNIQRSNPM

SEQ ID NO: 50983 - protein, 31 aa, Artificial Sequence
  Description of Artificial Sequence: Synthetic polypeptide
YEEEISTTNPVATEQYGSVGSTNIQRGAQFM

SEQ ID NO: 50984 - protein, 31 aa, Artificial Sequence
  Description of Artificial Sequence: Synthetic polypeptide
YEEEISTTNPVATEQYGSVGSTNIQNRGPFM

SEQ ID NO: 50985 - protein, 31 aa, Artificial Sequence
  Description of Artificial Sequence: Synthetic polypeptide
YEEEISTTNPVATEQYGSVGSTNGIQRGLPM

SEQ ID NO: 50986 - protein, 34 aa, Artificial Sequence
  Description of Artificial Sequence: Synthetic polypeptide
DEEEIRTTNPVATEQYGSVSPTNPLPPRGENEKL

SEQ ID NO: 50987 - protein, 31 aa, Artificial Sequence
  Description of Artificial Sequence: Synthetic polypeptide
YEEEISTTNPVATEQYGSVISYYNSLQRPNT

SEQ ID NO: 50988 - protein, 32 aa, Artificial Sequence
  Description of Artificial Sequence: Synthetic polypeptide
DEEEIRTTNPVATEQYGSVSPTDLTEREVQRL

SEQ ID NO: 50989 - protein, 30 aa, Artificial Sequence
  Description of Artificial Sequence: Synthetic polypeptide
YEEEVSTTNPVATEQYGSVSYTNSLIRPNT

SEQ ID NO: 50990 - protein, 32 aa, Artificial Sequence
  Description of Artificial Sequence: Synthetic polypeptide
DEEEIRTTNPVATEQYGSVSPTDLQQTELQLR

SEQ ID NO: 50991 - protein, 32 aa, Artificial Sequence
  Description of Artificial Sequence: Synthetic polypeptide
DEEEIRTTNPVATEQYGSVSPDMQFFGNSQRD

SEQ ID NO: 50992 - protein, 30 aa, Artificial Sequence
  Description of Artificial Sequence: Synthetic polypeptide
YESEIRTTNPVATECYGSVNSTNLQNTVNF

SEQ ID NO: 50993 - protein, 30 aa, Artificial Sequence
  Description of Artificial Sequence: Synthetic polypeptide
NEGEIRTTNPVATEQYGSVWPTNLQIGSQI

SEQ ID NO: 50994 - protein, 31 aa, Artificial Sequence
  Description of Artificial Sequence: Synthetic polypeptide
DEDEIRTTNPVAYEQYGSVSTNNQQDNGNVI

SEQ ID NO: 50995 - protein, 32 aa, Artificial Sequence
  Description of Artificial Sequence: Synthetic polypeptide
DEDEIRTTNPVAYEQYGSVSTNDQQPDNGNVR

SEQ ID NO: 50996 - protein, 32 aa, Artificial Sequence
  Description of Artificial Sequence: Synthetic polypeptide
DEDEIRTTNPVAYEQYGSVSTGNTGQDNGNVR

SEQ ID NO: 50997 - protein, 33 aa, Artificial Sequence
  Description of Artificial Sequence: Synthetic polypeptide
DEDEIRTTNPVAYEQYGSVPSCTNLQDGGNNRM

SEQ ID NO: 50998 - protein, 31 aa, Artificial Sequence
  Description of Artificial Sequence: Synthetic polypeptide
NEEEIRTTNPVATEQYGSVTSTGDLQREQGI

SEQ ID NO: 50999 - protein, 30 aa, Artificial Sequence
  Description of Artificial Sequence: Synthetic polypeptide
DEEEIRTTNPVATEQYGSVSPDPQVRSSQG

SEQ ID NO: 51000 - protein, 32 aa, Artificial Sequence
  Description of Artificial Sequence: Synthetic polypeptide
DEDEIRTTNPVAYEQYGKVSCTNLQTTGGNRM

SEQ ID NO: 51001 - protein, 31 aa, Artificial Sequence
  Description of Artificial Sequence: Synthetic polypeptide
NEEEIRTTNPVATEQYGSVSWGNLDEFGSDR

SEQ ID NO: 51002 - protein, 33 aa, Artificial Sequence
  Description of Artificial Sequence: Synthetic polypeptide
DEEEIRTTNPVATEQYGSVSPDTNQQQRGPQDF

SEQ ID NO: 51003 - protein, 29 aa, Artificial Sequence
  Description of Artificial Sequence: Synthetic peptide
NEGEIRTTNPVATEQYGSVWTLQQIGSQR

SEQ ID NO: 51004 - protein, 33 aa, Artificial Sequence
  Description of Artificial Sequence: Synthetic polypeptide
DEEEIRTTNPVATEQYGSVSPEELLQSVGNLRQ

SEQ ID NO: 51005 - protein, 32 aa, Artificial Sequence
  Description of Artificial Sequence: Synthetic polypeptide
NEEEIRTTNPVATEQYGSVSTNQTHQGENPRT

SEQ ID NO: 51006 - protein, 31 aa, Artificial Sequence
  Description of Artificial Sequence: Synthetic polypeptide
DEEEIRTTNPVATEQYGSVSPDLQRSEDFVM

SEQ ID NO: 51007 - protein, 30 aa, Artificial Sequence
  Description of Artificial Sequence: Synthetic polypeptide
NEHEIRTTNPVATEQYGCVSTVLQEGVEDR

SEQ ID NO: 51008 - protein, 31 aa, Artificial Sequence
  Description of Artificial Sequence: Synthetic polypeptide
DEEEIRTTNPVATEQYGSVSPDLQILDGDAQ

SEQ ID NO: 51009 - protein, 31 aa, Artificial Sequence
  Description of Artificial Sequence: Synthetic polypeptide
DEDEIRTTNPVAYEQYGTVSTNLGDENGENR

SEQ ID NO: 51010 - protein, 29 aa, Artificial Sequence
  Description of Artificial Sequence: Synthetic peptide
NEENIRTTNPVATEIYGQVTTNLERGSNQ

SEQ ID NO: 51011 - protein, 34 aa, Artificial Sequence
  Description of Artificial Sequence: Synthetic polypeptide
DEEEIRTTNPVATEQYGSVSPASNLQRVFVNERW

SEQ ID NO: 51012 - protein, 30 aa, Artificial Sequence
  Description of Artificial Sequence: Synthetic polypeptide
DEDEIRTTNPVAYEQYGTVSTNNQGDGNDT

SEQ ID NO: 51013 - protein, 33 aa, Artificial Sequence
  Description of Artificial Sequence: Synthetic polypeptide
DEEEIRTTNPVATEQYGSVSPATNLQRTSMMDD

SEQ ID NO: 51014 - protein, 30 aa, Artificial Sequence
  Description of Artificial Sequence: Synthetic polypeptide
DEDEIRTTNPVAYEQYGTVSTNLQMGGDDT

SEQ ID NO: 51015 - protein, 31 aa, Artificial Sequence
  Description of Artificial Sequence: Synthetic polypeptide
DEDEIRTTNPVAYEQYGTVSTNLQHNGDNDT

SEQ ID NO: 51016 - protein, 31 aa, Artificial Sequence
  Description of Artificial Sequence: Synthetic polypeptide
YESEIRTTNPVATEQYGSVSCINEPQDRGNG

SEQ ID NO: 51017 - protein, 33 aa, Artificial Sequence
  Description of Artificial Sequence: Synthetic polypeptide
DEEEIRTTNPVATEQYGSVSPCNLQREGEETEI

SEQ ID NO: 51018 - protein, 31 aa, Artificial Sequence
  Description of Artificial Sequence: Synthetic polypeptide
DEDEIRTTNPVAYEQYGTVSTNLQGEGGDAR

SEQ ID NO: 51019 - protein, 31 aa, Artificial Sequence
  Description of Artificial Sequence: Synthetic polypeptide
DEDEIRTTNPVAYEQYGTVSTNLQDAGGNHT

SEQ ID NO: 51020 - protein, 30 aa, Artificial Sequence
  Description of Artificial Sequence: Synthetic polypeptide
DEEEIRTTNPVATEQYGSVSPDEQIGEDIF

SEQ ID NO: 51021 - protein, 30 aa, Artificial Sequence
  Description of Artificial Sequence: Synthetic polypeptide
DEEEIRTTNPVATEQYGSVSPDLNPGDEDG

SEQ ID NO: 51022 - protein, 31 aa, Artificial Sequence
  Description of Artificial Sequence: Synthetic polypeptide
DEDEIRTTNPVAYEQYGTVSTNLGSNGGENR

SEQ ID NO: 51023 - protein, 31 aa, Artificial Sequence
  Description of Artificial Sequence: Synthetic polypeptide
DEDEIRTTNPVAYEQYGTVSTNLGSGEGGNR

SEQ ID NO: 51024 - protein, 31 aa, Artificial Sequence
  Description of Artificial Sequence: Synthetic polypeptide
DEDEIRTTNPVAYEQYGTVSTNLGSEGNNER

SEQ ID NO: 51025 - protein, 29 aa, Artificial Sequence
  Description of Artificial Sequence: Synthetic peptide
DEDEIRTTNPVAYEQYGTVSTGDQEGNMS

SEQ ID NO: 51026 - protein, 30 aa, Artificial Sequence
  Description of Artificial Sequence: Synthetic polypeptide
NEEEIRTTNPVATEQYGSVSTNDEGPGGIM

SEQ ID NO: 51027 - protein, 30 aa, Artificial Sequence
  Description of Artificial Sequence: Synthetic polypeptide
DEEEIRTTNPVATEQYGSVSPENDERNQEH

SEQ ID NO: 51028 - protein, 32 aa, Artificial Sequence
  Description of Artificial Sequence: Synthetic polypeptide
DEEEIRTTNPVATEQYGSVSPENLDQDMEVNE

SEQ ID NO: 51029 - protein, 31 aa, Artificial Sequence
  Description of Artificial Sequence: Synthetic polypeptide
DEEEIRTTNPVATEQYGSVSPIDLMRIGLAN

SEQ ID NO: 51030 - protein, 31 aa, Artificial Sequence
  Description of Artificial Sequence: Synthetic polypeptide
DEEEIRTTNPVATEQYGSVSPIDLPIGGENE

SEQ ID NO: 51031 - protein, 30 aa, Artificial Sequence
  Description of Artificial Sequence: Synthetic polypeptide
NEEEIRTTNPVATEQYGSVSAYNLDEFGET

SEQ ID NO: 51032 - protein, 30 aa, Artificial Sequence
  Description of Artificial Sequence: Synthetic polypeptide
NEEEIRTTNPVATEQYGSVSAYDLDEFDNR

SEQ ID NO: 51033 - protein, 32 aa, Artificial Sequence
  Description of Artificial Sequence: Synthetic polypeptide
NEEEIRTTNPVATEQYGSVSAWNNLDEFGNNR

SEQ ID NO: 51034 - protein, 31 aa, Artificial Sequence
  Description of Artificial Sequence: Synthetic polypeptide
YEPEISTTNPVATEQYGSVPSTNLIRDNVRS

SEQ ID NO: 51035 - protein, 29 aa, Artificial Sequence
  Description of Artificial Sequence: Synthetic peptide
YEPEISTTNPVATEGYGSFVITNLQRVER

SEQ ID NO: 51036 - protein, 30 aa, Artificial Sequence
  Description of Artificial Sequence: Synthetic polypeptide
YEPEIRTTNPVATEQYGQICSTGNLEIGNR

SEQ ID NO: 51037 - protein, 30 aa, Artificial Sequence
  Description of Artificial Sequence: Synthetic polypeptide
YENEVRTTNPVATEQYGDVSVTNLQRDNEV

SEQ ID NO: 51038 - protein, 32 aa, Artificial Sequence
  Description of Artificial Sequence: Synthetic polypeptide
AEEEIRTTNPVATEQYGSVVVVTNLEQQGGNQ

SEQ ID NO: 51039 - protein, 31 aa, Artificial Sequence
  Description of Artificial Sequence: Synthetic polypeptide
DEEEIRTTNPVATEQYGSVSPIMNLERNDVS

SEQ ID NO: 51040 - protein, 28 aa, Artificial Sequence
  Description of Artificial Sequence: Synthetic peptide
NENEIACTNPVATEQYGEASENLQRGGR

SEQ ID NO: 51041 - protein, 31 aa, Artificial Sequence
  Description of Artificial Sequence: Synthetic polypeptide
NEEEIRTTNPVATEQYGSVSAWNLDEYGSDR

SEQ ID NO: 51042 - protein, 30 aa, Artificial Sequence
  Description of Artificial Sequence: Synthetic polypeptide
NEEEIRTTNPVATEQYGSVSAWNLDEFGEF

SEQ ID NO: 51043 - protein, 32 aa, Artificial Sequence
  Description of Artificial Sequence: Synthetic polypeptide
DEEEIRTTNPVATEQYGSVSPINLEMRQEDPR

SEQ ID NO: 51044 - protein, 33 aa, Artificial Sequence
  Description of Artificial Sequence: Synthetic polypeptide
DEEEIRTTNPVATEQYGSVSPIANLQRQNSNIG

SEQ ID NO: 51045 - protein, 33 aa, Artificial Sequence
  Description of Artificial Sequence: Synthetic polypeptide
DEEEIRTTNPVATEQYGSVSPIALDQPRGPLVR

SEQ ID NO: 51046 - protein, 32 aa, Artificial Sequence
  Description of Artificial Sequence: Synthetic polypeptide
NEEEIRTTNPVATEQYGSVSLAINLDEFGNRI

SEQ ID NO: 51047 - protein, 33 aa, Artificial Sequence
  Description of Artificial Sequence: Synthetic polypeptide
AEEEIRTTNPVATEQYGSVVVVSTNLQQGGNTT

SEQ ID NO: 51048 - protein, 32 aa, Artificial Sequence
  Description of Artificial Sequence: Synthetic polypeptide
DEEEIRTTNPVATEQYGSVSPENLQQQSQERE

SEQ ID NO: 51049 - protein, 32 aa, Artificial Sequence
  Description of Artificial Sequence: Synthetic polypeptide
DEEEIRTTNPVATEQYGSVSPENPLIRENIAT

SEQ ID NO: 51050 - protein, 32 aa, Artificial Sequence
  Description of Artificial Sequence: Synthetic polypeptide
DEEEIRTTNPVATEQYGSVSPENQHQERDEIR

SEQ ID NO: 51051 - protein, 31 aa, Artificial Sequence
  Description of Artificial Sequence: Synthetic polypeptide
DEEEIRTTNPVATEQYGSVSPETLVERGEQD

SEQ ID NO: 51052 - protein, 29 aa, Artificial Sequence
  Description of Artificial Sequence: Synthetic peptide
YESEIATTNPVCTEQYGSVSDNEQREGNQ

SEQ ID NO: 51053 - protein, 32 aa, Artificial Sequence
  Description of Artificial Sequence: Synthetic polypeptide
DEEEIRTTNPVATEQYGSVSPFDNEQRAFDFR

SEQ ID NO: 51054 - protein, 33 aa, Artificial Sequence
  Description of Artificial Sequence: Synthetic polypeptide
DEEEIRTTNPVATEQYGSVSPFLLQRVGVNQDE

SEQ ID NO: 51055 - protein, 30 aa, Artificial Sequence
  Description of Artificial Sequence: Synthetic polypeptide
DEDEIRTTNPVAYEQYGTVSTTNDHQDGER

SEQ ID NO: 51056 - protein, 31 aa, Artificial Sequence
  Description of Artificial Sequence: Synthetic polypeptide
NEEEIRTTNPVATEQYGSVSPWNLPEFGEND

SEQ ID NO: 51057 - protein, 31 aa, Artificial Sequence
  Description of Artificial Sequence: Synthetic polypeptide
DEEEIRTTNPVATEQYGSVSPGDLQSIGLAI

SEQ ID NO: 51058 - protein, 31 aa, Artificial Sequence
  Description of Artificial Sequence: Synthetic polypeptide
NEEEIRTTNPVATEQYGSVSPTNHVMREGQE

SEQ ID NO: 51059 - protein, 31 aa, Artificial Sequence
  Description of Artificial Sequence: Synthetic polypeptide
YEREISTTNPVATEQYGSVGSTNITQRGNPM

SEQ ID NO: 51060 - protein, 33 aa, Artificial Sequence
  Description of Artificial Sequence: Synthetic polypeptide
DEEEIRTTNPVATEQYGSVSPGNLQDRGLEIES

SEQ ID NO: 51061 - protein, 31 aa, Artificial Sequence
  Description of Artificial Sequence: Synthetic polypeptide
YEREISTTNPVATEQYGSVGSTFNIQRGNFM

SEQ ID NO: 51062 - protein, 33 aa, Artificial Sequence
  Description of Artificial Sequence: Synthetic polypeptide
DEEEIRTTNPVATEQYGSVSPGNLQNTGLEIRD

SEQ ID NO: 51063 - protein, 29 aa, Artificial Sequence
  Description of Artificial Sequence: Synthetic peptide
YEREIKTTNPVATEQYGSVCTWNAQRGEL

SEQ ID NO: 51064 - protein, 32 aa, Artificial Sequence
  Description of Artificial Sequence: Synthetic polypeptide
DEEEIRTTNPVATEQYGSVSPFNVQRVGPPEE

SEQ ID NO: 51065 - protein, 29 aa, Artificial Sequence
  Description of Artificial Sequence: Synthetic peptide
YESEIRTTNPVCTEQYGSVSDNEPQSGNG

SEQ ID NO: 51066 - protein, 30 aa, Artificial Sequence
  Description of Artificial Sequence: Synthetic polypeptide
DEEEIRTTNPVATEQYGSVSPANNQTQEED

SEQ ID NO: 51067 - protein, 29 aa, Artificial Sequence
  Description of Artificial Sequence: Synthetic peptide
YESEIRTTNPVCTEQYGVVSDINLQSGNQ

SEQ ID NO: 51068 - protein, 32 aa, Artificial Sequence
  Description of Artificial Sequence: Synthetic polypeptide
DEEEIRTTNPVATEQYGSVSNTQDQGQNEGNT

SEQ ID NO: 51069 - protein, 32 aa, Artificial Sequence
  Description of Artificial Sequence: Synthetic polypeptide
DEEEIRTTNPVATEQYGSVSNTQLIGGNGNNE

SEQ ID NO: 51070 - protein, 33 aa, Artificial Sequence
  Description of Artificial Sequence: Synthetic polypeptide
DEEEIRTTNPVATEQYGSVSNTQLLEEMRGERY

SEQ ID NO: 51071 - protein, 33 aa, Artificial Sequence
  Description of Artificial Sequence: Synthetic polypeptide
DEEEIRTTNPVATEQYGSVSNTQNDGNQNNGNN

SEQ ID NO: 51072 - protein, 32 aa, Artificial Sequence
  Description of Artificial Sequence: Synthetic polypeptide
DEEEIRTTNPVATEQYGSVSNTQNVGMGNGQG

SEQ ID NO: 51073 - protein, 32 aa, Artificial Sequence
  Description of Artificial Sequence: Synthetic polypeptide
DEEEIRTTNPVATEQYGSVSNTQNVGVGNGGQ

SEQ ID NO: 51074 - protein, 32 aa, Artificial Sequence
  Description of Artificial Sequence: Synthetic polypeptide
DEEEIRTTNPVATEQYGSVSNTQNVGVGNTQQ

SEQ ID NO: 51075 - protein, 31 aa, Artificial Sequence
  Description of Artificial Sequence: Synthetic polypeptide
YQEEISTTNPVATEQYGSGVPSTNLERDNRS

SEQ ID NO: 51076 - protein, 31 aa, Artificial Sequence
  Description of Artificial Sequence: Synthetic polypeptide
DEDEISTTNPVAYEQYGSVATNLQRGDNMAQ

SEQ ID NO: 51077 - protein, 31 aa, Artificial Sequence
  Description of Artificial Sequence: Synthetic polypeptide
DEDEISTTNPVAYEQYGSVATNLQQRGNEDP

SEQ ID NO: 51078 - protein, 30 aa, Artificial Sequence
  Description of Artificial Sequence: Synthetic polypeptide
DEDEISTTNPVAYEQYGSVATNLQFGNSDE

SEQ ID NO: 51079 - protein, 31 aa, Artificial Sequence
  Description of Artificial Sequence: Synthetic polypeptide
DEDEISTTNPVAYEQYGSVATNLQDRGNATL

SEQ ID NO: 51080 - protein, 33 aa, Artificial Sequence
  Description of Artificial Sequence: Synthetic polypeptide
DEEEIRTTNPVATEQYGSVSNTSGLQREQSLER

SEQ ID NO: 51081 - protein, 31 aa, Artificial Sequence
  Description of Artificial Sequence: Synthetic polypeptide
DEDEISTTNPVATEQYGCVSTNSLFQQRGEF

SEQ ID NO: 51082 - protein, 29 aa, Artificial Sequence
  Description of Artificial Sequence: Synthetic peptide
NEEEIRTTNPVATEQYGSYSTMELQDQGD

SEQ ID NO: 51083 - protein, 35 aa, Artificial Sequence
  Description of Artificial Sequence: Synthetic polypeptide
DEEEIRTTNPVATEQYGSVSNTPNLLQRVGENEGG

SEQ ID NO: 51084 - protein, 34 aa, Artificial Sequence
  Description of Artificial Sequence: Synthetic polypeptide
DEEEIRTTNPVATEQYGSVSNTPNLGQTNGNGNF

SEQ ID NO: 51085 - protein, 32 aa, Artificial Sequence
  Description of Artificial Sequence: Synthetic polypeptide
DEEEIRTTNPVATEQYGSVSNTPNDIQWGGSD

SEQ ID NO: 51086 - protein, 33 aa, Artificial Sequence
  Description of Artificial Sequence: Synthetic polypeptide
DEEEIRTTNPVATEQYGSVSNTPLQEYFGSNQS

SEQ ID NO: 51087 - protein, 34 aa, Artificial Sequence
  Description of Artificial Sequence: Synthetic polypeptide
DEEEIRTTNPVATEQYGSVSNTNLVISRQGENVE

SEQ ID NO: 51088 - protein, 31 aa, Artificial Sequence
  Description of Artificial Sequence: Synthetic polypeptide
YTEEEISTTNPVATEQYGMVNSTNLEQGNIR

SEQ ID NO: 51089 - protein, 29 aa, Artificial Sequence
  Description of Artificial Sequence: Synthetic peptide
YSEEISTTNPVATEPYGQVSTLLQLRGNG

SEQ ID NO: 51090 - protein, 30 aa, Artificial Sequence
  Description of Artificial Sequence: Synthetic polypeptide
NEEEIRTTNPVATEQYGSYSTMELQRIQGE

SEQ ID NO: 51091 - protein, 33 aa, Artificial Sequence
  Description of Artificial Sequence: Synthetic polypeptide
DEEEIRTTNPVATEQYGSVSNTNNLDEFGNNDE

SEQ ID NO: 51092 - protein, 33 aa, Artificial Sequence
  Description of Artificial Sequence: Synthetic polypeptide
DEEEIRTTNPVATEQYGSVSNTNNLEEFGSTQR

SEQ ID NO: 51093 - protein, 32 aa, Artificial Sequence
  Description of Artificial Sequence: Synthetic polypeptide
NEEEIRTTNPVATEQYGSYSTMELQREQGNDT

SEQ ID NO: 51094 - protein, 32 aa, Artificial Sequence
  Description of Artificial Sequence: Synthetic polypeptide
DEEEIRTTNPVATEQYGSVSNTSNVEQVLPIR

SEQ ID NO: 51095 - protein, 34 aa, Artificial Sequence
  Description of Artificial Sequence: Synthetic polypeptide
DEEEIRTTNPVATEQYGSVSNTNNNLENRGEDRN

SEQ ID NO: 51096 - protein, 33 aa, Artificial Sequence
  Description of Artificial Sequence: Synthetic polypeptide
DEEEIRTTNPVATEQYGSVSNTNQQIGVGNNEE

SEQ ID NO: 51097 - protein, 31 aa, Artificial Sequence
  Description of Artificial Sequence: Synthetic polypeptide
YQEEISTTNPVATEQYGSVYSTNGLIRDNRS

SEQ ID NO: 51098 - protein, 31 aa, Artificial Sequence
  Description of Artificial Sequence: Synthetic polypeptide
YQEEISTTNPVATEQYGSVPSTNLVRDNPRS

SEQ ID NO: 51099 - protein, 33 aa, Artificial Sequence
  Description of Artificial Sequence: Synthetic polypeptide
DEEEIRTTNPVATEQYGSVSNTNVVGQGGGGNG

SEQ ID NO: 51100 - protein, 31 aa, Artificial Sequence
  Description of Artificial Sequence: Synthetic polypeptide
YQEEISTTNPVATEQYGSVPSTNLIRDNERP

SEQ ID NO: 51101 - protein, 32 aa, Artificial Sequence
  Description of Artificial Sequence: Synthetic polypeptide
DEEEIRTTNPVATEQYGSVSNTPDNQLVVNNI

SEQ ID NO: 51102 - protein, 31 aa, Artificial Sequence
  Description of Artificial Sequence: Synthetic polypeptide
DEEEIRTTNPVATEQYGSVSNTPDQLVDGDI

SEQ ID NO: 51103 - protein, 28 aa, Artificial Sequence
  Description of Artificial Sequence: Synthetic peptide
DEDTICTTNPVATEQYGVVETNPQNGNA

SEQ ID NO: 51104 - protein, 34 aa, Artificial Sequence
  Description of Artificial Sequence: Synthetic polypeptide
DEEEIRTTNPVATEQYGSVSPINLMQPRGEEVRD

SEQ ID NO: 51105 - protein, 29 aa, Artificial Sequence
  Description of Artificial Sequence: Synthetic peptide
DEDEIRTTNPVSTEQYGSVAANLQMGGQT

SEQ ID NO: 51106 - protein, 32 aa, Artificial Sequence
  Description of Artificial Sequence: Synthetic polypeptide
DEEEIRTTNPVATEQYGSVSNTSNVQVNNIVL

SEQ ID NO: 51107 - protein, 32 aa, Artificial Sequence
  Description of Artificial Sequence: Synthetic polypeptide
DEEEIRTTNPVATEQYGSVSPAANLQRLVQGE

SEQ ID NO: 51108 - protein, 31 aa, Artificial Sequence
  Description of Artificial Sequence: Synthetic polypeptide
YETEISTTNPVATEQYGSVKEGTNQQRGLNR

SEQ ID NO: 51109 - protein, 31 aa, Artificial Sequence
  Description of Artificial Sequence: Synthetic polypeptide
DEDEIRTTNPVAYERYGSVSTNLGQEGMGNG

SEQ ID NO: 51110 - protein, 30 aa, Artificial Sequence
  Description of Artificial Sequence: Synthetic polypeptide
YETEISTTNPVATEQYGQVSTLLQLRGNAG

SEQ ID NO: 51111 - protein, 33 aa, Artificial Sequence
  Description of Artificial Sequence: Synthetic polypeptide
DEEEIRTTNPVATEQYGSVSPAENLQTGQPLNT

SEQ ID NO: 51112 - protein, 30 aa, Artificial Sequence
  Description of Artificial Sequence: Synthetic polypeptide
YETEIKTTNPVATEQYGSVSMTNPQGGLNL

SEQ ID NO: 51113 - protein, 33 aa, Artificial Sequence
  Description of Artificial Sequence: Synthetic polypeptide
DEEEIRTTNPVATEQYGSVSPAFNLQNGVNQEL

SEQ ID NO: 51114 - protein, 32 aa, Artificial Sequence
  Description of Artificial Sequence: Synthetic polypeptide
DEEEIRTTNPVATEQYGSVSPAGLHQRLEVER

SEQ ID NO: 51115 - protein, 32 aa, Artificial Sequence
  Description of Artificial Sequence: Synthetic polypeptide
DEEEIRTTNPVATEQYGSVSPANGGQGRGEVD

SEQ ID NO: 51116 - protein, 32 aa, Artificial Sequence
  Description of Artificial Sequence: Synthetic polypeptide
DEEEIRTTNPVATEQYGSVSPANLGERQGEPI

SEQ ID NO: 51117 - protein, 31 aa, Artificial Sequence
  Description of Artificial Sequence: Synthetic polypeptide
YETEIGTTNPVATEQYGSVTSTWLDQRMGMR

SEQ ID NO: 51118 - protein, 33 aa, Artificial Sequence
  Description of Artificial Sequence: Synthetic polypeptide
DEEEIRTTNPVATEQYGSVSPANLPQMINLEVR

SEQ ID NO: 51119 - protein, 32 aa, Artificial Sequence
  Description of Artificial Sequence: Synthetic polypeptide
DEEEIRTTNPVATEQYGSVSPANLQQPGEIPG

SEQ ID NO: 51120 - protein, 33 aa, Artificial Sequence
  Description of Artificial Sequence: Synthetic polypeptide
DEEEIRTTNPVATEQYGSVSPANLQRGILMMDD

SEQ ID NO: 51121 - protein, 29 aa, Artificial Sequence
  Description of Artificial Sequence: Synthetic peptide
YESEISTTNPVATEQYGQVSTLLYLRGNG

SEQ ID NO: 51122 - protein, 32 aa, Artificial Sequence
  Description of Artificial Sequence: Synthetic polypeptide
DEEEIRTTNPVATEQYGSVSNYNSHQDGQNSE

SEQ ID NO: 51123 - protein, 32 aa, Artificial Sequence
  Description of Artificial Sequence: Synthetic polypeptide
DEEEIRTTNPVATEQYGSVSNYNDPQDGQNSE

SEQ ID NO: 51124 - protein, 30 aa, Artificial Sequence
  Description of Artificial Sequence: Synthetic polypeptide
YEYEIRGTNPVATEQYGSVVETNLQDGGNQ

SEQ ID NO: 51125 - protein, 33 aa, Artificial Sequence
  Description of Artificial Sequence: Synthetic polypeptide
DEEEIRTTNPVATEQYGSVSNVDLMHQSGNNRS

SEQ ID NO: 51126 - protein, 31 aa, Artificial Sequence
  Description of Artificial Sequence: Synthetic polypeptide
DEEEIRTTNPVATEQYGSVSNTSNVQVTPPS

SEQ ID NO: 51127 - protein, 33 aa, Artificial Sequence
  Description of Artificial Sequence: Synthetic polypeptide
DEEEIRTTNPVATEQYGSVSNTTDLQNEGGNGQ

SEQ ID NO: 51128 - protein, 33 aa, Artificial Sequence
  Description of Artificial Sequence: Synthetic polypeptide
DEEEIRTTNPVATEQYGSVSNTTLQGEGGNNEQ

SEQ ID NO: 51129 - protein, 32 aa, Artificial Sequence
  Description of Artificial Sequence: Synthetic polypeptide
DEEEIRTTNPVATEQYGSVSNTTNLEDGSLDG

SEQ ID NO: 51130 - protein, 32 aa, Artificial Sequence
  Description of Artificial Sequence: Synthetic polypeptide
DEEEIRTTNPVATEQYGSVSNTTSLEGMNERD

SEQ ID NO: 51131 - protein, 31 aa, Artificial Sequence
  Description of Artificial Sequence: Synthetic polypeptide
NEEEIRTTNPVATEQYGSYSTELQRFQSGRA

SEQ ID NO: 51132 - protein, 34 aa, Artificial Sequence
  Description of Artificial Sequence: Synthetic polypeptide
DEEEIRTTNPVATEQYGSVSNTVNLTQEDGENIP

SEQ ID NO: 51133 - protein, 31 aa, Artificial Sequence
  Description of Artificial Sequence: Synthetic polypeptide
NEEEIRTTNPVATEQYGSYSTMEDQRGQGRG

SEQ ID NO: 51134 - protein, 31 aa, Artificial Sequence
  Description of Artificial Sequence: Synthetic polypeptide
NEEEIRTTNPVATEQYGSYSPTTVLQTRQGR

SEQ ID NO: 51135 - protein, 30 aa, Artificial Sequence
  Description of Artificial Sequence: Synthetic polypeptide
YEYEISTTNPVATEQYGSVGSDNIQRGNFM

SEQ ID NO: 51136 - protein, 34 aa, Artificial Sequence
  Description of Artificial Sequence: Synthetic polypeptide
DEEEIRTTNPVATEQYGSVSNTWNNLEQRGEYFN

SEQ ID NO: 51137 - protein, 32 aa, Artificial Sequence
  Description of Artificial Sequence: Synthetic polypeptide
DEEEIRTTNPVATEQYGSVSNTWTLEGMNEER

SEQ ID NO: 51138 - protein, 31 aa, Artificial Sequence
  Description of Artificial Sequence: Synthetic polypeptide
DEDEIRTTNPVAYESWGSVSTNLQHNGDNER

SEQ ID NO: 51139 - protein, 32 aa, Artificial Sequence
  Description of Artificial Sequence: Synthetic polypeptide
YEYEIRTTNPVATEQYGMVNSCTDPLPQRGNR

SEQ ID NO: 51140 - protein, 31 aa, Artificial Sequence
  Description of Artificial Sequence: Synthetic polypeptide
DEDEIRTTNPVAYESWGSVSTNLEQGDGDNR

SEQ ID NO: 51141 - protein, 32 aa, Artificial Sequence
  Description of Artificial Sequence: Synthetic polypeptide
DEEEIRTTNPVATEQYGSVSNVDLMHGIENRS

SEQ ID NO: 51142 - protein, 30 aa, Artificial Sequence
  Description of Artificial Sequence: Synthetic polypeptide
YGEEIQTTNPVATEQYGSVSTITLSQRGGQ

SEQ ID NO: 51143 - protein, 32 aa, Artificial Sequence
  Description of Artificial Sequence: Synthetic polypeptide
DEEEIRTTNPVATEQYGSVSPINLQEREMDED

SEQ ID NO: 51144 - protein, 30 aa, Artificial Sequence
  Description of Artificial Sequence: Synthetic polypeptide
DEDEIRTTNPVAYEQWGTVSTNLQNGGDNH

SEQ ID NO: 51145 - protein, 29 aa, Artificial Sequence
  Description of Artificial Sequence: Synthetic peptide
NEPEIRTTNPVATEQYGSVWVPNLVIGER

SEQ ID NO: 51146 - protein, 32 aa, Artificial Sequence
  Description of Artificial Sequence: Synthetic polypeptide
DEEEIRTTNPVATEQYGSVSPPPQNIRGNELN

SEQ ID NO: 51147 - protein, 31 aa, Artificial Sequence
  Description of Artificial Sequence: Synthetic polypeptide
YEENISTTNPVATEQYGSVYTTNPLNQRMNR

SEQ ID NO: 51148 - protein, 33 aa, Artificial Sequence
  Description of Artificial Sequence: Synthetic polypeptide
DEEEIRTTNPVATEQYGSVSPPTSLIQRGLPLL

SEQ ID NO: 51149 - protein, 29 aa, Artificial Sequence
  Description of Artificial Sequence: Synthetic peptide
NEREIRTTNPVATEQYGSVWTNLEVIAER

SEQ ID NO: 51150 - protein, 30 aa, Artificial Sequence
  Description of Artificial Sequence: Synthetic polypeptide
YEENICTTNPVATEQYGSVSMMNPSQRGNS

SEQ ID NO: 51151 - protein, 32 aa, Artificial Sequence
  Description of Artificial Sequence: Synthetic polypeptide
YEEIISTTNPVATEQYGSVVGSTGNLQEGVNR

SEQ ID NO: 51152 - protein, 31 aa, Artificial Sequence
  Description of Artificial Sequence: Synthetic polypeptide
DEEEIRTTNPVATEQYGSVSPQTNLVIPLLD

SEQ ID NO: 51153 - protein, 31 aa, Artificial Sequence
  Description of Artificial Sequence: Synthetic polypeptide
AEEEIRTTNPVATEQYGSVVVTVNLGGTGNG

SEQ ID NO: 51154 - protein, 30 aa, Artificial Sequence
  Description of Artificial Sequence: Synthetic polypeptide
YEEHISTTNPVATEQYGSVFSTNIQRLNPM

SEQ ID NO: 51155 - protein, 31 aa, Artificial Sequence
  Description of Artificial Sequence: Synthetic polypeptide
DEEEIRTTNPVATEQYGSVSPSLQQNGDQLI

SEQ ID NO: 51156 - protein, 29 aa, Artificial Sequence
  Description of Artificial Sequence: Synthetic peptide
YEEHISTTNPVATEGYGSFVITNLTRGER

SEQ ID NO: 51157 - protein, 31 aa, Artificial Sequence
  Description of Artificial Sequence: Synthetic polypeptide
DEEEIRTTNPVATEQYGSVSPSNLHGSGEIF

SEQ ID NO: 51158 - protein, 31 aa, Artificial Sequence
  Description of Artificial Sequence: Synthetic polypeptide
DEEEIRTTNPVATEQYGSVSPSNLMPVNEED

SEQ ID NO: 51159 - protein, 33 aa, Artificial Sequence
  Description of Artificial Sequence: Synthetic polypeptide
DEEEIRTTNPVATEQYGSVSPSNLQNTGLVIRL

SEQ ID NO: 51160 - protein, 31 aa, Artificial Sequence
  Description of Artificial Sequence: Synthetic polypeptide
AEEEIRTTNPVATEQYGSVVVTVELQNGNQN

SEQ ID NO: 51161 - protein, 31 aa, Artificial Sequence
  Description of Artificial Sequence: Synthetic polypeptide
DEEEIRTTNPVATEQYGSVSPPPNIEQGNEL

SEQ ID NO: 51162 - protein, 31 aa, Artificial Sequence
  Description of Artificial Sequence: Synthetic polypeptide
DEEEIRTTNPVATEQYGSVSPPPLIIRENEL

SEQ ID NO: 51163 - protein, 30 aa, Artificial Sequence
  Description of Artificial Sequence: Synthetic polypeptide
DEEEIRTTNPVATEQYGSVSPPNIDTHGEQ

SEQ ID NO: 51164 - protein, 30 aa, Artificial Sequence
  Description of Artificial Sequence: Synthetic polypeptide
DEEEIRTTNPVATEQYGSVSPPLTERMEID

SEQ ID NO: 51165 - protein, 29 aa, Artificial Sequence
  Description of Artificial Sequence: Synthetic peptide
YEETICTTNPVATEQYGSVSMNFQDGGNS

SEQ ID NO: 51166 - protein, 29 aa, Artificial Sequence
  Description of Artificial Sequence: Synthetic peptide
NEREIRTTNPVATEQYGSVCWTNHQYGDA

SEQ ID NO: 51167 - protein, 30 aa, Artificial Sequence
  Description of Artificial Sequence: Synthetic polypeptide
NEEEIRTTNPVATEQYGSVLSWEHTQRQER

SEQ ID NO: 51168 - protein, 29 aa, Artificial Sequence
  Description of Artificial Sequence: Synthetic peptide
YEETICTTNPVATEQYGSVSGNQSIRGNS

SEQ ID NO: 51169 - protein, 30 aa, Artificial Sequence
  Description of Artificial Sequence: Synthetic polypeptide
NEREIRTTNPVATEQYGSVCWTNLQNGDAF

SEQ ID NO: 51170 - protein, 30 aa, Artificial Sequence
  Description of Artificial Sequence: Synthetic polypeptide
YEETICTTNPVATEQYGSVSAMNGEQRGNS

SEQ ID NO: 51171 - protein, 30 aa, Artificial Sequence
  Description of Artificial Sequence: Synthetic polypeptide
NEREIRTTNPVATEQYGSVCWTNLQYGSQV

SEQ ID NO: 51172 - protein, 30 aa, Artificial Sequence
  Description of Artificial Sequence: Synthetic polypeptide
YEEGITTTNPVATEQYGSVSMNSQPRGVNS

SEQ ID NO: 51173 - protein, 31 aa, Artificial Sequence
  Description of Artificial Sequence: Synthetic polypeptide
NEEEIRTTNPVATEQYGSVLSWEHLQRDTDR

SEQ ID NO: 51174 - protein, 31 aa, Artificial Sequence
  Description of Artificial Sequence: Synthetic polypeptide
DEDEIRTTNPVAYEQWGSVSTGDNLQDSGNA

SEQ ID NO: 51175 - protein, 32 aa, Artificial Sequence
  Description of Artificial Sequence: Synthetic polypeptide
DEEEIRTTNPVATEQYGSVSPNSLQLEGVDEE

SEQ ID NO: 51176 - protein, 33 aa, Artificial Sequence
  Description of Artificial Sequence: Synthetic polypeptide
DEEEIRTTNPVATEQYGSVSPNSLQQGVGVEPR

SEQ ID NO: 51177 - protein, 32 aa, Artificial Sequence
  Description of Artificial Sequence: Synthetic polypeptide
AEEEIRTTNPVATEQYGSVVVTVNLQEGEGNN

SEQ ID NO: 51178 - protein, 30 aa, Artificial Sequence
  Description of Artificial Sequence: Synthetic polypeptide
YEEQISTTNPVATEQYGSVSYTNSLQVVNT

SEQ ID NO: 51179 - protein, 32 aa, Artificial Sequence
  Description of Artificial Sequence: Synthetic polypeptide
DEEEIRTTNPVATEQYGSVSPNTNLELEGVIE

SEQ ID NO: 51180 - protein, 31 aa, Artificial Sequence
  Description of Artificial Sequence: Synthetic polypeptide
DEEEIRTTNPVATEQYGSVSPPHDQRNSNIM

SEQ ID NO: 51181 - protein, 30 aa, Artificial Sequence
  Description of Artificial Sequence: Synthetic polypeptide
NEEEIRTTNPVATEQYGSVLSWEHLQDTGR

SEQ ID NO: 51182 - protein, 30 aa, Artificial Sequence
  Description of Artificial Sequence: Synthetic polypeptide
YEETICTTNPVATEQYGSVSNNDSEQRGNS

SEQ ID NO: 51183 - protein, 30 aa, Artificial Sequence
  Description of Artificial Sequence: Synthetic polypeptide
NEREIRTTNPVATEQYGSVWTNQQINGQSR

SEQ ID NO: 51184 - protein, 32 aa, Artificial Sequence
  Description of Artificial Sequence: Synthetic polypeptide
DEEEIRTTNPVATEQYGSVSPTAGLVQGQMGN

SEQ ID NO: 51185 - protein, 30 aa, Artificial Sequence
  Description of Artificial Sequence: Synthetic polypeptide
YEEGICTTNPVATEQYGSVSMNDDQRGNDS

SEQ ID NO: 51186 - protein, 32 aa, Artificial Sequence
  Description of Artificial Sequence: Synthetic polypeptide
DEEEIRTTNPVATEQYGSVSPTDLEQPEVQRL

SEQ ID NO: 51187 - protein, 32 aa, Artificial Sequence
  Description of Artificial Sequence: Synthetic polypeptide
DEEEIRTTNPVATEQYGSVSPTDLEREDSQRM

SEQ ID NO: 51188 - protein, 32 aa, Artificial Sequence
  Description of Artificial Sequence: Synthetic polypeptide
NEEEIRTTNPVATEQYGSTVSAGNLSHEFGNR

SEQ ID NO: 51189 - protein, 31 aa, Artificial Sequence
  Description of Artificial Sequence: Synthetic polypeptide
DEEEIRTTNPVATEQYGSVSPTDLERILDFS

SEQ ID NO: 51190 - protein, 31 aa, Artificial Sequence
  Description of Artificial Sequence: Synthetic polypeptide
DEEEIRTTNPVATEQYGSVSPTDLERNIDFE

SEQ ID NO: 51191 - protein, 32 aa, Artificial Sequence
  Description of Artificial Sequence: Synthetic polypeptide
DEEEIRTTNPVATEQYGSVSPTDLFFRGGEDM

SEQ ID NO: 51192 - protein, 31 aa, Artificial Sequence
  Description of Artificial Sequence: Synthetic polypeptide
DEEEIRTTNPVATEQYGSVSPTDLLENIDFR

SEQ ID NO: 51193 - protein, 32 aa, Artificial Sequence
  Description of Artificial Sequence: Synthetic polypeptide
DEEEIRTTNPVATEQYGSVSPTDLQERESQGM

SEQ ID NO: 51194 - protein, 32 aa, Artificial Sequence
  Description of Artificial Sequence: Synthetic polypeptide
DEEEIRTTNPVATEQYGSVSPTDLQIELQLRT

SEQ ID NO: 51195 - protein, 32 aa, Artificial Sequence
  Description of Artificial Sequence: Synthetic polypeptide
DEEEIRTTNPVATEQYGSVSPTDLQIENENNM

SEQ ID NO: 51196 - protein, 32 aa, Artificial Sequence
  Description of Artificial Sequence: Synthetic polypeptide
DEEEIRTTNPVATEQYGSVSPTDLQMIGGLEN

SEQ ID NO: 51197 - protein, 29 aa, Artificial Sequence
  Description of Artificial Sequence: Synthetic peptide
YEEGICTTNPVATEQYGSVSMMNSARGNG

SEQ ID NO: 51198 - protein, 32 aa, Artificial Sequence
  Description of Artificial Sequence: Synthetic polypeptide
DEEEIRTTNPVATEQYGSVSPTDLQPSGGLEM

SEQ ID NO: 51199 - protein, 33 aa, Artificial Sequence
  Description of Artificial Sequence: Synthetic polypeptide
DEEEIRTTNPVATEQYGSVSPTDLQQMRGGLEM

SEQ ID NO: 51200 - protein, 33 aa, Artificial Sequence
  Description of Artificial Sequence: Synthetic polypeptide
DEEEIRTTNPVATEQYGSVSPTDLEIRFENDRI

SEQ ID NO: 51201 - protein, 32 aa, Artificial Sequence
  Description of Artificial Sequence: Synthetic polypeptide
NEEEIRTTNPVATEQYGSTVSCAGNLDEGGNR

SEQ ID NO: 51202 - protein, 29 aa, Artificial Sequence
  Description of Artificial Sequence: Synthetic peptide
YEEGICTTNPVATEQYGSVSMNDQHGNTS

SEQ ID NO: 51203 - protein, 32 aa, Artificial Sequence
  Description of Artificial Sequence: Synthetic polypeptide
NEEEIRTTNPVATEQYGSVCSAWNLDEFGDNR

SEQ ID NO: 51204 - protein, 30 aa, Artificial Sequence
  Description of Artificial Sequence: Synthetic polypeptide
NEREIRTTNPVATEWYGSVVETMNLQIGSR

SEQ ID NO: 51205 - protein, 30 aa, Artificial Sequence
  Description of Artificial Sequence: Synthetic polypeptide
YEEGICTTNPVATEQYGSVSMYNSQRSGNS

SEQ ID NO: 51206 - protein, 30 aa, Artificial Sequence
  Description of Artificial Sequence: Synthetic polypeptide
YEEGICTTNPVATEQYGSVSMNSQRGNNEE

SEQ ID NO: 51207 - protein, 32 aa, Artificial Sequence
  Description of Artificial Sequence: Synthetic polypeptide
DEEEIRTTNPVATEQYGSVSPTALGQREEEQM

SEQ ID NO: 51208 - protein, 32 aa, Artificial Sequence
  Description of Artificial Sequence: Synthetic polypeptide
DEEEIRTTNPVATEQYGSVSPTANLEGRMESD

SEQ ID NO: 51209 - protein, 33 aa, Artificial Sequence
  Description of Artificial Sequence: Synthetic polypeptide
DEEEIRTTNPVATEQYGSVSPTANLERMEEGLT

SEQ ID NO: 51210 - protein, 33 aa, Artificial Sequence
  Description of Artificial Sequence: Synthetic polypeptide
DEEEIRTTNPVATEQYGSVSPTANLQLVGLLPD

SEQ ID NO: 51211 - protein, 30 aa, Artificial Sequence
  Description of Artificial Sequence: Synthetic polypeptide
DEEEIRTTNPVATEQYGSVSPSVVQIGQDI

SEQ ID NO: 51212 - protein, 33 aa, Artificial Sequence
  Description of Artificial Sequence: Synthetic polypeptide
DEEEIRTTNPVATEQYGSVSPTANLQVQLTNLG

SEQ ID NO: 51213 - protein, 33 aa, Artificial Sequence
  Description of Artificial Sequence: Synthetic polypeptide
DEEEIRTTNPVATEQYGSVSPTANMLQDVGELS

SEQ ID NO: 51214 - protein, 29 aa, Artificial Sequence
  Description of Artificial Sequence: Synthetic peptide
YEEGICTTNPVATEQYGSVSMNSQIGNSS

SEQ ID NO: 51215 - protein, 32 aa, Artificial Sequence
  Description of Artificial Sequence: Synthetic polypeptide
DEEEIRTTNPVATEQYGSVSPTAPGQVGLNVV

SEQ ID NO: 51216 - protein, 32 aa, Artificial Sequence
  Description of Artificial Sequence: Synthetic polypeptide
DEEEIRTTNPVATEQYGSVSPTAVQQRIGLQE

SEQ ID NO: 51217 - protein, 28 aa, Artificial Sequence
  Description of Artificial Sequence: Synthetic peptide
NESEIACTNPVATEQYGEASENLQRGGR

SEQ ID NO: 51218 - protein, 32 aa, Artificial Sequence
  Description of Artificial Sequence: Synthetic polypeptide
DEEEIRTTNPVATEQYGSVSPTDIQPDLGPLR

SEQ ID NO: 51219 - protein, 29 aa, Artificial Sequence
  Description of Artificial Sequence: Synthetic peptide
YEEGICTTNPVATEQYGSVSMNQQVRGGS

SEQ ID NO: 51220 - protein, 29 aa, Artificial Sequence
  Description of Artificial Sequence: Synthetic peptide
YEEGICTTNPVATEQYGSVSMNSQRGESI

SEQ ID NO: 51221 - protein, 33 aa, Artificial Sequence
  Description of Artificial Sequence: Synthetic polypeptide
DEEEIRTTNPVATEQYGSVSPTTALQPRQNLND

SEQ ID NO: 51222 - protein, 29 aa, Artificial Sequence
  Description of Artificial Sequence: Synthetic peptide
NEREIRTTNPVATEQYGSVCGTELQIGDA

SEQ ID NO: 51223 - protein, 30 aa, Artificial Sequence
  Description of Artificial Sequence: Synthetic polypeptide
DEDEIRTTNPVAYEQWGSVSTNAGQGEANR

SEQ ID NO: 51224 - protein, 28 aa, Artificial Sequence
  Description of Artificial Sequence: Synthetic peptide
YENEIACVNPVATEQYGVVSDNLQRGNQ

SEQ ID NO: 51225 - protein, 28 aa, Artificial Sequence
  Description of Artificial Sequence: Synthetic peptide
YENEIACVNPVATEQYGEVSDNLQRGNQ

SEQ ID NO: 51226 - protein, 28 aa, Artificial Sequence
  Description of Artificial Sequence: Synthetic peptide
YENEIACTNPVATEQYGEVSENLQSGGR

SEQ ID NO: 51227 - protein, 28 aa, Artificial Sequence
  Description of Artificial Sequence: Synthetic peptide
YENEIACTNPVATEQYGEASENLQRGGR

SEQ ID NO: 51228 - protein, 31 aa, Artificial Sequence
  Description of Artificial Sequence: Synthetic polypeptide
DEEEIRTTNPVATEQYGSVSPMTHHIRGEEE

SEQ ID NO: 51229 - protein, 31 aa, Artificial Sequence
  Description of Artificial Sequence: Synthetic polypeptide
NEEEIRTTNPVATEQYGSVSAGNLDEFGNDT

SEQ ID NO: 51230 - protein, 32 aa, Artificial Sequence
  Description of Artificial Sequence: Synthetic polypeptide
DEEEIRTTNPVATEQYGSVSPMTNMQPFNENM

SEQ ID NO: 51231 - protein, 32 aa, Artificial Sequence
  Description of Artificial Sequence: Synthetic polypeptide
DEEEIRTTNPVATEQYGSVSPNDGLQIDNDQI

SEQ ID NO: 51232 - protein, 30 aa, Artificial Sequence
  Description of Artificial Sequence: Synthetic polypeptide
DEDEIRTTNPVAYEQWGSVSTTNDGQDGER

SEQ ID NO: 51233 - protein, 31 aa, Artificial Sequence
  Description of Artificial Sequence: Synthetic polypeptide
DEEEIRTTNPVATEQYGSVSPNGLQVIMQLS

SEQ ID NO: 51234 - protein, 31 aa, Artificial Sequence
  Description of Artificial Sequence: Synthetic polypeptide
NEEEIRTTNPVATEQYGSVSAGNLDEFGENF

SEQ ID NO: 51235 - protein, 28 aa, Artificial Sequence
  Description of Artificial Sequence: Synthetic peptide
YENEIACTNPVATEQYGEASDNLQSGNR

SEQ ID NO: 51236 - protein, 32 aa, Artificial Sequence
  Description of Artificial Sequence: Synthetic polypeptide
DEEEIRTTNPVATEQYGSVSPNLLQEEAEERL

SEQ ID NO: 51237 - protein, 30 aa, Artificial Sequence
  Description of Artificial Sequence: Synthetic polypeptide
DEDEIRTTNPVAYEQWGSVSTTGQDGMNDR

SEQ ID NO: 51238 - protein, 34 aa, Artificial Sequence
  Description of Artificial Sequence: Synthetic polypeptide
DEEEIRTTNPVATEQYGSVSPNLLQPEEGENPRL

SEQ ID NO: 51239 - protein, 32 aa, Artificial Sequence
  Description of Artificial Sequence: Synthetic polypeptide
DEEEIRTTNPVATEQYGSVSPMNSQRGEELVM

SEQ ID NO: 51240 - protein, 31 aa, Artificial Sequence
  Description of Artificial Sequence: Synthetic polypeptide
NEQEIRTTNPVATEQYGSVWPTNLQEIGSQR

SEQ ID NO: 51241 - protein, 28 aa, Artificial Sequence
  Description of Artificial Sequence: Synthetic peptide
YENEIASTNPVATEQYGEVSENLQSGGR

SEQ ID NO: 51242 - protein, 31 aa, Artificial Sequence
  Description of Artificial Sequence: Synthetic polypeptide
DEEEIRTTNPVATEQYGSVSPMNLQIHEFQD

SEQ ID NO: 51243 - protein, 30 aa, Artificial Sequence
  Description of Artificial Sequence: Synthetic polypeptide
DEEEIRTTNPVATEQYGSVSPIPLDNINEE

SEQ ID NO: 51244 - protein, 32 aa, Artificial Sequence
  Description of Artificial Sequence: Synthetic polypeptide
NEEEIRTTNPVATEQYGSVSAWNLDEAFGNAR

SEQ ID NO: 51245 - protein, 32 aa, Artificial Sequence
  Description of Artificial Sequence: Synthetic polypeptide
NEEEIRTTNPVATEQYGSVSAWNLDDEFIGNR

SEQ ID NO: 51246 - protein, 28 aa, Artificial Sequence
  Description of Artificial Sequence: Synthetic peptide
YENEIATTNPVCTEQYGVVSDNLQSGNQ

SEQ ID NO: 51247 - protein, 31 aa, Artificial Sequence
  Description of Artificial Sequence: Synthetic polypeptide
DEEEIRTTNPVATEQYGSVSPIYLEIGTNEL

SEQ ID NO: 51248 - protein, 31 aa, Artificial Sequence
  Description of Artificial Sequence: Synthetic polypeptide
YENEIATTNPVATEQYGSVSYTNSLQRPNTA

SEQ ID NO: 51249 - protein, 32 aa, Artificial Sequence
  Description of Artificial Sequence: Synthetic polypeptide
DEEEIRTTNPVATEQYGSVSPLENMIRGEMRD

SEQ ID NO: 51250 - protein, 31 aa, Artificial Sequence
  Description of Artificial Sequence: Synthetic polypeptide
DEDEIRTTNPVAYEQWGSVSTNLQNDGNNAQ

SEQ ID NO: 51251 - protein, 30 aa, Artificial Sequence
  Description of Artificial Sequence: Synthetic polypeptide
NEQEIRTTNPVATEQYGSLSTHLQRAQGQE

SEQ ID NO: 51252 - protein, 32 aa, Artificial Sequence
  Description of Artificial Sequence: Synthetic polypeptide
DEEEIRTTNPVATEQYGSVSPLNLQQSQEQNS

SEQ ID NO: 51253 - protein, 30 aa, Artificial Sequence
  Description of Artificial Sequence: Synthetic polypeptide
NEEEIRTTNPVATEQYGSVSAWCLDEFGNN

SEQ ID NO: 51254 - protein, 28 aa, Artificial Sequence
  Description of Artificial Sequence: Synthetic peptide
YENEIASVNPVATEQYGVVSDNLQRGNQ

SEQ ID NO: 51255 - protein, 28 aa, Artificial Sequence
  Description of Artificial Sequence: Synthetic peptide
YENEIASVNPVATEQYGVVSDNLQRGGR

SEQ ID NO: 51256 - protein, 32 aa, Artificial Sequence
  Description of Artificial Sequence: Synthetic polypeptide
NEEEIRTTNPVATEQYGSVSALNLDEFGNNNR

SEQ ID NO: 51257 - protein, 32 aa, Artificial Sequence
  Description of Artificial Sequence: Synthetic polypeptide
AEEEIRTTNPVATEQYGSVVVVTNLQNGNDNA

SEQ ID NO: 51258 - protein, 33 aa, Artificial Sequence
  Description of Artificial Sequence: Synthetic polypeptide
DEEEIRTTNPVATEQYGSVSPMNEGQRGEENTM

SEQ ID NO: 51259 - protein, 28 aa, Artificial Sequence
  Description of Artificial Sequence: Synthetic peptide
YENEIASVNPVATEQYGVVSENLQRGGR

SEQ ID NO: 51260 - protein, 32 aa, Artificial Sequence
  Description of Artificial Sequence: Synthetic polypeptide
DEEEIRTTNPVATEQYGSVSPNSLAQPPDIRE

SEQ ID NO: 51261 - protein, 32 aa, Artificial Sequence
  Description of Artificial Sequence: Synthetic polypeptide
DEDEIRTTNPVAYEQWGSVSTNLQGNMGDNER

SEQ ID NO: 51262 - protein, 32 aa, Artificial Sequence
  Description of Artificial Sequence: Synthetic polypeptide
DEDEIRTTNPVAYEQWGSVSTNLQGNAGNEER

SEQ ID NO: 51263 - protein, 30 aa, Artificial Sequence
  Description of Artificial Sequence: Synthetic polypeptide
NEREIRTTNPVATEQYGSAVETNLEPHGSR

SEQ ID NO: 51264 - protein, 31 aa, Artificial Sequence
  Description of Artificial Sequence: Synthetic polypeptide
DEDEIRTTNPVAYEQWGSVSTNLEQGSGDAR

SEQ ID NO: 51265 - protein, 31 aa, Artificial Sequence
  Description of Artificial Sequence: Synthetic polypeptide
YELEISTTNPVATEQYGSVYTTTPLNQRGNR

SEQ ID NO: 51266 - protein, 31 aa, Artificial Sequence
  Description of Artificial Sequence: Synthetic polypeptide
DEDEIRTTNPVAYEQWGSVSTNLEQDNGNGT

SEQ ID NO: 51267 - protein, 31 aa, Artificial Sequence
  Description of Artificial Sequence: Synthetic polypeptide
DEDEIRTTNPVAYEQWGSVSTNLEQDGDGNT

SEQ ID NO: 51268 - protein, 31 aa, Artificial Sequence
  Description of Artificial Sequence: Synthetic polypeptide
YEKEINTTNPVATEQYGSVVCITNLARGNDR

SEQ ID NO: 51269 - protein, 31 aa, Artificial Sequence
  Description of Artificial Sequence: Synthetic polypeptide
DEEEIRTTNPVATEQYGSVSPNNIDRNGEFE

SEQ ID NO: 51270 - protein, 31 aa, Artificial Sequence
  Description of Artificial Sequence: Synthetic polypeptide
DEDEIRTTNPVAYEQWGSVSTNGQQDNGNAR

SEQ ID NO: 51271 - protein, 34 aa, Artificial Sequence
  Description of Artificial Sequence: Synthetic polypeptide
DEEEIRTTNPVATEQYGSVSPNNILEQTRGFMRD

SEQ ID NO: 51272 - protein, 30 aa, Artificial Sequence
  Description of Artificial Sequence: Synthetic polypeptide
DEDEIRTTNPVAYEQWGSVSTNDMQEGDAR

SEQ ID NO: 51273 - protein, 30 aa, Artificial Sequence
  Description of Artificial Sequence: Synthetic polypeptide
DEEEIRTTNPVATEQYGSVSPNNIVLEQRE

SEQ ID NO: 51274 - protein, 30 aa, Artificial Sequence
  Description of Artificial Sequence: Synthetic polypeptide
YEGEISTTNPVATEQYGQVSTLLQLRGANG

SEQ ID NO: 51275 - protein, 30 aa, Artificial Sequence
  Description of Artificial Sequence: Synthetic polypeptide
NEREIRTTNPVATEQYGSAVYTPNLEIGSR

SEQ ID NO: 51276 - protein, 30 aa, Artificial Sequence
  Description of Artificial Sequence: Synthetic polypeptide
YEGEISTTNPVATEGYGSVSYTNSLQRPNT

SEQ ID NO: 51277 - protein, 32 aa, Artificial Sequence
  Description of Artificial Sequence: Synthetic polypeptide
NEEEIRTTNPVATEQYGSVNSCTVPLQRENMQ

SEQ ID NO: 51278 - protein, 31 aa, Artificial Sequence
  Description of Artificial Sequence: Synthetic polypeptide
NEEEIRTTNPVATEQYGSVSAENLDEFGNNA

SEQ ID NO: 51279 - protein, 31 aa, Artificial Sequence
  Description of Artificial Sequence: Synthetic polypeptide
DEEEIRTTNPVATEQYGSVSPNNGQRIPEQL

SEQ ID NO: 51280 - protein, 31 aa, Artificial Sequence
  Description of Artificial Sequence: Synthetic polypeptide
DEEEIRTTNPVATEQYGSVSPNNALQTIDDQ

SEQ ID NO: 51281 - protein, 31 aa, Artificial Sequence
  Description of Artificial Sequence: Synthetic polypeptide
DEEEIRTTNPVATEQYGSVSPNMQRQTQVVV

SEQ ID NO: 51282 - protein, 31 aa, Artificial Sequence
  Description of Artificial Sequence: Synthetic polypeptide
DEEEIRTTNPVATEQYGSVSPNLQPPDIVEG

SEQ ID NO: 51283 - protein, 31 aa, Artificial Sequence
  Description of Artificial Sequence: Synthetic polypeptide
DEDEIRTTNPVAYEQWGSVSTNLQGEHGDAR

SEQ ID NO: 51284 - protein, 31 aa, Artificial Sequence
  Description of Artificial Sequence: Synthetic polypeptide
DEDEIRTTNPVAYEQWGSVSTNLQGDGDDAR

SEQ ID NO: 51285 - protein, 31 aa, Artificial Sequence
  Description of Artificial Sequence: Synthetic polypeptide
DEDEIRTTNPVAYEQWGSVSTNLQGDAGNAG

SEQ ID NO: 51286 - protein, 31 aa, Artificial Sequence
  Description of Artificial Sequence: Synthetic polypeptide
DEEEIRTTNPVATEQYGSVSPNLQPPEIVQV

SEQ ID NO: 51287 - protein, 30 aa, Artificial Sequence
  Description of Artificial Sequence: Synthetic polypeptide
DEDEIRTTNPVAYEQWGSVSTNLQAGGDAS

SEQ ID NO: 51288 - protein, 30 aa, Artificial Sequence
  Description of Artificial Sequence: Synthetic polypeptide
DEDEIRTTNPVAYEQWGSVSTNLQAGGDAG

SEQ ID NO: 51289 - protein, 31 aa, Artificial Sequence
  Description of Artificial Sequence: Synthetic polypeptide
DEDEIRTTNPVAYEQWGSVSTNLQGNMGDER

SEQ ID NO: 51290 - protein, 31 aa, Artificial Sequence
  Description of Artificial Sequence: Synthetic polypeptide
DEDEIRTTNPVAYEQWGSVSTNLQADGGNNN

SEQ ID NO: 51291 - protein, 31 aa, Artificial Sequence
  Description of Artificial Sequence: Synthetic polypeptide
DEEEIRTTNPVATEQYGSVSPNLQQMEPDIP

SEQ ID NO: 51292 - protein, 30 aa, Artificial Sequence
  Description of Artificial Sequence: Synthetic polypeptide
NEEEIRTTNPVATEQYGSVSAGNEDEGGNE

SEQ ID NO: 51293 - protein, 30 aa, Artificial Sequence
  Description of Artificial Sequence: Synthetic polypeptide
DEDEIRTTNPVAYEQWGSVSTNLNGDSGNA

SEQ ID NO: 51294 - protein, 28 aa, Artificial Sequence
  Description of Artificial Sequence: Synthetic peptide
YENEIACTNPVATEQYGEASDNLQRGGR

SEQ ID NO: 51295 - protein, 31 aa, Artificial Sequence
  Description of Artificial Sequence: Synthetic polypeptide
NEEEIRTTNPVATEQYGSVSAGALDEFGSNR

SEQ ID NO: 51296 - protein, 32 aa, Artificial Sequence
  Description of Artificial Sequence: Synthetic polypeptide
YEMEISTTNPVATEQYGSVGSTGNLQESGVNR

SEQ ID NO: 51297 - protein, 32 aa, Artificial Sequence
  Description of Artificial Sequence: Synthetic polypeptide
AEEEIRTTNPVATEQYGSVVVVTNNLQQGGNT

SEQ ID NO: 51298 - protein, 30 aa, Artificial Sequence
  Description of Artificial Sequence: Synthetic polypeptide
DEDEIRTTNPVAYEQWGSVSTNLNSGNGNA

SEQ ID NO: 51299 - protein, 30 aa, Artificial Sequence
  Description of Artificial Sequence: Synthetic polypeptide
NESEIRTTNPVATEQYGSTVWTDNQQDGSR

SEQ ID NO: 51300 - protein, 33 aa, Artificial Sequence
  Description of Artificial Sequence: Synthetic polypeptide
DEEEIRTTNPVATEQYGSVSPTTILQRTPEQRI

SEQ ID NO: 51301 - protein, 32 aa, Artificial Sequence
  Description of Artificial Sequence: Synthetic polypeptide
YEEEISTTNPVATEQYGASVQSTNIQRGSNPM

SEQ ID NO: 51302 - protein, 28 aa, Artificial Sequence
  Description of Artificial Sequence: Synthetic peptide
YEEEIATVNPVCTEQYGVVSDNLQSGNL

SEQ ID NO: 51303 - protein, 30 aa, Artificial Sequence
  Description of Artificial Sequence: Synthetic polypeptide
NEEEIATTNPVATEQYGSVATNLQESGDEN

SEQ ID NO: 51304 - protein, 33 aa, Artificial Sequence
  Description of Artificial Sequence: Synthetic polypeptide
DEEEIRTTNPVATEQYGSVSSTTDLQNGGNNQT

SEQ ID NO: 51305 - protein, 31 aa, Artificial Sequence
  Description of Artificial Sequence: Synthetic polypeptide
NEEEIATTNPVATEQYGSVATNLQEGGNPED

SEQ ID NO: 51306 - protein, 30 aa, Artificial Sequence
  Description of Artificial Sequence: Synthetic polypeptide
DEDEIRTTNPVATEPYGETSTGNLSQRGDS

SEQ ID NO: 51307 - protein, 28 aa, Artificial Sequence
  Description of Artificial Sequence: Synthetic peptide
YEEEIATVNPVCTEQYGVVSDNLQAGNQ

SEQ ID NO: 51308 - protein, 33 aa, Artificial Sequence
  Description of Artificial Sequence: Synthetic polypeptide
DEEEIRTTNPVATEQYGSVSSTTLDQGGGNNQQ

SEQ ID NO: 51309 - protein, 33 aa, Artificial Sequence
  Description of Artificial Sequence: Synthetic polypeptide
DEEEIRTTNPVATEQYGSVSSTTLFQNGGGNQQ

SEQ ID NO: 51310 - protein, 33 aa, Artificial Sequence
  Description of Artificial Sequence: Synthetic polypeptide
DEEEIRTTNPVATEQYGSVSSTTLQDGGNNEQQ

SEQ ID NO: 51311 - protein, 31 aa, Artificial Sequence
  Description of Artificial Sequence: Synthetic polypeptide
NETEIRTTNPVATEMYGSVSTGNDLQNGDND

SEQ ID NO: 51312 - protein, 33 aa, Artificial Sequence
  Description of Artificial Sequence: Synthetic polypeptide
DEEEIRTTNPVATEQYGSVSSTTLQLIGGNNGQ

SEQ ID NO: 51313 - protein, 31 aa, Artificial Sequence
  Description of Artificial Sequence: Synthetic polypeptide
NETEIRTTNPVATEMYGSVSTNLQDNGGNND

SEQ ID NO: 51314 - protein, 31 aa, Artificial Sequence
  Description of Artificial Sequence: Synthetic polypeptide
NETEIRTTNPVATEMYGSVSTNLQGNMGNGD

SEQ ID NO: 51315 - protein, 33 aa, Artificial Sequence
  Description of Artificial Sequence: Synthetic polypeptide
DEEEIRTTNPVATEQYGSVSSTTNLLQATYTSR

SEQ ID NO: 51316 - protein, 34 aa, Artificial Sequence
  Description of Artificial Sequence: Synthetic polypeptide
DEEEIRTTNPVATEQYGSVSSTTNMDQHGHTTNR

SEQ ID NO: 51317 - protein, 33 aa, Artificial Sequence
  Description of Artificial Sequence: Synthetic polypeptide
DEEEIRTTNPVATEQYGSVSSTTDLQDIGGNNQ

SEQ ID NO: 51318 - protein, 29 aa, Artificial Sequence
  Description of Artificial Sequence: Synthetic peptide
YEEEIATVNPVCTEQYGSVSATNLQHGEQ

SEQ ID NO: 51319 - protein, 28 aa, Artificial Sequence
  Description of Artificial Sequence: Synthetic peptide
YEEEIATVNPVCTEQYGVVSDNLQSGNQ

SEQ ID NO: 51320 - protein, 28 aa, Artificial Sequence
  Description of Artificial Sequence: Synthetic peptide
YEEEIATVNPVCTEQYGVVSDNLQSGNV

SEQ ID NO: 51321 - protein, 33 aa, Artificial Sequence
  Description of Artificial Sequence: Synthetic polypeptide
DEEEIRTTNPVATEQYGSVSSTPAGPNRNGMNR

SEQ ID NO: 51322 - protein, 32 aa, Artificial Sequence
  Description of Artificial Sequence: Synthetic polypeptide
NEEEIATTNPVATEQYGSVATSNLVQQGENDR

SEQ ID NO: 51323 - protein, 31 aa, Artificial Sequence
  Description of Artificial Sequence: Synthetic polypeptide
DEDEIRTTNPVATEQWGEVSTNLQNGGDNNH

SEQ ID NO: 51324 - protein, 29 aa, Artificial Sequence
  Description of Artificial Sequence: Synthetic peptide
DEDEIRTTNPVATEQWGETSTNLQGNGDS

SEQ ID NO: 51325 - protein, 32 aa, Artificial Sequence
  Description of Artificial Sequence: Synthetic polypeptide
AEEEIRTTNPVATEQYGSVVVTTNLQQNGNNA

SEQ ID NO: 51326 - protein, 34 aa, Artificial Sequence
  Description of Artificial Sequence: Synthetic polypeptide
DEEEIRTTNPVATEQYGSVSSTPNLPNMRNGMNV

SEQ ID NO: 51327 - protein, 28 aa, Artificial Sequence
  Description of Artificial Sequence: Synthetic peptide
YEEEIATVNPVSTEQYGVVSDNLQSGNQ

SEQ ID NO: 51328 - protein, 33 aa, Artificial Sequence
  Description of Artificial Sequence: Synthetic polypeptide
DEEEIRTTNPVATEQYGSVSSTQNGQIGGGNET

SEQ ID NO: 51329 - protein, 29 aa, Artificial Sequence
  Description of Artificial Sequence: Synthetic peptide
DEDEIRTTNPVATEQWGCTATNLQRGDIE

SEQ ID NO: 51330 - protein, 33 aa, Artificial Sequence
  Description of Artificial Sequence: Synthetic polypeptide
DEEEIRTTNPVATEQYGSVSSTQNLGSGVGNTP

SEQ ID NO: 51331 - protein, 33 aa, Artificial Sequence
  Description of Artificial Sequence: Synthetic polypeptide
DEEEIRTTNPVATEQYGSVSSTSNGGQGGGNED

SEQ ID NO: 51332 - protein, 31 aa, Artificial Sequence
  Description of Artificial Sequence: Synthetic polypeptide
DEDEIRTTNPVATEQWGAVSTNLQGDTGNQS

SEQ ID NO: 51333 - protein, 28 aa, Artificial Sequence
  Description of Artificial Sequence: Synthetic peptide
YEEEIATVNPVCTEQYGVVSENLQSGNQ

SEQ ID NO: 51334 - protein, 30 aa, Artificial Sequence
  Description of Artificial Sequence: Synthetic polypeptide
NEEEIATTNPVATEQYGSVATNLQQPDQRE

SEQ ID NO: 51335 - protein, 31 aa, Artificial Sequence
  Description of Artificial Sequence: Synthetic polypeptide
NEEEIATTNPVATEQYGSVATNLQIGENPEE

SEQ ID NO: 51336 - protein, 32 aa, Artificial Sequence
  Description of Artificial Sequence: Synthetic polypeptide
DEDEIRTTNPVATEPYGSVSTNLQGEHGNNSD

SEQ ID NO: 51337 - protein, 28 aa, Artificial Sequence
  Description of Artificial Sequence: Synthetic peptide
YEEEIATVNPVCTEQYGEVSDNLQSGNK

SEQ ID NO: 51338 - protein, 31 aa, Artificial Sequence
  Description of Artificial Sequence: Synthetic polypeptide
NETEIRTTNPVATEMYGSVSTNLQNNGDNED

SEQ ID NO: 51339 - protein, 28 aa, Artificial Sequence
  Description of Artificial Sequence: Synthetic peptide
YEEEIATVNPVATEQYGVVSENLQSENQ

SEQ ID NO: 51340 - protein, 31 aa, Artificial Sequence
  Description of Artificial Sequence: Synthetic polypeptide
NEEEIATTNPVATEQYGSCSTHLQPRDQGDR

SEQ ID NO: 51341 - protein, 32 aa, Artificial Sequence
  Description of Artificial Sequence: Synthetic polypeptide
DEEEIRTTNPVATEQYGSVSSVFLQRVNEANV

SEQ ID NO: 51342 - protein, 31 aa, Artificial Sequence
  Description of Artificial Sequence: Synthetic polypeptide
DEEEIRTTNPVATEQYGSVSSVLLQDSGGID

SEQ ID NO: 51343 - protein, 34 aa, Artificial Sequence
  Description of Artificial Sequence: Synthetic polypeptide
DEEEIRTTNPVATEQYGSVSSVTENLLQGIGNTE

SEQ ID NO: 51344 - protein, 31 aa, Artificial Sequence
  Description of Artificial Sequence: Synthetic polypeptide
DEEEIRTTNPVATEQYGSVSSWLQDSTQGIM

SEQ ID NO: 51345 - protein, 32 aa, Artificial Sequence
  Description of Artificial Sequence: Synthetic polypeptide
AEEEIRTTNPVATEQYGSVVVTTNLQQGGNNY

SEQ ID NO: 51346 - protein, 33 aa, Artificial Sequence
  Description of Artificial Sequence: Synthetic polypeptide
DEEEIRTTNPVATEQYGSVSTADNAEQVGNSDQ

SEQ ID NO: 51347 - protein, 31 aa, Artificial Sequence
  Description of Artificial Sequence: Synthetic polypeptide
DEDEIRTTNPVATECYGSVSTTNGNDEMGNR

SEQ ID NO: 51348 - protein, 32 aa, Artificial Sequence
  Description of Artificial Sequence: Synthetic polypeptide
DEDEIRTTNPVATECYGSVSTNLQNNGDNLEE

SEQ ID NO: 51349 - protein, 31 aa, Artificial Sequence
  Description of Artificial Sequence: Synthetic polypeptide
DEDEIRTTNPVATECYGSVSTNLNGEHGNAD

SEQ ID NO: 51350 - protein, 29 aa, Artificial Sequence
  Description of Artificial Sequence: Synthetic peptide
NEEEIATTNPVATEQYGSCSTHLQDQGDN

SEQ ID NO: 51351 - protein, 28 aa, Artificial Sequence
  Description of Artificial Sequence: Synthetic peptide
YEEEIATVNPVATEQYGDVSENLQSENQ

SEQ ID NO: 51352 - protein, 33 aa, Artificial Sequence
  Description of Artificial Sequence: Synthetic polypeptide
DEEEIRTTNPVATEQYGSVSTALQGQGGGNIGE

SEQ ID NO: 51353 - protein, 33 aa, Artificial Sequence
  Description of Artificial Sequence: Synthetic polypeptide
DEEEIRTTNPVATEQYGSVSTALQQGINGGGQG

SEQ ID NO: 51354 - protein, 33 aa, Artificial Sequence
  Description of Artificial Sequence: Synthetic polypeptide
DEEEIRTTNPVATEQYGSVSTALQQGQGGTNEE

SEQ ID NO: 51355 - protein, 30 aa, Artificial Sequence
  Description of Artificial Sequence: Synthetic polypeptide
DEDEIRTTNPVATEGYGCVSTNGQGNGNVN

SEQ ID NO: 51356 - protein, 31 aa, Artificial Sequence
  Description of Artificial Sequence: Synthetic polypeptide
DEEEIRTTNPVATEQYGSVSSTWPLQDTDEQ

SEQ ID NO: 51357 - protein, 29 aa, Artificial Sequence
  Description of Artificial Sequence: Synthetic peptide
YEEEIATVNPVATEQYGVVSATDLQSGNQ

SEQ ID NO: 51358 - protein, 32 aa, Artificial Sequence
  Description of Artificial Sequence: Synthetic polypeptide
DEDEIRTTNPVATEGYGSVSTNLQGGGNGGGS

SEQ ID NO: 51359 - protein, 34 aa, Artificial Sequence
  Description of Artificial Sequence: Synthetic polypeptide
DEEEIRTTNPVATEQYGSVSSTTPAIQMRNGNPR

SEQ ID NO: 51360 - protein, 30 aa, Artificial Sequence
  Description of Artificial Sequence: Synthetic polypeptide
DEDEIRTTNPVATEHYGSVVTGNDGGAGNR

SEQ ID NO: 51361 - protein, 29 aa, Artificial Sequence
  Description of Artificial Sequence: Synthetic peptide
YEEEIATVNPVATEQYGVVSENLQSAGNQ

SEQ ID NO: 51362 - protein, 32 aa, Artificial Sequence
  Description of Artificial Sequence: Synthetic polypeptide
AEEEIRTTNPVATEQYGSVVVTTNLQQGGNST

SEQ ID NO: 51363 - protein, 31 aa, Artificial Sequence
  Description of Artificial Sequence: Synthetic polypeptide
NEEEIATTNPVATEQYGSVAITNLQQGNTPE

SEQ ID NO: 51364 - protein, 33 aa, Artificial Sequence
  Description of Artificial Sequence: Synthetic polypeptide
NEEEIATTNPVATEQYGSVAITANLVQRGENDR

SEQ ID NO: 51365 - protein, 32 aa, Artificial Sequence
  Description of Artificial Sequence: Synthetic polypeptide
DEDEIRTTNPVATEHYGSVSTNLQPQGDNNDG

SEQ ID NO: 51366 - protein, 32 aa, Artificial Sequence
  Description of Artificial Sequence: Synthetic polypeptide
YEEEICTTNPVATEQYGSVGSTGNLQEVGVLR

SEQ ID NO: 51367 - protein, 30 aa, Artificial Sequence
  Description of Artificial Sequence: Synthetic polypeptide
NEEEIATTNPVATEQYGSVAATNPDEAGNR

SEQ ID NO: 51368 - protein, 31 aa, Artificial Sequence
  Description of Artificial Sequence: Synthetic polypeptide
DEDEIRTTNPVATEHYGSVSTNLQGQGGDMN

SEQ ID NO: 51369 - protein, 29 aa, Artificial Sequence
  Description of Artificial Sequence: Synthetic peptide
NEEEIATTNPVATEQYGSTSTTLQPDQGR

SEQ ID NO: 51370 - protein, 32 aa, Artificial Sequence
  Description of Artificial Sequence: Synthetic polypeptide
NEEEIATTNPVATEQYGSISTHALSQRVGGNR

SEQ ID NO: 51371 - protein, 28 aa, Artificial Sequence
  Description of Artificial Sequence: Synthetic peptide
YEEEIATVNPVATEQYGVVSDNLQSGEL

SEQ ID NO: 51372 - protein, 28 aa, Artificial Sequence
  Description of Artificial Sequence: Synthetic peptide
YEEEIATVNPVATEQYGVVSDNLQSENQ

SEQ ID NO: 51373 - protein, 29 aa, Artificial Sequence
  Description of Artificial Sequence: Synthetic peptide
NEEEIATTNPVATEQYGSIATHLEQRQER

SEQ ID NO: 51374 - protein, 32 aa, Artificial Sequence
  Description of Artificial Sequence: Synthetic polypeptide
DEDEIRTTNPVATEGYGSVSTNLQGGNGGNVN

SEQ ID NO: 51375 - protein, 31 aa, Artificial Sequence
  Description of Artificial Sequence: Synthetic polypeptide
DEDEIRTTNPVATEHYGSVSTNLQHQGGDAN

SEQ ID NO: 51376 - protein, 31 aa, Artificial Sequence
  Description of Artificial Sequence: Synthetic polypeptide
YEEEIFTTNPTATEQYGSVNSTNLPEQGNIR

SEQ ID NO: 51377 - protein, 32 aa, Artificial Sequence
  Description of Artificial Sequence: Synthetic polypeptide
DEEEIRTTNPVATEQYGSVSSTPAGNMRGMNV

SEQ ID NO: 51378 - protein, 31 aa, Artificial Sequence
  Description of Artificial Sequence: Synthetic polypeptide
YEEEIGFTNPVATQQYGSVSTMNLQSRGNNQ

SEQ ID NO: 51379 - protein, 29 aa, Artificial Sequence
  Description of Artificial Sequence: Synthetic peptide
DEDEIRTTNPVATEQYGETSTNGQGGGGE

SEQ ID NO: 51380 - protein, 30 aa, Artificial Sequence
  Description of Artificial Sequence: Synthetic polypeptide
DEDEIRTTNPVATEQYGETSSTNSLQNGGS

SEQ ID NO: 51381 - protein, 33 aa, Artificial Sequence
  Description of Artificial Sequence: Synthetic polypeptide
DEEEIRTTNPVATEQYGSVSSTLGLQGEGNGDG

SEQ ID NO: 51382 - protein, 31 aa, Artificial Sequence
  Description of Artificial Sequence: Synthetic polypeptide
DEEEIRTTNPVATEQYGSVSSTLGQPVFQNE

SEQ ID NO: 51383 - protein, 33 aa, Artificial Sequence
  Description of Artificial Sequence: Synthetic polypeptide
DEEEIRTTNPVATEQYGSVSSTLNFQNMGDSRA

SEQ ID NO: 51384 - protein, 29 aa, Artificial Sequence
  Description of Artificial Sequence: Synthetic peptide
DEDEIRTTNPVATEQYGEMSTNGQGGDDN

SEQ ID NO: 51385 - protein, 33 aa, Artificial Sequence
  Description of Artificial Sequence: Synthetic polypeptide
DEEEIRTTNPVATEQYGSVSSTLNQVQNNGGNT

SEQ ID NO: 51386 - protein, 29 aa, Artificial Sequence
  Description of Artificial Sequence: Synthetic peptide
DEDEIRTTNPVATEQYGELTTDLQRGDSP

SEQ ID NO: 51387 - protein, 31 aa, Artificial Sequence
  Description of Artificial Sequence: Synthetic polypeptide
DEDEIRTTNPVATEQYGELTSTNLQRGDASL

SEQ ID NO: 51388 - protein, 32 aa, Artificial Sequence
  Description of Artificial Sequence: Synthetic polypeptide
YEEEIITTNPVATEQYGSVGSEGNLQEVGVNR

SEQ ID NO: 51389 - protein, 32 aa, Artificial Sequence
  Description of Artificial Sequence: Synthetic polypeptide
DEEEIRTTNPVATEQYGSVSSTNADRDSEVNM

SEQ ID NO: 51390 - protein, 33 aa, Artificial Sequence
  Description of Artificial Sequence: Synthetic polypeptide
DEEEIRTTNPVATEQYGSVSSTNDDQTGNGNGT

SEQ ID NO: 51391 - protein, 33 aa, Artificial Sequence
  Description of Artificial Sequence: Synthetic polypeptide
DEEEIRTTNPVATEQYGSVSSTNDIQTGNGNGQ

SEQ ID NO: 51392 - protein, 33 aa, Artificial Sequence
  Description of Artificial Sequence: Synthetic polypeptide
DEEEIRTTNPVATEQYGSVSSTNDQAQNGGNNT

SEQ ID NO: 51393 - protein, 33 aa, Artificial Sequence
  Description of Artificial Sequence: Synthetic polypeptide
DEEEIRTTNPVATEQYGSVSSTNDQGQTGGGNT

SEQ ID NO: 51394 - protein, 29 aa, Artificial Sequence
  Description of Artificial Sequence: Synthetic peptide
DEDEIRTTNPVATEQYGETSTNGQQGGDS

SEQ ID NO: 51395 - protein, 29 aa, Artificial Sequence
  Description of Artificial Sequence: Synthetic peptide
DEDEIRTTNPVATEQYGETSTNLLIGDSV

SEQ ID NO: 51396 - protein, 30 aa, Artificial Sequence
  Description of Artificial Sequence: Synthetic polypeptide
DEDEIRTTNPVATEQYGETSTNLQGDGDSG

SEQ ID NO: 51397 - protein, 30 aa, Artificial Sequence
  Description of Artificial Sequence: Synthetic polypeptide
DEDEIRTTNPVATEQYGETSTNLQGGDGSQ

SEQ ID NO: 51398 - protein, 30 aa, Artificial Sequence
  Description of Artificial Sequence: Synthetic polypeptide
DEDEIRTTNPVATEQYGEVTSTNGQGEGDG

SEQ ID NO: 51399 - protein, 31 aa, Artificial Sequence
  Description of Artificial Sequence: Synthetic polypeptide
NETEIRTTNPVATEHYGSVSTNLQNGGDNDD

SEQ ID NO: 51400 - protein, 32 aa, Artificial Sequence
  Description of Artificial Sequence: Synthetic polypeptide
DEDEIRTTNPVATEQYGEVTSCTGNLSQRGDS

SEQ ID NO: 51401 - protein, 32 aa, Artificial Sequence
  Description of Artificial Sequence: Synthetic polypeptide
YEEEIQTTNPVATEQYGSVYTTNPLNARGDNR

SEQ ID NO: 51402 - protein, 32 aa, Artificial Sequence
  Description of Artificial Sequence: Synthetic polypeptide
DEDEIRTTNPVATEQYGEVSTNLQNGMGQNNH

SEQ ID NO: 51403 - protein, 32 aa, Artificial Sequence
  Description of Artificial Sequence: Synthetic polypeptide
DEDEIRTTNPVATEQYGEVSTNLQNGGPNDEN

SEQ ID NO: 51404 - protein, 32 aa, Artificial Sequence
  Description of Artificial Sequence: Synthetic polypeptide
DEDEIRTTNPVATEQYGEVSTNLQGNGPNDGN

SEQ ID NO: 51405 - protein, 33 aa, Artificial Sequence
  Description of Artificial Sequence: Synthetic polypeptide
DEEEIRTTNPVATEQYGSVSSTNDQQGGGNTTT

SEQ ID NO: 51406 - protein, 32 aa, Artificial Sequence
  Description of Artificial Sequence: Synthetic polypeptide
DEDEIRTTNPVATEQYGEVISCTNLSQRGGDS

SEQ ID NO: 51407 - protein, 31 aa, Artificial Sequence
  Description of Artificial Sequence: Synthetic polypeptide
NETEIRTTNPVATEHYGSVSTNLQSNDGDND

SEQ ID NO: 51408 - protein, 31 aa, Artificial Sequence
  Description of Artificial Sequence: Synthetic polypeptide
DEDEIRTTNPVATEQYGETTSTDNLQRGDSQ

SEQ ID NO: 51409 - protein, 31 aa, Artificial Sequence
  Description of Artificial Sequence: Synthetic polypeptide
NEEEIATTNPVATEQYGSVSAINLDEADGNR

SEQ ID NO: 51410 - protein, 31 aa, Artificial Sequence
  Description of Artificial Sequence: Synthetic polypeptide
DEDEIRTTNPVATEQYGETSTNSLQRGDEPS

SEQ ID NO: 51411 - protein, 30 aa, Artificial Sequence
  Description of Artificial Sequence: Synthetic polypeptide
DEDEIRTTNPVATEQYGETSTNNQRGQDSQ

SEQ ID NO: 51412 - protein, 30 aa, Artificial Sequence
  Description of Artificial Sequence: Synthetic polypeptide
DEDEIRTTNPVATEQYGETSTNLQNGGDES

SEQ ID NO: 51413 - protein, 30 aa, Artificial Sequence
  Description of Artificial Sequence: Synthetic polypeptide
DEDEIRTTNPVATEQYGETSTNLQHGQGDS

SEQ ID NO: 51414 - protein, 33 aa, Artificial Sequence
  Description of Artificial Sequence: Synthetic polypeptide
YEEEIQTTNPVATEQYGSVGSTGNLQEVGVNTR

SEQ ID NO: 51415 - protein, 31 aa, Artificial Sequence
  Description of Artificial Sequence: Synthetic polypeptide
DEEEIRTTNPVATEQYGSVSTANGHGNGEFE

SEQ ID NO: 51416 - protein, 29 aa, Artificial Sequence
  Description of Artificial Sequence: Synthetic peptide
DEDEIRTTNPVATEQYGCVSTPLQHPDQD

SEQ ID NO: 51417 - protein, 32 aa, Artificial Sequence
  Description of Artificial Sequence: Synthetic polypeptide
DEDEIRTTNPVATEQYGCVSTNLNQNGEGNEH

SEQ ID NO: 51418 - protein, 29 aa, Artificial Sequence
  Description of Artificial Sequence: Synthetic peptide
DEDEIRTTNPVATEQYGATSTNGQGGDDE

SEQ ID NO: 51419 - protein, 35 aa, Artificial Sequence
  Description of Artificial Sequence: Synthetic polypeptide
DEEEIRTTNPVATEQYGSVSSTNLHQSRLGSEDRD

SEQ ID NO: 51420 - protein, 34 aa, Artificial Sequence
  Description of Artificial Sequence: Synthetic polypeptide
DEEEIRTTNPVATEQYGSVSSTNLLQNIGGNVTT

SEQ ID NO: 51421 - protein, 33 aa, Artificial Sequence
  Description of Artificial Sequence: Synthetic polypeptide
DEEEIRTTNPVATEQYGSVSSTNLQFGEGGQEQ

SEQ ID NO: 51422 - protein, 33 aa, Artificial Sequence
  Description of Artificial Sequence: Synthetic polypeptide
DEEEIRTTNPVATEQYGSVSSTNLQNGGGEVGT

SEQ ID NO: 51423 - protein, 34 aa, Artificial Sequence
  Description of Artificial Sequence: Synthetic polypeptide
DEEEIRTTNPVATEQYGSVSSTNLVGQGGTNQDV

SEQ ID NO: 51424 - protein, 33 aa, Artificial Sequence
  Description of Artificial Sequence: Synthetic polypeptide
DEEEIRTTNPVATEQYGSVSSTNNEDQEGGGNP

SEQ ID NO: 51425 - protein, 31 aa, Artificial Sequence
  Description of Artificial Sequence: Synthetic polypeptide
AEDEIATTNPVATEQYGSVSTNLQGGGNEDI

SEQ ID NO: 51426 - protein, 32 aa, Artificial Sequence
  Description of Artificial Sequence: Synthetic polypeptide
DEEEIRTTNPVATEQYGSVSSTNPSGRGSEAS

SEQ ID NO: 51427 - protein, 33 aa, Artificial Sequence
  Description of Artificial Sequence: Synthetic polypeptide
DEEEIRTTNPVATEQYGSVSSTNQQNEGGNVGT

SEQ ID NO: 51428 - protein, 33 aa, Artificial Sequence
  Description of Artificial Sequence: Synthetic polypeptide
DEEEIRTTNPVATEQYGSVSSTNQVQNLGANIT

SEQ ID NO: 51429 - protein, 33 aa, Artificial Sequence
  Description of Artificial Sequence: Synthetic polypeptide
DEEEIRTTNPVATEQYGSVSSTNQVQNNDGGNT

SEQ ID NO: 51430 - protein, 32 aa, Artificial Sequence
  Description of Artificial Sequence: Synthetic polypeptide
DEEEIRTTNPVATEQYGSVSSTNTEDMINNRD

SEQ ID NO: 51431 - protein, 30 aa, Artificial Sequence
  Description of Artificial Sequence: Synthetic polypeptide
YEEEIGTTNPVALEQGGSVSTGNLQTEVNR

SEQ ID NO: 51432 - protein, 31 aa, Artificial Sequence
  Description of Artificial Sequence: Synthetic polypeptide
NEEEIATTNPVATEQYGSVSAAINLDEMGNR

SEQ ID NO: 51433 - protein, 33 aa, Artificial Sequence
  Description of Artificial Sequence: Synthetic polypeptide
DEEEIRTTNPVATEQYGSVSSTNLFGEFTGNGQ

SEQ ID NO: 51434 - protein, 29 aa, Artificial Sequence
  Description of Artificial Sequence: Synthetic peptide
DEDEIRTTNPVATEQYGCLTTELQRGEDS

SEQ ID NO: 51435 - protein, 33 aa, Artificial Sequence
  Description of Artificial Sequence: Synthetic polypeptide
DEEEIRTTNPVATEQYGSVSSTNLDSDTGENED

SEQ ID NO: 51436 - protein, 30 aa, Artificial Sequence
  Description of Artificial Sequence: Synthetic polypeptide
DEDEIRTTNPVATEQYGCTATNLQRGDSSM

SEQ ID NO: 51437 - protein, 30 aa, Artificial Sequence
  Description of Artificial Sequence: Synthetic polypeptide
DEDEIRTTNPVATEQYGCVSTGLQRPMDDD

SEQ ID NO: 51438 - protein, 28 aa, Artificial Sequence
  Description of Artificial Sequence: Synthetic peptide
YEEEIISVNPVCTEQYGVVSTNLQSGNQ

SEQ ID NO: 51439 - protein, 33 aa, Artificial Sequence
  Description of Artificial Sequence: Synthetic polypeptide
DEEEIRTTNPVATEQYGSVSSTNDQVQNGGNTP

SEQ ID NO: 51440 - protein, 33 aa, Artificial Sequence
  Description of Artificial Sequence: Synthetic polypeptide
DEEEIRTTNPVATEQYGSVSSTNDQVQNSGGNT

SEQ ID NO: 51441 - protein, 28 aa, Artificial Sequence
  Description of Artificial Sequence: Synthetic peptide
DEDEIRTTNPVATEQYGCVATTLQDPPD

SEQ ID NO: 51442 - protein, 29 aa, Artificial Sequence
  Description of Artificial Sequence: Synthetic peptide
DEDEIRTTNPVATEQYGCVATNPLQDPDD

SEQ ID NO: 51443 - protein, 30 aa, Artificial Sequence
  Description of Artificial Sequence: Synthetic polypeptide
DEDEIRTTNPVATEQYGCVATNLQAPNDEI

SEQ ID NO: 51444 - protein, 32 aa, Artificial Sequence
  Description of Artificial Sequence: Synthetic polypeptide
DEDEIRTTNPVATEQYGCVSTNLQNGDGQNGH

SEQ ID NO: 51445 - protein, 28 aa, Artificial Sequence
  Description of Artificial Sequence: Synthetic peptide
DEDEIRTTNPVATEQYGCVATHGQRPDD

SEQ ID NO: 51446 - protein, 30 aa, Artificial Sequence
  Description of Artificial Sequence: Synthetic polypeptide
NEEEIATTNPVATEQYGSVSADNLDENGNT

SEQ ID NO: 51447 - protein, 30 aa, Artificial Sequence
  Description of Artificial Sequence: Synthetic polypeptide
DEDEIRTTNPVATEQYGCTSTNLQNFGSDV

SEQ ID NO: 51448 - protein, 31 aa, Artificial Sequence
  Description of Artificial Sequence: Synthetic polypeptide
NEEEIATTNPVATEQYGSVSAANLDDTGGNR

SEQ ID NO: 51449 - protein, 29 aa, Artificial Sequence
  Description of Artificial Sequence: Synthetic peptide
AEDEIATTNPVATEQYGSVATNLQDGPDP

SEQ ID NO: 51450 - protein, 33 aa, Artificial Sequence
  Description of Artificial Sequence: Synthetic polypeptide
DEEEIRTTNPVATEQYGSVSSTNIERSGESMRN

SEQ ID NO: 51451 - protein, 29 aa, Artificial Sequence
  Description of Artificial Sequence: Synthetic peptide
DEDEIRTTNPVATEQYGCTATNLQRSMDS

SEQ ID NO: 51452 - protein, 30 aa, Artificial Sequence
  Description of Artificial Sequence: Synthetic polypeptide
DEDEIRTTNPVATEQYGCTATNLQRGQPSE

SEQ ID NO: 51453 - protein, 30 aa, Artificial Sequence
  Description of Artificial Sequence: Synthetic polypeptide
DEDEIRTTNPVATEQYGCVAATGLQRPGDN

SEQ ID NO: 51454 - protein, 32 aa, Artificial Sequence
  Description of Artificial Sequence: Synthetic polypeptide
DEEEIRTTNPVATEQYGSVSTANLEEMRVEEE

SEQ ID NO: 51455 - protein, 34 aa, Artificial Sequence
  Description of Artificial Sequence: Synthetic polypeptide
DEEEIRTTNPVATEQYGSVSTANLNQNRGLEMDD

SEQ ID NO: 51456 - protein, 33 aa, Artificial Sequence
  Description of Artificial Sequence: Synthetic polypeptide
DEEEIRTTNPVATEQYGSVSTANLQFNEFNGEQ

SEQ ID NO: 51457 - protein, 32 aa, Artificial Sequence
  Description of Artificial Sequence: Synthetic polypeptide
DEEEIRTTNPVATEQYGSVSTDNMDNMGGNEI

SEQ ID NO: 51458 - protein, 32 aa, Artificial Sequence
  Description of Artificial Sequence: Synthetic polypeptide
AEEEIRTTNPVATEQYGSVVVTTNLEQGGNQA

SEQ ID NO: 51459 - protein, 33 aa, Artificial Sequence
  Description of Artificial Sequence: Synthetic polypeptide
DEEEIRTTNPVATEQYGSVSTDNMFQDEGENQI

SEQ ID NO: 51460 - protein, 33 aa, Artificial Sequence
  Description of Artificial Sequence: Synthetic polypeptide
DEEEIRTTNPVATEQYGSVSTDNMFQVEGGNEI

SEQ ID NO: 51461 - protein, 31 aa, Artificial Sequence
  Description of Artificial Sequence: Synthetic polypeptide
AEEEIRTTNPVATEQYGSVVVTTELQQSGNI

SEQ ID NO: 51462 - protein, 33 aa, Artificial Sequence
  Description of Artificial Sequence: Synthetic polypeptide
DEEEIRTTNPVATEQYGSVSTDNMQDEGGNEEI

SEQ ID NO: 51463 - protein, 30 aa, Artificial Sequence
  Description of Artificial Sequence: Synthetic polypeptide
NNEEIRTTNPVATEQYGCVSTNLQNGSDQA

SEQ ID NO: 51464 - protein, 33 aa, Artificial Sequence
  Description of Artificial Sequence: Synthetic polypeptide
DEEEIRTTNPVATEQYGSVSTDNMQEQNIGNGD

SEQ ID NO: 51465 - protein, 30 aa, Artificial Sequence
  Description of Artificial Sequence: Synthetic polypeptide
NEEEIACTNPVATEQYGSVATNLQAGNVDD

SEQ ID NO: 51466 - protein, 32 aa, Artificial Sequence
  Description of Artificial Sequence: Synthetic polypeptide
AEEEIRTTNPVATEQYGSVVVTSNNLNQNGNI

SEQ ID NO: 51467 - protein, 28 aa, Artificial Sequence
  Description of Artificial Sequence: Synthetic peptide
YEEEIASVNPVCTEQYGVVSENLQSGNR

SEQ ID NO: 51468 - protein, 30 aa, Artificial Sequence
  Description of Artificial Sequence: Synthetic polypeptide
NEEEIACTNPVATEQYGSVATNLQAGNNPM

SEQ ID NO: 51469 - protein, 30 aa, Artificial Sequence
  Description of Artificial Sequence: Synthetic polypeptide
AEEEIRTTNPVATEQYGVVSTNNQQDTGVG

SEQ ID NO: 51470 - protein, 33 aa, Artificial Sequence
  Description of Artificial Sequence: Synthetic polypeptide
DEEEIRTTNPVATEQYGSVSTDNMQQENIGNDS

SEQ ID NO: 51471 - protein, 28 aa, Artificial Sequence
  Description of Artificial Sequence: Synthetic peptide
YEEEIASVNPVCTEQYGVVSENLQRGNQ

SEQ ID NO: 51472 - protein, 33 aa, Artificial Sequence
  Description of Artificial Sequence: Synthetic polypeptide
DEEEIRTTNPVATEQYGSVSTDNLTSGMGNDEN

SEQ ID NO: 51473 - protein, 28 aa, Artificial Sequence
  Description of Artificial Sequence: Synthetic peptide
DEDEIATVNPVATEQYGCVATNLEDGND

SEQ ID NO: 51474 - protein, 29 aa, Artificial Sequence
  Description of Artificial Sequence: Synthetic peptide
DEDEIATVNPVATEQYGSVATNLETGNEH

SEQ ID NO: 51475 - protein, 33 aa, Artificial Sequence
  Description of Artificial Sequence: Synthetic polypeptide
DEEEIRTTNPVATEQYGSVSTDNLQQEVGMIID

SEQ ID NO: 51476 - protein, 32 aa, Artificial Sequence
  Description of Artificial Sequence: Synthetic polypeptide
DEEEIRTTNPVATEQYGSVSTDNGLGNNGQGQ

SEQ ID NO: 51477 - protein, 32 aa, Artificial Sequence
  Description of Artificial Sequence: Synthetic polypeptide
AEEEIRTTNPVATEQYGSVVVTTNLQDNQGNG

SEQ ID NO: 51478 - protein, 34 aa, Artificial Sequence
  Description of Artificial Sequence: Synthetic polypeptide
DEEEIRTTNPVATEQYGSVSTDNGLGQGGEGNDD

SEQ ID NO: 51479 - protein, 33 aa, Artificial Sequence
  Description of Artificial Sequence: Synthetic polypeptide
DEEEIRTTNPVATEQYGSVSTDNGMQGEGNSTG

SEQ ID NO: 51480 - protein, 31 aa, Artificial Sequence
  Description of Artificial Sequence: Synthetic polypeptide
NETEIRTTNPVATEVYGSVSTNLQGNEGNDA

SEQ ID NO: 51481 - protein, 33 aa, Artificial Sequence
  Description of Artificial Sequence: Synthetic polypeptide
DEEEIRTTNPVATEQYGSVSTDNGQTGGNNGDD

SEQ ID NO: 51482 - protein, 33 aa, Artificial Sequence
  Description of Artificial Sequence: Synthetic polypeptide
DEEEIRTTNPVATEQYGSVSTDNGQVGEGGNEG

SEQ ID NO: 51483 - protein, 33 aa, Artificial Sequence
  Description of Artificial Sequence: Synthetic polypeptide
DEEEIRTTNPVATEQYGSVSTDNMVDQEEGGND

SEQ ID NO: 51484 - protein, 32 aa, Artificial Sequence
  Description of Artificial Sequence: Synthetic polypeptide
DEEEIRTTNPVATEQYGSVSTDNGTDGEGENA

SEQ ID NO: 51485 - protein, 33 aa, Artificial Sequence
  Description of Artificial Sequence: Synthetic polypeptide
DEEEIRTTNPVATEQYGSVSTDNGVEQNEGGNG

SEQ ID NO: 51486 - protein, 33 aa, Artificial Sequence
  Description of Artificial Sequence: Synthetic polypeptide
DEEEIRTTNPVATEQYGSVSTDNGVNQEGGGND

SEQ ID NO: 51487 - protein, 32 aa, Artificial Sequence
  Description of Artificial Sequence: Synthetic polypeptide
AEEEIRTTNPVATEQYGSVVVTTNLGGNTGNR

SEQ ID NO: 51488 - protein, 30 aa, Artificial Sequence
  Description of Artificial Sequence: Synthetic polypeptide
DEDEICTTNPVATEPYGSVATNLTRGNNEQ

SEQ ID NO: 51489 - protein, 33 aa, Artificial Sequence
  Description of Artificial Sequence: Synthetic polypeptide
DEEEIRTTNPVATEQYGSVSTDNLQPPIVNSFL

SEQ ID NO: 51490 - protein, 31 aa, Artificial Sequence
  Description of Artificial Sequence: Synthetic polypeptide
AEEEIRTTNPVATEQYGSVVVTTNLGGEGNN

SEQ ID NO: 51491 - protein, 30 aa, Artificial Sequence
  Description of Artificial Sequence: Synthetic polypeptide
DEDEICTTNPAATEQYGSVPTNLQHGGNGD

SEQ ID NO: 51492 - protein, 33 aa, Artificial Sequence
  Description of Artificial Sequence: Synthetic polypeptide
DEEEIRTTNPVATEQYGSVSTDNGVEQEGTGND

SEQ ID NO: 51493 - protein, 33 aa, Artificial Sequence
  Description of Artificial Sequence: Synthetic polypeptide
DEEEIRTTNPVATEQYGSVSTDNGLGEGGNNIT

SEQ ID NO: 51494 - protein, 31 aa, Artificial Sequence
  Description of Artificial Sequence: Synthetic polypeptide
DEEEIRTTNPVATEQYGSVSTDNNGQEPEDH

SEQ ID NO: 51495 - protein, 33 aa, Artificial Sequence
  Description of Artificial Sequence: Synthetic polypeptide
DEEEIRTTNPVATEQYGSVSTDNSFQFEGGNEI

SEQ ID NO: 51496 - protein, 32 aa, Artificial Sequence
  Description of Artificial Sequence: Synthetic polypeptide
DEEEIRTTNPVATEQYGSVSTDVLQTDGSVQQ

SEQ ID NO: 51497 - protein, 33 aa, Artificial Sequence
  Description of Artificial Sequence: Synthetic polypeptide
DEEEIRTTNPVATEQYGSVSTDVLTQRFDNVQD

SEQ ID NO: 51498 - protein, 32 aa, Artificial Sequence
  Description of Artificial Sequence: Synthetic polypeptide
DEEEIRTTNPVATEQYGSVSTDVSLQDGGSQD

SEQ ID NO: 51499 - protein, 31 aa, Artificial Sequence
  Description of Artificial Sequence: Synthetic polypeptide
DEEEIRTTNPVATEQYGSVSTDWHLYLESRD

SEQ ID NO: 51500 - protein, 32 aa, Artificial Sequence
  Description of Artificial Sequence: Synthetic polypeptide
DEEEIRTTNPVATEQYGSVSTDWLDQQDMEDR

SEQ ID NO: 51501 - protein, 32 aa, Artificial Sequence
  Description of Artificial Sequence: Synthetic polypeptide
AEEEIRTTNPVATEQYGSVVVTNTNNQEGENR

SEQ ID NO: 51502 - protein, 32 aa, Artificial Sequence
  Description of Artificial Sequence: Synthetic polypeptide
DEEEIRTTNPVATEQYGSVSTEEHDQNFGSNF

SEQ ID NO: 51503 - protein, 32 aa, Artificial Sequence
  Description of Artificial Sequence: Synthetic polypeptide
DEEEIRTTNPVATEQYGSVSTEELQAFGSDAS

SEQ ID NO: 51504 - protein, 30 aa, Artificial Sequence
  Description of Artificial Sequence: Synthetic polypeptide
NEDEIRTTNPVAYEQYGSVVATNLSQIGSR

SEQ ID NO: 51505 - protein, 31 aa, Artificial Sequence
  Description of Artificial Sequence: Synthetic polypeptide
AEEEIRTTNPVATEQYGSVVVTNQLQNVNND

SEQ ID NO: 51506 - protein, 29 aa, Artificial Sequence
  Description of Artificial Sequence: Synthetic peptide
NNEEIRTTNPVATEQYGVCSTNLQDIPNS

SEQ ID NO: 51507 - protein, 33 aa, Artificial Sequence
  Description of Artificial Sequence: Synthetic polypeptide
DEEEIRTTNPVATEQYGSVSTEHQEFFGSNTRY

SEQ ID NO: 51508 - protein, 30 aa, Artificial Sequence
  Description of Artificial Sequence: Synthetic polypeptide
DEEEIRTTNPVATEQYGSVSTEIDNRNQFD

SEQ ID NO: 51509 - protein, 32 aa, Artificial Sequence
  Description of Artificial Sequence: Synthetic polypeptide
DEEEIRTTNPVATEQYGSVSTELDVNRDGVGT

SEQ ID NO: 51510 - protein, 33 aa, Artificial Sequence
  Description of Artificial Sequence: Synthetic polypeptide
DEEEIRTTNPVATEQYGSVSTELLTQTEGNNEI

SEQ ID NO: 51511 - protein, 32 aa, Artificial Sequence
  Description of Artificial Sequence: Synthetic polypeptide
NNEEIRTTNPVATEQYGTVQSTNLEQDGPNRE

SEQ ID NO: 51512 - protein, 33 aa, Artificial Sequence
  Description of Artificial Sequence: Synthetic polypeptide
DEEEIRTTNPVATEQYGSVSTDVLPQTRSGSQD

SEQ ID NO: 51513 - protein, 32 aa, Artificial Sequence
  Description of Artificial Sequence: Synthetic polypeptide
DEEEIRTTNPVATEQYGSVSTDVLPQTNGSQQ

SEQ ID NO: 51514 - protein, 31 aa, Artificial Sequence
  Description of Artificial Sequence: Synthetic polypeptide
DEDEIATTNPVAYEQYGSVSTGLDQDGGNER

SEQ ID NO: 51515 - protein, 29 aa, Artificial Sequence
  Description of Artificial Sequence: Synthetic peptide
NEEEIACTNPVATEQYGSVATNLQAEDNP

SEQ ID NO: 51516 - protein, 30 aa, Artificial Sequence
  Description of Artificial Sequence: Synthetic polypeptide
AEEEIRTTNPVATEQYGVVSTNQNQQANED

SEQ ID NO: 51517 - protein, 33 aa, Artificial Sequence
  Description of Artificial Sequence: Synthetic polypeptide
DEEEIRTTNPVATEQYGSVSTDNVGQNAGENTI

SEQ ID NO: 51518 - protein, 33 aa, Artificial Sequence
  Description of Artificial Sequence: Synthetic polypeptide
DEEEIRTTNPVATEQYGSVSTDNVIQDGGNDDN

SEQ ID NO: 51519 - protein, 29 aa, Artificial Sequence
  Description of Artificial Sequence: Synthetic peptide
NEEEIACTNPVATEQYGSVATNLQADNNP

SEQ ID NO: 51520 - protein, 28 aa, Artificial Sequence
  Description of Artificial Sequence: Synthetic peptide
NEEEIACTNPVATEQYGSVATALQNMMR

SEQ ID NO: 51521 - protein, 31 aa, Artificial Sequence
  Description of Artificial Sequence: Synthetic polypeptide
DEEEIRTTNPVATEQYGSVSTDPQVTSGSQG

SEQ ID NO: 51522 - protein, 31 aa, Artificial Sequence
  Description of Artificial Sequence: Synthetic polypeptide
DEEEIRTTNPVATEQYGSVSTDNQVSGEDTY

SEQ ID NO: 51523 - protein, 32 aa, Artificial Sequence
  Description of Artificial Sequence: Synthetic polypeptide
AEEEIRTTNPVATEQYGSVVVTSNLQQGIGNT

SEQ ID NO: 51524 - protein, 33 aa, Artificial Sequence
  Description of Artificial Sequence: Synthetic polypeptide
DEEEIRTTNPVATEQYGSVSTDTDPMQRIGNEF

SEQ ID NO: 51525 - protein, 31 aa, Artificial Sequence
  Description of Artificial Sequence: Synthetic polypeptide
DEEEIRTTNPVATEQYGSVSTDTLDEGQDIQ

SEQ ID NO: 51526 - protein, 31 aa, Artificial Sequence
  Description of Artificial Sequence: Synthetic polypeptide
AEEEIRTTNPVATEQYGVVSTQNNNQEIGNQ

SEQ ID NO: 51527 - protein, 28 aa, Artificial Sequence
  Description of Artificial Sequence: Synthetic peptide
YEEEIASVNPVCTEQYGVVSDNLQSGNR

SEQ ID NO: 51528 - protein, 30 aa, Artificial Sequence
  Description of Artificial Sequence: Synthetic polypeptide
DEDEIATTNPVAYEQYGSVSTNLQRDDTEM

SEQ ID NO: 51529 - protein, 30 aa, Artificial Sequence
  Description of Artificial Sequence: Synthetic polypeptide
DEEEIRTTNPVATEQYGSVSTDTLETTEAD

SEQ ID NO: 51530 - protein, 30 aa, Artificial Sequence
  Description of Artificial Sequence: Synthetic polypeptide
DEDEIATTNPVAYEQYGSVSTNLQHDNEHE

SEQ ID NO: 51531 - protein, 31 aa, Artificial Sequence
  Description of Artificial Sequence: Synthetic polypeptide
DEEEIRTTNPVATEQYGSVSTDQTDSGQFNP

SEQ ID NO: 51532 - protein, 33 aa, Artificial Sequence
  Description of Artificial Sequence: Synthetic polypeptide
DEEEIRTTNPVATEQYGSVSSTGNGQTGNGNGG

SEQ ID NO: 51533 - protein, 32 aa, Artificial Sequence
  Description of Artificial Sequence: Synthetic polypeptide
AEEEIRTTNPVATEQYGSVVVTTNLQDQGENG

SEQ ID NO: 51534 - protein, 33 aa, Artificial Sequence
  Description of Artificial Sequence: Synthetic polypeptide
DEEEIRTTNPVATEQYGSVSTDNGLEDGGNNEI

SEQ ID NO: 51535 - protein, 32 aa, Artificial Sequence
  Description of Artificial Sequence: Synthetic polypeptide
DEEEIRTTNPVATEQYGSVSTDDQIQGIGNGG

SEQ ID NO: 51536 - protein, 31 aa, Artificial Sequence
  Description of Artificial Sequence: Synthetic polypeptide
DEEEIRTTNPVATEQYGSVSTDDQLSEMHRN

SEQ ID NO: 51537 - protein, 32 aa, Artificial Sequence
  Description of Artificial Sequence: Synthetic polypeptide
AEEEIRTTNPVATEQYGTVCSTNLQNFGSNAV

SEQ ID NO: 51538 - protein, 32 aa, Artificial Sequence
  Description of Artificial Sequence: Synthetic polypeptide
AEEEIRTTNPVATEQYGTVCSTNLQNFGSNDP

SEQ ID NO: 51539 - protein, 30 aa, Artificial Sequence
  Description of Artificial Sequence: Synthetic polypeptide
NEEEIATTNPVATEQWGSVSTELQNGDNNE

SEQ ID NO: 51540 - protein, 29 aa, Artificial Sequence
  Description of Artificial Sequence: Synthetic peptide
NEEEIATTNPVATEQWGSVATNDQRGDDQ

SEQ ID NO: 51541 - protein, 31 aa, Artificial Sequence
  Description of Artificial Sequence: Synthetic polypeptide
DEEEIRTTNPVATEQYGSVSTDEQIDGDDFQ

SEQ ID NO: 51542 - protein, 31 aa, Artificial Sequence
  Description of Artificial Sequence: Synthetic polypeptide
DEEEIRTTNPVATEQYGSVSTDEQSLDEERG

SEQ ID NO: 51543 - protein, 31 aa, Artificial Sequence
  Description of Artificial Sequence: Synthetic polypeptide
NETEIRTTNPVATEPYGSVSTNLQANGDNGD

SEQ ID NO: 51544 - protein, 32 aa, Artificial Sequence
  Description of Artificial Sequence: Synthetic polypeptide
AEEEIRTTNPVATEQYGSVVVTTNLQNGNNDA

SEQ ID NO: 51545 - protein, 32 aa, Artificial Sequence
  Description of Artificial Sequence: Synthetic polypeptide
DEEEIRTTNPVATEQYGSVSTDGYHQEGSLER

SEQ ID NO: 51546 - protein, 32 aa, Artificial Sequence
  Description of Artificial Sequence: Synthetic polypeptide
AEEEIRTTNPVATEQYGSVVVTTNLQLGGNAG

SEQ ID NO: 51547 - protein, 32 aa, Artificial Sequence
  Description of Artificial Sequence: Synthetic polypeptide
DEDEIRTTNPCATEQYGSVSTNLQGDTGNGSD

SEQ ID NO: 51548 - protein, 32 aa, Artificial Sequence
  Description of Artificial Sequence: Synthetic polypeptide
DEDEIRTTNPCATEQYGSVSTNLQGDMGNNED

SEQ ID NO: 51549 - protein, 32 aa, Artificial Sequence
  Description of Artificial Sequence: Synthetic polypeptide
DEDEIRTTNPCATEQYGSVSTNLQGDMGGNQD

SEQ ID NO: 51550 - protein, 31 aa, Artificial Sequence
  Description of Artificial Sequence: Synthetic polypeptide
NEEEIATTNPVATEQWGSVSTNLQNNGDNMQ

SEQ ID NO: 51551 - protein, 30 aa, Artificial Sequence
  Description of Artificial Sequence: Synthetic polypeptide
NEEEIATTNPVATEQYGCVAATNLQQGNLQ

SEQ ID NO: 51552 - protein, 31 aa, Artificial Sequence
  Description of Artificial Sequence: Synthetic polypeptide
DEDEIRTTNPTATEQYGEVSTNLQGDGGNQQ

SEQ ID NO: 51553 - protein, 32 aa, Artificial Sequence
  Description of Artificial Sequence: Synthetic polypeptide
DEEEIRTTNPVATEQYGSVSTDALDQQNSEER

SEQ ID NO: 51554 - protein, 33 aa, Artificial Sequence
  Description of Artificial Sequence: Synthetic polypeptide
DEEEIRTTNPVATEQYGSVSTANMNDQGGIGNI

SEQ ID NO: 51555 - protein, 32 aa, Artificial Sequence
  Description of Artificial Sequence: Synthetic polypeptide
DEEEIRTTNPVATEQYGSVSTANMNNEGGGNI

SEQ ID NO: 51556 - protein, 31 aa, Artificial Sequence
  Description of Artificial Sequence: Synthetic polypeptide
NETEIRTTNPVATEMYGSVSTNLQNNGMNDE

SEQ ID NO: 51557 - protein, 29 aa, Artificial Sequence
  Description of Artificial Sequence: Synthetic peptide
YEEEIATVNPVATEQYGDVSENLQSAGNQ

SEQ ID NO: 51558 - protein, 28 aa, Artificial Sequence
  Description of Artificial Sequence: Synthetic peptide
NEEEIATTNPVATEQYGSCSTALQDQGD

SEQ ID NO: 51559 - protein, 29 aa, Artificial Sequence
  Description of Artificial Sequence: Synthetic peptide
YEEEIATTNPVCTEQYGVVSDNLQSEGNQ

SEQ ID NO: 51560 - protein, 33 aa, Artificial Sequence
  Description of Artificial Sequence: Synthetic polypeptide
DEEEIRTTNPVATEQYGSVSTANMNNQIEGGNI

SEQ ID NO: 51561 - protein, 32 aa, Artificial Sequence
  Description of Artificial Sequence: Synthetic polypeptide
DEDEIRTTNPCATEQYGSVSTNLNQGDTGGNE

SEQ ID NO: 51562 - protein, 33 aa, Artificial Sequence
  Description of Artificial Sequence: Synthetic polypeptide
DEEEIRTTNPVATEQYGSVSTANNLQNVGEGEI

SEQ ID NO: 51563 - protein, 28 aa, Artificial Sequence
  Description of Artificial Sequence: Synthetic peptide
YEEEIATTNPVCTEQYGVVPDNLQSGNQ

SEQ ID NO: 51564 - protein, 30 aa, Artificial Sequence
  Description of Artificial Sequence: Synthetic polypeptide
YEEEIATTNPVCTEQYGSVSDNLQDSEGNQ

SEQ ID NO: 51565 - protein, 28 aa, Artificial Sequence
  Description of Artificial Sequence: Synthetic peptide
YEEEIATTNPVATEQYGVVSDVLQSGEQ

SEQ ID NO: 51566 - protein, 29 aa, Artificial Sequence
  Description of Artificial Sequence: Synthetic peptide
DEDEIRTTNPVATDQYGVVDTNGEDRGNP

SEQ ID NO: 51567 - protein, 31 aa, Artificial Sequence
  Description of Artificial Sequence: Synthetic polypeptide
DEEEIRTTNPVATEQYGSVSTDADQTESNEN

SEQ ID NO: 51568 - protein, 31 aa, Artificial Sequence
  Description of Artificial Sequence: Synthetic polypeptide
DEEEIRTTNPVATEQYGSVSTDADYESNERN

SEQ ID NO: 51569 - protein, 28 aa, Artificial Sequence
  Description of Artificial Sequence: Synthetic peptide
YEEEIATTNPVATEQYGEAPDNLQSGNK

SEQ ID NO: 51570 - protein, 28 aa, Artificial Sequence
  Description of Artificial Sequence: Synthetic peptide
YEEEIATTNPVCTEQYGVVSDCLQSGNQ

SEQ ID NO: 51571 - protein, 32 aa, Artificial Sequence
  Description of Artificial Sequence: Synthetic polypeptide
AEEEIRTTNPVATEQYGVVSSTNQLQQGINTT

SEQ ID NO: 51572 - protein, 32 aa, Artificial Sequence
  Description of Artificial Sequence: Synthetic polypeptide
DEDEIRTTNPCATEQYGSVSTNLNQDGGGNDE

SEQ ID NO: 51573 - protein, 31 aa, Artificial Sequence
  Description of Artificial Sequence: Synthetic polypeptide
DEEEIRTTNPVATEQYGSVSTDILAAVVNDE

SEQ ID NO: 51574 - protein, 32 aa, Artificial Sequence
  Description of Artificial Sequence: Synthetic polypeptide
DEEEIRTTNPVATEQYGSVSTDNDLYRELEQS

SEQ ID NO: 51575 - protein, 29 aa, Artificial Sequence
  Description of Artificial Sequence: Synthetic peptide
NEEEIACTNPVATEQYGSVATNLQSGDPN

SEQ ID NO: 51576 - protein, 32 aa, Artificial Sequence
  Description of Artificial Sequence: Synthetic polypeptide
DEEEIRTTNPVATEQYGSVSTDNENQYFPSRV

SEQ ID NO: 51577 - protein, 33 aa, Artificial Sequence
  Description of Artificial Sequence: Synthetic polypeptide
DEEEIRTTNPVATEQYGSVSTDNGDQNEGGNEQ

SEQ ID NO: 51578 - protein, 28 aa, Artificial Sequence
  Description of Artificial Sequence: Synthetic peptide
YEEEIASVNPVCTEQYGVVSTNLQFGNQ

SEQ ID NO: 51579 - protein, 30 aa, Artificial Sequence
  Description of Artificial Sequence: Synthetic polypeptide
NEEEIACTNPVATEQYGSVATNLQRNANMG

SEQ ID NO: 51580 - protein, 33 aa, Artificial Sequence
  Description of Artificial Sequence: Synthetic polypeptide
DEEEIRTTNPVATEQYGSVSTDNGIQNEGGNQQ

SEQ ID NO: 51581 - protein, 33 aa, Artificial Sequence
  Description of Artificial Sequence: Synthetic polypeptide
DEEEIRTTNPVATEQYGSVSTDNGIQNGGGNIN

SEQ ID NO: 51582 - protein, 34 aa, Artificial Sequence
  Description of Artificial Sequence: Synthetic polypeptide
DEEEIRTTNPVATEQYGSVSTDNGLDQEEGGNQG

SEQ ID NO: 51583 - protein, 34 aa, Artificial Sequence
  Description of Artificial Sequence: Synthetic polypeptide
DEEEIRTTNPVATEQYGSVSTDNGLDQEFGNNEE

SEQ ID NO: 51584 - protein, 32 aa, Artificial Sequence
  Description of Artificial Sequence: Synthetic polypeptide
NETEIRTTNPVATESYGSVSTNLQGNEGNTDR

SEQ ID NO: 51585 - protein, 34 aa, Artificial Sequence
  Description of Artificial Sequence: Synthetic polypeptide
DEEEIRTTNPVATEQYGSVSTDNGLDQEMGNNGG

SEQ ID NO: 51586 - protein, 30 aa, Artificial Sequence
  Description of Artificial Sequence: Synthetic polypeptide
NEEEIACTNPVATEQYGSVATNLQEAGNND

SEQ ID NO: 51587 - protein, 34 aa, Artificial Sequence
  Description of Artificial Sequence: Synthetic polypeptide
DEEEIRTTNPVATEQYGSVSTDNGLDQEVGNNEQ

SEQ ID NO: 51588 - protein, 30 aa, Artificial Sequence
  Description of Artificial Sequence: Synthetic polypeptide
NEEEIACTNPVATEQYGSVATNLQEAGNMQ

SEQ ID NO: 51589 - protein, 32 aa, Artificial Sequence
  Description of Artificial Sequence: Synthetic polypeptide
DEEEIRTTNPVATEQYGSVSTDNDDDEGDENI

SEQ ID NO: 51590 - protein, 32 aa, Artificial Sequence
  Description of Artificial Sequence: Synthetic polypeptide
DEEEIRTTNPVATEQYGSVSTDMHQRSTQNDP

SEQ ID NO: 51591 - protein, 32 aa, Artificial Sequence
  Description of Artificial Sequence: Synthetic polypeptide
DEEEIRTTNPVATEQYGSVSTDLTQNIGDSDM

SEQ ID NO: 51592 - protein, 32 aa, Artificial Sequence
  Description of Artificial Sequence: Synthetic polypeptide
DEEEIRTTNPVATEQYGSVSTDLTQIDGDQIQ

SEQ ID NO: 51593 - protein, 29 aa, Artificial Sequence
  Description of Artificial Sequence: Synthetic peptide
NEEEIATTNPVATEMWGSVSTNQQHGNQD

SEQ ID NO: 51594 - protein, 32 aa, Artificial Sequence
  Description of Artificial Sequence: Synthetic polypeptide
DEDEIRTTNPCATEQYGSVSTNLGGEHGQNQR

SEQ ID NO: 51595 - protein, 32 aa, Artificial Sequence
  Description of Artificial Sequence: Synthetic polypeptide
DEEEIRTTNPVATEQYGSVSTDILHPSGDNDG

SEQ ID NO: 51596 - protein, 32 aa, Artificial Sequence
  Description of Artificial Sequence: Synthetic polypeptide
DEDEIRTTNPCATEQYGSVSTGNLGSGEGMNR

SEQ ID NO: 51597 - protein, 33 aa, Artificial Sequence
  Description of Artificial Sequence: Synthetic polypeptide
DEEEIRTTNPVATEQYGSVSTDLDQNQGGEEIR

SEQ ID NO: 51598 - protein, 32 aa, Artificial Sequence
  Description of Artificial Sequence: Synthetic polypeptide
DEEEIRTTNPVATEQYGSVSTDLDQQVDEEER

SEQ ID NO: 51599 - protein, 31 aa, Artificial Sequence
  Description of Artificial Sequence: Synthetic polypeptide
DEEEIRTTNPVATEQYGSVSTDLDQQWDEEI

SEQ ID NO: 51600 - protein, 30 aa, Artificial Sequence
  Description of Artificial Sequence: Synthetic polypeptide
NEEEIATTNPVATEMYGSVATNLQEAGNPQ

SEQ ID NO: 51601 - protein, 29 aa, Artificial Sequence
  Description of Artificial Sequence: Synthetic peptide
NEEEIACTNPVATESYGSVATNLQAGNDQ

SEQ ID NO: 51602 - protein, 32 aa, Artificial Sequence
  Description of Artificial Sequence: Synthetic polypeptide
DEEEIRTTNPVATEQYGSVSTDLHQDFGGSQG

SEQ ID NO: 51603 - protein, 33 aa, Artificial Sequence
  Description of Artificial Sequence: Synthetic polypeptide
DEEEIRTTNPVATEQYGSVSTDLLMQQGGNGND

SEQ ID NO: 51604 - protein, 28 aa, Artificial Sequence
  Description of Artificial Sequence: Synthetic peptide
YEEEIASVNPVCTEQYGVVSTNLQSGNQ

SEQ ID NO: 51605 - protein, 31 aa, Artificial Sequence
  Description of Artificial Sequence: Synthetic polypeptide
DEEEIRTTNPVATEQYGSVSTDLNRMMEIDG

SEQ ID NO: 51606 - protein, 28 aa, Artificial Sequence
  Description of Artificial Sequence: Synthetic peptide
YEEEIASVNPVCTEQYGVVSTNLQSGNG

SEQ ID NO: 51607 - protein, 33 aa, Artificial Sequence
  Description of Artificial Sequence: Synthetic polypeptide
DEEEIRTTNPVATEQYGSVSTDLQDIGMGNQDQ

SEQ ID NO: 51608 - protein, 28 aa, Artificial Sequence
  Description of Artificial Sequence: Synthetic peptide
YEEEIASVNPVCTEQYGVVSTNLQHGNQ

SEQ ID NO: 51609 - protein, 30 aa, Artificial Sequence
  Description of Artificial Sequence: Synthetic polypeptide
DEEEIRTTNPVATEQYGSVSTDLHPPDDDG

SEQ ID NO: 51610 - protein, 30 aa, Artificial Sequence
  Description of Artificial Sequence: Synthetic polypeptide
DEAEIRTTNPVAYEQWGSISTNDEHRGPNR

SEQ ID NO: 51611 - protein, 33 aa, Artificial Sequence
  Description of Artificial Sequence: Synthetic polypeptide
DEEEIRTTNPVATEQYGSVSSTGNGQTGNGGNE

SEQ ID NO: 51612 - protein, 31 aa, Artificial Sequence
  Description of Artificial Sequence: Synthetic polypeptide
NETEIRTTNPVATEGYGSVSTNLQHNQGDND

SEQ ID NO: 51613 - protein, 30 aa, Artificial Sequence
  Description of Artificial Sequence: Synthetic polypeptide
YEEEISTTNPVACNQYGSVSTGNLQTEVNR

SEQ ID NO: 51614 - protein, 31 aa, Artificial Sequence
  Description of Artificial Sequence: Synthetic polypeptide
YEEEISTTNPVACEQYGSVQSTNISQRGNPM

SEQ ID NO: 51615 - protein, 31 aa, Artificial Sequence
  Description of Artificial Sequence: Synthetic polypeptide
YEEEISTTNPVACEQYGSVNSTNLDEQGNIR

SEQ ID NO: 51616 - protein, 32 aa, Artificial Sequence
  Description of Artificial Sequence: Synthetic polypeptide
DEEEIRTTNPVATEQYGSVSPWNLQDDGETEL

SEQ ID NO: 51617 - protein, 33 aa, Artificial Sequence
  Description of Artificial Sequence: Synthetic polypeptide
DEEEIRTTNPVATEQYGSVSPWNLQSDMGGDER

SEQ ID NO: 51618 - protein, 32 aa, Artificial Sequence
  Description of Artificial Sequence: Synthetic polypeptide
DEEEIRTTNPVATEQYGSVSPYNEAEEGNNRN

SEQ ID NO: 51619 - protein, 30 aa, Artificial Sequence
  Description of Artificial Sequence: Synthetic polypeptide
YEEEISTTNPVACEQYGSVGSTNIQRDNFM

SEQ ID NO: 51620 - protein, 32 aa, Artificial Sequence
  Description of Artificial Sequence: Synthetic polypeptide
DEEEIRTTNPVATEQYGSVSPYNSERGNNEHG

SEQ ID NO: 51621 - protein, 30 aa, Artificial Sequence
  Description of Artificial Sequence: Synthetic polypeptide
YEEEISTTNPVAAEQYGSVESTGPYQRGNQ

SEQ ID NO: 51622 - protein, 28 aa, Artificial Sequence
  Description of Artificial Sequence: Synthetic peptide
YEEEISTTNPTATEQGGSVSTDDQRDNQ

SEQ ID NO: 51623 - protein, 30 aa, Artificial Sequence
  Description of Artificial Sequence: Synthetic polypeptide
YEEEISTTNPSATEQYGSVESSNPYQRGNQ

SEQ ID NO: 51624 - protein, 32 aa, Artificial Sequence
  Description of Artificial Sequence: Synthetic polypeptide
DEEEIRTTNPVATEQYGSVSQGPNLQVVDNDN

SEQ ID NO: 51625 - protein, 31 aa, Artificial Sequence
  Description of Artificial Sequence: Synthetic polypeptide
NESEIRTTNPVATEQYGSVSWTDNQMQDGSR

SEQ ID NO: 51626 - protein, 30 aa, Artificial Sequence
  Description of Artificial Sequence: Synthetic polypeptide
NEEEIRTTNPVATEQYGCVSAWNLDENGNA

SEQ ID NO: 51627 - protein, 32 aa, Artificial Sequence
  Description of Artificial Sequence: Synthetic polypeptide
DEEEIRTTNPVATEQYGSVSQMNEQRNEQNSM

SEQ ID NO: 51628 - protein, 31 aa, Artificial Sequence
  Description of Artificial Sequence: Synthetic polypeptide
YEEEISTTNPVAFEYYGSVKSGTNQQRGLNR

SEQ ID NO: 51629 - protein, 32 aa, Artificial Sequence
  Description of Artificial Sequence: Synthetic polypeptide
DEEEIRTTNPVATEQYGSVSQNNLENRFEQRF

SEQ ID NO: 51630 - protein, 31 aa, Artificial Sequence
  Description of Artificial Sequence: Synthetic polypeptide
YEEEISTTNPVAHEQYGSVNSVTNLEQGNIR

SEQ ID NO: 51631 - protein, 32 aa, Artificial Sequence
  Description of Artificial Sequence: Synthetic polypeptide
YEEEISTTNPVAKTEQYGSVNSTNLPEQGNIR

SEQ ID NO: 51632 - protein, 32 aa, Artificial Sequence
  Description of Artificial Sequence: Synthetic polypeptide
DEEEIRTTNPVATEQYGSVSPVENEERGTERE

SEQ ID NO: 51633 - protein, 30 aa, Artificial Sequence
  Description of Artificial Sequence: Synthetic polypeptide
YEEEISTTNPVALEQYGSVSTGNLKREVNC

SEQ ID NO: 51634 - protein, 32 aa, Artificial Sequence
  Description of Artificial Sequence: Synthetic polypeptide
YEEEISTTNPVALEQYGSVSTGNLIQREVHNR

SEQ ID NO: 51635 - protein, 31 aa, Artificial Sequence
  Description of Artificial Sequence: Synthetic polypeptide
DEEEIRTTNPVATEQYGSVSPVMLQIDVNNE

SEQ ID NO: 51636 - protein, 30 aa, Artificial Sequence
  Description of Artificial Sequence: Synthetic polypeptide
YEEEISTTNPVALEQYGSVSTGNLAPEVNR

SEQ ID NO: 51637 - protein, 33 aa, Artificial Sequence
  Description of Artificial Sequence: Synthetic polypeptide
DEEEIRTTNPVATEQYGSVSPVMNVQRMDENRI

SEQ ID NO: 51638 - protein, 30 aa, Artificial Sequence
  Description of Artificial Sequence: Synthetic polypeptide
YEEEISTTNPVALEQYGSVSTGNAQREVNI

SEQ ID NO: 51639 - protein, 30 aa, Artificial Sequence
  Description of Artificial Sequence: Synthetic polypeptide
YEEEISTTNPVALEQYGSVSTGFLQMEVNR

SEQ ID NO: 51640 - protein, 31 aa, Artificial Sequence
  Description of Artificial Sequence: Synthetic polypeptide
YEEEISTTNPVALEQYGSVPTGNLQREVNQR

SEQ ID NO: 51641 - protein, 32 aa, Artificial Sequence
  Description of Artificial Sequence: Synthetic polypeptide
DEEEIRTTNPVATEQYGSVSPVNLVQAQVNGN

SEQ ID NO: 51642 - protein, 32 aa, Artificial Sequence
  Description of Artificial Sequence: Synthetic polypeptide
DEEEIRTTNPVATEQYGSVSPVSNVQRSENDD

SEQ ID NO: 51643 - protein, 30 aa, Artificial Sequence
  Description of Artificial Sequence: Synthetic polypeptide
YEEEISTTNPVALEQYGSVFTGNLQREVNE

SEQ ID NO: 51644 - protein, 32 aa, Artificial Sequence
  Description of Artificial Sequence: Synthetic polypeptide
YEEEISTTNPVALEQYGQSVSTGNLYQREVNR

SEQ ID NO: 51645 - protein, 32 aa, Artificial Sequence
  Description of Artificial Sequence: Synthetic polypeptide
YEEEISTTNPVALEQFYGSVASTGNLQREVNR

SEQ ID NO: 51646 - protein, 30 aa, Artificial Sequence
  Description of Artificial Sequence: Synthetic polypeptide
YEEEISTTNPVALEKYGSVSTGNLQREVNN

SEQ ID NO: 51647 - protein, 30 aa, Artificial Sequence
  Description of Artificial Sequence: Synthetic polypeptide
NEEEIRTTNPVATEQYGEVSAWNLEEFGIR

SEQ ID NO: 51648 - protein, 30 aa, Artificial Sequence
  Description of Artificial Sequence: Synthetic polypeptide
NESEIRTTNPVATEQYGSVWTDNGQQDGSR

SEQ ID NO: 51649 - protein, 32 aa, Artificial Sequence
  Description of Artificial Sequence: Synthetic polypeptide
DEEEIRTTNPVATEQYGSVSQPANLLQDGELS

SEQ ID NO: 51650 - protein, 29 aa, Artificial Sequence
  Description of Artificial Sequence: Synthetic peptide
NEEEIRTTNPVATEQYGCVCGTALQNGEQ

SEQ ID NO: 51651 - protein, 30 aa, Artificial Sequence
  Description of Artificial Sequence: Synthetic polypeptide
YEEEISTTNPAATEQYGQVISTLLQLRGNG

SEQ ID NO: 51652 - protein, 32 aa, Artificial Sequence
  Description of Artificial Sequence: Synthetic polypeptide
DEEEIRTTNPVATEQYGSVSQTNGQNYNENQN

SEQ ID NO: 51653 - protein, 32 aa, Artificial Sequence
  Description of Artificial Sequence: Synthetic polypeptide
DEDEIRTTNPVATEQYGTVSTNLQVGGGNDGQ

SEQ ID NO: 51654 - protein, 32 aa, Artificial Sequence
  Description of Artificial Sequence: Synthetic polypeptide
DEDEIRTTNPVATEQYGTVSTNLQGNAGGDAR

SEQ ID NO: 51655 - protein, 32 aa, Artificial Sequence
  Description of Artificial Sequence: Synthetic polypeptide
DEDEIRTTNPVATEQYGTVSTNLNQGEGPNDN

SEQ ID NO: 51656 - protein, 33 aa, Artificial Sequence
  Description of Artificial Sequence: Synthetic polypeptide
DEEEIRTTNPVATEQYGSVSQTNGVQTPGENDQ

SEQ ID NO: 51657 - protein, 32 aa, Artificial Sequence
  Description of Artificial Sequence: Synthetic polypeptide
DEEEIRTTNPVATEQYGSVSQTNGVVTGEERQ

SEQ ID NO: 51658 - protein, 31 aa, Artificial Sequence
  Description of Artificial Sequence: Synthetic polypeptide
DEEEIRTTNPVATEQYGSVSQTNIQSAVTSA

SEQ ID NO: 51659 - protein, 31 aa, Artificial Sequence
  Description of Artificial Sequence: Synthetic polypeptide
DEDEIRTTNPVATEQYGSVVTTNGGNAGNAR

SEQ ID NO: 51660 - protein, 31 aa, Artificial Sequence
  Description of Artificial Sequence: Synthetic polypeptide
DEDEIRTTNPVATEQYGSVVTNGDGGAGNNR

SEQ ID NO: 51661 - protein, 32 aa, Artificial Sequence
  Description of Artificial Sequence: Synthetic polypeptide
DEDEIRTTNPVATEQYGSVSVTVNTQNEGNLQ

SEQ ID NO: 51662 - protein, 32 aa, Artificial Sequence
  Description of Artificial Sequence: Synthetic polypeptide
DEDEIRTTNPVATEQYGSVSVSTNTQQGGNLQ

SEQ ID NO: 51663 - protein, 30 aa, Artificial Sequence
  Description of Artificial Sequence: Synthetic polypeptide
NETEIATTNPVATEMYGSVSTNLQNGNDDE

SEQ ID NO: 51664 - protein, 33 aa, Artificial Sequence
  Description of Artificial Sequence: Synthetic polypeptide
DEEEIRTTNPVATEQYGSVSQTNLQPFDNNIND

SEQ ID NO: 51665 - protein, 30 aa, Artificial Sequence
  Description of Artificial Sequence: Synthetic polypeptide
YEEEISSTNPVGLEQYGSVSTGNLQREVNR

SEQ ID NO: 51666 - protein, 32 aa, Artificial Sequence
  Description of Artificial Sequence: Synthetic polypeptide
DEDEIRTTNPVATEQYGTVVSGNLQEMGNTRA

SEQ ID NO: 51667 - protein, 32 aa, Artificial Sequence
  Description of Artificial Sequence: Synthetic polypeptide
DEEEIRTTNPVATEQYGSVSQTNGLERSVFVE

SEQ ID NO: 51668 - protein, 30 aa, Artificial Sequence
  Description of Artificial Sequence: Synthetic polypeptide
YEEEISTTNPAATEQYGSVPSTNVIRDNRS

SEQ ID NO: 51669 - protein, 30 aa, Artificial Sequence
  Description of Artificial Sequence: Synthetic polypeptide
YEEEISTTNPAATERYGSVGSTNIQRGNPM

SEQ ID NO: 51670 - protein, 32 aa, Artificial Sequence
  Description of Artificial Sequence: Synthetic polypeptide
DEEEIRTTNPVATEQYGSVSQPNGGQPRGEVD

SEQ ID NO: 51671 - protein, 31 aa, Artificial Sequence
  Description of Artificial Sequence: Synthetic polypeptide
DEEEIRTTNPVATEQYGSVSQPNIQDGEDQD

SEQ ID NO: 51672 - protein, 29 aa, Artificial Sequence
  Description of Artificial Sequence: Synthetic peptide
YEEEISTTNPIATEQFGSVYSTDDQRGNQ

SEQ ID NO: 51673 - protein, 31 aa, Artificial Sequence
  Description of Artificial Sequence: Synthetic polypeptide
DEEEIRTTNPVATEQYGSVSQPNMQRIEEVP

SEQ ID NO: 51674 - protein, 32 aa, Artificial Sequence
  Description of Artificial Sequence: Synthetic polypeptide
DEEEIRTTNPVATEQYGSVSQPNSIQRDNQTI

SEQ ID NO: 51675 - protein, 32 aa, Artificial Sequence
  Description of Artificial Sequence: Synthetic polypeptide
DEEEIRTTNPVATEQYGSVSQPPNELQTVQRT

SEQ ID NO: 51676 - protein, 30 aa, Artificial Sequence
  Description of Artificial Sequence: Synthetic polypeptide
YEEEISTTNPFATEQYGSVPSGNLIRDNRS

SEQ ID NO: 51677 - protein, 30 aa, Artificial Sequence
  Description of Artificial Sequence: Synthetic polypeptide
YEEEISTTNPVALEQYGSVSTGNLMTEINR

SEQ ID NO: 51678 - protein, 31 aa, Artificial Sequence
  Description of Artificial Sequence: Synthetic polypeptide
YEEEISTTNPFALEQYGSVSTGNLQREVANR

SEQ ID NO: 51679 - protein, 33 aa, Artificial Sequence
  Description of Artificial Sequence: Synthetic polypeptide
DEEEIRTTNPVATEQYGSVSQTDDLQRVENNSQ

SEQ ID NO: 51680 - protein, 33 aa, Artificial Sequence
  Description of Artificial Sequence: Synthetic polypeptide
DEEEIRTTNPVATEQYGSVSQTEGLQRGQEDET

SEQ ID NO: 51681 - protein, 33 aa, Artificial Sequence
  Description of Artificial Sequence: Synthetic polypeptide
DEEEIRTTNPVATEQYGSVSQTGDQQRGENGEN

SEQ ID NO: 51682 - protein, 30 aa, Artificial Sequence
  Description of Artificial Sequence: Synthetic polypeptide
YEEEISTTNPEATEGYGSFVITNLHQRGER

SEQ ID NO: 51683 - protein, 32 aa, Artificial Sequence
  Description of Artificial Sequence: Synthetic polypeptide
DEEEIRTTNPVATEQYGSVSQTLLQRLETPVM

SEQ ID NO: 51684 - protein, 30 aa, Artificial Sequence
  Description of Artificial Sequence: Synthetic polypeptide
YEEEISTTNPDATEQYGKVGSTNIQRGNFM

SEQ ID NO: 51685 - protein, 29 aa, Artificial Sequence
  Description of Artificial Sequence: Synthetic peptide
YEEEISTTNPDATEQGGSVSTDDQRGNQA

SEQ ID NO: 51686 - protein, 31 aa, Artificial Sequence
  Description of Artificial Sequence: Synthetic polypeptide
YEEEISTTNPEATEGYGSVGSTGNLQEGVNR

SEQ ID NO: 51687 - protein, 32 aa, Artificial Sequence
  Description of Artificial Sequence: Synthetic polypeptide
NEEEIRTTNPVATEQYGEVVTANDLEQTPGNR

SEQ ID NO: 51688 - protein, 31 aa, Artificial Sequence
  Description of Artificial Sequence: Synthetic polypeptide
NEEEIRTTNPVATEQYGQYSTMELQREQGNG

SEQ ID NO: 51689 - protein, 32 aa, Artificial Sequence
  Description of Artificial Sequence: Synthetic polypeptide
DEEEIRTTNPVATEQYGSVSPTYNLQHFAEDQ

SEQ ID NO: 51690 - protein, 32 aa, Artificial Sequence
  Description of Artificial Sequence: Synthetic polypeptide
DEEEIRTTNPVATEQYGSVSPTTNVQPGDVEL

SEQ ID NO: 51691 - protein, 29 aa, Artificial Sequence
  Description of Artificial Sequence: Synthetic peptide
YEEEISTTNPVATEQGGSVSTDDFERGNQ

SEQ ID NO: 51692 - protein, 34 aa, Artificial Sequence
  Description of Artificial Sequence: Synthetic polypeptide
DEEEIRTTNPVATEQYGSVSPTTSMLQRGPNDQE

SEQ ID NO: 51693 - protein, 29 aa, Artificial Sequence
  Description of Artificial Sequence: Synthetic peptide
YEEEISTTNPVATEQGGSVSTDDEQRANQ

SEQ ID NO: 51694 - protein, 29 aa, Artificial Sequence
  Description of Artificial Sequence: Synthetic peptide
YEEEISTTNPVATEQGGSVPTDDPQRGNQ

SEQ ID NO: 51695 - protein, 28 aa, Artificial Sequence
  Description of Artificial Sequence: Synthetic peptide
YEEEISTTNPVATEQGGSESTDDQRGTQ

SEQ ID NO: 51696 - protein, 29 aa, Artificial Sequence
  Description of Artificial Sequence: Synthetic peptide
YEEEISTTNPVATEQGGQVSTDLQLRGDG

SEQ ID NO: 51697 - protein, 30 aa, Artificial Sequence
  Description of Artificial Sequence: Synthetic polypeptide
YEEEISTTNPVATEQFGSVGSTNIQPGNFM

SEQ ID NO: 51698 - protein, 28 aa, Artificial Sequence
  Description of Artificial Sequence: Synthetic peptide
YEEEISTTNPVATEQAGSVSVDDQRDNQ

SEQ ID NO: 51699 - protein, 31 aa, Artificial Sequence
  Description of Artificial Sequence: Synthetic polypeptide
YEEEISTTNPVATEPYGSVNSTNLEQGNIRD

SEQ ID NO: 51700 - protein, 31 aa, Artificial Sequence
  Description of Artificial Sequence: Synthetic polypeptide
YEEEISTTNPVATENYGSVPSTNLIGRDNRS

SEQ ID NO: 51701 - protein, 32 aa, Artificial Sequence
  Description of Artificial Sequence: Synthetic polypeptide
DEEEIRTTNPVATEQYGSVSPTVHVSDQRGEN

SEQ ID NO: 51702 - protein, 31 aa, Artificial Sequence
  Description of Artificial Sequence: Synthetic polypeptide
YEEEISTTNPVATEMYGSVYTTNPLNARGNR

SEQ ID NO: 51703 - protein, 29 aa, Artificial Sequence
  Description of Artificial Sequence: Synthetic peptide
YEEEISTTNPVATELYGQVSTLGQLRGNG

SEQ ID NO: 51704 - protein, 32 aa, Artificial Sequence
  Description of Artificial Sequence: Synthetic polypeptide
DEEEIRTTNPVATEQYGSVSPTVLVNASGQLR

SEQ ID NO: 51705 - protein, 29 aa, Artificial Sequence
  Description of Artificial Sequence: Synthetic peptide
YEEEISTTNPVATEQGGSVSTDDQRQGVQ

SEQ ID NO: 51706 - protein, 34 aa, Artificial Sequence
  Description of Artificial Sequence: Synthetic polypeptide
DEEEIRTTNPVATEQYGSVSPTTNQQQRGPNEDF

SEQ ID NO: 51707 - protein, 29 aa, Artificial Sequence
  Description of Artificial Sequence: Synthetic peptide
YEEEISTTNPVATEQGGSVSTDDVRGQNQ

SEQ ID NO: 51708 - protein, 29 aa, Artificial Sequence
  Description of Artificial Sequence: Synthetic peptide
YEEEISTTNPVATEQGGSVSTVDDQRGQQ

SEQ ID NO: 51709 - protein, 30 aa, Artificial Sequence
  Description of Artificial Sequence: Synthetic polypeptide
NEEEIRTTNPVATEQYGSCVTHDLQDRQGR

SEQ ID NO: 51710 - protein, 32 aa, Artificial Sequence
  Description of Artificial Sequence: Synthetic polypeptide
DEEEIRTTNPVATEQYGSVSPTTLQKSTQEER

SEQ ID NO: 51711 - protein, 32 aa, Artificial Sequence
  Description of Artificial Sequence: Synthetic polypeptide
DEEEIRTTNPVATEQYGSVSPTTNAQVGMVEL

SEQ ID NO: 51712 - protein, 33 aa, Artificial Sequence
  Description of Artificial Sequence: Synthetic polypeptide
DEEEIRTTNPVATEQYGSVSPTTNLIQPVNNFE

SEQ ID NO: 51713 - protein, 32 aa, Artificial Sequence
  Description of Artificial Sequence: Synthetic polypeptide
YEEEISTTNPVATEQSGSVGSTGNLTQEGVNR

SEQ ID NO: 51714 - protein, 32 aa, Artificial Sequence
  Description of Artificial Sequence: Synthetic polypeptide
YEEEISTTNPVATEQQYGSVNSPTNLEQGNIR

SEQ ID NO: 51715 - protein, 32 aa, Artificial Sequence
  Description of Artificial Sequence: Synthetic polypeptide
DEEEIRTTNPVATEQYGSVSPTTNLIQQNSFE

SEQ ID NO: 51716 - protein, 33 aa, Artificial Sequence
  Description of Artificial Sequence: Synthetic polypeptide
DEEEIRTTNPVATEQYGSVSPTVMWQERGEERS

SEQ ID NO: 51717 - protein, 30 aa, Artificial Sequence
  Description of Artificial Sequence: Synthetic polypeptide
NEEEIRTTNPVATEQYGSCSTHEGQDRQGR

SEQ ID NO: 51718 - protein, 32 aa, Artificial Sequence
  Description of Artificial Sequence: Synthetic polypeptide
DEEEIRTTNPVATEQYGSVSPTTNLPLGFLGQ

SEQ ID NO: 51719 - protein, 32 aa, Artificial Sequence
  Description of Artificial Sequence: Synthetic polypeptide
YEEEISTTNPVATEQLGSVGSTPNLQEVGVNR

SEQ ID NO: 51720 - protein, 30 aa, Artificial Sequence
  Description of Artificial Sequence: Synthetic polypeptide
YEEEISTTNPVATEQGGSVYSTDDQQRGNT

SEQ ID NO: 51721 - protein, 29 aa, Artificial Sequence
  Description of Artificial Sequence: Synthetic peptide
YEEEISTTNPVATEQGGSVSWDDQRVGNQ

SEQ ID NO: 51722 - protein, 30 aa, Artificial Sequence
  Description of Artificial Sequence: Synthetic polypeptide
YEEEISTTNPVATEQGGSVSTWDDIQRGNQ

SEQ ID NO: 51723 - protein, 32 aa, Artificial Sequence
  Description of Artificial Sequence: Synthetic polypeptide
DEEEIRTTNPVATEQYGSVSPTTNLQIILETV

SEQ ID NO: 51724 - protein, 33 aa, Artificial Sequence
  Description of Artificial Sequence: Synthetic polypeptide
DEEEIRTTNPVATEQYGSVSPTTNLQQPGQIEL

SEQ ID NO: 51725 - protein, 29 aa, Artificial Sequence
  Description of Artificial Sequence: Synthetic peptide
YEEEISTTNPVATEQQGQVSTLLQLKGNV

SEQ ID NO: 51726 - protein, 32 aa, Artificial Sequence
  Description of Artificial Sequence: Synthetic polypeptide
YEEEISSTNPVATEQYGSVGSTGNLQQVGVNR

SEQ ID NO: 51727 - protein, 32 aa, Artificial Sequence
  Description of Artificial Sequence: Synthetic polypeptide
YEEEISTTNPVATEIQYGSVNSTINLEQGNIR

SEQ ID NO: 51728 - protein, 29 aa, Artificial Sequence
  Description of Artificial Sequence: Synthetic peptide
NEEEIRTTNPVATEQYGSCSPTHNVVQGR

SEQ ID NO: 51729 - protein, 34 aa, Artificial Sequence
  Description of Artificial Sequence: Synthetic polypeptide
DEEEIRTTNPVATEQYGSVSPTVTLERSGDNDRV

SEQ ID NO: 51730 - protein, 34 aa, Artificial Sequence
  Description of Artificial Sequence: Synthetic polypeptide
DEEEIRTTNPVATEQYGSVSPTVTNLERSGNEQV

SEQ ID NO: 51731 - protein, 31 aa, Artificial Sequence
  Description of Artificial Sequence: Synthetic polypeptide
YEEEISTTNPVALEQYGSVSTQNLQTEVNRS

SEQ ID NO: 51732 - protein, 32 aa, Artificial Sequence
  Description of Artificial Sequence: Synthetic polypeptide
DEDEIRTTNPVATEQYGVVSTVSTNLQAGTED

SEQ ID NO: 51733 - protein, 32 aa, Artificial Sequence
  Description of Artificial Sequence: Synthetic polypeptide
DEEEIRTTNPVATEQYGSVSPTWLEHERSQNA

SEQ ID NO: 51734 - protein, 30 aa, Artificial Sequence
  Description of Artificial Sequence: Synthetic polypeptide
NEEEIRTTNPVATEQYGSCATHLQDRQGRM

SEQ ID NO: 51735 - protein, 34 aa, Artificial Sequence
  Description of Artificial Sequence: Synthetic polypeptide
DEEEIRTTNPVATEQYGSVSPTWNEQNRSQNGRE

SEQ ID NO: 51736 - protein, 33 aa, Artificial Sequence
  Description of Artificial Sequence: Synthetic polypeptide
DEEEIRTTNPVATEQYGSVSPTWNLERTSPNQF

SEQ ID NO: 51737 - protein, 30 aa, Artificial Sequence
  Description of Artificial Sequence: Synthetic polypeptide
YEEEISTTNPVALEQYGSVSTGNQQWEVNR

SEQ ID NO: 51738 - protein, 32 aa, Artificial Sequence
  Description of Artificial Sequence: Synthetic polypeptide
YEEEISTTNPVALEQYGSVSTGNQLQLREVNR

SEQ ID NO: 51739 - protein, 31 aa, Artificial Sequence
  Description of Artificial Sequence: Synthetic polypeptide
YEEEISTTNPVALEQYGSVSTGNLTQTTVNR

SEQ ID NO: 51740 - protein, 30 aa, Artificial Sequence
  Description of Artificial Sequence: Synthetic polypeptide
YEEEISTTNPVALEQYGSVSTGNLQTEVNK

SEQ ID NO: 51741 - protein, 31 aa, Artificial Sequence
  Description of Artificial Sequence: Synthetic polypeptide
NESEIRTTNPVATEQYGSVSWTDNDIQDGSR

SEQ ID NO: 51742 - protein, 34 aa, Artificial Sequence
  Description of Artificial Sequence: Synthetic polypeptide
DEEEIRTTNPVATEQYGSVSPTYNLGQSGNEEEH

SEQ ID NO: 51743 - protein, 32 aa, Artificial Sequence
  Description of Artificial Sequence: Synthetic polypeptide
YEEEISTTNPVALEQYGSVSTGNLQFREVNIR

SEQ ID NO: 51744 - protein, 32 aa, Artificial Sequence
  Description of Artificial Sequence: Synthetic polypeptide
YEEEISTTNPVAPEQYGQSVSTGNLQTREVNR

SEQ ID NO: 51745 - protein, 33 aa, Artificial Sequence
  Description of Artificial Sequence: Synthetic polypeptide
DEEEIRTTNPVATEQYGSVSPTVSEMQDRGNLL

SEQ ID NO: 51746 - protein, 32 aa, Artificial Sequence
  Description of Artificial Sequence: Synthetic polypeptide
DEEEIRTTNPVATEQYGSVSPTVPQARTEVRD

SEQ ID NO: 51747 - protein, 31 aa, Artificial Sequence
  Description of Artificial Sequence: Synthetic polypeptide
YEEEISTTNPVATAQYGSVESTNIYQNRGNQ

SEQ ID NO: 51748 - protein, 34 aa, Artificial Sequence
  Description of Artificial Sequence: Synthetic polypeptide
DEEEIRTTNPVATEQYGSVSPTVNFQPRNGEERQ

SEQ ID NO: 51749 - protein, 34 aa, Artificial Sequence
  Description of Artificial Sequence: Synthetic polypeptide
DEEEIRTTNPVATEQYGSVSPTVNLEQVPENVRT

SEQ ID NO: 51750 - protein, 34 aa, Artificial Sequence
  Description of Artificial Sequence: Synthetic polypeptide
DEEEIRTTNPVATEQYGSVSPTVNLIQRNSNFEL

SEQ ID NO: 51751 - protein, 32 aa, Artificial Sequence
  Description of Artificial Sequence: Synthetic polypeptide
DEEEIRTTNPVATEQYGSVSPTVNLQNNFPLL

SEQ ID NO: 51752 - protein, 33 aa, Artificial Sequence
  Description of Artificial Sequence: Synthetic polypeptide
DEEEIRTTNPVATEQYGSVSPTVNLQVPENGDQ

SEQ ID NO: 51753 - protein, 31 aa, Artificial Sequence
  Description of Artificial Sequence: Synthetic polypeptide
YEEEISTTNPVATEFYGSVYTTNPLNQQGNR

SEQ ID NO: 51754 - protein, 31 aa, Artificial Sequence
  Description of Artificial Sequence: Synthetic polypeptide
YEEEISTTNPVATEFYGSVGSTNIHQRGNPM

SEQ ID NO: 51755 - protein, 29 aa, Artificial Sequence
  Description of Artificial Sequence: Synthetic peptide
NEEEIRTTNPVATEQYGSCSTGLQGEQGI

SEQ ID NO: 51756 - protein, 29 aa, Artificial Sequence
  Description of Artificial Sequence: Synthetic peptide
YEEEISTTNPVATEEGGSVSYTDDQRGNQ

SEQ ID NO: 51757 - protein, 32 aa, Artificial Sequence
  Description of Artificial Sequence: Synthetic polypeptide
YEEEISTTNPVATECQYGSVNSTNLEQGNSRT

SEQ ID NO: 51758 - protein, 34 aa, Artificial Sequence
  Description of Artificial Sequence: Synthetic polypeptide
DEEEIRTTNPVATEQYGSVSPTVNPLNRGENETL

SEQ ID NO: 51759 - protein, 31 aa, Artificial Sequence
  Description of Artificial Sequence: Synthetic polypeptide
YEEEISTTNPVATEAYGTSVESTNPYQRGNQ

SEQ ID NO: 51760 - protein, 31 aa, Artificial Sequence
  Description of Artificial Sequence: Synthetic polypeptide
NEEEIRTTNPVATEQYGSCSDNLQEEGNNQI

SEQ ID NO: 51761 - protein, 33 aa, Artificial Sequence
  Description of Artificial Sequence: Synthetic polypeptide
DEEEIRTTNPVATEQYGSVSPTVNVHDQRGEMN

SEQ ID NO: 51762 - protein, 31 aa, Artificial Sequence
  Description of Artificial Sequence: Synthetic polypeptide
YEEEISTTNPVATCQYGSVYTTNPLNQRGNS

SEQ ID NO: 51763 - protein, 32 aa, Artificial Sequence
  Description of Artificial Sequence: Synthetic polypeptide
DEEEIRTTNPVATEQYGSVSPTVPQARLVEVR

SEQ ID NO: 51764 - protein, 30 aa, Artificial Sequence
  Description of Artificial Sequence: Synthetic polypeptide
YEEEISTTNPVATECYGSVQSTNIDRGNPM

SEQ ID NO: 51765 - protein, 33 aa, Artificial Sequence
  Description of Artificial Sequence: Synthetic polypeptide
DEEEIRTTNPVATEQYGSVSQTNLQVSVGEAVN

SEQ ID NO: 51766 - protein, 32 aa, Artificial Sequence
  Description of Artificial Sequence: Synthetic polypeptide
DEDEIRTTNPVATEQYGSVSTVNQLGDQGENQ

SEQ ID NO: 51767 - protein, 31 aa, Artificial Sequence
  Description of Artificial Sequence: Synthetic polypeptide
DEDEIRTTNPVATEQYGSVSTVNQGNQGENQ

SEQ ID NO: 51768 - protein, 31 aa, Artificial Sequence
  Description of Artificial Sequence: Synthetic polypeptide
DEDEIRTTNPVATEQYGSVQTANLIRTTNNT

SEQ ID NO: 51769 - protein, 29 aa, Artificial Sequence
  Description of Artificial Sequence: Synthetic peptide
DEDEIRTTNPVATEQYGSVQTALINETNN

SEQ ID NO: 51770 - protein, 29 aa, Artificial Sequence
  Description of Artificial Sequence: Synthetic peptide
DEDEIRTTNPVATEQYGSVQTALIADENN

SEQ ID NO: 51771 - protein, 31 aa, Artificial Sequence
  Description of Artificial Sequence: Synthetic polypeptide
DEEEIRTTNPVATEQYGSVSSNPQFFGSEQL

SEQ ID NO: 51772 - protein, 32 aa, Artificial Sequence
  Description of Artificial Sequence: Synthetic polypeptide
DEEEIRTTNPVATEQYGSVSSNTNLGNNWNVP

SEQ ID NO: 51773 - protein, 31 aa, Artificial Sequence
  Description of Artificial Sequence: Synthetic polypeptide
NETEIRTTNPVATECYGSVSTNLQGNDGNTH

SEQ ID NO: 51774 - protein, 32 aa, Artificial Sequence
  Description of Artificial Sequence: Synthetic polypeptide
DEEEIRTTNPVATEQYGSVSSNWLMVIGSQER

SEQ ID NO: 51775 - protein, 32 aa, Artificial Sequence
  Description of Artificial Sequence: Synthetic polypeptide
DEEEIRTTNPVATEQYGSVSSPYMNQTGENSR

SEQ ID NO: 51776 - protein, 32 aa, Artificial Sequence
  Description of Artificial Sequence: Synthetic polypeptide
NETEIRTTNPVATECYGSVSTNLQGNEGNGDR

SEQ ID NO: 51777 - protein, 33 aa, Artificial Sequence
  Description of Artificial Sequence: Synthetic polypeptide
DEEEIRTTNPVATEQYGSVSSSTGNGQTEGGNG

SEQ ID NO: 51778 - protein, 33 aa, Artificial Sequence
  Description of Artificial Sequence: Synthetic polypeptide
DEEEIRTTNPVATEQYGSVSSSTLNAGQTGGNG

SEQ ID NO: 51779 - protein, 29 aa, Artificial Sequence
  Description of Artificial Sequence: Synthetic peptide
YEEEIRSVNPVATEQYGVVSTALQMSGNV

SEQ ID NO: 51780 - protein, 31 aa, Artificial Sequence
  Description of Artificial Sequence: Synthetic polypeptide
NEEEIATTNPVAYEQYGSVATNLQRNNELRN

SEQ ID NO: 51781 - protein, 29 aa, Artificial Sequence
  Description of Artificial Sequence: Synthetic peptide
YEEEIRSVNPVATEQYGVVSDNLNMRGNQ

SEQ ID NO: 51782 - protein, 31 aa, Artificial Sequence
  Description of Artificial Sequence: Synthetic polypeptide
NETEIRTTNPVATECYGSVSTNLQGNMGNDG

SEQ ID NO: 51783 - protein, 29 aa, Artificial Sequence
  Description of Artificial Sequence: Synthetic peptide
DEDEIRTTNPVATEQYGSVQTAQLISENN

SEQ ID NO: 51784 - protein, 29 aa, Artificial Sequence
  Description of Artificial Sequence: Synthetic peptide
DEDEIRTTNPVATEQYGSVQTTALIGENV

SEQ ID NO: 51785 - protein, 30 aa, Artificial Sequence
  Description of Artificial Sequence: Synthetic polypeptide
NEEEIATTNPVAYEQYGSVATNLQVGDNDQ

SEQ ID NO: 51786 - protein, 28 aa, Artificial Sequence
  Description of Artificial Sequence: Synthetic peptide
YEEEIRSVNPVCTEQYGVVSDNLQSGNA

SEQ ID NO: 51787 - protein, 32 aa, Artificial Sequence
  Description of Artificial Sequence: Synthetic polypeptide
DEEEIRTTNPVATEQYGSVSSMDPTVQREGNQ

SEQ ID NO: 51788 - protein, 31 aa, Artificial Sequence
  Description of Artificial Sequence: Synthetic polypeptide
DEDEIRTTNPVATEQYGSVSSTNTQQEGILQ

SEQ ID NO: 51789 - protein, 31 aa, Artificial Sequence
  Description of Artificial Sequence: Synthetic polypeptide
DEDEIRTTNPVATEQYGSVSSTNTQNQGGLQ

SEQ ID NO: 51790 - protein, 31 aa, Artificial Sequence
  Description of Artificial Sequence: Synthetic polypeptide
NEEEIATTNPVAYEQYGSVSTNLQNRNPEPR

SEQ ID NO: 51791 - protein, 31 aa, Artificial Sequence
  Description of Artificial Sequence: Synthetic polypeptide
DEDEIRTTNPVATEQYGSVSSTNTNQQENLQ

SEQ ID NO: 51792 - protein, 31 aa, Artificial Sequence
  Description of Artificial Sequence: Synthetic polypeptide
DEDEIRTTNPVATEQYGSVSSTNNTQQGGLQ

SEQ ID NO: 51793 - protein, 32 aa, Artificial Sequence
  Description of Artificial Sequence: Synthetic polypeptide
DEDEIRTTNPVATEQYGSVSSHNDGQLRGNPE

SEQ ID NO: 51794 - protein, 28 aa, Artificial Sequence
  Description of Artificial Sequence: Synthetic peptide
YEEEIRSVNPVATEQYGVVSDALQSGNV

SEQ ID NO: 51795 - protein, 28 aa, Artificial Sequence
  Description of Artificial Sequence: Synthetic peptide
AECEIACTNPVATEQYGEASENLQRGGR

SEQ ID NO: 51796 - protein, 30 aa, Artificial Sequence
  Description of Artificial Sequence: Synthetic polypeptide
DEDEIRTTNPVATEQYGSVSNQNLFGNVNG

SEQ ID NO: 51797 - protein, 31 aa, Artificial Sequence
  Description of Artificial Sequence: Synthetic polypeptide
DEEEIRTTNPVATEQYGSVSSNAYDPRNFVR

SEQ ID NO: 51798 - protein, 31 aa, Artificial Sequence
  Description of Artificial Sequence: Synthetic polypeptide
DEDEIRTTNPVATEQYGSVSDTWLEQNSQNG

SEQ ID NO: 51799 - protein, 29 aa, Artificial Sequence
  Description of Artificial Sequence: Synthetic peptide
NEEEIATTNPVAYEQYGSVATTNDQNGNV

SEQ ID NO: 51800 - protein, 31 aa, Artificial Sequence
  Description of Artificial Sequence: Synthetic polypeptide
DEEEIRTTNPVATEQYGSVSSNGQNDNINEI

SEQ ID NO: 51801 - protein, 28 aa, Artificial Sequence
  Description of Artificial Sequence: Synthetic peptide
AEDEIACTNPVATEQYGEASENLQRGGR

SEQ ID NO: 51802 - protein, 28 aa, Artificial Sequence
  Description of Artificial Sequence: Synthetic peptide
YEEEIRSVNPVCTEQYGVVSDNLQSGNQ

SEQ ID NO: 51803 - protein, 31 aa, Artificial Sequence
  Description of Artificial Sequence: Synthetic polypeptide
YEEEIRTTNPSATEEYGSTVSTNAISQSGNR

SEQ ID NO: 51804 - protein, 31 aa, Artificial Sequence
  Description of Artificial Sequence: Synthetic polypeptide
DEDEIRTTNPVATEQYGSVSTAGGEHGGNER

SEQ ID NO: 51805 - protein, 31 aa, Artificial Sequence
  Description of Artificial Sequence: Synthetic polypeptide
AEEEIRTTNPVATEQYGSVVVTTNNQDVGNG

SEQ ID NO: 51806 - protein, 33 aa, Artificial Sequence
  Description of Artificial Sequence: Synthetic polypeptide
DEEEIRTTNPVATEQYGSVSSTDLQGIGQGNEQ

SEQ ID NO: 51807 - protein, 32 aa, Artificial Sequence
  Description of Artificial Sequence: Synthetic polypeptide
DEEEIRTTNPVATEQYGSVSSTEPAGPNRGNV

SEQ ID NO: 51808 - protein, 30 aa, Artificial Sequence
  Description of Artificial Sequence: Synthetic polypeptide
YEEEIRSTNPVATEQYGSVSDALNMRNGNQ

SEQ ID NO: 51809 - protein, 33 aa, Artificial Sequence
  Description of Artificial Sequence: Synthetic polypeptide
DEEEIRTTNPVATEQYGSVSSTEPALPNRGNPV

SEQ ID NO: 51810 - protein, 28 aa, Artificial Sequence
  Description of Artificial Sequence: Synthetic peptide
YEEEIRCTNPVCTEQYGVVSDNLMSGNQ

SEQ ID NO: 51811 - protein, 29 aa, Artificial Sequence
  Description of Artificial Sequence: Synthetic peptide
DEDEIRTTNPVATEQYGQTATNLQRSDSM

SEQ ID NO: 51812 - protein, 28 aa, Artificial Sequence
  Description of Artificial Sequence: Synthetic peptide
YEEEIRCTNPICTEQYGVVSENLQSGNQ

SEQ ID NO: 51813 - protein, 32 aa, Artificial Sequence
  Description of Artificial Sequence: Synthetic polypeptide
DEDEIRTTNPVATEQYGNVSTNLQPQGDNGDG

SEQ ID NO: 51814 - protein, 33 aa, Artificial Sequence
  Description of Artificial Sequence: Synthetic polypeptide
DEEEIRTTNPVATEQYGSVSSTGLFEQGGEGNE

SEQ ID NO: 51815 - protein, 33 aa, Artificial Sequence
  Description of Artificial Sequence: Synthetic polypeptide
DEEEIRTTNPVATEQYGSVSSTGLIQNGGNGTT

SEQ ID NO: 51816 - protein, 33 aa, Artificial Sequence
  Description of Artificial Sequence: Synthetic polypeptide
DEEEIRTTNPVATEQYGSVSSTGLQEGGGENGE

SEQ ID NO: 51817 - protein, 33 aa, Artificial Sequence
  Description of Artificial Sequence: Synthetic polypeptide
DEEEIRTTNPVATEQYGSVSSTGLQQGGGNELG

SEQ ID NO: 51818 - protein, 29 aa, Artificial Sequence
  Description of Artificial Sequence: Synthetic peptide
DEDEIRTTNPVATEQYGMTSATNGQGGDE

SEQ ID NO: 51819 - protein, 31 aa, Artificial Sequence
  Description of Artificial Sequence: Synthetic polypeptide
NETEIRTTNPVATEGYGSVSTNLQGNEGGND

SEQ ID NO: 51820 - protein, 28 aa, Artificial Sequence
  Description of Artificial Sequence: Synthetic peptide
YEEEIRCTNPICTEQYGVVSDNLQSGNQ

SEQ ID NO: 51821 - protein, 33 aa, Artificial Sequence
  Description of Artificial Sequence: Synthetic polypeptide
DEEEIRTTNPVATEQYGSVSSTGLQTGGNNGQE

SEQ ID NO: 51822 - protein, 32 aa, Artificial Sequence
  Description of Artificial Sequence: Synthetic polypeptide
NETEIRTTNPVATEEYGSVSTNLQGNEGDNDR

SEQ ID NO: 51823 - protein, 31 aa, Artificial Sequence
  Description of Artificial Sequence: Synthetic polypeptide
YEEEIRSTNPVATEQYGSVSSTALNMRNGNQ

SEQ ID NO: 51824 - protein, 32 aa, Artificial Sequence
  Description of Artificial Sequence: Synthetic polypeptide
DEEEIRTTNPVATEQYGSVSSTEPAGNRNGNV

SEQ ID NO: 51825 - protein, 28 aa, Artificial Sequence
  Description of Artificial Sequence: Synthetic peptide
YEEEIRSTNPVATEQYGVVSDNLMSENQ

SEQ ID NO: 51826 - protein, 32 aa, Artificial Sequence
  Description of Artificial Sequence: Synthetic polypeptide
DEDEIRTTNPVATEQYGSVATNLGQGQDGNVM

SEQ ID NO: 51827 - protein, 31 aa, Artificial Sequence
  Description of Artificial Sequence: Synthetic polypeptide
NETEIRTTNPVATECYGSVSTNLQSNGDNDD

SEQ ID NO: 51828 - protein, 31 aa, Artificial Sequence
  Description of Artificial Sequence: Synthetic polypeptide
DEDEIRTTNPVATEQYGSVAMTNGVQRGPFE

SEQ ID NO: 51829 - protein, 31 aa, Artificial Sequence
  Description of Artificial Sequence: Synthetic polypeptide
NETEIRTTNPVATECYGSVSTNLQSNGENED

SEQ ID NO: 51830 - protein, 33 aa, Artificial Sequence
  Description of Artificial Sequence: Synthetic polypeptide
DEEEIRTTNPVATEQYGSVSSTDNGLGGGNNDE

SEQ ID NO: 51831 - protein, 33 aa, Artificial Sequence
  Description of Artificial Sequence: Synthetic polypeptide
DEDEIRTTNPVATEQYGSVACTNLSQYGGNNRM

SEQ ID NO: 51832 - protein, 28 aa, Artificial Sequence
  Description of Artificial Sequence: Synthetic peptide
NEEEIATTNPVAYEQYGSVATADQNGNT

SEQ ID NO: 51833 - protein, 31 aa, Artificial Sequence
  Description of Artificial Sequence: Synthetic polypeptide
NETEIRTTNPVATECYGSVSTNLQGNQGNND

SEQ ID NO: 51834 - protein, 33 aa, Artificial Sequence
  Description of Artificial Sequence: Synthetic polypeptide
DEEEIRTTNPVATEQYGSVSSTDNGQTGNGNEN

SEQ ID NO: 51835 - protein, 28 aa, Artificial Sequence
  Description of Artificial Sequence: Synthetic peptide
YEEEIRSTNPVCTEQYGVISDNLQSGNQ

SEQ ID NO: 51836 - protein, 30 aa, Artificial Sequence
  Description of Artificial Sequence: Synthetic polypeptide
DEDEIRTTNPVATEQYGSCSTNPQGEEMGR

SEQ ID NO: 51837 - protein, 33 aa, Artificial Sequence
  Description of Artificial Sequence: Synthetic polypeptide
DEEEIRTTNPVATEQYGSVSSTDTANGQGGNNT

SEQ ID NO: 51838 - protein, 29 aa, Artificial Sequence
  Description of Artificial Sequence: Synthetic peptide
YEEEIRSTNPVATEQYGVVWSDNLQSGPQ

SEQ ID NO: 51839 - protein, 30 aa, Artificial Sequence
  Description of Artificial Sequence: Synthetic polypeptide
YEEEIRSTNPVATEQYGVVSDNLNMRNGNQ

SEQ ID NO: 51840 - protein, 32 aa, Artificial Sequence
  Description of Artificial Sequence: Synthetic polypeptide
DEDEIRTTNPVATEQYGSCSTNDQREGPQDRS

SEQ ID NO: 51841 - protein, 33 aa, Artificial Sequence
  Description of Artificial Sequence: Synthetic polypeptide
DEEEIRTTNPVATEQYGSVSSTENGNMRNGNPV

SEQ ID NO: 51842 - protein, 28 aa, Artificial Sequence
  Description of Artificial Sequence: Synthetic peptide
YEEEIRSTNPVCTEQYGVVSDNLQSENQ

SEQ ID NO: 51843 - protein, 33 aa, Artificial Sequence
  Description of Artificial Sequence: Synthetic polypeptide
DEEEIRTTNPVATEQYGSVSSTGNGQGQGNEEE

SEQ ID NO: 51844 - protein, 32 aa, Artificial Sequence
  Description of Artificial Sequence: Synthetic polypeptide
DEDEIRTTNPVATEQYGSVSTGNLAGDGPNDA

SEQ ID NO: 51845 - protein, 33 aa, Artificial Sequence
  Description of Artificial Sequence: Synthetic polypeptide
DEDEIRTTNPVATEQYGSVSTNGEPQQGDNGRQ

SEQ ID NO: 51846 - protein, 33 aa, Artificial Sequence
  Description of Artificial Sequence: Synthetic polypeptide
NEEEIRTTNPVATEQWGSVQKTDNLGQRGENYR

SEQ ID NO: 51847 - protein, 32 aa, Artificial Sequence
  Description of Artificial Sequence: Synthetic polypeptide
YEEEIRTTNPVATEQYGSVSTLTNTQRWGTCN

SEQ ID NO: 51848 - protein, 29 aa, Artificial Sequence
  Description of Artificial Sequence: Synthetic peptide
NETEIATTNPVATEQYGSVWTDNLGIGSR

SEQ ID NO: 51849 - protein, 29 aa, Artificial Sequence
  Description of Artificial Sequence: Synthetic peptide
NEEEIRTTNPVATEQWGSTSTHLQGDQGR

SEQ ID NO: 51850 - protein, 30 aa, Artificial Sequence
  Description of Artificial Sequence: Synthetic polypeptide
NEEEIRTTNPVATEQWGSLSTHGQRDQGER

SEQ ID NO: 51851 - protein, 32 aa, Artificial Sequence
  Description of Artificial Sequence: Synthetic polypeptide
YEEEIRTTNPVATEQYGSVSTLLTNTRFGTNN

SEQ ID NO: 51852 - protein, 32 aa, Artificial Sequence
  Description of Artificial Sequence: Synthetic polypeptide
DEEEIRTTNPVATEQYGSVSSDNLGNGFGENI

SEQ ID NO: 51853 - protein, 34 aa, Artificial Sequence
  Description of Artificial Sequence: Synthetic polypeptide
DEDEIRTTNPVATEQYGSVSTTNNLQDGTGDNNR

SEQ ID NO: 51854 - protein, 33 aa, Artificial Sequence
  Description of Artificial Sequence: Synthetic polypeptide
DEDEIRTTNPVATEQYGSVSTTNLNGNDGNLRQ

SEQ ID NO: 51855 - protein, 33 aa, Artificial Sequence
  Description of Artificial Sequence: Synthetic polypeptide
DEDEIRTTNPVATEQYGSVSTTNLGGDVGNGRQ

SEQ ID NO: 51856 - protein, 32 aa, Artificial Sequence
  Description of Artificial Sequence: Synthetic polypeptide
DEDEIRTTNPVATEQYGSVSTTNGSQGDGNEK

SEQ ID NO: 51857 - protein, 33 aa, Artificial Sequence
  Description of Artificial Sequence: Synthetic polypeptide
DEDEIRTTNPVATEQYGSVSTTNGSQDAGNNDR

SEQ ID NO: 51858 - protein, 33 aa, Artificial Sequence
  Description of Artificial Sequence: Synthetic polypeptide
DEDEIRTTNPVATEQYGSVSTTNGLQGDGNNAK

SEQ ID NO: 51859 - protein, 32 aa, Artificial Sequence
  Description of Artificial Sequence: Synthetic polypeptide
YEEEIRTTNPVATEQYGSVSTCTNTQRFGTHP

SEQ ID NO: 51860 - protein, 33 aa, Artificial Sequence
  Description of Artificial Sequence: Synthetic polypeptide
DEDEIRTTNPVATEQYGSVSTTNGLGDINGNNR

SEQ ID NO: 51861 - protein, 30 aa, Artificial Sequence
  Description of Artificial Sequence: Synthetic polypeptide
NEEEIRTTNPVATEQWGSVSAWNLDEHDNR

SEQ ID NO: 51862 - protein, 30 aa, Artificial Sequence
  Description of Artificial Sequence: Synthetic polypeptide
DEEEIRTTNPVATEQYGSVSSDLQVIVLAN

SEQ ID NO: 51863 - protein, 30 aa, Artificial Sequence
  Description of Artificial Sequence: Synthetic polypeptide
DEEEIRTTNPVATEQYGSVSSDLETRTESE

SEQ ID NO: 51864 - protein, 31 aa, Artificial Sequence
  Description of Artificial Sequence: Synthetic polypeptide
DEEEIRTTNPVATEQYGSVSSDEQDSGQNNT

SEQ ID NO: 51865 - protein, 30 aa, Artificial Sequence
  Description of Artificial Sequence: Synthetic polypeptide
YEEEISATNPVATEMYGSVESTNPYQRGNQ

SEQ ID NO: 51866 - protein, 29 aa, Artificial Sequence
  Description of Artificial Sequence: Synthetic peptide
YEEEIRTVNPVSTEQYGTVSDNLQSNGNQ

SEQ ID NO: 51867 - protein, 31 aa, Artificial Sequence
  Description of Artificial Sequence: Synthetic polypeptide
NETEIATTNPVATEQYGSVWTDNGLQDGNSR

SEQ ID NO: 51868 - protein, 28 aa, Artificial Sequence
  Description of Artificial Sequence: Synthetic peptide
AEAEISTTNPVATECYGNVGTNLQRGTQ

SEQ ID NO: 51869 - protein, 28 aa, Artificial Sequence
  Description of Artificial Sequence: Synthetic peptide
YEEEIRTTNPVSTEQYGVISDDLQQGNH

SEQ ID NO: 51870 - protein, 32 aa, Artificial Sequence
  Description of Artificial Sequence: Synthetic polypeptide
DEDEIRTTNPVATEQYGSVSTVNLGGQGENGQ

SEQ ID NO: 51871 - protein, 31 aa, Artificial Sequence
  Description of Artificial Sequence: Synthetic polypeptide
DEDEIRTTNPVATEQYGSVSTVNDGAQGNEQ

SEQ ID NO: 51872 - protein, 31 aa, Artificial Sequence
  Description of Artificial Sequence: Synthetic polypeptide
AEEEIRTTNPVATEQYGSVVVTTNQQEGNDE

SEQ ID NO: 51873 - protein, 29 aa, Artificial Sequence
  Description of Artificial Sequence: Synthetic peptide
YEEEIRTTNPVCTEQYGVVSDDLQQSGNQ

SEQ ID NO: 51874 - protein, 31 aa, Artificial Sequence
  Description of Artificial Sequence: Synthetic polypeptide
NEEEIRTTNPVATEQWGSYLSTDHLQRQGDR

SEQ ID NO: 51875 - protein, 32 aa, Artificial Sequence
  Description of Artificial Sequence: Synthetic polypeptide
NEEEIRTTNPVATEQWGSVSAWNLQDEFNGNR

SEQ ID NO: 51876 - protein, 33 aa, Artificial Sequence
  Description of Artificial Sequence: Synthetic polypeptide
DEDEIRTTNPVATEQYGSVSTTPNLQGEGGDFR

SEQ ID NO: 51877 - protein, 32 aa, Artificial Sequence
  Description of Artificial Sequence: Synthetic polypeptide
DEDEIRTTNPVATEQYGSVSTTNTQNQEGENQ

SEQ ID NO: 51878 - protein, 33 aa, Artificial Sequence
  Description of Artificial Sequence: Synthetic polypeptide
DEEEIRTTNPVATEQYGSVSQTVGLERSVQNRE

SEQ ID NO: 51879 - protein, 29 aa, Artificial Sequence
  Description of Artificial Sequence: Synthetic peptide
NETEIATTNPVATEQYGSVWTDNHQHGSR

SEQ ID NO: 51880 - protein, 33 aa, Artificial Sequence
  Description of Artificial Sequence: Synthetic polypeptide
DEEEIRTTNPVATEQYGSVSSANLQLGGGNEQG

SEQ ID NO: 51881 - protein, 32 aa, Artificial Sequence
  Description of Artificial Sequence: Synthetic polypeptide
DEEEIRTTNPVATEQYGSVSQTQNAIQITDNP

SEQ ID NO: 51882 - protein, 31 aa, Artificial Sequence
  Description of Artificial Sequence: Synthetic polypeptide
DEDEIRTTNPVATEQYGSVSTGSGGDHGNDR

SEQ ID NO: 51883 - protein, 32 aa, Artificial Sequence
  Description of Artificial Sequence: Synthetic polypeptide
DEDEIRTTNPVATEQYGSVSTTNGDQHGGNTK

SEQ ID NO: 51884 - protein, 32 aa, Artificial Sequence
  Description of Artificial Sequence: Synthetic polypeptide
DEDEIRTTNPVATEQYGSVSTTNDGQQGGNTK

SEQ ID NO: 51885 - protein, 31 aa, Artificial Sequence
  Description of Artificial Sequence: Synthetic polypeptide
NEEEIRATNPVATEQYGSVSVNDQDNGSNSR

SEQ ID NO: 51886 - protein, 32 aa, Artificial Sequence
  Description of Artificial Sequence: Synthetic polypeptide
DEDEIRTTNPVATEQYGSVSTQNLFGGNNNGS

SEQ ID NO: 51887 - protein, 32 aa, Artificial Sequence
  Description of Artificial Sequence: Synthetic polypeptide
DEDEIRTTNPVATEQYGSVSTQNLEYGNNNDQ

SEQ ID NO: 51888 - protein, 30 aa, Artificial Sequence
  Description of Artificial Sequence: Synthetic polypeptide
NEEEIRATNPVATEQWGSVCTNLGVRHGNA

SEQ ID NO: 51889 - protein, 29 aa, Artificial Sequence
  Description of Artificial Sequence: Synthetic peptide
NEEEICTTNPVATEQYGSVATNLQSPDDN

SEQ ID NO: 51890 - protein, 31 aa, Artificial Sequence
  Description of Artificial Sequence: Synthetic polypeptide
DEEEIRTTNPVATEQYGSVSSLLQPEGIEDG

SEQ ID NO: 51891 - protein, 33 aa, Artificial Sequence
  Description of Artificial Sequence: Synthetic polypeptide
DEDEIRTTNPVATEQYGSVSTQENLQIGNNNED

SEQ ID NO: 51892 - protein, 32 aa, Artificial Sequence
  Description of Artificial Sequence: Synthetic polypeptide
DEDEIRTTNPVATEQYGSVSTNLQGNGPQDQN

SEQ ID NO: 51893 - protein, 33 aa, Artificial Sequence
  Description of Artificial Sequence: Synthetic polypeptide
DEDEIRTTNPVATEQYGSVSTNLQGGNTQNGDA

SEQ ID NO: 51894 - protein, 32 aa, Artificial Sequence
  Description of Artificial Sequence: Synthetic polypeptide
DEDEIRTTNPVATEQYGSVSTNLNMGEGNGND

SEQ ID NO: 51895 - protein, 31 aa, Artificial Sequence
  Description of Artificial Sequence: Synthetic polypeptide
DEDEIRTTNPVATEQYGSVSTNLNMGDSQGQ

SEQ ID NO: 51896 - protein, 32 aa, Artificial Sequence
  Description of Artificial Sequence: Synthetic polypeptide
DEDEIRTTNPVATEQYGSVSTNLNGEGDNSQP

SEQ ID NO: 51897 - protein, 32 aa, Artificial Sequence
  Description of Artificial Sequence: Synthetic polypeptide
DEDEIRTTNPVATEQYGSVSTNLNAGNTGGNA

SEQ ID NO: 51898 - protein, 32 aa, Artificial Sequence
  Description of Artificial Sequence: Synthetic polypeptide
DEDEIRTTNPVATEQYGSVSTNLNAGGDGNNA

SEQ ID NO: 51899 - protein, 32 aa, Artificial Sequence
  Description of Artificial Sequence: Synthetic polypeptide
DEDEIRTTNPVATEQYGSVSTNLNAGDQGNNA

SEQ ID NO: 51900 - protein, 32 aa, Artificial Sequence
  Description of Artificial Sequence: Synthetic polypeptide
DEDEIRTTNPVATEQYGSVSTQNLLEGNNNND

SEQ ID NO: 51901 - protein, 31 aa, Artificial Sequence
  Description of Artificial Sequence: Synthetic polypeptide
DEDEIRTTNPVATEQYGSVSTQNLPGNNNED

SEQ ID NO: 51902 - protein, 33 aa, Artificial Sequence
  Description of Artificial Sequence: Synthetic polypeptide
DEDEIRTTNPVATEQYGSVSTQNLQFGGNNNED

SEQ ID NO: 51903 - protein, 31 aa, Artificial Sequence
  Description of Artificial Sequence: Synthetic polypeptide
NEEEIRCTNPVATEQYGSVATNLQNPGENHN

SEQ ID NO: 51904 - protein, 34 aa, Artificial Sequence
  Description of Artificial Sequence: Synthetic polypeptide
DEEEIRTTNPVATEQYGSVSSDTNNELQGGGGNP

SEQ ID NO: 51905 - protein, 34 aa, Artificial Sequence
  Description of Artificial Sequence: Synthetic polypeptide
DEEEIRTTNPVATEQYGSVSSDTSNELGQENGNA

SEQ ID NO: 51906 - protein, 33 aa, Artificial Sequence
  Description of Artificial Sequence: Synthetic polypeptide
DEEEIRTTNPVATEQYGSVSSDTSNQGQIGGNS

SEQ ID NO: 51907 - protein, 31 aa, Artificial Sequence
  Description of Artificial Sequence: Synthetic polypeptide
DEDEIRTTNPVATEQYGSVSTTLNGSDGDRQ

SEQ ID NO: 51908 - protein, 32 aa, Artificial Sequence
  Description of Artificial Sequence: Synthetic polypeptide
DEDEIRTTNPVATEQYGSVSTTLNGGDLGNRQ

SEQ ID NO: 51909 - protein, 32 aa, Artificial Sequence
  Description of Artificial Sequence: Synthetic polypeptide
DEDEIRTTNPVATEQYGSVSTTLNGDVGNDRQ

SEQ ID NO: 51910 - protein, 32 aa, Artificial Sequence
  Description of Artificial Sequence: Synthetic polypeptide
YEEEIRTTNPVATEQYGSVSFLTNEQRFGTHN

SEQ ID NO: 51911 - protein, 31 aa, Artificial Sequence
  Description of Artificial Sequence: Synthetic polypeptide
NETEIRTTNPVATEAYGSVSTNLQANGDNDS

SEQ ID NO: 51912 - protein, 31 aa, Artificial Sequence
  Description of Artificial Sequence: Synthetic polypeptide
DEDEIRTTNPVATEQYGSVSTTLNGDHGNHQ

SEQ ID NO: 51913 - protein, 28 aa, Artificial Sequence
  Description of Artificial Sequence: Synthetic peptide
NEEEIRTTNPVATECYGSLSTHLENQGR

SEQ ID NO: 51914 - protein, 31 aa, Artificial Sequence
  Description of Artificial Sequence: Synthetic polypeptide
DEDEIRTTNPVATEQYGSVSTTLGGDGNDAQ

SEQ ID NO: 51915 - protein, 33 aa, Artificial Sequence
  Description of Artificial Sequence: Synthetic polypeptide
DEDEIRTTNPVATEQYGSVSTTGNDQQQRGEER

SEQ ID NO: 51916 - protein, 31 aa, Artificial Sequence
  Description of Artificial Sequence: Synthetic polypeptide
DEDEIRTTNPVATEQYGSVSTSLEQEDEEDR

SEQ ID NO: 51917 - protein, 33 aa, Artificial Sequence
  Description of Artificial Sequence: Synthetic polypeptide
DEEEIRTTNPVATEQYGSVSSENNELQEGGGNG

SEQ ID NO: 51918 - protein, 30 aa, Artificial Sequence
  Description of Artificial Sequence: Synthetic polypeptide
NEEEIRTTNPVATDQYGSVSAWNLEEFGNE

SEQ ID NO: 51919 - protein, 32 aa, Artificial Sequence
  Description of Artificial Sequence: Synthetic polypeptide
DEEEIRTTNPVATEQYGSVSSFLQRVGVEIEY

SEQ ID NO: 51920 - protein, 32 aa, Artificial Sequence
  Description of Artificial Sequence: Synthetic polypeptide
DEDEIRTTNPVATEQYGSVSTTLNGDDGNNRQ

SEQ ID NO: 51921 - protein, 29 aa, Artificial Sequence
  Description of Artificial Sequence: Synthetic peptide
DEAEIRTTNPVAYEQWGSISTFLEGGPNR

SEQ ID NO: 51922 - protein, 30 aa, Artificial Sequence
  Description of Artificial Sequence: Synthetic polypeptide
DEAEIRTTNPVAYEQWGSVSTNQQNDGNLG

SEQ ID NO: 51923 - protein, 31 aa, Artificial Sequence
  Description of Artificial Sequence: Synthetic polypeptide
TNEEIATTNPVATEQYGVVSTNLQGDGPNAR

SEQ ID NO: 51924 - protein, 32 aa, Artificial Sequence
  Description of Artificial Sequence: Synthetic polypeptide
DEEEIRTTNPVATEQYGSYSTNLVIESGNVSK

SEQ ID NO: 51925 - protein, 33 aa, Artificial Sequence
  Description of Artificial Sequence: Synthetic polypeptide
DEEEIRTTNPVATEQYGSYSTPGLIQRGVEQRV

SEQ ID NO: 51926 - protein, 31 aa, Artificial Sequence
  Description of Artificial Sequence: Synthetic polypeptide
DEEEIRTTNPVATEQYGSYSTPNGEPEGMTR

SEQ ID NO: 51927 - protein, 31 aa, Artificial Sequence
  Description of Artificial Sequence: Synthetic polypeptide
DEAEICTTNPVATECYGSVSTDNLQDGGNEN

SEQ ID NO: 51928 - protein, 29 aa, Artificial Sequence
  Description of Artificial Sequence: Synthetic peptide
DEEEIRTTNPVATEQYGSYSVNDHDGDEQ

SEQ ID NO: 51929 - protein, 30 aa, Artificial Sequence
  Description of Artificial Sequence: Synthetic polypeptide
DEEEIRTTNPVATEQYGSYSVNDHRGDEDK

SEQ ID NO: 51930 - protein, 32 aa, Artificial Sequence
  Description of Artificial Sequence: Synthetic polypeptide
AEEEVRTTNPVATEQYGSVSTVELDQRIGSNQ

SEQ ID NO: 51931 - protein, 28 aa, Artificial Sequence
  Description of Artificial Sequence: Synthetic peptide
QEEEIATTNPVATEQYGEASEVLQREER

SEQ ID NO: 51932 - protein, 33 aa, Artificial Sequence
  Description of Artificial Sequence: Synthetic polypeptide
EEEEIRTTNPVATEQYGSVSTNLQQGNNVNEYG

SEQ ID NO: 51933 - protein, 30 aa, Artificial Sequence
  Description of Artificial Sequence: Synthetic polypeptide
TEEEIRTTNPVAFEAYGSVSCTYHPQSGNR

SEQ ID NO: 51934 - protein, 32 aa, Artificial Sequence
  Description of Artificial Sequence: Synthetic polypeptide
DEEEIRTTNPVATEQYGSYVEFTWLERVGVNP

SEQ ID NO: 51935 - protein, 31 aa, Artificial Sequence
  Description of Artificial Sequence: Synthetic polypeptide
EEEEIRTTNPVATEQYGSVSTNLQNDTTDTD

SEQ ID NO: 51936 - protein, 31 aa, Artificial Sequence
  Description of Artificial Sequence: Synthetic polypeptide
DEEEIRTTNPVATEQYGSYVESIELQQINLE

SEQ ID NO: 51937 - protein, 33 aa, Artificial Sequence
  Description of Artificial Sequence: Synthetic polypeptide
TEEEIRTTNPCATEQYGSVSYTGNALSQRVTNR

SEQ ID NO: 51938 - protein, 28 aa, Artificial Sequence
  Description of Artificial Sequence: Synthetic peptide
QEEEIATTNPVATEQYGEVPDNLQHENK

SEQ ID NO: 51939 - protein, 33 aa, Artificial Sequence
  Description of Artificial Sequence: Synthetic polypeptide
DEEEIRTTNPVATEQYGSYSTNLQERNGSPEQL

SEQ ID NO: 51940 - protein, 31 aa, Artificial Sequence
  Description of Artificial Sequence: Synthetic polypeptide
TEEEIRTTNPVATDQYGSVHTNLSQMGMNQT

SEQ ID NO: 51941 - protein, 31 aa, Artificial Sequence
  Description of Artificial Sequence: Synthetic polypeptide
TEEEIRTTNPVATEAWGKVSTNALQDRGGNE

SEQ ID NO: 51942 - protein, 33 aa, Artificial Sequence
  Description of Artificial Sequence: Synthetic polypeptide
EEEEIRTTNPVATEQYGSVSTPNLEIRVGANNE

SEQ ID NO: 51943 - protein, 32 aa, Artificial Sequence
  Description of Artificial Sequence: Synthetic polypeptide
EEEEIRTTNPVATEQYGSVSTPNEERVGINNE

SEQ ID NO: 51944 - protein, 31 aa, Artificial Sequence
  Description of Artificial Sequence: Synthetic polypeptide
DEEEIRTTNPVATEQYGSYCSSPNMLQGDNQ

SEQ ID NO: 51945 - protein, 33 aa, Artificial Sequence
  Description of Artificial Sequence: Synthetic polypeptide
DEEEIRTTNPVATEQYGSYNSTNGLDMPGLNRQ

SEQ ID NO: 51946 - protein, 28 aa, Artificial Sequence
  Description of Artificial Sequence: Synthetic peptide
QEEEIATTNPVATEQYGEASEVLQHGGR

SEQ ID NO: 51947 - protein, 31 aa, Artificial Sequence
  Description of Artificial Sequence: Synthetic polypeptide
TEEEIRTTNPVATEAYGKVSVTGLSTRGGNR

SEQ ID NO: 51948 - protein, 32 aa, Artificial Sequence
  Description of Artificial Sequence: Synthetic polypeptide
DEEEIRTTNPVATEQYGSYNSTVDDLQRDGEI

SEQ ID NO: 51949 - protein, 31 aa, Artificial Sequence
  Description of Artificial Sequence: Synthetic polypeptide
DEEEIRTTNPVATEQYGSYQNTNLQRSEDIL

SEQ ID NO: 51950 - protein, 31 aa, Artificial Sequence
  Description of Artificial Sequence: Synthetic polypeptide
TEEEIRTTNPVATEAWGSVSTDWSQRGGSNR

SEQ ID NO: 51951 - protein, 31 aa, Artificial Sequence
  Description of Artificial Sequence: Synthetic polypeptide
DEEEIRTTNPVATEQYGSYSETHDQNTGERG

SEQ ID NO: 51952 - protein, 32 aa, Artificial Sequence
  Description of Artificial Sequence: Synthetic polypeptide
TEEEIRTTNPVATEAWGSVSNTNLSQRTENNR

SEQ ID NO: 51953 - protein, 32 aa, Artificial Sequence
  Description of Artificial Sequence: Synthetic polypeptide
TEEEIRTTNPVATEAWGSVSCTNALQDRGNNE

SEQ ID NO: 51954 - protein, 30 aa, Artificial Sequence
  Description of Artificial Sequence: Synthetic polypeptide
TEEEIRTTNPVATEAWGKVSTYLSQRGNNE

SEQ ID NO: 51955 - protein, 32 aa, Artificial Sequence
  Description of Artificial Sequence: Synthetic polypeptide
DEEEIRTTNPVATEQYGSYSTDNVEVARNVNR

SEQ ID NO: 51956 - protein, 31 aa, Artificial Sequence
  Description of Artificial Sequence: Synthetic polypeptide
DEEEIRTTNPVATEQYGSYSTNEDQMEQGDD

SEQ ID NO: 51957 - protein, 31 aa, Artificial Sequence
  Description of Artificial Sequence: Synthetic polypeptide
DEAEICTTNPVATEAYGSVSTNLQGDSGNEQ

SEQ ID NO: 51958 - protein, 30 aa, Artificial Sequence
  Description of Artificial Sequence: Synthetic polypeptide
TEEEIRTTNPCATEGYGSCSTNLSARGGNE

SEQ ID NO: 51959 - protein, 31 aa, Artificial Sequence
  Description of Artificial Sequence: Synthetic polypeptide
TEEEIRSTNPVATEQYGSVSVNQSDRVGNNR

SEQ ID NO: 51960 - protein, 32 aa, Artificial Sequence
  Description of Artificial Sequence: Synthetic polypeptide
TEEEIRSTNPVATEQYGSVATNALSQRPGNYP

SEQ ID NO: 51961 - protein, 31 aa, Artificial Sequence
  Description of Artificial Sequence: Synthetic polypeptide
DEEEIRTTNPVATEQYGTCSTINGNQRENEN

SEQ ID NO: 51962 - protein, 31 aa, Artificial Sequence
  Description of Artificial Sequence: Synthetic polypeptide
DEAEIATTNPVAYEQYGSVVSTNLQVGDNEQ

SEQ ID NO: 51963 - protein, 31 aa, Artificial Sequence
  Description of Artificial Sequence: Synthetic polypeptide
TEEEIRCTNPIATEQYGSVVSENALMRGGNR

SEQ ID NO: 51964 - protein, 32 aa, Artificial Sequence
  Description of Artificial Sequence: Synthetic polypeptide
DEEEIRTTNPVATEQYGTCSTINPLQRDENNE

SEQ ID NO: 51965 - protein, 31 aa, Artificial Sequence
  Description of Artificial Sequence: Synthetic polypeptide
DEEEIRTTNPVATEQYGTCSTINPPQREDNN

SEQ ID NO: 51966 - protein, 31 aa, Artificial Sequence
  Description of Artificial Sequence: Synthetic polypeptide
EEEEIRTTNPVATEQYGSVSTNLIVLEQNTE

SEQ ID NO: 51967 - protein, 31 aa, Artificial Sequence
  Description of Artificial Sequence: Synthetic polypeptide
DEEEIRTTNPVATEQYGTFQSTINPLQRELN

SEQ ID NO: 51968 - protein, 29 aa, Artificial Sequence
  Description of Artificial Sequence: Synthetic peptide
DEAEIATTNPVAYEQYGSVSTNLQVPMDV

SEQ ID NO: 51969 - protein, 30 aa, Artificial Sequence
  Description of Artificial Sequence: Synthetic polypeptide
DEAEIATTNPVAYEQYGSVSTNLQSGGDEA

SEQ ID NO: 51970 - protein, 31 aa, Artificial Sequence
  Description of Artificial Sequence: Synthetic polypeptide
DEAEIATTNPVAYEQYGSVSTNLQNGDDNQA

SEQ ID NO: 51971 - protein, 31 aa, Artificial Sequence
  Description of Artificial Sequence: Synthetic polypeptide
DEAEIATTNPVAYEQYGSVSTNLQHGDNADP

SEQ ID NO: 51972 - protein, 31 aa, Artificial Sequence
  Description of Artificial Sequence: Synthetic polypeptide
DEAEIATTNPVAYEQYGSVSTNLQGNGDNNM

SEQ ID NO: 51973 - protein, 30 aa, Artificial Sequence
  Description of Artificial Sequence: Synthetic polypeptide
DEAEIATTNPVAYEQYGSVSTNLQGGPDDE

SEQ ID NO: 51974 - protein, 30 aa, Artificial Sequence
  Description of Artificial Sequence: Synthetic polypeptide
DEAEIATTNPVAYEQYGSVSTNLQDGADAE

SEQ ID NO: 51975 - protein, 30 aa, Artificial Sequence
  Description of Artificial Sequence: Synthetic polypeptide
DEAEIATTNPVAYEQYGSVSTNLQAGQTEE

SEQ ID NO: 51976 - protein, 32 aa, Artificial Sequence
  Description of Artificial Sequence: Synthetic polypeptide
DEEEIRTTNPVATEQYGTCSTINGLQRDENNE

SEQ ID NO: 51977 - protein, 33 aa, Artificial Sequence
  Description of Artificial Sequence: Synthetic polypeptide
TEEEIRTTNPVATEAYGSTVSCTLNLSQNGNRC

SEQ ID NO: 51978 - protein, 29 aa, Artificial Sequence
  Description of Artificial Sequence: Synthetic peptide
DEAEIATTNPVAYEQYGTVSTNLQDGGEA

SEQ ID NO: 51979 - protein, 30 aa, Artificial Sequence
  Description of Artificial Sequence: Synthetic polypeptide
TEEEIRCTNPIATEQYGSVVSENHSMRGNR

SEQ ID NO: 51980 - protein, 30 aa, Artificial Sequence
  Description of Artificial Sequence: Synthetic polypeptide
TEEEIRCTNPVAYEQYGSVSVNQDRGTNNR

SEQ ID NO: 51981 - protein, 32 aa, Artificial Sequence
  Description of Artificial Sequence: Synthetic polypeptide
DEEEIRTTNPVATEQYGSYVSTNNQQLQEEIE

SEQ ID NO: 51982 - protein, 29 aa, Artificial Sequence
  Description of Artificial Sequence: Synthetic peptide
DEAEIATTNPVSTEQYGSVATNDQDGNDD

SEQ ID NO: 51983 - protein, 33 aa, Artificial Sequence
  Description of Artificial Sequence: Synthetic polypeptide
DEEEIRTTNPVATEQYGSYVSTNQQLQVQENIE

SEQ ID NO: 51984 - protein, 32 aa, Artificial Sequence
  Description of Artificial Sequence: Synthetic polypeptide
TEEEIRCTNPVATEQYGKVSTNALSQRVGNYF

SEQ ID NO: 51985 - protein, 31 aa, Artificial Sequence
  Description of Artificial Sequence: Synthetic polypeptide
EEEEIRTTNPVATEQYGSVSTNLQEVIVDAE

SEQ ID NO: 51986 - protein, 29 aa, Artificial Sequence
  Description of Artificial Sequence: Synthetic peptide
AEENICTTNPVATEQYGSVSMNSQGGNNS

SEQ ID NO: 51987 - protein, 32 aa, Artificial Sequence
  Description of Artificial Sequence: Synthetic polypeptide
DEEEIRTTNPVATEQYGSYWSLPEMLQVRDNR

SEQ ID NO: 51988 - protein, 29 aa, Artificial Sequence
  Description of Artificial Sequence: Synthetic peptide
AEENIRTTNPVATEIYGQVTTNLQAGSNN

SEQ ID NO: 51989 - protein, 32 aa, Artificial Sequence
  Description of Artificial Sequence: Synthetic polypeptide
DEEEIRTTNPVATEQYGSYWSLPNMLQRDEER

SEQ ID NO: 51990 - protein, 31 aa, Artificial Sequence
  Description of Artificial Sequence: Synthetic polypeptide
DEEEIRTTNPVATEQYGTAVYSTNAPEYGNE

SEQ ID NO: 51991 - protein, 33 aa, Artificial Sequence
  Description of Artificial Sequence: Synthetic polypeptide
EEEEIRTTNPVATEQYGSVSTNLQESQGQNEQT

SEQ ID NO: 51992 - protein, 30 aa, Artificial Sequence
  Description of Artificial Sequence: Synthetic polypeptide
DEAEIATTNPVAYEQYGVVVSTNLDHGNER

SEQ ID NO: 51993 - protein, 28 aa, Artificial Sequence
  Description of Artificial Sequence: Synthetic peptide
QEEEIATTNPVATEQYGEVPENLQHGEK

SEQ ID NO: 51994 - protein, 28 aa, Artificial Sequence
  Description of Artificial Sequence: Synthetic peptide
QEEEIATTNPVATEQYGEVSENCQHGEK

SEQ ID NO: 51995 - protein, 31 aa, Artificial Sequence
  Description of Artificial Sequence: Synthetic polypeptide
DEEEIRTTNPVATEQYGTCSTIEPLQRNPNN

SEQ ID NO: 51996 - protein, 31 aa, Artificial Sequence
  Description of Artificial Sequence: Synthetic polypeptide
EEEEIRTTNPVATEQYGSVSTPNQLLIVNVD

SEQ ID NO: 51997 - protein, 31 aa, Artificial Sequence
  Description of Artificial Sequence: Synthetic polypeptide
TEEEIRTTNPVATEAYGSVATAELQNGGENR

SEQ ID NO: 51998 - protein, 31 aa, Artificial Sequence
  Description of Artificial Sequence: Synthetic polypeptide
DEEEIRTTNPVATEQYGSWSVLPNMLERDTR

SEQ ID NO: 51999 - protein, 32 aa, Artificial Sequence
  Description of Artificial Sequence: Synthetic polypeptide
TEEEIRTTNPVATEAYGVVSCTNALSQDRGNE

SEQ ID NO: 52000 - protein, 32 aa, Artificial Sequence
  Description of Artificial Sequence: Synthetic polypeptide
DEEEIRTTNPVATEQYGSVYTTNNGQTGNGNT

SEQ ID NO: 52001 - protein, 32 aa, Artificial Sequence
  Description of Artificial Sequence: Synthetic polypeptide
DEEEIRTTNPVATEQYGSVYTTNNTNQTGGND

SEQ ID NO: 52002 - protein, 33 aa, Artificial Sequence
  Description of Artificial Sequence: Synthetic polypeptide
EEEEIRTTNPVATEQYGSVSTTNLQSGTNVNEY

SEQ ID NO: 52003 - protein, 32 aa, Artificial Sequence
  Description of Artificial Sequence: Synthetic polypeptide
DEAEICTTNPVATENYGSVSTNLQGDAGNGER

SEQ ID NO: 52004 - protein, 30 aa, Artificial Sequence
  Description of Artificial Sequence: Synthetic polypeptide
DEAEICTTNPVATEMYGSVSTNLGNGMDDR

SEQ ID NO: 52005 - protein, 33 aa, Artificial Sequence
  Description of Artificial Sequence: Synthetic polypeptide
TEEEIRTTNPVATEAYGSVVSTNALQDRTGNNE

SEQ ID NO: 52006 - protein, 32 aa, Artificial Sequence
  Description of Artificial Sequence: Synthetic polypeptide
DEEEIRTTNPVATEQYGSVYTYELHRGNQEFE

SEQ ID NO: 52007 - protein, 33 aa, Artificial Sequence
  Description of Artificial Sequence: Synthetic polypeptide
TEEEIRTTNPVATEAYGSVVSCWNALQRGGNRC

SEQ ID NO: 52008 - protein, 33 aa, Artificial Sequence
  Description of Artificial Sequence: Synthetic polypeptide
EEEEIRTTNPVATEQYGSVSTTNLQQLGNANED

SEQ ID NO: 52009 - protein, 34 aa, Artificial Sequence
  Description of Artificial Sequence: Synthetic polypeptide
EEEEIRTTNPVATEQYGSVSTTNLQQGENGVPRN

SEQ ID NO: 52010 - protein, 33 aa, Artificial Sequence
  Description of Artificial Sequence: Synthetic polypeptide
TEEEIRTTNPVATEAYGSVSYTLNLSQNGGNRC

SEQ ID NO: 52011 - protein, 30 aa, Artificial Sequence
  Description of Artificial Sequence: Synthetic polypeptide
DEEEIRTTNPVATEQYGSVYVMGDLQRDEM

SEQ ID NO: 52012 - protein, 28 aa, Artificial Sequence
  Description of Artificial Sequence: Synthetic peptide
QEEEIATTNPVATEQYGEASDNLQSGEK

SEQ ID NO: 52013 - protein, 33 aa, Artificial Sequence
  Description of Artificial Sequence: Synthetic polypeptide
TEEEIRTTNPVATEAYGSVSTNSLSQRPGNYPW

SEQ ID NO: 52014 - protein, 31 aa, Artificial Sequence
  Description of Artificial Sequence: Synthetic polypeptide
DEAEICTTNPVATEQYGCVSTNLQMDGGNDP

SEQ ID NO: 52015 - protein, 32 aa, Artificial Sequence
  Description of Artificial Sequence: Synthetic polypeptide
DEEEIRTTNPVATEQYGSVYVPNLQRNIINNE

SEQ ID NO: 52016 - protein, 32 aa, Artificial Sequence
  Description of Artificial Sequence: Synthetic polypeptide
TEEEIRTTNPVATEAYGWVSVTNLSTRPGGNR

SEQ ID NO: 52017 - protein, 31 aa, Artificial Sequence
  Description of Artificial Sequence: Synthetic polypeptide
DEAEICTTNPVATEQYGEVSTNLQIGGGNEQ

SEQ ID NO: 52018 - protein, 32 aa, Artificial Sequence
  Description of Artificial Sequence: Synthetic polypeptide
DEAEICTTNPVATEQYGSVSTGNDLSGQGNER

SEQ ID NO: 52019 - protein, 33 aa, Artificial Sequence
  Description of Artificial Sequence: Synthetic polypeptide
DEAEICTTNPVATEQYGSVSTGNDLGDRQGNER

SEQ ID NO: 52020 - protein, 32 aa, Artificial Sequence
  Description of Artificial Sequence: Synthetic polypeptide
DEEEIRTTNPVATEQYGSVYTPNLQQYENEEY

SEQ ID NO: 52021 - protein, 32 aa, Artificial Sequence
  Description of Artificial Sequence: Synthetic polypeptide
DEAEICTTNPVATEQYGSVSTDNNDQRGDERT

SEQ ID NO: 52022 - protein, 32 aa, Artificial Sequence
  Description of Artificial Sequence: Synthetic polypeptide
DEAEICTTNPVATEQYGSVSTDNLGGNGMDNR

SEQ ID NO: 52023 - protein, 32 aa, Artificial Sequence
  Description of Artificial Sequence: Synthetic polypeptide
DEAEICTTNPVATEQYGSVSTDNLGDRGGDSR

SEQ ID NO: 52024 - protein, 33 aa, Artificial Sequence
  Description of Artificial Sequence: Synthetic polypeptide
DEAEICTTNPVATEQYGSVSTDNGLQGSGMNER

SEQ ID NO: 52025 - protein, 32 aa, Artificial Sequence
  Description of Artificial Sequence: Synthetic polypeptide
DEAEICTTNPVATEQYGSVSTDNGLQGEGQNE

SEQ ID NO: 52026 - protein, 32 aa, Artificial Sequence
  Description of Artificial Sequence: Synthetic polypeptide
DEAEICTTNPVATEQYGSVSTDNGLQDSGDNE

SEQ ID NO: 52027 - protein, 31 aa, Artificial Sequence
  Description of Artificial Sequence: Synthetic polypeptide
DEAEICTTNPVATEQYGSVSTDGLGDRGDLR

SEQ ID NO: 52028 - protein, 31 aa, Artificial Sequence
  Description of Artificial Sequence: Synthetic polypeptide
DEAEICTTNPVATEQYGSVSGTFLQRDTDRE

SEQ ID NO: 52029 - protein, 31 aa, Artificial Sequence
  Description of Artificial Sequence: Synthetic polypeptide
DEEEIRTTNPVATEQYGSVYTTLDGSQAGSV

SEQ ID NO: 52030 - protein, 31 aa, Artificial Sequence
  Description of Artificial Sequence: Synthetic polypeptide
TEEEIRTTNPVATECYGSVVINLSQRTVGNA

SEQ ID NO: 52031 - protein, 30 aa, Artificial Sequence
  Description of Artificial Sequence: Synthetic polypeptide
DEAEICTTNPVATEQYGSFSTHMEQRGNDN

SEQ ID NO: 52032 - protein, 31 aa, Artificial Sequence
  Description of Artificial Sequence: Synthetic polypeptide
DEAEICTTNPVATEQYGNVSTNLQGEHGNDA

SEQ ID NO: 52033 - protein, 32 aa, Artificial Sequence
  Description of Artificial Sequence: Synthetic polypeptide
DEEEIRTTNPVATEQYGSVYTTNLEREVVSRQ

SEQ ID NO: 52034 - protein, 31 aa, Artificial Sequence
  Description of Artificial Sequence: Synthetic polypeptide
TEEEIRCTNPIATEQYGSVSENLSMRTVGNR

SEQ ID NO: 52035 - protein, 33 aa, Artificial Sequence
  Description of Artificial Sequence: Synthetic polypeptide
DEEEIRTTNPVATEQYGSVYVTNLDEGRGNNPQ

SEQ ID NO: 52036 - protein, 29 aa, Artificial Sequence
  Description of Artificial Sequence: Synthetic peptide
DEAEICTTNPVATEHYGSVSTNDGNGMDR

SEQ ID NO: 52037 - protein, 31 aa, Artificial Sequence
  Description of Artificial Sequence: Synthetic polypeptide
TEEEIRTTNPVATEAYGSVSITGMIQGGNER

SEQ ID NO: 52038 - protein, 33 aa, Artificial Sequence
  Description of Artificial Sequence: Synthetic polypeptide
TEEEIRTTNPVATEAYGSVSCTNNLSARGGNRP

SEQ ID NO: 52039 - protein, 30 aa, Artificial Sequence
  Description of Artificial Sequence: Synthetic polypeptide
DEAEICTTNPVATECYGSVSTNNQGDGNET

SEQ ID NO: 52040 - protein, 31 aa, Artificial Sequence
  Description of Artificial Sequence: Synthetic polypeptide
DEAEICTTNPVATECYGSVSTNLQGEHGNDS

SEQ ID NO: 52041 - protein, 31 aa, Artificial Sequence
  Description of Artificial Sequence: Synthetic polypeptide
DEEEIRTTNPVATEQYGSWSLPNMLQRDDGQ

SEQ ID NO: 52042 - protein, 31 aa, Artificial Sequence
  Description of Artificial Sequence: Synthetic polypeptide
DEAEICTTNPVATECYGSVSTNLQDNGNNEN

SEQ ID NO: 52043 - protein, 33 aa, Artificial Sequence
  Description of Artificial Sequence: Synthetic polypeptide
TEEEIRTTNPVATEAYGSVSCTGNELQRGGVRG

SEQ ID NO: 52044 - protein, 30 aa, Artificial Sequence
  Description of Artificial Sequence: Synthetic polypeptide
DEAEICTTNPVATECYGSVSTNLGNDGMDR

SEQ ID NO: 52045 - protein, 32 aa, Artificial Sequence
  Description of Artificial Sequence: Synthetic polypeptide
TEEEIRTTNPVATEAYGSVSCTGNALQRGGVP

SEQ ID NO: 52046 - protein, 28 aa, Artificial Sequence
  Description of Artificial Sequence: Synthetic peptide
QEEEIATTNPVATEQYGEASEVLQHGER

SEQ ID NO: 52047 - protein, 32 aa, Artificial Sequence
  Description of Artificial Sequence: Synthetic polypeptide
EEEEIRTTNPVATEQYGSVSTPVLQMRGEVTG

SEQ ID NO: 52048 - protein, 30 aa, Artificial Sequence
  Description of Artificial Sequence: Synthetic polypeptide
DEEEIRTTNPVATEQYGSWSLPQDLQRDEF

SEQ ID NO: 52049 - protein, 33 aa, Artificial Sequence
  Description of Artificial Sequence: Synthetic polypeptide
TEEEIRTTNPVATEAYGSVPSCTNALQDRGTNE

SEQ ID NO: 52050 - protein, 31 aa, Artificial Sequence
  Description of Artificial Sequence: Synthetic polypeptide
TEEEIRTTNPVATEAYGSVCSCTNHSQQGNS

SEQ ID NO: 52051 - protein, 32 aa, Artificial Sequence
  Description of Artificial Sequence: Synthetic polypeptide
DEEEIRTTNPVATEQYGSWSPLPNMLEMRDNR

SEQ ID NO: 52052 - protein, 33 aa, Artificial Sequence
  Description of Artificial Sequence: Synthetic polypeptide
TEEEIRTTNPVATEAYGSVSTGNELSARTGNRY

SEQ ID NO: 52053 - protein, 31 aa, Artificial Sequence
  Description of Artificial Sequence: Synthetic polypeptide
DEAEICTTNPVATEHYGSVSTNLQANGDNDS

SEQ ID NO: 52054 - protein, 32 aa, Artificial Sequence
  Description of Artificial Sequence: Synthetic polypeptide
DEEEIRTTNPVATEQYGSWSLLPNMLQGDENR

SEQ ID NO: 52055 - protein, 32 aa, Artificial Sequence
  Description of Artificial Sequence: Synthetic polypeptide
TEEEIRTTNPVATEAYGSVSTNALGNRGGNNE

SEQ ID NO: 52056 - protein, 32 aa, Artificial Sequence
  Description of Artificial Sequence: Synthetic polypeptide
DEEEIRTTNPVATEQYGSVYVTNNNIQTGGNT

SEQ ID NO: 52057 - protein, 28 aa, Artificial Sequence
  Description of Artificial Sequence: Synthetic peptide
QEEEIATTNPVATEQYGEASENCQHGER

SEQ ID NO: 52058 - protein, 32 aa, Artificial Sequence
  Description of Artificial Sequence: Synthetic polypeptide
DEEEIRTTNPVATEQYGSVYVTNNNQTGGNTT

SEQ ID NO: 52059 - protein, 33 aa, Artificial Sequence
  Description of Artificial Sequence: Synthetic polypeptide
EEEEIRTTNPVATEQYGSVSTSNLTQRGEQYED

SEQ ID NO: 52060 - protein, 28 aa, Artificial Sequence
  Description of Artificial Sequence: Synthetic peptide
QEEEIATTNPVATEQYGEASENCQHGGR

SEQ ID NO: 52061 - protein, 33 aa, Artificial Sequence
  Description of Artificial Sequence: Synthetic polypeptide
DEEEIRTTNPVATEQYGSVYYETNDIQKGGNER

SEQ ID NO: 52062 - protein, 34 aa, Artificial Sequence
  Description of Artificial Sequence: Synthetic polypeptide
DEEEIRTTNPVATEQYGSVYYTPNLHQQRGEERI

SEQ ID NO: 52063 - protein, 28 aa, Artificial Sequence
  Description of Artificial Sequence: Synthetic peptide
QEEEIATTNPVATEQYGEASENLQHEGR

SEQ ID NO: 52064 - protein, 32 aa, Artificial Sequence
  Description of Artificial Sequence: Synthetic polypeptide
TEEEIRTTNPVATEAYGSVSTNALSQDSTGNE

SEQ ID NO: 52065 - protein, 32 aa, Artificial Sequence
  Description of Artificial Sequence: Synthetic polypeptide
DEEEIRTTNPVATEQYGSVYYVNDIQKGGNTR

SEQ ID NO: 52066 - protein, 32 aa, Artificial Sequence
  Description of Artificial Sequence: Synthetic polypeptide
DEEEIRTTNPVATEQYGSWCNTPNLEYGRGDR

SEQ ID NO: 52067 - protein, 33 aa, Artificial Sequence
  Description of Artificial Sequence: Synthetic polypeptide
EEEEIRTTNPVATEQYGSVSTSNLNQGQGENNE

SEQ ID NO: 52068 - protein, 32 aa, Artificial Sequence
  Description of Artificial Sequence: Synthetic polypeptide
DEEEIRTTNPVATEQYGSWCSSPNDLQRFDNQ

SEQ ID NO: 52069 - protein, 30 aa, Artificial Sequence
  Description of Artificial Sequence: Synthetic polypeptide
DEEEIRTTNPVATEQYGSWGLPNMEQTDNR

SEQ ID NO: 52070 - protein, 33 aa, Artificial Sequence
  Description of Artificial Sequence: Synthetic polypeptide
TEEEIRTTNPVATEAYGSVSTNALSQDRGGNEY

SEQ ID NO: 52071 - protein, 32 aa, Artificial Sequence
  Description of Artificial Sequence: Synthetic polypeptide
TEEEIRTTNPVATEAYGSVSTGNLSATGGNRY

SEQ ID NO: 52072 - protein, 33 aa, Artificial Sequence
  Description of Artificial Sequence: Synthetic polypeptide
EEEEIRTTNPVATEQYGSVSTVNLTQFAENYRI

SEQ ID NO: 52073 - protein, 30 aa, Artificial Sequence
  Description of Artificial Sequence: Synthetic polypeptide
DEAEIATTNPVAYEQYGSVSTNDQRQNDAQ

SEQ ID NO: 52074 - protein, 30 aa, Artificial Sequence
  Description of Artificial Sequence: Synthetic polypeptide
DEEEIRTTNPVATEQYGTISMDIQQQNGNR

SEQ ID NO: 52075 - protein, 32 aa, Artificial Sequence
  Description of Artificial Sequence: Synthetic polypeptide
TEEEICTTNPMATEQYGSVPTNALSQNRGNNR

SEQ ID NO: 52076 - protein, 31 aa, Artificial Sequence
  Description of Artificial Sequence: Synthetic polypeptide
QEEEIATTNPVATEQYGSVAGTNLQENGNPQ

SEQ ID NO: 52077 - protein, 35 aa, Artificial Sequence
  Description of Artificial Sequence: Synthetic polypeptide
DEEEIRTTNPVATEQYGTVTVSCTNEALSQRGGNR

SEQ ID NO: 52078 - protein, 33 aa, Artificial Sequence
  Description of Artificial Sequence: Synthetic polypeptide
DEEEIRTTNPVATEQYGTVTVSSTNLQQYGNVE

SEQ ID NO: 52079 - protein, 33 aa, Artificial Sequence
  Description of Artificial Sequence: Synthetic polypeptide
DEEEIRTTNPVATEQYGTVTVSTNLEQYGNNAE

SEQ ID NO: 52080 - protein, 30 aa, Artificial Sequence
  Description of Artificial Sequence: Synthetic polypeptide
QEEEIATTNPVATEQYGSVAITNDQQEGNT

SEQ ID NO: 52081 - protein, 32 aa, Artificial Sequence
  Description of Artificial Sequence: Synthetic polypeptide
DEEEIRTTNPVATEQYGTVTSVTNNNLQDENN

SEQ ID NO: 52082 - protein, 28 aa, Artificial Sequence
  Description of Artificial Sequence: Synthetic peptide
AEFEIACTNPVATEQYGEASENLQRGGR

SEQ ID NO: 52083 - protein, 33 aa, Artificial Sequence
  Description of Artificial Sequence: Synthetic polypeptide
DEEEIRTTNPVATEQYGTVTVSTNLQQYGNQES

SEQ ID NO: 52084 - protein, 32 aa, Artificial Sequence
  Description of Artificial Sequence: Synthetic polypeptide
DEEEIRTTNPVATEQYGTVTVSTSNLLQGENN

SEQ ID NO: 52085 - protein, 28 aa, Artificial Sequence
  Description of Artificial Sequence: Synthetic peptide
AEFEIAPTNPVATEQYGEASENLQRGGR

SEQ ID NO: 52086 - protein, 33 aa, Artificial Sequence
  Description of Artificial Sequence: Synthetic polypeptide
DEEEIRTTNPVATEQYGTVVSCTNLSQEVNNRP

SEQ ID NO: 52087 - protein, 33 aa, Artificial Sequence
  Description of Artificial Sequence: Synthetic polypeptide
EEEEIRTTNPVATEQYGSVIYPTPNLQTMGNER

SEQ ID NO: 52088 - protein, 31 aa, Artificial Sequence
  Description of Artificial Sequence: Synthetic polypeptide
DEEEIRTTNPVATEQYGTVWETINGLQREDN

SEQ ID NO: 52089 - protein, 33 aa, Artificial Sequence
  Description of Artificial Sequence: Synthetic polypeptide
DEEEIRTTNPVATEQYGTVTVSTNLQLQLGNED

SEQ ID NO: 52090 - protein, 31 aa, Artificial Sequence
  Description of Artificial Sequence: Synthetic polypeptide
DEEEIRTTNPVATEQYGTVTNTNNPLQGENN

SEQ ID NO: 52091 - protein, 32 aa, Artificial Sequence
  Description of Artificial Sequence: Synthetic polypeptide
DEEEIRTTNPVATEQYGTVTNSTTNNLQNENN

SEQ ID NO: 52092 - protein, 33 aa, Artificial Sequence
  Description of Artificial Sequence: Synthetic polypeptide
DEEEIRTTNPVATEQYGTVSYTNELSERTGGNP

SEQ ID NO: 52093 - protein, 31 aa, Artificial Sequence
  Description of Artificial Sequence: Synthetic polypeptide
EEEEIRTTNPVATEQYGSVSPAWNLNEFGAR

SEQ ID NO: 52094 - protein, 32 aa, Artificial Sequence
  Description of Artificial Sequence: Synthetic polypeptide
AEEEIRTTNPVATEQYGSVVTTVNLGQNGNNA

SEQ ID NO: 52095 - protein, 32 aa, Artificial Sequence
  Description of Artificial Sequence: Synthetic polypeptide
TEEEICTTNPVATEQYGQSVSCTNLSPIGGNR

SEQ ID NO: 52096 - protein, 32 aa, Artificial Sequence
  Description of Artificial Sequence: Synthetic polypeptide
EEEEIRTTNPVATEQYGSVSFAINLEEETGNR

SEQ ID NO: 52097 - protein, 33 aa, Artificial Sequence
  Description of Artificial Sequence: Synthetic polypeptide
EEEEIRTTNPVATEQYGSVSETQNLTQRNENTY

SEQ ID NO: 52098 - protein, 33 aa, Artificial Sequence
  Description of Artificial Sequence: Synthetic polypeptide
TEEEICTTNPVATEQYGKTVSTNLQDRTVGNRW

SEQ ID NO: 52099 - protein, 31 aa, Artificial Sequence
  Description of Artificial Sequence: Synthetic polypeptide
QEEEIATTNPVATEQYGSVAATNDQDRGPNQ

SEQ ID NO: 52100 - protein, 33 aa, Artificial Sequence
  Description of Artificial Sequence: Synthetic polypeptide
TEEEICTTNPVATEHYGSTVSTNLSQDRVGNRW

SEQ ID NO: 52101 - protein, 32 aa, Artificial Sequence
  Description of Artificial Sequence: Synthetic polypeptide
EEEEIRTTNPVATEQYGSVSENLQVAIGDLRS

SEQ ID NO: 52102 - protein, 29 aa, Artificial Sequence
  Description of Artificial Sequence: Synthetic peptide
DEEEIRTTNPVATEQYGTVSVGDTQIINM

SEQ ID NO: 52103 - protein, 33 aa, Artificial Sequence
  Description of Artificial Sequence: Synthetic polypeptide
DEEEIRTTNPVATEQYGTVSVNGHQVPRGVNER

SEQ ID NO: 52104 - protein, 33 aa, Artificial Sequence
  Description of Artificial Sequence: Synthetic polypeptide
DEEEIRTTNPVATEQYGTVSWTEGLDNRNGMNR

SEQ ID NO: 52105 - protein, 32 aa, Artificial Sequence
  Description of Artificial Sequence: Synthetic polypeptide
DEEEIRTTNPVATEQYGTVSWTELDNREGMTR

SEQ ID NO: 52106 - protein, 32 aa, Artificial Sequence
  Description of Artificial Sequence: Synthetic polypeptide
DEEEIRTTNPVATEQYGTVSWTELDNRGMNGS

SEQ ID NO: 52107 - protein, 33 aa, Artificial Sequence
  Description of Artificial Sequence: Synthetic polypeptide
DEEEIRTTNPVATEQYGTVSYTNASSQRTGGNP

SEQ ID NO: 52108 - protein, 32 aa, Artificial Sequence
  Description of Artificial Sequence: Synthetic polypeptide
QEEEIATTNPVATEQYGSVAITNLQNAGENRE

SEQ ID NO: 52109 - protein, 30 aa, Artificial Sequence
  Description of Artificial Sequence: Synthetic polypeptide
EEEEIRTTNPVATEQYGSVITNLEEQVNFD

SEQ ID NO: 52110 - protein, 30 aa, Artificial Sequence
  Description of Artificial Sequence: Synthetic polypeptide
DEEEIRTTNPVATEQYGTWGNINTLQRENN

SEQ ID NO: 52111 - protein, 31 aa, Artificial Sequence
  Description of Artificial Sequence: Synthetic polypeptide
DEEEIRTTNPVATEQYGTWSPHINPLQRENN

SEQ ID NO: 52112 - protein, 33 aa, Artificial Sequence
  Description of Artificial Sequence: Synthetic polypeptide
DEEEIRTTNPVATEQYGVSVCSTNHQFFGSNQA

SEQ ID NO: 52113 - protein, 30 aa, Artificial Sequence
  Description of Artificial Sequence: Synthetic polypeptide
DEAEIATTNPVAYEPYGSISTNLSTRPGNR

SEQ ID NO: 52114 - protein, 31 aa, Artificial Sequence
  Description of Artificial Sequence: Synthetic polypeptide
DEEEIRTTNPVATEQYGVVCSMWEHQRGSNQ

SEQ ID NO: 52115 - protein, 32 aa, Artificial Sequence
  Description of Artificial Sequence: Synthetic polypeptide
EEEEIRTTNPVATEQYGSVETSNVVQRGEAYR

SEQ ID NO: 52116 - protein, 31 aa, Artificial Sequence
  Description of Artificial Sequence: Synthetic polypeptide
DEEEIRTTNPVATEQYGVVCSNTEHQRFGDQ

SEQ ID NO: 52117 - protein, 28 aa, Artificial Sequence
  Description of Artificial Sequence: Synthetic peptide
AEGEIACTNPVASEQYGEVSENLQRGGR

SEQ ID NO: 52118 - protein, 31 aa, Artificial Sequence
  Description of Artificial Sequence: Synthetic polypeptide
DEEEIRTTNPVATEQYGVVCSNTEHQSGSNQ

SEQ ID NO: 52119 - protein, 32 aa, Artificial Sequence
  Description of Artificial Sequence: Synthetic polypeptide
DEEEIRTTNPVATEQYGVVCSNTELQGNSNRS

SEQ ID NO: 52120 - protein, 32 aa, Artificial Sequence
  Description of Artificial Sequence: Synthetic polypeptide
TEEEIATTNPVAYEQYGSVPSTINMLSQSGNR

SEQ ID NO: 52121 - protein, 28 aa, Artificial Sequence
  Description of Artificial Sequence: Synthetic peptide
AEGEIACTNPVATEQYGEASENLQRGGR

SEQ ID NO: 52122 - protein, 28 aa, Artificial Sequence
  Description of Artificial Sequence: Synthetic peptide
AEGEIACTNPVATEQYGTASENLQRGGR

SEQ ID NO: 52123 - protein, 31 aa, Artificial Sequence
  Description of Artificial Sequence: Synthetic polypeptide
DEEEIRTTNPVATEQYGVVCSSGNLQNNSNQ

SEQ ID NO: 52124 - protein, 32 aa, Artificial Sequence
  Description of Artificial Sequence: Synthetic polypeptide
DEEEIRTTNPVATEQYGVVCSTEDTQRFGSNI

SEQ ID NO: 52125 - protein, 32 aa, Artificial Sequence
  Description of Artificial Sequence: Synthetic polypeptide
DEEEIRTTNPVATEQYGVVCSTEELQGNSNRA

SEQ ID NO: 52126 - protein, 28 aa, Artificial Sequence
  Description of Artificial Sequence: Synthetic peptide
AEGEIACTNPVSTEQYGEVSCNLQRGGR

SEQ ID NO: 52127 - protein, 33 aa, Artificial Sequence
  Description of Artificial Sequence: Synthetic polypeptide
TEEEIATTNPVAYEQYGSVSTMNLSQREGGNYR

SEQ ID NO: 52128 - protein, 33 aa, Artificial Sequence
  Description of Artificial Sequence: Synthetic polypeptide
DEEEIRTTNPVATEQYGTVSTTNLQDQGQNEGG

SEQ ID NO: 52129 - protein, 32 aa, Artificial Sequence
  Description of Artificial Sequence: Synthetic polypeptide
AEEEIRTTNPVATEAYGVVSVSTVNLQNGNDQ

SEQ ID NO: 52130 - protein, 32 aa, Artificial Sequence
  Description of Artificial Sequence: Synthetic polypeptide
TEEEIATTNPVAYEQYGSVSTNSLSQVRGENE

SEQ ID NO: 52131 - protein, 31 aa, Artificial Sequence
  Description of Artificial Sequence: Synthetic polypeptide
DEEEIRTTNPVATEQYGTWSSTIGPLQRENN

SEQ ID NO: 52132 - protein, 31 aa, Artificial Sequence
  Description of Artificial Sequence: Synthetic polypeptide
DEEEIRTTNPVATEQYGTWSTINPLEQENND

SEQ ID NO: 52133 - protein, 30 aa, Artificial Sequence
  Description of Artificial Sequence: Synthetic polypeptide
DEEEIRTTNPVATEQYGTWSTINPLQGEEN

SEQ ID NO: 52134 - protein, 31 aa, Artificial Sequence
  Description of Artificial Sequence: Synthetic polypeptide
DEEEIRTTNPVATEQYGTWSTINPLQRNSEQ

SEQ ID NO: 52135 - protein, 30 aa, Artificial Sequence
  Description of Artificial Sequence: Synthetic polypeptide
DEEEIRTTNPVATEQYGTWSWINPLQREQN

SEQ ID NO: 52136 - protein, 32 aa, Artificial Sequence
  Description of Artificial Sequence: Synthetic polypeptide
DEEEIRTTNPVATEQYGTWTSTINPLQREMNN

SEQ ID NO: 52137 - protein, 29 aa, Artificial Sequence
  Description of Artificial Sequence: Synthetic peptide
DEAEIATTNPVAYEQWGAVSTNLQGNDER

SEQ ID NO: 52138 - protein, 28 aa, Artificial Sequence
  Description of Artificial Sequence: Synthetic peptide
AEGEIACTNPCATEQYGEVSENLQRGTR

SEQ ID NO: 52139 - protein, 30 aa, Artificial Sequence
  Description of Artificial Sequence: Synthetic polypeptide
DEEEIRTTNPVATEQYGTYSHINPLQRELN

SEQ ID NO: 52140 - protein, 32 aa, Artificial Sequence
  Description of Artificial Sequence: Synthetic polypeptide
DEEEIRTTNPVATEQYGTYSTINPLQRFISNQ

SEQ ID NO: 52141 - protein, 32 aa, Artificial Sequence
  Description of Artificial Sequence: Synthetic polypeptide
EEEEIRTTNPVATEQYGSVETVNTPQRGEAER

SEQ ID NO: 52142 - protein, 32 aa, Artificial Sequence
  Description of Artificial Sequence: Synthetic polypeptide
DEEEIRTTNPVATEQYGVCSPTENDSQGIGNR

SEQ ID NO: 52143 - protein, 32 aa, Artificial Sequence
  Description of Artificial Sequence: Synthetic polypeptide
DEEEIRTTNPVATEQYGVCVSTEHQNFGSNRF

SEQ ID NO: 52144 - protein, 32 aa, Artificial Sequence
  Description of Artificial Sequence: Synthetic polypeptide
DEEEIRTTNPVATEQYGVISEWTNLPRGMPRQ

SEQ ID NO: 52145 - protein, 33 aa, Artificial Sequence
  Description of Artificial Sequence: Synthetic polypeptide
DEEEIRTTNPVATEQYGVITSNTNNLQRLGNDA

SEQ ID NO: 52146 - protein, 31 aa, Artificial Sequence
  Description of Artificial Sequence: Synthetic polypeptide
DEEEIRTTNPVATEQYGVQVSTELQGFNSNQ

SEQ ID NO: 52147 - protein, 33 aa, Artificial Sequence
  Description of Artificial Sequence: Synthetic polypeptide
TEEEICTTNPVATEQYGSVSTNELSQERPGGNL

SEQ ID NO: 52148 - protein, 31 aa, Artificial Sequence
  Description of Artificial Sequence: Synthetic polypeptide
EEEEIRTTNPVATEQYGSVSPTELDVEGIRE

SEQ ID NO: 52149 - protein, 31 aa, Artificial Sequence
  Description of Artificial Sequence: Synthetic polypeptide
AEEEIRTTNPVATEAYGVVSTTENLQAGNQQ

SEQ ID NO: 52150 - protein, 30 aa, Artificial Sequence
  Description of Artificial Sequence: Synthetic polypeptide
DEAEIATTNPVAYEQYGSVATNDQQRGNPE

SEQ ID NO: 52151 - protein, 31 aa, Artificial Sequence
  Description of Artificial Sequence: Synthetic polypeptide
DEAEIATTNPVAYEQYGSVATNDGQRGNDRG

SEQ ID NO: 52152 - protein, 31 aa, Artificial Sequence
  Description of Artificial Sequence: Synthetic polypeptide
AEEQIRTTNPVATEQYGSVSTNLSMGLGNNT

SEQ ID NO: 52153 - protein, 32 aa, Artificial Sequence
  Description of Artificial Sequence: Synthetic polypeptide
DEEEIRTTNPVATEQYGTTSDTINPLQRENNT

SEQ ID NO: 52154 - protein, 31 aa, Artificial Sequence
  Description of Artificial Sequence: Synthetic polypeptide
DEEEIRTTNPVATEQYGTTSTINPLQDKENN

SEQ ID NO: 52155 - protein, 30 aa, Artificial Sequence
  Description of Artificial Sequence: Synthetic polypeptide
DEAEIATTNPVAYEQYGSVATALQREGPND

SEQ ID NO: 52156 - protein, 31 aa, Artificial Sequence
  Description of Artificial Sequence: Synthetic polypeptide
DEAEIATTNPVAYEQYGSVATAGNLQVGNRQ

SEQ ID NO: 52157 - protein, 32 aa, Artificial Sequence
  Description of Artificial Sequence: Synthetic polypeptide
DEEEIRTTNPVATEQYGTVCSTDGLVMFEGNR

SEQ ID NO: 52158 - protein, 31 aa, Artificial Sequence
  Description of Artificial Sequence: Synthetic polypeptide
DEEEIRTTNPVATEQYGTVCSTEDHQSGSNQ

SEQ ID NO: 52159 - protein, 31 aa, Artificial Sequence
  Description of Artificial Sequence: Synthetic polypeptide
TEEEIRCTNPIATEQYGSVPSENELMRGGNR

SEQ ID NO: 52160 - protein, 31 aa, Artificial Sequence
  Description of Artificial Sequence: Synthetic polypeptide
TEEEIRCTNPIATEQYGSVPSCENLSMRGNR

SEQ ID NO: 52161 - protein, 30 aa, Artificial Sequence
  Description of Artificial Sequence: Synthetic polypeptide
TEEEIRCTNPIATEQYGSTVSENLSMRVNR

SEQ ID NO: 52162 - protein, 32 aa, Artificial Sequence
  Description of Artificial Sequence: Synthetic polypeptide
DEEEIRTTNPVATEQYGTVCSTNDQSFGSERY

SEQ ID NO: 52163 - protein, 32 aa, Artificial Sequence
  Description of Artificial Sequence: Synthetic polypeptide
DEEEIRTTNPVATEQYGTVCSTNEQNFGSNQA

SEQ ID NO: 52164 - protein, 32 aa, Artificial Sequence
  Description of Artificial Sequence: Synthetic polypeptide
DEEEIRTTNPVATEQYGTVCSTNHQHFGSNTQ

SEQ ID NO: 52165 - protein, 31 aa, Artificial Sequence
  Description of Artificial Sequence: Synthetic polypeptide
EEEEIRTTNPVATEQYGSVSTNLEERNPIQN

SEQ ID NO: 52166 - protein, 32 aa, Artificial Sequence
  Description of Artificial Sequence: Synthetic polypeptide
DEEEIRTTNPVATEQYGTVCSTNLQNGGSQQS

SEQ ID NO: 52167 - protein, 30 aa, Artificial Sequence
  Description of Artificial Sequence: Synthetic polypeptide
DEAEIATTNPVAYEQYGSVATNDQRGNDES

SEQ ID NO: 52168 - protein, 32 aa, Artificial Sequence
  Description of Artificial Sequence: Synthetic polypeptide
DEEEIRTTNPVATEQYGTTISCTGNPLQRVNN

SEQ ID NO: 52169 - protein, 29 aa, Artificial Sequence
  Description of Artificial Sequence: Synthetic peptide
AEEQICTTNPVATEQYGSVSVNSNQAGNS

SEQ ID NO: 52170 - protein, 30 aa, Artificial Sequence
  Description of Artificial Sequence: Synthetic polypeptide
DEEEIRTTNPVATEQYGTISMNIQQQNGNH

SEQ ID NO: 52171 - protein, 31 aa, Artificial Sequence
  Description of Artificial Sequence: Synthetic polypeptide
DEEEIRTTNPVATEQYGTQSTINPLIRELNN

SEQ ID NO: 52172 - protein, 31 aa, Artificial Sequence
  Description of Artificial Sequence: Synthetic polypeptide
DEEEIRTTNPVATEQYGTQSTINPLQTENNN

SEQ ID NO: 52173 - protein, 30 aa, Artificial Sequence
  Description of Artificial Sequence: Synthetic polypeptide
AEEQIRTTNPVATEQYGSVSTNLNSMELND

SEQ ID NO: 52174 - protein, 30 aa, Artificial Sequence
  Description of Artificial Sequence: Synthetic polypeptide
AEEQIRTTNPVATEQYGSVSTNLSELQNQL

SEQ ID NO: 52175 - protein, 31 aa, Artificial Sequence
  Description of Artificial Sequence: Synthetic polypeptide
TEEEIRCTNPIATEQYGSVSEGNLSMRGTNR

SEQ ID NO: 52176 - protein, 30 aa, Artificial Sequence
  Description of Artificial Sequence: Synthetic polypeptide
DEAEIATTNPVAYEQYGSVATNLQVGDNDI

SEQ ID NO: 52177 - protein, 30 aa, Artificial Sequence
  Description of Artificial Sequence: Synthetic polypeptide
DEAEIATTNPVAYEQYGSVATNLQSGAERG

SEQ ID NO: 52178 - protein, 30 aa, Artificial Sequence
  Description of Artificial Sequence: Synthetic polypeptide
DEAEIATTNPVAYEQYGSVATNLQRPGEQH

SEQ ID NO: 52179 - protein, 33 aa, Artificial Sequence
  Description of Artificial Sequence: Synthetic polypeptide
DEEEIRTTNPVATEQYGTSVCSTNLERFGSEQS

SEQ ID NO: 52180 - protein, 31 aa, Artificial Sequence
  Description of Artificial Sequence: Synthetic polypeptide
DEAEIATTNPVAYEQYGSVATNLQRGDNADI

SEQ ID NO: 52181 - protein, 30 aa, Artificial Sequence
  Description of Artificial Sequence: Synthetic polypeptide
DEAEIATTNPVAYEQYGSVATNLQRENEHE

SEQ ID NO: 52182 - protein, 29 aa, Artificial Sequence
  Description of Artificial Sequence: Synthetic peptide
DEAEIATTNPVAYEQYGSVATNLQQGSDV

SEQ ID NO: 52183 - protein, 30 aa, Artificial Sequence
  Description of Artificial Sequence: Synthetic polypeptide
DEAEIATTNPVAYEQYGSVATNLQGGADRE

SEQ ID NO: 52184 - protein, 29 aa, Artificial Sequence
  Description of Artificial Sequence: Synthetic peptide
DEAEIATTNPVAYEQYGSVATNDQRSNDD

SEQ ID NO: 52185 - protein, 31 aa, Artificial Sequence
  Description of Artificial Sequence: Synthetic polypeptide
EEEEIRTTNPVATEQYGSVSTNLINASEVRD

SEQ ID NO: 52186 - protein, 29 aa, Artificial Sequence
  Description of Artificial Sequence: Synthetic peptide
DEAEIATTNPVAYEQYGSVAGTNDDRGND

SEQ ID NO: 52187 - protein, 30 aa, Artificial Sequence
  Description of Artificial Sequence: Synthetic polypeptide
TEEEIRCTNPIATEQYGSIVSELDLMRGNR

SEQ ID NO: 52188 - protein, 32 aa, Artificial Sequence
  Description of Artificial Sequence: Synthetic polypeptide
DEEEIRTTNPVATEQYGTVSSTNLSGNGTGNI

SEQ ID NO: 52189 - protein, 31 aa, Artificial Sequence
  Description of Artificial Sequence: Synthetic polypeptide
EEEEIRTTNPVATEQYGSVSPTNLIQEFPPE

SEQ ID NO: 52190 - protein, 30 aa, Artificial Sequence
  Description of Artificial Sequence: Synthetic polypeptide
DEEEIRTTNPVATEQYGTVSTEHQSFGSDQ

SEQ ID NO: 52191 - protein, 32 aa, Artificial Sequence
  Description of Artificial Sequence: Synthetic polypeptide
DEEEIRTTNPVATEQYGTVSTLGLQGGNGNGN

SEQ ID NO: 52192 - protein, 31 aa, Artificial Sequence
  Description of Artificial Sequence: Synthetic polypeptide
DEEEIRTTNPVATEQYGTVSTNDHQERFMIQ

SEQ ID NO: 52193 - protein, 30 aa, Artificial Sequence
  Description of Artificial Sequence: Synthetic polypeptide
TEEEICTTNPVAYEQYGSVSYTNLSQLVNQ

SEQ ID NO: 52194 - protein, 30 aa, Artificial Sequence
  Description of Artificial Sequence: Synthetic polypeptide
DEAEIATTNPVAYEQWGSVSTNLQRDGDSN

SEQ ID NO: 52195 - protein, 32 aa, Artificial Sequence
  Description of Artificial Sequence: Synthetic polypeptide
EEEEIRTTNPVATEQYGSVSPTNEQVGLVPRN

SEQ ID NO: 52196 - protein, 29 aa, Artificial Sequence
  Description of Artificial Sequence: Synthetic peptide
DEAEIATTNPVAYEQWGSVSTNLQDGDDA

SEQ ID NO: 52197 - protein, 32 aa, Artificial Sequence
  Description of Artificial Sequence: Synthetic polypeptide
DEEEIRTTNPVATEQYGTVSTPNLDVVGNNGD

SEQ ID NO: 52198 - protein, 32 aa, Artificial Sequence
  Description of Artificial Sequence: Synthetic polypeptide
TEEEICTTNPVAYEQYGSVSTNELSQERTGNL

SEQ ID NO: 52199 - protein, 31 aa, Artificial Sequence
  Description of Artificial Sequence: Synthetic polypeptide
AEEEIRTTNPVATEAYGVVSSVTNLQNGGNQ

SEQ ID NO: 52200 - protein, 33 aa, Artificial Sequence
  Description of Artificial Sequence: Synthetic polypeptide
DEEEIRTTNPVATEQYGTVSTQNLQGSGGNENT

SEQ ID NO: 52201 - protein, 30 aa, Artificial Sequence
  Description of Artificial Sequence: Synthetic polypeptide
QEEEIATTNPVATEQYGSVAANLQADGNDN

SEQ ID NO: 52202 - protein, 32 aa, Artificial Sequence
  Description of Artificial Sequence: Synthetic polypeptide
AEEEIRTTNPVATEQYGSVVTTVNLQNGNQEN

SEQ ID NO: 52203 - protein, 32 aa, Artificial Sequence
  Description of Artificial Sequence: Synthetic polypeptide
DEEEIRTTNPVATEQYGTVSSTNDQVNGGNDN

SEQ ID NO: 52204 - protein, 33 aa, Artificial Sequence
  Description of Artificial Sequence: Synthetic polypeptide
DEEEIRTTNPVATEQYGTVDSGTNLQQGIGNIF

SEQ ID NO: 52205 - protein, 30 aa, Artificial Sequence
  Description of Artificial Sequence: Synthetic polypeptide
AEEEIRTTNPVATEAYGVVSSVNLQAGTNM

SEQ ID NO: 52206 - protein, 30 aa, Artificial Sequence
  Description of Artificial Sequence: Synthetic polypeptide
AEEEIRTTNPVATEAYGVVSSINNLQIGNQ

SEQ ID NO: 52207 - protein, 30 aa, Artificial Sequence
  Description of Artificial Sequence: Synthetic polypeptide
AEEQIRTTNPVATEQYGSVSTNLSTMELNL

SEQ ID NO: 52208 - protein, 30 aa, Artificial Sequence
  Description of Artificial Sequence: Synthetic polypeptide
DEAEIATTNPVAYEQYGSVAATNDQRGNDV

SEQ ID NO: 52209 - protein, 32 aa, Artificial Sequence
  Description of Artificial Sequence: Synthetic polypeptide
EEEEIRTTNPVATEQYGSVSTNDLEERNNIQV

SEQ ID NO: 52210 - protein, 31 aa, Artificial Sequence
  Description of Artificial Sequence: Synthetic polypeptide
DEEEIRTTNPVATEQYGTVISTNETQETNFN

SEQ ID NO: 52211 - protein, 31 aa, Artificial Sequence
  Description of Artificial Sequence: Synthetic polypeptide
EEEEIRTTNPVATEQYGSVSTLLQRNAAFYA

SEQ ID NO: 52212 - protein, 31 aa, Artificial Sequence
  Description of Artificial Sequence: Synthetic polypeptide
DEEEIRTTNPVATEQYGTVKSTTNHLRGEQI

SEQ ID NO: 52213 - protein, 33 aa, Artificial Sequence
  Description of Artificial Sequence: Synthetic polypeptide
DEEEIRTTNPVATEQYGTVNSGTNLQDGNGNIF

SEQ ID NO: 52214 - protein, 29 aa, Artificial Sequence
  Description of Artificial Sequence: Synthetic peptide
DEAEIATTNPVAYEQYGSISTNLNAPNRN

SEQ ID NO: 52215 - protein, 30 aa, Artificial Sequence
  Description of Artificial Sequence: Synthetic polypeptide
TEEEIRCTNPIATEAYGSTVSENLMRGGNR

SEQ ID NO: 52216 - protein, 30 aa, Artificial Sequence
  Description of Artificial Sequence: Synthetic polypeptide
DEEEIRTTNPVATEQYGTVSMTNDHAGDVP

SEQ ID NO: 52217 - protein, 33 aa, Artificial Sequence
  Description of Artificial Sequence: Synthetic polypeptide
EEEEIRTTNPVATEQYGSVSTATNNLQDEQGNL

SEQ ID NO: 52218 - protein, 30 aa, Artificial Sequence
  Description of Artificial Sequence: Synthetic polypeptide
AEEEIRTTNPVATEAYGVVSSINNLQGGNM

SEQ ID NO: 52219 - protein, 29 aa, Artificial Sequence
  Description of Artificial Sequence: Synthetic peptide
DEAEIATTNPVAYEQYGSCSTNLEADNER

SEQ ID NO: 52220 - protein, 28 aa, Artificial Sequence
  Description of Artificial Sequence: Synthetic peptide
DEAEIATTNPVAYEQYGSCSTNDPAPNR

SEQ ID NO: 52221 - protein, 32 aa, Artificial Sequence
  Description of Artificial Sequence: Synthetic polypeptide
AEEEIRTTNPVATEQYGSVVTTVNNLQGEGNG

SEQ ID NO: 52222 - protein, 28 aa, Artificial Sequence
  Description of Artificial Sequence: Synthetic peptide
DEAEIATTNPVAYEQYGSCSANLDAPNR

SEQ ID NO: 52223 - protein, 31 aa, Artificial Sequence
  Description of Artificial Sequence: Synthetic polypeptide
DEEEIRTTNPVATEQYGVVCSTEHQNGNNQL

SEQ ID NO: 52224 - protein, 33 aa, Artificial Sequence
  Description of Artificial Sequence: Synthetic polypeptide
DEEEIRTTNPVATEQYGSVYTPNLQQRANVEDP

SEQ ID NO: 52225 - protein, 31 aa, Artificial Sequence
  Description of Artificial Sequence: Synthetic polypeptide
TEEEIRTTNPVATEEYGCISINALSQRGTNR

SEQ ID NO: 52226 - protein, 33 aa, Artificial Sequence
  Description of Artificial Sequence: Synthetic polypeptide
TEEEIRTTNPVATEQWGSVVSTNALSQRPGNYP

SEQ ID NO: 52227 - protein, 33 aa, Artificial Sequence
  Description of Artificial Sequence: Synthetic polypeptide
DEEEIRTTNPVATEQYGSVWELPNMLIQRDNRI

SEQ ID NO: 52228 - protein, 28 aa, Artificial Sequence
  Description of Artificial Sequence: Synthetic peptide
ESEEICTTNPVATDQYGSVSTWEQGGNF

SEQ ID NO: 52229 - protein, 31 aa, Artificial Sequence
  Description of Artificial Sequence: Synthetic polypeptide
DEEEIRTTNPVATEQYGSVWICNLDDAENPR

SEQ ID NO: 52230 - protein, 30 aa, Artificial Sequence
  Description of Artificial Sequence: Synthetic polypeptide
AEEEIRTTNPVATEAWGCFSINDLQRGENR

SEQ ID NO: 52231 - protein, 32 aa, Artificial Sequence
  Description of Artificial Sequence: Synthetic polypeptide
TEEEIRTTNPVATEQWGSVSCTNLQRAGLATT

SEQ ID NO: 52232 - protein, 33 aa, Artificial Sequence
  Description of Artificial Sequence: Synthetic polypeptide
DEEEIRTTNPVATEQYGSVWDSLPNMLQRDQQR

SEQ ID NO: 52233 - protein, 32 aa, Artificial Sequence
  Description of Artificial Sequence: Synthetic polypeptide
TEEEIRTTNPVATEQWGSVSATNALSQQGGNS

SEQ ID NO: 52234 - protein, 32 aa, Artificial Sequence
  Description of Artificial Sequence: Synthetic polypeptide
DEAEIRTTNPCATEQYGSVSTNLQQGDAGNAN

SEQ ID NO: 52235 - protein, 31 aa, Artificial Sequence
  Description of Artificial Sequence: Synthetic polypeptide
DEAEIRTTNPCATEQYGSVSTNLQGNENGEQ

SEQ ID NO: 52236 - protein, 31 aa, Artificial Sequence
  Description of Artificial Sequence: Synthetic polypeptide
DEAEIRTTNPCATEQYGSVSTNLQGNDGGEA

SEQ ID NO: 52237 - protein, 31 aa, Artificial Sequence
  Description of Artificial Sequence: Synthetic polypeptide
DEAEIRTTNPCATEQYGSVSTNLQGMGDGEA

SEQ ID NO: 52238 - protein, 28 aa, Artificial Sequence
  Description of Artificial Sequence: Synthetic peptide
ENEEISTTNPVATTQYGSVSTNPMGGNQ

SEQ ID NO: 52239 - protein, 32 aa, Artificial Sequence
  Description of Artificial Sequence: Synthetic polypeptide
DEEEIRTTNPVATEQYGSVWPTNSLEPNGERD

SEQ ID NO: 52240 - protein, 31 aa, Artificial Sequence
  Description of Artificial Sequence: Synthetic polypeptide
DEEEIRTTNPVATEQYGSVWPTLESQETGDR

SEQ ID NO: 52241 - protein, 28 aa, Artificial Sequence
  Description of Artificial Sequence: Synthetic peptide
QEEEIATTNPVATECYGDVSENLQHEER

SEQ ID NO: 52242 - protein, 33 aa, Artificial Sequence
  Description of Artificial Sequence: Synthetic polypeptide
DEEEIRTTNPVATEQYGSVVYSQNLQLPGANMG

SEQ ID NO: 52243 - protein, 28 aa, Artificial Sequence
  Description of Artificial Sequence: Synthetic peptide
DEAEIRTTNPEATRQYGQVPADLQRGNF

SEQ ID NO: 52244 - protein, 32 aa, Artificial Sequence
  Description of Artificial Sequence: Synthetic polypeptide
TEEEIRTTNPVATEQYGETVFTNLSQRGGNNK

SEQ ID NO: 52245 - protein, 33 aa, Artificial Sequence
  Description of Artificial Sequence: Synthetic polypeptide
FEEEIRETTNPVATEQYGPVSTMNLPQDRLNAR

SEQ ID NO: 52246 - protein, 32 aa, Artificial Sequence
  Description of Artificial Sequence: Synthetic polypeptide
DEEEIRTTNPVATEQYGSVVTTNNLERIQGQD

SEQ ID NO: 52247 - protein, 30 aa, Artificial Sequence
  Description of Artificial Sequence: Synthetic polypeptide
DEEEIRTTNPVATEQYGSVVVENLHRMEID

SEQ ID NO: 52248 - protein, 33 aa, Artificial Sequence
  Description of Artificial Sequence: Synthetic polypeptide
TEEEIRTTNPVATEQYGCVSTMNHNQRGSNTRS

SEQ ID NO: 52249 - protein, 32 aa, Artificial Sequence
  Description of Artificial Sequence: Synthetic polypeptide
TEEEIRTTNPVATEQYGCVSTAALSQRVGNYT

SEQ ID NO: 52250 - protein, 30 aa, Artificial Sequence
  Description of Artificial Sequence: Synthetic polypeptide
FEEEICTTNPAATEQYGSVPTNLQHSGNGT

SEQ ID NO: 52251 - protein, 32 aa, Artificial Sequence
  Description of Artificial Sequence: Synthetic polypeptide
TEEEIRTTNPVATEQYGCVNTGELNQRGSNTR

SEQ ID NO: 52252 - protein, 31 aa, Artificial Sequence
  Description of Artificial Sequence: Synthetic polypeptide
DEEEIRTTNPVATEQYGSVVVENLHRVGQQE

SEQ ID NO: 52253 - protein, 32 aa, Artificial Sequence
  Description of Artificial Sequence: Synthetic polypeptide
DEEEIRTTNPVATEQYGSVVVENLQRMVNEET

SEQ ID NO: 52254 - protein, 32 aa, Artificial Sequence
  Description of Artificial Sequence: Synthetic polypeptide
TEEEIRTTNPVATEQYGCVCSTELQERFGSNQ

SEQ ID NO: 52255 - protein, 34 aa, Artificial Sequence
  Description of Artificial Sequence: Synthetic polypeptide
DEEEIRTTNPVATEQYGSVVVSCQNLSPRGGNNR

SEQ ID NO: 52256 - protein, 32 aa, Artificial Sequence
  Description of Artificial Sequence: Synthetic polypeptide
DEEEIRTTNPVATEQYGSVVVTNGLQASVEFR

SEQ ID NO: 52257 - protein, 33 aa, Artificial Sequence
  Description of Artificial Sequence: Synthetic polypeptide
TEEEIRTTNPVATEQWGTTVSCTNLSQRGNDRD

SEQ ID NO: 52258 - protein, 30 aa, Artificial Sequence
  Description of Artificial Sequence: Synthetic polypeptide
FDEEIRTTNPVATEQWGNAVSTNLEQEGND

SEQ ID NO: 52259 - protein, 33 aa, Artificial Sequence
  Description of Artificial Sequence: Synthetic polypeptide
DEEEIRTTNPVATEQYGSVWPTNSLERGNGEDM

SEQ ID NO: 52260 - protein, 32 aa, Artificial Sequence
  Description of Artificial Sequence: Synthetic polypeptide
DEAEIRTTNPCATEQYGSVSTGNLGNMDGGNR

SEQ ID NO: 52261 - protein, 33 aa, Artificial Sequence
  Description of Artificial Sequence: Synthetic polypeptide
DEEEIRTTNPVATEQYGSVWPTNSLERGNNEAE

SEQ ID NO: 52262 - protein, 33 aa, Artificial Sequence
  Description of Artificial Sequence: Synthetic polypeptide
TEEEIRTTNPVATEQFGSVSTNALSQDRVGNYP

SEQ ID NO: 52263 - protein, 29 aa, Artificial Sequence
  Description of Artificial Sequence: Synthetic peptide
ENEEIATTNPVATTQYGSVSTNPMMGNDR

SEQ ID NO: 52264 - protein, 30 aa, Artificial Sequence
  Description of Artificial Sequence: Synthetic polypeptide
QEEEIATTNPVATECYGVVSTNLQNPGDRF

SEQ ID NO: 52265 - protein, 32 aa, Artificial Sequence
  Description of Artificial Sequence: Synthetic polypeptide
DEEEIRTTNPVATEQYGSVWSTGNYETRSDND

SEQ ID NO: 52266 - protein, 31 aa, Artificial Sequence
  Description of Artificial Sequence: Synthetic polypeptide
DEAEIRTTNPCATEEYGSVSTNLNGGNGNDR

SEQ ID NO: 52267 - protein, 30 aa, Artificial Sequence
  Description of Artificial Sequence: Synthetic polypeptide
DEAEIRTTNPCATEEYGSVSTNLGGENNDR

SEQ ID NO: 52268 - protein, 32 aa, Artificial Sequence
  Description of Artificial Sequence: Synthetic polypeptide
DEEEIRTTNPVATEQYGSVWSTNPLINGEQQE

SEQ ID NO: 52269 - protein, 32 aa, Artificial Sequence
  Description of Artificial Sequence: Synthetic polypeptide
DEEEIRTTNPVATEQYGSVWSTTNPLIDNGEQ

SEQ ID NO: 52270 - protein, 31 aa, Artificial Sequence
  Description of Artificial Sequence: Synthetic polypeptide
DEAEIRTTNPCATECYGSVSTNLQGGAGDER

SEQ ID NO: 52271 - protein, 32 aa, Artificial Sequence
  Description of Artificial Sequence: Synthetic polypeptide
ENEEIATTNPVATEQYGVVSTNLQGDRGPNSR

SEQ ID NO: 52272 - protein, 30 aa, Artificial Sequence
  Description of Artificial Sequence: Synthetic polypeptide
DEEEIRTTNPVATEQYGSVWTETVQMGDEQ

SEQ ID NO: 52273 - protein, 31 aa, Artificial Sequence
  Description of Artificial Sequence: Synthetic polypeptide
DEEEIRTTNPVATEQYGSVWTETVVQVMGER

SEQ ID NO: 52274 - protein, 31 aa, Artificial Sequence
  Description of Artificial Sequence: Synthetic polypeptide
ENEEIATTNPVATEQYGVVSTNLQGDHGQNR

SEQ ID NO: 52275 - protein, 30 aa, Artificial Sequence
  Description of Artificial Sequence: Synthetic polypeptide
ENEEIATTNPVATEQYGVVSTNLQGDGPNH

SEQ ID NO: 52276 - protein, 32 aa, Artificial Sequence
  Description of Artificial Sequence: Synthetic polypeptide
DEEEIRTTNPVATEQYGSVWTNAYIQELDNER

SEQ ID NO: 52277 - protein, 30 aa, Artificial Sequence
  Description of Artificial Sequence: Synthetic polypeptide
DEAEIRTTNGVAYCQYGSVSTPNLQRGDHQ

SEQ ID NO: 52278 - protein, 32 aa, Artificial Sequence
  Description of Artificial Sequence: Synthetic polypeptide
DEEEIRTTNPVATEQYGSVWSLPNMLQRDIQG

SEQ ID NO: 52279 - protein, 33 aa, Artificial Sequence
  Description of Artificial Sequence: Synthetic polypeptide
DEEEIRTTNPVATEQYGSVVTSNHERSGENERN

SEQ ID NO: 52280 - protein, 31 aa, Artificial Sequence
  Description of Artificial Sequence: Synthetic polypeptide
ENEEIRTTNPVATEPYGVVSTNLQGDGPNDR

SEQ ID NO: 52281 - protein, 29 aa, Artificial Sequence
  Description of Artificial Sequence: Synthetic peptide
ENEEISTTNPVATTQYGSVSTNPDDGNER

SEQ ID NO: 52282 - protein, 32 aa, Artificial Sequence
  Description of Artificial Sequence: Synthetic polypeptide
DEEEIRTTNPVATEQYGSVWPTNSLERNGETN

SEQ ID NO: 52283 - protein, 31 aa, Artificial Sequence
  Description of Artificial Sequence: Synthetic polypeptide
DEEEIRTTNPVATEQYGSVWPTNSLERNMEQ

SEQ ID NO: 52284 - protein, 31 aa, Artificial Sequence
  Description of Artificial Sequence: Synthetic polypeptide
TEEEIRTTNPVATEPYGVVVSTNLGTGGNRE

SEQ ID NO: 52285 - protein, 31 aa, Artificial Sequence
  Description of Artificial Sequence: Synthetic polypeptide
DEEEIRTTNPVATEQYGSVWPTNSLESNGEE

SEQ ID NO: 52286 - protein, 31 aa, Artificial Sequence
  Description of Artificial Sequence: Synthetic polypeptide
DEAEIRTTNPCATEQYGEVSTNLQLGGDNDE

SEQ ID NO: 52287 - protein, 31 aa, Artificial Sequence
  Description of Artificial Sequence: Synthetic polypeptide
DEAEIRTTNPCATEQYGEVSTNLQGNGDNNM

SEQ ID NO: 52288 - protein, 31 aa, Artificial Sequence
  Description of Artificial Sequence: Synthetic polypeptide
DEEEIRTTNPVATEQYGSVWPTYNNQGGDEE

SEQ ID NO: 52289 - protein, 30 aa, Artificial Sequence
  Description of Artificial Sequence: Synthetic polypeptide
DEAEIRTTNPCATEQYGEVATNLQGGNEDH

SEQ ID NO: 52290 - protein, 31 aa, Artificial Sequence
  Description of Artificial Sequence: Synthetic polypeptide
TEEEIRTTNPVATEPYGTVAYTNLQRTGGNP

SEQ ID NO: 52291 - protein, 31 aa, Artificial Sequence
  Description of Artificial Sequence: Synthetic polypeptide
DEAEIRTTNPCATEQYGCVSTNLQGDGNGGQ

SEQ ID NO: 52292 - protein, 33 aa, Artificial Sequence
  Description of Artificial Sequence: Synthetic polypeptide
DEEEIRTTNPVATEQYGSVSTSTLQQEVGENGF

SEQ ID NO: 52293 - protein, 32 aa, Artificial Sequence
  Description of Artificial Sequence: Synthetic polypeptide
DEAEIRTTNPCATEQYGCVSTNLQGDAGGNRD

SEQ ID NO: 52294 - protein, 30 aa, Artificial Sequence
  Description of Artificial Sequence: Synthetic polypeptide
DEAEIRTTNPCATEQYGAVSTGNGQGGDNS

SEQ ID NO: 52295 - protein, 33 aa, Artificial Sequence
  Description of Artificial Sequence: Synthetic polypeptide
TEEEIRTTNPVATEPYGTTVSCTNLSQRGNDRV

SEQ ID NO: 52296 - protein, 32 aa, Artificial Sequence
  Description of Artificial Sequence: Synthetic polypeptide
AEEEIRTTNPVATEQYGSVVTVTNLQNQENIR

SEQ ID NO: 52297 - protein, 31 aa, Artificial Sequence
  Description of Artificial Sequence: Synthetic polypeptide
DEEEIRTTNPVATEQYGSVWSLPIMLQRDQQ

SEQ ID NO: 52298 - protein, 33 aa, Artificial Sequence
  Description of Artificial Sequence: Synthetic polypeptide
DEAEIRTTNPLATEQWGSTVSCTNLSQRPGGNR

SEQ ID NO: 52299 - protein, 34 aa, Artificial Sequence
  Description of Artificial Sequence: Synthetic polypeptide
DEAEIRTTNPLATEQYGSVCSCTNLSQRPGGNNR

SEQ ID NO: 52300 - protein, 32 aa, Artificial Sequence
  Description of Artificial Sequence: Synthetic polypeptide
TEEEIRTTNPVATEQYGKTSTNALSQRVGNYV

SEQ ID NO: 52301 - protein, 30 aa, Artificial Sequence
  Description of Artificial Sequence: Synthetic polypeptide
AEEEIRATNPVATEQYGSVSTNWEEIFSNR

SEQ ID NO: 52302 - protein, 31 aa, Artificial Sequence
  Description of Artificial Sequence: Synthetic polypeptide
DEAEIRTTNPVATECYGSVSTNLNQGEGDSN

SEQ ID NO: 52303 - protein, 32 aa, Artificial Sequence
  Description of Artificial Sequence: Synthetic polypeptide
DEAEIRTTNPVATECYGSVSTNLNGESGGNQR

SEQ ID NO: 52304 - protein, 32 aa, Artificial Sequence
  Description of Artificial Sequence: Synthetic polypeptide
DEAEIRTTNPVATECYGSVSTNLNGEDGDNER

SEQ ID NO: 52305 - protein, 28 aa, Artificial Sequence
  Description of Artificial Sequence: Synthetic peptide
DEAEIRTTNPVATECYGKSSTNEQRREF

SEQ ID NO: 52306 - protein, 31 aa, Artificial Sequence
  Description of Artificial Sequence: Synthetic polypeptide
DEEEIRTTNPVATEQYGSVVSTNNDNMNDQD

SEQ ID NO: 52307 - protein, 33 aa, Artificial Sequence
  Description of Artificial Sequence: Synthetic polypeptide
DEEEIRTTNPVATEQYGSVVSTNNLDFRNNDGQ

SEQ ID NO: 52308 - protein, 33 aa, Artificial Sequence
  Description of Artificial Sequence: Synthetic polypeptide
DEEEIRTTNPVATEQYGSVVSTNNNDDRGGENQ

SEQ ID NO: 52309 - protein, 32 aa, Artificial Sequence
  Description of Artificial Sequence: Synthetic polypeptide
DEEEIRTTNPVATEQYGSVVSTPADQLGMNHP

SEQ ID NO: 52310 - protein, 33 aa, Artificial Sequence
  Description of Artificial Sequence: Synthetic polypeptide
DEEEIRTTNPVATEQYGSVVSTPNDDQGGDNDE

SEQ ID NO: 52311 - protein, 29 aa, Artificial Sequence
  Description of Artificial Sequence: Synthetic peptide
FEEEIRTTNPVATEQYGMVNTVGQQGNNH

SEQ ID NO: 52312 - protein, 33 aa, Artificial Sequence
  Description of Artificial Sequence: Synthetic polypeptide
DEEEIRTTNPVATEQYGSVVSTPNDDRGGDNEG

SEQ ID NO: 52313 - protein, 31 aa, Artificial Sequence
  Description of Artificial Sequence: Synthetic polypeptide
FEEEIRTTNPVATEQYGIVCELTNNQNRGNQ

SEQ ID NO: 52314 - protein, 32 aa, Artificial Sequence
  Description of Artificial Sequence: Synthetic polypeptide
FEEEIRTTNPVATEQYGEVSTNLQIGVGENVG

SEQ ID NO: 52315 - protein, 32 aa, Artificial Sequence
  Description of Artificial Sequence: Synthetic polypeptide
DEEEIRTTNPVATEQYGSVVSTSLDQEENGFE

SEQ ID NO: 52316 - protein, 32 aa, Artificial Sequence
  Description of Artificial Sequence: Synthetic polypeptide
TEEEIRTTNPVATEQYGSTVSAINLSQQGGNS

SEQ ID NO: 52317 - protein, 32 aa, Artificial Sequence
  Description of Artificial Sequence: Synthetic polypeptide
DEEEIRTTNPVATEQYGSVVSTTNLDFRNEDG

SEQ ID NO: 52318 - protein, 31 aa, Artificial Sequence
  Description of Artificial Sequence: Synthetic polypeptide
DEAEIRTTNPVATECYGSVSTNLQANGDEGD

SEQ ID NO: 52319 - protein, 32 aa, Artificial Sequence
  Description of Artificial Sequence: Synthetic polypeptide
DEAEIRTTNPVATECYGSVSTNLQANGDNGLD

SEQ ID NO: 52320 - protein, 31 aa, Artificial Sequence
  Description of Artificial Sequence: Synthetic polypeptide
DEAEIRTTNPVATEHYGNVSTNLQHNGDNNM

SEQ ID NO: 52321 - protein, 31 aa, Artificial Sequence
  Description of Artificial Sequence: Synthetic polypeptide
DEAEIRTTNPVATEGYGSVCSTELQRFGSEQ

SEQ ID NO: 52322 - protein, 32 aa, Artificial Sequence
  Description of Artificial Sequence: Synthetic polypeptide
DEAEIRTTNPVATEGYGSAVCSDNLQAPSGNR

SEQ ID NO: 52323 - protein, 32 aa, Artificial Sequence
  Description of Artificial Sequence: Synthetic polypeptide
FEEEIRTTNPVATEQYGSVASTDLVERGDNVT

SEQ ID NO: 52324 - protein, 32 aa, Artificial Sequence
  Description of Artificial Sequence: Synthetic polypeptide
FEEEIRTTNPVATEQYGSQDSTPLQRGSNPQL

SEQ ID NO: 52325 - protein, 32 aa, Artificial Sequence
  Description of Artificial Sequence: Synthetic polypeptide
DEEEIRTTNPVATEQYGSVVSTLNLERFESQQ

SEQ ID NO: 52326 - protein, 31 aa, Artificial Sequence
  Description of Artificial Sequence: Synthetic polypeptide
DEAEIRTTNPVATEGWGSVTTNLQRGGDNES

SEQ ID NO: 52327 - protein, 31 aa, Artificial Sequence
  Description of Artificial Sequence: Synthetic polypeptide
FEEEIRTTNPVATEQYGSCSPTFEVQRQGTR

SEQ ID NO: 52328 - protein, 31 aa, Artificial Sequence
  Description of Artificial Sequence: Synthetic polypeptide
DEAEIRTTNPVATEEWGSVSTNLQHQGNNDE

SEQ ID NO: 52329 - protein, 32 aa, Artificial Sequence
  Description of Artificial Sequence: Synthetic polypeptide
AEEEIRATNPVATEQYGSVSTGNLGQHGENGS

SEQ ID NO: 52330 - protein, 31 aa, Artificial Sequence
  Description of Artificial Sequence: Synthetic polypeptide
DEAEIRTTNPVATECYGTVSTNLQGDGDGTR

SEQ ID NO: 52331 - protein, 31 aa, Artificial Sequence
  Description of Artificial Sequence: Synthetic polypeptide
DEAEIRTTNPVATECYGSVSTTNGQDGNNGW

SEQ ID NO: 52332 - protein, 31 aa, Artificial Sequence
  Description of Artificial Sequence: Synthetic polypeptide
DEAEIRTTNPVATECYGSVSTNWEQRGAMSF

SEQ ID NO: 52333 - protein, 31 aa, Artificial Sequence
  Description of Artificial Sequence: Synthetic polypeptide
DEEEIRTTNPVATEQYGSVVSTNLEMNEDDG

SEQ ID NO: 52334 - protein, 32 aa, Artificial Sequence
  Description of Artificial Sequence: Synthetic polypeptide
DEAEIRTTNPVATECYGSVSTNLQANGGDMRD

SEQ ID NO: 52335 - protein, 32 aa, Artificial Sequence
  Description of Artificial Sequence: Synthetic polypeptide
TEEEIRTTNPVATEQYGSTVSCDESQRGGSNR

SEQ ID NO: 52336 - protein, 29 aa, Artificial Sequence
  Description of Artificial Sequence: Synthetic peptide
DEAEIRTTNGVAYCQYGSVSTNLTRGEEQ

SEQ ID NO: 52337 - protein, 33 aa, Artificial Sequence
  Description of Artificial Sequence: Synthetic polypeptide
DEEEIRTTNPVATEQYGSVVSTVDLQRFEEERI

SEQ ID NO: 52338 - protein, 34 aa, Artificial Sequence
  Description of Artificial Sequence: Synthetic polypeptide
DEEEIRTTNPVATEQYGSVVSTVDNLQRFEEQRS

SEQ ID NO: 52339 - protein, 31 aa, Artificial Sequence
  Description of Artificial Sequence: Synthetic polypeptide
DEAEIRTTNPVAFEQYGSISGTNLGERPNFR

SEQ ID NO: 52340 - protein, 32 aa, Artificial Sequence
  Description of Artificial Sequence: Synthetic polypeptide
TEEEIRTTNPVATEQYGKVWTNMLSQRVGNYM

SEQ ID NO: 52341 - protein, 29 aa, Artificial Sequence
  Description of Artificial Sequence: Synthetic peptide
DEAEIRTTNPVAFEQYGQISTNLEMPNFR

SEQ ID NO: 52342 - protein, 31 aa, Artificial Sequence
  Description of Artificial Sequence: Synthetic polypeptide
DEAEIRTTNPVAFEQYGASISTNGLERPNFR

SEQ ID NO: 52343 - protein, 30 aa, Artificial Sequence
  Description of Artificial Sequence: Synthetic polypeptide
DEAEIRTTNPVADEQYGSCSTNLERPDNSM

SEQ ID NO: 52344 - protein, 34 aa, Artificial Sequence
  Description of Artificial Sequence: Synthetic polypeptide
FEEEIRTTNPVATEQYGCVCSTENLNQRGSNYRS

SEQ ID NO: 52345 - protein, 32 aa, Artificial Sequence
  Description of Artificial Sequence: Synthetic polypeptide
TEEEIRTTNPVATEQYGKVSTPALSQRVGNLT

SEQ ID NO: 52346 - protein, 29 aa, Artificial Sequence
  Description of Artificial Sequence: Synthetic peptide
DEAEIRTTNPVACEQYGSCSTNLETENNQ

SEQ ID NO: 52347 - protein, 30 aa, Artificial Sequence
  Description of Artificial Sequence: Synthetic polypeptide
DEEEIRTTNPVATEQYGSVVTNNDMIGHEQ

SEQ ID NO: 52348 - protein, 32 aa, Artificial Sequence
  Description of Artificial Sequence: Synthetic polypeptide
TEEEIRTTNPVATEQYGKVSTNALSQLVGNQM

SEQ ID NO: 52349 - protein, 29 aa, Artificial Sequence
  Description of Artificial Sequence: Synthetic peptide
DEAEIRTTNPVACEQYGCISTNLERENNQ

SEQ ID NO: 52350 - protein, 31 aa, Artificial Sequence
  Description of Artificial Sequence: Synthetic polypeptide
TEEEIRTTNPVATEQYGKVSCTNGSQRGGSF

SEQ ID NO: 52351 - protein, 32 aa, Artificial Sequence
  Description of Artificial Sequence: Synthetic polypeptide
TEEEIRTTNPVATEQYGKVSCTGNALQNVNYR

SEQ ID NO: 52352 - protein, 31 aa, Artificial Sequence
  Description of Artificial Sequence: Synthetic polypeptide
QEEEIATTNPVATEAYGSVSTNLQQGDNEQM

SEQ ID NO: 52353 - protein, 31 aa, Artificial Sequence
  Description of Artificial Sequence: Synthetic polypeptide
FEEEIRTTNPVATEQYGAVSLNLQGVERVPR

SEQ ID NO: 52354 - protein, 32 aa, Artificial Sequence
  Description of Artificial Sequence: Synthetic polypeptide
TEEEIRTTNPVATEQYGMVSTNALSQIVGNYM

SEQ ID NO: 52355 - protein, 31 aa, Artificial Sequence
  Description of Artificial Sequence: Synthetic polypeptide
DEAEIRTTNPVATECWGCVSTNLQGNDSGNR

SEQ ID NO: 52356 - protein, 31 aa, Artificial Sequence
  Description of Artificial Sequence: Synthetic polypeptide
DEEEIRTTNPVATEQYGSVVTMNHWQIMNQV

SEQ ID NO: 52357 - protein, 33 aa, Artificial Sequence
  Description of Artificial Sequence: Synthetic polypeptide
DEEEIRTTNPVATEQYGSVVTGNNLEREGNEEE

SEQ ID NO: 52358 - protein, 34 aa, Artificial Sequence
  Description of Artificial Sequence: Synthetic polypeptide
DEEEIRTTNPVATEQYGSVVSTVDNLQRFGEQIT

SEQ ID NO: 52359 - protein, 32 aa, Artificial Sequence
  Description of Artificial Sequence: Synthetic polypeptide
DEAEIRTTNPVATEAYGSVVSCTNLSGSAGNR

SEQ ID NO: 52360 - protein, 32 aa, Artificial Sequence
  Description of Artificial Sequence: Synthetic polypeptide
DEAEIRTTNPVATEAYGSVSTNALSGSAGNNR

SEQ ID NO: 52361 - protein, 32 aa, Artificial Sequence
  Description of Artificial Sequence: Synthetic polypeptide
FEEEIRTTNPVATEQYGDVSTNLQQTGGENGD

SEQ ID NO: 52362 - protein, 31 aa, Artificial Sequence
  Description of Artificial Sequence: Synthetic polypeptide
AEEEIRCTNPVATEQYGSASTENGQMRNGGR

SEQ ID NO: 52363 - protein, 32 aa, Artificial Sequence
  Description of Artificial Sequence: Synthetic polypeptide
TEEEIRTTNPVATEQYGSLSTHELSQRVGGNS

SEQ ID NO: 52364 - protein, 32 aa, Artificial Sequence
  Description of Artificial Sequence: Synthetic polypeptide
DEAEIRTTNPVATEAYGSTVSTNLSGSAGGNR

SEQ ID NO: 52365 - protein, 30 aa, Artificial Sequence
  Description of Artificial Sequence: Synthetic polypeptide
DEEEIRTTNPVATEQYGSVVSVNLNKTTQQ

SEQ ID NO: 52366 - protein, 33 aa, Artificial Sequence
  Description of Artificial Sequence: Synthetic polypeptide
TEEEIRTTNPVATEQYGQSVVSCTNLSSIGNNR

SEQ ID NO: 52367 - protein, 28 aa, Artificial Sequence
  Description of Artificial Sequence: Synthetic peptide
QEEEIATTNPIATECYGSVSENLQREEL

SEQ ID NO: 52368 - protein, 29 aa, Artificial Sequence
  Description of Artificial Sequence: Synthetic peptide
DEAEIRTTNPVATDQYGSVNMQLQRGEDP

SEQ ID NO: 52369 - protein, 30 aa, Artificial Sequence
  Description of Artificial Sequence: Synthetic polypeptide
DEEEIRTTNPVATEQYGSVVTGLLQLDTQQ

SEQ ID NO: 52370 - protein, 33 aa, Artificial Sequence
  Description of Artificial Sequence: Synthetic polypeptide
TEEEIRTTNPVATEQYGQSVSTGNLSQSVTNYR

SEQ ID NO: 52371 - protein, 32 aa, Artificial Sequence
  Description of Artificial Sequence: Synthetic polypeptide
TEEEIRTTNPVATEQYGQSVSCTNLSPTGNND

SEQ ID NO: 52372 - protein, 34 aa, Artificial Sequence
  Description of Artificial Sequence: Synthetic polypeptide
TEEEIRTTNPVATEQYGQSVPSTGNLSQRVENYR

SEQ ID NO: 52373 - protein, 30 aa, Artificial Sequence
  Description of Artificial Sequence: Synthetic polypeptide
DEEEIRTTNPVATEQYGSVVTLLEGENNID

SEQ ID NO: 52374 - protein, 31 aa, Artificial Sequence
  Description of Artificial Sequence: Synthetic polypeptide
DEAEICTTNPVATEQYGSVSTGNGQNAGDER

SEQ ID NO: 52375 - protein, 30 aa, Artificial Sequence
  Description of Artificial Sequence: Synthetic polypeptide
DEAEIRTTNGVAYCQYGSVSTNLQNGSDRG

SEQ ID NO: 52376 - protein, 30 aa, Artificial Sequence
  Description of Artificial Sequence: Synthetic polypeptide
DEAEIRTTNGVAYCQYGSVSTNHQRGSDRP

SEQ ID NO: 52377 - protein, 34 aa, Artificial Sequence
  Description of Artificial Sequence: Synthetic polypeptide
DEEEIRTTNPVATEQYGSVYSTNLVHQTGPNPVY

SEQ ID NO: 52378 - protein, 32 aa, Artificial Sequence
  Description of Artificial Sequence: Synthetic polypeptide
DEAEIGTTNPVATEQYGSVSTVNQGQERMGNL

SEQ ID NO: 52379 - protein, 33 aa, Artificial Sequence
  Description of Artificial Sequence: Synthetic polypeptide
DEEEIRTTNPVATEQYGSVYSTNYNLQESDENQ

SEQ ID NO: 52380 - protein, 32 aa, Artificial Sequence
  Description of Artificial Sequence: Synthetic polypeptide
TEEEIRTTNPVATEHYGSVCSCTALSQTGSNR

SEQ ID NO: 52381 - protein, 30 aa, Artificial Sequence
  Description of Artificial Sequence: Synthetic polypeptide
EEEEIRTTNPVATEQYGSVTSTQLQNQQGS

SEQ ID NO: 52382 - protein, 32 aa, Artificial Sequence
  Description of Artificial Sequence: Synthetic polypeptide
DEAEIGTTNPVATEQYGCVSTNGLQERMGNQL

SEQ ID NO: 52383 - protein, 33 aa, Artificial Sequence
  Description of Artificial Sequence: Synthetic polypeptide
DEEEIRTTNPVATEQYGSVYSTNISILEGNYRG

SEQ ID NO: 52384 - protein, 32 aa, Artificial Sequence
  Description of Artificial Sequence: Synthetic polypeptide
EEEEIRTTNPVATEQYGSVTSTLLQLGNQNGE

SEQ ID NO: 52385 - protein, 32 aa, Artificial Sequence
  Description of Artificial Sequence: Synthetic polypeptide
DEEEIRTTNPVATEQYGSVYTDNDLQAREDSD

SEQ ID NO: 52386 - protein, 32 aa, Artificial Sequence
  Description of Artificial Sequence: Synthetic polypeptide
DEEEIRTTNPVATEQYGSVYTDNDLQTGMDSD

SEQ ID NO: 52387 - protein, 29 aa, Artificial Sequence
  Description of Artificial Sequence: Synthetic peptide
DEAEICTVNPVATEQYGSVSTNLSFEVNH

SEQ ID NO: 52388 - protein, 31 aa, Artificial Sequence
  Description of Artificial Sequence: Synthetic polypeptide
DEEEIRTTNPVATEQYGSVYTENLVVNNNVV

SEQ ID NO: 52389 - protein, 33 aa, Artificial Sequence
  Description of Artificial Sequence: Synthetic polypeptide
TEEEIRTTNPVATEHYGSTVCSTALSQRVGNRN

SEQ ID NO: 52390 - protein, 31 aa, Artificial Sequence
  Description of Artificial Sequence: Synthetic polypeptide
DEEEIRTTNPVATEQYGSVYTFLENIGSNQI

SEQ ID NO: 52391 - protein, 32 aa, Artificial Sequence
  Description of Artificial Sequence: Synthetic polypeptide
DEEEIRTTNPVATEQYGSVYTDNDLEGGMNSD

SEQ ID NO: 52392 - protein, 31 aa, Artificial Sequence
  Description of Artificial Sequence: Synthetic polypeptide
DEAEIKTTNPVAYEQYGSVSVTNLGQFGNTE

SEQ ID NO: 52393 - protein, 34 aa, Artificial Sequence
  Description of Artificial Sequence: Synthetic polypeptide
DEEEIRTTNPVATEQYGSVYSTNAQDQNENGANR

SEQ ID NO: 52394 - protein, 30 aa, Artificial Sequence
  Description of Artificial Sequence: Synthetic polypeptide
EEEEIRTTNPVATEQYGSVTSTTLQEQQGE

SEQ ID NO: 52395 - protein, 32 aa, Artificial Sequence
  Description of Artificial Sequence: Synthetic polypeptide
DEEEIRTTNPVATEQYGSVYPTNLQVIAALNE

SEQ ID NO: 52396 - protein, 33 aa, Artificial Sequence
  Description of Artificial Sequence: Synthetic polypeptide
EEEEIRTTNPVATEQYGSVYPTPNLQRMGENEA

SEQ ID NO: 52397 - protein, 34 aa, Artificial Sequence
  Description of Artificial Sequence: Synthetic polypeptide
TEEEIRTTNPVATEPYGISVSCTVNELQDRVGNR

SEQ ID NO: 52398 - protein, 32 aa, Artificial Sequence
  Description of Artificial Sequence: Synthetic polypeptide
DEEEIRTTNPVATEQYGSVYPTNQHQERDMLR

SEQ ID NO: 52399 - protein, 32 aa, Artificial Sequence
  Description of Artificial Sequence: Synthetic polypeptide
AEEEIRTTNPVATEQYGSVVTVNNLQQGTNFN

SEQ ID NO: 52400 - protein, 32 aa, Artificial Sequence
  Description of Artificial Sequence: Synthetic polypeptide
TEEEIRTTNPVATEPYGISVSCTNLSQQGGNS

SEQ ID NO: 52401 - protein, 34 aa, Artificial Sequence
  Description of Artificial Sequence: Synthetic polypeptide
EEEEIRTTNPVATEQYGSVYPTPNLQPRMGNERL

SEQ ID NO: 52402 - protein, 32 aa, Artificial Sequence
  Description of Artificial Sequence: Synthetic polypeptide
EEEEIRTTNPVATEQYGSVYPTPNLQLMGLER

SEQ ID NO: 52403 - protein, 30 aa, Artificial Sequence
  Description of Artificial Sequence: Synthetic polypeptide
DEEEIRTTNPVATEQYGSVYQVLDNRGGEF

SEQ ID NO: 52404 - protein, 33 aa, Artificial Sequence
  Description of Artificial Sequence: Synthetic polypeptide
EEEEIRTTNPVATEQYGSVYPTPNLPQAMGNER

SEQ ID NO: 52405 - protein, 31 aa, Artificial Sequence
  Description of Artificial Sequence: Synthetic polypeptide
DEEEIRTTNPVATEQYGSVYSEDLDDFRGEQ

SEQ ID NO: 52406 - protein, 28 aa, Artificial Sequence
  Description of Artificial Sequence: Synthetic peptide
QEEEIATTNPVATEQYGEAPDNLQHGNK

SEQ ID NO: 52407 - protein, 28 aa, Artificial Sequence
  Description of Artificial Sequence: Synthetic peptide
QEEEIATTNPVATEQYGEAPDNLQSGNK

SEQ ID NO: 52408 - protein, 31 aa, Artificial Sequence
  Description of Artificial Sequence: Synthetic polypeptide
DEEEIRTTNPVATEQYGSVYSNLTVNISNQR

SEQ ID NO: 52409 - protein, 31 aa, Artificial Sequence
  Description of Artificial Sequence: Synthetic polypeptide
DEAEIRATNPVATEQYGCVSTTNLFTGGENR

SEQ ID NO: 52410 - protein, 30 aa, Artificial Sequence
  Description of Artificial Sequence: Synthetic polypeptide
DEAEICTTNPVAYEQYGTVSTNLQGEGNAM

SEQ ID NO: 52411 - protein, 32 aa, Artificial Sequence
  Description of Artificial Sequence: Synthetic polypeptide
DEEEIRTTNPVATEQYGSVYTGTNGIQEDGNQ

SEQ ID NO: 52412 - protein, 33 aa, Artificial Sequence
  Description of Artificial Sequence: Synthetic polypeptide
DEEEIRTTNPVATEQYGSVYTNDHQNRVGEMFR

SEQ ID NO: 52413 - protein, 32 aa, Artificial Sequence
  Description of Artificial Sequence: Synthetic polypeptide
DEEEIRTTNPVATEQYGSVYTNDLQNTGDSVD

SEQ ID NO: 52414 - protein, 31 aa, Artificial Sequence
  Description of Artificial Sequence: Synthetic polypeptide
DEEEIRTTNPVATEQYGSVYTNLVTTQEEDG

SEQ ID NO: 52415 - protein, 31 aa, Artificial Sequence
  Description of Artificial Sequence: Synthetic polypeptide
DEAEICTTNPVATEQYGSVSTNLNGDHGNDS

SEQ ID NO: 52416 - protein, 30 aa, Artificial Sequence
  Description of Artificial Sequence: Synthetic polypeptide
DEAEICTTNPVATEQYGSVSTNLGNDMDER

SEQ ID NO: 52417 - protein, 32 aa, Artificial Sequence
  Description of Artificial Sequence: Synthetic polypeptide
EEEEIRTTNPVATEQYGSVSVTELQRGEEPFI

SEQ ID NO: 52418 - protein, 31 aa, Artificial Sequence
  Description of Artificial Sequence: Synthetic polypeptide
DEAEICTTNPVATEQYGSVSTNLGGNNGMDR

SEQ ID NO: 52419 - protein, 33 aa, Artificial Sequence
  Description of Artificial Sequence: Synthetic polypeptide
EEEEIRTTNPVATEQYGSVSTVYLAQRAENERI

SEQ ID NO: 52420 - protein, 30 aa, Artificial Sequence
  Description of Artificial Sequence: Synthetic polypeptide
DEAEICTTNPVATEQYGSVSTNLEGNGMDT

SEQ ID NO: 52421 - protein, 30 aa, Artificial Sequence
  Description of Artificial Sequence: Synthetic polypeptide
DEAEICTTNPVATEQYGSVSTNGQGNGEGA

SEQ ID NO: 52422 - protein, 32 aa, Artificial Sequence
  Description of Artificial Sequence: Synthetic polypeptide
DEAEICTTNPVATEQYGSVSTNGGNQRDGDQR

SEQ ID NO: 52423 - protein, 33 aa, Artificial Sequence
  Description of Artificial Sequence: Synthetic polypeptide
EEEEIRTTNPVATEQYGSVSTVNNAQREGEAYR

SEQ ID NO: 52424 - protein, 29 aa, Artificial Sequence
  Description of Artificial Sequence: Synthetic peptide
DEAEICTTNPVATEQYGSVSTNGGNGMDA

SEQ ID NO: 52425 - protein, 32 aa, Artificial Sequence
  Description of Artificial Sequence: Synthetic polypeptide
TEEEIRTTNPVATEEYGTIVSCINLSQRGGNR

SEQ ID NO: 52426 - protein, 31 aa, Artificial Sequence
  Description of Artificial Sequence: Synthetic polypeptide
DEAEICTTNPVATEQYGSVSTGNMGQTGNQN

SEQ ID NO: 52427 - protein, 32 aa, Artificial Sequence
  Description of Artificial Sequence: Synthetic polypeptide
DEAEICTTNPVATEQYGSVSTGNLGNAGENER

SEQ ID NO: 52428 - protein, 31 aa, Artificial Sequence
  Description of Artificial Sequence: Synthetic polypeptide
DEAEICTTNPVATEQYGSVSTGNGQSGNDEN

SEQ ID NO: 52429 - protein, 32 aa, Artificial Sequence
  Description of Artificial Sequence: Synthetic polypeptide
DEAEICTTNPVATEQYGSVSTNLQGDTGGNSD

SEQ ID NO: 52430 - protein, 32 aa, Artificial Sequence
  Description of Artificial Sequence: Synthetic polypeptide
DEEEIRTTNPVATEQYGSVYPTNLQIGESFVF

SEQ ID NO: 52431 - protein, 32 aa, Artificial Sequence
  Description of Artificial Sequence: Synthetic polypeptide
DEEEIRTTNPVATEQYGSVYTNLQVMTNNLGT

SEQ ID NO: 52432 - protein, 31 aa, Artificial Sequence
  Description of Artificial Sequence: Synthetic polypeptide
DEEEIRTTNPVATEQYGSVYTNLQVILALGE

SEQ ID NO: 52433 - protein, 30 aa, Artificial Sequence
  Description of Artificial Sequence: Synthetic polypeptide
DEEEIRTTNPVATEQYGSVYTNGHGNGEFA

SEQ ID NO: 52434 - protein, 31 aa, Artificial Sequence
  Description of Artificial Sequence: Synthetic polypeptide
DEAEICTTNPVATEYYGSVSTNLQGNGNNDD

SEQ ID NO: 52435 - protein, 31 aa, Artificial Sequence
  Description of Artificial Sequence: Synthetic polypeptide
DEAEICTTNPVATEYYGSVSTNLQGGNGNDS

SEQ ID NO: 52436 - protein, 31 aa, Artificial Sequence
  Description of Artificial Sequence: Synthetic polypeptide
DEAEICTTNPVATESWGSVSTNLQGDMGNER

SEQ ID NO: 52437 - protein, 31 aa, Artificial Sequence
  Description of Artificial Sequence: Synthetic polypeptide
DEAEICTTNPVATERYGSVSTNLQGDGNNEN

SEQ ID NO: 52438 - protein, 31 aa, Artificial Sequence
  Description of Artificial Sequence: Synthetic polypeptide
DEAEICTTNPVATEQYGVVSTNLQGDSGNAM

SEQ ID NO: 52439 - protein, 31 aa, Artificial Sequence
  Description of Artificial Sequence: Synthetic polypeptide
DEEEIRTTNPVATEQYGSVYTNLQMITVELE

SEQ ID NO: 52440 - protein, 33 aa, Artificial Sequence
  Description of Artificial Sequence: Synthetic polypeptide
EEEEIRTTNPVATEQYGSVSVTELQRVGENPFM

SEQ ID NO: 52441 - protein, 32 aa, Artificial Sequence
  Description of Artificial Sequence: Synthetic polypeptide
DEEEIRTTNPVATEQYGSVYTNLQQLVTNLGF

SEQ ID NO: 52442 - protein, 32 aa, Artificial Sequence
  Description of Artificial Sequence: Synthetic polypeptide
DEAEICTTNPVATEQYGSVSTTNLGQDNNDER

SEQ ID NO: 52443 - protein, 31 aa, Artificial Sequence
  Description of Artificial Sequence: Synthetic polypeptide
DEAEICTTNPVATEQYGSVSTTNGQNDSGER

SEQ ID NO: 52444 - protein, 32 aa, Artificial Sequence
  Description of Artificial Sequence: Synthetic polypeptide
DEAEICTTNPVATEQYGSVSTSNDGQNQGNER

SEQ ID NO: 52445 - protein, 32 aa, Artificial Sequence
  Description of Artificial Sequence: Synthetic polypeptide
DEAEICTTNPVATEQYGSVSTQNDDHQGGDNR

SEQ ID NO: 52446 - protein, 31 aa, Artificial Sequence
  Description of Artificial Sequence: Synthetic polypeptide
DEEEIRTTNPVATEQYGSVYTNLQVIELLET

SEQ ID NO: 52447 - protein, 31 aa, Artificial Sequence
  Description of Artificial Sequence: Synthetic polypeptide
DEAEICTTNPVATEQYGSVSTNSGQGDQGNK

SEQ ID NO: 52448 - protein, 32 aa, Artificial Sequence
  Description of Artificial Sequence: Synthetic polypeptide
DEAEICTTNPVATEQYGSVSTNLQHNGGDNNM

SEQ ID NO: 52449 - protein, 28 aa, Artificial Sequence
  Description of Artificial Sequence: Synthetic peptide
QEEEIATTNPVATEQYGDVSENLQHEEL

SEQ ID NO: 52450 - protein, 33 aa, Artificial Sequence
  Description of Artificial Sequence: Synthetic polypeptide
DEEEIRTTNPVATEQYGSVYPTNLGREGELTRE

SEQ ID NO: 52451 - protein, 32 aa, Artificial Sequence
  Description of Artificial Sequence: Synthetic polypeptide
DEEEIRTTNPVATEQYGSVYPTNDQNSGEVRS

SEQ ID NO: 52452 - protein, 31 aa, Artificial Sequence
  Description of Artificial Sequence: Synthetic polypeptide
TEEEIRTTNPVATEPYGSVSTNGSPRTGGSR

SEQ ID NO: 52453 - protein, 32 aa, Artificial Sequence
  Description of Artificial Sequence: Synthetic polypeptide
DEEEIRTTNPVATEQYGSVYEPTNLIQQREQQ

SEQ ID NO: 52454 - protein, 29 aa, Artificial Sequence
  Description of Artificial Sequence: Synthetic peptide
QEEEIATTNPVATEQWGSVAMNLQDQGDR

SEQ ID NO: 52455 - protein, 29 aa, Artificial Sequence
  Description of Artificial Sequence: Synthetic peptide
QEEEIATTNPVATEQWGSVSTELQNDGDN

SEQ ID NO: 52456 - protein, 31 aa, Artificial Sequence
  Description of Artificial Sequence: Synthetic polypeptide
DEEEIRTTNPVATEQYGSVYETYVQNRGFTT

SEQ ID NO: 52457 - protein, 31 aa, Artificial Sequence
  Description of Artificial Sequence: Synthetic polypeptide
QEEEIATTNPVATEQWGSVSTNLQNHGENED

SEQ ID NO: 52458 - protein, 31 aa, Artificial Sequence
  Description of Artificial Sequence: Synthetic polypeptide
DEEEIRTTNPVATEQYGSVYGTNGIQEDGEG

SEQ ID NO: 52459 - protein, 31 aa, Artificial Sequence
  Description of Artificial Sequence: Synthetic polypeptide
DEEEIRTTNPVATEQYGSVYIDDLQEGEFRD

SEQ ID NO: 52460 - protein, 30 aa, Artificial Sequence
  Description of Artificial Sequence: Synthetic polypeptide
QEEEIATTNPVATEQYGCVAITNALQDGER

SEQ ID NO: 52461 - protein, 31 aa, Artificial Sequence
  Description of Artificial Sequence: Synthetic polypeptide
DEEEIRTTNPVATEQYGSVYITVDQRGQDDC

SEQ ID NO: 52462 - protein, 32 aa, Artificial Sequence
  Description of Artificial Sequence: Synthetic polypeptide
EEEELRTTNPVATEQYGSVSTQNQLDQEIGNS

SEQ ID NO: 52463 - protein, 32 aa, Artificial Sequence
  Description of Artificial Sequence: Synthetic polypeptide
TEEEIRTTNPVATEPYGSVSCTNLSVKGGNNR

SEQ ID NO: 52464 - protein, 31 aa, Artificial Sequence
  Description of Artificial Sequence: Synthetic polypeptide
TEEEIRTTNPVATEPYGSVSCTNHMKGGNNR

SEQ ID NO: 52465 - protein, 31 aa, Artificial Sequence
  Description of Artificial Sequence: Synthetic polypeptide
DEAEIRTTNCVAYMQYGSVSTNLSQRGGDYR

SEQ ID NO: 52466 - protein, 30 aa, Artificial Sequence
  Description of Artificial Sequence: Synthetic polypeptide
DEAEIRTTNCVAYGQYGSVSVENLQRGVER

SEQ ID NO: 52467 - protein, 28 aa, Artificial Sequence
  Description of Artificial Sequence: Synthetic peptide
EENEIACTNPVATEQYGEASENLQRGGR

SEQ ID NO: 52468 - protein, 30 aa, Artificial Sequence
  Description of Artificial Sequence: Synthetic polypeptide
DEAEIRTTNCVAYDQYGSVSTNEHSQRGDR

SEQ ID NO: 52469 - protein, 29 aa, Artificial Sequence
  Description of Artificial Sequence: Synthetic peptide
QEEEIATTNPVATEPYGVVSTNLQQGDHQ

SEQ ID NO: 52470 - protein, 30 aa, Artificial Sequence
  Description of Artificial Sequence: Synthetic polypeptide
QEEEIATTNPVATEPYGSVATNLQQGNDTF

SEQ ID NO: 52471 - protein, 31 aa, Artificial Sequence
  Description of Artificial Sequence: Synthetic polypeptide
DEEEIRTTNPVATEQYGSVWTNDHHQEEGET

SEQ ID NO: 52472 - protein, 28 aa, Artificial Sequence
  Description of Artificial Sequence: Synthetic peptide
DEAEIRTTNGVAYCQYGSVSTGLEHGER

SEQ ID NO: 52473 - protein, 31 aa, Artificial Sequence
  Description of Artificial Sequence: Synthetic polypeptide
DEEEIRTTNPVATEQYGSVWTNDMTDSGQNN

SEQ ID NO: 52474 - protein, 33 aa, Artificial Sequence
  Description of Artificial Sequence: Synthetic polypeptide
TEEEIRTTNPVATEPYGSVVSTPNLDQRPGNGA

SEQ ID NO: 52475 - protein, 30 aa, Artificial Sequence
  Description of Artificial Sequence: Synthetic polypeptide
DEAEIRTTNGVAYCQYGSVSNTNVQRGIDR

SEQ ID NO: 52476 - protein, 29 aa, Artificial Sequence
  Description of Artificial Sequence: Synthetic peptide
DEAEIRTTNGVAYCQYGSVSENLQRGEDE

SEQ ID NO: 52477 - protein, 30 aa, Artificial Sequence
  Description of Artificial Sequence: Synthetic polypeptide
QEEEIATTNPVATEGYGVVSTNLQQGNDLS

SEQ ID NO: 52478 - protein, 32 aa, Artificial Sequence
  Description of Artificial Sequence: Synthetic polypeptide
AEEEISTTNPVATEQYGSVKSGTNQQYGLNTR

SEQ ID NO: 52479 - protein, 29 aa, Artificial Sequence
  Description of Artificial Sequence: Synthetic peptide
DEAEIRTTNGVAYCQYGSVCSTPLQNGDR

SEQ ID NO: 52480 - protein, 28 aa, Artificial Sequence
  Description of Artificial Sequence: Synthetic peptide
DEAEIRTTNGVAYCQYGSVATNLERGDE

SEQ ID NO: 52481 - protein, 31 aa, Artificial Sequence
  Description of Artificial Sequence: Synthetic polypeptide
DEEEIRTTNPVATEQYGSVWTVAPQRGSTQI

SEQ ID NO: 52482 - protein, 29 aa, Artificial Sequence
  Description of Artificial Sequence: Synthetic peptide
QEEEIATTNPVATEHYGVVSTNDQTGDNA

SEQ ID NO: 52483 - protein, 29 aa, Artificial Sequence
  Description of Artificial Sequence: Synthetic peptide
QEEEIATTNPVATEHYGVVSTNLQQGDEL

SEQ ID NO: 52484 - protein, 30 aa, Artificial Sequence
  Description of Artificial Sequence: Synthetic polypeptide
DEEEIRTTNPVATEQYGSVWYTNDDEDGFI

SEQ ID NO: 52485 - protein, 32 aa, Artificial Sequence
  Description of Artificial Sequence: Synthetic polypeptide
DEEEIRTTNPVATEQYGSVYATNLQVTPNLGT

SEQ ID NO: 52486 - protein, 32 aa, Artificial Sequence
  Description of Artificial Sequence: Synthetic polypeptide
DEEEIRTTNPVATEQYGSVYDPNLEQLMGENV

SEQ ID NO: 52487 - protein, 30 aa, Artificial Sequence
  Description of Artificial Sequence: Synthetic polypeptide
DEAEIRTTNGVAYCQYGSVSTNLQENFGDR

SEQ ID NO: 52488 - protein, 30 aa, Artificial Sequence
  Description of Artificial Sequence: Synthetic polypeptide
DEAEIRTTNCVAYDQYGSVSCTNLSQRVDR

SEQ ID NO: 52489 - protein, 33 aa, Artificial Sequence
  Description of Artificial Sequence: Synthetic polypeptide
DEEEIRTTNPVATEQYGSVYKTNEIDQKGGNER

SEQ ID NO: 52490 - protein, 30 aa, Artificial Sequence
  Description of Artificial Sequence: Synthetic polypeptide
DEAEIRTCNPVATEQYGCVSTYPLTRGNQE

SEQ ID NO: 52491 - protein, 31 aa, Artificial Sequence
  Description of Artificial Sequence: Synthetic polypeptide
EEEELRTTNPVATEQYGSVSTQNLDQDIGTN

SEQ ID NO: 52492 - protein, 28 aa, Artificial Sequence
  Description of Artificial Sequence: Synthetic peptide
QEEEIATTNPVATEQYGDVSECLQHENL

SEQ ID NO: 52493 - protein, 33 aa, Artificial Sequence
  Description of Artificial Sequence: Synthetic polypeptide
TEEEIRTTNPVATEPYGSTVSTPELQDRTVGNR

SEQ ID NO: 52494 - protein, 32 aa, Artificial Sequence
  Description of Artificial Sequence: Synthetic polypeptide
EEEEIRTTNPVATESYGSVSNTSLLQHRGDQR

SEQ ID NO: 52495 - protein, 28 aa, Artificial Sequence
  Description of Artificial Sequence: Synthetic peptide
QEEEIATTNPVATEQYGDVSECLQSGEQ

SEQ ID NO: 52496 - protein, 32 aa, Artificial Sequence
  Description of Artificial Sequence: Synthetic polypeptide
DEEEIRTTNPVATEQYGSVYPNPNLQNEGITR

SEQ ID NO: 52497 - protein, 32 aa, Artificial Sequence
  Description of Artificial Sequence: Synthetic polypeptide
EEEEIRTTNPVATEQYGTVCSTNHQRFGSNQS

SEQ ID NO: 52498 - protein, 32 aa, Artificial Sequence
  Description of Artificial Sequence: Synthetic polypeptide
DEEEIRTTNPVATEQYGSVYPTDLQRELQLRL

SEQ ID NO: 52499 - protein, 32 aa, Artificial Sequence
  Description of Artificial Sequence: Synthetic polypeptide
DEEEIRTTNPVATEQYGSVYPTELQQQRGMIL

SEQ ID NO: 52500 - protein, 32 aa, Artificial Sequence
  Description of Artificial Sequence: Synthetic polypeptide
TEEEIRTTNPVATEPYGSLVSCTGNHQRGGNE

SEQ ID NO: 52501 - protein, 32 aa, Artificial Sequence
  Description of Artificial Sequence: Synthetic polypeptide
TEEEIRTTNPVATEPYGSCSLPNMLSQRVGNR

SEQ ID NO: 52502 - protein, 30 aa, Artificial Sequence
  Description of Artificial Sequence: Synthetic polypeptide
DEAEIRCTNPVATEQYGSVATNLQRVTPEQ

SEQ ID NO: 52503 - protein, 32 aa, Artificial Sequence
  Description of Artificial Sequence: Synthetic polypeptide
DEEEIRTTNPVATEQYGSVYPTGEQREGNFQT

SEQ ID NO: 52504 - protein, 32 aa, Artificial Sequence
  Description of Artificial Sequence: Synthetic polypeptide
DEEEIRTTNPVATEQYGSVYPTINVQPQGERD

SEQ ID NO: 52505 - protein, 31 aa, Artificial Sequence
  Description of Artificial Sequence: Synthetic polypeptide
DEAEIRTCNPVATEQYGSVSMTRLQDGNQQE

SEQ ID NO: 52506 - protein, 32 aa, Artificial Sequence
  Description of Artificial Sequence: Synthetic polypeptide
EEEELRTTNPVATEQYGSVSTQNLNQQIGNNE

SEQ ID NO: 52507 - protein, 28 aa, Artificial Sequence
  Description of Artificial Sequence: Synthetic peptide
DEAEIRTCNPVATEQYGSVSTPMTRNQE

SEQ ID NO: 52508 - protein, 31 aa, Artificial Sequence
  Description of Artificial Sequence: Synthetic polypeptide
DEAEIRTTNCVAYAQYGSVSTNELSQRVGDR

SEQ ID NO: 52509 - protein, 31 aa, Artificial Sequence
  Description of Artificial Sequence: Synthetic polypeptide
DEAEIRTTNCVAYDQYGSTVSTNLSQRGTDR

SEQ ID NO: 52510 - protein, 32 aa, Artificial Sequence
  Description of Artificial Sequence: Synthetic polypeptide
TEEEIRTTNPVATEPYGSVSCNPLSQDSGGNR

SEQ ID NO: 52511 - protein, 30 aa, Artificial Sequence
  Description of Artificial Sequence: Synthetic polypeptide
DEAEIRTTNCVAYCQYGSVSTNLQRGDDQM

SEQ ID NO: 52512 - protein, 29 aa, Artificial Sequence
  Description of Artificial Sequence: Synthetic peptide
DEAEIRTTNCVAYCQYGSVSTNFLVRGEQ

SEQ ID NO: 52513 - protein, 29 aa, Artificial Sequence
  Description of Artificial Sequence: Synthetic peptide
QEEEIATTNPVATEQYGCVATALQNGDER

SEQ ID NO: 52514 - protein, 29 aa, Artificial Sequence
  Description of Artificial Sequence: Synthetic peptide
DEAEIRTTNCVAYCQYGSVATNLQRADRM

SEQ ID NO: 52515 - protein, 32 aa, Artificial Sequence
  Description of Artificial Sequence: Synthetic polypeptide
TEEEIRTTNPVATEPYGSVPSTPLSQRTGGNG

SEQ ID NO: 52516 - protein, 33 aa, Artificial Sequence
  Description of Artificial Sequence: Synthetic polypeptide
DEEEIRTTNPVATEQYGSVYLTENLQRENEQGE

SEQ ID NO: 52517 - protein, 28 aa, Artificial Sequence
  Description of Artificial Sequence: Synthetic peptide
QEEEIATTNPVATEQYGCVATGLADGER

SEQ ID NO: 52518 - protein, 33 aa, Artificial Sequence
  Description of Artificial Sequence: Synthetic polypeptide
TEEEIRTTNPVATEPYGSVPSTALSQDRTGGNR

SEQ ID NO: 52519 - protein, 32 aa, Artificial Sequence
  Description of Artificial Sequence: Synthetic polypeptide
DEEEIRTTNPVATEQYGSVYLTNLQQPQNINA

SEQ ID NO: 52520 - protein, 32 aa, Artificial Sequence
  Description of Artificial Sequence: Synthetic polypeptide
EEEELRTTNPVATEQYGSVSTQNLDQGIGNNF

SEQ ID NO: 52521 - protein, 33 aa, Artificial Sequence
  Description of Artificial Sequence: Synthetic polypeptide
DEEEIRTTNPVATEQYGSVYLTNLQVTEGNAID

SEQ ID NO: 52522 - protein, 33 aa, Artificial Sequence
  Description of Artificial Sequence: Synthetic polypeptide
DEEEIRTTNPVATEQYGSVYLTNNQNREGEMFR

SEQ ID NO: 52523 - protein, 31 aa, Artificial Sequence
  Description of Artificial Sequence: Synthetic polypeptide
DEEEIRTTNPVATEQYGSVYMNLQNRSDDYE

SEQ ID NO: 52524 - protein, 29 aa, Artificial Sequence
  Description of Artificial Sequence: Synthetic peptide
DEAEIRTTNCCAYQQYGSVSTNLQRGDDM

SEQ ID NO: 52525 - protein, 32 aa, Artificial Sequence
  Description of Artificial Sequence: Synthetic polypeptide
DEEEIRTTNPVATEQYGVVCSTEHQYSGSNRA

SEQ ID NO: 52526 - protein, 31 aa, Artificial Sequence
  Description of Artificial Sequence: Synthetic polypeptide
DEEEIRTTNPVATEQYGVVCSTELANFGSNA

SEQ ID NO: 52527 - protein, 30 aa, Artificial Sequence
  Description of Artificial Sequence: Synthetic polypeptide
QEEEIATTNPVATEQYGSVAMNLQEAGNDF

SEQ ID NO: 52528 - protein, 31 aa, Artificial Sequence
  Description of Artificial Sequence: Synthetic polypeptide
DEAEIATTNPVATEQYGCVAATNLQEMGNRN

SEQ ID NO: 52529 - protein, 28 aa, Artificial Sequence
  Description of Artificial Sequence: Synthetic peptide
DTEEIRTTNPVGTEQWGMVSTNLGVGVE

SEQ ID NO: 52530 - protein, 31 aa, Artificial Sequence
  Description of Artificial Sequence: Synthetic polypeptide
DTEEIRTTNPVGTEQWGAVSTNNLQRGVVRP

SEQ ID NO: 52531 - protein, 33 aa, Artificial Sequence
  Description of Artificial Sequence: Synthetic polypeptide
DEEEIRTTNPVATERYGSIPSCTFALSQRGGNR

SEQ ID NO: 52532 - protein, 32 aa, Artificial Sequence
  Description of Artificial Sequence: Synthetic polypeptide
DEEEIRTTNPVATERYGSQVGTNLERGSNNTI

SEQ ID NO: 52533 - protein, 31 aa, Artificial Sequence
  Description of Artificial Sequence: Synthetic polypeptide
DEEEIRTTNPVATERYGSTISCCNLQERGDL

SEQ ID NO: 52534 - protein, 31 aa, Artificial Sequence
  Description of Artificial Sequence: Synthetic polypeptide
DEAEIATTNPVATEQYGCVAATNLQQGNDRI

SEQ ID NO: 52535 - protein, 29 aa, Artificial Sequence
  Description of Artificial Sequence: Synthetic peptide
DTEEIRTTNPVGTEQWGAVSTNLQRILVE

SEQ ID NO: 52536 - protein, 31 aa, Artificial Sequence
  Description of Artificial Sequence: Synthetic polypeptide
AEEEIRTTNPVATEQYGSVVTTNLGGNGGNN

SEQ ID NO: 52537 - protein, 32 aa, Artificial Sequence
  Description of Artificial Sequence: Synthetic polypeptide
DEEEIRTTNPVATERYGSVCCTTLSQRGGNNF

SEQ ID NO: 52538 - protein, 34 aa, Artificial Sequence
  Description of Artificial Sequence: Synthetic polypeptide
DEEEIRTTNPVATERYGSVTSCTENHSQRPGGNR

SEQ ID NO: 52539 - protein, 34 aa, Artificial Sequence
  Description of Artificial Sequence: Synthetic polypeptide
DEEEIRTTNPVATERYGSVVLATLNALEQRGGNR

SEQ ID NO: 52540 - protein, 31 aa, Artificial Sequence
  Description of Artificial Sequence: Synthetic polypeptide
DEEEIRTTNPVATERYGTVSCTNLSHSGNNQ

SEQ ID NO: 52541 - protein, 31 aa, Artificial Sequence
  Description of Artificial Sequence: Synthetic polypeptide
DTEEIRTTNPVATTQYGSVSTTNGTQNGNDD

SEQ ID NO: 52542 - protein, 31 aa, Artificial Sequence
  Description of Artificial Sequence: Synthetic polypeptide
DTEEIRTTNPVGTEQWGAVSTNGLQRGVVRI

SEQ ID NO: 52543 - protein, 32 aa, Artificial Sequence
  Description of Artificial Sequence: Synthetic polypeptide
DEEEIRTTNPVATERWGSVSTNLSGRGGNNQY

SEQ ID NO: 52544 - protein, 32 aa, Artificial Sequence
  Description of Artificial Sequence: Synthetic polypeptide
DEEEIRTTNPVATERWGSTVSCTSELGRGGNR

SEQ ID NO: 52545 - protein, 28 aa, Artificial Sequence
  Description of Artificial Sequence: Synthetic peptide
DTEEIRTTNPVGTEQWGMVSTNNQTGVE

SEQ ID NO: 52546 - protein, 33 aa, Artificial Sequence
  Description of Artificial Sequence: Synthetic polypeptide
DEEEIRTTNPVATEQYGYVSTSNLQNGGGNNGN

SEQ ID NO: 52547 - protein, 33 aa, Artificial Sequence
  Description of Artificial Sequence: Synthetic polypeptide
DEEEIRTTNPVATEQYGYVSTSNLQNTGGNGDD

SEQ ID NO: 52548 - protein, 29 aa, Artificial Sequence
  Description of Artificial Sequence: Synthetic peptide
DEAEIATTNPVATEQYGCVSTELAYGSNT

SEQ ID NO: 52549 - protein, 33 aa, Artificial Sequence
  Description of Artificial Sequence: Synthetic polypeptide
DEEEIRTTNPVATEQYGYVSTSNLQSIGGNGQD

SEQ ID NO: 52550 - protein, 31 aa, Artificial Sequence
  Description of Artificial Sequence: Synthetic polypeptide
AEEEIRTTNPVATEPYGSVSTTNNQQQGNSE

SEQ ID NO: 52551 - protein, 33 aa, Artificial Sequence
  Description of Artificial Sequence: Synthetic polypeptide
DEEEIRTTNPVATEQYGYVSTVNLQFGGGNEEG

SEQ ID NO: 52552 - protein, 33 aa, Artificial Sequence
  Description of Artificial Sequence: Synthetic polypeptide
DEEEIRTTNPVATEQYGYVSTVNLQFNGGNGQD

SEQ ID NO: 52553 - protein, 30 aa, Artificial Sequence
  Description of Artificial Sequence: Synthetic polypeptide
DEAEIATTNPVATEQYGCVATNLQRDENSM

SEQ ID NO: 52554 - protein, 31 aa, Artificial Sequence
  Description of Artificial Sequence: Synthetic polypeptide
DEAEIATTNPVATEQYGCVATNLQGEGNNRD

SEQ ID NO: 52555 - protein, 31 aa, Artificial Sequence
  Description of Artificial Sequence: Synthetic polypeptide
DEAEIATTNPVATEQYGCVATNLQERGNDPE

SEQ ID NO: 52556 - protein, 31 aa, Artificial Sequence
  Description of Artificial Sequence: Synthetic polypeptide
AEEEIRTTNPVATEQYGSVVTTNLGGNGNGV

SEQ ID NO: 52557 - protein, 28 aa, Artificial Sequence
  Description of Artificial Sequence: Synthetic peptide
DTEEIRTTNPYATEQYGSVHTGDIEGNP

SEQ ID NO: 52558 - protein, 28 aa, Artificial Sequence
  Description of Artificial Sequence: Synthetic peptide
AEMEIAQTNPVATEQYGEASENLQRGGR

SEQ ID NO: 52559 - protein, 31 aa, Artificial Sequence
  Description of Artificial Sequence: Synthetic polypeptide
DEAEIATTNPVATEQYGCVATNLQDGNPERE

SEQ ID NO: 52560 - protein, 29 aa, Artificial Sequence
  Description of Artificial Sequence: Synthetic peptide
DEAEIATTNPVATEQYGCVATNLDNGPRE

SEQ ID NO: 52561 - protein, 28 aa, Artificial Sequence
  Description of Artificial Sequence: Synthetic peptide
AEMEIATTNPVATEQYGEVSTGLERGGD

SEQ ID NO: 52562 - protein, 30 aa, Artificial Sequence
  Description of Artificial Sequence: Synthetic polypeptide
DEEEIRTTNPVATESYGAVSCTNGGQKGKF

SEQ ID NO: 52563 - protein, 28 aa, Artificial Sequence
  Description of Artificial Sequence: Synthetic peptide
DEEEIRTTNPVATESYGAVSTNAENMQP

SEQ ID NO: 52564 - protein, 29 aa, Artificial Sequence
  Description of Artificial Sequence: Synthetic peptide
DEEEIRTTNPVATESYGCIAATNEQRDNT

SEQ ID NO: 52565 - protein, 31 aa, Artificial Sequence
  Description of Artificial Sequence: Synthetic polypeptide
DEEEIRTTNPVATESYGSVRSTNLVNNNFED

SEQ ID NO: 52566 - protein, 30 aa, Artificial Sequence
  Description of Artificial Sequence: Synthetic polypeptide
DTEEIRTTNPVATEQYGSVSSTGGQPAINV

SEQ ID NO: 52567 - protein, 32 aa, Artificial Sequence
  Description of Artificial Sequence: Synthetic polypeptide
DEEEIRTTNPVATESYGSVSTMNLVGGNGNND

SEQ ID NO: 52568 - protein, 30 aa, Artificial Sequence
  Description of Artificial Sequence: Synthetic polypeptide
DEAEIATTNPVATEQWGSVSAENLQQGNEH

SEQ ID NO: 52569 - protein, 29 aa, Artificial Sequence
  Description of Artificial Sequence: Synthetic peptide
DEAEIATTNPVATEQWGSVATNLETGNQT

SEQ ID NO: 52570 - protein, 30 aa, Artificial Sequence
  Description of Artificial Sequence: Synthetic polypeptide
DEAEIATTNPVATEQWGSVATNLERGDNVM

SEQ ID NO: 52571 - protein, 29 aa, Artificial Sequence
  Description of Artificial Sequence: Synthetic peptide
DEAEIATTNPVATEQWGSVAMNLEQGGNE

SEQ ID NO: 52572 - protein, 30 aa, Artificial Sequence
  Description of Artificial Sequence: Synthetic polypeptide
DEAEIATTNPVATEQWGSTATNLQREGNTS

SEQ ID NO: 52573 - protein, 31 aa, Artificial Sequence
  Description of Artificial Sequence: Synthetic polypeptide
DEEEIRTTNPVATESYGSVSTQNDNGGGNDG

SEQ ID NO: 52574 - protein, 31 aa, Artificial Sequence
  Description of Artificial Sequence: Synthetic polypeptide
TEDEIRTTNPVATEQYGETSTNALSQRGDNS

SEQ ID NO: 52575 - protein, 31 aa, Artificial Sequence
  Description of Artificial Sequence: Synthetic polypeptide
DEEEIRTTNPVATESYGSVYSTNCINKCGTR

SEQ ID NO: 52576 - protein, 32 aa, Artificial Sequence
  Description of Artificial Sequence: Synthetic polypeptide
DTEEIRTTNPVATEQYGSVSLTNQMGLRGTNI

SEQ ID NO: 52577 - protein, 33 aa, Artificial Sequence
  Description of Artificial Sequence: Synthetic polypeptide
DEEEIRTTNPVATESYGSVYSTNCIQKCGNPRI

SEQ ID NO: 52578 - protein, 32 aa, Artificial Sequence
  Description of Artificial Sequence: Synthetic polypeptide
DEEEIRTTNPVATESYGSVYSTNCIQKCIGNE

SEQ ID NO: 52579 - protein, 30 aa, Artificial Sequence
  Description of Artificial Sequence: Synthetic polypeptide
DEAEIATTNPVATEQWGAVSTNLQNGPERM

SEQ ID NO: 52580 - protein, 32 aa, Artificial Sequence
  Description of Artificial Sequence: Synthetic polypeptide
DTEEIRTTNPVATEQYGSVVSITNGQVEDNRG

SEQ ID NO: 52581 - protein, 33 aa, Artificial Sequence
  Description of Artificial Sequence: Synthetic polypeptide
DEEEIRTTNPVATEQYGYVSTSNLQFGGGNEQD

SEQ ID NO: 52582 - protein, 33 aa, Artificial Sequence
  Description of Artificial Sequence: Synthetic polypeptide
DEEEIRTTNPVATESYGSSVSTYLDQVNGSNRS

SEQ ID NO: 52583 - protein, 33 aa, Artificial Sequence
  Description of Artificial Sequence: Synthetic polypeptide
TEDEIRTTNPVATEQYGSVPSCTNLSQYGGNRM

SEQ ID NO: 52584 - protein, 31 aa, Artificial Sequence
  Description of Artificial Sequence: Synthetic polypeptide
QEEEIATTNPVATEQYGSVSVVNLQRDVTQR

SEQ ID NO: 52585 - protein, 29 aa, Artificial Sequence
  Description of Artificial Sequence: Synthetic peptide
DEEEIRTTNPVATESYGCIATNEQRDNDF

SEQ ID NO: 52586 - protein, 30 aa, Artificial Sequence
  Description of Artificial Sequence: Synthetic polypeptide
DEAEIATTNPVATEQYGAVSTTNDGQNGPR

SEQ ID NO: 52587 - protein, 31 aa, Artificial Sequence
  Description of Artificial Sequence: Synthetic polypeptide
DEAEIATTNPVATEQYGAVSTNLQNNGDPER

SEQ ID NO: 52588 - protein, 31 aa, Artificial Sequence
  Description of Artificial Sequence: Synthetic polypeptide
DEAEIATTNPVATEQYGAVSTNLQHNGGDSR

SEQ ID NO: 52589 - protein, 31 aa, Artificial Sequence
  Description of Artificial Sequence: Synthetic polypeptide
DEAEIATTNPVATEQYGAVSTNLQGNTGEER

SEQ ID NO: 52590 - protein, 31 aa, Artificial Sequence
  Description of Artificial Sequence: Synthetic polypeptide
DEAEIATTNPVATEQYGAVSTNLQGNSGDQR

SEQ ID NO: 52591 - protein, 28 aa, Artificial Sequence
  Description of Artificial Sequence: Synthetic peptide
DEEEIRTTNPVATESYGCSANNEQRDNF

SEQ ID NO: 52592 - protein, 31 aa, Artificial Sequence
  Description of Artificial Sequence: Synthetic polypeptide
DTEEIRTTNPVATTQYGSVSTQNGNQNGNGQ

SEQ ID NO: 52593 - protein, 34 aa, Artificial Sequence
  Description of Artificial Sequence: Synthetic polypeptide
DEEEIRTTNPVATESYGISTVSYTDLSQRGGNNR

SEQ ID NO: 52594 - protein, 31 aa, Artificial Sequence
  Description of Artificial Sequence: Synthetic polypeptide
TEDEIRTTNPVAYEQYGSVSTNISQRQGNYP

SEQ ID NO: 52595 - protein, 31 aa, Artificial Sequence
  Description of Artificial Sequence: Synthetic polypeptide
DTEEIRTTNPVATTQYGSVSTNGNQQNGNGG

SEQ ID NO: 52596 - protein, 29 aa, Artificial Sequence
  Description of Artificial Sequence: Synthetic peptide
TEDEIRTTNPVAYEAYGSVWTNLSQIGSR

SEQ ID NO: 52597 - protein, 31 aa, Artificial Sequence
  Description of Artificial Sequence: Synthetic polypeptide
AEEEIRTTNPVATEQYGCVATNLQNHGDNDP

SEQ ID NO: 52598 - protein, 30 aa, Artificial Sequence
  Description of Artificial Sequence: Synthetic polypeptide
DTEEIRTTNPVATEYYGSVVSTNIEGDGNY

SEQ ID NO: 52599 - protein, 31 aa, Artificial Sequence
  Description of Artificial Sequence: Synthetic polypeptide
AEEEIRTTNPVATEQYGSVVTTNLGGGGNNA

SEQ ID NO: 52600 - protein, 31 aa, Artificial Sequence
  Description of Artificial Sequence: Synthetic polypeptide
DEAEIATTNPVATEQYGCVSTNLQGAGNEGH

SEQ ID NO: 52601 - protein, 31 aa, Artificial Sequence
  Description of Artificial Sequence: Synthetic polypeptide
DEAEIATTNPVATEQYGCVSTNLQGDAGNDA

SEQ ID NO: 52602 - protein, 30 aa, Artificial Sequence
  Description of Artificial Sequence: Synthetic polypeptide
DEAEIATTNPVATEQYGCVSTNLQHGDEQQ

SEQ ID NO: 52603 - protein, 28 aa, Artificial Sequence
  Description of Artificial Sequence: Synthetic peptide
TEECIRTTNPVATEQYGCVSTNLAGLDQ

SEQ ID NO: 52604 - protein, 31 aa, Artificial Sequence
  Description of Artificial Sequence: Synthetic polypeptide
DEAEIATTNPVATEQYGSVAATNLMRGGNED

SEQ ID NO: 52605 - protein, 31 aa, Artificial Sequence
  Description of Artificial Sequence: Synthetic polypeptide
DEAEIATTNPVATEQYGSVAATNLARGVNED

SEQ ID NO: 52606 - protein, 30 aa, Artificial Sequence
  Description of Artificial Sequence: Synthetic polypeptide
DEAEIATTNPVATEQYGSVAATNIQQDGNP

SEQ ID NO: 52607 - protein, 30 aa, Artificial Sequence
  Description of Artificial Sequence: Synthetic polypeptide
DEAEIATTNPVATEQYGSVAATNDSRGNED

SEQ ID NO: 52608 - protein, 31 aa, Artificial Sequence
  Description of Artificial Sequence: Synthetic polypeptide
QEEEIATTNPVATEQYGSVSTNDQNNGNEDL

SEQ ID NO: 52609 - protein, 31 aa, Artificial Sequence
  Description of Artificial Sequence: Synthetic polypeptide
DEAEIATTNPVATEQYGSVAATNDQRGPNDQ

SEQ ID NO: 52610 - protein, 28 aa, Artificial Sequence
  Description of Artificial Sequence: Synthetic peptide
DTETIRTTNPVATEQYGTVSTNTQLVEL

SEQ ID NO: 52611 - protein, 30 aa, Artificial Sequence
  Description of Artificial Sequence: Synthetic polypeptide
DTEEIRYTNPVATEQYGYSKVSTNIQNGTV

SEQ ID NO: 52612 - protein, 31 aa, Artificial Sequence
  Description of Artificial Sequence: Synthetic polypeptide
DEEEIRTTNPVATEQYGYTISTNGGGQGGNG

SEQ ID NO: 52613 - protein, 31 aa, Artificial Sequence
  Description of Artificial Sequence: Synthetic polypeptide
DEEEIRTTNPVATEQYGYTIVTNEGQRGNGG

SEQ ID NO: 52614 - protein, 32 aa, Artificial Sequence
  Description of Artificial Sequence: Synthetic polypeptide
DEEEIRTTNPVATEQYGYTIYETNLLQRGNDN

SEQ ID NO: 52615 - protein, 30 aa, Artificial Sequence
  Description of Artificial Sequence: Synthetic polypeptide
DEAEIATTNPVATEQYGSVAANLQEAGNDN

SEQ ID NO: 52616 - protein, 29 aa, Artificial Sequence
  Description of Artificial Sequence: Synthetic peptide
DEAEIATTNPVATEQYGSVAANLQDDADR

SEQ ID NO: 52617 - protein, 32 aa, Artificial Sequence
  Description of Artificial Sequence: Synthetic polypeptide
DEEEIRTTNPVATEQYGYTWSDTQNPLQRLNN

SEQ ID NO: 52618 - protein, 31 aa, Artificial Sequence
  Description of Artificial Sequence: Synthetic polypeptide
QEEEIATTNPVATEQYGSVSTNDQEAGNEDF

SEQ ID NO: 52619 - protein, 30 aa, Artificial Sequence
  Description of Artificial Sequence: Synthetic polypeptide
DTEEIRYTNPVATEQYGVKVSTNLENGTQR

SEQ ID NO: 52620 - protein, 28 aa, Artificial Sequence
  Description of Artificial Sequence: Synthetic peptide
AEMEIAATNPVATEQYGEASENLQRGGR

SEQ ID NO: 52621 - protein, 30 aa, Artificial Sequence
  Description of Artificial Sequence: Synthetic polypeptide
DEAEIATTNPVATEQYGSVAATNLTDQGND

SEQ ID NO: 52622 - protein, 29 aa, Artificial Sequence
  Description of Artificial Sequence: Synthetic peptide
AEEEIRTTNPVATEGYGCTSINNDQRGND

SEQ ID NO: 52623 - protein, 30 aa, Artificial Sequence
  Description of Artificial Sequence: Synthetic polypeptide
AEEEIRTTNPVATEGYGCTSNINLQRAGNA

SEQ ID NO: 52624 - protein, 31 aa, Artificial Sequence
  Description of Artificial Sequence: Synthetic polypeptide
DEEEIRTTNPVATEQYGYITISTNGGQDGNG

SEQ ID NO: 52625 - protein, 31 aa, Artificial Sequence
  Description of Artificial Sequence: Synthetic polypeptide
DEAEIATTNPVATEQYGSVAGTNLQDGNPQM

SEQ ID NO: 52626 - protein, 31 aa, Artificial Sequence
  Description of Artificial Sequence: Synthetic polypeptide
DTTEIRTTNPVATEQYGSVSTTNTLQLGGAT

SEQ ID NO: 52627 - protein, 31 aa, Artificial Sequence
  Description of Artificial Sequence: Synthetic polypeptide
DEEEIRTTNPVATEQYGYSVQINSIQRFDNG

SEQ ID NO: 52628 - protein, 29 aa, Artificial Sequence
  Description of Artificial Sequence: Synthetic peptide
DEAEIATTNPVATEQYGSVAGNDQDGNDQ

SEQ ID NO: 52629 - protein, 32 aa, Artificial Sequence
  Description of Artificial Sequence: Synthetic polypeptide
DEEEIRTTNPVATEQYGYTCSTEELQRFGSNQ

SEQ ID NO: 52630 - protein, 32 aa, Artificial Sequence
  Description of Artificial Sequence: Synthetic polypeptide
DEEEIRTTNPVATEQYGYTGSDTINPLQRHNN

SEQ ID NO: 52631 - protein, 30 aa, Artificial Sequence
  Description of Artificial Sequence: Synthetic polypeptide
TEECIRTTNPVATEQYGSVCSTNLIYLNQA

SEQ ID NO: 52632 - protein, 30 aa, Artificial Sequence
  Description of Artificial Sequence: Synthetic polypeptide
TEECIRTTNPVATEQYGSVCSTNLINLSNA

SEQ ID NO: 52633 - protein, 31 aa, Artificial Sequence
  Description of Artificial Sequence: Synthetic polypeptide
DEEEIRTTNPVATEQYGYTINSNEEQRGNRQ

SEQ ID NO: 52634 - protein, 30 aa, Artificial Sequence
  Description of Artificial Sequence: Synthetic polypeptide
TEECIRTTNPVATEQYGSVCSTNDAYLSNR

SEQ ID NO: 52635 - protein, 31 aa, Artificial Sequence
  Description of Artificial Sequence: Synthetic polypeptide
DTTEIRTTNPVATEQYGSVSTNTQQLGNTTA

SEQ ID NO: 52636 - protein, 31 aa, Artificial Sequence
  Description of Artificial Sequence: Synthetic polypeptide
DEAEIATTNPVATEQYGSVAATNLTRPGGER

SEQ ID NO: 52637 - protein, 31 aa, Artificial Sequence
  Description of Artificial Sequence: Synthetic polypeptide
DEAEIATTNPVATEQYGSVAATNLQGGQPRI

SEQ ID NO: 52638 - protein, 31 aa, Artificial Sequence
  Description of Artificial Sequence: Synthetic polypeptide
DEAEIATTNPVATEQWGAVSTNLQNDGDPNR

SEQ ID NO: 52639 - protein, 30 aa, Artificial Sequence
  Description of Artificial Sequence: Synthetic polypeptide
DTEEIRYTNPVATEQYGTKVSTNLGENGTR

SEQ ID NO: 52640 - protein, 31 aa, Artificial Sequence
  Description of Artificial Sequence: Synthetic polypeptide
TEECIRTTNPVATEQWGSVFTNLSTRPGGNR

SEQ ID NO: 52641 - protein, 32 aa, Artificial Sequence
  Description of Artificial Sequence: Synthetic polypeptide
AEEEIRTTNPVATEQYGSVVTTNLQNENGQNE

SEQ ID NO: 52642 - protein, 31 aa, Artificial Sequence
  Description of Artificial Sequence: Synthetic polypeptide
DTEEIRVTNPVATEQYGSYVSTVLQPNGLER

SEQ ID NO: 52643 - protein, 31 aa, Artificial Sequence
  Description of Artificial Sequence: Synthetic polypeptide
DTEEIRVTNPVATEQYGSFVSTNLQPNGTAE

SEQ ID NO: 52644 - protein, 30 aa, Artificial Sequence
  Description of Artificial Sequence: Synthetic polypeptide
AEEEIRTTNPVATENYGSVVTQSLQMGPTR

SEQ ID NO: 52645 - protein, 32 aa, Artificial Sequence
  Description of Artificial Sequence: Synthetic polypeptide
AEEEIRTTNPVATEQYGSVVTTNLQGNGNTNA

SEQ ID NO: 52646 - protein, 32 aa, Artificial Sequence
  Description of Artificial Sequence: Synthetic polypeptide
AEEEIRTTNPVATEQYGSVVTTNLQENGNNNA

SEQ ID NO: 52647 - protein, 31 aa, Artificial Sequence
  Description of Artificial Sequence: Synthetic polypeptide
AEEEIRTTNPVATEQYGSVVTTNLIQTTNNV

SEQ ID NO: 52648 - protein, 33 aa, Artificial Sequence
  Description of Artificial Sequence: Synthetic polypeptide
DEEEIRTTNPVATEQYGYVSTNLAQGMGENTGQ

SEQ ID NO: 52649 - protein, 32 aa, Artificial Sequence
  Description of Artificial Sequence: Synthetic polypeptide
AEEEIRTTNPVATEQYGSVVTTNLGGQEGNQV

SEQ ID NO: 52650 - protein, 31 aa, Artificial Sequence
  Description of Artificial Sequence: Synthetic polypeptide
DEAEIATTNPVATEQYGEVVATNLQRGNEDH

SEQ ID NO: 52651 - protein, 32 aa, Artificial Sequence
  Description of Artificial Sequence: Synthetic polypeptide
DEAEIATTNPVATEQYGEVSTNLQSNGDNGDR

SEQ ID NO: 52652 - protein, 31 aa, Artificial Sequence
  Description of Artificial Sequence: Synthetic polypeptide
DEAEIATTNPVATEQYGEVSTNLQIGDGNEA

SEQ ID NO: 52653 - protein, 31 aa, Artificial Sequence
  Description of Artificial Sequence: Synthetic polypeptide
DEAEIATTNPVATEQYGEVSTNLQGNAGPER

SEQ ID NO: 52654 - protein, 31 aa, Artificial Sequence
  Description of Artificial Sequence: Synthetic polypeptide
DEAEIATTNPVATEQYGEVSTNLNGDQGNTR

SEQ ID NO: 52655 - protein, 30 aa, Artificial Sequence
  Description of Artificial Sequence: Synthetic polypeptide
DEAEIATTNPVATEQYGDVSTELQNGDNDE

SEQ ID NO: 52656 - protein, 31 aa, Artificial Sequence
  Description of Artificial Sequence: Synthetic polypeptide
DTEEIRVTNPVAYEQYGSTVSTNLDQNGDTR

SEQ ID NO: 52657 - protein, 31 aa, Artificial Sequence
  Description of Artificial Sequence: Synthetic polypeptide
TEECIRTTNPVATEQWGSVSQGNLSQTGGNR

SEQ ID NO: 52658 - protein, 30 aa, Artificial Sequence
  Description of Artificial Sequence: Synthetic polypeptide
TEECIRCTNPVATEQYGSVSWNLFERGENQ

SEQ ID NO: 52659 - protein, 32 aa, Artificial Sequence
  Description of Artificial Sequence: Synthetic polypeptide
AEEEIRTTNPVATEIYGSVSTTNLQQGNNEGI

SEQ ID NO: 52660 - protein, 31 aa, Artificial Sequence
  Description of Artificial Sequence: Synthetic polypeptide
AEEEIRTTNPVATEGYGSVSTLNVLPTGDNP

SEQ ID NO: 52661 - protein, 30 aa, Artificial Sequence
  Description of Artificial Sequence: Synthetic polypeptide
DTEEIRYTNPVATEQYGSNVSENLENGTQR

SEQ ID NO: 52662 - protein, 32 aa, Artificial Sequence
  Description of Artificial Sequence: Synthetic polypeptide
AEEEIRTTNPVATEQYGSVVTTNLQQNGNNAT

SEQ ID NO: 52663 - protein, 31 aa, Artificial Sequence
  Description of Artificial Sequence: Synthetic polypeptide
DTEEIRYTNPVATEQYGSKVYSTMNGQNGTR

SEQ ID NO: 52664 - protein, 30 aa, Artificial Sequence
  Description of Artificial Sequence: Synthetic polypeptide
AEEEIRTTNPVATEHWGCFSINDLQHRGNR

SEQ ID NO: 52665 - protein, 31 aa, Artificial Sequence
  Description of Artificial Sequence: Synthetic polypeptide
DEEEIRTTNPVATEQYGYVSCEMLDRGENNE

SEQ ID NO: 52666 - protein, 28 aa, Artificial Sequence
  Description of Artificial Sequence: Synthetic peptide
AEMEIACTNPVATEQYGEASENLQRGGR

SEQ ID NO: 52667 - protein, 28 aa, Artificial Sequence
  Description of Artificial Sequence: Synthetic peptide
AEMEIACTNPVATEQYGELSENLQRGGR

SEQ ID NO: 52668 - protein, 32 aa, Artificial Sequence
  Description of Artificial Sequence: Synthetic polypeptide
QEEEIATTNPVATEQYGSVSTNNLQEAGNPEF

SEQ ID NO: 52669 - protein, 32 aa, Artificial Sequence
  Description of Artificial Sequence: Synthetic polypeptide
DTEEIRYTNPVATEQYGSKVCSTMNLQNGTRV

SEQ ID NO: 52670 - protein, 30 aa, Artificial Sequence
  Description of Artificial Sequence: Synthetic polypeptide
DTEEIRYTNPVATEQYGSKLSTNLQNGTQD

SEQ ID NO: 52671 - protein, 32 aa, Artificial Sequence
  Description of Artificial Sequence: Synthetic polypeptide
AEEEIRTTNPVATEQYGSVVTTNLQNQEGTNE

SEQ ID NO: 52672 - protein, 29 aa, Artificial Sequence
  Description of Artificial Sequence: Synthetic peptide
DEAEIATTNPVATEQYGSTAPNLDRNGNE

SEQ ID NO: 52673 - protein, 28 aa, Artificial Sequence
  Description of Artificial Sequence: Synthetic peptide
AEMEIACTNPVATEQYGEVSTGLQRGGD

SEQ ID NO: 52674 - protein, 31 aa, Artificial Sequence
  Description of Artificial Sequence: Synthetic polypeptide
DEEEIRTTNPVATEQYGYVSTENLFISINEW

SEQ ID NO: 52675 - protein, 32 aa, Artificial Sequence
  Description of Artificial Sequence: Synthetic polypeptide
AEEEIRTTNPVATEQYGSVVTTNLQNGNNNAA

SEQ ID NO: 52676 - protein, 30 aa, Artificial Sequence
  Description of Artificial Sequence: Synthetic polypeptide
DTTEIRTTNPVATEQYGSVSTTNTNQLGEA

SEQ ID NO: 52677 - protein, 30 aa, Artificial Sequence
  Description of Artificial Sequence: Synthetic polypeptide
DEAEIATTNPVATEQWGAVSTNLQHNGDER

SEQ ID NO: 52678 - protein, 30 aa, Artificial Sequence
  Description of Artificial Sequence: Synthetic polypeptide
DEAEIATTNPVATEQWGAVSTNLQDNGGPR

SEQ ID NO: 52679 - protein, 31 aa, Artificial Sequence
  Description of Artificial Sequence: Synthetic polypeptide
TEAEIRTTNPVATEQYGQVSCTTLSQRGGDR

SEQ ID NO: 52680 - protein, 31 aa, Artificial Sequence
  Description of Artificial Sequence: Synthetic polypeptide
DEEEIRTTNPVAVEQYGSVSTTNGNQVNNSD

SEQ ID NO: 52681 - protein, 33 aa, Artificial Sequence
  Description of Artificial Sequence: Synthetic polypeptide
TEAEIRTTNPVATEQYGQSVSTNLSQRTSGNYP

SEQ ID NO: 52682 - protein, 31 aa, Artificial Sequence
  Description of Artificial Sequence: Synthetic polypeptide
DEEEIRTTNPVAVEQYGSVSTTNLGQVNDED

SEQ ID NO: 52683 - protein, 32 aa, Artificial Sequence
  Description of Artificial Sequence: Synthetic polypeptide
DEEEIRTTNPVAVEQYGSVSTTNLLLQNGQEE

SEQ ID NO: 52684 - protein, 32 aa, Artificial Sequence
  Description of Artificial Sequence: Synthetic polypeptide
DEEEIRTTNPVAVEQYGSVSTTNLNQGTNNSD

SEQ ID NO: 52685 - protein, 31 aa, Artificial Sequence
  Description of Artificial Sequence: Synthetic polypeptide
QEEEIATTNPVATEQYGVVSTNLQVGDNDLF

SEQ ID NO: 52686 - protein, 30 aa, Artificial Sequence
  Description of Artificial Sequence: Synthetic polypeptide
DEAEIACTNPVATEQYGCVATNLQAEGNRD

SEQ ID NO: 52687 - protein, 33 aa, Artificial Sequence
  Description of Artificial Sequence: Synthetic polypeptide
TEAEIRTTNPVATEQYGCTVSCTQNELQRPGNR

SEQ ID NO: 52688 - protein, 29 aa, Artificial Sequence
  Description of Artificial Sequence: Synthetic peptide
QEEEIATTNPVATESYGCVATNLQQGDRQ

SEQ ID NO: 52689 - protein, 30 aa, Artificial Sequence
  Description of Artificial Sequence: Synthetic polypeptide
DTEEIRTTNPQATEHYGSVSFNLQREENNE

SEQ ID NO: 52690 - protein, 30 aa, Artificial Sequence
  Description of Artificial Sequence: Synthetic polypeptide
DTEEIRTTNPQATEHYGSVSFNLQNRNETR

SEQ ID NO: 52691 - protein, 33 aa, Artificial Sequence
  Description of Artificial Sequence: Synthetic polypeptide
DEEEIRTTNPVAVEQYGSVSTTNNLLQNGQERE

SEQ ID NO: 52692 - protein, 29 aa, Artificial Sequence
  Description of Artificial Sequence: Synthetic peptide
DTEEIRTTNPQATEHYGSVSFNLQEEENN

SEQ ID NO: 52693 - protein, 32 aa, Artificial Sequence
  Description of Artificial Sequence: Synthetic polypeptide
DEEEIRTTNPVAVEQYGSVSTTNLQVNNQSED

SEQ ID NO: 52694 - protein, 32 aa, Artificial Sequence
  Description of Artificial Sequence: Synthetic polypeptide
TEAEIRTTNPVATEQYGSVSCTNLSQDEGGNE

SEQ ID NO: 52695 - protein, 30 aa, Artificial Sequence
  Description of Artificial Sequence: Synthetic polypeptide
DEAEIACTNPVATEQYGCVATNLQQRGNED

SEQ ID NO: 52696 - protein, 32 aa, Artificial Sequence
  Description of Artificial Sequence: Synthetic polypeptide
DEEEIRTTNPVAVEQYGSVSTTNDGNQNGQER

SEQ ID NO: 52697 - protein, 30 aa, Artificial Sequence
  Description of Artificial Sequence: Synthetic polypeptide
DEAEIACTNPVATEQYGSVATNLERGNEDL

SEQ ID NO: 52698 - protein, 31 aa, Artificial Sequence
  Description of Artificial Sequence: Synthetic polypeptide
DTEEIRTTNPVATDQYGSVSTVSGVQNGNLR

SEQ ID NO: 52699 - protein, 33 aa, Artificial Sequence
  Description of Artificial Sequence: Synthetic polypeptide
DEEEIRTTNPVAVEQYGSVSTNNDLLQGGNGTQ

SEQ ID NO: 52700 - protein, 30 aa, Artificial Sequence
  Description of Artificial Sequence: Synthetic polypeptide
DTEEIRTTNPVATDQYGSVSTSGVQNGNNS

SEQ ID NO: 52701 - protein, 33 aa, Artificial Sequence
  Description of Artificial Sequence: Synthetic polypeptide
DEEEIRTTNPVAVEQYGSVSTNNDLLQQGIGNT

SEQ ID NO: 52702 - protein, 30 aa, Artificial Sequence
  Description of Artificial Sequence: Synthetic polypeptide
TEAEIRTTNPVAYEAYGSVSTNLSGSAGNR

SEQ ID NO: 52703 - protein, 31 aa, Artificial Sequence
  Description of Artificial Sequence: Synthetic polypeptide
AEEEIRTTNPVATEQYGSVVTTNGNLQGTNS

SEQ ID NO: 52704 - protein, 30 aa, Artificial Sequence
  Description of Artificial Sequence: Synthetic polypeptide
DTEEIRTTNPQATEIYGSVSFMNLQRNQNQ

SEQ ID NO: 52705 - protein, 28 aa, Artificial Sequence
  Description of Artificial Sequence: Synthetic peptide
QEEEIATTNPVATEQYGVVSEVLQHENK

SEQ ID NO: 52706 - protein, 33 aa, Artificial Sequence
  Description of Artificial Sequence: Synthetic polypeptide
DEEEIRTTNPVAVEQYGSVSTNTNDLLQIGNIS

SEQ ID NO: 52707 - protein, 29 aa, Artificial Sequence
  Description of Artificial Sequence: Synthetic peptide
DTEEIRTTNPQATEHYGSVSFNQQRVNQV

SEQ ID NO: 52708 - protein, 30 aa, Artificial Sequence
  Description of Artificial Sequence: Synthetic polypeptide
DTEEIRTTNPQATEHYGSVSFNLTQRENQE

SEQ ID NO: 52709 - protein, 32 aa, Artificial Sequence
  Description of Artificial Sequence: Synthetic polypeptide
TEAEIRTTNPVATEQYGSVSCTNLSQKGGNYI

SEQ ID NO: 52710 - protein, 33 aa, Artificial Sequence
  Description of Artificial Sequence: Synthetic polypeptide
DEEEIRTTNPVAVEQYGSVSTQNNQLLQNGNGS

SEQ ID NO: 52711 - protein, 32 aa, Artificial Sequence
  Description of Artificial Sequence: Synthetic polypeptide
DEEEIRTTNPVAVEQYGSVSTTNDELQNGQEQ

SEQ ID NO: 52712 - protein, 29 aa, Artificial Sequence
  Description of Artificial Sequence: Synthetic peptide
DTEEIRTTNPQATEHYGSVSFNLLQRETE

SEQ ID NO: 52713 - protein, 32 aa, Artificial Sequence
  Description of Artificial Sequence: Synthetic polypeptide
DEEEIRTTNPVAVEQYGSVSTTNNLQGNNSDQ

SEQ ID NO: 52714 - protein, 31 aa, Artificial Sequence
  Description of Artificial Sequence: Synthetic polypeptide
DEEEIRTTNPVAVEQYGSVSTTNNLQNNDSD

SEQ ID NO: 52715 - protein, 33 aa, Artificial Sequence
  Description of Artificial Sequence: Synthetic polypeptide
DEEEIRTTNPVAVEQYGSVSTTNNLQQGVNNSD

SEQ ID NO: 52716 - protein, 29 aa, Artificial Sequence
  Description of Artificial Sequence: Synthetic peptide
DTEEIRTTNPCATEHYGSVSFNPDQGENR

SEQ ID NO: 52717 - protein, 31 aa, Artificial Sequence
  Description of Artificial Sequence: Synthetic polypeptide
DTEEIRTTNPCATEHYGSVSCNLQRDEHNSR

SEQ ID NO: 52718 - protein, 30 aa, Artificial Sequence
  Description of Artificial Sequence: Synthetic polypeptide
DTEEIRTTNPCATEHYGSVSCNLQHEHNMR

SEQ ID NO: 52719 - protein, 32 aa, Artificial Sequence
  Description of Artificial Sequence: Synthetic polypeptide
AEEEIRTTNPVATEQYGSVVTSTTNNQQGNNS

SEQ ID NO: 52720 - protein, 29 aa, Artificial Sequence
  Description of Artificial Sequence: Synthetic peptide
QEEEIATTNPVAYEPYGSVATNDLQNGND

SEQ ID NO: 52721 - protein, 33 aa, Artificial Sequence
  Description of Artificial Sequence: Synthetic polypeptide
DEEEIRTTNPVAVEQYGSVVSQTNELLQEGILR

SEQ ID NO: 52722 - protein, 30 aa, Artificial Sequence
  Description of Artificial Sequence: Synthetic polypeptide
DEEEIRTTNPVAVEQYGSVVTNLQVNDTEQ

SEQ ID NO: 52723 - protein, 29 aa, Artificial Sequence
  Description of Artificial Sequence: Synthetic peptide
QEEEIATTNPVAYEPYGSVATNLQDGNDS

SEQ ID NO: 52724 - protein, 32 aa, Artificial Sequence
  Description of Artificial Sequence: Synthetic polypeptide
DEEEIRTTNPVAVEQYGSVVTNNNLLQRGEGT

SEQ ID NO: 52725 - protein, 29 aa, Artificial Sequence
  Description of Artificial Sequence: Synthetic peptide
TDEEIRTTNPVATDQYGSVSTTLQTVNFV

SEQ ID NO: 52726 - protein, 32 aa, Artificial Sequence
  Description of Artificial Sequence: Synthetic polypeptide
AEEEIRTTNPVATEQYGSVVTSTNNQQNGNGS

SEQ ID NO: 52727 - protein, 32 aa, Artificial Sequence
  Description of Artificial Sequence: Synthetic polypeptide
DEEEIRTTNPVAVEQYGSVVTTNDNLQNGIER

SEQ ID NO: 52728 - protein, 32 aa, Artificial Sequence
  Description of Artificial Sequence: Synthetic polypeptide
AEEEIRTTNPVATEQYGSVVTSTNNNQQGNGD

SEQ ID NO: 52729 - protein, 32 aa, Artificial Sequence
  Description of Artificial Sequence: Synthetic polypeptide
AEEEIRTTNPVATEQYGSVVTSTNNNQDEGNL

SEQ ID NO: 52730 - protein, 30 aa, Artificial Sequence
  Description of Artificial Sequence: Synthetic polypeptide
DEEEIRTTNPVAVEQYGSVVTTNLQVNDEN

SEQ ID NO: 52731 - protein, 30 aa, Artificial Sequence
  Description of Artificial Sequence: Synthetic polypeptide
DTEEIRTTNPCATEHYGSVSWNLQRFNSNQ

SEQ ID NO: 52732 - protein, 30 aa, Artificial Sequence
  Description of Artificial Sequence: Synthetic polypeptide
DEAEIACTNPVATEQYGSVATNLERSENDR

SEQ ID NO: 52733 - protein, 30 aa, Artificial Sequence
  Description of Artificial Sequence: Synthetic polypeptide
QEEEIATTNPVATESYGSVSNTNLEQGDQR

SEQ ID NO: 52734 - protein, 32 aa, Artificial Sequence
  Description of Artificial Sequence: Synthetic polypeptide
AEEEIRTTNPVATEQYGSVVTTANLNQEGENV

SEQ ID NO: 52735 - protein, 32 aa, Artificial Sequence
  Description of Artificial Sequence: Synthetic polypeptide
DEEEIRTTNPVAVEQYGSVSTTNNLQVNNSDN

SEQ ID NO: 52736 - protein, 28 aa, Artificial Sequence
  Description of Artificial Sequence: Synthetic peptide
DTEEIRTTNPCAYEPYGTVSANLQRENF

SEQ ID NO: 52737 - protein, 33 aa, Artificial Sequence
  Description of Artificial Sequence: Synthetic polypeptide
TEAEIRTTNPVATEAYGSTVSTQNELSQRMGNR

SEQ ID NO: 52738 - protein, 32 aa, Artificial Sequence
  Description of Artificial Sequence: Synthetic polypeptide
TEAEIRTTNPLATEQYGSVSTNELSQRPGGNE

SEQ ID NO: 52739 - protein, 29 aa, Artificial Sequence
  Description of Artificial Sequence: Synthetic peptide
DTEEIRTTNPCAYEPYGSVSANLQRTENL

SEQ ID NO: 52740 - protein, 29 aa, Artificial Sequence
  Description of Artificial Sequence: Synthetic peptide
DTEEIRTTNPCAYEPYGSVSANLQRENES

SEQ ID NO: 52741 - protein, 33 aa, Artificial Sequence
  Description of Artificial Sequence: Synthetic polypeptide
DEEEIRTTNPVAVEQYGSVSTVNNDLLQRGIIA

SEQ ID NO: 52742 - protein, 29 aa, Artificial Sequence
  Description of Artificial Sequence: Synthetic peptide
DTEEIRTTNPCAYEPYGSVSANLQAENDR

SEQ ID NO: 52743 - protein, 33 aa, Artificial Sequence
  Description of Artificial Sequence: Synthetic polypeptide
DEEEIRTTNPVAVEQYGSVSTVNQNLQSGIGND

SEQ ID NO: 52744 - protein, 33 aa, Artificial Sequence
  Description of Artificial Sequence: Synthetic polypeptide
DEEEIRTTNPVAVEQYGSVSTVTNDLLQRGEIG

SEQ ID NO: 52745 - protein, 33 aa, Artificial Sequence
  Description of Artificial Sequence: Synthetic polypeptide
DEEEIRTTNPVAVEQYGSVSTVTNDLLQRGTES

SEQ ID NO: 52746 - protein, 31 aa, Artificial Sequence
  Description of Artificial Sequence: Synthetic polypeptide
TEAEIKTTNPVATERYGSTVSTNLSQRGGNM

SEQ ID NO: 52747 - protein, 30 aa, Artificial Sequence
  Description of Artificial Sequence: Synthetic polypeptide
DTEEIRTTNPCAYEAYGSVSCFNLSQRENR

SEQ ID NO: 52748 - protein, 30 aa, Artificial Sequence
  Description of Artificial Sequence: Synthetic polypeptide
TEAEIATTNPVAYEQYGSVATNLQNRGNDQ

SEQ ID NO: 52749 - protein, 28 aa, Artificial Sequence
  Description of Artificial Sequence: Synthetic peptide
TEAEIACTNPVATEQYGEASENLQRGGR

SEQ ID NO: 52750 - protein, 29 aa, Artificial Sequence
  Description of Artificial Sequence: Synthetic peptide
QEEEIATTNPVATESYGSVATNLQQPDRN

SEQ ID NO: 52751 - protein, 30 aa, Artificial Sequence
  Description of Artificial Sequence: Synthetic polypeptide
DEAEIACTNPVATEQYGSVATNLQADNDRN

SEQ ID NO: 52752 - protein, 29 aa, Artificial Sequence
  Description of Artificial Sequence: Synthetic peptide
DEAEIACTNPVATEQYGSVATNLQDGDES

SEQ ID NO: 52753 - protein, 30 aa, Artificial Sequence
  Description of Artificial Sequence: Synthetic polypeptide
DEAEIACTNPVATEQYGSVATNLQGGNLQD

SEQ ID NO: 52754 - protein, 30 aa, Artificial Sequence
  Description of Artificial Sequence: Synthetic polypeptide
DEAEIATTNPVATENYGTVSTNLQGGGDGR

SEQ ID NO: 52755 - protein, 31 aa, Artificial Sequence
  Description of Artificial Sequence: Synthetic polypeptide
DEAEIATTNPVATENYGSVSTNLQGGTGNAN

SEQ ID NO: 52756 - protein, 31 aa, Artificial Sequence
  Description of Artificial Sequence: Synthetic polypeptide
DEAEIATTNPVATENYGSVSTNLNGEDGDNR

SEQ ID NO: 52757 - protein, 29 aa, Artificial Sequence
  Description of Artificial Sequence: Synthetic peptide
DEAEIATTNPVATEMWGSVATNLERGNQD

SEQ ID NO: 52758 - protein, 30 aa, Artificial Sequence
  Description of Artificial Sequence: Synthetic polypeptide
DEAEIATTNPVATEIYGSVSTNLQGEDDSR

SEQ ID NO: 52759 - protein, 31 aa, Artificial Sequence
  Description of Artificial Sequence: Synthetic polypeptide
AEEEIRTTNPVATEQYGSVVTTNLESGENET

SEQ ID NO: 52760 - protein, 32 aa, Artificial Sequence
  Description of Artificial Sequence: Synthetic polypeptide
DEAEIATTNPVATEHYGSVSTNLQRDGQNDGE

SEQ ID NO: 52761 - protein, 31 aa, Artificial Sequence
  Description of Artificial Sequence: Synthetic polypeptide
DEAEIATTNPVATEHYGSVSTNLQGDGNNGE

SEQ ID NO: 52762 - protein, 30 aa, Artificial Sequence
  Description of Artificial Sequence: Synthetic polypeptide
DEAEIATTNPVATEHYGSVSTNLQGDGDDA

SEQ ID NO: 52763 - protein, 31 aa, Artificial Sequence
  Description of Artificial Sequence: Synthetic polypeptide
DEAEIATTNPVATEHYGNVSTNLQRDGDNEI

SEQ ID NO: 52764 - protein, 31 aa, Artificial Sequence
  Description of Artificial Sequence: Synthetic polypeptide
DEAEIATTNPVATEHYGCVSTNLQRDGNNDE

SEQ ID NO: 52765 - protein, 29 aa, Artificial Sequence
  Description of Artificial Sequence: Synthetic peptide
DEAEIATTNPVATEGYGSVSTQGDQNGNH

SEQ ID NO: 52766 - protein, 29 aa, Artificial Sequence
  Description of Artificial Sequence: Synthetic peptide
DEAEIATTNPVATEGYGSVATNLQDGGEE

SEQ ID NO: 52767 - protein, 28 aa, Artificial Sequence
  Description of Artificial Sequence: Synthetic peptide
DEAEIATTNPVATEGYGSVATNDTAGNE

SEQ ID NO: 52768 - protein, 31 aa, Artificial Sequence
  Description of Artificial Sequence: Synthetic polypeptide
DEAEIATTNPVATEEYGSVSTNLQNGGDNDD

SEQ ID NO: 52769 - protein, 31 aa, Artificial Sequence
  Description of Artificial Sequence: Synthetic polypeptide
DEAEIATTNPVATENYGTVSTNLQRGDGDRR

SEQ ID NO: 52770 - protein, 32 aa, Artificial Sequence
  Description of Artificial Sequence: Synthetic polypeptide
DEAEIATTNPVATECYGSVSTNLQGNDEGNTR

SEQ ID NO: 52771 - protein, 32 aa, Artificial Sequence
  Description of Artificial Sequence: Synthetic polypeptide
DEEEIRTTNPVATETYGSVSNFNELQQEQVNR

SEQ ID NO: 52772 - protein, 31 aa, Artificial Sequence
  Description of Artificial Sequence: Synthetic polypeptide
DEEEIRTTNPVATETYGQVSSTNLTQLEGEE

SEQ ID NO: 52773 - protein, 28 aa, Artificial Sequence
  Description of Artificial Sequence: Synthetic peptide
DEAEIATTNPVATEQWGAVATNLQNGPV

SEQ ID NO: 52774 - protein, 31 aa, Artificial Sequence
  Description of Artificial Sequence: Synthetic polypeptide
AEEEIRTTNPVATEQYGSVVTTNLGGEGNVG

SEQ ID NO: 52775 - protein, 30 aa, Artificial Sequence
  Description of Artificial Sequence: Synthetic polypeptide
DTEEIRTTNPVATEQYGSVATNTAQGLDNK

SEQ ID NO: 52776 - protein, 31 aa, Artificial Sequence
  Description of Artificial Sequence: Synthetic polypeptide
DEAEIATTNPVATEPYGSVSTNLQGNMGNNG

SEQ ID NO: 52777 - protein, 31 aa, Artificial Sequence
  Description of Artificial Sequence: Synthetic polypeptide
AEEEIRTTNPVATEQYGSVVTTNLGGEGGNV

SEQ ID NO: 52778 - protein, 28 aa, Artificial Sequence
  Description of Artificial Sequence: Synthetic peptide
QEEEIATTNPVATEQYGVVPENLQHENK

SEQ ID NO: 52779 - protein, 30 aa, Artificial Sequence
  Description of Artificial Sequence: Synthetic polypeptide
DTEEIRTTNPVATEQWGSVTVTTTLQRGTE

SEQ ID NO: 52780 - protein, 32 aa, Artificial Sequence
  Description of Artificial Sequence: Synthetic polypeptide
DEEEIRTTNPVATESYGVVSTVNLQFNGENID

SEQ ID NO: 52781 - protein, 32 aa, Artificial Sequence
  Description of Artificial Sequence: Synthetic polypeptide
DEEEIRTTNPVATESYGVVSTVNLQFNGGNNQ

SEQ ID NO: 52782 - protein, 30 aa, Artificial Sequence
  Description of Artificial Sequence: Synthetic polypeptide
DEAEIATTNPVATEPYGSVCATNLTRGGND

SEQ ID NO: 52783 - protein, 30 aa, Artificial Sequence
  Description of Artificial Sequence: Synthetic polypeptide
DEAEIATTNPVATEPYGSVATNLQRADDRN

SEQ ID NO: 52784 - protein, 29 aa, Artificial Sequence
  Description of Artificial Sequence: Synthetic peptide
DEAEIATTNPVATEPYGSVATNLQQHNDL

SEQ ID NO: 52785 - protein, 29 aa, Artificial Sequence
  Description of Artificial Sequence: Synthetic peptide
TEDEIRTTNPVATEAYGETSTNLSQRGDS

SEQ ID NO: 52786 - protein, 28 aa, Artificial Sequence
  Description of Artificial Sequence: Synthetic peptide
DEAEIATTNPVATEPYGSVATGLQQGQM

SEQ ID NO: 52787 - protein, 30 aa, Artificial Sequence
  Description of Artificial Sequence: Synthetic polypeptide
TEDEIATTNPVAYEQYGSVSTNLQQGNDQL

SEQ ID NO: 52788 - protein, 32 aa, Artificial Sequence
  Description of Artificial Sequence: Synthetic polypeptide
DEEEIRTTNPVATETYGSVACTNLQRGGEDDP

SEQ ID NO: 52789 - protein, 30 aa, Artificial Sequence
  Description of Artificial Sequence: Synthetic polypeptide
DEEEIRTTNPVATESYGTVSSVTNEQNNNF

SEQ ID NO: 52790 - protein, 33 aa, Artificial Sequence
  Description of Artificial Sequence: Synthetic polypeptide
DEEEIRTTNPVATETYGSVSTNLVQQGGGGNES

SEQ ID NO: 52791 - protein, 30 aa, Artificial Sequence
  Description of Artificial Sequence: Synthetic polypeptide
DEAEIATTNPVATEAYGSVATNLQDGNDNN

SEQ ID NO: 52792 - protein, 32 aa, Artificial Sequence
  Description of Artificial Sequence: Synthetic polypeptide
TEAEIRTTNPVAYEPYGSVVSTTNLQRGTNNR

SEQ ID NO: 52793 - protein, 31 aa, Artificial Sequence
  Description of Artificial Sequence: Synthetic polypeptide
DEEEIRTTNPVATEYYGSVSLSNLQHMVNDQ

SEQ ID NO: 52794 - protein, 30 aa, Artificial Sequence
  Description of Artificial Sequence: Synthetic polypeptide
DEAEIASTNPVAYEQYGSVSTNLQRGDGDE

SEQ ID NO: 52795 - protein, 29 aa, Artificial Sequence
  Description of Artificial Sequence: Synthetic peptide
DEAEIASTNPVAYEQYGSVATNLNRGDRQ

SEQ ID NO: 52796 - protein, 32 aa, Artificial Sequence
  Description of Artificial Sequence: Synthetic polypeptide
DEEEIRTTNPVATEYYGSVSTNLQMSNEDNYF

SEQ ID NO: 52797 - protein, 28 aa, Artificial Sequence
  Description of Artificial Sequence: Synthetic peptide
DEAEIACTNPVAYEQYGSVATNLNRGDL

SEQ ID NO: 52798 - protein, 29 aa, Artificial Sequence
  Description of Artificial Sequence: Synthetic peptide
DEAEIACTNPVAYEPYGSVATNLQRGNDE

SEQ ID NO: 52799 - protein, 31 aa, Artificial Sequence
  Description of Artificial Sequence: Synthetic polypeptide
DEAEIACTNPVATEQYGSVSTNQLQEQMGNL

SEQ ID NO: 52800 - protein, 30 aa, Artificial Sequence
  Description of Artificial Sequence: Synthetic polypeptide
DEAEIACTNPVATEQYGSVSTNLQQGDPVH

SEQ ID NO: 52801 - protein, 30 aa, Artificial Sequence
  Description of Artificial Sequence: Synthetic polypeptide
DEAEIACTNPVATEQYGSVSTNLQHEENDE

SEQ ID NO: 52802 - protein, 28 aa, Artificial Sequence
  Description of Artificial Sequence: Synthetic peptide
QEEEIATTNPVATEQYGVVSECLQHENL

SEQ ID NO: 52803 - protein, 31 aa, Artificial Sequence
  Description of Artificial Sequence: Synthetic polypeptide
DEEEIRTTNPVATNQYGSVYSTNCINKCGND

SEQ ID NO: 52804 - protein, 32 aa, Artificial Sequence
  Description of Artificial Sequence: Synthetic polypeptide
DEAEIACTNPVATEQYGSVATNLQRGEENGRE

SEQ ID NO: 52805 - protein, 30 aa, Artificial Sequence
  Description of Artificial Sequence: Synthetic polypeptide
DEAEIACTNPVATEQYGSVATNLQRENNDE

SEQ ID NO: 52806 - protein, 30 aa, Artificial Sequence
  Description of Artificial Sequence: Synthetic polypeptide
DEAEIACTNPVATEQYGSVATNLQREDNSL

SEQ ID NO: 52807 - protein, 32 aa, Artificial Sequence
  Description of Artificial Sequence: Synthetic polypeptide
DEEEIRTTNPVATEYYGCVCSTALQRFGSERS

SEQ ID NO: 52808 - protein, 34 aa, Artificial Sequence
  Description of Artificial Sequence: Synthetic polypeptide
DEEEIRTTNPVATETYGSVVPSCTFALSQRGGNR

SEQ ID NO: 52809 - protein, 29 aa, Artificial Sequence
  Description of Artificial Sequence: Synthetic peptide
DTEEIRTTNPVATEQWGSVTSTLLQGATD

SEQ ID NO: 52810 - protein, 31 aa, Artificial Sequence
  Description of Artificial Sequence: Synthetic polypeptide
DEEEIRTTNPVATEWYGVVSTNLDKGGANGQ

SEQ ID NO: 52811 - protein, 30 aa, Artificial Sequence
  Description of Artificial Sequence: Synthetic polypeptide
DEAEIATTNPVATCQYGCVSTALQRGSNNQ

SEQ ID NO: 52812 - protein, 30 aa, Artificial Sequence
  Description of Artificial Sequence: Synthetic polypeptide
DTEEIRTTNPVATEQWGSVTVTNLLQIGTE

SEQ ID NO: 52813 - protein, 33 aa, Artificial Sequence
  Description of Artificial Sequence: Synthetic polypeptide
DEEEIRTTNPVATEVYGSVSGTNLVQGGGGNES

SEQ ID NO: 52814 - protein, 30 aa, Artificial Sequence
  Description of Artificial Sequence: Synthetic polypeptide
DTEEIRTTNPVATEQWGSVTVTLNLQQGTT

SEQ ID NO: 52815 - protein, 28 aa, Artificial Sequence
  Description of Artificial Sequence: Synthetic peptide
QEEEIATTNPVATEQYGVVPENLQHENQ

SEQ ID NO: 52816 - protein, 32 aa, Artificial Sequence
  Description of Artificial Sequence: Synthetic polypeptide
DEEEIRTTNPVATEVYGSVSTNLTNLDSGALR

SEQ ID NO: 52817 - protein, 28 aa, Artificial Sequence
  Description of Artificial Sequence: Synthetic peptide
DEAEIATTNPVATAQYGCVAFNLERGNP

SEQ ID NO: 52818 - protein, 28 aa, Artificial Sequence
  Description of Artificial Sequence: Synthetic peptide
DEAEIATTNPVATAQWGSVSTNDDNGNT

SEQ ID NO: 52819 - protein, 28 aa, Artificial Sequence
  Description of Artificial Sequence: Synthetic peptide
DEAEIATTNPVATAQWGSVSMNLDTGNT

SEQ ID NO: 52820 - protein, 30 aa, Artificial Sequence
  Description of Artificial Sequence: Synthetic polypeptide
DTEEIRTTNPVATEQWGSVTSTQLLQAGTE

SEQ ID NO: 52821 - protein, 31 aa, Artificial Sequence
  Description of Artificial Sequence: Synthetic polypeptide
DEEEIRTTNPVATEWYGSVSTNSHENRDMIR

SEQ ID NO: 52822 - protein, 31 aa, Artificial Sequence
  Description of Artificial Sequence: Synthetic polypeptide
DEEEIRTTNPVATEWYGSVSTTNLIDNGTLG

SEQ ID NO: 52823 - protein, 30 aa, Artificial Sequence
  Description of Artificial Sequence: Synthetic polypeptide
DTEEIRTTNPVATEQWGSVTSTLLQNGTDD

SEQ ID NO: 52824 - protein, 31 aa, Artificial Sequence
  Description of Artificial Sequence: Synthetic polypeptide
TEAEIRTTNSVAYDQYGSVSCTNLSQRGDNR

SEQ ID NO: 52825 - protein, 30 aa, Artificial Sequence
  Description of Artificial Sequence: Synthetic polypeptide
DTEEIRTTNPVATEQWGSVTSTLLQGTGTD

SEQ ID NO: 52826 - protein, 30 aa, Artificial Sequence
  Description of Artificial Sequence: Synthetic polypeptide
DEEEIRTTNPVATEYYGCHSTNEQRNSNFP

SEQ ID NO: 52827 - protein, 31 aa, Artificial Sequence
  Description of Artificial Sequence: Synthetic polypeptide
DEAEIATTNPVATEQYGSVAITNLEERGPER

SEQ ID NO: 52828 - protein, 30 aa, Artificial Sequence
  Description of Artificial Sequence: Synthetic polypeptide
DEAEIATTNPVATEQYGSVAITNLEGGNQD

SEQ ID NO: 52829 - protein, 31 aa, Artificial Sequence
  Description of Artificial Sequence: Synthetic polypeptide
TEECIRTTNPVATEQYGSVSCTNLSSMLTNR

SEQ ID NO: 52830 - protein, 32 aa, Artificial Sequence
  Description of Artificial Sequence: Synthetic polypeptide
DEEEIRTTNPVATEQYGVVSTEHQRFGSNNAI

SEQ ID NO: 52831 - protein, 28 aa, Artificial Sequence
  Description of Artificial Sequence: Synthetic peptide
AEHEIACTNPVATEQYGEASENLQRGVR

SEQ ID NO: 52832 - protein, 32 aa, Artificial Sequence
  Description of Artificial Sequence: Synthetic polypeptide
DEEEIRTTNPVATEQYGVVSTELNQGFGSNQE

SEQ ID NO: 52833 - protein, 32 aa, Artificial Sequence
  Description of Artificial Sequence: Synthetic polypeptide
DEEEIRTTNPVATEQYGVVSTELQYFGSENQA

SEQ ID NO: 52834 - protein, 30 aa, Artificial Sequence
  Description of Artificial Sequence: Synthetic polypeptide
DEEEIRTTNPVATEQYGVVSTELQYFISEQ

SEQ ID NO: 52835 - protein, 30 aa, Artificial Sequence
  Description of Artificial Sequence: Synthetic polypeptide
DEEEIRTTNPVATEQYGVVSTEPQYFGSEA

SEQ ID NO: 52836 - protein, 30 aa, Artificial Sequence
  Description of Artificial Sequence: Synthetic polypeptide
DEEEIRTTNPVATEQYGVVSTEHQGFNSNF

SEQ ID NO: 52837 - protein, 31 aa, Artificial Sequence
  Description of Artificial Sequence: Synthetic polypeptide
DEEEIRTTNPVATEQYGVVSTETQGFNSNRA

SEQ ID NO: 52838 - protein, 32 aa, Artificial Sequence
  Description of Artificial Sequence: Synthetic polypeptide
DEEEIRTTNPVATEQYGVVSTGNLENFGSNDP

SEQ ID NO: 52839 - protein, 33 aa, Artificial Sequence
  Description of Artificial Sequence: Synthetic polypeptide
DEEEIRTTNPVATEQYGVVSTGNLQSFGSNNQS

SEQ ID NO: 52840 - protein, 30 aa, Artificial Sequence
  Description of Artificial Sequence: Synthetic polypeptide
QEEEIATTNPVATEQYGSVATNLQEVDNDF

SEQ ID NO: 52841 - protein, 31 aa, Artificial Sequence
  Description of Artificial Sequence: Synthetic polypeptide
DEAEIATTNPVATEQYGSVCSPNGPQNRGNA

SEQ ID NO: 52842 - protein, 32 aa, Artificial Sequence
  Description of Artificial Sequence: Synthetic polypeptide
DEEEIRTTNPVATEQYGVVSTGNTQHFGSNQT

SEQ ID NO: 52843 - protein, 31 aa, Artificial Sequence
  Description of Artificial Sequence: Synthetic polypeptide
QEEEIATTNPVATEQYGSVATNLQEVGNDDQ

SEQ ID NO: 52844 - protein, 31 aa, Artificial Sequence
  Description of Artificial Sequence: Synthetic polypeptide
DEEEIRTTNPVATEQYGVVSTGNHQGFFSNQ

SEQ ID NO: 52845 - protein, 32 aa, Artificial Sequence
  Description of Artificial Sequence: Synthetic polypeptide
AEEEIRTTNPVATEQYGSVVTTTNGNLQNGNI

SEQ ID NO: 52846 - protein, 28 aa, Artificial Sequence
  Description of Artificial Sequence: Synthetic peptide
AEHEIACTNPVATEQYGEASENLQRGGR

SEQ ID NO: 52847 - protein, 30 aa, Artificial Sequence
  Description of Artificial Sequence: Synthetic polypeptide
AEEEIRTTNPVATECYGCISINNLPREGNR

SEQ ID NO: 52848 - protein, 31 aa, Artificial Sequence
  Description of Artificial Sequence: Synthetic polypeptide
DEAEIATTNPVATEQYGSVSANLQEDGVNDM

SEQ ID NO: 52849 - protein, 31 aa, Artificial Sequence
  Description of Artificial Sequence: Synthetic polypeptide
DEAEIATTNPVATEQYGSVSANLQDDPNERP

SEQ ID NO: 52850 - protein, 32 aa, Artificial Sequence
  Description of Artificial Sequence: Synthetic polypeptide
DEEEIRTTNPVATEQYGVVSSTNLQGDGEGEE

SEQ ID NO: 52851 - protein, 30 aa, Artificial Sequence
  Description of Artificial Sequence: Synthetic polypeptide
DEAEIATTNPVATEQYGSVSANLDRGETEM

SEQ ID NO: 52852 - protein, 30 aa, Artificial Sequence
  Description of Artificial Sequence: Synthetic polypeptide
DEAEIATTNPVATEQYGSVSANLDNGNNQD

SEQ ID NO: 52853 - protein, 32 aa, Artificial Sequence
  Description of Artificial Sequence: Synthetic polypeptide
DEEEIRTTNPVATEQYGVVSSTNLQGGGGEEQ

SEQ ID NO: 52854 - protein, 32 aa, Artificial Sequence
  Description of Artificial Sequence: Synthetic polypeptide
DEEEIRTTNPVATEQYGVVSSTNLQGGGGEQG

SEQ ID NO: 52855 - protein, 32 aa, Artificial Sequence
  Description of Artificial Sequence: Synthetic polypeptide
DEEEIRTTNPVATEQYGVVSSTNLQGIGQGEQ

SEQ ID NO: 52856 - protein, 33 aa, Artificial Sequence
  Description of Artificial Sequence: Synthetic polypeptide
TEEEIATTNPVATEQYGSTVPSTNMLERPGNNR

SEQ ID NO: 52857 - protein, 31 aa, Artificial Sequence
  Description of Artificial Sequence: Synthetic polypeptide
QEEEIATTNPVATEQYGSVATNLQEAGNPDD

SEQ ID NO: 52858 - protein, 29 aa, Artificial Sequence
  Description of Artificial Sequence: Synthetic peptide
AEEEIRTTNPVATECWGCFSIPDLQRGNR

SEQ ID NO: 52859 - protein, 32 aa, Artificial Sequence
  Description of Artificial Sequence: Synthetic polypeptide
EEEEIRTTNPVATEQYGCVCSTNLQNFGSNQS

SEQ ID NO: 52860 - protein, 32 aa, Artificial Sequence
  Description of Artificial Sequence: Synthetic polypeptide
DEEEIRTTNPVATEQYGVVSTDNGQSGGENIP

SEQ ID NO: 52861 - protein, 32 aa, Artificial Sequence
  Description of Artificial Sequence: Synthetic polypeptide
DEEEIRTTNPVATEQYGVVSTDNMQTNGGNID

SEQ ID NO: 52862 - protein, 31 aa, Artificial Sequence
  Description of Artificial Sequence: Synthetic polypeptide
DEAEIATTNPVATEQYGSVCTNLQGQGDNHQ

SEQ ID NO: 52863 - protein, 33 aa, Artificial Sequence
  Description of Artificial Sequence: Synthetic polypeptide
DEEEIRTTNPVATEQYGVVSTINLQTVNGGNVE

SEQ ID NO: 52864 - protein, 31 aa, Artificial Sequence
  Description of Artificial Sequence: Synthetic polypeptide
DEEEIRTTNPVATEQYGVVSTLLSDGSGNEG

SEQ ID NO: 52865 - protein, 31 aa, Artificial Sequence
  Description of Artificial Sequence: Synthetic polypeptide
AEEEIRTTNPVATEQYGSVVTTSNNQEGEND

SEQ ID NO: 52866 - protein, 32 aa, Artificial Sequence
  Description of Artificial Sequence: Synthetic polypeptide
DEEEIRTTNPVATEQYGVVSTMDTNGQGEGNA

SEQ ID NO: 52867 - protein, 33 aa, Artificial Sequence
  Description of Artificial Sequence: Synthetic polypeptide
DEEEIRTTNPVATEQYGVVSTMNLNVQQDGNED

SEQ ID NO: 52868 - protein, 33 aa, Artificial Sequence
  Description of Artificial Sequence: Synthetic polypeptide
DEEEIRTTNPVATEQYGVVSTMNLTQDDGENQG

SEQ ID NO: 52869 - protein, 28 aa, Artificial Sequence
  Description of Artificial Sequence: Synthetic peptide
AEIEIACTNPVATEQYGEASENLQRGGR

SEQ ID NO: 52870 - protein, 28 aa, Artificial Sequence
  Description of Artificial Sequence: Synthetic peptide
AEKEIACTNPVATEQYGEASENLQRGGR

SEQ ID NO: 52871 - protein, 29 aa, Artificial Sequence
  Description of Artificial Sequence: Synthetic peptide
AEEEIRTTNPVATEEYGCFSSNLQRFGQQ

SEQ ID NO: 52872 - protein, 31 aa, Artificial Sequence
  Description of Artificial Sequence: Synthetic polypeptide
TEEEIATTNPVATEQYGNVSCTVLQGTGGNR

SEQ ID NO: 52873 - protein, 31 aa, Artificial Sequence
  Description of Artificial Sequence: Synthetic polypeptide
TEEEIATTNPVATEQYGNVSCTDLSQGGGNR

SEQ ID NO: 52874 - protein, 33 aa, Artificial Sequence
  Description of Artificial Sequence: Synthetic polypeptide
DEEEIRTTNPVATEQYGVVSTMNLVGEQDGNNM

SEQ ID NO: 52875 - protein, 31 aa, Artificial Sequence
  Description of Artificial Sequence: Synthetic polypeptide
TEEEIATTNPVATEQYGKLVSTNQSQRGGNE

SEQ ID NO: 52876 - protein, 32 aa, Artificial Sequence
  Description of Artificial Sequence: Synthetic polypeptide
DEEEIRTTNPVATEQYGVVSTMNLVNGQGNND

SEQ ID NO: 52877 - protein, 28 aa, Artificial Sequence
  Description of Artificial Sequence: Synthetic peptide
AEEEIRTTNPVATEEYGCKSINLQIGEG

SEQ ID NO: 52878 - protein, 28 aa, Artificial Sequence
  Description of Artificial Sequence: Synthetic peptide
AEKEIGCTNPVATEQYGEASENLQRGGR

SEQ ID NO: 52879 - protein, 33 aa, Artificial Sequence
  Description of Artificial Sequence: Synthetic polypeptide
DEEEIRTTNPVATEQYGVVSTMNLVNVQEGNNM

SEQ ID NO: 52880 - protein, 33 aa, Artificial Sequence
  Description of Artificial Sequence: Synthetic polypeptide
DEEEIRTTNPVATEQYGVVSTMNLVQEGGGNDQ

SEQ ID NO: 52881 - protein, 33 aa, Artificial Sequence
  Description of Artificial Sequence: Synthetic polypeptide
DEEEIRTTNPVATEQYGVVSTMNLVQEGGGNND

SEQ ID NO: 52882 - protein, 32 aa, Artificial Sequence
  Description of Artificial Sequence: Synthetic polypeptide
EEEEIKTTNPVATEQYGSVSTNLMQHSINNRL

SEQ ID NO: 52883 - protein, 30 aa, Artificial Sequence
  Description of Artificial Sequence: Synthetic polypeptide
DEAEIATTNPVATEQYGSVSANLQENDNVS

SEQ ID NO: 52884 - protein, 32 aa, Artificial Sequence
  Description of Artificial Sequence: Synthetic polypeptide
DEEEIRTTNPVATEQYGVVSTMNLGVNGGNIG

SEQ ID NO: 52885 - protein, 28 aa, Artificial Sequence
  Description of Artificial Sequence: Synthetic peptide
AEHEINCTNPVATEQYGEASENLQRGGR

SEQ ID NO: 52886 - protein, 32 aa, Artificial Sequence
  Description of Artificial Sequence: Synthetic polypeptide
DEEEIRTTNPVATEQYGVVSTMLDTGQGGGNQ

SEQ ID NO: 52887 - protein, 32 aa, Artificial Sequence
  Description of Artificial Sequence: Synthetic polypeptide
DEEEIRTTNPVATEQYGVVSTMNEGQGGGNVP

SEQ ID NO: 52888 - protein, 32 aa, Artificial Sequence
  Description of Artificial Sequence: Synthetic polypeptide
DEEEIRTTNPVATEQYGVVSTMNGGQTGGNGG

SEQ ID NO: 52889 - protein, 30 aa, Artificial Sequence
  Description of Artificial Sequence: Synthetic polypeptide
AEEEIRTTNPVATEEYGCFCSWNLQRSGNA

SEQ ID NO: 52890 - protein, 33 aa, Artificial Sequence
  Description of Artificial Sequence: Synthetic polypeptide
DEEEIRTTNPVATEQYGVVSTMNGLQEEGGENV

SEQ ID NO: 52891 - protein, 32 aa, Artificial Sequence
  Description of Artificial Sequence: Synthetic polypeptide
EEEEIRTTNPVATEQYGCVCSTELQRGGSNQA

SEQ ID NO: 52892 - protein, 32 aa, Artificial Sequence
  Description of Artificial Sequence: Synthetic polypeptide
DEEEIRTTNPVATEQYGVVSTMNGQIGGENED

SEQ ID NO: 52893 - protein, 31 aa, Artificial Sequence
  Description of Artificial Sequence: Synthetic polypeptide
QEEEIATTNPVATEQYGSVATNLQNDGNPLF

SEQ ID NO: 52894 - protein, 32 aa, Artificial Sequence
  Description of Artificial Sequence: Synthetic polypeptide
DEEEIRTTNPVATEQYGVVSTMNLDQEQGIGQ

SEQ ID NO: 52895 - protein, 33 aa, Artificial Sequence
  Description of Artificial Sequence: Synthetic polypeptide
DEEEIRTTNPVATEQYGVVSTMNLEQDGGNFGV

SEQ ID NO: 52896 - protein, 31 aa, Artificial Sequence
  Description of Artificial Sequence: Synthetic polypeptide
AEEEIRTTNPVATEQYGSVVTTNSNQQGGNQ

SEQ ID NO: 52897 - protein, 30 aa, Artificial Sequence
  Description of Artificial Sequence: Synthetic polypeptide
AEEEIRTTNPVATEEYGCFSINDDQRGNQR

SEQ ID NO: 52898 - protein, 33 aa, Artificial Sequence
  Description of Artificial Sequence: Synthetic polypeptide
DEEEIRTTNPVATEQYGVVSTMNLEQGEGGGNP

SEQ ID NO: 52899 - protein, 33 aa, Artificial Sequence
  Description of Artificial Sequence: Synthetic polypeptide
DEEEIRTTNPVATEQYGVVSTMNLEQGQGINNT

SEQ ID NO: 52900 - protein, 30 aa, Artificial Sequence
  Description of Artificial Sequence: Synthetic polypeptide
EEEEIRCTNPIATEQYGSVSVNDLMVRENR

SEQ ID NO: 52901 - protein, 33 aa, Artificial Sequence
  Description of Artificial Sequence: Synthetic polypeptide
DEEEIRTTNPVATEQYGVVSTMNLGQEEGGTNV

SEQ ID NO: 52902 - protein, 31 aa, Artificial Sequence
  Description of Artificial Sequence: Synthetic polypeptide
DEAEIATTNPVATEQYGSVSANLQESGDNQM

SEQ ID NO: 52903 - protein, 30 aa, Artificial Sequence
  Description of Artificial Sequence: Synthetic polypeptide
DEAEIATTNPVATEQYGSVSANLQHDNPTP

SEQ ID NO: 52904 - protein, 31 aa, Artificial Sequence
  Description of Artificial Sequence: Synthetic polypeptide
DEAEIATTNPVATEQYGSVSANLQRAEPNHE

SEQ ID NO: 52905 - protein, 31 aa, Artificial Sequence
  Description of Artificial Sequence: Synthetic polypeptide
DEAEIATTNPVATETYGTVSTNLQGDEGDNR

SEQ ID NO: 52906 - protein, 32 aa, Artificial Sequence
  Description of Artificial Sequence: Synthetic polypeptide
DEEEIRTTNPVATEQYGVVCSTNLQHFTSNAL

SEQ ID NO: 52907 - protein, 32 aa, Artificial Sequence
  Description of Artificial Sequence: Synthetic polypeptide
DEEEIRTTNPVATEQYGVVCSTNLQSFGSDFA

SEQ ID NO: 52908 - protein, 32 aa, Artificial Sequence
  Description of Artificial Sequence: Synthetic polypeptide
DEEEIRTTNPVATEQYGVVCSTNLQSFGSDQN

SEQ ID NO: 52909 - protein, 30 aa, Artificial Sequence
  Description of Artificial Sequence: Synthetic polypeptide
QEEEIATTNPVATEQYGSVATALQNGDQRH

SEQ ID NO: 52910 - protein, 30 aa, Artificial Sequence
  Description of Artificial Sequence: Synthetic polypeptide
DEAEIATTNPVATESYGSVATNLQQGNDTA

SEQ ID NO: 52911 - protein, 30 aa, Artificial Sequence
  Description of Artificial Sequence: Synthetic polypeptide
EEEEIRTTNPVATEQYGSVATALQNENFEE

SEQ ID NO: 52912 - protein, 30 aa, Artificial Sequence
  Description of Artificial Sequence: Synthetic polypeptide
DEAEIATTNPVATESYGSVATNLQDGDTRS

SEQ ID NO: 52913 - protein, 31 aa, Artificial Sequence
  Description of Artificial Sequence: Synthetic polypeptide
DEEEIRTTNPVATEQYGVVCSTTEHQRGSEQ

SEQ ID NO: 52914 - protein, 30 aa, Artificial Sequence
  Description of Artificial Sequence: Synthetic polypeptide
TEEEIATTNPVAYEQYGNVSCTHLSQGGNR

SEQ ID NO: 52915 - protein, 31 aa, Artificial Sequence
  Description of Artificial Sequence: Synthetic polypeptide
QEEEIATTNPVATEQYGSVATNDQRPGNESA

SEQ ID NO: 52916 - protein, 33 aa, Artificial Sequence
  Description of Artificial Sequence: Synthetic polypeptide
DEEEIRTTNPVATEQYGVVDSTENHQNFGSNRV

SEQ ID NO: 52917 - protein, 30 aa, Artificial Sequence
  Description of Artificial Sequence: Synthetic polypeptide
QEEEIATTNPVATEQYGSVATNLADNGDNS

SEQ ID NO: 52918 - protein, 29 aa, Artificial Sequence
  Description of Artificial Sequence: Synthetic peptide
DEAEIATTNPVATEQYGSYSTEGHEMGNR

SEQ ID NO: 52919 - protein, 33 aa, Artificial Sequence
  Description of Artificial Sequence: Synthetic polypeptide
DEAEIATTNPVATEQYGSVVSTGNLQDAGENHR

SEQ ID NO: 52920 - protein, 28 aa, Artificial Sequence
  Description of Artificial Sequence: Synthetic peptide
AEGEIAPTNPVASEQYGEVSENLQRGTR

SEQ ID NO: 52921 - protein, 30 aa, Artificial Sequence
  Description of Artificial Sequence: Synthetic polypeptide
EEEEIRTTNPVATEQYGSVATALQENNQFE

SEQ ID NO: 52922 - protein, 31 aa, Artificial Sequence
  Description of Artificial Sequence: Synthetic polypeptide
DEAEIATTNPVATEVYGSVSTNLQQGGGNNH

SEQ ID NO: 52923 - protein, 32 aa, Artificial Sequence
  Description of Artificial Sequence: Synthetic polypeptide
DEEEIRTTNPVATEQYGVVCSTNHNQHSGSNQ

SEQ ID NO: 52924 - protein, 32 aa, Artificial Sequence
  Description of Artificial Sequence: Synthetic polypeptide
AEEEIRTTNPVATEQYGSVVTTTNNLQTGNNA

SEQ ID NO: 52925 - protein, 30 aa, Artificial Sequence
  Description of Artificial Sequence: Synthetic polypeptide
TEEEIATTNPVAYEQYGNVVSCTPLQGGNR

SEQ ID NO: 52926 - protein, 32 aa, Artificial Sequence
  Description of Artificial Sequence: Synthetic polypeptide
DEEEIRTTNPVATEQYGVVCSTELQHGSENQA

SEQ ID NO: 52927 - protein, 32 aa, Artificial Sequence
  Description of Artificial Sequence: Synthetic polypeptide
DEEEIRTTNPVATEQYGVVCSTELQYFGSDRT

SEQ ID NO: 52928 - protein, 32 aa, Artificial Sequence
  Description of Artificial Sequence: Synthetic polypeptide
AEEEIRTTNPVATEQYGSVVTTTNNLQGEGND

SEQ ID NO: 52929 - protein, 32 aa, Artificial Sequence
  Description of Artificial Sequence: Synthetic polypeptide
DEEEIRTTNPVATEQYGVVCSTENLQAFGSDQ

SEQ ID NO: 52930 - protein, 32 aa, Artificial Sequence
  Description of Artificial Sequence: Synthetic polypeptide
DEEEIRTTNPVATEQYGVVCSTENLQNFTSNA

SEQ ID NO: 52931 - protein, 31 aa, Artificial Sequence
  Description of Artificial Sequence: Synthetic polypeptide
DEEEIRTTNPVATEQYGVVCSTEPQNFGSER

SEQ ID NO: 52932 - protein, 31 aa, Artificial Sequence
  Description of Artificial Sequence: Synthetic polypeptide
EEEEIRTTNPVATEQYGSVATALQTNNNEER

SEQ ID NO: 52933 - protein, 31 aa, Artificial Sequence
  Description of Artificial Sequence: Synthetic polypeptide
DEEEIRTTNPVATEQYGVVCSTETQEGNSNQ

SEQ ID NO: 52934 - protein, 31 aa, Artificial Sequence
  Description of Artificial Sequence: Synthetic polypeptide
DEEEIRTTNPVATEQYGVVCSTGAHQGGSNQ

SEQ ID NO: 52935 - protein, 31 aa, Artificial Sequence
  Description of Artificial Sequence: Synthetic polypeptide
DEEEIRTTNPVATEQYGVVCSTGEPQRGSEQ

SEQ ID NO: 52936 - protein, 30 aa, Artificial Sequence
  Description of Artificial Sequence: Synthetic polypeptide
EEEEIRTTNPVATEQYGSVATALQQNNFET

SEQ ID NO: 52937 - protein, 28 aa, Artificial Sequence
  Description of Artificial Sequence: Synthetic peptide
AEGEIAPTNPVASEQYGEVSCNLQRGTR

SEQ ID NO: 52938 - protein, 29 aa, Artificial Sequence
  Description of Artificial Sequence: Synthetic peptide
DEAEIATTNPVATQQYGCVATNLERGDNP

SEQ ID NO: 52939 - protein, 28 aa, Artificial Sequence
  Description of Artificial Sequence: Synthetic peptide
AEGEIAPTNPVASEQYGEVSENLQRGGR

SEQ ID NO: 52940 - protein, 30 aa, Artificial Sequence
  Description of Artificial Sequence: Synthetic polypeptide
AEEEIRTTNPVATEEYGCKSINLQRGENQE

SEQ ID NO: 52941 - protein, 32 aa, Artificial Sequence
  Description of Artificial Sequence: Synthetic polypeptide
DEEEIRTTNPVATEQYGVVPTTNLQISIGNSA

SEQ ID NO: 52942 - protein, 31 aa, Artificial Sequence
  Description of Artificial Sequence: Synthetic polypeptide
EEEEIRTTNPVATEQYGSVATALEQNNNDER

SEQ ID NO: 52943 - protein, 30 aa, Artificial Sequence
  Description of Artificial Sequence: Synthetic polypeptide
AEEEIRTTNPVATEAYGVVVNSENLQTGNI

SEQ ID NO: 52944 - protein, 32 aa, Artificial Sequence
  Description of Artificial Sequence: Synthetic polypeptide
DEAEIATTNPVATEQYGSVSTNLNGNDGMDNR

SEQ ID NO: 52945 - protein, 32 aa, Artificial Sequence
  Description of Artificial Sequence: Synthetic polypeptide
DEAEIATTNPVATEQYGSVSTGNDLQMDGSQR

SEQ ID NO: 52946 - protein, 31 aa, Artificial Sequence
  Description of Artificial Sequence: Synthetic polypeptide
DEAEIATTNPVATEQYGSVSTDLQQGNGNQH

SEQ ID NO: 52947 - protein, 32 aa, Artificial Sequence
  Description of Artificial Sequence: Synthetic polypeptide
DEEEIRTTNPVATEQYGVVSGTNDQEGGGNNA

SEQ ID NO: 52948 - protein, 31 aa, Artificial Sequence
  Description of Artificial Sequence: Synthetic polypeptide
EEEEIRTTNPVATEQYGSTSTNLLQGNQNGE

SEQ ID NO: 52949 - protein, 31 aa, Artificial Sequence
  Description of Artificial Sequence: Synthetic polypeptide
EEEEIRTTNPVATEQYGSTSTLLQQGQTGNE

SEQ ID NO: 52950 - protein, 32 aa, Artificial Sequence
  Description of Artificial Sequence: Synthetic polypeptide
DEEEIRTTNPVATEQYGVVSNNLEQSGENNGM

SEQ ID NO: 52951 - protein, 30 aa, Artificial Sequence
  Description of Artificial Sequence: Synthetic polypeptide
DEAEIATTNPVATEQYGSVSGNLDNGDNNQ

SEQ ID NO: 52952 - protein, 32 aa, Artificial Sequence
  Description of Artificial Sequence: Synthetic polypeptide
DEEEIRTTNPVATEQYGVVSNTELQRFGSEQF

SEQ ID NO: 52953 - protein, 32 aa, Artificial Sequence
  Description of Artificial Sequence: Synthetic polypeptide
DEEEIRTTNPVATEQYGVVSNTNDQQGGGNDN

SEQ ID NO: 52954 - protein, 31 aa, Artificial Sequence
  Description of Artificial Sequence: Synthetic polypeptide
AEEEIRTTNPVATEQYGSVVTTTNLGGIGNG

SEQ ID NO: 52955 - protein, 31 aa, Artificial Sequence
  Description of Artificial Sequence: Synthetic polypeptide
AEEEIRTTNPVATEQYGSVVTTTNIQTGNNE

SEQ ID NO: 52956 - protein, 33 aa, Artificial Sequence
  Description of Artificial Sequence: Synthetic polypeptide
DEEEIRTTNPVATEQYGVVSSTDPNLQMSNGNQ

SEQ ID NO: 52957 - protein, 31 aa, Artificial Sequence
  Description of Artificial Sequence: Synthetic polypeptide
DEEEIRTTNPVATEQYGVVSSTLLNIGMPRD

SEQ ID NO: 52958 - protein, 31 aa, Artificial Sequence
  Description of Artificial Sequence: Synthetic polypeptide
DEAEIATTNPVATEQYGSVSTNLQGEDNNTE

SEQ ID NO: 52959 - protein, 32 aa, Artificial Sequence
  Description of Artificial Sequence: Synthetic polypeptide
DEAEIATTNPVATEQYGSVSVTNPLTDDGNRE

SEQ ID NO: 52960 - protein, 31 aa, Artificial Sequence
  Description of Artificial Sequence: Synthetic polypeptide
DEAEIATTNPVATEQYGSVSTNLQGNEDNHE

SEQ ID NO: 52961 - protein, 34 aa, Artificial Sequence
  Description of Artificial Sequence: Synthetic polypeptide
TEEEIATTNPVATEQYGSVPSCTGNLSQRGENYR

SEQ ID NO: 52962 - protein, 31 aa, Artificial Sequence
  Description of Artificial Sequence: Synthetic polypeptide
DEAEIATTNPVATEQYGSVSVNLQDQGNDPE

SEQ ID NO: 52963 - protein, 30 aa, Artificial Sequence
  Description of Artificial Sequence: Synthetic polypeptide
DEAEIATTNPVATEQYGSVSVANLQDPGDN

SEQ ID NO: 52964 - protein, 30 aa, Artificial Sequence
  Description of Artificial Sequence: Synthetic polypeptide
DEAEIATTNPVATEQYGSVSTTPQERDNEN

SEQ ID NO: 52965 - protein, 33 aa, Artificial Sequence
  Description of Artificial Sequence: Synthetic polypeptide
DEEEIRTTNPVATEQYGVVSEWTNLENEGMNNR

SEQ ID NO: 52966 - protein, 33 aa, Artificial Sequence
  Description of Artificial Sequence: Synthetic polypeptide
DEEEIRTTNPVATEQYGVVSEWTNMLNEQAMNR

SEQ ID NO: 52967 - protein, 32 aa, Artificial Sequence
  Description of Artificial Sequence: Synthetic polypeptide
DEEEIRTTNPVATEQYGVVSGSNGLGQGGGND

SEQ ID NO: 52968 - protein, 31 aa, Artificial Sequence
  Description of Artificial Sequence: Synthetic polypeptide
DEAEIATTNPVATEQYGSVSTPNLQNRTEPD

SEQ ID NO: 52969 - protein, 32 aa, Artificial Sequence
  Description of Artificial Sequence: Synthetic polypeptide
AEEEIRTTNPVATEAYGVVSVSVTNLQNGNQE

SEQ ID NO: 52970 - protein, 31 aa, Artificial Sequence
  Description of Artificial Sequence: Synthetic polypeptide
DEAEIATTNPVATEQYGSVSTNPQNGDNNSD

SEQ ID NO: 52971 - protein, 31 aa, Artificial Sequence
  Description of Artificial Sequence: Synthetic polypeptide
QEEEIATTNPVATEQYGSVATNLPERGDNDQ

SEQ ID NO: 52972 - protein, 32 aa, Artificial Sequence
  Description of Artificial Sequence: Synthetic polypeptide
AEEEIRTTNPVATEQYGSVVTTTNLQDNGNDN

SEQ ID NO: 52973 - protein, 30 aa, Artificial Sequence
  Description of Artificial Sequence: Synthetic polypeptide
QEEEIATTNPVATEQYGSVATNLQAEPGRD

SEQ ID NO: 52974 - protein, 32 aa, Artificial Sequence
  Description of Artificial Sequence: Synthetic polypeptide
DEAEIATTNPVATEQYGSVSTNLQNREPNPEQ

SEQ ID NO: 52975 - protein, 31 aa, Artificial Sequence
  Description of Artificial Sequence: Synthetic polypeptide
QEEEIATTNPVATEQYGSVATNLQAVPGNHH

SEQ ID NO: 52976 - protein, 31 aa, Artificial Sequence
  Description of Artificial Sequence: Synthetic polypeptide
QEEEIATTNPVATEQYGSVATNLQDAGPNDA

SEQ ID NO: 52977 - protein, 31 aa, Artificial Sequence
  Description of Artificial Sequence: Synthetic polypeptide
EEEEIRTTNPVATEQYGSTSTTLLQQGNQGE

SEQ ID NO: 52978 - protein, 33 aa, Artificial Sequence
  Description of Artificial Sequence: Synthetic polypeptide
DEEEIRTTNPVATEQYGVVSTMNLVQIGNGNNM

SEQ ID NO: 52979 - protein, 28 aa, Artificial Sequence
  Description of Artificial Sequence: Synthetic peptide
AELEIACTNPVATEQYGEASENLQRGGR

SEQ ID NO: 52980 - protein, 31 aa, Artificial Sequence
  Description of Artificial Sequence: Synthetic polypeptide
AEEEIRTTNPVATEQYGSVVTTNNQTGNNVV

SEQ ID NO: 52981 - protein, 30 aa, Artificial Sequence
  Description of Artificial Sequence: Synthetic polypeptide
DEAEIATTNPVATEQYGSVATNDQGGNPDF

SEQ ID NO: 52982 - protein, 29 aa, Artificial Sequence
  Description of Artificial Sequence: Synthetic peptide
DEAEIATTNPVATEQYGSVATNDQGGEAH

SEQ ID NO: 52983 - protein, 30 aa, Artificial Sequence
  Description of Artificial Sequence: Synthetic polypeptide
DEAEIATTNPVATEQYGSVATNDQEGTNES

SEQ ID NO: 52984 - protein, 31 aa, Artificial Sequence
  Description of Artificial Sequence: Synthetic polypeptide
DEAEIATTNPVATEQYGSVATNDQDEGDNRQ

SEQ ID NO: 52985 - protein, 31 aa, Artificial Sequence
  Description of Artificial Sequence: Synthetic polypeptide
DEAEIATTNPVATEQYGSVATGNLQNRNERH

SEQ ID NO: 52986 - protein, 33 aa, Artificial Sequence
  Description of Artificial Sequence: Synthetic polypeptide
DEEEIRTTNPVATEQYGVVSVSTNNLNQQQNMG

SEQ ID NO: 52987 - protein, 31 aa, Artificial Sequence
  Description of Artificial Sequence: Synthetic polypeptide
DEAEIATTNPVATEQYGSVATGNLQDNGTNV

SEQ ID NO: 52988 - protein, 32 aa, Artificial Sequence
  Description of Artificial Sequence: Synthetic polypeptide
DEEEIRTTNPVATEQYGVVSVTNLNNLGQNLG

SEQ ID NO: 52989 - protein, 31 aa, Artificial Sequence
  Description of Artificial Sequence: Synthetic polypeptide
AEEEIRTTNPVATEEYGCVFCSINDLQRGNE

SEQ ID NO: 52990 - protein, 30 aa, Artificial Sequence
  Description of Artificial Sequence: Synthetic polypeptide
DEAEIATTNPVATEQYGSVATAPQRGNPES

SEQ ID NO: 52991 - protein, 30 aa, Artificial Sequence
  Description of Artificial Sequence: Synthetic polypeptide
DEAEIATTNPVATEQYGSVATALQRPENMD

SEQ ID NO: 52992 - protein, 30 aa, Artificial Sequence
  Description of Artificial Sequence: Synthetic polypeptide
DEAEIATTNPVATEQYGSVAQNPQNRGNDD

SEQ ID NO: 52993 - protein, 32 aa, Artificial Sequence
  Description of Artificial Sequence: Synthetic polypeptide
AEEEIRTTNPVATEEYGCVFYSINDLQDRGNR

SEQ ID NO: 52994 - protein, 30 aa, Artificial Sequence
  Description of Artificial Sequence: Synthetic polypeptide
EDEEICTTNPVATEQYGVVSTTNLQDGQNS

SEQ ID NO: 52995 - protein, 30 aa, Artificial Sequence
  Description of Artificial Sequence: Synthetic polypeptide
EDEEICTTNPVATEQYGVVSTNLQLGGNVS

SEQ ID NO: 52996 - protein, 30 aa, Artificial Sequence
  Description of Artificial Sequence: Synthetic polypeptide
DEAEIATTNPVATEQYGSVATNDQMGENDQ

SEQ ID NO: 52997 - protein, 32 aa, Artificial Sequence
  Description of Artificial Sequence: Synthetic polypeptide
AEEEIRTTNPVATEQYGSVVTTNNLQQEGNEA

SEQ ID NO: 52998 - protein, 29 aa, Artificial Sequence
  Description of Artificial Sequence: Synthetic peptide
AEEEIRTTNPVATEEYGCSSWNHQNGSNR

SEQ ID NO: 52999 - protein, 31 aa, Artificial Sequence
  Description of Artificial Sequence: Synthetic polypeptide
DEAEIATTNPVATEQYGSVATNDQRDGNPES

SEQ ID NO: 53000 - protein, 29 aa, Artificial Sequence
  Description of Artificial Sequence: Synthetic peptide
AEEEIRTTNPVATEEYGCSSSNLQENGNQ

SEQ ID NO: 53001 - protein, 31 aa, Artificial Sequence
  Description of Artificial Sequence: Synthetic polypeptide
DEAEIATTNPVATEQYGSVATNLERGDENED

SEQ ID NO: 53002 - protein, 31 aa, Artificial Sequence
  Description of Artificial Sequence: Synthetic polypeptide
DEAEIATTNPVATEQYGSVATNLEEARGNDA

SEQ ID NO: 53003 - protein, 29 aa, Artificial Sequence
  Description of Artificial Sequence: Synthetic peptide
DEAEIATTNPVATEQYGSVATNLEDGGDM

SEQ ID NO: 53004 - protein, 30 aa, Artificial Sequence
  Description of Artificial Sequence: Synthetic polypeptide
DEAEIATTNPVATEQYGSVATNLDADDGND

SEQ ID NO: 53005 - protein, 29 aa, Artificial Sequence
  Description of Artificial Sequence: Synthetic peptide
DEAEIATTNPVATEQYGSVATNLADGPDE

SEQ ID NO: 53006 - protein, 34 aa, Artificial Sequence
  Description of Artificial Sequence: Synthetic polypeptide
DEEEIRTTNPVATEQYGVVSVSTNLNNNQQGSNM

SEQ ID NO: 53007 - protein, 31 aa, Artificial Sequence
  Description of Artificial Sequence: Synthetic polypeptide
EDEEIRTTNPVATEQYGVVSTNLQDNGDNSA

SEQ ID NO: 53008 - protein, 31 aa, Artificial Sequence
  Description of Artificial Sequence: Synthetic polypeptide
EDEEIRTTNPVATEQYGVVSTNLQDGDNQSE

SEQ ID NO: 53009 - protein, 30 aa, Artificial Sequence
  Description of Artificial Sequence: Synthetic polypeptide
DEAEIATTNPVATEQYGSVATNLAAQGNEH

SEQ ID NO: 53010 - protein, 29 aa, Artificial Sequence
  Description of Artificial Sequence: Synthetic peptide
TEECIRTTNPVAYEQYGTVSTNDSGGLNR

SEQ ID NO: 53011 - protein, 30 aa, Artificial Sequence
  Description of Artificial Sequence: Synthetic polypeptide
DEAEIATTNPVATEQYGSVATNGEQAGNES

SEQ ID NO: 53012 - protein, 30 aa, Artificial Sequence
  Description of Artificial Sequence: Synthetic polypeptide
DEAEIATTNPVATEQYGSVATNDQSGDNSQ

SEQ ID NO: 53013 - protein, 31 aa, Artificial Sequence
  Description of Artificial Sequence: Synthetic polypeptide
DEAEIATTNPVATEQYGSVATNDQRGPNEQM

SEQ ID NO: 53014 - protein, 31 aa, Artificial Sequence
  Description of Artificial Sequence: Synthetic polypeptide
DEAEIATTNPVATEQYGSVATNDQRGPNDMQ

SEQ ID NO: 53015 - protein, 31 aa, Artificial Sequence
  Description of Artificial Sequence: Synthetic polypeptide
QEEEIATTNPVATEQYGSVSANLQAEGPNDH

SEQ ID NO: 53016 - protein, 30 aa, Artificial Sequence
  Description of Artificial Sequence: Synthetic polypeptide
DEAEIATTNPVATEQYGSVATNLERGQQDA

SEQ ID NO: 53017 - protein, 31 aa, Artificial Sequence
  Description of Artificial Sequence: Synthetic polypeptide
QEEEIATTNPVATEQYGSVSANLQEAGNVDD

SEQ ID NO: 53018 - protein, 32 aa, Artificial Sequence
  Description of Artificial Sequence: Synthetic polypeptide
AEEEIRTTNPVATEQYGSVVTTNNLQNEGNGT

SEQ ID NO: 53019 - protein, 29 aa, Artificial Sequence
  Description of Artificial Sequence: Synthetic peptide
DEAEIATTNPVATEQYGSVAMNDQGGNQV

SEQ ID NO: 53020 - protein, 30 aa, Artificial Sequence
  Description of Artificial Sequence: Synthetic polypeptide
DEEEIRTTNPVATEQYGVVTTNSDERETNI

SEQ ID NO: 53021 - protein, 33 aa, Artificial Sequence
  Description of Artificial Sequence: Synthetic polypeptide
DEEEIRTTNPVATEQYGVVTVSSTNLLQYGNEE

SEQ ID NO: 53022 - protein, 30 aa, Artificial Sequence
  Description of Artificial Sequence: Synthetic polypeptide
DTTEIRTTNPVATEQYGVVNSTQLQAGNQQ

SEQ ID NO: 53023 - protein, 33 aa, Artificial Sequence
  Description of Artificial Sequence: Synthetic polypeptide
DEEEIRTTNPVATEQYGVVTVSTNLLQYGNNES

SEQ ID NO: 53024 - protein, 30 aa, Artificial Sequence
  Description of Artificial Sequence: Synthetic polypeptide
AEEEIRTTNPVATEEYGQMTSIMNLQRGNQ

SEQ ID NO: 53025 - protein, 31 aa, Artificial Sequence
  Description of Artificial Sequence: Synthetic polypeptide
DTTEIRTTNPVATEQYGSVSVTNTNLQLGMA

SEQ ID NO: 53026 - protein, 33 aa, Artificial Sequence
  Description of Artificial Sequence: Synthetic polypeptide
DEEEIRTTNPVATEQYGVVYTCNLTQRGNDPEQ

SEQ ID NO: 53027 - protein, 31 aa, Artificial Sequence
  Description of Artificial Sequence: Synthetic polypeptide
DTTEIRTTNPVATEQYGSVSVTNTLDQLGGA

SEQ ID NO: 53028 - protein, 32 aa, Artificial Sequence
  Description of Artificial Sequence: Synthetic polypeptide
DEAEIATTNPVATEQYGSVAITNLNAREGNRN

SEQ ID NO: 53029 - protein, 30 aa, Artificial Sequence
  Description of Artificial Sequence: Synthetic polypeptide
DEAEIATTNPVATEQYGSVAITNLERGPFA

SEQ ID NO: 53030 - protein, 30 aa, Artificial Sequence
  Description of Artificial Sequence: Synthetic polypeptide
DEAEIATTNPVATEQYGSVAITNLERAENQ

SEQ ID NO: 53031 - protein, 31 aa, Artificial Sequence
  Description of Artificial Sequence: Synthetic polypeptide
DTTEIRTTNPVATEQYGSVSTTTTLQLGNMA

SEQ ID NO: 53032 - protein, 34 aa, Artificial Sequence
  Description of Artificial Sequence: Synthetic polypeptide
DEEEIRTTNPVATEQYGWVPSCTGNSSQRGGNRA

SEQ ID NO: 53033 - protein, 30 aa, Artificial Sequence
  Description of Artificial Sequence: Synthetic polypeptide
DTTEIRTTNPVATEQYGSVSTTTLDQLGEA

SEQ ID NO: 53034 - protein, 30 aa, Artificial Sequence
  Description of Artificial Sequence: Synthetic polypeptide
DTTEIRTTNPVATEQYGVVNSTQLQYGNTQ

SEQ ID NO: 53035 - protein, 32 aa, Artificial Sequence
  Description of Artificial Sequence: Synthetic polypeptide
DTWEIRTTNPVATEQYGSVQSVNLSQRGGNQE

SEQ ID NO: 53036 - protein, 30 aa, Artificial Sequence
  Description of Artificial Sequence: Synthetic polypeptide
DEAEIATTNPVATEQYGSVAMNDQRGDNDQ

SEQ ID NO: 53037 - protein, 30 aa, Artificial Sequence
  Description of Artificial Sequence: Synthetic polypeptide
DEAEIATTNPVATEQYGSVAMNLQDPGIDR

SEQ ID NO: 53038 - protein, 30 aa, Artificial Sequence
  Description of Artificial Sequence: Synthetic polypeptide
DEAEIATTNPVATEQYGSVAPNLQEAGNDF

SEQ ID NO: 53039 - protein, 31 aa, Artificial Sequence
  Description of Artificial Sequence: Synthetic polypeptide
QEEEIATTNPVATEQYGSVSANLQENGENED

SEQ ID NO: 53040 - protein, 30 aa, Artificial Sequence
  Description of Artificial Sequence: Synthetic polypeptide
DTTEIRTTNPVATEQYGVVNSVTVLQGGNQ

SEQ ID NO: 53041 - protein, 30 aa, Artificial Sequence
  Description of Artificial Sequence: Synthetic polypeptide
TEECIRTTNPVATEQYGSVSWNEDSGGLNR

SEQ ID NO: 53042 - protein, 30 aa, Artificial Sequence
  Description of Artificial Sequence: Synthetic polypeptide
TEECIRTTNPVATEQYGSVSWNDNSGLGNR

SEQ ID NO: 53043 - protein, 31 aa, Artificial Sequence
  Description of Artificial Sequence: Synthetic polypeptide
QEEEIATTNPVATEQYGSVSANLQENGMDRN

SEQ ID NO: 53044 - protein, 30 aa, Artificial Sequence
  Description of Artificial Sequence: Synthetic polypeptide
TEECIRTTNPVATEQYGSVSTTNLAYLSNQ

SEQ ID NO: 53045 - protein, 32 aa, Artificial Sequence
  Description of Artificial Sequence: Synthetic polypeptide
AEEEIRTTNPVATEQYGSVVTTNNLQEGTNLT

SEQ ID NO: 53046 - protein, 30 aa, Artificial Sequence
  Description of Artificial Sequence: Synthetic polypeptide
DTTEIRTTNPVATEQYGVVNSTVQLQAGNQ

SEQ ID NO: 53047 - protein, 31 aa, Artificial Sequence
  Description of Artificial Sequence: Synthetic polypeptide
DTTEIRTTNPVATEQYGVVNSTVNLQGGNQD

SEQ ID NO: 53048 - protein, 31 aa, Artificial Sequence
  Description of Artificial Sequence: Synthetic polypeptide
DEEEIRTTNPVATEQYGVVSWNHQFFGSNDG

SEQ ID NO: 53049 - protein, 30 aa, Artificial Sequence
  Description of Artificial Sequence: Synthetic polypeptide
DEEEIRTTNPVATEQYGVVSWNHQYFGSEQ

SEQ ID NO: 53050 - protein, 32 aa, Artificial Sequence
  Description of Artificial Sequence: Synthetic polypeptide
AEEEIRTTNPVATEQYGSVVTTNNLQEGNNLT

SEQ ID NO: 53051 - protein, 31 aa, Artificial Sequence
  Description of Artificial Sequence: Synthetic polypeptide
DEAEIATTNPVATEQYGSVAMNLTTRGNNPR

SEQ ID NO: 53052 - protein, 31 aa, Artificial Sequence
  Description of Artificial Sequence: Synthetic polypeptide
DEAEIATTNPVATEQYGSVAMNLQERGTNDT

SEQ ID NO: 53053 - protein, 32 aa, Artificial Sequence
  Description of Artificial Sequence: Synthetic polypeptide
DEEEIRTTNPVATEQYGVVTSTNLSQEAQNGG

SEQ ID NO: 53054 - protein, 30 aa, Artificial Sequence
  Description of Artificial Sequence: Synthetic polypeptide
DEAEIRTTNPVATEHYGSVIVENLQHGNMM

SEQ ID NO: 53055 - protein, 32 aa, Artificial Sequence
  Description of Artificial Sequence: Synthetic polypeptide
DEAEIATTNPVATEQYGSVATNLERPGDNPRA

SEQ ID NO: 53056 - protein, 30 aa, Artificial Sequence
  Description of Artificial Sequence: Synthetic polypeptide
DEAEIATTNPVATEQYGSVATNLERPNQAD

SEQ ID NO: 53057 - protein, 31 aa, Artificial Sequence
  Description of Artificial Sequence: Synthetic polypeptide
DEEEIRTTNPVATEQYGVVSTQNVGVGGNGQ

SEQ ID NO: 53058 - protein, 31 aa, Artificial Sequence
  Description of Artificial Sequence: Synthetic polypeptide
DEAEIATTNPVATEQYGSVATNLTTRDGNDN

SEQ ID NO: 53059 - protein, 30 aa, Artificial Sequence
  Description of Artificial Sequence: Synthetic polypeptide
DEAEIATTNPVATEQYGSVATNLTTEGNLV

SEQ ID NO: 53060 - protein, 31 aa, Artificial Sequence
  Description of Artificial Sequence: Synthetic polypeptide
DEAEIATTNPVATEQYGSVATNLTRDGMNDL

SEQ ID NO: 53061 - protein, 31 aa, Artificial Sequence
  Description of Artificial Sequence: Synthetic polypeptide
DEAEIATTNPVATEQYGSVATNLTQGDGNTD

SEQ ID NO: 53062 - protein, 33 aa, Artificial Sequence
  Description of Artificial Sequence: Synthetic polypeptide
DEEEIRTTNPVATEQYGVVSTSNLQTGSGNDGN

SEQ ID NO: 53063 - protein, 33 aa, Artificial Sequence
  Description of Artificial Sequence: Synthetic polypeptide
DEEEIRTTNPVATEQYGVVSTSNLQTQGGNGGD

SEQ ID NO: 53064 - protein, 31 aa, Artificial Sequence
  Description of Artificial Sequence: Synthetic polypeptide
TEEEIATTNPVATEAYGKVSTYELSQRGNNR

SEQ ID NO: 53065 - protein, 30 aa, Artificial Sequence
  Description of Artificial Sequence: Synthetic polypeptide
DEAEIATTNPVATEQYGSVATNLTDGNNDM

SEQ ID NO: 53066 - protein, 30 aa, Artificial Sequence
  Description of Artificial Sequence: Synthetic polypeptide
DEAEIATTNPVATEQYGSVATNLTDDGNLM

SEQ ID NO: 53067 - protein, 33 aa, Artificial Sequence
  Description of Artificial Sequence: Synthetic polypeptide
DEEEIRTTNPVATEQYGVVSTSNLQVGSGNNGN

SEQ ID NO: 53068 - protein, 30 aa, Artificial Sequence
  Description of Artificial Sequence: Synthetic polypeptide
DEAEIATTNPVATEQYGSVATNLQVPGDVQ

SEQ ID NO: 53069 - protein, 31 aa, Artificial Sequence
  Description of Artificial Sequence: Synthetic polypeptide
QEEEIATTNPVATEQYGSVATNPLEERGDNT

SEQ ID NO: 53070 - protein, 30 aa, Artificial Sequence
  Description of Artificial Sequence: Synthetic polypeptide
DEAEIATTNPVATEQYGSVATNLQVHGDEV

SEQ ID NO: 53071 - protein, 29 aa, Artificial Sequence
  Description of Artificial Sequence: Synthetic peptide
DEAEIATTNPVATEQYGSVATNLQVHDVS

SEQ ID NO: 53072 - protein, 31 aa, Artificial Sequence
  Description of Artificial Sequence: Synthetic polypeptide
DEAEIATTNPVATEQYGSVATNTQQRGNEPL

SEQ ID NO: 53073 - protein, 33 aa, Artificial Sequence
  Description of Artificial Sequence: Synthetic polypeptide
QEEEIATTNPVATEQYGSVATSNLVQRPGENDR

SEQ ID NO: 53074 - protein, 31 aa, Artificial Sequence
  Description of Artificial Sequence: Synthetic polypeptide
DEAEIATTNPVATEQYGSVATNVLERDGDND

SEQ ID NO: 53075 - protein, 30 aa, Artificial Sequence
  Description of Artificial Sequence: Synthetic polypeptide
EEEEIATTNPVATEQYGSVATNLQAPNPEE

SEQ ID NO: 53076 - protein, 31 aa, Artificial Sequence
  Description of Artificial Sequence: Synthetic polypeptide
QEEEIATTNPVATEQYGSVATNLQRNPNDYM

SEQ ID NO: 53077 - protein, 33 aa, Artificial Sequence
  Description of Artificial Sequence: Synthetic polypeptide
DEEEIRTTNPVATEQYGVVSTMNLVQQGGGNND

SEQ ID NO: 53078 - protein, 32 aa, Artificial Sequence
  Description of Artificial Sequence: Synthetic polypeptide
DEEEIRTTNPVATEQYGVVSTMTNFGQGGGNQ

SEQ ID NO: 53079 - protein, 31 aa, Artificial Sequence
  Description of Artificial Sequence: Synthetic polypeptide
AEEEIRTTNPVATEEYGCSCSAGNLQRGSNQ

SEQ ID NO: 53080 - protein, 32 aa, Artificial Sequence
  Description of Artificial Sequence: Synthetic polypeptide
DEEEIRTTNPVATEQYGVVSTNGLVRGSDTTP

SEQ ID NO: 53081 - protein, 32 aa, Artificial Sequence
  Description of Artificial Sequence: Synthetic polypeptide
DEEEIRTTNPVATEQYGVVSTNGVQQGGGNED

SEQ ID NO: 53082 - protein, 31 aa, Artificial Sequence
  Description of Artificial Sequence: Synthetic polypeptide
DEEEIRTTNPVATEQYGVVSTNLAFFNSNQE

SEQ ID NO: 53083 - protein, 31 aa, Artificial Sequence
  Description of Artificial Sequence: Synthetic polypeptide
TEEEIATTNPVATEQYGCVSVTGLSQGGTNR

SEQ ID NO: 53084 - protein, 30 aa, Artificial Sequence
  Description of Artificial Sequence: Synthetic polypeptide
DEAEIATTNPVATEQYGSVATVNLERGTES

SEQ ID NO: 53085 - protein, 33 aa, Artificial Sequence
  Description of Artificial Sequence: Synthetic polypeptide
DEEEIRTTNPVATEQYGVVSTPNNLDQIGFGNQ

SEQ ID NO: 53086 - protein, 31 aa, Artificial Sequence
  Description of Artificial Sequence: Synthetic polypeptide
DEAEIATTNPVATEQYGSVATPNLQNRNEDR

SEQ ID NO: 53087 - protein, 30 aa, Artificial Sequence
  Description of Artificial Sequence: Synthetic polypeptide
DEAEIATTNPVATEQYGSVATPLQRPNMDI

SEQ ID NO: 53088 - protein, 32 aa, Artificial Sequence
  Description of Artificial Sequence: Synthetic polypeptide
DEEEIRTTNPVATEQYGVVSTQLNQNGSGNEN

SEQ ID NO: 53089 - protein, 31 aa, Artificial Sequence
  Description of Artificial Sequence: Synthetic polypeptide
EEEEIATTNPVATEQYGSVATNLQATGNPEE

SEQ ID NO: 53090 - protein, 32 aa, Artificial Sequence
  Description of Artificial Sequence: Synthetic polypeptide
DEEEIRTTNPVATEQYGVVSTQLSQGSGNVED

SEQ ID NO: 53091 - protein, 32 aa, Artificial Sequence
  Description of Artificial Sequence: Synthetic polypeptide
TEEEIATTNPVATEPYGSTSTNLSQREGGNNR

SEQ ID NO: 53092 - protein, 32 aa, Artificial Sequence
  Description of Artificial Sequence: Synthetic polypeptide
DEAEIATTNPVATEQYGSVATNLERPGENDRE

SEQ ID NO: 53093 - protein, 30 aa, Artificial Sequence
  Description of Artificial Sequence: Synthetic polypeptide
EEEEIACTNPVATEQYGSVATNLQGGNPEN

SEQ ID NO: 53094 - protein, 32 aa, Artificial Sequence
  Description of Artificial Sequence: Synthetic polypeptide
DEEEIRTTNPVATEQYGVVSTSTLGQIEGNTS

SEQ ID NO: 53095 - protein, 30 aa, Artificial Sequence
  Description of Artificial Sequence: Synthetic polypeptide
DEAEIATTNPVATEQYGSVATNLQGDENSE

SEQ ID NO: 53096 - protein, 30 aa, Artificial Sequence
  Description of Artificial Sequence: Synthetic polypeptide
DEAEIATTNPVATEQYGSVATNLQGDDQRN

SEQ ID NO: 53097 - protein, 31 aa, Artificial Sequence
  Description of Artificial Sequence: Synthetic polypeptide
DEAEIATTNPVATEQYGSVATNLQEAGNNDN

SEQ ID NO: 53098 - protein, 32 aa, Artificial Sequence
  Description of Artificial Sequence: Synthetic polypeptide
EEAEIRTTNPVATEQYGSVSTNLQQGNEGNAN

SEQ ID NO: 53099 - protein, 29 aa, Artificial Sequence
  Description of Artificial Sequence: Synthetic peptide
DEAEIATTNPVATEQYGSVATNLQDQEFP

SEQ ID NO: 53100 - protein, 30 aa, Artificial Sequence
  Description of Artificial Sequence: Synthetic polypeptide
DEAEIATTNPVATEQYGSVATNLQDGGDVS

SEQ ID NO: 53101 - protein, 30 aa, Artificial Sequence
  Description of Artificial Sequence: Synthetic polypeptide
DEAEIATTNPVATEQYGSVATNLQAQAPND

SEQ ID NO: 53102 - protein, 31 aa, Artificial Sequence
  Description of Artificial Sequence: Synthetic polypeptide
EDEEIRTTNPVATEQYGVVSTTNLQNDGDNS

SEQ ID NO: 53103 - protein, 30 aa, Artificial Sequence
  Description of Artificial Sequence: Synthetic polypeptide
DEAEIATTNPVATEQYGSVATNLQAMPNNH

SEQ ID NO: 53104 - protein, 30 aa, Artificial Sequence
  Description of Artificial Sequence: Synthetic polypeptide
DEAEIATTNPVATEQYGSVATNLQAEHNDE

SEQ ID NO: 53105 - protein, 33 aa, Artificial Sequence
  Description of Artificial Sequence: Synthetic polypeptide
DEEEIRTTNPVATEQYGVVSTVNLEQVVIGQNN

SEQ ID NO: 53106 - protein, 32 aa, Artificial Sequence
  Description of Artificial Sequence: Synthetic polypeptide
AEEEIRTTNPVATEQYGSVVTTNNLQTEGNTG

SEQ ID NO: 53107 - protein, 32 aa, Artificial Sequence
  Description of Artificial Sequence: Synthetic polypeptide
AEEEIRTTNPVATEQYGSVVTTNNLQTEEGNG

SEQ ID NO: 53108 - protein, 30 aa, Artificial Sequence
  Description of Artificial Sequence: Synthetic polypeptide
DEAEIATTNPVATEQYGSVATNLETGNQDS

SEQ ID NO: 53109 - protein, 33 aa, Artificial Sequence
  Description of Artificial Sequence: Synthetic polypeptide
DEEEIRTTNPVATEQYGVVSTVNLQAEGGNIEG

SEQ ID NO: 53110 - protein, 31 aa, Artificial Sequence
  Description of Artificial Sequence: Synthetic polypeptide
DEAEIATTNPVATEQYGSVATNLQGDGENDY

SEQ ID NO: 53111 - protein, 31 aa, Artificial Sequence
  Description of Artificial Sequence: Synthetic polypeptide
DEAEIATTNPVATEQYGSVATNLQTDDGNDQ

SEQ ID NO: 53112 - protein, 30 aa, Artificial Sequence
  Description of Artificial Sequence: Synthetic polypeptide
DEAEIATTNPVATEQYGSVATNLQGEEERI

SEQ ID NO: 53113 - protein, 29 aa, Artificial Sequence
  Description of Artificial Sequence: Synthetic peptide
DEAEIATTNPVATEQYGSVATNLQGPDPQ

SEQ ID NO: 53114 - protein, 32 aa, Artificial Sequence
  Description of Artificial Sequence: Synthetic polypeptide
DEEEIRTTNPVATEQYGVVSTSTLNQNGGNTS

SEQ ID NO: 53115 - protein, 29 aa, Artificial Sequence
  Description of Artificial Sequence: Synthetic peptide
DEAEIATTNPVATEQYGSVATNLQSPSVQ

SEQ ID NO: 53116 - protein, 32 aa, Artificial Sequence
  Description of Artificial Sequence: Synthetic polypeptide
DEAEIATTNPVATEQYGSVATNLQRPAENDRN

SEQ ID NO: 53117 - protein, 31 aa, Artificial Sequence
  Description of Artificial Sequence: Synthetic polypeptide
DEAEIATTNPVATEQYGSVATNLQRNHSDRN

SEQ ID NO: 53118 - protein, 30 aa, Artificial Sequence
  Description of Artificial Sequence: Synthetic polypeptide
DEAEIATTNPVATEQYGSVATNLQREHPSE

SEQ ID NO: 53119 - protein, 31 aa, Artificial Sequence
  Description of Artificial Sequence: Synthetic polypeptide
DEAEIATTNPVATEQYGSVATNLQRAEMNVE

SEQ ID NO: 53120 - protein, 31 aa, Artificial Sequence
  Description of Artificial Sequence: Synthetic polypeptide
DEAEIATTNPVATEQYGSVATNLQRAEMGDS

SEQ ID NO: 53121 - protein, 30 aa, Artificial Sequence
  Description of Artificial Sequence: Synthetic polypeptide
TEEEIACTNPVATEPYGSVATNLQPGVNMR

SEQ ID NO: 53122 - protein, 32 aa, Artificial Sequence
  Description of Artificial Sequence: Synthetic polypeptide
EECEIATTNPVATEQYGSVSTDNDLQFDNGNR

SEQ ID NO: 53123 - protein, 30 aa, Artificial Sequence
  Description of Artificial Sequence: Synthetic polypeptide
EEAEIRTTNPVAYEQYGTVSTNLQHDGNNA

SEQ ID NO: 53124 - protein, 33 aa, Artificial Sequence
  Description of Artificial Sequence: Synthetic polypeptide
DEEEIRTTNPVATEQYGVVSTTNLGQDDGENEQ

SEQ ID NO: 53125 - protein, 31 aa, Artificial Sequence
  Description of Artificial Sequence: Synthetic polypeptide
DEAEIATTNPVATEQYGSVATNLQNRGEEQA

SEQ ID NO: 53126 - protein, 30 aa, Artificial Sequence
  Description of Artificial Sequence: Synthetic polypeptide
AEEEIRTTNPVATEEYGCSSINHQRGSNRS

SEQ ID NO: 53127 - protein, 31 aa, Artificial Sequence
  Description of Artificial Sequence: Synthetic polypeptide
DEAEIATTNPVATEQYGSVATNLQNGDDNEA

SEQ ID NO: 53128 - protein, 31 aa, Artificial Sequence
  Description of Artificial Sequence: Synthetic polypeptide
DEAEIATTNPVATEQYGSVATNLQMVGEERE

SEQ ID NO: 53129 - protein, 31 aa, Artificial Sequence
  Description of Artificial Sequence: Synthetic polypeptide
DEAEIATTNPVATEQYGSVATNLQGNQEGNP

SEQ ID NO: 53130 - protein, 33 aa, Artificial Sequence
  Description of Artificial Sequence: Synthetic polypeptide
DEAEIRTTNPVATEHYGSVSTNLNQGDTGGNAR

SEQ ID NO: 53131 - protein, 30 aa, Artificial Sequence
  Description of Artificial Sequence: Synthetic polypeptide
DETEIRTTNPVAVEQYGSVISTNGQERNIQ

SEQ ID NO: 53132 - protein, 32 aa, Artificial Sequence
  Description of Artificial Sequence: Synthetic polypeptide
DEAEIRTTNPVATEHYGSVSTNLQANGDNDDD

SEQ ID NO: 53133 - protein, 31 aa, Artificial Sequence
  Description of Artificial Sequence: Synthetic polypeptide
DEAEIRTTNPVATEQYGSVSNTNLENTGDGQ

SEQ ID NO: 53134 - protein, 33 aa, Artificial Sequence
  Description of Artificial Sequence: Synthetic polypeptide
AEEEIRTTNPVATEQYGSVVVSATNLQQGENNE

SEQ ID NO: 53135 - protein, 33 aa, Artificial Sequence
  Description of Artificial Sequence: Synthetic polypeptide
DEEEIRTTNPVATEQYGSVSTYNDGDQNQGNGQ

SEQ ID NO: 53136 - protein, 32 aa, Artificial Sequence
  Description of Artificial Sequence: Synthetic polypeptide
FEEEIRTTNPVATEQYGSVSTPNLQTQVADRN

SEQ ID NO: 53137 - protein, 33 aa, Artificial Sequence
  Description of Artificial Sequence: Synthetic polypeptide
DEEEIRTTNPVATEQYGSVSTYNDLNQNQNEGI

SEQ ID NO: 53138 - protein, 34 aa, Artificial Sequence
  Description of Artificial Sequence: Synthetic polypeptide
DEEEIRTTNPVATEQYGSVSTYNDLQNGQGNEGD

SEQ ID NO: 53139 - protein, 32 aa, Artificial Sequence
  Description of Artificial Sequence: Synthetic polypeptide
DEAEIRTTNPVATEQYGSVSNDLQRIGDNNQQ

SEQ ID NO: 53140 - protein, 32 aa, Artificial Sequence
  Description of Artificial Sequence: Synthetic polypeptide
DEEEIRTTNPVATEQYGSVSTYNDDQNQGEGD

SEQ ID NO: 53141 - protein, 32 aa, Artificial Sequence
  Description of Artificial Sequence: Synthetic polypeptide
DEAEIRTTNPVATEQYGSVSNDDYLQRGGNGQ

SEQ ID NO: 53142 - protein, 31 aa, Artificial Sequence
  Description of Artificial Sequence: Synthetic polypeptide
TEEEIRTTNPVGYEQYGSVSTNMLGQGGSNP

SEQ ID NO: 53143 - protein, 34 aa, Artificial Sequence
  Description of Artificial Sequence: Synthetic polypeptide
DEEEIRTTNPVATEQYGSVSTYNLDQITGEGNDD

SEQ ID NO: 53144 - protein, 29 aa, Artificial Sequence
  Description of Artificial Sequence: Synthetic peptide
DEAEIRTTNPVATEQYGSVSLLLDRQEED

SEQ ID NO: 53145 - protein, 33 aa, Artificial Sequence
  Description of Artificial Sequence: Synthetic polypeptide
DEEEIRTTNPVATEQYGSVSTYNLFNENGENEG

SEQ ID NO: 53146 - protein, 33 aa, Artificial Sequence
  Description of Artificial Sequence: Synthetic polypeptide
DEEEIRTTNPVATEQYGSVSTYNLGQTGEEEMI

SEQ ID NO: 53147 - protein, 34 aa, Artificial Sequence
  Description of Artificial Sequence: Synthetic polypeptide
DEEEIRTTNPVATEQYGSVSTYNLLNQNGGNEQE

SEQ ID NO: 53148 - protein, 34 aa, Artificial Sequence
  Description of Artificial Sequence: Synthetic polypeptide
DEEEIRTTNPVATEQYGSVSTYNLLSNQNGGNEQ

SEQ ID NO: 53149 - protein, 33 aa, Artificial Sequence
  Description of Artificial Sequence: Synthetic polypeptide
DEEEIRTTNPVATEQYGSVSTYNLDAEGGNLED

SEQ ID NO: 53150 - protein, 34 aa, Artificial Sequence
  Description of Artificial Sequence: Synthetic polypeptide
DEEEIRTTNPVATEQYGSVSTYNLNNNQNGGNEQ

SEQ ID NO: 53151 - protein, 32 aa, Artificial Sequence
  Description of Artificial Sequence: Synthetic polypeptide
TEEEIRTTNPVSTEQYGSVSCTNELGMGGDNR

SEQ ID NO: 53152 - protein, 29 aa, Artificial Sequence
  Description of Artificial Sequence: Synthetic peptide
TEEEIRTTNPVSTEQYGSVTFNLQGGQQT

SEQ ID NO: 53153 - protein, 32 aa, Artificial Sequence
  Description of Artificial Sequence: Synthetic polypeptide
DEEEIRTTNPVATEQYGSVSTYGLSNEFGGNQ

SEQ ID NO: 53154 - protein, 33 aa, Artificial Sequence
  Description of Artificial Sequence: Synthetic polypeptide
DEEEIRTTNPVATEQYGSVSTYGLSNEQDGENI

SEQ ID NO: 53155 - protein, 32 aa, Artificial Sequence
  Description of Artificial Sequence: Synthetic polypeptide
TEEEISTTNPVATEQYNGSVKSGTNQQDGLNR

SEQ ID NO: 53156 - protein, 31 aa, Artificial Sequence
  Description of Artificial Sequence: Synthetic polypeptide
AEEEIATTNPVATEQYGSVSTNLQHPGEQPN

SEQ ID NO: 53157 - protein, 31 aa, Artificial Sequence
  Description of Artificial Sequence: Synthetic polypeptide
AEEEIATTNPVATEQYGSVSTNLQPHNGEQP

SEQ ID NO: 53158 - protein, 31 aa, Artificial Sequence
  Description of Artificial Sequence: Synthetic polypeptide
DEAEIRTTNPVATEQYGSVSPTNVDTGMNSD

SEQ ID NO: 53159 - protein, 32 aa, Artificial Sequence
  Description of Artificial Sequence: Synthetic polypeptide
DEAEIRTTNPVATEQYGSVSPTNLSDGEINNE

SEQ ID NO: 53160 - protein, 31 aa, Artificial Sequence
  Description of Artificial Sequence: Synthetic polypeptide
DEEEIRTTNPVATEQYGSVSTYLQQNEEMVL

SEQ ID NO: 53161 - protein, 30 aa, Artificial Sequence
  Description of Artificial Sequence: Synthetic polypeptide
AEEEIRTTNPVATEQYGSVVVSNLNSGNIG

SEQ ID NO: 53162 - protein, 31 aa, Artificial Sequence
  Description of Artificial Sequence: Synthetic polypeptide
FEEEIRTTNPVATEQYGSVSTQNDGEGGGND

SEQ ID NO: 53163 - protein, 32 aa, Artificial Sequence
  Description of Artificial Sequence: Synthetic polypeptide
DEAEIRTTNPVATEQYGSVSPTNLEGRNNEEV

SEQ ID NO: 53164 - protein, 32 aa, Artificial Sequence
  Description of Artificial Sequence: Synthetic polypeptide
FEEEIRTTNPVATEQYGSVSTPNTLQLVVDRN

SEQ ID NO: 53165 - protein, 32 aa, Artificial Sequence
  Description of Artificial Sequence: Synthetic polypeptide
DEAEIRTTNPVATEQYGSVSPTNDQNSGNVDS

SEQ ID NO: 53166 - protein, 30 aa, Artificial Sequence
  Description of Artificial Sequence: Synthetic polypeptide
QEEEIACTNPVATEQYGSVATNLQEEHGTR

SEQ ID NO: 53167 - protein, 33 aa, Artificial Sequence
  Description of Artificial Sequence: Synthetic polypeptide
DEEEIRTTNPVATEQYGSVSTYLGDVGNEVMRF

SEQ ID NO: 53168 - protein, 31 aa, Artificial Sequence
  Description of Artificial Sequence: Synthetic polypeptide
DEAEIRTTNPVATEQYGSVSPLEDLQRGDDG

SEQ ID NO: 53169 - protein, 31 aa, Artificial Sequence
  Description of Artificial Sequence: Synthetic polypeptide
FEEEIRTTNPVATEQYGSVSTQNDNGGGNED

SEQ ID NO: 53170 - protein, 33 aa, Artificial Sequence
  Description of Artificial Sequence: Synthetic polypeptide
TEEELRTTNPVAYEQYGSVSCTGNLDQRTGGNR

SEQ ID NO: 53171 - protein, 30 aa, Artificial Sequence
  Description of Artificial Sequence: Synthetic polypeptide
DEAEIRTTNPVATEQYGSVSENLDDGGEEG

SEQ ID NO: 53172 - protein, 33 aa, Artificial Sequence
  Description of Artificial Sequence: Synthetic polypeptide
DEEEIRTTNPVATEQYGSVSTYNLSNDEGGGNG

SEQ ID NO: 53173 - protein, 32 aa, Artificial Sequence
  Description of Artificial Sequence: Synthetic polypeptide
DEEEIRTTNPVATEQYGSVSVDLTQNTGNQQK

SEQ ID NO: 53174 - protein, 32 aa, Artificial Sequence
  Description of Artificial Sequence: Synthetic polypeptide
TEEEIRTTNPVAYEQYGSVVSTCASSQRGNNR

SEQ ID NO: 53175 - protein, 31 aa, Artificial Sequence
  Description of Artificial Sequence: Synthetic polypeptide
DEEEIRTTNPVATEQYGSVSVDLTRIDIIND

SEQ ID NO: 53176 - protein, 31 aa, Artificial Sequence
  Description of Artificial Sequence: Synthetic polypeptide
DEEEIRTTNPVATEQYGSVSVDMQGSGINDG

SEQ ID NO: 53177 - protein, 33 aa, Artificial Sequence
  Description of Artificial Sequence: Synthetic polypeptide
DEEEIRTTNPVATEQYGSVSVDNLQNTGDNTQE

SEQ ID NO: 53178 - protein, 32 aa, Artificial Sequence
  Description of Artificial Sequence: Synthetic polypeptide
AEEEIRTTNPVATEQYGSVVVNTNNLQTGEND

SEQ ID NO: 53179 - protein, 30 aa, Artificial Sequence
  Description of Artificial Sequence: Synthetic polypeptide
DEEEIRTTNPVATEQYGSVSVEDNQTSING

SEQ ID NO: 53180 - protein, 29 aa, Artificial Sequence
  Description of Artificial Sequence: Synthetic peptide
AEEEIATTNPVATESYGCISANLDRGNRQ

SEQ ID NO: 53181 - protein, 31 aa, Artificial Sequence
  Description of Artificial Sequence: Synthetic polypeptide
TEEEIRTTNPVAYEQYGSVSTNLSGFQGNYP

SEQ ID NO: 53182 - protein, 31 aa, Artificial Sequence
  Description of Artificial Sequence: Synthetic polypeptide
DEEEIRTTNPVATEQYGSVSVEMLPQRNVFI

SEQ ID NO: 53183 - protein, 34 aa, Artificial Sequence
  Description of Artificial Sequence: Synthetic polypeptide
FEEEIRTTNPVATEQYGSVSTPNFLQIRGVENNS

SEQ ID NO: 53184 - protein, 32 aa, Artificial Sequence
  Description of Artificial Sequence: Synthetic polypeptide
DEEEIRTTNPVATEQYGSVSVGDNDHQRVNDI

SEQ ID NO: 53185 - protein, 30 aa, Artificial Sequence
  Description of Artificial Sequence: Synthetic polypeptide
DEEEIRTTNPVATEQYGSVSVGLTSGPLQN

SEQ ID NO: 53186 - protein, 30 aa, Artificial Sequence
  Description of Artificial Sequence: Synthetic polypeptide
DEAEIRTTNPVATEQYGSVNSVNDQNGGEQ

SEQ ID NO: 53187 - protein, 32 aa, Artificial Sequence
  Description of Artificial Sequence: Synthetic polypeptide
DEEEIRTTNPVATEQYGSVSVIFNLDQQVNIQ

SEQ ID NO: 53188 - protein, 30 aa, Artificial Sequence
  Description of Artificial Sequence: Synthetic polypeptide
DEEEIRTTNPVATEQYGSVSVLDGTRGGEN

SEQ ID NO: 53189 - protein, 31 aa, Artificial Sequence
  Description of Artificial Sequence: Synthetic polypeptide
TEEEIRTTNPVAYEQYGSVSTGNLSTSGNDE

SEQ ID NO: 53190 - protein, 33 aa, Artificial Sequence
  Description of Artificial Sequence: Synthetic polypeptide
DEEEIRTTNPVATEQYGSVSTYNLQNTIGGDEE

SEQ ID NO: 53191 - protein, 32 aa, Artificial Sequence
  Description of Artificial Sequence: Synthetic polypeptide
DEEEIRTTNPVATEQYGSVSVDLQTTFGNQIP

SEQ ID NO: 53192 - protein, 29 aa, Artificial Sequence
  Description of Artificial Sequence: Synthetic peptide
QEEEIACTNPVATEQYGSVATNLQMPNNP

SEQ ID NO: 53193 - protein, 33 aa, Artificial Sequence
  Description of Artificial Sequence: Synthetic polypeptide
DEEEIRTTNPVATEQYGSVSTYNLSNDEGGGNV

SEQ ID NO: 53194 - protein, 33 aa, Artificial Sequence
  Description of Artificial Sequence: Synthetic polypeptide
DEAEIRTTNPVATEQYGSVSCTNGSQRTGGSNF

SEQ ID NO: 53195 - protein, 33 aa, Artificial Sequence
  Description of Artificial Sequence: Synthetic polypeptide
DEEEIRTTNPVATEQYGSVSTYNLSNENGGNNG

SEQ ID NO: 53196 - protein, 32 aa, Artificial Sequence
  Description of Artificial Sequence: Synthetic polypeptide
DEAEIRTTNPVATEQYGSVSCTNAQRPGVYQV

SEQ ID NO: 53197 - protein, 33 aa, Artificial Sequence
  Description of Artificial Sequence: Synthetic polypeptide
DEEEIRTTNPVATEQYGSVSTYNLSNFTGGNGG

SEQ ID NO: 53198 - protein, 31 aa, Artificial Sequence
  Description of Artificial Sequence: Synthetic polypeptide
TEEEIRTTNPVGTEQYGSVSCTNMLGRGGGP

SEQ ID NO: 53199 - protein, 33 aa, Artificial Sequence
  Description of Artificial Sequence: Synthetic polypeptide
DEEEIRTTNPVATEQYGSVSTYNLSNMDNGENI

SEQ ID NO: 53200 - protein, 31 aa, Artificial Sequence
  Description of Artificial Sequence: Synthetic polypeptide
DEEEIRTTNPVATEQYGSVSVDFDLQEQVNI

SEQ ID NO: 53201 - protein, 31 aa, Artificial Sequence
  Description of Artificial Sequence: Synthetic polypeptide
TEEEIRTTNPVAYERYGTVSTNELSHRGNYR

SEQ ID NO: 53202 - protein, 33 aa, Artificial Sequence
  Description of Artificial Sequence: Synthetic polypeptide
DEEEIRTTNPVATEQYGSVSTYNLSNQNGFEEQ

SEQ ID NO: 53203 - protein, 32 aa, Artificial Sequence
  Description of Artificial Sequence: Synthetic polypeptide
DEEEIRTTNPVATEQYGSVSTYPLQNTGSGQN

SEQ ID NO: 53204 - protein, 28 aa, Artificial Sequence
  Description of Artificial Sequence: Synthetic peptide
AEEEIATTNPVATESYGCIAGNLQQGNR

SEQ ID NO: 53205 - protein, 33 aa, Artificial Sequence
  Description of Artificial Sequence: Synthetic polypeptide
FEEEIRTTNPVATEQYGSVSTPNLPQVEGNGNE

SEQ ID NO: 53206 - protein, 32 aa, Artificial Sequence
  Description of Artificial Sequence: Synthetic polypeptide
TEEEIRTTNPVAYEQYGVVSTNLSQRQGNYPI

SEQ ID NO: 53207 - protein, 32 aa, Artificial Sequence
  Description of Artificial Sequence: Synthetic polypeptide
TEEEIRTTNPVAYEQYGTVSCTNLSQDGNQRM

SEQ ID NO: 53208 - protein, 33 aa, Artificial Sequence
  Description of Artificial Sequence: Synthetic polypeptide
DEAEIRTTNPVATEQYGSVPSCTNLSGSAGNNR

SEQ ID NO: 53209 - protein, 30 aa, Artificial Sequence
  Description of Artificial Sequence: Synthetic polypeptide
DEAEIRTTNPVATEQYGSVQTADLIRMSNQ

SEQ ID NO: 53210 - protein, 32 aa, Artificial Sequence
  Description of Artificial Sequence: Synthetic polypeptide
DEAEIRTTNPVATEQYGSVNSTNDERGENEST

SEQ ID NO: 53211 - protein, 33 aa, Artificial Sequence
  Description of Artificial Sequence: Synthetic polypeptide
TEEEVRTTNPVATEAYGSVSTGNLDQRTGGNNR

SEQ ID NO: 53212 - protein, 32 aa, Artificial Sequence
  Description of Artificial Sequence: Synthetic polypeptide
TEEEVRTTNPVATEQYGCVSTGELDQRIGSNR

SEQ ID NO: 53213 - protein, 32 aa, Artificial Sequence
  Description of Artificial Sequence: Synthetic polypeptide
DEEEIRTTNPVATEQYGSVSTVNPNQTEMGEL

SEQ ID NO: 53214 - protein, 33 aa, Artificial Sequence
  Description of Artificial Sequence: Synthetic polypeptide
DEAEIRTTNPVATEQYGSVSTNNLQNFGEENQY

SEQ ID NO: 53215 - protein, 32 aa, Artificial Sequence
  Description of Artificial Sequence: Synthetic polypeptide
DEAEIRTTNPVATEQYGSVSTNNDQRSGQEDG

SEQ ID NO: 53216 - protein, 30 aa, Artificial Sequence
  Description of Artificial Sequence: Synthetic polypeptide
TEEGIATTNPVATEQYGSVSMNSSQRGNNS

SEQ ID NO: 53217 - protein, 32 aa, Artificial Sequence
  Description of Artificial Sequence: Synthetic polypeptide
DEAEIRTTNPVATEQYGSVSTNLQGQGGDMSG

SEQ ID NO: 53218 - protein, 33 aa, Artificial Sequence
  Description of Artificial Sequence: Synthetic polypeptide
DEAEIRTTNPVATEQYGSVSTNLQGNTGDNNDS

SEQ ID NO: 53219 - protein, 32 aa, Artificial Sequence
  Description of Artificial Sequence: Synthetic polypeptide
DEAEIRTTNPVATEQYGSVSTNLQGNDGQGEA

SEQ ID NO: 53220 - protein, 33 aa, Artificial Sequence
  Description of Artificial Sequence: Synthetic polypeptide
DEEEIRTTNPVATEQYGSVSTVNPNQQEIENRQ

SEQ ID NO: 53221 - protein, 32 aa, Artificial Sequence
  Description of Artificial Sequence: Synthetic polypeptide
DEAEIRTTNPVATEQYGSVSTNLQGGMGGDEA

SEQ ID NO: 53222 - protein, 33 aa, Artificial Sequence
  Description of Artificial Sequence: Synthetic polypeptide
DEAEIRTTNPVATEQYGSVSTNLNQGQMGDMGR

SEQ ID NO: 53223 - protein, 33 aa, Artificial Sequence
  Description of Artificial Sequence: Synthetic polypeptide
DEAEIRTTNPVATEQYGSVSTNLNQGNTGDNNS

SEQ ID NO: 53224 - protein, 33 aa, Artificial Sequence
  Description of Artificial Sequence: Synthetic polypeptide
DEAEIRTTNPVATEQYGSVSTNLNQGLNGNDEN

SEQ ID NO: 53225 - protein, 33 aa, Artificial Sequence
  Description of Artificial Sequence: Synthetic polypeptide
DEAEIRTTNPVATEQYGSVSTNLNQGDSGGNNM

SEQ ID NO: 53226 - protein, 32 aa, Artificial Sequence
  Description of Artificial Sequence: Synthetic polypeptide
DEAEIRTTNPVATEQYGSVSTNLNQGDSGDAM

SEQ ID NO: 53227 - protein, 32 aa, Artificial Sequence
  Description of Artificial Sequence: Synthetic polypeptide
DEAEIRTTNPVATEQYGSVSTNLNGLGGGNEN

SEQ ID NO: 53228 - protein, 32 aa, Artificial Sequence
  Description of Artificial Sequence: Synthetic polypeptide
DEAEIRTTNPVATEQYGSVSTNLNGEHGGNSS

SEQ ID NO: 53229 - protein, 33 aa, Artificial Sequence
  Description of Artificial Sequence: Synthetic polypeptide
DEAEIRTTNPVATEQYGSVSTNLNQLGGDNGEN

SEQ ID NO: 53230 - protein, 31 aa, Artificial Sequence
  Description of Artificial Sequence: Synthetic polypeptide
DEAEIRTTNPVATEQYGSVSTNLDVNTYNQE

SEQ ID NO: 53231 - protein, 32 aa, Artificial Sequence
  Description of Artificial Sequence: Synthetic polypeptide
DEAEIRTTNPVATEQYGSVSTPNLTQHGGEDI

SEQ ID NO: 53232 - protein, 30 aa, Artificial Sequence
  Description of Artificial Sequence: Synthetic polypeptide
AEEEIATTNPVATEQYGSVATNLQDQNDSD

SEQ ID NO: 53233 - protein, 31 aa, Artificial Sequence
  Description of Artificial Sequence: Synthetic polypeptide
DEAEIRTTNPVATEQYGSVSTYNLQTDEEMI

SEQ ID NO: 53234 - protein, 31 aa, Artificial Sequence
  Description of Artificial Sequence: Synthetic polypeptide
AEEEIATTNPVATEQYGSVATNLQAGPNEDM

SEQ ID NO: 53235 - protein, 31 aa, Artificial Sequence
  Description of Artificial Sequence: Synthetic polypeptide
TEEGIATTNPVATEQYGSVSTGNELDMGLNR

SEQ ID NO: 53236 - protein, 31 aa, Artificial Sequence
  Description of Artificial Sequence: Synthetic polypeptide
AEEEIATTNPVATEQYGSVATNLQDQGDNTM

SEQ ID NO: 53237 - protein, 34 aa, Artificial Sequence
  Description of Artificial Sequence: Synthetic polypeptide
DEAEIRTTNPVATEQYGSVSTTQNLQGGVNGNDR

SEQ ID NO: 53238 - protein, 32 aa, Artificial Sequence
  Description of Artificial Sequence: Synthetic polypeptide
DEAEIRTTNPVATEQYGSVSTTQDGQRGDNES

SEQ ID NO: 53239 - protein, 32 aa, Artificial Sequence
  Description of Artificial Sequence: Synthetic polypeptide
DEAEIRTTNPVATEQYGSVSTTQDGDQRGNQE

SEQ ID NO: 53240 - protein, 30 aa, Artificial Sequence
  Description of Artificial Sequence: Synthetic polypeptide
AEEEIATTNPVATEQYGSVATNLQETEDTR

SEQ ID NO: 53241 - protein, 32 aa, Artificial Sequence
  Description of Artificial Sequence: Synthetic polypeptide
FEEEIRTTNPVATEQYGSVSTSGLIQRLENYG

SEQ ID NO: 53242 - protein, 32 aa, Artificial Sequence
  Description of Artificial Sequence: Synthetic polypeptide
AEEEIATTNPVATEQYGSVATNLQDQGENSRE

SEQ ID NO: 53243 - protein, 32 aa, Artificial Sequence
  Description of Artificial Sequence: Synthetic polypeptide
DEAEIRTTNPVATEQYGSVSTTNGGNSGENDR

SEQ ID NO: 53244 - protein, 33 aa, Artificial Sequence
  Description of Artificial Sequence: Synthetic polypeptide
DEAEIRTTNPVATEQYGSVSTTNDLNQERDNDS

SEQ ID NO: 53245 - protein, 32 aa, Artificial Sequence
  Description of Artificial Sequence: Synthetic polypeptide
DEAEIRTTNPVATEQYGSVSTTNAGDQQNGNH

SEQ ID NO: 53246 - protein, 33 aa, Artificial Sequence
  Description of Artificial Sequence: Synthetic polypeptide
DEEEIRTTNPVATEQYGSVSTVNNLIGGGNGQE

SEQ ID NO: 53247 - protein, 32 aa, Artificial Sequence
  Description of Artificial Sequence: Synthetic polypeptide
DEAEIRTTNPVATEQYGSVSTTGPDGQAGGNR

SEQ ID NO: 53248 - protein, 32 aa, Artificial Sequence
  Description of Artificial Sequence: Synthetic polypeptide
DEAEIRTTNPVATEQYGSVSTTDLNQERDNED

SEQ ID NO: 53249 - protein, 32 aa, Artificial Sequence
  Description of Artificial Sequence: Synthetic polypeptide
DEAEIRTTNPVATEQYGSVSTTNHNNQGDGNM

SEQ ID NO: 53250 - protein, 33 aa, Artificial Sequence
  Description of Artificial Sequence: Synthetic polypeptide
DEEEIRTTNPVATEQYGSVSTYGLQDTGEEQRD

SEQ ID NO: 53251 - protein, 30 aa, Artificial Sequence
  Description of Artificial Sequence: Synthetic polypeptide
AEEEIATTNPVATEQYGSVATNLQGGPPDM

SEQ ID NO: 53252 - protein, 31 aa, Artificial Sequence
  Description of Artificial Sequence: Synthetic polypeptide
DEAEIRTTNPVATEQYGSVSTNHNGDGGQNM

SEQ ID NO: 53253 - protein, 33 aa, Artificial Sequence
  Description of Artificial Sequence: Synthetic polypeptide
DEAEIRTTNPVATEQYGSVSTENNLQGEGDNTS

SEQ ID NO: 53254 - protein, 32 aa, Artificial Sequence
  Description of Artificial Sequence: Synthetic polypeptide
DEAEIRTTNPVATEQYGSVSTDLNNGNENSRE

SEQ ID NO: 53255 - protein, 32 aa, Artificial Sequence
  Description of Artificial Sequence: Synthetic polypeptide
DEAEIRTTNPVATEQYGSVSTDLNGGNEANRE

SEQ ID NO: 53256 - protein, 30 aa, Artificial Sequence
  Description of Artificial Sequence: Synthetic polypeptide
AEEEIATTNPVATEQYGSVATNLQQPNSPE

SEQ ID NO: 53257 - protein, 33 aa, Artificial Sequence
  Description of Artificial Sequence: Synthetic polypeptide
FEEEIRTTNPVATEQYGSVSTQNLQGDNGNDQQ

SEQ ID NO: 53258 - protein, 32 aa, Artificial Sequence
  Description of Artificial Sequence: Synthetic polypeptide
AEEEIRTTNPVATEQYGSVVVSNNLNQQNGNI

SEQ ID NO: 53259 - protein, 33 aa, Artificial Sequence
  Description of Artificial Sequence: Synthetic polypeptide
DEEEIRTTNPVATEQYGSVSTWNLQQGTGEELF

SEQ ID NO: 53260 - protein, 33 aa, Artificial Sequence
  Description of Artificial Sequence: Synthetic polypeptide
DEAEIRTTNPVATEQYGSVSTGNLSQGQGGDMR

SEQ ID NO: 53261 - protein, 30 aa, Artificial Sequence
  Description of Artificial Sequence: Synthetic polypeptide
DEAEIRTTNPVATEQYGSVSSNLHGSGEIM

SEQ ID NO: 53262 - protein, 32 aa, Artificial Sequence
  Description of Artificial Sequence: Synthetic polypeptide
DEEEIRTTNPVATEQYGSVSTWPLTNVSNQER

SEQ ID NO: 53263 - protein, 33 aa, Artificial Sequence
  Description of Artificial Sequence: Synthetic polypeptide
DEEEIRTTNPVATEQYGSVSTWTNADEQRGDAQ

SEQ ID NO: 53264 - protein, 31 aa, Artificial Sequence
  Description of Artificial Sequence: Synthetic polypeptide
DEEEIRTTNPVATEQYGSVSTWVDRIEEQRE

SEQ ID NO: 53265 - protein, 33 aa, Artificial Sequence
  Description of Artificial Sequence: Synthetic polypeptide
AEEEIATTNPVATEQYGSVATNNLPQRGGENER

SEQ ID NO: 53266 - protein, 32 aa, Artificial Sequence
  Description of Artificial Sequence: Synthetic polypeptide
DEEEIRTTNPVATEQYGSVSTYDTGQTGQGNE

SEQ ID NO: 53267 - protein, 31 aa, Artificial Sequence
  Description of Artificial Sequence: Synthetic polypeptide
AEEEIRTTNPVATEQYGSVVVSNNLGIGNNA

SEQ ID NO: 53268 - protein, 32 aa, Artificial Sequence
  Description of Artificial Sequence: Synthetic polypeptide
DEEEIRTTNPVATEQYGSVSTYGDGQNQGNGD

SEQ ID NO: 53269 - protein, 31 aa, Artificial Sequence
  Description of Artificial Sequence: Synthetic polypeptide
AEEEIRTTNPVATEQYGSVVVSNNLGNIGNN

SEQ ID NO: 53270 - protein, 32 aa, Artificial Sequence
  Description of Artificial Sequence: Synthetic polypeptide
DEAEIRTTNPVATEQYGSVSTNLDAGNQGNED

SEQ ID NO: 53271 - protein, 32 aa, Artificial Sequence
  Description of Artificial Sequence: Synthetic polypeptide
DEAEIRTTNPVATEQYGSVSTGPQDQAGGNAR

SEQ ID NO: 53272 - protein, 32 aa, Artificial Sequence
  Description of Artificial Sequence: Synthetic polypeptide
DEEEIRTTNPVATEQYGSVSTWLNADGSDQRY

SEQ ID NO: 53273 - protein, 31 aa, Artificial Sequence
  Description of Artificial Sequence: Synthetic polypeptide
DEAEIRTTNPVATEQYGSVSTNGGQDQGMSG

SEQ ID NO: 53274 - protein, 34 aa, Artificial Sequence
  Description of Artificial Sequence: Synthetic polypeptide
DEAEIRTTNPVATEQYGSVSTNDLDQLRFGENEF

SEQ ID NO: 53275 - protein, 29 aa, Artificial Sequence
  Description of Artificial Sequence: Synthetic peptide
TEEGIATTNPVATEQYGSVATNLNMPNQR

SEQ ID NO: 53276 - protein, 30 aa, Artificial Sequence
  Description of Artificial Sequence: Synthetic polypeptide
AEEEIATTNPVATEQYGSVATNLQHPGEQD

SEQ ID NO: 53277 - protein, 33 aa, Artificial Sequence
  Description of Artificial Sequence: Synthetic polypeptide
FEEEIRTTNPVATEQYGSVSTQNLQTNGGNITP

SEQ ID NO: 53278 - protein, 31 aa, Artificial Sequence
  Description of Artificial Sequence: Synthetic polypeptide
AEEEIATTNPVATEQYGSVATNLQNGNNEAH

SEQ ID NO: 53279 - protein, 33 aa, Artificial Sequence
  Description of Artificial Sequence: Synthetic polypeptide
TEEEVRTTNPVAYEQYGSVSCTLNLSQRTGGNR

SEQ ID NO: 53280 - protein, 31 aa, Artificial Sequence
  Description of Artificial Sequence: Synthetic polypeptide
AEEEIATTNPVATEQYGSVATNLQQGENPDE

SEQ ID NO: 53281 - protein, 34 aa, Artificial Sequence
  Description of Artificial Sequence: Synthetic polypeptide
DEEEIRTTNPVATEQYGSVSTVNVLQNAGENTIE

SEQ ID NO: 53282 - protein, 29 aa, Artificial Sequence
  Description of Artificial Sequence: Synthetic peptide
AEEEIATTNPVATEQYGSVATNLQPQTDS

SEQ ID NO: 53283 - protein, 31 aa, Artificial Sequence
  Description of Artificial Sequence: Synthetic polypeptide
AEEEIATTNPVATEQYGSVATNLQQGDNSEE

SEQ ID NO: 53284 - protein, 31 aa, Artificial Sequence
  Description of Artificial Sequence: Synthetic polypeptide
DEAEIRTTNPVATEQYGSVSTLLTTEGGDNQ

SEQ ID NO: 53285 - protein, 32 aa, Artificial Sequence
  Description of Artificial Sequence: Synthetic polypeptide
DEEEIRTTNPVATEQYGSVSTWDLNRNENFSD

SEQ ID NO: 53286 - protein, 31 aa, Artificial Sequence
  Description of Artificial Sequence: Synthetic polypeptide
DEEEIRTTNPVATEQYGSVSTWEGQAGMEQS

SEQ ID NO: 53287 - protein, 32 aa, Artificial Sequence
  Description of Artificial Sequence: Synthetic polypeptide
DEEEIRTTNPVATEQYGSVSTWLGDHGMEQRE

SEQ ID NO: 53288 - protein, 32 aa, Artificial Sequence
  Description of Artificial Sequence: Synthetic polypeptide
DEAEIRTTNPVATEQYGSVSTHLESPGNAEDR

SEQ ID NO: 53289 - protein, 33 aa, Artificial Sequence
  Description of Artificial Sequence: Synthetic polypeptide
DEEEIRTTNPVATEQYGSVSTVPLQDNGIGNQI

SEQ ID NO: 53290 - protein, 31 aa, Artificial Sequence
  Description of Artificial Sequence: Synthetic polypeptide
DEAEIRTTNPVATEQYGSVSVSTNLQIVEIN

SEQ ID NO: 53291 - protein, 30 aa, Artificial Sequence
  Description of Artificial Sequence: Synthetic polypeptide
QEEEIACTNPVATEQYGSVATNLQNDGNQF

SEQ ID NO: 53292 - protein, 31 aa, Artificial Sequence
  Description of Artificial Sequence: Synthetic polypeptide
TEEEIRTTNPVAYEQYGSVSINLQPIPGNNY

SEQ ID NO: 53293 - protein, 33 aa, Artificial Sequence
  Description of Artificial Sequence: Synthetic polypeptide
FEEEIRTTNPVATEQYGSVSTMNLDQGGNNDEG

SEQ ID NO: 53294 - protein, 32 aa, Artificial Sequence
  Description of Artificial Sequence: Synthetic polypeptide
DEEEIRTTNPVATEQYGSVSVTGLMPVGVERI

SEQ ID NO: 53295 - protein, 31 aa, Artificial Sequence
  Description of Artificial Sequence: Synthetic polypeptide
DEEEIRTTNPVATEQYGSVSVTGLQGELVSF

SEQ ID NO: 53296 - protein, 33 aa, Artificial Sequence
  Description of Artificial Sequence: Synthetic polypeptide
FEEEIRTTNPVATEQYGSVSTMNLDQEGGNDND

SEQ ID NO: 53297 - protein, 32 aa, Artificial Sequence
  Description of Artificial Sequence: Synthetic polypeptide
DEEEIRTTNPVATEQYGSVSVTGLQRESQQAF

SEQ ID NO: 53298 - protein, 32 aa, Artificial Sequence
  Description of Artificial Sequence: Synthetic polypeptide
DEEEIRTTNPVATEQYGSVSVTGLQRLAHDQL

SEQ ID NO: 53299 - protein, 32 aa, Artificial Sequence
  Description of Artificial Sequence: Synthetic polypeptide
TEEEIRTTNPVAYEPYGSVSTNLQATGTNNVR

SEQ ID NO: 53300 - protein, 32 aa, Artificial Sequence
  Description of Artificial Sequence: Synthetic polypeptide
DEEEIRTTNPVATEQYGSVSVTGLAIRGMLDQ

SEQ ID NO: 53301 - protein, 34 aa, Artificial Sequence
  Description of Artificial Sequence: Synthetic polypeptide
DEEEIRTTNPVATEQYGSVSVTGNNDQRAGNAMD

SEQ ID NO: 53302 - protein, 31 aa, Artificial Sequence
  Description of Artificial Sequence: Synthetic polypeptide
DEEEIRTTNPVATEQYGSVSVTILESEENEA

SEQ ID NO: 53303 - protein, 33 aa, Artificial Sequence
  Description of Artificial Sequence: Synthetic polypeptide
DEEEIRTTNPVATEQYGSVSVTINLSQGGEILD

SEQ ID NO: 53304 - protein, 33 aa, Artificial Sequence
  Description of Artificial Sequence: Synthetic polypeptide
FEEEIRTTNPVATEQYGSVSTMNLDQEEGGNDT

SEQ ID NO: 53305 - protein, 33 aa, Artificial Sequence
  Description of Artificial Sequence: Synthetic polypeptide
DEEEIRTTNPVATEQYGSVSVTLTLGQTGENNQ

SEQ ID NO: 53306 - protein, 29 aa, Artificial Sequence
  Description of Artificial Sequence: Synthetic peptide
TEEEIRTTNPVAYEPYGSVATALQNGGPR

SEQ ID NO: 53307 - protein, 32 aa, Artificial Sequence
  Description of Artificial Sequence: Synthetic polypeptide
FEEEIRTTNPVATEQYGSVSTMNGQGGGNDEI

SEQ ID NO: 53308 - protein, 31 aa, Artificial Sequence
  Description of Artificial Sequence: Synthetic polypeptide
TEEEIRTTNPVAYEPYGSTVSTNAQNGGNNR

SEQ ID NO: 53309 - protein, 32 aa, Artificial Sequence
  Description of Artificial Sequence: Synthetic polypeptide
DEEEIRTTNPVATEQYGSVSVTHNIVRSNEMQ

SEQ ID NO: 53310 - protein, 32 aa, Artificial Sequence
  Description of Artificial Sequence: Synthetic polypeptide
FEEEIRTTNPVATEQYGSVSTMNGQGGGGNET

SEQ ID NO: 53311 - protein, 31 aa, Artificial Sequence
  Description of Artificial Sequence: Synthetic polypeptide
TEEEIRTTNPVAYEPYGSVVFTNLSTRAGNR

SEQ ID NO: 53312 - protein, 33 aa, Artificial Sequence
  Description of Artificial Sequence: Synthetic polypeptide
FEEEIRTTNPVATEQYGSVSTMNLDQNGNGNEG

SEQ ID NO: 53313 - protein, 32 aa, Artificial Sequence
  Description of Artificial Sequence: Synthetic polypeptide
DEAEIRTTNPVATEQYGSVCSTNHQNFGSNQI

SEQ ID NO: 53314 - protein, 30 aa, Artificial Sequence
  Description of Artificial Sequence: Synthetic polypeptide
QEEEIACTNPVATEQYGSVATNLTAEDGNR

SEQ ID NO: 53315 - protein, 30 aa, Artificial Sequence
  Description of Artificial Sequence: Synthetic polypeptide
DEAEIRTTNPVATEQYGSVCSTEHQYGSDQ

SEQ ID NO: 53316 - protein, 31 aa, Artificial Sequence
  Description of Artificial Sequence: Synthetic polypeptide
DEEEIRTTNPVATEQYGSVSVTDAEQDTNQQ

SEQ ID NO: 53317 - protein, 30 aa, Artificial Sequence
  Description of Artificial Sequence: Synthetic polypeptide
TEEEIRTTNPVAYEQWGSVSTNLSQLVNYQ

SEQ ID NO: 53318 - protein, 31 aa, Artificial Sequence
  Description of Artificial Sequence: Synthetic polypeptide
DEEEIRTTNPVATEQYGSVSVTDLERNSQQE

SEQ ID NO: 53319 - protein, 30 aa, Artificial Sequence
  Description of Artificial Sequence: Synthetic polypeptide
TEEEIRTTNPVAYEQWGSVSQGNLGTGGNR

SEQ ID NO: 53320 - protein, 33 aa, Artificial Sequence
  Description of Artificial Sequence: Synthetic polypeptide
FEEEIRTTNPVATEQYGSVSTMNLDQGGNNQEG

SEQ ID NO: 53321 - protein, 32 aa, Artificial Sequence
  Description of Artificial Sequence: Synthetic polypeptide
DEEEIRTTNPVATEQYGSVSVTDLQISEEQNM

SEQ ID NO: 53322 - protein, 32 aa, Artificial Sequence
  Description of Artificial Sequence: Synthetic polypeptide
DEEEIRTTNPVATEQYGSVSVTDLQPEGGLEI

SEQ ID NO: 53323 - protein, 33 aa, Artificial Sequence
  Description of Artificial Sequence: Synthetic polypeptide
FEEEIRTTNPVATEQYGSVSTMNLDQSGENNEG

SEQ ID NO: 53324 - protein, 31 aa, Artificial Sequence
  Description of Artificial Sequence: Synthetic polypeptide
TEEEIRTTNPVAYEQWGKVSCTNLTQRGNNS

SEQ ID NO: 53325 - protein, 31 aa, Artificial Sequence
  Description of Artificial Sequence: Synthetic polypeptide
TEEEIRTTNPVAYEQWGKVPSTNLSQRGNNS

SEQ ID NO: 53326 - protein, 31 aa, Artificial Sequence
  Description of Artificial Sequence: Synthetic polypeptide
DEAEIRTTNPVATEQYGSVCSQNLFRNMNTQ

SEQ ID NO: 53327 - protein, 30 aa, Artificial Sequence
  Description of Artificial Sequence: Synthetic polypeptide
DEAEIRTTNPVATEQYGSVCSQELFRNSNQ

SEQ ID NO: 53328 - protein, 33 aa, Artificial Sequence
  Description of Artificial Sequence: Synthetic polypeptide
DEEEIRTTNPVATEQYGSVSVTFALSTRGGSNL

SEQ ID NO: 53329 - protein, 30 aa, Artificial Sequence
  Description of Artificial Sequence: Synthetic polypeptide
QEEEIACTNPVATEQYGSVATNLTQNGNDE

SEQ ID NO: 53330 - protein, 33 aa, Artificial Sequence
  Description of Artificial Sequence: Synthetic polypeptide
DEEEIRTTNPVATEQYGSVSVSTNQLQGNNNIG

SEQ ID NO: 53331 - protein, 33 aa, Artificial Sequence
  Description of Artificial Sequence: Synthetic polypeptide
DEEEIRTTNPVATEQYGSVSVTNHERSDENMRN

SEQ ID NO: 53332 - protein, 32 aa, Artificial Sequence
  Description of Artificial Sequence: Synthetic polypeptide
DEEEIRTTNPVATEQYGSVSVTNHQDERDDEL

SEQ ID NO: 53333 - protein, 31 aa, Artificial Sequence
  Description of Artificial Sequence: Synthetic polypeptide
DEEEIRTTNPVATEQYGSVSVTNMIRNEQLS

SEQ ID NO: 53334 - protein, 34 aa, Artificial Sequence
  Description of Artificial Sequence: Synthetic polypeptide
DEEEIRTTNPVATEQYGSVSVTNMLQRPGGGVLQ

SEQ ID NO: 53335 - protein, 32 aa, Artificial Sequence
  Description of Artificial Sequence: Synthetic polypeptide
FEEEIRTTNPVATEQYGSVSTMNEDGQNGGNV

SEQ ID NO: 53336 - protein, 34 aa, Artificial Sequence
  Description of Artificial Sequence: Synthetic polypeptide
DEEEIRTTNPVATEQYGSVSVTNPLDDRNGNVEE

SEQ ID NO: 53337 - protein, 34 aa, Artificial Sequence
  Description of Artificial Sequence: Synthetic polypeptide
DEEEIRTTNPVATEQYGSVSVTNPLGDDMGNVRE

SEQ ID NO: 53338 - protein, 32 aa, Artificial Sequence
  Description of Artificial Sequence: Synthetic polypeptide
DEEEIRTTNPVATEQYGSVSVTNVENSGENTQ

SEQ ID NO: 53339 - protein, 32 aa, Artificial Sequence
  Description of Artificial Sequence: Synthetic polypeptide
DEEEIRTTNPVATEQYGSVSVTNVQVMSQDRE

SEQ ID NO: 53340 - protein, 31 aa, Artificial Sequence
  Description of Artificial Sequence: Synthetic polypeptide
TEEEIRTTNPVAYEHYGSVSCTNLSHRGDQR

SEQ ID NO: 53341 - protein, 30 aa, Artificial Sequence
  Description of Artificial Sequence: Synthetic polypeptide
DEAEIRTTNPVATEQYGSSSVYDLQIGNEQ

SEQ ID NO: 53342 - protein, 33 aa, Artificial Sequence
  Description of Artificial Sequence: Synthetic polypeptide
DEEEIRTTNPVATEQYGSVSVTTGLDQRALNGL

SEQ ID NO: 53343 - protein, 32 aa, Artificial Sequence
  Description of Artificial Sequence: Synthetic polypeptide
DEEEIRTTNPVATEQYGSVSVTTGLQDQGAVT

SEQ ID NO: 53344 - protein, 33 aa, Artificial Sequence
  Description of Artificial Sequence: Synthetic polypeptide
DEEEIRTTNPVATEQYGSVSVTTLERYDDNIRM

SEQ ID NO: 53345 - protein, 33 aa, Artificial Sequence
  Description of Artificial Sequence: Synthetic polypeptide
FEEEIRTTNPVATEQYGSVSTGPSLQRFGGARS

SEQ ID NO: 53346 - protein, 32 aa, Artificial Sequence
  Description of Artificial Sequence: Synthetic polypeptide
FEEEIRTTNPVATEQYGSVSTGNLQQGQGEGE

SEQ ID NO: 53347 - protein, 30 aa, Artificial Sequence
  Description of Artificial Sequence: Synthetic polypeptide
TEEEIRTTNPVAYEEYGCISINLSQRGGNR

SEQ ID NO: 53348 - protein, 32 aa, Artificial Sequence
  Description of Artificial Sequence: Synthetic polypeptide
DEEEIRTTNPVATEQYGSVSVTVNGTQVGVGD

SEQ ID NO: 53349 - protein, 32 aa, Artificial Sequence
  Description of Artificial Sequence: Synthetic polypeptide
FEEEIRTTNPVATEQYGSVSTLNGLQADIVRH

SEQ ID NO: 53350 - protein, 32 aa, Artificial Sequence
  Description of Artificial Sequence: Synthetic polypeptide
DEEEIRTTNPVATEQYGSVSVTNHHQERVETQ

SEQ ID NO: 53351 - protein, 31 aa, Artificial Sequence
  Description of Artificial Sequence: Synthetic polypeptide
TEEEIRTTNPVAYEKYGSVPSTMNHQSGNRY

SEQ ID NO: 53352 - protein, 31 aa, Artificial Sequence
  Description of Artificial Sequence: Synthetic polypeptide
TEEEIRTTNPVAYEMYGKTVSTNESQRGNNR

SEQ ID NO: 53353 - protein, 34 aa, Artificial Sequence
  Description of Artificial Sequence: Synthetic polypeptide
DEEEIRTTNPVATEQYGSVSVTNIEQQRGPQERT

SEQ ID NO: 53354 - protein, 32 aa, Artificial Sequence
  Description of Artificial Sequence: Synthetic polypeptide
DEEEIRTTNPVATEQYGSVSVTNILELDDNIS

SEQ ID NO: 53355 - protein, 33 aa, Artificial Sequence
  Description of Artificial Sequence: Synthetic polypeptide
DEEEIRTTNPVATEQYGSVSVTNILHDNRLPER

SEQ ID NO: 53356 - protein, 32 aa, Artificial Sequence
  Description of Artificial Sequence: Synthetic polypeptide
DEEEIRTTNPVATEQYGSVSVTNLDDLNIEND

SEQ ID NO: 53357 - protein, 33 aa, Artificial Sequence
  Description of Artificial Sequence: Synthetic polypeptide
DEEEIRTTNPVATEQYGSVSVTNLDQEGSGEII

SEQ ID NO: 53358 - protein, 33 aa, Artificial Sequence
  Description of Artificial Sequence: Synthetic polypeptide
DEEEIRTTNPVATEQYGSVSVTNLDQFPGEEII

SEQ ID NO: 53359 - protein, 33 aa, Artificial Sequence
  Description of Artificial Sequence: Synthetic polypeptide
DEEEIRTTNPVATEQYGSVSVTNLDSNSNNDRF

SEQ ID NO: 53360 - protein, 33 aa, Artificial Sequence
  Description of Artificial Sequence: Synthetic polypeptide
DEEEIRTTNPVATEQYGSVSVTNLTQTSQIQRN

SEQ ID NO: 53361 - protein, 33 aa, Artificial Sequence
  Description of Artificial Sequence: Synthetic polypeptide
DEAEIRTTNPVATEQYGSVATTNLNQDNDGNTR

SEQ ID NO: 53362 - protein, 30 aa, Artificial Sequence
  Description of Artificial Sequence: Synthetic polypeptide
TEEEIRTTNPVAYEPYGHVSTNLSQNGGSR

SEQ ID NO: 53363 - protein, 32 aa, Artificial Sequence
  Description of Artificial Sequence: Synthetic polypeptide
DEAEIRTTNPVATEQYGSVALTNLDMRNGENP

SEQ ID NO: 53364 - protein, 32 aa, Artificial Sequence
  Description of Artificial Sequence: Synthetic polypeptide
DEAEIRTTNPVATEQYGSVACTNLSGSAGGNR

SEQ ID NO: 53365 - protein, 33 aa, Artificial Sequence
  Description of Artificial Sequence: Synthetic polypeptide
DEEEIRTTNPVATEQYGSVSVTNLMTPGLEHRD

SEQ ID NO: 53366 - protein, 33 aa, Artificial Sequence
  Description of Artificial Sequence: Synthetic polypeptide
DEEEIRTTNPVATEQYGSVSVTNLPQPPPLERD

SEQ ID NO: 53367 - protein, 32 aa, Artificial Sequence
  Description of Artificial Sequence: Synthetic polypeptide
DEEEIRTTNPVATEQYGSVSVTNLQNDPLLFL

SEQ ID NO: 53368 - protein, 28 aa, Artificial Sequence
  Description of Artificial Sequence: Synthetic peptide
QEEEIACTNPVATEQYGSVSEVCQHGER

SEQ ID NO: 53369 - protein, 32 aa, Artificial Sequence
  Description of Artificial Sequence: Synthetic polypeptide
DEEEIRTTNPVATEQYGSVSVTNLEVPNENDQ

SEQ ID NO: 53370 - protein, 32 aa, Artificial Sequence
  Description of Artificial Sequence: Synthetic polypeptide
TEEEIRTTNPVAYEQYGSVSINLSQRTQGNYP

SEQ ID NO: 53371 - protein, 33 aa, Artificial Sequence
  Description of Artificial Sequence: Synthetic polypeptide
DEAEIRTTNPVATEQYGSVCSTNMLQRSSENDN

SEQ ID NO: 53372 - protein, 33 aa, Artificial Sequence
  Description of Artificial Sequence: Synthetic polypeptide
FEEEIRTTNPVATEQYGSVSTMNLGQEGGGNTT

SEQ ID NO: 53373 - protein, 33 aa, Artificial Sequence
  Description of Artificial Sequence: Synthetic polypeptide
DEEEIRTTNPVATEQYGSVSVNLQQQRVMEERM

SEQ ID NO: 53374 - protein, 33 aa, Artificial Sequence
  Description of Artificial Sequence: Synthetic polypeptide
FEEEIRTTNPVATEQYGSVSTNLQQGQGNNGED

SEQ ID NO: 53375 - protein, 30 aa, Artificial Sequence
  Description of Artificial Sequence: Synthetic polypeptide
DEAEIRTTNPVATEQYGSVMVQNLFRNENQ

SEQ ID NO: 53376 - protein, 32 aa, Artificial Sequence
  Description of Artificial Sequence: Synthetic polypeptide
DEEEIRTTNPVATEQYGSVSVNMLDRIMNGFD

SEQ ID NO: 53377 - protein, 31 aa, Artificial Sequence
  Description of Artificial Sequence: Synthetic polypeptide
DEAEIRTTNPVATEQYGSVIWNLQTDDNFRG

SEQ ID NO: 53378 - protein, 31 aa, Artificial Sequence
  Description of Artificial Sequence: Synthetic polypeptide
DEEEIRTTNPVATEQYGSVSVNNLDSIGEED

SEQ ID NO: 53379 - protein, 31 aa, Artificial Sequence
  Description of Artificial Sequence: Synthetic polypeptide
AEEEICTTNPVATEQWGSVATNLQQGNESRD

SEQ ID NO: 53380 - protein, 32 aa, Artificial Sequence
  Description of Artificial Sequence: Synthetic polypeptide
TEEEIRTTNPVAYEQYGSVPCTNALSQRGNYT

SEQ ID NO: 53381 - protein, 33 aa, Artificial Sequence
  Description of Artificial Sequence: Synthetic polypeptide
FEEEIRTTNPVATEQYGSVSTNLQIGGGNQTIQ

SEQ ID NO: 53382 - protein, 32 aa, Artificial Sequence
  Description of Artificial Sequence: Synthetic polypeptide
AEEEICTTNPVATEQYGNVSVTSTNLQGGNAD

SEQ ID NO: 53383 - protein, 30 aa, Artificial Sequence
  Description of Artificial Sequence: Synthetic polypeptide
TEEEIRTTNPVAYEQYGSVATAELQNVGDR

SEQ ID NO: 53384 - protein, 32 aa, Artificial Sequence
  Description of Artificial Sequence: Synthetic polypeptide
DEEEIRTTNPVATEQYGSVSVPDDQVEGNENR

SEQ ID NO: 53385 - protein, 31 aa, Artificial Sequence
  Description of Artificial Sequence: Synthetic polypeptide
TEEEIRTTNPVAYEQYGSTVSTQNLSQLVNQ

SEQ ID NO: 53386 - protein, 32 aa, Artificial Sequence
  Description of Artificial Sequence: Synthetic polypeptide
DEEEIRTTNPVATEQYGSVSVPLQNTGDNTQH

SEQ ID NO: 53387 - protein, 32 aa, Artificial Sequence
  Description of Artificial Sequence: Synthetic polypeptide
TEEEIRTTNPVAYEQYGSTVSTNLSQNSGARF

SEQ ID NO: 53388 - protein, 32 aa, Artificial Sequence
  Description of Artificial Sequence: Synthetic polypeptide
DEEEIRTTNPVATEQYGSVSVPNWSQNDGNPI

SEQ ID NO: 53389 - protein, 31 aa, Artificial Sequence
  Description of Artificial Sequence: Synthetic polypeptide
DEAEIRTTNPVATEQYGSVISTNNQFGGEDI

SEQ ID NO: 53390 - protein, 33 aa, Artificial Sequence
  Description of Artificial Sequence: Synthetic polypeptide
AEEEICTTNPVATEQYGSVSTTNWQPREGNDRV

SEQ ID NO: 53391 - protein, 30 aa, Artificial Sequence
  Description of Artificial Sequence: Synthetic polypeptide
QEEEIACTNPVATEQYGSVATNLQQGNPEE

SEQ ID NO: 53392 - protein, 30 aa, Artificial Sequence
  Description of Artificial Sequence: Synthetic polypeptide
QEEEIACTNPVATEQYGSVATNLQPGNDTL

SEQ ID NO: 53393 - protein, 30 aa, Artificial Sequence
  Description of Artificial Sequence: Synthetic polypeptide
DEEEIRTTNPVATEQYGSVSVMALIIPENV

SEQ ID NO: 53394 - protein, 30 aa, Artificial Sequence
  Description of Artificial Sequence: Synthetic polypeptide
QEEEIACTNPVATEQYGSVATNLQNNGDNQ

SEQ ID NO: 53395 - protein, 31 aa, Artificial Sequence
  Description of Artificial Sequence: Synthetic polypeptide
TEEEIRTTNPVAYEQYGSVSCTNLSQLPVNQ

SEQ ID NO: 53396 - protein, 32 aa, Artificial Sequence
  Description of Artificial Sequence: Synthetic polypeptide
DEEEIRTTNPVATEQYGSVSVMLDLDLQVPNR

SEQ ID NO: 53397 - protein, 31 aa, Artificial Sequence
  Description of Artificial Sequence: Synthetic polypeptide
TEEEIRTTNPVAYEQYGSVSCTNELSQHNNQ

SEQ ID NO: 53398 - protein, 32 aa, Artificial Sequence
  Description of Artificial Sequence: Synthetic polypeptide
TEEEIRTTNPVAYEQYGSVSCTNELQRVANYD

SEQ ID NO: 53399 - protein, 32 aa, Artificial Sequence
  Description of Artificial Sequence: Synthetic polypeptide
AEEEIRTTNPVATEQYGSVVVNTNLQQGGNQT

SEQ ID NO: 53400 - protein, 32 aa, Artificial Sequence
  Description of Artificial Sequence: Synthetic polypeptide
DEEEIRTTNPVATEQYGSVSVNKHQERDMEIR

SEQ ID NO: 53401 - protein, 32 aa, Artificial Sequence
  Description of Artificial Sequence: Synthetic polypeptide
FEEEIRTTNPVATEQYGSVSTNVTQGVGGNIQ

SEQ ID NO: 53402 - protein, 30 aa, Artificial Sequence
  Description of Artificial Sequence: Synthetic polypeptide
AEEEIATTNPVAYEQYGSVSTGDLQDDGNP

SEQ ID NO: 53403 - protein, 29 aa, Artificial Sequence
  Description of Artificial Sequence: Synthetic peptide
AEEEIATTNPVAYEQYGSVSTGDQGMGNP

SEQ ID NO: 53404 - protein, 29 aa, Artificial Sequence
  Description of Artificial Sequence: Synthetic peptide
AEEEIATTNPVAYEQYGSVSTGDQMNGNA

SEQ ID NO: 53405 - protein, 30 aa, Artificial Sequence
  Description of Artificial Sequence: Synthetic polypeptide
AEEEIATTNPVAYEQYGSVSTGLQDGDNPS

SEQ ID NO: 53406 - protein, 30 aa, Artificial Sequence
  Description of Artificial Sequence: Synthetic polypeptide
AEEEIATTNPVAYEQYGSVSTNLQGNPEPD

SEQ ID NO: 53407 - protein, 32 aa, Artificial Sequence
  Description of Artificial Sequence: Synthetic polypeptide
DEEEIRTTNPVATEQYGSVSVNDGTRAVENRL

SEQ ID NO: 53408 - protein, 31 aa, Artificial Sequence
  Description of Artificial Sequence: Synthetic polypeptide
DEEEIRTTNPVATEQYGSVSVNDHQETDMIR

SEQ ID NO: 53409 - protein, 29 aa, Artificial Sequence
  Description of Artificial Sequence: Synthetic peptide
AEEEIATTNPVAYEQYGSVATNLETQNDR

SEQ ID NO: 53410 - protein, 31 aa, Artificial Sequence
  Description of Artificial Sequence: Synthetic polypeptide
TEEEIRTTNPVAYEQWGSVVSCGNLQTGGNR

SEQ ID NO: 53411 - protein, 31 aa, Artificial Sequence
  Description of Artificial Sequence: Synthetic polypeptide
DEEEIRTTNPVATEQYGSVSVSDLESGEQRA

SEQ ID NO: 53412 - protein, 31 aa, Artificial Sequence
  Description of Artificial Sequence: Synthetic polypeptide
AEEEICTTNPVATEQYGTVSVTNMELQGGNL

SEQ ID NO: 53413 - protein, 29 aa, Artificial Sequence
  Description of Artificial Sequence: Synthetic peptide
DEAEIRTTNPVATEQYGSVETDLQGTEEG

SEQ ID NO: 53414 - protein, 32 aa, Artificial Sequence
  Description of Artificial Sequence: Synthetic polypeptide
DEEEIRTTNPVATEQYGSVSVSMNLQYNSNIA

SEQ ID NO: 53415 - protein, 33 aa, Artificial Sequence
  Description of Artificial Sequence: Synthetic polypeptide
FEEEIRTTNPVATEQYGSVSTMNLVGQEGENGQ

SEQ ID NO: 53416 - protein, 31 aa, Artificial Sequence
  Description of Artificial Sequence: Synthetic polypeptide
TEEEIRTTNPVAYEQYGQVSCQNLQSNGGNR

SEQ ID NO: 53417 - protein, 30 aa, Artificial Sequence
  Description of Artificial Sequence: Synthetic polypeptide
QEEEIACTNPVATEQYGSVATNLQVEDNRE

SEQ ID NO: 53418 - protein, 33 aa, Artificial Sequence
  Description of Artificial Sequence: Synthetic polypeptide
DEEEIRTTNPVATEQYGSVSVSTNLEQGNTNID

SEQ ID NO: 53419 - protein, 34 aa, Artificial Sequence
  Description of Artificial Sequence: Synthetic polypeptide
DEEEIRTTNPVATEQYGSVSVSTNLQQGNNNIIA

SEQ ID NO: 53420 - protein, 33 aa, Artificial Sequence
  Description of Artificial Sequence: Synthetic polypeptide
FEEEIRTTNPVATEQYGSVSTMNLVQDEGNNGQ

SEQ ID NO: 53421 - protein, 31 aa, Artificial Sequence
  Description of Artificial Sequence: Synthetic polypeptide
DEAEIRTTNPVATEQYGSVCSWNLFNNSNRM

SEQ ID NO: 53422 - protein, 33 aa, Artificial Sequence
  Description of Artificial Sequence: Synthetic polypeptide
FEEEIRTTNPVATEQYGSVSTMNLVEQEGNGQT

SEQ ID NO: 53423 - protein, 34 aa, Artificial Sequence
  Description of Artificial Sequence: Synthetic polypeptide
DEEEIRTTNPVATEQYGSVSVSTNLQSGNNNNIG

SEQ ID NO: 53424 - protein, 33 aa, Artificial Sequence
  Description of Artificial Sequence: Synthetic polypeptide
FEEEIRTTNPVATEQYGSVSTMNLQNGTGNQGI

SEQ ID NO: 53425 - protein, 34 aa, Artificial Sequence
  Description of Artificial Sequence: Synthetic polypeptide
DEEEIRTTNPVATEQYGSVSVSTNLQYGNNGNNI

SEQ ID NO: 53426 - protein, 31 aa, Artificial Sequence
  Description of Artificial Sequence: Synthetic polypeptide
AEEEIRATNPVATEQYGSVATNLQEAGNMEN

SEQ ID NO: 53427 - protein, 33 aa, Artificial Sequence
  Description of Artificial Sequence: Synthetic polypeptide
FEEEIRTTNPVATEQYGSVSTMNLGQEGGNQEI

SEQ ID NO: 53428 - protein, 34 aa, Artificial Sequence
  Description of Artificial Sequence: Synthetic polypeptide
DEEEIRTTNPVATEQYGSVSVSTNNLQQGNNNIV

SEQ ID NO: 53429 - protein, 34 aa, Artificial Sequence
  Description of Artificial Sequence: Synthetic polypeptide
DEEEIRTTNPVATEQYGSVSVSTNLQQGNNNNQI

SEQ ID NO: 53430 - protein, 29 aa, Artificial Sequence
  Description of Artificial Sequence: Synthetic peptide
AEEEICTTNPVATEQYGTVSVTMTQGGNQ

SEQ ID NO: 53431 - protein, 31 aa, Artificial Sequence
  Description of Artificial Sequence: Synthetic polypeptide
DEEEIRTTNPVATEQYGSVSVSLLSEEGSER

SEQ ID NO: 53432 - protein, 33 aa, Artificial Sequence
  Description of Artificial Sequence: Synthetic polypeptide
DEEEIRTTNPVATEQYGSVSVSGNLSQRVTNNP

SEQ ID NO: 53433 - protein, 33 aa, Artificial Sequence
  Description of Artificial Sequence: Synthetic polypeptide
DEEEIRTTNPVATEQYGSVSVSFNLEQREVNIV

SEQ ID NO: 53434 - protein, 32 aa, Artificial Sequence
  Description of Artificial Sequence: Synthetic polypeptide
DEEEIRTTNPVATEQYGSVSVSFNLERPVNLI

SEQ ID NO: 53435 - protein, 33 aa, Artificial Sequence
  Description of Artificial Sequence: Synthetic polypeptide
DEEEIRTTNPVATEQYGSVSVSFNLQDEVNGIR

SEQ ID NO: 53436 - protein, 30 aa, Artificial Sequence
  Description of Artificial Sequence: Synthetic polypeptide
QEEEIACTNPVATEQYGSVATNLQRENSID

SEQ ID NO: 53437 - protein, 30 aa, Artificial Sequence
  Description of Artificial Sequence: Synthetic polypeptide
AEEEICTTNPVATEQYGTVSVTQLQGGNQD

SEQ ID NO: 53438 - protein, 32 aa, Artificial Sequence
  Description of Artificial Sequence: Synthetic polypeptide
DEEEIRTTNPVATEQYGSVSVSFNLQDVDNSS

SEQ ID NO: 53439 - protein, 32 aa, Artificial Sequence
  Description of Artificial Sequence: Synthetic polypeptide
DEEEIRTTNPVATEQYGSVSVSFNLQDVQNDV

SEQ ID NO: 53440 - protein, 30 aa, Artificial Sequence
  Description of Artificial Sequence: Synthetic polypeptide
QEEEIACTNPVATEQYGSVATNLQSEEDNR

SEQ ID NO: 53441 - protein, 30 aa, Artificial Sequence
  Description of Artificial Sequence: Synthetic polypeptide
QEEEIACTNPVATEQYGSVATNLQRHNDTL

SEQ ID NO: 53442 - protein, 32 aa, Artificial Sequence
  Description of Artificial Sequence: Synthetic polypeptide
DEEEIRTTNPVATEQYGSVSVSFNLQQVVNIE

SEQ ID NO: 53443 - protein, 33 aa, Artificial Sequence
  Description of Artificial Sequence: Synthetic polypeptide
DEEEIRTTNPVATEQYGSVSVSFNLQREVNIIE

SEQ ID NO: 53444 - protein, 31 aa, Artificial Sequence
  Description of Artificial Sequence: Synthetic polypeptide
DEAEIRTTNPVATEQYGSVFITNDPQMNGNY

SEQ ID NO: 53445 - protein, 30 aa, Artificial Sequence
  Description of Artificial Sequence: Synthetic polypeptide
AEEEICTTNPVATEQYGTVSVTTLQGGNDQ

SEQ ID NO: 53446 - protein, 31 aa, Artificial Sequence
  Description of Artificial Sequence: Synthetic polypeptide
DEAEIRTTNPVATEQYGSVFFTNSDQLGGNM

SEQ ID NO: 53447 - protein, 31 aa, Artificial Sequence
  Description of Artificial Sequence: Synthetic polypeptide
DEEEIRTTNPVATEQYGSVSVSGNLQSVSDQ

SEQ ID NO: 53448 - protein, 32 aa, Artificial Sequence
  Description of Artificial Sequence: Synthetic polypeptide
DEEEIRTTNPVATEQYGSVSVSGNLSQGVGDQ

SEQ ID NO: 53449 - protein, 30 aa, Artificial Sequence
  Description of Artificial Sequence: Synthetic polypeptide
QEEEIACTNPVATEQYGSVATNLQRQNDEM

SEQ ID NO: 53450 - protein, 30 aa, Artificial Sequence
  Description of Artificial Sequence: Synthetic polypeptide
TEEEIRTTNPVAYEEYGCISINELQRVGNR

SEQ ID NO: 53451 - protein, 32 aa, Artificial Sequence
  Description of Artificial Sequence: Synthetic polypeptide
DEAEIRTTNPVATEQYGSVSVSYNLQRVENNI

SEQ ID NO: 53452 - protein, 33 aa, Artificial Sequence
  Description of Artificial Sequence: Synthetic polypeptide
DEEEIRTTNPVATEQYGSVSTVNLMQNNNSFQP

SEQ ID NO: 53453 - protein, 32 aa, Artificial Sequence
  Description of Artificial Sequence: Synthetic polypeptide
DEEEIRTTNPVATEQYGSVSTTNDQVGQAGSF

SEQ ID NO: 53454 - protein, 32 aa, Artificial Sequence
  Description of Artificial Sequence: Synthetic polypeptide
DEEEIRTTNPVATEQYGSVSTTNDTQENIENT

SEQ ID NO: 53455 - protein, 30 aa, Artificial Sequence
  Description of Artificial Sequence: Synthetic polypeptide
FEEEIRTTNPVATEQYGSVTTGLQRNPIFN

SEQ ID NO: 53456 - protein, 33 aa, Artificial Sequence
  Description of Artificial Sequence: Synthetic polypeptide
DEEEIRTTNPVATEQYGSVSTTNELEMDNGNND

SEQ ID NO: 53457 - protein, 33 aa, Artificial Sequence
  Description of Artificial Sequence: Synthetic polypeptide
DEEEIRTTNPVATEQYGSVSTTNELFRSLEDRG

SEQ ID NO: 53458 - protein, 33 aa, Artificial Sequence
  Description of Artificial Sequence: Synthetic polypeptide
DEEEIRTTNPVATEQYGSVSTTNELNMDNGMER

SEQ ID NO: 53459 - protein, 34 aa, Artificial Sequence
  Description of Artificial Sequence: Synthetic polypeptide
DEEEIRTTNPVATEQYGSVSTTNELTPEVGNIRD

SEQ ID NO: 53460 - protein, 33 aa, Artificial Sequence
  Description of Artificial Sequence: Synthetic polypeptide
DEEEIRTTNPVATEQYGSVSTTNDNQEQGEQRE

SEQ ID NO: 53461 - protein, 33 aa, Artificial Sequence
  Description of Artificial Sequence: Synthetic polypeptide
DEEEIRTTNPVATEQYGSVSTTNFLNRGEEDQD

SEQ ID NO: 53462 - protein, 33 aa, Artificial Sequence
  Description of Artificial Sequence: Synthetic polypeptide
DEEEIRTTNPVATEQYGSVSTTNGIQESGTNTT

SEQ ID NO: 53463 - protein, 32 aa, Artificial Sequence
  Description of Artificial Sequence: Synthetic polypeptide
DEEEIRTTNPVATEQYGSVSTTNGLEEGEELD

SEQ ID NO: 53464 - protein, 33 aa, Artificial Sequence
  Description of Artificial Sequence: Synthetic polypeptide
AEEEIRTTNPVATEQYGSVVVSTNLQNGNQNDG

SEQ ID NO: 53465 - protein, 29 aa, Artificial Sequence
  Description of Artificial Sequence: Synthetic peptide
TEIEICTVNPVATEQYGSVSTNLEEEGNE

SEQ ID NO: 53466 - protein, 30 aa, Artificial Sequence
  Description of Artificial Sequence: Synthetic polypeptide
AEEEIATTNPVATEQWGSVSDNPQGGNPRM

SEQ ID NO: 53467 - protein, 29 aa, Artificial Sequence
  Description of Artificial Sequence: Synthetic peptide
AEEEIATTNPVATEQWGSVSENLQDGEDN

SEQ ID NO: 53468 - protein, 33 aa, Artificial Sequence
  Description of Artificial Sequence: Synthetic polypeptide
DEEEIRTTNPVATEQYGSVSTTNGNGQEIGNQD

SEQ ID NO: 53469 - protein, 29 aa, Artificial Sequence
  Description of Artificial Sequence: Synthetic peptide
DEAEIRTTNPVAYECWGSVSTNNDHSGNR

SEQ ID NO: 53470 - protein, 33 aa, Artificial Sequence
  Description of Artificial Sequence: Synthetic polypeptide
DEEEIRTTNPVATEQYGSVSTTNGNQEIGNNQQ

SEQ ID NO: 53471 - protein, 31 aa, Artificial Sequence
  Description of Artificial Sequence: Synthetic polypeptide
AEEEIRTTNPVATEQYGSVVVSTNNEQGNGN

SEQ ID NO: 53472 - protein, 31 aa, Artificial Sequence
  Description of Artificial Sequence: Synthetic polypeptide
DEAEIRTTNPVAYECYGVVSTTNLQGEGNDR

SEQ ID NO: 53473 - protein, 33 aa, Artificial Sequence
  Description of Artificial Sequence: Synthetic polypeptide
DEEEIRTTNPVATEQYGSVSTTMNLEGFGGENI

SEQ ID NO: 53474 - protein, 32 aa, Artificial Sequence
  Description of Artificial Sequence: Synthetic polypeptide
TENEIRTTNPVATEQYGSVSTGALSQRVGNYP

SEQ ID NO: 53475 - protein, 33 aa, Artificial Sequence
  Description of Artificial Sequence: Synthetic polypeptide
FEEEIRTTNPVATEQYGSVYPTPNLQPRMGEER

SEQ ID NO: 53476 - protein, 34 aa, Artificial Sequence
  Description of Artificial Sequence: Synthetic polypeptide
DEEEIRTTNPVATEQYGSVSTTMNLGQGPGENIV

SEQ ID NO: 53477 - protein, 28 aa, Artificial Sequence
  Description of Artificial Sequence: Synthetic peptide
TENEIQCTNPVATEQYGEASENLQRGGR

SEQ ID NO: 53478 - protein, 32 aa, Artificial Sequence
  Description of Artificial Sequence: Synthetic polypeptide
DEEEIRTTNPVATEQYGSVSTTMNLIPNENIG

SEQ ID NO: 53479 - protein, 33 aa, Artificial Sequence
  Description of Artificial Sequence: Synthetic polypeptide
DEEEIRTTNPVATEQYGSVSTTMNLQEIMQPRF

SEQ ID NO: 53480 - protein, 34 aa, Artificial Sequence
  Description of Artificial Sequence: Synthetic polypeptide
DEEEIRTTNPVATEQYGSVSTTNDLPQRENVENT

SEQ ID NO: 53481 - protein, 34 aa, Artificial Sequence
  Description of Artificial Sequence: Synthetic polypeptide
DEEEIRTTNPVATEQYGSVSTTMNLQGPEGENIE

SEQ ID NO: 53482 - protein, 33 aa, Artificial Sequence
  Description of Artificial Sequence: Synthetic polypeptide
AEEEIRTTNPVATEQYGSVVVSTNNLEQGGNTD

SEQ ID NO: 53483 - protein, 32 aa, Artificial Sequence
  Description of Artificial Sequence: Synthetic polypeptide
DEEEIRTTNPVATEQYGSVSTTMNVIPGGENI

SEQ ID NO: 53484 - protein, 28 aa, Artificial Sequence
  Description of Artificial Sequence: Synthetic peptide
TENEIACTNPVATEQYGEASFNLQRGGR

SEQ ID NO: 53485 - protein, 32 aa, Artificial Sequence
  Description of Artificial Sequence: Synthetic polypeptide
FEEEIRTTNPVATEQYGSVVSTNVQQPGNFQN

SEQ ID NO: 53486 - protein, 35 aa, Artificial Sequence
  Description of Artificial Sequence: Synthetic polypeptide
DEEEIRTTNPVATEQYGSVSTTNALQQVFGNTQRQ

SEQ ID NO: 53487 - protein, 28 aa, Artificial Sequence
  Description of Artificial Sequence: Synthetic peptide
TENEIACTNPVATEQYGEASENLQRGGR

SEQ ID NO: 53488 - protein, 34 aa, Artificial Sequence
  Description of Artificial Sequence: Synthetic polypeptide
DEEEIRTTNPVATEQYGSVSTTNDLDQLYGEEER

SEQ ID NO: 53489 - protein, 34 aa, Artificial Sequence
  Description of Artificial Sequence: Synthetic polypeptide
DEEEIRTTNPVATEQYGSVSTTMNLQIGFGNEGE

SEQ ID NO: 53490 - protein, 33 aa, Artificial Sequence
  Description of Artificial Sequence: Synthetic polypeptide
DEEEIRTTNPVATEQYGSVSTTMNLDINGGNGQ

SEQ ID NO: 53491 - protein, 31 aa, Artificial Sequence
  Description of Artificial Sequence: Synthetic polypeptide
TEHEIRTTNPVAYEQYGSVSTGLSQRGGNNA

SEQ ID NO: 53492 - protein, 33 aa, Artificial Sequence
  Description of Artificial Sequence: Synthetic polypeptide
AEEEIRTTNPVATEQYGSVVVSTNLQNGNNNGN

SEQ ID NO: 53493 - protein, 30 aa, Artificial Sequence
  Description of Artificial Sequence: Synthetic polypeptide
DEAEIRTTNPVATKHYGSVSTLNLQRTEDD

SEQ ID NO: 53494 - protein, 31 aa, Artificial Sequence
  Description of Artificial Sequence: Synthetic polypeptide
DEAEIRTTNPVATEYYGVVSTNLQGNGDERD

SEQ ID NO: 53495 - protein, 31 aa, Artificial Sequence
  Description of Artificial Sequence: Synthetic polypeptide
DEAEIRTTNPVATEWYGSVSTNLQLGGDDGE

SEQ ID NO: 53496 - protein, 30 aa, Artificial Sequence
  Description of Artificial Sequence: Synthetic polypeptide
FEEEIRTTNPVATEQYGSVSVTELTRDDQV

SEQ ID NO: 53497 - protein, 33 aa, Artificial Sequence
  Description of Artificial Sequence: Synthetic polypeptide
AEEEIRTTNPVATEQYGSVVVSTNLNQNGNNEG

SEQ ID NO: 53498 - protein, 32 aa, Artificial Sequence
  Description of Artificial Sequence: Synthetic polypeptide
AEEEIRTTNPVATEQYGSVVVSTNLNLGNNED

SEQ ID NO: 53499 - protein, 33 aa, Artificial Sequence
  Description of Artificial Sequence: Synthetic polypeptide
FEEEIRTTNPVATEQYGSVSTVNLQNTGGNNAV

SEQ ID NO: 53500 - protein, 28 aa, Artificial Sequence
  Description of Artificial Sequence: Synthetic peptide
DEAEIRTTNPVATKHYGSVSTVLERTDM

SEQ ID NO: 53501 - protein, 34 aa, Artificial Sequence
  Description of Artificial Sequence: Synthetic polypeptide
DEEEIRTTNPVATEQYGSVSTTNLQPQEMVNSRN

SEQ ID NO: 53502 - protein, 35 aa, Artificial Sequence
  Description of Artificial Sequence: Synthetic polypeptide
DEEEIRTTNPVATEQYGSVSTTNLQQETVGPNLRV

SEQ ID NO: 53503 - protein, 33 aa, Artificial Sequence
  Description of Artificial Sequence: Synthetic polypeptide
FEEEIRTTNPVATEQYGSVSTVNLPQVGGNGNE

SEQ ID NO: 53504 - protein, 34 aa, Artificial Sequence
  Description of Artificial Sequence: Synthetic polypeptide
DEEEIRTTNPVATEQYGSVSTTNLQQIGFGNEGD

SEQ ID NO: 53505 - protein, 32 aa, Artificial Sequence
  Description of Artificial Sequence: Synthetic polypeptide
AEEEIRTTNPVATEQYGSVVVSTNLGGTGNGT

SEQ ID NO: 53506 - protein, 30 aa, Artificial Sequence
  Description of Artificial Sequence: Synthetic polypeptide
DEAEIRTTNPVATEQYGYTISTNELQEGEH

SEQ ID NO: 53507 - protein, 34 aa, Artificial Sequence
  Description of Artificial Sequence: Synthetic polypeptide
DEEEIRTTNPVATEQYGSVSTTNLQQVFVNTARQ

SEQ ID NO: 53508 - protein, 32 aa, Artificial Sequence
  Description of Artificial Sequence: Synthetic polypeptide
DEAEIRTTNPVATEQYGVVVSTNLQGDGMNGE

SEQ ID NO: 53509 - protein, 31 aa, Artificial Sequence
  Description of Artificial Sequence: Synthetic polypeptide
DEAEIRTTNPVATETYGEVSTNLQHQGNNES

SEQ ID NO: 53510 - protein, 34 aa, Artificial Sequence
  Description of Artificial Sequence: Synthetic polypeptide
DEEEIRTTNPVATEQYGSVSTTNGPQMRNGMNPV

SEQ ID NO: 53511 - protein, 31 aa, Artificial Sequence
  Description of Artificial Sequence: Synthetic polypeptide
DEAEIRTTNPVATQQYGKVSTNELSERGGNP

SEQ ID NO: 53512 - protein, 30 aa, Artificial Sequence
  Description of Artificial Sequence: Synthetic polypeptide
DEAEIRTTNPVAVEQYGSCSTNLEREPNSD

SEQ ID NO: 53513 - protein, 33 aa, Artificial Sequence
  Description of Artificial Sequence: Synthetic polypeptide
DEEEIRTTNPVATEQYGSVSTTNLDQTVNENNQ

SEQ ID NO: 53514 - protein, 33 aa, Artificial Sequence
  Description of Artificial Sequence: Synthetic polypeptide
DEEEIRTTNPVATEQYGSVSTTNLEDRMIVARD

SEQ ID NO: 53515 - protein, 32 aa, Artificial Sequence
  Description of Artificial Sequence: Synthetic polypeptide
DEAEIRTTNPVAYEAYGSVPSTNMLSQRGGNA

SEQ ID NO: 53516 - protein, 31 aa, Artificial Sequence
  Description of Artificial Sequence: Synthetic polypeptide
DEAEIRTTNPVAYEAYGQVSCTTLQRPGGNR

SEQ ID NO: 53517 - protein, 33 aa, Artificial Sequence
  Description of Artificial Sequence: Synthetic polypeptide
DEEEIRTTNPVATEQYGSVSTTNLGGQEQGQGV

SEQ ID NO: 53518 - protein, 31 aa, Artificial Sequence
  Description of Artificial Sequence: Synthetic polypeptide
AEEEIATTNPVATEQWGSVSTWLQQGRHGNM

SEQ ID NO: 53519 - protein, 34 aa, Artificial Sequence
  Description of Artificial Sequence: Synthetic polypeptide
DEEEIRTTNPVATEQYGSVSTTNLGQSRGEIEET

SEQ ID NO: 53520 - protein, 33 aa, Artificial Sequence
  Description of Artificial Sequence: Synthetic polypeptide
DEEEIRTTNPVATEQYGSVSTTNLQGFGLGEMD

SEQ ID NO: 53521 - protein, 32 aa, Artificial Sequence
  Description of Artificial Sequence: Synthetic polypeptide
DEEEIRTTNPVATEQYGSVSTTNLLNHDGELE

SEQ ID NO: 53522 - protein, 33 aa, Artificial Sequence
  Description of Artificial Sequence: Synthetic polypeptide
AEEEIRTTNPVATEQYGSVVVSTNLQNGNNNAT

SEQ ID NO: 53523 - protein, 33 aa, Artificial Sequence
  Description of Artificial Sequence: Synthetic polypeptide
DEEEIRTTNPVATEQYGSVSTTNLLQQRAVEEL

SEQ ID NO: 53524 - protein, 33 aa, Artificial Sequence
  Description of Artificial Sequence: Synthetic polypeptide
AEEEIRTTNPVATEQYGSVVVSTNLQNGNENGQ

SEQ ID NO: 53525 - protein, 30 aa, Artificial Sequence
  Description of Artificial Sequence: Synthetic polypeptide
DEAEIRTTNPVAWEQYGCICSTNLERPNRA

SEQ ID NO: 53526 - protein, 33 aa, Artificial Sequence
  Description of Artificial Sequence: Synthetic polypeptide
TEGEIRTTNPVATEQYGSVVSTNLSQRTSGNYP

SEQ ID NO: 53527 - protein, 33 aa, Artificial Sequence
  Description of Artificial Sequence: Synthetic polypeptide
DEEEIRTTNPVATEQYGSVSTTNLQEVGTPIGD

SEQ ID NO: 53528 - protein, 29 aa, Artificial Sequence
  Description of Artificial Sequence: Synthetic peptide
DEAEIRTTNPVAVEQYGSCSTNLETQENQ

SEQ ID NO: 53529 - protein, 33 aa, Artificial Sequence
  Description of Artificial Sequence: Synthetic polypeptide
DEEEIRTTNPVATEQYGSVSTTNLLQQGPEEEF

SEQ ID NO: 53530 - protein, 32 aa, Artificial Sequence
  Description of Artificial Sequence: Synthetic polypeptide
DEAEIRTTNPVATEQYGVVSTSLSQRTPGNND

SEQ ID NO: 53531 - protein, 31 aa, Artificial Sequence
  Description of Artificial Sequence: Synthetic polypeptide
DEAEIRTTNPVAYEEYGSVVSTNLQGGGNTE

SEQ ID NO: 53532 - protein, 32 aa, Artificial Sequence
  Description of Artificial Sequence: Synthetic polypeptide
TENEIRTTNPVAYEQYGSVSCTLNALSQAGNR

SEQ ID NO: 53533 - protein, 30 aa, Artificial Sequence
  Description of Artificial Sequence: Synthetic polypeptide
TESEIRTTNPVAYEQYGSVWTNLDQIGGSR

SEQ ID NO: 53534 - protein, 30 aa, Artificial Sequence
  Description of Artificial Sequence: Synthetic polypeptide
TESEIRTTNPVAYEQYGSVWCTNMLQIGSR

SEQ ID NO: 53535 - protein, 31 aa, Artificial Sequence
  Description of Artificial Sequence: Synthetic polypeptide
TESEIRTTNPVAYEQYGSVVSTGLQRGGNNA

SEQ ID NO: 53536 - protein, 30 aa, Artificial Sequence
  Description of Artificial Sequence: Synthetic polypeptide
DEAEIRTTNPVAYEQWGEVSTNLQPGGNDM

SEQ ID NO: 53537 - protein, 30 aa, Artificial Sequence
  Description of Artificial Sequence: Synthetic polypeptide
FEEGITTTNPVATEQYGSVSMNSTQRGENS

SEQ ID NO: 53538 - protein, 29 aa, Artificial Sequence
  Description of Artificial Sequence: Synthetic peptide
FEEGITTTNPVATEQYGSVSMNDSQTGNS

SEQ ID NO: 53539 - protein, 32 aa, Artificial Sequence
  Description of Artificial Sequence: Synthetic polypeptide
FEEEISTTNPVATEQYGSVKSGTNQQRGLNTT

SEQ ID NO: 53540 - protein, 30 aa, Artificial Sequence
  Description of Artificial Sequence: Synthetic polypeptide
DEAEIRTTNPVAYEQWGNVSTNLQDGDNNM

SEQ ID NO: 53541 - protein, 33 aa, Artificial Sequence
  Description of Artificial Sequence: Synthetic polypeptide
DEEEIRTTNPVATEQYGSVSTTFNLGQQGQVIG

SEQ ID NO: 53542 - protein, 33 aa, Artificial Sequence
  Description of Artificial Sequence: Synthetic polypeptide
DEEEIRTTNPVATEQYGSVSTTGLINQGGGNNE

SEQ ID NO: 53543 - protein, 33 aa, Artificial Sequence
  Description of Artificial Sequence: Synthetic polypeptide
DEEEIRTTNPVATEQYGSVSTTGLQSEGGNENT

SEQ ID NO: 53544 - protein, 33 aa, Artificial Sequence
  Description of Artificial Sequence: Synthetic polypeptide
DEEEIRTTNPVATEQYGSVSTTGLQVEGGNGNI

SEQ ID NO: 53545 - protein, 30 aa, Artificial Sequence
  Description of Artificial Sequence: Synthetic polypeptide
TESEIRTTNPVAYEQYGQVSCQNLQSGNNR

SEQ ID NO: 53546 - protein, 34 aa, Artificial Sequence
  Description of Artificial Sequence: Synthetic polypeptide
DEEEIRTTNPVATEQYGSVSTTGNLQQEEGGNGG

SEQ ID NO: 53547 - protein, 31 aa, Artificial Sequence
  Description of Artificial Sequence: Synthetic polypeptide
FEEEISGTNPVATEQYGSVPSTNLIRDNHRS

SEQ ID NO: 53548 - protein, 30 aa, Artificial Sequence
  Description of Artificial Sequence: Synthetic polypeptide
AEEEIRTTNPVAYEPYVVSVATNLQRGNWP

SEQ ID NO: 53549 - protein, 32 aa, Artificial Sequence
  Description of Artificial Sequence: Synthetic polypeptide
FEEEISTTNPIATEQYGSVKSGTNQQRGLNMR

SEQ ID NO: 53550 - protein, 29 aa, Artificial Sequence
  Description of Artificial Sequence: Synthetic peptide
TESEIRTTNPVATKHYGSVSTGNLERTNM

SEQ ID NO: 53551 - protein, 31 aa, Artificial Sequence
  Description of Artificial Sequence: Synthetic polypeptide
DEAEIRTTNPVAYEQWGNVSTNLQGGDGNPR

SEQ ID NO: 53552 - protein, 31 aa, Artificial Sequence
  Description of Artificial Sequence: Synthetic polypeptide
DEAEIRTTNPVAYEQWGNVSTNLQNDGNNDR

SEQ ID NO: 53553 - protein, 33 aa, Artificial Sequence
  Description of Artificial Sequence: Synthetic polypeptide
DEEEIRTTNPVATEQYGSVSTSTLQSDGGNVFT

SEQ ID NO: 53554 - protein, 33 aa, Artificial Sequence
  Description of Artificial Sequence: Synthetic polypeptide
DEEEIRTTNPVATEQYGSVSTSTLQVEMGNEFT

SEQ ID NO: 53555 - protein, 32 aa, Artificial Sequence
  Description of Artificial Sequence: Synthetic polypeptide
TNEEIATTNPVATEQYGSVSTNLQGNGGENSR

SEQ ID NO: 53556 - protein, 34 aa, Artificial Sequence
  Description of Artificial Sequence: Synthetic polypeptide
DEEEIRTTNPVATEQYGSVSTSVLDQRGGELNEM

SEQ ID NO: 53557 - protein, 30 aa, Artificial Sequence
  Description of Artificial Sequence: Synthetic polypeptide
AEEEIRTTNPVAYEEYGKISINLQRGGNNR

SEQ ID NO: 53558 - protein, 29 aa, Artificial Sequence
  Description of Artificial Sequence: Synthetic peptide
FEETIKTTNPVATEQYGSVSEMNSQTGNS

SEQ ID NO: 53559 - protein, 32 aa, Artificial Sequence
  Description of Artificial Sequence: Synthetic polypeptide
DEEEIRTTNPVATEQYGSVSTTAGPMRNGMNV

SEQ ID NO: 53560 - protein, 32 aa, Artificial Sequence
  Description of Artificial Sequence: Synthetic polypeptide
DEEEIRTTNPVATEQYGSVSTTDELEMRNMDR

SEQ ID NO: 53561 - protein, 28 aa, Artificial Sequence
  Description of Artificial Sequence: Synthetic peptide
TEYEIRSTNPVATEQYGSVEMNLQEGEQ

SEQ ID NO: 53562 - protein, 30 aa, Artificial Sequence
  Description of Artificial Sequence: Synthetic polypeptide
QEEEIACTNPVATEQYGSVATNLENRGENE

SEQ ID NO: 53563 - protein, 28 aa, Artificial Sequence
  Description of Artificial Sequence: Synthetic peptide
AEEEIASVNPVCTEQYGVVSENLQRGNQ

SEQ ID NO: 53564 - protein, 32 aa, Artificial Sequence
  Description of Artificial Sequence: Synthetic polypeptide
DEEEIRTTNPVATEQYGSVSTTALQQNSTNEE

SEQ ID NO: 53565 - protein, 29 aa, Artificial Sequence
  Description of Artificial Sequence: Synthetic peptide
DEAEIRTTNPVAYEQWGSASTNDGERPNR

SEQ ID NO: 53566 - protein, 31 aa, Artificial Sequence
  Description of Artificial Sequence: Synthetic polypeptide
TETEIRTTNPVAYEAYGSVPSVTNLSQRSNR

SEQ ID NO: 53567 - protein, 31 aa, Artificial Sequence
  Description of Artificial Sequence: Synthetic polypeptide
DEAEIRTTNPVAYEQWGQKVSCTTLQRGGNR

SEQ ID NO: 53568 - protein, 34 aa, Artificial Sequence
  Description of Artificial Sequence: Synthetic polypeptide
DEEEIRTTNPVATEQYGSVSTTANLNQNRGLPDD

SEQ ID NO: 53569 - protein, 30 aa, Artificial Sequence
  Description of Artificial Sequence: Synthetic polypeptide
FEEIIRTTNPVATEQYGCVSTNCQGMGGNC

SEQ ID NO: 53570 - protein, 30 aa, Artificial Sequence
  Description of Artificial Sequence: Synthetic polypeptide
DEAEIRTTNPVAYEEYGVVSTNLQGGDNDG

SEQ ID NO: 53571 - protein, 32 aa, Artificial Sequence
  Description of Artificial Sequence: Synthetic polypeptide
DEEEIRTTNPVATEQYGSVSTTGQEGGGNNEQ

SEQ ID NO: 53572 - protein, 32 aa, Artificial Sequence
  Description of Artificial Sequence: Synthetic polypeptide
TESEIRTTNPVATEQYGVVSTNALSQRVGNYM

SEQ ID NO: 53573 - protein, 31 aa, Artificial Sequence
  Description of Artificial Sequence: Synthetic polypeptide
TEREIRTTNPVAYEQYGSVVWTNLSQPGSNR

SEQ ID NO: 53574 - protein, 33 aa, Artificial Sequence
  Description of Artificial Sequence: Synthetic polypeptide
DEEEIRTTNPVATEQYGSVSTTLNLSGGGNGNT

SEQ ID NO: 53575 - protein, 33 aa, Artificial Sequence
  Description of Artificial Sequence: Synthetic polypeptide
DEEEIRTTNPVATEQYGSVSTTLPNQLQGEDNQ

SEQ ID NO: 53576 - protein, 33 aa, Artificial Sequence
  Description of Artificial Sequence: Synthetic polypeptide
DEEEIRTTNPVATEQYGSVSTTLPQFNGGNNST

SEQ ID NO: 53577 - protein, 33 aa, Artificial Sequence
  Description of Artificial Sequence: Synthetic polypeptide
DEEEIRTTNPVATEQYGSVSTTLQQERTIPLRL

SEQ ID NO: 53578 - protein, 32 aa, Artificial Sequence
  Description of Artificial Sequence: Synthetic polypeptide
DEAEIRTTNPVAYEPYGISVSTTNLSGRGNNR

SEQ ID NO: 53579 - protein, 30 aa, Artificial Sequence
  Description of Artificial Sequence: Synthetic polypeptide
DEAEIRTTNPVAYEPWGSISTNLSERPGNR

SEQ ID NO: 53580 - protein, 32 aa, Artificial Sequence
  Description of Artificial Sequence: Synthetic polypeptide
FEEEIRTTNPVATEQYGTVSTTNLQQGENTEE

SEQ ID NO: 53581 - protein, 32 aa, Artificial Sequence
  Description of Artificial Sequence: Synthetic polypeptide
DEEEIRTTNPVATEQYGSVSTTLQVPVFQNET

SEQ ID NO: 53582 - protein, 30 aa, Artificial Sequence
  Description of Artificial Sequence: Synthetic polypeptide
DEAEIRTTNPVAYEHYGTVSTNLQGDGNNQ

SEQ ID NO: 53583 - protein, 30 aa, Artificial Sequence
  Description of Artificial Sequence: Synthetic polypeptide
DEAEIRTTNPVAYEHYGEVSTNLQGGGNQE

SEQ ID NO: 53584 - protein, 30 aa, Artificial Sequence
  Description of Artificial Sequence: Synthetic polypeptide
TEQEIRTTNPVATEQYGSVWVNLEVIGNSR

SEQ ID NO: 53585 - protein, 32 aa, Artificial Sequence
  Description of Artificial Sequence: Synthetic polypeptide
DEEEIRTTNPVATEQYGSVSTTMDQPREGSEQ

SEQ ID NO: 53586 - protein, 32 aa, Artificial Sequence
  Description of Artificial Sequence: Synthetic polypeptide
DEEEIRTTNPVATEQYGSVSTTMIQVRPGELQ

SEQ ID NO: 53587 - protein, 33 aa, Artificial Sequence
  Description of Artificial Sequence: Synthetic polypeptide
DEEEIRTTNPVATEQYGSVSTTMMLQEVMENRF

SEQ ID NO: 53588 - protein, 33 aa, Artificial Sequence
  Description of Artificial Sequence: Synthetic polypeptide
DEEEIRTTNPVATEQYGSVSTTMNEGQGEGGNQ

SEQ ID NO: 53589 - protein, 29 aa, Artificial Sequence
  Description of Artificial Sequence: Synthetic peptide
DEAEIRTTNPVAYEKWGEVSTNLQGGNVN

SEQ ID NO: 53590 - protein, 33 aa, Artificial Sequence
  Description of Artificial Sequence: Synthetic polypeptide
AEEEIRTTNPVATEQYGSVVVSTNNLQNGNNGT

SEQ ID NO: 53591 - protein, 30 aa, Artificial Sequence
  Description of Artificial Sequence: Synthetic polypeptide
QEEEIACTNPVATEQYGSVATNLQADNNRQ

SEQ ID NO: 53592 - protein, 29 aa, Artificial Sequence
  Description of Artificial Sequence: Synthetic peptide
TESEIRATNPVAYEQYGSVPTNELQHGNQ

SEQ ID NO: 53593 - protein, 33 aa, Artificial Sequence
  Description of Artificial Sequence: Synthetic polypeptide
DEEEIRTTNPVATEQYGSVSTTINDLQQGEEIL

SEQ ID NO: 53594 - protein, 31 aa, Artificial Sequence
  Description of Artificial Sequence: Synthetic polypeptide
DEEEIRTTNPVATEQYGSVSTTIVQGGSTIM

SEQ ID NO: 53595 - protein, 32 aa, Artificial Sequence
  Description of Artificial Sequence: Synthetic polypeptide
DEEEIRTTNPVATEQYGSVSTTIVVIRGEERE

SEQ ID NO: 53596 - protein, 32 aa, Artificial Sequence
  Description of Artificial Sequence: Synthetic polypeptide
DEEEIRTTNPVATEQYGSVSTTLDKSTQNERN

SEQ ID NO: 53597 - protein, 33 aa, Artificial Sequence
  Description of Artificial Sequence: Synthetic polypeptide
DEEEIRTTNPVATEQYGSVSTTLDLNQIGEFND

SEQ ID NO: 53598 - protein, 33 aa, Artificial Sequence
  Description of Artificial Sequence: Synthetic polypeptide
DEEEIRTTNPVATEQYGSVSTTLDLNQIGEFNG

SEQ ID NO: 53599 - protein, 32 aa, Artificial Sequence
  Description of Artificial Sequence: Synthetic polypeptide
TESEIRTTNPVATEQYGSVVSTNQSQRQGNYP

SEQ ID NO: 53600 - protein, 33 aa, Artificial Sequence
  Description of Artificial Sequence: Synthetic polypeptide
DEEEIRTTNPVATEQYGSVSTTLNDLQENENFE

SEQ ID NO: 53601 - protein, 33 aa, Artificial Sequence
  Description of Artificial Sequence: Synthetic polypeptide
TESEIRTTNPVATEQYGSVSTNLSQTRGGNNDK

SEQ ID NO: 53602 - protein, 33 aa, Artificial Sequence
  Description of Artificial Sequence: Synthetic polypeptide
AEEEIRTTNPVATEQYGSVVVSTNNLQLGGNVE

SEQ ID NO: 53603 - protein, 32 aa, Artificial Sequence
  Description of Artificial Sequence: Synthetic polypeptide
FEEEIRTTNPVATEQYGVVSTVNLQFNGGNEF

SEQ ID NO: 53604 - protein, 32 aa, Artificial Sequence
  Description of Artificial Sequence: Synthetic polypeptide
DEEEIRTTNPVATEQYGSVSTTLLERMMMPRM

SEQ ID NO: 53605 - protein, 33 aa, Artificial Sequence
  Description of Artificial Sequence: Synthetic polypeptide
DEEEIRTTNPVATEQYGSVSTTLLFQNGGGNEG

SEQ ID NO: 53606 - protein, 33 aa, Artificial Sequence
  Description of Artificial Sequence: Synthetic polypeptide
AEEEIRTTNPVATEQYGSVVVSTNNLQAGNANT

SEQ ID NO: 53607 - protein, 30 aa, Artificial Sequence
  Description of Artificial Sequence: Synthetic polypeptide
TESEIRTTNPVATEAYGSVWTNLSQIGGSR

SEQ ID NO: 53608 - protein, 33 aa, Artificial Sequence
  Description of Artificial Sequence: Synthetic polypeptide
AEEEIRTTNPVATEQYGSVVVSTNNLGQGTGNG

SEQ ID NO: 53609 - protein, 34 aa, Artificial Sequence
  Description of Artificial Sequence: Synthetic polypeptide
TESEIRTTNPVATEQYGSTVSCTGNLSQRGENYR

SEQ ID NO: 53610 - protein, 31 aa, Artificial Sequence
  Description of Artificial Sequence: Synthetic polypeptide
AEEEIATTNPVATEQYGSVATNLQAGPESRD

SEQ ID NO: 53611 - protein, 31 aa, Artificial Sequence
  Description of Artificial Sequence: Synthetic polypeptide
AEEEIRTTNPVSTEQWGSQVSTNLQSGGSNG

SEQ ID NO: 53612 - protein, 32 aa, Artificial Sequence
  Description of Artificial Sequence: Synthetic polypeptide
DEAEIRTTNPVATEQYGVVSTNLQSNGDNGGK

SEQ ID NO: 53613 - protein, 32 aa, Artificial Sequence
  Description of Artificial Sequence: Synthetic polypeptide
DEEEIRTTNPVATEQYGSVSTTVLTGMGGNGN

SEQ ID NO: 53614 - protein, 33 aa, Artificial Sequence
  Description of Artificial Sequence: Synthetic polypeptide
DEEEIRTTNPVATEQYGSVSTTVLVQRGEILVT

SEQ ID NO: 53615 - protein, 29 aa, Artificial Sequence
  Description of Artificial Sequence: Synthetic peptide
TEEGICTTNPVATEQYGSVVSTNLEMENQ

SEQ ID NO: 53616 - protein, 34 aa, Artificial Sequence
  Description of Artificial Sequence: Synthetic polypeptide
DEEEIRTTNPVATEQYGSVSTTVNLQSIGFNELE

SEQ ID NO: 53617 - protein, 31 aa, Artificial Sequence
  Description of Artificial Sequence: Synthetic polypeptide
DEEEIRTTNPVATEQYGSVSTTWLGRLTLGD

SEQ ID NO: 53618 - protein, 31 aa, Artificial Sequence
  Description of Artificial Sequence: Synthetic polypeptide
AEEEIATTNPVATEQYGSVAATNDQDRGNQM

SEQ ID NO: 53619 - protein, 33 aa, Artificial Sequence
  Description of Artificial Sequence: Synthetic polypeptide
DEEEIRTTNPVATEQYGSVSTVDDHQNGQNPRN

SEQ ID NO: 53620 - protein, 33 aa, Artificial Sequence
  Description of Artificial Sequence: Synthetic polypeptide
DEEEIRTTNPVATEQYGSVSTTVLQSNGGNGNE

SEQ ID NO: 53621 - protein, 31 aa, Artificial Sequence
  Description of Artificial Sequence: Synthetic polypeptide
DEEEIRTTNPVATEQYGSVSTVDGQENDEIR

SEQ ID NO: 53622 - protein, 33 aa, Artificial Sequence
  Description of Artificial Sequence: Synthetic polypeptide
DEAEIRTTNPVATEQYGSVVSYTNISQHVGNRF

SEQ ID NO: 53623 - protein, 33 aa, Artificial Sequence
  Description of Artificial Sequence: Synthetic polypeptide
DEAEIRTTNPVATEQYGSVVSTTNDGQNNGNSR

SEQ ID NO: 53624 - protein, 32 aa, Artificial Sequence
  Description of Artificial Sequence: Synthetic polypeptide
DEEEIRTTNPVATEQYGSVSTVDLLQNTGSQN

SEQ ID NO: 53625 - protein, 33 aa, Artificial Sequence
  Description of Artificial Sequence: Synthetic polypeptide
DEAEIRTTNPVATEQYGSVVSTNNLQGDGMNQE

SEQ ID NO: 53626 - protein, 33 aa, Artificial Sequence
  Description of Artificial Sequence: Synthetic polypeptide
DEAEIRTTNPVATEQYGSVVSTNNGDGERGNER

SEQ ID NO: 53627 - protein, 33 aa, Artificial Sequence
  Description of Artificial Sequence: Synthetic polypeptide
DEAEIRTTNPVATEQYGSVVSTNNDRGEHGNER

SEQ ID NO: 53628 - protein, 32 aa, Artificial Sequence
  Description of Artificial Sequence: Synthetic polypeptide
DEAEIRTTNPVATEQYGSVVSTNNDGEHGQNR

SEQ ID NO: 53629 - protein, 30 aa, Artificial Sequence
  Description of Artificial Sequence: Synthetic polypeptide
TEEGICTTNPVATEQYGSVSMNESQRGGNE

SEQ ID NO: 53630 - protein, 33 aa, Artificial Sequence
  Description of Artificial Sequence: Synthetic polypeptide
DEAEIRTTNPVATEQYGSVVSTNMLSGSPGNNR

SEQ ID NO: 53631 - protein, 33 aa, Artificial Sequence
  Description of Artificial Sequence: Synthetic polypeptide
DEEEIRTTNPVATEQYGSVSTTVLQSIGTNENE

SEQ ID NO: 53632 - protein, 33 aa, Artificial Sequence
  Description of Artificial Sequence: Synthetic polypeptide
DEEEIRTTNPVATEQYGSVSTTVLQGSGGNNGN

SEQ ID NO: 53633 - protein, 32 aa, Artificial Sequence
  Description of Artificial Sequence: Synthetic polypeptide
TEEGIRTTNPVATEQYGSVSMTSNLLSQQLNR

SEQ ID NO: 53634 - protein, 33 aa, Artificial Sequence
  Description of Artificial Sequence: Synthetic polypeptide
FEEEIRTTNPVATEQYGSVSTTGNLQDGGNTDE

SEQ ID NO: 53635 - protein, 31 aa, Artificial Sequence
  Description of Artificial Sequence: Synthetic polypeptide
AEEEIATTNPVATEQYGNVSHTMLQDGGQNR

SEQ ID NO: 53636 - protein, 30 aa, Artificial Sequence
  Description of Artificial Sequence: Synthetic polypeptide
TEEGIRTTNPVATEQYGSSVSTNLSMLERP

SEQ ID NO: 53637 - protein, 32 aa, Artificial Sequence
  Description of Artificial Sequence: Synthetic polypeptide
DEEEIRTTNPVATEQYGSVSTTTLTDGNEGNI

SEQ ID NO: 53638 - protein, 33 aa, Artificial Sequence
  Description of Artificial Sequence: Synthetic polypeptide
DEEEIRTTNPVATEQYGSVSTTTNGGQEGNQNF

SEQ ID NO: 53639 - protein, 30 aa, Artificial Sequence
  Description of Artificial Sequence: Synthetic polypeptide
AEEEIATTNPVATEQYGNVSVTMLQGGNIS

SEQ ID NO: 53640 - protein, 33 aa, Artificial Sequence
  Description of Artificial Sequence: Synthetic polypeptide
DEEEIRTTNPVATEQYGSVSTTVLQGSGTNENV

SEQ ID NO: 53641 - protein, 30 aa, Artificial Sequence
  Description of Artificial Sequence: Synthetic polypeptide
TEEGIRTTNPVATEQYGCVSTNLEMIENRD

SEQ ID NO: 53642 - protein, 29 aa, Artificial Sequence
  Description of Artificial Sequence: Synthetic peptide
TEEGIRTTNPVATEQYGCVSTNLEMEGQD

SEQ ID NO: 53643 - protein, 33 aa, Artificial Sequence
  Description of Artificial Sequence: Synthetic polypeptide
AEEEIRTTNPVATEQYGSVVVSTANLNQNGNTD

SEQ ID NO: 53644 - protein, 31 aa, Artificial Sequence
  Description of Artificial Sequence: Synthetic polypeptide
TEEGIRTTNPVATEAYGSVSCTNLSSMVGNR

SEQ ID NO: 53645 - protein, 31 aa, Artificial Sequence
  Description of Artificial Sequence: Synthetic polypeptide
QEEEIACTNPVATEQYGSVATNLQDGAPNRV

SEQ ID NO: 53646 - protein, 33 aa, Artificial Sequence
  Description of Artificial Sequence: Synthetic polypeptide
DEEEIRTTNPVATEQYGSVSTTVLQESGGNIND

SEQ ID NO: 53647 - protein, 29 aa, Artificial Sequence
  Description of Artificial Sequence: Synthetic peptide
TEEGICTTNPVAYEQYGSVSINSQRTGNS

SEQ ID NO: 53648 - protein, 33 aa, Artificial Sequence
  Description of Artificial Sequence: Synthetic polypeptide
DEEEIRTTNPVATEQYGSVSTTVLQESGGTNNI

SEQ ID NO: 53649 - protein, 29 aa, Artificial Sequence
  Description of Artificial Sequence: Synthetic peptide
TEEGIRTTNPVATEQYGCVSTNLEMENFQ

SEQ ID NO: 53650 - protein, 33 aa, Artificial Sequence
  Description of Artificial Sequence: Synthetic polypeptide
FEEEIRTTNPVATEQYGSVSTTGNLQQGQGGNE

SEQ ID NO: 53651 - protein, 31 aa, Artificial Sequence
  Description of Artificial Sequence: Synthetic polypeptide
DEEEIRTTNPVATEQYGSVSTVDPQAGEDTD

SEQ ID NO: 53652 - protein, 31 aa, Artificial Sequence
  Description of Artificial Sequence: Synthetic polypeptide
DEEEIRTTNPVATEQYGSVSTVELTDDQERQ

SEQ ID NO: 53653 - protein, 32 aa, Artificial Sequence
  Description of Artificial Sequence: Synthetic polypeptide
FEEEIRTTNPVATEQYGSVSTSNEGQEGENDD

SEQ ID NO: 53654 - protein, 33 aa, Artificial Sequence
  Description of Artificial Sequence: Synthetic polypeptide
DEEEIRTTNPVATEQYGSVSTVLQQNVDGNEMD

SEQ ID NO: 53655 - protein, 30 aa, Artificial Sequence
  Description of Artificial Sequence: Synthetic polypeptide
DEAEIRTTNPVATEQYGSVSWNNDIGNNIE

SEQ ID NO: 53656 - protein, 32 aa, Artificial Sequence
  Description of Artificial Sequence: Synthetic polypeptide
DEEEIRTTNPVATEQYGSVSTVLQRVEEEEES

SEQ ID NO: 53657 - protein, 30 aa, Artificial Sequence
  Description of Artificial Sequence: Synthetic polypeptide
DEAEIRTTNPVATEQYGSVSWDMIQNGNEE

SEQ ID NO: 53658 - protein, 33 aa, Artificial Sequence
  Description of Artificial Sequence: Synthetic polypeptide
DEEEIRTTNPVATEQYGSVSTVLQSENGENGQG

SEQ ID NO: 53659 - protein, 30 aa, Artificial Sequence
  Description of Artificial Sequence: Synthetic polypeptide
AEEEIATTNPVATEQYGSVATNDQDNGNNQ

SEQ ID NO: 53660 - protein, 32 aa, Artificial Sequence
  Description of Artificial Sequence: Synthetic polypeptide
AEEEIATTNPVATEQYGSVASATNLQDRNPNQ

SEQ ID NO: 53661 - protein, 32 aa, Artificial Sequence
  Description of Artificial Sequence: Synthetic polypeptide
DEEEIRTTNPVATEQYGSVSTVLVGMGGINDQ

SEQ ID NO: 53662 - protein, 32 aa, Artificial Sequence
  Description of Artificial Sequence: Synthetic polypeptide
DEEEIRTTNPVATEQYGSVSTVNDGQENDEER

SEQ ID NO: 53663 - protein, 30 aa, Artificial Sequence
  Description of Artificial Sequence: Synthetic polypeptide
AEEEIATTNPVATEQYGSVATNDQDQGENQ

SEQ ID NO: 53664 - protein, 31 aa, Artificial Sequence
  Description of Artificial Sequence: Synthetic polypeptide
AEEEIATTNPVATEQYGSVATNLAERGNDTP

SEQ ID NO: 53665 - protein, 33 aa, Artificial Sequence
  Description of Artificial Sequence: Synthetic polypeptide
DEEEIRTTNPVATEQYGSVSTVNLDFNGGQNQV

SEQ ID NO: 53666 - protein, 33 aa, Artificial Sequence
  Description of Artificial Sequence: Synthetic polypeptide
DEEEIRTTNPVATEQYGSVSTVNLIGSNGGNNQ

SEQ ID NO: 53667 - protein, 34 aa, Artificial Sequence
  Description of Artificial Sequence: Synthetic polypeptide
DEEEIRTTNPVATEQYGSVSTVNLIQEDGGNTQT

SEQ ID NO: 53668 - protein, 30 aa, Artificial Sequence
  Description of Artificial Sequence: Synthetic polypeptide
QEEEIACTNPVATEQYGSVATNLQDGPNED

SEQ ID NO: 53669 - protein, 33 aa, Artificial Sequence
  Description of Artificial Sequence: Synthetic polypeptide
DEEEIRTTNPVATEQYGSVSTVLVNQGSGQTNT

SEQ ID NO: 53670 - protein, 32 aa, Artificial Sequence
  Description of Artificial Sequence: Synthetic polypeptide
DEEEIRTTNPVATEQYGSVSTVDQNRMSNEDH

SEQ ID NO: 53671 - protein, 32 aa, Artificial Sequence
  Description of Artificial Sequence: Synthetic polypeptide
DEAEIRTTNPVATEQYGSVSYNMLQMAGEVNF

SEQ ID NO: 53672 - protein, 33 aa, Artificial Sequence
  Description of Artificial Sequence: Synthetic polypeptide
DEAEIRTTNPVATEQYGSVTSTNDNNGERNGNR

SEQ ID NO: 53673 - protein, 30 aa, Artificial Sequence
  Description of Artificial Sequence: Synthetic polypeptide
AEEEIRTTNPVATEQYGSVVVSNQNQTGNQ

SEQ ID NO: 53674 - protein, 33 aa, Artificial Sequence
  Description of Artificial Sequence: Synthetic polypeptide
FEEEIRTTNPVATEQYGSVSTSNEGQRGENGGF

SEQ ID NO: 53675 - protein, 32 aa, Artificial Sequence
  Description of Artificial Sequence: Synthetic polypeptide
DEEEIRTTNPVATEQYGSVSTVFNQGGEGGND

SEQ ID NO: 53676 - protein, 32 aa, Artificial Sequence
  Description of Artificial Sequence: Synthetic polypeptide
DEAEIRTTNPVATEQYGSVVPSCTNLSTGGSR

SEQ ID NO: 53677 - protein, 32 aa, Artificial Sequence
  Description of Artificial Sequence: Synthetic polypeptide
DEEEIRTTNPVATEQYGSVSTVGLIDRDVNED

SEQ ID NO: 53678 - protein, 32 aa, Artificial Sequence
  Description of Artificial Sequence: Synthetic polypeptide
DEEEIRTTNPVATEQYGSVSTVIVGQNSGNMG

SEQ ID NO: 53679 - protein, 31 aa, Artificial Sequence
  Description of Artificial Sequence: Synthetic polypeptide
DEEEIRTTNPVATEQYGSVSTVLEGPRSFEQ

SEQ ID NO: 53680 - protein, 33 aa, Artificial Sequence
  Description of Artificial Sequence: Synthetic polypeptide
DEEEIRTTNPVATEQYGSVSTVLQLDQGEGGNE

SEQ ID NO: 53681 - protein, 31 aa, Artificial Sequence
  Description of Artificial Sequence: Synthetic polypeptide
AEEEIATTNPVATEQYGSVAATNLTQDGNSP

SEQ ID NO: 53682 - protein, 31 aa, Artificial Sequence
  Description of Artificial Sequence: Synthetic polypeptide
AEEEIATTNPVATEQYGSVAITNLQDQGNDE

SEQ ID NO: 53683 - protein, 32 aa, Artificial Sequence
  Description of Artificial Sequence: Synthetic polypeptide
DEEEIRTTNPVATEQYGSVSTVLNGMQGINES

SEQ ID NO: 53684 - protein, 34 aa, Artificial Sequence
  Description of Artificial Sequence: Synthetic polypeptide
DEEEIRTTNPVATEQYGSVSTVLNLQSSEGGNDE

SEQ ID NO: 53685 - protein, 30 aa, Artificial Sequence
  Description of Artificial Sequence: Synthetic polypeptide
AEEEIATTNPVATEQYGSVANNLQDDGNDM

SEQ ID NO: 53686 - protein, 33 aa, Artificial Sequence
  Description of Artificial Sequence: Synthetic polypeptide
DEEEIRTTNPVATEQYGSVSTVLNQNVEGENEM

SEQ ID NO: 53687 - protein, 31 aa, Artificial Sequence
  Description of Artificial Sequence: Synthetic polypeptide
DEEEIRTTNPVATEQYGSVSTVLPDNDIDNQ

SEQ ID NO: 53688 - protein, 33 aa, Artificial Sequence
  Description of Artificial Sequence: Synthetic polypeptide
DEEEIRTTNPVATEQYGSVSTVLQGDGNGNFDF

SEQ ID NO: 53689 - protein, 30 aa, Artificial Sequence
  Description of Artificial Sequence: Synthetic polypeptide
TEEGICTTNPVATEQYGSVSCQNSQRGNNS

SEQ ID NO: 53690 - protein, 28 aa, Artificial Sequence
  Description of Artificial Sequence: Synthetic peptide
TEFEICTVNPVATEQYGSVSTNLEEVNH

SEQ ID NO: 53691 - protein, 33 aa, Artificial Sequence
  Description of Artificial Sequence: Synthetic polypeptide
FEEEIRTTNPVATEQYGSVSTTGNLQQTGNGGE

SEQ ID NO: 53692 - protein, 32 aa, Artificial Sequence
  Description of Artificial Sequence: Synthetic polypeptide
DEEEIRTTNPVATEQYGSVSTTTLGEGGNEFN

SEQ ID NO: 53693 - protein, 32 aa, Artificial Sequence
  Description of Artificial Sequence: Synthetic polypeptide
FEEEIRTTNPVATEQYGSVSTVMNLISGGNNT

SEQ ID NO: 53694 - protein, 32 aa, Artificial Sequence
  Description of Artificial Sequence: Synthetic polypeptide
AEEEIRTTNPVATEQYGSVVVSTNLGGNGNTE

SEQ ID NO: 53695 - protein, 30 aa, Artificial Sequence
  Description of Artificial Sequence: Synthetic polypeptide
TEEVICTTNPVATEQYGSVSCMNSSQRGNS

SEQ ID NO: 53696 - protein, 29 aa, Artificial Sequence
  Description of Artificial Sequence: Synthetic peptide
TEEVICTTNPVATEQYGSVATNLSMALNR

SEQ ID NO: 53697 - protein, 33 aa, Artificial Sequence
  Description of Artificial Sequence: Synthetic polypeptide
DEEEIRTTNPVATEQYGSVSTTNNGIQESGNNT

SEQ ID NO: 53698 - protein, 30 aa, Artificial Sequence
  Description of Artificial Sequence: Synthetic polypeptide
TEESIRTTNPVAYEQYGKTVSTNLSMVGNR

SEQ ID NO: 53699 - protein, 33 aa, Artificial Sequence
  Description of Artificial Sequence: Synthetic polypeptide
DEEEIRTTNPVATEQYGSVSTTNNLGGQQGQEV

SEQ ID NO: 53700 - protein, 31 aa, Artificial Sequence
  Description of Artificial Sequence: Synthetic polypeptide
DEAEIRTTNPVATEQYGTVSTNLQGEHNNQQ

SEQ ID NO: 53701 - protein, 34 aa, Artificial Sequence
  Description of Artificial Sequence: Synthetic polypeptide
DEEEIRTTNPVATEQYGSVSTTNNLQVPVGENEE

SEQ ID NO: 53702 - protein, 32 aa, Artificial Sequence
  Description of Artificial Sequence: Synthetic polypeptide
DEEEIRTTNPVATEQYGSVSTTNNNRTLNIED

SEQ ID NO: 53703 - protein, 31 aa, Artificial Sequence
  Description of Artificial Sequence: Synthetic polypeptide
AEEEIATTNPVATEQYGCVATNLQANGDNRD

SEQ ID NO: 53704 - protein, 32 aa, Artificial Sequence
  Description of Artificial Sequence: Synthetic polypeptide
DEEEIRTTNPVATEQYGSVSTTNNQGQQGQQV

SEQ ID NO: 53705 - protein, 33 aa, Artificial Sequence
  Description of Artificial Sequence: Synthetic polypeptide
DEEEIRTTNPVATEQYGSVSTTNPLNRGEEVLD

SEQ ID NO: 53706 - protein, 33 aa, Artificial Sequence
  Description of Artificial Sequence: Synthetic polypeptide
DEEEIRTTNPVATEQYGSVSTTNQGGQQGGNQF

SEQ ID NO: 53707 - protein, 28 aa, Artificial Sequence
  Description of Artificial Sequence: Synthetic peptide
TEESIATTNPVATEQYGSVATNLGMLNN

SEQ ID NO: 53708 - protein, 31 aa, Artificial Sequence
  Description of Artificial Sequence: Synthetic polypeptide
DEEEIRTTNPVATEQYGSVSTTNQNTPGLEV

SEQ ID NO: 53709 - protein, 33 aa, Artificial Sequence
  Description of Artificial Sequence: Synthetic polypeptide
DEEEIRTTNPVATEQYGSVSTTNNMLQVPFENE

SEQ ID NO: 53710 - protein, 34 aa, Artificial Sequence
  Description of Artificial Sequence: Synthetic polypeptide
DEEEIRTTNPVATEQYGSVSTTNQQLQQGSTNQE

SEQ ID NO: 53711 - protein, 33 aa, Artificial Sequence
  Description of Artificial Sequence: Synthetic polypeptide
DEEEIRTTNPVATEQYGSVSTTNMIRIGDPQRS

SEQ ID NO: 53712 - protein, 33 aa, Artificial Sequence
  Description of Artificial Sequence: Synthetic polypeptide
DEEEIRTTNPVATEQYGSVSTTNLVQIDGIIDI

SEQ ID NO: 53713 - protein, 33 aa, Artificial Sequence
  Description of Artificial Sequence: Synthetic polypeptide
DEAEIRTTNPVATEQYGVVSTNLNQGNDEGNTR

SEQ ID NO: 53714 - protein, 32 aa, Artificial Sequence
  Description of Artificial Sequence: Synthetic polypeptide
TEEVIRTTNPVATEQYGSVVSTNELSSMVGNR

SEQ ID NO: 53715 - protein, 32 aa, Artificial Sequence
  Description of Artificial Sequence: Synthetic polypeptide
FEEEIRTTNPVATEQYGSVSTVNEQTGGGNGN

SEQ ID NO: 53716 - protein, 31 aa, Artificial Sequence
  Description of Artificial Sequence: Synthetic polypeptide
DEAEIRTTNPVATEQYGVVSTMELQRFPSNQ

SEQ ID NO: 53717 - protein, 30 aa, Artificial Sequence
  Description of Artificial Sequence: Synthetic polypeptide
DEAEIRTTNPVATEQYGVVSTKPQRPENDT

SEQ ID NO: 53718 - protein, 31 aa, Artificial Sequence
  Description of Artificial Sequence: Synthetic polypeptide
DEAEIRTTNPVATEQYGVVSTEELQRSPSND

SEQ ID NO: 53719 - protein, 29 aa, Artificial Sequence
  Description of Artificial Sequence: Synthetic peptide
DEAEIRTTNPVATEQYGVVSTEDQGPSND

SEQ ID NO: 53720 - protein, 33 aa, Artificial Sequence
  Description of Artificial Sequence: Synthetic polypeptide
FEEEIRTTNPVATEQYGSVSTVMNLISGQGGNT

SEQ ID NO: 53721 - protein, 31 aa, Artificial Sequence
  Description of Artificial Sequence: Synthetic polypeptide
DEAEIRTTNPVATEQYGVVSNTELQRFPSND

SEQ ID NO: 53722 - protein, 31 aa, Artificial Sequence
  Description of Artificial Sequence: Synthetic polypeptide
DEAEIRTTNPVATEQYGVVSCTGLSQRPGSD

SEQ ID NO: 53723 - protein, 33 aa, Artificial Sequence
  Description of Artificial Sequence: Synthetic polypeptide
DEEEIRTTNPVATEQYGSVSTTNLQVAGIELTT

SEQ ID NO: 53724 - protein, 33 aa, Artificial Sequence
  Description of Artificial Sequence: Synthetic polypeptide
DEEEIRTTNPVATEQYGSVSTTNLQVDGIELVS

SEQ ID NO: 53725 - protein, 33 aa, Artificial Sequence
  Description of Artificial Sequence: Synthetic polypeptide
DEEEIRTTNPVATEQYGSVSTTNLQVRPVQPFI

SEQ ID NO: 53726 - protein, 32 aa, Artificial Sequence
  Description of Artificial Sequence: Synthetic polypeptide
TEEVIRTTNPVATEQYGSVVSCTNLSDNGTNR

SEQ ID NO: 53727 - protein, 33 aa, Artificial Sequence
  Description of Artificial Sequence: Synthetic polypeptide
DEEEIRTTNPVATEQYGSVSTTNLQVVLGEQLF

SEQ ID NO: 53728 - protein, 33 aa, Artificial Sequence
  Description of Artificial Sequence: Synthetic polypeptide
DEEEIRTTNPVATEQYGSVSTTNLTGFGENTGQ

SEQ ID NO: 53729 - protein, 31 aa, Artificial Sequence
  Description of Artificial Sequence: Synthetic polypeptide
DEAEIRTTNPVATEQYGVVSNNLQGDGDNNG

SEQ ID NO: 53730 - protein, 33 aa, Artificial Sequence
  Description of Artificial Sequence: Synthetic polypeptide
DEEEIRTTNPVATEQYGSVSTTTLQEGFGENTG

SEQ ID NO: 53731 - protein, 33 aa, Artificial Sequence
  Description of Artificial Sequence: Synthetic polypeptide
DEEEIRTTNPVATEQYGSVSTTNSLVQSQMARY

SEQ ID NO: 53732 - protein, 28 aa, Artificial Sequence
  Description of Artificial Sequence: Synthetic peptide
TEESIACTNPVATEQYGSVATNLTMLNR

SEQ ID NO: 53733 - protein, 32 aa, Artificial Sequence
  Description of Artificial Sequence: Synthetic polypeptide
AEEEIRTTNPVATEQYGSVVVSTDNGQIGNTG

SEQ ID NO: 53734 - protein, 33 aa, Artificial Sequence
  Description of Artificial Sequence: Synthetic polypeptide
DEEEIRTTNPVATEQYGSVSTTQLPNQLQEDNQ

SEQ ID NO: 53735 - protein, 33 aa, Artificial Sequence
  Description of Artificial Sequence: Synthetic polypeptide
DEEEIRTTNPVATEQYGSVSTTQNGGQNGGNQQ

SEQ ID NO: 53736 - protein, 28 aa, Artificial Sequence
  Description of Artificial Sequence: Synthetic peptide
AEEEIATTNPVATEQYGEASENCQHGGR

SEQ ID NO: 53737 - protein, 28 aa, Artificial Sequence
  Description of Artificial Sequence: Synthetic peptide
AEEEIATTNPVATEQYGEASENCQRGEK

SEQ ID NO: 53738 - protein, 28 aa, Artificial Sequence
  Description of Artificial Sequence: Synthetic peptide
AEEEIATTNPVATEQYGEASENLQHEGR

SEQ ID NO: 53739 - protein, 31 aa, Artificial Sequence
  Description of Artificial Sequence: Synthetic polypeptide
AEEEIATTNPVATEQYGEASSTTNLQRGMNV

SEQ ID NO: 53740 - protein, 30 aa, Artificial Sequence
  Description of Artificial Sequence: Synthetic polypeptide
DEEEIRTTNPVATEQYGSVSTTPQTAETQQ

SEQ ID NO: 53741 - protein, 30 aa, Artificial Sequence
  Description of Artificial Sequence: Synthetic polypeptide
QEEEIACTNPVATEQYGSVATNLQDDGNPD

SEQ ID NO: 53742 - protein, 29 aa, Artificial Sequence
  Description of Artificial Sequence: Synthetic peptide
TEEGIRTTNPVATEQYGSVSTLLSEVVNV

SEQ ID NO: 53743 - protein, 32 aa, Artificial Sequence
  Description of Artificial Sequence: Synthetic polypeptide
DEEEIRTTNPVATEQYGSVSTTQQLLQNSQNV

SEQ ID NO: 53744 - protein, 33 aa, Artificial Sequence
  Description of Artificial Sequence: Synthetic polypeptide
DEEEIRTTNPVATEQYGSVSTTQQLLQQNSTNR

SEQ ID NO: 53745 - protein, 31 aa, Artificial Sequence
  Description of Artificial Sequence: Synthetic polypeptide
TEEGIRTTNPVATEQYGSVSTGNLDGNMNNR

SEQ ID NO: 53746 - protein, 31 aa, Artificial Sequence
  Description of Artificial Sequence: Synthetic polypeptide
TEEGIRTTNPVATEQYGSVSPTSNLSMQENR

SEQ ID NO: 53747 - protein, 31 aa, Artificial Sequence
  Description of Artificial Sequence: Synthetic polypeptide
TEEGIRTTNPVATEQYGSVSPTNLSMMLNER

SEQ ID NO: 53748 - protein, 32 aa, Artificial Sequence
  Description of Artificial Sequence: Synthetic polypeptide
TEEGIRTTNPVATEQYGSVSPTNLQSMQLNVR

SEQ ID NO: 53749 - protein, 31 aa, Artificial Sequence
  Description of Artificial Sequence: Synthetic polypeptide
TEEGIRTTNPVATEQYGSVSTLNLTEGLDRG

SEQ ID NO: 53750 - protein, 32 aa, Artificial Sequence
  Description of Artificial Sequence: Synthetic polypeptide
FEEEIRTTNPVATEQYGSVSTTQNGQGGNEEE

SEQ ID NO: 53751 - protein, 33 aa, Artificial Sequence
  Description of Artificial Sequence: Synthetic polypeptide
DEEEIRTTNPVATEQYGSVSTTPNLVISGEVRI

SEQ ID NO: 53752 - protein, 30 aa, Artificial Sequence
  Description of Artificial Sequence: Synthetic polypeptide
TEEGIRTTNPVATEQYGSVSTNLSNMLDRD

SEQ ID NO: 53753 - protein, 33 aa, Artificial Sequence
  Description of Artificial Sequence: Synthetic polypeptide
FEEEIRTTNPVATEQYGSVSTTNLQFQEGNGGE

SEQ ID NO: 53754 - protein, 32 aa, Artificial Sequence
  Description of Artificial Sequence: Synthetic polypeptide
AEEEIRTTNPVATEQYGSVVVSTNDNQQIGNS

SEQ ID NO: 53755 - protein, 32 aa, Artificial Sequence
  Description of Artificial Sequence: Synthetic polypeptide
FEEEIRTTNPVATEQYGSVSTTNGQEGGNEEE

SEQ ID NO: 53756 - protein, 29 aa, Artificial Sequence
  Description of Artificial Sequence: Synthetic peptide
TEEQIRTTNPVATEQYGSVSTHESTRVNT

SEQ ID NO: 53757 - protein, 28 aa, Artificial Sequence
  Description of Artificial Sequence: Synthetic peptide
TEEQIATTNPVATEQYGCVATNLTMMNR

SEQ ID NO: 53758 - protein, 28 aa, Artificial Sequence
  Description of Artificial Sequence: Synthetic peptide
TEENIRTTNPVAYEQYGTVSTNDSGHNR

SEQ ID NO: 53759 - protein, 32 aa, Artificial Sequence
  Description of Artificial Sequence: Synthetic polypeptide
DEEEIRTTNPVATEQYGSVSTTPAGMMRGNPV

SEQ ID NO: 53760 - protein, 34 aa, Artificial Sequence
  Description of Artificial Sequence: Synthetic polypeptide
DEEEIRTTNPVATEQYGSVSTTPNLQQETVGNGG

SEQ ID NO: 53761 - protein, 33 aa, Artificial Sequence
  Description of Artificial Sequence: Synthetic polypeptide
FEEEIRTTNPVATEQYGSVSTTMNLQGGENTIE

SEQ ID NO: 53762 - protein, 33 aa, Artificial Sequence
  Description of Artificial Sequence: Synthetic polypeptide
FEEEIRTTNPVATEQYGSVSTTMNLQEGTGNGN

SEQ ID NO: 53763 - protein, 32 aa, Artificial Sequence
  Description of Artificial Sequence: Synthetic polypeptide
AEEEIRTTNPVATEQYGSVVVSTDNQQIGNNG

SEQ ID NO: 53764 - protein, 31 aa, Artificial Sequence
  Description of Artificial Sequence: Synthetic polypeptide
TEEGIRTTNPVATEQYGSVSTSNLSMNLNER

SEQ ID NO: 53765 - protein, 33 aa, Artificial Sequence
  Description of Artificial Sequence: Synthetic polypeptide
FEEEIRTTNPVATEQYGSVSTTMNLGQEGGNDN

SEQ ID NO: 53766 - protein, 33 aa, Artificial Sequence
  Description of Artificial Sequence: Synthetic polypeptide
FEEEIRTTNPVATEQYGSVSTTMNLDQQGNGNE

SEQ ID NO: 53767 - protein, 28 aa, Artificial Sequence
  Description of Artificial Sequence: Synthetic peptide
AEEEIATTNPVATEQYGEAPENLQHGGR

SEQ ID NO: 53768 - protein, 32 aa, Artificial Sequence
  Description of Artificial Sequence: Synthetic polypeptide
TEEGIRTTNPVATEQYGSVSTNLSTMTLGNNR

SEQ ID NO: 53769 - protein, 34 aa, Artificial Sequence
  Description of Artificial Sequence: Synthetic polypeptide
DEAEIRTTNPVATEQYGSVYSTWQLEQFRGDNRI

SEQ ID NO: 53770 - protein, 32 aa, Artificial Sequence
  Description of Artificial Sequence: Synthetic polypeptide
FEEEIRTTNPVATEQYGSVSTGNEGQTGGNGN

SEQ ID NO: 53771 - protein, 33 aa, Artificial Sequence
  Description of Artificial Sequence: Synthetic polypeptide
FEEEIRTTNPVATEQYGSVSTMNLQDQGGNTDE

SEQ ID NO: 53772 - protein, 32 aa, Artificial Sequence
  Description of Artificial Sequence: Synthetic polypeptide
DEAEIRTTNPVATEQWGSVVSTNLSGSAGNNR

SEQ ID NO: 53773 - protein, 33 aa, Artificial Sequence
  Description of Artificial Sequence: Synthetic polypeptide
DEAEIRTTNPVATEQYGDVSCATNQLQRGDTRV

SEQ ID NO: 53774 - protein, 31 aa, Artificial Sequence
  Description of Artificial Sequence: Synthetic polypeptide
DEEEIRTTNPVATEQYGSVTPENLQPPQTDR

SEQ ID NO: 53775 - protein, 31 aa, Artificial Sequence
  Description of Artificial Sequence: Synthetic polypeptide
DEAEIRTTNPVATEQYGEVSTNLNGDLGNEQ

SEQ ID NO: 53776 - protein, 31 aa, Artificial Sequence
  Description of Artificial Sequence: Synthetic polypeptide
DEEEIRTTNPVATEQYGSVTWTPTLQRNFDN

SEQ ID NO: 53777 - protein, 32 aa, Artificial Sequence
  Description of Artificial Sequence: Synthetic polypeptide
DEAEIRTTNPVATEQYGEVSTNLQGGTGNDEE

SEQ ID NO: 53778 - protein, 29 aa, Artificial Sequence
  Description of Artificial Sequence: Synthetic peptide
AEEEIRATNPCATEQYGSVSVENLNSGNM

SEQ ID NO: 53779 - protein, 28 aa, Artificial Sequence
  Description of Artificial Sequence: Synthetic peptide
AEEEIRATNPCATEQYGVVSENLMQGNV

SEQ ID NO: 53780 - protein, 31 aa, Artificial Sequence
  Description of Artificial Sequence: Synthetic polypeptide
DEEEIRTTNPVATEQYGSVTYTNNELRGSDD

SEQ ID NO: 53781 - protein, 32 aa, Artificial Sequence
  Description of Artificial Sequence: Synthetic polypeptide
DEEEIRTTNPVATEQYGSVTYTNQDQLRGDAD

SEQ ID NO: 53782 - protein, 33 aa, Artificial Sequence
  Description of Artificial Sequence: Synthetic polypeptide
TEEEIRTTNPVATEQYGSVSTNNLSARVGNNKT

SEQ ID NO: 53783 - protein, 31 aa, Artificial Sequence
  Description of Artificial Sequence: Synthetic polypeptide
DEEEIRTTNPVATEQYGSVTYTNQNDLRGDD

SEQ ID NO: 53784 - protein, 28 aa, Artificial Sequence
  Description of Artificial Sequence: Synthetic peptide
QEEEIASTNPVATEQYGVVPENLQSGNQ

SEQ ID NO: 53785 - protein, 30 aa, Artificial Sequence
  Description of Artificial Sequence: Synthetic polypeptide
AEEEICTTNPVATEQYGVVSVTTLQMGGNA

SEQ ID NO: 53786 - protein, 32 aa, Artificial Sequence
  Description of Artificial Sequence: Synthetic polypeptide
DEEEIRTTNPVATEQYGSVVAINLEQMLNPTR

SEQ ID NO: 53787 - protein, 31 aa, Artificial Sequence
  Description of Artificial Sequence: Synthetic polypeptide
DEAEIRTTNPVATEQYGEVSTNLQIGGGDEN

SEQ ID NO: 53788 - protein, 31 aa, Artificial Sequence
  Description of Artificial Sequence: Synthetic polypeptide
DEEEIRTTNPVATEQYGSVVANTLELNNQRD

SEQ ID NO: 53789 - protein, 32 aa, Artificial Sequence
  Description of Artificial Sequence: Synthetic polypeptide
DEAEIRTTNPVATEQYGEVSTNLQIGGGNNEH

SEQ ID NO: 53790 - protein, 29 aa, Artificial Sequence
  Description of Artificial Sequence: Synthetic peptide
AEEEIRATNPCATEQYGVVSTENLMSGNM

SEQ ID NO: 53791 - protein, 34 aa, Artificial Sequence
  Description of Artificial Sequence: Synthetic polypeptide
DEEEIRTTNPVATEQYGSVVATGNLSQPPNVGNR

SEQ ID NO: 53792 - protein, 33 aa, Artificial Sequence
  Description of Artificial Sequence: Synthetic polypeptide
FEEEIRTTNPVATEQYGSVISTNLQSGTGNDDG

SEQ ID NO: 53793 - protein, 33 aa, Artificial Sequence
  Description of Artificial Sequence: Synthetic polypeptide
FEEEIRTTNPVATEQYGSVISTNLQSGGGENEG

SEQ ID NO: 53794 - protein, 34 aa, Artificial Sequence
  Description of Artificial Sequence: Synthetic polypeptide
DEEEIRTTNPVATEQYGSVVCSCTNNLSTGGGNR

SEQ ID NO: 53795 - protein, 32 aa, Artificial Sequence
  Description of Artificial Sequence: Synthetic polypeptide
FEEEIRTTNPVATEQYGSVSNTNIGQGGNEEE

SEQ ID NO: 53796 - protein, 32 aa, Artificial Sequence
  Description of Artificial Sequence: Synthetic polypeptide
DEEEIRTTNPVATEQYGSVTMTGNGIQEDGNF

SEQ ID NO: 53797 - protein, 32 aa, Artificial Sequence
  Description of Artificial Sequence: Synthetic polypeptide
DEAEIRTTNPVATEQYGEVSTNLQIGDGNDGE

SEQ ID NO: 53798 - protein, 32 aa, Artificial Sequence
  Description of Artificial Sequence: Synthetic polypeptide
DEEEIRTTNPVATEQYGSVTMTDNGIQEGGNI

SEQ ID NO: 53799 - protein, 33 aa, Artificial Sequence
  Description of Artificial Sequence: Synthetic polypeptide
DEEEIRTTNPVATEQYGSVTVVTSNLSQNIGNT

SEQ ID NO: 53800 - protein, 34 aa, Artificial Sequence
  Description of Artificial Sequence: Synthetic polypeptide
TEEEIRTTNPVATEQYGSVNCTGNLSQRTGENYR

SEQ ID NO: 53801 - protein, 29 aa, Artificial Sequence
  Description of Artificial Sequence: Synthetic peptide
AEEEIRATNPCATEQYGSVSENLELGNMG

SEQ ID NO: 53802 - protein, 33 aa, Artificial Sequence
  Description of Artificial Sequence: Synthetic polypeptide
DEEEIRTTNPVATEQYGSVTTPNMLDQRGEDIQ

SEQ ID NO: 53803 - protein, 30 aa, Artificial Sequence
  Description of Artificial Sequence: Synthetic polypeptide
TEEEIRTTNPVATEQYGSVNTALQNNGEFF

SEQ ID NO: 53804 - protein, 32 aa, Artificial Sequence
  Description of Artificial Sequence: Synthetic polypeptide
DEEEIRTTNPVATEQYGSVTQTNLQTIENELQ

SEQ ID NO: 53805 - protein, 32 aa, Artificial Sequence
  Description of Artificial Sequence: Synthetic polypeptide
DEEEIRTTNPVATEQYGSVTQTNLINGENNEL

SEQ ID NO: 53806 - protein, 33 aa, Artificial Sequence
  Description of Artificial Sequence: Synthetic polypeptide
FEEEIRTTNPVATEQYGSVNSDTNLQNDGVNDQ

SEQ ID NO: 53807 - protein, 30 aa, Artificial Sequence
  Description of Artificial Sequence: Synthetic polypeptide
AEEEIKTTNPVATEGYGCTSIMNLQRPGNR

SEQ ID NO: 53808 - protein, 32 aa, Artificial Sequence
  Description of Artificial Sequence: Synthetic polypeptide
DEEEIRTTNPVATEQYGSVTQAGNEIGRGNRT

SEQ ID NO: 53809 - protein, 32 aa, Artificial Sequence
  Description of Artificial Sequence: Synthetic polypeptide
DEEEIRTTNPVATEQYGSVTPTVNEQRGQLFG

SEQ ID NO: 53810 - protein, 32 aa, Artificial Sequence
  Description of Artificial Sequence: Synthetic polypeptide
AEEEIGTTNPVATEQYGSVSTNQLNQEIMGNL

SEQ ID NO: 53811 - protein, 33 aa, Artificial Sequence
  Description of Artificial Sequence: Synthetic polypeptide
FEEEIRTTNPVATEQYGSVSGTNLQAGEGNQGI

SEQ ID NO: 53812 - protein, 33 aa, Artificial Sequence
  Description of Artificial Sequence: Synthetic polypeptide
DEEEIRTTNPVATEQYGSVTVVTQNLGQAIGNT

SEQ ID NO: 53813 - protein, 32 aa, Artificial Sequence
  Description of Artificial Sequence: Synthetic polypeptide
DEEEIRTTNPVATEQYGSVTVGPLQEGGNNRD

SEQ ID NO: 53814 - protein, 33 aa, Artificial Sequence
  Description of Artificial Sequence: Synthetic polypeptide
TEEEIRTTNPVATEQYGSVNITGNLSTRGGNYR

SEQ ID NO: 53815 - protein, 31 aa, Artificial Sequence
  Description of Artificial Sequence: Synthetic polypeptide
AEEEIGTTNPVATEQYGSVSTNQAQEEMGNL

SEQ ID NO: 53816 - protein, 34 aa, Artificial Sequence
  Description of Artificial Sequence: Synthetic polypeptide
DEEEIRTTNPVATEQYGSVTVSVTENLLQAIGNT

SEQ ID NO: 53817 - protein, 33 aa, Artificial Sequence
  Description of Artificial Sequence: Synthetic polypeptide
DEEEIRTTNPVATEQYGSVTPTMNLDQRGLFIE

SEQ ID NO: 53818 - protein, 33 aa, Artificial Sequence
  Description of Artificial Sequence: Synthetic polypeptide
DEEEIRTTNPVATEQYGSVTPTMNEQRMFVNER

SEQ ID NO: 53819 - protein, 30 aa, Artificial Sequence
  Description of Artificial Sequence: Synthetic polypeptide
DEEEIRTTNPVATEQYGSVTPTMMQEENNQ

SEQ ID NO: 53820 - protein, 31 aa, Artificial Sequence
  Description of Artificial Sequence: Synthetic polypeptide
FEEEIRTTNPVATEQYGSVITNQQDVGENEL

SEQ ID NO: 53821 - protein, 31 aa, Artificial Sequence
  Description of Artificial Sequence: Synthetic polypeptide
DEEEIRTTNPVATEQYGSVTPTMMQEENEDR

SEQ ID NO: 53822 - protein, 29 aa, Artificial Sequence
  Description of Artificial Sequence: Synthetic peptide
AEEEICTVNPVATEQYGSVSTALQRNTQE

SEQ ID NO: 53823 - protein, 33 aa, Artificial Sequence
  Description of Artificial Sequence: Synthetic polypeptide
TEEEIRTTNPVATEQYGSVSTNLSQGTSGNYPL

SEQ ID NO: 53824 - protein, 33 aa, Artificial Sequence
  Description of Artificial Sequence: Synthetic polypeptide
TEEEIRTTNPVATEQYGSVNETDNLDQRGENYG

SEQ ID NO: 53825 - protein, 32 aa, Artificial Sequence
  Description of Artificial Sequence: Synthetic polypeptide
DEEEIRTTNPVATEQYGSVTPTNEQAIGPEQR

SEQ ID NO: 53826 - protein, 31 aa, Artificial Sequence
  Description of Artificial Sequence: Synthetic polypeptide
DEAEIRTTNPVATEQYGCTCSTNLQRSGDQA

SEQ ID NO: 53827 - protein, 32 aa, Artificial Sequence
  Description of Artificial Sequence: Synthetic polypeptide
FEEEIRTTNPVATEQYGSVSNTNLEQRTFEDL

SEQ ID NO: 53828 - protein, 31 aa, Artificial Sequence
  Description of Artificial Sequence: Synthetic polypeptide
DEEEIRTTNPVATEQYGSVVETNHNQRSEDG

SEQ ID NO: 53829 - protein, 33 aa, Artificial Sequence
  Description of Artificial Sequence: Synthetic polypeptide
DEEEIRTTNPVATEQYGSVVGSTVLQQDEGNEG

SEQ ID NO: 53830 - protein, 33 aa, Artificial Sequence
  Description of Artificial Sequence: Synthetic polypeptide
DEEEIRTTNPVATEQYGSVVITNLQPDTNNPRD

SEQ ID NO: 53831 - protein, 32 aa, Artificial Sequence
  Description of Artificial Sequence: Synthetic polypeptide
TEEEIRTTNPVATEQYGSVVATNPSQPNVGNR

SEQ ID NO: 53832 - protein, 32 aa, Artificial Sequence
  Description of Artificial Sequence: Synthetic polypeptide
DEEEIRTTNPVATEQYGSVSYTTHQDATDNQR

SEQ ID NO: 53833 - protein, 34 aa, Artificial Sequence
  Description of Artificial Sequence: Synthetic polypeptide
DEEEIRTTNPVATEQYGSVSYTPNWLEQRIVANL

SEQ ID NO: 53834 - protein, 31 aa, Artificial Sequence
  Description of Artificial Sequence: Synthetic polypeptide
DEEEIRTTNPVATEQYGSVVIVNLDWGTNIQ

SEQ ID NO: 53835 - protein, 33 aa, Artificial Sequence
  Description of Artificial Sequence: Synthetic polypeptide
TEEEIRTTNPVATEQYGSVVSTNLSGRTQGNYQ

SEQ ID NO: 53836 - protein, 32 aa, Artificial Sequence
  Description of Artificial Sequence: Synthetic polypeptide
FEEEIRTTNPVATEQYGSVSPTNLQQQNNVVE

SEQ ID NO: 53837 - protein, 34 aa, Artificial Sequence
  Description of Artificial Sequence: Synthetic polypeptide
DEEEIRTTNPVATEQYGSVSYTPNFLQRMTNNQN

SEQ ID NO: 53838 - protein, 32 aa, Artificial Sequence
  Description of Artificial Sequence: Synthetic polypeptide
DEEEIRTTNPVATEQYGSVSYTNYLLDTGDEL

SEQ ID NO: 53839 - protein, 32 aa, Artificial Sequence
  Description of Artificial Sequence: Synthetic polypeptide
DEEEIRTTNPVATEQYGSVSYTNGGQGGEQGE

SEQ ID NO: 53840 - protein, 33 aa, Artificial Sequence
  Description of Artificial Sequence: Synthetic polypeptide
DEEEIRTTNPVATEQYGSVVGSTVLQNDGFNIE

SEQ ID NO: 53841 - protein, 31 aa, Artificial Sequence
  Description of Artificial Sequence: Synthetic polypeptide
DEEEIRTTNPVATEQYGSVSYTNGGEGGQGT

SEQ ID NO: 53842 - protein, 33 aa, Artificial Sequence
  Description of Artificial Sequence: Synthetic polypeptide
DEEEIRTTNPVATEQYGSVSYTNDDPYRYENRI

SEQ ID NO: 53843 - protein, 35 aa, Artificial Sequence
  Description of Artificial Sequence: Synthetic polypeptide
DEEEIRTTNPVATEQYGSVSYTNASSQNRGGNNRQ

SEQ ID NO: 53844 - protein, 32 aa, Artificial Sequence
  Description of Artificial Sequence: Synthetic polypeptide
DEAEIRTTNPVATEQYGQVSCTGTLSQRGGSR

SEQ ID NO: 53845 - protein, 32 aa, Artificial Sequence
  Description of Artificial Sequence: Synthetic polypeptide
DEEEIRTTNPVATEQYGSVVMDTQLQSNFGNP

SEQ ID NO: 53846 - protein, 28 aa, Artificial Sequence
  Description of Artificial Sequence: Synthetic peptide
QEEEIAPTNPVCTEQYGVVSDNLQSGTR

SEQ ID NO: 53847 - protein, 33 aa, Artificial Sequence
  Description of Artificial Sequence: Synthetic polypeptide
DEAEIRTTNPVATEQYGQVSCTTELSQRGGNYR

SEQ ID NO: 53848 - protein, 32 aa, Artificial Sequence
  Description of Artificial Sequence: Synthetic polypeptide
DEAEIRTTNPVATEQYGQVSCTTLSQQGGNNR

SEQ ID NO: 53849 - protein, 34 aa, Artificial Sequence
  Description of Artificial Sequence: Synthetic polypeptide
TEEEIRTTNPVATEQYGSVWTDNGLKQRAGENDR

SEQ ID NO: 53850 - protein, 31 aa, Artificial Sequence
  Description of Artificial Sequence: Synthetic polypeptide
TEEEIRTTNPVATEQYGSYSTMELQREQGGD

SEQ ID NO: 53851 - protein, 31 aa, Artificial Sequence
  Description of Artificial Sequence: Synthetic polypeptide
TEEEIRTTNPVATEQYGTISTENMLSQRENN

SEQ ID NO: 53852 - protein, 31 aa, Artificial Sequence
  Description of Artificial Sequence: Synthetic polypeptide
TEEEIRTTNPVATEQYGTISTGNSLSQRVNN

SEQ ID NO: 53853 - protein, 35 aa, Artificial Sequence
  Description of Artificial Sequence: Synthetic polypeptide
DEEEIRTTNPVATEQYGSVSYTNELSQNRGGNNDQ

SEQ ID NO: 53854 - protein, 32 aa, Artificial Sequence
  Description of Artificial Sequence: Synthetic polypeptide
FEEEIRTTNPVATEQYGSVSNTNLEQRTIDDL

SEQ ID NO: 53855 - protein, 32 aa, Artificial Sequence
  Description of Artificial Sequence: Synthetic polypeptide
FEEEIRTTNPVATEQYGSVGTNLEQQTGNIGG

SEQ ID NO: 53856 - protein, 31 aa, Artificial Sequence
  Description of Artificial Sequence: Synthetic polypeptide
TEEEIRTTNPVATEQYGSVVACTALQNGGSR

SEQ ID NO: 53857 - protein, 33 aa, Artificial Sequence
  Description of Artificial Sequence: Synthetic polypeptide
DEEEIRTTNPVATEQYGSVTISTGLQGGGGGNS

SEQ ID NO: 53858 - protein, 33 aa, Artificial Sequence
  Description of Artificial Sequence: Synthetic polypeptide
DEEEIRTTNPVATEQYGSVVFNLEQLRNGENFA

SEQ ID NO: 53859 - protein, 32 aa, Artificial Sequence
  Description of Artificial Sequence: Synthetic polypeptide
DEEEIRTTNPVATEQYGSVVFSNDNNEQIGNC

SEQ ID NO: 53860 - protein, 31 aa, Artificial Sequence
  Description of Artificial Sequence: Synthetic polypeptide
DEEEIRTTNPVATEQYGSVVFTNQDQGGDDG

SEQ ID NO: 53861 - protein, 33 aa, Artificial Sequence
  Description of Artificial Sequence: Synthetic polypeptide
FEEEIRTTNPVATEQYGSVISTNLQSDTGNNQG

SEQ ID NO: 53862 - protein, 33 aa, Artificial Sequence
  Description of Artificial Sequence: Synthetic polypeptide
DEEEIRTTNPVATEQYGSVTGTNLQGEMGNGET

SEQ ID NO: 53863 - protein, 33 aa, Artificial Sequence
  Description of Artificial Sequence: Synthetic polypeptide
DEEEIRTTNPVATEQYGSVTGTDENELQNEGNG

SEQ ID NO: 53864 - protein, 34 aa, Artificial Sequence
  Description of Artificial Sequence: Synthetic polypeptide
TEEEIRTTNPVATEQYGSVCSTNALSQRPGNYPT

SEQ ID NO: 53865 - protein, 31 aa, Artificial Sequence
  Description of Artificial Sequence: Synthetic polypeptide
DEEEIRTTNPVATEQYGSVVGNVDLGENERQ

SEQ ID NO: 53866 - protein, 32 aa, Artificial Sequence
  Description of Artificial Sequence: Synthetic polypeptide
DEEEIRTTNPVATEQYGSVTEVPGLQRGNSEN

SEQ ID NO: 53867 - protein, 30 aa, Artificial Sequence
  Description of Artificial Sequence: Synthetic polypeptide
DEEEIRTTNPVATEQYGSVTEQQHQVMGNE

SEQ ID NO: 53868 - protein, 31 aa, Artificial Sequence
  Description of Artificial Sequence: Synthetic polypeptide
FEEEIRTTNPVATEQYGSVSPNNTQQRMNED

SEQ ID NO: 53869 - protein, 33 aa, Artificial Sequence
  Description of Artificial Sequence: Synthetic polypeptide
TEEEIRTTNPVATEQYGSVSWTDNHQDRNGNAY

SEQ ID NO: 53870 - protein, 30 aa, Artificial Sequence
  Description of Artificial Sequence: Synthetic polypeptide
AEEEIRATNPCATEQYGSVSTENLMMEGNM

SEQ ID NO: 53871 - protein, 30 aa, Artificial Sequence
  Description of Artificial Sequence: Synthetic polypeptide
DEEEIRTTNPVATEQYGSVTELLDRNDNEI

SEQ ID NO: 53872 - protein, 32 aa, Artificial Sequence
  Description of Artificial Sequence: Synthetic polypeptide
DEAEIRTTNPVATEQWGSVCDTNPQDVRGNRG

SEQ ID NO: 53873 - protein, 32 aa, Artificial Sequence
  Description of Artificial Sequence: Synthetic polypeptide
DEAEIRTTNPVATEQYGNVSTNLQANGGDNNM

SEQ ID NO: 53874 - protein, 33 aa, Artificial Sequence
  Description of Artificial Sequence: Synthetic polypeptide
TEEEIRTTNPVATEQYGSVSWTDNLDDRNGNQY

SEQ ID NO: 53875 - protein, 33 aa, Artificial Sequence
  Description of Artificial Sequence: Synthetic polypeptide
DEEEIRTTNPVATEQYGSVTDTNLVQEGGGNQA

SEQ ID NO: 53876 - protein, 33 aa, Artificial Sequence
  Description of Artificial Sequence: Synthetic polypeptide
TEEEIRTTNPVATEQYGSVSWTDNMLQRDQNDE

SEQ ID NO: 53877 - protein, 30 aa, Artificial Sequence
  Description of Artificial Sequence: Synthetic polypeptide
DEAEIRTTNPVATEQWGSVATNLETGDNEQ

SEQ ID NO: 53878 - protein, 32 aa, Artificial Sequence
  Description of Artificial Sequence: Synthetic polypeptide
TEEEIRTTNPVATEQYGSVSWTDNQQRNANDE

SEQ ID NO: 53879 - protein, 34 aa, Artificial Sequence
  Description of Artificial Sequence: Synthetic polypeptide
TEEEIRTTNPVATEQYGSVSYTNALSQRQGNYPD

SEQ ID NO: 53880 - protein, 32 aa, Artificial Sequence
  Description of Artificial Sequence: Synthetic polypeptide
AEEEICTTNPVATEQYGVVSVTNMNLQGGNER

SEQ ID NO: 53881 - protein, 33 aa, Artificial Sequence
  Description of Artificial Sequence: Synthetic polypeptide
FEEEIRTTNPVATEQYGSVISGTSNLQGGGNIE

SEQ ID NO: 53882 - protein, 31 aa, Artificial Sequence
  Description of Artificial Sequence: Synthetic polypeptide
DEEEIRTTNPVATEQYGSVSYTGMGGQGGQG

SEQ ID NO: 53883 - protein, 32 aa, Artificial Sequence
  Description of Artificial Sequence: Synthetic polypeptide
DEAEIRTTNPVATEQYGCTSMTENLSQRIGER

SEQ ID NO: 53884 - protein, 29 aa, Artificial Sequence
  Description of Artificial Sequence: Synthetic peptide
DEAEIRTTNPVATEQYGCVWTVLERGEDM

SEQ ID NO: 53885 - protein, 31 aa, Artificial Sequence
  Description of Artificial Sequence: Synthetic polypeptide
AEEEIRATNPCATEQYGSVSTENLDQQGGNV

SEQ ID NO: 53886 - protein, 31 aa, Artificial Sequence
  Description of Artificial Sequence: Synthetic polypeptide
AEEEIRATNPCATEQYGSVSTENLQMTGNEM

SEQ ID NO: 53887 - protein, 33 aa, Artificial Sequence
  Description of Artificial Sequence: Synthetic polypeptide
TEEEIRTTNPVATEQYGSVSCTNALSQRGGPQV

SEQ ID NO: 53888 - protein, 33 aa, Artificial Sequence
  Description of Artificial Sequence: Synthetic polypeptide
TEEEIRTTNPVATEQYGSVSCTMNLSQSGGNDE

SEQ ID NO: 53889 - protein, 33 aa, Artificial Sequence
  Description of Artificial Sequence: Synthetic polypeptide
TEEEIRTTNPVATEQYGSVSTGNLQGTGGGNNG

SEQ ID NO: 53890 - protein, 34 aa, Artificial Sequence
  Description of Artificial Sequence: Synthetic polypeptide
DEEEIRTTNPVATEQYGSVTSTMNLDQEEGENII

SEQ ID NO: 53891 - protein, 34 aa, Artificial Sequence
  Description of Artificial Sequence: Synthetic polypeptide
DEEEIRTTNPVATEQYGSVTSTMNLDQEEGEGNT

SEQ ID NO: 53892 - protein, 33 aa, Artificial Sequence
  Description of Artificial Sequence: Synthetic polypeptide
TEEEIRTTNPVATEQYGSVSTGNLQGTGGNGTT

SEQ ID NO: 53893 - protein, 32 aa, Artificial Sequence
  Description of Artificial Sequence: Synthetic polypeptide
TEEEIRTTNPVATEQYGSVSTHLSQRTSGDYP

SEQ ID NO: 53894 - protein, 31 aa, Artificial Sequence
  Description of Artificial Sequence: Synthetic polypeptide
FEEEIRTTNPVATEQYGSVSDTNGGQGGEFV

SEQ ID NO: 53895 - protein, 33 aa, Artificial Sequence
  Description of Artificial Sequence: Synthetic polypeptide
DEEEIRTTNPVATEQYGSVTSTTDNGQGGGNDD

SEQ ID NO: 53896 - protein, 30 aa, Artificial Sequence
  Description of Artificial Sequence: Synthetic polypeptide
AEEEIRATNPCATEQYGSVSTENLETGQNM

SEQ ID NO: 53897 - protein, 33 aa, Artificial Sequence
  Description of Artificial Sequence: Synthetic polypeptide
TEEEIRTTNPVATEQYGSVSTNALSPRVGNYMG

SEQ ID NO: 53898 - protein, 33 aa, Artificial Sequence
  Description of Artificial Sequence: Synthetic polypeptide
DEEEIRTTNPVATEQYGSVTSTLNVLENGQGNQ

SEQ ID NO: 53899 - protein, 30 aa, Artificial Sequence
  Description of Artificial Sequence: Synthetic polypeptide
DEAEIRTTNPVATEQYGCVCSSELQHGSNQ

SEQ ID NO: 53900 - protein, 33 aa, Artificial Sequence
  Description of Artificial Sequence: Synthetic polypeptide
TEEEIRTTNPVATEQYGSVSTNASSQRPGNYPK

SEQ ID NO: 53901 - protein, 31 aa, Artificial Sequence
  Description of Artificial Sequence: Synthetic polypeptide
TEEEIRTTNPVATEQYGSVSAGNGSDEFGNR

SEQ ID NO: 53902 - protein, 29 aa, Artificial Sequence
  Description of Artificial Sequence: Synthetic peptide
AEEEIRATNPCATEQYGSVSNNELMQGNV

SEQ ID NO: 53903 - protein, 34 aa, Artificial Sequence
  Description of Artificial Sequence: Synthetic polypeptide
TEEEIRTTNPVATEQYGSVSTNELSQRTQGNYPD

SEQ ID NO: 53904 - protein, 33 aa, Artificial Sequence
  Description of Artificial Sequence: Synthetic polypeptide
DEEEIRTTNPVATEQYGSVTSTLNNENIQGGNQ

SEQ ID NO: 53905 - protein, 32 aa, Artificial Sequence
  Description of Artificial Sequence: Synthetic polypeptide
DEEEIRTTNPVATEQYGSVTSTLNNENIGNIQ

SEQ ID NO: 53906 - protein, 33 aa, Artificial Sequence
  Description of Artificial Sequence: Synthetic polypeptide
DEEEIRTTNPVATEQYGSVTSTLNLENQGNIQQ

SEQ ID NO: 53907 - protein, 32 aa, Artificial Sequence
  Description of Artificial Sequence: Synthetic polypeptide
TEEEIRTTNPVATEQYGSVSAENALSDEFGNR

SEQ ID NO: 53908 - protein, 31 aa, Artificial Sequence
  Description of Artificial Sequence: Synthetic polypeptide
DEAEIRTTNPVATEQYGCVSNSVLQRGDNDQ

SEQ ID NO: 53909 - protein, 33 aa, Artificial Sequence
  Description of Artificial Sequence: Synthetic polypeptide
TEEEIRTTNPVATEQYGSVSTNALSQITPGNYP

SEQ ID NO: 53910 - protein, 34 aa, Artificial Sequence
  Description of Artificial Sequence: Synthetic polypeptide
TEEEIRTTNPVATEQYGSVQSTNLSQRTSGNYPA

SEQ ID NO: 53911 - protein, 33 aa, Artificial Sequence
  Description of Artificial Sequence: Synthetic polypeptide
DEEEIRTTNPVATEQYGSVTSTNNLDIFGGNEQ

SEQ ID NO: 53912 - protein, 33 aa, Artificial Sequence
  Description of Artificial Sequence: Synthetic polypeptide
DEEEIRTTNPVATEQYGSVTSTNNLDFGNNEEA

SEQ ID NO: 53913 - protein, 33 aa, Artificial Sequence
  Description of Artificial Sequence: Synthetic polypeptide
FEEEIRTTNPVATEQYGSVNSTMNLQSGGGNIG

SEQ ID NO: 53914 - protein, 33 aa, Artificial Sequence
  Description of Artificial Sequence: Synthetic polypeptide
TEEEIRTTNPVATEQYGSVSLGNLSQRTSGNYP

SEQ ID NO: 53915 - protein, 33 aa, Artificial Sequence
  Description of Artificial Sequence: Synthetic polypeptide
DEEEIRTTNPVATEQYGSVTSTNLPEIGGNGQE

SEQ ID NO: 53916 - protein, 32 aa, Artificial Sequence
  Description of Artificial Sequence: Synthetic polypeptide
DEEEIRTTNPVATEQYGSVTSTNGHQERFMEQ

SEQ ID NO: 53917 - protein, 32 aa, Artificial Sequence
  Description of Artificial Sequence: Synthetic polypeptide
DEAEIRTTNPVATEQYGCVCSTNLQGFGSDRT

SEQ ID NO: 53918 - protein, 33 aa, Artificial Sequence
  Description of Artificial Sequence: Synthetic polypeptide
DEAEIRTTNPVATEQYGCVCSTGNLQYFGSNRS

SEQ ID NO: 53919 - protein, 32 aa, Artificial Sequence
  Description of Artificial Sequence: Synthetic polypeptide
TEEEIRTTNPVATEQYGSVSNTNEQQGGGNGE

SEQ ID NO: 53920 - protein, 33 aa, Artificial Sequence
  Description of Artificial Sequence: Synthetic polypeptide
DEEEIRTTNPVATEQYGSVTSTNDNDRGGDDDR

SEQ ID NO: 53921 - protein, 31 aa, Artificial Sequence
  Description of Artificial Sequence: Synthetic polypeptide
DEEEIRTTNPVATEQYGSVTSTNDDLNLDDV

SEQ ID NO: 53922 - protein, 33 aa, Artificial Sequence
  Description of Artificial Sequence: Synthetic polypeptide
DEEEIRTTNPVATEQYGSVTSTMNNDQEEGEND

SEQ ID NO: 53923 - protein, 34 aa, Artificial Sequence
  Description of Artificial Sequence: Synthetic polypeptide
DEEEIRTTNPVATEQYGSVTSTMNLNQNQGGNII

SEQ ID NO: 53924 - protein, 30 aa, Artificial Sequence
  Description of Artificial Sequence: Synthetic polypeptide
AEEEIRATNPCATEQYGSVSTENLPGTGNM

SEQ ID NO: 53925 - protein, 30 aa, Artificial Sequence
  Description of Artificial Sequence: Synthetic polypeptide
AEEEIRATNPCATEQYGSVSTENLLSGDNM

SEQ ID NO: 53926 - protein, 34 aa, Artificial Sequence
  Description of Artificial Sequence: Synthetic polypeptide
DEEEIRTTNPVATEQYGSVTSTMNLNQNNGGNIN

SEQ ID NO: 53927 - protein, 34 aa, Artificial Sequence
  Description of Artificial Sequence: Synthetic polypeptide
DEEEIRTTNPVATEQYGSVTSTMNLNQNDGNIQD

SEQ ID NO: 53928 - protein, 34 aa, Artificial Sequence
  Description of Artificial Sequence: Synthetic polypeptide
DEEEIRTTNPVATEQYGSVTSTMNLGQNEGGNID

SEQ ID NO: 53929 - protein, 33 aa, Artificial Sequence
  Description of Artificial Sequence: Synthetic polypeptide
TEEEIRTTNPVATEQYGSVSPTLNLERGGDNAE

SEQ ID NO: 53930 - protein, 32 aa, Artificial Sequence
  Description of Artificial Sequence: Synthetic polypeptide
TEEEIRTTNPVATEQYGSVSPVNLPEFPGNRD

SEQ ID NO: 53931 - protein, 34 aa, Artificial Sequence
  Description of Artificial Sequence: Synthetic polypeptide
DEEEIRTTNPVATEQYGSVTSTMNLDQESGENTG

SEQ ID NO: 53932 - protein, 31 aa, Artificial Sequence
  Description of Artificial Sequence: Synthetic polypeptide
DEAEIRTTNPVATEQYGCVCSTELQNGSNII

SEQ ID NO: 53933 - protein, 28 aa, Artificial Sequence
  Description of Artificial Sequence: Synthetic peptide
QEEEIASTNPVGTEQYGVVASTLQHGNR

SEQ ID NO: 53934 - protein, 34 aa, Artificial Sequence
  Description of Artificial Sequence: Synthetic polypeptide
DEEEIRTTNPVATEQYGSVTSTMNLDQESGENDI

SEQ ID NO: 53935 - protein, 32 aa, Artificial Sequence
  Description of Artificial Sequence: Synthetic polypeptide
TEEEIRTTNPVATEQYGSVSTDLQNIGNNINL

SEQ ID NO: 53936 - protein, 31 aa, Artificial Sequence
  Description of Artificial Sequence: Synthetic polypeptide
AEEEIRATNPCATEQYGSVSTENLMQQGNDV

SEQ ID NO: 53937 - protein, 28 aa, Artificial Sequence
  Description of Artificial Sequence: Synthetic peptide
QEEEIASTNPVSTEQYGVVSCNLQSGNQ

SEQ ID NO: 53938 - protein, 33 aa, Artificial Sequence
  Description of Artificial Sequence: Synthetic polypeptide
DEEEIRTTNPVATEQYGSVTQTVDLQRMENNRQ

SEQ ID NO: 53939 - protein, 32 aa, Artificial Sequence
  Description of Artificial Sequence: Synthetic polypeptide
DEEEIRTTNPVATEQYGSVTSTLNINENQGNQ

SEQ ID NO: 53940 - protein, 33 aa, Artificial Sequence
  Description of Artificial Sequence: Synthetic polypeptide
TEEEIRTTNPVATEQYGSVPSVNALSQRQGNYP

SEQ ID NO: 53941 - protein, 33 aa, Artificial Sequence
  Description of Artificial Sequence: Synthetic polypeptide
TEEEIRTTNPVATEQYGSVNTGNLNQRGSNFQG

SEQ ID NO: 53942 - protein, 32 aa, Artificial Sequence
  Description of Artificial Sequence: Synthetic polypeptide
DEEEIRTTNPVATEQYGSVTTLNLERGGDIAE

SEQ ID NO: 53943 - protein, 30 aa, Artificial Sequence
  Description of Artificial Sequence: Synthetic polypeptide
DEAEIRTTNPVATEQYGCVSTPLDRGEQIE

SEQ ID NO: 53944 - protein, 33 aa, Artificial Sequence
  Description of Artificial Sequence: Synthetic polypeptide
DEEEIRTTNPVATEQYGSVTSTDNLDEQGDNEF

SEQ ID NO: 53945 - protein, 30 aa, Artificial Sequence
  Description of Artificial Sequence: Synthetic polypeptide
DEAEIRTTNPVATEQYGCVATNLQGAGTDG

SEQ ID NO: 53946 - protein, 31 aa, Artificial Sequence
  Description of Artificial Sequence: Synthetic polypeptide
DEAEIRTTNPVATEQYGCVATNLQERGEDQA

SEQ ID NO: 53947 - protein, 32 aa, Artificial Sequence
  Description of Artificial Sequence: Synthetic polypeptide
DEEEIRTTNPVATEQYGSVTSTDLQGESVQRF

SEQ ID NO: 53948 - protein, 33 aa, Artificial Sequence
  Description of Artificial Sequence: Synthetic polypeptide
DEEEIRTTNPVATEQYGSVTSTDDNDQNEGGNT

SEQ ID NO: 53949 - protein, 30 aa, Artificial Sequence
  Description of Artificial Sequence: Synthetic polypeptide
AEEEIRATNPCATEQYGSVSENLQMGIGNM

SEQ ID NO: 53950 - protein, 31 aa, Artificial Sequence
  Description of Artificial Sequence: Synthetic polypeptide
DEAEIRTTNPVATEQYGCVSWENLNRGSNQS

SEQ ID NO: 53951 - protein, 33 aa, Artificial Sequence
  Description of Artificial Sequence: Synthetic polypeptide
DEEEIRTTNPVATEQYGSVTSNNLNQNNGGNIT

SEQ ID NO: 53952 - protein, 30 aa, Artificial Sequence
  Description of Artificial Sequence: Synthetic polypeptide
AEEEIRATNPCATEQYGSVSENLQMGTGNM

SEQ ID NO: 53953 - protein, 33 aa, Artificial Sequence
  Description of Artificial Sequence: Synthetic polypeptide
DEEEIRTTNPVATEQYGSVTSNNLGQSNGGNQE

SEQ ID NO: 53954 - protein, 30 aa, Artificial Sequence
  Description of Artificial Sequence: Synthetic polypeptide
AEEEIRATNPCATEQYGSVSENLMQTGNNM

SEQ ID NO: 53955 - protein, 28 aa, Artificial Sequence
  Description of Artificial Sequence: Synthetic peptide
AEEEIRATNPCATEQYGSVSENLMQNNM

SEQ ID NO: 53956 - protein, 30 aa, Artificial Sequence
  Description of Artificial Sequence: Synthetic polypeptide
AEEEIRATNPCATEQYGSVSENLMQGGNVG

SEQ ID NO: 53957 - protein, 28 aa, Artificial Sequence
  Description of Artificial Sequence: Synthetic peptide
QEEEIASTNPVCTEQYGVVSDNLQSGNQ

SEQ ID NO: 53958 - protein, 29 aa, Artificial Sequence
  Description of Artificial Sequence: Synthetic peptide
AEEEIRATNPCATEQYGSVSENLMGGNMD

SEQ ID NO: 53959 - protein, 32 aa, Artificial Sequence
  Description of Artificial Sequence: Synthetic polypeptide
DEEEIRTTNPVATEQYGSVTSETNLQPVFQEE

SEQ ID NO: 53960 - protein, 33 aa, Artificial Sequence
  Description of Artificial Sequence: Synthetic polypeptide
TEEEIRTTNPVATEQYGSVSTNLQQTGGGGNEG

SEQ ID NO: 53961 - protein, 29 aa, Artificial Sequence
  Description of Artificial Sequence: Synthetic peptide
AEEEIRATNPCATEQYGSVSENLMEGNVM

SEQ ID NO: 53962 - protein, 35 aa, Artificial Sequence
  Description of Artificial Sequence: Synthetic polypeptide
DEEEIRTTNPVATEQYGSVTSCTNSELSQPTGGNR

SEQ ID NO: 53963 - protein, 30 aa, Artificial Sequence
  Description of Artificial Sequence: Synthetic polypeptide
DEAEIRTTNPVATEQYGCTSTGNLQNGSDQ

SEQ ID NO: 53964 - protein, 29 aa, Artificial Sequence
  Description of Artificial Sequence: Synthetic peptide
AEEEIRATNPCATEQYGSVSENLMAGENM

SEQ ID NO: 53965 - protein, 30 aa, Artificial Sequence
  Description of Artificial Sequence: Synthetic polypeptide
AEEEIRATNPCATEQYGSVSENLNMQIGNV

SEQ ID NO: 53966 - protein, 32 aa, Artificial Sequence
  Description of Artificial Sequence: Synthetic polypeptide
TEEEIRTTNPVATEQYGSVPSYTNLSQLVNYQ

SEQ ID NO: 53967 - protein, 32 aa, Artificial Sequence
  Description of Artificial Sequence: Synthetic polypeptide
TEEEIRTTNPVATEQYGSVSTNLDGGNINNGD

SEQ ID NO: 53968 - protein, 33 aa, Artificial Sequence
  Description of Artificial Sequence: Synthetic polypeptide
DEEEIRTTNPVATEQYGSVTTDNLQMEFGGNIT

SEQ ID NO: 53969 - protein, 31 aa, Artificial Sequence
  Description of Artificial Sequence: Synthetic polypeptide
FEEEIRTTNPVATEQYGSVSETQLQSNENTY

SEQ ID NO: 53970 - protein, 31 aa, Artificial Sequence
  Description of Artificial Sequence: Synthetic polypeptide
DEAEIRTTNPVATEQYGCVSPNLQDFGSDQR

SEQ ID NO: 53971 - protein, 33 aa, Artificial Sequence
  Description of Artificial Sequence: Synthetic polypeptide
DEEEIRTTNPVATEQYGSVTSTVNTLGMGGNEN

SEQ ID NO: 53972 - protein, 32 aa, Artificial Sequence
  Description of Artificial Sequence: Synthetic polypeptide
TEEEIRTTNPVATEQYGSVSTNGSQTGGNNDQ

SEQ ID NO: 53973 - protein, 34 aa, Artificial Sequence
  Description of Artificial Sequence: Synthetic polypeptide
DEEEIRTTNPVATEQYGSVTSTLNGLENQGGGNQ

SEQ ID NO: 53974 - protein, 33 aa, Artificial Sequence
  Description of Artificial Sequence: Synthetic polypeptide
DEEEIRTTNPVATEQYGSVTSTVNTLGMGGNGN

SEQ ID NO: 53975 - protein, 33 aa, Artificial Sequence
  Description of Artificial Sequence: Synthetic polypeptide
DEEEIRTTNPVATEQYGSVTSTLNGLENEGNDQ

SEQ ID NO: 53976 - protein, 32 aa, Artificial Sequence
  Description of Artificial Sequence: Synthetic polypeptide
DEEEIRTTNPVATEQYGSVTSTLGLGNGGNIQ

SEQ ID NO: 53977 - protein, 34 aa, Artificial Sequence
  Description of Artificial Sequence: Synthetic polypeptide
DEEEIRTTNPVATEQYGSVTSTGNLQVEGEGGNA

SEQ ID NO: 53978 - protein, 31 aa, Artificial Sequence
  Description of Artificial Sequence: Synthetic polypeptide
DEAEIRTTNPVATEQYGCVSTDLNNGNENRF

SEQ ID NO: 53979 - protein, 30 aa, Artificial Sequence
  Description of Artificial Sequence: Synthetic polypeptide
DEAEIRTTNPVATEQYGCVSTELQNFPSND

SEQ ID NO: 53980 - protein, 32 aa, Artificial Sequence
  Description of Artificial Sequence: Synthetic polypeptide
DEEEIRTTNPVATEQYGSVTSTEHQRFGSEQP

SEQ ID NO: 53981 - protein, 33 aa, Artificial Sequence
  Description of Artificial Sequence: Synthetic polypeptide
DEEEIRTTNPVATEQYGSVTSTGNHQGFGSNDA

SEQ ID NO: 53982 - protein, 33 aa, Artificial Sequence
  Description of Artificial Sequence: Synthetic polypeptide
DEEEIRTTNPVATEQYGSVTSVTENLLQGIGTT

SEQ ID NO: 53983 - protein, 32 aa, Artificial Sequence
  Description of Artificial Sequence: Synthetic polypeptide
DEEEIRTTNPVATEQYGSVTSWDNDDRNGDDR

SEQ ID NO: 53984 - protein, 31 aa, Artificial Sequence
  Description of Artificial Sequence: Synthetic polypeptide
DEAEIRTTNPVATEQYGCVSTNLENIGDNQI

SEQ ID NO: 53985 - protein, 30 aa, Artificial Sequence
  Description of Artificial Sequence: Synthetic polypeptide
DEAEIRTTNPVATEQYGCVSTNLERELVEG

SEQ ID NO: 53986 - protein, 32 aa, Artificial Sequence
  Description of Artificial Sequence: Synthetic polypeptide
FEEEIRTTNPVATEQYGSVSTGNDGQNQGNGQ

SEQ ID NO: 53987 - protein, 31 aa, Artificial Sequence
  Description of Artificial Sequence: Synthetic polypeptide
DEAEIRTTNPVATEQYGCVSTNLQGDVNGGS

SEQ ID NO: 53988 - protein, 32 aa, Artificial Sequence
  Description of Artificial Sequence: Synthetic polypeptide
DEEEIRTTNPVATEQYGSVTTDILNRMEENRD

SEQ ID NO: 53989 - protein, 32 aa, Artificial Sequence
  Description of Artificial Sequence: Synthetic polypeptide
DEAEIRTTNPVATEQYGCVSTNLQGGAGNDGK

SEQ ID NO: 53990 - protein, 32 aa, Artificial Sequence
  Description of Artificial Sequence: Synthetic polypeptide
DEAEIRTTNPVATEQYGCVSTNLQMDGNNGSP

SEQ ID NO: 53991 - protein, 32 aa, Artificial Sequence
  Description of Artificial Sequence: Synthetic polypeptide
DEAEIRTTNPVATEQYGCVSTNLQMDNGNGDP

SEQ ID NO: 53992 - protein, 31 aa, Artificial Sequence
  Description of Artificial Sequence: Synthetic polypeptide
DEAEIRTTNPVATEQYGCVSTNLQNFNSNAS

SEQ ID NO: 53993 - protein, 33 aa, Artificial Sequence
  Description of Artificial Sequence: Synthetic polypeptide
DEEEIRTTNPVATEQYGSVTSVMPLDQRINERG

SEQ ID NO: 53994 - protein, 34 aa, Artificial Sequence
  Description of Artificial Sequence: Synthetic polypeptide
TEEEIRTTNPVATEQYGTTVSCTNLSQRTGNDRK

SEQ ID NO: 53995 - protein, 33 aa, Artificial Sequence
  Description of Artificial Sequence: Synthetic polypeptide
DEEEIRTTNPVATEQYGSVTSTNLNFNGGNIQG

SEQ ID NO: 53996 - protein, 32 aa, Artificial Sequence
  Description of Artificial Sequence: Synthetic polypeptide
FEEEIRTTNPVATEQYGSVSTDLDQGGEGNIP

SEQ ID NO: 53997 - protein, 31 aa, Artificial Sequence
  Description of Artificial Sequence: Synthetic polypeptide
TEEEIRTTNPVATEQYGSVATHELSQNGGAR

SEQ ID NO: 53998 - protein, 34 aa, Artificial Sequence
  Description of Artificial Sequence: Synthetic polypeptide
DEEEIRTTNPVATEQYGSVVPSCTGNALSGRGNN

SEQ ID NO: 53999 - protein, 35 aa, Artificial Sequence
  Description of Artificial Sequence: Synthetic polypeptide
DEEEIRTTNPVATEQYGSVVPSCTGNSLSGRGNRM

SEQ ID NO: 54000 - protein, 30 aa, Artificial Sequence
  Description of Artificial Sequence: Synthetic polypeptide
DEEEIRTTNPVATEQYGSVSWMPPLQDTEQ

SEQ ID NO: 54001 - protein, 33 aa, Artificial Sequence
  Description of Artificial Sequence: Synthetic polypeptide
DEEEIRTTNPVATEQYGSVSWYNGLQDSNGNMQ

SEQ ID NO: 54002 - protein, 32 aa, Artificial Sequence
  Description of Artificial Sequence: Synthetic polypeptide
DEAEIRTTNPVATENYGSVSTNLNGNDGQNER

SEQ ID NO: 54003 - protein, 33 aa, Artificial Sequence
  Description of Artificial Sequence: Synthetic polypeptide
TEEEIRTTNPVATEQYGSTVSTNLSQSAQGNYP

SEQ ID NO: 54004 - protein, 33 aa, Artificial Sequence
  Description of Artificial Sequence: Synthetic polypeptide
DEEEIRTTNPVATEQYGSVVSAINEIPIQPGNR

SEQ ID NO: 54005 - protein, 33 aa, Artificial Sequence
  Description of Artificial Sequence: Synthetic polypeptide
FEEEIRTTNPVATEQYGSVGSTMNLDQGNGNNQ

SEQ ID NO: 54006 - protein, 31 aa, Artificial Sequence
  Description of Artificial Sequence: Synthetic polypeptide
TEEEIRTTNPVATEQYGSVATALSQNGGDTR

SEQ ID NO: 54007 - protein, 31 aa, Artificial Sequence
  Description of Artificial Sequence: Synthetic polypeptide
TEEEIRTTNPVAYEAYGSVSTNALQDGGNNE

SEQ ID NO: 54008 - protein, 33 aa, Artificial Sequence
  Description of Artificial Sequence: Synthetic polypeptide
DEEEIRTTNPVATEQYGSVSWTEDDGQQRSQNR

SEQ ID NO: 54009 - protein, 33 aa, Artificial Sequence
  Description of Artificial Sequence: Synthetic polypeptide
FEEEIRTTNPVATEQYGSVSSTNLQITGGGNED

SEQ ID NO: 54010 - protein, 30 aa, Artificial Sequence
  Description of Artificial Sequence: Synthetic polypeptide
TEEEIRTTNPVATEQYGSVATADQNGDFDR

SEQ ID NO: 54011 - protein, 31 aa, Artificial Sequence
  Description of Artificial Sequence: Synthetic polypeptide
TEEEIRTTNPVATEYYGSVPSTNLQHTENMD

SEQ ID NO: 54012 - protein, 31 aa, Artificial Sequence
  Description of Artificial Sequence: Synthetic polypeptide
DEAEIRTTNPVATEQWGAVSTNLQGGTNGDQ

SEQ ID NO: 54013 - protein, 33 aa, Artificial Sequence
  Description of Artificial Sequence: Synthetic polypeptide
DEEEIRTTNPVATEQYGSVSWNPNLENRGEDRN

SEQ ID NO: 54014 - protein, 32 aa, Artificial Sequence
  Description of Artificial Sequence: Synthetic polypeptide
DEEEIRTTNPVATEQYGSVSWTETVQERSENV

SEQ ID NO: 54015 - protein, 32 aa, Artificial Sequence
  Description of Artificial Sequence: Synthetic polypeptide
DEEEIRTTNPVATEQYGSVSYENLGIPDGELR

SEQ ID NO: 54016 - protein, 33 aa, Artificial Sequence
  Description of Artificial Sequence: Synthetic polypeptide
TEEEIRTTNPVATEQYGSTVSYTSWSQRGGSNR

SEQ ID NO: 54017 - protein, 34 aa, Artificial Sequence
  Description of Artificial Sequence: Synthetic polypeptide
DEEEIRTTNPVATEQYGSVSYEPNLQRMTFNDRN

SEQ ID NO: 54018 - protein, 33 aa, Artificial Sequence
  Description of Artificial Sequence: Synthetic polypeptide
DEEEIRTTNPVATEQYGSVSYEPNDLNRINERM

SEQ ID NO: 54019 - protein, 31 aa, Artificial Sequence
  Description of Artificial Sequence: Synthetic polypeptide
TEEEIRTTNPVATEQYGSVATADLQNNGDFR

SEQ ID NO: 54020 - protein, 31 aa, Artificial Sequence
  Description of Artificial Sequence: Synthetic polypeptide
TEEEIRTTNPVATERYGTVSTNEDSGRGNNR

SEQ ID NO: 54021 - protein, 31 aa, Artificial Sequence
  Description of Artificial Sequence: Synthetic polypeptide
DEAEIRTTNPVATENWGSVSTNLNGEDGNER

SEQ ID NO: 54022 - protein, 34 aa, Artificial Sequence
  Description of Artificial Sequence: Synthetic polypeptide
DEEEIRTTNPVATEQYGSVVSCTNAISQNGGGNR

SEQ ID NO: 54023 - protein, 28 aa, Artificial Sequence
  Description of Artificial Sequence: Synthetic peptide
QEEEIAPTNPIATEQYGIVSENLMSGNR

SEQ ID NO: 54024 - protein, 28 aa, Artificial Sequence
  Description of Artificial Sequence: Synthetic peptide
QEEEIAPTNPCATEQYGSVSCNLMSGTR

SEQ ID NO: 54025 - protein, 31 aa, Artificial Sequence
  Description of Artificial Sequence: Synthetic polypeptide
TEEEIRTTNPVATEWYGSVVSTNHSQRGGSE

SEQ ID NO: 54026 - protein, 31 aa, Artificial Sequence
  Description of Artificial Sequence: Synthetic polypeptide
DEEEIRTTNPVATEQYGSVVNTVNLYGTGTT

SEQ ID NO: 54027 - protein, 33 aa, Artificial Sequence
  Description of Artificial Sequence: Synthetic polypeptide
DEAEIRTTNPVATEQWGCSVACTNLSQRPGNRE

SEQ ID NO: 54028 - protein, 31 aa, Artificial Sequence
  Description of Artificial Sequence: Synthetic polypeptide
DEEEIRTTNPVATEQYGSVSWLYECDEGNER

SEQ ID NO: 54029 - protein, 33 aa, Artificial Sequence
  Description of Artificial Sequence: Synthetic polypeptide
DEEEIRTTNPVATEQYGSVSWTDNEGGQRGKSD

SEQ ID NO: 54030 - protein, 33 aa, Artificial Sequence
  Description of Artificial Sequence: Synthetic polypeptide
DEAEIRTTNPVATEQWGCSVACTNLSQRGSNRE

SEQ ID NO: 54031 - protein, 30 aa, Artificial Sequence
  Description of Artificial Sequence: Synthetic polypeptide
DEEEIRTTNPVATEQYGSVSWNPYQVVDDE

SEQ ID NO: 54032 - protein, 30 aa, Artificial Sequence
  Description of Artificial Sequence: Synthetic polypeptide
DEAEIRTTNPVATEPYGSVCFTQLTRGNNM

SEQ ID NO: 54033 - protein, 33 aa, Artificial Sequence
  Description of Artificial Sequence: Synthetic polypeptide
TEEEIRTTNPVATEQYGSVATNALSQRPGNYAW

SEQ ID NO: 54034 - protein, 31 aa, Artificial Sequence
  Description of Artificial Sequence: Synthetic polypeptide
DEEEIRTTNPVATEQYGSVSYGNGGQGGQGQ

SEQ ID NO: 54035 - protein, 29 aa, Artificial Sequence
  Description of Artificial Sequence: Synthetic peptide
DEAEIRTTNPVATEQWGAVATNLQHGPDQ

SEQ ID NO: 54036 - protein, 33 aa, Artificial Sequence
  Description of Artificial Sequence: Synthetic polypeptide
DEEEIRTTNPVATEQYGSVSWTLDDGQRSQNDR

SEQ ID NO: 54037 - protein, 32 aa, Artificial Sequence
  Description of Artificial Sequence: Synthetic polypeptide
DEEEIRTTNPVATEQYGSVSWTTLGQLGEMSQ

SEQ ID NO: 54038 - protein, 31 aa, Artificial Sequence
  Description of Artificial Sequence: Synthetic polypeptide
DEEEIRTTNPVATEQYGSVSWTSPLQDTEQD

SEQ ID NO: 54039 - protein, 32 aa, Artificial Sequence
  Description of Artificial Sequence: Synthetic polypeptide
DEEEIRTTNPVATEQYGSVVMEGNLQRGPQSI

SEQ ID NO: 54040 - protein, 33 aa, Artificial Sequence
  Description of Artificial Sequence: Synthetic polypeptide
DEEEIRTTNPVATEQYGSVSWTPSLQERQENND

SEQ ID NO: 54041 - protein, 31 aa, Artificial Sequence
  Description of Artificial Sequence: Synthetic polypeptide
TEEEIRTTNPVAYEAYGSVSTGLSQNRGNNN

SEQ ID NO: 54042 - protein, 31 aa, Artificial Sequence
  Description of Artificial Sequence: Synthetic polypeptide
DEEEIRTTNPVATEQYGSVSWTPLQDVTEEQ

SEQ ID NO: 54043 - protein, 31 aa, Artificial Sequence
  Description of Artificial Sequence: Synthetic polypeptide
DEAEIRTTNPVATENYGSVSTNLNGNSGNGE

SEQ ID NO: 54044 - protein, 32 aa, Artificial Sequence
  Description of Artificial Sequence: Synthetic polypeptide
DEEEIRTTNPVATEQYGSVSWNLPRQGVEEFN

SEQ ID NO: 54045 - protein, 30 aa, Artificial Sequence
  Description of Artificial Sequence: Synthetic polypeptide
DEEEIRTTNPVATEQYGSVSWTPAQDDTEQ

SEQ ID NO: 54046 - protein, 32 aa, Artificial Sequence
  Description of Artificial Sequence: Synthetic polypeptide
DEEEIRTTNPVATEQYGSVSWNLQRVSEAQVM

SEQ ID NO: 54047 - protein, 29 aa, Artificial Sequence
  Description of Artificial Sequence: Synthetic peptide
QEEEIACTNPVATEQYGVVSTNLQQGEEA

SEQ ID NO: 54048 - protein, 34 aa, Artificial Sequence
  Description of Artificial Sequence: Synthetic polypeptide
DEEEIRTTNPVATEQYGSVSWTNWNNQPNGNNRN

SEQ ID NO: 54049 - protein, 35 aa, Artificial Sequence
  Description of Artificial Sequence: Synthetic polypeptide
DEEEIRTTNPVATEQYGSVVPSYTNISQRGGNPRQ

SEQ ID NO: 54050 - protein, 29 aa, Artificial Sequence
  Description of Artificial Sequence: Synthetic peptide
DEAEIRTTNPVATEQFGTSVSEYLLRGES

SEQ ID NO: 54051 - protein, 28 aa, Artificial Sequence
  Description of Artificial Sequence: Synthetic peptide
QEEEIACTNPVAYEQYGCVATNLQVGND

SEQ ID NO: 54052 - protein, 31 aa, Artificial Sequence
  Description of Artificial Sequence: Synthetic polypeptide
DEEEIRTTNPVATEQYGSVVPTVLDLQINNE

SEQ ID NO: 54053 - protein, 32 aa, Artificial Sequence
  Description of Artificial Sequence: Synthetic polypeptide
DEEEIRTTNPVATEQYGSVSWNLQRVTEEQVV

SEQ ID NO: 54054 - protein, 31 aa, Artificial Sequence
  Description of Artificial Sequence: Synthetic polypeptide
AEEEIRATNPVATEQWGSVSTELQERGNDPE

SEQ ID NO: 54055 - protein, 32 aa, Artificial Sequence
  Description of Artificial Sequence: Synthetic polypeptide
DEEEIRTTNPVATEQYGSVSWTNNLENQMTQI

SEQ ID NO: 54056 - protein, 31 aa, Artificial Sequence
  Description of Artificial Sequence: Synthetic polypeptide
DEEEIRTTNPVATEQYGSVSWTVNVEPLVND

SEQ ID NO: 54057 - protein, 33 aa, Artificial Sequence
  Description of Artificial Sequence: Synthetic polypeptide
DEEEIRTTNPVATEQYGSVSWVNWLQLVTNERD

SEQ ID NO: 54058 - protein, 28 aa, Artificial Sequence
  Description of Artificial Sequence: Synthetic peptide
QEEEIAPTNPIATEQYGIVSCNLMSGNR

SEQ ID NO: 54059 - protein, 32 aa, Artificial Sequence
  Description of Artificial Sequence: Synthetic polypeptide
DEEEIRTTNPVATEQYGSVSWNIERSGENMGN

SEQ ID NO: 54060 - protein, 32 aa, Artificial Sequence
  Description of Artificial Sequence: Synthetic polypeptide
FEEEIRTTNPVATEQYGSVSSTNGNEQGGNNA

SEQ ID NO: 54061 - protein, 32 aa, Artificial Sequence
  Description of Artificial Sequence: Synthetic polypeptide
DEEEIRTTNPVATEQYGSVSWTNIQIGVHEPD

SEQ ID NO: 54062 - protein, 32 aa, Artificial Sequence
  Description of Artificial Sequence: Synthetic polypeptide
FEEEIRTTNPVATEQYGSVSTDNNDQNGENEF

SEQ ID NO: 54063 - protein, 31 aa, Artificial Sequence
  Description of Artificial Sequence: Synthetic polypeptide
FEEEIRTTNPVATEQYGSVSTDNNEFGNLDD

SEQ ID NO: 54064 - protein, 31 aa, Artificial Sequence
  Description of Artificial Sequence: Synthetic polypeptide
DEAEIRTTNPVATENYGTVSTNLQGDGDGER

SEQ ID NO: 54065 - protein, 32 aa, Artificial Sequence
  Description of Artificial Sequence: Synthetic polypeptide
DEAEIRTTNPVATEQYGSISCTNEHQREGGDR

SEQ ID NO: 54066 - protein, 35 aa, Artificial Sequence
  Description of Artificial Sequence: Synthetic polypeptide
DEEEIRTTNPVATEQYGSVVPSCTNLSTRPGNYRD

SEQ ID NO: 54067 - protein, 33 aa, Artificial Sequence
  Description of Artificial Sequence: Synthetic polypeptide
DEEEIRTTNPVATEQYGSVSWNLDQVTVGPEVR

SEQ ID NO: 54068 - protein, 31 aa, Artificial Sequence
  Description of Artificial Sequence: Synthetic polypeptide
TEEEIRTTNPVATEQYGSVAKALEQNQGDNR

SEQ ID NO: 54069 - protein, 32 aa, Artificial Sequence
  Description of Artificial Sequence: Synthetic polypeptide
DEEEIRTTNPVATEQYGSVSWVLQRVTEANVV

SEQ ID NO: 54070 - protein, 33 aa, Artificial Sequence
  Description of Artificial Sequence: Synthetic polypeptide
DEEEIRTTNPVATEQYGSVVPSCTNPSTRPGND

SEQ ID NO: 54071 - protein, 34 aa, Artificial Sequence
  Description of Artificial Sequence: Synthetic polypeptide
DEEEIRTTNPVATEQYGSVVPSTNAISQNHGNNR

SEQ ID NO: 54072 - protein, 30 aa, Artificial Sequence
  Description of Artificial Sequence: Synthetic polypeptide
DEEEIRTTNPVATEQYGSVSWTVNVEPMID

SEQ ID NO: 54073 - protein, 32 aa, Artificial Sequence
  Description of Artificial Sequence: Synthetic polypeptide
DEAEIRTTNPVATEQYGSHSTNELQRSGEDPQ

SEQ ID NO: 54074 - protein, 31 aa, Artificial Sequence
  Description of Artificial Sequence: Synthetic polypeptide
DEAEIRTTNPVATENYGTVSTNLQGDTGDGR

SEQ ID NO: 54075 - protein, 31 aa, Artificial Sequence
  Description of Artificial Sequence: Synthetic polypeptide
DEEEIRTTNPVATEQYGSVSWGLEQHDDQRD

SEQ ID NO: 54076 - protein, 34 aa, Artificial Sequence
  Description of Artificial Sequence: Synthetic polypeptide
TEEEIRTTNPVATEQYGSVAWTDNGLKQRGENNR

SEQ ID NO: 54077 - protein, 31 aa, Artificial Sequence
  Description of Artificial Sequence: Synthetic polypeptide
DEAEIRTTNPVATEIWGSVSTNLQGGPNGDM

SEQ ID NO: 54078 - protein, 28 aa, Artificial Sequence
  Description of Artificial Sequence: Synthetic peptide
QEEEIAPTNPISTEQYGIVSENLQSGNR

SEQ ID NO: 54079 - protein, 33 aa, Artificial Sequence
  Description of Artificial Sequence: Synthetic polypeptide
DEEEIRTTNPVATEQYGSVVMTMNLIRGELNIN

SEQ ID NO: 54080 - protein, 32 aa, Artificial Sequence
  Description of Artificial Sequence: Synthetic polypeptide
DEEEIRTTNPVATEQYGSVSYNPLPTNNQERI

SEQ ID NO: 54081 - protein, 31 aa, Artificial Sequence
  Description of Artificial Sequence: Synthetic polypeptide
FEEEIRTTNPVATEQYGSVSTDLNTEFGNLV

SEQ ID NO: 54082 - protein, 34 aa, Artificial Sequence
  Description of Artificial Sequence: Synthetic polypeptide
TEEEIRTTNPVATEQYGSVCNTGNLNQRGSNTRN

SEQ ID NO: 54083 - protein, 32 aa, Artificial Sequence
  Description of Artificial Sequence: Synthetic polypeptide
DEEEIRTTNPVATEQYGSVVMTNLIRIGELEN

SEQ ID NO: 54084 - protein, 32 aa, Artificial Sequence
  Description of Artificial Sequence: Synthetic polypeptide
DEEEIRTTNPVATEQYGSVVMTNMVIRGELRN

SEQ ID NO: 54085 - protein, 31 aa, Artificial Sequence
  Description of Artificial Sequence: Synthetic polypeptide
DEEEIRTTNPVATEQYGSVSYNPLPNSQERI

SEQ ID NO: 54086 - protein, 31 aa, Artificial Sequence
  Description of Artificial Sequence: Synthetic polypeptide
DEEEIRTTNPVATEQYGSVVMTPLILGELNN

SEQ ID NO: 54087 - protein, 28 aa, Artificial Sequence
  Description of Artificial Sequence: Synthetic peptide
QEEEIAPTNPISSEQYGSVSCNLQRGTR

SEQ ID NO: 54088 - protein, 33 aa, Artificial Sequence
  Description of Artificial Sequence: Synthetic polypeptide
DEEEIRTTNPVATEQYGSVSYNMNHQRMGLNPE

SEQ ID NO: 54089 - protein, 31 aa, Artificial Sequence
  Description of Artificial Sequence: Synthetic polypeptide
TEEEIRTTNPVATERYGTVSCTNLSHRGNNP

SEQ ID NO: 54090 - protein, 32 aa, Artificial Sequence
  Description of Artificial Sequence: Synthetic polypeptide
TEEEIRTTNPVATERYGSVPVCTGLSQRGNNR

SEQ ID NO: 54091 - protein, 32 aa, Artificial Sequence
  Description of Artificial Sequence: Synthetic polypeptide
DEAEIRTTNPVATEQYGSCSTNELPQRGEDFM

SEQ ID NO: 54092 - protein, 34 aa, Artificial Sequence
  Description of Artificial Sequence: Synthetic polypeptide
TEEEIRTTNPVATEQYGVTVPSCTNLSQRGNDRK

SEQ ID NO: 54093 - protein, 33 aa, Artificial Sequence
  Description of Artificial Sequence: Synthetic polypeptide
TEEEIRTTNPVATEQYGTVSYTPNLSQRTGGNP

SEQ ID NO: 54094 - protein, 31 aa, Artificial Sequence
  Description of Artificial Sequence: Synthetic polypeptide
DEEEIRTTNPVATEQYGSVSYPSLEQRNIEF

SEQ ID NO: 54095 - protein, 32 aa, Artificial Sequence
  Description of Artificial Sequence: Synthetic polypeptide
DEEEIRTTNPVATEQYGSVSWPGVNLQRVEEE

SEQ ID NO: 54096 - protein, 32 aa, Artificial Sequence
  Description of Artificial Sequence: Synthetic polypeptide
TEEEIRTTNPVAYEAYGSVSTVNALQRPGEYR

SEQ ID NO: 54097 - protein, 33 aa, Artificial Sequence
  Description of Artificial Sequence: Synthetic polypeptide
TEEEIRTTNPVATEQYGTVSCTNLSQRGGNDEL

SEQ ID NO: 54098 - protein, 32 aa, Artificial Sequence
  Description of Artificial Sequence: Synthetic polypeptide
DEEEIRTTNPVATEQYGSVVMNSNLQRGEQFD

SEQ ID NO: 54099 - protein, 33 aa, Artificial Sequence
  Description of Artificial Sequence: Synthetic polypeptide
DEEEIRTTNPVATEQYGSVSVVINLQREVNQDF

SEQ ID NO: 54100 - protein, 31 aa, Artificial Sequence
  Description of Artificial Sequence: Synthetic polypeptide
TEEEIRTTNPVAYEAYGSVSTNLSQRVLNPA

SEQ ID NO: 54101 - protein, 28 aa, Artificial Sequence
  Description of Artificial Sequence: Synthetic peptide
QEEEIAPTNPCSSEQYGSVSCNLQRGTR

SEQ ID NO: 54102 - protein, 30 aa, Artificial Sequence
  Description of Artificial Sequence: Synthetic polypeptide
DEAEIRTTNPVATEQYGSCATNTQREGGEL

SEQ ID NO: 54103 - protein, 29 aa, Artificial Sequence
  Description of Artificial Sequence: Synthetic peptide
DEEEIRTTNPVATEQYGSVVSSDLGSSEN

SEQ ID NO: 54104 - protein, 33 aa, Artificial Sequence
  Description of Artificial Sequence: Synthetic polypeptide
DEEEIRTTNPVATEQYGSVSYTDLDQTQGDEVR

SEQ ID NO: 54105 - protein, 31 aa, Artificial Sequence
  Description of Artificial Sequence: Synthetic polypeptide
DEEEIRTTNPVATEQYGSVSVWGLQRDLVED

SEQ ID NO: 54106 - protein, 31 aa, Artificial Sequence
  Description of Artificial Sequence: Synthetic polypeptide
TEEEIRTTNPVAYEAYGSVSTNALSQDMGNE

SEQ ID NO: 54107 - protein, 32 aa, Artificial Sequence
  Description of Artificial Sequence: Synthetic polypeptide
DEAEIRTTNPVATEHYGSVSTNLQGNDMGNTN

SEQ ID NO: 54108 - protein, 32 aa, Artificial Sequence
  Description of Artificial Sequence: Synthetic polypeptide
DEEEIRTTNPVATEQYGSVSWDNPNQVRGGDH

SEQ ID NO: 54109 - protein, 34 aa, Artificial Sequence
  Description of Artificial Sequence: Synthetic polypeptide
DEEEIRTTNPVATEQYGSVVSSNITNLDAEGSNR

SEQ ID NO: 54110 - protein, 30 aa, Artificial Sequence
  Description of Artificial Sequence: Synthetic polypeptide
DEEEIRTTNPVATEQYGSVSYSGGQNHGGD

SEQ ID NO: 54111 - protein, 33 aa, Artificial Sequence
  Description of Artificial Sequence: Synthetic polypeptide
DEEEIRTTNPVATEQYGSVVSCVVDLQRFGERT

SEQ ID NO: 54112 - protein, 33 aa, Artificial Sequence
  Description of Artificial Sequence: Synthetic polypeptide
DEEEIRTTNPVATEQYGSVVSGDNSAQDRSGNP

SEQ ID NO: 54113 - protein, 31 aa, Artificial Sequence
  Description of Artificial Sequence: Synthetic polypeptide
DEAEIRTTNPVATENYGTVSTNLQGMGDGER

SEQ ID NO: 54114 - protein, 31 aa, Artificial Sequence
  Description of Artificial Sequence: Synthetic polypeptide
DEAEIRTTNPVATENYGTVSTNLQHDGDGQR

SEQ ID NO: 54115 - protein, 28 aa, Artificial Sequence
  Description of Artificial Sequence: Synthetic peptide
QEEEIAPTNPCATEQYGIVSCNLMSGNR

SEQ ID NO: 54116 - protein, 31 aa, Artificial Sequence
  Description of Artificial Sequence: Synthetic polypeptide
FEEEIRTTNPVATEQYGSVDTGLQRNANFDG

SEQ ID NO: 54117 - protein, 32 aa, Artificial Sequence
  Description of Artificial Sequence: Synthetic polypeptide
TEEEIRTTNPVATEQYGSVCEGNELQRTGGLR

SEQ ID NO: 54118 - protein, 32 aa, Artificial Sequence
  Description of Artificial Sequence: Synthetic polypeptide
DEEEIRTTNPVATEQYGSVVMWGNLQRGPQDG

SEQ ID NO: 54119 - protein, 34 aa, Artificial Sequence
  Description of Artificial Sequence: Synthetic polypeptide
DEEEIRTTNPVATEQYGSVSYMNLQPRAGENEET

SEQ ID NO: 54120 - protein, 32 aa, Artificial Sequence
  Description of Artificial Sequence: Synthetic polypeptide
DEEEIRTTNPVATEQYGSVSYNALQRTLIPDG

SEQ ID NO: 54121 - protein, 31 aa, Artificial Sequence
  Description of Artificial Sequence: Synthetic polypeptide
DEAEIRTTNPVATEPYGEVSTNLQSNGDNGA

SEQ ID NO: 54122 - protein, 34 aa, Artificial Sequence
  Description of Artificial Sequence: Synthetic polypeptide
TEEEIRTTNPVATEQYGSTVSVTVNELSQRGGSR

SEQ ID NO: 54123 - protein, 31 aa, Artificial Sequence
  Description of Artificial Sequence: Synthetic polypeptide
DEEEIRTTNPVATEQYGSVSWEDHQRFGSEQ

SEQ ID NO: 54124 - protein, 31 aa, Artificial Sequence
  Description of Artificial Sequence: Synthetic polypeptide
DEEEIRTTNPVATEQYGSVSWENPQVVFNDD

SEQ ID NO: 54125 - protein, 32 aa, Artificial Sequence
  Description of Artificial Sequence: Synthetic polypeptide
DEAEIRTTNPVATEQYGSCSTNPQREGPLPRM

SEQ ID NO: 54126 - protein, 30 aa, Artificial Sequence
  Description of Artificial Sequence: Synthetic polypeptide
TEEEIRTTNPVATEQYGSVCGTALQNGSEQ

SEQ ID NO: 54127 - protein, 31 aa, Artificial Sequence
  Description of Artificial Sequence: Synthetic polypeptide
DEEEIRTTNPVATEQYGSVVMTSVQPVGTNA

SEQ ID NO: 54128 - protein, 28 aa, Artificial Sequence
  Description of Artificial Sequence: Synthetic peptide
QEEEIAPTNPCSTEQYGIVSCNLQSGNR

SEQ ID NO: 54129 - protein, 31 aa, Artificial Sequence
  Description of Artificial Sequence: Synthetic polypeptide
TEEEIRTTNPVAYEAYGSVSTNALQDRVTNE

SEQ ID NO: 54130 - protein, 33 aa, Artificial Sequence
  Description of Artificial Sequence: Synthetic polypeptide
TEEEIRTTNPVATERYGSVVPSCTNLSTRPGNR

SEQ ID NO: 54131 - protein, 31 aa, Artificial Sequence
  Description of Artificial Sequence: Synthetic polypeptide
DEEEIRTTNPVATEQYGSVSYNDLADGEEEY

SEQ ID NO: 54132 - protein, 32 aa, Artificial Sequence
  Description of Artificial Sequence: Synthetic polypeptide
DEEEIRTTNPVATEQYGSVVMTPLQRENEEPQ

SEQ ID NO: 54133 - protein, 34 aa, Artificial Sequence
  Description of Artificial Sequence: Synthetic polypeptide
DEEEIRTTNPVATEQYGSVVSPTVLEQRGDNDAD

SEQ ID NO: 54134 - protein, 33 aa, Artificial Sequence
  Description of Artificial Sequence: Synthetic polypeptide
DEEEIRTTNPVATEQYGSVSYNLQTRSTQNDID

SEQ ID NO: 54135 - protein, 32 aa, Artificial Sequence
  Description of Artificial Sequence: Synthetic polypeptide
DEEEIRTTNPVATEQYGSVSWPLHQRSTNGMD

SEQ ID NO: 54136 - protein, 29 aa, Artificial Sequence
  Description of Artificial Sequence: Synthetic peptide
DEAEIRTTNPVATEQYGSCSWPNQNGNQQ

SEQ ID NO: 54137 - protein, 32 aa, Artificial Sequence
  Description of Artificial Sequence: Synthetic polypeptide
TEEEIRTTNPVATEQYGSVCCTGNLTDRGGTR

SEQ ID NO: 54138 - protein, 33 aa, Artificial Sequence
  Description of Artificial Sequence: Synthetic polypeptide
FEEEIRTTNPVATEQYGSVGSTNLQNDEGNNQT

SEQ ID NO: 54139 - protein, 33 aa, Artificial Sequence
  Description of Artificial Sequence: Synthetic polypeptide
DEEEIRTTNPVATEQYGSVSYNLQQRMTGPGVD

SEQ ID NO: 54140 - protein, 33 aa, Artificial Sequence
  Description of Artificial Sequence: Synthetic polypeptide
FEEEIRTTNPVATEQYGSVSSTNLQNDGGNNGQ

SEQ ID NO: 54141 - protein, 33 aa, Artificial Sequence
  Description of Artificial Sequence: Synthetic polypeptide
TEEEIRTTNPVATERYGSVVSCTANLQRTVNNR

SEQ ID NO: 54142 - protein, 31 aa, Artificial Sequence
  Description of Artificial Sequence: Synthetic polypeptide
TEEEIRTTNPVATERYGSVSANLSNRTVGNL

SEQ ID NO: 54143 - protein, 30 aa, Artificial Sequence
  Description of Artificial Sequence: Synthetic polypeptide
DEEEIRTTNPVATEQYGSVSWPPLQIDTEQ

SEQ ID NO: 54144 - protein, 32 aa, Artificial Sequence
  Description of Artificial Sequence: Synthetic polypeptide
DEEEIRTTNPVATEQYGSVSWPNDDQPFGIER

SEQ ID NO: 54145 - protein, 32 aa, Artificial Sequence
  Description of Artificial Sequence: Synthetic polypeptide
TEEEIRTTNPVATERYGSVSQTNLSQQGGNNS

SEQ ID NO: 54146 - protein, 33 aa, Artificial Sequence
  Description of Artificial Sequence: Synthetic polypeptide
TEEEIRTTNPVATEQYGSTVSTNELSQKSGARF

SEQ ID NO: 54147 - protein, 33 aa, Artificial Sequence
  Description of Artificial Sequence: Synthetic polypeptide
DEEEIRTTNPVATEQYGSVVSPTNAHQMIGDNE

SEQ ID NO: 54148 - protein, 32 aa, Artificial Sequence
  Description of Artificial Sequence: Synthetic polypeptide
QEEGIRTTNPVATEQYGSVSTNGLGEGQTNGG

SEQ ID NO: 54149 - protein, 33 aa, Artificial Sequence
  Description of Artificial Sequence: Synthetic polypeptide
DEEEIRTTNPVATEQYGMVGSGNLNQEVGGNNV

SEQ ID NO: 54150 - protein, 31 aa, Artificial Sequence
  Description of Artificial Sequence: Synthetic polypeptide
QEEEIRTTNPVATEGYGCTSINGLGQRGQNI

SEQ ID NO: 54151 - protein, 33 aa, Artificial Sequence
  Description of Artificial Sequence: Synthetic polypeptide
DEEEIRTTNPVATEQYGDVSTTCLPNMRNGMNV

SEQ ID NO: 54152 - protein, 32 aa, Artificial Sequence
  Description of Artificial Sequence: Synthetic polypeptide
DEEEIRTTNPVATEQYGMVGSTMNGEGNGNGE

SEQ ID NO: 54153 - protein, 32 aa, Artificial Sequence
  Description of Artificial Sequence: Synthetic polypeptide
QEEEICTTNPVATEQYGSVATTNLQENGENTE

SEQ ID NO: 54154 - protein, 28 aa, Artificial Sequence
  Description of Artificial Sequence: Synthetic peptide
QEEEIASVNPVCTEQYGEVSDNLQSGNK

SEQ ID NO: 54155 - protein, 29 aa, Artificial Sequence
  Description of Artificial Sequence: Synthetic peptide
QEEEIASVNPVCTEQYGVVSTDNLQSGNQ

SEQ ID NO: 54156 - protein, 32 aa, Artificial Sequence
  Description of Artificial Sequence: Synthetic polypeptide
QEEEICTTNPVATEQYGSVATPNLTQDGNEAA

SEQ ID NO: 54157 - protein, 33 aa, Artificial Sequence
  Description of Artificial Sequence: Synthetic polypeptide
QEEEIRTTNPVATEQYGSVNTTSNLGQEGENYT

SEQ ID NO: 54158 - protein, 32 aa, Artificial Sequence
  Description of Artificial Sequence: Synthetic polypeptide
DEEEIRTTNPVATEQYGDVVNMTNGIQEDGNG

SEQ ID NO: 54159 - protein, 28 aa, Artificial Sequence
  Description of Artificial Sequence: Synthetic peptide
QEEEIASVNPVSTEQYGVVSCNLQSGNQ

SEQ ID NO: 54160 - protein, 30 aa, Artificial Sequence
  Description of Artificial Sequence: Synthetic polypeptide
NEREIRTTNPVATEQYGSVCWTNDQNGSDA

SEQ ID NO: 54161 - protein, 33 aa, Artificial Sequence
  Description of Artificial Sequence: Synthetic polypeptide
QEEEIRTTNPVATECYGSVSTPCLPQMRGMNPL

SEQ ID NO: 54162 - protein, 31 aa, Artificial Sequence
  Description of Artificial Sequence: Synthetic polypeptide
QEEEIACTNPVATEQYGCVATNLQVGAENRV

SEQ ID NO: 54163 - protein, 28 aa, Artificial Sequence
  Description of Artificial Sequence: Synthetic peptide
QEEEIATTNPVATECYGDVSECLQHEER

SEQ ID NO: 54164 - protein, 28 aa, Artificial Sequence
  Description of Artificial Sequence: Synthetic peptide
QEEEIATTNPVCTECYGDVSDNLQSENQ

SEQ ID NO: 54165 - protein, 31 aa, Artificial Sequence
  Description of Artificial Sequence: Synthetic polypeptide
NEYEIRTTNPVAYEQYGSVSTETLQAGNNFL

SEQ ID NO: 54166 - protein, 31 aa, Artificial Sequence
  Description of Artificial Sequence: Synthetic polypeptide
QEEEIATTNPVAYEQYGSVAITNLQVTDNRE

SEQ ID NO: 54167 - protein, 31 aa, Artificial Sequence
  Description of Artificial Sequence: Synthetic polypeptide
NEYEIRCTNPVATEQYGSVETNLTQEHFGNQ

SEQ ID NO: 54168 - protein, 34 aa, Artificial Sequence
  Description of Artificial Sequence: Synthetic polypeptide
DEEEIRTTNPVATEQYGKVFCTNELSARGGNQRM

SEQ ID NO: 54169 - protein, 28 aa, Artificial Sequence
  Description of Artificial Sequence: Synthetic peptide
QEEEIRTTNPVATEQYGEAPENLQHEEK

SEQ ID NO: 54170 - protein, 31 aa, Artificial Sequence
  Description of Artificial Sequence: Synthetic polypeptide
QEEEIATTNPVAYEQYGSVAATNLQNPGNDV

SEQ ID NO: 54171 - protein, 29 aa, Artificial Sequence
  Description of Artificial Sequence: Synthetic peptide
QEEEIATTNPVAYEPYGSVATNLARGDSL

SEQ ID NO: 54172 - protein, 31 aa, Artificial Sequence
  Description of Artificial Sequence: Synthetic polypeptide
QEEEIATTNPVATEMWGSVATNLQDQGNDRH

SEQ ID NO: 54173 - protein, 31 aa, Artificial Sequence
  Description of Artificial Sequence: Synthetic polypeptide
NETEIRTTNPVATEYWGAVSTNLQGQDGNER

SEQ ID NO: 54174 - protein, 31 aa, Artificial Sequence
  Description of Artificial Sequence: Synthetic polypeptide
QEEEIATTNPVATEMYGSVATNLQDSGNDQM

SEQ ID NO: 54175 - protein, 32 aa, Artificial Sequence
  Description of Artificial Sequence: Synthetic polypeptide
QEEEIATTNPVATEPYGSVAATNLQDRDGGNN

SEQ ID NO: 54176 - protein, 28 aa, Artificial Sequence
  Description of Artificial Sequence: Synthetic peptide
QEEEIATTNPCASEQYGEVPCNLQHGER

SEQ ID NO: 54177 - protein, 30 aa, Artificial Sequence
  Description of Artificial Sequence: Synthetic polypeptide
QEEEIACTNPVATEQYGSVATNLQAEDSND

SEQ ID NO: 54178 - protein, 32 aa, Artificial Sequence
  Description of Artificial Sequence: Synthetic polypeptide
QEEGIRTTNPVATEQYGSVSTNGLGEGQGNIG

SEQ ID NO: 54179 - protein, 32 aa, Artificial Sequence
  Description of Artificial Sequence: Synthetic polypeptide
NSEEIRTTNPVATEQYGVTVSCTNPSQDGGNR

SEQ ID NO: 54180 - protein, 32 aa, Artificial Sequence
  Description of Artificial Sequence: Synthetic polypeptide
DEEEIRTTNPVATEQYGKVFCTNLSARGGSQN

SEQ ID NO: 54181 - protein, 32 aa, Artificial Sequence
  Description of Artificial Sequence: Synthetic polypeptide
QEEGIRTTNPVATEQYGSVSTNGLGEGQDGDG

SEQ ID NO: 54182 - protein, 28 aa, Artificial Sequence
  Description of Artificial Sequence: Synthetic peptide
QEEEIATTNPCASEQYGIVPCNLQSGTR

SEQ ID NO: 54183 - protein, 31 aa, Artificial Sequence
  Description of Artificial Sequence: Synthetic polypeptide
NSEEIRTTNPVAYEQYGVVSCINLQDTGGNR

SEQ ID NO: 54184 - protein, 32 aa, Artificial Sequence
  Description of Artificial Sequence: Synthetic polypeptide
NEEEIRTTNPVAYEQYGSTVSAGNLDESGGNR

SEQ ID NO: 54185 - protein, 31 aa, Artificial Sequence
  Description of Artificial Sequence: Synthetic polypeptide
NNEEIRTTNPVATEQYGVVSTNLPEDGPNID

SEQ ID NO: 54186 - protein, 28 aa, Artificial Sequence
  Description of Artificial Sequence: Synthetic peptide
QEEEIRTTNPVATEQYGEASENCMREEK

SEQ ID NO: 54187 - protein, 33 aa, Artificial Sequence
  Description of Artificial Sequence: Synthetic polypeptide
DEEEIRTTNPVATEQYGDVVSGNLNQTIGGNFA

SEQ ID NO: 54188 - protein, 31 aa, Artificial Sequence
  Description of Artificial Sequence: Synthetic polypeptide
QEEEIATTNPVATEQWGSVAITNDQREGPNQ

SEQ ID NO: 54189 - protein, 32 aa, Artificial Sequence
  Description of Artificial Sequence: Synthetic polypeptide
NETEIRTTNPVATESYGSVSTNLQGNEGQNDH

SEQ ID NO: 54190 - protein, 33 aa, Artificial Sequence
  Description of Artificial Sequence: Synthetic polypeptide
DEEEIRTTNPVATEQYGDVSTDNGQVGEGGNNG

SEQ ID NO: 54191 - protein, 29 aa, Artificial Sequence
  Description of Artificial Sequence: Synthetic peptide
QEEEIATTNPVAYEQYGSVATNDDQGNDL

SEQ ID NO: 54192 - protein, 29 aa, Artificial Sequence
  Description of Artificial Sequence: Synthetic peptide
QEEEIGSVNPVCTEQYGVVSTDNLQNGNN

SEQ ID NO: 54193 - protein, 30 aa, Artificial Sequence
  Description of Artificial Sequence: Synthetic polypeptide
NEREIRTTNPVATEQYGSVPVNLVEIGQSR

SEQ ID NO: 54194 - protein, 33 aa, Artificial Sequence
  Description of Artificial Sequence: Synthetic polypeptide
DEEEIRTTNPVATEQYGDVVSENNLVNQGGNGN

SEQ ID NO: 54195 - protein, 31 aa, Artificial Sequence
  Description of Artificial Sequence: Synthetic polypeptide
NSEEIRTTNPVATECYGCVSTNTLQYGGNGG

SEQ ID NO: 54196 - protein, 33 aa, Artificial Sequence
  Description of Artificial Sequence: Synthetic polypeptide
DEEEIRTTNPVATEQYGMVSTNNGTQEGGGNIE

SEQ ID NO: 54197 - protein, 33 aa, Artificial Sequence
  Description of Artificial Sequence: Synthetic polypeptide
DEEEIRTTNPVATEQYGDVSTGGLGQEEGGGNQ

SEQ ID NO: 54198 - protein, 28 aa, Artificial Sequence
  Description of Artificial Sequence: Synthetic peptide
QEEEIATTNPCATEQYGEVSENCQHGEK

SEQ ID NO: 54199 - protein, 28 aa, Artificial Sequence
  Description of Artificial Sequence: Synthetic peptide
QEEEIACTNPVATEQYGDVSECLQHEER

SEQ ID NO: 54200 - protein, 33 aa, Artificial Sequence
  Description of Artificial Sequence: Synthetic polypeptide
DEEEIRTTNPVATEQYGDVSTSNVQSQGMGNEG

SEQ ID NO: 54201 - protein, 33 aa, Artificial Sequence
  Description of Artificial Sequence: Synthetic polypeptide
DEEEIRTTNPVATEQYGMVTSTVNLEFEGGNEQ

SEQ ID NO: 54202 - protein, 31 aa, Artificial Sequence
  Description of Artificial Sequence: Synthetic polypeptide
NEREIRTTNPVATEQYGSVQTNLVEIGQSRT

SEQ ID NO: 54203 - protein, 28 aa, Artificial Sequence
  Description of Artificial Sequence: Synthetic peptide
QEEEIRTTNPVATEQYGEAPENCQHENK

SEQ ID NO: 54204 - protein, 31 aa, Artificial Sequence
  Description of Artificial Sequence: Synthetic polypeptide
QEEEIRTTNPVATEQYGSVMATALQNNGFDG

SEQ ID NO: 54205 - protein, 28 aa, Artificial Sequence
  Description of Artificial Sequence: Synthetic peptide
QEEEIATTNPVCTECYGVVSDCLQHGNL

SEQ ID NO: 54206 - protein, 31 aa, Artificial Sequence
  Description of Artificial Sequence: Synthetic polypeptide
QEEEIACTNPVATEQYGSVATNLQAEDNVRV

SEQ ID NO: 54207 - protein, 33 aa, Artificial Sequence
  Description of Artificial Sequence: Synthetic polypeptide
DEEEIRTTNPVATEQYGDVTSTGNLNQNMNEGM

SEQ ID NO: 54208 - protein, 34 aa, Artificial Sequence
  Description of Artificial Sequence: Synthetic polypeptide
DEEEIRTTNPVATEQYGDVSTENLQQDEMGNNGD

SEQ ID NO: 54209 - protein, 32 aa, Artificial Sequence
  Description of Artificial Sequence: Synthetic polypeptide
DEEEIRTTNPVATEQYGMVGSGNMDQGGENSV

SEQ ID NO: 54210 - protein, 32 aa, Artificial Sequence
  Description of Artificial Sequence: Synthetic polypeptide
QEEEICTTNPVATEQYGSVATTNLQERGEPEE

SEQ ID NO: 54211 - protein, 29 aa, Artificial Sequence
  Description of Artificial Sequence: Synthetic peptide
QEEEIRTTNPVATEQFGSVAMHLVIGNPT

SEQ ID NO: 54212 - protein, 34 aa, Artificial Sequence
  Description of Artificial Sequence: Synthetic polypeptide
QEEEICTTNPVATEQYGSVATTNLQERAGENTRE

SEQ ID NO: 54213 - protein, 28 aa, Artificial Sequence
  Description of Artificial Sequence: Synthetic peptide
QEEEIASVNPVATEQYGVVPDNLQSGNQ

SEQ ID NO: 54214 - protein, 30 aa, Artificial Sequence
  Description of Artificial Sequence: Synthetic polypeptide
QEEEIATTNPVATESYGSVATNLQEEEDTR

SEQ ID NO: 54215 - protein, 32 aa, Artificial Sequence
  Description of Artificial Sequence: Synthetic polypeptide
QEEEIRTTNPVATEQYGSVSPTNEQAQLVPRN

SEQ ID NO: 54216 - protein, 31 aa, Artificial Sequence
  Description of Artificial Sequence: Synthetic polypeptide
QEEEIACTNPVATEQYGSVATNLQAEDPGGR

SEQ ID NO: 54217 - protein, 28 aa, Artificial Sequence
  Description of Artificial Sequence: Synthetic peptide
QEEEIATTNPCATEQYGEVSCNCQHGEK

SEQ ID NO: 54218 - protein, 28 aa, Artificial Sequence
  Description of Artificial Sequence: Synthetic peptide
QEEEIATTNPVCTECYGDVSDNLQSENL

SEQ ID NO: 54219 - protein, 30 aa, Artificial Sequence
  Description of Artificial Sequence: Synthetic polypeptide
QEEEIATTNPVAYEQYGSVATNDQRQNDTA

SEQ ID NO: 54220 - protein, 33 aa, Artificial Sequence
  Description of Artificial Sequence: Synthetic polypeptide
DEEEIRTTNPVATEQYGMVGSTDNDNQGGGGNV

SEQ ID NO: 54221 - protein, 28 aa, Artificial Sequence
  Description of Artificial Sequence: Synthetic peptide
QEEEIASVNPVCTEQYGEVSDNLQSGNQ

SEQ ID NO: 54222 - protein, 28 aa, Artificial Sequence
  Description of Artificial Sequence: Synthetic peptide
QEEEIATTNPVATECYGDVSENLQHEEL

SEQ ID NO: 54223 - protein, 28 aa, Artificial Sequence
  Description of Artificial Sequence: Synthetic peptide
QEEEIASVNPVCTEQYGVVSDNLQVGNQ

SEQ ID NO: 54224 - protein, 33 aa, Artificial Sequence
  Description of Artificial Sequence: Synthetic polypeptide
DEEEIRTTNPVATEQYGEVSGTNNGQTGGGNNT

SEQ ID NO: 54225 - protein, 28 aa, Artificial Sequence
  Description of Artificial Sequence: Synthetic peptide
NENEIACTNPVATEQYGEASENLQKGGR

SEQ ID NO: 54226 - protein, 29 aa, Artificial Sequence
  Description of Artificial Sequence: Synthetic peptide
QEEEIACTNPVATEQYGCVATNLQDGGEE

SEQ ID NO: 54227 - protein, 32 aa, Artificial Sequence
  Description of Artificial Sequence: Synthetic polypeptide
DEEEIRTTNPVATEQYGMVGSGTNGGQTGEGG

SEQ ID NO: 54228 - protein, 28 aa, Artificial Sequence
  Description of Artificial Sequence: Synthetic peptide
QEEEIATTNPVATECYGDVSENLQHEEQ

SEQ ID NO: 54229 - protein, 29 aa, Artificial Sequence
  Description of Artificial Sequence: Synthetic peptide
QEEEIACTNPVATEQYGCVATNLQDGDDF

SEQ ID NO: 54230 - protein, 30 aa, Artificial Sequence
  Description of Artificial Sequence: Synthetic polypeptide
QEEEIACTNPVATEQYGSVATNLQAEAENH

SEQ ID NO: 54231 - protein, 28 aa, Artificial Sequence
  Description of Artificial Sequence: Synthetic peptide
QEEEIATTNPVASEQYGIVSENCQSETR

SEQ ID NO: 54232 - protein, 33 aa, Artificial Sequence
  Description of Artificial Sequence: Synthetic polypeptide
QEEEICTTNPVATEQYGSVSTNLQNHQGDNEDD

SEQ ID NO: 54233 - protein, 31 aa, Artificial Sequence
  Description of Artificial Sequence: Synthetic polypeptide
QEENICTTNPVATEQYGSVSTMNSQSGNNSE

SEQ ID NO: 54234 - protein, 33 aa, Artificial Sequence
  Description of Artificial Sequence: Synthetic polypeptide
DEEEIRTTNPVATEQYGMVGSGTNGQGEGEGNE

SEQ ID NO: 54235 - protein, 29 aa, Artificial Sequence
  Description of Artificial Sequence: Synthetic peptide
NEQEIRTTNPVATEQYGSLSTHLQHYQGQ

SEQ ID NO: 54236 - protein, 31 aa, Artificial Sequence
  Description of Artificial Sequence: Synthetic polypeptide
NNEEIRTTNPVATEQYGVCVSTVLQQDGQNE

SEQ ID NO: 54237 - protein, 33 aa, Artificial Sequence
  Description of Artificial Sequence: Synthetic polypeptide
DEEEIRTTNPVATEQYGCVYKTNDIQKNGDNDR

SEQ ID NO: 54238 - protein, 30 aa, Artificial Sequence
  Description of Artificial Sequence: Synthetic polypeptide
QEEEIACTNPVATEQYGCVATNLQAGNQLN

SEQ ID NO: 54239 - protein, 33 aa, Artificial Sequence
  Description of Artificial Sequence: Synthetic polypeptide
DEEEIRTTNPVATEQYGMVSTVNMNLNGEGNDD

SEQ ID NO: 54240 - protein, 28 aa, Artificial Sequence
  Description of Artificial Sequence: Synthetic peptide
QEEEIASVNPVCTEQYGVVSDNLQSGNQ

SEQ ID NO: 54241 - protein, 31 aa, Artificial Sequence
  Description of Artificial Sequence: Synthetic polypeptide
QEEEIRTTNPVATEQYGSVSEAGPNRNGNPV

SEQ ID NO: 54242 - protein, 33 aa, Artificial Sequence
  Description of Artificial Sequence: Synthetic polypeptide
DEEEIRTTNPVATEQYGDVVDTNNLNREGMNGL

SEQ ID NO: 54243 - protein, 32 aa, Artificial Sequence
  Description of Artificial Sequence: Synthetic polypeptide
DEEEIRTTNPVATEQYGDVSVGNMTQGGGNGE

SEQ ID NO: 54244 - protein, 32 aa, Artificial Sequence
  Description of Artificial Sequence: Synthetic polypeptide
DEEEIRTTNPVATEQYGGVSTENLNGFGSSTS

SEQ ID NO: 54245 - protein, 31 aa, Artificial Sequence
  Description of Artificial Sequence: Synthetic polypeptide
QEEEIRTTNPVATEQYGSVSEINCPQDHGEK

SEQ ID NO: 54246 - protein, 31 aa, Artificial Sequence
  Description of Artificial Sequence: Synthetic polypeptide
NNEEIRTTNPVATEQYGVCVSTNQQDGPNQE

SEQ ID NO: 54247 - protein, 31 aa, Artificial Sequence
  Description of Artificial Sequence: Synthetic polypeptide
DEEEIRTTNPVATEQYGCWSEINPLNRENND

SEQ ID NO: 54248 - protein, 30 aa, Artificial Sequence
  Description of Artificial Sequence: Synthetic polypeptide
NEGEIACTNPVATEQYGSVATNLQNGAGSR

SEQ ID NO: 54249 - protein, 32 aa, Artificial Sequence
  Description of Artificial Sequence: Synthetic polypeptide
DEEEIRTTNPVATEQYGMVGSGNMQGGGDENS

SEQ ID NO: 54250 - protein, 32 aa, Artificial Sequence
  Description of Artificial Sequence: Synthetic polypeptide
DEEEIRTTNPVATEQYGCWCSWPNMLQGDSNR

SEQ ID NO: 54251 - protein, 30 aa, Artificial Sequence
  Description of Artificial Sequence: Synthetic polypeptide
NEHEIRTTNPVATEQYGSLSTHGQRQSGQE

SEQ ID NO: 54252 - protein, 28 aa, Artificial Sequence
  Description of Artificial Sequence: Synthetic peptide
QEEEIATTNPVATECYGDVSECLQHGEL

SEQ ID NO: 54253 - protein, 32 aa, Artificial Sequence
  Description of Artificial Sequence: Synthetic polypeptide
DEEEIRTTNPVATEQYGEVDSTDNDDQPANET

SEQ ID NO: 54254 - protein, 28 aa, Artificial Sequence
  Description of Artificial Sequence: Synthetic peptide
QEEEIASVNPVCTEQYGVVSINLQSGNQ

SEQ ID NO: 54255 - protein, 30 aa, Artificial Sequence
  Description of Artificial Sequence: Synthetic polypeptide
QEEEIRTTNPVATEQWGSVSEVEPQDRENG

SEQ ID NO: 54256 - protein, 28 aa, Artificial Sequence
  Description of Artificial Sequence: Synthetic peptide
QEEEIATTNPVATEQYGVVPEVLQHENK

SEQ ID NO: 54257 - protein, 30 aa, Artificial Sequence
  Description of Artificial Sequence: Synthetic polypeptide
NEMEIRTTNPVATEQYGSLSTHLERQGFQE

SEQ ID NO: 54258 - protein, 31 aa, Artificial Sequence
  Description of Artificial Sequence: Synthetic polypeptide
NEGEIRTTNPVATEQYGSVWTWPLQIGFSDR

SEQ ID NO: 54259 - protein, 32 aa, Artificial Sequence
  Description of Artificial Sequence: Synthetic polypeptide
NEGEIRTTNPVATEQYGSVWTWPLQEIGNSGR

SEQ ID NO: 54260 - protein, 28 aa, Artificial Sequence
  Description of Artificial Sequence: Synthetic peptide
QEEEIATTNPVATECYGDVSENLMHGEL

SEQ ID NO: 54261 - protein, 28 aa, Artificial Sequence
  Description of Artificial Sequence: Synthetic peptide
DEEEIRTTNPVATEQYGEVPEVEQAEDK

SEQ ID NO: 54262 - protein, 31 aa, Artificial Sequence
  Description of Artificial Sequence: Synthetic polypeptide
QEEEIRTTNPVATEQYGSVSEACPNRNGNPV

SEQ ID NO: 54263 - protein, 28 aa, Artificial Sequence
  Description of Artificial Sequence: Synthetic peptide
QEEEIATTNPVATECYGVVSECLQHENQ

SEQ ID NO: 54264 - protein, 33 aa, Artificial Sequence
  Description of Artificial Sequence: Synthetic polypeptide
DEEEIRTTNPVATEQYGMVSTVNLNLNEGENEM

SEQ ID NO: 54265 - protein, 31 aa, Artificial Sequence
  Description of Artificial Sequence: Synthetic polypeptide
NEMEIRTTNPVATEQYGSVSAWNVDEFGNRQ

SEQ ID NO: 54266 - protein, 28 aa, Artificial Sequence
  Description of Artificial Sequence: Synthetic peptide
QEEEIASVNPVCTEQYGVVSENLQSGNQ

SEQ ID NO: 54267 - protein, 35 aa, Artificial Sequence
  Description of Artificial Sequence: Synthetic polypeptide
DEEEIRTTNPVATEQYGHVSCWTNELSNRTGGGNR

SEQ ID NO: 54268 - protein, 30 aa, Artificial Sequence
  Description of Artificial Sequence: Synthetic polypeptide
NNEEIRTTNPVATEQYGVVSTLNLQESPEK

SEQ ID NO: 54269 - protein, 33 aa, Artificial Sequence
  Description of Artificial Sequence: Synthetic polypeptide
DEEEIRTTNPVATEQYGMVSTTNTGIQGGNQGN

SEQ ID NO: 54270 - protein, 30 aa, Artificial Sequence
  Description of Artificial Sequence: Synthetic polypeptide
QEEEIACTNPVATEQYGCVATNLQDRPGIE

SEQ ID NO: 54271 - protein, 31 aa, Artificial Sequence
  Description of Artificial Sequence: Synthetic polypeptide
DEEEIRTTNPVATEQYGCWCSTINPLERETN

SEQ ID NO: 54272 - protein, 31 aa, Artificial Sequence
  Description of Artificial Sequence: Synthetic polypeptide
DEEEIRTTNPVATEQYGMVGSGNMEGGGENG

SEQ ID NO: 54273 - protein, 28 aa, Artificial Sequence
  Description of Artificial Sequence: Synthetic peptide
NENEIACTNPVATEQYGEASENLQHGGR

SEQ ID NO: 54274 - protein, 32 aa, Artificial Sequence
  Description of Artificial Sequence: Synthetic polypeptide
DEEEIRTTNPVATEQYGEVSGTNNIGGNGNNN

SEQ ID NO: 54275 - protein, 30 aa, Artificial Sequence
  Description of Artificial Sequence: Synthetic polypeptide
QEEEIATTNPVAYEQYGSVATNLQGVGEDD

SEQ ID NO: 54276 - protein, 33 aa, Artificial Sequence
  Description of Artificial Sequence: Synthetic polypeptide
DEEEIRTTNPVATEQYGMVSTTNGIQEGGGNQE

SEQ ID NO: 54277 - protein, 30 aa, Artificial Sequence
  Description of Artificial Sequence: Synthetic polypeptide
NEGEIRTTNPVATEQYGSVWTLLDEIGSQR

SEQ ID NO: 54278 - protein, 30 aa, Artificial Sequence
  Description of Artificial Sequence: Synthetic polypeptide
DEEEIRTTNPVATEQYGMVSTNSNYVVLME

SEQ ID NO: 54279 - protein, 33 aa, Artificial Sequence
  Description of Artificial Sequence: Synthetic polypeptide
DEEEIRTTNPVATEQYGDVVGTGNLQDGGNGNE

SEQ ID NO: 54280 - protein, 31 aa, Artificial Sequence
  Description of Artificial Sequence: Synthetic polypeptide
QEEEICTTNPVATEQYGSVATNLSERENTEH

SEQ ID NO: 54281 - protein, 33 aa, Artificial Sequence
  Description of Artificial Sequence: Synthetic polypeptide
DEEEIRTTNPVATEQYGDVTSTVNTLGMGGNGD

SEQ ID NO: 54282 - protein, 31 aa, Artificial Sequence
  Description of Artificial Sequence: Synthetic polypeptide
QEEEICTTNPVAYEQYGSVATNDQRNGNESA

SEQ ID NO: 54283 - protein, 29 aa, Artificial Sequence
  Description of Artificial Sequence: Synthetic peptide
QEEEIATTNPVATESYGCIANNLQDDGNR

SEQ ID NO: 54284 - protein, 30 aa, Artificial Sequence
  Description of Artificial Sequence: Synthetic polypeptide
QEEEICTTNPVAYEQYGSVATNLQAENHSD

SEQ ID NO: 54285 - protein, 29 aa, Artificial Sequence
  Description of Artificial Sequence: Synthetic peptide
QEEEIATTNPVATEQYGSVSTVCQDHEEK

SEQ ID NO: 54286 - protein, 28 aa, Artificial Sequence
  Description of Artificial Sequence: Synthetic peptide
QEEEIASVNPVCTEQYGVVSRNLQSGNQ

SEQ ID NO: 54287 - protein, 33 aa, Artificial Sequence
  Description of Artificial Sequence: Synthetic polypeptide
DEEEIRTTNPVATEQYGDVSTGLPQNEGGNGNG

SEQ ID NO: 54288 - protein, 31 aa, Artificial Sequence
  Description of Artificial Sequence: Synthetic polypeptide
QEEEIRTTNPVATEQYGAVMTTNLQRASQDK

SEQ ID NO: 54289 - protein, 33 aa, Artificial Sequence
  Description of Artificial Sequence: Synthetic polypeptide
DEEEIRTTNPVATEQYGDVTSTMELNQGNGNNE

SEQ ID NO: 54290 - protein, 33 aa, Artificial Sequence
  Description of Artificial Sequence: Synthetic polypeptide
DEEEIRTTNPVATEQYGMVGSGNLNQEGGNGEE

SEQ ID NO: 54291 - protein, 28 aa, Artificial Sequence
  Description of Artificial Sequence: Synthetic peptide
QEEEIRTTNPVATEQYGSVPEVCQHEEK

SEQ ID NO: 54292 - protein, 31 aa, Artificial Sequence
  Description of Artificial Sequence: Synthetic polypeptide
QEEEICTTNPVAYEQYGSVATNLQAGPNTEN

SEQ ID NO: 54293 - protein, 30 aa, Artificial Sequence
  Description of Artificial Sequence: Synthetic polypeptide
NNEEIRTTNPVATEQYGSVSAVNLDEFFNQ

SEQ ID NO: 54294 - protein, 30 aa, Artificial Sequence
  Description of Artificial Sequence: Synthetic polypeptide
QEEEIATTNPVAYEQYGSVATNLQVGDQDH

SEQ ID NO: 54295 - protein, 31 aa, Artificial Sequence
  Description of Artificial Sequence: Synthetic polypeptide
QEEEICTTNPVAYEQYGSVATNLQHGDNSDD

SEQ ID NO: 54296 - protein, 29 aa, Artificial Sequence
  Description of Artificial Sequence: Synthetic peptide
NEEEIRTTNPVCTEHYGSVSWPPLMRGTL

SEQ ID NO: 54297 - protein, 32 aa, Artificial Sequence
  Description of Artificial Sequence: Synthetic polypeptide
QEEEIATTNPVATEQYGSVSTPNPDRNGNPQM

SEQ ID NO: 54298 - protein, 28 aa, Artificial Sequence
  Description of Artificial Sequence: Synthetic peptide
QEEEIASVNPVCTEQYGEVSENLQHGNQ

SEQ ID NO: 54299 - protein, 33 aa, Artificial Sequence
  Description of Artificial Sequence: Synthetic polypeptide
DEEEIRTTNPVATEQYGMVGSTDNMTQNGGNID

SEQ ID NO: 54300 - protein, 30 aa, Artificial Sequence
  Description of Artificial Sequence: Synthetic polypeptide
NEEEIRTTNPVCTEHYGSVSWPNTQRGTLV

SEQ ID NO: 54301 - protein, 32 aa, Artificial Sequence
  Description of Artificial Sequence: Synthetic polypeptide
DEEEIRTTNPVATEQYGMVGSTGNGQTGGEGG

SEQ ID NO: 54302 - protein, 31 aa, Artificial Sequence
  Description of Artificial Sequence: Synthetic polypeptide
QEEEIATTNPVATESYGSVAGTNLARDGDQR

SEQ ID NO: 54303 - protein, 33 aa, Artificial Sequence
  Description of Artificial Sequence: Synthetic polypeptide
DEEEIRTTNPVATEQYGDVSTTLPQNEMGGNTD

SEQ ID NO: 54304 - protein, 31 aa, Artificial Sequence
  Description of Artificial Sequence: Synthetic polypeptide
NNEEIRTTNPVATEQYGVVSTNLEDYGPNQE

SEQ ID NO: 54305 - protein, 31 aa, Artificial Sequence
  Description of Artificial Sequence: Synthetic polypeptide
QEEEIATTNPVAYEQYGSVSANLQDTGNEEN

SEQ ID NO: 54306 - protein, 28 aa, Artificial Sequence
  Description of Artificial Sequence: Synthetic peptide
QEEEIASVNPVCTEQYGVVSSNLQHGNQ

SEQ ID NO: 54307 - protein, 28 aa, Artificial Sequence
  Description of Artificial Sequence: Synthetic peptide
QEEEIATTNPVATESYGCIATNDQRDNN

SEQ ID NO: 54308 - protein, 30 aa, Artificial Sequence
  Description of Artificial Sequence: Synthetic polypeptide
QEENICTTNPVATEQYGSVSVMNSQTGNNS

SEQ ID NO: 54309 - protein, 30 aa, Artificial Sequence
  Description of Artificial Sequence: Synthetic polypeptide
QEENICTTNPVATEQYGSVSVMNSQGGNNS

SEQ ID NO: 54310 - protein, 33 aa, Artificial Sequence
  Description of Artificial Sequence: Synthetic polypeptide
DEEEIRTTNPVATEQYGMVGSNMNLGQIGGNGD

SEQ ID NO: 54311 - protein, 28 aa, Artificial Sequence
  Description of Artificial Sequence: Synthetic peptide
QEEEIATTNPIATECYGSVSENLQHEEL

SEQ ID NO: 54312 - protein, 31 aa, Artificial Sequence
  Description of Artificial Sequence: Synthetic polypeptide
NEREIRTTNPVATEQYGCVCWTNLQNSGSQR

SEQ ID NO: 54313 - protein, 31 aa, Artificial Sequence
  Description of Artificial Sequence: Synthetic polypeptide
NNEEIRTTNPVATEQYGVAPSTNLNENGPNR

SEQ ID NO: 54314 - protein, 30 aa, Artificial Sequence
  Description of Artificial Sequence: Synthetic polypeptide
QEEEIACTNPVATEQYGCVATNLQREAPRV

SEQ ID NO: 54315 - protein, 32 aa, Artificial Sequence
  Description of Artificial Sequence: Synthetic polypeptide
NNEEIRTTNPVATEQYGTVQSTNLEQEDDPNR

SEQ ID NO: 54316 - protein, 30 aa, Artificial Sequence
  Description of Artificial Sequence: Synthetic polypeptide
QEEEIRTTNPVATEQWGSVSEVCPQDRENG

SEQ ID NO: 54317 - protein, 30 aa, Artificial Sequence
  Description of Artificial Sequence: Synthetic polypeptide
NEREIRTTNPVATEQYGCVGTNLNQIGSDA

SEQ ID NO: 54318 - protein, 28 aa, Artificial Sequence
  Description of Artificial Sequence: Synthetic peptide
QEEEIASVNPVCTEQYGVVSDNLQHGNQ

SEQ ID NO: 54319 - protein, 30 aa, Artificial Sequence
  Description of Artificial Sequence: Synthetic polypeptide
NEREIRTTNPVATEQYGCVGTNLQISGSQQ

SEQ ID NO: 54320 - protein, 32 aa, Artificial Sequence
  Description of Artificial Sequence: Synthetic polypeptide
QEEEICTTNPVAYEQYGSAVSLTNLQDRGPHY

SEQ ID NO: 54321 - protein, 28 aa, Artificial Sequence
  Description of Artificial Sequence: Synthetic peptide
QEEEIASVNPVCTEQYGVVSCNLQSGTR

SEQ ID NO: 54322 - protein, 30 aa, Artificial Sequence
  Description of Artificial Sequence: Synthetic polypeptide
QEEEIACTNPVATEQYGSVATNLNEMGDNT

SEQ ID NO: 54323 - protein, 33 aa, Artificial Sequence
  Description of Artificial Sequence: Synthetic polypeptide
DEEEIRTTNPVATEQYGDVVDDTNLNREGMNEG

SEQ ID NO: 54324 - protein, 33 aa, Artificial Sequence
  Description of Artificial Sequence: Synthetic polypeptide
DEEEIRTTNPVATEQYGDVVDDTNLNREGMNGQ

SEQ ID NO: 54325 - protein, 28 aa, Artificial Sequence
  Description of Artificial Sequence: Synthetic peptide
QEEEIATTNPIATECYGSVSENLMREEL

SEQ ID NO: 54326 - protein, 30 aa, Artificial Sequence
  Description of Artificial Sequence: Synthetic polypeptide
NEREIRTTNPVATEQYGCVWTNLQNFGDAA

SEQ ID NO: 54327 - protein, 31 aa, Artificial Sequence
  Description of Artificial Sequence: Synthetic polypeptide
QEEEIATTNPVAYEQYGSVATNLQAGPNNQN

SEQ ID NO: 54328 - protein, 28 aa, Artificial Sequence
  Description of Artificial Sequence: Synthetic peptide
QEEEIATTNPVATEQYGTVPTVCQHGEK

SEQ ID NO: 54329 - protein, 28 aa, Artificial Sequence
  Description of Artificial Sequence: Synthetic peptide
QEEEIASVNPVCTEQYGQVSDNLQSGNQ

SEQ ID NO: 54330 - protein, 29 aa, Artificial Sequence
  Description of Artificial Sequence: Synthetic peptide
QEEEIRTTNPVATEQYGSVPTVCQMHEEV

SEQ ID NO: 54331 - protein, 31 aa, Artificial Sequence
  Description of Artificial Sequence: Synthetic polypeptide
NEEEIYTTNPVATEQYGSVSVWNLDEAFGNQ

SEQ ID NO: 54332 - protein, 28 aa, Artificial Sequence
  Description of Artificial Sequence: Synthetic peptide
QEEEIATTNPIATECYGDVSENLQHEER

SEQ ID NO: 54333 - protein, 33 aa, Artificial Sequence
  Description of Artificial Sequence: Synthetic polypeptide
DEEEIRTTNPVATEQYGMVGSITGNLEGNGNGN

SEQ ID NO: 54334 - protein, 28 aa, Artificial Sequence
  Description of Artificial Sequence: Synthetic peptide
QEEEIATTNPCSSEQYGIVSCNLQHGTR

SEQ ID NO: 54335 - protein, 33 aa, Artificial Sequence
  Description of Artificial Sequence: Synthetic polypeptide
DEEEIRTTNPVATEQYGCVVTNDNQQYGGENPR

SEQ ID NO: 54336 - protein, 30 aa, Artificial Sequence
  Description of Artificial Sequence: Synthetic polypeptide
DEEEIRTTNPVATEQYGEVSPEPACQREEK

SEQ ID NO: 54337 - protein, 28 aa, Artificial Sequence
  Description of Artificial Sequence: Synthetic peptide
QEEEIASVNPVCTEQYGVVSCNLQSGNQ

SEQ ID NO: 54338 - protein, 28 aa, Artificial Sequence
  Description of Artificial Sequence: Synthetic peptide
QEEEIATTNPVATEQYGEVSEVCQHEER

SEQ ID NO: 54339 - protein, 30 aa, Artificial Sequence
  Description of Artificial Sequence: Synthetic polypeptide
QAEEIATTNPVATEQYGCVATNLQAGPNDA

SEQ ID NO: 54340 - protein, 32 aa, Artificial Sequence
  Description of Artificial Sequence: Synthetic polypeptide
QEEEIATTNPVATEQWGSVATNLDQRGNNPDM

SEQ ID NO: 54341 - protein, 30 aa, Artificial Sequence
  Description of Artificial Sequence: Synthetic polypeptide
QEEEIATTNPVATEQYGSVATALQANGDQE

SEQ ID NO: 54342 - protein, 33 aa, Artificial Sequence
  Description of Artificial Sequence: Synthetic polypeptide
DEEEIRTTNPVATEQYGMVSTGNGGQGGNDNNI

SEQ ID NO: 54343 - protein, 31 aa, Artificial Sequence
  Description of Artificial Sequence: Synthetic polypeptide
QEEEIACTNPVATEQYGSVATNLQRDQNDAW

SEQ ID NO: 54344 - protein, 31 aa, Artificial Sequence
  Description of Artificial Sequence: Synthetic polypeptide
NETEIRTTNPVATEEYGSVSTNLQGNEGGDM

SEQ ID NO: 54345 - protein, 34 aa, Artificial Sequence
  Description of Artificial Sequence: Synthetic polypeptide
DEEEIRTTNPVATEQYGKVVSCTNLSTSAGNNRV

SEQ ID NO: 54346 - protein, 31 aa, Artificial Sequence
  Description of Artificial Sequence: Synthetic polypeptide
QEEEIACTNPVATEQYGSVATNLQRDQGDQH

SEQ ID NO: 54347 - protein, 33 aa, Artificial Sequence
  Description of Artificial Sequence: Synthetic polypeptide
DEEEIRTTNPVATEQYGEVSSTTNGNRNGMNPV

SEQ ID NO: 54348 - protein, 33 aa, Artificial Sequence
  Description of Artificial Sequence: Synthetic polypeptide
DEEEIRTTNPVATEQYGMVSTGNIGQGQGTNIE

SEQ ID NO: 54349 - protein, 31 aa, Artificial Sequence
  Description of Artificial Sequence: Synthetic polypeptide
QEAEIRTTNPVATEHYGSVSLINLEQVGNNM

SEQ ID NO: 54350 - protein, 34 aa, Artificial Sequence
  Description of Artificial Sequence: Synthetic polypeptide
DEEEIRTTNPVATEQYGISVVSCTNMLQATGGSE

SEQ ID NO: 54351 - protein, 32 aa, Artificial Sequence
  Description of Artificial Sequence: Synthetic polypeptide
NETEIRTTNPVATEEYGSVSTNLQGNEGNNSD

SEQ ID NO: 54352 - protein, 28 aa, Artificial Sequence
  Description of Artificial Sequence: Synthetic peptide
QEEEIRCTNPVATEQYGEASENCMRENK

SEQ ID NO: 54353 - protein, 28 aa, Artificial Sequence
  Description of Artificial Sequence: Synthetic peptide
QEEEVATTNPVATEQYGEVPETCQRGER

SEQ ID NO: 54354 - protein, 29 aa, Artificial Sequence
  Description of Artificial Sequence: Synthetic peptide
QEAVICTTNPVAYEQYGSVSMNEQRPGNS

SEQ ID NO: 54355 - protein, 33 aa, Artificial Sequence
  Description of Artificial Sequence: Synthetic polypeptide
QEEEVRTTNPVATEQYGSVITMNLDQRIGNGGQ

SEQ ID NO: 54356 - protein, 31 aa, Artificial Sequence
  Description of Artificial Sequence: Synthetic polypeptide
QEDEIATTNPVATECYGSVSTGNLQDGNLGQ

SEQ ID NO: 54357 - protein, 34 aa, Artificial Sequence
  Description of Artificial Sequence: Synthetic polypeptide
QEEEIRTTNPVATEQYGSVETSNLVQRIGPEERH

SEQ ID NO: 54358 - protein, 33 aa, Artificial Sequence
  Description of Artificial Sequence: Synthetic polypeptide
QEEEIRPTNPVATEQYGSVSSTTNLPNRGMNPV

SEQ ID NO: 54359 - protein, 31 aa, Artificial Sequence
  Description of Artificial Sequence: Synthetic polypeptide
QEEEIACTNPVATEQYGSVATNLQRNANMYS

SEQ ID NO: 54360 - protein, 30 aa, Artificial Sequence
  Description of Artificial Sequence: Synthetic polypeptide
QEAEIATTNPVAYEQYGSVATNLQAGQGRE

SEQ ID NO: 54361 - protein, 31 aa, Artificial Sequence
  Description of Artificial Sequence: Synthetic polypeptide
DEEEIRTTNPVATEQYGEVVATELQRDAVHD

SEQ ID NO: 54362 - protein, 31 aa, Artificial Sequence
  Description of Artificial Sequence: Synthetic polypeptide
NETEIRTTNPVATECYGSVSTNQQGNEGLND

SEQ ID NO: 54363 - protein, 30 aa, Artificial Sequence
  Description of Artificial Sequence: Synthetic polypeptide
QEAEIATTNPVAYEQYGSVATNLQAGPNNP

SEQ ID NO: 54364 - protein, 33 aa, Artificial Sequence
  Description of Artificial Sequence: Synthetic polypeptide
DEEEIRTTNPVATEQYGMVSTNGTQGMEGNGQG

SEQ ID NO: 54365 - protein, 32 aa, Artificial Sequence
  Description of Artificial Sequence: Synthetic polypeptide
DEEEIRTTNPVATEQYGDVSTNVVGNGNGNGQ

SEQ ID NO: 54366 - protein, 33 aa, Artificial Sequence
  Description of Artificial Sequence: Synthetic polypeptide
DEEEIRTTNPVATEQYGDVSDTNLDMEGNNGQE

SEQ ID NO: 54367 - protein, 30 aa, Artificial Sequence
  Description of Artificial Sequence: Synthetic polypeptide
QEEEICTTNPVATEMYGSVATNLQDHNNDA

SEQ ID NO: 54368 - protein, 32 aa, Artificial Sequence
  Description of Artificial Sequence: Synthetic polypeptide
QEEEIRTTNPVATEQYGSVSTTPVGPNRGMNV

SEQ ID NO: 54369 - protein, 32 aa, Artificial Sequence
  Description of Artificial Sequence: Synthetic polypeptide
DEEEIRTTNPVATEQYGMVSTNDTTGMEGNGG

SEQ ID NO: 54370 - protein, 32 aa, Artificial Sequence
  Description of Artificial Sequence: Synthetic polypeptide
NESEIRTTNPVATEQYGSVSWNDNGLQDQGSR

SEQ ID NO: 54371 - protein, 32 aa, Artificial Sequence
  Description of Artificial Sequence: Synthetic polypeptide
QEEEIRTTNPVATEQYGSVSTTPAGPNRGMNV

SEQ ID NO: 54372 - protein, 32 aa, Artificial Sequence
  Description of Artificial Sequence: Synthetic polypeptide
QEEEIRGTNPVATEQYGSVSTYNQTVQHGINE

SEQ ID NO: 54373 - protein, 28 aa, Artificial Sequence
  Description of Artificial Sequence: Synthetic peptide
QEEEIATTNPVATEQYGEASEVLQREEK

SEQ ID NO: 54374 - protein, 31 aa, Artificial Sequence
  Description of Artificial Sequence: Synthetic polypeptide
QEEEICTTNPVATEMYGSVATNLQDSGNAEM

SEQ ID NO: 54375 - protein, 32 aa, Artificial Sequence
  Description of Artificial Sequence: Synthetic polypeptide
NESEIRTTNPVATEQYGSVAWTDNGLTQDGSR

SEQ ID NO: 54376 - protein, 32 aa, Artificial Sequence
  Description of Artificial Sequence: Synthetic polypeptide
DEEEIRTTNPVATEQYGEVSSTTPAGNMRGNK

SEQ ID NO: 54377 - protein, 31 aa, Artificial Sequence
  Description of Artificial Sequence: Synthetic polypeptide
NETEIRTTNPVATEEYGCVSTNLQGNEGEND

SEQ ID NO: 54378 - protein, 32 aa, Artificial Sequence
  Description of Artificial Sequence: Synthetic polypeptide
QEDEVRTTNPVATEQYGSVSGQNDDQRIGNRT

SEQ ID NO: 54379 - protein, 32 aa, Artificial Sequence
  Description of Artificial Sequence: Synthetic polypeptide
QEAEIATTNPVATEQYGSVATSNLVERGENDR

SEQ ID NO: 54380 - protein, 31 aa, Artificial Sequence
  Description of Artificial Sequence: Synthetic polypeptide
QAEEIATTNPVATEQYGVVSTNLQDQGPGND

SEQ ID NO: 54381 - protein, 28 aa, Artificial Sequence
  Description of Artificial Sequence: Synthetic peptide
QEEEIAPTNPVCSEQYGVVSCNLQSGTR

SEQ ID NO: 54382 - protein, 32 aa, Artificial Sequence
  Description of Artificial Sequence: Synthetic polypeptide
DEEEIRTTNPVATEQYGDYTISTNGGQGGGNG

SEQ ID NO: 54383 - protein, 31 aa, Artificial Sequence
  Description of Artificial Sequence: Synthetic polypeptide
DEEEIRTTNPVATEQYGDYSTNLEQGPSSDS

SEQ ID NO: 54384 - protein, 28 aa, Artificial Sequence
  Description of Artificial Sequence: Synthetic peptide
QEEEIATTNPVATEQYGEASDNCQSGEK

SEQ ID NO: 54385 - protein, 31 aa, Artificial Sequence
  Description of Artificial Sequence: Synthetic polypeptide
NETEIRTTNPVATEMWGSVSTNLQHNGDNDQ

SEQ ID NO: 54386 - protein, 31 aa, Artificial Sequence
  Description of Artificial Sequence: Synthetic polypeptide
QEEEIATTNPVATEQYGSVATNLQEAGSDDF

SEQ ID NO: 54387 - protein, 31 aa, Artificial Sequence
  Description of Artificial Sequence: Synthetic polypeptide
QEEEIACTNPVATEQYGSVATNLQMNGNETL

SEQ ID NO: 54388 - protein, 30 aa, Artificial Sequence
  Description of Artificial Sequence: Synthetic polypeptide
QEEEIATTNPVATEQYGSVATNLQEEHDTS

SEQ ID NO: 54389 - protein, 28 aa, Artificial Sequence
  Description of Artificial Sequence: Synthetic peptide
QEEEIRTTNPIATECYGSVSECLMHENL

SEQ ID NO: 54390 - protein, 28 aa, Artificial Sequence
  Description of Artificial Sequence: Synthetic peptide
QEEEIATTNPVATEQYGEAPEVLQSGNK

SEQ ID NO: 54391 - protein, 31 aa, Artificial Sequence
  Description of Artificial Sequence: Synthetic polypeptide
QEEEIRTTNPVATEQYGSVSTEAGNMRNENV

SEQ ID NO: 54392 - protein, 31 aa, Artificial Sequence
  Description of Artificial Sequence: Synthetic polypeptide
DEEEIRTTNPVATEQYGDVVYTQYAQANGNE

SEQ ID NO: 54393 - protein, 34 aa, Artificial Sequence
  Description of Artificial Sequence: Synthetic polypeptide
DEEEIRTTNPVATEQYGKTVSCCNLSTRDGNNRT

SEQ ID NO: 54394 - protein, 32 aa, Artificial Sequence
  Description of Artificial Sequence: Synthetic polypeptide
DEEEIRTTNPVATEQYGDVSGNFNGQSGNNEI

SEQ ID NO: 54395 - protein, 28 aa, Artificial Sequence
  Description of Artificial Sequence: Synthetic peptide
QEEEIRTTNPIATECYGSVSECLMHGEL

SEQ ID NO: 54396 - protein, 28 aa, Artificial Sequence
  Description of Artificial Sequence: Synthetic peptide
QEEEIATTNPVATEQYGEAPEVLQHGNK

SEQ ID NO: 54397 - protein, 28 aa, Artificial Sequence
  Description of Artificial Sequence: Synthetic peptide
QEEEIATTNPVATEQYGEAPEVLQHGER

SEQ ID NO: 54398 - protein, 28 aa, Artificial Sequence
  Description of Artificial Sequence: Synthetic peptide
QEEEIASTNPCCTEQYGVVSDNLQSGNQ

SEQ ID NO: 54399 - protein, 28 aa, Artificial Sequence
  Description of Artificial Sequence: Synthetic peptide
QEEEIRTTNPCSSEQYGIVSCALQSGTR

SEQ ID NO: 54400 - protein, 28 aa, Artificial Sequence
  Description of Artificial Sequence: Synthetic peptide
QEEEIATTNPVATEQYGEASENCQHEER

SEQ ID NO: 54401 - protein, 32 aa, Artificial Sequence
  Description of Artificial Sequence: Synthetic polypeptide
QEEEIATTNPVATEQYGSVATNLQEAAGNTDN

SEQ ID NO: 54402 - protein, 31 aa, Artificial Sequence
  Description of Artificial Sequence: Synthetic polypeptide
NETEIRTTNPVATEMWGSVSTNLQANGDNND

SEQ ID NO: 54403 - protein, 31 aa, Artificial Sequence
  Description of Artificial Sequence: Synthetic polypeptide
NETEIRTTNPVATEMWGSVSTNLQGNDGNTM

SEQ ID NO: 54404 - protein, 33 aa, Artificial Sequence
  Description of Artificial Sequence: Synthetic polypeptide
DEEEIRTTNPVATEQYGMVSTDNTNQTNGGNID

SEQ ID NO: 54405 - protein, 31 aa, Artificial Sequence
  Description of Artificial Sequence: Synthetic polypeptide
NETEIRTTNPVATEMWGSVSTNLQGNEGNSD

SEQ ID NO: 54406 - protein, 31 aa, Artificial Sequence
  Description of Artificial Sequence: Synthetic polypeptide
QEEEIATTNPVATEQYGSVATNLAEAGNVDF

SEQ ID NO: 54407 - protein, 30 aa, Artificial Sequence
  Description of Artificial Sequence: Synthetic polypeptide
QEEEICTTNPVATEQWGNVAVTMLQGGNER

SEQ ID NO: 54408 - protein, 30 aa, Artificial Sequence
  Description of Artificial Sequence: Synthetic polypeptide
QEEEIATTNPVATEQYGSVATNLENDGDMD

SEQ ID NO: 54409 - protein, 30 aa, Artificial Sequence
  Description of Artificial Sequence: Synthetic polypeptide
QEEEIATTNPVATEQYGSVATNLQAEEDTN

SEQ ID NO: 54410 - protein, 31 aa, Artificial Sequence
  Description of Artificial Sequence: Synthetic polypeptide
QAEEIATTNPVATEQYGSVATNLQEAGNVPE

SEQ ID NO: 54411 - protein, 32 aa, Artificial Sequence
  Description of Artificial Sequence: Synthetic polypeptide
QEEEIRTTNPCATEQYGSVSTCALPNMRGNPV

SEQ ID NO: 54412 - protein, 32 aa, Artificial Sequence
  Description of Artificial Sequence: Synthetic polypeptide
DEEEIRTTNPVATEQYGMVDSTNLQEEQESDW

SEQ ID NO: 54413 - protein, 28 aa, Artificial Sequence
  Description of Artificial Sequence: Synthetic peptide
QEEEIAPTNPVCTEQYGVVSDNLQSGTQ

SEQ ID NO: 54414 - protein, 33 aa, Artificial Sequence
  Description of Artificial Sequence: Synthetic polypeptide
DEEEIRTTNPVATEQYGMVSTDNMTQENGGNID

SEQ ID NO: 54415 - protein, 32 aa, Artificial Sequence
  Description of Artificial Sequence: Synthetic polypeptide
QEECIATTNPVATEQWGISVSTNLSQRGGNNP

SEQ ID NO: 54416 - protein, 32 aa, Artificial Sequence
  Description of Artificial Sequence: Synthetic polypeptide
DEEEIRTTNPVATEQYGMVGSDTDNGQETGEG

SEQ ID NO: 54417 - protein, 32 aa, Artificial Sequence
  Description of Artificial Sequence: Synthetic polypeptide
DEEEIRTTNPVATEQYGMVSTDNMDGGNGNGD

SEQ ID NO: 54418 - protein, 32 aa, Artificial Sequence
  Description of Artificial Sequence: Synthetic polypeptide
DEEEIRTTNPVATEQYGMVGSGNLNDEGGGNG

SEQ ID NO: 54419 - protein, 28 aa, Artificial Sequence
  Description of Artificial Sequence: Synthetic peptide
QEEEIATTNPVATEQYGEASEVCQREER

SEQ ID NO: 54420 - protein, 33 aa, Artificial Sequence
  Description of Artificial Sequence: Synthetic polypeptide
DEEEIRTTNPVATEQYGDVNSDTNGQDEGENQG

SEQ ID NO: 54421 - protein, 33 aa, Artificial Sequence
  Description of Artificial Sequence: Synthetic polypeptide
DEEEIRTTNPVATEQYGEVTSTFNTLVNPGLNN

SEQ ID NO: 54422 - protein, 32 aa, Artificial Sequence
  Description of Artificial Sequence: Synthetic polypeptide
QEAEIATTNPVATEQYGSVATNDQRDGMNERA

SEQ ID NO: 54423 - protein, 31 aa, Artificial Sequence
  Description of Artificial Sequence: Synthetic polypeptide
QEEEIRTTNPVATEQYGVVSNENGLQEQHNE

SEQ ID NO: 54424 - protein, 28 aa, Artificial Sequence
  Description of Artificial Sequence: Synthetic peptide
QEEEIATTNPVATEQYGEVSTVPQHEEK

SEQ ID NO: 54425 - protein, 29 aa, Artificial Sequence
  Description of Artificial Sequence: Synthetic peptide
QEEEIATTNPVATEQYGEVSTVPQHEGEK

SEQ ID NO: 54426 - protein, 31 aa, Artificial Sequence
  Description of Artificial Sequence: Synthetic polypeptide
QEEEIRTTNPVATEQYGSVYTALQNEGFDDT

SEQ ID NO: 54427 - protein, 30 aa, Artificial Sequence
  Description of Artificial Sequence: Synthetic polypeptide
QAEEIATTNPVAYEQYGSVATNLQDDGNDH

SEQ ID NO: 54428 - protein, 28 aa, Artificial Sequence
  Description of Artificial Sequence: Synthetic peptide
QEEEIATTNPVATEQYGIVPCNCQHGEK

SEQ ID NO: 54429 - protein, 28 aa, Artificial Sequence
  Description of Artificial Sequence: Synthetic peptide
QEEEIATTNPVATEQYGIVPCNCQSGEK

SEQ ID NO: 54430 - protein, 28 aa, Artificial Sequence
  Description of Artificial Sequence: Synthetic peptide
QEEEIRCTNPVATEQYGSASEVCQREEK

SEQ ID NO: 54431 - protein, 28 aa, Artificial Sequence
  Description of Artificial Sequence: Synthetic peptide
QEEEIATTNPVATEQYGSAPTVLQHEEK

SEQ ID NO: 54432 - protein, 28 aa, Artificial Sequence
  Description of Artificial Sequence: Synthetic peptide
QEEEIACTNPVATEQYGSVPEVCQHGER

SEQ ID NO: 54433 - protein, 29 aa, Artificial Sequence
  Description of Artificial Sequence: Synthetic peptide
QEEEIATTNPVATEQYGSASTDLEHEGEK

SEQ ID NO: 54434 - protein, 29 aa, Artificial Sequence
  Description of Artificial Sequence: Synthetic peptide
QEEEIATTNPVATEQYGEVSEVCPQRENK

SEQ ID NO: 54435 - protein, 28 aa, Artificial Sequence
  Description of Artificial Sequence: Synthetic peptide
QEEEIATTNPVATEQYGSASTVCQHEEK

SEQ ID NO: 54436 - protein, 31 aa, Artificial Sequence
  Description of Artificial Sequence: Synthetic polypeptide
NETEIRTTNPVATECYGNVSTNLQGQQGNDS

SEQ ID NO: 54437 - protein, 31 aa, Artificial Sequence
  Description of Artificial Sequence: Synthetic polypeptide
QEEEIATTNPVATEQYGSCSTHLQPDGQGDR

SEQ ID NO: 54438 - protein, 28 aa, Artificial Sequence
  Description of Artificial Sequence: Synthetic peptide
QEEEIATVNPVATEQYGVVSDVLQHENK

SEQ ID NO: 54439 - protein, 31 aa, Artificial Sequence
  Description of Artificial Sequence: Synthetic polypeptide
QEEEIRTTNPVATEQYGSVVNWLNWTERGNE

SEQ ID NO: 54440 - protein, 29 aa, Artificial Sequence
  Description of Artificial Sequence: Synthetic peptide
QEEEIATTNPVATEQYGEVSTGPQHEGEK

SEQ ID NO: 54441 - protein, 32 aa, Artificial Sequence
  Description of Artificial Sequence: Synthetic polypeptide
NETEIRTTNPVATECYGNVSTNLQGNMGNNDR

SEQ ID NO: 54442 - protein, 33 aa, Artificial Sequence
  Description of Artificial Sequence: Synthetic polypeptide
QEEEIRTTNPVATERWGSVSTNELSQRGGSNVN

SEQ ID NO: 54443 - protein, 28 aa, Artificial Sequence
  Description of Artificial Sequence: Synthetic peptide
QEEEIATVNPVATEQYGVVSECLQHENL

SEQ ID NO: 54444 - protein, 34 aa, Artificial Sequence
  Description of Artificial Sequence: Synthetic polypeptide
DEEEIRTTNPVATEQYGDVNSNTQNLQSEGGGNG

SEQ ID NO: 54445 - protein, 29 aa, Artificial Sequence
  Description of Artificial Sequence: Synthetic peptide
QAEEIATTNPVAYEQYGSVATNLQDGGQM

SEQ ID NO: 54446 - protein, 31 aa, Artificial Sequence
  Description of Artificial Sequence: Synthetic polypeptide
QEEEIACTNPVATEQYGSVVTNLQAEDGNEA

SEQ ID NO: 54447 - protein, 28 aa, Artificial Sequence
  Description of Artificial Sequence: Synthetic peptide
QEEEIATTNPVATEQYGEVSEVCQHGEK

SEQ ID NO: 54448 - protein, 30 aa, Artificial Sequence
  Description of Artificial Sequence: Synthetic polypeptide
QAEEIATTNPVAYEQYGSVATNLQDGNDNP

SEQ ID NO: 54449 - protein, 33 aa, Artificial Sequence
  Description of Artificial Sequence: Synthetic polypeptide
QEEEIRTTNPVAYEQYGSTVSATNLQDREWEDR

SEQ ID NO: 54450 - protein, 32 aa, Artificial Sequence
  Description of Artificial Sequence: Synthetic polypeptide
NETEIRTTNPVATEAYGSVSTNLQGNEGNNDE

SEQ ID NO: 54451 - protein, 28 aa, Artificial Sequence
  Description of Artificial Sequence: Synthetic peptide
QEEEIRTTNPVSTEQYGSVAANDQGPQT

SEQ ID NO: 54452 - protein, 29 aa, Artificial Sequence
  Description of Artificial Sequence: Synthetic peptide
QEEEIRTTNPVSTEQYGSVAMNDQGGQTH

SEQ ID NO: 54453 - protein, 31 aa, Artificial Sequence
  Description of Artificial Sequence: Synthetic polypeptide
QEEEIACTNPVATEQYGSVSTNPQEAGNPDF

SEQ ID NO: 54454 - protein, 31 aa, Artificial Sequence
  Description of Artificial Sequence: Synthetic polypeptide
QEEEIACTNPVATEQYGSVSTNLQPEEEDTR

SEQ ID NO: 54455 - protein, 31 aa, Artificial Sequence
  Description of Artificial Sequence: Synthetic polypeptide
QEEEIRTTNPVAYEEYGSVPPTILNRAGSNR

SEQ ID NO: 54456 - protein, 29 aa, Artificial Sequence
  Description of Artificial Sequence: Synthetic peptide
QAEEIATTNPVAYEQYGSVATNLQDGGDT

SEQ ID NO: 54457 - protein, 31 aa, Artificial Sequence
  Description of Artificial Sequence: Synthetic polypeptide
NETEIATTNPVATESYGSVSTNLQGNEGNDD

SEQ ID NO: 54458 - protein, 30 aa, Artificial Sequence
  Description of Artificial Sequence: Synthetic polypeptide
QAEEIATTNPVAYEQYGSVATNLQDGPNDQ

SEQ ID NO: 54459 - protein, 31 aa, Artificial Sequence
  Description of Artificial Sequence: Synthetic polypeptide
QAEEIATTNPVAYEQYGSVATNLQERGNDQM

SEQ ID NO: 54460 - protein, 30 aa, Artificial Sequence
  Description of Artificial Sequence: Synthetic polypeptide
QEEEIATTNPVATEQYGSVAANLNETGDNT

SEQ ID NO: 54461 - protein, 28 aa, Artificial Sequence
  Description of Artificial Sequence: Synthetic peptide
DEEEIRTTNPVATEQYGDVPEVEQAEDK

SEQ ID NO: 54462 - protein, 28 aa, Artificial Sequence
  Description of Artificial Sequence: Synthetic peptide
QEEEIAPTNPCSSEQYGIVSCNLQSGNR

SEQ ID NO: 54463 - protein, 34 aa, Artificial Sequence
  Description of Artificial Sequence: Synthetic polypeptide
DEEEIRTTNPVATEQYGESTVASYTNELNRGDTC

SEQ ID NO: 54464 - protein, 28 aa, Artificial Sequence
  Description of Artificial Sequence: Synthetic peptide
QEEEIATVNPVATEQYGDVSECLQHGEL

SEQ ID NO: 54465 - protein, 29 aa, Artificial Sequence
  Description of Artificial Sequence: Synthetic peptide
QAEEIATTNPVAYEQYGSVATNLQVSGDV

SEQ ID NO: 54466 - protein, 28 aa, Artificial Sequence
  Description of Artificial Sequence: Synthetic peptide
QEEEIAPTNPCSTEQYGSVSCNLMSGTR

SEQ ID NO: 54467 - protein, 28 aa, Artificial Sequence
  Description of Artificial Sequence: Synthetic peptide
QEEEIATVNPVATEQYGDVSECLQHENL

SEQ ID NO: 54468 - protein, 32 aa, Artificial Sequence
  Description of Artificial Sequence: Synthetic polypeptide
NETEIRTTNPVATECYGSVSTNLQGNEGTNEH

SEQ ID NO: 54469 - protein, 31 aa, Artificial Sequence
  Description of Artificial Sequence: Synthetic polypeptide
QAEEIATTNPVAYEQYGSVSANLQDRGNAEM

SEQ ID NO: 54470 - protein, 29 aa, Artificial Sequence
  Description of Artificial Sequence: Synthetic peptide
QAHEIATTNPVAYEQYGSVATNLQDGNDD

SEQ ID NO: 54471 - protein, 32 aa, Artificial Sequence
  Description of Artificial Sequence: Synthetic polypeptide
NETEIRTTNPVATECYGSVSTNLQGNEGPNDS

SEQ ID NO: 54472 - protein, 28 aa, Artificial Sequence
  Description of Artificial Sequence: Synthetic peptide
QEEEIATVNPVATECYGVVSECLQSGNL

SEQ ID NO: 54473 - protein, 31 aa, Artificial Sequence
  Description of Artificial Sequence: Synthetic polypeptide
QEEEICTTNPTAYEQYGSVATNLQHSGDNDR

SEQ ID NO: 54474 - protein, 31 aa, Artificial Sequence
  Description of Artificial Sequence: Synthetic polypeptide
QEEEIATTNPVATEQYGSVAITNLQEPEDTR

SEQ ID NO: 54475 - protein, 28 aa, Artificial Sequence
  Description of Artificial Sequence: Synthetic peptide
DEEEIRTTNPVATEQYGDVPEIEQAEDK

SEQ ID NO: 54476 - protein, 30 aa, Artificial Sequence
  Description of Artificial Sequence: Synthetic polypeptide
QEEEIATTNPVATEQYGSVAITNLTDGDEQ

SEQ ID NO: 54477 - protein, 32 aa, Artificial Sequence
  Description of Artificial Sequence: Synthetic polypeptide
NETEIRTTNPVATECYGSVSTNLQMNGGDNND

SEQ ID NO: 54478 - protein, 28 aa, Artificial Sequence
  Description of Artificial Sequence: Synthetic peptide
QEEEIATVNPVATECYGVVSDCLQSGNL

SEQ ID NO: 54479 - protein, 28 aa, Artificial Sequence
  Description of Artificial Sequence: Synthetic peptide
QEEEIAPTNPCSTEQYGVVSDNLQSGNQ

SEQ ID NO: 54480 - protein, 31 aa, Artificial Sequence
  Description of Artificial Sequence: Synthetic polypeptide
QEEEIATTNPVATEQYGSVAITNLPEGDDNT

SEQ ID NO: 54481 - protein, 33 aa, Artificial Sequence
  Description of Artificial Sequence: Synthetic polypeptide
QEEEIRTTNPVATEQYGSVSWTDNQQDRNANEQ

SEQ ID NO: 54482 - protein, 28 aa, Artificial Sequence
  Description of Artificial Sequence: Synthetic peptide
QEEEIATVNPVATEQYGEVPDNLQHGEK

SEQ ID NO: 54483 - protein, 29 aa, Artificial Sequence
  Description of Artificial Sequence: Synthetic peptide
NESVEIATTNPVAYEQYGSVATNLQSGSD

SEQ ID NO: 54484 - protein, 30 aa, Artificial Sequence
  Description of Artificial Sequence: Synthetic polypeptide
QAEEIATTNPVAYEQYGSVAATNLQNGNVD

SEQ ID NO: 54485 - protein, 34 aa, Artificial Sequence
  Description of Artificial Sequence: Synthetic polypeptide
QEEEIRTTNPVATEQYGSVTSTMNLNQNEGGNIP

SEQ ID NO: 54486 - protein, 30 aa, Artificial Sequence
  Description of Artificial Sequence: Synthetic polypeptide
QEEEIACTNPVATEQYGSVATNNQAEDNNR

SEQ ID NO: 54487 - protein, 31 aa, Artificial Sequence
  Description of Artificial Sequence: Synthetic polypeptide
NETEIRTTNPVATECYGSVSTNIQGNEGNDT

SEQ ID NO: 54488 - protein, 28 aa, Artificial Sequence
  Description of Artificial Sequence: Synthetic peptide
QEEEIAPTNPCSSEQYGSVSCNLQSGTR

SEQ ID NO: 54489 - protein, 31 aa, Artificial Sequence
  Description of Artificial Sequence: Synthetic polypeptide
QEEEIATTNPVATEQYGSVAANLQEAGNNDQ

SEQ ID NO: 54490 - protein, 31 aa, Artificial Sequence
  Description of Artificial Sequence: Synthetic polypeptide
NETEIATTNPVATEMYGSVSTNLQNGGDNDS

SEQ ID NO: 54491 - protein, 33 aa, Artificial Sequence
  Description of Artificial Sequence: Synthetic polypeptide
NETEIRTTNPVATECYGSVSTNLPQGNEGGNDR

SEQ ID NO: 54492 - protein, 30 aa, Artificial Sequence
  Description of Artificial Sequence: Synthetic polypeptide
NETEIATTNPVATEMYGEVSTNLQGNGDND

SEQ ID NO: 54493 - protein, 29 aa, Artificial Sequence
  Description of Artificial Sequence: Synthetic peptide
QEEEIAPTNPCSTEQYGIVSCNLQSGMNR

SEQ ID NO: 54494 - protein, 28 aa, Artificial Sequence
  Description of Artificial Sequence: Synthetic peptide
QEEEIATVNPVATEQYGVVSEVLQHENK

SEQ ID NO: 54495 - protein, 28 aa, Artificial Sequence
  Description of Artificial Sequence: Synthetic peptide
QEEEIATVNPVATEQYGVVPDNLQHGEK

SEQ ID NO: 54496 - protein, 31 aa, Artificial Sequence
  Description of Artificial Sequence: Synthetic polypeptide
NETEIATTNPVATEHYGSVSTNLQGNTGDND

SEQ ID NO: 54497 - protein, 28 aa, Artificial Sequence
  Description of Artificial Sequence: Synthetic peptide
QEEEIATVNPVCTECYGVVSDNLQSGNQ

SEQ ID NO: 54498 - protein, 32 aa, Artificial Sequence
  Description of Artificial Sequence: Synthetic polypeptide
NETEIRTTNPVATECYGSVSTNLQGNAGNEDT

SEQ ID NO: 54499 - protein, 31 aa, Artificial Sequence
  Description of Artificial Sequence: Synthetic polypeptide
DEEEIRTTNPVATEQYGDVSTPIGMNAAGNA

SEQ ID NO: 54500 - protein, 34 aa, Artificial Sequence
  Description of Artificial Sequence: Synthetic polypeptide
NETEDEIRTTNPVATEQYGSVSTNLQGGMGGNQG

SEQ ID NO: 54501 - protein, 33 aa, Artificial Sequence
  Description of Artificial Sequence: Synthetic polypeptide
QEEEIACTNPVATEQYGSVATTNLQERPGENRE

SEQ ID NO: 54502 - protein, 31 aa, Artificial Sequence
  Description of Artificial Sequence: Synthetic polypeptide
NESEIATTNPVATEQYGSVWTDNGLQQDGSR

SEQ ID NO: 54503 - protein, 33 aa, Artificial Sequence
  Description of Artificial Sequence: Synthetic polypeptide
DEEEIRTTNPVATEQYGDVNSDGNLQDNGENDD

SEQ ID NO: 54504 - protein, 32 aa, Artificial Sequence
  Description of Artificial Sequence: Synthetic polypeptide
DEEEIRTTNPVATEQYGDVNDTNMGQGGGNGG

SEQ ID NO: 54505 - protein, 32 aa, Artificial Sequence
  Description of Artificial Sequence: Synthetic polypeptide
DEEEIRTTNPVATEQYGMVSMTLNLQEYSDAL

SEQ ID NO: 54506 - protein, 29 aa, Artificial Sequence
  Description of Artificial Sequence: Synthetic peptide
QAEEIATTNPVATAQWGSVSTNPDRGNQN

SEQ ID NO: 54507 - protein, 33 aa, Artificial Sequence
  Description of Artificial Sequence: Synthetic polypeptide
DEEEIRTTNPVATEQYGMVSITNVGQGGNGNQN

SEQ ID NO: 54508 - protein, 34 aa, Artificial Sequence
  Description of Artificial Sequence: Synthetic polypeptide
DEEEIRTTNPVATEQYGMSGSTNLQFTVGEGGNE

SEQ ID NO: 54509 - protein, 34 aa, Artificial Sequence
  Description of Artificial Sequence: Synthetic polypeptide
DEEEIRTTNPVATEQYGMSGSTNLQFEVGEGENT

SEQ ID NO: 54510 - protein, 28 aa, Artificial Sequence
  Description of Artificial Sequence: Synthetic peptide
QAEEIATTNPCAYEPYGSVSANLQRDNS

SEQ ID NO: 54511 - protein, 31 aa, Artificial Sequence
  Description of Artificial Sequence: Synthetic polypeptide
NETEIRTTNPVATEMYGTVSTNLQGNEGNDN

SEQ ID NO: 54512 - protein, 28 aa, Artificial Sequence
  Description of Artificial Sequence: Synthetic peptide
QEEEIATTNPVCTEQYGVVSDCLQSGEQ

SEQ ID NO: 54513 - protein, 31 aa, Artificial Sequence
  Description of Artificial Sequence: Synthetic polypeptide
QEEEIATTNPVATEQYGSVSANLQEAEDNEN

SEQ ID NO: 54514 - protein, 32 aa, Artificial Sequence
  Description of Artificial Sequence: Synthetic polypeptide
DEEEIRTTNPVATEQYGDVSSTMDLNEIEGNQ

SEQ ID NO: 54515 - protein, 31 aa, Artificial Sequence
  Description of Artificial Sequence: Synthetic polypeptide
DEEEIRTTNPVATEQYGEVSSEPAGNMRGNK

SEQ ID NO: 54516 - protein, 33 aa, Artificial Sequence
  Description of Artificial Sequence: Synthetic polypeptide
DEEEIRTTNPVATEQYGMVGSGNLNIGQNGGNV

SEQ ID NO: 54517 - protein, 32 aa, Artificial Sequence
  Description of Artificial Sequence: Synthetic polypeptide
DEEEIRTTNPVATEQYGMVSIFTGNGQGNEQN

SEQ ID NO: 54518 - protein, 33 aa, Artificial Sequence
  Description of Artificial Sequence: Synthetic polypeptide
DEEEIRTTNPVATEQYGMSGSTNLQETDGEIEN

SEQ ID NO: 54519 - protein, 34 aa, Artificial Sequence
  Description of Artificial Sequence: Synthetic polypeptide
DEEEIRTTNPVATEQYGMSGSTNDLGQSGGNQDE

SEQ ID NO: 54520 - protein, 33 aa, Artificial Sequence
  Description of Artificial Sequence: Synthetic polypeptide
DEEEIRTTNPVATEQYGDVSSTNDQLNIIEGNE

SEQ ID NO: 54521 - protein, 30 aa, Artificial Sequence
  Description of Artificial Sequence: Synthetic polypeptide
QAAEIATTNPVATEQYGSVATNLQEAGNDE

SEQ ID NO: 54522 - protein, 30 aa, Artificial Sequence
  Description of Artificial Sequence: Synthetic polypeptide
QEEEIACTNPVATEMYGSVATNLQDQGNDV

SEQ ID NO: 54523 - protein, 28 aa, Artificial Sequence
  Description of Artificial Sequence: Synthetic peptide
QEEEIACTNPVATEGYGVMASNLQRGDR

SEQ ID NO: 54524 - protein, 28 aa, Artificial Sequence
  Description of Artificial Sequence: Synthetic peptide
QEEEIATTNPVCTEQYGVVSECLQHENQ

SEQ ID NO: 54525 - protein, 32 aa, Artificial Sequence
  Description of Artificial Sequence: Synthetic polypeptide
DEEEIRTTNPVATEQYGICVCSTGELQNGSEQ

SEQ ID NO: 54526 - protein, 28 aa, Artificial Sequence
  Description of Artificial Sequence: Synthetic peptide
QEEEIATTNPVCTEQYGVVSECLQSGEQ

SEQ ID NO: 54527 - protein, 28 aa, Artificial Sequence
  Description of Artificial Sequence: Synthetic peptide
QEEEIATTNPVATEQYGEAPENLQHEER

SEQ ID NO: 54528 - protein, 31 aa, Artificial Sequence
  Description of Artificial Sequence: Synthetic polypeptide
QEEEIRCTNPAATEQYGSVSIENMLMRGNEA

SEQ ID NO: 54529 - protein, 28 aa, Artificial Sequence
  Description of Artificial Sequence: Synthetic peptide
QEEEIATTNPVATEQYGSVPTVCQHEEK

SEQ ID NO: 54530 - protein, 28 aa, Artificial Sequence
  Description of Artificial Sequence: Synthetic peptide
QEEEIATTNPVATEQYGEAPENCQHGGR

SEQ ID NO: 54531 - protein, 28 aa, Artificial Sequence
  Description of Artificial Sequence: Synthetic peptide
QEEEIATTNPVATEQYGEAPDVLQSGNK

SEQ ID NO: 54532 - protein, 28 aa, Artificial Sequence
  Description of Artificial Sequence: Synthetic peptide
QEEEIATTNPVATEQYGEAPDVLQHGNK

SEQ ID NO: 54533 - protein, 28 aa, Artificial Sequence
  Description of Artificial Sequence: Synthetic peptide
QEEEIATTNPVATEQYGEAPDNLQHENK

SEQ ID NO: 54534 - protein, 28 aa, Artificial Sequence
  Description of Artificial Sequence: Synthetic peptide
QEEEIASTNPVCTEQYGVVSDVLQSGNK

SEQ ID NO: 54535 - protein, 28 aa, Artificial Sequence
  Description of Artificial Sequence: Synthetic peptide
QEEEIATTNPVATEQYGEAPCNLQHEER

SEQ ID NO: 54536 - protein, 31 aa, Artificial Sequence
  Description of Artificial Sequence: Synthetic polypeptide
NETEIRTTNPVATEMYGSVSTNQQGNEGNND

SEQ ID NO: 54537 - protein, 29 aa, Artificial Sequence
  Description of Artificial Sequence: Synthetic peptide
QAEEIATTNPVATEPYGVVSTNLQAGPME

SEQ ID NO: 54538 - protein, 32 aa, Artificial Sequence
  Description of Artificial Sequence: Synthetic polypeptide
QEEEIATTNPVATEQYGSVSAGNLDEAGNHRN

SEQ ID NO: 54539 - protein, 31 aa, Artificial Sequence
  Description of Artificial Sequence: Synthetic polypeptide
DEEEIRTTNPVATEQYGFVSAGNDPWRLEIR

SEQ ID NO: 54540 - protein, 33 aa, Artificial Sequence
  Description of Artificial Sequence: Synthetic polypeptide
DEEEIRTTNPVATEQYGMVSNMNLGQIGGNGQG

SEQ ID NO: 54541 - protein, 33 aa, Artificial Sequence
  Description of Artificial Sequence: Synthetic polypeptide
DEEEIRTTNPVATEQYGMVSNMNLEQNIGGNGE

SEQ ID NO: 54542 - protein, 28 aa, Artificial Sequence
  Description of Artificial Sequence: Synthetic peptide
QEEEIATTNPVATEQYGDVSECLQHEEL

SEQ ID NO: 54543 - protein, 32 aa, Artificial Sequence
  Description of Artificial Sequence: Synthetic polypeptide
DEEEIRTTNPVATEQYGICVCSTNTQNFGSEQ

SEQ ID NO: 54544 - protein, 33 aa, Artificial Sequence
  Description of Artificial Sequence: Synthetic polypeptide
NETEIRTTNPVATEQYGSVSTMGLGQERGGNSG

SEQ ID NO: 54545 - protein, 32 aa, Artificial Sequence
  Description of Artificial Sequence: Synthetic polypeptide
DEEEIRTTNPVATEQYGDVSSTTGDQGEGGNG

SEQ ID NO: 54546 - protein, 30 aa, Artificial Sequence
  Description of Artificial Sequence: Synthetic polypeptide
PSEEICTTNPVATECYGSVSTNLQNSGKIE

SEQ ID NO: 54547 - protein, 32 aa, Artificial Sequence
  Description of Artificial Sequence: Synthetic polypeptide
QEEEICTTNPVATEQYGSVATNLQNDGMNGMF

SEQ ID NO: 54548 - protein, 28 aa, Artificial Sequence
  Description of Artificial Sequence: Synthetic peptide
QEEEIATTNPVCTECYGVVSDNLQSENQ

SEQ ID NO: 54549 - protein, 31 aa, Artificial Sequence
  Description of Artificial Sequence: Synthetic polypeptide
QEEEIATTNPVATEQYGSVSAPNPDRGNPAF

SEQ ID NO: 54550 - protein, 32 aa, Artificial Sequence
  Description of Artificial Sequence: Synthetic polypeptide
NSHEIRTTNPVATEQYGVTVSCTNLSQEGGNR

SEQ ID NO: 54551 - protein, 30 aa, Artificial Sequence
  Description of Artificial Sequence: Synthetic polypeptide
QEEEIATTNPVATEQYGSVSENCPQDHGEK

SEQ ID NO: 54552 - protein, 31 aa, Artificial Sequence
  Description of Artificial Sequence: Synthetic polypeptide
NESEIRTTNPVATEAYGSVWCTNLSQIVSNR

SEQ ID NO: 54553 - protein, 30 aa, Artificial Sequence
  Description of Artificial Sequence: Synthetic polypeptide
QEEEIATTNPVATEQYGCVATALQDGGERH

SEQ ID NO: 54554 - protein, 31 aa, Artificial Sequence
  Description of Artificial Sequence: Synthetic polypeptide
NETEIRTTNPVATEQYGSVSTTQMGEGNNDR

SEQ ID NO: 54555 - protein, 32 aa, Artificial Sequence
  Description of Artificial Sequence: Synthetic polypeptide
QEEEIRTTNPVATEQYGSVSPWMLQQGVNQIL

SEQ ID NO: 54556 - protein, 32 aa, Artificial Sequence
  Description of Artificial Sequence: Synthetic polypeptide
DEEEIRTTNPVATEQYGMVGSTNMGQDGGGEE

SEQ ID NO: 54557 - protein, 32 aa, Artificial Sequence
  Description of Artificial Sequence: Synthetic polypeptide
QEEEIATTNPVATEQYGCVAATNLQPRDGNDN

SEQ ID NO: 54558 - protein, 28 aa, Artificial Sequence
  Description of Artificial Sequence: Synthetic peptide
QEEEIASTNPVSSEQYGIVSCNLQSGNQ

SEQ ID NO: 54559 - protein, 31 aa, Artificial Sequence
  Description of Artificial Sequence: Synthetic polypeptide
QEEGIRTTNPVATEQYGSVSTNGLGEGEDGG

SEQ ID NO: 54560 - protein, 31 aa, Artificial Sequence
  Description of Artificial Sequence: Synthetic polypeptide
QEEEIATTNPVATEQYGCVAATNLQEPEDNR

SEQ ID NO: 54561 - protein, 31 aa, Artificial Sequence
  Description of Artificial Sequence: Synthetic polypeptide
NETEIRTTNPVATEQYGSVSWTENQDIHGSR

SEQ ID NO: 54562 - protein, 33 aa, Artificial Sequence
  Description of Artificial Sequence: Synthetic polypeptide
DEEEIRTTNPVATEQYGDVVSGTNIGGGQTGND

SEQ ID NO: 54563 - protein, 32 aa, Artificial Sequence
  Description of Artificial Sequence: Synthetic polypeptide
QEEEIRTTNPVATEQYGSVSSTCAGNMRNGNV

SEQ ID NO: 54564 - protein, 28 aa, Artificial Sequence
  Description of Artificial Sequence: Synthetic peptide
QEEEIATTNPVCTEQYGDVSECLQSGEQ

SEQ ID NO: 54565 - protein, 33 aa, Artificial Sequence
  Description of Artificial Sequence: Synthetic polypeptide
DEEEIRTTNPVATEQYGMVGSTVNLNLNGENDQ

SEQ ID NO: 54566 - protein, 34 aa, Artificial Sequence
  Description of Artificial Sequence: Synthetic polypeptide
DEEEIRTTNPVATEQYGMSGSTNDLGQEGGGNDE

SEQ ID NO: 54567 - protein, 30 aa, Artificial Sequence
  Description of Artificial Sequence: Synthetic polypeptide
NETEIRTTNPVATEQYGSVSTQQMGDGGND

SEQ ID NO: 54568 - protein, 29 aa, Artificial Sequence
  Description of Artificial Sequence: Synthetic peptide
QEEEIRTTNPVAHEQYGSVWTNQGVFDSR

SEQ ID NO: 54569 - protein, 33 aa, Artificial Sequence
  Description of Artificial Sequence: Synthetic polypeptide
DEEEIRTTNPVATEQYGDVVSNNLGQNGGNGQE

SEQ ID NO: 54570 - protein, 31 aa, Artificial Sequence
  Description of Artificial Sequence: Synthetic polypeptide
QEEEICTTNPVATEQYGSVATNLQGGDESMD

SEQ ID NO: 54571 - protein, 33 aa, Artificial Sequence
  Description of Artificial Sequence: Synthetic polypeptide
DEEEIRTTNPVATEQYGMVGSVTELQGSGNTDQ

SEQ ID NO: 54572 - protein, 33 aa, Artificial Sequence
  Description of Artificial Sequence: Synthetic polypeptide
DEEEIRTTNPVATEQYGMNVVTNNNLQEIGNVD

SEQ ID NO: 54573 - protein, 28 aa, Artificial Sequence
  Description of Artificial Sequence: Synthetic peptide
QEEEIRTTNPVATEQYGEVSEICQHEEA

SEQ ID NO: 54574 - protein, 28 aa, Artificial Sequence
  Description of Artificial Sequence: Synthetic peptide
QEEEIASTNPVGTEGYGVVSDNLQHGNQ

SEQ ID NO: 54575 - protein, 32 aa, Artificial Sequence
  Description of Artificial Sequence: Synthetic polypeptide
QEEEIRATNPVATEQYGSVATNLQQPGENAEE

SEQ ID NO: 54576 - protein, 28 aa, Artificial Sequence
  Description of Artificial Sequence: Synthetic peptide
QEEEIATTNPVCTEQYGDVSENLQHEEL

SEQ ID NO: 54577 - protein, 28 aa, Artificial Sequence
  Description of Artificial Sequence: Synthetic peptide
QEEEIRTTNPVATEQYGEVSEICQAEEA

SEQ ID NO: 54578 - protein, 28 aa, Artificial Sequence
  Description of Artificial Sequence: Synthetic peptide
QEEEIASTNPVGTEGYGVVSSNLQHGNQ

SEQ ID NO: 54579 - protein, 30 aa, Artificial Sequence
  Description of Artificial Sequence: Synthetic polypeptide
NETEIRTTNPVATEQYGSVSTTQGGGDGND

SEQ ID NO: 54580 - protein, 28 aa, Artificial Sequence
  Description of Artificial Sequence: Synthetic peptide
QEEEIGSVNPVCTEQYGVVSVNLQSGNV

SEQ ID NO: 54581 - protein, 33 aa, Artificial Sequence
  Description of Artificial Sequence: Synthetic polypeptide
DEEEIRTTNPVATEQYGMVGSTVNLNLNGENQG

SEQ ID NO: 54582 - protein, 31 aa, Artificial Sequence
  Description of Artificial Sequence: Synthetic polypeptide
NESEIRTTNPVATEAYGSVWTNQSQIGGSNR

SEQ ID NO: 54583 - protein, 30 aa, Artificial Sequence
  Description of Artificial Sequence: Synthetic polypeptide
QEEEIATTNPVATEQYGCVATNLQRNPEGA

SEQ ID NO: 54584 - protein, 31 aa, Artificial Sequence
  Description of Artificial Sequence: Synthetic polypeptide
QEECICTTNPVATEAWGSVSTNALSQSGNNR

SEQ ID NO: 54585 - protein, 28 aa, Artificial Sequence
  Description of Artificial Sequence: Synthetic peptide
QEEEIATTNPVCTEQYGVVSENLQHEEL

SEQ ID NO: 54586 - protein, 28 aa, Artificial Sequence
  Description of Artificial Sequence: Synthetic peptide
QEEEIRTTNPVATEQYGSASEVCQHEEK

SEQ ID NO: 54587 - protein, 28 aa, Artificial Sequence
  Description of Artificial Sequence: Synthetic peptide
QEEEIATVNPVATECYGDVSECLQSGNL

SEQ ID NO: 54588 - protein, 28 aa, Artificial Sequence
  Description of Artificial Sequence: Synthetic peptide
QEEEIATVNPVATECYGDVSDCLQHGNQ

SEQ ID NO: 54589 - protein, 32 aa, Artificial Sequence
  Description of Artificial Sequence: Synthetic polypeptide
QEEEIATTNPVSTEQYGIVSTNLPQMRNGTPR

SEQ ID NO: 54590 - protein, 31 aa, Artificial Sequence
  Description of Artificial Sequence: Synthetic polypeptide
NETEIRTTNPVATEMYGEVSTNLQGNEGNAQ

SEQ ID NO: 54591 - protein, 31 aa, Artificial Sequence
  Description of Artificial Sequence: Synthetic polypeptide
QEEGIRTTNPVATEQYGDVSTNGQGEGGNQQ

SEQ ID NO: 54592 - protein, 31 aa, Artificial Sequence
  Description of Artificial Sequence: Synthetic polypeptide
QEEEIACTNPVATEQYGSVATNLQDRQNDFA

SEQ ID NO: 54593 - protein, 33 aa, Artificial Sequence
  Description of Artificial Sequence: Synthetic polypeptide
DEEEIRTTNPVATEQYGDVGSTMNVGQTGQNGD

SEQ ID NO: 54594 - protein, 28 aa, Artificial Sequence
  Description of Artificial Sequence: Synthetic peptide
QEEEIATVNPVATECYGVVSDCLQHGNQ

SEQ ID NO: 54595 - protein, 34 aa, Artificial Sequence
  Description of Artificial Sequence: Synthetic polypeptide
DEEEIRTTNPVATEQYGDVGSTMNLNQGGNGQDQ

SEQ ID NO: 54596 - protein, 31 aa, Artificial Sequence
  Description of Artificial Sequence: Synthetic polypeptide
QEEEIATTNPVATEQYGSVATNLQQPEDTRS

SEQ ID NO: 54597 - protein, 28 aa, Artificial Sequence
  Description of Artificial Sequence: Synthetic peptide
QEEEIASTNPVATEQYGEVSEVLQHGEQ

SEQ ID NO: 54598 - protein, 33 aa, Artificial Sequence
  Description of Artificial Sequence: Synthetic polypeptide
DEEEIRTTNPVATEQYGMVSTDNIMQGNGGNIG

SEQ ID NO: 54599 - protein, 32 aa, Artificial Sequence
  Description of Artificial Sequence: Synthetic polypeptide
NETEIRTTNPVATEMYGEVSTNLQGNEGNNDR

SEQ ID NO: 54600 - protein, 33 aa, Artificial Sequence
  Description of Artificial Sequence: Synthetic polypeptide
DEEEIRTTNPVATEQYGMVSTDNEMQEGGGEND

SEQ ID NO: 54601 - protein, 33 aa, Artificial Sequence
  Description of Artificial Sequence: Synthetic polypeptide
DEEEIRTTNPVATEQYGDVGSNMNLEQGGEENQ

SEQ ID NO: 54602 - protein, 31 aa, Artificial Sequence
  Description of Artificial Sequence: Synthetic polypeptide
QEEEICTTNPVATEQYGSVATNGQRDGPDQM

SEQ ID NO: 54603 - protein, 30 aa, Artificial Sequence
  Description of Artificial Sequence: Synthetic polypeptide
QAEEIATTNPVATEQYGSVATNLQEADNDH

SEQ ID NO: 54604 - protein, 31 aa, Artificial Sequence
  Description of Artificial Sequence: Synthetic polypeptide
QEEEIACTNPVATEQYGSVATNLQDSNGNFP

SEQ ID NO: 54605 - protein, 31 aa, Artificial Sequence
  Description of Artificial Sequence: Synthetic polypeptide
NETEIRTTNPVATEMWGSVSTNLQSNDGNDA

SEQ ID NO: 54606 - protein, 34 aa, Artificial Sequence
  Description of Artificial Sequence: Synthetic polypeptide
QEEEIRTTNPVATEQYGSVSSTPNLGQNANGNEN

SEQ ID NO: 54607 - protein, 30 aa, Artificial Sequence
  Description of Artificial Sequence: Synthetic polypeptide
QEEEIATTNPVATEQYGSVATNLQGAPLHD

SEQ ID NO: 54608 - protein, 31 aa, Artificial Sequence
  Description of Artificial Sequence: Synthetic polypeptide
QAEEIATTNPVATEQYGSVATNLQEAGNTEN

SEQ ID NO: 54609 - protein, 28 aa, Artificial Sequence
  Description of Artificial Sequence: Synthetic peptide
QEEEIRTTNPIATECYGSVSECLQHEEL

SEQ ID NO: 54610 - protein, 33 aa, Artificial Sequence
  Description of Artificial Sequence: Synthetic polypeptide
DEEEIRTTNPVATEQYGDVSGTNDQQNGEGNGE

SEQ ID NO: 54611 - protein, 30 aa, Artificial Sequence
  Description of Artificial Sequence: Synthetic polypeptide
QEEEIACTNPVATEQYGSVATNLQFEANHV

SEQ ID NO: 54612 - protein, 28 aa, Artificial Sequence
  Description of Artificial Sequence: Synthetic peptide
QEEEIASTNPCSTEQYGVVSDNLQSGNQ

SEQ ID NO: 54613 - protein, 28 aa, Artificial Sequence
  Description of Artificial Sequence: Synthetic peptide
QEEEIASTNPIATEQYGSVSETLMRGDI

SEQ ID NO: 54614 - protein, 31 aa, Artificial Sequence
  Description of Artificial Sequence: Synthetic polypeptide
QEECICTTNPVATEQWGSVSCTNLSQRGGSQ

SEQ ID NO: 54615 - protein, 31 aa, Artificial Sequence
  Description of Artificial Sequence: Synthetic polypeptide
NETEIRTTNPVATEMWGSVSTNLQNDGNTDE

SEQ ID NO: 54616 - protein, 33 aa, Artificial Sequence
  Description of Artificial Sequence: Synthetic polypeptide
DEEEIRTTNPVATEQYGISVSCTLNSSHAGGSR

SEQ ID NO: 54617 - protein, 28 aa, Artificial Sequence
  Description of Artificial Sequence: Synthetic peptide
QEEEIASTNPVATEQYGEAPDNLQHGNK

SEQ ID NO: 54618 - protein, 30 aa, Artificial Sequence
  Description of Artificial Sequence: Synthetic polypeptide
QEECICTTNPVAYEAWGSVSTNLSGRGNNR

SEQ ID NO: 54619 - protein, 28 aa, Artificial Sequence
  Description of Artificial Sequence: Synthetic peptide
QEEEIATTNPVATEQYGEAPETCQRGER

SEQ ID NO: 54620 - protein, 28 aa, Artificial Sequence
  Description of Artificial Sequence: Synthetic peptide
QEEEIASTNPVATEQYGEASDNLQSGEK

SEQ ID NO: 54621 - protein, 33 aa, Artificial Sequence
  Description of Artificial Sequence: Synthetic polypeptide
QEEEIRTTNPVATEQYGSVSSTTNGPNRGMNPV

SEQ ID NO: 54622 - protein, 32 aa, Artificial Sequence
  Description of Artificial Sequence: Synthetic polypeptide
QEEEIATTNPVATEQYGSVATNLQNPGENPEE

SEQ ID NO: 54623 - protein, 28 aa, Artificial Sequence
  Description of Artificial Sequence: Synthetic peptide
QEEEIASTNPVATEQYGEVSEVLQHGEK

SEQ ID NO: 54624 - protein, 28 aa, Artificial Sequence
  Description of Artificial Sequence: Synthetic peptide
QEEEIATTNPVSTEQYGIVPCVLQSGTR

SEQ ID NO: 54625 - protein, 28 aa, Artificial Sequence
  Description of Artificial Sequence: Synthetic peptide
QEEEIASTNPVCTEQYGVVSDNLQSGTQ

SEQ ID NO: 54626 - protein, 31 aa, Artificial Sequence
  Description of Artificial Sequence: Synthetic polypeptide
DEEEIRTTNPVATEQYGISVMTNDITRQDID

SEQ ID NO: 54627 - protein, 28 aa, Artificial Sequence
  Description of Artificial Sequence: Synthetic peptide
QEEEIASTNPVCTEQYGVVPDNLQSGNQ

SEQ ID NO: 54628 - protein, 32 aa, Artificial Sequence
  Description of Artificial Sequence: Synthetic polypeptide
DEEEIRTTNPVATEQYGDVSTQNDNNGGGNDD

SEQ ID NO: 54629 - protein, 32 aa, Artificial Sequence
  Description of Artificial Sequence: Synthetic polypeptide
NETEIRTTNPVATEMYGSVSTNLQGNTGGNND

SEQ ID NO: 54630 - protein, 32 aa, Artificial Sequence
  Description of Artificial Sequence: Synthetic polypeptide
NETEIRTTNPVATEMYGSVSTNLQHNGGDNDH

SEQ ID NO: 54631 - protein, 31 aa, Artificial Sequence
  Description of Artificial Sequence: Synthetic polypeptide
QEEEIATTNPVATEQYGSVATNPQEAGNEEG

SEQ ID NO: 54632 - protein, 28 aa, Artificial Sequence
  Description of Artificial Sequence: Synthetic peptide
QEEEIATTNPVSSEQYGIVSCNLNSGTR

SEQ ID NO: 54633 - protein, 33 aa, Artificial Sequence
  Description of Artificial Sequence: Synthetic polypeptide
DEEEIRTTNPVATEQYGDVVSTMNGQGGGNGQQ

SEQ ID NO: 54634 - protein, 28 aa, Artificial Sequence
  Description of Artificial Sequence: Synthetic peptide
QEEEIRCTNPIATEQYGEASENLMRGEK

SEQ ID NO: 54635 - protein, 28 aa, Artificial Sequence
  Description of Artificial Sequence: Synthetic peptide
QEEEIACTNPIATEQYGVMASNLQRGDR

SEQ ID NO: 54636 - protein, 33 aa, Artificial Sequence
  Description of Artificial Sequence: Synthetic polypeptide
DEEEIRTTNPVATEQYGISLVSCTNSSQAGGSS

SEQ ID NO: 54637 - protein, 30 aa, Artificial Sequence
  Description of Artificial Sequence: Synthetic polypeptide
DEEEIRTTNPVATEQYGCYSTVDERGEESL

SEQ ID NO: 54638 - protein, 28 aa, Artificial Sequence
  Description of Artificial Sequence: Synthetic peptide
QEEEIATTNPVATEQYGEAPENLQHGEK

SEQ ID NO: 54639 - protein, 30 aa, Artificial Sequence
  Description of Artificial Sequence: Synthetic polypeptide
QEEEIACTNPVATEQYGSVATNLQDPGDTA

SEQ ID NO: 54640 - protein, 30 aa, Artificial Sequence
  Description of Artificial Sequence: Synthetic polypeptide
QEEEIATTNPVATEQYGSVPATVLQDHGEL

SEQ ID NO: 54641 - protein, 28 aa, Artificial Sequence
  Description of Artificial Sequence: Synthetic peptide
QEEEIATTNPVATEQYGSVPENEQHEEK

SEQ ID NO: 54642 - protein, 28 aa, Artificial Sequence
  Description of Artificial Sequence: Synthetic peptide
QEEEIATTNPVATEQYGEAPENLQHENK

SEQ ID NO: 54643 - protein, 28 aa, Artificial Sequence
  Description of Artificial Sequence: Synthetic peptide
QEEEIATTNPVATEQYGEAPENLQHEGR

SEQ ID NO: 54644 - protein, 28 aa, Artificial Sequence
  Description of Artificial Sequence: Synthetic peptide
QEEEIASTNPVCTEQYGVVSDCLQHGNL

SEQ ID NO: 54645 - protein, 32 aa, Artificial Sequence
  Description of Artificial Sequence: Synthetic polypeptide
DEEEIRTTNPVATEQYGDVSNLNLEQSENGEG

SEQ ID NO: 54646 - protein, 32 aa, Artificial Sequence
  Description of Artificial Sequence: Synthetic polypeptide
DEEEIRTTNPVATEQYGCYSVTNNMLIRGEDI

SEQ ID NO: 54647 - protein, 31 aa, Artificial Sequence
  Description of Artificial Sequence: Synthetic polypeptide
NETEIRTTNPVATEMYGEVSTNLQHNGDNDG

SEQ ID NO: 54648 - protein, 28 aa, Artificial Sequence
  Description of Artificial Sequence: Synthetic peptide
QEEEIACTNPIATECYGDVSENLQHENR

SEQ ID NO: 54649 - protein, 30 aa, Artificial Sequence
  Description of Artificial Sequence: Synthetic polypeptide
QEEEIATTNPVATEQYGSVATNLTDDGDMD

SEQ ID NO: 54650 - protein, 32 aa, Artificial Sequence
  Description of Artificial Sequence: Synthetic polypeptide
DEEEIRTTNPVATEQYGMVSTDNDGGNGNEED

SEQ ID NO: 54651 - protein, 28 aa, Artificial Sequence
  Description of Artificial Sequence: Synthetic peptide
QEEEIATTNPVSTEQYGIASCNLQSGTK

SEQ ID NO: 54652 - protein, 28 aa, Artificial Sequence
  Description of Artificial Sequence: Synthetic peptide
QEEEIASTNPVCTEQYGVVPENLQSGNQ

SEQ ID NO: 54653 - protein, 31 aa, Artificial Sequence
  Description of Artificial Sequence: Synthetic polypeptide
QEEEIRTTNPVATEQYGSVGTTTVLNRGTFG

SEQ ID NO: 54654 - protein, 31 aa, Artificial Sequence
  Description of Artificial Sequence: Synthetic polypeptide
QEEGIRTTNPVATEQYGSVSTNGLEGLTNGN

SEQ ID NO: 54655 - protein, 31 aa, Artificial Sequence
  Description of Artificial Sequence: Synthetic polypeptide
NETEIRTTNPVATEMYGEVSTNLQGNEGQND

SEQ ID NO: 54656 - protein, 31 aa, Artificial Sequence
  Description of Artificial Sequence: Synthetic polypeptide
QAEEIATTNPVATEQYGSVATNLQAGPNENN

SEQ ID NO: 54657 - protein, 31 aa, Artificial Sequence
  Description of Artificial Sequence: Synthetic polypeptide
QAEEIATTNPVATEQYGSVATNLQAEGPNDA

SEQ ID NO: 54658 - protein, 31 aa, Artificial Sequence
  Description of Artificial Sequence: Synthetic polypeptide
QAEEIATTNPVATEQYGSVATALTQNGDENR

SEQ ID NO: 54659 - protein, 28 aa, Artificial Sequence
  Description of Artificial Sequence: Synthetic peptide
QEEEIRCTNPIATEQYGEVPENCQHGER

SEQ ID NO: 54660 - protein, 28 aa, Artificial Sequence
  Description of Artificial Sequence: Synthetic peptide
QEEEIATTNPVSTEQYGIASCNCQHGTR

SEQ ID NO: 54661 - protein, 29 aa, Artificial Sequence
  Description of Artificial Sequence: Synthetic peptide
QEEEIATTNPVATEQYGSVATNLTDVDDL

SEQ ID NO: 54662 - protein, 28 aa, Artificial Sequence
  Description of Artificial Sequence: Synthetic peptide
QEEEIACTNPIATEQYGSVSETLMRGDI

SEQ ID NO: 54663 - protein, 31 aa, Artificial Sequence
  Description of Artificial Sequence: Synthetic polypeptide
QEEGIRTTNPVATEQYGSVSTNGLENGLGGE

SEQ ID NO: 54664 - protein, 34 aa, Artificial Sequence
  Description of Artificial Sequence: Synthetic polypeptide
DEEEIRTTNPVATEQYGISVACTNLDQHGGSNDY

SEQ ID NO: 54665 - protein, 32 aa, Artificial Sequence
  Description of Artificial Sequence: Synthetic polypeptide
QEEGIRTTNPVATEQYGSVSTNGLEEGQGNIN

SEQ ID NO: 54666 - protein, 32 aa, Artificial Sequence
  Description of Artificial Sequence: Synthetic polypeptide
DEEEIRTTNPVATEQYGMVGSNTNGQTDGEGE

SEQ ID NO: 54667 - protein, 32 aa, Artificial Sequence
  Description of Artificial Sequence: Synthetic polypeptide
DEEEIRTTNPVATEQYGCVCSTNLEHFGSQTQ

SEQ ID NO: 54668 - protein, 28 aa, Artificial Sequence
  Description of Artificial Sequence: Synthetic peptide
QEFEICTVNPVATEQYGMVSTNQFEGNH

SEQ ID NO: 54669 - protein, 32 aa, Artificial Sequence
  Description of Artificial Sequence: Synthetic polypeptide
TEEEIRTTNPVATEQYGSTVSCTNHFGHGGNA

SEQ ID NO: 54670 - protein, 32 aa, Artificial Sequence
  Description of Artificial Sequence: Synthetic polypeptide
DEEEIRTTNPVATEQYGAVWESDINDLQNENN

SEQ ID NO: 54671 - protein, 33 aa, Artificial Sequence
  Description of Artificial Sequence: Synthetic polypeptide
DEEEIRTTNPVATEQYGAVWEQTINPEQREGNN

SEQ ID NO: 54672 - protein, 33 aa, Artificial Sequence
  Description of Artificial Sequence: Synthetic polypeptide
DEEEIRTTNPVATEQYGAVVVSFQNLDQFGGNF

SEQ ID NO: 54673 - protein, 33 aa, Artificial Sequence
  Description of Artificial Sequence: Synthetic polypeptide
DEEEIRTTNPVATEQYGAVVSTGNMQGTGGNQG

SEQ ID NO: 54674 - protein, 33 aa, Artificial Sequence
  Description of Artificial Sequence: Synthetic polypeptide
TEEEIRTTNPVATEQYGSTVSTNLSARTVANND

SEQ ID NO: 54675 - protein, 34 aa, Artificial Sequence
  Description of Artificial Sequence: Synthetic polypeptide
TEEEIRTTNPVATEQYGSTVSTNSHQEITVGINR

SEQ ID NO: 54676 - protein, 33 aa, Artificial Sequence
  Description of Artificial Sequence: Synthetic polypeptide
TEEEIRTTNPVATEQYGSTVSVSGNLSQRVNYE

SEQ ID NO: 54677 - protein, 33 aa, Artificial Sequence
  Description of Artificial Sequence: Synthetic polypeptide
TEEEIRTTNPVATEQYGSTVSVTNLSQHVANND

SEQ ID NO: 54678 - protein, 31 aa, Artificial Sequence
  Description of Artificial Sequence: Synthetic polypeptide
TEEEIRTTNPVATEQYGSVAKALEQNGGGDR

SEQ ID NO: 54679 - protein, 32 aa, Artificial Sequence
  Description of Artificial Sequence: Synthetic polypeptide
DEEEIRTTNPVATEQYGAVSTVNLPEGGGGFE

SEQ ID NO: 54680 - protein, 34 aa, Artificial Sequence
  Description of Artificial Sequence: Synthetic polypeptide
TEEEIRTTNPVATEQYGSVCNTGNLNQRFGSNTA

SEQ ID NO: 54681 - protein, 34 aa, Artificial Sequence
  Description of Artificial Sequence: Synthetic polypeptide
TEEEIRTTNPVATEQYGSVCNTGNLNQRSGSNNQ

SEQ ID NO: 54682 - protein, 33 aa, Artificial Sequence
  Description of Artificial Sequence: Synthetic polypeptide
TEEEIRTTNPVATEQYGSVCNTMELNQRGSNNQ

SEQ ID NO: 54683 - protein, 32 aa, Artificial Sequence
  Description of Artificial Sequence: Synthetic polypeptide
DEEEIRTTNPVATEQYGAVSTTLNGQGGGGQG

SEQ ID NO: 54684 - protein, 32 aa, Artificial Sequence
  Description of Artificial Sequence: Synthetic polypeptide
DEEEIRTTNPVATEQYGAVWNTINPEQREINN

SEQ ID NO: 54685 - protein, 34 aa, Artificial Sequence
  Description of Artificial Sequence: Synthetic polypeptide
TEEEIRTTNPVATEQYGSVCSKTNDDLQRNAGDQ

SEQ ID NO: 54686 - protein, 32 aa, Artificial Sequence
  Description of Artificial Sequence: Synthetic polypeptide
DEEEIRTTNPVATEQYGAVWNTINPGQGEGNI

SEQ ID NO: 54687 - protein, 33 aa, Artificial Sequence
  Description of Artificial Sequence: Synthetic polypeptide
DEEEIRTTNPVATEQYGAVWSLTINVGQGEGNQ

SEQ ID NO: 54688 - protein, 31 aa, Artificial Sequence
  Description of Artificial Sequence: Synthetic polypeptide
DEEEIRTTNPVATEQYGCFSWPNLLQNDSNQ

SEQ ID NO: 54689 - protein, 34 aa, Artificial Sequence
  Description of Artificial Sequence: Synthetic polypeptide
TEEEIRTTNPVATEQYGISTVSGTNMLSQAGGSR

SEQ ID NO: 54690 - protein, 34 aa, Artificial Sequence
  Description of Artificial Sequence: Synthetic polypeptide
TEEEIRTTNPVATEQYGKTVSCTNLSTRTGNARV

SEQ ID NO: 54691 - protein, 33 aa, Artificial Sequence
  Description of Artificial Sequence: Synthetic polypeptide
TEEEIRTTNPVATEQYGKVFCTNGLSARGGNQR

SEQ ID NO: 54692 - protein, 32 aa, Artificial Sequence
  Description of Artificial Sequence: Synthetic polypeptide
TEEEIRTTNPVATEQYGKVVSAGNLDEFGGNR

SEQ ID NO: 54693 - protein, 33 aa, Artificial Sequence
  Description of Artificial Sequence: Synthetic polypeptide
DEEEIRTTNPVATEQYGCAVSTENLQHFGSEQS

SEQ ID NO: 54694 - protein, 35 aa, Artificial Sequence
  Description of Artificial Sequence: Synthetic polypeptide
TEEEIRTTNPVATEQYGQSVSYTGNLSQRVENYRA

SEQ ID NO: 54695 - protein, 33 aa, Artificial Sequence
  Description of Artificial Sequence: Synthetic polypeptide
TEEEIRTTNPVATEQYGSISTNLSDPPGGNNRF

SEQ ID NO: 54696 - protein, 32 aa, Artificial Sequence
  Description of Artificial Sequence: Synthetic polypeptide
TEEEIRTTNPVATEQYGSTVATAMLQNTGGDR

SEQ ID NO: 54697 - protein, 31 aa, Artificial Sequence
  Description of Artificial Sequence: Synthetic polypeptide
DEEEIRTTNPVATEQYGAVYTNGEGGNNEIS

SEQ ID NO: 54698 - protein, 33 aa, Artificial Sequence
  Description of Artificial Sequence: Synthetic polypeptide
TEEEIRTTNPVATEQYGSTVPSCAGNLDEFGNR

SEQ ID NO: 54699 - protein, 33 aa, Artificial Sequence
  Description of Artificial Sequence: Synthetic polypeptide
TEEEIRTTNPVATEQYGSTVPSCTRLERPGNTE

SEQ ID NO: 54700 - protein, 35 aa, Artificial Sequence
  Description of Artificial Sequence: Synthetic polypeptide
TEEEIRTTNPVATEQYGSTVPSVTNLPQNRTVANR

SEQ ID NO: 54701 - protein, 33 aa, Artificial Sequence
  Description of Artificial Sequence: Synthetic polypeptide
TEEEIRTTNPVATEQYGSTVSAGNLDEFTGNNR

SEQ ID NO: 54702 - protein, 33 aa, Artificial Sequence
  Description of Artificial Sequence: Synthetic polypeptide
DEEEIRTTNPVATEQYGAVWSTINPGQGEGNND

SEQ ID NO: 54703 - protein, 33 aa, Artificial Sequence
  Description of Artificial Sequence: Synthetic polypeptide
DEEEIRTTNPVATEQYGAVWSLPNMLQRDQNDI

SEQ ID NO: 54704 - protein, 33 aa, Artificial Sequence
  Description of Artificial Sequence: Synthetic polypeptide
DEEEIRTTNPVATEQYGCICSTGNPLQRFNSNQ

SEQ ID NO: 54705 - protein, 32 aa, Artificial Sequence
  Description of Artificial Sequence: Synthetic polypeptide
DEEEIRTTNPVATEQYGAVSTSLNGMGGNEED

SEQ ID NO: 54706 - protein, 33 aa, Artificial Sequence
  Description of Artificial Sequence: Synthetic polypeptide
TEEEIRTTNPVATEQYGSVGSGTNNGQTGGGNN

SEQ ID NO: 54707 - protein, 32 aa, Artificial Sequence
  Description of Artificial Sequence: Synthetic polypeptide
DEEEIRTTNPVATEQYGAVSNLNLEQSENNGM

SEQ ID NO: 54708 - protein, 33 aa, Artificial Sequence
  Description of Artificial Sequence: Synthetic polypeptide
DEEEIRTTNPVATEQYGAVSITNGDPFRGTNND

SEQ ID NO: 54709 - protein, 32 aa, Artificial Sequence
  Description of Artificial Sequence: Synthetic polypeptide
DEEEIRTTNPVATEQYGAVSGTNNTDGGNNED

SEQ ID NO: 54710 - protein, 32 aa, Artificial Sequence
  Description of Artificial Sequence: Synthetic polypeptide
DEEEIRTTNPVATEQYGAVSGDNLTGNQGNIG

SEQ ID NO: 54711 - protein, 31 aa, Artificial Sequence
  Description of Artificial Sequence: Synthetic polypeptide
DEEEIRTTNPVATEQYGAVSGDDGNGNQGNI

SEQ ID NO: 54712 - protein, 33 aa, Artificial Sequence
  Description of Artificial Sequence: Synthetic polypeptide
DEEEIRTTNPVATEQYGAVMGTSNLQGGGNGGD

SEQ ID NO: 54713 - protein, 33 aa, Artificial Sequence
  Description of Artificial Sequence: Synthetic polypeptide
TEEEIRTTNPVATEQYGSVSTNNLSAPGGNNVT

SEQ ID NO: 54714 - protein, 30 aa, Artificial Sequence
  Description of Artificial Sequence: Synthetic polypeptide
DEEEIRTTNPVATEQYGAVGENLDNINEID

SEQ ID NO: 54715 - protein, 34 aa, Artificial Sequence
  Description of Artificial Sequence: Synthetic polypeptide
DEEEIRTTNPVATEQYGAVDSTNLQGDNGNNEET

SEQ ID NO: 54716 - protein, 34 aa, Artificial Sequence
  Description of Artificial Sequence: Synthetic polypeptide
DEEEIRTTNPVATEQYGAVDSDTNLQGGTGNGDE

SEQ ID NO: 54717 - protein, 33 aa, Artificial Sequence
  Description of Artificial Sequence: Synthetic polypeptide
DEEEIRTTNPVATEQYGAVDSDTNDGQEGGNGN

SEQ ID NO: 54718 - protein, 34 aa, Artificial Sequence
  Description of Artificial Sequence: Synthetic polypeptide
DEEEIRTTNPVATEQYGAVDSDTGNLQEGGGNDS

SEQ ID NO: 54719 - protein, 31 aa, Artificial Sequence
  Description of Artificial Sequence: Synthetic polypeptide
DEEEIRTTNPVATEQYGAVCTTNPNQPGGVV

SEQ ID NO: 54720 - protein, 33 aa, Artificial Sequence
  Description of Artificial Sequence: Synthetic polypeptide
DEEEIRTTNPVATEQYGAVCSTNYNQEYEGMFR

SEQ ID NO: 54721 - protein, 31 aa, Artificial Sequence
  Description of Artificial Sequence: Synthetic polypeptide
TEEEIRTTNPVATEQYGSVSTTNGERVELQS

SEQ ID NO: 54722 - protein, 32 aa, Artificial Sequence
  Description of Artificial Sequence: Synthetic polypeptide
DEEEIRTTNPVATEQYGAVSSGNEQGEGGGNT

SEQ ID NO: 54723 - protein, 32 aa, Artificial Sequence
  Description of Artificial Sequence: Synthetic polypeptide
TEEEIRTTNPVATEQYGSVETSNLETIGEEYR

SEQ ID NO: 54724 - protein, 34 aa, Artificial Sequence
  Description of Artificial Sequence: Synthetic polypeptide
TEEEIRTTNPVATEQYGSVSTGNLQGTGGGNETI

SEQ ID NO: 54725 - protein, 32 aa, Artificial Sequence
  Description of Artificial Sequence: Synthetic polypeptide
TEEEIRTTNPVATEQYGSVSPVNLPEIINLRD

SEQ ID NO: 54726 - protein, 30 aa, Artificial Sequence
  Description of Artificial Sequence: Synthetic polypeptide
TEEEIRTTNPVATEQYGSVGTADQNFGSDQ

SEQ ID NO: 54727 - protein, 34 aa, Artificial Sequence
  Description of Artificial Sequence: Synthetic polypeptide
TEEEIRTTNPVATEQYGSVISCLPNMLSQHDGNR

SEQ ID NO: 54728 - protein, 34 aa, Artificial Sequence
  Description of Artificial Sequence: Synthetic polypeptide
TEEEIRTTNPVATEQYGSVNCTGNALSQRGENYD

SEQ ID NO: 54729 - protein, 35 aa, Artificial Sequence
  Description of Artificial Sequence: Synthetic polypeptide
TEEEIRTTNPVATEQYGSVNCTGNELSQRGENYRW

SEQ ID NO: 54730 - protein, 33 aa, Artificial Sequence
  Description of Artificial Sequence: Synthetic polypeptide
TEEEIRTTNPVATEQYGSVNETSNILQRMDNYQ

SEQ ID NO: 54731 - protein, 33 aa, Artificial Sequence
  Description of Artificial Sequence: Synthetic polypeptide
TEEEIRTTNPVATEQYGSVNETSNLDQREVNYQ

SEQ ID NO: 54732 - protein, 34 aa, Artificial Sequence
  Description of Artificial Sequence: Synthetic polypeptide
TEEEIRTTNPVATEQYGSVNETSNSLDQRGYNYQ

SEQ ID NO: 54733 - protein, 31 aa, Artificial Sequence
  Description of Artificial Sequence: Synthetic polypeptide
TEEEIRTTNPVATEQYGSVNTALQNNGEFDE

SEQ ID NO: 54734 - protein, 32 aa, Artificial Sequence
  Description of Artificial Sequence: Synthetic polypeptide
TEEEIRTTNPVATEQYGSVNTGELNQNGSNTQ

SEQ ID NO: 54735 - protein, 34 aa, Artificial Sequence
  Description of Artificial Sequence: Synthetic polypeptide
TEEEIRTTNPVATEQYGSVNTGNLSQRTVTNYRW

SEQ ID NO: 54736 - protein, 34 aa, Artificial Sequence
  Description of Artificial Sequence: Synthetic polypeptide
TEEEIRTTNPVATEQYGSVPSTNNLSARTGGNKT

SEQ ID NO: 54737 - protein, 34 aa, Artificial Sequence
  Description of Artificial Sequence: Synthetic polypeptide
TEEEIRTTNPVATEQYGSVSCTGNALSQRTQNYP

SEQ ID NO: 54738 - protein, 31 aa, Artificial Sequence
  Description of Artificial Sequence: Synthetic polypeptide
DEEEIRTTNPVATEQYGAVSTNDDYGDEELN

SEQ ID NO: 54739 - protein, 33 aa, Artificial Sequence
  Description of Artificial Sequence: Synthetic polypeptide
TEEEIRTTNPVATEQYGSVSGTSNGQDGNGNDG

SEQ ID NO: 54740 - protein, 33 aa, Artificial Sequence
  Description of Artificial Sequence: Synthetic polypeptide
TEEEIRTTNPVATEQYGSVSNNNLQSGGGNQGG

SEQ ID NO: 54741 - protein, 33 aa, Artificial Sequence
  Description of Artificial Sequence: Synthetic polypeptide
TEEEIRTTNPVATEQYGSVSTDNEGQGGGENGE

SEQ ID NO: 54742 - protein, 31 aa, Artificial Sequence
  Description of Artificial Sequence: Synthetic polypeptide
TEEEIRTTNPVATEQYGDVVIQNLTQTGNDS

SEQ ID NO: 54743 - protein, 32 aa, Artificial Sequence
  Description of Artificial Sequence: Synthetic polypeptide
TEEEIRTTNPVATEQYGCVNTGNLNQSGSNFQ

SEQ ID NO: 54744 - protein, 33 aa, Artificial Sequence
  Description of Artificial Sequence: Synthetic polypeptide
DEEEIRTTNPVATEQYGCIVCSTELQRFGSEQN

SEQ ID NO: 54745 - protein, 32 aa, Artificial Sequence
  Description of Artificial Sequence: Synthetic polypeptide
DEEEIRTTNPVATEQYGCTAATENLTARIGND

SEQ ID NO: 54746 - protein, 32 aa, Artificial Sequence
  Description of Artificial Sequence: Synthetic polypeptide
TEEEIRTTNPVATEHYGSVCSTGAHSQAGGNR

SEQ ID NO: 54747 - protein, 33 aa, Artificial Sequence
  Description of Artificial Sequence: Synthetic polypeptide
TEEEIRTTNPVATEHYGSVCSVTALSTRTGGNR

SEQ ID NO: 54748 - protein, 34 aa, Artificial Sequence
  Description of Artificial Sequence: Synthetic polypeptide
TEEEIRTTNPVATEHYGSVVCSTGALSQRGGNYR

SEQ ID NO: 54749 - protein, 31 aa, Artificial Sequence
  Description of Artificial Sequence: Synthetic polypeptide
TEEEIRTTNPVATEPFGISVSTYLSTRGGNS

SEQ ID NO: 54750 - protein, 32 aa, Artificial Sequence
  Description of Artificial Sequence: Synthetic polypeptide
TEEEIRTTNPVATEPWGSVSCTPLSTDRGGNR

SEQ ID NO: 54751 - protein, 34 aa, Artificial Sequence
  Description of Artificial Sequence: Synthetic polypeptide
TEEEIRTTNPVATEPYGISVSCTPLSQDRGGNLR

SEQ ID NO: 54752 - protein, 33 aa, Artificial Sequence
  Description of Artificial Sequence: Synthetic polypeptide
TEEEIRTTNPVATEPYGKVCSCTPLSQDRGGNR

SEQ ID NO: 54753 - protein, 33 aa, Artificial Sequence
  Description of Artificial Sequence: Synthetic polypeptide
TEEEIRTTNPVATEPYGKVSCTMALSQDRGGNR

SEQ ID NO: 54754 - protein, 34 aa, Artificial Sequence
  Description of Artificial Sequence: Synthetic polypeptide
TEEEIRTTNPVATEPYGSTVNTGNALSQRGENYR

SEQ ID NO: 54755 - protein, 34 aa, Artificial Sequence
  Description of Artificial Sequence: Synthetic polypeptide
TEEEIRTTNPVATEPYGSTVSCTPMLSQDRGGNR

SEQ ID NO: 54756 - protein, 32 aa, Artificial Sequence
  Description of Artificial Sequence: Synthetic polypeptide
TEEEIRTTNPVATEPYGSTVSTNQSQRSGSDS

SEQ ID NO: 54757 - protein, 32 aa, Artificial Sequence
  Description of Artificial Sequence: Synthetic polypeptide
TEEEIRTTNPVATEPYGSTVSVSGNLSQRVNI

SEQ ID NO: 54758 - protein, 33 aa, Artificial Sequence
  Description of Artificial Sequence: Synthetic polypeptide
TEEEIRTTNPVATEPYGSVACTLLSQTRGGNYR

SEQ ID NO: 54759 - protein, 32 aa, Artificial Sequence
  Description of Artificial Sequence: Synthetic polypeptide
TEEEIRTTNPVATEPYGSVACTPFSQDRGGNR

SEQ ID NO: 54760 - protein, 32 aa, Artificial Sequence
  Description of Artificial Sequence: Synthetic polypeptide
TEEEIRTTNPVATEHYGSVCSTAMHSQSGGNR

SEQ ID NO: 54761 - protein, 33 aa, Artificial Sequence
  Description of Artificial Sequence: Synthetic polypeptide
TEEEIRTTNPVATEPYGSVACTQHLSQDRGGNR

SEQ ID NO: 54762 - protein, 33 aa, Artificial Sequence
  Description of Artificial Sequence: Synthetic polypeptide
DEEEIRTTNPVATEQYGCTCSTGELQERFGSNQ

SEQ ID NO: 54763 - protein, 33 aa, Artificial Sequence
  Description of Artificial Sequence: Synthetic polypeptide
TEEEIRTTNPVATEHYGSVCSTALSQTTGGNNR

SEQ ID NO: 54764 - protein, 31 aa, Artificial Sequence
  Description of Artificial Sequence: Synthetic polypeptide
TEEEIRTTNPVATEAYGVVPSTNAGSQEGNL

SEQ ID NO: 54765 - protein, 32 aa, Artificial Sequence
  Description of Artificial Sequence: Synthetic polypeptide
TEEEIRTTNPVATEAYGVVPSVTGNGSQEGNR

SEQ ID NO: 54766 - protein, 29 aa, Artificial Sequence
  Description of Artificial Sequence: Synthetic peptide
DEEEIRTTNPVATEQYGCTSVVLGIGGQE

SEQ ID NO: 54767 - protein, 31 aa, Artificial Sequence
  Description of Artificial Sequence: Synthetic polypeptide
TEEEIRTTNPVATEEYGCISCINLSTRGGNR

SEQ ID NO: 54768 - protein, 33 aa, Artificial Sequence
  Description of Artificial Sequence: Synthetic polypeptide
DEEEIRTTNPVATEQYGCTSMTENLNQGIGSDR

SEQ ID NO: 54769 - protein, 32 aa, Artificial Sequence
  Description of Artificial Sequence: Synthetic polypeptide
TEEEIRTTNPVATEHWGSTVCSTALSQRGGNK

SEQ ID NO: 54770 - protein, 33 aa, Artificial Sequence
  Description of Artificial Sequence: Synthetic polypeptide
DEEEIRTTNPVATEQYGCTPSTGELSQSGGNNR

SEQ ID NO: 54771 - protein, 32 aa, Artificial Sequence
  Description of Artificial Sequence: Synthetic polypeptide
TEEEIRTTNPVATEHYGCVPSTNGSQEEGGNR

SEQ ID NO: 54772 - protein, 32 aa, Artificial Sequence
  Description of Artificial Sequence: Synthetic polypeptide
TEEEIRTTNPVATEHYGSTVCSTALSQFGGSR

SEQ ID NO: 54773 - protein, 33 aa, Artificial Sequence
  Description of Artificial Sequence: Synthetic polypeptide
TEEEIRTTNPVATEHYGSTVCSTALSQSGGNRT

SEQ ID NO: 54774 - protein, 34 aa, Artificial Sequence
  Description of Artificial Sequence: Synthetic polypeptide
TEEEIRTTNPVATEHYGSTVCSTGALSQRGGNRL

SEQ ID NO: 54775 - protein, 33 aa, Artificial Sequence
  Description of Artificial Sequence: Synthetic polypeptide
TEEEIRTTNPVATEHYGSVCSCTAALSQHGNNR

SEQ ID NO: 54776 - protein, 33 aa, Artificial Sequence
  Description of Artificial Sequence: Synthetic polypeptide
TEEEIRTTNPVATEHYGSVCSCTAALSQRGNYE

SEQ ID NO: 54777 - protein, 32 aa, Artificial Sequence
  Description of Artificial Sequence: Synthetic polypeptide
TEEEIRTTNPVATEHYGSVCSTAHSQRTGGNS

SEQ ID NO: 54778 - protein, 32 aa, Artificial Sequence
  Description of Artificial Sequence: Synthetic polypeptide
DEEEIRTTNPVATEQYGCTCSTNEHQGGSNQA

SEQ ID NO: 54779 - protein, 33 aa, Artificial Sequence
  Description of Artificial Sequence: Synthetic polypeptide
DEEEIRTTNPVATEQYGCTCSTMELQRFGSNQF

SEQ ID NO: 54780 - protein, 32 aa, Artificial Sequence
  Description of Artificial Sequence: Synthetic polypeptide
TEEEIRTTNPVATEPYGSVNCTPLSHDRGGNR

SEQ ID NO: 54781 - protein, 34 aa, Artificial Sequence
  Description of Artificial Sequence: Synthetic polypeptide
TEEEIRTTNPVATEPYGSVPSTPLSQDRAGGNNR

SEQ ID NO: 54782 - protein, 33 aa, Artificial Sequence
  Description of Artificial Sequence: Synthetic polypeptide
TEEEIRTTNPVATEPYGSVQSCTPHSQDRGGNR

SEQ ID NO: 54783 - protein, 33 aa, Artificial Sequence
  Description of Artificial Sequence: Synthetic polypeptide
TEEEIRTTNPVATEPYGSVVSCTPLSQDRGGNS

SEQ ID NO: 54784 - protein, 32 aa, Artificial Sequence
  Description of Artificial Sequence: Synthetic polypeptide
DEEEIRTTNPVATEQYGCQVCSTNHQGFNSQQ

SEQ ID NO: 54785 - protein, 34 aa, Artificial Sequence
  Description of Artificial Sequence: Synthetic polypeptide
DEEEIRTTNPVATEQYGCQVCSTGNLQHFGSNQA

SEQ ID NO: 54786 - protein, 33 aa, Artificial Sequence
  Description of Artificial Sequence: Synthetic polypeptide
DEEEIRTTNPVATEQYGCQVCSTELQYFGSERA

SEQ ID NO: 54787 - protein, 33 aa, Artificial Sequence
  Description of Artificial Sequence: Synthetic polypeptide
DEEEIRTTNPVATEQYGCQVCSTEHQRFGSNQQ

SEQ ID NO: 54788 - protein, 34 aa, Artificial Sequence
  Description of Artificial Sequence: Synthetic polypeptide
DEEEIRTTNPVATEQYGCQVCSDTNLQNFGSNDA

SEQ ID NO: 54789 - protein, 32 aa, Artificial Sequence
  Description of Artificial Sequence: Synthetic polypeptide
DEEEIRTTNPVATEQYGCQISTNVDQPGKNNT

SEQ ID NO: 54790 - protein, 33 aa, Artificial Sequence
  Description of Artificial Sequence: Synthetic polypeptide
TEEEIRTTNPVATEPYGSVVSYTPLSQDVGGNR

SEQ ID NO: 54791 - protein, 31 aa, Artificial Sequence
  Description of Artificial Sequence: Synthetic polypeptide
DEEEIRTTNPVATEQYGCNVFATNSLEVDNE

SEQ ID NO: 54792 - protein, 31 aa, Artificial Sequence
  Description of Artificial Sequence: Synthetic polypeptide
TEEEIRTTNPVATEQWGISVSTYLSLTGGNS

SEQ ID NO: 54793 - protein, 32 aa, Artificial Sequence
  Description of Artificial Sequence: Synthetic polypeptide
TEEEIRTTNPVATEQWGSTVSCTNMSPQTGNH

SEQ ID NO: 54794 - protein, 32 aa, Artificial Sequence
  Description of Artificial Sequence: Synthetic polypeptide
TEEEIRTTNPVATEQWGSVSTNMDSPQTGNNH

SEQ ID NO: 54795 - protein, 32 aa, Artificial Sequence
  Description of Artificial Sequence: Synthetic polypeptide
DEEEIRTTNPVATEQYGCIVSTELQNFGSEQF

SEQ ID NO: 54796 - protein, 32 aa, Artificial Sequence
  Description of Artificial Sequence: Synthetic polypeptide
TEEEIRTTNPVATEQWGSVVYGCGNDAQRGNR

SEQ ID NO: 54797 - protein, 34 aa, Artificial Sequence
  Description of Artificial Sequence: Synthetic polypeptide
TEEEIRTTNPVATEQWGVVPSYTNLSQERTEGNR

SEQ ID NO: 54798 - protein, 32 aa, Artificial Sequence
  Description of Artificial Sequence: Synthetic polypeptide
TEEEIRTTNPVATEPYGSVVCTPLSQDRGGSR

SEQ ID NO: 54799 - protein, 31 aa, Artificial Sequence
  Description of Artificial Sequence: Synthetic polypeptide
TEEEIRTTNPVATEPYGSVVATAALQNGGSR

SEQ ID NO: 54800 - protein, 31 aa, Artificial Sequence
  Description of Artificial Sequence: Synthetic polypeptide
DEEEIRTTNPVATEQYGCQVSTELTNFGSEQ

SEQ ID NO: 54801 - protein, 32 aa, Artificial Sequence
  Description of Artificial Sequence: Synthetic polypeptide
TEEEIRTTNPVATEPYGSVSTPSSQDMGGNNR

SEQ ID NO: 54802 - protein, 32 aa, Artificial Sequence
  Description of Artificial Sequence: Synthetic polypeptide
TEEEIRTTNPVATEPYGSVSCPLSQDIGGNNR

SEQ ID NO: 54803 - protein, 32 aa, Artificial Sequence
  Description of Artificial Sequence: Synthetic polypeptide
TEEEIRTTNPVATEPYGSVSCSGNLQATGNNV

SEQ ID NO: 54804 - protein, 32 aa, Artificial Sequence
  Description of Artificial Sequence: Synthetic polypeptide
DEEEIRTTNPVATEQYGCSSWPNMLQRDSNAS

SEQ ID NO: 54805 - protein, 33 aa, Artificial Sequence
  Description of Artificial Sequence: Synthetic polypeptide
DEEEIRTTNPVATEQYGCSSTGNPLQRFESNQA

SEQ ID NO: 54806 - protein, 32 aa, Artificial Sequence
  Description of Artificial Sequence: Synthetic polypeptide
TEEEIRTTNPVATEPYGSVSCTPLSGDRGGNL

SEQ ID NO: 54807 - protein, 33 aa, Artificial Sequence
  Description of Artificial Sequence: Synthetic polypeptide
TEEEIRTTNPVATEPYGSVSCTPLSLDRGGNYR

SEQ ID NO: 54808 - protein, 33 aa, Artificial Sequence
  Description of Artificial Sequence: Synthetic polypeptide
TEEEIRTTNPVATEPYGSVSCTPLSQDRPGGNG

SEQ ID NO: 54809 - protein, 33 aa, Artificial Sequence
  Description of Artificial Sequence: Synthetic polypeptide
TEEEIRTTNPVATEQYGSVSTVNDQNGNGNGQE

SEQ ID NO: 54810 - protein, 34 aa, Artificial Sequence
  Description of Artificial Sequence: Synthetic polypeptide
TEEEIRTTNPVATEPYGSVSCTPLSQSRPGGNRC

SEQ ID NO: 54811 - protein, 32 aa, Artificial Sequence
  Description of Artificial Sequence: Synthetic polypeptide
TEEEIRTTNPVATEPYGSVSCTPPSQDGGGNR

SEQ ID NO: 54812 - protein, 34 aa, Artificial Sequence
  Description of Artificial Sequence: Synthetic polypeptide
TEEEIRTTNPVATEPYGSVSQTPELSQDRTGGNR

SEQ ID NO: 54813 - protein, 32 aa, Artificial Sequence
  Description of Artificial Sequence: Synthetic polypeptide
TEEEIRTTNPVATEPYGSVSTPGSQDGTGGNR

SEQ ID NO: 54814 - protein, 32 aa, Artificial Sequence
  Description of Artificial Sequence: Synthetic polypeptide
TEEEIRTTNPVATEPYGSVSTPLSGIRTGGNE

SEQ ID NO: 54815 - protein, 33 aa, Artificial Sequence
  Description of Artificial Sequence: Synthetic polypeptide
TEEEIRTTNPVATEPYGSVSTPLSTDRTGGNRF

SEQ ID NO: 54816 - protein, 33 aa, Artificial Sequence
  Description of Artificial Sequence: Synthetic polypeptide
DEEEIRTTNPVATEQYGCQVSTNHQNFGSENQS

SEQ ID NO: 54817 - protein, 33 aa, Artificial Sequence
  Description of Artificial Sequence: Synthetic polypeptide
TEEEIRTTNPVATEPYGSVSTPMLSSDRGGNNR

SEQ ID NO: 54818 - protein, 33 aa, Artificial Sequence
  Description of Artificial Sequence: Synthetic polypeptide
DEEEIRTTNPVATEQYGCSCSTGNPLQRFSSDQ

SEQ ID NO: 54819 - protein, 32 aa, Artificial Sequence
  Description of Artificial Sequence: Synthetic polypeptide
TEEEIRTTNPVATEAYGSVVSTYLSQEPDGNQ

SEQ ID NO: 54820 - protein, 34 aa, Artificial Sequence
  Description of Artificial Sequence: Synthetic polypeptide
TEEEIRTTNPVATEQYGSVSTVNLQFNGNGNGQL

SEQ ID NO: 54821 - protein, 33 aa, Artificial Sequence
  Description of Artificial Sequence: Synthetic polypeptide
TEEEIRTTNPVATEQYGSVSWTDNQQDRQANGS

SEQ ID NO: 54822 - protein, 31 aa, Artificial Sequence
  Description of Artificial Sequence: Synthetic polypeptide
TEEGIATTNPVATEQYGSVSTGNNDSGLGNR

SEQ ID NO: 54823 - protein, 31 aa, Artificial Sequence
  Description of Artificial Sequence: Synthetic polypeptide
TEEGICTTNPVATEQYGSTVSQNSSQRGNNS

SEQ ID NO: 54824 - protein, 31 aa, Artificial Sequence
  Description of Artificial Sequence: Synthetic polypeptide
TEEGICTTNPVATEQYGSVSINASSQRGNNS

SEQ ID NO: 54825 - protein, 31 aa, Artificial Sequence
  Description of Artificial Sequence: Synthetic polypeptide
TEEGICTTNPVATEQYGSVSLNSSQRTGNNS

SEQ ID NO: 54826 - protein, 29 aa, Artificial Sequence
  Description of Artificial Sequence: Synthetic peptide
TEEGIRCTNPVATEQYGCVSTNLEMEVQR

SEQ ID NO: 54827 - protein, 32 aa, Artificial Sequence
  Description of Artificial Sequence: Synthetic polypeptide
TEEGIRTTNPVATEAYGSVVSTNLSMTVGNNR

SEQ ID NO: 54828 - protein, 33 aa, Artificial Sequence
  Description of Artificial Sequence: Synthetic polypeptide
TEEGIRTTNPVATEQYGSTVSTNELSSMTPGNR

SEQ ID NO: 54829 - protein, 31 aa, Artificial Sequence
  Description of Artificial Sequence: Synthetic polypeptide
TEEGIRTTNPVATEQYGSVSPMNLLSSQLNR

SEQ ID NO: 54830 - protein, 33 aa, Artificial Sequence
  Description of Artificial Sequence: Synthetic polypeptide
DEEEIRTTNPVATEQWGSVSEINEPQDREGENK

SEQ ID NO: 54831 - protein, 30 aa, Artificial Sequence
  Description of Artificial Sequence: Synthetic polypeptide
TEEGIRTTNPVATEQYGSVSTLNLTELQDN

SEQ ID NO: 54832 - protein, 33 aa, Artificial Sequence
  Description of Artificial Sequence: Synthetic polypeptide
DEEEIRTTNPVATEQWGSVSCTNMQSPATGTNH

SEQ ID NO: 54833 - protein, 33 aa, Artificial Sequence
  Description of Artificial Sequence: Synthetic polypeptide
DEEEIRTTNPVATEQWGSVSCTNMPSPQTGTNL

SEQ ID NO: 54834 - protein, 31 aa, Artificial Sequence
  Description of Artificial Sequence: Synthetic polypeptide
TEEGIRTTNPVATEQYGSVSTPNLSAELDRI

SEQ ID NO: 54835 - protein, 31 aa, Artificial Sequence
  Description of Artificial Sequence: Synthetic polypeptide
TEEGIRTTNPVATEQYGSVSTSLLSMQNFER

SEQ ID NO: 54836 - protein, 31 aa, Artificial Sequence
  Description of Artificial Sequence: Synthetic polypeptide
TEEGIRTTNPVATEQYGSVSVTGLSTVVNNR

SEQ ID NO: 54837 - protein, 33 aa, Artificial Sequence
  Description of Artificial Sequence: Synthetic polypeptide
DEEEIRTTNPVATEQWGSVSPGNPQRPGDNEHA

SEQ ID NO: 54838 - protein, 31 aa, Artificial Sequence
  Description of Artificial Sequence: Synthetic polypeptide
TEEGIRTTNPVAYEQYGKTVSTNLGMVGNRG

SEQ ID NO: 54839 - protein, 33 aa, Artificial Sequence
  Description of Artificial Sequence: Synthetic polypeptide
DEEEIRTTNPVATEQWGSVSSTNGGQRGGDIFM

SEQ ID NO: 54840 - protein, 34 aa, Artificial Sequence
  Description of Artificial Sequence: Synthetic polypeptide
TEEEVRTTNPVAYEQYGSTVSTGNLDQRTVGNER

SEQ ID NO: 54841 - protein, 30 aa, Artificial Sequence
  Description of Artificial Sequence: Synthetic polypeptide
TEEEIRTTNPVAYERYGSVATHAVQSGGNR

SEQ ID NO: 54842 - protein, 31 aa, Artificial Sequence
  Description of Artificial Sequence: Synthetic polypeptide
TEEEIRTTNPVAYERYGSVSTPNLQATVNNV

SEQ ID NO: 54843 - protein, 31 aa, Artificial Sequence
  Description of Artificial Sequence: Synthetic polypeptide
TEEEIRTTNPVGYEQYGSVSTNMLSGRGGSP

SEQ ID NO: 54844 - protein, 33 aa, Artificial Sequence
  Description of Artificial Sequence: Synthetic polypeptide
TEEEIRTTNPVSTEQYGQSVSTNLSDATGGKNR

SEQ ID NO: 54845 - protein, 32 aa, Artificial Sequence
  Description of Artificial Sequence: Synthetic polypeptide
TEEEIRTTNPVSTEQYGSVPSTNELSGRGGDP

SEQ ID NO: 54846 - protein, 34 aa, Artificial Sequence
  Description of Artificial Sequence: Synthetic polypeptide
TEEEIRTTNPVSTEQYGSVVSCTANELQMGGNNR

SEQ ID NO: 54847 - protein, 33 aa, Artificial Sequence
  Description of Artificial Sequence: Synthetic polypeptide
TEEEIRTTNPVSYEQYGSVSYTNALPQRGGNNA

SEQ ID NO: 54848 - protein, 32 aa, Artificial Sequence
  Description of Artificial Sequence: Synthetic polypeptide
TEEEIRTVNPVATEQYGSVSTRALSQRTVGQE

SEQ ID NO: 54849 - protein, 33 aa, Artificial Sequence
  Description of Artificial Sequence: Synthetic polypeptide
TEEEIRYTNPVATEQYGSVSCVNAQSDRVGNNR

SEQ ID NO: 54850 - protein, 32 aa, Artificial Sequence
  Description of Artificial Sequence: Synthetic polypeptide
TEEEISTTNPVATEAYGSTVPSCTNLERVNER

SEQ ID NO: 54851 - protein, 31 aa, Artificial Sequence
  Description of Artificial Sequence: Synthetic polypeptide
TEEEISTTNPVATEPYGSVSTNDQATGGNNV

SEQ ID NO: 54852 - protein, 32 aa, Artificial Sequence
  Description of Artificial Sequence: Synthetic polypeptide
TEEEISTTNPVATEQYGNTVSVTPLSQGGGNR

SEQ ID NO: 54853 - protein, 34 aa, Artificial Sequence
  Description of Artificial Sequence: Synthetic polypeptide
TEEEVRTTNPVATEQYGSTVSCTGNSDQRTGGNR

SEQ ID NO: 54854 - protein, 33 aa, Artificial Sequence
  Description of Artificial Sequence: Synthetic polypeptide
DEEEIRTTNPVATEQWGSVSTGNMMSGQTGGNP

SEQ ID NO: 54855 - protein, 34 aa, Artificial Sequence
  Description of Artificial Sequence: Synthetic polypeptide
TEEEVRTTNPVATEQYGSVSCTGNLSQSTGGNNR

SEQ ID NO: 54856 - protein, 29 aa, Artificial Sequence
  Description of Artificial Sequence: Synthetic peptide
TEEGIATTNPVATECYGSVSTNDSGNLNR

SEQ ID NO: 54857 - protein, 33 aa, Artificial Sequence
  Description of Artificial Sequence: Synthetic polypeptide
TEEEIRTTNPVAYEQYGTVCSTDALSQRPGGNR

SEQ ID NO: 54858 - protein, 29 aa, Artificial Sequence
  Description of Artificial Sequence: Synthetic peptide
TEEIIRTTNPVATEQYGCVQTNCEFGNCF

SEQ ID NO: 54859 - protein, 29 aa, Artificial Sequence
  Description of Artificial Sequence: Synthetic peptide
TEESIACTNPVATEQYGSVATNLADLNRD

SEQ ID NO: 54860 - protein, 29 aa, Artificial Sequence
  Description of Artificial Sequence: Synthetic peptide
TENEIACTNPVATEAYGEASENLQRGGNR

SEQ ID NO: 54861 - protein, 28 aa, Artificial Sequence
  Description of Artificial Sequence: Synthetic peptide
TENEIACTNPVATEQYGEASEELQRGGR

SEQ ID NO: 54862 - protein, 29 aa, Artificial Sequence
  Description of Artificial Sequence: Synthetic peptide
TENEIACTNPVATEQYGEASENLQRGKGR

SEQ ID NO: 54863 - protein, 29 aa, Artificial Sequence
  Description of Artificial Sequence: Synthetic peptide
TENEIACTNPVATEQYGKASENLQRGGGR

SEQ ID NO: 54864 - protein, 31 aa, Artificial Sequence
  Description of Artificial Sequence: Synthetic polypeptide
TENEIRTTNPVATEAYGSTVSNNLSQRGGTQ

SEQ ID NO: 54865 - protein, 31 aa, Artificial Sequence
  Description of Artificial Sequence: Synthetic polypeptide
TEREIRTTNPVATEAYGSVWTNELSQGGGSR

SEQ ID NO: 54866 - protein, 31 aa, Artificial Sequence
  Description of Artificial Sequence: Synthetic polypeptide
TESEIATTNPVATEQYGSTVSCTNLSMPGNT

SEQ ID NO: 54867 - protein, 34 aa, Artificial Sequence
  Description of Artificial Sequence: Synthetic polypeptide
DEEEIRTTNPVATEQWGSVPSTNEHSQERDVGIR

SEQ ID NO: 54868 - protein, 31 aa, Artificial Sequence
  Description of Artificial Sequence: Synthetic polypeptide
TESEIRCTNPVATEQYGSVFTNLSQHTGGNQ

SEQ ID NO: 54869 - protein, 30 aa, Artificial Sequence
  Description of Artificial Sequence: Synthetic polypeptide
TESEIRCTNPVAYEQYGSTVFTNLQHGGNQ

SEQ ID NO: 54870 - protein, 32 aa, Artificial Sequence
  Description of Artificial Sequence: Synthetic polypeptide
TESEIRTTNPVATEPYGQSVSCTNLQATGGNV

SEQ ID NO: 54871 - protein, 31 aa, Artificial Sequence
  Description of Artificial Sequence: Synthetic polypeptide
TESEIRTTNPVATEPYGVVSVTGLSQRPGND

SEQ ID NO: 54872 - protein, 32 aa, Artificial Sequence
  Description of Artificial Sequence: Synthetic polypeptide
TESEIRTTNPVATEQWGSVSTNLSQNPPGNPM

SEQ ID NO: 54873 - protein, 33 aa, Artificial Sequence
  Description of Artificial Sequence: Synthetic polypeptide
TESEIRTTNPVATHQYGSVSCTGNALSPRGGNR

SEQ ID NO: 54874 - protein, 31 aa, Artificial Sequence
  Description of Artificial Sequence: Synthetic polypeptide
TESEIRTTNPVATQQYGCVSTNLSERGGNYP

SEQ ID NO: 54875 - protein, 34 aa, Artificial Sequence
  Description of Artificial Sequence: Synthetic polypeptide
DEEEIRTTNPVATEQWGSVQSAGNELSQRGGNYH

SEQ ID NO: 54876 - protein, 31 aa, Artificial Sequence
  Description of Artificial Sequence: Synthetic polypeptide
TEEPIRTTNPVATEQYGCVSTNHSQFGGNNE

SEQ ID NO: 54877 - protein, 32 aa, Artificial Sequence
  Description of Artificial Sequence: Synthetic polypeptide
TEHEIRTTNPVAYEQYGSVSQNELSTRNGNNR

SEQ ID NO: 54878 - protein, 32 aa, Artificial Sequence
  Description of Artificial Sequence: Synthetic polypeptide
DEEEIRTTNPVATEQWGSVSATGTGGQPRGAT

SEQ ID NO: 54879 - protein, 29 aa, Artificial Sequence
  Description of Artificial Sequence: Synthetic peptide
TEESIACTNPVATEQYGSVATNLAMPNER

SEQ ID NO: 54880 - protein, 29 aa, Artificial Sequence
  Description of Artificial Sequence: Synthetic peptide
TEESIACTNPVATEQYGSVATNLNMGLNH

SEQ ID NO: 54881 - protein, 31 aa, Artificial Sequence
  Description of Artificial Sequence: Synthetic polypeptide
TEESIATTNPVATEAYGSTVNTNELSQRGNM

SEQ ID NO: 54882 - protein, 29 aa, Artificial Sequence
  Description of Artificial Sequence: Synthetic peptide
TEESIATTNPVATEQYGCVATNLSMDNER

SEQ ID NO: 54883 - protein, 31 aa, Artificial Sequence
  Description of Artificial Sequence: Synthetic polypeptide
TEEVIKTTNPVAYEQWGSVPSTNLSQRGGNL

SEQ ID NO: 54884 - protein, 32 aa, Artificial Sequence
  Description of Artificial Sequence: Synthetic polypeptide
TEEVIRTTNPVATEAYGSVQSTNEQSQTGNNR

SEQ ID NO: 54885 - protein, 33 aa, Artificial Sequence
  Description of Artificial Sequence: Synthetic polypeptide
TEEVIRTTNPVATEPYGSVPSCTPLSQDRGGNR

SEQ ID NO: 54886 - protein, 33 aa, Artificial Sequence
  Description of Artificial Sequence: Synthetic polypeptide
TEEVIRTTNPVATEQYGSVVSTNALSDGGGNRI

SEQ ID NO: 54887 - protein, 32 aa, Artificial Sequence
  Description of Artificial Sequence: Synthetic polypeptide
TEGEIRTTNPVATEAWGSVSCTNLQRPPGNEM

SEQ ID NO: 54888 - protein, 32 aa, Artificial Sequence
  Description of Artificial Sequence: Synthetic polypeptide
TEGEIRTTNPVATEPYGSVPSTNELQATGGNV

SEQ ID NO: 54889 - protein, 32 aa, Artificial Sequence
  Description of Artificial Sequence: Synthetic polypeptide
TEGEIRTTNPVATEPYGSVSCTPLSQDRGGNA

SEQ ID NO: 54890 - protein, 33 aa, Artificial Sequence
  Description of Artificial Sequence: Synthetic polypeptide
TEGEIRTTNPVATEQWGSTVSTNLSQRPPGNNP

SEQ ID NO: 54891 - protein, 33 aa, Artificial Sequence
  Description of Artificial Sequence: Synthetic polypeptide
DEEEIRTTNPVATEQWGSVSCINEPQDREGENG

SEQ ID NO: 54892 - protein, 32 aa, Artificial Sequence
  Description of Artificial Sequence: Synthetic polypeptide
DEEEIRTTNPVATEQWGSVSCINEPQDREGEG

SEQ ID NO: 54893 - protein, 33 aa, Artificial Sequence
  Description of Artificial Sequence: Synthetic polypeptide
TEGEIRTTNPVATEQWGSVSCTNLQRPPGNNNK

SEQ ID NO: 54894 - protein, 32 aa, Artificial Sequence
  Description of Artificial Sequence: Synthetic polypeptide
TEHEIATTNPVATEQYGSVSCTNISQHGGNRF

SEQ ID NO: 54895 - protein, 33 aa, Artificial Sequence
  Description of Artificial Sequence: Synthetic polypeptide
TEEEIRTTNPVAYEQYGSVSYNCLSQRGGNNDV

SEQ ID NO: 54896 - protein, 34 aa, Artificial Sequence
  Description of Artificial Sequence: Synthetic polypeptide
TEEEIRTTNPVAYEQYGSVSTGNELSQGGENYRN

SEQ ID NO: 54897 - protein, 34 aa, Artificial Sequence
  Description of Artificial Sequence: Synthetic polypeptide
TEEEIRTTNPVAYEQYGSVSLANELSQRGGNYRN

SEQ ID NO: 54898 - protein, 32 aa, Artificial Sequence
  Description of Artificial Sequence: Synthetic polypeptide
TEEEIRTTNPVAYDQYGSVVSANALSPRGGNR

SEQ ID NO: 54899 - protein, 32 aa, Artificial Sequence
  Description of Artificial Sequence: Synthetic polypeptide
DEEEIRTTNPVATEQWGTVVTTVTNLQLGGNS

SEQ ID NO: 54900 - protein, 30 aa, Artificial Sequence
  Description of Artificial Sequence: Synthetic polypeptide
DEEEIRTTNPVATEQWGTVVTTTLLGGNST

SEQ ID NO: 54901 - protein, 30 aa, Artificial Sequence
  Description of Artificial Sequence: Synthetic polypeptide
DEEEIRTTNPVATEQWGTVVTTELLGNGNS

SEQ ID NO: 54902 - protein, 31 aa, Artificial Sequence
  Description of Artificial Sequence: Synthetic polypeptide
TEEEIRTTNPVAYEAYGEVSCTNLHRGTDPR

SEQ ID NO: 54903 - protein, 32 aa, Artificial Sequence
  Description of Artificial Sequence: Synthetic polypeptide
TEEEIRTTNPVAYEAYGHVSWTNLSNRTGGNR

SEQ ID NO: 54904 - protein, 31 aa, Artificial Sequence
  Description of Artificial Sequence: Synthetic polypeptide
TEEEIRTTNPVAYEAYGSVSCTNLDRGTDQH

SEQ ID NO: 54905 - protein, 31 aa, Artificial Sequence
  Description of Artificial Sequence: Synthetic polypeptide
TEEEIRTTNPVAYEAYGSVSCTNLHRGTSQI

SEQ ID NO: 54906 - protein, 30 aa, Artificial Sequence
  Description of Artificial Sequence: Synthetic polypeptide
TEEEIRTTNPVAYEAYGVIPSTNGSQEGNR

SEQ ID NO: 54907 - protein, 33 aa, Artificial Sequence
  Description of Artificial Sequence: Synthetic polypeptide
TEEEIRTTNPVAYECYGSVCSTDNLSQRPGGND

SEQ ID NO: 54908 - protein, 31 aa, Artificial Sequence
  Description of Artificial Sequence: Synthetic polypeptide
TEEEIRTTNPVAYEEYGCTIPSINLQRGGNR

SEQ ID NO: 54909 - protein, 33 aa, Artificial Sequence
  Description of Artificial Sequence: Synthetic polypeptide
TEEEIRTTNPVAYEHYGSTVCSTALSQRGGNRK

SEQ ID NO: 54910 - protein, 31 aa, Artificial Sequence
  Description of Artificial Sequence: Synthetic polypeptide
TEEEIRTTNPVAYEHYGSVCFTTLSTRGGNR

SEQ ID NO: 54911 - protein, 31 aa, Artificial Sequence
  Description of Artificial Sequence: Synthetic polypeptide
TEEEIRTTNPVAYEHYGSVCSTAHSSRGGNR

SEQ ID NO: 54912 - protein, 33 aa, Artificial Sequence
  Description of Artificial Sequence: Synthetic polypeptide
TEEEIRTTNPVAYEHYGSVCSTALSQNRGGNRL

SEQ ID NO: 54913 - protein, 34 aa, Artificial Sequence
  Description of Artificial Sequence: Synthetic polypeptide
DEEEIRTTNPVATEQWGVSNVSETNYLQLRPGGF

SEQ ID NO: 54914 - protein, 31 aa, Artificial Sequence
  Description of Artificial Sequence: Synthetic polypeptide
TEEEIRTTNPVAYEHYGSVPFTDLSQEGGNR

SEQ ID NO: 54915 - protein, 31 aa, Artificial Sequence
  Description of Artificial Sequence: Synthetic polypeptide
TEEEIRTTNPVAYDQDGSVSTNAISQNGGNR

SEQ ID NO: 54916 - protein, 34 aa, Artificial Sequence
  Description of Artificial Sequence: Synthetic polypeptide
DEEEIRTTNPVATEQWGYSNVSLTNPLQVRPGGF

SEQ ID NO: 54917 - protein, 32 aa, Artificial Sequence
  Description of Artificial Sequence: Synthetic polypeptide
TEEEIRTTNPVATEQYGSVVACTGAVQNGSNR

SEQ ID NO: 54918 - protein, 31 aa, Artificial Sequence
  Description of Artificial Sequence: Synthetic polypeptide
TEEEIRTTNPVATEQYGSVVTALQNDGEFFD

SEQ ID NO: 54919 - protein, 31 aa, Artificial Sequence
  Description of Artificial Sequence: Synthetic polypeptide
TEEEIRTTNPVATEQYGSVVTALQNGEFDED

SEQ ID NO: 54920 - protein, 32 aa, Artificial Sequence
  Description of Artificial Sequence: Synthetic polypeptide
DEEEIRTTNPVATEQYGAAVSTNEDQINNEQQ

SEQ ID NO: 54921 - protein, 33 aa, Artificial Sequence
  Description of Artificial Sequence: Synthetic polypeptide
TEEEIRTTNPVATEQYGTVSNNGHSQRVGNNRC

SEQ ID NO: 54922 - protein, 31 aa, Artificial Sequence
  Description of Artificial Sequence: Synthetic polypeptide
TEEEIRTTNPVATERYGQSVATPHSQRGGNP

SEQ ID NO: 54923 - protein, 31 aa, Artificial Sequence
  Description of Artificial Sequence: Synthetic polypeptide
TEEEIRTTNPVATERYGSVATGGVQSGGNNR

SEQ ID NO: 54924 - protein, 33 aa, Artificial Sequence
  Description of Artificial Sequence: Synthetic polypeptide
TEEEIRTTNPVATESYGSVSVTNALSHRGGDQR

SEQ ID NO: 54925 - protein, 33 aa, Artificial Sequence
  Description of Artificial Sequence: Synthetic polypeptide
DEEEIRTTNPVATEQWGYTISKTNEDQRDGQNR

SEQ ID NO: 54926 - protein, 33 aa, Artificial Sequence
  Description of Artificial Sequence: Synthetic polypeptide
TEEEIRTTNPVAVEQYGSTVSTNPSQRVGNNDS

SEQ ID NO: 54927 - protein, 32 aa, Artificial Sequence
  Description of Artificial Sequence: Synthetic polypeptide
TEEEIRTTNPVAYDPDGQSVSTNALSQRGGNR

SEQ ID NO: 54928 - protein, 34 aa, Artificial Sequence
  Description of Artificial Sequence: Synthetic polypeptide
DEEEIRTTNPVATEQWGYSVVSLTNPLQHRPGGE

SEQ ID NO: 54929 - protein, 34 aa, Artificial Sequence
  Description of Artificial Sequence: Synthetic polypeptide
DEEEIRTTNPVATEQWGYSNVSYTNPLQHRPGGL

SEQ ID NO: 54930 - protein, 34 aa, Artificial Sequence
  Description of Artificial Sequence: Synthetic polypeptide
DEEEIRTTNPVATEQWGYSNVSYTNELQHRPGGH

SEQ ID NO: 54931 - protein, 34 aa, Artificial Sequence
  Description of Artificial Sequence: Synthetic polypeptide
DEEEIRTTNPVATEQWGYSNVSPTNYLQVRPGGN

SEQ ID NO: 54932 - protein, 34 aa, Artificial Sequence
  Description of Artificial Sequence: Synthetic polypeptide
DEEEIRTTNPVATEQWGWSNVSYTNYLQHRPGGE

SEQ ID NO: 54933 - protein, 30 aa, Artificial Sequence
  Description of Artificial Sequence: Synthetic polypeptide
DEEEIRTTNPVATEQWGTTVSAALGLNGNS

SEQ ID NO: 54934 - protein, 31 aa, Artificial Sequence
  Description of Artificial Sequence: Synthetic polypeptide
TEEEIRTTNPVAYENYGSVSTNLQAAGQDEH

SEQ ID NO: 54935 - protein, 31 aa, Artificial Sequence
  Description of Artificial Sequence: Synthetic polypeptide
TEEEIRTTNPVAYEPYGISVSTNLQATVNNH

SEQ ID NO: 54936 - protein, 33 aa, Artificial Sequence
  Description of Artificial Sequence: Synthetic polypeptide
DEEEIRTTNPVATEQWGSVYHWTNDIQKTGNSR

SEQ ID NO: 54937 - protein, 34 aa, Artificial Sequence
  Description of Artificial Sequence: Synthetic polypeptide
DEEEIRTTNPVATEQWGSVVSVTGNMLQSVGERM

SEQ ID NO: 54938 - protein, 34 aa, Artificial Sequence
  Description of Artificial Sequence: Synthetic polypeptide
DEEEIRTTNPVATEQWGSVVSVTGNMLQRNVGEA

SEQ ID NO: 54939 - protein, 34 aa, Artificial Sequence
  Description of Artificial Sequence: Synthetic polypeptide
DEEEIRTTNPVATEQWGSVVSVTGNALQREVGED

SEQ ID NO: 54940 - protein, 32 aa, Artificial Sequence
  Description of Artificial Sequence: Synthetic polypeptide
TEEEIRTTNPVAYEQYGSTCNCTNLQPGGNNR

SEQ ID NO: 54941 - protein, 33 aa, Artificial Sequence
  Description of Artificial Sequence: Synthetic polypeptide
TEEEIRTTNPVAYEQYGSTVSCENMHQRGENYR

SEQ ID NO: 54942 - protein, 34 aa, Artificial Sequence
  Description of Artificial Sequence: Synthetic polypeptide
TEEEIRTTNPVAYEQYGSTVSCLNWLSQRGQENR

SEQ ID NO: 54943 - protein, 32 aa, Artificial Sequence
  Description of Artificial Sequence: Synthetic polypeptide
TEEEIRTTNPVAYEQYGSTVSLNLSQRVANND

SEQ ID NO: 54944 - protein, 32 aa, Artificial Sequence
  Description of Artificial Sequence: Synthetic polypeptide
TEEEIRTTNPVAYEQYGSVCCTGNLGNRGGTR

SEQ ID NO: 54945 - protein, 34 aa, Artificial Sequence
  Description of Artificial Sequence: Synthetic polypeptide
TEEEIRTTNPVAYEQYGSVCSCTDNSSQRPGNRT

SEQ ID NO: 54946 - protein, 32 aa, Artificial Sequence
  Description of Artificial Sequence: Synthetic polypeptide
TEEEIRTTNPVAYEQYGSVPSLNLQFGGSNEW

SEQ ID NO: 54947 - protein, 32 aa, Artificial Sequence
  Description of Artificial Sequence: Synthetic polypeptide
DEEEIRTTNPVATEQWGSVSVSINDHQQRQNI

SEQ ID NO: 54948 - protein, 33 aa, Artificial Sequence
  Description of Artificial Sequence: Synthetic polypeptide
DEEEIRTTNPVATEQWGSVSTNMMSTQTGGNNH

SEQ ID NO: 54949 - protein, 33 aa, Artificial Sequence
  Description of Artificial Sequence: Synthetic polypeptide
TEEEIRTTNPVAYEQYGSVSCTHELAQRSQNNR

SEQ ID NO: 54950 - protein, 34 aa, Artificial Sequence
  Description of Artificial Sequence: Synthetic polypeptide
TEEEIRTTNPVAYEQYGSVSCTNMEQERPGTNYR

SEQ ID NO: 54951 - protein, 32 aa, Artificial Sequence
  Description of Artificial Sequence: Synthetic polypeptide
DEEEIRTTNPVATEQWGSVYSDRHDGQRSQNR

SEQ ID NO: 54952 - protein, 33 aa, Artificial Sequence
  Description of Artificial Sequence: Synthetic polypeptide
DEEEIRTTNPVATEQWGSVYSDTLWDGQRSQNR

SEQ ID NO: 54953 - protein, 30 aa, Artificial Sequence
  Description of Artificial Sequence: Synthetic polypeptide
TEEEIRTTNPVAYEQYGKVSCVNLSGRGPD

SEQ ID NO: 54954 - protein, 32 aa, Artificial Sequence
  Description of Artificial Sequence: Synthetic polypeptide
DEEEIRTTNPVATEQWGTCSTGNPLQPRENDN

SEQ ID NO: 54955 - protein, 31 aa, Artificial Sequence
  Description of Artificial Sequence: Synthetic polypeptide
TEEEIRTTNPVAYEPYGQVASCTDLQRVNNR

SEQ ID NO: 54956 - protein, 32 aa, Artificial Sequence
  Description of Artificial Sequence: Synthetic polypeptide
TEEEIRTTNPVAYEPYGSTVSTPLSQDAGGNR

SEQ ID NO: 54957 - protein, 32 aa, Artificial Sequence
  Description of Artificial Sequence: Synthetic polypeptide
DEEEIRTTNPVATEQWGTSVSTHLLRDGPDSQ

SEQ ID NO: 54958 - protein, 32 aa, Artificial Sequence
  Description of Artificial Sequence: Synthetic polypeptide
TEEEIRTTNPVAYEPYGSVSCLNMDQRGTNYR

SEQ ID NO: 54959 - protein, 32 aa, Artificial Sequence
  Description of Artificial Sequence: Synthetic polypeptide
TEEEIRTTNPVAYEPYGSVSCTNLTQATGNNV

SEQ ID NO: 54960 - protein, 31 aa, Artificial Sequence
  Description of Artificial Sequence: Synthetic polypeptide
TEEEIRTTNPVAYEPYGSVSTNLSQQVANNY

SEQ ID NO: 54961 - protein, 32 aa, Artificial Sequence
  Description of Artificial Sequence: Synthetic polypeptide
TEEEIRTTNPVAYEPYGSVSYTPLSQDRGGDR

SEQ ID NO: 54962 - protein, 34 aa, Artificial Sequence
  Description of Artificial Sequence: Synthetic polypeptide
TEEEIRTTNPVATEQYGSVSTVNLQQGNGNNGQE

SEQ ID NO: 54963 - protein, 31 aa, Artificial Sequence
  Description of Artificial Sequence: Synthetic polypeptide
TEEEIRTTNPVAYEPYGSVVSTNAHQATGNV

SEQ ID NO: 54964 - protein, 32 aa, Artificial Sequence
  Description of Artificial Sequence: Synthetic polypeptide
TEEEIRTTNPVAYEQWGSISTHLSQRQQGGNR

SEQ ID NO: 54965 - protein, 33 aa, Artificial Sequence
  Description of Artificial Sequence: Synthetic polypeptide
TEEEIRTTNPVAYEQWGSVCSCTANLSTRPGNR

SEQ ID NO: 54966 - protein, 32 aa, Artificial Sequence
  Description of Artificial Sequence: Synthetic polypeptide
TEEEIRTTNPVAYEQWGSVSTNMNSDRGTNYR

SEQ ID NO: 54967 - protein, 31 aa, Artificial Sequence
  Description of Artificial Sequence: Synthetic polypeptide
DEEEIRTTNPVATEQWGTSSTGAPLQARDNN

SEQ ID NO: 54968 - protein, 34 aa, Artificial Sequence
  Description of Artificial Sequence: Synthetic polypeptide
DEEEIRTTNPVATEQWGTSNVSYTNYLQIREGGF

SEQ ID NO: 54969 - protein, 32 aa, Artificial Sequence
  Description of Artificial Sequence: Synthetic polypeptide
TEEEIRTTNPVAYEQYGGVSTNTGLQEGNVKS

SEQ ID NO: 54970 - protein, 33 aa, Artificial Sequence
  Description of Artificial Sequence: Synthetic polypeptide
TEEEIRTTNPVAYEQYGIVSVSVNELSQRVGND

SEQ ID NO: 54971 - protein, 32 aa, Artificial Sequence
  Description of Artificial Sequence: Synthetic polypeptide
TEEEIRTTNPVAYEPYGSVYCTPLSQDRGGNR

SEQ ID NO: 54972 - protein, 32 aa, Artificial Sequence
  Description of Artificial Sequence: Synthetic polypeptide
DEEEIRTTNPVATEQYGCVAATNDQNQGNLQQ

SEQ ID NO: 54973 - protein, 31 aa, Artificial Sequence
  Description of Artificial Sequence: Synthetic polypeptide
DEEEIRTTNPVATEQYGCVAATNLQAAEPGE

SEQ ID NO: 54974 - protein, 34 aa, Artificial Sequence
  Description of Artificial Sequence: Synthetic polypeptide
TEEEIRTTNPVATEAYGSVVSCTGPLSQRGLNYR

SEQ ID NO: 54975 - protein, 33 aa, Artificial Sequence
  Description of Artificial Sequence: Synthetic polypeptide
DEEEIRTTNPVATEQYGCVCSTEELQGGSNTDS

SEQ ID NO: 54976 - protein, 33 aa, Artificial Sequence
  Description of Artificial Sequence: Synthetic polypeptide
DEEEIRTTNPVATEQYGCVCSTEELQASGSNAS

SEQ ID NO: 54977 - protein, 30 aa, Artificial Sequence
  Description of Artificial Sequence: Synthetic polypeptide
TEECIRCTNPVATEQYGSVSWNLNEIGSNQ

SEQ ID NO: 54978 - protein, 33 aa, Artificial Sequence
  Description of Artificial Sequence: Synthetic polypeptide
DEEEIRTTNPVATEQYGCVCSTEELDQNGSNQG

SEQ ID NO: 54979 - protein, 33 aa, Artificial Sequence
  Description of Artificial Sequence: Synthetic polypeptide
DEEEIRTTNPVATEQYGCVCSTEEHQYSGSNRA

SEQ ID NO: 54980 - protein, 32 aa, Artificial Sequence
  Description of Artificial Sequence: Synthetic polypeptide
DEEEIRTTNPVATEQYGCVCSTEEHQYGSNQD

SEQ ID NO: 54981 - protein, 32 aa, Artificial Sequence
  Description of Artificial Sequence: Synthetic polypeptide
TEECIRSTNPVAYEQYGSVPSVTNLSQRGTNT

SEQ ID NO: 54982 - protein, 31 aa, Artificial Sequence
  Description of Artificial Sequence: Synthetic polypeptide
TEECIRTTNPVATEAYGETVSCTNASQDGNR

SEQ ID NO: 54983 - protein, 33 aa, Artificial Sequence
  Description of Artificial Sequence: Synthetic polypeptide
TEECIRTTNPVATEPYGSTVSCTNMLQSGGNPR

SEQ ID NO: 54984 - protein, 31 aa, Artificial Sequence
  Description of Artificial Sequence: Synthetic polypeptide
DEEEIRTTNPVATEQYGCVCSTEEHQSGSDA

SEQ ID NO: 54985 - protein, 33 aa, Artificial Sequence
  Description of Artificial Sequence: Synthetic polypeptide
DEEEIRTTNPVATEQYGCVCSTEEHQRGSNNQN

SEQ ID NO: 54986 - protein, 34 aa, Artificial Sequence
  Description of Artificial Sequence: Synthetic polypeptide
TEECIRTTNPVATEQWGSVVPSCTNLQYRGGNRM

SEQ ID NO: 54987 - protein, 34 aa, Artificial Sequence
  Description of Artificial Sequence: Synthetic polypeptide
TEECIRTTNPVATEQWGSVVPSTNLSQTRTGNRM

SEQ ID NO: 54988 - protein, 30 aa, Artificial Sequence
  Description of Artificial Sequence: Synthetic polypeptide
TEECIRTTNPVATEQYGCVCSNTNLAYLNQ

SEQ ID NO: 54989 - protein, 29 aa, Artificial Sequence
  Description of Artificial Sequence: Synthetic peptide
TEECIRTTNPVATEQYGCVCSTNHANLNA

SEQ ID NO: 54990 - protein, 30 aa, Artificial Sequence
  Description of Artificial Sequence: Synthetic polypeptide
TEECIRCTNPVATEQYGSVSWNFERIGSNQ

SEQ ID NO: 54991 - protein, 31 aa, Artificial Sequence
  Description of Artificial Sequence: Synthetic polypeptide
TEECIRTTNPVATEQYGCVCSTNLAYLSNRG

SEQ ID NO: 54992 - protein, 31 aa, Artificial Sequence
  Description of Artificial Sequence: Synthetic polypeptide
TEECIRCTNPVATEQYGSTVSCNFSQRGGNL

SEQ ID NO: 54993 - protein, 31 aa, Artificial Sequence
  Description of Artificial Sequence: Synthetic polypeptide
TEECICTTNPVATEQWGSVSCTNLSQSTGNF

SEQ ID NO: 54994 - protein, 31 aa, Artificial Sequence
  Description of Artificial Sequence: Synthetic polypeptide
TEEAEIRTTNPVAYEQWGSVSTNLQDGGDQQ

SEQ ID NO: 54995 - protein, 31 aa, Artificial Sequence
  Description of Artificial Sequence: Synthetic polypeptide
DEEEIRTTNPVATEQYGCVCSTEHQGGSDFM

SEQ ID NO: 54996 - protein, 32 aa, Artificial Sequence
  Description of Artificial Sequence: Synthetic polypeptide
DEEEIRTTNPVATEQYGCVCSTEHQGFGSNTT

SEQ ID NO: 54997 - protein, 33 aa, Artificial Sequence
  Description of Artificial Sequence: Synthetic polypeptide
DEEEIRTTNPVATEQYGCVCSTEHQFFGSNTRS

SEQ ID NO: 54998 - protein, 32 aa, Artificial Sequence
  Description of Artificial Sequence: Synthetic polypeptide
DEEEIRTTNPVATEQYGCVCSTEHQENFGNQN

SEQ ID NO: 54999 - protein, 32 aa, Artificial Sequence
  Description of Artificial Sequence: Synthetic polypeptide
TEEAEIRTTNPVAYEQWGSVSTNLQDGGEGRE

SEQ ID NO: 55000 - protein, 33 aa, Artificial Sequence
  Description of Artificial Sequence: Synthetic polypeptide
TEEAEIRTTNPVAYEQWGSVSTNLQDGNGGGQR

SEQ ID NO: 55001 - protein, 32 aa, Artificial Sequence
  Description of Artificial Sequence: Synthetic polypeptide
TEEAEIRTTNPVAYEQWGSVSTNLQMGGDEQR

SEQ ID NO: 55002 - protein, 32 aa, Artificial Sequence
  Description of Artificial Sequence: Synthetic polypeptide
TEEAIRTTNPVATEQYGSVPSCTNEQSQTGER

SEQ ID NO: 55003 - protein, 33 aa, Artificial Sequence
  Description of Artificial Sequence: Synthetic polypeptide
TEEAIRTTNPVATEQYGSVSTNEQSQQTGGNNR

SEQ ID NO: 55004 - protein, 32 aa, Artificial Sequence
  Description of Artificial Sequence: Synthetic polypeptide
DEEEIRTTNPVATEQYGCVCSTEHQEGFSNQA

SEQ ID NO: 55005 - protein, 30 aa, Artificial Sequence
  Description of Artificial Sequence: Synthetic polypeptide
TEECIATTNPVATEQYGSVSWNEVSGDLNR

SEQ ID NO: 55006 - protein, 31 aa, Artificial Sequence
  Description of Artificial Sequence: Synthetic polypeptide
DEEEIRTTNPVATEQYGCVCSTEHAFFGNQS

SEQ ID NO: 55007 - protein, 29 aa, Artificial Sequence
  Description of Artificial Sequence: Synthetic peptide
TEECIATTNPVAYEQYGTVSKNLEDTGNR

SEQ ID NO: 55008 - protein, 29 aa, Artificial Sequence
  Description of Artificial Sequence: Synthetic peptide
TEECIATVNPVAYEPYGSVSDNLERGGNR

SEQ ID NO: 55009 - protein, 31 aa, Artificial Sequence
  Description of Artificial Sequence: Synthetic polypeptide
TEECICTTNPVATEQYGSVVSMNSSQRGNNS

SEQ ID NO: 55010 - protein, 31 aa, Artificial Sequence
  Description of Artificial Sequence: Synthetic polypeptide
DEEEIRTTNPVATEQYGCVCSTEHQHFGSET

SEQ ID NO: 55011 - protein, 32 aa, Artificial Sequence
  Description of Artificial Sequence: Synthetic polypeptide
TEECIRTTNPVATEQYGKTVSCTPNASQDGNR

SEQ ID NO: 55012 - protein, 32 aa, Artificial Sequence
  Description of Artificial Sequence: Synthetic polypeptide
DEEEIRTTNPVATEQYGCVCSTEEHQRFNSNQ

SEQ ID NO: 55013 - protein, 31 aa, Artificial Sequence
  Description of Artificial Sequence: Synthetic polypeptide
DEEEIRTTNPVATEQYGCVCSTATQFGSDQP

SEQ ID NO: 55014 - protein, 32 aa, Artificial Sequence
  Description of Artificial Sequence: Synthetic polypeptide
TEECIRTTNPVATERYGSVSCTNEIQRPPGPR

SEQ ID NO: 55015 - protein, 31 aa, Artificial Sequence
  Description of Artificial Sequence: Synthetic polypeptide
TEECIRTTNPVAYEPYGSVSTPISQDRGGNR

SEQ ID NO: 55016 - protein, 32 aa, Artificial Sequence
  Description of Artificial Sequence: Synthetic polypeptide
DEEEIRTTNPVATEQYGCVCSTAPQGFGSNQS

SEQ ID NO: 55017 - protein, 32 aa, Artificial Sequence
  Description of Artificial Sequence: Synthetic polypeptide
DEEEIRTTNPVATEQYGCVCSTALTNFGSNQM

SEQ ID NO: 55018 - protein, 31 aa, Artificial Sequence
  Description of Artificial Sequence: Synthetic polypeptide
DEEEIRTTNPVATEQYGCVCSTALQNNSDQM

SEQ ID NO: 55019 - protein, 33 aa, Artificial Sequence
  Description of Artificial Sequence: Synthetic polypeptide
DEEEIRTTNPVATEQYGCVCSTALQNFGSDNQS

SEQ ID NO: 55020 - protein, 30 aa, Artificial Sequence
  Description of Artificial Sequence: Synthetic polypeptide
TEECSRTTNPIAYEQYGEVSLTNLQRGNQE

SEQ ID NO: 55021 - protein, 32 aa, Artificial Sequence
  Description of Artificial Sequence: Synthetic polypeptide
DEEEIRTTNPVATEQYGCVCSTALQGFQSNQI

SEQ ID NO: 55022 - protein, 33 aa, Artificial Sequence
  Description of Artificial Sequence: Synthetic polypeptide
DEEEIRTTNPVATEQYGCVCSTALQEHFGSNAS

SEQ ID NO: 55023 - protein, 33 aa, Artificial Sequence
  Description of Artificial Sequence: Synthetic polypeptide
DEEEIRTTNPVATEQYGCVCSTALIRFGSNNQS

SEQ ID NO: 55024 - protein, 31 aa, Artificial Sequence
  Description of Artificial Sequence: Synthetic polypeptide
DEEEIRTTNPVATEQYGCVCSTAHQNIGSEQ

SEQ ID NO: 55025 - protein, 31 aa, Artificial Sequence
  Description of Artificial Sequence: Synthetic polypeptide
TEEEIACTNPIATEQYGSTVSENLSMRGGNR

SEQ ID NO: 55026 - protein, 32 aa, Artificial Sequence
  Description of Artificial Sequence: Synthetic polypeptide
DEEEIRTTNPVATEQYGCVCSTAHQENFGSNQ

SEQ ID NO: 55027 - protein, 32 aa, Artificial Sequence
  Description of Artificial Sequence: Synthetic polypeptide
DEEEIRTTNPVATEQYGCVCSTAHNQRGSEQS

SEQ ID NO: 55028 - protein, 33 aa, Artificial Sequence
  Description of Artificial Sequence: Synthetic polypeptide
DEEEIRTTNPVATEQYGCVCSTDDLQNFGSENQ

SEQ ID NO: 55029 - protein, 32 aa, Artificial Sequence
  Description of Artificial Sequence: Synthetic polypeptide
TEECIRTTNPVATEQYGMTVSTNPSQDTGGNR

SEQ ID NO: 55030 - protein, 32 aa, Artificial Sequence
  Description of Artificial Sequence: Synthetic polypeptide
TEECIRTTNPVATEQYGSYVQTCNLVAGGNRN

SEQ ID NO: 55031 - protein, 32 aa, Artificial Sequence
  Description of Artificial Sequence: Synthetic polypeptide
DEEEIRTTNPVATEQYGCVCSTEALQFGSDQN

SEQ ID NO: 55032 - protein, 34 aa, Artificial Sequence
  Description of Artificial Sequence: Synthetic polypeptide
TEECIRTTNPVATEQYGQSVPSLTNALSQQVGNR

SEQ ID NO: 55033 - protein, 31 aa, Artificial Sequence
  Description of Artificial Sequence: Synthetic polypeptide
TEECIRTTNPVATEQYGSVCSTNLIEYLSNQ

SEQ ID NO: 55034 - protein, 33 aa, Artificial Sequence
  Description of Artificial Sequence: Synthetic polypeptide
TEECIRTTNPVATEQYGSVPSVTNLPQRTVDNP

SEQ ID NO: 55035 - protein, 31 aa, Artificial Sequence
  Description of Artificial Sequence: Synthetic polypeptide
DEEEIRTTNPVATEQYGCVCSTEEHQGGSQQ

SEQ ID NO: 55036 - protein, 32 aa, Artificial Sequence
  Description of Artificial Sequence: Synthetic polypeptide
DEEEIRTTNPVATEQYGCVCSTEDQRFGSDDP

SEQ ID NO: 55037 - protein, 31 aa, Artificial Sequence
  Description of Artificial Sequence: Synthetic polypeptide
DEEEIRTTNPVATEQYGCVCSTEDQHGSDQP

SEQ ID NO: 55038 - protein, 31 aa, Artificial Sequence
  Description of Artificial Sequence: Synthetic polypeptide
DEEEIRTTNPVATEQYGCVCSTEDQFPSNQY

SEQ ID NO: 55039 - protein, 32 aa, Artificial Sequence
  Description of Artificial Sequence: Synthetic polypeptide
DEEEIRTTNPVATEQYGCVCSTEDPQERGSEQ

SEQ ID NO: 55040 - protein, 33 aa, Artificial Sequence
  Description of Artificial Sequence: Synthetic polypeptide
DEEEIRTTNPVATEQYGCVCSTEDLQRFGSDQT

SEQ ID NO: 55041 - protein, 33 aa, Artificial Sequence
  Description of Artificial Sequence: Synthetic polypeptide
DEEEIRTTNPVATEQYGCVCSTEDLQNGSNDQV

SEQ ID NO: 55042 - protein, 33 aa, Artificial Sequence
  Description of Artificial Sequence: Synthetic polypeptide
DEEEIRTTNPVATEQYGCVCSTEDLQHGSENQD

SEQ ID NO: 55043 - protein, 32 aa, Artificial Sequence
  Description of Artificial Sequence: Synthetic polypeptide
DEEEIRTTNPVATEQYGCVCSTEDLQHFGSEV

SEQ ID NO: 55044 - protein, 30 aa, Artificial Sequence
  Description of Artificial Sequence: Synthetic polypeptide
TEECIRTTNPVATEQYGSVSTNLAYFLSEQ

SEQ ID NO: 55045 - protein, 32 aa, Artificial Sequence
  Description of Artificial Sequence: Synthetic polypeptide
DEEEIRTTNPVATEQYGCVCSTEDLEYGSNDG

SEQ ID NO: 55046 - protein, 32 aa, Artificial Sequence
  Description of Artificial Sequence: Synthetic polypeptide
DEEEIRTTNPVATEQYGCVCSTEDHQNGSNAN

SEQ ID NO: 55047 - protein, 31 aa, Artificial Sequence
  Description of Artificial Sequence: Synthetic polypeptide
DEEEIRTTNPVATEQYGCVCSTDPQYFGSEQ

SEQ ID NO: 55048 - protein, 31 aa, Artificial Sequence
  Description of Artificial Sequence: Synthetic polypeptide
TEDEITTTNPVATEQYGQTVSTNLHREVNRA

SEQ ID NO: 55049 - protein, 31 aa, Artificial Sequence
  Description of Artificial Sequence: Synthetic polypeptide
DEEEIRTTNPVATEQYGCVCSTEHQHNSNAS

SEQ ID NO: 55050 - protein, 32 aa, Artificial Sequence
  Description of Artificial Sequence: Synthetic polypeptide
DEEEIRTTNPVATEQYGCVCSTEHQHNSNNRT

SEQ ID NO: 55051 - protein, 32 aa, Artificial Sequence
  Description of Artificial Sequence: Synthetic polypeptide
DEEEIRTTNPVATEQYGCVCSTENHQYFGSEQ

SEQ ID NO: 55052 - protein, 30 aa, Artificial Sequence
  Description of Artificial Sequence: Synthetic polypeptide
TDEEIRTTNPVATDQYGSVSTTLQTVNINS

SEQ ID NO: 55053 - protein, 33 aa, Artificial Sequence
  Description of Artificial Sequence: Synthetic polypeptide
DEEEIRTTNPVATEQYGCVCSTENHQRFGSQAV

SEQ ID NO: 55054 - protein, 33 aa, Artificial Sequence
  Description of Artificial Sequence: Synthetic polypeptide
DEEEIRTTNPVATEQYGCVCSTENHQRFGSDQM

SEQ ID NO: 55055 - protein, 32 aa, Artificial Sequence
  Description of Artificial Sequence: Synthetic polypeptide
DEEEIRTTNPVATEQYGCVCSTENHQNFGQQS

SEQ ID NO: 55056 - protein, 33 aa, Artificial Sequence
  Description of Artificial Sequence: Synthetic polypeptide
DEEEIRTTNPVATEQYGCVCSTENHQHGNSDQL

SEQ ID NO: 55057 - protein, 33 aa, Artificial Sequence
  Description of Artificial Sequence: Synthetic polypeptide
DEEEIRTTNPVATEQYGCVCSTENHQEYGSNQS

SEQ ID NO: 55058 - protein, 29 aa, Artificial Sequence
  Description of Artificial Sequence: Synthetic peptide
TDEEIRTTNPVATEQWGAVSTNQEEEGND

SEQ ID NO: 55059 - protein, 31 aa, Artificial Sequence
  Description of Artificial Sequence: Synthetic polypeptide
TEACIRTTNPVATEQYGSVVSTNLSGNVGPR

SEQ ID NO: 55060 - protein, 32 aa, Artificial Sequence
  Description of Artificial Sequence: Synthetic polypeptide
TEAEIKTTNPVATEQYGSTVNTNLSQRPGGNS

SEQ ID NO: 55061 - protein, 32 aa, Artificial Sequence
  Description of Artificial Sequence: Synthetic polypeptide
DEEEIRTTNPVATEQYGCVCSTEMLQNFGEQS

SEQ ID NO: 55062 - protein, 32 aa, Artificial Sequence
  Description of Artificial Sequence: Synthetic polypeptide
DEEEIRTTNPVATEQYGCVCSTEMHQNGGSER

SEQ ID NO: 55063 - protein, 31 aa, Artificial Sequence
  Description of Artificial Sequence: Synthetic polypeptide
DEEEIRTTNPVATEQYGCVCSTELQYISETQ

SEQ ID NO: 55064 - protein, 31 aa, Artificial Sequence
  Description of Artificial Sequence: Synthetic polypeptide
TEAEIRTTNPVATEHYGSVVSTNLSTDVGPR

SEQ ID NO: 55065 - protein, 32 aa, Artificial Sequence
  Description of Artificial Sequence: Synthetic polypeptide
TEAEIRTTNPVATEQWGKVSTNLSQRPPGNNM

SEQ ID NO: 55066 - protein, 33 aa, Artificial Sequence
  Description of Artificial Sequence: Synthetic polypeptide
DEEEIRTTNPVATEQYGCVCSTENHQYFGSNDF

SEQ ID NO: 55067 - protein, 33 aa, Artificial Sequence
  Description of Artificial Sequence: Synthetic polypeptide
TEAEIRTTNPVATEQYGCSVACTNLSQRGGNHE

SEQ ID NO: 55068 - protein, 33 aa, Artificial Sequence
  Description of Artificial Sequence: Synthetic polypeptide
DEEEIRTTNPVATEQYGCVCSTENHQYFGSNDG

SEQ ID NO: 55069 - protein, 32 aa, Artificial Sequence
  Description of Artificial Sequence: Synthetic polypeptide
DEEEIRTTNPVATEQYGCVCSTENHQYGSDQM

SEQ ID NO: 55070 - protein, 34 aa, Artificial Sequence
  Description of Artificial Sequence: Synthetic polypeptide
DEEEIRTTNPVATEQYGCVCSTENLQEGGSNNQD

SEQ ID NO: 55071 - protein, 31 aa, Artificial Sequence
  Description of Artificial Sequence: Synthetic polypeptide
SSEEIRTTNPVAYHQYGSVSTHELSQRTGND

SEQ ID NO: 55072 - protein, 30 aa, Artificial Sequence
  Description of Artificial Sequence: Synthetic polypeptide
SSSEIRCTNPVATEQYGSVFTNLSQHGGNQ

SEQ ID NO: 55073 - protein, 31 aa, Artificial Sequence
  Description of Artificial Sequence: Synthetic polypeptide
TAEEEIATTNPVAYEQWGSVSTNLQGGGDAR

SEQ ID NO: 55074 - protein, 31 aa, Artificial Sequence
  Description of Artificial Sequence: Synthetic polypeptide
TAEEEIATTNPVAYEQWGSVSTNLQGGGDER

SEQ ID NO: 55075 - protein, 34 aa, Artificial Sequence
  Description of Artificial Sequence: Synthetic polypeptide
DEEEIRTTNPVATEQYGCVCSTENLQEGFGSNTD

SEQ ID NO: 55076 - protein, 31 aa, Artificial Sequence
  Description of Artificial Sequence: Synthetic polypeptide
TAEEEIATTNPVAYEQYGSVSTNLQGGGDDA

SEQ ID NO: 55077 - protein, 33 aa, Artificial Sequence
  Description of Artificial Sequence: Synthetic polypeptide
DEEEIRTTNPVATEQYGCVCSTENLQCFGSEQQ

SEQ ID NO: 55078 - protein, 34 aa, Artificial Sequence
  Description of Artificial Sequence: Synthetic polypeptide
DEEEIRTTNPVATEQYGCVCSTENLNQYFGSNQA

SEQ ID NO: 55079 - protein, 33 aa, Artificial Sequence
  Description of Artificial Sequence: Synthetic polypeptide
DEEEIRTTNPVATEQYGCVCSTENLNQNGSEQI

SEQ ID NO: 55080 - protein, 31 aa, Artificial Sequence
  Description of Artificial Sequence: Synthetic polypeptide
TAEEEIATTNPVAYEQYGTVSTNLQGDGDDR

SEQ ID NO: 55081 - protein, 33 aa, Artificial Sequence
  Description of Artificial Sequence: Synthetic polypeptide
DEEEIRTTNPVATEQYGCVCSTENLANSGSNQY

SEQ ID NO: 55082 - protein, 32 aa, Artificial Sequence
  Description of Artificial Sequence: Synthetic polypeptide
TAEEIRTTNPVATEPYGSTVCNTNSAQRGNNR

SEQ ID NO: 55083 - protein, 31 aa, Artificial Sequence
  Description of Artificial Sequence: Synthetic polypeptide
TCEEIRSTNPVATEQYGSVSTNQQAHNGQRA

SEQ ID NO: 55084 - protein, 29 aa, Artificial Sequence
  Description of Artificial Sequence: Synthetic peptide
TDECIRTTNPVATEQYGTVSTNHQGNDNL

SEQ ID NO: 55085 - protein, 30 aa, Artificial Sequence
  Description of Artificial Sequence: Synthetic polypeptide
TDEEIRTTNPVATDQYGSVSTTLQTVGIFD

SEQ ID NO: 55086 - protein, 32 aa, Artificial Sequence
  Description of Artificial Sequence: Synthetic polypeptide
DEEEIRTTNPVATEQYGCVCSTELQNFNSVDY

SEQ ID NO: 55087 - protein, 33 aa, Artificial Sequence
  Description of Artificial Sequence: Synthetic polypeptide
DEEEIRTTNPVATEQYGCVCSTELQNFGSNFQS

SEQ ID NO: 55088 - protein, 33 aa, Artificial Sequence
  Description of Artificial Sequence: Synthetic polypeptide
DEEEIRTTNPVATEQYGCVCSTELQNFGQNNQP

SEQ ID NO: 55089 - protein, 33 aa, Artificial Sequence
  Description of Artificial Sequence: Synthetic polypeptide
DEEEIRTTNPVATEQYGCVCSTELNQNFGSNQM

SEQ ID NO: 55090 - protein, 33 aa, Artificial Sequence
  Description of Artificial Sequence: Synthetic polypeptide
DEEEIRTTNPVATEQYGCVCSTELNQGFGSNAM

SEQ ID NO: 55091 - protein, 28 aa, Artificial Sequence
  Description of Artificial Sequence: Synthetic peptide
TEAGIATTNPVATEQYGSVAMNLNMLNR

SEQ ID NO: 55092 - protein, 31 aa, Artificial Sequence
  Description of Artificial Sequence: Synthetic polypeptide
DEEEIRTTNPVATEQYGCVCSTELIHNSNQA

SEQ ID NO: 55093 - protein, 32 aa, Artificial Sequence
  Description of Artificial Sequence: Synthetic polypeptide
DEEEIRTTNPVATEQYGCVCSTELIESGSNQV

SEQ ID NO: 55094 - protein, 30 aa, Artificial Sequence
  Description of Artificial Sequence: Synthetic polypeptide
TEDEIRTTNPVATEHYGMVSTNLQAEGLMP

SEQ ID NO: 55095 - protein, 33 aa, Artificial Sequence
  Description of Artificial Sequence: Synthetic polypeptide
TEDEIRTTNPVATEQWGSVSTNLSQRPPGNNNM

SEQ ID NO: 55096 - protein, 31 aa, Artificial Sequence
  Description of Artificial Sequence: Synthetic polypeptide
DEEEIRTTNPVATEQYGCVCSTELEYGSQQY

SEQ ID NO: 55097 - protein, 32 aa, Artificial Sequence
  Description of Artificial Sequence: Synthetic polypeptide
DEEEIRTTNPVATEQYGCVCSTELERFGSETQ

SEQ ID NO: 55098 - protein, 32 aa, Artificial Sequence
  Description of Artificial Sequence: Synthetic polypeptide
DEEEIRTTNPVATEQYGCVCSTELENFGSNTD

SEQ ID NO: 55099 - protein, 33 aa, Artificial Sequence
  Description of Artificial Sequence: Synthetic polypeptide
DEEEIRTTNPVATEQYGCVCSTELDQNGSNTQS

SEQ ID NO: 55100 - protein, 31 aa, Artificial Sequence
  Description of Artificial Sequence: Synthetic polypeptide
DEEEIRTTNPVATEQYGCVCSTELANFNSEQ

SEQ ID NO: 55101 - protein, 31 aa, Artificial Sequence
  Description of Artificial Sequence: Synthetic polypeptide
DEEEIRTTNPVATEQYGCVCSTEHQYGSDDP

SEQ ID NO: 55102 - protein, 31 aa, Artificial Sequence
  Description of Artificial Sequence: Synthetic polypeptide
DEEEIRTTNPVATEQYGCVCSTEHQNFGDQP

SEQ ID NO: 55103 - protein, 32 aa, Artificial Sequence
  Description of Artificial Sequence: Synthetic polypeptide
DEEEIRTTNPVATEQYGCVCSTEHQIIGSNQA

SEQ ID NO: 55104 - protein, 32 aa, Artificial Sequence
  Description of Artificial Sequence: Synthetic polypeptide
DEEEIRTTNPVATEQYGCVCSTELNQNFISNI

SEQ ID NO: 55105 - protein, 32 aa, Artificial Sequence
  Description of Artificial Sequence: Synthetic polypeptide
DEEEIRTTNPVATEQYGCVCSTELNQNGSDQS

SEQ ID NO: 55106 - protein, 32 aa, Artificial Sequence
  Description of Artificial Sequence: Synthetic polypeptide
TEAEISTTNPVATEQYGSTVNCTNLSQRPGNS

SEQ ID NO: 55107 - protein, 32 aa, Artificial Sequence
  Description of Artificial Sequence: Synthetic polypeptide
TEAEIRTTNSVAYDQYGSVVSTNLSQRGGDNR

SEQ ID NO: 55108 - protein, 32 aa, Artificial Sequence
  Description of Artificial Sequence: Synthetic polypeptide
DEEEIRTTNPVATEQYGCVCSTELQNFGDTQP

SEQ ID NO: 55109 - protein, 32 aa, Artificial Sequence
  Description of Artificial Sequence: Synthetic polypeptide
DEEEIRTTNPVATEQYGCVCSTELQHNSDNQS

SEQ ID NO: 55110 - protein, 32 aa, Artificial Sequence
  Description of Artificial Sequence: Synthetic polypeptide
DEEEIRTTNPVATEQYGCVCSTELQHMGSDQM

SEQ ID NO: 55111 - protein, 33 aa, Artificial Sequence
  Description of Artificial Sequence: Synthetic polypeptide
DEEEIRTTNPVATEQYGCVCSTELQHFGSENQV

SEQ ID NO: 55112 - protein, 32 aa, Artificial Sequence
  Description of Artificial Sequence: Synthetic polypeptide
TEAEIRTTNPVATEQYGSVASTNLSTNVGPRT

SEQ ID NO: 55113 - protein, 32 aa, Artificial Sequence
  Description of Artificial Sequence: Synthetic polypeptide
DEEEIRTTNPVATEQYGCVCSTELQGINSNQF

SEQ ID NO: 55114 - protein, 31 aa, Artificial Sequence
  Description of Artificial Sequence: Synthetic polypeptide
TEAEIRTTNPVATEQYGSVVSTNVSTIVGPR

SEQ ID NO: 55115 - protein, 32 aa, Artificial Sequence
  Description of Artificial Sequence: Synthetic polypeptide
DEEEIRTTNPVATEQYGCVCSTAHNQNSGSNQ

SEQ ID NO: 55116 - protein, 32 aa, Artificial Sequence
  Description of Artificial Sequence: Synthetic polypeptide
DEEEIRTTNPVATEQYGCVCSTELQGFNSDQS

SEQ ID NO: 55117 - protein, 33 aa, Artificial Sequence
  Description of Artificial Sequence: Synthetic polypeptide
DEEEIRTTNPVATEQYGCVCSTELQEYFGSNQI

SEQ ID NO: 55118 - protein, 33 aa, Artificial Sequence
  Description of Artificial Sequence: Synthetic polypeptide
DEEEIRTTNPVATEQYGCVCSTELQERFNSQAT

SEQ ID NO: 55119 - protein, 33 aa, Artificial Sequence
  Description of Artificial Sequence: Synthetic polypeptide
DEEEIRTTNPVATEQYGCVCSTELQERFGSDIT

SEQ ID NO: 55120 - protein, 33 aa, Artificial Sequence
  Description of Artificial Sequence: Synthetic polypeptide
DEEEIRTTNPVATEQYGCVCSTELQEHFGSNQA

SEQ ID NO: 55121 - protein, 32 aa, Artificial Sequence
  Description of Artificial Sequence: Synthetic polypeptide
TEAEIRTTNPVAYEQYGEVSTNLSQRPGGNYA

SEQ ID NO: 55122 - protein, 31 aa, Artificial Sequence
  Description of Artificial Sequence: Synthetic polypeptide
TEAEIRTTNPVAYEQYGSVVWTNALSQIGSR

SEQ ID NO: 55123 - protein, 33 aa, Artificial Sequence
  Description of Artificial Sequence: Synthetic polypeptide
DEEEIRTTNPVATEQYGCVCSTELNQYFGSNQM

SEQ ID NO: 55124 - protein, 33 aa, Artificial Sequence
  Description of Artificial Sequence: Synthetic polypeptide
DEEEIRTTNPVATEQYGCVCSTELQFFGSVNQP

SEQ ID NO: 55125 - protein, 31 aa, Artificial Sequence
  Description of Artificial Sequence: Synthetic polypeptide
DEEEIRTTNPVATEQYGCVCSSNTQNNSNQM

SEQ ID NO: 55126 - protein, 32 aa, Artificial Sequence
  Description of Artificial Sequence: Synthetic polypeptide
DEEEIRTTNPVATEQYGCVCSSNPQSFGSNQE

SEQ ID NO: 55127 - protein, 32 aa, Artificial Sequence
  Description of Artificial Sequence: Synthetic polypeptide
DEEEIRTTNPVATEQYGCVCSSNLQSSGSEQG

SEQ ID NO: 55128 - protein, 32 aa, Artificial Sequence
  Description of Artificial Sequence: Synthetic polypeptide
DEEEIRTTNPVATEQYGCVCSMTEHQSGSENQ

SEQ ID NO: 55129 - protein, 33 aa, Artificial Sequence
  Description of Artificial Sequence: Synthetic polypeptide
DEEEIRTTNPVATEQYGCVCSMSNLQNFGSNAA

SEQ ID NO: 55130 - protein, 31 aa, Artificial Sequence
  Description of Artificial Sequence: Synthetic polypeptide
TEEEICTTNPVAYEQYGTVSTNDSQPPGTNR

SEQ ID NO: 55131 - protein, 33 aa, Artificial Sequence
  Description of Artificial Sequence: Synthetic polypeptide
TEEEIGTTNPVATEAYGSTVPSTNLSERGGNTR

SEQ ID NO: 55132 - protein, 33 aa, Artificial Sequence
  Description of Artificial Sequence: Synthetic polypeptide
DEEEIRTTNPVATEQYGCVCSDTNDHQGGSNQV

SEQ ID NO: 55133 - protein, 33 aa, Artificial Sequence
  Description of Artificial Sequence: Synthetic polypeptide
DEEEIRTTNPVATEQYGCVCSDTGNHQGFGSNQ

SEQ ID NO: 55134 - protein, 29 aa, Artificial Sequence
  Description of Artificial Sequence: Synthetic peptide
TEEEIGTTNPVATEPYGQVVSTIDQPGNI

SEQ ID NO: 55135 - protein, 33 aa, Artificial Sequence
  Description of Artificial Sequence: Synthetic polypeptide
TEEEIKTTNPVATEQYGSVSCTNLSQESTVNQR

SEQ ID NO: 55136 - protein, 33 aa, Artificial Sequence
  Description of Artificial Sequence: Synthetic polypeptide
TEEEINTTNPVATEPYGSTVPSTNLSGRGTNER

SEQ ID NO: 55137 - protein, 33 aa, Artificial Sequence
  Description of Artificial Sequence: Synthetic polypeptide
TEEEINTTNPVAYEQYGSTVPSCTNLIDRGNNR

SEQ ID NO: 55138 - protein, 31 aa, Artificial Sequence
  Description of Artificial Sequence: Synthetic polypeptide
TEEEIRCTNPIATEAYGSVSENLSMRGGNYR

SEQ ID NO: 55139 - protein, 31 aa, Artificial Sequence
  Description of Artificial Sequence: Synthetic polypeptide
DEEEIRTTNPVATEQYGCVCQTELQNFGEQS

SEQ ID NO: 55140 - protein, 31 aa, Artificial Sequence
  Description of Artificial Sequence: Synthetic polypeptide
TEEEIRCTNPIATEPYGSTVSCENLSMRGNR

SEQ ID NO: 55141 - protein, 33 aa, Artificial Sequence
  Description of Artificial Sequence: Synthetic polypeptide
DEEEIRTTNPVATEQYGCVCPTTNLQNFGSNQA

SEQ ID NO: 55142 - protein, 31 aa, Artificial Sequence
  Description of Artificial Sequence: Synthetic polypeptide
TEEEIRCTNPIATEPYGSVVSENLSMRGGNR

SEQ ID NO: 55143 - protein, 32 aa, Artificial Sequence
  Description of Artificial Sequence: Synthetic polypeptide
DEEEIRTTNPVATEQYGCVCSMTGELQFGSQQ

SEQ ID NO: 55144 - protein, 31 aa, Artificial Sequence
  Description of Artificial Sequence: Synthetic polypeptide
TEEEIRCTNPIATEQWGSVSENLSMRGGNNR

SEQ ID NO: 55145 - protein, 32 aa, Artificial Sequence
  Description of Artificial Sequence: Synthetic polypeptide
DEEEIRTTNPVATEQYGCVCSMTNHQNFGQQA

SEQ ID NO: 55146 - protein, 32 aa, Artificial Sequence
  Description of Artificial Sequence: Synthetic polypeptide
TEEEICTTNPVATEQYGSVSYTNADSQPPVNR

SEQ ID NO: 55147 - protein, 33 aa, Artificial Sequence
  Description of Artificial Sequence: Synthetic polypeptide
DEEEIRTTNPVATEQYGCVCSNTELQHFGSNAE

SEQ ID NO: 55148 - protein, 33 aa, Artificial Sequence
  Description of Artificial Sequence: Synthetic polypeptide
DEEEIRTTNPVATEQYGCVCSNTELQERGSEAF

SEQ ID NO: 55149 - protein, 32 aa, Artificial Sequence
  Description of Artificial Sequence: Synthetic polypeptide
TEEEIATTNPVAYESYGSVSTNELSQRGGNQS

SEQ ID NO: 55150 - protein, 33 aa, Artificial Sequence
  Description of Artificial Sequence: Synthetic polypeptide
DEEEIRTTNPVATEQYGCVCSNTELQENGSNII

SEQ ID NO: 55151 - protein, 33 aa, Artificial Sequence
  Description of Artificial Sequence: Synthetic polypeptide
DEEEIRTTNPVATEQYGCVCSNTELHQGFGSNQ

SEQ ID NO: 55152 - protein, 28 aa, Artificial Sequence
  Description of Artificial Sequence: Synthetic peptide
TEEEIAVVNPVCTEQYGVVSVNLQSGNQ

SEQ ID NO: 55153 - protein, 32 aa, Artificial Sequence
  Description of Artificial Sequence: Synthetic polypeptide
DEEEIRTTNPVATEQYGCVCSNTEHQGGSNQV

SEQ ID NO: 55154 - protein, 33 aa, Artificial Sequence
  Description of Artificial Sequence: Synthetic polypeptide
DEEEIRTTNPVATEQYGCVCSNTEELTRGSNQG

SEQ ID NO: 55155 - protein, 32 aa, Artificial Sequence
  Description of Artificial Sequence: Synthetic polypeptide
TEEEICTTNPVATEHYGSTVCATALSQRGGNR

SEQ ID NO: 55156 - protein, 32 aa, Artificial Sequence
  Description of Artificial Sequence: Synthetic polypeptide
DEEEIRTTNPVATEQYGCVCSNTALQYGSEQS

SEQ ID NO: 55157 - protein, 33 aa, Artificial Sequence
  Description of Artificial Sequence: Synthetic polypeptide
DEEEIRTTNPVATEQYGCVCSNTALQRFISNQS

SEQ ID NO: 55158 - protein, 32 aa, Artificial Sequence
  Description of Artificial Sequence: Synthetic polypeptide
DEEEIRTTNPVATEQYGCVCSNTALINFGSNQ

SEQ ID NO: 55159 - protein, 33 aa, Artificial Sequence
  Description of Artificial Sequence: Synthetic polypeptide
TEEEICTTNPVATEQYGSTVPSCTNLTRVNNRY

SEQ ID NO: 55160 - protein, 32 aa, Artificial Sequence
  Description of Artificial Sequence: Synthetic polypeptide
TEEEICTTNPVATEQYGSVSCTNDSQPPGTSR

SEQ ID NO: 55161 - protein, 33 aa, Artificial Sequence
  Description of Artificial Sequence: Synthetic polypeptide
DEEEIRTTNPVATEQYGCVCSMTYLQRFNSDQA

SEQ ID NO: 55162 - protein, 32 aa, Artificial Sequence
  Description of Artificial Sequence: Synthetic polypeptide
TEEEICTTNPVATERYGSTVSCTNDSQPPGNR

SEQ ID NO: 55163 - protein, 32 aa, Artificial Sequence
  Description of Artificial Sequence: Synthetic polypeptide
TEEEIRCTNPIATEQYGSVSCENELSMRVGNR

SEQ ID NO: 55164 - protein, 32 aa, Artificial Sequence
  Description of Artificial Sequence: Synthetic polypeptide
DEEEIRTTNPVATEQYGCVCGTNLQNFGSEIM

SEQ ID NO: 55165 - protein, 33 aa, Artificial Sequence
  Description of Artificial Sequence: Synthetic polypeptide
DEEEIRTTNPVATEQYGCVCGTNLQEGFGSNAA

SEQ ID NO: 55166 - protein, 33 aa, Artificial Sequence
  Description of Artificial Sequence: Synthetic polypeptide
TEEEIRTTNPVATEAYGSISTNMLSDRPGGNRF

SEQ ID NO: 55167 - protein, 32 aa, Artificial Sequence
  Description of Artificial Sequence: Synthetic polypeptide
TEEEIRTTNPVATEAYGSTVSAGNLSDEFGNR

SEQ ID NO: 55168 - protein, 33 aa, Artificial Sequence
  Description of Artificial Sequence: Synthetic polypeptide
TEEEIRTTNPVATEAYGSVACTLLSQDRGGNTR

SEQ ID NO: 55169 - protein, 31 aa, Artificial Sequence
  Description of Artificial Sequence: Synthetic polypeptide
TEEEIRTTNPVATEAYGSVPWCTALSQIVNR

SEQ ID NO: 55170 - protein, 32 aa, Artificial Sequence
  Description of Artificial Sequence: Synthetic polypeptide
DEEEIRTTNPVATEQYGCVATNDLTQTSNIES

SEQ ID NO: 55171 - protein, 31 aa, Artificial Sequence
  Description of Artificial Sequence: Synthetic polypeptide
DEEEIRTTNPVATEQYGCVATAGGTRDGDDR

SEQ ID NO: 55172 - protein, 33 aa, Artificial Sequence
  Description of Artificial Sequence: Synthetic polypeptide
DEEEIRTTNPVATEQYGCVAMTNLNGAGMNDRH

SEQ ID NO: 55173 - protein, 32 aa, Artificial Sequence
  Description of Artificial Sequence: Synthetic polypeptide
DEEEIRTTNPVATEQYGCVAGTNEHQERDMMR

SEQ ID NO: 55174 - protein, 31 aa, Artificial Sequence
  Description of Artificial Sequence: Synthetic polypeptide
DEEEIRTTNPVATEQYGCVADTWLVQDSQNS

SEQ ID NO: 55175 - protein, 31 aa, Artificial Sequence
  Description of Artificial Sequence: Synthetic polypeptide
DEEEIRTTNPVATEQYGCVADTWLDTRSQNS

SEQ ID NO: 55176 - protein, 32 aa, Artificial Sequence
  Description of Artificial Sequence: Synthetic polypeptide
DEEEIRTTNPVATEQYGCVADTWLDQTRSQER

SEQ ID NO: 55177 - protein, 32 aa, Artificial Sequence
  Description of Artificial Sequence: Synthetic polypeptide
DEEEIRTTNPVATEQYGCVADTWLDQRTSQND

SEQ ID NO: 55178 - protein, 32 aa, Artificial Sequence
  Description of Artificial Sequence: Synthetic polypeptide
TEEEIRTTNPVATEAYGSVSVSGNELSQRVND

SEQ ID NO: 55179 - protein, 32 aa, Artificial Sequence
  Description of Artificial Sequence: Synthetic polypeptide
DEEEIRTTNPVATEQYGCVADTWLAQRSENNP

SEQ ID NO: 55180 - protein, 34 aa, Artificial Sequence
  Description of Artificial Sequence: Synthetic polypeptide
TEEEIRTTNPVATEAYGSVVCSTALSQNRPGGNR

SEQ ID NO: 55181 - protein, 34 aa, Artificial Sequence
  Description of Artificial Sequence: Synthetic polypeptide
TEEEIRTTNPVATEAYGQSVNTGNALSQRGENYR

SEQ ID NO: 55182 - protein, 32 aa, Artificial Sequence
  Description of Artificial Sequence: Synthetic polypeptide
TEEEIRTTNPVATDQWGSVSTNALSVSGTSNR

SEQ ID NO: 55183 - protein, 34 aa, Artificial Sequence
  Description of Artificial Sequence: Synthetic polypeptide
TEEEIRTTNPVATDQWGISVVSTNALSQRPGNNR

SEQ ID NO: 55184 - protein, 33 aa, Artificial Sequence
  Description of Artificial Sequence: Synthetic polypeptide
TEEEIRTTNPVATDQWGEVSCTNALSQRGGNRL

SEQ ID NO: 55185 - protein, 31 aa, Artificial Sequence
  Description of Artificial Sequence: Synthetic polypeptide
DEEEIRTTNPVATEQYGCVCGTNHQNFGSEQ

SEQ ID NO: 55186 - protein, 32 aa, Artificial Sequence
  Description of Artificial Sequence: Synthetic polypeptide
TEEEIRCTNPIATEQYGSVSENELSGRTGGNR

SEQ ID NO: 55187 - protein, 32 aa, Artificial Sequence
  Description of Artificial Sequence: Synthetic polypeptide
DEEEIRTTNPVATEQYGCVAWTTLNRDGMEDR

SEQ ID NO: 55188 - protein, 33 aa, Artificial Sequence
  Description of Artificial Sequence: Synthetic polypeptide
DEEEIRTTNPVATEQYGCVAWTNLNTRDGMNGV

SEQ ID NO: 55189 - protein, 32 aa, Artificial Sequence
  Description of Artificial Sequence: Synthetic polypeptide
TEEEIRCTNPIATEQYGSVSENELSMRGTNNR

SEQ ID NO: 55190 - protein, 32 aa, Artificial Sequence
  Description of Artificial Sequence: Synthetic polypeptide
TEEEIRCTNPIATEQYGSVVSCENALSMRGNR

SEQ ID NO: 55191 - protein, 32 aa, Artificial Sequence
  Description of Artificial Sequence: Synthetic polypeptide
DEEEIRTTNPVATEQYGCVATNSHQERDMIRN

SEQ ID NO: 55192 - protein, 31 aa, Artificial Sequence
  Description of Artificial Sequence: Synthetic polypeptide
TEEEIATTNPVAYEQYGVVSTNMLSQRVNLM

SEQ ID NO: 55193 - protein, 31 aa, Artificial Sequence
  Description of Artificial Sequence: Synthetic polypeptide
TEEEIRCTNPIAYEAYGSVSTENLSMRGGNR

SEQ ID NO: 55194 - protein, 31 aa, Artificial Sequence
  Description of Artificial Sequence: Synthetic polypeptide
TEEEIRCTNPIAYEQYGSTVSENLMRTGGNR

SEQ ID NO: 55195 - protein, 31 aa, Artificial Sequence
  Description of Artificial Sequence: Synthetic polypeptide
TEEEIRCTNPIAYEQYGSVSCENLTRTGGNR

SEQ ID NO: 55196 - protein, 31 aa, Artificial Sequence
  Description of Artificial Sequence: Synthetic polypeptide
TEEEIRCTNPIAYEQYGSVSENLSMRVGNNR

SEQ ID NO: 55197 - protein, 31 aa, Artificial Sequence
  Description of Artificial Sequence: Synthetic polypeptide
TEEEIRCTNPIAYEQYGSVVSENLSMRGTNR

SEQ ID NO: 55198 - protein, 32 aa, Artificial Sequence
  Description of Artificial Sequence: Synthetic polypeptide
TEEEIRTTNPMAYEQYGSVPACTNLSQRGNYA

SEQ ID NO: 55199 - protein, 32 aa, Artificial Sequence
  Description of Artificial Sequence: Synthetic polypeptide
TEEEIRTTNPVATAPYGSVPSTNLSQATGGNV

SEQ ID NO: 55200 - protein, 33 aa, Artificial Sequence
  Description of Artificial Sequence: Synthetic polypeptide
TEEEIRTTNPVATDQDGSVVSTNALSQRTVTNR

SEQ ID NO: 55201 - protein, 30 aa, Artificial Sequence
  Description of Artificial Sequence: Synthetic polypeptide
TEEEIRCTNPIAYEQYGKVSENLSMRGGNR

SEQ ID NO: 55202 - protein, 30 aa, Artificial Sequence
  Description of Artificial Sequence: Synthetic polypeptide
TESEIRTTNPVAYEGYGSVANNLEQRQNRG

SEQ ID NO: 55203 - protein, 34 aa, Artificial Sequence
  Description of Artificial Sequence: Synthetic polypeptide
DEEEIRTTNPVATEQYGCVCSNTELQRFGSNTII

SEQ ID NO: 55204 - protein, 33 aa, Artificial Sequence
  Description of Artificial Sequence: Synthetic polypeptide
TEEEIATTNPVAYEQYGSVVPCTNLQQRGGNRQ

SEQ ID NO: 55205 - protein, 32 aa, Artificial Sequence
  Description of Artificial Sequence: Synthetic polypeptide
DEEEIRTTNPVATEQYGCVCSSELQRGSETQS

SEQ ID NO: 55206 - protein, 32 aa, Artificial Sequence
  Description of Artificial Sequence: Synthetic polypeptide
DEEEIRTTNPVATEQYGCVCSSELQRFGSQQY

SEQ ID NO: 55207 - protein, 32 aa, Artificial Sequence
  Description of Artificial Sequence: Synthetic polypeptide
DEEEIRTTNPVATEQYGCVCSSELQHFGSNQS

SEQ ID NO: 55208 - protein, 31 aa, Artificial Sequence
  Description of Artificial Sequence: Synthetic polypeptide
DEEEIRTTNPVATEQYGCVCSSELQGFNSDQ

SEQ ID NO: 55209 - protein, 31 aa, Artificial Sequence
  Description of Artificial Sequence: Synthetic polypeptide
DEEEIRTTNPVATEQYGCVCSSELIGFGSNQ

SEQ ID NO: 55210 - protein, 31 aa, Artificial Sequence
  Description of Artificial Sequence: Synthetic polypeptide
DEEEIRTTNPVATEQYGCVCSSEHQYGSERY

SEQ ID NO: 55211 - protein, 31 aa, Artificial Sequence
  Description of Artificial Sequence: Synthetic polypeptide
DEEEIRTTNPVATEQYGCVCSSEHQNGSNTA

SEQ ID NO: 55212 - protein, 31 aa, Artificial Sequence
  Description of Artificial Sequence: Synthetic polypeptide
DEEEIRTTNPVATEQYGCVCSSEHQNFGSNV

SEQ ID NO: 55213 - protein, 32 aa, Artificial Sequence
  Description of Artificial Sequence: Synthetic polypeptide
TEEEIATTNPVATEQYGNVSVTMLQDGAGNER

SEQ ID NO: 55214 - protein, 33 aa, Artificial Sequence
  Description of Artificial Sequence: Synthetic polypeptide
DEEEIRTTNPVATEQYGCVCSNWNLQHFGSNQI

SEQ ID NO: 55215 - protein, 33 aa, Artificial Sequence
  Description of Artificial Sequence: Synthetic polypeptide
DEEEIRTTNPVATEQYGCVCSNWNHQNFGSNNR

SEQ ID NO: 55216 - protein, 32 aa, Artificial Sequence
  Description of Artificial Sequence: Synthetic polypeptide
DEEEIRTTNPVATEQYGCVCSNWMNLINGSNQ

SEQ ID NO: 55217 - protein, 32 aa, Artificial Sequence
  Description of Artificial Sequence: Synthetic polypeptide
TEEEIATTNPVATEQYGNVSVTSELQGTVGNR

SEQ ID NO: 55218 - protein, 33 aa, Artificial Sequence
  Description of Artificial Sequence: Synthetic polypeptide
DEEEIRTTNPVATEQYGCVCSNTYLQSFNSERY

SEQ ID NO: 55219 - protein, 34 aa, Artificial Sequence
  Description of Artificial Sequence: Synthetic polypeptide
TEEEIATTNPVATEQYGSTVPSCTNALAERGNNR

SEQ ID NO: 55220 - protein, 31 aa, Artificial Sequence
  Description of Artificial Sequence: Synthetic polypeptide
DEEEIRTTNPVATEQYGCVCSSELQYFNSEQ

SEQ ID NO: 55221 - protein, 34 aa, Artificial Sequence
  Description of Artificial Sequence: Synthetic polypeptide
DEEEIRTTNPVATEQYGCVCSNTPLQERFGSNNQ

SEQ ID NO: 55222 - protein, 32 aa, Artificial Sequence
  Description of Artificial Sequence: Synthetic polypeptide
TEEEIATTNPVATEQYGNVSVTALSQGTGNNR

SEQ ID NO: 55223 - protein, 33 aa, Artificial Sequence
  Description of Artificial Sequence: Synthetic polypeptide
DEEEIRTTNPVATEQYGCVCSSENLQFFGSNQS

SEQ ID NO: 55224 - protein, 31 aa, Artificial Sequence
  Description of Artificial Sequence: Synthetic polypeptide
DEEEIRTTNPVATEQYGCVCSSNLQNNSEQA

SEQ ID NO: 55225 - protein, 31 aa, Artificial Sequence
  Description of Artificial Sequence: Synthetic polypeptide
TEEEIACTNPVATEQYGSVATNLQAPGHNDH

SEQ ID NO: 55226 - protein, 32 aa, Artificial Sequence
  Description of Artificial Sequence: Synthetic polypeptide
DEEEIRTTNPVATEQYGCVCSSNLQNFGSEQY

SEQ ID NO: 55227 - protein, 32 aa, Artificial Sequence
  Description of Artificial Sequence: Synthetic polypeptide
DEEEIRTTNPVATEQYGCVCSSNLQFFISNDA

SEQ ID NO: 55228 - protein, 28 aa, Artificial Sequence
  Description of Artificial Sequence: Synthetic peptide
TEEEIASVNPVCTEQYGVVSDNLQSGNQ

SEQ ID NO: 55229 - protein, 29 aa, Artificial Sequence
  Description of Artificial Sequence: Synthetic peptide
TEEEIASVNPVCTEQYGVVSTDNLQPGNQ

SEQ ID NO: 55230 - protein, 32 aa, Artificial Sequence
  Description of Artificial Sequence: Synthetic polypeptide
DEEEIRTTNPVATEQYGCVCSSNHQRFGSEIY

SEQ ID NO: 55231 - protein, 32 aa, Artificial Sequence
  Description of Artificial Sequence: Synthetic polypeptide
DEEEIRTTNPVATEQYGCVCSSNHQNFGSNQM

SEQ ID NO: 55232 - protein, 31 aa, Artificial Sequence
  Description of Artificial Sequence: Synthetic polypeptide
TEEEIATTNPVATEQWGSTVPSLNLQFPGNE

SEQ ID NO: 55233 - protein, 31 aa, Artificial Sequence
  Description of Artificial Sequence: Synthetic polypeptide
DEEEIRTTNPVATEQYGCVCSSNDQNGSDQP

SEQ ID NO: 55234 - protein, 32 aa, Artificial Sequence
  Description of Artificial Sequence: Synthetic polypeptide
DEEEIRTTNPVATEQYGCVCSSGNTQFFGSER

SEQ ID NO: 55235 - protein, 33 aa, Artificial Sequence
  Description of Artificial Sequence: Synthetic polypeptide
DEEEIRTTNPVATEQYGCVCSSGNLQRFGSDQY

SEQ ID NO: 55236 - protein, 33 aa, Artificial Sequence
  Description of Artificial Sequence: Synthetic polypeptide
DEEEIRTTNPVATEQYGCVCSSGNLQGFGSNAA

SEQ ID NO: 55237 - protein, 33 aa, Artificial Sequence
  Description of Artificial Sequence: Synthetic polypeptide
DEEEIRTTNPVATEQYGCVCSSGNLQFFGSNQQ

SEQ ID NO: 55238 - protein, 31 aa, Artificial Sequence
  Description of Artificial Sequence: Synthetic polypeptide
DEEEIRTTNPVATEQYGCVCSSGELQNNSNA

SEQ ID NO: 55239 - protein, 32 aa, Artificial Sequence
  Description of Artificial Sequence: Synthetic polypeptide
DEEEIRTTNPVATEQYGCVCSSENLQFFGSEQ

SEQ ID NO: 55240 - protein, 33 aa, Artificial Sequence
  Description of Artificial Sequence: Synthetic polypeptide
DEEEIRTTNPVATEQYGCVCSNTPLQEFGSNQE

SEQ ID NO: 55241 - protein, 33 aa, Artificial Sequence
  Description of Artificial Sequence: Synthetic polypeptide
TEEEIATTNPVATEQYGSTVPSCTNALEGGNER

SEQ ID NO: 55242 - protein, 32 aa, Artificial Sequence
  Description of Artificial Sequence: Synthetic polypeptide
DEEEIRTTNPVATEQYGCVCSNTNPQNNSNQM

SEQ ID NO: 55243 - protein, 33 aa, Artificial Sequence
  Description of Artificial Sequence: Synthetic polypeptide
DEEEIRTTNPVATEQYGCVCSNTNDQRFGSQQS

SEQ ID NO: 55244 - protein, 32 aa, Artificial Sequence
  Description of Artificial Sequence: Synthetic polypeptide
DEEEIRTTNPVATEQYGCVCSNTNDQNGSDQI

SEQ ID NO: 55245 - protein, 31 aa, Artificial Sequence
  Description of Artificial Sequence: Synthetic polypeptide
TEEEIATTNPVAYEQYGNVSVTSLQGTGGNR

SEQ ID NO: 55246 - protein, 34 aa, Artificial Sequence
  Description of Artificial Sequence: Synthetic polypeptide
DEEEIRTTNPVATEQYGCVCSNTNDLQRFGSIQS

SEQ ID NO: 55247 - protein, 31 aa, Artificial Sequence
  Description of Artificial Sequence: Synthetic polypeptide
TEEEIATTNPVAYEQYGNVSVTVALSQGGNR

SEQ ID NO: 55248 - protein, 33 aa, Artificial Sequence
  Description of Artificial Sequence: Synthetic polypeptide
DEEEIRTTNPVATEQYGCVCSNTMNLQSGSEQA

SEQ ID NO: 55249 - protein, 34 aa, Artificial Sequence
  Description of Artificial Sequence: Synthetic polypeptide
DEEEIRTTNPVATEQYGCVCSNTMNLQNFGSNQA

SEQ ID NO: 55250 - protein, 33 aa, Artificial Sequence
  Description of Artificial Sequence: Synthetic polypeptide
TEEEIATTNPVAYEQYGQSTVPSCTNLVRGNER

SEQ ID NO: 55251 - protein, 33 aa, Artificial Sequence
  Description of Artificial Sequence: Synthetic polypeptide
TEEEIATTNPVAYEQYGSTVPCTNLSQIRGNRQ

SEQ ID NO: 55252 - protein, 34 aa, Artificial Sequence
  Description of Artificial Sequence: Synthetic polypeptide
DEEEIRTTNPVATEQYGCVCSNTGNLQGFGSNND

SEQ ID NO: 55253 - protein, 31 aa, Artificial Sequence
  Description of Artificial Sequence: Synthetic polypeptide
TEEEIATTNPVAYEQYGSVATNLQRNPPEGR

SEQ ID NO: 55254 - protein, 34 aa, Artificial Sequence
  Description of Artificial Sequence: Synthetic polypeptide
DEEEIRTTNPVATEQYGCVCSNTGNLEQNSGSNQ

SEQ ID NO: 55255 - protein, 34 aa, Artificial Sequence
  Description of Artificial Sequence: Synthetic polypeptide
DEEEIRTTNPVATEQYGCVCSNTGNHQHGGSNRS

SEQ ID NO: 55256 - protein, 33 aa, Artificial Sequence
  Description of Artificial Sequence: Synthetic polypeptide
DEEEIRTTNPVATEQYGCVCSNTGEHQYGGSNR

SEQ ID NO: 55257 - protein, 33 aa, Artificial Sequence
  Description of Artificial Sequence: Synthetic polypeptide
DEEEIRTTNPVATEQYGCVCSNTENLQNGSEAF

SEQ ID NO: 55258 - protein, 31 aa, Artificial Sequence
  Description of Artificial Sequence: Synthetic polypeptide
TEEEIATTNPVAYEQYGNVSVTPLSQGGGNR

SEQ ID NO: 55259 - protein, 34 aa, Artificial Sequence
  Description of Artificial Sequence: Synthetic polypeptide
DEEEIRTTNPVATEQYGCVCSNTNGLQFFGSNNQ

SEQ ID NO: 55260 - protein, 33 aa, Artificial Sequence
  Description of Artificial Sequence: Synthetic polypeptide
DEEEIRTTNPVATEQYGCVCSNTNHNQHFNSNR

SEQ ID NO: 55261 - protein, 32 aa, Artificial Sequence
  Description of Artificial Sequence: Synthetic polypeptide
DEEEIRTTNPVATEQYGCVCSNTNHNQYGSQF

SEQ ID NO: 55262 - protein, 34 aa, Artificial Sequence
  Description of Artificial Sequence: Synthetic polypeptide
DEEEIRTTNPVATEQYGCVCSNTNNLQFSGSNQA

SEQ ID NO: 55263 - protein, 34 aa, Artificial Sequence
  Description of Artificial Sequence: Synthetic polypeptide
DEEEIRTTNPVATEQYGCVCSNTNLSQNFGSNQE

SEQ ID NO: 55264 - protein, 33 aa, Artificial Sequence
  Description of Artificial Sequence: Synthetic polypeptide
DEEEIRTTNPVATEQYGCVCSNTNLQYFNSNAV

SEQ ID NO: 55265 - protein, 34 aa, Artificial Sequence
  Description of Artificial Sequence: Synthetic polypeptide
DEEEIRTTNPVATEQYGCVCSNTNLQYFGSENQS

SEQ ID NO: 55266 - protein, 34 aa, Artificial Sequence
  Description of Artificial Sequence: Synthetic polypeptide
DEEEIRTTNPVATEQYGCVCSNTNLQSSGSENQE

SEQ ID NO: 55267 - protein, 33 aa, Artificial Sequence
  Description of Artificial Sequence: Synthetic polypeptide
DEEEIRTTNPVATEQYGCVCSNTNLQHGGSEQF

SEQ ID NO: 55268 - protein, 31 aa, Artificial Sequence
  Description of Artificial Sequence: Synthetic polypeptide
TEEEIATTNPVATERYGSVATCVSQRGGNNR

SEQ ID NO: 55269 - protein, 31 aa, Artificial Sequence
  Description of Artificial Sequence: Synthetic polypeptide
TEEEIATTNPVAYEQYGSVVSTNLQGTVNNW

SEQ ID NO: 55270 - protein, 32 aa, Artificial Sequence
  Description of Artificial Sequence: Synthetic polypeptide
TEEEIATTNPVAYEAYGSVSTMNLSQRGENYV

SEQ ID NO: 55271 - protein, 34 aa, Artificial Sequence
  Description of Artificial Sequence: Synthetic polypeptide
DEEEIRTTNPVATEQYGCVCSNTNLNQNFGSNAA

SEQ ID NO: 55272 - protein, 33 aa, Artificial Sequence
  Description of Artificial Sequence: Synthetic polypeptide
DEEEIRTTNPVATEQYGCVCSNTNLFQSFGSEQ

SEQ ID NO: 55273 - protein, 32 aa, Artificial Sequence
  Description of Artificial Sequence: Synthetic polypeptide
TEEEIATTNPVAYEQWGSTVPSCTNLERGNER

SEQ ID NO: 55274 - protein, 33 aa, Artificial Sequence
  Description of Artificial Sequence: Synthetic polypeptide
DEEEIRTTNPVATEQYGCVCSNTNHQYGSNTQA

SEQ ID NO: 55275 - protein, 33 aa, Artificial Sequence
  Description of Artificial Sequence: Synthetic polypeptide
DEEEIRTTNPVATEQYGCVCSNTNHQRSGSDQA

SEQ ID NO: 55276 - protein, 33 aa, Artificial Sequence
  Description of Artificial Sequence: Synthetic polypeptide
DEEEIRTTNPVATEQYGCVCSNTNHQNGSENAF

SEQ ID NO: 55277 - protein, 31 aa, Artificial Sequence
  Description of Artificial Sequence: Synthetic polypeptide
DEEEIRTTNPVATEQYGCVCSNTNHQGQSEQ

SEQ ID NO: 55278 - protein, 29 aa, Artificial Sequence
  Description of Artificial Sequence: Synthetic peptide
TEEEIATTNPVAYEPWGKVSTNLQATGNV

SEQ ID NO: 55279 - protein, 34 aa, Artificial Sequence
  Description of Artificial Sequence: Synthetic polypeptide
DEEEIRTTNPVATEQWGSVNVSYTNELQEREGGF

SEQ ID NO: 55280 - protein, 32 aa, Artificial Sequence
  Description of Artificial Sequence: Synthetic polypeptide
DEEEIRTTNPVATEQWGSVNTIINLIQFEENT

SEQ ID NO: 55281 - protein, 32 aa, Artificial Sequence
  Description of Artificial Sequence: Synthetic polypeptide
TESEIRTTNPVAYEQYGSVPSTGNLQQGENNQ

SEQ ID NO: 55282 - protein, 28 aa, Artificial Sequence
  Description of Artificial Sequence: Synthetic peptide
YEEEIATVNPVCTEQYGVVSDCLQSGNQ

SEQ ID NO: 55283 - protein, 28 aa, Artificial Sequence
  Description of Artificial Sequence: Synthetic peptide
YEEEIATVNPVCTEQYGVVSDILQSGNQ

SEQ ID NO: 55284 - protein, 28 aa, Artificial Sequence
  Description of Artificial Sequence: Synthetic peptide
YEEEIATVNPVCTEQYGVVSDNIQSGNQ

SEQ ID NO: 55285 - protein, 29 aa, Artificial Sequence
  Description of Artificial Sequence: Synthetic peptide
YEEEIATVNPVCTEQYGVVSDNLQQSGNQ

SEQ ID NO: 55286 - protein, 28 aa, Artificial Sequence
  Description of Artificial Sequence: Synthetic peptide
YEEEIATVNPVCTEQYGVVSDNLQSENQ

SEQ ID NO: 55287 - protein, 28 aa, Artificial Sequence
  Description of Artificial Sequence: Synthetic peptide
YEEEIATVNPVCTEQYGVVSDPLQSGNQ

SEQ ID NO: 55288 - protein, 28 aa, Artificial Sequence
  Description of Artificial Sequence: Synthetic peptide
YEEEIATVNPVCTEQYGVVSENLQHENL

SEQ ID NO: 55289 - protein, 28 aa, Artificial Sequence
  Description of Artificial Sequence: Synthetic peptide
YEEEIATVNPVCTEQYGVVSENLQSENL

SEQ ID NO: 55290 - protein, 28 aa, Artificial Sequence
  Description of Artificial Sequence: Synthetic peptide
YEEEIATVNPVCTEQYGVVSENLQSENQ

SEQ ID NO: 55291 - protein, 29 aa, Artificial Sequence
  Description of Artificial Sequence: Synthetic peptide
YEEEIATVNPVSTEQYGVVSDNLQSNGNQ

SEQ ID NO: 55292 - protein, 28 aa, Artificial Sequence
  Description of Artificial Sequence: Synthetic peptide
YEEEIAVVNPVCTEQYGAVSDNLQSGNQ

SEQ ID NO: 55293 - protein, 28 aa, Artificial Sequence
  Description of Artificial Sequence: Synthetic peptide
YEEEIAVVNPVCTEQYGVVSDNLQSGNQ

SEQ ID NO: 55294 - protein, 28 aa, Artificial Sequence
  Description of Artificial Sequence: Synthetic peptide
YEEEICSVNPVCTEQYGVVSDNLQSGNQ

SEQ ID NO: 55295 - protein, 33 aa, Artificial Sequence
  Description of Artificial Sequence: Synthetic polypeptide
DEEEIRTTNPVATEPYGSVCFTNEDHQRGGGNT

SEQ ID NO: 55296 - protein, 32 aa, Artificial Sequence
  Description of Artificial Sequence: Synthetic polypeptide
DEEEIRTTNPVATEPYGSVCFTNEDHERGGNA

SEQ ID NO: 55297 - protein, 28 aa, Artificial Sequence
  Description of Artificial Sequence: Synthetic peptide
YEEEIATVNPVCTEQYGVVSDCLQSGNL

SEQ ID NO: 55298 - protein, 28 aa, Artificial Sequence
  Description of Artificial Sequence: Synthetic peptide
YEEEIDSVNPVCTEQYGVVSDNLQSGNQ

SEQ ID NO: 55299 - protein, 28 aa, Artificial Sequence
  Description of Artificial Sequence: Synthetic peptide
YEEEIATVNPVCTEQYGVVSDCLQHGNQ

SEQ ID NO: 55300 - protein, 28 aa, Artificial Sequence
  Description of Artificial Sequence: Synthetic peptide
YEEEIATVNPVCTEPYGVVSDNLQQGNQ

SEQ ID NO: 55301 - protein, 28 aa, Artificial Sequence
  Description of Artificial Sequence: Synthetic peptide
YEEEIATTNPVCTEQYGVVSDILMAGNQ

SEQ ID NO: 55302 - protein, 28 aa, Artificial Sequence
  Description of Artificial Sequence: Synthetic peptide
YEEEIATTNPVCTEQYGVVSDILMSGNQ

SEQ ID NO: 55303 - protein, 28 aa, Artificial Sequence
  Description of Artificial Sequence: Synthetic peptide
YEEEIATVNPVATEQYGDVSENLQHEEQ

SEQ ID NO: 55304 - protein, 33 aa, Artificial Sequence
  Description of Artificial Sequence: Synthetic polypeptide
DEEEIRTTNPVATEPYGSVCVTMSLTQRGGQTR

SEQ ID NO: 55305 - protein, 28 aa, Artificial Sequence
  Description of Artificial Sequence: Synthetic peptide
YEEEIATVNPVATEQYGDVSENLQSEEQ

SEQ ID NO: 55306 - protein, 28 aa, Artificial Sequence
  Description of Artificial Sequence: Synthetic peptide
YEEEIATVNPVATEQYGEVSEVLQSENK

SEQ ID NO: 55307 - protein, 29 aa, Artificial Sequence
  Description of Artificial Sequence: Synthetic peptide
YEEEIATVNPVATEQYGSVSDDLQSGEDL

SEQ ID NO: 55308 - protein, 28 aa, Artificial Sequence
  Description of Artificial Sequence: Synthetic peptide
YEEEIATVNPVATEQYGVASDVLQHGNK

SEQ ID NO: 55309 - protein, 28 aa, Artificial Sequence
  Description of Artificial Sequence: Synthetic peptide
YEEEIATVNPVATEQYGVVSDNLESGEL

SEQ ID NO: 55310 - protein, 31 aa, Artificial Sequence
  Description of Artificial Sequence: Synthetic polypeptide
DEEEIRTTNPVATEPYGSVCFVANLTIGGER

SEQ ID NO: 55311 - protein, 33 aa, Artificial Sequence
  Description of Artificial Sequence: Synthetic polypeptide
DEEEIRTTNPVATEPYGSVCFTVANLTQIGGNS

SEQ ID NO: 55312 - protein, 31 aa, Artificial Sequence
  Description of Artificial Sequence: Synthetic polypeptide
DEEEIRTTNPVATEPYGSVCFTTQLTRGGQE

SEQ ID NO: 55313 - protein, 28 aa, Artificial Sequence
  Description of Artificial Sequence: Synthetic peptide
YEEEIATVNPVATEQYGVVSECLQHENL

SEQ ID NO: 55314 - protein, 31 aa, Artificial Sequence
  Description of Artificial Sequence: Synthetic polypeptide
DEEEIRTTNPVATEPYGSVCFTQLTRGSQQE

SEQ ID NO: 55315 - protein, 34 aa, Artificial Sequence
  Description of Artificial Sequence: Synthetic polypeptide
DEEEIRTTNPVATEPYGSVCFTNWETQRGGQNRP

SEQ ID NO: 55316 - protein, 28 aa, Artificial Sequence
  Description of Artificial Sequence: Synthetic peptide
YEEEIATVNPVCTEQYGVVSDALQSGNQ

SEQ ID NO: 55317 - protein, 28 aa, Artificial Sequence
  Description of Artificial Sequence: Synthetic peptide
YEEEIATTNPVATEQYGVVPDVLQSGEQ

SEQ ID NO: 55318 - protein, 28 aa, Artificial Sequence
  Description of Artificial Sequence: Synthetic peptide
YEEEIGSVNPVCTEQYGVVSDNLQSGNQ

SEQ ID NO: 55319 - protein, 33 aa, Artificial Sequence
  Description of Artificial Sequence: Synthetic polypeptide
DEEEIRTTNPVATEPYGSVCFTDNQDTDRGGNR

SEQ ID NO: 55320 - protein, 28 aa, Artificial Sequence
  Description of Artificial Sequence: Synthetic peptide
YEEEIRSTNPVCTEQYGVISDNIQSGNQ

SEQ ID NO: 55321 - protein, 35 aa, Artificial Sequence
  Description of Artificial Sequence: Synthetic polypeptide
DEEEIRTTNPVATEPYGSTVSCTNMLIQSGGNPRS

SEQ ID NO: 55322 - protein, 31 aa, Artificial Sequence
  Description of Artificial Sequence: Synthetic polypeptide
YEEEIRSTNPVCTEQYGVVSSDNLPQRNGNQ

SEQ ID NO: 55323 - protein, 30 aa, Artificial Sequence
  Description of Artificial Sequence: Synthetic polypeptide
YEEEIRSTNPVCTEQYGVVSSDNLPQSGNQ

SEQ ID NO: 55324 - protein, 32 aa, Artificial Sequence
  Description of Artificial Sequence: Synthetic polypeptide
YEEEIRSTNPVCTEQYGVVSSTPNLPQRNGNQ

SEQ ID NO: 55325 - protein, 28 aa, Artificial Sequence
  Description of Artificial Sequence: Synthetic peptide
YEEEIRSVNPICTEQYGVVSDNLQSGNQ

SEQ ID NO: 55326 - protein, 34 aa, Artificial Sequence
  Description of Artificial Sequence: Synthetic polypeptide
DEEEIRTTNPVATEPYGSTVSCCNMLAQSGGNPR

SEQ ID NO: 55327 - protein, 31 aa, Artificial Sequence
  Description of Artificial Sequence: Synthetic polypeptide
YEEEIRSVNPVATEQYGSVSTPALQMSGMNV

SEQ ID NO: 55328 - protein, 29 aa, Artificial Sequence
  Description of Artificial Sequence: Synthetic peptide
YEEEIRSVNPVATEQYGVVSDALQMSGNV

SEQ ID NO: 55329 - protein, 33 aa, Artificial Sequence
  Description of Artificial Sequence: Synthetic polypeptide
DEEEIRTTNPVATEPYGSTVACTNMTQSGGNPR

SEQ ID NO: 55330 - protein, 30 aa, Artificial Sequence
  Description of Artificial Sequence: Synthetic polypeptide
YEEEIRSVNPVATEQYGVVSDNLNMRNGNQ

SEQ ID NO: 55331 - protein, 30 aa, Artificial Sequence
  Description of Artificial Sequence: Synthetic polypeptide
YEEEIRSVNPVATEQYGVVSTALQMSGMNV

SEQ ID NO: 55332 - protein, 28 aa, Artificial Sequence
  Description of Artificial Sequence: Synthetic peptide
YEEEIRSVNPVCTEQWGVVSDNLQSGNG

SEQ ID NO: 55333 - protein, 28 aa, Artificial Sequence
  Description of Artificial Sequence: Synthetic peptide
YEEEIRSVNPVCTEQWGVVSDNLQSGNQ

SEQ ID NO: 55334 - protein, 28 aa, Artificial Sequence
  Description of Artificial Sequence: Synthetic peptide
YEEEIRSVNPVCTEQYGVVSDALQSGNQ

SEQ ID NO: 55335 - protein, 33 aa, Artificial Sequence
  Description of Artificial Sequence: Synthetic polypeptide
DEEEIRTTNPVATEPYGSVCAATNETRGGDNRM

SEQ ID NO: 55336 - protein, 32 aa, Artificial Sequence
  Description of Artificial Sequence: Synthetic polypeptide
DEEEIRTTNPVATEPYGSVCFTGVLTQIGGTR

SEQ ID NO: 55337 - protein, 28 aa, Artificial Sequence
  Description of Artificial Sequence: Synthetic peptide
YEEEIRSTNPVATEQYGVVSDNLMSEDQ

SEQ ID NO: 55338 - protein, 31 aa, Artificial Sequence
  Description of Artificial Sequence: Synthetic polypeptide
YEEEIRSTNPVATEQYGAVSDNLQGVEGVPR

SEQ ID NO: 55339 - protein, 28 aa, Artificial Sequence
  Description of Artificial Sequence: Synthetic peptide
YEEEIHSVNPVCTEQYGVVSDNLQSGNQ

SEQ ID NO: 55340 - protein, 28 aa, Artificial Sequence
  Description of Artificial Sequence: Synthetic peptide
YEEEIISVNPVCTEQYGVVSDNLQSGNQ

SEQ ID NO: 55341 - protein, 33 aa, Artificial Sequence
  Description of Artificial Sequence: Synthetic polypeptide
DEEEIRTTNPVATEPYGSVCFTDNEDHRGGGNR

SEQ ID NO: 55342 - protein, 28 aa, Artificial Sequence
  Description of Artificial Sequence: Synthetic peptide
YEEEIKSVNPVCTEQYGVVSDNLQSGNQ

SEQ ID NO: 55343 - protein, 28 aa, Artificial Sequence
  Description of Artificial Sequence: Synthetic peptide
YEEEIKSVNPVCTEQYGVVSDNLQSGNV

SEQ ID NO: 55344 - protein, 28 aa, Artificial Sequence
  Description of Artificial Sequence: Synthetic peptide
YEEEIKTVNPVCTEMYGRVSDNLQSGNQ

SEQ ID NO: 55345 - protein, 28 aa, Artificial Sequence
  Description of Artificial Sequence: Synthetic peptide
YEEEIMSVNPVCTEQYGVVSDNLQSGNQ

SEQ ID NO: 55346 - protein, 31 aa, Artificial Sequence
  Description of Artificial Sequence: Synthetic polypeptide
YEEEIMTTNPVATEQYGSVSTLTNTHFGTRN

SEQ ID NO: 55347 - protein, 28 aa, Artificial Sequence
  Description of Artificial Sequence: Synthetic peptide
YEEEINSVNPVCTEQYGVVSDNLQSGNQ

SEQ ID NO: 55348 - protein, 28 aa, Artificial Sequence
  Description of Artificial Sequence: Synthetic peptide
YEEEIQSVNPVCTEQYGVVSDNLQSGNQ

SEQ ID NO: 55349 - protein, 30 aa, Artificial Sequence
  Description of Artificial Sequence: Synthetic polypeptide
YEEEIRATNPVATEQYGCVSTNPSDGINNA

SEQ ID NO: 55350 - protein, 31 aa, Artificial Sequence
  Description of Artificial Sequence: Synthetic polypeptide
YEEEIRCTNPAATEQYGSVSIENMLMRGGNG

SEQ ID NO: 55351 - protein, 34 aa, Artificial Sequence
  Description of Artificial Sequence: Synthetic polypeptide
DEEEIRTTNPVATEPYGSVCFETNAQHNRGGNVR

SEQ ID NO: 55352 - protein, 33 aa, Artificial Sequence
  Description of Artificial Sequence: Synthetic polypeptide
DEEEIRTTNPVATEPYGSVCFCTPNLTRTGGNS

SEQ ID NO: 55353 - protein, 29 aa, Artificial Sequence
  Description of Artificial Sequence: Synthetic peptide
YEEEIRSTNPVATEQWGVVWSDNLQSGPQ

SEQ ID NO: 55354 - protein, 31 aa, Artificial Sequence
  Description of Artificial Sequence: Synthetic polypeptide
YEEEIRSTNPVATEQYGSVSSDALNMRNGNQ

SEQ ID NO: 55355 - protein, 28 aa, Artificial Sequence
  Description of Artificial Sequence: Synthetic peptide
YEEEIATTNPVATECYGVVSECLQHENQ

SEQ ID NO: 55356 - protein, 28 aa, Artificial Sequence
  Description of Artificial Sequence: Synthetic peptide
YEEEIASVNPVSTEQYGVVSNNLQSGNQ

SEQ ID NO: 55357 - protein, 28 aa, Artificial Sequence
  Description of Artificial Sequence: Synthetic peptide
YEEEIASVNPVSTEQYGVVSDNLQSGNQ

SEQ ID NO: 55358 - protein, 28 aa, Artificial Sequence
  Description of Artificial Sequence: Synthetic peptide
YEEEIASVNPVCTEQYGVVSDNLQSGNW

SEQ ID NO: 55359 - protein, 28 aa, Artificial Sequence
  Description of Artificial Sequence: Synthetic peptide
YEEEIASVNPVCTEQYGVVSDNLQSGNY

SEQ ID NO: 55360 - protein, 28 aa, Artificial Sequence
  Description of Artificial Sequence: Synthetic peptide
YEEEIASVNPVCTEQYGVVSDNLQSGTR

SEQ ID NO: 55361 - protein, 32 aa, Artificial Sequence
  Description of Artificial Sequence: Synthetic polypeptide
DEEEIRTTNPVATEPYGSVSTNSHNEERDMIR

SEQ ID NO: 55362 - protein, 28 aa, Artificial Sequence
  Description of Artificial Sequence: Synthetic peptide
YEEEIASVNPVCTEQYGVVSDNLQTGNQ

SEQ ID NO: 55363 - protein, 28 aa, Artificial Sequence
  Description of Artificial Sequence: Synthetic peptide
YEEEIASVNPVCTEQYGVVSDNLQWGNQ

SEQ ID NO: 55364 - protein, 28 aa, Artificial Sequence
  Description of Artificial Sequence: Synthetic peptide
YEEEIASVNPVCTEQYGVVSDNLQYGNQ

SEQ ID NO: 55365 - protein, 28 aa, Artificial Sequence
  Description of Artificial Sequence: Synthetic peptide
YEEEIASVNPVCTEQYGVVSDNRQSGNR

SEQ ID NO: 55366 - protein, 29 aa, Artificial Sequence
  Description of Artificial Sequence: Synthetic peptide
YEEEIASVNPVCTEQYGVVSDTNLQSGNQ

SEQ ID NO: 55367 - protein, 28 aa, Artificial Sequence
  Description of Artificial Sequence: Synthetic peptide
YEEEIASVNPVCTEQYGVVSENLQHGNQ

SEQ ID NO: 55368 - protein, 28 aa, Artificial Sequence
  Description of Artificial Sequence: Synthetic peptide
YEEEIASVNPVCTEQYGVVSENLQSGGR

SEQ ID NO: 55369 - protein, 28 aa, Artificial Sequence
  Description of Artificial Sequence: Synthetic peptide
YEEEIASVNPVCTEQYGVVSENLQSGNQ

SEQ ID NO: 55370 - protein, 29 aa, Artificial Sequence
  Description of Artificial Sequence: Synthetic peptide
YEEEIASVNPVCTEQYGVVSFNLQRSGNQ

SEQ ID NO: 55371 - protein, 28 aa, Artificial Sequence
  Description of Artificial Sequence: Synthetic peptide
YEEEIASVNPVCTEQYGVVSFNLQSGNQ

SEQ ID NO: 55372 - protein, 28 aa, Artificial Sequence
  Description of Artificial Sequence: Synthetic peptide
YEEEIASVNPVCTEQYGVVSGNLQNGNQ

SEQ ID NO: 55373 - protein, 28 aa, Artificial Sequence
  Description of Artificial Sequence: Synthetic peptide
YEEEIASVNPVCTEQYGVVSDNLQSGNV

SEQ ID NO: 55374 - protein, 28 aa, Artificial Sequence
  Description of Artificial Sequence: Synthetic peptide
YEEEIASVNPVCTEQYGVVSGNLQSGNQ

SEQ ID NO: 55375 - protein, 28 aa, Artificial Sequence
  Description of Artificial Sequence: Synthetic peptide
YEEEIASVNPVCTEQYGVVSDNLQSGNT

SEQ ID NO: 55376 - protein, 28 aa, Artificial Sequence
  Description of Artificial Sequence: Synthetic peptide
YEEEIASVNPVCTEQYGVVSDNLQSGNN

SEQ ID NO: 55377 - protein, 28 aa, Artificial Sequence
  Description of Artificial Sequence: Synthetic peptide
YEEEIASVNPVCTEQYGVVSDNLQNGNQ

SEQ ID NO: 55378 - protein, 28 aa, Artificial Sequence
  Description of Artificial Sequence: Synthetic peptide
YEEEIASVNPVCTEQYGVVSDNLQQGNQ

SEQ ID NO: 55379 - protein, 28 aa, Artificial Sequence
  Description of Artificial Sequence: Synthetic peptide
YEEEIASVNPVCTEQYGVVSDNLQQGNV

SEQ ID NO: 55380 - protein, 28 aa, Artificial Sequence
  Description of Artificial Sequence: Synthetic peptide
YEEEIASVNPVCTEQYGVVSDNLQSGGR

SEQ ID NO: 55381 - protein, 28 aa, Artificial Sequence
  Description of Artificial Sequence: Synthetic peptide
YEEEIASVNPVCTEQYGVVSDNLQSGNA

SEQ ID NO: 55382 - protein, 28 aa, Artificial Sequence
  Description of Artificial Sequence: Synthetic peptide
YEEEIASVNPVCTEQYGVVSDNLQSGNC

SEQ ID NO: 55383 - protein, 28 aa, Artificial Sequence
  Description of Artificial Sequence: Synthetic peptide
YEEEIASVNPVCTEQYGVVSDNLQSGND

SEQ ID NO: 55384 - protein, 28 aa, Artificial Sequence
  Description of Artificial Sequence: Synthetic peptide
YEEEIASVNPVCTEQYGVVSDNLQSGNE

SEQ ID NO: 55385 - protein, 28 aa, Artificial Sequence
  Description of Artificial Sequence: Synthetic peptide
YEEEIASVNPVCTEQYGVVSDNLQSGNF

SEQ ID NO: 55386 - protein, 28 aa, Artificial Sequence
  Description of Artificial Sequence: Synthetic peptide
YEEEIASVNPVCTEQYGVVSDNLQSGNG

SEQ ID NO: 55387 - protein, 28 aa, Artificial Sequence
  Description of Artificial Sequence: Synthetic peptide
YEEEIASVNPVCTEQYGVVSDNLQSGNH

SEQ ID NO: 55388 - protein, 28 aa, Artificial Sequence
  Description of Artificial Sequence: Synthetic peptide
YEEEIASVNPVCTEQYGVVSDNLQSGNI

SEQ ID NO: 55389 - protein, 28 aa, Artificial Sequence
  Description of Artificial Sequence: Synthetic peptide
YEEEIASVNPVCTEQYGVVSDNLQSGNK

SEQ ID NO: 55390 - protein, 28 aa, Artificial Sequence
  Description of Artificial Sequence: Synthetic peptide
YEEEIASVNPVCTEQYGVVSDNLQSGNL

SEQ ID NO: 55391 - protein, 28 aa, Artificial Sequence
  Description of Artificial Sequence: Synthetic peptide
YEEEIASVNPVCTEQYGVVSDNLQSGNM

SEQ ID NO: 55392 - protein, 28 aa, Artificial Sequence
  Description of Artificial Sequence: Synthetic peptide
YEEEIASVNPVCTEQYGVVSDNLQSGNS

SEQ ID NO: 55393 - protein, 28 aa, Artificial Sequence
  Description of Artificial Sequence: Synthetic peptide
YEEEIASVNPVCTEQYGVVSHNLQSGNQ

SEQ ID NO: 55394 - protein, 29 aa, Artificial Sequence
  Description of Artificial Sequence: Synthetic peptide
YEEEIASVNPVCTEQYGVVSIDNLQSGNR

SEQ ID NO: 55395 - protein, 28 aa, Artificial Sequence
  Description of Artificial Sequence: Synthetic peptide
YEEEIASVNPVCTEQYGVVSINLQSGNQ

SEQ ID NO: 55396 - protein, 28 aa, Artificial Sequence
  Description of Artificial Sequence: Synthetic peptide
YEEEIASVNPVCTEQYGVVSVNLQFGNQ

SEQ ID NO: 55397 - protein, 28 aa, Artificial Sequence
  Description of Artificial Sequence: Synthetic peptide
YEEEIASVNPVCTEQYGVVSVNLQSGNQ

SEQ ID NO: 55398 - protein, 28 aa, Artificial Sequence
  Description of Artificial Sequence: Synthetic peptide
YEEEIASVNPVCTEQYGVVSWNLQSGNQ

SEQ ID NO: 55399 - protein, 28 aa, Artificial Sequence
  Description of Artificial Sequence: Synthetic peptide
YEEEIASVNPVCTEQYGVVSYNLQCGNQ

SEQ ID NO: 55400 - protein, 28 aa, Artificial Sequence
  Description of Artificial Sequence: Synthetic peptide
YEEEIASVNPVCTEQYGVVSYNLQQGNQ

SEQ ID NO: 55401 - protein, 28 aa, Artificial Sequence
  Description of Artificial Sequence: Synthetic peptide
YEEEIASVNPVCTEQYGVVSYNLQSGNQ

SEQ ID NO: 55402 - protein, 28 aa, Artificial Sequence
  Description of Artificial Sequence: Synthetic peptide
YEEEIASVNPVCTEQYGWVSDNLQSGNQ

SEQ ID NO: 55403 - protein, 28 aa, Artificial Sequence
  Description of Artificial Sequence: Synthetic peptide
YEEEIASVNPVCTEQYGYVSDNLQSGNQ

SEQ ID NO: 55404 - protein, 28 aa, Artificial Sequence
  Description of Artificial Sequence: Synthetic peptide
YEEEIASVNPVGTEQYGNVSDNLQSGNQ

SEQ ID NO: 55405 - protein, 28 aa, Artificial Sequence
  Description of Artificial Sequence: Synthetic peptide
YEEEIASVNPVGTEQYGVVSDNLQSGNQ

SEQ ID NO: 55406 - protein, 28 aa, Artificial Sequence
  Description of Artificial Sequence: Synthetic peptide
YEEEIASVNPVGTEQYGVVSSNLQSGNQ

SEQ ID NO: 55407 - protein, 28 aa, Artificial Sequence
  Description of Artificial Sequence: Synthetic peptide
YEEEIASVNPVNTEQYGVVSDNLQSGNQ

SEQ ID NO: 55408 - protein, 28 aa, Artificial Sequence
  Description of Artificial Sequence: Synthetic peptide
YEEEIASVNPVSTEQYGIVSDNLQSGTR

SEQ ID NO: 55409 - protein, 28 aa, Artificial Sequence
  Description of Artificial Sequence: Synthetic peptide
YEEEIASVNPVSTEQYGVVSCNLQSGTR

SEQ ID NO: 55410 - protein, 28 aa, Artificial Sequence
  Description of Artificial Sequence: Synthetic peptide
YEEEIASVNPVSTEQYGVVSDNLQQGNQ

SEQ ID NO: 55411 - protein, 29 aa, Artificial Sequence
  Description of Artificial Sequence: Synthetic peptide
YEEEIASVNPVCTEQYGVVSTTNLQSGNQ

SEQ ID NO: 55412 - protein, 28 aa, Artificial Sequence
  Description of Artificial Sequence: Synthetic peptide
YEEEIASVNPVCTEQYGVVSTNPQSGND

SEQ ID NO: 55413 - protein, 29 aa, Artificial Sequence
  Description of Artificial Sequence: Synthetic peptide
YEEEIASVNPVCTEQYGVVSTNLQSGYNQ

SEQ ID NO: 55414 - protein, 32 aa, Artificial Sequence
  Description of Artificial Sequence: Synthetic polypeptide
DEEEIRTTNPVATEPYGSVSILLTQIENVNRA

SEQ ID NO: 55415 - protein, 28 aa, Artificial Sequence
  Description of Artificial Sequence: Synthetic peptide
YEEEIASVNPVCTEQYGVVSKNLQSGNQ

SEQ ID NO: 55416 - protein, 28 aa, Artificial Sequence
  Description of Artificial Sequence: Synthetic peptide
YEEEIASVNPVCTEQYGVVSLNLQSGNQ

SEQ ID NO: 55417 - protein, 33 aa, Artificial Sequence
  Description of Artificial Sequence: Synthetic polypeptide
DEEEIRTTNPVATEPYGSVSTNDEGNGQTGNNG

SEQ ID NO: 55418 - protein, 28 aa, Artificial Sequence
  Description of Artificial Sequence: Synthetic peptide
YEEEIASVNPVCTEQYGVVSMNLQSGNQ

SEQ ID NO: 55419 - protein, 28 aa, Artificial Sequence
  Description of Artificial Sequence: Synthetic peptide
YEEEIASVNPVCTEQYGVVSNNLQGGNQ

SEQ ID NO: 55420 - protein, 28 aa, Artificial Sequence
  Description of Artificial Sequence: Synthetic peptide
YEEEIASVNPVCTEQYGVVSNNLQSGNQ

SEQ ID NO: 55421 - protein, 28 aa, Artificial Sequence
  Description of Artificial Sequence: Synthetic peptide
YEEEIASVNPVCTEQYGVVSPNLQSGNQ

SEQ ID NO: 55422 - protein, 28 aa, Artificial Sequence
  Description of Artificial Sequence: Synthetic peptide
YEEEIRSVNPVCTEQYGVVSDALQSGNV

SEQ ID NO: 55423 - protein, 28 aa, Artificial Sequence
  Description of Artificial Sequence: Synthetic peptide
YEEEIASVNPVCTEQYGVVSQNLQSGNQ

SEQ ID NO: 55424 - protein, 32 aa, Artificial Sequence
  Description of Artificial Sequence: Synthetic polypeptide
DEEEIRTTNPVATEPYGSVSTEDIPNMRNGNH

SEQ ID NO: 55425 - protein, 32 aa, Artificial Sequence
  Description of Artificial Sequence: Synthetic polypeptide
DEEEIRTTNPVATEPYGSVSTEDGPNMRNGNH

SEQ ID NO: 55426 - protein, 28 aa, Artificial Sequence
  Description of Artificial Sequence: Synthetic peptide
YEEEIASVNPVCTEQYGVVSSNLQSGNQ

SEQ ID NO: 55427 - protein, 28 aa, Artificial Sequence
  Description of Artificial Sequence: Synthetic peptide
YEEEIASVNPVCTEQYGVVSTALQSGNQ

SEQ ID NO: 55428 - protein, 28 aa, Artificial Sequence
  Description of Artificial Sequence: Synthetic peptide
YEEEIASVNPVCTEQYGVVSTDLQSGNQ

SEQ ID NO: 55429 - protein, 29 aa, Artificial Sequence
  Description of Artificial Sequence: Synthetic peptide
YEEEIASVNPVCTEQYGVVSTDNLQSGNQ

SEQ ID NO: 55430 - protein, 29 aa, Artificial Sequence
  Description of Artificial Sequence: Synthetic peptide
YEEEIASVNPVCTEQYGVVSTNLQHEGNQ

SEQ ID NO: 55431 - protein, 28 aa, Artificial Sequence
  Description of Artificial Sequence: Synthetic peptide
YEEEIASVNPVCTEQYGVVSRNLQSGNQ

SEQ ID NO: 55432 - protein, 28 aa, Artificial Sequence
  Description of Artificial Sequence: Synthetic peptide
YEEEIRSVNPVCTEQYGVVSDNLQSENA

SEQ ID NO: 55433 - protein, 30 aa, Artificial Sequence
  Description of Artificial Sequence: Synthetic polypeptide
YEEEIRSVNPVCTEQYGVVSTNLQMSGNPQ

SEQ ID NO: 55434 - protein, 34 aa, Artificial Sequence
  Description of Artificial Sequence: Synthetic polypeptide
DEEEIRTTNPVATEPYGKTVSCTNMLTQSGGNPR

SEQ ID NO: 55435 - protein, 28 aa, Artificial Sequence
  Description of Artificial Sequence: Synthetic peptide
YENEIASTNPVATEQYGEASDNLQSGNQ

SEQ ID NO: 55436 - protein, 28 aa, Artificial Sequence
  Description of Artificial Sequence: Synthetic peptide
YENEIASTNPVATEQYGEASENLQSGGR

SEQ ID NO: 55437 - protein, 28 aa, Artificial Sequence
  Description of Artificial Sequence: Synthetic peptide
YENEIASTNPVCTEQYGVVSDNLQSGNQ

SEQ ID NO: 55438 - protein, 28 aa, Artificial Sequence
  Description of Artificial Sequence: Synthetic peptide
YENEIASVNPVATEQYGEASENLQSGNR

SEQ ID NO: 55439 - protein, 28 aa, Artificial Sequence
  Description of Artificial Sequence: Synthetic peptide
YENEIASVNPVATEQYGEVSDNLQSGNQ

SEQ ID NO: 55440 - protein, 28 aa, Artificial Sequence
  Description of Artificial Sequence: Synthetic peptide
YENEIASVNPVATEQYGVVSDNLQSGNQ

SEQ ID NO: 55441 - protein, 28 aa, Artificial Sequence
  Description of Artificial Sequence: Synthetic peptide
YENEIASVNPVCTEQYGVVSDNLQRGNQ

SEQ ID NO: 55442 - protein, 29 aa, Artificial Sequence
  Description of Artificial Sequence: Synthetic peptide
YENEIATVNPVATEQYGDVSENLQSAGNQ

SEQ ID NO: 55443 - protein, 28 aa, Artificial Sequence
  Description of Artificial Sequence: Synthetic peptide
YENEIATVNPVCTEQYGTVSDNLQSGNQ

SEQ ID NO: 55444 - protein, 28 aa, Artificial Sequence
  Description of Artificial Sequence: Synthetic peptide
YENEIATVNPVCTEQYGVVSDNLQSGNQ

SEQ ID NO: 55445 - protein, 29 aa, Artificial Sequence
  Description of Artificial Sequence: Synthetic peptide
YENEIRTTNPVCTEQYGVVSENLQSAENA

SEQ ID NO: 55446 - protein, 28 aa, Artificial Sequence
  Description of Artificial Sequence: Synthetic peptide
YENEIRTTNPVSTEQYGVISDDLQQGNH

SEQ ID NO: 55447 - protein, 31 aa, Artificial Sequence
  Description of Artificial Sequence: Synthetic polypeptide
YENEITTTNPVATEMYGAVASTNLQNGNPRY

SEQ ID NO: 55448 - protein, 28 aa, Artificial Sequence
  Description of Artificial Sequence: Synthetic peptide
YENEVACTNPVATEQYGEASENLQRGGR

SEQ ID NO: 55449 - protein, 33 aa, Artificial Sequence
  Description of Artificial Sequence: Synthetic polypeptide
DEEEIRTTNPVATEGYGSVSTMNNGQAEGGNDD

SEQ ID NO: 55450 - protein, 28 aa, Artificial Sequence
  Description of Artificial Sequence: Synthetic peptide
YENEIACTNPVATEQYGEASENLQSGGR

SEQ ID NO: 55451 - protein, 29 aa, Artificial Sequence
  Description of Artificial Sequence: Synthetic peptide
YEQDIRTTNPMATEQYGSVNSTTLVSGER

SEQ ID NO: 55452 - protein, 33 aa, Artificial Sequence
  Description of Artificial Sequence: Synthetic polypeptide
DEEEIRTTNPVATEGYGSVSTSTLQQTEMGNND

SEQ ID NO: 55453 - protein, 33 aa, Artificial Sequence
  Description of Artificial Sequence: Synthetic polypeptide
DEEEIRTTNPVATEGYGSVSTSTLQTEMGNNGN

SEQ ID NO: 55454 - protein, 33 aa, Artificial Sequence
  Description of Artificial Sequence: Synthetic polypeptide
DEEEIRTTNPVATEGYGSVYSTRNCIQKTGNQE

SEQ ID NO: 55455 - protein, 33 aa, Artificial Sequence
  Description of Artificial Sequence: Synthetic polypeptide
DEEEIRTTNPVATEGYGSVYSTNCIQKTGNNQD

SEQ ID NO: 55456 - protein, 30 aa, Artificial Sequence
  Description of Artificial Sequence: Synthetic polypeptide
YEETICTTNPVATEQYGSVSDMNGGDRGNS

SEQ ID NO: 55457 - protein, 31 aa, Artificial Sequence
  Description of Artificial Sequence: Synthetic polypeptide
YEETICTTNPVATEQYGSVSIMGNGQGRGNS

SEQ ID NO: 55458 - protein, 31 aa, Artificial Sequence
  Description of Artificial Sequence: Synthetic polypeptide
YEETICTTNPVATEQYGSVSIMNGGQRGGNG

SEQ ID NO: 55459 - protein, 31 aa, Artificial Sequence
  Description of Artificial Sequence: Synthetic polypeptide
YEETIRCTNPVATEQYGSVYETCNLVAGGNR

SEQ ID NO: 55460 - protein, 30 aa, Artificial Sequence
  Description of Artificial Sequence: Synthetic polypeptide
YEGAIRTTNPVATETYGSAVTNDLQRFGNN

SEQ ID NO: 55461 - protein, 28 aa, Artificial Sequence
  Description of Artificial Sequence: Synthetic peptide
YEGEIASTNPVSTEQYGVVSCNLQSGTR

SEQ ID NO: 55462 - protein, 32 aa, Artificial Sequence
  Description of Artificial Sequence: Synthetic polypeptide
DEEEIRTTNPVATEGYGSVYSTDCINKTIANR

SEQ ID NO: 55463 - protein, 33 aa, Artificial Sequence
  Description of Artificial Sequence: Synthetic polypeptide
DEEEIRTTNPVATEGYGSVVFTNLIRGGMNGNI

SEQ ID NO: 55464 - protein, 34 aa, Artificial Sequence
  Description of Artificial Sequence: Synthetic polypeptide
DEEEIRTTNPVATEGYGSVTSTNLQDEGGENITV

SEQ ID NO: 55465 - protein, 33 aa, Artificial Sequence
  Description of Artificial Sequence: Synthetic polypeptide
DEEEIRTTNPVATEGYGSVSTYNLSNEFGGNVT

SEQ ID NO: 55466 - protein, 30 aa, Artificial Sequence
  Description of Artificial Sequence: Synthetic polypeptide
YENCIRATNPVATEQYGMVNSTPLLQGGNR

SEQ ID NO: 55467 - protein, 28 aa, Artificial Sequence
  Description of Artificial Sequence: Synthetic peptide
YENEIACTNPVATEQYGEASDNLQSGNQ

SEQ ID NO: 55468 - protein, 28 aa, Artificial Sequence
  Description of Artificial Sequence: Synthetic peptide
YENEIACTNPVATEQYGEASENLQREGR

SEQ ID NO: 55469 - protein, 28 aa, Artificial Sequence
  Description of Artificial Sequence: Synthetic peptide
YENEIACTNPVATEQYGEASENLQRGGQ

SEQ ID NO: 55470 - protein, 28 aa, Artificial Sequence
  Description of Artificial Sequence: Synthetic peptide
YEQEIASVNPVCTEQYGVVSTNLQSGNQ

SEQ ID NO: 55471 - protein, 30 aa, Artificial Sequence
  Description of Artificial Sequence: Synthetic polypeptide
YEQEIATTNPVATEQYGSVSATNLEDHGEL

SEQ ID NO: 55472 - protein, 30 aa, Artificial Sequence
  Description of Artificial Sequence: Synthetic polypeptide
YEQEIATTNPVCTEQYGSVSATNLQDHGEL

SEQ ID NO: 55473 - protein, 31 aa, Artificial Sequence
  Description of Artificial Sequence: Synthetic polypeptide
YESEIRTTNPSQTEQYGSVSTGNNLQQNGNS

SEQ ID NO: 55474 - protein, 32 aa, Artificial Sequence
  Description of Artificial Sequence: Synthetic polypeptide
DEEEIRTTNPVATEGYGSVSTMELNDEFGNNE

SEQ ID NO: 55475 - protein, 31 aa, Artificial Sequence
  Description of Artificial Sequence: Synthetic polypeptide
YESEIRTTNPVATEQWGSVSCINEPQDRGNG

SEQ ID NO: 55476 - protein, 31 aa, Artificial Sequence
  Description of Artificial Sequence: Synthetic polypeptide
YESEIRTTNPVATEQYGSVSCINEPQDSGNG

SEQ ID NO: 55477 - protein, 32 aa, Artificial Sequence
  Description of Artificial Sequence: Synthetic polypeptide
DEEEIRTTNPVATEGYGSVSTENHQNFNSNQS

SEQ ID NO: 55478 - protein, 32 aa, Artificial Sequence
  Description of Artificial Sequence: Synthetic polypeptide
DEEEIRTTNPVATEGYGSVSTEHQEGFGSNDS

SEQ ID NO: 55479 - protein, 32 aa, Artificial Sequence
  Description of Artificial Sequence: Synthetic polypeptide
YGEEIRTTNPVAIEQYGSSVSNTWNIERGNRV

SEQ ID NO: 55480 - protein, 31 aa, Artificial Sequence
  Description of Artificial Sequence: Synthetic polypeptide
YGEEIRTTNPVATECWGSVSFTNSLEIGNRI

SEQ ID NO: 55481 - protein, 30 aa, Artificial Sequence
  Description of Artificial Sequence: Synthetic polypeptide
YGEEIRTTNPVATEQYGNVSTTNFDQNVER

SEQ ID NO: 55482 - protein, 30 aa, Artificial Sequence
  Description of Artificial Sequence: Synthetic polypeptide
YPEEIRSTNPVATEQYGSVSTNMIEEIGNI

SEQ ID NO: 55483 - protein, 31 aa, Artificial Sequence
  Description of Artificial Sequence: Synthetic polypeptide
YPEEIRTTNPVATEQYGQVVSHENNQGGGNR

SEQ ID NO: 55484 - protein, 33 aa, Artificial Sequence
  Description of Artificial Sequence: Synthetic polypeptide
DEEEIRTTNPVATEGYGSVSTDNEGQSEGTNIQ

SEQ ID NO: 55485 - protein, 30 aa, Artificial Sequence
  Description of Artificial Sequence: Synthetic polypeptide
YSEEIRTTNPVATEQYGSIIECNLDRMNNR

SEQ ID NO: 55486 - protein, 34 aa, Artificial Sequence
  Description of Artificial Sequence: Synthetic polypeptide
DEEEIRTTNPVATEGYGSVSSTTAGQMRVGMNPR

SEQ ID NO: 55487 - protein, 31 aa, Artificial Sequence
  Description of Artificial Sequence: Synthetic polypeptide
YSEEIRTTNPVATEQYGSVISTFNDANWGNT

SEQ ID NO: 55488 - protein, 33 aa, Artificial Sequence
  Description of Artificial Sequence: Synthetic polypeptide
DEEEIRTTNPVATEGYGSVSTMELQDEFGNNNT

SEQ ID NO: 55489 - protein, 33 aa, Artificial Sequence
  Description of Artificial Sequence: Synthetic polypeptide
DEEEIRTTNPVATEGYGSVSTMELQDEFGNTNN

SEQ ID NO: 55490 - protein, 28 aa, Artificial Sequence
  Description of Artificial Sequence: Synthetic peptide
YESEIRSTNPVCTEQWGVVSDNLQSGNG

SEQ ID NO: 55491 - protein, 28 aa, Artificial Sequence
  Description of Artificial Sequence: Synthetic peptide
YESEIATVNPVCTEQYGVVSDNLQSGNQ

SEQ ID NO: 55492 - protein, 29 aa, Artificial Sequence
  Description of Artificial Sequence: Synthetic peptide
YEQEIATVNPVCTEQYGSVSATNLQHGEQ

SEQ ID NO: 55493 - protein, 30 aa, Artificial Sequence
  Description of Artificial Sequence: Synthetic polypeptide
YEQEIRTTNPVATEAYGNTVSTLEQGGINR

SEQ ID NO: 55494 - protein, 31 aa, Artificial Sequence
  Description of Artificial Sequence: Synthetic polypeptide
YEQEIRTTNPVATEQYGSVSTLTNTRFGNHN

SEQ ID NO: 55495 - protein, 32 aa, Artificial Sequence
  Description of Artificial Sequence: Synthetic polypeptide
YEREIMTTNPVATEQYGSVSSTPNGLVQRINN

SEQ ID NO: 55496 - protein, 28 aa, Artificial Sequence
  Description of Artificial Sequence: Synthetic peptide
YESEIASTNPVATECWGSVSCNEQRGNG

SEQ ID NO: 55497 - protein, 29 aa, Artificial Sequence
  Description of Artificial Sequence: Synthetic peptide
YESEIASTNPVCTEQYGSVSDNEQREGNQ

SEQ ID NO: 55498 - protein, 28 aa, Artificial Sequence
  Description of Artificial Sequence: Synthetic peptide
YESEIASTNPVCTEQYGVVSDNLQSGNQ

SEQ ID NO: 55499 - protein, 29 aa, Artificial Sequence
  Description of Artificial Sequence: Synthetic peptide
YEETICTTNPVATEQYGSVNMNSGDRGNS

SEQ ID NO: 55500 - protein, 28 aa, Artificial Sequence
  Description of Artificial Sequence: Synthetic peptide
YESEIASVNPVCTEQYGVVSDNLQRGNQ

SEQ ID NO: 55501 - protein, 29 aa, Artificial Sequence
  Description of Artificial Sequence: Synthetic peptide
YESEIATTNPVCTEQYGVVSDINLQSGNQ

SEQ ID NO: 55502 - protein, 29 aa, Artificial Sequence
  Description of Artificial Sequence: Synthetic peptide
YESEIATVNPVATEQYGVVSDNLQDSGNQ

SEQ ID NO: 55503 - protein, 29 aa, Artificial Sequence
  Description of Artificial Sequence: Synthetic peptide
YESEIATVNPVATEQYGVVSDNLQSEGNQ

SEQ ID NO: 55504 - protein, 33 aa, Artificial Sequence
  Description of Artificial Sequence: Synthetic polypeptide
DEEEIRTTNPVATEGYGSVSTMNLDQEEGGGDE

SEQ ID NO: 55505 - protein, 33 aa, Artificial Sequence
  Description of Artificial Sequence: Synthetic polypeptide
DEEEIRTTNPVATEGYGSVSTMNGFGQGGENTE

SEQ ID NO: 55506 - protein, 33 aa, Artificial Sequence
  Description of Artificial Sequence: Synthetic polypeptide
DEEEIRTTNPVATEGYGSVSTMLDLEQGGGNDG

SEQ ID NO: 55507 - protein, 33 aa, Artificial Sequence
  Description of Artificial Sequence: Synthetic polypeptide
DEEEIRTTNPVATEGYGSVSTMELQNEFGGNNQ

SEQ ID NO: 55508 - protein, 34 aa, Artificial Sequence
  Description of Artificial Sequence: Synthetic polypeptide
DEEEIRTTNPVATEGYGSVSTMNLDQNGGENIDV

SEQ ID NO: 55509 - protein, 28 aa, Artificial Sequence
  Description of Artificial Sequence: Synthetic peptide
YEEEIASVNPVCTEQYGVVSDNLQMGNQ

SEQ ID NO: 55510 - protein, 29 aa, Artificial Sequence
  Description of Artificial Sequence: Synthetic peptide
YEETICTTNPVATEQYGSVNIMNGQRGGS

SEQ ID NO: 55511 - protein, 31 aa, Artificial Sequence
  Description of Artificial Sequence: Synthetic polypeptide
YEESEIRTTNPVAVSQYGSVASWMNLERDNR

SEQ ID NO: 55512 - protein, 29 aa, Artificial Sequence
  Description of Artificial Sequence: Synthetic peptide
YEEEIRTTNPVATEQYGVVSDILMAAGDA

SEQ ID NO: 55513 - protein, 33 aa, Artificial Sequence
  Description of Artificial Sequence: Synthetic polypeptide
YEEEIRTTNPVCTEQYGSVSSDPNLQMRNGMNV

SEQ ID NO: 55514 - protein, 33 aa, Artificial Sequence
  Description of Artificial Sequence: Synthetic polypeptide
YEEEIRTTNPVCTEQYGSVSSTPNLNMRNGMNV

SEQ ID NO: 55515 - protein, 32 aa, Artificial Sequence
  Description of Artificial Sequence: Synthetic polypeptide
YEEEIRTVNPVATEQYGSVSSTPALQMSGMNV

SEQ ID NO: 55516 - protein, 28 aa, Artificial Sequence
  Description of Artificial Sequence: Synthetic peptide
YEEEISSVNPVCTEQYGVVSDNLQSGNQ

SEQ ID NO: 55517 - protein, 34 aa, Artificial Sequence
  Description of Artificial Sequence: Synthetic polypeptide
DEEEIRTTNPVATEPYGISVQSTVEGLQPRIVNR

SEQ ID NO: 55518 - protein, 32 aa, Artificial Sequence
  Description of Artificial Sequence: Synthetic polypeptide
DEEEIRTTNPVATEPYGISVLTVNNQPNIVNR

SEQ ID NO: 55519 - protein, 34 aa, Artificial Sequence
  Description of Artificial Sequence: Synthetic polypeptide
DEEEIRTTNPVATEPYGISTSTVNDLQDRIGNDN

SEQ ID NO: 55520 - protein, 32 aa, Artificial Sequence
  Description of Artificial Sequence: Synthetic polypeptide
DEEEIRTTNPVATEPYGISGSYVNLQDRIKND

SEQ ID NO: 55521 - protein, 32 aa, Artificial Sequence
  Description of Artificial Sequence: Synthetic polypeptide
DEEEIRTTNPVATEPYGISCSTVNLQDTIKNP

SEQ ID NO: 55522 - protein, 33 aa, Artificial Sequence
  Description of Artificial Sequence: Synthetic polypeptide
DEEEIRTTNPVATEPYGISCSTVNLQDRIDNAE

SEQ ID NO: 55523 - protein, 32 aa, Artificial Sequence
  Description of Artificial Sequence: Synthetic polypeptide
DEEEIRTTNPVATEPYGISCSTVNLQDRIDDD

SEQ ID NO: 55524 - protein, 33 aa, Artificial Sequence
  Description of Artificial Sequence: Synthetic polypeptide
DEEEIRTTNPVATEPYGISCSNTVNLQDSINNR

SEQ ID NO: 55525 - protein, 32 aa, Artificial Sequence
  Description of Artificial Sequence: Synthetic polypeptide
DEEEIRTTNPVATEPYGISCATVNLQDMIENR

SEQ ID NO: 55526 - protein, 33 aa, Artificial Sequence
  Description of Artificial Sequence: Synthetic polypeptide
DEEEIRTTNPVATEPYGCVCSTSNLTQQGDQVR

SEQ ID NO: 55527 - protein, 31 aa, Artificial Sequence
  Description of Artificial Sequence: Synthetic polypeptide
YEEEIRTTNPVATEQYGTVSLNLQGVEGVPW

SEQ ID NO: 55528 - protein, 31 aa, Artificial Sequence
  Description of Artificial Sequence: Synthetic polypeptide
DEEEIRTTNPVATEPWGTCGTNNLGQARGND

SEQ ID NO: 55529 - protein, 32 aa, Artificial Sequence
  Description of Artificial Sequence: Synthetic polypeptide
YEEEIRTTNPVATEQYGSVSTLTPTQRFGTIN

SEQ ID NO: 55530 - protein, 32 aa, Artificial Sequence
  Description of Artificial Sequence: Synthetic polypeptide
YEEEIRTTNPVATEQYGSVSTLTHVQRFGTHN

SEQ ID NO: 55531 - protein, 32 aa, Artificial Sequence
  Description of Artificial Sequence: Synthetic polypeptide
YEEEIRTTNPLATEQYGSVSTLTNTGRFGTRN

SEQ ID NO: 55532 - protein, 31 aa, Artificial Sequence
  Description of Artificial Sequence: Synthetic polypeptide
YEEEIRTTNPVATEQYGAVSAHLQGVEGVPR

SEQ ID NO: 55533 - protein, 33 aa, Artificial Sequence
  Description of Artificial Sequence: Synthetic polypeptide
YEEEIRTTNPVATEQYGAVSFTNLQTVEGVHRK

SEQ ID NO: 55534 - protein, 32 aa, Artificial Sequence
  Description of Artificial Sequence: Synthetic polypeptide
YEEEIRTTNPVATEQYGAVSLNLQGYEGVPRE

SEQ ID NO: 55535 - protein, 33 aa, Artificial Sequence
  Description of Artificial Sequence: Synthetic polypeptide
YEEEIRTTNPVATEQYGAVVEPSTNANQDFGNR

SEQ ID NO: 55536 - protein, 33 aa, Artificial Sequence
  Description of Artificial Sequence: Synthetic polypeptide
YEEEIRTTNPVATEQYGAVVSPTNANQCFGVNR

SEQ ID NO: 55537 - protein, 32 aa, Artificial Sequence
  Description of Artificial Sequence: Synthetic polypeptide
YEEEIRTTNPVATEQYGEVETGNLRQRRHGEI

SEQ ID NO: 55538 - protein, 32 aa, Artificial Sequence
  Description of Artificial Sequence: Synthetic polypeptide
YEEEIRTTNPVATEQYGHVSTLTNETRFGTRN

SEQ ID NO: 55539 - protein, 35 aa, Artificial Sequence
  Description of Artificial Sequence: Synthetic polypeptide
YEEEIRTTNPVATEQYGSAVMLNTNDLQCRGNDRY

SEQ ID NO: 55540 - protein, 30 aa, Artificial Sequence
  Description of Artificial Sequence: Synthetic polypeptide
YEEEIRTTNPVATEQYGSVNTIITNIPQNR

SEQ ID NO: 55541 - protein, 32 aa, Artificial Sequence
  Description of Artificial Sequence: Synthetic polypeptide
YEEEIRTTNPVATEQYGSVSELKNTQRFGTHN

SEQ ID NO: 55542 - protein, 34 aa, Artificial Sequence
  Description of Artificial Sequence: Synthetic polypeptide
YEEEIRTTNPVATEQYGSVSSTDNLPNMRNGMNV

SEQ ID NO: 55543 - protein, 33 aa, Artificial Sequence
  Description of Artificial Sequence: Synthetic polypeptide
YEEEIRTTNPVATEQYGSVSSTPALNMRNGMNV

SEQ ID NO: 55544 - protein, 32 aa, Artificial Sequence
  Description of Artificial Sequence: Synthetic polypeptide
YEEEIRTTNPVATEQYGSVSTDNTNTRFGTHN

SEQ ID NO: 55545 - protein, 32 aa, Artificial Sequence
  Description of Artificial Sequence: Synthetic polypeptide
YEEEIRTTNPVATEQYGSVSTLQTTQRFGTHN

SEQ ID NO: 55546 - protein, 32 aa, Artificial Sequence
  Description of Artificial Sequence: Synthetic polypeptide
YEEEIRTTNPVATEQYGSVSTLTNRTNFGTRN

SEQ ID NO: 55547 - protein, 34 aa, Artificial Sequence
  Description of Artificial Sequence: Synthetic polypeptide
DEEEIRTTNPVATEPWGSVSYTNALSQRNGGPRP

SEQ ID NO: 55548 - protein, 32 aa, Artificial Sequence
  Description of Artificial Sequence: Synthetic polypeptide
DEEEIRTTNPVATEPWGSVSCTNMVPQTGGNH

SEQ ID NO: 55549 - protein, 33 aa, Artificial Sequence
  Description of Artificial Sequence: Synthetic polypeptide
DEEEIRTTNPVATEPWGISVVTVNLQDGGIKNR

SEQ ID NO: 55550 - protein, 30 aa, Artificial Sequence
  Description of Artificial Sequence: Synthetic polypeptide
YEEEIVTTNPVATEHYGFVCSCNQQRGNTI

SEQ ID NO: 55551 - protein, 31 aa, Artificial Sequence
  Description of Artificial Sequence: Synthetic polypeptide
YEEEIVTTNPVATEQYGFVHSCNDQQRGNTI

SEQ ID NO: 55552 - protein, 28 aa, Artificial Sequence
  Description of Artificial Sequence: Synthetic peptide
YEEEVASVNPVCTEQYGSVSDNLQSGNQ

SEQ ID NO: 55553 - protein, 29 aa, Artificial Sequence
  Description of Artificial Sequence: Synthetic peptide
YEEGICTTNPVATEQYGSVSINVINRGFS

SEQ ID NO: 55554 - protein, 30 aa, Artificial Sequence
  Description of Artificial Sequence: Synthetic polypeptide
YEEGICTTNPVATEQYGSVSMMVSQRVGNS

SEQ ID NO: 55555 - protein, 33 aa, Artificial Sequence
  Description of Artificial Sequence: Synthetic polypeptide
DEEEIRTTNPVATEHYGISVPSCTNEFQAGGSR

SEQ ID NO: 55556 - protein, 31 aa, Artificial Sequence
  Description of Artificial Sequence: Synthetic polypeptide
YEEGICTTNPVATEQYGSVSMNNSQTRGNQS

SEQ ID NO: 55557 - protein, 33 aa, Artificial Sequence
  Description of Artificial Sequence: Synthetic polypeptide
DEEEIRTTNPVATEHYGCVCSTNLQFFGSENQP

SEQ ID NO: 55558 - protein, 31 aa, Artificial Sequence
  Description of Artificial Sequence: Synthetic polypeptide
DEEEIRTTNPVATEHYGCVCSTEHQNMGSNQ

SEQ ID NO: 55559 - protein, 29 aa, Artificial Sequence
  Description of Artificial Sequence: Synthetic peptide
YEEGITTTNPVATEQYGSVSMNSQPLVNS

SEQ ID NO: 55560 - protein, 32 aa, Artificial Sequence
  Description of Artificial Sequence: Synthetic polypeptide
DEEEIRTTNPVATEHWGIVVSTNHSQRPGGNE

SEQ ID NO: 55561 - protein, 34 aa, Artificial Sequence
  Description of Artificial Sequence: Synthetic polypeptide
YEEHIRTTNPVATEQYGCAVSNSTNLTQRNGNRF

SEQ ID NO: 55562 - protein, 31 aa, Artificial Sequence
  Description of Artificial Sequence: Synthetic polypeptide
YEEIIRTTNPVATEQYGSVETCNAVAGGNRN

SEQ ID NO: 55563 - protein, 32 aa, Artificial Sequence
  Description of Artificial Sequence: Synthetic polypeptide
DEEEIRTTNPVATEGYGVVSTMELQDEFGNEN

SEQ ID NO: 55564 - protein, 30 aa, Artificial Sequence
  Description of Artificial Sequence: Synthetic polypeptide
YEEQIRTCNPVATEQYGSVSQSFLQERGDV

SEQ ID NO: 55565 - protein, 28 aa, Artificial Sequence
  Description of Artificial Sequence: Synthetic peptide
YEEEIVSVNPVCTEQYGVVSDNLQSGNQ

SEQ ID NO: 55566 - protein, 29 aa, Artificial Sequence
  Description of Artificial Sequence: Synthetic peptide
YEEEIVSTNPVATEQYGTVSTDNPESGND

SEQ ID NO: 55567 - protein, 29 aa, Artificial Sequence
  Description of Artificial Sequence: Synthetic peptide
YEEEIVSTNPVATEQYGTVSTDNPEFGND

SEQ ID NO: 55568 - protein, 28 aa, Artificial Sequence
  Description of Artificial Sequence: Synthetic peptide
YEEEITSVNPVCTEQYGVVSDNLQSGNQ

SEQ ID NO: 55569 - protein, 33 aa, Artificial Sequence
  Description of Artificial Sequence: Synthetic polypeptide
DEEEIRTTNPVATEPWGISVSTVNQLQDMIKNR

SEQ ID NO: 55570 - protein, 34 aa, Artificial Sequence
  Description of Artificial Sequence: Synthetic polypeptide
DEEEIRTTNPVATEPWGISVSTVNLQDRNEKNTR

SEQ ID NO: 55571 - protein, 32 aa, Artificial Sequence
  Description of Artificial Sequence: Synthetic polypeptide
DEEEIRTTNPVATEPWGISVSTVNLGDVIKNR

SEQ ID NO: 55572 - protein, 33 aa, Artificial Sequence
  Description of Artificial Sequence: Synthetic polypeptide
DEEEIRTTNPVATEPWGISVRTWNDLQDRNTNR

SEQ ID NO: 55573 - protein, 33 aa, Artificial Sequence
  Description of Artificial Sequence: Synthetic polypeptide
DEEEIRTTNPVATEPWGISVRTWNDEQDRQGNR

SEQ ID NO: 55574 - protein, 30 aa, Artificial Sequence
  Description of Artificial Sequence: Synthetic polypeptide
DEEEIRTTNPVATENYGSVPATNAEGQENE

SEQ ID NO: 55575 - protein, 32 aa, Artificial Sequence
  Description of Artificial Sequence: Synthetic polypeptide
DEEEIRTTNPVATEMYGVVSTNLNIGQGNQGI

SEQ ID NO: 55576 - protein, 28 aa, Artificial Sequence
  Description of Artificial Sequence: Synthetic peptide
YEETIATVNPVCTEQYGVVSDNLQSGNQ

SEQ ID NO: 55577 - protein, 32 aa, Artificial Sequence
  Description of Artificial Sequence: Synthetic polypeptide
DEEEIRTTNPVATEMYGSVYSTECIQKTGNMM

SEQ ID NO: 55578 - protein, 29 aa, Artificial Sequence
  Description of Artificial Sequence: Synthetic peptide
DEEEIRTTNPVATEMWGTSCSTAELHGNS

SEQ ID NO: 55579 - protein, 34 aa, Artificial Sequence
  Description of Artificial Sequence: Synthetic polypeptide
DEEEIRTTNPVATELYGSVYSTNCIMQKESGNRE

SEQ ID NO: 55580 - protein, 31 aa, Artificial Sequence
  Description of Artificial Sequence: Synthetic polypeptide
DEEEIRTTNPVATELYGSVVSVENYSTHGNV

SEQ ID NO: 55581 - protein, 31 aa, Artificial Sequence
  Description of Artificial Sequence: Synthetic polypeptide
DEEEIRTTNPVATELYGSVSCMEDLEEWGNE

SEQ ID NO: 55582 - protein, 30 aa, Artificial Sequence
  Description of Artificial Sequence: Synthetic polypeptide
DEEEIRTTNPVATEHYGVVSATNFNQTAVE

SEQ ID NO: 55583 - protein, 32 aa, Artificial Sequence
  Description of Artificial Sequence: Synthetic polypeptide
DEEEIRTTNPVATEHYGVVPSCQNGSQEGNNR

SEQ ID NO: 55584 - protein, 34 aa, Artificial Sequence
  Description of Artificial Sequence: Synthetic polypeptide
DEEEIRTTNPVATEHYGTVTVSCTGELSQRGGNR

SEQ ID NO: 55585 - protein, 34 aa, Artificial Sequence
  Description of Artificial Sequence: Synthetic polypeptide
DEEEIRTTNPVATEMYGSVSCTNHLDMARAGNHQ

SEQ ID NO: 55586 - protein, 34 aa, Artificial Sequence
  Description of Artificial Sequence: Synthetic polypeptide
DEEEIRTTNPVATEQYGCVCSTENLQERFGSDQA

SEQ ID NO: 55587 - protein, 28 aa, Artificial Sequence
  Description of Artificial Sequence: Synthetic peptide
YEEEIASVNPVCTEQYGVVSDNLQKGNQ

SEQ ID NO: 55588 - protein, 28 aa, Artificial Sequence
  Description of Artificial Sequence: Synthetic peptide
YEEEIASVNPVCTEQYGVVSDNLQHGNQ

SEQ ID NO: 55589 - protein, 33 aa, Artificial Sequence
  Description of Artificial Sequence: Synthetic polypeptide
VEEEIRTTNPVATEQYGSVNTDTNLQMNGGNIG

SEQ ID NO: 55590 - protein, 33 aa, Artificial Sequence
  Description of Artificial Sequence: Synthetic polypeptide
VEEEIRTTNPVATEQYGSVNTQNLNQGEGENDD

SEQ ID NO: 55591 - protein, 33 aa, Artificial Sequence
  Description of Artificial Sequence: Synthetic polypeptide
VEEEIRTTNPVATEQYGSVNTSNLDQGGGENDD

SEQ ID NO: 55592 - protein, 34 aa, Artificial Sequence
  Description of Artificial Sequence: Synthetic polypeptide
DEEEIRTTNPVATEQWGHSNVSNTNFLQHRGGGP

SEQ ID NO: 55593 - protein, 34 aa, Artificial Sequence
  Description of Artificial Sequence: Synthetic polypeptide
DEEEIRTTNPVATEQWGHSNVSNTNFLQERAGGF

SEQ ID NO: 55594 - protein, 32 aa, Artificial Sequence
  Description of Artificial Sequence: Synthetic polypeptide
VEEEIRTTNPVATEQYGSVQCTYLQNRDNALA

SEQ ID NO: 55595 - protein, 33 aa, Artificial Sequence
  Description of Artificial Sequence: Synthetic polypeptide
VEEEIRTTNPVATEQYGSVSGSTDNGQTGGNGG

SEQ ID NO: 55596 - protein, 33 aa, Artificial Sequence
  Description of Artificial Sequence: Synthetic polypeptide
VEEEIRTTNPVATEQYGSVSGTNGQDEGGTNIF

SEQ ID NO: 55597 - protein, 34 aa, Artificial Sequence
  Description of Artificial Sequence: Synthetic polypeptide
VEEEIRTTNPVATEQYGSVSLTNGEIQVSGPNER

SEQ ID NO: 55598 - protein, 34 aa, Artificial Sequence
  Description of Artificial Sequence: Synthetic polypeptide
DEEEIRTTNPVATEQWGHSNVSHTNYLQHRTGGF

SEQ ID NO: 55599 - protein, 34 aa, Artificial Sequence
  Description of Artificial Sequence: Synthetic polypeptide
DEEEIRTTNPVATEQWGHSFVSYTNDLQHRPGGI

SEQ ID NO: 55600 - protein, 33 aa, Artificial Sequence
  Description of Artificial Sequence: Synthetic polypeptide
VEEEIRTTNPVATEQYGSVSLTPNLQPEGELGV

SEQ ID NO: 55601 - protein, 30 aa, Artificial Sequence
  Description of Artificial Sequence: Synthetic polypeptide
VEEEIRTTNPVATEQYGSVSPNDEQTQSEE

SEQ ID NO: 55602 - protein, 33 aa, Artificial Sequence
  Description of Artificial Sequence: Synthetic polypeptide
VEEEIRTTNPVATEQYGSVSPTNLVQPAQVNIE

SEQ ID NO: 55603 - protein, 33 aa, Artificial Sequence
  Description of Artificial Sequence: Synthetic polypeptide
VEEEIRTTNPVATEQYGSVSSTGLQGEEGNNNE

SEQ ID NO: 55604 - protein, 32 aa, Artificial Sequence
  Description of Artificial Sequence: Synthetic polypeptide
VEEEIRTTNPVATEQYGSVNMSNLDQEGENGD

SEQ ID NO: 55605 - protein, 33 aa, Artificial Sequence
  Description of Artificial Sequence: Synthetic polypeptide
DEEEIRTTNPVATEQWGESTVSTNLSTSGTTNE

SEQ ID NO: 55606 - protein, 33 aa, Artificial Sequence
  Description of Artificial Sequence: Synthetic polypeptide
VEEEIRTTNPVATEQYGSVGSTMNGQEDGGNTT

SEQ ID NO: 55607 - protein, 33 aa, Artificial Sequence
  Description of Artificial Sequence: Synthetic polypeptide
VEEEIRTTNPVATEQYGSVGSNTDLQGGEGNED

SEQ ID NO: 55608 - protein, 28 aa, Artificial Sequence
  Description of Artificial Sequence: Synthetic peptide
VEEEIASVNPVCTEQYGVVSYNLQSGNQ

SEQ ID NO: 55609 - protein, 34 aa, Artificial Sequence
  Description of Artificial Sequence: Synthetic polypeptide
DEEEIRTTNPVATEQWGHSTVSYTNYLQHRGGEF

SEQ ID NO: 55610 - protein, 34 aa, Artificial Sequence
  Description of Artificial Sequence: Synthetic polypeptide
DEEEIRTTNPVATEQWGHSNVSYTNPLQHRPGGT

SEQ ID NO: 55611 - protein, 34 aa, Artificial Sequence
  Description of Artificial Sequence: Synthetic polypeptide
DEEEIRTTNPVATEQWGHSNVSYTNPLQDRGGIF

SEQ ID NO: 55612 - protein, 34 aa, Artificial Sequence
  Description of Artificial Sequence: Synthetic polypeptide
DEEEIRTTNPVATEQWGHSNVSYTNMLQHRPGGQ

SEQ ID NO: 55613 - protein, 34 aa, Artificial Sequence
  Description of Artificial Sequence: Synthetic polypeptide
DEEEIRTTNPVATEQWGHSNVSYTNELQMRPGGS

SEQ ID NO: 55614 - protein, 29 aa, Artificial Sequence
  Description of Artificial Sequence: Synthetic peptide
VEEEIATTNPVATEQWGNVSVTMLQGGDS

SEQ ID NO: 55615 - protein, 31 aa, Artificial Sequence
  Description of Artificial Sequence: Synthetic polypeptide
VEEEIATTNPVATEQYGSCSTHLQPDQAGDR

SEQ ID NO: 55616 - protein, 31 aa, Artificial Sequence
  Description of Artificial Sequence: Synthetic polypeptide
VEEEIATTNPVAYEQYGSVATNLQESNNGRN

SEQ ID NO: 55617 - protein, 35 aa, Artificial Sequence
  Description of Artificial Sequence: Synthetic polypeptide
DEEEIRTTNPVATEQWGHSNVSYTNELQHRPGGDR

SEQ ID NO: 55618 - protein, 34 aa, Artificial Sequence
  Description of Artificial Sequence: Synthetic polypeptide
DEEEIRTTNPVATEQWGHSNVSYTNELQERPGGC

SEQ ID NO: 55619 - protein, 32 aa, Artificial Sequence
  Description of Artificial Sequence: Synthetic polypeptide
VEEEIRTTNPVATEGYGSVSTNGLQFGGQQFT

SEQ ID NO: 55620 - protein, 33 aa, Artificial Sequence
  Description of Artificial Sequence: Synthetic polypeptide
VEEEIRTTNPVATEPYGSTVSANLSQRTGGNNA

SEQ ID NO: 55621 - protein, 34 aa, Artificial Sequence
  Description of Artificial Sequence: Synthetic polypeptide
DEEEIRTTNPVATEQWGHSNVSNTNFLQTRPGEF

SEQ ID NO: 55622 - protein, 34 aa, Artificial Sequence
  Description of Artificial Sequence: Synthetic polypeptide
DEEEIRTTNPVATEQWGHSNVSNTNFLQSRPGGN

SEQ ID NO: 55623 - protein, 33 aa, Artificial Sequence
  Description of Artificial Sequence: Synthetic polypeptide
VEEEIRTTNPVATEQYGSVGSNTNLFNGGNNEQ

SEQ ID NO: 55624 - protein, 28 aa, Artificial Sequence
  Description of Artificial Sequence: Synthetic peptide
VEEEIASVNPVCTEQYGVVSDNLQSGNQ

SEQ ID NO: 55625 - protein, 34 aa, Artificial Sequence
  Description of Artificial Sequence: Synthetic polypeptide
DEEEIRTTNPVATEQWGESNVSYTNQLQIRSGGF

SEQ ID NO: 55626 - protein, 34 aa, Artificial Sequence
  Description of Artificial Sequence: Synthetic polypeptide
DEEEIRTTNPVATEQWGDSNVSYTNYLQERPGGF

SEQ ID NO: 55627 - protein, 33 aa, Artificial Sequence
  Description of Artificial Sequence: Synthetic polypeptide
VEEEIRTTNPVATEQYGSVSTTGNEQGGTGNGT

SEQ ID NO: 55628 - protein, 33 aa, Artificial Sequence
  Description of Artificial Sequence: Synthetic polypeptide
VEEEIRTTNPVATEQYGSVSTTLDQEEGGNNEQ

SEQ ID NO: 55629 - protein, 33 aa, Artificial Sequence
  Description of Artificial Sequence: Synthetic polypeptide
VEEEIRTTNPVATEQYGSVSTTLDQQTGQGNIG

SEQ ID NO: 55630 - protein, 31 aa, Artificial Sequence
  Description of Artificial Sequence: Synthetic polypeptide
VEEEIRTTNPVATEQYGSVSTTLQGTEVPQN

SEQ ID NO: 55631 - protein, 31 aa, Artificial Sequence
  Description of Artificial Sequence: Synthetic polypeptide
VEEEIRTTNPVATEQYGSVSTTSLGTEVPND

SEQ ID NO: 55632 - protein, 31 aa, Artificial Sequence
  Description of Artificial Sequence: Synthetic polypeptide
VEEEIRTTNPVATEQYGSVSVTTLTNTQNVN

SEQ ID NO: 55633 - protein, 33 aa, Artificial Sequence
  Description of Artificial Sequence: Synthetic polypeptide
VEEEIRTTNPVATEQYGSVSWTDNQQDRNANGH

SEQ ID NO: 55634 - protein, 32 aa, Artificial Sequence
  Description of Artificial Sequence: Synthetic polypeptide
VEEEIRTTNPVATEQYGVVSNTQNGQGEGGNI

SEQ ID NO: 55635 - protein, 32 aa, Artificial Sequence
  Description of Artificial Sequence: Synthetic polypeptide
VEEEIRTTNPVATEQYGVVSTDNGQEEGGGNV

SEQ ID NO: 55636 - protein, 33 aa, Artificial Sequence
  Description of Artificial Sequence: Synthetic polypeptide
VEEEIRTTNPVATEQYGVVSTNLAIGQGGNENV

SEQ ID NO: 55637 - protein, 33 aa, Artificial Sequence
  Description of Artificial Sequence: Synthetic polypeptide
VEEEIRTTNPVATERYGSVSYANLSQRTGGNNA

SEQ ID NO: 55638 - protein, 33 aa, Artificial Sequence
  Description of Artificial Sequence: Synthetic polypeptide
VEEEIRTTNPVAYEQWGSVFKTDNLDQRGENER

SEQ ID NO: 55639 - protein, 32 aa, Artificial Sequence
  Description of Artificial Sequence: Synthetic polypeptide
VEEEIRTTNPVAYERYGSVSCANLSQRPGGNA

SEQ ID NO: 55640 - protein, 34 aa, Artificial Sequence
  Description of Artificial Sequence: Synthetic polypeptide
VEEELRTTNPVATEQYGSVCSTWEQLDQREGNER

SEQ ID NO: 55641 - protein, 34 aa, Artificial Sequence
  Description of Artificial Sequence: Synthetic polypeptide
VEEELRTTNPVATEQYGSVCSTWNGEDQRIGNNR

SEQ ID NO: 55642 - protein, 34 aa, Artificial Sequence
  Description of Artificial Sequence: Synthetic polypeptide
VEEEIRTTNPVATEQYGSVSTPNLDQNGGEGQNI

SEQ ID NO: 55643 - protein, 30 aa, Artificial Sequence
  Description of Artificial Sequence: Synthetic polypeptide
DEEEIRTTNPVATEQWGDVSTIENNAAENA

SEQ ID NO: 55644 - protein, 33 aa, Artificial Sequence
  Description of Artificial Sequence: Synthetic polypeptide
VEEEIRTTNPVATEQYGSVSTNTLGVGGNNGGQ

SEQ ID NO: 55645 - protein, 32 aa, Artificial Sequence
  Description of Artificial Sequence: Synthetic polypeptide
VEEEIRTTNPVATEQYGSVSTNENQTSVQDRG

SEQ ID NO: 55646 - protein, 33 aa, Artificial Sequence
  Description of Artificial Sequence: Synthetic polypeptide
VEEEIRTTNPVATEQYGSVSSTNDQGQNGGNET

SEQ ID NO: 55647 - protein, 32 aa, Artificial Sequence
  Description of Artificial Sequence: Synthetic polypeptide
DEEEIRTTNPVATEQWGCVAMTNLNRGGMNDL

SEQ ID NO: 55648 - protein, 32 aa, Artificial Sequence
  Description of Artificial Sequence: Synthetic polypeptide
VEEEIRTTNPVATEQYGSVSTDGEGQDGENGV

SEQ ID NO: 55649 - protein, 33 aa, Artificial Sequence
  Description of Artificial Sequence: Synthetic polypeptide
VEEEIRTTNPVATEQYGSVSTDNEGQRGEGGEQ

SEQ ID NO: 55650 - protein, 34 aa, Artificial Sequence
  Description of Artificial Sequence: Synthetic polypeptide
DEEEIRTTNPVATEQWGCSNVSYTNNLQHRPGGF

SEQ ID NO: 55651 - protein, 32 aa, Artificial Sequence
  Description of Artificial Sequence: Synthetic polypeptide
DEEEIRTTNPVATEQWGCSISTNSSGHDGNGR

SEQ ID NO: 55652 - protein, 33 aa, Artificial Sequence
  Description of Artificial Sequence: Synthetic polypeptide
VEEEIRTTNPVATEQYGSVSTDNEGQSGGENGE

SEQ ID NO: 55653 - protein, 33 aa, Artificial Sequence
  Description of Artificial Sequence: Synthetic polypeptide
VEEEIRTTNPVATEQYGSVSTDNGNDQNEGGNQ

SEQ ID NO: 55654 - protein, 33 aa, Artificial Sequence
  Description of Artificial Sequence: Synthetic polypeptide
VEEEIRTTNPVATEQYGSVSTDNGQGEGNNEEE

SEQ ID NO: 55655 - protein, 33 aa, Artificial Sequence
  Description of Artificial Sequence: Synthetic polypeptide
VEEEIRTTNPVATEQYGSVSTDNGQTGEGNEEE

SEQ ID NO: 55656 - protein, 32 aa, Artificial Sequence
  Description of Artificial Sequence: Synthetic polypeptide
VEEEIRTTNPVATEQYGSVSTGTNGETGNGNE

SEQ ID NO: 55657 - protein, 32 aa, Artificial Sequence
  Description of Artificial Sequence: Synthetic polypeptide
VEEEIRTTNPVATEQYGSVSTGVTGQGEGGNA

SEQ ID NO: 55658 - protein, 32 aa, Artificial Sequence
  Description of Artificial Sequence: Synthetic polypeptide
VEEEIRTTNPVATEQYGSVSTMNLIANGVELM

SEQ ID NO: 55659 - protein, 33 aa, Artificial Sequence
  Description of Artificial Sequence: Synthetic polypeptide
VEEEIRTTNPVATEQYGSVSTMNTEIRGQNALM

SEQ ID NO: 55660 - protein, 32 aa, Artificial Sequence
  Description of Artificial Sequence: Synthetic polypeptide
VEEEIRTTNPVATEQYGSVSTNAGNTGNGGNI

SEQ ID NO: 55661 - protein, 34 aa, Artificial Sequence
  Description of Artificial Sequence: Synthetic polypeptide
DEEEIRTTNPVATEQWGASNVSYTNELQLRTGGF

SEQ ID NO: 55662 - protein, 28 aa, Artificial Sequence
  Description of Artificial Sequence: Synthetic peptide
VEEEIASVNPVCTEQYGVVSCNLQSGNA

SEQ ID NO: 55663 - protein, 30 aa, Artificial Sequence
  Description of Artificial Sequence: Synthetic polypeptide
VEEEIACTNPVATEQYGSVATNLQAEDNGV

SEQ ID NO: 55664 - protein, 30 aa, Artificial Sequence
  Description of Artificial Sequence: Synthetic polypeptide
VEEEIACTNPVATEQYGSVATNDQDSGNQD

SEQ ID NO: 55665 - protein, 31 aa, Artificial Sequence
  Description of Artificial Sequence: Synthetic polypeptide
TSEEIRTTNPLAYEHYGSTVSCFNLQREGNR

SEQ ID NO: 55666 - protein, 32 aa, Artificial Sequence
  Description of Artificial Sequence: Synthetic polypeptide
TSEEIRTTNPVATECYGSLVFCTNLQSVGNQR

SEQ ID NO: 55667 - protein, 33 aa, Artificial Sequence
  Description of Artificial Sequence: Synthetic polypeptide
DEEEIRTTNPVATEQWGSTVSTNMGSPQTGTNH

SEQ ID NO: 55668 - protein, 31 aa, Artificial Sequence
  Description of Artificial Sequence: Synthetic polypeptide
TSEEIRTTNPVATECYGSVFCTNLHSVGNTR

SEQ ID NO: 55669 - protein, 31 aa, Artificial Sequence
  Description of Artificial Sequence: Synthetic polypeptide
TSEEIRTTNPVATECYGSVFCTNLQNSVGNS

SEQ ID NO: 55670 - protein, 32 aa, Artificial Sequence
  Description of Artificial Sequence: Synthetic polypeptide
TSEEIRTTNPVATECYGSVVFCTQNLQSVGNR

SEQ ID NO: 55671 - protein, 33 aa, Artificial Sequence
  Description of Artificial Sequence: Synthetic polypeptide
TSEEIRTTNPVATEHYGSTVCSTALSQRGGNRC

SEQ ID NO: 55672 - protein, 33 aa, Artificial Sequence
  Description of Artificial Sequence: Synthetic polypeptide
TSEEIRTTNPVATEHYGSVCSTGAELSQRGGNR

SEQ ID NO: 55673 - protein, 33 aa, Artificial Sequence
  Description of Artificial Sequence: Synthetic polypeptide
TSEEIRTTNPVATEPYGSVSCTPLSQDRGGNPR

SEQ ID NO: 55674 - protein, 32 aa, Artificial Sequence
  Description of Artificial Sequence: Synthetic polypeptide
TSEEIRTTNPVATEQYGCTVSCTNLSMDGGNR

SEQ ID NO: 55675 - protein, 33 aa, Artificial Sequence
  Description of Artificial Sequence: Synthetic polypeptide
DEEEIRTTNPVATEQWGSTVPSTNMESPQTGNH

SEQ ID NO: 55676 - protein, 33 aa, Artificial Sequence
  Description of Artificial Sequence: Synthetic polypeptide
TSEEIRTTNPVATEQYGSVSCTNALSDRGGNLG

SEQ ID NO: 55677 - protein, 32 aa, Artificial Sequence
  Description of Artificial Sequence: Synthetic polypeptide
DEEEIRTTNPVATEQWGSTSMTNNLPTMIGNH

SEQ ID NO: 55678 - protein, 31 aa, Artificial Sequence
  Description of Artificial Sequence: Synthetic polypeptide
TSEEIRTTNPVAYECYGSVFCTNLQSVGNRS

SEQ ID NO: 55679 - protein, 32 aa, Artificial Sequence
  Description of Artificial Sequence: Synthetic polypeptide
DEEEIRTTNPVATEQWGSSYSLPNMLQDQDNR

SEQ ID NO: 55680 - protein, 31 aa, Artificial Sequence
  Description of Artificial Sequence: Synthetic polypeptide
TSEEIRSTNPVAYEQYGSTVSTNMLQNGGTR

SEQ ID NO: 55681 - protein, 31 aa, Artificial Sequence
  Description of Artificial Sequence: Synthetic polypeptide
TSEEIRTTNPVAYEQWGSVPSTLLSQRGTTR

SEQ ID NO: 55682 - protein, 31 aa, Artificial Sequence
  Description of Artificial Sequence: Synthetic polypeptide
TSEEIRSTNPVATEQYGSISCTNGSQRGGNN

SEQ ID NO: 55683 - protein, 31 aa, Artificial Sequence
  Description of Artificial Sequence: Synthetic polypeptide
TQEEIRTTNPVATEQWGTVSCTNMLQTGGNQ

SEQ ID NO: 55684 - protein, 31 aa, Artificial Sequence
  Description of Artificial Sequence: Synthetic polypeptide
TESEIRTTNPVAYEQYGSVPWTNMLQIGGSR

SEQ ID NO: 55685 - protein, 30 aa, Artificial Sequence
  Description of Artificial Sequence: Synthetic polypeptide
TEYEIRATNPVAYEQYGSVFTNLQHGGNNQ

SEQ ID NO: 55686 - protein, 30 aa, Artificial Sequence
  Description of Artificial Sequence: Synthetic polypeptide
TEYEIRCTNPVATEQYGSVETDLTQEHGNQ

SEQ ID NO: 55687 - protein, 30 aa, Artificial Sequence
  Description of Artificial Sequence: Synthetic polypeptide
TGEEIRTTNPVAYEQWGSVTSTLLEDRGTR

SEQ ID NO: 55688 - protein, 30 aa, Artificial Sequence
  Description of Artificial Sequence: Synthetic polypeptide
TNAEIATTNPVATEQYGVVSWNELQDGPNR

SEQ ID NO: 55689 - protein, 30 aa, Artificial Sequence
  Description of Artificial Sequence: Synthetic polypeptide
TNEEIATTNPVATTQYGSVSTNPMGDGDNR

SEQ ID NO: 55690 - protein, 31 aa, Artificial Sequence
  Description of Artificial Sequence: Synthetic polypeptide
TNEEIRTTNPVATEQYGEVSTGQGDQRGGND

SEQ ID NO: 55691 - protein, 32 aa, Artificial Sequence
  Description of Artificial Sequence: Synthetic polypeptide
TNEEIRTTNPVATEQYGSVSTDQGDQRGGNTD

SEQ ID NO: 55692 - protein, 32 aa, Artificial Sequence
  Description of Artificial Sequence: Synthetic polypeptide
TNEEIRTTNPVATEQYGSVSTDQGDQRQGNDS

SEQ ID NO: 55693 - protein, 32 aa, Artificial Sequence
  Description of Artificial Sequence: Synthetic polypeptide
TNEEIRTTNPVATEQYGSVSTGGLGNTGGENR

SEQ ID NO: 55694 - protein, 29 aa, Artificial Sequence
  Description of Artificial Sequence: Synthetic peptide
TNEEISTTNPVATTQWGSVSTNPMSGDNR

SEQ ID NO: 55695 - protein, 29 aa, Artificial Sequence
  Description of Artificial Sequence: Synthetic peptide
TNEEISTTNPVATTQYGCVSTNPMGDGNR

SEQ ID NO: 55696 - protein, 30 aa, Artificial Sequence
  Description of Artificial Sequence: Synthetic polypeptide
TNEEISTTNPVATTQYGSVSTNPMNDGDNR

SEQ ID NO: 55697 - protein, 32 aa, Artificial Sequence
  Description of Artificial Sequence: Synthetic polypeptide
DEEEIRTTNPVATEQWGSVATNMFSPQTGGNP

SEQ ID NO: 55698 - protein, 32 aa, Artificial Sequence
  Description of Artificial Sequence: Synthetic polypeptide
TQEEIRTTNPVATEQWGTTVSCTNLQEGGNRV

SEQ ID NO: 55699 - protein, 31 aa, Artificial Sequence
  Description of Artificial Sequence: Synthetic polypeptide
TQEEIRTTNPVAYEQWGTVPSTGNLQEGGNR

SEQ ID NO: 55700 - protein, 32 aa, Artificial Sequence
  Description of Artificial Sequence: Synthetic polypeptide
DEEEIRTTNPVATEQWGSSYSLPNMDQREDNR

SEQ ID NO: 55701 - protein, 33 aa, Artificial Sequence
  Description of Artificial Sequence: Synthetic polypeptide
DEEEIRTTNPVATEQWGSSYSLPNDLDQRNDNR

SEQ ID NO: 55702 - protein, 31 aa, Artificial Sequence
  Description of Artificial Sequence: Synthetic polypeptide
TSEEIRTTNPVAYHQYGSVSTWELQRGGNNQ

SEQ ID NO: 55703 - protein, 30 aa, Artificial Sequence
  Description of Artificial Sequence: Synthetic polypeptide
TTEEIRTTNPVATEQWGAVSTGNQQEGGNG

SEQ ID NO: 55704 - protein, 33 aa, Artificial Sequence
  Description of Artificial Sequence: Synthetic polypeptide
DEEEIRTTNPVATEQWGKVVSTGPLSQGGNNRG

SEQ ID NO: 55705 - protein, 32 aa, Artificial Sequence
  Description of Artificial Sequence: Synthetic polypeptide
DEEEIRTTNPVATEQWGKVVSTGPLQGGGNNQ

SEQ ID NO: 55706 - protein, 29 aa, Artificial Sequence
  Description of Artificial Sequence: Synthetic peptide
TTEEIRTTNPVATEQWGTVSTDGGQEGNI

SEQ ID NO: 55707 - protein, 30 aa, Artificial Sequence
  Description of Artificial Sequence: Synthetic polypeptide
TTEEIRTTNPVATEQWGTVSTNGQGEGNEG

SEQ ID NO: 55708 - protein, 31 aa, Artificial Sequence
  Description of Artificial Sequence: Synthetic polypeptide
TTEEIRTTNPVATEQWGTVSTNLQAEGGGNI

SEQ ID NO: 55709 - protein, 28 aa, Artificial Sequence
  Description of Artificial Sequence: Synthetic peptide
TTEEIRTTNPVATEQWGTVVTNGGEGNE

SEQ ID NO: 55710 - protein, 29 aa, Artificial Sequence
  Description of Artificial Sequence: Synthetic peptide
TTEEIRTTNPVATEQWGVVSTNGGQEGGM

SEQ ID NO: 55711 - protein, 28 aa, Artificial Sequence
  Description of Artificial Sequence: Synthetic peptide
VCNEIACTNPVATEQYGEASENLQRGGR

SEQ ID NO: 55712 - protein, 28 aa, Artificial Sequence
  Description of Artificial Sequence: Synthetic peptide
VEDEIACTNPVATEQYGCVATNLQDGEN

SEQ ID NO: 55713 - protein, 30 aa, Artificial Sequence
  Description of Artificial Sequence: Synthetic polypeptide
VEDEIATTNPVATEQYGSVATNLQDPGEGN

SEQ ID NO: 55714 - protein, 30 aa, Artificial Sequence
  Description of Artificial Sequence: Synthetic polypeptide
VEDEIATTNPVAYEQYGSVATNLQQGPNDQ

SEQ ID NO: 55715 - protein, 31 aa, Artificial Sequence
  Description of Artificial Sequence: Synthetic polypeptide
VEDEVATTNPVAYEQYGSVATPNLDQRIGNR

SEQ ID NO: 55716 - protein, 33 aa, Artificial Sequence
  Description of Artificial Sequence: Synthetic polypeptide
VEDEVRTTNPVATEQWGSVSKTENLDQREGNER

SEQ ID NO: 55717 - protein, 33 aa, Artificial Sequence
  Description of Artificial Sequence: Synthetic polypeptide
DEEEIRTTNPVATEQWGKVVPSTGPLSQGGNYR

SEQ ID NO: 55718 - protein, 33 aa, Artificial Sequence
  Description of Artificial Sequence: Synthetic polypeptide
DEEEIRTTNPVATEQWGKVVSYTGDLSQGGNYR

SEQ ID NO: 55719 - protein, 31 aa, Artificial Sequence
  Description of Artificial Sequence: Synthetic polypeptide
TTEEIRSTNPVATEQYGSVVSTNLQNGGGGQ

SEQ ID NO: 55720 - protein, 32 aa, Artificial Sequence
  Description of Artificial Sequence: Synthetic polypeptide
TTEEIRATNPVATEQYGSVVSITNLQFNGETR

SEQ ID NO: 55721 - protein, 29 aa, Artificial Sequence
  Description of Artificial Sequence: Synthetic peptide
TTAEIRTTNPVATEQYGVTTSTVLQDGNT

SEQ ID NO: 55722 - protein, 32 aa, Artificial Sequence
  Description of Artificial Sequence: Synthetic polypeptide
TSEEIRTTNPVGTEQWGCVSCTNLSQRGTVNR

SEQ ID NO: 55723 - protein, 31 aa, Artificial Sequence
  Description of Artificial Sequence: Synthetic polypeptide
DEEEIRTTNPVATEQWGSASEINEQHEGENG

SEQ ID NO: 55724 - protein, 32 aa, Artificial Sequence
  Description of Artificial Sequence: Synthetic polypeptide
TSEEIRTTNPVGTEQWGMVSTNELSQRVGVNR

SEQ ID NO: 55725 - protein, 31 aa, Artificial Sequence
  Description of Artificial Sequence: Synthetic polypeptide
TSEEIRTTNPVGTEQWGQVSCTNLSQRGGVR

SEQ ID NO: 55726 - protein, 29 aa, Artificial Sequence
  Description of Artificial Sequence: Synthetic peptide
TTAEIRTTNPVATEQYGDVTSTVDQHGNT

SEQ ID NO: 55727 - protein, 29 aa, Artificial Sequence
  Description of Artificial Sequence: Synthetic peptide
TTAEIRTTNPVATEQYGQCSTVDQGEGNR

SEQ ID NO: 55728 - protein, 34 aa, Artificial Sequence
  Description of Artificial Sequence: Synthetic polypeptide
DEEEIRTTNPVATEQWGQSNVSYTNDLQTRIGGF

SEQ ID NO: 55729 - protein, 31 aa, Artificial Sequence
  Description of Artificial Sequence: Synthetic polypeptide
VEEEVATTNPVATEQWGSVSTGVLDQDDGNR

SEQ ID NO: 55730 - protein, 34 aa, Artificial Sequence
  Description of Artificial Sequence: Synthetic polypeptide
DEEEIRTTNPVATEQWGQSNVSYTNDLQARPGEF

SEQ ID NO: 55731 - protein, 28 aa, Artificial Sequence
  Description of Artificial Sequence: Synthetic peptide
TTAEIRTTNPVATEQYGTCSTVDQFGND

SEQ ID NO: 55732 - protein, 33 aa, Artificial Sequence
  Description of Artificial Sequence: Synthetic polypeptide
DEEEIRTTNPVATEQWGNTTTSTNELQGNGNDR

SEQ ID NO: 55733 - protein, 33 aa, Artificial Sequence
  Description of Artificial Sequence: Synthetic polypeptide
DEEEIRTTNPVATEQWGNTTSTNELQGNGDNRN

SEQ ID NO: 55734 - protein, 32 aa, Artificial Sequence
  Description of Artificial Sequence: Synthetic polypeptide
DEEEIRTTNPVATEQWGNTTSTNELQGMGNEH

SEQ ID NO: 55735 - protein, 32 aa, Artificial Sequence
  Description of Artificial Sequence: Synthetic polypeptide
DEEEIRTTNPVATEQWGNTTSTNELPQGNGNF

SEQ ID NO: 55736 - protein, 31 aa, Artificial Sequence
  Description of Artificial Sequence: Synthetic polypeptide
DEEEIRTTNPVATEQWGNTTSTGELQGMGNN

SEQ ID NO: 55737 - protein, 28 aa, Artificial Sequence
  Description of Artificial Sequence: Synthetic peptide
TTAEIRTTNPVATEQYGTTSTVLQFGQE

SEQ ID NO: 55738 - protein, 34 aa, Artificial Sequence
  Description of Artificial Sequence: Synthetic polypeptide
DEEEIRTTNPVATEQWGQSIVSYTNDLQHRSGGF

SEQ ID NO: 55739 - protein, 32 aa, Artificial Sequence
  Description of Artificial Sequence: Synthetic polypeptide
VEEEVATTNPVATEQYGSVSTGNLDQDIGGRA

SEQ ID NO: 55740 - protein, 33 aa, Artificial Sequence
  Description of Artificial Sequence: Synthetic polypeptide
VEEEVRTTNPVATEQYGSVCSTWEQDQDREGNR

SEQ ID NO: 55741 - protein, 32 aa, Artificial Sequence
  Description of Artificial Sequence: Synthetic polypeptide
VEEEVRTTNPVATEQYGSVSTWNLDTRIQNFE

SEQ ID NO: 55742 - protein, 29 aa, Artificial Sequence
  Description of Artificial Sequence: Synthetic peptide
YEEEIASVNPVATEQYGVVSTALQSGMNQ

SEQ ID NO: 55743 - protein, 29 aa, Artificial Sequence
  Description of Artificial Sequence: Synthetic peptide
YEEEIASVNPVATEQYGVVSTTNGQSGNQ

SEQ ID NO: 55744 - protein, 28 aa, Artificial Sequence
  Description of Artificial Sequence: Synthetic peptide
YEEEIASVNPVATEQYGVVYDNLQSGNQ

SEQ ID NO: 55745 - protein, 31 aa, Artificial Sequence
  Description of Artificial Sequence: Synthetic polypeptide
DEEEIRTTNPVATEPYGTISMEDLQQQQGNR

SEQ ID NO: 55746 - protein, 32 aa, Artificial Sequence
  Description of Artificial Sequence: Synthetic polypeptide
DEEEIRTTNPVATEPYGTISCTENELSQRVNV

SEQ ID NO: 55747 - protein, 28 aa, Artificial Sequence
  Description of Artificial Sequence: Synthetic peptide
YEEEIASVNPVAVEQYGVVSDNLQSGNQ

SEQ ID NO: 55748 - protein, 28 aa, Artificial Sequence
  Description of Artificial Sequence: Synthetic peptide
YEEEIASVNPVCSEQYGVVSDNLQSGNR

SEQ ID NO: 55749 - protein, 32 aa, Artificial Sequence
  Description of Artificial Sequence: Synthetic polypeptide
DEEEIRTTNPVATEPYGSVVVTVNLQDEEQNG

SEQ ID NO: 55750 - protein, 28 aa, Artificial Sequence
  Description of Artificial Sequence: Synthetic peptide
YEEEIASVNPVCTEQYGAVSDNLQSGNQ

SEQ ID NO: 55751 - protein, 28 aa, Artificial Sequence
  Description of Artificial Sequence: Synthetic peptide
YEEEIASVNPVCTEQYGCVSDNLQSGNI

SEQ ID NO: 55752 - protein, 28 aa, Artificial Sequence
  Description of Artificial Sequence: Synthetic peptide
YEEEIASVNPVCTEQYGCVSDNLQSGNQ

SEQ ID NO: 55753 - protein, 28 aa, Artificial Sequence
  Description of Artificial Sequence: Synthetic peptide
YEEEIASVNPVCTEQYGCVSNNLQSGNQ

SEQ ID NO: 55754 - protein, 28 aa, Artificial Sequence
  Description of Artificial Sequence: Synthetic peptide
YEEEIASVNPVCTEQYGDVSDNLQSGNQ

SEQ ID NO: 55755 - protein, 28 aa, Artificial Sequence
  Description of Artificial Sequence: Synthetic peptide
YEEEIASVNPVCTEQYGDVSSNLQSGNQ

SEQ ID NO: 55756 - protein, 28 aa, Artificial Sequence
  Description of Artificial Sequence: Synthetic peptide
YEEEIASVNPVCTEQYGEASDNLQSGNR

SEQ ID NO: 55757 - protein, 29 aa, Artificial Sequence
  Description of Artificial Sequence: Synthetic peptide
YEEEIASVNPVATEQYGVVSNDNLQSGNQ

SEQ ID NO: 55758 - protein, 28 aa, Artificial Sequence
  Description of Artificial Sequence: Synthetic peptide
YEEEIASVNPVCTEQYGEASENLQSGNR

SEQ ID NO: 55759 - protein, 33 aa, Artificial Sequence
  Description of Artificial Sequence: Synthetic polypeptide
DEEEIRTTNPVATEPYGTVSCTNLQEETGGNNV

SEQ ID NO: 55760 - protein, 28 aa, Artificial Sequence
  Description of Artificial Sequence: Synthetic peptide
YEEEIASVNPVATEQYGVVSENEQSGNQ

SEQ ID NO: 55761 - protein, 28 aa, Artificial Sequence
  Description of Artificial Sequence: Synthetic peptide
YEEEIASVNPICTEQYGSVSDNLQSGNQ

SEQ ID NO: 55762 - protein, 28 aa, Artificial Sequence
  Description of Artificial Sequence: Synthetic peptide
YEEEIASVNPVATECYGVVSDNLQSGNG

SEQ ID NO: 55763 - protein, 29 aa, Artificial Sequence
  Description of Artificial Sequence: Synthetic peptide
YEEEIASVNPVATEQYGAVSDNLQSKGNQ

SEQ ID NO: 55764 - protein, 34 aa, Artificial Sequence
  Description of Artificial Sequence: Synthetic polypeptide
DEEEIRTTNPVATEPYGYSVCSTVNLEQPEIVNR

SEQ ID NO: 55765 - protein, 28 aa, Artificial Sequence
  Description of Artificial Sequence: Synthetic peptide
YEEEIASVNPVATEQYGDVSDNLMSGNQ

SEQ ID NO: 55766 - protein, 28 aa, Artificial Sequence
  Description of Artificial Sequence: Synthetic peptide
YEEEIASVNPVATEQYGEASENLQSGNQ

SEQ ID NO: 55767 - protein, 32 aa, Artificial Sequence
  Description of Artificial Sequence: Synthetic polypeptide
DEEEIRTTNPVATEPYGVVVVTVNLQDQTGND

SEQ ID NO: 55768 - protein, 29 aa, Artificial Sequence
  Description of Artificial Sequence: Synthetic peptide
YEEEIASVNPVATEQYGSVSADNLQSGEL

SEQ ID NO: 55769 - protein, 29 aa, Artificial Sequence
  Description of Artificial Sequence: Synthetic peptide
YEEEIASVNPVATEQYGSVSDNLQDSGEL

SEQ ID NO: 55770 - protein, 28 aa, Artificial Sequence
  Description of Artificial Sequence: Synthetic peptide
YEEEIASVNPVATEQYGVVPDNLQSGNQ

SEQ ID NO: 55771 - protein, 29 aa, Artificial Sequence
  Description of Artificial Sequence: Synthetic peptide
YEEEIASVNPVATEQYGVVSATDLQSGNQ

SEQ ID NO: 55772 - protein, 29 aa, Artificial Sequence
  Description of Artificial Sequence: Synthetic peptide
YEEEIASVNPVATEQYGVVSDNLQSEGNQ

SEQ ID NO: 55773 - protein, 29 aa, Artificial Sequence
  Description of Artificial Sequence: Synthetic peptide
YEEEIASVNPVATEQYGVVSDNLQSGQNQ

SEQ ID NO: 55774 - protein, 28 aa, Artificial Sequence
  Description of Artificial Sequence: Synthetic peptide
YEEEIASVNPVATEQYGVVSDNLQSGSQ

SEQ ID NO: 55775 - protein, 28 aa, Artificial Sequence
  Description of Artificial Sequence: Synthetic peptide
YEEEIASVNPVATEQYGVVSDVLQSGNQ

SEQ ID NO: 55776 - protein, 29 aa, Artificial Sequence
  Description of Artificial Sequence: Synthetic peptide
YEEEIASVNPVATEQYGVVSENLQSAGNQ

SEQ ID NO: 55777 - protein, 28 aa, Artificial Sequence
  Description of Artificial Sequence: Synthetic peptide
YEEEIASVNPVCTEQYGEVSDNLQSGNK

SEQ ID NO: 55778 - protein, 28 aa, Artificial Sequence
  Description of Artificial Sequence: Synthetic peptide
YEEEIASVNPVCTEQYGEVSDNLQSGNQ

SEQ ID NO: 55779 - protein, 28 aa, Artificial Sequence
  Description of Artificial Sequence: Synthetic peptide
YEEEIASVNPVCTEQYGEVSENLQHGNQ

SEQ ID NO: 55780 - protein, 28 aa, Artificial Sequence
  Description of Artificial Sequence: Synthetic peptide
YEEEIASVNPVCTEQYGVVSANLQSGNQ

SEQ ID NO: 55781 - protein, 29 aa, Artificial Sequence
  Description of Artificial Sequence: Synthetic peptide
YEEEIASVNPVCTEQYGVVSATNLQSGNQ

SEQ ID NO: 55782 - protein, 28 aa, Artificial Sequence
  Description of Artificial Sequence: Synthetic peptide
YEEEIASVNPVCTEQYGVVSCNLQSGNQ

SEQ ID NO: 55783 - protein, 29 aa, Artificial Sequence
  Description of Artificial Sequence: Synthetic peptide
YEEEIASVNPVCTEQYGVVSCNLQSGNQR

SEQ ID NO: 55784 - protein, 28 aa, Artificial Sequence
  Description of Artificial Sequence: Synthetic peptide
YEEEIASVNPVCTEQYGVVSCNLQSGTR

SEQ ID NO: 55785 - protein, 28 aa, Artificial Sequence
  Description of Artificial Sequence: Synthetic peptide
YEEEIASVNPVCTEQYGVVSDNIQSGNR

SEQ ID NO: 55786 - protein, 28 aa, Artificial Sequence
  Description of Artificial Sequence: Synthetic peptide
YEEEIASVNPVCTEQYGVVSDNLQAGNQ

SEQ ID NO: 55787 - protein, 28 aa, Artificial Sequence
  Description of Artificial Sequence: Synthetic peptide
YEEEIASVNPVCTEQYGVVSDNLQCGNQ

SEQ ID NO: 55788 - protein, 32 aa, Artificial Sequence
  Description of Artificial Sequence: Synthetic polypeptide
DEEEIRTTNPVATEPYGSVVGTNMTRGGNNGQ

SEQ ID NO: 55789 - protein, 28 aa, Artificial Sequence
  Description of Artificial Sequence: Synthetic peptide
YEEEIASVNPVCTEQYGVVSDNLQDGNQ

SEQ ID NO: 55790 - protein, 34 aa, Artificial Sequence
  Description of Artificial Sequence: Synthetic polypeptide
DEEEIRTTNPVATEPYGSVVCFTNALSTREGGNR

SEQ ID NO: 55791 - protein, 28 aa, Artificial Sequence
  Description of Artificial Sequence: Synthetic peptide
YEEEIASVNPVCTEQYGVVSDNLQEGNQ

SEQ ID NO: 55792 - protein, 28 aa, Artificial Sequence
  Description of Artificial Sequence: Synthetic peptide
YEEEIASVNPVCTEQYGVVSDNLQFGNQ

SEQ ID NO: 55793 - protein, 28 aa, Artificial Sequence
  Description of Artificial Sequence: Synthetic peptide
YEEEIASVNPVCTEQYGVVSDNLQGGNQ

SEQ ID NO: 55794 - protein, 28 aa, Artificial Sequence
  Description of Artificial Sequence: Synthetic peptide
YEEEIASVNPVCTEQYGVVSDNLQHGNL

SEQ ID NO: 55795 - protein, 29 aa, Artificial Sequence
  Description of Artificial Sequence: Synthetic peptide
YEEEIASVNPVCTEQYGVVSADNLQSGNR

SEQ ID NO: 55796 - protein, 29 aa, Artificial Sequence
  Description of Artificial Sequence: Synthetic peptide
YEEEIASVNPVCTEQYGVVSADNLQRGNQ

SEQ ID NO: 55797 - protein, 28 aa, Artificial Sequence
  Description of Artificial Sequence: Synthetic peptide
YEEEIASVNPVCTEQYGVVADNLQRGQR

SEQ ID NO: 55798 - protein, 28 aa, Artificial Sequence
  Description of Artificial Sequence: Synthetic peptide
YEEEIASVNPVCTEQYGTVSDNLQSGNQ

SEQ ID NO: 55799 - protein, 28 aa, Artificial Sequence
  Description of Artificial Sequence: Synthetic peptide
YEEEIASVNPVCTEQYGEVSENLQSGNQ

SEQ ID NO: 55800 - protein, 28 aa, Artificial Sequence
  Description of Artificial Sequence: Synthetic peptide
YEEEIASVNPVCTEQYGFVSDNLQSGNQ

SEQ ID NO: 55801 - protein, 32 aa, Artificial Sequence
  Description of Artificial Sequence: Synthetic polypeptide
DEEEIRTTNPVATEPYGSVVSTPQSQRSGSDS

SEQ ID NO: 55802 - protein, 28 aa, Artificial Sequence
  Description of Artificial Sequence: Synthetic peptide
YEEEIASVNPVCTEQYGHVSDNLQSGNQ

SEQ ID NO: 55803 - protein, 28 aa, Artificial Sequence
  Description of Artificial Sequence: Synthetic peptide
YEEEIASVNPVCTEQYGIVSDNLQSGNQ

SEQ ID NO: 55804 - protein, 28 aa, Artificial Sequence
  Description of Artificial Sequence: Synthetic peptide
YEEEIASVNPVCTEQYGKVSDNLQSGNQ

SEQ ID NO: 55805 - protein, 28 aa, Artificial Sequence
  Description of Artificial Sequence: Synthetic peptide
YEEEIASVNPVCTEQYGKVSDNLQTGNQ

SEQ ID NO: 55806 - protein, 28 aa, Artificial Sequence
  Description of Artificial Sequence: Synthetic peptide
YEEEIASVNPCCTEQYGVVSDNLQSGNR

SEQ ID NO: 55807 - protein, 28 aa, Artificial Sequence
  Description of Artificial Sequence: Synthetic peptide
YEEEIASVNPVCTEQYGMVSDNLQSGNQ

SEQ ID NO: 55808 - protein, 28 aa, Artificial Sequence
  Description of Artificial Sequence: Synthetic peptide
YEEEIASVNPVCTEQYGNVSDNLQSGNQ

SEQ ID NO: 55809 - protein, 28 aa, Artificial Sequence
  Description of Artificial Sequence: Synthetic peptide
YEEEIASVNPVCTEQYGQVSDNLQSGNQ

SEQ ID NO: 55810 - protein, 28 aa, Artificial Sequence
  Description of Artificial Sequence: Synthetic peptide
YEEEIASVNPVCTEQYGRVSDNLQSGNQ

SEQ ID NO: 55811 - protein, 29 aa, Artificial Sequence
  Description of Artificial Sequence: Synthetic peptide
YEEEIASVNPVCTEQYGSVSATNLQHGEQ

SEQ ID NO: 55812 - protein, 29 aa, Artificial Sequence
  Description of Artificial Sequence: Synthetic peptide
YEEEIASVNPVCTEQYGSVVSDNLQSGNQ

SEQ ID NO: 55813 - protein, 29 aa, Artificial Sequence
  Description of Artificial Sequence: Synthetic peptide
YEEEIASVNPVCTEQYGTVSATNLQSGNQ

SEQ ID NO: 55814 - protein, 28 aa, Artificial Sequence
  Description of Artificial Sequence: Synthetic peptide
YEEEIASVNPVCTEQYGTVSDNLQSGND

SEQ ID NO: 55815 - protein, 28 aa, Artificial Sequence
  Description of Artificial Sequence: Synthetic peptide
YEEEIASVNPVCTEQYGNVSDNIQSGNR

SEQ ID NO: 55816 - protein, 28 aa, Artificial Sequence
  Description of Artificial Sequence: Synthetic peptide
YEEEIASVNPVCTEQYGVVSDNLQKGNA

SEQ ID NO: 55817 - protein, 28 aa, Artificial Sequence
  Description of Artificial Sequence: Synthetic peptide
YEEEIASTNPVSTEQYGVVSDDLQQGNQ

SEQ ID NO: 55818 - protein, 28 aa, Artificial Sequence
  Description of Artificial Sequence: Synthetic peptide
YEEEIASTNPVGTEGYGVVSDNLQHGNQ

SEQ ID NO: 55819 - protein, 32 aa, Artificial Sequence
  Description of Artificial Sequence: Synthetic polypeptide
YEEAEIRTTNPNATEQYGSVSTDSLGARLNRP

SEQ ID NO: 55820 - protein, 34 aa, Artificial Sequence
  Description of Artificial Sequence: Synthetic polypeptide
YEEAEVIRTTNPAATEQYGSVAEFTNLQLRGNIR

SEQ ID NO: 55821 - protein, 34 aa, Artificial Sequence
  Description of Artificial Sequence: Synthetic polypeptide
YEEAYIRTTNPTATEQYGSSVSFTMNLQLRGNNR

SEQ ID NO: 55822 - protein, 31 aa, Artificial Sequence
  Description of Artificial Sequence: Synthetic polypeptide
YEECIRTTNPVATEQYGSVETCNIVAGGNRM

SEQ ID NO: 55823 - protein, 31 aa, Artificial Sequence
  Description of Artificial Sequence: Synthetic polypeptide
YEECIRTTNPVATEQYGSVETCNLVAGGNTV

SEQ ID NO: 55824 - protein, 28 aa, Artificial Sequence
  Description of Artificial Sequence: Synthetic peptide
YEEEIAAVNPVCTEQYGVVSDNLQSGNQ

SEQ ID NO: 55825 - protein, 28 aa, Artificial Sequence
  Description of Artificial Sequence: Synthetic peptide
YEEEIACTNPICTEQYGVVSENLQSGNQ

SEQ ID NO: 55826 - protein, 28 aa, Artificial Sequence
  Description of Artificial Sequence: Synthetic peptide
YEEEIACTNPVCTEQYGEASDNLQRGGQ

SEQ ID NO: 55827 - protein, 28 aa, Artificial Sequence
  Description of Artificial Sequence: Synthetic peptide
YEEEIACTNPVCTEQYGVASENLQSGGR

SEQ ID NO: 55828 - protein, 28 aa, Artificial Sequence
  Description of Artificial Sequence: Synthetic peptide
YEEEIACTNPVCTEQYGVVSDNLMSGNQ

SEQ ID NO: 55829 - protein, 28 aa, Artificial Sequence
  Description of Artificial Sequence: Synthetic peptide
YEEEIACTNPVCTEQYGVVSENLMSGNQ

SEQ ID NO: 55830 - protein, 33 aa, Artificial Sequence
  Description of Artificial Sequence: Synthetic polypeptide
DEEEIRTTNPVATEQFGTSVCSTMYLARSGSNQ

SEQ ID NO: 55831 - protein, 31 aa, Artificial Sequence
  Description of Artificial Sequence: Synthetic polypeptide
DEEEIRTTNPVATEQFGTCVSTYLAHGSNTQ

SEQ ID NO: 55832 - protein, 28 aa, Artificial Sequence
  Description of Artificial Sequence: Synthetic peptide
YEEEIACVNPICTEQYGSVSENLQSGNQ

SEQ ID NO: 55833 - protein, 30 aa, Artificial Sequence
  Description of Artificial Sequence: Synthetic polypeptide
DEEEIRTTNPVATEQFGTCVCSTYTANGNQ

SEQ ID NO: 55834 - protein, 33 aa, Artificial Sequence
  Description of Artificial Sequence: Synthetic polypeptide
YEEAEIRTTNPNATEQYGSVSNTNSLGARGNQP

SEQ ID NO: 55835 - protein, 28 aa, Artificial Sequence
  Description of Artificial Sequence: Synthetic peptide
YEEEIACVNPVCTEQYGVVSDNLQSGNQ

SEQ ID NO: 55836 - protein, 32 aa, Artificial Sequence
  Description of Artificial Sequence: Synthetic polypeptide
DEEEIRTTNPVATEQFGTSVSTYLLRGGEDTS

SEQ ID NO: 55837 - protein, 28 aa, Artificial Sequence
  Description of Artificial Sequence: Synthetic peptide
YCEEIASVNPVCTEQYGVVSTNLQSGNQ

SEQ ID NO: 55838 - protein, 29 aa, Artificial Sequence
  Description of Artificial Sequence: Synthetic peptide
VENEIACTNPVATEQYGEASENLQRGGRI

SEQ ID NO: 55839 - protein, 31 aa, Artificial Sequence
  Description of Artificial Sequence: Synthetic polypeptide
VEQEIRTTNPVATEQYGSVSTMRDNLGEGRE

SEQ ID NO: 55840 - protein, 30 aa, Artificial Sequence
  Description of Artificial Sequence: Synthetic polypeptide
VESEIRTTNPVATDWYGSVSTTLQPRATNM

SEQ ID NO: 55841 - protein, 31 aa, Artificial Sequence
  Description of Artificial Sequence: Synthetic polypeptide
VESEVATTNPVAYEQYGSVSTGNLDERDGNR

SEQ ID NO: 55842 - protein, 31 aa, Artificial Sequence
  Description of Artificial Sequence: Synthetic polypeptide
VESEVATTNPVAYEQYGSVSTPNLDQDIGNR

SEQ ID NO: 55843 - protein, 31 aa, Artificial Sequence
  Description of Artificial Sequence: Synthetic polypeptide
VNEEIRTTNPVATEQYGVVSPNTQEAQGPNR

SEQ ID NO: 55844 - protein, 31 aa, Artificial Sequence
  Description of Artificial Sequence: Synthetic polypeptide
WEEEIACTNPVATEQYGSVATNLQAEEGTRE

SEQ ID NO: 55845 - protein, 28 aa, Artificial Sequence
  Description of Artificial Sequence: Synthetic peptide
WEEEIASVNPVCTEQYGVVSDNLQSGNQ

SEQ ID NO: 55846 - protein, 32 aa, Artificial Sequence
  Description of Artificial Sequence: Synthetic polypeptide
WEEEIATTNPVATEQYGSVAANNLTQDGENDR

SEQ ID NO: 55847 - protein, 33 aa, Artificial Sequence
  Description of Artificial Sequence: Synthetic polypeptide
WEEEIATTNPVATEQYGSVAATNNLEARGENDR

SEQ ID NO: 55848 - protein, 33 aa, Artificial Sequence
  Description of Artificial Sequence: Synthetic polypeptide
WEEEIATTNPVATEQYGSVATGNLPQQMGENPR

SEQ ID NO: 55849 - protein, 33 aa, Artificial Sequence
  Description of Artificial Sequence: Synthetic polypeptide
WEEEIRTTNPVATEQYGCVCSTTNHQGSGILNR

SEQ ID NO: 55850 - protein, 34 aa, Artificial Sequence
  Description of Artificial Sequence: Synthetic polypeptide
WEEEIRTTNPVATEQYGSVSPTSNLQERGEAYHT

SEQ ID NO: 55851 - protein, 34 aa, Artificial Sequence
  Description of Artificial Sequence: Synthetic polypeptide
WEEEIRTTNPVATEQYGSVWSPTSNLQERGEAYS

SEQ ID NO: 55852 - protein, 28 aa, Artificial Sequence
  Description of Artificial Sequence: Synthetic peptide
WENEIACTNPVATEQYGEASENLQYGGR

SEQ ID NO: 55853 - protein, 28 aa, Artificial Sequence
  Description of Artificial Sequence: Synthetic peptide
YECEIGSTNPVCTEQYGVVSDNLQSGNQ

SEQ ID NO: 55854 - protein, 28 aa, Artificial Sequence
  Description of Artificial Sequence: Synthetic peptide
YEEEIACVNPVCTEQYGVVSENLQSGNQ

SEQ ID NO: 55855 - protein, 28 aa, Artificial Sequence
  Description of Artificial Sequence: Synthetic peptide
YEEEIAGVNPVCTEQYGVVSDNLQSGNQ

SEQ ID NO: 55856 - protein, 28 aa, Artificial Sequence
  Description of Artificial Sequence: Synthetic peptide
YEEEIAPTNPCSSEQYGVVSCNLQSGNR

SEQ ID NO: 55857 - protein, 28 aa, Artificial Sequence
  Description of Artificial Sequence: Synthetic peptide
YEEEIASTNPVCTEQYGVVSDDLQSGNQ

SEQ ID NO: 55858 - protein, 29 aa, Artificial Sequence
  Description of Artificial Sequence: Synthetic peptide
YEEEIASTNPVCTEQYGVVSDNLIQSGNQ

SEQ ID NO: 55859 - protein, 28 aa, Artificial Sequence
  Description of Artificial Sequence: Synthetic peptide
YEEEIASTNPVCTEQYGVVSDNLMSGNQ

SEQ ID NO: 55860 - protein, 29 aa, Artificial Sequence
  Description of Artificial Sequence: Synthetic peptide
YEEEIASTNPVCTEQYGVVSDNLQQSGNQ

SEQ ID NO: 55861 - protein, 28 aa, Artificial Sequence
  Description of Artificial Sequence: Synthetic peptide
YEEEIASTNPVCTEQYGVVSDNLQSENQ

SEQ ID NO: 55862 - protein, 29 aa, Artificial Sequence
  Description of Artificial Sequence: Synthetic peptide
YEEEIASTNPVCTEQYGVVSDNLQSGMNQ

SEQ ID NO: 55863 - protein, 29 aa, Artificial Sequence
  Description of Artificial Sequence: Synthetic peptide
YEEEIASTNPVCTEQYGVVSDNLQSGNQF

SEQ ID NO: 55864 - protein, 28 aa, Artificial Sequence
  Description of Artificial Sequence: Synthetic peptide
YEEEIASTNPVCTEQYGVVSDNLQSGPQ

SEQ ID NO: 55865 - protein, 29 aa, Artificial Sequence
  Description of Artificial Sequence: Synthetic peptide
YEEEIASTNPVCTEQYGVVSDNLQSSGNQ

SEQ ID NO: 55866 - protein, 29 aa, Artificial Sequence
  Description of Artificial Sequence: Synthetic peptide
YEEEIASTNPVCTEQYGVVSDNLVQSGNQ

SEQ ID NO: 55867 - protein, 28 aa, Artificial Sequence
  Description of Artificial Sequence: Synthetic peptide
YEEEIASTNPVCTEQYGVVSDNPQSGNQ

SEQ ID NO: 55868 - protein, 28 aa, Artificial Sequence
  Description of Artificial Sequence: Synthetic peptide
YEEEIASTNPVCTEQYGVVSDTLQHGNQ

SEQ ID NO: 55869 - protein, 28 aa, Artificial Sequence
  Description of Artificial Sequence: Synthetic peptide
YEEEIASTNPVCTEQYGVVSENLMSGNQ

SEQ ID NO: 55870 - protein, 28 aa, Artificial Sequence
  Description of Artificial Sequence: Synthetic peptide
YEEEIASTNPVCTEQYGVVSENLQSENQ

SEQ ID NO: 55871 - protein, 29 aa, Artificial Sequence
  Description of Artificial Sequence: Synthetic peptide
YEEEIASTNPVCTEQYGVVSMENLQSGNQ

SEQ ID NO: 55872 - protein, 29 aa, Artificial Sequence
  Description of Artificial Sequence: Synthetic peptide
YEEEIASTNPVCTEQYGVVSADNLQSGNQ

SEQ ID NO: 55873 - protein, 29 aa, Artificial Sequence
  Description of Artificial Sequence: Synthetic peptide
YEEEIASTNPVCTEQYGSVSTDLQDHGEL

SEQ ID NO: 55874 - protein, 28 aa, Artificial Sequence
  Description of Artificial Sequence: Synthetic peptide
YEEEIASTNPVCTEQYGEASDNLQSGNQ

SEQ ID NO: 55875 - protein, 28 aa, Artificial Sequence
  Description of Artificial Sequence: Synthetic peptide
YEEEIASTNPVCTEQYGEASDNLQSGGR

SEQ ID NO: 55876 - protein, 28 aa, Artificial Sequence
  Description of Artificial Sequence: Synthetic peptide
YEEEIAPTNPCSTEQYGIVSCNLQSGTR

SEQ ID NO: 55877 - protein, 28 aa, Artificial Sequence
  Description of Artificial Sequence: Synthetic peptide
YEEEIAPTNPCSTEQYGVVSCNLQSGTR

SEQ ID NO: 55878 - protein, 28 aa, Artificial Sequence
  Description of Artificial Sequence: Synthetic peptide
YEEEIAPTNPVSSEQYGVVSCNLQSGNQ

SEQ ID NO: 55879 - protein, 28 aa, Artificial Sequence
  Description of Artificial Sequence: Synthetic peptide
YEEEIAPVNPVCTEQYGEVSDNLQSGNQ

SEQ ID NO: 55880 - protein, 28 aa, Artificial Sequence
  Description of Artificial Sequence: Synthetic peptide
YEEEIAPVNPVCTEQYGVVSDNLQSGNQ

SEQ ID NO: 55881 - protein, 28 aa, Artificial Sequence
  Description of Artificial Sequence: Synthetic peptide
YEEEIAPVNPVCTEQYGVVSVNLQSGNQ

SEQ ID NO: 55882 - protein, 28 aa, Artificial Sequence
  Description of Artificial Sequence: Synthetic peptide
YEEEIASCNPVCTEQYGVVSDNLQSGNQ

SEQ ID NO: 55883 - protein, 28 aa, Artificial Sequence
  Description of Artificial Sequence: Synthetic peptide
YEEEIASTNPVSTEQYGVVSDDLQQGNH

SEQ ID NO: 55884 - protein, 28 aa, Artificial Sequence
  Description of Artificial Sequence: Synthetic peptide
YEEEIASTNPCSTEQYGIVSCNLQSGTR

SEQ ID NO: 55885 - protein, 28 aa, Artificial Sequence
  Description of Artificial Sequence: Synthetic peptide
YEEEIASTNPICTEQYGVVSENLQSGNQ

SEQ ID NO: 55886 - protein, 30 aa, Artificial Sequence
  Description of Artificial Sequence: Synthetic polypeptide
YEEEIASTNPVATEQWGSVSDNEPQREGNQ

SEQ ID NO: 55887 - protein, 30 aa, Artificial Sequence
  Description of Artificial Sequence: Synthetic polypeptide
DEEEIRTTNPVATEQFGSVDENIQQQAGTH

SEQ ID NO: 55888 - protein, 31 aa, Artificial Sequence
  Description of Artificial Sequence: Synthetic polypeptide
YEEEIASTNPVATEQYGSVSADNLQDHEGNQ

SEQ ID NO: 55889 - protein, 30 aa, Artificial Sequence
  Description of Artificial Sequence: Synthetic polypeptide
YEEEIASTNPVATEQYGVVSDNLQDSEGNQ

SEQ ID NO: 55890 - protein, 29 aa, Artificial Sequence
  Description of Artificial Sequence: Synthetic peptide
YEEEIASTNPVATEQYGVVSTALNSGMNQ

SEQ ID NO: 55891 - protein, 29 aa, Artificial Sequence
  Description of Artificial Sequence: Synthetic peptide
YEEEIASTNPVATEQYGVVWSDNLQSGPQ

SEQ ID NO: 55892 - protein, 28 aa, Artificial Sequence
  Description of Artificial Sequence: Synthetic peptide
YEEEIASTNPCSTEQYGVVSCNLQSGTR

SEQ ID NO: 55893 - protein, 28 aa, Artificial Sequence
  Description of Artificial Sequence: Synthetic peptide
QEEVICCTNPVAYEQYGSVSMNEQHGNQ

SEQ ID NO: 55894 - protein, 31 aa, Artificial Sequence
  Description of Artificial Sequence: Synthetic polypeptide
SSEEIRTTNPVAYHQYGSVSTFLSQRTGGNF

SEQ ID NO: 55895 - protein, 31 aa, Artificial Sequence
  Description of Artificial Sequence: Synthetic polypeptide
SSEEIRTTNPVATTQYGCVSTWDLQDRGNQF

SEQ ID NO: 55896 - protein, 28 aa, Artificial Sequence
  Description of Artificial Sequence: Synthetic peptide
SEEEIASVNPVSTEQYGVVSNNLQSGNQ

SEQ ID NO: 55897 - protein, 28 aa, Artificial Sequence
  Description of Artificial Sequence: Synthetic peptide
SEEEIATTNPIATECYGDVSENLQHEER

SEQ ID NO: 55898 - protein, 28 aa, Artificial Sequence
  Description of Artificial Sequence: Synthetic peptide
SEEEIATTNPIATECYGSVSENLMREEL

SEQ ID NO: 55899 - protein, 28 aa, Artificial Sequence
  Description of Artificial Sequence: Synthetic peptide
SEEEIATTNPIATEQYGSVPEVCMRGER

SEQ ID NO: 55900 - protein, 31 aa, Artificial Sequence
  Description of Artificial Sequence: Synthetic polypeptide
SEEEIATTNPIATEQYGSVSAENLMDHEGNR

SEQ ID NO: 55901 - protein, 31 aa, Artificial Sequence
  Description of Artificial Sequence: Synthetic polypeptide
SEEEIATTNPIATEQYGSVSATNLEDRGEDL

SEQ ID NO: 55902 - protein, 28 aa, Artificial Sequence
  Description of Artificial Sequence: Synthetic peptide
SEEEIATTNPVATECYGDVSECLMHENR

SEQ ID NO: 55903 - protein, 30 aa, Artificial Sequence
  Description of Artificial Sequence: Synthetic polypeptide
SEEEIATTNPVATECYGVVSTNLQNNPGRN

SEQ ID NO: 55904 - protein, 32 aa, Artificial Sequence
  Description of Artificial Sequence: Synthetic polypeptide
DEEEIRTTNPVATEQYGCVSTNHQENFGSELA

SEQ ID NO: 55905 - protein, 30 aa, Artificial Sequence
  Description of Artificial Sequence: Synthetic polypeptide
SEEEIATTNPVATEMWGSVAMNLDQGGNDR

SEQ ID NO: 55906 - protein, 31 aa, Artificial Sequence
  Description of Artificial Sequence: Synthetic polypeptide
SEEEIATTNPVATEPYGSVSTEGLQQNGNTA

SEQ ID NO: 55907 - protein, 32 aa, Artificial Sequence
  Description of Artificial Sequence: Synthetic polypeptide
DEEEIRTTNPVATEQYGCVSTNHETIGENMEN

SEQ ID NO: 55908 - protein, 31 aa, Artificial Sequence
  Description of Artificial Sequence: Synthetic polypeptide
DEEEIRTTNPVATEQYGCVSTNHENFGSDVS

SEQ ID NO: 55909 - protein, 29 aa, Artificial Sequence
  Description of Artificial Sequence: Synthetic peptide
SEEEIATTNPVATEQWGSVSTELQNMPEN

SEQ ID NO: 55910 - protein, 28 aa, Artificial Sequence
  Description of Artificial Sequence: Synthetic peptide
SEEEIATTNPVATEQYGEVSEVCQHEER

SEQ ID NO: 55911 - protein, 28 aa, Artificial Sequence
  Description of Artificial Sequence: Synthetic peptide
SEEEIASVNPVCTEQYGVVSENLQSGNQ

SEQ ID NO: 55912 - protein, 33 aa, Artificial Sequence
  Description of Artificial Sequence: Synthetic polypeptide
SEEEIATTNPVATEQYGSTVSCTNLSQESVNQR

SEQ ID NO: 55913 - protein, 28 aa, Artificial Sequence
  Description of Artificial Sequence: Synthetic peptide
SEEEIASVNPVCTEQYGVVSDNLQSGNQ

SEQ ID NO: 55914 - protein, 29 aa, Artificial Sequence
  Description of Artificial Sequence: Synthetic peptide
SEEEIASTNPVATEQYGSVAENIMSRGQR

SEQ ID NO: 55915 - protein, 31 aa, Artificial Sequence
  Description of Artificial Sequence: Synthetic polypeptide
SEEEIACTNPVATEQYGSVATNLQVPGNPEE

SEQ ID NO: 55916 - protein, 31 aa, Artificial Sequence
  Description of Artificial Sequence: Synthetic polypeptide
SEEEIACTNPVATEQYGSVSATDLEDHEGNR

SEQ ID NO: 55917 - protein, 33 aa, Artificial Sequence
  Description of Artificial Sequence: Synthetic polypeptide
DEEEIRTTNPVATEQYGCVSTNLEQGILQNDEI

SEQ ID NO: 55918 - protein, 30 aa, Artificial Sequence
  Description of Artificial Sequence: Synthetic polypeptide
SEEEIACTNPVATEQYGSVSENLEDHEGNL

SEQ ID NO: 55919 - protein, 29 aa, Artificial Sequence
  Description of Artificial Sequence: Synthetic peptide
SEEEIACTNPVATESYGSVATNLQADNDH

SEQ ID NO: 55920 - protein, 29 aa, Artificial Sequence
  Description of Artificial Sequence: Synthetic peptide
SEEEIACTNPVATESYGSVATNLQAENTQ

SEQ ID NO: 55921 - protein, 30 aa, Artificial Sequence
  Description of Artificial Sequence: Synthetic polypeptide
SEEEIACTNPVATESYGSVATNLQEGQDRE

SEQ ID NO: 55922 - protein, 29 aa, Artificial Sequence
  Description of Artificial Sequence: Synthetic peptide
SEEEIACTNPVATESYGSVATNLQQGDLP

SEQ ID NO: 55923 - protein, 29 aa, Artificial Sequence
  Description of Artificial Sequence: Synthetic peptide
SEEEIACTNPVATEVYGSVATNLQADNPQ

SEQ ID NO: 55924 - protein, 30 aa, Artificial Sequence
  Description of Artificial Sequence: Synthetic polypeptide
SEEEIACTNPVAYEQYGSVATNLQAGPDNH

SEQ ID NO: 55925 - protein, 29 aa, Artificial Sequence
  Description of Artificial Sequence: Synthetic peptide
SEEEIACTNPVAYEVYGSVATNLQAGNDQ

SEQ ID NO: 55926 - protein, 28 aa, Artificial Sequence
  Description of Artificial Sequence: Synthetic peptide
SEEEIACVNPICTEQYGVVSENLQSGNR

SEQ ID NO: 55927 - protein, 28 aa, Artificial Sequence
  Description of Artificial Sequence: Synthetic peptide
SEEEIACVNPVCTEQYGVVSDNLQSGNH

SEQ ID NO: 55928 - protein, 28 aa, Artificial Sequence
  Description of Artificial Sequence: Synthetic peptide
SEEEIAPTNPCASEQYGIVSCNLQSGTR

SEQ ID NO: 55929 - protein, 28 aa, Artificial Sequence
  Description of Artificial Sequence: Synthetic peptide
SEEEIASTNPVATEGYGSMAENLMRGNI

SEQ ID NO: 55930 - protein, 28 aa, Artificial Sequence
  Description of Artificial Sequence: Synthetic peptide
SEEEIASVNPICTEQYGSVSDNLQSGNQ

SEQ ID NO: 55931 - protein, 30 aa, Artificial Sequence
  Description of Artificial Sequence: Synthetic polypeptide
SEEEIACTNPVATEQYGSVATNLQSTNGPD

SEQ ID NO: 55932 - protein, 32 aa, Artificial Sequence
  Description of Artificial Sequence: Synthetic polypeptide
SEEEIATTNPVATEQYGSTVSDTNLLQDNNGG

SEQ ID NO: 55933 - protein, 32 aa, Artificial Sequence
  Description of Artificial Sequence: Synthetic polypeptide
SEEEIATTNPVATEQYGSVAITNLQQGENENA

SEQ ID NO: 55934 - protein, 31 aa, Artificial Sequence
  Description of Artificial Sequence: Synthetic polypeptide
SEEEIATTNPVATEQYGSVATNLTAEGPNEY

SEQ ID NO: 55935 - protein, 31 aa, Artificial Sequence
  Description of Artificial Sequence: Synthetic polypeptide
SEEEIATTNPVATEQYGSVATNPQEAGNPDF

SEQ ID NO: 55936 - protein, 31 aa, Artificial Sequence
  Description of Artificial Sequence: Synthetic polypeptide
DEEEIRTTNPVATEQYGCVSTLLDQEMLDIE

SEQ ID NO: 55937 - protein, 33 aa, Artificial Sequence
  Description of Artificial Sequence: Synthetic polypeptide
SEEEIATTNPVATEQYGSVATSNLNQDPGENGR

SEQ ID NO: 55938 - protein, 31 aa, Artificial Sequence
  Description of Artificial Sequence: Synthetic polypeptide
SEEEIATTNPVATEQYGSVCADTNLQDLNDE

SEQ ID NO: 55939 - protein, 31 aa, Artificial Sequence
  Description of Artificial Sequence: Synthetic polypeptide
SEEEIATTNPVATEQYGSVSAEDLEDHEGNR

SEQ ID NO: 55940 - protein, 31 aa, Artificial Sequence
  Description of Artificial Sequence: Synthetic polypeptide
SEEEIATTNPVATEQYGSVSATDLEDRGEDL

SEQ ID NO: 55941 - protein, 32 aa, Artificial Sequence
  Description of Artificial Sequence: Synthetic polypeptide
DEEEIRTTNPVATEQYGCVSTGYHQRFNSDQA

SEQ ID NO: 55942 - protein, 31 aa, Artificial Sequence
  Description of Artificial Sequence: Synthetic polypeptide
DEEEIRTTNPVATEQYGCVSTGYHQFGSDQS

SEQ ID NO: 55943 - protein, 32 aa, Artificial Sequence
  Description of Artificial Sequence: Synthetic polypeptide
DEEEIRTTNPVATEQYGCVSTGPTQNFGSNQT

SEQ ID NO: 55944 - protein, 30 aa, Artificial Sequence
  Description of Artificial Sequence: Synthetic polypeptide
SEEEIATTNPVATESYGSVAATNLAGGDQR

SEQ ID NO: 55945 - protein, 33 aa, Artificial Sequence
  Description of Artificial Sequence: Synthetic polypeptide
DEEEIRTTNPVATEQYGCVSTGPLDQRGFEDHT

SEQ ID NO: 55946 - protein, 31 aa, Artificial Sequence
  Description of Artificial Sequence: Synthetic polypeptide
SEEEIATTNPVATESYGSVATNLQEAGNDPL

SEQ ID NO: 55947 - protein, 31 aa, Artificial Sequence
  Description of Artificial Sequence: Synthetic polypeptide
DEEEIRTTNPVATEQYGCVSTGNTEAMGGDS

SEQ ID NO: 55948 - protein, 30 aa, Artificial Sequence
  Description of Artificial Sequence: Synthetic polypeptide
SEEEIATTNPVAYEQYGSVATNLQAPPPRF

SEQ ID NO: 55949 - protein, 30 aa, Artificial Sequence
  Description of Artificial Sequence: Synthetic polypeptide
SEEEIATTNPVATEQYGSVATNLQQPDSPE

SEQ ID NO: 55950 - protein, 31 aa, Artificial Sequence
  Description of Artificial Sequence: Synthetic polypeptide
SEEEIATTNPVATEQYGSVAITADQREGNDQ

SEQ ID NO: 55951 - protein, 32 aa, Artificial Sequence
  Description of Artificial Sequence: Synthetic polypeptide
DEEEIRTTNPVATEQYGCVSTMEPQNFGSERA

SEQ ID NO: 55952 - protein, 31 aa, Artificial Sequence
  Description of Artificial Sequence: Synthetic polypeptide
SEEEIATTNPVATEQYGSVATNLQPDDQGEE

SEQ ID NO: 55953 - protein, 32 aa, Artificial Sequence
  Description of Artificial Sequence: Synthetic polypeptide
DEEEIRTTNPVATEQYGCVSTNDQTGGGEEES

SEQ ID NO: 55954 - protein, 32 aa, Artificial Sequence
  Description of Artificial Sequence: Synthetic polypeptide
SEEEIATTNPVATEQYGSVATNLEPGNQNPRQ

SEQ ID NO: 55955 - protein, 31 aa, Artificial Sequence
  Description of Artificial Sequence: Synthetic polypeptide
SEEEIATTNPVATEQYGSVATNLNRNLNEYN

SEQ ID NO: 55956 - protein, 32 aa, Artificial Sequence
  Description of Artificial Sequence: Synthetic polypeptide
SEEEIATTNPVATEQYGSVATNLNTRNGEERN

SEQ ID NO: 55957 - protein, 32 aa, Artificial Sequence
  Description of Artificial Sequence: Synthetic polypeptide
SEEEIATTNPVATEQYGSVATNLQAAPGNAEE

SEQ ID NO: 55958 - protein, 33 aa, Artificial Sequence
  Description of Artificial Sequence: Synthetic polypeptide
DEEEIRTTNPVATEQYGCVSTNDLDQLYGEMEE

SEQ ID NO: 55959 - protein, 30 aa, Artificial Sequence
  Description of Artificial Sequence: Synthetic polypeptide
SEEEIATTNPVATEQYGSVATNLQAPPDDE

SEQ ID NO: 55960 - protein, 32 aa, Artificial Sequence
  Description of Artificial Sequence: Synthetic polypeptide
DEEEIRTTNPVATEQYGCVSTNDHQNFNSDQT

SEQ ID NO: 55961 - protein, 31 aa, Artificial Sequence
  Description of Artificial Sequence: Synthetic polypeptide
DEEEIRTTNPVATEQYGCVSTNDHQHNSEQT

SEQ ID NO: 55962 - protein, 31 aa, Artificial Sequence
  Description of Artificial Sequence: Synthetic polypeptide
DEEEIRTTNPVATEQYGCVSTNDHQEYSMDQ

SEQ ID NO: 55963 - protein, 31 aa, Artificial Sequence
  Description of Artificial Sequence: Synthetic polypeptide
SEEEIATTNPVATEQYGSVATNLQDQGEEAA

SEQ ID NO: 55964 - protein, 32 aa, Artificial Sequence
  Description of Artificial Sequence: Synthetic polypeptide
SEEEIATTNPVATEQYGSVATNLQDQGGNEEA

SEQ ID NO: 55965 - protein, 31 aa, Artificial Sequence
  Description of Artificial Sequence: Synthetic polypeptide
DEEEIRTTNPVATEQYGCVSTNDDNGIQEHT

SEQ ID NO: 55966 - protein, 32 aa, Artificial Sequence
  Description of Artificial Sequence: Synthetic polypeptide
SEEEIATTNPVATEQYGSVATNLQNGPMENQD

SEQ ID NO: 55967 - protein, 32 aa, Artificial Sequence
  Description of Artificial Sequence: Synthetic polypeptide
SEEEIATTNPVATEQYGSVATNLQNQGDNEQA

SEQ ID NO: 55968 - protein, 32 aa, Artificial Sequence
  Description of Artificial Sequence: Synthetic polypeptide
DEEEIRTTNPVATEQYGCVSTMGQGGGNGNGQ

SEQ ID NO: 55969 - protein, 31 aa, Artificial Sequence
  Description of Artificial Sequence: Synthetic polypeptide
SEEEIACTNPVATEQYGSVATNLQREDDNAD

SEQ ID NO: 55970 - protein, 31 aa, Artificial Sequence
  Description of Artificial Sequence: Synthetic polypeptide
SEEEIACTNPVATEQYGSVATNLQRDQGDTV

SEQ ID NO: 55971 - protein, 30 aa, Artificial Sequence
  Description of Artificial Sequence: Synthetic polypeptide
SEEEIACTNPVATEQYGSVATNLQRDDMID

SEQ ID NO: 55972 - protein, 28 aa, Artificial Sequence
  Description of Artificial Sequence: Synthetic peptide
SEEEIACTNPIATEQYGEVPENLMRGNK

SEQ ID NO: 55973 - protein, 31 aa, Artificial Sequence
  Description of Artificial Sequence: Synthetic polypeptide
SEEEIACTNPIATEQYGSVSAENLMDREGNR

SEQ ID NO: 55974 - protein, 28 aa, Artificial Sequence
  Description of Artificial Sequence: Synthetic peptide
SEEEIACTNPIATEQYGSVSEVCMRGER

SEQ ID NO: 55975 - protein, 30 aa, Artificial Sequence
  Description of Artificial Sequence: Synthetic polypeptide
SEEEIACTNPIATEQYGSVSGENLMDRGNH

SEQ ID NO: 55976 - protein, 28 aa, Artificial Sequence
  Description of Artificial Sequence: Synthetic peptide
SEEEIACTNPIGTEGYGSVASNLQRGDR

SEQ ID NO: 55977 - protein, 28 aa, Artificial Sequence
  Description of Artificial Sequence: Synthetic peptide
SEEEIACTNPIGTEGYGSVASTLQRGDR

SEQ ID NO: 55978 - protein, 28 aa, Artificial Sequence
  Description of Artificial Sequence: Synthetic peptide
SEEEIACTNPIGTEQYGSVAENLMRGNI

SEQ ID NO: 55979 - protein, 28 aa, Artificial Sequence
  Description of Artificial Sequence: Synthetic peptide
SEEEIACTNPIGTEQYGSVASNLQRGDI

SEQ ID NO: 55980 - protein, 28 aa, Artificial Sequence
  Description of Artificial Sequence: Synthetic peptide
SEEEIACTNPIGTEQYGVVSENLMHGNR

SEQ ID NO: 55981 - protein, 28 aa, Artificial Sequence
  Description of Artificial Sequence: Synthetic peptide
SEEEIACTNPTAYAQYGSVSENLNRGNQ

SEQ ID NO: 55982 - protein, 30 aa, Artificial Sequence
  Description of Artificial Sequence: Synthetic polypeptide
SEEEIACTNPVATEAYGSVATNLQAGDNDE

SEQ ID NO: 55983 - protein, 29 aa, Artificial Sequence
  Description of Artificial Sequence: Synthetic peptide
SEEEIACTNPVATEAYGSVATNLQDGGDE

SEQ ID NO: 55984 - protein, 30 aa, Artificial Sequence
  Description of Artificial Sequence: Synthetic polypeptide
SEEEIACTNPVATEAYGSVATNLQEGNALE

SEQ ID NO: 55985 - protein, 30 aa, Artificial Sequence
  Description of Artificial Sequence: Synthetic polypeptide
SEEEIACTNPVATEAYGSVATNLQEGNEQM

SEQ ID NO: 55986 - protein, 30 aa, Artificial Sequence
  Description of Artificial Sequence: Synthetic polypeptide
SEEEIACTNPVATEAYGSVSTNLQDGGEME

SEQ ID NO: 55987 - protein, 32 aa, Artificial Sequence
  Description of Artificial Sequence: Synthetic polypeptide
DEEEIRTTNPVATEQYGCVSTNLQPNLDEDKD

SEQ ID NO: 55988 - protein, 28 aa, Artificial Sequence
  Description of Artificial Sequence: Synthetic peptide
SEEEIACTNPVATECYGDVSECLQREER

SEQ ID NO: 55989 - protein, 28 aa, Artificial Sequence
  Description of Artificial Sequence: Synthetic peptide
SEEEIACTNPIATEQYGEASEVLQHGNR

SEQ ID NO: 55990 - protein, 28 aa, Artificial Sequence
  Description of Artificial Sequence: Synthetic peptide
SEEEIACTNPIATEGYGSVASNLMRGDR

SEQ ID NO: 55991 - protein, 30 aa, Artificial Sequence
  Description of Artificial Sequence: Synthetic polypeptide
SEDHIATTNPVAYEQYGSVATNLQDPGNRN

SEQ ID NO: 55992 - protein, 28 aa, Artificial Sequence
  Description of Artificial Sequence: Synthetic peptide
SEECIACTNPIATEQYGSVAANLMRGNE

SEQ ID NO: 55993 - protein, 29 aa, Artificial Sequence
  Description of Artificial Sequence: Synthetic peptide
SEECIACTNPTATEQYGSVSANLDRGNEN

SEQ ID NO: 55994 - protein, 28 aa, Artificial Sequence
  Description of Artificial Sequence: Synthetic peptide
SEECIACTNPTATEQYGSVSDNLMRGDQ

SEQ ID NO: 55995 - protein, 29 aa, Artificial Sequence
  Description of Artificial Sequence: Synthetic peptide
SEECIACTNPTATEQYGSVSENLDNGNER

SEQ ID NO: 55996 - protein, 29 aa, Artificial Sequence
  Description of Artificial Sequence: Synthetic peptide
SEECIACTNPTATEQYGSVSENLMTRGNQ

SEQ ID NO: 55997 - protein, 29 aa, Artificial Sequence
  Description of Artificial Sequence: Synthetic peptide
SEECIACTNPTATEQYGSVSENLNRGNEM

SEQ ID NO: 55998 - protein, 29 aa, Artificial Sequence
  Description of Artificial Sequence: Synthetic peptide
SEECIACTNPTAYEQYGSVSGNLERGNER

SEQ ID NO: 55999 - protein, 30 aa, Artificial Sequence
  Description of Artificial Sequence: Synthetic polypeptide
SEECIRTTNPVAYEQYGQVSTNNVQAGNEN

SEQ ID NO: 56000 - protein, 30 aa, Artificial Sequence
  Description of Artificial Sequence: Synthetic polypeptide
SEECISTTNPVATEQYGCVSSNHQRGSNQA

SEQ ID NO: 56001 - protein, 31 aa, Artificial Sequence
  Description of Artificial Sequence: Synthetic polypeptide
SEECISTTNPVATEQYGSVSWNDQRFGSNQA

SEQ ID NO: 56002 - protein, 28 aa, Artificial Sequence
  Description of Artificial Sequence: Synthetic peptide
SEECYATTNPIAYEPYGEVSTNLQRGND

SEQ ID NO: 56003 - protein, 28 aa, Artificial Sequence
  Description of Artificial Sequence: Synthetic peptide
SEEEIACTNPIATECYGDVSENLQHENR

SEQ ID NO: 56004 - protein, 28 aa, Artificial Sequence
  Description of Artificial Sequence: Synthetic peptide
SEEEIACTNPIATECYGSVSENLMREER

SEQ ID NO: 56005 - protein, 28 aa, Artificial Sequence
  Description of Artificial Sequence: Synthetic peptide
SEEEIACTNPIATECYGSVSENLMRENL

SEQ ID NO: 56006 - protein, 30 aa, Artificial Sequence
  Description of Artificial Sequence: Synthetic polypeptide
SEEEIACTNPIATEQWGSVSEGNLMRGNER

SEQ ID NO: 56007 - protein, 28 aa, Artificial Sequence
  Description of Artificial Sequence: Synthetic peptide
SEEEIACTNPVATEGYGSVATNLQDADN

SEQ ID NO: 56008 - protein, 30 aa, Artificial Sequence
  Description of Artificial Sequence: Synthetic polypeptide
SEEEIACTNPVATEMYGSVATNLQAGSNNH

SEQ ID NO: 56009 - protein, 30 aa, Artificial Sequence
  Description of Artificial Sequence: Synthetic polypeptide
SEEEIACTNPVATEPYGSVATNLQAANNRQ

SEQ ID NO: 56010 - protein, 31 aa, Artificial Sequence
  Description of Artificial Sequence: Synthetic polypeptide
DEEEIRTTNPVATEQYGCVSTNLMPMLEDEI

SEQ ID NO: 56011 - protein, 31 aa, Artificial Sequence
  Description of Artificial Sequence: Synthetic polypeptide
SEEEIACTNPVATEQYGSVATNLQAEDPNER

SEQ ID NO: 56012 - protein, 30 aa, Artificial Sequence
  Description of Artificial Sequence: Synthetic polypeptide
SEEEIACTNPVATEQYGSVATNLQDGDDTG

SEQ ID NO: 56013 - protein, 30 aa, Artificial Sequence
  Description of Artificial Sequence: Synthetic polypeptide
SEEEIACTNPVATEQYGSVATNLQEAGHDN

SEQ ID NO: 56014 - protein, 31 aa, Artificial Sequence
  Description of Artificial Sequence: Synthetic polypeptide
SEEEIACTNPVATEQYGSVATNLQEAGNQDH

SEQ ID NO: 56015 - protein, 31 aa, Artificial Sequence
  Description of Artificial Sequence: Synthetic polypeptide
SEEEIACTNPVATEQYGSVATNLQGAEGNTM

SEQ ID NO: 56016 - protein, 30 aa, Artificial Sequence
  Description of Artificial Sequence: Synthetic polypeptide
SEEEIACTNPVATEQYGSVATNLQGDDNND

SEQ ID NO: 56017 - protein, 30 aa, Artificial Sequence
  Description of Artificial Sequence: Synthetic polypeptide
SEEEIACTNPVATEQYGSVATNLQGEENID

SEQ ID NO: 56018 - protein, 30 aa, Artificial Sequence
  Description of Artificial Sequence: Synthetic polypeptide
SEEEIACTNPVATEQYGSVATNLQGVGDDA

SEQ ID NO: 56019 - protein, 31 aa, Artificial Sequence
  Description of Artificial Sequence: Synthetic polypeptide
SEEEIACTNPVATEQYGSVATNLQNPGGENV

SEQ ID NO: 56020 - protein, 31 aa, Artificial Sequence
  Description of Artificial Sequence: Synthetic polypeptide
SEEEIACTNPVATEQYGSVATNLQPDNENER

SEQ ID NO: 56021 - protein, 31 aa, Artificial Sequence
  Description of Artificial Sequence: Synthetic polypeptide
SEEEIACTNPVATEQYGSVATNLQPRNINEN

SEQ ID NO: 56022 - protein, 31 aa, Artificial Sequence
  Description of Artificial Sequence: Synthetic polypeptide
SEEEIACTNPVATEQYGSVATNLQQDGNPDE

SEQ ID NO: 56023 - protein, 30 aa, Artificial Sequence
  Description of Artificial Sequence: Synthetic polypeptide
SEEEIACTNPVATEQYGSVATNLQRADPLN

SEQ ID NO: 56024 - protein, 31 aa, Artificial Sequence
  Description of Artificial Sequence: Synthetic polypeptide
SEEEIACTNPVATEQYGSVATNLQRAEGGID

SEQ ID NO: 56025 - protein, 30 aa, Artificial Sequence
  Description of Artificial Sequence: Synthetic polypeptide
SEEEIACTNPVATEQYGSVATNLQAEDNVQ

SEQ ID NO: 56026 - protein, 30 aa, Artificial Sequence
  Description of Artificial Sequence: Synthetic polypeptide
SEEEIACTNPVATEQYGSVATNLQADPQDR

SEQ ID NO: 56027 - protein, 30 aa, Artificial Sequence
  Description of Artificial Sequence: Synthetic polypeptide
SEEEIACTNPVATEQYGSVATNLQADPNGE

SEQ ID NO: 56028 - protein, 30 aa, Artificial Sequence
  Description of Artificial Sequence: Synthetic polypeptide
SEEEIACTNPVATEQYGSVATNLQADNTDN

SEQ ID NO: 56029 - protein, 29 aa, Artificial Sequence
  Description of Artificial Sequence: Synthetic peptide
SEEEIACTNPVATEPYGSVSTNLADPDNH

SEQ ID NO: 56030 - protein, 31 aa, Artificial Sequence
  Description of Artificial Sequence: Synthetic polypeptide
SEEEIACTNPVATEPYGSVSTNLQNSNPDRN

SEQ ID NO: 56031 - protein, 30 aa, Artificial Sequence
  Description of Artificial Sequence: Synthetic polypeptide
SEEEIACTNPVATEPYGSVSTNLQSPEDRN

SEQ ID NO: 56032 - protein, 30 aa, Artificial Sequence
  Description of Artificial Sequence: Synthetic polypeptide
SEEEIACTNPVATEQWGSVATNLERGLDRL

SEQ ID NO: 56033 - protein, 29 aa, Artificial Sequence
  Description of Artificial Sequence: Synthetic peptide
SEEEIACTNPVATEQYGAVATNLQDGPDQ

SEQ ID NO: 56034 - protein, 31 aa, Artificial Sequence
  Description of Artificial Sequence: Synthetic polypeptide
SEEEIACTNPVATEQYGCVATNLQAEDGNRN

SEQ ID NO: 56035 - protein, 30 aa, Artificial Sequence
  Description of Artificial Sequence: Synthetic polypeptide
SEEEIACTNPVATEQYGCVATNLQRDDLND

SEQ ID NO: 56036 - protein, 30 aa, Artificial Sequence
  Description of Artificial Sequence: Synthetic polypeptide
SEEEIATTNPVAYEQYGSVATNLQEAGPPP

SEQ ID NO: 56037 - protein, 28 aa, Artificial Sequence
  Description of Artificial Sequence: Synthetic peptide
SEEEIACTNPVATEQYGSVAETLMHGDR

SEQ ID NO: 56038 - protein, 32 aa, Artificial Sequence
  Description of Artificial Sequence: Synthetic polypeptide
SEEEIACTNPVATEQYGSVATNLDNRAGENGR

SEQ ID NO: 56039 - protein, 31 aa, Artificial Sequence
  Description of Artificial Sequence: Synthetic polypeptide
SEEEIACTNPVATEQYGSVATNLENRGENVY

SEQ ID NO: 56040 - protein, 31 aa, Artificial Sequence
  Description of Artificial Sequence: Synthetic polypeptide
SEEEIACTNPVATEQYGSVATNLNRNGGERD

SEQ ID NO: 56041 - protein, 30 aa, Artificial Sequence
  Description of Artificial Sequence: Synthetic polypeptide
SEEEIACTNPVATEQYGSVATNLQAAANNN

SEQ ID NO: 56042 - protein, 30 aa, Artificial Sequence
  Description of Artificial Sequence: Synthetic polypeptide
SEEEIACTNPVATEQYGSVATNLQADENHN

SEQ ID NO: 56043 - protein, 30 aa, Artificial Sequence
  Description of Artificial Sequence: Synthetic polypeptide
SEEEIACTNPVATEQYGSVATNLQADNNNE

SEQ ID NO: 56044 - protein, 30 aa, Artificial Sequence
  Description of Artificial Sequence: Synthetic polypeptide
SEEEIACTNPVATEQYGSVATNLQADNNNN

SEQ ID NO: 56045 - protein, 30 aa, Artificial Sequence
  Description of Artificial Sequence: Synthetic polypeptide
SEEEIACTNPVATEQYGSVAITNDQDSGNQ

SEQ ID NO: 56046 - protein, 30 aa, Artificial Sequence
  Description of Artificial Sequence: Synthetic polypeptide
SEDEIATTNPVAYEQYGSVATNLQRNPDPR

SEQ ID NO: 56047 - protein, 33 aa, Artificial Sequence
  Description of Artificial Sequence: Synthetic polypeptide
DEEEIRTTNPVATEQYGCVSTGNLQFFNSNTQS

SEQ ID NO: 56048 - protein, 29 aa, Artificial Sequence
  Description of Artificial Sequence: Synthetic peptide
SEEEICCTNPTATEQWGSVSENLMRGNEQ

SEQ ID NO: 56049 - protein, 32 aa, Artificial Sequence
  Description of Artificial Sequence: Synthetic polypeptide
DEEEIRTTNPVATEQYGCVSTDDQREIENNGG

SEQ ID NO: 56050 - protein, 34 aa, Artificial Sequence
  Description of Artificial Sequence: Synthetic polypeptide
DEEEIRTTNPVATEQYGCVSTDDLQQRQGDNEVI

SEQ ID NO: 56051 - protein, 32 aa, Artificial Sequence
  Description of Artificial Sequence: Synthetic polypeptide
DEEEIRTTNPVATEQYGCVSTDDLQGEINNVD

SEQ ID NO: 56052 - protein, 28 aa, Artificial Sequence
  Description of Artificial Sequence: Synthetic peptide
SEEEIRCTNPIATECYGATAENLMRGNR

SEQ ID NO: 56053 - protein, 30 aa, Artificial Sequence
  Description of Artificial Sequence: Synthetic polypeptide
SEEEIRCTNPIATECYGSTTWSENLARGNR

SEQ ID NO: 56054 - protein, 32 aa, Artificial Sequence
  Description of Artificial Sequence: Synthetic polypeptide
DEEEIRTTNPVATEQYGCVSTALQNFGSDTQS

SEQ ID NO: 56055 - protein, 30 aa, Artificial Sequence
  Description of Artificial Sequence: Synthetic polypeptide
SEEEIRCTNPIATECYGSVSGENDMDRGNR

SEQ ID NO: 56056 - protein, 32 aa, Artificial Sequence
  Description of Artificial Sequence: Synthetic polypeptide
DEEEIRTTNPVATEQYGCVSTALQESFGSEQA

SEQ ID NO: 56057 - protein, 30 aa, Artificial Sequence
  Description of Artificial Sequence: Synthetic polypeptide
SEEEIRCTNPIATEGYGSVSENNLMRGWNE

SEQ ID NO: 56058 - protein, 30 aa, Artificial Sequence
  Description of Artificial Sequence: Synthetic polypeptide
SEEEIRCTNPIATEQWGSVSCNEMDRGENR

SEQ ID NO: 56059 - protein, 30 aa, Artificial Sequence
  Description of Artificial Sequence: Synthetic polypeptide
SEEEIRCTNPIATEQWGSVSCNEMREGENR

SEQ ID NO: 56060 - protein, 31 aa, Artificial Sequence
  Description of Artificial Sequence: Synthetic polypeptide
SEEEIRCTNPIATEQWGSVSEINLQDREGNG

SEQ ID NO: 56061 - protein, 32 aa, Artificial Sequence
  Description of Artificial Sequence: Synthetic polypeptide
DEEEIRTTNPVATEQYGCVSTAHQERFGSEQM

SEQ ID NO: 56062 - protein, 32 aa, Artificial Sequence
  Description of Artificial Sequence: Synthetic polypeptide
DEEEIRTTNPVATEQYGCVSTAEPQTTDGNQG

SEQ ID NO: 56063 - protein, 31 aa, Artificial Sequence
  Description of Artificial Sequence: Synthetic polypeptide
DEEEIRTTNPVATEQYGCVSSNNQFFGSEQA

SEQ ID NO: 56064 - protein, 32 aa, Artificial Sequence
  Description of Artificial Sequence: Synthetic polypeptide
DEEEIRTTNPVATEQYGCVSTDELQEGGGEFQ

SEQ ID NO: 56065 - protein, 30 aa, Artificial Sequence
  Description of Artificial Sequence: Synthetic polypeptide
SEEEIRCTNPIATEQWGSVSGENDMRGNQR

SEQ ID NO: 56066 - protein, 32 aa, Artificial Sequence
  Description of Artificial Sequence: Synthetic polypeptide
DEEEIRTTNPVATEQYGCVSTDGWPRNGEEDR

SEQ ID NO: 56067 - protein, 33 aa, Artificial Sequence
  Description of Artificial Sequence: Synthetic polypeptide
DEEEIRTTNPVATEQYGCVSTDLQQRGTMEDHI

SEQ ID NO: 56068 - protein, 29 aa, Artificial Sequence
  Description of Artificial Sequence: Synthetic peptide
SEEEIRCTNPCATEQYGSCNSENLERENQ

SEQ ID NO: 56069 - protein, 31 aa, Artificial Sequence
  Description of Artificial Sequence: Synthetic polypeptide
SEEEIRCTNPCATEQYGSVCSPENLHRENRD

SEQ ID NO: 56070 - protein, 30 aa, Artificial Sequence
  Description of Artificial Sequence: Synthetic polypeptide
SEEEIRCTNPCATEQYGSVNSENDMRGEER

SEQ ID NO: 56071 - protein, 31 aa, Artificial Sequence
  Description of Artificial Sequence: Synthetic polypeptide
DEEEIRTTNPVATEQYGCVSTEEHQHGSQQN

SEQ ID NO: 56072 - protein, 31 aa, Artificial Sequence
  Description of Artificial Sequence: Synthetic polypeptide
DEEEIRTTNPVATEQYGCVSTEEHQGGSEQS

SEQ ID NO: 56073 - protein, 32 aa, Artificial Sequence
  Description of Artificial Sequence: Synthetic polypeptide
DEEEIRTTNPVATEQYGCVSTEEHQENGSNQN

SEQ ID NO: 56074 - protein, 33 aa, Artificial Sequence
  Description of Artificial Sequence: Synthetic polypeptide
DEEEIRTTNPVATEQYGCVSTEEEHQRFGSNQA

SEQ ID NO: 56075 - protein, 32 aa, Artificial Sequence
  Description of Artificial Sequence: Synthetic polypeptide
DEEEIRTTNPVATEQYGCVSTEDQHFGSNNQY

SEQ ID NO: 56076 - protein, 31 aa, Artificial Sequence
  Description of Artificial Sequence: Synthetic polypeptide
SEEEIRCTNPCATEQYGSVSLENLLERENQR

SEQ ID NO: 56077 - protein, 32 aa, Artificial Sequence
  Description of Artificial Sequence: Synthetic polypeptide
DEEEIRTTNPVATEQYGCVSTEDLQYFGSEQN

SEQ ID NO: 56078 - protein, 30 aa, Artificial Sequence
  Description of Artificial Sequence: Synthetic polypeptide
SEEEIRCTNPCATEQYGSVVPENLHRGNID

SEQ ID NO: 56079 - protein, 30 aa, Artificial Sequence
  Description of Artificial Sequence: Synthetic polypeptide
SEEEIRCTNPCATEQYGSVWPENLMRENQR

SEQ ID NO: 56080 - protein, 30 aa, Artificial Sequence
  Description of Artificial Sequence: Synthetic polypeptide
SEEEIRCTNPCATEQYGSYVSNENLMRENE

SEQ ID NO: 56081 - protein, 28 aa, Artificial Sequence
  Description of Artificial Sequence: Synthetic peptide
SEEEIRCTNPCSSEQYGIVSCNLMSGNR

SEQ ID NO: 56082 - protein, 34 aa, Artificial Sequence
  Description of Artificial Sequence: Synthetic polypeptide
DEEEIRTTNPVATEQYGCVSTDVLQQRQGDNNQE

SEQ ID NO: 56083 - protein, 32 aa, Artificial Sequence
  Description of Artificial Sequence: Synthetic polypeptide
DEEEIRTTNPVATEQYGCVSTDLEQQESEDRI

SEQ ID NO: 56084 - protein, 29 aa, Artificial Sequence
  Description of Artificial Sequence: Synthetic peptide
SEEEIRCTNPCATEQYGCVSWNLMYGNQS

SEQ ID NO: 56085 - protein, 32 aa, Artificial Sequence
  Description of Artificial Sequence: Synthetic polypeptide
DEEEIRTTNPVATEQYGCVSSNLQPNASEGDI

SEQ ID NO: 56086 - protein, 30 aa, Artificial Sequence
  Description of Artificial Sequence: Synthetic polypeptide
SEEEIRCTNPIATEQYGATVWSENLMRGPR

SEQ ID NO: 56087 - protein, 28 aa, Artificial Sequence
  Description of Artificial Sequence: Synthetic peptide
SEEEIRCTNPIATEQYGSAPENCMRGER

SEQ ID NO: 56088 - protein, 28 aa, Artificial Sequence
  Description of Artificial Sequence: Synthetic peptide
SEEEIRCTNPIATEQYGSAPENCQREER

SEQ ID NO: 56089 - protein, 32 aa, Artificial Sequence
  Description of Artificial Sequence: Synthetic polypeptide
DEEEIRTTNPVATEQYGCVSSGNPQFFGSNQL

SEQ ID NO: 56090 - protein, 32 aa, Artificial Sequence
  Description of Artificial Sequence: Synthetic polypeptide
SEEEIRCTNPIATEQYGSIVSEMNLMRGVNDR

SEQ ID NO: 56091 - protein, 33 aa, Artificial Sequence
  Description of Artificial Sequence: Synthetic polypeptide
DEEEIRTTNPVATEQYGCVSSENLQFFGSNNQE

SEQ ID NO: 56092 - protein, 30 aa, Artificial Sequence
  Description of Artificial Sequence: Synthetic polypeptide
SEEEIRCTNPIATEQYGSNSENNLMDGTNR

SEQ ID NO: 56093 - protein, 31 aa, Artificial Sequence
  Description of Artificial Sequence: Synthetic polypeptide
SEEEIRCTNPIATEQYGSTVWSNENLMRGPR

SEQ ID NO: 56094 - protein, 30 aa, Artificial Sequence
  Description of Artificial Sequence: Synthetic polypeptide
SEEEIRCTNPIATEQYGSTWSNENLMRGNI

SEQ ID NO: 56095 - protein, 28 aa, Artificial Sequence
  Description of Artificial Sequence: Synthetic peptide
SEEEIRCTNPIATEQYGSVAETLMHGDR

SEQ ID NO: 56096 - protein, 31 aa, Artificial Sequence
  Description of Artificial Sequence: Synthetic polypeptide
SEEEIRCTNPIATEQYGSVASGEHNDMRGNR

SEQ ID NO: 56097 - protein, 30 aa, Artificial Sequence
  Description of Artificial Sequence: Synthetic polypeptide
SEEEIRCTNPIATEQYGSVCCDENDMRGNR

SEQ ID NO: 56098 - protein, 30 aa, Artificial Sequence
  Description of Artificial Sequence: Synthetic polypeptide
SEEEIRCTNPIATEQYGSVCMENDDMRGNR

SEQ ID NO: 56099 - protein, 30 aa, Artificial Sequence
  Description of Artificial Sequence: Synthetic polypeptide
SEEEIRCTNPIATEQYGSVCSGENDMDGNR

SEQ ID NO: 56100 - protein, 30 aa, Artificial Sequence
  Description of Artificial Sequence: Synthetic polypeptide
SEEEIRCTNPIATEQYGSVCSSELMRFGNA

SEQ ID NO: 56101 - protein, 31 aa, Artificial Sequence
  Description of Artificial Sequence: Synthetic polypeptide
SEEEIRCTNPIATEQYGSVCSSNLARFGNQA

SEQ ID NO: 56102 - protein, 31 aa, Artificial Sequence
  Description of Artificial Sequence: Synthetic polypeptide
SEEEIRCTNPIATEQYGQSVSEMNNPRGNDR

SEQ ID NO: 56103 - protein, 29 aa, Artificial Sequence
  Description of Artificial Sequence: Synthetic peptide
SEEEIRCTNPIATEQYGATSENLMERGPR

SEQ ID NO: 56104 - protein, 31 aa, Artificial Sequence
  Description of Artificial Sequence: Synthetic polypeptide
SEEEIRCTNPIATEQYGQSVSEMNLFEGNDR

SEQ ID NO: 56105 - protein, 28 aa, Artificial Sequence
  Description of Artificial Sequence: Synthetic peptide
SEEEIRCTNPIATEQYGNVAENIMRGQR

SEQ ID NO: 56106 - protein, 31 aa, Artificial Sequence
  Description of Artificial Sequence: Synthetic polypeptide
DEEEIRTTNPVATEQYGCVSSNLQFFISEDY

SEQ ID NO: 56107 - protein, 29 aa, Artificial Sequence
  Description of Artificial Sequence: Synthetic peptide
SEEEIRCTNPIATEQYGCVCSSNLINGNA

SEQ ID NO: 56108 - protein, 30 aa, Artificial Sequence
  Description of Artificial Sequence: Synthetic polypeptide
SEEEIRCTNPIATEQYGCVCSSNLMNFGNR

SEQ ID NO: 56109 - protein, 30 aa, Artificial Sequence
  Description of Artificial Sequence: Synthetic polypeptide
SEEEIRCTNPIATEQYGCVCSWNDARFGNR

SEQ ID NO: 56110 - protein, 30 aa, Artificial Sequence
  Description of Artificial Sequence: Synthetic polypeptide
SEEEIRCTNPIATEQYGCVSENLERDNQRL

SEQ ID NO: 56111 - protein, 28 aa, Artificial Sequence
  Description of Artificial Sequence: Synthetic peptide
SEEEIRCTNPIATEQYGCVSSNLMNGEQ

SEQ ID NO: 56112 - protein, 32 aa, Artificial Sequence
  Description of Artificial Sequence: Synthetic polypeptide
DEEEIRTTNPVATEQYGCVSSNLELAGPNESG

SEQ ID NO: 56113 - protein, 30 aa, Artificial Sequence
  Description of Artificial Sequence: Synthetic polypeptide
SEEEIRCTNPIATEQYGCVSWNLIRFGNQN

SEQ ID NO: 56114 - protein, 29 aa, Artificial Sequence
  Description of Artificial Sequence: Synthetic peptide
SEEEIRCTNPIATEQYGCVSWNPARFGNQ

SEQ ID NO: 56115 - protein, 29 aa, Artificial Sequence
  Description of Artificial Sequence: Synthetic peptide
SEEEIRCTNPIATEQYGDVSENEMNRGDR

SEQ ID NO: 56116 - protein, 28 aa, Artificial Sequence
  Description of Artificial Sequence: Synthetic peptide
SEEEIRCTNPIATEQYGEAPEVLQHGNR

SEQ ID NO: 56117 - protein, 31 aa, Artificial Sequence
  Description of Artificial Sequence: Synthetic polypeptide
SEEEIRCTNPIATEQYGESVSEENAMRGANR

SEQ ID NO: 56118 - protein, 28 aa, Artificial Sequence
  Description of Artificial Sequence: Synthetic peptide
SEEEIRCTNPIATEQYGEVPENCQHGER

SEQ ID NO: 56119 - protein, 28 aa, Artificial Sequence
  Description of Artificial Sequence: Synthetic peptide
SEEEIRCTNPIATEQYGEVPEVLMHGNR

SEQ ID NO: 56120 - protein, 31 aa, Artificial Sequence
  Description of Artificial Sequence: Synthetic polypeptide
SEEEIRCTNPIATEQYGKTVSENLSTRGGNR

SEQ ID NO: 56121 - protein, 30 aa, Artificial Sequence
  Description of Artificial Sequence: Synthetic polypeptide
SEEEIRCTNPIATEQYGQCVSWNLARGSNQ

SEQ ID NO: 56122 - protein, 30 aa, Artificial Sequence
  Description of Artificial Sequence: Synthetic polypeptide
SEEEIRCTNPCATEQYGCVSENTLHRGNFD

SEQ ID NO: 56123 - protein, 29 aa, Artificial Sequence
  Description of Artificial Sequence: Synthetic peptide
SEEEIRCTNPCATEQYGCVCSWNLTHGNQ

SEQ ID NO: 56124 - protein, 33 aa, Artificial Sequence
  Description of Artificial Sequence: Synthetic polypeptide
DEEEIRTTNPVATEQYGCVSTEELQFFGSNTQE

SEQ ID NO: 56125 - protein, 31 aa, Artificial Sequence
  Description of Artificial Sequence: Synthetic polypeptide
SEEEICTTNPVATEMYGSVATNLQQDGNDHE

SEQ ID NO: 56126 - protein, 31 aa, Artificial Sequence
  Description of Artificial Sequence: Synthetic polypeptide
SEEEICTTNPVATEPYGSVATNLQDDGNDNH

SEQ ID NO: 56127 - protein, 31 aa, Artificial Sequence
  Description of Artificial Sequence: Synthetic polypeptide
SEEEICTTNPVATEPYGSVATNLQDSGNAEE

SEQ ID NO: 56128 - protein, 31 aa, Artificial Sequence
  Description of Artificial Sequence: Synthetic polypeptide
DEEEIRTTNPVATEQYGCVSTEPQSFGSEVS

SEQ ID NO: 56129 - protein, 31 aa, Artificial Sequence
  Description of Artificial Sequence: Synthetic polypeptide
DEEEIRTTNPVATEQYGCVSTEPQRFISEQM

SEQ ID NO: 56130 - protein, 32 aa, Artificial Sequence
  Description of Artificial Sequence: Synthetic polypeptide
DEEEIRTTNPVATEQYGCVSTEPQRFGSETQQ

SEQ ID NO: 56131 - protein, 32 aa, Artificial Sequence
  Description of Artificial Sequence: Synthetic polypeptide
DEEEIRTTNPVATEQYGCVSTEPQRFGSDTQS

SEQ ID NO: 56132 - protein, 31 aa, Artificial Sequence
  Description of Artificial Sequence: Synthetic polypeptide
SEEEICTTNPVATEPYGSVATNLQTADGGNH

SEQ ID NO: 56133 - protein, 31 aa, Artificial Sequence
  Description of Artificial Sequence: Synthetic polypeptide
DEEEIRTTNPVATEQYGCVSTEPQEHGSEQL

SEQ ID NO: 56134 - protein, 30 aa, Artificial Sequence
  Description of Artificial Sequence: Synthetic polypeptide
SEEEICTTNPVATEPYGSVATNLTIDGNEN

SEQ ID NO: 56135 - protein, 32 aa, Artificial Sequence
  Description of Artificial Sequence: Synthetic polypeptide
SEEEICTTNPVATEPYGSVSTNLQDGLGNDSE

SEQ ID NO: 56136 - protein, 31 aa, Artificial Sequence
  Description of Artificial Sequence: Synthetic polypeptide
SEEEICTTNPVATEPYGSVSTNLQIDGDDIG

SEQ ID NO: 56137 - protein, 30 aa, Artificial Sequence
  Description of Artificial Sequence: Synthetic polypeptide
SEEEICTTNPVATEPYGSVSTNLQSPDDVA

SEQ ID NO: 56138 - protein, 30 aa, Artificial Sequence
  Description of Artificial Sequence: Synthetic polypeptide
SEEEICTTNPVATEPYGSVSTNLQSPDQFA

SEQ ID NO: 56139 - protein, 30 aa, Artificial Sequence
  Description of Artificial Sequence: Synthetic polypeptide
SEEEICTTNPVATEPYGSVSTNPQIDGDDL

SEQ ID NO: 56140 - protein, 31 aa, Artificial Sequence
  Description of Artificial Sequence: Synthetic polypeptide
SEEEICTTNPVATEMYGSVATNLQPDGNPIE

SEQ ID NO: 56141 - protein, 31 aa, Artificial Sequence
  Description of Artificial Sequence: Synthetic polypeptide
SEEEICTTNPVATEQYGSVAANLQQGGNEQV

SEQ ID NO: 56142 - protein, 31 aa, Artificial Sequence
  Description of Artificial Sequence: Synthetic polypeptide
SEEEICTTNPVATEMYGSVATNLQDGAGNEE

SEQ ID NO: 56143 - protein, 32 aa, Artificial Sequence
  Description of Artificial Sequence: Synthetic polypeptide
DEEEIRTTNPVATEQYGCVSTEPTQGFGSNQM

SEQ ID NO: 56144 - protein, 33 aa, Artificial Sequence
  Description of Artificial Sequence: Synthetic polypeptide
DEEEIRTTNPVATEQYGCVSTGNHQNFGSNPQA

SEQ ID NO: 56145 - protein, 32 aa, Artificial Sequence
  Description of Artificial Sequence: Synthetic polypeptide
DEEEIRTTNPVATEQYGCVSTGNHQFFNSDQE

SEQ ID NO: 56146 - protein, 30 aa, Artificial Sequence
  Description of Artificial Sequence: Synthetic polypeptide
SEEEICCTNPTATEQYGSVAENHLMRGNER

SEQ ID NO: 56147 - protein, 29 aa, Artificial Sequence
  Description of Artificial Sequence: Synthetic peptide
SEEEICCTNPTATEQYGSVAENLMRGNGE

SEQ ID NO: 56148 - protein, 30 aa, Artificial Sequence
  Description of Artificial Sequence: Synthetic polypeptide
DEEEIRTTNPVATEQYGCVSTGLAHDEDQD

SEQ ID NO: 56149 - protein, 29 aa, Artificial Sequence
  Description of Artificial Sequence: Synthetic peptide
SEEEICCTNPTATEQYGSVSENLMRGDGQ

SEQ ID NO: 56150 - protein, 32 aa, Artificial Sequence
  Description of Artificial Sequence: Synthetic polypeptide
DEEEIRTTNPVATEQYGCVSTGEPQRFGSEQT

SEQ ID NO: 56151 - protein, 29 aa, Artificial Sequence
  Description of Artificial Sequence: Synthetic peptide
SEEEICCTNPTATEQYGSVSENLMRGDKM

SEQ ID NO: 56152 - protein, 33 aa, Artificial Sequence
  Description of Artificial Sequence: Synthetic polypeptide
DEEEIRTTNPVATEQYGCVSTGELQFFGSENQE

SEQ ID NO: 56153 - protein, 32 aa, Artificial Sequence
  Description of Artificial Sequence: Synthetic polypeptide
DEEEIRTTNPVATEQYGCVSTGELENFGSNQG

SEQ ID NO: 56154 - protein, 33 aa, Artificial Sequence
  Description of Artificial Sequence: Synthetic polypeptide
DEEEIRTTNPVATEQYGCVSTGELDQNFGSNQG

SEQ ID NO: 56155 - protein, 30 aa, Artificial Sequence
  Description of Artificial Sequence: Synthetic polypeptide
SEEEICCTNPTATEQYGSVSENLMRGNESM

SEQ ID NO: 56156 - protein, 29 aa, Artificial Sequence
  Description of Artificial Sequence: Synthetic peptide
SEEEICCTNPTAYEQYGSVSANLMRGNGQ

SEQ ID NO: 56157 - protein, 32 aa, Artificial Sequence
  Description of Artificial Sequence: Synthetic polypeptide
DEEEIRTTNPVATEQYGCVSTETQEHFGSNQP

SEQ ID NO: 56158 - protein, 32 aa, Artificial Sequence
  Description of Artificial Sequence: Synthetic polypeptide
SEEEICTTNPTATEQYGSVATNLQDRGMNGEM

SEQ ID NO: 56159 - protein, 32 aa, Artificial Sequence
  Description of Artificial Sequence: Synthetic polypeptide
SEEEICTTNPTATEQYGSVATNLQHSGDNGRM

SEQ ID NO: 56160 - protein, 31 aa, Artificial Sequence
  Description of Artificial Sequence: Synthetic polypeptide
SEEEICTTNPVATEQYGSVATNLQDPGPAEE

SEQ ID NO: 56161 - protein, 31 aa, Artificial Sequence
  Description of Artificial Sequence: Synthetic polypeptide
SEEEICTTNPVATEQYGSVATNLQEGDFTVS

SEQ ID NO: 56162 - protein, 30 aa, Artificial Sequence
  Description of Artificial Sequence: Synthetic polypeptide
SEEEICTTNPVATEQYGSVATNLQGVDDMW

SEQ ID NO: 56163 - protein, 30 aa, Artificial Sequence
  Description of Artificial Sequence: Synthetic polypeptide
SEEEIRCTNPAATEQYGAVSIENMLMRGNG

SEQ ID NO: 56164 - protein, 29 aa, Artificial Sequence
  Description of Artificial Sequence: Synthetic peptide
SEEEIRCTNPAATEQYGCVSLENLERENA

SEQ ID NO: 56165 - protein, 29 aa, Artificial Sequence
  Description of Artificial Sequence: Synthetic peptide
SEEEIRCTNPAATEQYGCVYENLERGNQI

SEQ ID NO: 56166 - protein, 31 aa, Artificial Sequence
  Description of Artificial Sequence: Synthetic polypeptide
SEEEIRCTNPAATEQYGSVCYENLERGNQRE

SEQ ID NO: 56167 - protein, 29 aa, Artificial Sequence
  Description of Artificial Sequence: Synthetic peptide
SEEEIRCTNPAATEQYGSVISENGMGGNA

SEQ ID NO: 56168 - protein, 31 aa, Artificial Sequence
  Description of Artificial Sequence: Synthetic polypeptide
SEEEIRCTNPAATEQYGSVSEMNGMRIGNDR

SEQ ID NO: 56169 - protein, 31 aa, Artificial Sequence
  Description of Artificial Sequence: Synthetic polypeptide
DEEEIRTTNPVATEQYGCVSTEHQNFTSNNQ

SEQ ID NO: 56170 - protein, 29 aa, Artificial Sequence
  Description of Artificial Sequence: Synthetic peptide
SEEEIRCTNPAATEQYGSVSENGMGGDNI

SEQ ID NO: 56171 - protein, 31 aa, Artificial Sequence
  Description of Artificial Sequence: Synthetic polypeptide
DEEEIRTTNPVATEQYGCVSTEHQGSGSDQS

SEQ ID NO: 56172 - protein, 31 aa, Artificial Sequence
  Description of Artificial Sequence: Synthetic polypeptide
DEEEIRTTNPVATEQYGCVSTEHQESFTSNQ

SEQ ID NO: 56173 - protein, 31 aa, Artificial Sequence
  Description of Artificial Sequence: Synthetic polypeptide
SEEEIRCTNPAATEQYGSVSIENMLMRGGER

SEQ ID NO: 56174 - protein, 29 aa, Artificial Sequence
  Description of Artificial Sequence: Synthetic peptide
SEEEIRCTNPAATEQYGSVWENLMGGNGG

SEQ ID NO: 56175 - protein, 31 aa, Artificial Sequence
  Description of Artificial Sequence: Synthetic polypeptide
DEEEIRTTNPVATEQYGCVSTEEPQNIGSEQ

SEQ ID NO: 56176 - protein, 33 aa, Artificial Sequence
  Description of Artificial Sequence: Synthetic polypeptide
DEEEIRTTNPVATEQYGCVSTEELQRFGSETQS

SEQ ID NO: 56177 - protein, 33 aa, Artificial Sequence
  Description of Artificial Sequence: Synthetic polypeptide
DEEEIRTTNPVATEQYGCVSTEELQHFGSETRA

SEQ ID NO: 56178 - protein, 33 aa, Artificial Sequence
  Description of Artificial Sequence: Synthetic polypeptide
SEEEIRATNPVATEQYGSVSTDNGNMQRGEDDR

SEQ ID NO: 56179 - protein, 31 aa, Artificial Sequence
  Description of Artificial Sequence: Synthetic polypeptide
DEEEIRTTNPVATEQYGCVSTEHQRFTSETQ

SEQ ID NO: 56180 - protein, 31 aa, Artificial Sequence
  Description of Artificial Sequence: Synthetic polypeptide
DEEEIRTTNPVATEQYGCVSTEHQYLGSEQS

SEQ ID NO: 56181 - protein, 31 aa, Artificial Sequence
  Description of Artificial Sequence: Synthetic polypeptide
SEEEIRATNPAATEQYGSVSIENMLMRGNGQ

SEQ ID NO: 56182 - protein, 32 aa, Artificial Sequence
  Description of Artificial Sequence: Synthetic polypeptide
DEEEIRTTNPVATEQYGCVSTENHQHSNSNQT

SEQ ID NO: 56183 - protein, 31 aa, Artificial Sequence
  Description of Artificial Sequence: Synthetic polypeptide
SEEEICTTNPVATEQYGSVATNLQQGGEGDD

SEQ ID NO: 56184 - protein, 31 aa, Artificial Sequence
  Description of Artificial Sequence: Synthetic polypeptide
SEEEICTTNPVATEQYGSVCATNLQSDNDAE

SEQ ID NO: 56185 - protein, 31 aa, Artificial Sequence
  Description of Artificial Sequence: Synthetic polypeptide
DEEEIRTTNPVATEQYGCVSTELQFFMSDQY

SEQ ID NO: 56186 - protein, 32 aa, Artificial Sequence
  Description of Artificial Sequence: Synthetic polypeptide
DEEEIRTTNPVATEQYGCVSTELQEYFISNQA

SEQ ID NO: 56187 - protein, 31 aa, Artificial Sequence
  Description of Artificial Sequence: Synthetic polypeptide
SEEEICTTNPVATEQYGTQVSTNLVDGQNNF

SEQ ID NO: 56188 - protein, 31 aa, Artificial Sequence
  Description of Artificial Sequence: Synthetic polypeptide
SEEEICTTNPVATESYGSVATNLQGDGTNGE

SEQ ID NO: 56189 - protein, 30 aa, Artificial Sequence
  Description of Artificial Sequence: Synthetic polypeptide
SEEEIATTNPVAYEQYGSVATNLQQNPEGR

SEQ ID NO: 56190 - protein, 33 aa, Artificial Sequence
  Description of Artificial Sequence: Synthetic polypeptide
DEEEIRTTNPVATEQYGCVSTELQEGFGSDNQV

SEQ ID NO: 56191 - protein, 31 aa, Artificial Sequence
  Description of Artificial Sequence: Synthetic polypeptide
SEEEICTTNPVATESYGSVATNLQPGDNSDG

SEQ ID NO: 56192 - protein, 29 aa, Artificial Sequence
  Description of Artificial Sequence: Synthetic peptide
SEEEICTTNPVATEYYGTVSSNLQIMNMQ

SEQ ID NO: 56193 - protein, 31 aa, Artificial Sequence
  Description of Artificial Sequence: Synthetic polypeptide
SEEEICTTNPVAYEQYGSVATNLQHGDNEAE

SEQ ID NO: 56194 - protein, 31 aa, Artificial Sequence
  Description of Artificial Sequence: Synthetic polypeptide
SEEEICTTNPVAYEQYGSVATNLQHGDNGDL

SEQ ID NO: 56195 - protein, 31 aa, Artificial Sequence
  Description of Artificial Sequence: Synthetic polypeptide
DEEEIRTTNPVATEQYGCVSTELENFGSDQN

SEQ ID NO: 56196 - protein, 29 aa, Artificial Sequence
  Description of Artificial Sequence: Synthetic peptide
SEEEIDCTNPIATEAYGRVSENLMRGSNR

SEQ ID NO: 56197 - protein, 32 aa, Artificial Sequence
  Description of Artificial Sequence: Synthetic polypeptide
SEEEIKTTNPVAYERYGSVSCTNLSQERVNNR

SEQ ID NO: 56198 - protein, 32 aa, Artificial Sequence
  Description of Artificial Sequence: Synthetic polypeptide
DEEEIRTTNPVATEQYGCVSTELLQNFGSDDM

SEQ ID NO: 56199 - protein, 30 aa, Artificial Sequence
  Description of Artificial Sequence: Synthetic polypeptide
SEDEIATTNPVAYEQYGSVATNLQQGNDQV

SEQ ID NO: 56200 - protein, 29 aa, Artificial Sequence
  Description of Artificial Sequence: Synthetic peptide
SEDEIACTNPVATEQYGSVATNLQGENIE

SEQ ID NO: 56201 - protein, 32 aa, Artificial Sequence
  Description of Artificial Sequence: Synthetic polypeptide
SECEIRTTNPVATEQWGSVSSPNLQTEEGSNR

SEQ ID NO: 56202 - protein, 30 aa, Artificial Sequence
  Description of Artificial Sequence: Synthetic polypeptide
QEGEIRTTNPCATEQYGSVSCALNMRGNPV

SEQ ID NO: 56203 - protein, 28 aa, Artificial Sequence
  Description of Artificial Sequence: Synthetic peptide
QEGEIRTTNPCSSEQYGIVSCNLQSGTR

SEQ ID NO: 56204 - protein, 32 aa, Artificial Sequence
  Description of Artificial Sequence: Synthetic polypeptide
QEHEIATTNPVATEQYGSVSANLQERAGDNAQ

SEQ ID NO: 56205 - protein, 30 aa, Artificial Sequence
  Description of Artificial Sequence: Synthetic polypeptide
QEMEIATTNPVATEQYGDVCSTCLQFEGNL

SEQ ID NO: 56206 - protein, 29 aa, Artificial Sequence
  Description of Artificial Sequence: Synthetic peptide
QEMEIATTNPVATEQYGTVSTGLEFEGND

SEQ ID NO: 56207 - protein, 32 aa, Artificial Sequence
  Description of Artificial Sequence: Synthetic polypeptide
DEEEIRTTNPVATEQYGCVSTVTQGGGNGNGN

SEQ ID NO: 56208 - protein, 28 aa, Artificial Sequence
  Description of Artificial Sequence: Synthetic peptide
QEMEIVSTNPVATEGYGTVSTGLQHGND

SEQ ID NO: 56209 - protein, 30 aa, Artificial Sequence
  Description of Artificial Sequence: Synthetic polypeptide
QEMEIVTTNPVATEQYGDVCSTCLQFEGND

SEQ ID NO: 56210 - protein, 28 aa, Artificial Sequence
  Description of Artificial Sequence: Synthetic peptide
QENEIACTNPIATEQYGSVSECLMRGER

SEQ ID NO: 56211 - protein, 31 aa, Artificial Sequence
  Description of Artificial Sequence: Synthetic polypeptide
DEEEIRTTNPVATEQYGCVSTVTDLGGEHRD

SEQ ID NO: 56212 - protein, 28 aa, Artificial Sequence
  Description of Artificial Sequence: Synthetic peptide
QENEIACTNPVATECYGDVSENLQREER

SEQ ID NO: 56213 - protein, 28 aa, Artificial Sequence
  Description of Artificial Sequence: Synthetic peptide
QENEIACTNPVATECYGDVSENLQRGEL

SEQ ID NO: 56214 - protein, 28 aa, Artificial Sequence
  Description of Artificial Sequence: Synthetic peptide
QENEIACTNPVATECYGEASENLQRGGR

SEQ ID NO: 56215 - protein, 32 aa, Artificial Sequence
  Description of Artificial Sequence: Synthetic polypeptide
DEEEIRTTNPVATEQYGCVSTVNNLDQTDDQQ

SEQ ID NO: 56216 - protein, 28 aa, Artificial Sequence
  Description of Artificial Sequence: Synthetic peptide
QENEIACTNPVATECYGSVSENLMHENR

SEQ ID NO: 56217 - protein, 29 aa, Artificial Sequence
  Description of Artificial Sequence: Synthetic peptide
QEGEIRTTNPCASEQYGIVSCINLQSGTR

SEQ ID NO: 56218 - protein, 33 aa, Artificial Sequence
  Description of Artificial Sequence: Synthetic polypeptide
DEEEIRTTNPVATEQYGCVSTVNLDQRFDDDQQ

SEQ ID NO: 56219 - protein, 32 aa, Artificial Sequence
  Description of Artificial Sequence: Synthetic polypeptide
DEEEIRTTNPVATEQYGCVSTVWDDQRGIQHD

SEQ ID NO: 56220 - protein, 29 aa, Artificial Sequence
  Description of Artificial Sequence: Synthetic peptide
QEGEIRPTNPVSTEQYGIVSCNLQNSGDR

SEQ ID NO: 56221 - protein, 29 aa, Artificial Sequence
  Description of Artificial Sequence: Synthetic peptide
QEGEIATTNPVATEQYGTVSTGLEFEGND

SEQ ID NO: 56222 - protein, 28 aa, Artificial Sequence
  Description of Artificial Sequence: Synthetic peptide
QEGEIATTNPVSSEQYGIVSCNLQSGTR

SEQ ID NO: 56223 - protein, 28 aa, Artificial Sequence
  Description of Artificial Sequence: Synthetic peptide
QEGEIATTNPVSTEQYGDVSCNLQSGTL

SEQ ID NO: 56224 - protein, 34 aa, Artificial Sequence
  Description of Artificial Sequence: Synthetic polypeptide
DEEEIRTTNPVATEQYGCVSVSGNLNQRFNSNQS

SEQ ID NO: 56225 - protein, 33 aa, Artificial Sequence
  Description of Artificial Sequence: Synthetic polypeptide
DEEEIRTTNPVATEQYGCVSVSGNLNQNNSNIA

SEQ ID NO: 56226 - protein, 28 aa, Artificial Sequence
  Description of Artificial Sequence: Synthetic peptide
QEGEIATTNPVSTEQYGIASCNLQSGTR

SEQ ID NO: 56227 - protein, 33 aa, Artificial Sequence
  Description of Artificial Sequence: Synthetic polypeptide
DEEEIRTTNPVATEQYGCVSVNNLDQRMDVERS

SEQ ID NO: 56228 - protein, 31 aa, Artificial Sequence
  Description of Artificial Sequence: Synthetic polypeptide
DEEEIRTTNPVATEQYGCVSTYPQHFGSEQL

SEQ ID NO: 56229 - protein, 31 aa, Artificial Sequence
  Description of Artificial Sequence: Synthetic polypeptide
QEGEIATTNPVSTEQYGIVSTNLPQMRNGTR

SEQ ID NO: 56230 - protein, 32 aa, Artificial Sequence
  Description of Artificial Sequence: Synthetic polypeptide
DEEEIRTTNPVATEQYGCVSTYLESGIGEQRS

SEQ ID NO: 56231 - protein, 28 aa, Artificial Sequence
  Description of Artificial Sequence: Synthetic peptide
QEGEIRPTNPCSSEQYGIVSTNLQSGTR

SEQ ID NO: 56232 - protein, 28 aa, Artificial Sequence
  Description of Artificial Sequence: Synthetic peptide
QEGEIRPTNPCSSEQYGSVSCNLQSGTR

SEQ ID NO: 56233 - protein, 28 aa, Artificial Sequence
  Description of Artificial Sequence: Synthetic peptide
QEGEIRPTNPCSTEQYGIVSCNLQQGTR

SEQ ID NO: 56234 - protein, 28 aa, Artificial Sequence
  Description of Artificial Sequence: Synthetic peptide
QEGEIRPTNPCSTEQYGIVSCNLQSGTR

SEQ ID NO: 56235 - protein, 28 aa, Artificial Sequence
  Description of Artificial Sequence: Synthetic peptide
QEGEIRPTNPVSSECYGIVSCNLQSGNR

SEQ ID NO: 56236 - protein, 28 aa, Artificial Sequence
  Description of Artificial Sequence: Synthetic peptide
QEGEIRPTNPVSTEQYGTISMNLQQGTR

SEQ ID NO: 56237 - protein, 28 aa, Artificial Sequence
  Description of Artificial Sequence: Synthetic peptide
QEGEIATTNPVATEQYGEVPENLQHGTK

SEQ ID NO: 56238 - protein, 32 aa, Artificial Sequence
  Description of Artificial Sequence: Synthetic polypeptide
DEEEIRTTNPVATEQYGCVSTVNLDERDEDQQ

SEQ ID NO: 56239 - protein, 28 aa, Artificial Sequence
  Description of Artificial Sequence: Synthetic peptide
QENEIACTNPVATEQYGEASENCQRGER

SEQ ID NO: 56240 - protein, 28 aa, Artificial Sequence
  Description of Artificial Sequence: Synthetic peptide
QENEIAPTNPVASEQYGIVSENLQSGTR

SEQ ID NO: 56241 - protein, 28 aa, Artificial Sequence
  Description of Artificial Sequence: Synthetic peptide
QENEIAPTNPVSTEQYGIVSCNLQSGTR

SEQ ID NO: 56242 - protein, 28 aa, Artificial Sequence
  Description of Artificial Sequence: Synthetic peptide
QENEIASTNPVATEQYGEASETLQRGDR

SEQ ID NO: 56243 - protein, 28 aa, Artificial Sequence
  Description of Artificial Sequence: Synthetic peptide
QENEIASTNPVATEQYGEASSNLQRGDI

SEQ ID NO: 56244 - protein, 28 aa, Artificial Sequence
  Description of Artificial Sequence: Synthetic peptide
QENEIASTNPVATEQYGVASSNLQHGDR

SEQ ID NO: 56245 - protein, 28 aa, Artificial Sequence
  Description of Artificial Sequence: Synthetic peptide
QENEIASTNPVATEQYGVASSNLQHGGR

SEQ ID NO: 56246 - protein, 28 aa, Artificial Sequence
  Description of Artificial Sequence: Synthetic peptide
QENEIASTNPVCTEQYGVVSDNLQSGNL

SEQ ID NO: 56247 - protein, 28 aa, Artificial Sequence
  Description of Artificial Sequence: Synthetic peptide
QENEIASTNPVGTEQYGEMSENLQRGGR

SEQ ID NO: 56248 - protein, 28 aa, Artificial Sequence
  Description of Artificial Sequence: Synthetic peptide
QENEIATTNPIATEQYGDVSECLQREER

SEQ ID NO: 56249 - protein, 28 aa, Artificial Sequence
  Description of Artificial Sequence: Synthetic peptide
QENEIATTNPVASEQYGIVSCCLQSGTR

SEQ ID NO: 56250 - protein, 28 aa, Artificial Sequence
  Description of Artificial Sequence: Synthetic peptide
QENEIATTNPVASEQYGIVSECLQSGTR

SEQ ID NO: 56251 - protein, 28 aa, Artificial Sequence
  Description of Artificial Sequence: Synthetic peptide
QENEIATTNPVATECWGSVSCNLQREEL

SEQ ID NO: 56252 - protein, 28 aa, Artificial Sequence
  Description of Artificial Sequence: Synthetic peptide
QENEIATTNPVATECYGDASENLQREGR

SEQ ID NO: 56253 - protein, 29 aa, Artificial Sequence
  Description of Artificial Sequence: Synthetic peptide
QENEIATTNPVATECYGDVCSTCLQHGNL

SEQ ID NO: 56254 - protein, 28 aa, Artificial Sequence
  Description of Artificial Sequence: Synthetic peptide
QENEIATTNPVATECYGDVSECLQHENR

SEQ ID NO: 56255 - protein, 28 aa, Artificial Sequence
  Description of Artificial Sequence: Synthetic peptide
QENEIACTNPVSTEQYGEVSENLQSGGR

SEQ ID NO: 56256 - protein, 28 aa, Artificial Sequence
  Description of Artificial Sequence: Synthetic peptide
QENEIACTNPVATEQYGDVSENLQHGGL

SEQ ID NO: 56257 - protein, 32 aa, Artificial Sequence
  Description of Artificial Sequence: Synthetic polypeptide
DEEEIRTTNPVATEQYGCVSTTLDQEYQDNQL

SEQ ID NO: 56258 - protein, 28 aa, Artificial Sequence
  Description of Artificial Sequence: Synthetic peptide
QENEIACTNPVATEQYGVASSNLQHGGR

SEQ ID NO: 56259 - protein, 28 aa, Artificial Sequence
  Description of Artificial Sequence: Synthetic peptide
QENEIACTNPVATEQYGEASENCQRGGR

SEQ ID NO: 56260 - protein, 31 aa, Artificial Sequence
  Description of Artificial Sequence: Synthetic polypeptide
DEEEIRTTNPVATEQYGCVSTVLVGSENLQY

SEQ ID NO: 56261 - protein, 29 aa, Artificial Sequence
  Description of Artificial Sequence: Synthetic peptide
QENEIACTNPVATEQYGEASENLQNRGGR

SEQ ID NO: 56262 - protein, 28 aa, Artificial Sequence
  Description of Artificial Sequence: Synthetic peptide
QENEIACTNPVATEQYGEASENLQREGR

SEQ ID NO: 56263 - protein, 32 aa, Artificial Sequence
  Description of Artificial Sequence: Synthetic polypeptide
DEEEIRTTNPVATEQYGCVSTVLLSGGGIDRF

SEQ ID NO: 56264 - protein, 28 aa, Artificial Sequence
  Description of Artificial Sequence: Synthetic peptide
QENEIACTNPVATEQYGEASENLQRGEK

SEQ ID NO: 56265 - protein, 32 aa, Artificial Sequence
  Description of Artificial Sequence: Synthetic polypeptide
DEEEIRTTNPVATEQYGCVSTVLESGTDEQRS

SEQ ID NO: 56266 - protein, 31 aa, Artificial Sequence
  Description of Artificial Sequence: Synthetic polypeptide
DEEEIRTTNPVATEQYGCVSTVLENTGEQGS

SEQ ID NO: 56267 - protein, 28 aa, Artificial Sequence
  Description of Artificial Sequence: Synthetic peptide
QENEIACTNPVATEQYGEASENLQRGGI

SEQ ID NO: 56268 - protein, 28 aa, Artificial Sequence
  Description of Artificial Sequence: Synthetic peptide
QENEIACTNPVATEQYGEASENLQRGGK

SEQ ID NO: 56269 - protein, 29 aa, Artificial Sequence
  Description of Artificial Sequence: Synthetic peptide
QENEIACTNPVATEQYGEASENLQRRGGR

SEQ ID NO: 56270 - protein, 28 aa, Artificial Sequence
  Description of Artificial Sequence: Synthetic peptide
QENEIACTNPVATEQYGEMSENLQRGGI

SEQ ID NO: 56271 - protein, 32 aa, Artificial Sequence
  Description of Artificial Sequence: Synthetic polypeptide
DEEEIRTTNPVATEQYGCVSTVDEGGITNERG

SEQ ID NO: 56272 - protein, 31 aa, Artificial Sequence
  Description of Artificial Sequence: Synthetic polypeptide
DEEEIRTTNPVATEQYGCVSTVDDRGIQFHD

SEQ ID NO: 56273 - protein, 28 aa, Artificial Sequence
  Description of Artificial Sequence: Synthetic peptide
QENEIACTNPVATEQYGVASENLQHGDR

SEQ ID NO: 56274 - protein, 28 aa, Artificial Sequence
  Description of Artificial Sequence: Synthetic peptide
QENEIACTNPVATEQYGVMSSTLQRGGR

SEQ ID NO: 56275 - protein, 28 aa, Artificial Sequence
  Description of Artificial Sequence: Synthetic peptide
QEGEIATTNPVATEQYGDVSCCLQHGEL

SEQ ID NO: 56276 - protein, 28 aa, Artificial Sequence
  Description of Artificial Sequence: Synthetic peptide
QEGEIATTNPVATECYGDVSECLQHGER

SEQ ID NO: 56277 - protein, 33 aa, Artificial Sequence
  Description of Artificial Sequence: Synthetic polypeptide
DEEEIRTTNPVATEQYGCVSVTENHQRFGSEQT

SEQ ID NO: 56278 - protein, 28 aa, Artificial Sequence
  Description of Artificial Sequence: Synthetic peptide
QEGEIAPTNPCASEQYGSVSCNLQSGTR

SEQ ID NO: 56279 - protein, 29 aa, Artificial Sequence
  Description of Artificial Sequence: Synthetic peptide
QEGEIAPTNPCATECWGSVSCNLQREGNR

SEQ ID NO: 56280 - protein, 28 aa, Artificial Sequence
  Description of Artificial Sequence: Synthetic peptide
QEGEIAPTNPCATEQYGDVSCNLQSGTR

SEQ ID NO: 56281 - protein, 28 aa, Artificial Sequence
  Description of Artificial Sequence: Synthetic peptide
QEGEIAPTNPCATEQYGIVSCNLMSGNR

SEQ ID NO: 56282 - protein, 28 aa, Artificial Sequence
  Description of Artificial Sequence: Synthetic peptide
QEGEIAPTNPCATEQYGIVSCNLQSGTR

SEQ ID NO: 56283 - protein, 29 aa, Artificial Sequence
  Description of Artificial Sequence: Synthetic peptide
QEGEIAPTNPCATEQYGIVSSCNLQRGTR

SEQ ID NO: 56284 - protein, 29 aa, Artificial Sequence
  Description of Artificial Sequence: Synthetic peptide
QEGEIAPTNPCATEQYGIVSTNLQDSGTR

SEQ ID NO: 56285 - protein, 28 aa, Artificial Sequence
  Description of Artificial Sequence: Synthetic peptide
QEGEIAPTNPCCTEQYGIVSDNLQSGNR

SEQ ID NO: 56286 - protein, 28 aa, Artificial Sequence
  Description of Artificial Sequence: Synthetic peptide
QEGEIAPTNPCCTEQYGVVSDNLQSGNR

SEQ ID NO: 56287 - protein, 28 aa, Artificial Sequence
  Description of Artificial Sequence: Synthetic peptide
QEGEIAPTNPCSSEQYGIVSCNLQRGNR

SEQ ID NO: 56288 - protein, 28 aa, Artificial Sequence
  Description of Artificial Sequence: Synthetic peptide
QEGEIAPTNPCSSEQYGSVSCNLQRGTR

SEQ ID NO: 56289 - protein, 28 aa, Artificial Sequence
  Description of Artificial Sequence: Synthetic peptide
QEGEIAPTNPCSSEQYGSVSCNLQSGNR

SEQ ID NO: 56290 - protein, 28 aa, Artificial Sequence
  Description of Artificial Sequence: Synthetic peptide
QEGEIAPTNPCSTEQYGEVSENLQRGTR

SEQ ID NO: 56291 - protein, 28 aa, Artificial Sequence
  Description of Artificial Sequence: Synthetic peptide
QEGEIAPTNPCSTEQYGIVSCNLQRGTR

SEQ ID NO: 56292 - protein, 28 aa, Artificial Sequence
  Description of Artificial Sequence: Synthetic peptide
QEGEIAPTNPCSTEQYGIVSCNLQSGNR

SEQ ID NO: 56293 - protein, 32 aa, Artificial Sequence
  Description of Artificial Sequence: Synthetic polypeptide
DEEEIRTTNPVATEQYGCVTGNTGNLIERGEQ

SEQ ID NO: 56294 - protein, 28 aa, Artificial Sequence
  Description of Artificial Sequence: Synthetic peptide
QEGEIAPTNPCSTEQYGSVSCNLQSGTR

SEQ ID NO: 56295 - protein, 29 aa, Artificial Sequence
  Description of Artificial Sequence: Synthetic peptide
QEGEIAPTNPCASEQYGSVSCNLQSGENR

SEQ ID NO: 56296 - protein, 32 aa, Artificial Sequence
  Description of Artificial Sequence: Synthetic polypeptide
DEEEIRTTNPVATEQYGCVTSTEHQRFGSDQT

SEQ ID NO: 56297 - protein, 28 aa, Artificial Sequence
  Description of Artificial Sequence: Synthetic peptide
QEGEIACTNPCASEQYGIVSCNLQRGTR

SEQ ID NO: 56298 - protein, 33 aa, Artificial Sequence
  Description of Artificial Sequence: Synthetic polypeptide
DEEEIRTTNPVATEQYGCVVCSTNLQYFGSEQS

SEQ ID NO: 56299 - protein, 32 aa, Artificial Sequence
  Description of Artificial Sequence: Synthetic polypeptide
DEEEIRTTNPVATEQYGCVTTDDLQTGENNVH

SEQ ID NO: 56300 - protein, 28 aa, Artificial Sequence
  Description of Artificial Sequence: Synthetic peptide
QEGEIACTNPCATEQYGIVSENLQSGTR

SEQ ID NO: 56301 - protein, 28 aa, Artificial Sequence
  Description of Artificial Sequence: Synthetic peptide
QEGEIACTNPCSTEQYGIVSCNLQRGGR

SEQ ID NO: 56302 - protein, 28 aa, Artificial Sequence
  Description of Artificial Sequence: Synthetic peptide
QEGEIACTNPCSTEQYGIVSCNLQRGTR

SEQ ID NO: 56303 - protein, 28 aa, Artificial Sequence
  Description of Artificial Sequence: Synthetic peptide
QEGEIACTNPCSTEQYGSVSCNLMSGNR

SEQ ID NO: 56304 - protein, 28 aa, Artificial Sequence
  Description of Artificial Sequence: Synthetic peptide
QEGEIAPTNPCASECYGIVSCNLQRGNR

SEQ ID NO: 56305 - protein, 28 aa, Artificial Sequence
  Description of Artificial Sequence: Synthetic peptide
QEGEIAPTNPCASEQYGEVSCNLQRGTR

SEQ ID NO: 56306 - protein, 28 aa, Artificial Sequence
  Description of Artificial Sequence: Synthetic peptide
QEGEIAPTNPCASEQYGIVSCNLQRGTR

SEQ ID NO: 56307 - protein, 28 aa, Artificial Sequence
  Description of Artificial Sequence: Synthetic peptide
QEGEIAPTNPCASEQYGIVSCNLQSGNR

SEQ ID NO: 56308 - protein, 28 aa, Artificial Sequence
  Description of Artificial Sequence: Synthetic peptide
QEGEIAPTNPCASEQYGIVSTNLQSGER

SEQ ID NO: 56309 - protein, 33 aa, Artificial Sequence
  Description of Artificial Sequence: Synthetic polypeptide
DEEEIRTTNPVATEQYGCVTSTGNLQGFGSEDG

SEQ ID NO: 56310 - protein, 33 aa, Artificial Sequence
  Description of Artificial Sequence: Synthetic polypeptide
DEEEIRTTNPVATEQYGCVTSTENHQNFGSNDM

SEQ ID NO: 56311 - protein, 28 aa, Artificial Sequence
  Description of Artificial Sequence: Synthetic peptide
QEGEIAPTNPCASEQYGIVSTNLQSGTR

SEQ ID NO: 56312 - protein, 33 aa, Artificial Sequence
  Description of Artificial Sequence: Synthetic polypeptide
DEEEIRTTNPVATEQYGCVTSMTNHQFFGSNQA

SEQ ID NO: 56313 - protein, 28 aa, Artificial Sequence
  Description of Artificial Sequence: Synthetic peptide
QEGEIAPTNPCSTEQYGVVSCNLQSGNR

SEQ ID NO: 56314 - protein, 28 aa, Artificial Sequence
  Description of Artificial Sequence: Synthetic peptide
QEGEIAPTNPVASEQYGEVSCNLQSGTR

SEQ ID NO: 56315 - protein, 28 aa, Artificial Sequence
  Description of Artificial Sequence: Synthetic peptide
QEGEIAPTNPVASEQYGIVSCNLQSGTR

SEQ ID NO: 56316 - protein, 29 aa, Artificial Sequence
  Description of Artificial Sequence: Synthetic peptide
QEGEIATTNPCASEQYGTVSTNLESEGNR

SEQ ID NO: 56317 - protein, 28 aa, Artificial Sequence
  Description of Artificial Sequence: Synthetic peptide
QEGEIATTNPCATEQYGIVSCNLQSGEL

SEQ ID NO: 56318 - protein, 29 aa, Artificial Sequence
  Description of Artificial Sequence: Synthetic peptide
QEGEIATTNPCATEQYGIVSCNLQSGTPR

SEQ ID NO: 56319 - protein, 30 aa, Artificial Sequence
  Description of Artificial Sequence: Synthetic polypeptide
QEGEIATTNPCATEQYGIVSSCNLPQRGTR

SEQ ID NO: 56320 - protein, 30 aa, Artificial Sequence
  Description of Artificial Sequence: Synthetic polypeptide
QEGEIATTNPCATEQYGSVSCNLNMRGNPV

SEQ ID NO: 56321 - protein, 28 aa, Artificial Sequence
  Description of Artificial Sequence: Synthetic peptide
QEGEIATTNPCSSEQYGIVSTNLQSGTR

SEQ ID NO: 56322 - protein, 29 aa, Artificial Sequence
  Description of Artificial Sequence: Synthetic peptide
QEGEIATTNPCSSEQYGTVSTNLQSEGNR

SEQ ID NO: 56323 - protein, 28 aa, Artificial Sequence
  Description of Artificial Sequence: Synthetic peptide
QEGEIATTNPCSTEQYGIVSTDLQSGTR

SEQ ID NO: 56324 - protein, 30 aa, Artificial Sequence
  Description of Artificial Sequence: Synthetic polypeptide
QEGEIATTNPCSTEQYGIVSTNLPQRNGTR

SEQ ID NO: 56325 - protein, 28 aa, Artificial Sequence
  Description of Artificial Sequence: Synthetic peptide
QEGEIATTNPVASEQYGDVSCNLQHEER

SEQ ID NO: 56326 - protein, 28 aa, Artificial Sequence
  Description of Artificial Sequence: Synthetic peptide
QEGEIATTNPVASEQYGDVSCNLQHETR

SEQ ID NO: 56327 - protein, 28 aa, Artificial Sequence
  Description of Artificial Sequence: Synthetic peptide
QEGEIATTNPVASEQYGIVSCNLQSETR

SEQ ID NO: 56328 - protein, 32 aa, Artificial Sequence
  Description of Artificial Sequence: Synthetic polypeptide
DEEEIRTTNPVATEQYGCVSWELQERFGSEQS

SEQ ID NO: 56329 - protein, 30 aa, Artificial Sequence
  Description of Artificial Sequence: Synthetic polypeptide
DEEEIRTTNPVATEQYGCVSWEHQNGSQQS

SEQ ID NO: 56330 - protein, 31 aa, Artificial Sequence
  Description of Artificial Sequence: Synthetic polypeptide
DEEEIRTTNPVATEQYGCVSWEEHQNFGSNQ

SEQ ID NO: 56331 - protein, 28 aa, Artificial Sequence
  Description of Artificial Sequence: Synthetic peptide
QEGEIASVNPVCTEQYGVVSDNLQSGNR

SEQ ID NO: 56332 - protein, 28 aa, Artificial Sequence
  Description of Artificial Sequence: Synthetic peptide
QEGEIASTNPVSTEQYGVVSCNLQSGTR

SEQ ID NO: 56333 - protein, 28 aa, Artificial Sequence
  Description of Artificial Sequence: Synthetic peptide
QEGEIAPTNPVSTEQYGVVSDNLQSGTR

SEQ ID NO: 56334 - protein, 29 aa, Artificial Sequence
  Description of Artificial Sequence: Synthetic peptide
QEGEIAPTNPVSTEQYGTVSCNLQSNGNR

SEQ ID NO: 56335 - protein, 28 aa, Artificial Sequence
  Description of Artificial Sequence: Synthetic peptide
QEGEIAPTNPVASEQYGTVSTNLEFGND

SEQ ID NO: 56336 - protein, 28 aa, Artificial Sequence
  Description of Artificial Sequence: Synthetic peptide
QEGEIAPTNPVATECYGIVSCNLQSGTR

SEQ ID NO: 56337 - protein, 29 aa, Artificial Sequence
  Description of Artificial Sequence: Synthetic peptide
QEGEIAPTNPVATEQYGIVSTDLQSEGER

SEQ ID NO: 56338 - protein, 29 aa, Artificial Sequence
  Description of Artificial Sequence: Synthetic peptide
QEGEIAPTNPVATEQYGTVSTNLEFEGND

SEQ ID NO: 56339 - protein, 31 aa, Artificial Sequence
  Description of Artificial Sequence: Synthetic polypeptide
DEEEIRTTNPVATEQYGCVSWNDQNFGSEQS

SEQ ID NO: 56340 - protein, 28 aa, Artificial Sequence
  Description of Artificial Sequence: Synthetic peptide
QEGEIAPTNPVCTEQYGVVSDNLQSGTR

SEQ ID NO: 56341 - protein, 28 aa, Artificial Sequence
  Description of Artificial Sequence: Synthetic peptide
QEGEIAPTNPVSSEQYGTVSTNLEFGNR

SEQ ID NO: 56342 - protein, 28 aa, Artificial Sequence
  Description of Artificial Sequence: Synthetic peptide
QENEIATTNPVATECYGDVSECLQREGR

SEQ ID NO: 56343 - protein, 28 aa, Artificial Sequence
  Description of Artificial Sequence: Synthetic peptide
QEGEIAPTNPVSTEQYGDVSENLQSGTR

SEQ ID NO: 56344 - protein, 28 aa, Artificial Sequence
  Description of Artificial Sequence: Synthetic peptide
QEGEIAPTNPVSTEQYGEASCNLQRGGR

SEQ ID NO: 56345 - protein, 31 aa, Artificial Sequence
  Description of Artificial Sequence: Synthetic polypeptide
DEEEIRTTNPVATEQYGCVSWGELANFGGNQ

SEQ ID NO: 56346 - protein, 32 aa, Artificial Sequence
  Description of Artificial Sequence: Synthetic polypeptide
DEEEIRTTNPVATEQYGCVSWENLQFFGSEDG

SEQ ID NO: 56347 - protein, 28 aa, Artificial Sequence
  Description of Artificial Sequence: Synthetic peptide
QEGEIAPTNPVSTEQYGEASENLQRGGR

SEQ ID NO: 56348 - protein, 28 aa, Artificial Sequence
  Description of Artificial Sequence: Synthetic peptide
QEGEIAPTNPVSTEQYGEVSCNLQSGGR

SEQ ID NO: 56349 - protein, 31 aa, Artificial Sequence
  Description of Artificial Sequence: Synthetic polypeptide
DEEEIRTTNPVATEQYGCVSWENHARFGSQQ

SEQ ID NO: 56350 - protein, 28 aa, Artificial Sequence
  Description of Artificial Sequence: Synthetic peptide
QEGEIAPTNPVSTEQYGIVSENLQSGTR

SEQ ID NO: 56351 - protein, 32 aa, Artificial Sequence
  Description of Artificial Sequence: Synthetic polypeptide
DEEEIRTTNPVATEQYGCVSWGNLQNFGSDQA

SEQ ID NO: 56352 - protein, 28 aa, Artificial Sequence
  Description of Artificial Sequence: Synthetic peptide
QENEIATTNPVATECYGDVSECLQRENL

SEQ ID NO: 56353 - protein, 28 aa, Artificial Sequence
  Description of Artificial Sequence: Synthetic peptide
QENEIATTNPVATECYGDVSECLQRGEL

SEQ ID NO: 56354 - protein, 28 aa, Artificial Sequence
  Description of Artificial Sequence: Synthetic peptide
QENEIATTNPVATECYGDVSENLQHEER

SEQ ID NO: 56355 - protein, 28 aa, Artificial Sequence
  Description of Artificial Sequence: Synthetic peptide
REEEIASVNPVCTEQYGVVSHNLQSGNQ

SEQ ID NO: 56356 - protein, 28 aa, Artificial Sequence
  Description of Artificial Sequence: Synthetic peptide
REEEIASVNPVCTEQYGVVSSNLQSGNQ

SEQ ID NO: 56357 - protein, 28 aa, Artificial Sequence
  Description of Artificial Sequence: Synthetic peptide
REEEIASVNPVTTEQYGVVSDNLQSGNQ

SEQ ID NO: 56358 - protein, 31 aa, Artificial Sequence
  Description of Artificial Sequence: Synthetic polypeptide
DEEEIRTTNPVATEQYGCVSTPEHQGFFSNQ

SEQ ID NO: 56359 - protein, 32 aa, Artificial Sequence
  Description of Artificial Sequence: Synthetic polypeptide
REEEIRTTNPVATEQYGAVCPSTNLETLGQDR

SEQ ID NO: 56360 - protein, 31 aa, Artificial Sequence
  Description of Artificial Sequence: Synthetic polypeptide
REEEIRTTNPVATEQYGAVVPSENLETLNQR

SEQ ID NO: 56361 - protein, 33 aa, Artificial Sequence
  Description of Artificial Sequence: Synthetic polypeptide
REEEIRTTNPVATEQYGAVVPSTNLQTTLGQFR

SEQ ID NO: 56362 - protein, 34 aa, Artificial Sequence
  Description of Artificial Sequence: Synthetic polypeptide
REEEIRTTNPVATEQYGAVVPSTVNLEQLEGQNR

SEQ ID NO: 56363 - protein, 30 aa, Artificial Sequence
  Description of Artificial Sequence: Synthetic polypeptide
REEEIRTTNPVATEQYGSVAPSALQNSEDR

SEQ ID NO: 56364 - protein, 32 aa, Artificial Sequence
  Description of Artificial Sequence: Synthetic polypeptide
REEEIRTTNPVATEQYGSVATADLHQNGGDFR

SEQ ID NO: 56365 - protein, 28 aa, Artificial Sequence
  Description of Artificial Sequence: Synthetic peptide
REEEIVSVNPVCTEQYGVVSDNLQSGNQ

SEQ ID NO: 56366 - protein, 28 aa, Artificial Sequence
  Description of Artificial Sequence: Synthetic peptide
RENEIACTNPVATEHYGEASENLQRGGR

SEQ ID NO: 56367 - protein, 33 aa, Artificial Sequence
  Description of Artificial Sequence: Synthetic polypeptide
DEEEIRTTNPVATEQYGCVSTNTDGQEEGGGNG

SEQ ID NO: 56368 - protein, 28 aa, Artificial Sequence
  Description of Artificial Sequence: Synthetic peptide
RENEIACTNPVATEQYGEASENLQRGGL

SEQ ID NO: 56369 - protein, 28 aa, Artificial Sequence
  Description of Artificial Sequence: Synthetic peptide
RENEIACTNPVATEQYGEASENSQRGGR

SEQ ID NO: 56370 - protein, 28 aa, Artificial Sequence
  Description of Artificial Sequence: Synthetic peptide
REEEIASVNPVCTEQYGVVSDNLQSGNT

SEQ ID NO: 56371 - protein, 29 aa, Artificial Sequence
  Description of Artificial Sequence: Synthetic peptide
SAEEIATTNPVATAQWGSVSGTNPDRGNQ

SEQ ID NO: 56372 - protein, 28 aa, Artificial Sequence
  Description of Artificial Sequence: Synthetic peptide
REEEIASVNPVCTEQYGVVSDNLQSGNQ

SEQ ID NO: 56373 - protein, 31 aa, Artificial Sequence
  Description of Artificial Sequence: Synthetic polypeptide
QESEIRTTNPVATEGWGSVSCNLPQREGENG

SEQ ID NO: 56374 - protein, 28 aa, Artificial Sequence
  Description of Artificial Sequence: Synthetic peptide
QESEIATTNPVATEGYGVVSTDLQHGEI

SEQ ID NO: 56375 - protein, 28 aa, Artificial Sequence
  Description of Artificial Sequence: Synthetic peptide
QESEIATTNPVATEQYGVVSTDLEHGDI

SEQ ID NO: 56376 - protein, 28 aa, Artificial Sequence
  Description of Artificial Sequence: Synthetic peptide
QESEIRCTNPIATEGYGSVAENLMHGNR

SEQ ID NO: 56377 - protein, 28 aa, Artificial Sequence
  Description of Artificial Sequence: Synthetic peptide
QESEIRCTNPIATEGYGSVSENLMHGDR

SEQ ID NO: 56378 - protein, 30 aa, Artificial Sequence
  Description of Artificial Sequence: Synthetic polypeptide
QESEIRPTNPCATECWGSVSCINLQREGNR

SEQ ID NO: 56379 - protein, 28 aa, Artificial Sequence
  Description of Artificial Sequence: Synthetic peptide
QESEIRSTNPVGTEGYGVVASTLQRGDR

SEQ ID NO: 56380 - protein, 31 aa, Artificial Sequence
  Description of Artificial Sequence: Synthetic polypeptide
DEEEIRTTNPVATEQYGCVSTPLENFGSQQG

SEQ ID NO: 56381 - protein, 31 aa, Artificial Sequence
  Description of Artificial Sequence: Synthetic polypeptide
QESEIRTTNPCATECWGSVSCINLQREGENR

SEQ ID NO: 56382 - protein, 29 aa, Artificial Sequence
  Description of Artificial Sequence: Synthetic peptide
QESEIRTTNPCSTECWGIVSCNLQRGENR

SEQ ID NO: 56383 - protein, 29 aa, Artificial Sequence
  Description of Artificial Sequence: Synthetic peptide
QESEIRTTNPVASEQYGIVSCNEQDSGNG

SEQ ID NO: 56384 - protein, 32 aa, Artificial Sequence
  Description of Artificial Sequence: Synthetic polypeptide
DEEEIRTTNPVATEQYGCVSTPLDQEWNEDKF

SEQ ID NO: 56385 - protein, 29 aa, Artificial Sequence
  Description of Artificial Sequence: Synthetic peptide
QESEIRTTNPVATECYGDVSCCEPQRGNL

SEQ ID NO: 56386 - protein, 31 aa, Artificial Sequence
  Description of Artificial Sequence: Synthetic polypeptide
QESEIRTTNPVATECYGIVSCINLPQRGENG

SEQ ID NO: 56387 - protein, 31 aa, Artificial Sequence
  Description of Artificial Sequence: Synthetic polypeptide
QESEIRTTNPVATECYGSVSCINEPQRGENG

SEQ ID NO: 56388 - protein, 30 aa, Artificial Sequence
  Description of Artificial Sequence: Synthetic polypeptide
QESEIRTTNPVATECYGSVSEINEPQHGNG

SEQ ID NO: 56389 - protein, 33 aa, Artificial Sequence
  Description of Artificial Sequence: Synthetic polypeptide
QSEEIRTTNPVATDQYGSVPSTNELSQNLGNRR

SEQ ID NO: 56390 - protein, 33 aa, Artificial Sequence
  Description of Artificial Sequence: Synthetic polypeptide
DEEEIRTTNPVATEQYGCVSTNQHQERDMIMRD

SEQ ID NO: 56391 - protein, 30 aa, Artificial Sequence
  Description of Artificial Sequence: Synthetic polypeptide
SAEEIATTNPVATAQWGSVSMTGLDQRGND

SEQ ID NO: 56392 - protein, 29 aa, Artificial Sequence
  Description of Artificial Sequence: Synthetic peptide
SAEEIATTNPVATAQWGSVSTDLQDGNDM

SEQ ID NO: 56393 - protein, 32 aa, Artificial Sequence
  Description of Artificial Sequence: Synthetic polypeptide
DEEEIRTTNPVATEQYGCVSTNNLDNRDEDQE

SEQ ID NO: 56394 - protein, 30 aa, Artificial Sequence
  Description of Artificial Sequence: Synthetic polypeptide
SEAEIATTNPVATEQYGSVAMNLQEAGNVD

SEQ ID NO: 56395 - protein, 32 aa, Artificial Sequence
  Description of Artificial Sequence: Synthetic polypeptide
SEAEIATTNPVATEQYGSVSTNLNGNDGGNPR

SEQ ID NO: 56396 - protein, 31 aa, Artificial Sequence
  Description of Artificial Sequence: Synthetic polypeptide
SEAEIATTNPVATEQYGSVVATNLERGPNDQ

SEQ ID NO: 56397 - protein, 31 aa, Artificial Sequence
  Description of Artificial Sequence: Synthetic polypeptide
SEAEIATTNPVAYEQYGSVAATNDQRGNDRG

SEQ ID NO: 56398 - protein, 31 aa, Artificial Sequence
  Description of Artificial Sequence: Synthetic polypeptide
SEAEIATTNPVAYEQYGSVATAGNLQDGNRN

SEQ ID NO: 56399 - protein, 30 aa, Artificial Sequence
  Description of Artificial Sequence: Synthetic polypeptide
SEAEIATTNPVAYEQYGSVATNLQAGPPRE

SEQ ID NO: 56400 - protein, 29 aa, Artificial Sequence
  Description of Artificial Sequence: Synthetic peptide
SEAEIATTNPVAYEQYGSVATNLQAPPNF

SEQ ID NO: 56401 - protein, 31 aa, Artificial Sequence
  Description of Artificial Sequence: Synthetic polypeptide
SEAEIATTNPVAYEQYGSVVSTNLQQGNLQE

SEQ ID NO: 56402 - protein, 32 aa, Artificial Sequence
  Description of Artificial Sequence: Synthetic polypeptide
DEEEIRTTNPVATEQYGCVSTNNHQENDMIGR

SEQ ID NO: 56403 - protein, 28 aa, Artificial Sequence
  Description of Artificial Sequence: Synthetic peptide
SEAPIACTNPVATEPYGSVVTNLQHGNQ

SEQ ID NO: 56404 - protein, 29 aa, Artificial Sequence
  Description of Artificial Sequence: Synthetic peptide
SEAVEIACTNPVATEPYGSVATNLQHGNQ

SEQ ID NO: 56405 - protein, 32 aa, Artificial Sequence
  Description of Artificial Sequence: Synthetic polypeptide
DEEEIRTTNPVATEQYGCVSTNNDNRNGDAQD

SEQ ID NO: 56406 - protein, 32 aa, Artificial Sequence
  Description of Artificial Sequence: Synthetic polypeptide
SECEIATTNPVATEQYGSVSTNLNGNDGMNQR

SEQ ID NO: 56407 - protein, 30 aa, Artificial Sequence
  Description of Artificial Sequence: Synthetic polypeptide
SECEICATNPVATEQYGSVETNLQHGNNQE

SEQ ID NO: 56408 - protein, 29 aa, Artificial Sequence
  Description of Artificial Sequence: Synthetic peptide
SEAEIASTNPVAYEQYGSVATNLQAGPND

SEQ ID NO: 56409 - protein, 29 aa, Artificial Sequence
  Description of Artificial Sequence: Synthetic peptide
SEAEIACTNPVATEQYGSVATNLTEAGNE

SEQ ID NO: 56410 - protein, 30 aa, Artificial Sequence
  Description of Artificial Sequence: Synthetic polypeptide
SEAEIACTNPVATEQYGSVATNLQNHGNEQ

SEQ ID NO: 56411 - protein, 30 aa, Artificial Sequence
  Description of Artificial Sequence: Synthetic polypeptide
SEAEIACTNPVATEQYGSVATNLQEAGNDN

SEQ ID NO: 56412 - protein, 28 aa, Artificial Sequence
  Description of Artificial Sequence: Synthetic peptide
SAEEIATTNPVATAQWGSVSTDLQHGTS

SEQ ID NO: 56413 - protein, 29 aa, Artificial Sequence
  Description of Artificial Sequence: Synthetic peptide
SAEEIATTNPVATAQWGSVSTGLQDGNFD

SEQ ID NO: 56414 - protein, 30 aa, Artificial Sequence
  Description of Artificial Sequence: Synthetic polypeptide
SAEEIATTNPVATAQWGSVSTGLQRGNVQV

SEQ ID NO: 56415 - protein, 30 aa, Artificial Sequence
  Description of Artificial Sequence: Synthetic polypeptide
SAEEIATTNPVATEQWGCNVATNLQEGNRP

SEQ ID NO: 56416 - protein, 29 aa, Artificial Sequence
  Description of Artificial Sequence: Synthetic peptide
SAEEIATTNPVATEQWGCVATNLQDGNQM

SEQ ID NO: 56417 - protein, 29 aa, Artificial Sequence
  Description of Artificial Sequence: Synthetic peptide
SAEEIATTNPVATEQWGCVATNLQMPNQR

SEQ ID NO: 56418 - protein, 28 aa, Artificial Sequence
  Description of Artificial Sequence: Synthetic peptide
SAEEIATTNPVATEQWGTVSMNLQEGDV

SEQ ID NO: 56419 - protein, 28 aa, Artificial Sequence
  Description of Artificial Sequence: Synthetic peptide
QESEIATTNPVATEGYGSVATTLQHGDL

SEQ ID NO: 56420 - protein, 30 aa, Artificial Sequence
  Description of Artificial Sequence: Synthetic polypeptide
SAEEIATTNPVATEQWGTVSMNLQVGDNRQ

SEQ ID NO: 56421 - protein, 30 aa, Artificial Sequence
  Description of Artificial Sequence: Synthetic polypeptide
SAEEIATTNPVAYEQYGSVATNLQDGNDDN

SEQ ID NO: 56422 - protein, 28 aa, Artificial Sequence
  Description of Artificial Sequence: Synthetic peptide
SDEEIRCTNPVATEQYGNVAETIMRGNR

SEQ ID NO: 56423 - protein, 29 aa, Artificial Sequence
  Description of Artificial Sequence: Synthetic peptide
SDMEIRTTNPVATEQWGAVSTNLEEEGND

SEQ ID NO: 56424 - protein, 29 aa, Artificial Sequence
  Description of Artificial Sequence: Synthetic peptide
SDSEVACTNPIATEQYGSVSAENLQRGNR

SEQ ID NO: 56425 - protein, 32 aa, Artificial Sequence
  Description of Artificial Sequence: Synthetic polypeptide
DEEEIRTTNPVATEQYGCVSTNNNDNRDGDQI

SEQ ID NO: 56426 - protein, 28 aa, Artificial Sequence
  Description of Artificial Sequence: Synthetic peptide
SEAEIACTNPTATEQWGSVSENLMRGNQ

SEQ ID NO: 56427 - protein, 28 aa, Artificial Sequence
  Description of Artificial Sequence: Synthetic peptide
SEAEIACTNPVATAQYGCVATNLERGNP

SEQ ID NO: 56428 - protein, 30 aa, Artificial Sequence
  Description of Artificial Sequence: Synthetic polypeptide
SAEEIATTNPVATEQYGSVATNLERNNMEM

SEQ ID NO: 56429 - protein, 30 aa, Artificial Sequence
  Description of Artificial Sequence: Synthetic polypeptide
SEEEIRCTNPIATEQYGSVCSSNLAYGNQS

SEQ ID NO: 56430 - protein, 29 aa, Artificial Sequence
  Description of Artificial Sequence: Synthetic peptide
QESEIATTNPVATECYGSVSENLQHEGEL

SEQ ID NO: 56431 - protein, 28 aa, Artificial Sequence
  Description of Artificial Sequence: Synthetic peptide
QESEIASTNPVGTEQYGSMSSTLQRGDR

SEQ ID NO: 56432 - protein, 28 aa, Artificial Sequence
  Description of Artificial Sequence: Synthetic peptide
QENEIATTNPVATEQYGDVSENLQHEEL

SEQ ID NO: 56433 - protein, 28 aa, Artificial Sequence
  Description of Artificial Sequence: Synthetic peptide
QENEIATTNPVATEQYGEAPENLQHGER

SEQ ID NO: 56434 - protein, 28 aa, Artificial Sequence
  Description of Artificial Sequence: Synthetic peptide
QENEIATTNPVATEQYGEASEVCQRGER

SEQ ID NO: 56435 - protein, 28 aa, Artificial Sequence
  Description of Artificial Sequence: Synthetic peptide
QENEIATTNPVATEQYGEVSECLQREEL

SEQ ID NO: 56436 - protein, 28 aa, Artificial Sequence
  Description of Artificial Sequence: Synthetic peptide
QENEIATTNPVATEQYGEVSENLQHEGL

SEQ ID NO: 56437 - protein, 28 aa, Artificial Sequence
  Description of Artificial Sequence: Synthetic peptide
QENEIATTNPVATEQYGIVSECLQSGTL

SEQ ID NO: 56438 - protein, 28 aa, Artificial Sequence
  Description of Artificial Sequence: Synthetic peptide
QENEIATTNPVATEQYGIVSENLQSETL

SEQ ID NO: 56439 - protein, 28 aa, Artificial Sequence
  Description of Artificial Sequence: Synthetic peptide
QENEIATTNPVATEQYGSVSEALQHEEL

SEQ ID NO: 56440 - protein, 28 aa, Artificial Sequence
  Description of Artificial Sequence: Synthetic peptide
QENEIATTNPVATEQYGSVSECLQHEEL

SEQ ID NO: 56441 - protein, 29 aa, Artificial Sequence
  Description of Artificial Sequence: Synthetic peptide
QENEIATTNPVATEQYGSVSECLQHEGEL

SEQ ID NO: 56442 - protein, 29 aa, Artificial Sequence
  Description of Artificial Sequence: Synthetic peptide
QENEIATTNPVATEQYGSVSEDLQHEGEL

SEQ ID NO: 56443 - protein, 29 aa, Artificial Sequence
  Description of Artificial Sequence: Synthetic peptide
QENEIATTNPVATEQYGSVSTCLQDHEEL

SEQ ID NO: 56444 - protein, 29 aa, Artificial Sequence
  Description of Artificial Sequence: Synthetic peptide
QENEIATTNPVATEQYGSVSTDLQDHEEL

SEQ ID NO: 56445 - protein, 28 aa, Artificial Sequence
  Description of Artificial Sequence: Synthetic peptide
QENEIATTNPVATEQYGVVSDCLQHENQ

SEQ ID NO: 56446 - protein, 32 aa, Artificial Sequence
  Description of Artificial Sequence: Synthetic polypeptide
DEEEIRTTNPVATEQYGCVSTTEPQRFGSEQA

SEQ ID NO: 56447 - protein, 28 aa, Artificial Sequence
  Description of Artificial Sequence: Synthetic peptide
QENEIATTNPVATEQYGDVSECLQREEL

SEQ ID NO: 56448 - protein, 28 aa, Artificial Sequence
  Description of Artificial Sequence: Synthetic peptide
QENEIATTNPVATEQYGVVSDCLQSENQ

SEQ ID NO: 56449 - protein, 29 aa, Artificial Sequence
  Description of Artificial Sequence: Synthetic peptide
QENEIATTNPVATEQYGDVSATDLQHGEL

SEQ ID NO: 56450 - protein, 28 aa, Artificial Sequence
  Description of Artificial Sequence: Synthetic peptide
QENEIATTNPVATEQYGDASENLQHGEL

SEQ ID NO: 56451 - protein, 28 aa, Artificial Sequence
  Description of Artificial Sequence: Synthetic peptide
QENEIATTNPVATECYGDVSENLQHGEL

SEQ ID NO: 56452 - protein, 28 aa, Artificial Sequence
  Description of Artificial Sequence: Synthetic peptide
QENEIATTNPVATECYGDVSENLQREEL

SEQ ID NO: 56453 - protein, 28 aa, Artificial Sequence
  Description of Artificial Sequence: Synthetic peptide
QENEIATTNPVATECYGDVSENLQSEER

SEQ ID NO: 56454 - protein, 28 aa, Artificial Sequence
  Description of Artificial Sequence: Synthetic peptide
QENEIATTNPVATECYGDVSENLQSETR

SEQ ID NO: 56455 - protein, 28 aa, Artificial Sequence
  Description of Artificial Sequence: Synthetic peptide
QENEIATTNPVATECYGEASECLQRGER

SEQ ID NO: 56456 - protein, 28 aa, Artificial Sequence
  Description of Artificial Sequence: Synthetic peptide
QENEIATTNPVATECYGEASECLQRGGR

SEQ ID NO: 56457 - protein, 28 aa, Artificial Sequence
  Description of Artificial Sequence: Synthetic peptide
QENEIATTNPVATECYGEVSECLQREGR

SEQ ID NO: 56458 - protein, 28 aa, Artificial Sequence
  Description of Artificial Sequence: Synthetic peptide
QENEIATTNPVATECYGSVSECLMHGER

SEQ ID NO: 56459 - protein, 28 aa, Artificial Sequence
  Description of Artificial Sequence: Synthetic peptide
QENEIATTNPVATECYGSVSECLQHGEL

SEQ ID NO: 56460 - protein, 28 aa, Artificial Sequence
  Description of Artificial Sequence: Synthetic peptide
QENEIATTNPVATECYGSVSEDLQHGEL

SEQ ID NO: 56461 - protein, 28 aa, Artificial Sequence
  Description of Artificial Sequence: Synthetic peptide
QENEIATTNPVATECYGSVSENLQHEEL

SEQ ID NO: 56462 - protein, 29 aa, Artificial Sequence
  Description of Artificial Sequence: Synthetic peptide
QENEIATTNPVATECYGSVSENLQHEGEL

SEQ ID NO: 56463 - protein, 29 aa, Artificial Sequence
  Description of Artificial Sequence: Synthetic peptide
QENEIATTNPVATEGYGDVSANCLQRGEL

SEQ ID NO: 56464 - protein, 28 aa, Artificial Sequence
  Description of Artificial Sequence: Synthetic peptide
QENEIATTNPVATEGYGDVSECLQRGEL

SEQ ID NO: 56465 - protein, 29 aa, Artificial Sequence
  Description of Artificial Sequence: Synthetic peptide
QENEIATTNPVATEGYGNVSANCLQRGEL

SEQ ID NO: 56466 - protein, 29 aa, Artificial Sequence
  Description of Artificial Sequence: Synthetic peptide
QENEIATTNPVATEQYGDVSATCLQHGEL

SEQ ID NO: 56467 - protein, 28 aa, Artificial Sequence
  Description of Artificial Sequence: Synthetic peptide
QENEIATTNPVCTEQYGVVSDNLQSENQ

SEQ ID NO: 56468 - protein, 28 aa, Artificial Sequence
  Description of Artificial Sequence: Synthetic peptide
QENEIATTNPVSTEQYGDVSENLQHGEL

SEQ ID NO: 56469 - protein, 28 aa, Artificial Sequence
  Description of Artificial Sequence: Synthetic peptide
QENEIATTNPVSTEQYGDVSENLQHGTL

SEQ ID NO: 56470 - protein, 30 aa, Artificial Sequence
  Description of Artificial Sequence: Synthetic polypeptide
QEQEIATTNPVATEQYGSVSATDLQHGEDI

SEQ ID NO: 56471 - protein, 29 aa, Artificial Sequence
  Description of Artificial Sequence: Synthetic peptide
QEQEIATTNPVATEQYGSVSEDLQDHGEL

SEQ ID NO: 56472 - protein, 28 aa, Artificial Sequence
  Description of Artificial Sequence: Synthetic peptide
QEQEIATTNPVATEQYGSVSEDLQHEEK

SEQ ID NO: 56473 - protein, 28 aa, Artificial Sequence
  Description of Artificial Sequence: Synthetic peptide
QEQEIATTNPVATEQYGSVSTCLEHEEL

SEQ ID NO: 56474 - protein, 30 aa, Artificial Sequence
  Description of Artificial Sequence: Synthetic polypeptide
QEQEIATTNPVATEQYGSVSTCLQHEGEDL

SEQ ID NO: 56475 - protein, 29 aa, Artificial Sequence
  Description of Artificial Sequence: Synthetic peptide
QEQEIATTNPVATEQYGSVSTDLEHGEDI

SEQ ID NO: 56476 - protein, 29 aa, Artificial Sequence
  Description of Artificial Sequence: Synthetic peptide
QEQEIATTNPVATEQYGSVSTDLEHGEDL

SEQ ID NO: 56477 - protein, 29 aa, Artificial Sequence
  Description of Artificial Sequence: Synthetic peptide
QEQEIATTNPVSTEQYGSVSACDLQSGTR

SEQ ID NO: 56478 - protein, 28 aa, Artificial Sequence
  Description of Artificial Sequence: Synthetic peptide
QESEIACTNPVATEQYGEASENLQHGGR

SEQ ID NO: 56479 - protein, 28 aa, Artificial Sequence
  Description of Artificial Sequence: Synthetic peptide
QESEIACTNPVATEQYGEASENLQRGDI

SEQ ID NO: 56480 - protein, 28 aa, Artificial Sequence
  Description of Artificial Sequence: Synthetic peptide
QESEIACTNPVATEQYGVVASTLMRGNI

SEQ ID NO: 56481 - protein, 28 aa, Artificial Sequence
  Description of Artificial Sequence: Synthetic peptide
QESEIACTNPVGTEQYGEASSNLQRGGR

SEQ ID NO: 56482 - protein, 29 aa, Artificial Sequence
  Description of Artificial Sequence: Synthetic peptide
QESEIASTNPVATEQYGSMSTTLQRNGDI

SEQ ID NO: 56483 - protein, 28 aa, Artificial Sequence
  Description of Artificial Sequence: Synthetic peptide
QESEIASTNPVGTEQYGEASSNLQRGGR

SEQ ID NO: 56484 - protein, 28 aa, Artificial Sequence
  Description of Artificial Sequence: Synthetic peptide
QESEIASTNPVGTEQYGSMSETLQRGDR

SEQ ID NO: 56485 - protein, 28 aa, Artificial Sequence
  Description of Artificial Sequence: Synthetic peptide
QEQEIATTNPVATEQYGDVSEDLQHGEL

SEQ ID NO: 56486 - protein, 28 aa, Artificial Sequence
  Description of Artificial Sequence: Synthetic peptide
QEQEIATTNPVATEGYGVVSTDLQHGEI

SEQ ID NO: 56487 - protein, 29 aa, Artificial Sequence
  Description of Artificial Sequence: Synthetic peptide
QEQEIATTNPCASEQYGSVSATNLQSGTL

SEQ ID NO: 56488 - protein, 31 aa, Artificial Sequence
  Description of Artificial Sequence: Synthetic polypeptide
DEEEIRTTNPVATEQYGCVSTPTQGFGSDQT

SEQ ID NO: 56489 - protein, 28 aa, Artificial Sequence
  Description of Artificial Sequence: Synthetic peptide
QENEIRPTNPCATEQYGDVSCILQSGDR

SEQ ID NO: 56490 - protein, 28 aa, Artificial Sequence
  Description of Artificial Sequence: Synthetic peptide
QENEIRPTNPCSTEQYGIVSCNLQQGTR

SEQ ID NO: 56491 - protein, 28 aa, Artificial Sequence
  Description of Artificial Sequence: Synthetic peptide
QENEIRPTNPVASEQYGIVSCNLQAGTA

SEQ ID NO: 56492 - protein, 28 aa, Artificial Sequence
  Description of Artificial Sequence: Synthetic peptide
QENEIRTTNPCATEQYGDVSCILQSGDA

SEQ ID NO: 56493 - protein, 32 aa, Artificial Sequence
  Description of Artificial Sequence: Synthetic polypeptide
DEEEIRTTNPVATEQYGCVSTTEEPQRFGSEQ

SEQ ID NO: 56494 - protein, 28 aa, Artificial Sequence
  Description of Artificial Sequence: Synthetic peptide
QENEIRTTNPCSTEPYGIVSCNLQQGTR

SEQ ID NO: 56495 - protein, 28 aa, Artificial Sequence
  Description of Artificial Sequence: Synthetic peptide
QENEIRTTNPIATECYGSVSENLMREEL

SEQ ID NO: 56496 - protein, 31 aa, Artificial Sequence
  Description of Artificial Sequence: Synthetic polypeptide
QESEIATTNPVATECWGSVSCNLQDREGENR

SEQ ID NO: 56497 - protein, 28 aa, Artificial Sequence
  Description of Artificial Sequence: Synthetic peptide
QENEIRTTNPVATECYGDVSECLQHENL

SEQ ID NO: 56498 - protein, 28 aa, Artificial Sequence
  Description of Artificial Sequence: Synthetic peptide
QENEIRTTNPVATECYGDVSENLQHEEL

SEQ ID NO: 56499 - protein, 28 aa, Artificial Sequence
  Description of Artificial Sequence: Synthetic peptide
QENEIRTTNPVATECYGSVSECLMREEL

SEQ ID NO: 56500 - protein, 29 aa, Artificial Sequence
  Description of Artificial Sequence: Synthetic peptide
QENEIRTTNPVATECYGTVSMCLQQHGNH

SEQ ID NO: 56501 - protein, 29 aa, Artificial Sequence
  Description of Artificial Sequence: Synthetic peptide
QENEIVTTNPVATEQYGTVSTDCLQHENL

SEQ ID NO: 56502 - protein, 29 aa, Artificial Sequence
  Description of Artificial Sequence: Synthetic peptide
QEQEIAPTNPCASEQYGSVSATNLQSGTR

SEQ ID NO: 56503 - protein, 29 aa, Artificial Sequence
  Description of Artificial Sequence: Synthetic peptide
QEQEIAPTNPCATEQYGIVSTNLQDSGTR

SEQ ID NO: 56504 - protein, 28 aa, Artificial Sequence
  Description of Artificial Sequence: Synthetic peptide
QEQEIAPTNPCSTEQYGIVSTNLQSGER

SEQ ID NO: 56505 - protein, 28 aa, Artificial Sequence
  Description of Artificial Sequence: Synthetic peptide
QENEIRTTNPVATECYGDVSENLMHENL

SEQ ID NO: 56506 - protein, 30 aa, Artificial Sequence
  Description of Artificial Sequence: Synthetic polypeptide
SEEEIRCTNPIATEQYGSVFFENDDMRGNR

SEQ ID NO: 56507 - protein, 31 aa, Artificial Sequence
  Description of Artificial Sequence: Synthetic polypeptide
SEEEIRCTNPIATEQYGSVFSENDDMRNGNR

SEQ ID NO: 56508 - protein, 31 aa, Artificial Sequence
  Description of Artificial Sequence: Synthetic polypeptide
SEEEIRCTNPIATEQYGSVFSENDMNRGDNR

SEQ ID NO: 56509 - protein, 33 aa, Artificial Sequence
  Description of Artificial Sequence: Synthetic polypeptide
DEEEIRTTNPVATEQYGCVCSTNDQNFGSNFAM

SEQ ID NO: 56510 - protein, 33 aa, Artificial Sequence
  Description of Artificial Sequence: Synthetic polypeptide
SENEIRTTNPVATEQYGSVSTWNLEFRNGDNDE

SEQ ID NO: 56511 - protein, 32 aa, Artificial Sequence
  Description of Artificial Sequence: Synthetic polypeptide
DEEEIRTTNPVATEQYGCVCSTNDQHFNSEQS

SEQ ID NO: 56512 - protein, 29 aa, Artificial Sequence
  Description of Artificial Sequence: Synthetic peptide
SENEIRTTNPVATEQYGTISEDLQQQGNH

SEQ ID NO: 56513 - protein, 31 aa, Artificial Sequence
  Description of Artificial Sequence: Synthetic polypeptide
SENEIRTTNPVSTEPYGSVSMEDLQQQRGNR

SEQ ID NO: 56514 - protein, 33 aa, Artificial Sequence
  Description of Artificial Sequence: Synthetic polypeptide
DEEEIRTTNPVATEQYGCVCSTNDPQNFGSNQE

SEQ ID NO: 56515 - protein, 32 aa, Artificial Sequence
  Description of Artificial Sequence: Synthetic polypeptide
DEEEIRTTNPVATEQYGCVCSTNDPQENGSEQ

SEQ ID NO: 56516 - protein, 29 aa, Artificial Sequence
  Description of Artificial Sequence: Synthetic peptide
SEPEIACTNPTAYEQYGSVSENLMRGNER

SEQ ID NO: 56517 - protein, 29 aa, Artificial Sequence
  Description of Artificial Sequence: Synthetic peptide
SEPEIRCTNPIATECYGSVSENLARGENT

SEQ ID NO: 56518 - protein, 29 aa, Artificial Sequence
  Description of Artificial Sequence: Synthetic peptide
SEQEIACTNPVATEQYGSVSAENLERGEL

SEQ ID NO: 56519 - protein, 34 aa, Artificial Sequence
  Description of Artificial Sequence: Synthetic polypeptide
DEEEIRTTNPVATEQYGCVCSTNDLQRFGSEPQM

SEQ ID NO: 56520 - protein, 31 aa, Artificial Sequence
  Description of Artificial Sequence: Synthetic polypeptide
SEQEIATTNPVATEQYGSVSATDLEDHEGNR

SEQ ID NO: 56521 - protein, 33 aa, Artificial Sequence
  Description of Artificial Sequence: Synthetic polypeptide
DEEEIRTTNPVATEQYGCVCSTNDLQNFGSDQF

SEQ ID NO: 56522 - protein, 33 aa, Artificial Sequence
  Description of Artificial Sequence: Synthetic polypeptide
DEEEIRTTNPVATEQYGCVCSTNDLQGFGSDPQ

SEQ ID NO: 56523 - protein, 30 aa, Artificial Sequence
  Description of Artificial Sequence: Synthetic polypeptide
SEQEIATTNPVATEQYGSVSTDLEDHEGER

SEQ ID NO: 56524 - protein, 30 aa, Artificial Sequence
  Description of Artificial Sequence: Synthetic polypeptide
SENEIRTTNPVATEQYGSVSEILMNAAGDR

SEQ ID NO: 56525 - protein, 34 aa, Artificial Sequence
  Description of Artificial Sequence: Synthetic polypeptide
DEEEIRTTNPVATEQYGCVCSTNDLQEFGSENQS

SEQ ID NO: 56526 - protein, 29 aa, Artificial Sequence
  Description of Artificial Sequence: Synthetic peptide
SENEIRTTNPVATEPYGSISMDIQMRGNH

SEQ ID NO: 56527 - protein, 29 aa, Artificial Sequence
  Description of Artificial Sequence: Synthetic peptide
SENEIRTTNPIATEQYGSVSENEMNREDR

SEQ ID NO: 56528 - protein, 28 aa, Artificial Sequence
  Description of Artificial Sequence: Synthetic peptide
SENEIACTNPVATEQYGEASENLQGGGR

SEQ ID NO: 56529 - protein, 29 aa, Artificial Sequence
  Description of Artificial Sequence: Synthetic peptide
SENEIACTNPVATEQYGVEASENLQRGGR

SEQ ID NO: 56530 - protein, 28 aa, Artificial Sequence
  Description of Artificial Sequence: Synthetic peptide
SENEIACTNPVATNQYGEASENLQRGGR

SEQ ID NO: 56531 - protein, 28 aa, Artificial Sequence
  Description of Artificial Sequence: Synthetic peptide
SENEIATTNPIATECYGSVSENLQREEL

SEQ ID NO: 56532 - protein, 32 aa, Artificial Sequence
  Description of Artificial Sequence: Synthetic polypeptide
DEEEIRTTNPVATEQYGCVCSTNGQNFGSDQA

SEQ ID NO: 56533 - protein, 30 aa, Artificial Sequence
  Description of Artificial Sequence: Synthetic polypeptide
SENEIRATNPVATEQYGSVETVNLEHGNQQ

SEQ ID NO: 56534 - protein, 28 aa, Artificial Sequence
  Description of Artificial Sequence: Synthetic peptide
SENEIRCTNPIATEQYGSISENIMRGNH

SEQ ID NO: 56535 - protein, 29 aa, Artificial Sequence
  Description of Artificial Sequence: Synthetic peptide
SENEIRCTNPIATEQYGSVSENEMAAGNR

SEQ ID NO: 56536 - protein, 29 aa, Artificial Sequence
  Description of Artificial Sequence: Synthetic peptide
SENEIRCTNPIATEQYGSVSENEMRAGNA

SEQ ID NO: 56537 - protein, 29 aa, Artificial Sequence
  Description of Artificial Sequence: Synthetic peptide
SENEIRCTNPIATEQYGSVSENLMAAGDR

SEQ ID NO: 56538 - protein, 34 aa, Artificial Sequence
  Description of Artificial Sequence: Synthetic polypeptide
DEEEIRTTNPVATEQYGCVCSTNELNQFFGSNQE

SEQ ID NO: 56539 - protein, 32 aa, Artificial Sequence
  Description of Artificial Sequence: Synthetic polypeptide
DEEEIRTTNPVATEQYGCVCSTNEHQGFGSQQ

SEQ ID NO: 56540 - protein, 34 aa, Artificial Sequence
  Description of Artificial Sequence: Synthetic polypeptide
DEEEIRTTNPVATEQYGCVCSTNEDLQFFGSNQA

SEQ ID NO: 56541 - protein, 32 aa, Artificial Sequence
  Description of Artificial Sequence: Synthetic polypeptide
DEEEIRTTNPVATEQYGCVCSTNDQYFGSDQV

SEQ ID NO: 56542 - protein, 30 aa, Artificial Sequence
  Description of Artificial Sequence: Synthetic polypeptide
SENEIRCTNPVATEQYGSVSENLMNAAGDR

SEQ ID NO: 56543 - protein, 28 aa, Artificial Sequence
  Description of Artificial Sequence: Synthetic peptide
SENEIRTTNPIATEQYGSVSENEMREDA

SEQ ID NO: 56544 - protein, 29 aa, Artificial Sequence
  Description of Artificial Sequence: Synthetic peptide
SENEIACTNPVATEQYGEASENLQARGGR

SEQ ID NO: 56545 - protein, 31 aa, Artificial Sequence
  Description of Artificial Sequence: Synthetic polypeptide
SEQEIRGTNPVATEQYGSVVETNLQDDGENQ

SEQ ID NO: 56546 - protein, 30 aa, Artificial Sequence
  Description of Artificial Sequence: Synthetic polypeptide
SEQEIRTTNPIATEQYGSVSAEDLMDHGNR

SEQ ID NO: 56547 - protein, 33 aa, Artificial Sequence
  Description of Artificial Sequence: Synthetic polypeptide
DEEEIRTTNPVATEQYGCVCSTMNLQRFMSEQG

SEQ ID NO: 56548 - protein, 34 aa, Artificial Sequence
  Description of Artificial Sequence: Synthetic polypeptide
DEEEIRTTNPVATEQYGCVCSTMNLQNFGSNTQS

SEQ ID NO: 56549 - protein, 33 aa, Artificial Sequence
  Description of Artificial Sequence: Synthetic polypeptide
DEEEIRTTNPVATEQYGCVCSTMNLQNFGSEQG

SEQ ID NO: 56550 - protein, 33 aa, Artificial Sequence
  Description of Artificial Sequence: Synthetic polypeptide
DEEEIRTTNPVATEQYGCVCSTMNLQGFGSDQT

SEQ ID NO: 56551 - protein, 34 aa, Artificial Sequence
  Description of Artificial Sequence: Synthetic polypeptide
DEEEIRTTNPVATEQYGCVCSTMNLQFFGSNNQN

SEQ ID NO: 56552 - protein, 34 aa, Artificial Sequence
  Description of Artificial Sequence: Synthetic polypeptide
DEEEIRTTNPVATEQYGCVCSTMNLQEYFGSNQA

SEQ ID NO: 56553 - protein, 34 aa, Artificial Sequence
  Description of Artificial Sequence: Synthetic polypeptide
DEEEIRTTNPVATEQYGCVCSTMNLQESFGSNQE

SEQ ID NO: 56554 - protein, 34 aa, Artificial Sequence
  Description of Artificial Sequence: Synthetic polypeptide
DEEEIRTTNPVATEQYGCVCSTMNLQEGFGSNQI

SEQ ID NO: 56555 - protein, 34 aa, Artificial Sequence
  Description of Artificial Sequence: Synthetic polypeptide
DEEEIRTTNPVATEQYGCVCSTMNLDQNFGSNQT

SEQ ID NO: 56556 - protein, 34 aa, Artificial Sequence
  Description of Artificial Sequence: Synthetic polypeptide
DEEEIRTTNPVATEQYGCVCSTMNHQNFGSNNRL

SEQ ID NO: 56557 - protein, 33 aa, Artificial Sequence
  Description of Artificial Sequence: Synthetic polypeptide
DEEEIRTTNPVATEQYGCVCSTMNHQHFNSNRT

SEQ ID NO: 56558 - protein, 33 aa, Artificial Sequence
  Description of Artificial Sequence: Synthetic polypeptide
DEEEIRTTNPVATEQYGCVCSTMNHQGFGSNQA

SEQ ID NO: 56559 - protein, 34 aa, Artificial Sequence
  Description of Artificial Sequence: Synthetic polypeptide
DEEEIRTTNPVATEQYGCVCSTMNDLQRFGSEQT

SEQ ID NO: 56560 - protein, 30 aa, Artificial Sequence
  Description of Artificial Sequence: Synthetic polypeptide
SESEIRCTNPIATEQYGSVSENEMDRGENR

SEQ ID NO: 56561 - protein, 31 aa, Artificial Sequence
  Description of Artificial Sequence: Synthetic polypeptide
SESEIRCTNPIATEQYGSVSENLPMDREGNR

SEQ ID NO: 56562 - protein, 33 aa, Artificial Sequence
  Description of Artificial Sequence: Synthetic polypeptide
DEEEIRTTNPVATEQYGCVCSTMYHQRFGSNQT

SEQ ID NO: 56563 - protein, 34 aa, Artificial Sequence
  Description of Artificial Sequence: Synthetic polypeptide
DEEEIRTTNPVATEQYGCVCSTNDLNQNFGSNTQ

SEQ ID NO: 56564 - protein, 29 aa, Artificial Sequence
  Description of Artificial Sequence: Synthetic peptide
SESEIRCTNPIATEGYGSVSETLQRVGQR

SEQ ID NO: 56565 - protein, 33 aa, Artificial Sequence
  Description of Artificial Sequence: Synthetic polypeptide
DEEEIRTTNPVATEQYGCVCSTNAIQEGFGSNQ

SEQ ID NO: 56566 - protein, 33 aa, Artificial Sequence
  Description of Artificial Sequence: Synthetic polypeptide
DEEEIRTTNPVATEQYGCVCSTNDIQENGSNQN

SEQ ID NO: 56567 - protein, 32 aa, Artificial Sequence
  Description of Artificial Sequence: Synthetic polypeptide
DEEEIRTTNPVATEQYGCVCSTNDHQNGSDQS

SEQ ID NO: 56568 - protein, 33 aa, Artificial Sequence
  Description of Artificial Sequence: Synthetic polypeptide
DEEEIRTTNPVATEQYGCVCSTNDHQEHFGSNQ

SEQ ID NO: 56569 - protein, 33 aa, Artificial Sequence
  Description of Artificial Sequence: Synthetic polypeptide
DEEEIRTTNPVATEQYGCVCSTNDHQEFGSNNQ

SEQ ID NO: 56570 - protein, 33 aa, Artificial Sequence
  Description of Artificial Sequence: Synthetic polypeptide
DEEEIRTTNPVATEQYGCVCSTNDHQEFGSNAS

SEQ ID NO: 56571 - protein, 32 aa, Artificial Sequence
  Description of Artificial Sequence: Synthetic polypeptide
DEEEIRTTNPVATEQYGCVCSTNDHQASGSDQ

SEQ ID NO: 56572 - protein, 29 aa, Artificial Sequence
  Description of Artificial Sequence: Synthetic peptide
SESEIACTNPIATEQYGNVAENLQSRGNR

SEQ ID NO: 56573 - protein, 28 aa, Artificial Sequence
  Description of Artificial Sequence: Synthetic peptide
SESEIACTNPIATEQYGNVSETLQRGQR

SEQ ID NO: 56574 - protein, 32 aa, Artificial Sequence
  Description of Artificial Sequence: Synthetic polypeptide
DEEEIRTTNPVATEQYGCVCSTNDDQNFISNQ

SEQ ID NO: 56575 - protein, 33 aa, Artificial Sequence
  Description of Artificial Sequence: Synthetic polypeptide
DEEEIRTTNPVATEQYGCVCSTNDDQEHFGSNQ

SEQ ID NO: 56576 - protein, 30 aa, Artificial Sequence
  Description of Artificial Sequence: Synthetic polypeptide
SESEIACTNPVATEQYGNVAENLQSRVGNR

SEQ ID NO: 56577 - protein, 28 aa, Artificial Sequence
  Description of Artificial Sequence: Synthetic peptide
SESEIASTNPVATEGYGSMAENLQRGNI

SEQ ID NO: 56578 - protein, 30 aa, Artificial Sequence
  Description of Artificial Sequence: Synthetic polypeptide
SESEIRCTNPCATEQYGWVSPENLHRGNRD

SEQ ID NO: 56579 - protein, 30 aa, Artificial Sequence
  Description of Artificial Sequence: Synthetic polypeptide
SESEIRCTNPIATECYGSVSCNEQDREGNR

SEQ ID NO: 56580 - protein, 33 aa, Artificial Sequence
  Description of Artificial Sequence: Synthetic polypeptide
DEEEIRTTNPVATEQYGCVCSTNAIQENGSNNQ

SEQ ID NO: 56581 - protein, 28 aa, Artificial Sequence
  Description of Artificial Sequence: Synthetic peptide
SESEIRCTNPIATEGYGSVSENLMHGDR

SEQ ID NO: 56582 - protein, 28 aa, Artificial Sequence
  Description of Artificial Sequence: Synthetic peptide
SENEIACTNPIATEQYGEASENLQRGGR

SEQ ID NO: 56583 - protein, 32 aa, Artificial Sequence
  Description of Artificial Sequence: Synthetic polypeptide
SEMEIVTTNPVATEQYGSVCSATDNLMFEGNR

SEQ ID NO: 56584 - protein, 30 aa, Artificial Sequence
  Description of Artificial Sequence: Synthetic polypeptide
SEMEIRTTNPVATEQYGTVCSTDNPEFGND

SEQ ID NO: 56585 - protein, 33 aa, Artificial Sequence
  Description of Artificial Sequence: Synthetic polypeptide
DEEEIRTTNPVATEQYGCVCSTNLDQNFNSNQS

SEQ ID NO: 56586 - protein, 28 aa, Artificial Sequence
  Description of Artificial Sequence: Synthetic peptide
SEEEVACTNPVATEQYGSVANTIQRGQR

SEQ ID NO: 56587 - protein, 30 aa, Artificial Sequence
  Description of Artificial Sequence: Synthetic polypeptide
SEEEVACTNPVATEQYGSVSANTIQSRGQR

SEQ ID NO: 56588 - protein, 33 aa, Artificial Sequence
  Description of Artificial Sequence: Synthetic polypeptide
DEEEIRTTNPVATEQYGCVCSTNLARFNSNNQA

SEQ ID NO: 56589 - protein, 33 aa, Artificial Sequence
  Description of Artificial Sequence: Synthetic polypeptide
DEEEIRTTNPVATEQYGCVCSTNLAEFFGSERP

SEQ ID NO: 56590 - protein, 28 aa, Artificial Sequence
  Description of Artificial Sequence: Synthetic peptide
SEEEVASTNPIATEQYGNVSNTLMRGNR

SEQ ID NO: 56591 - protein, 33 aa, Artificial Sequence
  Description of Artificial Sequence: Synthetic polypeptide
DEEEIRTTNPVATEQYGCVCSTNHQYSGSNNQI

SEQ ID NO: 56592 - protein, 32 aa, Artificial Sequence
  Description of Artificial Sequence: Synthetic polypeptide
DEEEIRTTNPVATEQYGCVCSTNHQYSGSDQF

SEQ ID NO: 56593 - protein, 32 aa, Artificial Sequence
  Description of Artificial Sequence: Synthetic polypeptide
DEEEIRTTNPVATEQYGCVCSTNHQSFGSEQA

SEQ ID NO: 56594 - protein, 32 aa, Artificial Sequence
  Description of Artificial Sequence: Synthetic polypeptide
DEEEIRTTNPVATEQYGCVCSTNHQRSSSEQD

SEQ ID NO: 56595 - protein, 33 aa, Artificial Sequence
  Description of Artificial Sequence: Synthetic polypeptide
DEEEIRTTNPVATEQYGCVCSTNHQRFNSNNVT

SEQ ID NO: 56596 - protein, 33 aa, Artificial Sequence
  Description of Artificial Sequence: Synthetic polypeptide
DEEEIRTTNPVATEQYGCVCSTNHQNSGSNPQG

SEQ ID NO: 56597 - protein, 32 aa, Artificial Sequence
  Description of Artificial Sequence: Synthetic polypeptide
DEEEIRTTNPVATEQYGCVCSTNHQNNSDNQM

SEQ ID NO: 56598 - protein, 33 aa, Artificial Sequence
  Description of Artificial Sequence: Synthetic polypeptide
SEEEVRTTNPVATEQYGCVSTGNHDQRIGSNRS

SEQ ID NO: 56599 - protein, 33 aa, Artificial Sequence
  Description of Artificial Sequence: Synthetic polypeptide
SEEEVRTTNPVATEQYGSVCSTENDLDQNIGNQ

SEQ ID NO: 56600 - protein, 34 aa, Artificial Sequence
  Description of Artificial Sequence: Synthetic polypeptide
DEEEIRTTNPVATEQYGCVCSTNLEERFGSNTQA

SEQ ID NO: 56601 - protein, 31 aa, Artificial Sequence
  Description of Artificial Sequence: Synthetic polypeptide
DEEEIRTTNPVATEQYGCVCSTNHQNFSDDA

SEQ ID NO: 56602 - protein, 32 aa, Artificial Sequence
  Description of Artificial Sequence: Synthetic polypeptide
SEEEIVTTNPIATEQYGSVCSATDNLMFEGNR

SEQ ID NO: 56603 - protein, 30 aa, Artificial Sequence
  Description of Artificial Sequence: Synthetic polypeptide
SEEEIVCTNPIATEQYGSVSENLVEREGND

SEQ ID NO: 56604 - protein, 33 aa, Artificial Sequence
  Description of Artificial Sequence: Synthetic polypeptide
DEEEIRTTNPVATEQYGCVCSTNLNQYFGSQQS

SEQ ID NO: 56605 - protein, 28 aa, Artificial Sequence
  Description of Artificial Sequence: Synthetic peptide
SEEEIRTTNPVSTEPYGTVSEDLMQGNH

SEQ ID NO: 56606 - protein, 33 aa, Artificial Sequence
  Description of Artificial Sequence: Synthetic polypeptide
DEEEIRTTNPVATEQYGCVCSTNLNQNFNSEQQ

SEQ ID NO: 56607 - protein, 33 aa, Artificial Sequence
  Description of Artificial Sequence: Synthetic polypeptide
DEEEIRTTNPVATEQYGCVCSTNLNQNFNSEQG

SEQ ID NO: 56608 - protein, 33 aa, Artificial Sequence
  Description of Artificial Sequence: Synthetic polypeptide
DEEEIRTTNPVATEQYGCVCSTNLNQESFNSNQ

SEQ ID NO: 56609 - protein, 34 aa, Artificial Sequence
  Description of Artificial Sequence: Synthetic polypeptide
DEEEIRTTNPVATEQYGCVCSTNLNQERFNSEQA

SEQ ID NO: 56610 - protein, 33 aa, Artificial Sequence
  Description of Artificial Sequence: Synthetic polypeptide
DEEEIRTTNPVATEQYGCVCSTNLNQENFNSNI

SEQ ID NO: 56611 - protein, 34 aa, Artificial Sequence
  Description of Artificial Sequence: Synthetic polypeptide
DEEEIRTTNPVATEQYGCVCSTNLNQEGFGSNQE

SEQ ID NO: 56612 - protein, 29 aa, Artificial Sequence
  Description of Artificial Sequence: Synthetic peptide
SEEEIRTTNPVSTEPYGTVSEDLMQNGNH

SEQ ID NO: 56613 - protein, 34 aa, Artificial Sequence
  Description of Artificial Sequence: Synthetic polypeptide
DEEEIRTTNPVATEQYGCVCSTNLHQNFGSNTQL

SEQ ID NO: 56614 - protein, 29 aa, Artificial Sequence
  Description of Artificial Sequence: Synthetic peptide
SEEEISTTNPVATEQYGCVGTALQNFGDQ

SEQ ID NO: 56615 - protein, 32 aa, Artificial Sequence
  Description of Artificial Sequence: Synthetic polypeptide
SEEEISTTNPVATEQYGSVVITPNELAQRGGP

SEQ ID NO: 56616 - protein, 33 aa, Artificial Sequence
  Description of Artificial Sequence: Synthetic polypeptide
DEEEIRTTNPVATEQYGCVCSTNLENFGSQNQS

SEQ ID NO: 56617 - protein, 33 aa, Artificial Sequence
  Description of Artificial Sequence: Synthetic polypeptide
SEEEISTTNPVATEQYGSVYSFYNLQREGSEYR

SEQ ID NO: 56618 - protein, 32 aa, Artificial Sequence
  Description of Artificial Sequence: Synthetic polypeptide
SEEEIVCTNPIATEQYGSVCSATDNLMREGNR

SEQ ID NO: 56619 - protein, 30 aa, Artificial Sequence
  Description of Artificial Sequence: Synthetic polypeptide
SEEEIVCTNPVATEQYGSVSTGLVEFEGND

SEQ ID NO: 56620 - protein, 33 aa, Artificial Sequence
  Description of Artificial Sequence: Synthetic polypeptide
DEEEIRTTNPVATEQYGCVCSTNHQNFGSQNQI

SEQ ID NO: 56621 - protein, 33 aa, Artificial Sequence
  Description of Artificial Sequence: Synthetic polypeptide
DEEEIRTTNPVATEQYGCVCSTNHQNFGSNTQA

SEQ ID NO: 56622 - protein, 32 aa, Artificial Sequence
  Description of Artificial Sequence: Synthetic polypeptide
DEEEIRTTNPVATEQYGCVCSTNHQNFGGDQP

SEQ ID NO: 56623 - protein, 32 aa, Artificial Sequence
  Description of Artificial Sequence: Synthetic polypeptide
DEEEIRTTNPVATEQYGCVCSTNHNQSFNSDQ

SEQ ID NO: 56624 - protein, 28 aa, Artificial Sequence
  Description of Artificial Sequence: Synthetic peptide
SEGEIRCTNPISSEQYGSVSENLMSGNR

SEQ ID NO: 56625 - protein, 32 aa, Artificial Sequence
  Description of Artificial Sequence: Synthetic polypeptide
DEEEIRTTNPVATEQYGCVCSTNHNQNGSQQA

SEQ ID NO: 56626 - protein, 28 aa, Artificial Sequence
  Description of Artificial Sequence: Synthetic peptide
SEGEIRPTNPCASEQYGSVSCNLMSGTR

SEQ ID NO: 56627 - protein, 28 aa, Artificial Sequence
  Description of Artificial Sequence: Synthetic peptide
SEGEIRPTNPCSSEQYGSVSCNLQSGTR

SEQ ID NO: 56628 - protein, 33 aa, Artificial Sequence
  Description of Artificial Sequence: Synthetic polypeptide
DEEEIRTTNPVATEQYGCVCSTNHNQGGSNNQV

SEQ ID NO: 56629 - protein, 33 aa, Artificial Sequence
  Description of Artificial Sequence: Synthetic polypeptide
DEEEIRTTNPVATEQYGCVCSTNHFQHSGSNQT

SEQ ID NO: 56630 - protein, 28 aa, Artificial Sequence
  Description of Artificial Sequence: Synthetic peptide
SEGEIRPTNPIASEQYGSVSCNLMSGTR

SEQ ID NO: 56631 - protein, 29 aa, Artificial Sequence
  Description of Artificial Sequence: Synthetic peptide
SEMEIRCTNPIATEQYGSVCSEGLMFGNR

SEQ ID NO: 56632 - protein, 33 aa, Artificial Sequence
  Description of Artificial Sequence: Synthetic polypeptide
DEEEIRTTNPVATEQYGCVCSTNHDQNGSDNQS

SEQ ID NO: 56633 - protein, 29 aa, Artificial Sequence
  Description of Artificial Sequence: Synthetic peptide
SEMEIRCTNPIATEQYGSVSEGPEREGNR

SEQ ID NO: 56634 - protein, 29 aa, Artificial Sequence
  Description of Artificial Sequence: Synthetic peptide
SEMEIRCTNPIATEQYGSVSEGPMREGNR

SEQ ID NO: 56635 - protein, 33 aa, Artificial Sequence
  Description of Artificial Sequence: Synthetic polypeptide
DEEEIRTTNPVATEQYGCVCSTNHDQNFGSNTQ

SEQ ID NO: 56636 - protein, 29 aa, Artificial Sequence
  Description of Artificial Sequence: Synthetic peptide
SEMEIRCTNPVATEQYGCVETNLQHGSDQ

SEQ ID NO: 56637 - protein, 32 aa, Artificial Sequence
  Description of Artificial Sequence: Synthetic polypeptide
DEEEIRTTNPVATEQYGCVCSTNHAEGGSNQV

SEQ ID NO: 56638 - protein, 32 aa, Artificial Sequence
  Description of Artificial Sequence: Synthetic polypeptide
DEEEIRTTNPVATEQYGCVCSTNHQASNSDQA

SEQ ID NO: 56639 - protein, 32 aa, Artificial Sequence
  Description of Artificial Sequence: Synthetic polypeptide
DEEEIRTTNPVATEQYGCVCSTNHQEFSSNQA

SEQ ID NO: 56640 - protein, 33 aa, Artificial Sequence
  Description of Artificial Sequence: Synthetic polypeptide
DEEEIRTTNPVATEQYGCVCSTNHQEGGSNNQS

SEQ ID NO: 56641 - protein, 29 aa, Artificial Sequence
  Description of Artificial Sequence: Synthetic peptide
SEGEIACTNPVATEQYGSVATNLQGSNDQ

SEQ ID NO: 56642 - protein, 32 aa, Artificial Sequence
  Description of Artificial Sequence: Synthetic polypeptide
DEEEIRTTNPVATEQYGCVCSTNHQHFQSNNQ

SEQ ID NO: 56643 - protein, 32 aa, Artificial Sequence
  Description of Artificial Sequence: Synthetic polypeptide
DEEEIRTTNPVATEQYGCVCSTNHQHFNSVQL

SEQ ID NO: 56644 - protein, 34 aa, Artificial Sequence
  Description of Artificial Sequence: Synthetic polypeptide
SEEEVRTTNPVATEQYGSVSTWNLPQSRIGNNQY

SEQ ID NO: 56645 - protein, 29 aa, Artificial Sequence
  Description of Artificial Sequence: Synthetic peptide
SEEGICTTNPVAYEQYGSVSMNSQHGNDS

SEQ ID NO: 56646 - protein, 32 aa, Artificial Sequence
  Description of Artificial Sequence: Synthetic polypeptide
DEEEIRTTNPVATEQYGCVCSTNHQGIGSDQA

SEQ ID NO: 56647 - protein, 33 aa, Artificial Sequence
  Description of Artificial Sequence: Synthetic polypeptide
DEEEIRTTNPVATEQYGCVCSTNHQGFGSNFQV

SEQ ID NO: 56648 - protein, 32 aa, Artificial Sequence
  Description of Artificial Sequence: Synthetic polypeptide
DEEEIRTTNPVATEQYGCVCSTNHQFSQSNDY

SEQ ID NO: 56649 - protein, 32 aa, Artificial Sequence
  Description of Artificial Sequence: Synthetic polypeptide
DEEEIRTTNPVATEQYGCVCSTMEPQGGSERS

SEQ ID NO: 56650 - protein, 32 aa, Artificial Sequence
  Description of Artificial Sequence: Synthetic polypeptide
DEEEIRTTNPVATEQYGCVCSTNHQFINSNQA

SEQ ID NO: 56651 - protein, 33 aa, Artificial Sequence
  Description of Artificial Sequence: Synthetic polypeptide
DEEEIRTTNPVATEQYGCVCSTNHQERSNSNQS

SEQ ID NO: 56652 - protein, 28 aa, Artificial Sequence
  Description of Artificial Sequence: Synthetic peptide
SEEVICSTNPVATEQYGSVAMNEQMGNH

SEQ ID NO: 56653 - protein, 33 aa, Artificial Sequence
  Description of Artificial Sequence: Synthetic polypeptide
DEEEIRTTNPVATEQYGCVCSTNHQERSGSELG

SEQ ID NO: 56654 - protein, 29 aa, Artificial Sequence
  Description of Artificial Sequence: Synthetic peptide
SEEVICTTNPVAYEQYGSVSANSQSGNDS

SEQ ID NO: 56655 - protein, 33 aa, Artificial Sequence
  Description of Artificial Sequence: Synthetic polypeptide
DEEEIRTTNPVATEQYGCVCSTNHQERFNSNQS

SEQ ID NO: 56656 - protein, 33 aa, Artificial Sequence
  Description of Artificial Sequence: Synthetic polypeptide
DEEEIRTTNPVATEQYGCVCSTNHQEHGSNPQT

SEQ ID NO: 56657 - protein, 30 aa, Artificial Sequence
  Description of Artificial Sequence: Synthetic polypeptide
SEGEIACTNPVATEQYGSVATNLQGGNNQM

SEQ ID NO: 56658 - protein, 32 aa, Artificial Sequence
  Description of Artificial Sequence: Synthetic polypeptide
DEEEIRTTNPVATEQYGCVCSTNHQEYNSNQN

SEQ ID NO: 56659 - protein, 32 aa, Artificial Sequence
  Description of Artificial Sequence: Synthetic polypeptide
DEEEIRTTNPVATEQYGCVCSTMELQSGSDQS

SEQ ID NO: 56660 - protein, 33 aa, Artificial Sequence
  Description of Artificial Sequence: Synthetic polypeptide
DEEEIRTTNPVATEQYGCVCSTMELQRFGSDQS

SEQ ID NO: 56661 - protein, 33 aa, Artificial Sequence
  Description of Artificial Sequence: Synthetic polypeptide
DEEEIRTTNPVATEQYGCVCSTMELQFFGSDNQ

SEQ ID NO: 56662 - protein, 32 aa, Artificial Sequence
  Description of Artificial Sequence: Synthetic polypeptide
DEEEIRTTNPVATEQYGCVCSTEPQHSGSERS

SEQ ID NO: 56663 - protein, 32 aa, Artificial Sequence
  Description of Artificial Sequence: Synthetic polypeptide
DEEEIRTTNPVATEQYGCVCSTEPQAFGSDRG

SEQ ID NO: 56664 - protein, 33 aa, Artificial Sequence
  Description of Artificial Sequence: Synthetic polypeptide
DEEEIRTTNPVATEQYGCVCSTEPLNQNFGSNI

SEQ ID NO: 56665 - protein, 32 aa, Artificial Sequence
  Description of Artificial Sequence: Synthetic polypeptide
DEEEIRTTNPVATEQYGCVCSTEPLERFGSDA

SEQ ID NO: 56666 - protein, 32 aa, Artificial Sequence
  Description of Artificial Sequence: Synthetic polypeptide
DEEEIRTTNPVATEQYGCVCSTEPHQRGSEQS

SEQ ID NO: 56667 - protein, 30 aa, Artificial Sequence
  Description of Artificial Sequence: Synthetic polypeptide
SQEEIATTNPVAYEQWGTVSTNLQDGHNNR

SEQ ID NO: 56668 - protein, 30 aa, Artificial Sequence
  Description of Artificial Sequence: Synthetic polypeptide
SQEEIATTNPVAYEQWGTVSTNLQEGDNRE

SEQ ID NO: 56669 - protein, 33 aa, Artificial Sequence
  Description of Artificial Sequence: Synthetic polypeptide
DEEEIRTTNPVATEQYGCVCSTEPDLERFGSNQ

SEQ ID NO: 56670 - protein, 30 aa, Artificial Sequence
  Description of Artificial Sequence: Synthetic polypeptide
SQEEIATTNPVAYEQWGTVSTNLQGDGNSR

SEQ ID NO: 56671 - protein, 30 aa, Artificial Sequence
  Description of Artificial Sequence: Synthetic polypeptide
SQEEIATTNPVAYEQWGTVSTNLQHDGDNR

SEQ ID NO: 56672 - protein, 32 aa, Artificial Sequence
  Description of Artificial Sequence: Synthetic polypeptide
DEEEIRTTNPVATEQYGCVCSTENPQNGSEIQ

SEQ ID NO: 56673 - protein, 29 aa, Artificial Sequence
  Description of Artificial Sequence: Synthetic peptide
SQEEIRTTNPVATEQWGCCSTNTQEGERP

SEQ ID NO: 56674 - protein, 30 aa, Artificial Sequence
  Description of Artificial Sequence: Synthetic polypeptide
SQEEIRTTNPVATEQWGCVCSWNLQYGSNA

SEQ ID NO: 56675 - protein, 30 aa, Artificial Sequence
  Description of Artificial Sequence: Synthetic polypeptide
SQEEIRTTNPVATEQWGCVSTLNLQENNEQ

SEQ ID NO: 56676 - protein, 30 aa, Artificial Sequence
  Description of Artificial Sequence: Synthetic polypeptide
SQEEIRTTNPVATEQWGCVSTNLQEGEDEQ

SEQ ID NO: 56677 - protein, 30 aa, Artificial Sequence
  Description of Artificial Sequence: Synthetic polypeptide
SGEEIATTNPVAYEQWGTVSTNLQEGGNAR

SEQ ID NO: 56678 - protein, 29 aa, Artificial Sequence
  Description of Artificial Sequence: Synthetic peptide
SQEEIRTTNPVATEQWGCVSTNLTEGFDS

SEQ ID NO: 56679 - protein, 32 aa, Artificial Sequence
  Description of Artificial Sequence: Synthetic polypeptide
DEEEIRTTNPVATEQYGCVCSTEPQNFGSNQA

SEQ ID NO: 56680 - protein, 30 aa, Artificial Sequence
  Description of Artificial Sequence: Synthetic polypeptide
SEYEIRQTNPVATEQYGCVETNLQHFGSNQ

SEQ ID NO: 56681 - protein, 33 aa, Artificial Sequence
  Description of Artificial Sequence: Synthetic polypeptide
DEEEIRTTNPVATEQYGCVCSTGALQRFGSEQS

SEQ ID NO: 56682 - protein, 32 aa, Artificial Sequence
  Description of Artificial Sequence: Synthetic polypeptide
DEEEIRTTNPVATEQYGCVCSTGAHQGGSNQV

SEQ ID NO: 56683 - protein, 34 aa, Artificial Sequence
  Description of Artificial Sequence: Synthetic polypeptide
DEEEIRTTNPVATEQYGCVCSTEYHNQRFGSNRS

SEQ ID NO: 56684 - protein, 31 aa, Artificial Sequence
  Description of Artificial Sequence: Synthetic polypeptide
SEVEIATTNPVATEQYGSVAITNLQQGNEQA

SEQ ID NO: 56685 - protein, 32 aa, Artificial Sequence
  Description of Artificial Sequence: Synthetic polypeptide
DEEEIRTTNPVATEQYGCVCSTETQYFGSERT

SEQ ID NO: 56686 - protein, 29 aa, Artificial Sequence
  Description of Artificial Sequence: Synthetic peptide
SEVEIATTNPVAYEPYGSVATNLQDGNDD

SEQ ID NO: 56687 - protein, 32 aa, Artificial Sequence
  Description of Artificial Sequence: Synthetic polypeptide
DEEEIRTTNPVATEQYGCVCSTETQEHSGSER

SEQ ID NO: 56688 - protein, 30 aa, Artificial Sequence
  Description of Artificial Sequence: Synthetic polypeptide
SEYEIRCTNPVATEQYGCVETNLDQHGSNQ

SEQ ID NO: 56689 - protein, 29 aa, Artificial Sequence
  Description of Artificial Sequence: Synthetic peptide
SEYEIRCTNPVATEQYGCVETNLQHGEQT

SEQ ID NO: 56690 - protein, 30 aa, Artificial Sequence
  Description of Artificial Sequence: Synthetic polypeptide
SEYEIRCTNPVATEQYGSVCETELQEHGNQ

SEQ ID NO: 56691 - protein, 31 aa, Artificial Sequence
  Description of Artificial Sequence: Synthetic polypeptide
DEEEIRTTNPVATEQYGCVCSTETAGGSNQS

SEQ ID NO: 56692 - protein, 30 aa, Artificial Sequence
  Description of Artificial Sequence: Synthetic polypeptide
SEYEIRMTNPVATEQYGSVEPTNLGHGNFQ

SEQ ID NO: 56693 - protein, 32 aa, Artificial Sequence
  Description of Artificial Sequence: Synthetic polypeptide
DEEEIRTTNPVATEQYGCVCSTEPQRFGSEIS

SEQ ID NO: 56694 - protein, 30 aa, Artificial Sequence
  Description of Artificial Sequence: Synthetic polypeptide
SEYEIRMTNPVATESYGSSVETNLQHGLNQ

SEQ ID NO: 56695 - protein, 29 aa, Artificial Sequence
  Description of Artificial Sequence: Synthetic peptide
SEYEIRMTNPVATESYGSVETNIEQHGNQ

SEQ ID NO: 56696 - protein, 31 aa, Artificial Sequence
  Description of Artificial Sequence: Synthetic polypeptide
SEYEIRSTNPVATEQYGSVETNLTQEHGNNQ

SEQ ID NO: 56697 - protein, 29 aa, Artificial Sequence
  Description of Artificial Sequence: Synthetic peptide
SQEEIRTTNPVATEQWGCVSVPDLQEGNG

SEQ ID NO: 56698 - protein, 29 aa, Artificial Sequence
  Description of Artificial Sequence: Synthetic peptide
SQEEIRTTNPVATEQWGMTVVWNLEEGNR

SEQ ID NO: 56699 - protein, 31 aa, Artificial Sequence
  Description of Artificial Sequence: Synthetic polypeptide
SQEEIRTTNPVATEQWGTVCSTENLQNGNQA

SEQ ID NO: 56700 - protein, 31 aa, Artificial Sequence
  Description of Artificial Sequence: Synthetic polypeptide
SSEEIRTTNPVATDQYGSVSTTGGQRGQGNF

SEQ ID NO: 56701 - protein, 30 aa, Artificial Sequence
  Description of Artificial Sequence: Synthetic polypeptide
SSEEIRTTNPVATDQYGSVVTGGQERGDNF

SEQ ID NO: 56702 - protein, 31 aa, Artificial Sequence
  Description of Artificial Sequence: Synthetic polypeptide
SSEEIRTTNPVATEAWGTVSCTNLQETGGNR

SEQ ID NO: 56703 - protein, 32 aa, Artificial Sequence
  Description of Artificial Sequence: Synthetic polypeptide
SSEEIRTTNPVATEQWGTVPSCTNMLQEGGNR

SEQ ID NO: 56704 - protein, 30 aa, Artificial Sequence
  Description of Artificial Sequence: Synthetic polypeptide
SSEEIRTTNPVATHQYGCVCSTELQNGSNA

SEQ ID NO: 56705 - protein, 33 aa, Artificial Sequence
  Description of Artificial Sequence: Synthetic polypeptide
DEEEIRTTNPVATEQYGCVCSTENLQNFGSQQS

SEQ ID NO: 56706 - protein, 30 aa, Artificial Sequence
  Description of Artificial Sequence: Synthetic polypeptide
SSEEIRTTNPVATHQYGCVSTELQRGSEFS

SEQ ID NO: 56707 - protein, 30 aa, Artificial Sequence
  Description of Artificial Sequence: Synthetic polypeptide
SSEEIRTTNPVATHQYGCVSTELQSGSNQS

SEQ ID NO: 56708 - protein, 29 aa, Artificial Sequence
  Description of Artificial Sequence: Synthetic peptide
SSEEIRTTNPVATHQYGCVSWELQNGSNQ

SEQ ID NO: 56709 - protein, 30 aa, Artificial Sequence
  Description of Artificial Sequence: Synthetic polypeptide
SSEEIRTTNPVATHQYGSVCSTETQNGSNF

SEQ ID NO: 56710 - protein, 34 aa, Artificial Sequence
  Description of Artificial Sequence: Synthetic polypeptide
DEEEIRTTNPVATEQYGCVCSTENLQFGGSNTQQ

SEQ ID NO: 56711 - protein, 34 aa, Artificial Sequence
  Description of Artificial Sequence: Synthetic polypeptide
DEEEIRTTNPVATEQYGCVCSTENLQEYFGSNDA

SEQ ID NO: 56712 - protein, 34 aa, Artificial Sequence
  Description of Artificial Sequence: Synthetic polypeptide
DEEEIRTTNPVATEQYGCVCSTENLQESGGSNQQ

SEQ ID NO: 56713 - protein, 31 aa, Artificial Sequence
  Description of Artificial Sequence: Synthetic polypeptide
SSEEIRTTNPVATHQYGSVSPTWLQSGENFE

SEQ ID NO: 56714 - protein, 32 aa, Artificial Sequence
  Description of Artificial Sequence: Synthetic polypeptide
SSEEIRTTNPVATHQYGSVSTVELSQRGGNNE

SEQ ID NO: 56715 - protein, 31 aa, Artificial Sequence
  Description of Artificial Sequence: Synthetic polypeptide
SSEEIRTTNPVATDQYGSVSTTGGQERGNEF

SEQ ID NO: 56716 - protein, 32 aa, Artificial Sequence
  Description of Artificial Sequence: Synthetic polypeptide
SSEEIRTTNPVATDQYGSVSTNGGEQRGQNEF

SEQ ID NO: 56717 - protein, 30 aa, Artificial Sequence
  Description of Artificial Sequence: Synthetic polypeptide
SSEEIRTTNPVATDQYGSVSTGGQGGENNF

SEQ ID NO: 56718 - protein, 30 aa, Artificial Sequence
  Description of Artificial Sequence: Synthetic polypeptide
SSEEIRTTNPVATDQYGSVSTGGQEGGDNI

SEQ ID NO: 56719 - protein, 32 aa, Artificial Sequence
  Description of Artificial Sequence: Synthetic polypeptide
SQEEIRTTNPVATEQWGTVCSTGNLQYFGSNR

SEQ ID NO: 56720 - protein, 31 aa, Artificial Sequence
  Description of Artificial Sequence: Synthetic polypeptide
SQEEIRTTNPVATEQWGTVSETNQQEGNLRA

SEQ ID NO: 56721 - protein, 30 aa, Artificial Sequence
  Description of Artificial Sequence: Synthetic polypeptide
SQEEIRTTNPVATEQWGTVSTNLQHFGSQA

SEQ ID NO: 56722 - protein, 31 aa, Artificial Sequence
  Description of Artificial Sequence: Synthetic polypeptide
SQEEIRTTNPVATEQWGTVSTNLQNFGSNNA

SEQ ID NO: 56723 - protein, 29 aa, Artificial Sequence
  Description of Artificial Sequence: Synthetic peptide
SQGEIRTTNPVATEQWGCVSTNLQEINDS

SEQ ID NO: 56724 - protein, 29 aa, Artificial Sequence
  Description of Artificial Sequence: Synthetic peptide
SQHEIRTTNPVATEQWGTVSWNLDEEGNR

SEQ ID NO: 56725 - protein, 30 aa, Artificial Sequence
  Description of Artificial Sequence: Synthetic polypeptide
SSEEIATTNPVATTCYGSVSTWDLDQRGNF

SEQ ID NO: 56726 - protein, 31 aa, Artificial Sequence
  Description of Artificial Sequence: Synthetic polypeptide
DEEEIRTTNPVATEQYGCVCSTGATQNGSEQ

SEQ ID NO: 56727 - protein, 30 aa, Artificial Sequence
  Description of Artificial Sequence: Synthetic polypeptide
SSEEIRGTNPVATWQYGSVSTVLQQRGVVN

SEQ ID NO: 56728 - protein, 32 aa, Artificial Sequence
  Description of Artificial Sequence: Synthetic polypeptide
DEEEIRTTNPVATEQYGCVCSTENLQYNSDQM

SEQ ID NO: 56729 - protein, 30 aa, Artificial Sequence
  Description of Artificial Sequence: Synthetic polypeptide
SSEEIRTTNPVATDQWGCVSTWDLDQRGNF

SEQ ID NO: 56730 - protein, 33 aa, Artificial Sequence
  Description of Artificial Sequence: Synthetic polypeptide
DEEEIRTTNPVATEQYGCVCSTENLQYFNSDQQ

SEQ ID NO: 56731 - protein, 31 aa, Artificial Sequence
  Description of Artificial Sequence: Synthetic polypeptide
SSEEIRTTNPVATDQYGCVSTWDLDQRGNAS

SEQ ID NO: 56732 - protein, 31 aa, Artificial Sequence
  Description of Artificial Sequence: Synthetic polypeptide
SSEEIRTTNPVATDQYGSVSPTWLQRGFEFN

SEQ ID NO: 56733 - protein, 31 aa, Artificial Sequence
  Description of Artificial Sequence: Synthetic polypeptide
SSEEIRTTNPVATDQYGSVSPTWLQRGSQFD

SEQ ID NO: 56734 - protein, 30 aa, Artificial Sequence
  Description of Artificial Sequence: Synthetic polypeptide
SSEEIRTTNPVATDQYGSVSTGGQDEGNVF

SEQ ID NO: 56735 - protein, 30 aa, Artificial Sequence
  Description of Artificial Sequence: Synthetic polypeptide
SSEEIRTTNPVATAQYGSVSWWLERMGNNF

SEQ ID NO: 56736 - protein, 33 aa, Artificial Sequence
  Description of Artificial Sequence: Synthetic polypeptide
DEEEIRTTNPVATEQYGCVCSTNLQEGFISDQA

SEQ ID NO: 56737 - protein, 29 aa, Artificial Sequence
  Description of Artificial Sequence: Synthetic peptide
SETEIRCTNPVATEQYGSVYTVDQHGNTQ

SEQ ID NO: 56738 - protein, 33 aa, Artificial Sequence
  Description of Artificial Sequence: Synthetic polypeptide
DEEEIRTTNPVATEQYGCVCSTGEDQRFGSNPQ

SEQ ID NO: 56739 - protein, 32 aa, Artificial Sequence
  Description of Artificial Sequence: Synthetic polypeptide
SESEIRTTNPVATEQWGSVSEINEQDREGENR

SEQ ID NO: 56740 - protein, 32 aa, Artificial Sequence
  Description of Artificial Sequence: Synthetic polypeptide
DEEEIRTTNPVATEQYGCVCSTGNTQFFNSEQ

SEQ ID NO: 56741 - protein, 33 aa, Artificial Sequence
  Description of Artificial Sequence: Synthetic polypeptide
DEEEIRTTNPVATEQYGCVCSTGNTQENGSNAS

SEQ ID NO: 56742 - protein, 33 aa, Artificial Sequence
  Description of Artificial Sequence: Synthetic polypeptide
DEEEIRTTNPVATEQYGCVCSTGNTQEGGSNDS

SEQ ID NO: 56743 - protein, 32 aa, Artificial Sequence
  Description of Artificial Sequence: Synthetic polypeptide
DEEEIRTTNPVATEQYGCVCSTGNPQNGSQQQ

SEQ ID NO: 56744 - protein, 33 aa, Artificial Sequence
  Description of Artificial Sequence: Synthetic polypeptide
DEEEIRTTNPVATEQYGCVCSTGNPQFGGSNQS

SEQ ID NO: 56745 - protein, 33 aa, Artificial Sequence
  Description of Artificial Sequence: Synthetic polypeptide
DEEEIRTTNPVATEQYGCVCSTGNPQEGGSNQG

SEQ ID NO: 56746 - protein, 34 aa, Artificial Sequence
  Description of Artificial Sequence: Synthetic polypeptide
DEEEIRTTNPVATEQYGCVCSTGNLQSFGSEDRS

SEQ ID NO: 56747 - protein, 33 aa, Artificial Sequence
  Description of Artificial Sequence: Synthetic polypeptide
DEEEIRTTNPVATEQYGCVCSTGNLQNSGSEQS

SEQ ID NO: 56748 - protein, 33 aa, Artificial Sequence
  Description of Artificial Sequence: Synthetic polypeptide
DEEEIRTTNPVATEQYGCVCSTGNLQNSGSEAG

SEQ ID NO: 56749 - protein, 33 aa, Artificial Sequence
  Description of Artificial Sequence: Synthetic polypeptide
DEEEIRTTNPVATEQYGCVCSTGNLQGFMSNDA

SEQ ID NO: 56750 - protein, 33 aa, Artificial Sequence
  Description of Artificial Sequence: Synthetic polypeptide
DEEEIRTTNPVATEQYGCVCSTGNLQGFGSQAG

SEQ ID NO: 56751 - protein, 33 aa, Artificial Sequence
  Description of Artificial Sequence: Synthetic polypeptide
DEEEIRTTNPVATEQYGCVCSTGNLQGFGSEVA

SEQ ID NO: 56752 - protein, 32 aa, Artificial Sequence
  Description of Artificial Sequence: Synthetic polypeptide
DEEEIRTTNPVATEQYGCVCSTGNLQFQSDQA

SEQ ID NO: 56753 - protein, 28 aa, Artificial Sequence
  Description of Artificial Sequence: Synthetic peptide
SESEVACTNPISTEGYGSVSNNLQRGNR

SEQ ID NO: 56754 - protein, 32 aa, Artificial Sequence
  Description of Artificial Sequence: Synthetic polypeptide
SESEIRTTNPVATEQWGSVSCINLQDREGENG

SEQ ID NO: 56755 - protein, 33 aa, Artificial Sequence
  Description of Artificial Sequence: Synthetic polypeptide
DEEEIRTTNPVATEQYGCVCSTGNLQFFNSDAE

SEQ ID NO: 56756 - protein, 31 aa, Artificial Sequence
  Description of Artificial Sequence: Synthetic polypeptide
SESEIRTTNPVATEQWGSVSCINEPQRGENG

SEQ ID NO: 56757 - protein, 30 aa, Artificial Sequence
  Description of Artificial Sequence: Synthetic polypeptide
SESEIRSTNPVAYEQYGSVFCTNLQHVGNQ

SEQ ID NO: 56758 - protein, 32 aa, Artificial Sequence
  Description of Artificial Sequence: Synthetic polypeptide
DEEEIRTTNPVATEQYGCVCSTMEHQNGSNQE

SEQ ID NO: 56759 - protein, 32 aa, Artificial Sequence
  Description of Artificial Sequence: Synthetic polypeptide
DEEEIRTTNPVATEQYGCVCSTMEHQIFGSNQ

SEQ ID NO: 56760 - protein, 33 aa, Artificial Sequence
  Description of Artificial Sequence: Synthetic polypeptide
DEEEIRTTNPVATEQYGCVCSTMALQNFGSNQM

SEQ ID NO: 56761 - protein, 33 aa, Artificial Sequence
  Description of Artificial Sequence: Synthetic polypeptide
DEEEIRTTNPVATEQYGCVCSTMAHQRFGSNQA

SEQ ID NO: 56762 - protein, 33 aa, Artificial Sequence
  Description of Artificial Sequence: Synthetic polypeptide
DEEEIRTTNPVATEQYGCVCSTINLQGFGSDQI

SEQ ID NO: 56763 - protein, 31 aa, Artificial Sequence
  Description of Artificial Sequence: Synthetic polypeptide
SESEIRCTNPVATECYGSVSCINEQDREGNR

SEQ ID NO: 56764 - protein, 33 aa, Artificial Sequence
  Description of Artificial Sequence: Synthetic polypeptide
DEEEIRTTNPVATEQYGCVCSTGPLQRSGSEQA

SEQ ID NO: 56765 - protein, 32 aa, Artificial Sequence
  Description of Artificial Sequence: Synthetic polypeptide
DEEEIRTTNPVATEQYGCVCSTGPLANGSNQS

SEQ ID NO: 56766 - protein, 30 aa, Artificial Sequence
  Description of Artificial Sequence: Synthetic polypeptide
SESEIRCTNPVATEQWGSVSENEMDRGENR

SEQ ID NO: 56767 - protein, 29 aa, Artificial Sequence
  Description of Artificial Sequence: Synthetic peptide
SESEIRSTNPIATEGYGSVSETLQRVGQR

SEQ ID NO: 56768 - protein, 32 aa, Artificial Sequence
  Description of Artificial Sequence: Synthetic polypeptide
DEEEIRTTNPVATEQYGCVCSTGNTQYFGSEQ

SEQ ID NO: 56769 - protein, 29 aa, Artificial Sequence
  Description of Artificial Sequence: Synthetic peptide
SESEIRSTNPIATEQYGSVSETIMRVGNR

SEQ ID NO: 56770 - protein, 32 aa, Artificial Sequence
  Description of Artificial Sequence: Synthetic polypeptide
DEEEIRTTNPVATEQYGCVCSTGNTQGGSEQS

SEQ ID NO: 56771 - protein, 29 aa, Artificial Sequence
  Description of Artificial Sequence: Synthetic peptide
SESEIRSTNPVATEQYGNVSETIMRVGNR

SEQ ID NO: 56772 - protein, 30 aa, Artificial Sequence
  Description of Artificial Sequence: Synthetic polypeptide
SESEIRSTNPVATEQYGNVSETIMSRVGNR

SEQ ID NO: 56773 - protein, 28 aa, Artificial Sequence
  Description of Artificial Sequence: Synthetic peptide
SESEIRSTNPVGTEQYGVMASNLQRGNI

SEQ ID NO: 56774 - protein, 33 aa, Artificial Sequence
  Description of Artificial Sequence: Synthetic polypeptide
DEEEIRTTNPVATEQYGCVCSTGNLQFFISNAE

SEQ ID NO: 56775 - protein, 29 aa, Artificial Sequence
  Description of Artificial Sequence: Synthetic peptide
SETEIRCTNPIATECYGSVSENLMPGNYR

SEQ ID NO: 56776 - protein, 29 aa, Artificial Sequence
  Description of Artificial Sequence: Synthetic peptide
SETEIRCTNPIATEQWGSVWSENLARGPR

SEQ ID NO: 56777 - protein, 32 aa, Artificial Sequence
  Description of Artificial Sequence: Synthetic polypeptide
DEEEIRTTNPVATEQYGCVCSTGNDHQFGSDA

SEQ ID NO: 56778 - protein, 32 aa, Artificial Sequence
  Description of Artificial Sequence: Synthetic polypeptide
DEEEIRTTNPVATEQYGCVCSTGELTNFGSNA

SEQ ID NO: 56779 - protein, 33 aa, Artificial Sequence
  Description of Artificial Sequence: Synthetic polypeptide
DEEEIRTTNPVATEQYGCVCSTGELQYFGSNQN

SEQ ID NO: 56780 - protein, 33 aa, Artificial Sequence
  Description of Artificial Sequence: Synthetic polypeptide
DEEEIRTTNPVATEQYGCVCSTGELQFFGSNAA

SEQ ID NO: 56781 - protein, 33 aa, Artificial Sequence
  Description of Artificial Sequence: Synthetic polypeptide
DEEEIRTTNPVATEQYGCVCSTGELNQNGSNQN

SEQ ID NO: 56782 - protein, 32 aa, Artificial Sequence
  Description of Artificial Sequence: Synthetic polypeptide
DEEEIRTTNPVATEQYGCVCSTGELEGGSNQG

SEQ ID NO: 56783 - protein, 32 aa, Artificial Sequence
  Description of Artificial Sequence: Synthetic polypeptide
DEEEIRTTNPVATEQYGCVCSTGEHQTFGSNA

SEQ ID NO: 56784 - protein, 30 aa, Artificial Sequence
  Description of Artificial Sequence: Synthetic polypeptide
SETEIRCTNPVATEQYGSVYCNELQHDGNQ

SEQ ID NO: 56785 - protein, 30 aa, Artificial Sequence
  Description of Artificial Sequence: Synthetic polypeptide
SETEIRCTNPVATEQYGSVYITDLQHDGNQ

SEQ ID NO: 56786 - protein, 30 aa, Artificial Sequence
  Description of Artificial Sequence: Synthetic polypeptide
SETEIRCTNPVATEQYGSVYTENDQDHGNQ

SEQ ID NO: 56787 - protein, 33 aa, Artificial Sequence
  Description of Artificial Sequence: Synthetic polypeptide
DEEEIRTTNPVATEQYGCVCSTGEHQRFNSNRT

SEQ ID NO: 56788 - protein, 31 aa, Artificial Sequence
  Description of Artificial Sequence: Synthetic polypeptide
SETEIRCTNPVATEQYGSVYTNLQDHNGNTQ

SEQ ID NO: 56789 - protein, 32 aa, Artificial Sequence
  Description of Artificial Sequence: Synthetic polypeptide
DEEEIRTTNPVATEQYGCVCSTGEHQNGSENQ

SEQ ID NO: 56790 - protein, 33 aa, Artificial Sequence
  Description of Artificial Sequence: Synthetic polypeptide
DEEEIRTTNPVATEQYGCVCSTGEHNQGFGSNR

SEQ ID NO: 56791 - protein, 32 aa, Artificial Sequence
  Description of Artificial Sequence: Synthetic polypeptide
DEEEIRTTNPVATEQYGCVCSTGEHFQNGSNQ

SEQ ID NO: 56792 - protein, 35 aa, Artificial Sequence
  Description of Artificial Sequence: Synthetic polypeptide
DEEEIRTTNPVATEQYGCVCSTGNDLEQRFGSNQY

SEQ ID NO: 56793 - protein, 33 aa, Artificial Sequence
  Description of Artificial Sequence: Synthetic polypeptide
DEEEIRTTNPVATEQYGCVCSTGNDQYFGSNAP

SEQ ID NO: 56794 - protein, 33 aa, Artificial Sequence
  Description of Artificial Sequence: Synthetic polypeptide
DEEEIRTTNPVATEQYGCVCSTGNHQENGSNQE

SEQ ID NO: 56795 - protein, 33 aa, Artificial Sequence
  Description of Artificial Sequence: Synthetic polypeptide
DEEEIRTTNPVATEQYGCVCSTGNHQFFGSNAM

SEQ ID NO: 56796 - protein, 34 aa, Artificial Sequence
  Description of Artificial Sequence: Synthetic polypeptide
DEEEIRTTNPVATEQYGCVCSTGNLQEGIGSNQA

SEQ ID NO: 56797 - protein, 33 aa, Artificial Sequence
  Description of Artificial Sequence: Synthetic polypeptide
DEEEIRTTNPVATEQYGCVCSTGNLQEGGSQQN

SEQ ID NO: 56798 - protein, 34 aa, Artificial Sequence
  Description of Artificial Sequence: Synthetic polypeptide
DEEEIRTTNPVATEQYGCVCSTGNLQEGFNSNQM

SEQ ID NO: 56799 - protein, 33 aa, Artificial Sequence
  Description of Artificial Sequence: Synthetic polypeptide
DEEEIRTTNPVATEQYGCVCSTGNLDESFGSNQ

SEQ ID NO: 56800 - protein, 33 aa, Artificial Sequence
  Description of Artificial Sequence: Synthetic polypeptide
DEEEIRTTNPVATEQYGCVCSTGNLANSGSNQE

SEQ ID NO: 56801 - protein, 32 aa, Artificial Sequence
  Description of Artificial Sequence: Synthetic polypeptide
DEEEIRTTNPVATEQYGCVCSTGNLANFNSNQ

SEQ ID NO: 56802 - protein, 33 aa, Artificial Sequence
  Description of Artificial Sequence: Synthetic polypeptide
DEEEIRTTNPVATEQYGCVCSTGNHQYSGSNQE

SEQ ID NO: 56803 - protein, 32 aa, Artificial Sequence
  Description of Artificial Sequence: Synthetic polypeptide
DEEEIRTTNPVATEQYGCVCSTGEDQGGSNQM

SEQ ID NO: 56804 - protein, 33 aa, Artificial Sequence
  Description of Artificial Sequence: Synthetic polypeptide
DEEEIRTTNPVATEQYGCVCSTGNHQYFGSNTQ

SEQ ID NO: 56805 - protein, 33 aa, Artificial Sequence
  Description of Artificial Sequence: Synthetic polypeptide
DEEEIRTTNPVATEQYGCVCSTGNHQHSGSNQL

SEQ ID NO: 56806 - protein, 32 aa, Artificial Sequence
  Description of Artificial Sequence: Synthetic polypeptide
DEEEIRTTNPVATEQYGCVCSTGNHQHNSERT

SEQ ID NO: 56807 - protein, 32 aa, Artificial Sequence
  Description of Artificial Sequence: Synthetic polypeptide
DEEEIRTTNPVATEQYGCVCSTGNHQGGSDQS

SEQ ID NO: 56808 - protein, 29 aa, Artificial Sequence
  Description of Artificial Sequence: Synthetic peptide
SETEIRCTNPIATEQYGSVWSEDWARGNR

SEQ ID NO: 56809 - protein, 30 aa, Artificial Sequence
  Description of Artificial Sequence: Synthetic polypeptide
SETEIRCTNPIATEQYGSVWSENLMPGNYR

SEQ ID NO: 56810 - protein, 32 aa, Artificial Sequence
  Description of Artificial Sequence: Synthetic polypeptide
DEEEIRTTNPVATEQYGCVCSTGNHQFLGSEQ

SEQ ID NO: 56811 - protein, 33 aa, Artificial Sequence
  Description of Artificial Sequence: Synthetic polypeptide
DEEEIRTTNPVATEQYGCVCSTGNHQFFGSNQA

SEQ ID NO: 56812 - protein, 33 aa, Artificial Sequence
  Description of Artificial Sequence: Synthetic polypeptide
DEEEIRTTNPVATEQYGCVCSTGNHQRSGSDQS

SEQ ID NO: 56813 - protein, 30 aa, Artificial Sequence
  Description of Artificial Sequence: Synthetic polypeptide
SSEEIRTTNPVATTQYGEVSTWDGGQRGNF

SEQ ID NO: 56814 - protein, 30 aa, Artificial Sequence
  Description of Artificial Sequence: Synthetic polypeptide
SEEEIRTTNPVGTEQWGSVSTVELGRGPME

SEQ ID NO: 56815 - protein, 34 aa, Artificial Sequence
  Description of Artificial Sequence: Synthetic polypeptide
DEEEIRTTNPVATEQYGCVCSTNLQENSGSENQG

SEQ ID NO: 56816 - protein, 31 aa, Artificial Sequence
  Description of Artificial Sequence: Synthetic polypeptide
SEEEIRCTNPVATEQYGSVATNLTAEGSNEE

SEQ ID NO: 56817 - protein, 31 aa, Artificial Sequence
  Description of Artificial Sequence: Synthetic polypeptide
SEEEIRCTNPVATEQYGSVSEPNGMMRGNPV

SEQ ID NO: 56818 - protein, 31 aa, Artificial Sequence
  Description of Artificial Sequence: Synthetic polypeptide
SEEEIRCTNPVATEQYGSVSSENGNRNGNPV

SEQ ID NO: 56819 - protein, 32 aa, Artificial Sequence
  Description of Artificial Sequence: Synthetic polypeptide
SEEEIRCTNPVATEQYGSVSSTENGNRNGNPV

SEQ ID NO: 56820 - protein, 32 aa, Artificial Sequence
  Description of Artificial Sequence: Synthetic polypeptide
SEEEIRCTNPVATEQYGSVSSTPNGMMRGNPV

SEQ ID NO: 56821 - protein, 30 aa, Artificial Sequence
  Description of Artificial Sequence: Synthetic polypeptide
SEEEIRCTNPVATEQYGTVSEDNPMREGND

SEQ ID NO: 56822 - protein, 32 aa, Artificial Sequence
  Description of Artificial Sequence: Synthetic polypeptide
DEEEIRTTNPVATEQYGCVDSTEHQSFGSNQI

SEQ ID NO: 56823 - protein, 32 aa, Artificial Sequence
  Description of Artificial Sequence: Synthetic polypeptide
DEEEIRTTNPVATEQYGCVDSTEEHQRFGSQD

SEQ ID NO: 56824 - protein, 33 aa, Artificial Sequence
  Description of Artificial Sequence: Synthetic polypeptide
DEEEIRTTNPVATEQYGCVDSTEEHQRFGSNAA

SEQ ID NO: 56825 - protein, 32 aa, Artificial Sequence
  Description of Artificial Sequence: Synthetic polypeptide
DEEEIRTTNPVATEQYGCVDSTEEHQENGSND

SEQ ID NO: 56826 - protein, 32 aa, Artificial Sequence
  Description of Artificial Sequence: Synthetic polypeptide
DEEEIRTTNPVATEQYGCVCYTNLQNFGSDQT

SEQ ID NO: 56827 - protein, 28 aa, Artificial Sequence
  Description of Artificial Sequence: Synthetic peptide
SEEEIRCTNPVSTEPYGSVSEDLMQGNH

SEQ ID NO: 56828 - protein, 29 aa, Artificial Sequence
  Description of Artificial Sequence: Synthetic peptide
SEEEIRGTNPAATEQYGSVVSENGMGGNG

SEQ ID NO: 56829 - protein, 28 aa, Artificial Sequence
  Description of Artificial Sequence: Synthetic peptide
SEEEIRSTNPISTEQYGSVAENIMRGQR

SEQ ID NO: 56830 - protein, 33 aa, Artificial Sequence
  Description of Artificial Sequence: Synthetic polypeptide
DEEEIRTTNPVATEQYGCVCSYTNLQNFGSDQS

SEQ ID NO: 56831 - protein, 28 aa, Artificial Sequence
  Description of Artificial Sequence: Synthetic peptide
SEEEIRCTNPVATEQYGEASEVLQHEER

SEQ ID NO: 56832 - protein, 32 aa, Artificial Sequence
  Description of Artificial Sequence: Synthetic polypeptide
DEEEIRTTNPVATEQYGCVCSWNTQRSGSEQP

SEQ ID NO: 56833 - protein, 28 aa, Artificial Sequence
  Description of Artificial Sequence: Synthetic peptide
SEEEIRCTNPVATEQYGEAPEVLMRGER

SEQ ID NO: 56834 - protein, 29 aa, Artificial Sequence
  Description of Artificial Sequence: Synthetic peptide
SEEEIRCTNPVATEQYGDVSENLMAAEDR

SEQ ID NO: 56835 - protein, 30 aa, Artificial Sequence
  Description of Artificial Sequence: Synthetic polypeptide
DEEEIRTTNPVATEQYGCVIINHPAGRVNE

SEQ ID NO: 56836 - protein, 32 aa, Artificial Sequence
  Description of Artificial Sequence: Synthetic polypeptide
DEEEIRTTNPVATEQYGCVGWTNLNTGGMERH

SEQ ID NO: 56837 - protein, 31 aa, Artificial Sequence
  Description of Artificial Sequence: Synthetic polypeptide
SEEEIRCTNPISTEQYGSVSEENLQQRNGNH

SEQ ID NO: 56838 - protein, 30 aa, Artificial Sequence
  Description of Artificial Sequence: Synthetic polypeptide
SEEEIRCTNPISTEQYGSVSENLQQQNGNH

SEQ ID NO: 56839 - protein, 30 aa, Artificial Sequence
  Description of Artificial Sequence: Synthetic polypeptide
SEEEIRCTNPISTEQYGSVSMNLQQQNGNH

SEQ ID NO: 56840 - protein, 31 aa, Artificial Sequence
  Description of Artificial Sequence: Synthetic polypeptide
DEEEIRTTNPVATEQYGCVGTELQNFGSEQA

SEQ ID NO: 56841 - protein, 30 aa, Artificial Sequence
  Description of Artificial Sequence: Synthetic polypeptide
SEEEIRCTNPTATEQWGSVFSWENDMRGNR

SEQ ID NO: 56842 - protein, 30 aa, Artificial Sequence
  Description of Artificial Sequence: Synthetic polypeptide
SEEEIRCTNPTATEQYGAVSEMNGMRGNIR

SEQ ID NO: 56843 - protein, 31 aa, Artificial Sequence
  Description of Artificial Sequence: Synthetic polypeptide
SEEEIRCTNPTATEQYGSVSGENDMNRGGNR

SEQ ID NO: 56844 - protein, 32 aa, Artificial Sequence
  Description of Artificial Sequence: Synthetic polypeptide
SEEEIRCTNPVATECWGSVSCINLPQREGENR

SEQ ID NO: 56845 - protein, 30 aa, Artificial Sequence
  Description of Artificial Sequence: Synthetic polypeptide
SEEEIRCTNPVATECYGSVSENEPMRGENG

SEQ ID NO: 56846 - protein, 32 aa, Artificial Sequence
  Description of Artificial Sequence: Synthetic polypeptide
SEEEIRCTNPVATENYGSVSTNLQDITGTTRE

SEQ ID NO: 56847 - protein, 31 aa, Artificial Sequence
  Description of Artificial Sequence: Synthetic polypeptide
SEEEIRCTNPVATEQWGSVSCNEMDREGENR

SEQ ID NO: 56848 - protein, 32 aa, Artificial Sequence
  Description of Artificial Sequence: Synthetic polypeptide
SEEEIRCTNPVATEQWGSVSEINLQDREGENG

SEQ ID NO: 56849 - protein, 28 aa, Artificial Sequence
  Description of Artificial Sequence: Synthetic peptide
SEEEIRCTNPVATEQWGSVSENEMAGDA

SEQ ID NO: 56850 - protein, 28 aa, Artificial Sequence
  Description of Artificial Sequence: Synthetic peptide
SEEEIRCTNPVATEQYGEAPENLMHENR

SEQ ID NO: 56851 - protein, 28 aa, Artificial Sequence
  Description of Artificial Sequence: Synthetic peptide
SEEEIRCTNPISTEQYGNVAENIQRGQR

SEQ ID NO: 56852 - protein, 28 aa, Artificial Sequence
  Description of Artificial Sequence: Synthetic peptide
SEEEIRSTNPISTEQYGSVANNIMRGQR

SEQ ID NO: 56853 - protein, 33 aa, Artificial Sequence
  Description of Artificial Sequence: Synthetic polypeptide
SEEEIRSTNPVATEQYGSVSTNLQAVGYVNDDI

SEQ ID NO: 56854 - protein, 31 aa, Artificial Sequence
  Description of Artificial Sequence: Synthetic polypeptide
DEEEIRTTNPVATEQYGCVCSWNHINGSNQG

SEQ ID NO: 56855 - protein, 31 aa, Artificial Sequence
  Description of Artificial Sequence: Synthetic polypeptide
DEEEIRTTNPVATEQYGCVCSWNDQYFGSEQ

SEQ ID NO: 56856 - protein, 32 aa, Artificial Sequence
  Description of Artificial Sequence: Synthetic polypeptide
DEEEIRTTNPVATEQYGCVCSWGELQYGSNQS

SEQ ID NO: 56857 - protein, 33 aa, Artificial Sequence
  Description of Artificial Sequence: Synthetic polypeptide
SEEEIRTTNPIATEQYGSVSSENLNMRNGMNPR

SEQ ID NO: 56858 - protein, 32 aa, Artificial Sequence
  Description of Artificial Sequence: Synthetic polypeptide
DEEEIRTTNPVATEQYGCVCSWGELIRFGGNQ

SEQ ID NO: 56859 - protein, 34 aa, Artificial Sequence
  Description of Artificial Sequence: Synthetic polypeptide
SEEEIRTTNPIATEQYGSVSSTTNLNMRNGMNPR

SEQ ID NO: 56860 - protein, 30 aa, Artificial Sequence
  Description of Artificial Sequence: Synthetic polypeptide
SEEEIRTTNPIATEQYGTISEDLQQQQGNR

SEQ ID NO: 56861 - protein, 33 aa, Artificial Sequence
  Description of Artificial Sequence: Synthetic polypeptide
DEEEIRTTNPVATEQYGCVCSWENLQSFGSNQQ

SEQ ID NO: 56862 - protein, 31 aa, Artificial Sequence
  Description of Artificial Sequence: Synthetic polypeptide
SEEEIRTTNPVATAQYGSVCSNNLQEALGTG

SEQ ID NO: 56863 - protein, 33 aa, Artificial Sequence
  Description of Artificial Sequence: Synthetic polypeptide
SEEEIRTTNPVATEAYGSVSGSNGNMQRGENDR

SEQ ID NO: 56864 - protein, 32 aa, Artificial Sequence
  Description of Artificial Sequence: Synthetic polypeptide
DEEEIRTTNPVATEQYGCVCSWELQNGSENQV

SEQ ID NO: 56865 - protein, 31 aa, Artificial Sequence
  Description of Artificial Sequence: Synthetic polypeptide
DEEEIRTTNPVATEQYGCVCSWELQNFGSEV

SEQ ID NO: 56866 - protein, 32 aa, Artificial Sequence
  Description of Artificial Sequence: Synthetic polypeptide
DEEEIRTTNPVATEQYGCVCSWELQFFGSNQS

SEQ ID NO: 56867 - protein, 31 aa, Artificial Sequence
  Description of Artificial Sequence: Synthetic polypeptide
DEEEIRTTNPVATEQYGCVCSWEHQYGSNQA

SEQ ID NO: 56868 - protein, 31 aa, Artificial Sequence
  Description of Artificial Sequence: Synthetic polypeptide
DEEEIRTTNPVATEQYGCVCSWEHQNGSNVN

SEQ ID NO: 56869 - protein, 31 aa, Artificial Sequence
  Description of Artificial Sequence: Synthetic polypeptide
DEEEIRTTNPVATEQYGCVCSWNHQNGSQQE

SEQ ID NO: 56870 - protein, 31 aa, Artificial Sequence
  Description of Artificial Sequence: Synthetic polypeptide
SEEEIRSTNPVATEQYGSVHNVDQDRGSNSR

SEQ ID NO: 56871 - protein, 33 aa, Artificial Sequence
  Description of Artificial Sequence: Synthetic polypeptide
DEEEIRTTNPVATEQYGCVCSWNHQRFGSENAA

SEQ ID NO: 56872 - protein, 30 aa, Artificial Sequence
  Description of Artificial Sequence: Synthetic polypeptide
SEEEIRTTNPIATEQYGSISEDIQQQNGNR

SEQ ID NO: 56873 - protein, 31 aa, Artificial Sequence
  Description of Artificial Sequence: Synthetic polypeptide
DEEEIRTTNPVATEQYGCVCSWNPQNGSEQS

SEQ ID NO: 56874 - protein, 30 aa, Artificial Sequence
  Description of Artificial Sequence: Synthetic polypeptide
SEEEIRTTNPAATEQYGSVCTDLARGQGET

SEQ ID NO: 56875 - protein, 32 aa, Artificial Sequence
  Description of Artificial Sequence: Synthetic polypeptide
DEEEIRTTNPVATEQYGCVCSWNLQYFGSDQA

SEQ ID NO: 56876 - protein, 29 aa, Artificial Sequence
  Description of Artificial Sequence: Synthetic peptide
SEEEIRTTNPIATECYGSTVAENWMPGNR

SEQ ID NO: 56877 - protein, 30 aa, Artificial Sequence
  Description of Artificial Sequence: Synthetic polypeptide
SEEEIRTTNPIATECYGSVANENWMERGNR

SEQ ID NO: 56878 - protein, 29 aa, Artificial Sequence
  Description of Artificial Sequence: Synthetic peptide
SEEEIRTTNPIATEQWGSVSEILMNRGDA

SEQ ID NO: 56879 - protein, 32 aa, Artificial Sequence
  Description of Artificial Sequence: Synthetic polypeptide
DEEEIRTTNPVATEQYGCVCSWNLQNFGSDVS

SEQ ID NO: 56880 - protein, 32 aa, Artificial Sequence
  Description of Artificial Sequence: Synthetic polypeptide
DEEEIRTTNPVATEQYGCVCSWNLQHFGSEIS

SEQ ID NO: 56881 - protein, 32 aa, Artificial Sequence
  Description of Artificial Sequence: Synthetic polypeptide
DEEEIRTTNPVATEQYGCVCSWNLQFFGSDQS

SEQ ID NO: 56882 - protein, 32 aa, Artificial Sequence
  Description of Artificial Sequence: Synthetic polypeptide
DEEEIRTTNPVATEQYGCVCSWNLQEHFGSEA

SEQ ID NO: 56883 - protein, 32 aa, Artificial Sequence
  Description of Artificial Sequence: Synthetic polypeptide
DEEEIRTTNPVATEQYGCVCSWNLQEFFGSQQ

SEQ ID NO: 56884 - protein, 28 aa, Artificial Sequence
  Description of Artificial Sequence: Synthetic peptide
SEEEIRTTNPIATEQYGEAPEVCQRENR

SEQ ID NO: 56885 - protein, 32 aa, Artificial Sequence
  Description of Artificial Sequence: Synthetic polypeptide
DEEEIRTTNPVATEQYGCVCSWNLQAFGSEQM

SEQ ID NO: 56886 - protein, 28 aa, Artificial Sequence
  Description of Artificial Sequence: Synthetic peptide
SEEEIRTTNPIATEQYGEVSENCMHEER

SEQ ID NO: 56887 - protein, 33 aa, Artificial Sequence
  Description of Artificial Sequence: Synthetic polypeptide
DEEEIRTTNPVATEQYGCVCSWNLDQRFGSEQA

SEQ ID NO: 56888 - protein, 32 aa, Artificial Sequence
  Description of Artificial Sequence: Synthetic polypeptide
DEEEIRTTNPVATEQYGCVCSWNHQSGSENQS

SEQ ID NO: 56889 - protein, 28 aa, Artificial Sequence
  Description of Artificial Sequence: Synthetic peptide
SEEEIRCTNPIGTEGYGVVSETLMRGNR

SEQ ID NO: 56890 - protein, 32 aa, Artificial Sequence
  Description of Artificial Sequence: Synthetic polypeptide
DEEEIRTTNPVATEQYGCVITNLDFEIQEEER

SEQ ID NO: 56891 - protein, 32 aa, Artificial Sequence
  Description of Artificial Sequence: Synthetic polypeptide
DEEEIRTTNPVATEQYGCVNTNDHQHRGSEEE

SEQ ID NO: 56892 - protein, 32 aa, Artificial Sequence
  Description of Artificial Sequence: Synthetic polypeptide
DEEEIRTTNPVATEQYGCVSNTNHQSFGSEQD

SEQ ID NO: 56893 - protein, 32 aa, Artificial Sequence
  Description of Artificial Sequence: Synthetic polypeptide
DEEEIRTTNPVATEQYGCVSNTNGGVQERAAP

SEQ ID NO: 56894 - protein, 29 aa, Artificial Sequence
  Description of Artificial Sequence: Synthetic peptide
SEEEIRCTNPIATEQYGSVSENLMAAEDR

SEQ ID NO: 56895 - protein, 32 aa, Artificial Sequence
  Description of Artificial Sequence: Synthetic polypeptide
DEEEIRTTNPVATEQYGCVSNTNDNQYFGDFA

SEQ ID NO: 56896 - protein, 33 aa, Artificial Sequence
  Description of Artificial Sequence: Synthetic polypeptide
DEEEIRTTNPVATEQYGCVSNTGNHQNGGSNQG

SEQ ID NO: 56897 - protein, 31 aa, Artificial Sequence
  Description of Artificial Sequence: Synthetic polypeptide
SEEEIRCTNPIATEQYGSVSENLMMRGMNPV

SEQ ID NO: 56898 - protein, 31 aa, Artificial Sequence
  Description of Artificial Sequence: Synthetic polypeptide
DEEEIRTTNPVATEQYGCVSNTGEPQNGSDQ

SEQ ID NO: 56899 - protein, 33 aa, Artificial Sequence
  Description of Artificial Sequence: Synthetic polypeptide
DEEEIRTTNPVATEQYGCVSNTGELQFFGSNQE

SEQ ID NO: 56900 - protein, 31 aa, Artificial Sequence
  Description of Artificial Sequence: Synthetic polypeptide
DEEEIRTTNPVATEQYGCVSNTELQNNSEQF

SEQ ID NO: 56901 - protein, 30 aa, Artificial Sequence
  Description of Artificial Sequence: Synthetic polypeptide
SEEEIRCTNPIATEQYGSVSEVLMTGGNRQ

SEQ ID NO: 56902 - protein, 31 aa, Artificial Sequence
  Description of Artificial Sequence: Synthetic polypeptide
DEEEIRTTNPVATEQYGCVSNTEHQNNSNAT

SEQ ID NO: 56903 - protein, 33 aa, Artificial Sequence
  Description of Artificial Sequence: Synthetic polypeptide
DEEEIRTTNPVATEQYGCVSNTEEHQRFGSNQN

SEQ ID NO: 56904 - protein, 32 aa, Artificial Sequence
  Description of Artificial Sequence: Synthetic polypeptide
DEEEIRTTNPVATEQYGCVSNTEDLQFGSEQF

SEQ ID NO: 56905 - protein, 30 aa, Artificial Sequence
  Description of Artificial Sequence: Synthetic polypeptide
SEEEIRCTNPIATEQYGSVSGENDMGGGNR

SEQ ID NO: 56906 - protein, 31 aa, Artificial Sequence
  Description of Artificial Sequence: Synthetic polypeptide
SEEEIRCTNPIATEQYGSVSGENDMRAGNNR

SEQ ID NO: 56907 - protein, 34 aa, Artificial Sequence
  Description of Artificial Sequence: Synthetic polypeptide
DEEEIRTTNPVATEQYGCVSNTNLQEFFGSNTQE

SEQ ID NO: 56908 - protein, 31 aa, Artificial Sequence
  Description of Artificial Sequence: Synthetic polypeptide
SEEEIRCTNPIATEQYGSVSGENGDMRGNGR

SEQ ID NO: 56909 - protein, 32 aa, Artificial Sequence
  Description of Artificial Sequence: Synthetic polypeptide
SEEEIRCTNPIATEQYGSVSENALSTRGGNNR

SEQ ID NO: 56910 - protein, 31 aa, Artificial Sequence
  Description of Artificial Sequence: Synthetic polypeptide
SEEEIRCTNPIATEQYGSVSEMNLMRGLTDR

SEQ ID NO: 56911 - protein, 31 aa, Artificial Sequence
  Description of Artificial Sequence: Synthetic polypeptide
SEEEIRCTNPIATEQYGSVFSENDMRDGNDR

SEQ ID NO: 56912 - protein, 32 aa, Artificial Sequence
  Description of Artificial Sequence: Synthetic polypeptide
SEEEIRCTNPIATEQYGSVISFEMNLMRGNDR

SEQ ID NO: 56913 - protein, 31 aa, Artificial Sequence
  Description of Artificial Sequence: Synthetic polypeptide
SEEEIRCTNPIATEQYGSVNSEKNLFMRGGR

SEQ ID NO: 56914 - protein, 30 aa, Artificial Sequence
  Description of Artificial Sequence: Synthetic polypeptide
SEEEIRCTNPIATEQYGSVNSKEWLMRGNP

SEQ ID NO: 56915 - protein, 32 aa, Artificial Sequence
  Description of Artificial Sequence: Synthetic polypeptide
SEEEIRCTNPIATEQYGSVPSEGNLSMRGGNR

SEQ ID NO: 56916 - protein, 31 aa, Artificial Sequence
  Description of Artificial Sequence: Synthetic polypeptide
DEEEIRTTNPVATEQYGCVSSEDQNFGSNQA

SEQ ID NO: 56917 - protein, 29 aa, Artificial Sequence
  Description of Artificial Sequence: Synthetic peptide
SEEEIRCTNPIATEQYGSVQSMNPMLANR

SEQ ID NO: 56918 - protein, 30 aa, Artificial Sequence
  Description of Artificial Sequence: Synthetic polypeptide
SEEEIRCTNPIATEQYGSVSAENLMHGEDR

SEQ ID NO: 56919 - protein, 33 aa, Artificial Sequence
  Description of Artificial Sequence: Synthetic polypeptide
DEEEIRTTNPVATEQYGCVSNWGNLQFFGSNDG

SEQ ID NO: 56920 - protein, 31 aa, Artificial Sequence
  Description of Artificial Sequence: Synthetic polypeptide
SEEEIRCTNPIATEQYGSVSCINLPMDRGNG

SEQ ID NO: 56921 - protein, 30 aa, Artificial Sequence
  Description of Artificial Sequence: Synthetic polypeptide
SEEEIRCTNPIATEQYGSVSEDILMYGANR

SEQ ID NO: 56922 - protein, 30 aa, Artificial Sequence
  Description of Artificial Sequence: Synthetic polypeptide
SEEEIRCTNPIATEQYGSVSEDNPMREGND

SEQ ID NO: 56923 - protein, 29 aa, Artificial Sequence
  Description of Artificial Sequence: Synthetic peptide
SEEEIRCTNPIATEQYGSVSEENIMQGNH

SEQ ID NO: 56924 - protein, 30 aa, Artificial Sequence
  Description of Artificial Sequence: Synthetic polypeptide
SEEEIRCTNPIATEQYGSVSEENIMQNGNH

SEQ ID NO: 56925 - protein, 32 aa, Artificial Sequence
  Description of Artificial Sequence: Synthetic polypeptide
SEEEIRCTNPIATEQYGSVSEGNLSMRVGNNR

SEQ ID NO: 56926 - protein, 31 aa, Artificial Sequence
  Description of Artificial Sequence: Synthetic polypeptide
SEEEIRCTNPIATEQYGSVSEMNLMRMGNDL

SEQ ID NO: 56927 - protein, 31 aa, Artificial Sequence
  Description of Artificial Sequence: Synthetic polypeptide
SEEEIRCTNPIATEQYGSVSGENNDMRNGNR

SEQ ID NO: 56928 - protein, 32 aa, Artificial Sequence
  Description of Artificial Sequence: Synthetic polypeptide
DEEEIRTTNPVATEQYGCVSMTEHQNMGSNQS

SEQ ID NO: 56929 - protein, 31 aa, Artificial Sequence
  Description of Artificial Sequence: Synthetic polypeptide
SEEEIRCTNPIATEQYGSVSIEMNEMRGNDR

SEQ ID NO: 56930 - protein, 32 aa, Artificial Sequence
  Description of Artificial Sequence: Synthetic polypeptide
DEEEIRTTNPVATEQYGCVSCNLGQDDPQWQR

SEQ ID NO: 56931 - protein, 31 aa, Artificial Sequence
  Description of Artificial Sequence: Synthetic polypeptide
SEEEIRCTNPIATEQYGSVVSENHSTRGGNR

SEQ ID NO: 56932 - protein, 31 aa, Artificial Sequence
  Description of Artificial Sequence: Synthetic polypeptide
SEEEIRCTNPIATEQYGSVYSGENDMNRGNR

SEQ ID NO: 56933 - protein, 29 aa, Artificial Sequence
  Description of Artificial Sequence: Synthetic peptide
SEEEIRCTNPIATEQYGTISEDLQQQGNR

SEQ ID NO: 56934 - protein, 30 aa, Artificial Sequence
  Description of Artificial Sequence: Synthetic polypeptide
SEEEIRCTNPIATEQYGTISEENLMRNGNR

SEQ ID NO: 56935 - protein, 28 aa, Artificial Sequence
  Description of Artificial Sequence: Synthetic peptide
SEEEIRCTNPIATEQYGTISENIMQGNR

SEQ ID NO: 56936 - protein, 30 aa, Artificial Sequence
  Description of Artificial Sequence: Synthetic polypeptide
SEEEIRCTNPIATEQYGTVSAENLEREGND

SEQ ID NO: 56937 - protein, 30 aa, Artificial Sequence
  Description of Artificial Sequence: Synthetic polypeptide
SEEEIRCTNPIATEQYGTVSEGLVEREGNR

SEQ ID NO: 56938 - protein, 29 aa, Artificial Sequence
  Description of Artificial Sequence: Synthetic peptide
SEEEIRCTNPIATEQYGTVSMDLMQNGNH

SEQ ID NO: 56939 - protein, 31 aa, Artificial Sequence
  Description of Artificial Sequence: Synthetic polypeptide
SEEEIRCTNPIATEQYGVVSCENLSMRGGNR

SEQ ID NO: 56940 - protein, 30 aa, Artificial Sequence
  Description of Artificial Sequence: Synthetic polypeptide
SEEEIRCTNPIATEYYGSVSEMNGMRGNDR

SEQ ID NO: 56941 - protein, 28 aa, Artificial Sequence
  Description of Artificial Sequence: Synthetic peptide
SEEEIRCTNPIATQQYGSVSEEIMRNNR

SEQ ID NO: 56942 - protein, 31 aa, Artificial Sequence
  Description of Artificial Sequence: Synthetic polypeptide
SEEEIRCTNPIAYEQYGSTVSENLSTRVGNR

SEQ ID NO: 56943 - protein, 31 aa, Artificial Sequence
  Description of Artificial Sequence: Synthetic polypeptide
SEEEIRCTNPIAYEQYGSVSENELTRGGNNR

SEQ ID NO: 56944 - protein, 29 aa, Artificial Sequence
  Description of Artificial Sequence: Synthetic peptide
SEEEIRCTNPIAYEQYGSVSENLMRGAEA

SEQ ID NO: 56945 - protein, 31 aa, Artificial Sequence
  Description of Artificial Sequence: Synthetic polypeptide
SEEEIRCTNPIATEQYGSVVSAENQLMRGNI

SEQ ID NO: 56946 - protein, 31 aa, Artificial Sequence
  Description of Artificial Sequence: Synthetic polypeptide
SEEEIRCTNPIATEQYGSVVENLLMDRGSNR

SEQ ID NO: 56947 - protein, 32 aa, Artificial Sequence
  Description of Artificial Sequence: Synthetic polypeptide
DEEEIRTTNPVATEQYGCVSCTNHNQHFGGDF

SEQ ID NO: 56948 - protein, 30 aa, Artificial Sequence
  Description of Artificial Sequence: Synthetic polypeptide
SEEEIRCTNPIATEQYGSVSWNLMNGSNQQ

SEQ ID NO: 56949 - protein, 31 aa, Artificial Sequence
  Description of Artificial Sequence: Synthetic polypeptide
SEEEIRCTNPIATEQYGSVSIENDDMRGMNR

SEQ ID NO: 56950 - protein, 33 aa, Artificial Sequence
  Description of Artificial Sequence: Synthetic polypeptide
DEEEIRTTNPVATEQYGCVSGTNGHQERDMGRD

SEQ ID NO: 56951 - protein, 32 aa, Artificial Sequence
  Description of Artificial Sequence: Synthetic polypeptide
DEEEIRTTNPVATEQYGCVSGDYGMQRGGNTN

SEQ ID NO: 56952 - protein, 30 aa, Artificial Sequence
  Description of Artificial Sequence: Synthetic polypeptide
SEEEIRCTNPIATEQYGSVSSENGNRGNPV

SEQ ID NO: 56953 - protein, 32 aa, Artificial Sequence
  Description of Artificial Sequence: Synthetic polypeptide
DEEEIRTTNPVATEQYGCVSEQLDRGNDIDED

SEQ ID NO: 56954 - protein, 32 aa, Artificial Sequence
  Description of Artificial Sequence: Synthetic polypeptide
SEEEIRCTNPIATEQYGSVSSENLMRNGMNPR

SEQ ID NO: 56955 - protein, 32 aa, Artificial Sequence
  Description of Artificial Sequence: Synthetic polypeptide
SEEEIRCTNPIATEQYGSVSSENLNRNGMNPR

SEQ ID NO: 56956 - protein, 31 aa, Artificial Sequence
  Description of Artificial Sequence: Synthetic polypeptide
SEEEIRTTNPVATECYGSVSENEPMDRGENG

SEQ ID NO: 56957 - protein, 32 aa, Artificial Sequence
  Description of Artificial Sequence: Synthetic polypeptide
DEEEIRTTNPVATEQYGCVSDWELNQRSSNQS

SEQ ID NO: 56958 - protein, 29 aa, Artificial Sequence
  Description of Artificial Sequence: Synthetic peptide
SEEEIRCTNPIATEQYGSVSSNHMGGSNQ

SEQ ID NO: 56959 - protein, 30 aa, Artificial Sequence
  Description of Artificial Sequence: Synthetic polypeptide
SEEEIRCTNPIATEQYGSVSSNLARFGSDQ

SEQ ID NO: 56960 - protein, 29 aa, Artificial Sequence
  Description of Artificial Sequence: Synthetic peptide
SEEEIRCTNPIATEQYGSVSSNLMNGSDQ

SEQ ID NO: 56961 - protein, 33 aa, Artificial Sequence
  Description of Artificial Sequence: Synthetic polypeptide
DEEEIRTTNPVATEQYGCVSDTELNQRFSSNQM

SEQ ID NO: 56962 - protein, 32 aa, Artificial Sequence
  Description of Artificial Sequence: Synthetic polypeptide
DEEEIRTTNPVATEQYGCVSDTALNQNFSSNQ

SEQ ID NO: 56963 - protein, 32 aa, Artificial Sequence
  Description of Artificial Sequence: Synthetic polypeptide
SEEEIRCTNPIATEQYGSVSTEALPMMRGNPR

SEQ ID NO: 56964 - protein, 32 aa, Artificial Sequence
  Description of Artificial Sequence: Synthetic polypeptide
SEEEIRCTNPIATEQYGSVSTEALPNMRGNPR

SEQ ID NO: 56965 - protein, 30 aa, Artificial Sequence
  Description of Artificial Sequence: Synthetic polypeptide
SEEEIRCTNPIATEQYGSVSSNDMRFGSNQ

SEQ ID NO: 56966 - protein, 32 aa, Artificial Sequence
  Description of Artificial Sequence: Synthetic polypeptide
DEEEIRTTNPVATEQYGCVCSWEELQNSGSER

SEQ ID NO: 56967 - protein, 32 aa, Artificial Sequence
  Description of Artificial Sequence: Synthetic polypeptide
DEEEIRTTNPVATEQYGCVCSWEDQRFGSENQ

SEQ ID NO: 56968 - protein, 32 aa, Artificial Sequence
  Description of Artificial Sequence: Synthetic polypeptide
DEEEIRTTNPVATEQYGCVCSWEDLQNGSNQS

SEQ ID NO: 56969 - protein, 33 aa, Artificial Sequence
  Description of Artificial Sequence: Synthetic polypeptide
SEEEIRTTNPVATEQYGSVSSTEPNGNMRGNPV

SEQ ID NO: 56970 - protein, 34 aa, Artificial Sequence
  Description of Artificial Sequence: Synthetic polypeptide
DEEEIRTTNPVATEQYGCVCSTNNLQFSGSNNQG

SEQ ID NO: 56971 - protein, 33 aa, Artificial Sequence
  Description of Artificial Sequence: Synthetic polypeptide
SEEEIRTTNPVATEQYGSVSTGNLQHFNSNFAS

SEQ ID NO: 56972 - protein, 33 aa, Artificial Sequence
  Description of Artificial Sequence: Synthetic polypeptide
SEEEIRTTNPVATEQYGSVSTNILQNNSIEDRI

SEQ ID NO: 56973 - protein, 32 aa, Artificial Sequence
  Description of Artificial Sequence: Synthetic polypeptide
SEEEIRTTNPVATEQYGSVSTPAGPNRNGNPV

SEQ ID NO: 56974 - protein, 33 aa, Artificial Sequence
  Description of Artificial Sequence: Synthetic polypeptide
SEEEIRTTNPVATEQYGSVSTTNLQNNSGEDFI

SEQ ID NO: 56975 - protein, 34 aa, Artificial Sequence
  Description of Artificial Sequence: Synthetic polypeptide
DEEEIRTTNPVATEQYGCVCSTNNLQESFGSNNQ

SEQ ID NO: 56976 - protein, 32 aa, Artificial Sequence
  Description of Artificial Sequence: Synthetic polypeptide
SEEEIRTTNPVATEQYGSVSTWNFQTANENLS

SEQ ID NO: 56977 - protein, 33 aa, Artificial Sequence
  Description of Artificial Sequence: Synthetic polypeptide
SEEEIRTTNPVATEQYGSVSVTNLNDENISDQR

SEQ ID NO: 56978 - protein, 33 aa, Artificial Sequence
  Description of Artificial Sequence: Synthetic polypeptide
DEEEIRTTNPVATEQYGCVCSTNNHQFSGSDRV

SEQ ID NO: 56979 - protein, 32 aa, Artificial Sequence
  Description of Artificial Sequence: Synthetic polypeptide
SEEEIRTTNPVATEQYGSVWTMLHQQAGMNEL

SEQ ID NO: 56980 - protein, 32 aa, Artificial Sequence
  Description of Artificial Sequence: Synthetic polypeptide
SEEEIRTTNPVATEQYGSVWTSVLEQRGEQKE

SEQ ID NO: 56981 - protein, 33 aa, Artificial Sequence
  Description of Artificial Sequence: Synthetic polypeptide
DEEEIRTTNPVATEQYGCVCSTNNHQFFGSNAS

SEQ ID NO: 56982 - protein, 33 aa, Artificial Sequence
  Description of Artificial Sequence: Synthetic polypeptide
DEEEIRTTNPVATEQYGCVCSTNMTQNFGSNQS

SEQ ID NO: 56983 - protein, 32 aa, Artificial Sequence
  Description of Artificial Sequence: Synthetic polypeptide
SEEEIRTTNPVATEQYGSVYTVTNLQIVNDEN

SEQ ID NO: 56984 - protein, 34 aa, Artificial Sequence
  Description of Artificial Sequence: Synthetic polypeptide
DEEEIRTTNPVATEQYGCVCSTNNLQNFGSNNAV

SEQ ID NO: 56985 - protein, 33 aa, Artificial Sequence
  Description of Artificial Sequence: Synthetic polypeptide
SEEEIRTTNPVATEQYGTVSWVDNDQRQGMNNR

SEQ ID NO: 56986 - protein, 33 aa, Artificial Sequence
  Description of Artificial Sequence: Synthetic polypeptide
SEEEIRTTNPVATEQYGSVSSTEPALMRNGMNV

SEQ ID NO: 56987 - protein, 32 aa, Artificial Sequence
  Description of Artificial Sequence: Synthetic polypeptide
SEEEIRTTNPVATEQYGSVSITNGGQGGETFE

SEQ ID NO: 56988 - protein, 30 aa, Artificial Sequence
  Description of Artificial Sequence: Synthetic polypeptide
SEEEIRTTNPVATEQYGSVFLEADSQVGNN

SEQ ID NO: 56989 - protein, 30 aa, Artificial Sequence
  Description of Artificial Sequence: Synthetic polypeptide
SEEEIRTTNPVATEQYGSVMTNPSGMSNAW

SEQ ID NO: 56990 - protein, 34 aa, Artificial Sequence
  Description of Artificial Sequence: Synthetic polypeptide
DEEEIRTTNPVATEQYGCVCSTNPLQFFGSNNQM

SEQ ID NO: 56991 - protein, 33 aa, Artificial Sequence
  Description of Artificial Sequence: Synthetic polypeptide
DEEEIRTTNPVATEQYGCVCSTNPLIFFGSNQS

SEQ ID NO: 56992 - protein, 34 aa, Artificial Sequence
  Description of Artificial Sequence: Synthetic polypeptide
SEEEIRTTNPVATEQYGSVNETSNLDQRIGENYE

SEQ ID NO: 56993 - protein, 33 aa, Artificial Sequence
  Description of Artificial Sequence: Synthetic polypeptide
SEEEIRTTNPVATEQYGSVNTSNGLTQRDENYE

SEQ ID NO: 56994 - protein, 33 aa, Artificial Sequence
  Description of Artificial Sequence: Synthetic polypeptide
SEEEIRTTNPVATEQYGSVNTSNLDQEGENYEE

SEQ ID NO: 56995 - protein, 32 aa, Artificial Sequence
  Description of Artificial Sequence: Synthetic polypeptide
SEEEIRTTNPVATEQYGSVNTSNVDQDGENYE

SEQ ID NO: 56996 - protein, 32 aa, Artificial Sequence
  Description of Artificial Sequence: Synthetic polypeptide
SEEEIRTTNPVATEQYGSVSATDLEDREGEDL

SEQ ID NO: 56997 - protein, 31 aa, Artificial Sequence
  Description of Artificial Sequence: Synthetic polypeptide
SEEEIRTTNPVATEQYGSVSDEEIQYGEQER

SEQ ID NO: 56998 - protein, 32 aa, Artificial Sequence
  Description of Artificial Sequence: Synthetic polypeptide
SEEEIRTTNPVATEQYGSVSDTNGGQEGGGEF

SEQ ID NO: 56999 - protein, 33 aa, Artificial Sequence
  Description of Artificial Sequence: Synthetic polypeptide
SEEEIRTTNPVATEQYGSVSDTNGGQGEGNDND

SEQ ID NO: 57000 - protein, 32 aa, Artificial Sequence
  Description of Artificial Sequence: Synthetic polypeptide
SEEEIRTTNPVATEQYGSVSDTNGGQGGEETF

SEQ ID NO: 57001 - protein, 33 aa, Artificial Sequence
  Description of Artificial Sequence: Synthetic polypeptide
SEEEIRTTNPVATEQYGSVSDTNGGQGGNEQGD

SEQ ID NO: 57002 - protein, 32 aa, Artificial Sequence
  Description of Artificial Sequence: Synthetic polypeptide
SEEEIRTTNPVATEQYGSVSDTNGGQGQGEGE

SEQ ID NO: 57003 - protein, 31 aa, Artificial Sequence
  Description of Artificial Sequence: Synthetic polypeptide
SEEEIRTTNPVATEQYGSVSPWDNLDENNNE

SEQ ID NO: 57004 - protein, 32 aa, Artificial Sequence
  Description of Artificial Sequence: Synthetic polypeptide
DEEEIRTTNPVATEQYGCVCSTNLTENGSDDA

SEQ ID NO: 57005 - protein, 32 aa, Artificial Sequence
  Description of Artificial Sequence: Synthetic polypeptide
DEEEIRTTNPVATEQYGCVCSTNLQYSMSEQA

SEQ ID NO: 57006 - protein, 32 aa, Artificial Sequence
  Description of Artificial Sequence: Synthetic polypeptide
SEEEIRTTNPVATESYGNSVSATNLEWGDQRQ

SEQ ID NO: 57007 - protein, 31 aa, Artificial Sequence
  Description of Artificial Sequence: Synthetic polypeptide
SEEEIRTTNPVATESYGSVSNWNLHSGDQRD

SEQ ID NO: 57008 - protein, 32 aa, Artificial Sequence
  Description of Artificial Sequence: Synthetic polypeptide
DEEEIRTTNPVATEQYGCVCSTNLQHFISEQG

SEQ ID NO: 57009 - protein, 32 aa, Artificial Sequence
  Description of Artificial Sequence: Synthetic polypeptide
SEEEIRTTNPVATESYGSVVSNTNLIRGGDQT

SEQ ID NO: 57010 - protein, 30 aa, Artificial Sequence
  Description of Artificial Sequence: Synthetic polypeptide
SEEEIRTTNPVATESYGVVAGTNLARGDQA

SEQ ID NO: 57011 - protein, 30 aa, Artificial Sequence
  Description of Artificial Sequence: Synthetic polypeptide
SEEEIRTTNPVATESYGVVSNTNNHDGDQR

SEQ ID NO: 57012 - protein, 33 aa, Artificial Sequence
  Description of Artificial Sequence: Synthetic polypeptide
SEEEIRTTNPVATETYGSVPSNTNLEQWGDQNQ

SEQ ID NO: 57013 - protein, 32 aa, Artificial Sequence
  Description of Artificial Sequence: Synthetic polypeptide
SEEEIRTTNPVATEYYGSVCSNTNLARFGDTQ

SEQ ID NO: 57014 - protein, 32 aa, Artificial Sequence
  Description of Artificial Sequence: Synthetic polypeptide
SEEEIRTTNPVAYEAYGSISTNLSGRPGGNRF

SEQ ID NO: 57015 - protein, 32 aa, Artificial Sequence
  Description of Artificial Sequence: Synthetic polypeptide
SEEEIRTTNPVAYEPYGQSVSTNQSQRSGSRS

SEQ ID NO: 57016 - protein, 33 aa, Artificial Sequence
  Description of Artificial Sequence: Synthetic polypeptide
SEEEIRTTNPVAYEQWGSVYKTDNLDQRGENYR

SEQ ID NO: 57017 - protein, 33 aa, Artificial Sequence
  Description of Artificial Sequence: Synthetic polypeptide
SEEEIRTTNPVAYEQYGQSVSETNDLLQRGIEN

SEQ ID NO: 57018 - protein, 31 aa, Artificial Sequence
  Description of Artificial Sequence: Synthetic polypeptide
SEEEIRTTNPVAYEQYGSCNCTNLSGPGGNR

SEQ ID NO: 57019 - protein, 33 aa, Artificial Sequence
  Description of Artificial Sequence: Synthetic polypeptide
DEEEIRTTNPVATEQYGCVCSTNLQEYSGSEAG

SEQ ID NO: 57020 - protein, 32 aa, Artificial Sequence
  Description of Artificial Sequence: Synthetic polypeptide
DEEEIRTTNPVATEQYGCVCSTNLQEYISEQA

SEQ ID NO: 57021 - protein, 33 aa, Artificial Sequence
  Description of Artificial Sequence: Synthetic polypeptide
SEEEIRTTNPVAYEQYGSVSVTGFALSGRGGNR

SEQ ID NO: 57022 - protein, 32 aa, Artificial Sequence
  Description of Artificial Sequence: Synthetic polypeptide
SEEEIRTTNPVATESYGSVSNTWNLERGSDQD

SEQ ID NO: 57023 - protein, 33 aa, Artificial Sequence
  Description of Artificial Sequence: Synthetic polypeptide
DEEEIRTTNPVATEQYGCVCSTNLQNFNSQNQS

SEQ ID NO: 57024 - protein, 32 aa, Artificial Sequence
  Description of Artificial Sequence: Synthetic polypeptide
SEEEIRTTNPVATESYGSVSNTVNLHRGDQED

SEQ ID NO: 57025 - protein, 32 aa, Artificial Sequence
  Description of Artificial Sequence: Synthetic polypeptide
SEEEIRTTNPVATESYGSVSNTSNLEHRDGQG

SEQ ID NO: 57026 - protein, 32 aa, Artificial Sequence
  Description of Artificial Sequence: Synthetic polypeptide
SEEEIRTTNPVATESYGSCSNTNLHRENDQRD

SEQ ID NO: 57027 - protein, 32 aa, Artificial Sequence
  Description of Artificial Sequence: Synthetic polypeptide
SEEEIRTTNPVATESYGSVAATNLARPGDQRH

SEQ ID NO: 57028 - protein, 32 aa, Artificial Sequence
  Description of Artificial Sequence: Synthetic polypeptide
SEEEIRTTNPVATESYGSVANTNLVRDGDDRH

SEQ ID NO: 57029 - protein, 33 aa, Artificial Sequence
  Description of Artificial Sequence: Synthetic polypeptide
SEEEIRTTNPVATESYGSVCSNTVNLHRGDQRE

SEQ ID NO: 57030 - protein, 32 aa, Artificial Sequence
  Description of Artificial Sequence: Synthetic polypeptide
SEEEIRTTNPVATESYGSVSITNLVREGEDQN

SEQ ID NO: 57031 - protein, 32 aa, Artificial Sequence
  Description of Artificial Sequence: Synthetic polypeptide
SEEEIRTTNPVATESYGSVSITNLVREGGQGQ

SEQ ID NO: 57032 - protein, 31 aa, Artificial Sequence
  Description of Artificial Sequence: Synthetic polypeptide
SEEEIRTTNPVATESYGSVSNGNDHRGGDQR

SEQ ID NO: 57033 - protein, 31 aa, Artificial Sequence
  Description of Artificial Sequence: Synthetic polypeptide
SEEEIRTTNPVATEQYGSVEQTFNQSIANSR

SEQ ID NO: 57034 - protein, 31 aa, Artificial Sequence
  Description of Artificial Sequence: Synthetic polypeptide
SEEEIRTTNPVATESYGSVSNMNLHEGGDQR

SEQ ID NO: 57035 - protein, 33 aa, Artificial Sequence
  Description of Artificial Sequence: Synthetic polypeptide
DEEEIRTTNPVATEQYGCVCSTNLQSFNSETQM

SEQ ID NO: 57036 - protein, 33 aa, Artificial Sequence
  Description of Artificial Sequence: Synthetic polypeptide
DEEEIRTTNPVATEQYGCVCSTNLQSFGSDTAS

SEQ ID NO: 57037 - protein, 31 aa, Artificial Sequence
  Description of Artificial Sequence: Synthetic polypeptide
SEEEIRTTNPVATESYGSVSNTNLIGTGDQE

SEQ ID NO: 57038 - protein, 32 aa, Artificial Sequence
  Description of Artificial Sequence: Synthetic polypeptide
SEEEIRTTNPVATESYGSVSNTNLIRGEGQGE

SEQ ID NO: 57039 - protein, 33 aa, Artificial Sequence
  Description of Artificial Sequence: Synthetic polypeptide
SEEEIRTTNPVATESYGSVSNTNNFGQRGDQRG

SEQ ID NO: 57040 - protein, 31 aa, Artificial Sequence
  Description of Artificial Sequence: Synthetic polypeptide
SEEEIRTTNPVATESYGSVSNTNPHDDGDQR

SEQ ID NO: 57041 - protein, 31 aa, Artificial Sequence
  Description of Artificial Sequence: Synthetic polypeptide
SEEEIRTTNPVATESYGSVSNTNTHTGDQRD

SEQ ID NO: 57042 - protein, 30 aa, Artificial Sequence
  Description of Artificial Sequence: Synthetic polypeptide
SEEEIRTTNPVATESYGSVSNNNMHDGDQR

SEQ ID NO: 57043 - protein, 33 aa, Artificial Sequence
  Description of Artificial Sequence: Synthetic polypeptide
DEEEIRTTNPVATEQYGCVCSTNLQENFNSDII

SEQ ID NO: 57044 - protein, 33 aa, Artificial Sequence
  Description of Artificial Sequence: Synthetic polypeptide
DEEEIRTTNPVATEQYGCVCSTNPQEYFGSNQE

SEQ ID NO: 57045 - protein, 33 aa, Artificial Sequence
  Description of Artificial Sequence: Synthetic polypeptide
SEEEIRTTNPVATEQYGSVCSTNLARFNSNFAS

SEQ ID NO: 57046 - protein, 30 aa, Artificial Sequence
  Description of Artificial Sequence: Synthetic polypeptide
SEEEIRTTNPVATEGYGSVSNTNHTHGDQQ

SEQ ID NO: 57047 - protein, 32 aa, Artificial Sequence
  Description of Artificial Sequence: Synthetic polypeptide
DEEEIRTTNPVATEQYGCVCSTTELQFGSDAA

SEQ ID NO: 57048 - protein, 32 aa, Artificial Sequence
  Description of Artificial Sequence: Synthetic polypeptide
SEEEIRTTNPVATEGYGSVSNTNLAERFGDQQ

SEQ ID NO: 57049 - protein, 32 aa, Artificial Sequence
  Description of Artificial Sequence: Synthetic polypeptide
DEEEIRTTNPVATEQYGCVCSTTEHQNFGSNT

SEQ ID NO: 57050 - protein, 32 aa, Artificial Sequence
  Description of Artificial Sequence: Synthetic polypeptide
DEEEIRTTNPVATEQYGCVCSTTEHQEHGSNA

SEQ ID NO: 57051 - protein, 33 aa, Artificial Sequence
  Description of Artificial Sequence: Synthetic polypeptide
DEEEIRTTNPVATEQYGCVCSTTATQRFGSNQS

SEQ ID NO: 57052 - protein, 33 aa, Artificial Sequence
  Description of Artificial Sequence: Synthetic polypeptide
SEEEIRTTNPVATEHYGEVSTSNGNMQRGENDR

SEQ ID NO: 57053 - protein, 30 aa, Artificial Sequence
  Description of Artificial Sequence: Synthetic polypeptide
SEEEIRTTNPVATEMWGSVATNLQGNGTDS

SEQ ID NO: 57054 - protein, 32 aa, Artificial Sequence
  Description of Artificial Sequence: Synthetic polypeptide
DEEEIRTTNPVATEQYGCVCSTPTQNFGSDRT

SEQ ID NO: 57055 - protein, 33 aa, Artificial Sequence
  Description of Artificial Sequence: Synthetic polypeptide
DEEEIRTTNPVATEQYGCVCSTPNLQSFTSNQS

SEQ ID NO: 57056 - protein, 31 aa, Artificial Sequence
  Description of Artificial Sequence: Synthetic polypeptide
SEEEIRTTNPVATENYGSVYTDNNLQIGQPL

SEQ ID NO: 57057 - protein, 33 aa, Artificial Sequence
  Description of Artificial Sequence: Synthetic polypeptide
DEEEIRTTNPVATEQYGCVCSTPNLEQNGSEQS

SEQ ID NO: 57058 - protein, 31 aa, Artificial Sequence
  Description of Artificial Sequence: Synthetic polypeptide
SEEEIRTTNPVATEQWGSVSCINEPMRGENG

SEQ ID NO: 57059 - protein, 32 aa, Artificial Sequence
  Description of Artificial Sequence: Synthetic polypeptide
DEEEIRTTNPVATEQYGCVCSTPLQNFLSNDS

SEQ ID NO: 57060 - protein, 32 aa, Artificial Sequence
  Description of Artificial Sequence: Synthetic polypeptide
DEEEIRTTNPVATEQYGCVCSTPLQNFGSDQE

SEQ ID NO: 57061 - protein, 32 aa, Artificial Sequence
  Description of Artificial Sequence: Synthetic polypeptide
SEEEIRTTNPVATEGYGSVCSNTNLAHGSDQR

SEQ ID NO: 57062 - protein, 34 aa, Artificial Sequence
  Description of Artificial Sequence: Synthetic polypeptide
DEEEIRTTNPVATEQYGCVCSTPLQERFGSNNQF

SEQ ID NO: 57063 - protein, 31 aa, Artificial Sequence
  Description of Artificial Sequence: Synthetic polypeptide
SEEEIRTTNPVATEGYGCVSNTNLARFNDTQ

SEQ ID NO: 57064 - protein, 34 aa, Artificial Sequence
  Description of Artificial Sequence: Synthetic polypeptide
DEEEIRTTNPVATEQYGCVCSTTMELQRFGSNQT

SEQ ID NO: 57065 - protein, 33 aa, Artificial Sequence
  Description of Artificial Sequence: Synthetic polypeptide
DEEEIRTTNPVATEQYGCVCSVSMNLQHISNIM

SEQ ID NO: 57066 - protein, 32 aa, Artificial Sequence
  Description of Artificial Sequence: Synthetic polypeptide
DEEEIRTTNPVATEQYGCVCSVSMELQHVSNQ

SEQ ID NO: 57067 - protein, 32 aa, Artificial Sequence
  Description of Artificial Sequence: Synthetic polypeptide
DEEEIRTTNPVATEQYGCVCSTYLQNFTSNQG

SEQ ID NO: 57068 - protein, 32 aa, Artificial Sequence
  Description of Artificial Sequence: Synthetic polypeptide
DEEEIRTTNPVATEQYGCVCSTYLQFFGSEQP

SEQ ID NO: 57069 - protein, 33 aa, Artificial Sequence
  Description of Artificial Sequence: Synthetic polypeptide
DEEEIRTTNPVATEQYGCVCSTYLNQYFGSNQP

SEQ ID NO: 57070 - protein, 32 aa, Artificial Sequence
  Description of Artificial Sequence: Synthetic polypeptide
DEEEIRTTNPVATEQYGCVCSTYDQRFNSEQG

SEQ ID NO: 57071 - protein, 32 aa, Artificial Sequence
  Description of Artificial Sequence: Synthetic polypeptide
DEEEIRTTNPVATEQYGCVCSTYDQHFGSNQP

SEQ ID NO: 57072 - protein, 33 aa, Artificial Sequence
  Description of Artificial Sequence: Synthetic polypeptide
DEEEIRTTNPVATEQYGCVCSTWNLQFFGSEDG

SEQ ID NO: 57073 - protein, 33 aa, Artificial Sequence
  Description of Artificial Sequence: Synthetic polypeptide
DEEEIRTTNPVATEQYGCVCSTWELQGFGSNQS

SEQ ID NO: 57074 - protein, 32 aa, Artificial Sequence
  Description of Artificial Sequence: Synthetic polypeptide
DEEEIRTTNPVATEQYGCVCSTWAHQNFGSNQ

SEQ ID NO: 57075 - protein, 33 aa, Artificial Sequence
  Description of Artificial Sequence: Synthetic polypeptide
DEEEIRTTNPVATEQYGCVCSTTNLQYFGSQDY

SEQ ID NO: 57076 - protein, 33 aa, Artificial Sequence
  Description of Artificial Sequence: Synthetic polypeptide
DEEEIRTTNPVATEQYGCVCSTTNLQYFGSEQE

SEQ ID NO: 57077 - protein, 33 aa, Artificial Sequence
  Description of Artificial Sequence: Synthetic polypeptide
DEEEIRTTNPVATEQYGCVCSTTNLQHSNSNQL

SEQ ID NO: 57078 - protein, 32 aa, Artificial Sequence
  Description of Artificial Sequence: Synthetic polypeptide
DEEEIRTTNPVATEQYGCVCSTTNLQGFQSEQ

SEQ ID NO: 57079 - protein, 34 aa, Artificial Sequence
  Description of Artificial Sequence: Synthetic polypeptide
DEEEIRTTNPVATEQYGCVCSTTNLDQENFGSNQ

SEQ ID NO: 57080 - protein, 30 aa, Artificial Sequence
  Description of Artificial Sequence: Synthetic polypeptide
SEEEIRTTNPVATEGYGCTNINLQREGGNI

SEQ ID NO: 57081 - protein, 31 aa, Artificial Sequence
  Description of Artificial Sequence: Synthetic polypeptide
SEEEIRTTNPVATEQYGCVCGTALQNFGDRS

SEQ ID NO: 57082 - protein, 31 aa, Artificial Sequence
  Description of Artificial Sequence: Synthetic polypeptide
SEEEIRTTNPVATEQYGCVCSTAHQNFGSNQ

SEQ ID NO: 57083 - protein, 33 aa, Artificial Sequence
  Description of Artificial Sequence: Synthetic polypeptide
DEEEIRTTNPVATEQYGCVCSTPLDQGFGSNQA

SEQ ID NO: 57084 - protein, 32 aa, Artificial Sequence
  Description of Artificial Sequence: Synthetic polypeptide
SEEEIRTTNPVATEQYGSVATALEQEGTQFRF

SEQ ID NO: 57085 - protein, 31 aa, Artificial Sequence
  Description of Artificial Sequence: Synthetic polypeptide
SEEEIRTTNPVATEQYGSVATALEQESTQIR

SEQ ID NO: 57086 - protein, 31 aa, Artificial Sequence
  Description of Artificial Sequence: Synthetic polypeptide
SEEEIRTTNPVATEQYGSVATALLTQEGQFD

SEQ ID NO: 57087 - protein, 32 aa, Artificial Sequence
  Description of Artificial Sequence: Synthetic polypeptide
DEEEIRTTNPVATEQYGCVCSTNTQYFGSDDY

SEQ ID NO: 57088 - protein, 33 aa, Artificial Sequence
  Description of Artificial Sequence: Synthetic polypeptide
SEEEIRTTNPVATEQYGSVATNLQDNPGENAEE

SEQ ID NO: 57089 - protein, 31 aa, Artificial Sequence
  Description of Artificial Sequence: Synthetic polypeptide
SEEEIRTTNPVATEQYGSVATPALEQETQFR

SEQ ID NO: 57090 - protein, 32 aa, Artificial Sequence
  Description of Artificial Sequence: Synthetic polypeptide
DEEEIRTTNPVATEQYGCVCSTNTQNFGSDDP

SEQ ID NO: 57091 - protein, 31 aa, Artificial Sequence
  Description of Artificial Sequence: Synthetic polypeptide
SEEEIRTTNPVATEQYGSVATVSLEQETQFR

SEQ ID NO: 57092 - protein, 33 aa, Artificial Sequence
  Description of Artificial Sequence: Synthetic polypeptide
DEEEIRTTNPVATEQYGCVCSTNTNQSFGSNQE

SEQ ID NO: 57093 - protein, 32 aa, Artificial Sequence
  Description of Artificial Sequence: Synthetic polypeptide
DEEEIRTTNPVATEQYGCVCSTNTMGFGSNQS

SEQ ID NO: 57094 - protein, 29 aa, Artificial Sequence
  Description of Artificial Sequence: Synthetic peptide
SEEEIRTTNPVATEQYGSVCDCTSHRIER

SEQ ID NO: 57095 - protein, 30 aa, Artificial Sequence
  Description of Artificial Sequence: Synthetic polypeptide
SEEEIRTTNPVATEQYGSVCSENLESEEFE

SEQ ID NO: 57096 - protein, 34 aa, Artificial Sequence
  Description of Artificial Sequence: Synthetic polypeptide
SEEEIRTTNPVATEQYGSVCSTGNLQERFNSNFA

SEQ ID NO: 57097 - protein, 34 aa, Artificial Sequence
  Description of Artificial Sequence: Synthetic polypeptide
SEEEIRTTNPVATEQYGSVCSTMNLDQHFGSNTQ

SEQ ID NO: 57098 - protein, 31 aa, Artificial Sequence
  Description of Artificial Sequence: Synthetic polypeptide
SEEEIRTTNPVATEQYGSVCSTNIEFDNVEI

SEQ ID NO: 57099 - protein, 32 aa, Artificial Sequence
  Description of Artificial Sequence: Synthetic polypeptide
SEEEIRTTNPVATEQYGSVAFTWELQDNGVDR

SEQ ID NO: 57100 - protein, 32 aa, Artificial Sequence
  Description of Artificial Sequence: Synthetic polypeptide
SEEEIRTTNPVATEQYGSVAFTWELQDNGGTR

SEQ ID NO: 57101 - protein, 33 aa, Artificial Sequence
  Description of Artificial Sequence: Synthetic polypeptide
SEEEIRTTNPVATEQYGEVSGGNGNMQRGENDR

SEQ ID NO: 57102 - protein, 32 aa, Artificial Sequence
  Description of Artificial Sequence: Synthetic polypeptide
DEEEIRTTNPVATEQYGCVCSTNTQYFGSQAS

SEQ ID NO: 57103 - protein, 32 aa, Artificial Sequence
  Description of Artificial Sequence: Synthetic polypeptide
DEEEIRTTNPVATEQYGCVCSTPLAYFGSNQE

SEQ ID NO: 57104 - protein, 33 aa, Artificial Sequence
  Description of Artificial Sequence: Synthetic polypeptide
SEEEIRTTNPVATEQYGCVCSTENLDQNGSNPQ

SEQ ID NO: 57105 - protein, 34 aa, Artificial Sequence
  Description of Artificial Sequence: Synthetic polypeptide
SEEEIRTTNPVATEQYGCVCSTGNDLDQRGSNTQ

SEQ ID NO: 57106 - protein, 33 aa, Artificial Sequence
  Description of Artificial Sequence: Synthetic polypeptide
SEEEIRTTNPVATEQYGCVCSTMNLDQRNSNTQ

SEQ ID NO: 57107 - protein, 32 aa, Artificial Sequence
  Description of Artificial Sequence: Synthetic polypeptide
SEEEIRTTNPVATEQYGCVCSTNHQESFGSNQ

SEQ ID NO: 57108 - protein, 31 aa, Artificial Sequence
  Description of Artificial Sequence: Synthetic polypeptide
SEEEIRTTNPVATEQYGCVCSTNHQFGSEQM

SEQ ID NO: 57109 - protein, 32 aa, Artificial Sequence
  Description of Artificial Sequence: Synthetic polypeptide
SEEEIRTTNPVATEQYGCVCSTNHQHFGSNQA

SEQ ID NO: 57110 - protein, 32 aa, Artificial Sequence
  Description of Artificial Sequence: Synthetic polypeptide
SEEEIRTTNPVATEQYGSVCSTNLEFIDNQDI

SEQ ID NO: 57111 - protein, 32 aa, Artificial Sequence
  Description of Artificial Sequence: Synthetic polypeptide
DEEEIRTTNPVATEQYGCVCSTPDQFSGSNQP

SEQ ID NO: 57112 - protein, 33 aa, Artificial Sequence
  Description of Artificial Sequence: Synthetic polypeptide
DEEEIRTTNPVATEQYGCVCSTPDQFFGSNNRY

SEQ ID NO: 57113 - protein, 32 aa, Artificial Sequence
  Description of Artificial Sequence: Synthetic polypeptide
DEEEIRTTNPVATEQYGCVCSTPDERFGSNQG

SEQ ID NO: 57114 - protein, 33 aa, Artificial Sequence
  Description of Artificial Sequence: Synthetic polypeptide
DEEEIRTTNPVATEQYGCVCSTPDDQRFGSNQS

SEQ ID NO: 57115 - protein, 30 aa, Artificial Sequence
  Description of Artificial Sequence: Synthetic polypeptide
SEEEIRTTNPVATEQYGCVSTEHQNFGSDQ

SEQ ID NO: 57116 - protein, 32 aa, Artificial Sequence
  Description of Artificial Sequence: Synthetic polypeptide
SEEEIRTTNPVATEQYGCVSTGNPDQNGSNTQ

SEQ ID NO: 57117 - protein, 33 aa, Artificial Sequence
  Description of Artificial Sequence: Synthetic polypeptide
DEEEIRTTNPVATEQYGCVCSTNWHQNFGSNLN

SEQ ID NO: 57118 - protein, 30 aa, Artificial Sequence
  Description of Artificial Sequence: Synthetic polypeptide
SEEEIRTTNPVATEQYGDYSTMELQREQGD

SEQ ID NO: 57119 - protein, 32 aa, Artificial Sequence
  Description of Artificial Sequence: Synthetic polypeptide
SEEEIRTTNPVATEQYGCVCSTNLQEGFGSEQ

SEQ ID NO: 57120 - protein, 32 aa, Artificial Sequence
  Description of Artificial Sequence: Synthetic polypeptide
NEEEIRTTNPVAYEQYGSISTHELSQRPGGNM

SEQ ID NO: 57121 - protein, 30 aa, Artificial Sequence
  Description of Artificial Sequence: Synthetic polypeptide
DERVIRTTNPVATEQYGCVETNPQEYGSNQ

SEQ ID NO: 57122 - protein, 31 aa, Artificial Sequence
  Description of Artificial Sequence: Synthetic polypeptide
NEEEIRTTNPVAYEQWGSVSAWNLGDEFGNR

SEQ ID NO: 57123 - protein, 32 aa, Artificial Sequence
  Description of Artificial Sequence: Synthetic polypeptide
DEEEIRTTNPVATEQYGSVNNTNPDEREENGD

SEQ ID NO: 57124 - protein, 33 aa, Artificial Sequence
  Description of Artificial Sequence: Synthetic polypeptide
DEEEIRTTNPVATEQYGVVSWNVLQDRPNDNSD

SEQ ID NO: 57125 - protein, 34 aa, Artificial Sequence
  Description of Artificial Sequence: Synthetic polypeptide
DEEEIRTTNPVATEQYGSVNNTNLDQNRSGDGEG

SEQ ID NO: 57126 - protein, 33 aa, Artificial Sequence
  Description of Artificial Sequence: Synthetic polypeptide
DEEEIRTTNPVATEQYGSVNNTNEEQERLTNGQ

SEQ ID NO: 57127 - protein, 34 aa, Artificial Sequence
  Description of Artificial Sequence: Synthetic polypeptide
DEEEIRTTNPVATEQYGVVVGSTMNLQTENGGNQ

SEQ ID NO: 57128 - protein, 34 aa, Artificial Sequence
  Description of Artificial Sequence: Synthetic polypeptide
DEEEIRTTNPVATEQYGVVVTSVTENLLQGIGNT

SEQ ID NO: 57129 - protein, 32 aa, Artificial Sequence
  Description of Artificial Sequence: Synthetic polypeptide
DEEEIRTTNPVATEQYGVYTIFTNEGQRGNGG

SEQ ID NO: 57130 - protein, 31 aa, Artificial Sequence
  Description of Artificial Sequence: Synthetic polypeptide
DEEEIRTTNPVATEQYGSVNNTNDNRSEQGI

SEQ ID NO: 57131 - protein, 32 aa, Artificial Sequence
  Description of Artificial Sequence: Synthetic polypeptide
DEEEIRTTNPVATEQYGSVNNTNDNREENENF

SEQ ID NO: 57132 - protein, 33 aa, Artificial Sequence
  Description of Artificial Sequence: Synthetic polypeptide
DEEEIRTTNPVATEQYGSVNNTNPNEGIENIRQ

SEQ ID NO: 57133 - protein, 32 aa, Artificial Sequence
  Description of Artificial Sequence: Synthetic polypeptide
DEEEIRTTNPVATEQYGSVNNTNDNPREENND

SEQ ID NO: 57134 - protein, 33 aa, Artificial Sequence
  Description of Artificial Sequence: Synthetic polypeptide
DEEEIRTTNPVATEQYGSVNNTNDMPRGDNDGG

SEQ ID NO: 57135 - protein, 32 aa, Artificial Sequence
  Description of Artificial Sequence: Synthetic polypeptide
DEEEIRTTNPVATEQYGYGTISTNGGQGGGNG

SEQ ID NO: 57136 - protein, 32 aa, Artificial Sequence
  Description of Artificial Sequence: Synthetic polypeptide
DEEEIRTTNPVATEQYGSVNNTNDEREEDFND

SEQ ID NO: 57137 - protein, 31 aa, Artificial Sequence
  Description of Artificial Sequence: Synthetic polypeptide
DEEEIRTTNPVATEQYGSVNNTNDDDDRQQV

SEQ ID NO: 57138 - protein, 31 aa, Artificial Sequence
  Description of Artificial Sequence: Synthetic polypeptide
DEEEIRTTNPVATEQYGSVNNTMDQGNGQDD

SEQ ID NO: 57139 - protein, 31 aa, Artificial Sequence
  Description of Artificial Sequence: Synthetic polypeptide
DEEEIRTTNPVATEQYGYTISPSNEEQRQNL

SEQ ID NO: 57140 - protein, 30 aa, Artificial Sequence
  Description of Artificial Sequence: Synthetic polypeptide
DEEEIRTTNPVATEQYGYTISSFVEQQQNR

SEQ ID NO: 57141 - protein, 31 aa, Artificial Sequence
  Description of Artificial Sequence: Synthetic polypeptide
DEEEIRTTNPVATEQYGYTISSNAEQERQFR

SEQ ID NO: 57142 - protein, 32 aa, Artificial Sequence
  Description of Artificial Sequence: Synthetic polypeptide
DEEEIRTTNPVATEQYGSVNNTEEEPQQGNEV

SEQ ID NO: 57143 - protein, 33 aa, Artificial Sequence
  Description of Artificial Sequence: Synthetic polypeptide
DEEEIRTTNPVATEQYGSVNNTNDMPRGENEGV

SEQ ID NO: 57144 - protein, 32 aa, Artificial Sequence
  Description of Artificial Sequence: Synthetic polypeptide
DEEEIRTTNPVATEQYGYTISSNAEQTRQNRN

SEQ ID NO: 57145 - protein, 32 aa, Artificial Sequence
  Description of Artificial Sequence: Synthetic polypeptide
DEEEIRTTNPVATEQYGSVNNTQDQRNENEGG

SEQ ID NO: 57146 - protein, 31 aa, Artificial Sequence
  Description of Artificial Sequence: Synthetic polypeptide
DEEEIRTTNPVATEQYGSVNNTQDQRNTQIG

SEQ ID NO: 57147 - protein, 34 aa, Artificial Sequence
  Description of Artificial Sequence: Synthetic polypeptide
DEEEIRTTNPVATEQYGSVNSDTNNLQNQGEGEI

SEQ ID NO: 57148 - protein, 34 aa, Artificial Sequence
  Description of Artificial Sequence: Synthetic polypeptide
DEEEIRTTNPVATEQYGSVNSDTGELQNGGTNGD

SEQ ID NO: 57149 - protein, 35 aa, Artificial Sequence
  Description of Artificial Sequence: Synthetic polypeptide
DEEEIRTTNPVATEQYGSVNSDTANLQMNEGGNIQ

SEQ ID NO: 57150 - protein, 35 aa, Artificial Sequence
  Description of Artificial Sequence: Synthetic polypeptide
DEEEIRTTNPVATEQYGSVNSDSTNLQNDGVGNDG

SEQ ID NO: 57151 - protein, 33 aa, Artificial Sequence
  Description of Artificial Sequence: Synthetic polypeptide
DEEEIRTTNPVATEQYGSVNSDGNNQGEFGNNG

SEQ ID NO: 57152 - protein, 31 aa, Artificial Sequence
  Description of Artificial Sequence: Synthetic polypeptide
DEEEIRTTNPVATEQYGSVNSCSELQELEDI

SEQ ID NO: 57153 - protein, 33 aa, Artificial Sequence
  Description of Artificial Sequence: Synthetic polypeptide
DEEEIRTTNPVATEQYGSVNSCENEDERGNEFP

SEQ ID NO: 57154 - protein, 33 aa, Artificial Sequence
  Description of Artificial Sequence: Synthetic polypeptide
DEEEIRTTNPVATEQYGSVNQTDQDDRYGENVR

SEQ ID NO: 57155 - protein, 34 aa, Artificial Sequence
  Description of Artificial Sequence: Synthetic polypeptide
DEEEIRTTNPVATEQYGSVNNTVQDDQRGENERG

SEQ ID NO: 57156 - protein, 32 aa, Artificial Sequence
  Description of Artificial Sequence: Synthetic polypeptide
DEEEIRTTNPVATEQYGSVNNTQDQRNINQDG

SEQ ID NO: 57157 - protein, 30 aa, Artificial Sequence
  Description of Artificial Sequence: Synthetic polypeptide
DEEEIRTTNPVATEQYGSVNNTTTEGNNEM

SEQ ID NO: 57158 - protein, 32 aa, Artificial Sequence
  Description of Artificial Sequence: Synthetic polypeptide
DEEEIRTTNPVATEQYGSVNNTTNLYGNGTET

SEQ ID NO: 57159 - protein, 34 aa, Artificial Sequence
  Description of Artificial Sequence: Synthetic polypeptide
DEEEIRTTNPVATEQYGSVNNTTNLQYGNTNTDE

SEQ ID NO: 57160 - protein, 34 aa, Artificial Sequence
  Description of Artificial Sequence: Synthetic polypeptide
DEEEIRTTNPVATEQYGSVNNTTNLQYGNTGNTV

SEQ ID NO: 57161 - protein, 34 aa, Artificial Sequence
  Description of Artificial Sequence: Synthetic polypeptide
DEEEIRTTNPVATEQYGSVNNTTNLQYGNNGTEQ

SEQ ID NO: 57162 - protein, 32 aa, Artificial Sequence
  Description of Artificial Sequence: Synthetic polypeptide
DEEEIRTTNPVATEQYGVVSVVSLGFRGSNQS

SEQ ID NO: 57163 - protein, 34 aa, Artificial Sequence
  Description of Artificial Sequence: Synthetic polypeptide
DEEEIRTTNPVATEQYGVVSVVTNLNNQNGQNED

SEQ ID NO: 57164 - protein, 32 aa, Artificial Sequence
  Description of Artificial Sequence: Synthetic polypeptide
DEEEIRTTNPVATEQYGSVNNTQLERMNENEG

SEQ ID NO: 57165 - protein, 32 aa, Artificial Sequence
  Description of Artificial Sequence: Synthetic polypeptide
DEEEIRTTNPVATEQYGSVNNTQLEAGENEGG

SEQ ID NO: 57166 - protein, 33 aa, Artificial Sequence
  Description of Artificial Sequence: Synthetic polypeptide
DEEEIRTTNPVATEQYGSVNNTQDQTREGNYQD

SEQ ID NO: 57167 - protein, 32 aa, Artificial Sequence
  Description of Artificial Sequence: Synthetic polypeptide
DEEEIRTTNPVATEQYGSVNNTTNLYGNGTTN

SEQ ID NO: 57168 - protein, 32 aa, Artificial Sequence
  Description of Artificial Sequence: Synthetic polypeptide
DEEEIRTTNPVATEQYGSVNSELAERYGEEVR

SEQ ID NO: 57169 - protein, 31 aa, Artificial Sequence
  Description of Artificial Sequence: Synthetic polypeptide
DEEEIRTTNPVATEQYGYTISSNEEQRQNFE

SEQ ID NO: 57170 - protein, 35 aa, Artificial Sequence
  Description of Artificial Sequence: Synthetic polypeptide
DEEEIRTTNPVATEQYGSVNNSTPNLQGSGGNIEN

SEQ ID NO: 57171 - protein, 32 aa, Artificial Sequence
  Description of Artificial Sequence: Synthetic polypeptide
DEEEIRTTNPVATEQYGSVNGTNSDQREIEDD

SEQ ID NO: 57172 - protein, 31 aa, Artificial Sequence
  Description of Artificial Sequence: Synthetic polypeptide
DEEEIRTTNPVATEQYGSVNGTNSDQNDFDD

SEQ ID NO: 57173 - protein, 34 aa, Artificial Sequence
  Description of Artificial Sequence: Synthetic polypeptide
DEEEIRTTNPVATEQYGYVSTMNGLEQDEGGGNG

SEQ ID NO: 57174 - protein, 34 aa, Artificial Sequence
  Description of Artificial Sequence: Synthetic polypeptide
DEEEIRTTNPVATEQYGYVSTMNLEQGGGGQGNT

SEQ ID NO: 57175 - protein, 33 aa, Artificial Sequence
  Description of Artificial Sequence: Synthetic polypeptide
DEEEIRTTNPVATEQYGSVNGTNMDDERGDNEE

SEQ ID NO: 57176 - protein, 33 aa, Artificial Sequence
  Description of Artificial Sequence: Synthetic polypeptide
DEEEIRTTNPVATEQYGYVSTNLNLDEGGNENV

SEQ ID NO: 57177 - protein, 34 aa, Artificial Sequence
  Description of Artificial Sequence: Synthetic polypeptide
DEEEIRTTNPVATEQYGYVSTVNLEQVVEGQNED

SEQ ID NO: 57178 - protein, 33 aa, Artificial Sequence
  Description of Artificial Sequence: Synthetic polypeptide
DEEEIRTTNPVATEQYGSVNGTNDQGGGEQNGD

SEQ ID NO: 57179 - protein, 31 aa, Artificial Sequence
  Description of Artificial Sequence: Synthetic polypeptide
DEEEIRTTNPVATEQYGSVNGTLDQGFGEEQ

SEQ ID NO: 57180 - protein, 31 aa, Artificial Sequence
  Description of Artificial Sequence: Synthetic polypeptide
DEEEIRTTNPVATEQYGSVNGTNSDSRDDDD

SEQ ID NO: 57181 - protein, 31 aa, Artificial Sequence
  Description of Artificial Sequence: Synthetic polypeptide
DEEEIRTTNPVATEQYGSVNGTLDQGDNQQI

SEQ ID NO: 57182 - protein, 32 aa, Artificial Sequence
  Description of Artificial Sequence: Synthetic polypeptide
DEEEIRTTNPVATERYGEVSHTNPEMRDGNAI

SEQ ID NO: 57183 - protein, 33 aa, Artificial Sequence
  Description of Artificial Sequence: Synthetic polypeptide
DEEEIRTTNPVATERYGSIFCTNALQRGGNNEE

SEQ ID NO: 57184 - protein, 34 aa, Artificial Sequence
  Description of Artificial Sequence: Synthetic polypeptide
DEEEIRTTNPVATERYGSTVSTGNAHSQFGGNFR

SEQ ID NO: 57185 - protein, 32 aa, Artificial Sequence
  Description of Artificial Sequence: Synthetic polypeptide
DEEEIRTTNPVATERYGSTVSTNHSGFGDNNE

SEQ ID NO: 57186 - protein, 33 aa, Artificial Sequence
  Description of Artificial Sequence: Synthetic polypeptide
DEEEIRTTNPVATERYGSTVSVSGNLSQKVGNI

SEQ ID NO: 57187 - protein, 33 aa, Artificial Sequence
  Description of Artificial Sequence: Synthetic polypeptide
DEEEIRTTNPVATERYGSVAFCTNGSGRGGNYR

SEQ ID NO: 57188 - protein, 31 aa, Artificial Sequence
  Description of Artificial Sequence: Synthetic polypeptide
DEEEIRTTNPVATERYGVVSFEMQRENSIRV

SEQ ID NO: 57189 - protein, 29 aa, Artificial Sequence
  Description of Artificial Sequence: Synthetic peptide
DEEEIRTTNPVATERYGVVSTGQGELHNV

SEQ ID NO: 57190 - protein, 32 aa, Artificial Sequence
  Description of Artificial Sequence: Synthetic polypeptide
DEEEIRTTNPVATERYGYTWSDTINPLQRENN

SEQ ID NO: 57191 - protein, 31 aa, Artificial Sequence
  Description of Artificial Sequence: Synthetic polypeptide
DEEEIRTTNPVATEQYGSVNGTLDDPGFNEG

SEQ ID NO: 57192 - protein, 32 aa, Artificial Sequence
  Description of Artificial Sequence: Synthetic polypeptide
DEEEIRTTNPVATEQYGSVNNTCNDDLGENQD

SEQ ID NO: 57193 - protein, 33 aa, Artificial Sequence
  Description of Artificial Sequence: Synthetic polypeptide
DEEEIRTTNPVATEQYGSVNGTNSDSRGFDNDA

SEQ ID NO: 57194 - protein, 34 aa, Artificial Sequence
  Description of Artificial Sequence: Synthetic polypeptide
DEEEIRTTNPVATEQYGYVSTGNMDLQGEGGNNG

SEQ ID NO: 57195 - protein, 30 aa, Artificial Sequence
  Description of Artificial Sequence: Synthetic polypeptide
DEEEIRTTNPVATEQYGSVNNSNDEGNEIG

SEQ ID NO: 57196 - protein, 31 aa, Artificial Sequence
  Description of Artificial Sequence: Synthetic polypeptide
DEEEIRTTNPVATEQYGSVNNSNDDEGNEMQ

SEQ ID NO: 57197 - protein, 34 aa, Artificial Sequence
  Description of Artificial Sequence: Synthetic polypeptide
DEEEIRTTNPVATEQYGYVGSTGNLDQIGGNGDD

SEQ ID NO: 57198 - protein, 33 aa, Artificial Sequence
  Description of Artificial Sequence: Synthetic polypeptide
DEEEIRTTNPVATEQYGYVGSTTDLQIGGGNGE

SEQ ID NO: 57199 - protein, 33 aa, Artificial Sequence
  Description of Artificial Sequence: Synthetic polypeptide
DEEEIRTTNPVATEQYGYVGSTTLQQDGEGGNG

SEQ ID NO: 57200 - protein, 32 aa, Artificial Sequence
  Description of Artificial Sequence: Synthetic polypeptide
DEEEIRTTNPVATEQYGSVNNFNEQRETENDQ

SEQ ID NO: 57201 - protein, 32 aa, Artificial Sequence
  Description of Artificial Sequence: Synthetic polypeptide
DEEEIRTTNPVATEQYGSVNNFNEQREENMDQ

SEQ ID NO: 57202 - protein, 33 aa, Artificial Sequence
  Description of Artificial Sequence: Synthetic polypeptide
DEEEIRTTNPVATEQYGYVGSTVNGQGGGNEDV

SEQ ID NO: 57203 - protein, 32 aa, Artificial Sequence
  Description of Artificial Sequence: Synthetic polypeptide
DEEEIRTTNPVATEQYGSVNNFNEQNEGNEDN

SEQ ID NO: 57204 - protein, 32 aa, Artificial Sequence
  Description of Artificial Sequence: Synthetic polypeptide
DEEEIRTTNPVATEQYGSVNGTNSDSRNEDND

SEQ ID NO: 57205 - protein, 31 aa, Artificial Sequence
  Description of Artificial Sequence: Synthetic polypeptide
DEEEIRTTNPVATEQYGSVNNFNEQLEENED

SEQ ID NO: 57206 - protein, 33 aa, Artificial Sequence
  Description of Artificial Sequence: Synthetic polypeptide
DEEEIRTTNPVATEQYGYVSNANLQQGEGGGND

SEQ ID NO: 57207 - protein, 32 aa, Artificial Sequence
  Description of Artificial Sequence: Synthetic polypeptide
DEEEIRTTNPVATEQYGSVNNATSLEREENEQ

SEQ ID NO: 57208 - protein, 33 aa, Artificial Sequence
  Description of Artificial Sequence: Synthetic polypeptide
DEEEIRTTNPVATEQYGYVSTDLIMTQEGGNGD

SEQ ID NO: 57209 - protein, 33 aa, Artificial Sequence
  Description of Artificial Sequence: Synthetic polypeptide
DEEEIRTTNPVATEQYGYVSTDNGELDEGGGNG

SEQ ID NO: 57210 - protein, 33 aa, Artificial Sequence
  Description of Artificial Sequence: Synthetic polypeptide
DEEEIRTTNPVATEQYGSVNMTNGIQEDGENQG

SEQ ID NO: 57211 - protein, 33 aa, Artificial Sequence
  Description of Artificial Sequence: Synthetic polypeptide
DEEEIRTTNPVATEQYGYVSTDNMNLDEGNENV

SEQ ID NO: 57212 - protein, 32 aa, Artificial Sequence
  Description of Artificial Sequence: Synthetic polypeptide
DEEEIRTTNPVATEQYGSVNLTNGIGTDGNDP

SEQ ID NO: 57213 - protein, 33 aa, Artificial Sequence
  Description of Artificial Sequence: Synthetic polypeptide
DEEEIRTTNPVATEQYGSVNICTNGGQRFGKYT

SEQ ID NO: 57214 - protein, 33 aa, Artificial Sequence
  Description of Artificial Sequence: Synthetic polypeptide
DEEEIRTTNPVATEQYGSVNHPEMNLVQRLNNV

SEQ ID NO: 57215 - protein, 34 aa, Artificial Sequence
  Description of Artificial Sequence: Synthetic polypeptide
DEEEIRTTNPVATEQYGYVGSTVNLQIEGGNEDV

SEQ ID NO: 57216 - protein, 31 aa, Artificial Sequence
  Description of Artificial Sequence: Synthetic polypeptide
DEEEIRTTNPVATEQYGSVNSELDSGDENDA

SEQ ID NO: 57217 - protein, 33 aa, Artificial Sequence
  Description of Artificial Sequence: Synthetic polypeptide
DEEEIRTTNPVATEQYGSVNSENDDQRDGEEIF

SEQ ID NO: 57218 - protein, 33 aa, Artificial Sequence
  Description of Artificial Sequence: Synthetic polypeptide
DEEEIRTTNPVATEQYGSVNSESNDDERGEERQ

SEQ ID NO: 57219 - protein, 33 aa, Artificial Sequence
  Description of Artificial Sequence: Synthetic polypeptide
DEEEIRTTNPVATEQYGSVNSTNDFDRGGEEDG

SEQ ID NO: 57220 - protein, 33 aa, Artificial Sequence
  Description of Artificial Sequence: Synthetic polypeptide
DEEEIRTTNPVATEQYGSVNSTNDFDEGGEERN

SEQ ID NO: 57221 - protein, 33 aa, Artificial Sequence
  Description of Artificial Sequence: Synthetic polypeptide
DEEEIRTTNPVATEQYGVVSGTGNGQTGGNGGE

SEQ ID NO: 57222 - protein, 32 aa, Artificial Sequence
  Description of Artificial Sequence: Synthetic polypeptide
DEEEIRTTNPVATEQYGVVSNMNLGQGEFNEQ

SEQ ID NO: 57223 - protein, 33 aa, Artificial Sequence
  Description of Artificial Sequence: Synthetic polypeptide
DEEEIRTTNPVATEQYGVVSNMNLGQSGEFNET

SEQ ID NO: 57224 - protein, 34 aa, Artificial Sequence
  Description of Artificial Sequence: Synthetic polypeptide
DEEEIRTTNPVATEQYGSVNSTNDDQRENENIDG

SEQ ID NO: 57225 - protein, 31 aa, Artificial Sequence
  Description of Artificial Sequence: Synthetic polypeptide
DEEEIRTTNPVATEQYGVVSSELQGFGSEQG

SEQ ID NO: 57226 - protein, 32 aa, Artificial Sequence
  Description of Artificial Sequence: Synthetic polypeptide
DEEEIRTTNPVATEQYGVVSSTNDQGEGGGET

SEQ ID NO: 57227 - protein, 34 aa, Artificial Sequence
  Description of Artificial Sequence: Synthetic polypeptide
DEEEIRTTNPVATEQYGSVNSTNDDQIRMNEEID

SEQ ID NO: 57228 - protein, 33 aa, Artificial Sequence
  Description of Artificial Sequence: Synthetic polypeptide
DEEEIRTTNPVATEQYGSVNSTNDHNQEGEESN

SEQ ID NO: 57229 - protein, 34 aa, Artificial Sequence
  Description of Artificial Sequence: Synthetic polypeptide
DEEEIRTTNPVATEQYGVVSSTTPNLQMSNGMNQ

SEQ ID NO: 57230 - protein, 34 aa, Artificial Sequence
  Description of Artificial Sequence: Synthetic polypeptide
DEEEIRTTNPVATEQYGSVNSTNDDLRSGNEEIS

SEQ ID NO: 57231 - protein, 32 aa, Artificial Sequence
  Description of Artificial Sequence: Synthetic polypeptide
DEEEIRTTNPVATEQYGVVSTDGDGQNQGNEQ

SEQ ID NO: 57232 - protein, 33 aa, Artificial Sequence
  Description of Artificial Sequence: Synthetic polypeptide
DEEEIRTTNPVATEQYGSVNSTNDDHRENENDN

SEQ ID NO: 57233 - protein, 34 aa, Artificial Sequence
  Description of Artificial Sequence: Synthetic polypeptide
DEEEIRTTNPVATEQYGSVNSTNDDDQTGNEEIN

SEQ ID NO: 57234 - protein, 34 aa, Artificial Sequence
  Description of Artificial Sequence: Synthetic polypeptide
DEEEIRTTNPVATEQYGSVNSTNDDDQRGGEEVY

SEQ ID NO: 57235 - protein, 32 aa, Artificial Sequence
  Description of Artificial Sequence: Synthetic polypeptide
DEEEIRTTNPVATEQYGVVSTEHQEGFNSNQS

SEQ ID NO: 57236 - protein, 34 aa, Artificial Sequence
  Description of Artificial Sequence: Synthetic polypeptide
DEEEIRTTNPVATEQYGSVNSTMNLGDGFGNNDG

SEQ ID NO: 57237 - protein, 33 aa, Artificial Sequence
  Description of Artificial Sequence: Synthetic polypeptide
DEEEIRTTNPVATEQYGSVNSTMELDPEGENGE

SEQ ID NO: 57238 - protein, 35 aa, Artificial Sequence
  Description of Artificial Sequence: Synthetic polypeptide
DEEEIRTTNPVATEQYGSVNSTLNGLQEEFGGNET

SEQ ID NO: 57239 - protein, 33 aa, Artificial Sequence
  Description of Artificial Sequence: Synthetic polypeptide
DEEEIRTTNPVATEQYGSVNSTNDDNGGNNDGQ

SEQ ID NO: 57240 - protein, 32 aa, Artificial Sequence
  Description of Artificial Sequence: Synthetic polypeptide
DEEEIRTTNPVATEQYGVVSTGVGGQEEGNEM

SEQ ID NO: 57241 - protein, 33 aa, Artificial Sequence
  Description of Artificial Sequence: Synthetic polypeptide
DEEEIRTTNPVATEQYGSVNSTNDHNQEGIESS

SEQ ID NO: 57242 - protein, 33 aa, Artificial Sequence
  Description of Artificial Sequence: Synthetic polypeptide
DEEEIRTTNPVATEQYGVVSGTDLQNEGGGNET

SEQ ID NO: 57243 - protein, 33 aa, Artificial Sequence
  Description of Artificial Sequence: Synthetic polypeptide
DEEEIRTTNPVATEQYGVVCSTELQERFGSDQG

SEQ ID NO: 57244 - protein, 32 aa, Artificial Sequence
  Description of Artificial Sequence: Synthetic polypeptide
DEEEIRTTNPVATEQYGVVCSTELQYFGSEAF

SEQ ID NO: 57245 - protein, 31 aa, Artificial Sequence
  Description of Artificial Sequence: Synthetic polypeptide
DEEEIRTTNPVATEQYGVVCSTEPQSGSEQA

SEQ ID NO: 57246 - protein, 34 aa, Artificial Sequence
  Description of Artificial Sequence: Synthetic polypeptide
DEEEIRTTNPVATEQYGVVCSTGNDLQSFGSNQI

SEQ ID NO: 57247 - protein, 32 aa, Artificial Sequence
  Description of Artificial Sequence: Synthetic polypeptide
DEEEIRTTNPVATEQYGVVCSTGNHQGFISNQ

SEQ ID NO: 57248 - protein, 33 aa, Artificial Sequence
  Description of Artificial Sequence: Synthetic polypeptide
DEEEIRTTNPVATEQYGVVCSTGNPQNSGSNQS

SEQ ID NO: 57249 - protein, 32 aa, Artificial Sequence
  Description of Artificial Sequence: Synthetic polypeptide
DEEEIRTTNPVATEQYGVVCSTNHQAFGSDQF

SEQ ID NO: 57250 - protein, 32 aa, Artificial Sequence
  Description of Artificial Sequence: Synthetic polypeptide
DEEEIRTTNPVATEQYGVVCSTNLENFGSDQS

SEQ ID NO: 57251 - protein, 32 aa, Artificial Sequence
  Description of Artificial Sequence: Synthetic polypeptide
DEEEIRTTNPVATEQYGSVNSTNHDESEQNVN

SEQ ID NO: 57252 - protein, 34 aa, Artificial Sequence
  Description of Artificial Sequence: Synthetic polypeptide
DEEEIRTTNPVATEQYGSVNSTNDMDQRGGEEIM

SEQ ID NO: 57253 - protein, 32 aa, Artificial Sequence
  Description of Artificial Sequence: Synthetic polypeptide
DEEEIRTTNPVATEQYGVVCSTTEHQGFGSNQ

SEQ ID NO: 57254 - protein, 32 aa, Artificial Sequence
  Description of Artificial Sequence: Synthetic polypeptide
DEEEIRTTNPVATEQYGVVCSWNLQNFGSEQQ

SEQ ID NO: 57255 - protein, 34 aa, Artificial Sequence
  Description of Artificial Sequence: Synthetic polypeptide
DEEEIRTTNPVATEQYGVVESEWTNLENRGMPRQ

SEQ ID NO: 57256 - protein, 33 aa, Artificial Sequence
  Description of Artificial Sequence: Synthetic polypeptide
DEEEIRTTNPVATEQYGVVNTNWLQKQLNSNRP

SEQ ID NO: 57257 - protein, 33 aa, Artificial Sequence
  Description of Artificial Sequence: Synthetic polypeptide
DEEEIRTTNPVATEQYGVVSDTDNGQTGGNEGT

SEQ ID NO: 57258 - protein, 33 aa, Artificial Sequence
  Description of Artificial Sequence: Synthetic polypeptide
DEEEIRTTNPVATEQYGVVSGSNNDLQGAGNEL

SEQ ID NO: 57259 - protein, 32 aa, Artificial Sequence
  Description of Artificial Sequence: Synthetic polypeptide
DEEEIRTTNPVATEQYGVVSGSNNEGQTGGNE

SEQ ID NO: 57260 - protein, 33 aa, Artificial Sequence
  Description of Artificial Sequence: Synthetic polypeptide
DEEEIRTTNPVATEQYGVVSGSNNLGQGEGGNL

SEQ ID NO: 57261 - protein, 32 aa, Artificial Sequence
  Description of Artificial Sequence: Synthetic polypeptide
DEEEIRTTNPVATEQYGSVNSTNDNGFSDSDR

SEQ ID NO: 57262 - protein, 32 aa, Artificial Sequence
  Description of Artificial Sequence: Synthetic polypeptide
DEEEIRTTNPVATEQYGSVNSTNDNDEENSEA

SEQ ID NO: 57263 - protein, 32 aa, Artificial Sequence
  Description of Artificial Sequence: Synthetic polypeptide
DEEEIRTTNPVATEQYGVVCSWELQRFGSDQS

SEQ ID NO: 57264 - protein, 33 aa, Artificial Sequence
  Description of Artificial Sequence: Synthetic polypeptide
DEEEIRTTNPVATEQYGVVSTMDNGQTEIGNDV

SEQ ID NO: 57265 - protein, 33 aa, Artificial Sequence
  Description of Artificial Sequence: Synthetic polypeptide
DEEEIRTTNPVATEQYGVVSTMNGLGEGGENTE

SEQ ID NO: 57266 - protein, 32 aa, Artificial Sequence
  Description of Artificial Sequence: Synthetic polypeptide
DEEEIRTTNPVATEQYGVVSTMNGMGEGGNIS

SEQ ID NO: 57267 - protein, 34 aa, Artificial Sequence
  Description of Artificial Sequence: Synthetic polypeptide
DEEEIRTTNPVATEQYGSVNSNTVEQERGETERE

SEQ ID NO: 57268 - protein, 34 aa, Artificial Sequence
  Description of Artificial Sequence: Synthetic polypeptide
DEEEIRTTNPVATEQYGSVNSNTQNLFENGENIQ

SEQ ID NO: 57269 - protein, 33 aa, Artificial Sequence
  Description of Artificial Sequence: Synthetic polypeptide
DEEEIRTTNPVATEQYGVVSTQLSQNGSGDNEE

SEQ ID NO: 57270 - protein, 34 aa, Artificial Sequence
  Description of Artificial Sequence: Synthetic polypeptide
DEEEIRTTNPVATEQYGSVNSNTMNDQGEFGNNG

SEQ ID NO: 57271 - protein, 33 aa, Artificial Sequence
  Description of Artificial Sequence: Synthetic polypeptide
DEEEIRTTNPVATEQYGVVSTQLSQNGSGENDE

SEQ ID NO: 57272 - protein, 31 aa, Artificial Sequence
  Description of Artificial Sequence: Synthetic polypeptide
DEEEIRTTNPVATEQYGSVNSIPLENGMEGF

SEQ ID NO: 57273 - protein, 33 aa, Artificial Sequence
  Description of Artificial Sequence: Synthetic polypeptide
DEEEIRTTNPVATEQYGSVNSINELDELNGEER

SEQ ID NO: 57274 - protein, 32 aa, Artificial Sequence
  Description of Artificial Sequence: Synthetic polypeptide
DEEEIRTTNPVATEQYGVVSTSTDDQDEGNTS

SEQ ID NO: 57275 - protein, 32 aa, Artificial Sequence
  Description of Artificial Sequence: Synthetic polypeptide
DEEEIRTTNPVATEQYGSVNSGTTDERGEDVV

SEQ ID NO: 57276 - protein, 33 aa, Artificial Sequence
  Description of Artificial Sequence: Synthetic polypeptide
DEEEIRTTNPVATEQYGVVSTPNLIGPEGNQGV

SEQ ID NO: 57277 - protein, 34 aa, Artificial Sequence
  Description of Artificial Sequence: Synthetic polypeptide
DEEEIRTTNPVATEQYGSVNSGTQNLFENGGNIT

SEQ ID NO: 57278 - protein, 34 aa, Artificial Sequence
  Description of Artificial Sequence: Synthetic polypeptide
DEEEIRTTNPVATEQYGSVNSGTMNLTNGGGNGD

SEQ ID NO: 57279 - protein, 33 aa, Artificial Sequence
  Description of Artificial Sequence: Synthetic polypeptide
DEEEIRTTNPVATEQYGVVSTSTNLNENQGTNM

SEQ ID NO: 57280 - protein, 33 aa, Artificial Sequence
  Description of Artificial Sequence: Synthetic polypeptide
DEEEIRTTNPVATEQYGSVNSGTMGLGGPEGNA

SEQ ID NO: 57281 - protein, 33 aa, Artificial Sequence
  Description of Artificial Sequence: Synthetic polypeptide
DEEEIRTTNPVATEQYGVVSTSTNQTNLQGTNM

SEQ ID NO: 57282 - protein, 32 aa, Artificial Sequence
  Description of Artificial Sequence: Synthetic polypeptide
DEEEIRTTNPVATEQYGSVNSGTDQGGGENEQ

SEQ ID NO: 57283 - protein, 33 aa, Artificial Sequence
  Description of Artificial Sequence: Synthetic polypeptide
DEEEIRTTNPVATEQYGSVNSGQNLENGGNIED

SEQ ID NO: 57284 - protein, 34 aa, Artificial Sequence
  Description of Artificial Sequence: Synthetic polypeptide
DEEEIRTTNPVATEQYGSVNSGMTNLQNEVNEDI

SEQ ID NO: 57285 - protein, 34 aa, Artificial Sequence
  Description of Artificial Sequence: Synthetic polypeptide
DEEEIRTTNPVATEQYGSVNSGMGNLQNNGTNGD

SEQ ID NO: 57286 - protein, 32 aa, Artificial Sequence
  Description of Artificial Sequence: Synthetic polypeptide
DEEEIRTTNPVATEQYGSVNSETEDDHRNERD

SEQ ID NO: 57287 - protein, 34 aa, Artificial Sequence
  Description of Artificial Sequence: Synthetic polypeptide
DEEEIRTTNPVATEQYGSVNSGTNMEQGIGNDEQ

SEQ ID NO: 57288 - protein, 33 aa, Artificial Sequence
  Description of Artificial Sequence: Synthetic polypeptide
DEEEIRTTNPVATEQYGVVSTNGGGQEGGENED

SEQ ID NO: 57289 - protein, 31 aa, Artificial Sequence
  Description of Artificial Sequence: Synthetic polypeptide
DEEEIRTTNPVATEQYGVVSTNDWSYDLVIR

SEQ ID NO: 57290 - protein, 33 aa, Artificial Sequence
  Description of Artificial Sequence: Synthetic polypeptide
DEEEIRTTNPVATEQYGVVSTMNLVQQDGEGED

SEQ ID NO: 57291 - protein, 33 aa, Artificial Sequence
  Description of Artificial Sequence: Synthetic polypeptide
DEEEIRTTNPVATEQYGVVSTMNGQGEGGNEDT

SEQ ID NO: 57292 - protein, 33 aa, Artificial Sequence
  Description of Artificial Sequence: Synthetic polypeptide
DEEEIRTTNPVATEQYGVVSTMNLAQDDEMNDQ

SEQ ID NO: 57293 - protein, 34 aa, Artificial Sequence
  Description of Artificial Sequence: Synthetic polypeptide
DEEEIRTTNPVATEQYGSVNSTFNLDGFGGNNNG

SEQ ID NO: 57294 - protein, 33 aa, Artificial Sequence
  Description of Artificial Sequence: Synthetic polypeptide
DEEEIRTTNPVATEQYGSVNSTETEDQRNENEQ

SEQ ID NO: 57295 - protein, 32 aa, Artificial Sequence
  Description of Artificial Sequence: Synthetic polypeptide
DEEEIRTTNPVATEQYGSVNSTEDLDPSEERI

SEQ ID NO: 57296 - protein, 32 aa, Artificial Sequence
  Description of Artificial Sequence: Synthetic polypeptide
DEEEIRTTNPVATEQYGSVNSTEAQIYNENQQ

SEQ ID NO: 57297 - protein, 33 aa, Artificial Sequence
  Description of Artificial Sequence: Synthetic polypeptide
DEEEIRTTNPVATEQYGVVSTMNLGQPEGQSDD

SEQ ID NO: 57298 - protein, 34 aa, Artificial Sequence
  Description of Artificial Sequence: Synthetic polypeptide
DEEEIRTTNPVATEQYGVVSTMNLINIQGGNNDD

SEQ ID NO: 57299 - protein, 34 aa, Artificial Sequence
  Description of Artificial Sequence: Synthetic polypeptide
DEEEIRTTNPVATEQYGVVSTMNLVDDQGGENND

SEQ ID NO: 57300 - protein, 33 aa, Artificial Sequence
  Description of Artificial Sequence: Synthetic polypeptide
DEEEIRTTNPVATEQYGVVSTMNLVDVQGNNDE

SEQ ID NO: 57301 - protein, 34 aa, Artificial Sequence
  Description of Artificial Sequence: Synthetic polypeptide
DEEEIRTTNPVATEQYGVVSTMNLVEGQEGGNND

SEQ ID NO: 57302 - protein, 33 aa, Artificial Sequence
  Description of Artificial Sequence: Synthetic polypeptide
DEEEIRTTNPVATEQYGVVSTMNLVEGQGINQM

SEQ ID NO: 57303 - protein, 33 aa, Artificial Sequence
  Description of Artificial Sequence: Synthetic polypeptide
DEEEIRTTNPVATEQYGVVSTMNLVEIQGENND

SEQ ID NO: 57304 - protein, 33 aa, Artificial Sequence
  Description of Artificial Sequence: Synthetic polypeptide
DEEEIRTTNPVATEQYGVVSTMNLVIGQGINNP

SEQ ID NO: 57305 - protein, 33 aa, Artificial Sequence
  Description of Artificial Sequence: Synthetic polypeptide
DEEEIRTTNPVATEQYGVVSTMNLVNIGGNNDQ

SEQ ID NO: 57306 - protein, 34 aa, Artificial Sequence
  Description of Artificial Sequence: Synthetic polypeptide
DEEEIRTTNPVATEQYGVVSTMNLVNIQGGGNND

SEQ ID NO: 57307 - protein, 33 aa, Artificial Sequence
  Description of Artificial Sequence: Synthetic polypeptide
DEEEIRTTNPVATEQYGVVSTMNLVNIQGINDD

SEQ ID NO: 57308 - protein, 34 aa, Artificial Sequence
  Description of Artificial Sequence: Synthetic polypeptide
DEEEIRTTNPVATEQYGVVSTMNLVQGQGINNLG

SEQ ID NO: 57309 - protein, 34 aa, Artificial Sequence
  Description of Artificial Sequence: Synthetic polypeptide
DEEEIRTTNPVATEQYGSVNSQTGNIGQGEGNET

SEQ ID NO: 57310 - protein, 34 aa, Artificial Sequence
  Description of Artificial Sequence: Synthetic polypeptide
DEEEIRTTNPVATEQYGVVSTMNLVQIQDGENGQ

SEQ ID NO: 57311 - protein, 34 aa, Artificial Sequence
  Description of Artificial Sequence: Synthetic polypeptide
DEEEIRTTNPVATEQYGVVSTMNLVQIQEGENEM

SEQ ID NO: 57312 - protein, 30 aa, Artificial Sequence
  Description of Artificial Sequence: Synthetic polypeptide
DEEEIRTTNPVATESYGCIATANEQRDNNH

SEQ ID NO: 57313 - protein, 32 aa, Artificial Sequence
  Description of Artificial Sequence: Synthetic polypeptide
DEEEIRTTNPVATEQYGSVNETNDDEARGDQI

SEQ ID NO: 57314 - protein, 34 aa, Artificial Sequence
  Description of Artificial Sequence: Synthetic polypeptide
DEEEIRTTNPVATESYGISVVSGMNLQDRDGNEE

SEQ ID NO: 57315 - protein, 33 aa, Artificial Sequence
  Description of Artificial Sequence: Synthetic polypeptide
DEEEIRTTNPVATEQYGSVNDTINLDQGEFNEQ

SEQ ID NO: 57316 - protein, 32 aa, Artificial Sequence
  Description of Artificial Sequence: Synthetic polypeptide
DEEEIRTTNPVAYEAYGSVSTVNALQSGGEYQ

SEQ ID NO: 57317 - protein, 32 aa, Artificial Sequence
  Description of Artificial Sequence: Synthetic polypeptide
DEEEIRTTNPVAYEAYGSVSTVNALTGGGEYR

SEQ ID NO: 57318 - protein, 33 aa, Artificial Sequence
  Description of Artificial Sequence: Synthetic polypeptide
DEEEIRTTNPVATEQYGSVIVINNLQREENEDE

SEQ ID NO: 57319 - protein, 32 aa, Artificial Sequence
  Description of Artificial Sequence: Synthetic polypeptide
DEEEIRTTNPVAYEAYGSVVTTNELVDRENIR

SEQ ID NO: 57320 - protein, 32 aa, Artificial Sequence
  Description of Artificial Sequence: Synthetic polypeptide
DEEEIRTTNPVAYEAYGVVVSTNELDQNGGNP

SEQ ID NO: 57321 - protein, 33 aa, Artificial Sequence
  Description of Artificial Sequence: Synthetic polypeptide
DEEEIRTTNPVAYEEYGSTVPSTNELAQFGGNQ

SEQ ID NO: 57322 - protein, 32 aa, Artificial Sequence
  Description of Artificial Sequence: Synthetic polypeptide
DEEEIRTTNPVAYEEYGSVSCTNELSQFGGSA

SEQ ID NO: 57323 - protein, 33 aa, Artificial Sequence
  Description of Artificial Sequence: Synthetic polypeptide
DEEEIRTTNPVATEQYGSVITTGNGQGNAGNGD

SEQ ID NO: 57324 - protein, 31 aa, Artificial Sequence
  Description of Artificial Sequence: Synthetic polypeptide
DEEEIRTTNPVAYEEYGSVSTNELSTPGGSQ

SEQ ID NO: 57325 - protein, 33 aa, Artificial Sequence
  Description of Artificial Sequence: Synthetic polypeptide
DEEEIRTTNPVATEQYGSVIYCTENLQTNVNGF

SEQ ID NO: 57326 - protein, 33 aa, Artificial Sequence
  Description of Artificial Sequence: Synthetic polypeptide
DEEEIRTTNPVAYEEYGSVVSCTNELQIGGNQA

SEQ ID NO: 57327 - protein, 33 aa, Artificial Sequence
  Description of Artificial Sequence: Synthetic polypeptide
DEEEIRTTNPVAYEEYGSVVSCTNELQQAGGNQ

SEQ ID NO: 57328 - protein, 32 aa, Artificial Sequence
  Description of Artificial Sequence: Synthetic polypeptide
DEEEIRTTNPVAYEFYGVVPSTGNGSQMGGNR

SEQ ID NO: 57329 - protein, 33 aa, Artificial Sequence
  Description of Artificial Sequence: Synthetic polypeptide
DEEEIRTTNPVAYEHWGSVPSDTNLSQSVGNDR

SEQ ID NO: 57330 - protein, 33 aa, Artificial Sequence
  Description of Artificial Sequence: Synthetic polypeptide
DEEEIRTTNPVATEQYGSVITPLMDPQREIELR

SEQ ID NO: 57331 - protein, 33 aa, Artificial Sequence
  Description of Artificial Sequence: Synthetic polypeptide
DEEEIRTTNPVATEQYGSVITPENLIRQTNVGT

SEQ ID NO: 57332 - protein, 33 aa, Artificial Sequence
  Description of Artificial Sequence: Synthetic polypeptide
DEEEIRTTNPVAYEMYGSVPSCNCLSQRGGNND

SEQ ID NO: 57333 - protein, 34 aa, Artificial Sequence
  Description of Artificial Sequence: Synthetic polypeptide
DEEEIRTTNPVATEQYGSVITNTNLTQVRENNGV

SEQ ID NO: 57334 - protein, 33 aa, Artificial Sequence
  Description of Artificial Sequence: Synthetic polypeptide
DEEEIRTTNPVAYEPWGSVSTNELSQRNGGARM

SEQ ID NO: 57335 - protein, 32 aa, Artificial Sequence
  Description of Artificial Sequence: Synthetic polypeptide
DEEEIRTTNPVAYEPWGSVSTNLSQPNGGERT

SEQ ID NO: 57336 - protein, 34 aa, Artificial Sequence
  Description of Artificial Sequence: Synthetic polypeptide
DEEEIRTTNPVATEQYGSVITSNNLQMNGGNNGE

SEQ ID NO: 57337 - protein, 31 aa, Artificial Sequence
  Description of Artificial Sequence: Synthetic polypeptide
DEEEIRTTNPVAYEPWGSVSTNLSQSNGGAI

SEQ ID NO: 57338 - protein, 33 aa, Artificial Sequence
  Description of Artificial Sequence: Synthetic polypeptide
DEEEIRTTNPVAYEAYGSVSTVNALQQTGGEYR

SEQ ID NO: 57339 - protein, 32 aa, Artificial Sequence
  Description of Artificial Sequence: Synthetic polypeptide
DEEEIRTTNPVAYEAYGSVSTNELDQPGGPTS

SEQ ID NO: 57340 - protein, 33 aa, Artificial Sequence
  Description of Artificial Sequence: Synthetic polypeptide
DEEEIRTTNPVAYEAYGQSTVSCTNELDQNGNP

SEQ ID NO: 57341 - protein, 32 aa, Artificial Sequence
  Description of Artificial Sequence: Synthetic polypeptide
DEEEIRTTNPVATEQYGSVLSPTPIQQLPVRD

SEQ ID NO: 57342 - protein, 32 aa, Artificial Sequence
  Description of Artificial Sequence: Synthetic polypeptide
DEEEIRTTNPVAYEAYGSLVNWNLSQGTEGNR

SEQ ID NO: 57343 - protein, 32 aa, Artificial Sequence
  Description of Artificial Sequence: Synthetic polypeptide
DEEEIRTTNPVAYEAYGSTFCTNELQRGGNEN

SEQ ID NO: 57344 - protein, 32 aa, Artificial Sequence
  Description of Artificial Sequence: Synthetic polypeptide
DEEEIRTTNPVAYEAYGSTVSTGNTQTMVGNA

SEQ ID NO: 57345 - protein, 32 aa, Artificial Sequence
  Description of Artificial Sequence: Synthetic polypeptide
DEEEIRTTNPVATEQYGSVLSNILDQIVGTDW

SEQ ID NO: 57346 - protein, 33 aa, Artificial Sequence
  Description of Artificial Sequence: Synthetic polypeptide
DEEEIRTTNPVAYEAYGSVPCTGNLSYQRGGTR

SEQ ID NO: 57347 - protein, 32 aa, Artificial Sequence
  Description of Artificial Sequence: Synthetic polypeptide
DEEEIRTTNPVAYEAYGSVPSTDNMLSPSGND

SEQ ID NO: 57348 - protein, 34 aa, Artificial Sequence
  Description of Artificial Sequence: Synthetic polypeptide
DEEEIRTTNPVAYEAYGSVPSTVNALQREGGDYR

SEQ ID NO: 57349 - protein, 32 aa, Artificial Sequence
  Description of Artificial Sequence: Synthetic polypeptide
DEEEIRTTNPVAYEAYGSVSTNELDQPGGSPP

SEQ ID NO: 57350 - protein, 33 aa, Artificial Sequence
  Description of Artificial Sequence: Synthetic polypeptide
DEEEIRTTNPVAYEAYGSVPSTVNALQSGGETR

SEQ ID NO: 57351 - protein, 33 aa, Artificial Sequence
  Description of Artificial Sequence: Synthetic polypeptide
DEEEIRTTNPVAYEAYGSVPSYNCLSQRGGNNS

SEQ ID NO: 57352 - protein, 32 aa, Artificial Sequence
  Description of Artificial Sequence: Synthetic polypeptide
DEEEIRTTNPVATEQYGSVLFTGTDTRFGTRT

SEQ ID NO: 57353 - protein, 34 aa, Artificial Sequence
  Description of Artificial Sequence: Synthetic polypeptide
DEEEIRTTNPVATEQYGSVLATNEEQRQGQELRV

SEQ ID NO: 57354 - protein, 33 aa, Artificial Sequence
  Description of Artificial Sequence: Synthetic polypeptide
DEEEIRTTNPVAYEAYGSVSCTVNLQRGGEYDW

SEQ ID NO: 57355 - protein, 33 aa, Artificial Sequence
  Description of Artificial Sequence: Synthetic polypeptide
DEEEIRTTNPVATEQYGSVKPTNEQAIGPVQNF

SEQ ID NO: 57356 - protein, 32 aa, Artificial Sequence
  Description of Artificial Sequence: Synthetic polypeptide
DEEEIRTTNPVAYEAYGSVSTNEGADQNGGNL

SEQ ID NO: 57357 - protein, 33 aa, Artificial Sequence
  Description of Artificial Sequence: Synthetic polypeptide
DEEEIRTTNPVATEQYGSVIYTEVIGQPRGLER

SEQ ID NO: 57358 - protein, 33 aa, Artificial Sequence
  Description of Artificial Sequence: Synthetic polypeptide
DEEEIRTTNPVATEQYGSVIYPTNPGQPRQLLR

SEQ ID NO: 57359 - protein, 33 aa, Artificial Sequence
  Description of Artificial Sequence: Synthetic polypeptide
DEEEIRTTNPVATEQYGSVIYPTNLGREGEIED

SEQ ID NO: 57360 - protein, 34 aa, Artificial Sequence
  Description of Artificial Sequence: Synthetic polypeptide
DEEEIRTTNPVAYEAYGSVPSTVNALVQRGGSYR

SEQ ID NO: 57361 - protein, 32 aa, Artificial Sequence
  Description of Artificial Sequence: Synthetic polypeptide
DEEEIRTTNPVAYEPWGTVSTNLSQERNGGPR

SEQ ID NO: 57362 - protein, 33 aa, Artificial Sequence
  Description of Artificial Sequence: Synthetic polypeptide
DEEEIRTTNPVATEQYGSVITNMIQRMDMNGEG

SEQ ID NO: 57363 - protein, 32 aa, Artificial Sequence
  Description of Artificial Sequence: Synthetic polypeptide
DEEEIRTTNPVAYEPYGICVSTVNLQERISNQ

SEQ ID NO: 57364 - protein, 32 aa, Artificial Sequence
  Description of Artificial Sequence: Synthetic polypeptide
DEEEIRTTNPVATEQYGSVITNEVVEMGEAER

SEQ ID NO: 57365 - protein, 33 aa, Artificial Sequence
  Description of Artificial Sequence: Synthetic polypeptide
DEEEIRTTNPVAYEQWGSCVRQTNDHLQRGIQR

SEQ ID NO: 57366 - protein, 34 aa, Artificial Sequence
  Description of Artificial Sequence: Synthetic polypeptide
DEEEIRTTNPVAYEQWGSCVYSDTWNDGQRSGNR

SEQ ID NO: 57367 - protein, 34 aa, Artificial Sequence
  Description of Artificial Sequence: Synthetic polypeptide
DEEEIRTTNPVAYEQWGSTCSPTENLDQRDGNNR

SEQ ID NO: 57368 - protein, 32 aa, Artificial Sequence
  Description of Artificial Sequence: Synthetic polypeptide
DEEEIRTTNPVAYEQWGSTSPTENDSQRQGNS

SEQ ID NO: 57369 - protein, 31 aa, Artificial Sequence
  Description of Artificial Sequence: Synthetic polypeptide
DEEEIRTTNPVATEQYGSVITNDEGEEGELT

SEQ ID NO: 57370 - protein, 32 aa, Artificial Sequence
  Description of Artificial Sequence: Synthetic polypeptide
DEEEIRTTNPVAYEQWGSTSPTENQSQGDGNR

SEQ ID NO: 57371 - protein, 31 aa, Artificial Sequence
  Description of Artificial Sequence: Synthetic polypeptide
DEEEIRTTNPVAYEQWGSVAWTELQLLDGSR

SEQ ID NO: 57372 - protein, 32 aa, Artificial Sequence
  Description of Artificial Sequence: Synthetic polypeptide
DEEEIRTTNPVAYEQWGSVCTIELDQVGDSNR

SEQ ID NO: 57373 - protein, 34 aa, Artificial Sequence
  Description of Artificial Sequence: Synthetic polypeptide
DEEEIRTTNPVAYEQWGQSYVSQTNDHLQRGDRR

SEQ ID NO: 57374 - protein, 33 aa, Artificial Sequence
  Description of Artificial Sequence: Synthetic polypeptide
DEEEIRTTNPVATEQYGSVITGNGQERVISNIV

SEQ ID NO: 57375 - protein, 34 aa, Artificial Sequence
  Description of Artificial Sequence: Synthetic polypeptide
DEEEIRTTNPVAYEQWGSVPSYNACLSQRGGNNR

SEQ ID NO: 57376 - protein, 33 aa, Artificial Sequence
  Description of Artificial Sequence: Synthetic polypeptide
DEEEIRTTNPVATEQYGSVITGGNMQGNAGNGG

SEQ ID NO: 57377 - protein, 32 aa, Artificial Sequence
  Description of Artificial Sequence: Synthetic polypeptide
DEEEIRTTNPVAYEQWGSVSTDNMLSGSGNND

SEQ ID NO: 57378 - protein, 32 aa, Artificial Sequence
  Description of Artificial Sequence: Synthetic polypeptide
DEEEIRTTNPVAYEQWGSVSTNMHSPQPGTNL

SEQ ID NO: 57379 - protein, 32 aa, Artificial Sequence
  Description of Artificial Sequence: Synthetic polypeptide
DEEEIRTTNPVATEQYGSVITDLLQPQTGDVE

SEQ ID NO: 57380 - protein, 33 aa, Artificial Sequence
  Description of Artificial Sequence: Synthetic polypeptide
DEEEIRTTNPVAYEQWGSVVPTWNLSQMTGGNR

SEQ ID NO: 57381 - protein, 29 aa, Artificial Sequence
  Description of Artificial Sequence: Synthetic peptide
DEEEIRTTNPVAYEQWGSVWIELQDNDSR

SEQ ID NO: 57382 - protein, 30 aa, Artificial Sequence
  Description of Artificial Sequence: Synthetic polypeptide
DEEEIRTTNPVAYEQWGSVWTELQVMDTSR

SEQ ID NO: 57383 - protein, 31 aa, Artificial Sequence
  Description of Artificial Sequence: Synthetic polypeptide
DEEEIRTTNPVAYEQWGSVWTELQVRDESDR

SEQ ID NO: 57384 - protein, 31 aa, Artificial Sequence
  Description of Artificial Sequence: Synthetic polypeptide
DEEEIRTTNPVAYEQWGSVIWTELQVDDGSR

SEQ ID NO: 57385 - protein, 33 aa, Artificial Sequence
  Description of Artificial Sequence: Synthetic polypeptide
DEEEIRTTNPVAYEQWGQSTVVATNLSTTRGNR

SEQ ID NO: 57386 - protein, 32 aa, Artificial Sequence
  Description of Artificial Sequence: Synthetic polypeptide
DEEEIRTTNPVATEQYGSVITNINVQMQNEMT

SEQ ID NO: 57387 - protein, 32 aa, Artificial Sequence
  Description of Artificial Sequence: Synthetic polypeptide
DEEEIRTTNPVAYEQWGQSTVSTYLSLRGTNS

SEQ ID NO: 57388 - protein, 34 aa, Artificial Sequence
  Description of Artificial Sequence: Synthetic polypeptide
DEEEIRTTNPVAYEPYGISTVSTVNLSQDRSTNR

SEQ ID NO: 57389 - protein, 33 aa, Artificial Sequence
  Description of Artificial Sequence: Synthetic polypeptide
DEEEIRTTNPVAYEPYGISVSTNNLSQQRVTNP

SEQ ID NO: 57390 - protein, 31 aa, Artificial Sequence
  Description of Artificial Sequence: Synthetic polypeptide
DEEEIRTTNPVAYEPYGKVFCTNLARGGNQL

SEQ ID NO: 57391 - protein, 33 aa, Artificial Sequence
  Description of Artificial Sequence: Synthetic polypeptide
DEEEIRTTNPVAYEPYGQSVSQNELSQRTGDMR

SEQ ID NO: 57392 - protein, 33 aa, Artificial Sequence
  Description of Artificial Sequence: Synthetic polypeptide
DEEEIRTTNPVAYEPYGQSVSTNQSQRSVGSRD

SEQ ID NO: 57393 - protein, 32 aa, Artificial Sequence
  Description of Artificial Sequence: Synthetic polypeptide
DEEEIRTTNPVAYEPYGQSVSTNQSQVVGSRI

SEQ ID NO: 57394 - protein, 33 aa, Artificial Sequence
  Description of Artificial Sequence: Synthetic polypeptide
DEEEIRTTNPVAYEPYGSVCCTFNLSTQRGGTR

SEQ ID NO: 57395 - protein, 32 aa, Artificial Sequence
  Description of Artificial Sequence: Synthetic polypeptide
DEEEIRTTNPVAYEPYGSVCCTGNLTYRGGDR

SEQ ID NO: 57396 - protein, 32 aa, Artificial Sequence
  Description of Artificial Sequence: Synthetic polypeptide
DEEEIRTTNPVAYEPYGSVCFTNLSTRAGGNE

SEQ ID NO: 57397 - protein, 31 aa, Artificial Sequence
  Description of Artificial Sequence: Synthetic polypeptide
DEEEIRTTNPVAYEPYGSVNCTNSSQYGVNK

SEQ ID NO: 57398 - protein, 32 aa, Artificial Sequence
  Description of Artificial Sequence: Synthetic polypeptide
DEEEIRTTNPVAYEPYGSVNTNISQRAVGNYK

SEQ ID NO: 57399 - protein, 33 aa, Artificial Sequence
  Description of Artificial Sequence: Synthetic polypeptide
DEEEIRTTNPVAYEPYGSVSYNCALSARGGNNR

SEQ ID NO: 57400 - protein, 33 aa, Artificial Sequence
  Description of Artificial Sequence: Synthetic polypeptide
DEEEIRTTNPVAYEPYGSVVVFTNLSTRAGTNR

SEQ ID NO: 57401 - protein, 30 aa, Artificial Sequence
  Description of Artificial Sequence: Synthetic polypeptide
DEEEIRTTNPVAYEPYGSVWCTNISHGVNK

SEQ ID NO: 57402 - protein, 31 aa, Artificial Sequence
  Description of Artificial Sequence: Synthetic polypeptide
DEEEIRTTNPVAYEQFGQSVSTYLSTNGGNS

SEQ ID NO: 57403 - protein, 33 aa, Artificial Sequence
  Description of Artificial Sequence: Synthetic polypeptide
DEEEIRTTNPVAYEQWGCSVSRNDLDQRQGERR

SEQ ID NO: 57404 - protein, 32 aa, Artificial Sequence
  Description of Artificial Sequence: Synthetic polypeptide
DEEEIRTTNPVAYEQWGESVSQNDPLQEGIRR

SEQ ID NO: 57405 - protein, 33 aa, Artificial Sequence
  Description of Artificial Sequence: Synthetic polypeptide
DEEEIRTTNPVAYEQWGHTSPTDNLDQRDGNGR

SEQ ID NO: 57406 - protein, 32 aa, Artificial Sequence
  Description of Artificial Sequence: Synthetic polypeptide
DEEEIRTTNPVAYEQWGHTSPTDNLDQREGNP

SEQ ID NO: 57407 - protein, 33 aa, Artificial Sequence
  Description of Artificial Sequence: Synthetic polypeptide
DEEEIRTTNPVAYEQWGISVRQTNDHLQRGDAR

SEQ ID NO: 57408 - protein, 33 aa, Artificial Sequence
  Description of Artificial Sequence: Synthetic polypeptide
DEEEIRTTNPVATEQYGSVITNLELMIVGNEEY

SEQ ID NO: 57409 - protein, 33 aa, Artificial Sequence
  Description of Artificial Sequence: Synthetic polypeptide
DEEEIRTTNPVATEQYGSVLSTNEQPRQPEEQT

SEQ ID NO: 57410 - protein, 32 aa, Artificial Sequence
  Description of Artificial Sequence: Synthetic polypeptide
DEEEIRTTNPVATEQYGVVCSTELQAFGSDQP

SEQ ID NO: 57411 - protein, 32 aa, Artificial Sequence
  Description of Artificial Sequence: Synthetic polypeptide
DEEEIRTTNPVAYEAYGQSTVATNLSTTPGNR

SEQ ID NO: 57412 - protein, 34 aa, Artificial Sequence
  Description of Artificial Sequence: Synthetic polypeptide
DEEEIRTTNPVAYEAYGKLVSYTNLQRTGTENRG

SEQ ID NO: 57413 - protein, 32 aa, Artificial Sequence
  Description of Artificial Sequence: Synthetic polypeptide
DEEEIRTTNPVATEWYGSVTSLNTFQRGSDQI

SEQ ID NO: 57414 - protein, 33 aa, Artificial Sequence
  Description of Artificial Sequence: Synthetic polypeptide
DEEEIRTTNPVATEWYGSVVATNMFSQRGWQRD

SEQ ID NO: 57415 - protein, 33 aa, Artificial Sequence
  Description of Artificial Sequence: Synthetic polypeptide
DEEEIRTTNPVATEWYGVCVYSTNDLQNMGENH

SEQ ID NO: 57416 - protein, 32 aa, Artificial Sequence
  Description of Artificial Sequence: Synthetic polypeptide
DEEEIRTTNPVATEYYGCVCSNTELQRGSEQS

SEQ ID NO: 57417 - protein, 31 aa, Artificial Sequence
  Description of Artificial Sequence: Synthetic polypeptide
DEEEIRTTNPVATEYYGCVSTEELQNGSEDS

SEQ ID NO: 57418 - protein, 35 aa, Artificial Sequence
  Description of Artificial Sequence: Synthetic polypeptide
DEEEIRTTNPVATHQYGSVVSCTNALSMRGGNNRN

SEQ ID NO: 57419 - protein, 33 aa, Artificial Sequence
  Description of Artificial Sequence: Synthetic polypeptide
DEEEIRTTNPVAVEQYGQVVSNTNGLLQGGIIR

SEQ ID NO: 57420 - protein, 33 aa, Artificial Sequence
  Description of Artificial Sequence: Synthetic polypeptide
DEEEIRTTNPVAVEQYGSVSTNNDLLQGIGIGT

SEQ ID NO: 57421 - protein, 33 aa, Artificial Sequence
  Description of Artificial Sequence: Synthetic polypeptide
DEEEIRTTNPVAVEQYGSVSTNNDNLQQGIGTD

SEQ ID NO: 57422 - protein, 32 aa, Artificial Sequence
  Description of Artificial Sequence: Synthetic polypeptide
DEEEIRTTNPVATEVYGTVSITPTTLYSSGNR

SEQ ID NO: 57423 - protein, 33 aa, Artificial Sequence
  Description of Artificial Sequence: Synthetic polypeptide
DEEEIRTTNPVAVEQYGSVSTNNNDLLQGNIGT

SEQ ID NO: 57424 - protein, 33 aa, Artificial Sequence
  Description of Artificial Sequence: Synthetic polypeptide
DEEEIRTTNPVAVEQYGSVSTNNNLLQAEIGTS

SEQ ID NO: 57425 - protein, 33 aa, Artificial Sequence
  Description of Artificial Sequence: Synthetic polypeptide
DEEEIRTTNPVAVEQYGSVSTNTNDNLQSGTIS

SEQ ID NO: 57426 - protein, 33 aa, Artificial Sequence
  Description of Artificial Sequence: Synthetic polypeptide
DEEEIRTTNPVAVEQYGSVSTNTNELLQSGIIS

SEQ ID NO: 57427 - protein, 33 aa, Artificial Sequence
  Description of Artificial Sequence: Synthetic polypeptide
DEEEIRTTNPVAVEQYGSVSTNTNNQQGVNNSD

SEQ ID NO: 57428 - protein, 33 aa, Artificial Sequence
  Description of Artificial Sequence: Synthetic polypeptide
DEEEIRTTNPVAVEQYGSVSTTNDNLQQGQEEL

SEQ ID NO: 57429 - protein, 33 aa, Artificial Sequence
  Description of Artificial Sequence: Synthetic polypeptide
DEEEIRTTNPVAVEQYGSVSTTNDQLGNNGQED

SEQ ID NO: 57430 - protein, 31 aa, Artificial Sequence
  Description of Artificial Sequence: Synthetic polypeptide
DEEEIRTTNPVATEQYGSVMSGMFNNQEVEI

SEQ ID NO: 57431 - protein, 33 aa, Artificial Sequence
  Description of Artificial Sequence: Synthetic polypeptide
DEEEIRTTNPVATEQYGSVMSGMFNDQEGNGNI

SEQ ID NO: 57432 - protein, 33 aa, Artificial Sequence
  Description of Artificial Sequence: Synthetic polypeptide
DEEEIRTTNPVAVEQYGSVSTTNLEQGNNNSDD

SEQ ID NO: 57433 - protein, 33 aa, Artificial Sequence
  Description of Artificial Sequence: Synthetic polypeptide
DEEEIRTTNPVAVEQYGSVSTNNNDNLQGGIGT

SEQ ID NO: 57434 - protein, 33 aa, Artificial Sequence
  Description of Artificial Sequence: Synthetic polypeptide
DEEEIRTTNPVAVEQYGSVSTTNNDLLQQGIGT

SEQ ID NO: 57435 - protein, 33 aa, Artificial Sequence
  Description of Artificial Sequence: Synthetic polypeptide
DEEEIRTTNPVATEVYGSVVDFTNELTRGGNND

SEQ ID NO: 57436 - protein, 34 aa, Artificial Sequence
  Description of Artificial Sequence: Synthetic polypeptide
DEEEIRTTNPVATEVYGSVSTGVNLTQGGGNGEN

SEQ ID NO: 57437 - protein, 32 aa, Artificial Sequence
  Description of Artificial Sequence: Synthetic polypeptide
DEEEIRTTNPVATEQYGSVNDQNFGQSGENED

SEQ ID NO: 57438 - protein, 33 aa, Artificial Sequence
  Description of Artificial Sequence: Synthetic polypeptide
DEEEIRTTNPVATESYGISVVSGMNLQDTDGNN

SEQ ID NO: 57439 - protein, 33 aa, Artificial Sequence
  Description of Artificial Sequence: Synthetic polypeptide
DEEEIRTTNPVATESYGISVVTGMNLQDHDGNG

SEQ ID NO: 57440 - protein, 33 aa, Artificial Sequence
  Description of Artificial Sequence: Synthetic polypeptide
DEEEIRTTNPVATESYGIVVSQVNLQDRNVNRT

SEQ ID NO: 57441 - protein, 33 aa, Artificial Sequence
  Description of Artificial Sequence: Synthetic polypeptide
DEEEIRTTNPVATEQYGSVNDGTNLQNDVENED

SEQ ID NO: 57442 - protein, 34 aa, Artificial Sequence
  Description of Artificial Sequence: Synthetic polypeptide
DEEEIRTTNPVATEQYGSVNDDTINLDQGEFGNG

SEQ ID NO: 57443 - protein, 34 aa, Artificial Sequence
  Description of Artificial Sequence: Synthetic polypeptide
DEEEIRTTNPVATESYGSVASDTNPDQIGGNQRR

SEQ ID NO: 57444 - protein, 33 aa, Artificial Sequence
  Description of Artificial Sequence: Synthetic polypeptide
DEEEIRTTNPVATESYGSVSGTNMTQGDGDNIQ

SEQ ID NO: 57445 - protein, 33 aa, Artificial Sequence
  Description of Artificial Sequence: Synthetic polypeptide
DEEEIRTTNPVATESYGSVSTYGLQEMGGNEDN

SEQ ID NO: 57446 - protein, 34 aa, Artificial Sequence
  Description of Artificial Sequence: Synthetic polypeptide
DEEEIRTTNPVATEVYGSVSTGVNLTQGGGNGEQ

SEQ ID NO: 57447 - protein, 32 aa, Artificial Sequence
  Description of Artificial Sequence: Synthetic polypeptide
DEEEIRTTNPVATESYGSVYSTNCIQKCGEIE

SEQ ID NO: 57448 - protein, 32 aa, Artificial Sequence
  Description of Artificial Sequence: Synthetic polypeptide
DEEEIRTTNPVATESYGVVSTVNLFGNGNEDE

SEQ ID NO: 57449 - protein, 32 aa, Artificial Sequence
  Description of Artificial Sequence: Synthetic polypeptide
DEEEIRTTNPVATESYGVVSTVNLGFNGGNND

SEQ ID NO: 57450 - protein, 32 aa, Artificial Sequence
  Description of Artificial Sequence: Synthetic polypeptide
DEEEIRTTNPVATESYGVVSTVNLIFENGGNQ

SEQ ID NO: 57451 - protein, 32 aa, Artificial Sequence
  Description of Artificial Sequence: Synthetic polypeptide
DEEEIRTTNPVATESYGVVSTVNLNFNGNEDD

SEQ ID NO: 57452 - protein, 32 aa, Artificial Sequence
  Description of Artificial Sequence: Synthetic polypeptide
DEEEIRTTNPVATESYGVVSTVNLTFNGGNGN

SEQ ID NO: 57453 - protein, 33 aa, Artificial Sequence
  Description of Artificial Sequence: Synthetic polypeptide
DEEEIRTTNPVATESYGYSVSTGNGHQERDMIR

SEQ ID NO: 57454 - protein, 33 aa, Artificial Sequence
  Description of Artificial Sequence: Synthetic polypeptide
DEEEIRTTNPVATETYGSVSTNLNIGNNGNDDE

SEQ ID NO: 57455 - protein, 31 aa, Artificial Sequence
  Description of Artificial Sequence: Synthetic polypeptide
DEEEIRTTNPVATEVWGSVCSTGREDHRGNY

SEQ ID NO: 57456 - protein, 33 aa, Artificial Sequence
  Description of Artificial Sequence: Synthetic polypeptide
DEEEIRTTNPVATEVYGSVSGNNNLTQGGGNGE

SEQ ID NO: 57457 - protein, 32 aa, Artificial Sequence
  Description of Artificial Sequence: Synthetic polypeptide
DEEEIRTTNPVATESYGVVSTVNLFENGGNGG

SEQ ID NO: 57458 - protein, 33 aa, Artificial Sequence
  Description of Artificial Sequence: Synthetic polypeptide
DEEEIRTTNPVAVEQYGSVSTTNNDNLQNGQEL

SEQ ID NO: 57459 - protein, 33 aa, Artificial Sequence
  Description of Artificial Sequence: Synthetic polypeptide
DEEEIRTTNPVAVEQYGSVSTTNNDQLQNGQED

SEQ ID NO: 57460 - protein, 33 aa, Artificial Sequence
  Description of Artificial Sequence: Synthetic polypeptide
DEEEIRTTNPVAVEQYGSVSTTNNLLQGNGQEA

SEQ ID NO: 57461 - protein, 32 aa, Artificial Sequence
  Description of Artificial Sequence: Synthetic polypeptide
DEEEIRTTNPVAVEQYGSVVTNNNELQQGIGT

SEQ ID NO: 57462 - protein, 33 aa, Artificial Sequence
  Description of Artificial Sequence: Synthetic polypeptide
DEEEIRTTNPVAVEQYGSVVTQTNDLLQRGIGT

SEQ ID NO: 57463 - protein, 33 aa, Artificial Sequence
  Description of Artificial Sequence: Synthetic polypeptide
DEEEIRTTNPVAVEQYGSVVTQTNELLQRGITS

SEQ ID NO: 57464 - protein, 33 aa, Artificial Sequence
  Description of Artificial Sequence: Synthetic polypeptide
DEEEIRTTNPVATEQYGSVLVMTPLQREVTERG

SEQ ID NO: 57465 - protein, 32 aa, Artificial Sequence
  Description of Artificial Sequence: Synthetic polypeptide
DEEEIRTTNPVAVEQYGSVVTTNLLLQNGIGE

SEQ ID NO: 57466 - protein, 33 aa, Artificial Sequence
  Description of Artificial Sequence: Synthetic polypeptide
DEEEIRTTNPVATEQYGSVLTPTLSQIRNVNQN

SEQ ID NO: 57467 - protein, 34 aa, Artificial Sequence
  Description of Artificial Sequence: Synthetic polypeptide
DEEEIRTTNPVAWEPYGSTVSCTNMLFQSGGNPR

SEQ ID NO: 57468 - protein, 33 aa, Artificial Sequence
  Description of Artificial Sequence: Synthetic polypeptide
DEEEIRTTNPVAWEQYGSISCLPNMLSQHVGNR

SEQ ID NO: 57469 - protein, 32 aa, Artificial Sequence
  Description of Artificial Sequence: Synthetic polypeptide
DEEEIRTTNPVAWEQYGSVAWTDNGLQAQDSR

SEQ ID NO: 57470 - protein, 33 aa, Artificial Sequence
  Description of Artificial Sequence: Synthetic polypeptide
DEEEIRTTNPVAVEQYGSVSTVTNQELQNGIIS

SEQ ID NO: 57471 - protein, 32 aa, Artificial Sequence
  Description of Artificial Sequence: Synthetic polypeptide
DEEEIRTTNPVAWEQYGSVWTDNGLDQGQDSR

SEQ ID NO: 57472 - protein, 33 aa, Artificial Sequence
  Description of Artificial Sequence: Synthetic polypeptide
DEEEIRTTNPVAYDQYGQSVSTNALSQSVGLYR

SEQ ID NO: 57473 - protein, 32 aa, Artificial Sequence
  Description of Artificial Sequence: Synthetic polypeptide
DEEEIRTTNPVAYEAWGSTVSTNELDQNGGNP

SEQ ID NO: 57474 - protein, 32 aa, Artificial Sequence
  Description of Artificial Sequence: Synthetic polypeptide
DEEEIRTTNPVAYEAWGSVPSTNLAQQTGENQ

SEQ ID NO: 57475 - protein, 33 aa, Artificial Sequence
  Description of Artificial Sequence: Synthetic polypeptide
DEEEIRTTNPVATEQYGSVLSTVDYLQETQNEV

SEQ ID NO: 57476 - protein, 33 aa, Artificial Sequence
  Description of Artificial Sequence: Synthetic polypeptide
DEEEIRTTNPVAYEAYGCSVVSTALSQHVGNLR

SEQ ID NO: 57477 - protein, 33 aa, Artificial Sequence
  Description of Artificial Sequence: Synthetic polypeptide
DEEEIRTTNPVAYEAYGCTPSTNELSQRTGGNR

SEQ ID NO: 57478 - protein, 32 aa, Artificial Sequence
  Description of Artificial Sequence: Synthetic polypeptide
DEEEIRTTNPVAYEAYGEKVSTNQSQFTGTNR

SEQ ID NO: 57479 - protein, 34 aa, Artificial Sequence
  Description of Artificial Sequence: Synthetic polypeptide
DEEEIRTTNPVAYEAYGISVQSTVNLSQQRVTNR

SEQ ID NO: 57480 - protein, 34 aa, Artificial Sequence
  Description of Artificial Sequence: Synthetic polypeptide
DEEEIRTTNPVAYEAYGISVSTQNALSQDRVTNR

SEQ ID NO: 57481 - protein, 31 aa, Artificial Sequence
  Description of Artificial Sequence: Synthetic polypeptide
DEEEIRTTNPVAWEQYGSVWTNLGAVFDGSF

SEQ ID NO: 57482 - protein, 33 aa, Artificial Sequence
  Description of Artificial Sequence: Synthetic polypeptide
DEEEIRTTNPVATEQYGSVMGNLISGQENGNED

SEQ ID NO: 57483 - protein, 31 aa, Artificial Sequence
  Description of Artificial Sequence: Synthetic polypeptide
DEEEIRTTNPVATEQYGSVMGTFNGGGFGTE

SEQ ID NO: 57484 - protein, 33 aa, Artificial Sequence
  Description of Artificial Sequence: Synthetic polypeptide
DEEEIRTTNPVAVEQYGSVSTVTNNQGQQGNTD

SEQ ID NO: 57485 - protein, 33 aa, Artificial Sequence
  Description of Artificial Sequence: Synthetic polypeptide
DEEEIRTTNPVAVEQYGSVSTTNNLLQNEGQED

SEQ ID NO: 57486 - protein, 33 aa, Artificial Sequence
  Description of Artificial Sequence: Synthetic polypeptide
DEEEIRTTNPVATEQYGSVMSGMFNDQEEGANI

SEQ ID NO: 57487 - protein, 33 aa, Artificial Sequence
  Description of Artificial Sequence: Synthetic polypeptide
DEEEIRTTNPVAVEQYGSVSTTNNLNQVNNSED

SEQ ID NO: 57488 - protein, 33 aa, Artificial Sequence
  Description of Artificial Sequence: Synthetic polypeptide
DEEEIRTTNPVAVEQYGSVSTTNNLNQVNNSTD

SEQ ID NO: 57489 - protein, 33 aa, Artificial Sequence
  Description of Artificial Sequence: Synthetic polypeptide
DEEEIRTTNPVAVEQYGSVSTTNNLQGSNNNSD

SEQ ID NO: 57490 - protein, 33 aa, Artificial Sequence
  Description of Artificial Sequence: Synthetic polypeptide
DEEEIRTTNPVAVEQYGSVSTTNNQLQNNGQED

SEQ ID NO: 57491 - protein, 33 aa, Artificial Sequence
  Description of Artificial Sequence: Synthetic polypeptide
DEEEIRTTNPVATEQYGSVMSDTNEGQEDDNGD

SEQ ID NO: 57492 - protein, 33 aa, Artificial Sequence
  Description of Artificial Sequence: Synthetic polypeptide
DEEEIRTTNPVAVEQYGSVSTTNQLNQNGEEDE

SEQ ID NO: 57493 - protein, 33 aa, Artificial Sequence
  Description of Artificial Sequence: Synthetic polypeptide
DEEEIRTTNPVAVEQYGSVSTTNQQLQNGQEQE

SEQ ID NO: 57494 - protein, 34 aa, Artificial Sequence
  Description of Artificial Sequence: Synthetic polypeptide
DEEEIRTTNPVAVEQYGSVSTTNQQLQNNGNEDD

SEQ ID NO: 57495 - protein, 33 aa, Artificial Sequence
  Description of Artificial Sequence: Synthetic polypeptide
DEEEIRTTNPVAVEQYGSVSTVNNNLLQQGITD

SEQ ID NO: 57496 - protein, 33 aa, Artificial Sequence
  Description of Artificial Sequence: Synthetic polypeptide
DEEEIRTTNPVAVEQYGSVSTVTNELLQQGSTS

SEQ ID NO: 57497 - protein, 33 aa, Artificial Sequence
  Description of Artificial Sequence: Synthetic polypeptide
DEEEIRTTNPVAVEQYGSVSTVTNLNNQQGTTD

SEQ ID NO: 57498 - protein, 34 aa, Artificial Sequence
  Description of Artificial Sequence: Synthetic polypeptide
DEEEIRTTNPVAVEQYGSVSTVTNLQGGNNSNDV

SEQ ID NO: 57499 - protein, 31 aa, Artificial Sequence
  Description of Artificial Sequence: Synthetic polypeptide
DEEEIRTTNPVATEQYGSVMQNEIQGQDDIR

SEQ ID NO: 57500 - protein, 34 aa, Artificial Sequence
  Description of Artificial Sequence: Synthetic polypeptide
DEEEIRTTNPVAVEQYGSVSTVTNNLNQGGNNSD

SEQ ID NO: 57501 - protein, 34 aa, Artificial Sequence
  Description of Artificial Sequence: Synthetic polypeptide
DEEEIRTTNPVAVEQYGSVSTVTNNLNQQQGNTD

SEQ ID NO: 57502 - protein, 34 aa, Artificial Sequence
  Description of Artificial Sequence: Synthetic polypeptide
DEEEIRTTNPVAVEQYGSVSTVTNNLQGGNNSDN

SEQ ID NO: 57503 - protein, 31 aa, Artificial Sequence
  Description of Artificial Sequence: Synthetic polypeptide
DEEEIRTTNPVATEQYGSVMNTFNGGGGGTI

SEQ ID NO: 57504 - protein, 32 aa, Artificial Sequence
  Description of Artificial Sequence: Synthetic polypeptide
DEEEIRTTNPVATEQYGSVMNTFNGGGEGGTR

SEQ ID NO: 57505 - protein, 34 aa, Artificial Sequence
  Description of Artificial Sequence: Synthetic polypeptide
DEEEIRTTNPVAVEQYGSVSTVTNNNLQQGNTDT

SEQ ID NO: 57506 - protein, 34 aa, Artificial Sequence
  Description of Artificial Sequence: Synthetic polypeptide
DEEEIRTTNPVAYEAYGKVVSYTNNLQRTGTENR

SEQ ID NO: 57507 - protein, 33 aa, Artificial Sequence
  Description of Artificial Sequence: Synthetic polypeptide
DEEEIRTTNPVATEQYGVVCSTELDQHFGSNQP

SEQ ID NO: 57508 - protein, 33 aa, Artificial Sequence
  Description of Artificial Sequence: Synthetic polypeptide
DEEEIRTTNPVATEQYGVVCSTELDQGSGSNQS

SEQ ID NO: 57509 - protein, 31 aa, Artificial Sequence
  Description of Artificial Sequence: Synthetic polypeptide
DEEEIRTTNPVATEQYGVVCSTEHQGNSNAL

SEQ ID NO: 57510 - protein, 33 aa, Artificial Sequence
  Description of Artificial Sequence: Synthetic polypeptide
DEEEIRTTNPVATEQYGSVVTNGLLAQQEGEEG

SEQ ID NO: 57511 - protein, 33 aa, Artificial Sequence
  Description of Artificial Sequence: Synthetic polypeptide
DEEEIRTTNPVATEQYGSVQCTNLEQRAELLVA

SEQ ID NO: 57512 - protein, 31 aa, Artificial Sequence
  Description of Artificial Sequence: Synthetic polypeptide
DEEEIRTTNPVATEQYGSVQCSNLERPELIS

SEQ ID NO: 57513 - protein, 33 aa, Artificial Sequence
  Description of Artificial Sequence: Synthetic polypeptide
DEEEIRTTNPVATEQYGSVQCPTNLQVVIPERL

SEQ ID NO: 57514 - protein, 32 aa, Artificial Sequence
  Description of Artificial Sequence: Synthetic polypeptide
DEEEIRTTNPVATEQYGSVQCNTMGEQPEGNS

SEQ ID NO: 57515 - protein, 33 aa, Artificial Sequence
  Description of Artificial Sequence: Synthetic polypeptide
DEEEIRTTNPVATEQYGSVVTNQEQMGNNGNDE

SEQ ID NO: 57516 - protein, 32 aa, Artificial Sequence
  Description of Artificial Sequence: Synthetic polypeptide
DEEEIRTTNPVATEQYGSVQATNLEPRATPTG

SEQ ID NO: 57517 - protein, 32 aa, Artificial Sequence
  Description of Artificial Sequence: Synthetic polypeptide
DEEEIRTTNPVATEQYGSVPYTYLSQYGDTYG

SEQ ID NO: 57518 - protein, 33 aa, Artificial Sequence
  Description of Artificial Sequence: Synthetic polypeptide
DEEEIRTTNPVATEQYGSVVTNQEQMGSNENEG

SEQ ID NO: 57519 - protein, 32 aa, Artificial Sequence
  Description of Artificial Sequence: Synthetic polypeptide
DEEEIRTTNPVATEQYGSVVTNDNQEHNEFKN

SEQ ID NO: 57520 - protein, 32 aa, Artificial Sequence
  Description of Artificial Sequence: Synthetic polypeptide
DEEEIRTTNPVATEQYGSVPWTTLESEDNQRI

SEQ ID NO: 57521 - protein, 32 aa, Artificial Sequence
  Description of Artificial Sequence: Synthetic polypeptide
DEEEIRTTNPVATEQYGSVVTNTTNLYGGGTE

SEQ ID NO: 57522 - protein, 31 aa, Artificial Sequence
  Description of Artificial Sequence: Synthetic polypeptide
DEEEIRTTNPVATEQYGSVPWPQGLERLPER

SEQ ID NO: 57523 - protein, 34 aa, Artificial Sequence
  Description of Artificial Sequence: Synthetic polypeptide
DEEEIRTTNPVATEQYGSVPVTNLPQLRGLEEMD

SEQ ID NO: 57524 - protein, 34 aa, Artificial Sequence
  Description of Artificial Sequence: Synthetic polypeptide
DEEEIRTTNPVATEQYGSVPVTNLIQTTVVENRQ

SEQ ID NO: 57525 - protein, 31 aa, Artificial Sequence
  Description of Artificial Sequence: Synthetic polypeptide
DEEEIRTTNPVATEQYGSVPVSFNVTRVVLP

SEQ ID NO: 57526 - protein, 32 aa, Artificial Sequence
  Description of Artificial Sequence: Synthetic polypeptide
DEEEIRTTNPVATEQYGSVVVENLHRSGQQQE

SEQ ID NO: 57527 - protein, 33 aa, Artificial Sequence
  Description of Artificial Sequence: Synthetic polypeptide
DEEEIRTTNPVATEQYGSVPVSFNVQRQVFNIQ

SEQ ID NO: 57528 - protein, 33 aa, Artificial Sequence
  Description of Artificial Sequence: Synthetic polypeptide
DEEEIRTTNPVATEQYGSVPVSFNVQREVNLIT

SEQ ID NO: 57529 - protein, 32 aa, Artificial Sequence
  Description of Artificial Sequence: Synthetic polypeptide
DEEEIRTTNPVATEQYGSVPVSFMVGQRVVNP

SEQ ID NO: 57530 - protein, 32 aa, Artificial Sequence
  Description of Artificial Sequence: Synthetic polypeptide
DEEEIRTTNPVATEQYGSVVTNQETMGNNEDE

SEQ ID NO: 57531 - protein, 31 aa, Artificial Sequence
  Description of Artificial Sequence: Synthetic polypeptide
DEEEIRTTNPVATEQYGSVVVGNLHGIGQQE

SEQ ID NO: 57532 - protein, 32 aa, Artificial Sequence
  Description of Artificial Sequence: Synthetic polypeptide
DEEEIRTTNPVATEQYGSVQCTPGLPRGEVIE

SEQ ID NO: 57533 - protein, 33 aa, Artificial Sequence
  Description of Artificial Sequence: Synthetic polypeptide
DEEEIRTTNPVATEQYGSVQCTPNLQRNQMDFD

SEQ ID NO: 57534 - protein, 34 aa, Artificial Sequence
  Description of Artificial Sequence: Synthetic polypeptide
DEEEIRTTNPVATEQYGSVQNTPNLQTEGEFLRN

SEQ ID NO: 57535 - protein, 34 aa, Artificial Sequence
  Description of Artificial Sequence: Synthetic polypeptide
DEEEIRTTNPVATEQYGSVVSTNGWLAQQENEEQ

SEQ ID NO: 57536 - protein, 33 aa, Artificial Sequence
  Description of Artificial Sequence: Synthetic polypeptide
DEEEIRTTNPVATEQYGSVQNTGNLIERGSDQS

SEQ ID NO: 57537 - protein, 32 aa, Artificial Sequence
  Description of Artificial Sequence: Synthetic polypeptide
DEEEIRTTNPVATEQYGSVQNTGNLIENGSTQ

SEQ ID NO: 57538 - protein, 33 aa, Artificial Sequence
  Description of Artificial Sequence: Synthetic polypeptide
DEEEIRTTNPVATEQYGSVQLTSPLQRIVAQNE

SEQ ID NO: 57539 - protein, 34 aa, Artificial Sequence
  Description of Artificial Sequence: Synthetic polypeptide
DEEEIRTTNPVATEQYGSVQLTPLGQVRGQNEII

SEQ ID NO: 57540 - protein, 33 aa, Artificial Sequence
  Description of Artificial Sequence: Synthetic polypeptide
DEEEIRTTNPVATEQYGSVQLTNSLQTNNPDAL

SEQ ID NO: 57541 - protein, 32 aa, Artificial Sequence
  Description of Artificial Sequence: Synthetic polypeptide
DEEEIRTTNPVATEQYGSVQLTNSLDQEIVQD

SEQ ID NO: 57542 - protein, 32 aa, Artificial Sequence
  Description of Artificial Sequence: Synthetic polypeptide
DEEEIRTTNPVATEQYGSVQLENSLVRGQVDT

SEQ ID NO: 57543 - protein, 34 aa, Artificial Sequence
  Description of Artificial Sequence: Synthetic polypeptide
DEEEIRTTNPVATEQYGSVQCTPNLPQRLSEGFN

SEQ ID NO: 57544 - protein, 33 aa, Artificial Sequence
  Description of Artificial Sequence: Synthetic polypeptide
DEEEIRTTNPVATEQYGSVVSTPNFDEGNDNQE

SEQ ID NO: 57545 - protein, 30 aa, Artificial Sequence
  Description of Artificial Sequence: Synthetic polypeptide
DEEEIRTTNPVATEQYGSVQETPIQTVVVM

SEQ ID NO: 57546 - protein, 30 aa, Artificial Sequence
  Description of Artificial Sequence: Synthetic polypeptide
DEEEIRTTNPVATEQYGSVQETPGQTVVQD

SEQ ID NO: 57547 - protein, 30 aa, Artificial Sequence
  Description of Artificial Sequence: Synthetic polypeptide
DEEEIRTTNPVATEQYGSVQETPGQSTVVV

SEQ ID NO: 57548 - protein, 33 aa, Artificial Sequence
  Description of Artificial Sequence: Synthetic polypeptide
DEEEIRTTNPVATEQYGSVVSTVPNFDRGGDEM

SEQ ID NO: 57549 - protein, 32 aa, Artificial Sequence
  Description of Artificial Sequence: Synthetic polypeptide
DEEEIRTTNPVATEQYGSVQEENLPNGVEVRI

SEQ ID NO: 57550 - protein, 29 aa, Artificial Sequence
  Description of Artificial Sequence: Synthetic peptide
DEEEIRTTNPVATEQYGSVQEDPGQTVVG

SEQ ID NO: 57551 - protein, 32 aa, Artificial Sequence
  Description of Artificial Sequence: Synthetic polypeptide
DEEEIRTTNPVATEQYGSVQDWTDLESEDNQR

SEQ ID NO: 57552 - protein, 34 aa, Artificial Sequence
  Description of Artificial Sequence: Synthetic polypeptide
DEEEIRTTNPVATEQYGSVVSVTNVLQTPFEEND

SEQ ID NO: 57553 - protein, 32 aa, Artificial Sequence
  Description of Artificial Sequence: Synthetic polypeptide
DEEEIRTTNPVATEQYGSVVTANDLEHRNEDQ

SEQ ID NO: 57554 - protein, 34 aa, Artificial Sequence
  Description of Artificial Sequence: Synthetic polypeptide
DEEEIRTTNPVATEQYGSVVSTPNFDRGGDNFEK

SEQ ID NO: 57555 - protein, 33 aa, Artificial Sequence
  Description of Artificial Sequence: Synthetic polypeptide
DEEEIRTTNPVATEQYGSVPTVWLQERPEDQRD

SEQ ID NO: 57556 - protein, 31 aa, Artificial Sequence
  Description of Artificial Sequence: Synthetic polypeptide
DEEEIRTTNPVATEQYGSVPTVSLEEINGED

SEQ ID NO: 57557 - protein, 30 aa, Artificial Sequence
  Description of Artificial Sequence: Synthetic polypeptide
DEEEIRTTNPVATEQYGSVVWEWPLQDTEQ

SEQ ID NO: 57558 - protein, 34 aa, Artificial Sequence
  Description of Artificial Sequence: Synthetic polypeptide
DEEEIRTTNPVATEQYGSVPTNGPQTRQGNENQN

SEQ ID NO: 57559 - protein, 34 aa, Artificial Sequence
  Description of Artificial Sequence: Synthetic polypeptide
DEEEIRTTNPVATEQYGSVPTNGLNLSRQGQEDR

SEQ ID NO: 57560 - protein, 34 aa, Artificial Sequence
  Description of Artificial Sequence: Synthetic polypeptide
DEEEIRTTNPVATEQYGSVPTNELQTRQGQIEVT

SEQ ID NO: 57561 - protein, 33 aa, Artificial Sequence
  Description of Artificial Sequence: Synthetic polypeptide
DEEEIRTTNPVATEQYGSVYCDTWQDGQRSQNR

SEQ ID NO: 57562 - protein, 32 aa, Artificial Sequence
  Description of Artificial Sequence: Synthetic polypeptide
DEEEIRTTNPVATEQYGSVYENELDEGDMEER

SEQ ID NO: 57563 - protein, 32 aa, Artificial Sequence
  Description of Artificial Sequence: Synthetic polypeptide
DEEEIRTTNPVATEQYGSVYENLDQARNEDQA

SEQ ID NO: 57564 - protein, 32 aa, Artificial Sequence
  Description of Artificial Sequence: Synthetic polypeptide
DEEEIRTTNPVATEQYGSVYENLDQGRNEDES

SEQ ID NO: 57565 - protein, 32 aa, Artificial Sequence
  Description of Artificial Sequence: Synthetic polypeptide
DEEEIRTTNPVATEQYGSVYEPALLIQRMGQQ

SEQ ID NO: 57566 - protein, 32 aa, Artificial Sequence
  Description of Artificial Sequence: Synthetic polypeptide
DEEEIRTTNPVATEQYGSVYETNLQTFLEEDG

SEQ ID NO: 57567 - protein, 32 aa, Artificial Sequence
  Description of Artificial Sequence: Synthetic polypeptide
DEEEIRTTNPVATEQYGSVPTNLDETFEQNQE

SEQ ID NO: 57568 - protein, 31 aa, Artificial Sequence
  Description of Artificial Sequence: Synthetic polypeptide
DEEEIRTTNPVATEQYGSVYETPQGLQTVVV

SEQ ID NO: 57569 - protein, 32 aa, Artificial Sequence
  Description of Artificial Sequence: Synthetic polypeptide
DEEEIRTTNPVATEQYGSVYGPEVEQRGENLT

SEQ ID NO: 57570 - protein, 33 aa, Artificial Sequence
  Description of Artificial Sequence: Synthetic polypeptide
DEEEIRTTNPVATEQYGSVYGTNGIQEDEGNEI

SEQ ID NO: 57571 - protein, 31 aa, Artificial Sequence
  Description of Artificial Sequence: Synthetic polypeptide
DEEEIRTTNPVATEQYGSVYIMTYIDEGVVR

SEQ ID NO: 57572 - protein, 33 aa, Artificial Sequence
  Description of Artificial Sequence: Synthetic polypeptide
DEEEIRTTNPVATEQYGSVYITNMLAERTENEQ

SEQ ID NO: 57573 - protein, 32 aa, Artificial Sequence
  Description of Artificial Sequence: Synthetic polypeptide
DEEEIRTTNPVATEQYGSVYIVPNSLDGGESR

SEQ ID NO: 57574 - protein, 33 aa, Artificial Sequence
  Description of Artificial Sequence: Synthetic polypeptide
DEEEIRTTNPVATEQYGSVPTDNLQPPIVNEML

SEQ ID NO: 57575 - protein, 31 aa, Artificial Sequence
  Description of Artificial Sequence: Synthetic polypeptide
DEEEIRTTNPVATEQYGSVPTDMIQDGGEEM

SEQ ID NO: 57576 - protein, 33 aa, Artificial Sequence
  Description of Artificial Sequence: Synthetic polypeptide
DEEEIRTTNPVATEQYGSVYKMNDIQKIEGENR

SEQ ID NO: 57577 - protein, 34 aa, Artificial Sequence
  Description of Artificial Sequence: Synthetic polypeptide
DEEEIRTTNPVATEQYGSVYKWTNDIAQDLGDNR

SEQ ID NO: 57578 - protein, 33 aa, Artificial Sequence
  Description of Artificial Sequence: Synthetic polypeptide
DEEEIRTTNPVATEQYGSVYETVLQQRTLENDA

SEQ ID NO: 57579 - protein, 32 aa, Artificial Sequence
  Description of Artificial Sequence: Synthetic polypeptide
DEEEIRTTNPVATEQYGSVPTNLDETMEQERE

SEQ ID NO: 57580 - protein, 33 aa, Artificial Sequence
  Description of Artificial Sequence: Synthetic polypeptide
DEEEIRTTNPVATEQYGSVPTNLEQATGLEQED

SEQ ID NO: 57581 - protein, 33 aa, Artificial Sequence
  Description of Artificial Sequence: Synthetic polypeptide
DEEEIRTTNPVATEQYGSVPTNLEQERMLEEDD

SEQ ID NO: 57582 - protein, 31 aa, Artificial Sequence
  Description of Artificial Sequence: Synthetic polypeptide
DEEEIRTTNPVATEQYGSVWAPPQWQGSSQR

SEQ ID NO: 57583 - protein, 33 aa, Artificial Sequence
  Description of Artificial Sequence: Synthetic polypeptide
DEEEIRTTNPVATEQYGSVWELMNMIQRDSNRI

SEQ ID NO: 57584 - protein, 32 aa, Artificial Sequence
  Description of Artificial Sequence: Synthetic polypeptide
DEEEIRTTNPVATEQYGSVWELPQMLQRDIND

SEQ ID NO: 57585 - protein, 33 aa, Artificial Sequence
  Description of Artificial Sequence: Synthetic polypeptide
DEEEIRTTNPVATEQYGSVWMTNNPQNMGGNYG

SEQ ID NO: 57586 - protein, 34 aa, Artificial Sequence
  Description of Artificial Sequence: Synthetic polypeptide
DEEEIRTTNPVATEQYGSVWPENSLERGNGEERS

SEQ ID NO: 57587 - protein, 30 aa, Artificial Sequence
  Description of Artificial Sequence: Synthetic polypeptide
DEEEIRTTNPVATEQYGSVPTPLIPVEETD

SEQ ID NO: 57588 - protein, 32 aa, Artificial Sequence
  Description of Artificial Sequence: Synthetic polypeptide
DEEEIRTTNPVATEQYGSVPTNTLELNNQEDG

SEQ ID NO: 57589 - protein, 34 aa, Artificial Sequence
  Description of Artificial Sequence: Synthetic polypeptide
DEEEIRTTNPVATEQYGSVWPTNSLEPGNNEIRP

SEQ ID NO: 57590 - protein, 34 aa, Artificial Sequence
  Description of Artificial Sequence: Synthetic polypeptide
DEEEIRTTNPVATEQYGSVWPTNSLERGNNESGY

SEQ ID NO: 57591 - protein, 33 aa, Artificial Sequence
  Description of Artificial Sequence: Synthetic polypeptide
DEEEIRTTNPVATEQYGSVWPTNSLERNNEIKE

SEQ ID NO: 57592 - protein, 33 aa, Artificial Sequence
  Description of Artificial Sequence: Synthetic polypeptide
DEEEIRTTNPVATEQYGSVWPTYSLERGNNESD

SEQ ID NO: 57593 - protein, 31 aa, Artificial Sequence
  Description of Artificial Sequence: Synthetic polypeptide
DEEEIRTTNPVATEQYGSVWSFNSSPVDGQL

SEQ ID NO: 57594 - protein, 33 aa, Artificial Sequence
  Description of Artificial Sequence: Synthetic polypeptide
DEEEIRTTNPVATEQYGSVWSIENLQMNPNNNL

SEQ ID NO: 57595 - protein, 32 aa, Artificial Sequence
  Description of Artificial Sequence: Synthetic polypeptide
DEEEIRTTNPVATEQYGSVWSLLEEQLVGENV

SEQ ID NO: 57596 - protein, 33 aa, Artificial Sequence
  Description of Artificial Sequence: Synthetic polypeptide
DEEEIRTTNPVATEQYGSVWSLPNMLQHMDQRN

SEQ ID NO: 57597 - protein, 32 aa, Artificial Sequence
  Description of Artificial Sequence: Synthetic polypeptide
DEEEIRTTNPVATEQYGSVWSLPQMLMQGDQR

SEQ ID NO: 57598 - protein, 32 aa, Artificial Sequence
  Description of Artificial Sequence: Synthetic polypeptide
DEEEIRTTNPVATEQYGSVWSPTTPLEINGEQ

SEQ ID NO: 57599 - protein, 31 aa, Artificial Sequence
  Description of Artificial Sequence: Synthetic polypeptide
DEEEIRTTNPVATEQYGSVWTDVLQVASSQQ

SEQ ID NO: 57600 - protein, 31 aa, Artificial Sequence
  Description of Artificial Sequence: Synthetic polypeptide
DEEEIRTTNPVATEQYGSVPTNLNIEAEEVE

SEQ ID NO: 57601 - protein, 32 aa, Artificial Sequence
  Description of Artificial Sequence: Synthetic polypeptide
DEEEIRTTNPVATEQYGSVWTMERERFGVNEA

SEQ ID NO: 57602 - protein, 31 aa, Artificial Sequence
  Description of Artificial Sequence: Synthetic polypeptide
DEEEIRTTNPVATEQYGSVWTNDMTGGQIEG

SEQ ID NO: 57603 - protein, 34 aa, Artificial Sequence
  Description of Artificial Sequence: Synthetic polypeptide
DEEEIRTTNPVATEQYGSVQPDTYDLQRAGGIRA

SEQ ID NO: 57604 - protein, 34 aa, Artificial Sequence
  Description of Artificial Sequence: Synthetic polypeptide
DEEEIRTTNPVATEQYGSVYKWTNDIQKGGGNHR

SEQ ID NO: 57605 - protein, 32 aa, Artificial Sequence
  Description of Artificial Sequence: Synthetic polypeptide
DEEEIRTTNPVATEQYGSVVSTLDDQAYGQEG

SEQ ID NO: 57606 - protein, 33 aa, Artificial Sequence
  Description of Artificial Sequence: Synthetic polypeptide
DEEEIRTTNPVATEQYGSVQPPLNLQPREQNLL

SEQ ID NO: 57607 - protein, 32 aa, Artificial Sequence
  Description of Artificial Sequence: Synthetic polypeptide
DEEEIRTTNPVATEQYGSVTSTNDPNAEENIT

SEQ ID NO: 57608 - protein, 32 aa, Artificial Sequence
  Description of Artificial Sequence: Synthetic polypeptide
DEEEIRTTNPVATEQYGSVQSVTLDNPEVGVV

SEQ ID NO: 57609 - protein, 34 aa, Artificial Sequence
  Description of Artificial Sequence: Synthetic polypeptide
DEEEIRTTNPVATEQYGSVTSTNLISGMGGNEQG

SEQ ID NO: 57610 - protein, 33 aa, Artificial Sequence
  Description of Artificial Sequence: Synthetic polypeptide
DEEEIRTTNPVATEQYGSVQSVSSAEQEVGNRG

SEQ ID NO: 57611 - protein, 31 aa, Artificial Sequence
  Description of Artificial Sequence: Synthetic polypeptide
DEEEIRTTNPVATEQYGSVQSVSNQAPLIRS

SEQ ID NO: 57612 - protein, 33 aa, Artificial Sequence
  Description of Artificial Sequence: Synthetic polypeptide
DEEEIRTTNPVATEQYGSVQSTTELAERTENEQ

SEQ ID NO: 57613 - protein, 34 aa, Artificial Sequence
  Description of Artificial Sequence: Synthetic polypeptide
DEEEIRTTNPVATEQYGSVQSTPTIIQEQEGNMR

SEQ ID NO: 57614 - protein, 35 aa, Artificial Sequence
  Description of Artificial Sequence: Synthetic polypeptide
DEEEIRTTNPVATEQYGSVQSTPNMLVPRGEELRS

SEQ ID NO: 57615 - protein, 33 aa, Artificial Sequence
  Description of Artificial Sequence: Synthetic polypeptide
DEEEIRTTNPVATEQYGSVTSTQTQDEIGGNQG

SEQ ID NO: 57616 - protein, 35 aa, Artificial Sequence
  Description of Artificial Sequence: Synthetic polypeptide
DEEEIRTTNPVATEQYGSVTSTMNLNQNQGGNGNI

SEQ ID NO: 57617 - protein, 33 aa, Artificial Sequence
  Description of Artificial Sequence: Synthetic polypeptide
DEEEIRTTNPVATEQYGSVTSTSDLTGMGNANI

SEQ ID NO: 57618 - protein, 34 aa, Artificial Sequence
  Description of Artificial Sequence: Synthetic polypeptide
DEEEIRTTNPVATEQYGSVQSTPNCIQEQEDANR

SEQ ID NO: 57619 - protein, 34 aa, Artificial Sequence
  Description of Artificial Sequence: Synthetic polypeptide
DEEEIRTTNPVATEQYGSVQSTPGLEVRLANIRG

SEQ ID NO: 57620 - protein, 34 aa, Artificial Sequence
  Description of Artificial Sequence: Synthetic polypeptide
DEEEIRTTNPVATEQYGSVTSTTLNDLQENIENT

SEQ ID NO: 57621 - protein, 33 aa, Artificial Sequence
  Description of Artificial Sequence: Synthetic polypeptide
DEEEIRTTNPVATEQYGSVTSTVNTLGMGGEEV

SEQ ID NO: 57622 - protein, 34 aa, Artificial Sequence
  Description of Artificial Sequence: Synthetic polypeptide
DEEEIRTTNPVATEQYGSVTSTVNTLGMGGENIT

SEQ ID NO: 57623 - protein, 34 aa, Artificial Sequence
  Description of Artificial Sequence: Synthetic polypeptide
DEEEIRTTNPVATEQYGSVTSTVNTLGMGGGNDG

SEQ ID NO: 57624 - protein, 34 aa, Artificial Sequence
  Description of Artificial Sequence: Synthetic polypeptide
DEEEIRTTNPVATEQYGSVTSTVNTLGMGGNVVE

SEQ ID NO: 57625 - protein, 33 aa, Artificial Sequence
  Description of Artificial Sequence: Synthetic polypeptide
DEEEIRTTNPVATEQYGSVTTDNGDQEEGGNNS

SEQ ID NO: 57626 - protein, 33 aa, Artificial Sequence
  Description of Artificial Sequence: Synthetic polypeptide
DEEEIRTTNPVATEQYGSVTTENEQRMMVEERD

SEQ ID NO: 57627 - protein, 34 aa, Artificial Sequence
  Description of Artificial Sequence: Synthetic polypeptide
DEEEIRTTNPVATEQYGSVQSTPNCIQEQENNPR

SEQ ID NO: 57628 - protein, 33 aa, Artificial Sequence
  Description of Artificial Sequence: Synthetic polypeptide
DEEEIRTTNPVATEQYGSVTTGNMNQGGGGNQG

SEQ ID NO: 57629 - protein, 31 aa, Artificial Sequence
  Description of Artificial Sequence: Synthetic polypeptide
DEEEIRTTNPVATEQYGSVQTDHLGTDSQNE

SEQ ID NO: 57630 - protein, 35 aa, Artificial Sequence
  Description of Artificial Sequence: Synthetic polypeptide
DEEEIRTTNPVATEQYGSVTSTMNLDQESGENNQD

SEQ ID NO: 57631 - protein, 33 aa, Artificial Sequence
  Description of Artificial Sequence: Synthetic polypeptide
DEEEIRTTNPVATEQYGSVQTNLDFGGNMNFEG

SEQ ID NO: 57632 - protein, 32 aa, Artificial Sequence
  Description of Artificial Sequence: Synthetic polypeptide
DEEEIRTTNPVATEQYGSVTSTDWIQNGSQQS

SEQ ID NO: 57633 - protein, 32 aa, Artificial Sequence
  Description of Artificial Sequence: Synthetic polypeptide
DEEEIRTTNPVATEQYGSVTSTEHQNFGSEQD

SEQ ID NO: 57634 - protein, 33 aa, Artificial Sequence
  Description of Artificial Sequence: Synthetic polypeptide
DEEEIRTTNPVATEQYGSVQTNDHLQTDSQNEN

SEQ ID NO: 57635 - protein, 33 aa, Artificial Sequence
  Description of Artificial Sequence: Synthetic polypeptide
DEEEIRTTNPVATEQYGSVTSTLNGMENQGNGQ

SEQ ID NO: 57636 - protein, 33 aa, Artificial Sequence
  Description of Artificial Sequence: Synthetic polypeptide
DEEEIRTTNPVATEQYGSVTSTLNIENQGFNIQ

SEQ ID NO: 57637 - protein, 33 aa, Artificial Sequence
  Description of Artificial Sequence: Synthetic polypeptide
DEEEIRTTNPVATEQYGSVTSTLNQAENQGNEQ

SEQ ID NO: 57638 - protein, 34 aa, Artificial Sequence
  Description of Artificial Sequence: Synthetic polypeptide
DEEEIRTTNPVATEQYGSVTSTLNTQENGQGGNQ

SEQ ID NO: 57639 - protein, 33 aa, Artificial Sequence
  Description of Artificial Sequence: Synthetic polypeptide
DEEEIRTTNPVATEQYGSVTSTLNVDENQGNIQ

SEQ ID NO: 57640 - protein, 35 aa, Artificial Sequence
  Description of Artificial Sequence: Synthetic polypeptide
DEEEIRTTNPVATEQYGSVTSTMNLDQESGEQNEQ

SEQ ID NO: 57641 - protein, 34 aa, Artificial Sequence
  Description of Artificial Sequence: Synthetic polypeptide
DEEEIRTTNPVATEQYGSVTSTMDLNQNGGGNIM

SEQ ID NO: 57642 - protein, 35 aa, Artificial Sequence
  Description of Artificial Sequence: Synthetic polypeptide
DEEEIRTTNPVATEQYGSVTSTMNDLDQEEGENID

SEQ ID NO: 57643 - protein, 35 aa, Artificial Sequence
  Description of Artificial Sequence: Synthetic polypeptide
DEEEIRTTNPVATEQYGSVTSTMNELDQEGGENGT

SEQ ID NO: 57644 - protein, 34 aa, Artificial Sequence
  Description of Artificial Sequence: Synthetic polypeptide
DEEEIRTTNPVATEQYGSVTSTMNLDFESGENDI

SEQ ID NO: 57645 - protein, 35 aa, Artificial Sequence
  Description of Artificial Sequence: Synthetic polypeptide
DEEEIRTTNPVATEQYGSVTSTMNLDQEEGENNDQ

SEQ ID NO: 57646 - protein, 34 aa, Artificial Sequence
  Description of Artificial Sequence: Synthetic polypeptide
DEEEIRTTNPVATEQYGSVTSTMNLDQENEFNDD

SEQ ID NO: 57647 - protein, 35 aa, Artificial Sequence
  Description of Artificial Sequence: Synthetic polypeptide
DEEEIRTTNPVATEQYGSVTSTMNLDQESGEDNGT

SEQ ID NO: 57648 - protein, 30 aa, Artificial Sequence
  Description of Artificial Sequence: Synthetic polypeptide
DEEEIRTTNPVATEQYGSVQTDLVTTEEEL

SEQ ID NO: 57649 - protein, 34 aa, Artificial Sequence
  Description of Artificial Sequence: Synthetic polypeptide
DEEEIRTTNPVATEQYGSVTSTMNLDQESGEEGD

SEQ ID NO: 57650 - protein, 33 aa, Artificial Sequence
  Description of Artificial Sequence: Synthetic polypeptide
DEEEIRTTNPVATEQYGSVQTDLVQTNGEAERE

SEQ ID NO: 57651 - protein, 33 aa, Artificial Sequence
  Description of Artificial Sequence: Synthetic polypeptide
DEEEIRTTNPVATEQYGSVQTGNGLMRDGIEMQ

SEQ ID NO: 57652 - protein, 32 aa, Artificial Sequence
  Description of Artificial Sequence: Synthetic polypeptide
DEEEIRTTNPVATEQYGSVTTTDEQRQGVLLM

SEQ ID NO: 57653 - protein, 33 aa, Artificial Sequence
  Description of Artificial Sequence: Synthetic polypeptide
DEEEIRTTNPVATEQYGSVTTYNVGQQENANRY

SEQ ID NO: 57654 - protein, 34 aa, Artificial Sequence
  Description of Artificial Sequence: Synthetic polypeptide
DEEEIRTTNPVATEQYGSVTVNTENLLQGIGNNI

SEQ ID NO: 57655 - protein, 32 aa, Artificial Sequence
  Description of Artificial Sequence: Synthetic polypeptide
DEEEIRTTNPVATEQYGSVVNTFNLGGGGGTE

SEQ ID NO: 57656 - protein, 33 aa, Artificial Sequence
  Description of Artificial Sequence: Synthetic polypeptide
DEEEIRTTNPVATEQYGSVQSNINLAERTENEQ

SEQ ID NO: 57657 - protein, 33 aa, Artificial Sequence
  Description of Artificial Sequence: Synthetic polypeptide
DEEEIRTTNPVATEQYGSVQSMNLEQRTVVEQE

SEQ ID NO: 57658 - protein, 35 aa, Artificial Sequence
  Description of Artificial Sequence: Synthetic polypeptide
DEEEIRTTNPVATEQYGSVVPSCTNAIDQNGGGNR

SEQ ID NO: 57659 - protein, 34 aa, Artificial Sequence
  Description of Artificial Sequence: Synthetic polypeptide
DEEEIRTTNPVATEQYGSVVPSCTNALVRVNNEG

SEQ ID NO: 57660 - protein, 33 aa, Artificial Sequence
  Description of Artificial Sequence: Synthetic polypeptide
DEEEIRTTNPVATEQYGSVQSFTNSGERFGLFM

SEQ ID NO: 57661 - protein, 33 aa, Artificial Sequence
  Description of Artificial Sequence: Synthetic polypeptide
DEEEIRTTNPVATEQYGSVVPWSNSLPRQENRI

SEQ ID NO: 57662 - protein, 32 aa, Artificial Sequence
  Description of Artificial Sequence: Synthetic polypeptide
DEEEIRTTNPVATEQYGSVQQTNTQQLGEIDE

SEQ ID NO: 57663 - protein, 34 aa, Artificial Sequence
  Description of Artificial Sequence: Synthetic polypeptide
DEEEIRTTNPVATEQYGSVVSADNLQPDNGSLRG

SEQ ID NO: 57664 - protein, 32 aa, Artificial Sequence
  Description of Artificial Sequence: Synthetic polypeptide
DEEEIRTTNPVATEQYGSVVNTFNITGGGGTR

SEQ ID NO: 57665 - protein, 33 aa, Artificial Sequence
  Description of Artificial Sequence: Synthetic polypeptide
DEEEIRTTNPVATEQYGSVVSCEEWQRVGNDIS

SEQ ID NO: 57666 - protein, 32 aa, Artificial Sequence
  Description of Artificial Sequence: Synthetic polypeptide
DEEEIRTTNPVATEQYGSVQPTTNEVQDAGEI

SEQ ID NO: 57667 - protein, 34 aa, Artificial Sequence
  Description of Artificial Sequence: Synthetic polypeptide
DEEEIRTTNPVATEQYGSVQPTTNEQERGENQDP

SEQ ID NO: 57668 - protein, 32 aa, Artificial Sequence
  Description of Artificial Sequence: Synthetic polypeptide
DEEEIRTTNPVATEQYGSVVSNNQQNDLDDER

SEQ ID NO: 57669 - protein, 34 aa, Artificial Sequence
  Description of Artificial Sequence: Synthetic polypeptide
DEEEIRTTNPVATEQYGSVQPTSLLEQRGVNIND

SEQ ID NO: 57670 - protein, 33 aa, Artificial Sequence
  Description of Artificial Sequence: Synthetic polypeptide
DEEEIRTTNPVATEQYGSVQPTPNLVRQANDFD

SEQ ID NO: 57671 - protein, 32 aa, Artificial Sequence
  Description of Artificial Sequence: Synthetic polypeptide
DEEEIRTTNPVATEQYGSVVSPLPLQLEVQND

SEQ ID NO: 57672 - protein, 32 aa, Artificial Sequence
  Description of Artificial Sequence: Synthetic polypeptide
DEEEIRTTNPVATEQYGSVVSPPNFDRGGDEE

SEQ ID NO: 57673 - protein, 34 aa, Artificial Sequence
  Description of Artificial Sequence: Synthetic polypeptide
DEEEIRTTNPVATEQYGSVVSPTNLEQMIGFDEI

SEQ ID NO: 57674 - protein, 33 aa, Artificial Sequence
  Description of Artificial Sequence: Synthetic polypeptide
DEEEIRTTNPVATEQYGSVQPTNDQRQGEEGMM

SEQ ID NO: 57675 - protein, 32 aa, Artificial Sequence
  Description of Artificial Sequence: Synthetic polypeptide
DEEEIRTTNPVATEQYGSVQPTYLIPNGELRL

SEQ ID NO: 57676 - protein, 32 aa, Artificial Sequence
  Description of Artificial Sequence: Synthetic polypeptide
DEEEIRTTNPVATEQYGSVVNNTTNLYGNGTV

SEQ ID NO: 57677 - protein, 35 aa, Artificial Sequence
  Description of Artificial Sequence: Synthetic polypeptide
DEEEIRTTNPVATEQYGSVQSNTVSDDQRGENERQ

SEQ ID NO: 57678 - protein, 32 aa, Artificial Sequence
  Description of Artificial Sequence: Synthetic polypeptide
DEEEIRTTNPVATEQYGSVVMTPLQMRILVEQ

SEQ ID NO: 57679 - protein, 35 aa, Artificial Sequence
  Description of Artificial Sequence: Synthetic polypeptide
DEEEIRTTNPVATEQYGSVTVSTTENLQQGIGTNI

SEQ ID NO: 57680 - protein, 33 aa, Artificial Sequence
  Description of Artificial Sequence: Synthetic polypeptide
DEEEIRTTNPVATEQYGSVTVTDVLEQRGDFDG

SEQ ID NO: 57681 - protein, 33 aa, Artificial Sequence
  Description of Artificial Sequence: Synthetic polypeptide
DEEEIRTTNPVATEQYGSVTVTMGIQIRGVNEQ

SEQ ID NO: 57682 - protein, 32 aa, Artificial Sequence
  Description of Artificial Sequence: Synthetic polypeptide
DEEEIRTTNPVATEQYGSVTVTNLDNPEEFNE

SEQ ID NO: 57683 - protein, 31 aa, Artificial Sequence
  Description of Artificial Sequence: Synthetic polypeptide
DEEEIRTTNPVATEQYGSVTVTYNLDMILEG

SEQ ID NO: 57684 - protein, 34 aa, Artificial Sequence
  Description of Artificial Sequence: Synthetic polypeptide
DEEEIRTTNPVATEQYGSVTVVTENLNQAIGNTA

SEQ ID NO: 57685 - protein, 34 aa, Artificial Sequence
  Description of Artificial Sequence: Synthetic polypeptide
DEEEIRTTNPVATEQYGSVTVVTENLSQGIGTNT

SEQ ID NO: 57686 - protein, 31 aa, Artificial Sequence
  Description of Artificial Sequence: Synthetic polypeptide
DEEEIRTTNPVATEQYGSVTYTEQNQLGGDD

SEQ ID NO: 57687 - protein, 32 aa, Artificial Sequence
  Description of Artificial Sequence: Synthetic polypeptide
DEEEIRTTNPVATEQYGSVQSTNEVDEGEEMI

SEQ ID NO: 57688 - protein, 31 aa, Artificial Sequence
  Description of Artificial Sequence: Synthetic polypeptide
DEEEIRTTNPVATEQYGSVVANQDEGGDERQ

SEQ ID NO: 57689 - protein, 30 aa, Artificial Sequence
  Description of Artificial Sequence: Synthetic polypeptide
DEEEIRTTNPVATEQYGSVVAPWQDSGEGI

SEQ ID NO: 57690 - protein, 34 aa, Artificial Sequence
  Description of Artificial Sequence: Synthetic polypeptide
DEEEIRTTNPVATEQYGSVVAVQNLSQPNGGNNR

SEQ ID NO: 57691 - protein, 31 aa, Artificial Sequence
  Description of Artificial Sequence: Synthetic polypeptide
DEEEIRTTNPVATEQYGSVVCNTADHFNSDR

SEQ ID NO: 57692 - protein, 33 aa, Artificial Sequence
  Description of Artificial Sequence: Synthetic polypeptide
DEEEIRTTNPVATEQYGSVVGGTNDIQTGGGNN

SEQ ID NO: 57693 - protein, 34 aa, Artificial Sequence
  Description of Artificial Sequence: Synthetic polypeptide
DEEEIRTTNPVATEQYGSVQSTMNLQQESVNQVA

SEQ ID NO: 57694 - protein, 33 aa, Artificial Sequence
  Description of Artificial Sequence: Synthetic polypeptide
DEEEIRTTNPVATEQYGSVVGGTNDIQTGGGNT

SEQ ID NO: 57695 - protein, 33 aa, Artificial Sequence
  Description of Artificial Sequence: Synthetic polypeptide
DEEEIRTTNPVATEQYGSVVGSTMGQGDGGENT

SEQ ID NO: 57696 - protein, 32 aa, Artificial Sequence
  Description of Artificial Sequence: Synthetic polypeptide
DEEEIRTTNPVATEQYGSVQSTGLVVVIPERL

SEQ ID NO: 57697 - protein, 35 aa, Artificial Sequence
  Description of Artificial Sequence: Synthetic polypeptide
DEEEIRTTNPVATEQYGSVQSSTDVLQSGMEINRS

SEQ ID NO: 57698 - protein, 33 aa, Artificial Sequence
  Description of Artificial Sequence: Synthetic polypeptide
DEEEIRTTNPVATEQYGSVQSQTNPLTNHGFVG

SEQ ID NO: 57699 - protein, 32 aa, Artificial Sequence
  Description of Artificial Sequence: Synthetic polypeptide
DEEEIRTTNPVATEQYGSVVMTMPLIRGELQN

SEQ ID NO: 57700 - protein, 32 aa, Artificial Sequence
  Description of Artificial Sequence: Synthetic polypeptide
DEEEIRTTNPVATEQYGSVQPNNLQTEVDVRL

SEQ ID NO: 57701 - protein, 31 aa, Artificial Sequence
  Description of Artificial Sequence: Synthetic polypeptide
DEEEIRTTNPVAYEQWGSYWSLDNMDQRDNR

SEQ ID NO: 57702 - protein, 34 aa, Artificial Sequence
  Description of Artificial Sequence: Synthetic polypeptide
DEEEIRTTNPVATEQYGSVPSTTNMLQQISEENT

SEQ ID NO: 57703 - protein, 33 aa, Artificial Sequence
  Description of Artificial Sequence: Synthetic polypeptide
DEEEIRTTNPVATEQYGSVYLTNLGGLGEVVRQ

SEQ ID NO: 57704 - protein, 31 aa, Artificial Sequence
  Description of Artificial Sequence: Synthetic polypeptide
DEEEIRTTNPVATEQYGSVNTNDNGSENNDD

SEQ ID NO: 57705 - protein, 34 aa, Artificial Sequence
  Description of Artificial Sequence: Synthetic polypeptide
DEEEIRTTNPVATEQYGTTCSCTGEELSQRGGNR

SEQ ID NO: 57706 - protein, 34 aa, Artificial Sequence
  Description of Artificial Sequence: Synthetic polypeptide
DEEEIRTTNPVATEQYGTTPSCTNEELSQLVGNR

SEQ ID NO: 57707 - protein, 32 aa, Artificial Sequence
  Description of Artificial Sequence: Synthetic polypeptide
DEEEIRTTNPVATEQYGSVNTENDPMQREIEV

SEQ ID NO: 57708 - protein, 32 aa, Artificial Sequence
  Description of Artificial Sequence: Synthetic polypeptide
DEEEIRTTNPVATEQYGTVCSSELQHFGSERS

SEQ ID NO: 57709 - protein, 32 aa, Artificial Sequence
  Description of Artificial Sequence: Synthetic polypeptide
DEEEIRTTNPVATEQYGTVCSTENHQGGSQQS

SEQ ID NO: 57710 - protein, 31 aa, Artificial Sequence
  Description of Artificial Sequence: Synthetic polypeptide
DEEEIRTTNPVATEQYGTVCSTEPQSGSEQS

SEQ ID NO: 57711 - protein, 33 aa, Artificial Sequence
  Description of Artificial Sequence: Synthetic polypeptide
DEEEIRTTNPVATEQYGTVCSTNDHQERDMDIR

SEQ ID NO: 57712 - protein, 34 aa, Artificial Sequence
  Description of Artificial Sequence: Synthetic polypeptide
DEEEIRTTNPVATEQYGTVDSTNLIQGGGGNEDG

SEQ ID NO: 57713 - protein, 33 aa, Artificial Sequence
  Description of Artificial Sequence: Synthetic polypeptide
DEEEIRTTNPVATEQYGTSCSTGNDLQHFISNQ

SEQ ID NO: 57714 - protein, 33 aa, Artificial Sequence
  Description of Artificial Sequence: Synthetic polypeptide
DEEEIRTTNPVATEQYGTVDSTVNLEGGNGNQG

SEQ ID NO: 57715 - protein, 33 aa, Artificial Sequence
  Description of Artificial Sequence: Synthetic polypeptide
DEEEIRTTNPVATEQYGSVNTDTNLPESEGNIG

SEQ ID NO: 57716 - protein, 32 aa, Artificial Sequence
  Description of Artificial Sequence: Synthetic polypeptide
DEEEIRTTNPVATEQYGTVITNLGSGVGNNGD

SEQ ID NO: 57717 - protein, 32 aa, Artificial Sequence
  Description of Artificial Sequence: Synthetic polypeptide
DEEEIRTTNPVATEQYGTVSANLVEVGGNNGE

SEQ ID NO: 57718 - protein, 34 aa, Artificial Sequence
  Description of Artificial Sequence: Synthetic polypeptide
DEEEIRTTNPVATEQYGTVSITNLQVGVGENNGD

SEQ ID NO: 57719 - protein, 32 aa, Artificial Sequence
  Description of Artificial Sequence: Synthetic polypeptide
DEEEIRTTNPVATEQYGSVNTDNDDENEGNDD

SEQ ID NO: 57720 - protein, 33 aa, Artificial Sequence
  Description of Artificial Sequence: Synthetic polypeptide
DEEEIRTTNPVATEQYGTVSNLNLDQGEFGNQQ

SEQ ID NO: 57721 - protein, 33 aa, Artificial Sequence
  Description of Artificial Sequence: Synthetic polypeptide
DEEEIRTTNPVATEQYGSVNTAGNMTQTEGGNI

SEQ ID NO: 57722 - protein, 33 aa, Artificial Sequence
  Description of Artificial Sequence: Synthetic polypeptide
DEEEIRTTNPVATEQYGTVSNTELTGQEGGGNN

SEQ ID NO: 57723 - protein, 33 aa, Artificial Sequence
  Description of Artificial Sequence: Synthetic polypeptide
DEEEIRTTNPVATEQYGSVNSVTTGQAEGGGNQ

SEQ ID NO: 57724 - protein, 34 aa, Artificial Sequence
  Description of Artificial Sequence: Synthetic polypeptide
DEEEIRTTNPVATEQYGTVISCTINELSQRVNNP

SEQ ID NO: 57725 - protein, 33 aa, Artificial Sequence
  Description of Artificial Sequence: Synthetic polypeptide
DEEEIRTTNPVATEQYGTVSNTELTGQEGGGNS

SEQ ID NO: 57726 - protein, 32 aa, Artificial Sequence
  Description of Artificial Sequence: Synthetic polypeptide
DEEEIRTTNPVATEQYGTQSVINPLQQRENNS

SEQ ID NO: 57727 - protein, 30 aa, Artificial Sequence
  Description of Artificial Sequence: Synthetic polypeptide
DEEEIRTTNPVATEQYGTISMDIQQQNGNH

SEQ ID NO: 57728 - protein, 33 aa, Artificial Sequence
  Description of Artificial Sequence: Synthetic polypeptide
DEEEIRTTNPVATEQYGSYSVNDVEQRGGDERN

SEQ ID NO: 57729 - protein, 32 aa, Artificial Sequence
  Description of Artificial Sequence: Synthetic polypeptide
DEEEIRTTNPVATEQYGSYTQIMTNEGQGGNG

SEQ ID NO: 57730 - protein, 32 aa, Artificial Sequence
  Description of Artificial Sequence: Synthetic polypeptide
DEEEIRTTNPVATEQYGSYVEPTPLERVAVNI

SEQ ID NO: 57731 - protein, 33 aa, Artificial Sequence
  Description of Artificial Sequence: Synthetic polypeptide
DEEEIRTTNPVATEQYGSYVIEETELQRGPEFL

SEQ ID NO: 57732 - protein, 33 aa, Artificial Sequence
  Description of Artificial Sequence: Synthetic polypeptide
DEEEIRTTNPVATEQYGSVNTNNDGQNEGNQGT

SEQ ID NO: 57733 - protein, 34 aa, Artificial Sequence
  Description of Artificial Sequence: Synthetic polypeptide
DEEEIRTTNPVATEQYGSYVQLTWNLQEVGEERT

SEQ ID NO: 57734 - protein, 33 aa, Artificial Sequence
  Description of Artificial Sequence: Synthetic polypeptide
DEEEIRTTNPVATEQYGSYVQTWNLPVEGEERM

SEQ ID NO: 57735 - protein, 33 aa, Artificial Sequence
  Description of Artificial Sequence: Synthetic polypeptide
DEEEIRTTNPVATEQYGSYVSQTEGEQRGEDET

SEQ ID NO: 57736 - protein, 33 aa, Artificial Sequence
  Description of Artificial Sequence: Synthetic polypeptide
DEEEIRTTNPVATEQYGSYVSTPNGEQVQENIE

SEQ ID NO: 57737 - protein, 31 aa, Artificial Sequence
  Description of Artificial Sequence: Synthetic polypeptide
DEEEIRTTNPVATEQYGTISMDIQQQQNGNR

SEQ ID NO: 57738 - protein, 34 aa, Artificial Sequence
  Description of Artificial Sequence: Synthetic polypeptide
DEEEIRTTNPVATEQYGSYVSVENPLQMRLVNEE

SEQ ID NO: 57739 - protein, 32 aa, Artificial Sequence
  Description of Artificial Sequence: Synthetic polypeptide
DEEEIRTTNPVATEQYGSYWSLPNMLEVRDNI

SEQ ID NO: 57740 - protein, 31 aa, Artificial Sequence
  Description of Artificial Sequence: Synthetic polypeptide
DEEEIRTTNPVATEQYGTCSTGNPLQAEPMN

SEQ ID NO: 57741 - protein, 31 aa, Artificial Sequence
  Description of Artificial Sequence: Synthetic polypeptide
DEEEIRTTNPVATEQYGTCSTIDPGDQRENN

SEQ ID NO: 57742 - protein, 33 aa, Artificial Sequence
  Description of Artificial Sequence: Synthetic polypeptide
DEEEIRTTNPVATEQYGTCSTIDPLDQRGEGNN

SEQ ID NO: 57743 - protein, 31 aa, Artificial Sequence
  Description of Artificial Sequence: Synthetic polypeptide
DEEEIRTTNPVATEQYGTCSTIEPGQERENN

SEQ ID NO: 57744 - protein, 32 aa, Artificial Sequence
  Description of Artificial Sequence: Synthetic polypeptide
DEEEIRTTNPVATEQYGTCSTINPLQGEHNEN

SEQ ID NO: 57745 - protein, 31 aa, Artificial Sequence
  Description of Artificial Sequence: Synthetic polypeptide
DEEEIRTTNPVATEQYGTCSTNNPGQESENN

SEQ ID NO: 57746 - protein, 32 aa, Artificial Sequence
  Description of Artificial Sequence: Synthetic polypeptide
DEEEIRTTNPVATEQYGTICSTENPLQNISNQ

SEQ ID NO: 57747 - protein, 33 aa, Artificial Sequence
  Description of Artificial Sequence: Synthetic polypeptide
DEEEIRTTNPVATEQYGTISCTGNPLSQRVNNN

SEQ ID NO: 57748 - protein, 31 aa, Artificial Sequence
  Description of Artificial Sequence: Synthetic polypeptide
DEEEIRTTNPVATEQYGSYVWPEPEQIGTQR

SEQ ID NO: 57749 - protein, 32 aa, Artificial Sequence
  Description of Artificial Sequence: Synthetic polypeptide
DEEEIRTTNPVATEQYGSVNSVPEPLDRTNGE

SEQ ID NO: 57750 - protein, 33 aa, Artificial Sequence
  Description of Artificial Sequence: Synthetic polypeptide
DEEEIRTTNPVATEQYGSVNSVNDHNQEGFENS

SEQ ID NO: 57751 - protein, 34 aa, Artificial Sequence
  Description of Artificial Sequence: Synthetic polypeptide
DEEEIRTTNPVATEQYGSVNSVENLDIRSGEERS

SEQ ID NO: 57752 - protein, 32 aa, Artificial Sequence
  Description of Artificial Sequence: Synthetic polypeptide
DEEEIRTTNPVATEQYGTVTVNTNNQLQDENN

SEQ ID NO: 57753 - protein, 34 aa, Artificial Sequence
  Description of Artificial Sequence: Synthetic polypeptide
DEEEIRTTNPVATEQYGTVTVSTNLLQQGNNEEG

SEQ ID NO: 57754 - protein, 34 aa, Artificial Sequence
  Description of Artificial Sequence: Synthetic polypeptide
DEEEIRTTNPVATEQYGTVTVSTNLLQQGTNDEQ

SEQ ID NO: 57755 - protein, 32 aa, Artificial Sequence
  Description of Artificial Sequence: Synthetic polypeptide
DEEEIRTTNPVATEQYGTVTVTNNLLQQEENN

SEQ ID NO: 57756 - protein, 32 aa, Artificial Sequence
  Description of Artificial Sequence: Synthetic polypeptide
DEEEIRTTNPVATEQYGTVTVTNNQLQNENNN

SEQ ID NO: 57757 - protein, 33 aa, Artificial Sequence
  Description of Artificial Sequence: Synthetic polypeptide
DEEEIRTTNPVATEQYGTVVSTNLLGVGGNNGD

SEQ ID NO: 57758 - protein, 33 aa, Artificial Sequence
  Description of Artificial Sequence: Synthetic polypeptide
DEEEIRTTNPVATEQYGTVWESINIGQREGNND

SEQ ID NO: 57759 - protein, 32 aa, Artificial Sequence
  Description of Artificial Sequence: Synthetic polypeptide
DEEEIRTTNPVATEQYGTVWEYINGLQRDENN

SEQ ID NO: 57760 - protein, 31 aa, Artificial Sequence
  Description of Artificial Sequence: Synthetic polypeptide
DEEEIRTTNPVATEQYGTVYPQNDLQMFTER

SEQ ID NO: 57761 - protein, 32 aa, Artificial Sequence
  Description of Artificial Sequence: Synthetic polypeptide
DEEEIRTTNPVATEQYGTVTTTNNNLQDENEN

SEQ ID NO: 57762 - protein, 33 aa, Artificial Sequence
  Description of Artificial Sequence: Synthetic polypeptide
DEEEIRTTNPVATEQYGSVNSTNMTMEGEGGNG

SEQ ID NO: 57763 - protein, 33 aa, Artificial Sequence
  Description of Artificial Sequence: Synthetic polypeptide
DEEEIRTTNPVATEQYGTYSVTINPLQRELNNT

SEQ ID NO: 57764 - protein, 32 aa, Artificial Sequence
  Description of Artificial Sequence: Synthetic polypeptide
DEEEIRTTNPVATEQYGVIVSANGLQADMDRH

SEQ ID NO: 57765 - protein, 32 aa, Artificial Sequence
  Description of Artificial Sequence: Synthetic polypeptide
DEEEIRTTNPVATEQYGVSVCSASANDRGDNF

SEQ ID NO: 57766 - protein, 33 aa, Artificial Sequence
  Description of Artificial Sequence: Synthetic polypeptide
DEEEIRTTNPVATEQYGVSVCSTEHQNFGSNQG

SEQ ID NO: 57767 - protein, 32 aa, Artificial Sequence
  Description of Artificial Sequence: Synthetic polypeptide
DEEEIRTTNPVATEQYGVVCSNTEHQNFGNQA

SEQ ID NO: 57768 - protein, 32 aa, Artificial Sequence
  Description of Artificial Sequence: Synthetic polypeptide
DEEEIRTTNPVATEQYGVVCSNTEHQRGSDQS

SEQ ID NO: 57769 - protein, 33 aa, Artificial Sequence
  Description of Artificial Sequence: Synthetic polypeptide
DEEEIRTTNPVATEQYGVVCSNTGNHQGGSNQA

SEQ ID NO: 57770 - protein, 33 aa, Artificial Sequence
  Description of Artificial Sequence: Synthetic polypeptide
DEEEIRTTNPVATEQYGVVCSNTNLQYFGSDQG

SEQ ID NO: 57771 - protein, 32 aa, Artificial Sequence
  Description of Artificial Sequence: Synthetic polypeptide
DEEEIRTTNPVATEQYGVVCSSELQHFGSERS

SEQ ID NO: 57772 - protein, 32 aa, Artificial Sequence
  Description of Artificial Sequence: Synthetic polypeptide
DEEEIRTTNPVATEQYGTYEITINYLQRENNE

SEQ ID NO: 57773 - protein, 34 aa, Artificial Sequence
  Description of Artificial Sequence: Synthetic polypeptide
DEEEIRTTNPVATEQYGSVNSTQNLFENGGNITQ

SEQ ID NO: 57774 - protein, 32 aa, Artificial Sequence
  Description of Artificial Sequence: Synthetic polypeptide
DEEEIRTTNPVATEQYGTVSTYTDLFGGNGNN

SEQ ID NO: 57775 - protein, 33 aa, Artificial Sequence
  Description of Artificial Sequence: Synthetic polypeptide
DEEEIRTTNPVATEQYGTVSTVNLVDVGENNGD

SEQ ID NO: 57776 - protein, 33 aa, Artificial Sequence
  Description of Artificial Sequence: Synthetic polypeptide
DEEEIRTTNPVATEQYGTVSSENNLQGSGTNGQ

SEQ ID NO: 57777 - protein, 33 aa, Artificial Sequence
  Description of Artificial Sequence: Synthetic polypeptide
DEEEIRTTNPVATEQYGTVSTDNSNEQTGGNNV

SEQ ID NO: 57778 - protein, 33 aa, Artificial Sequence
  Description of Artificial Sequence: Synthetic polypeptide
DEEEIRTTNPVATEQYGTVSTENLVEVGGNNGD

SEQ ID NO: 57779 - protein, 32 aa, Artificial Sequence
  Description of Artificial Sequence: Synthetic polypeptide
DEEEIRTTNPVATEQYGTVSTNGGGQENGGGE

SEQ ID NO: 57780 - protein, 34 aa, Artificial Sequence
  Description of Artificial Sequence: Synthetic polypeptide
DEEEIRTTNPVATEQYGSVNSTTNIDNFGNIERM

SEQ ID NO: 57781 - protein, 33 aa, Artificial Sequence
  Description of Artificial Sequence: Synthetic polypeptide
DEEEIRTTNPVATEQYGTVSTNLTVGVGGNNGD

SEQ ID NO: 57782 - protein, 33 aa, Artificial Sequence
  Description of Artificial Sequence: Synthetic polypeptide
DEEEIRTTNPVATEQYGSVNSTTNDENSGEVRS

SEQ ID NO: 57783 - protein, 32 aa, Artificial Sequence
  Description of Artificial Sequence: Synthetic polypeptide
DEEEIRTTNPVATEQYGTVSTQNLDFEINGGD

SEQ ID NO: 57784 - protein, 33 aa, Artificial Sequence
  Description of Artificial Sequence: Synthetic polypeptide
DEEEIRTTNPVATEQYGSVNSTTNAEDQESERS

SEQ ID NO: 57785 - protein, 33 aa, Artificial Sequence
  Description of Artificial Sequence: Synthetic polypeptide
DEEEIRTTNPVATEQYGTVSTQNLVEVGGNNGD

SEQ ID NO: 57786 - protein, 32 aa, Artificial Sequence
  Description of Artificial Sequence: Synthetic polypeptide
DEEEIRTTNPVATEQYGTVSTTNLDFEINTGG

SEQ ID NO: 57787 - protein, 31 aa, Artificial Sequence
  Description of Artificial Sequence: Synthetic polypeptide
DEEEIRTTNPVATEQYGSVNSTTEPDNRNQE

SEQ ID NO: 57788 - protein, 34 aa, Artificial Sequence
  Description of Artificial Sequence: Synthetic polypeptide
DEEEIRTTNPVATEQYGSVNSTTENLAERTENEQ

SEQ ID NO: 57789 - protein, 32 aa, Artificial Sequence
  Description of Artificial Sequence: Synthetic polypeptide
DEEEIRTTNPVATEQYGTVSTTNLGFEINGGQ

SEQ ID NO: 57790 - protein, 33 aa, Artificial Sequence
  Description of Artificial Sequence: Synthetic polypeptide
DEEEIRTTNPVATEQYGTVSTTNNTNQQRTENN

SEQ ID NO: 57791 - protein, 34 aa, Artificial Sequence
  Description of Artificial Sequence: Synthetic polypeptide
DEEEIRTTNPVATEQYGSVNSTSNEDQQYGNEEI

SEQ ID NO: 57792 - protein, 32 aa, Artificial Sequence
  Description of Artificial Sequence: Synthetic polypeptide
DEEEIRTTNPVATEQYGTVSTTTNLGFEINGG

SEQ ID NO: 57793 - protein, 34 aa, Artificial Sequence
  Description of Artificial Sequence: Synthetic polypeptide
DEEEIRTTNPVATEQYGTVSTVNLQVGDGGNNGD

SEQ ID NO: 57794 - protein, 33 aa, Artificial Sequence
  Description of Artificial Sequence: Synthetic polypeptide
DEEEIRTTNPVATEQYGSVNSTSEDQQREGEEQ

SEQ ID NO: 57795 - protein, 34 aa, Artificial Sequence
  Description of Artificial Sequence: Synthetic polypeptide
DEEEIRTTNPVATEQYGSVNSTSDFDQRGNQEPI

SEQ ID NO: 57796 - protein, 33 aa, Artificial Sequence
  Description of Artificial Sequence: Synthetic polypeptide
DEEEIRTTNPVATEQYGSVNSTSDDQQRVSENQ

SEQ ID NO: 57797 - protein, 31 aa, Artificial Sequence
  Description of Artificial Sequence: Synthetic polypeptide
DEEEIRTTNPVATEQYGSYSVNDHRGGDEEN

SEQ ID NO: 57798 - protein, 32 aa, Artificial Sequence
  Description of Artificial Sequence: Synthetic polypeptide
DEEEIRTTNPVATEQYGSVYLMGLQQRENEES

SEQ ID NO: 57799 - protein, 33 aa, Artificial Sequence
  Description of Artificial Sequence: Synthetic polypeptide
DEEEIRTTNPVATEQYGSVNTTCNVEQRVLVER

SEQ ID NO: 57800 - protein, 33 aa, Artificial Sequence
  Description of Artificial Sequence: Synthetic polypeptide
DEEEIRTTNPVATEQYGSYSTNLVDPNAENERI

SEQ ID NO: 57801 - protein, 32 aa, Artificial Sequence
  Description of Artificial Sequence: Synthetic polypeptide
DEEEIRTTNPVATEQYGSVYSNVNQPRGMYVQ

SEQ ID NO: 57802 - protein, 33 aa, Artificial Sequence
  Description of Artificial Sequence: Synthetic polypeptide
DEEEIRTTNPVATEQYGSVPSPPPGLARVGVNL

SEQ ID NO: 57803 - protein, 32 aa, Artificial Sequence
  Description of Artificial Sequence: Synthetic polypeptide
DEEEIRTTNPVATEQYGSVPSPPNLQLDVEQS

SEQ ID NO: 57804 - protein, 34 aa, Artificial Sequence
  Description of Artificial Sequence: Synthetic polypeptide
DEEEIRTTNPVATEQYGSVYSSPNLPMYMGENRI

SEQ ID NO: 57805 - protein, 33 aa, Artificial Sequence
  Description of Artificial Sequence: Synthetic polypeptide
DEEEIRTTNPVATEQYGSVYSTNLELEVMENVD

SEQ ID NO: 57806 - protein, 33 aa, Artificial Sequence
  Description of Artificial Sequence: Synthetic polypeptide
DEEEIRTTNPVATEQYGSVPSNLEQARGLEEED

SEQ ID NO: 57807 - protein, 33 aa, Artificial Sequence
  Description of Artificial Sequence: Synthetic polypeptide
DEEEIRTTNPVATEQYGSVYSTTAQDQNCGATR

SEQ ID NO: 57808 - protein, 32 aa, Artificial Sequence
  Description of Artificial Sequence: Synthetic polypeptide
DEEEIRTTNPVATEQYGSVYSTTNLNGEIDGL

SEQ ID NO: 57809 - protein, 32 aa, Artificial Sequence
  Description of Artificial Sequence: Synthetic polypeptide
DEEEIRTTNPVATEQYGSVPSLNMPEQENMNG

SEQ ID NO: 57810 - protein, 34 aa, Artificial Sequence
  Description of Artificial Sequence: Synthetic polypeptide
DEEEIRTTNPVATEQYGSVYSLVNAQDQNCGANR

SEQ ID NO: 57811 - protein, 33 aa, Artificial Sequence
  Description of Artificial Sequence: Synthetic polypeptide
DEEEIRTTNPVATEQYGSVYTENDIQVNDGDSR

SEQ ID NO: 57812 - protein, 32 aa, Artificial Sequence
  Description of Artificial Sequence: Synthetic polypeptide
DEEEIRTTNPVATEQYGSVYTNKHQERDMIIE

SEQ ID NO: 57813 - protein, 32 aa, Artificial Sequence
  Description of Artificial Sequence: Synthetic polypeptide
DEEEIRTTNPVATEQYGSVYTNLQQEEVIEAG

SEQ ID NO: 57814 - protein, 34 aa, Artificial Sequence
  Description of Artificial Sequence: Synthetic polypeptide
DEEEIRTTNPVATEQYGSVPSCTNEHSQERDVIR

SEQ ID NO: 57815 - protein, 33 aa, Artificial Sequence
  Description of Artificial Sequence: Synthetic polypeptide
DEEEIRTTNPVATEQYGSVPSCTNEGSQFGTSF

SEQ ID NO: 57816 - protein, 34 aa, Artificial Sequence
  Description of Artificial Sequence: Synthetic polypeptide
DEEEIRTTNPVATEQYGSVPSCTNADDQNGVGNL

SEQ ID NO: 57817 - protein, 31 aa, Artificial Sequence
  Description of Artificial Sequence: Synthetic polypeptide
DEEEIRTTNPVATEQYGSVYTNQENSEEVNT

SEQ ID NO: 57818 - protein, 34 aa, Artificial Sequence
  Description of Artificial Sequence: Synthetic polypeptide
DEEEIRTTNPVATEQYGSVPSCTGNEGSQRDGSF

SEQ ID NO: 57819 - protein, 34 aa, Artificial Sequence
  Description of Artificial Sequence: Synthetic polypeptide
DEEEIRTTNPVATEQYGSVPSATPNGGSQRGVLF

SEQ ID NO: 57820 - protein, 32 aa, Artificial Sequence
  Description of Artificial Sequence: Synthetic polypeptide
DEEEIRTTNPVATEQYGSVYTTHEEGNGENFR

SEQ ID NO: 57821 - protein, 34 aa, Artificial Sequence
  Description of Artificial Sequence: Synthetic polypeptide
DEEEIRTTNPVATEQYGSVPSETPLLQRFLNDDT

SEQ ID NO: 57822 - protein, 33 aa, Artificial Sequence
  Description of Artificial Sequence: Synthetic polypeptide
DEEEIRTTNPVATEQYGSVYTTLLLAEGINERD

SEQ ID NO: 57823 - protein, 34 aa, Artificial Sequence
  Description of Artificial Sequence: Synthetic polypeptide
DEEEIRTTNPVATEQYGSVYSITNAQDQNCGANP

SEQ ID NO: 57824 - protein, 33 aa, Artificial Sequence
  Description of Artificial Sequence: Synthetic polypeptide
DEEEIRTTNPVATEQYGSVYSEAPNEIQRGQDT

SEQ ID NO: 57825 - protein, 33 aa, Artificial Sequence
  Description of Artificial Sequence: Synthetic polypeptide
DEEEIRTTNPVATEQYGSVYLTNLQPEMPELRS

SEQ ID NO: 57826 - protein, 32 aa, Artificial Sequence
  Description of Artificial Sequence: Synthetic polypeptide
DEEEIRTTNPVATEQYGSVYLTNLQQTQVPLE

SEQ ID NO: 57827 - protein, 31 aa, Artificial Sequence
  Description of Artificial Sequence: Synthetic polypeptide
DEEEIRTTNPVATEQYGSVYNTSLQTQVSQQ

SEQ ID NO: 57828 - protein, 33 aa, Artificial Sequence
  Description of Artificial Sequence: Synthetic polypeptide
DEEEIRTTNPVATEQYGSVYNTWNLQRTLEQDG

SEQ ID NO: 57829 - protein, 33 aa, Artificial Sequence
  Description of Artificial Sequence: Synthetic polypeptide
DEEEIRTTNPVATEQYGSVYPDTELQVFGKNKN

SEQ ID NO: 57830 - protein, 33 aa, Artificial Sequence
  Description of Artificial Sequence: Synthetic polypeptide
DEEEIRTTNPVATEQYGSVYPDTLEQLMGENRQ

SEQ ID NO: 57831 - protein, 32 aa, Artificial Sequence
  Description of Artificial Sequence: Synthetic polypeptide
DEEEIRTTNPVATEQYGSVYPFNLEQLMLEND

SEQ ID NO: 57832 - protein, 32 aa, Artificial Sequence
  Description of Artificial Sequence: Synthetic polypeptide
DEEEIRTTNPVATEQYGSVYPGNLEQRNVVHN

SEQ ID NO: 57833 - protein, 32 aa, Artificial Sequence
  Description of Artificial Sequence: Synthetic polypeptide
DEEEIRTTNPVATEQYGSVYPMNLQREVTQQI

SEQ ID NO: 57834 - protein, 30 aa, Artificial Sequence
  Description of Artificial Sequence: Synthetic polypeptide
DEEEIRTTNPVATEQYGSVYSEVETTGEEG

SEQ ID NO: 57835 - protein, 32 aa, Artificial Sequence
  Description of Artificial Sequence: Synthetic polypeptide
DEEEIRTTNPVATEQYGSVYPSNLQVANVNIY

SEQ ID NO: 57836 - protein, 33 aa, Artificial Sequence
  Description of Artificial Sequence: Synthetic polypeptide
DEEEIRTTNPVATEQYGSVYPTENLQPQMELRD

SEQ ID NO: 57837 - protein, 33 aa, Artificial Sequence
  Description of Artificial Sequence: Synthetic polypeptide
DEEEIRTTNPVATEQYGSVYPTNLPQQILNDLI

SEQ ID NO: 57838 - protein, 32 aa, Artificial Sequence
  Description of Artificial Sequence: Synthetic polypeptide
DEEEIRTTNPVATEQYGSVYPTNLQVIMELGT

SEQ ID NO: 57839 - protein, 34 aa, Artificial Sequence
  Description of Artificial Sequence: Synthetic polypeptide
DEEEIRTTNPVATEQYGSVYPTNLTETRGVNVIT

SEQ ID NO: 57840 - protein, 34 aa, Artificial Sequence
  Description of Artificial Sequence: Synthetic polypeptide
DEEEIRTTNPVATEQYGSVYPTNVEQREGGNEYS

SEQ ID NO: 57841 - protein, 32 aa, Artificial Sequence
  Description of Artificial Sequence: Synthetic polypeptide
DEEEIRTTNPVATEQYGSVYPTSLGGLGEVDR

SEQ ID NO: 57842 - protein, 34 aa, Artificial Sequence
  Description of Artificial Sequence: Synthetic polypeptide
DEEEIRTTNPVATEQYGSVYPTSNLMQMRGVEDQ

SEQ ID NO: 57843 - protein, 33 aa, Artificial Sequence
  Description of Artificial Sequence: Synthetic polypeptide
DEEEIRTTNPVATEQYGSVYPTVLPERMMNERM

SEQ ID NO: 57844 - protein, 30 aa, Artificial Sequence
  Description of Artificial Sequence: Synthetic polypeptide
DEEEIRTTNPVATEQYGSVYQVLDGGGEDF

SEQ ID NO: 57845 - protein, 34 aa, Artificial Sequence
  Description of Artificial Sequence: Synthetic polypeptide
DEEEIRTTNPVATEQYGSVPSTNEHSTERDVGLR

SEQ ID NO: 57846 - protein, 33 aa, Artificial Sequence
  Description of Artificial Sequence: Synthetic polypeptide
DEEEIRTTNPVATEQYGSVPPVGNEQRMQVNER

SEQ ID NO: 57847 - protein, 32 aa, Artificial Sequence
  Description of Artificial Sequence: Synthetic polypeptide
DEEEIRTTNPVATEQYGSVYTTNMEREGVSDE

SEQ ID NO: 57848 - protein, 32 aa, Artificial Sequence
  Description of Artificial Sequence: Synthetic polypeptide
DEEEIRTTNPVATEQYGSVPPTPGLARGVEFE

SEQ ID NO: 57849 - protein, 31 aa, Artificial Sequence
  Description of Artificial Sequence: Synthetic polypeptide
DEEEIRTTNPVATEQYGSVPDLVLGQASPNQ

SEQ ID NO: 57850 - protein, 32 aa, Artificial Sequence
  Description of Artificial Sequence: Synthetic polypeptide
DEEEIRTTNPVATEQYGSVPCWDNGGQRGDFG

SEQ ID NO: 57851 - protein, 31 aa, Artificial Sequence
  Description of Artificial Sequence: Synthetic polypeptide
DEEEIRTTNPVATEQYGSVPCPNGGLRGVQF

SEQ ID NO: 57852 - protein, 33 aa, Artificial Sequence
  Description of Artificial Sequence: Synthetic polypeptide
DEEEIRTTNPVATEQYGSVPCNTINVYGRGATR

SEQ ID NO: 57853 - protein, 35 aa, Artificial Sequence
  Description of Artificial Sequence: Synthetic polypeptide
DEEEIRTTNPVATEQYGSVPCNTFNLQYGRHGATR

SEQ ID NO: 57854 - protein, 32 aa, Artificial Sequence
  Description of Artificial Sequence: Synthetic polypeptide
DEEEIRTTNPVATEQYGSVPCDNGGGQRGHDF

SEQ ID NO: 57855 - protein, 32 aa, Artificial Sequence
  Description of Artificial Sequence: Synthetic polypeptide
DEEEIRTTNPVATEQYGSVPCDNGGGQREGKV

SEQ ID NO: 57856 - protein, 32 aa, Artificial Sequence
  Description of Artificial Sequence: Synthetic polypeptide
DEEEIRTTNPVATEQYGSVPAPNHQNIGIERN

SEQ ID NO: 57857 - protein, 33 aa, Artificial Sequence
  Description of Artificial Sequence: Synthetic polypeptide
DEEEIRTTNPVATEQYGSWTSVTDNEQEGEDRD

SEQ ID NO: 57858 - protein, 31 aa, Artificial Sequence
  Description of Artificial Sequence: Synthetic polypeptide
DEEEIRTTNPVATEQYGSWSLPNMLQGDEEI

SEQ ID NO: 57859 - protein, 32 aa, Artificial Sequence
  Description of Artificial Sequence: Synthetic polypeptide
DEEEIRTTNPVATEQYGSYASTENTQRNEIDL

SEQ ID NO: 57860 - protein, 33 aa, Artificial Sequence
  Description of Artificial Sequence: Synthetic polypeptide
DEEEIRTTNPVATEQYGSVNYTSLDQQREGEQQ

SEQ ID NO: 57861 - protein, 31 aa, Artificial Sequence
  Description of Artificial Sequence: Synthetic polypeptide
DEEEIRTTNPVATEQYGSVNYTELWDRNEEH

SEQ ID NO: 57862 - protein, 31 aa, Artificial Sequence
  Description of Artificial Sequence: Synthetic polypeptide
DEEEIRTTNPVATEQYGSVNYTEELEDRNEE

SEQ ID NO: 57863 - protein, 31 aa, Artificial Sequence
  Description of Artificial Sequence: Synthetic polypeptide
DEEEIRTTNPVATEQYGSYQSTNMSQHDLTG

SEQ ID NO: 57864 - protein, 32 aa, Artificial Sequence
  Description of Artificial Sequence: Synthetic polypeptide
DEEEIRTTNPVATEQYGSVNVQNVESDLGNQR

SEQ ID NO: 57865 - protein, 31 aa, Artificial Sequence
  Description of Artificial Sequence: Synthetic polypeptide
DEEEIRTTNPVATEQYGSYSNTPDQLVGEQI

SEQ ID NO: 57866 - protein, 33 aa, Artificial Sequence
  Description of Artificial Sequence: Synthetic polypeptide
DEEEIRTTNPVATEQYGSYSPTNIGLAFGTLNE

SEQ ID NO: 57867 - protein, 33 aa, Artificial Sequence
  Description of Artificial Sequence: Synthetic polypeptide
DEEEIRTTNPVATEQYGSYSTNLFDMRNSEEER

SEQ ID NO: 57868 - protein, 33 aa, Artificial Sequence
  Description of Artificial Sequence: Synthetic polypeptide
DEEEIRTTNPVATEQYGSVNTTVELQVLGNDNQ

SEQ ID NO: 57869 - protein, 33 aa, Artificial Sequence
  Description of Artificial Sequence: Synthetic polypeptide
DEEEIRTTNPVATEQYGSYASTPNLQRAVDEVI

SEQ ID NO: 57870 - protein, 32 aa, Artificial Sequence
  Description of Artificial Sequence: Synthetic polypeptide
DEEEIRTTNPVATEQYGSWSLPNMLERQDDNQ

SEQ ID NO: 57871 - protein, 33 aa, Artificial Sequence
  Description of Artificial Sequence: Synthetic polypeptide
DEEEIRTTNPVATEQYGSVPHPNLQRQGEQGVM

SEQ ID NO: 57872 - protein, 30 aa, Artificial Sequence
  Description of Artificial Sequence: Synthetic polypeptide
DEEEIRTTNPVATEQYGSVPIIQSVIRMNS

SEQ ID NO: 57873 - protein, 32 aa, Artificial Sequence
  Description of Artificial Sequence: Synthetic polypeptide
DEEEIRTTNPVATEQYGSVYTTNMERELVSRN

SEQ ID NO: 57874 - protein, 33 aa, Artificial Sequence
  Description of Artificial Sequence: Synthetic polypeptide
DEEEIRTTNPVATEQYGSVYTTNNNIQESGNNA

SEQ ID NO: 57875 - protein, 33 aa, Artificial Sequence
  Description of Artificial Sequence: Synthetic polypeptide
DEEEIRTTNPVATEQYGSVYTVLMLEQAQNDQR

SEQ ID NO: 57876 - protein, 33 aa, Artificial Sequence
  Description of Artificial Sequence: Synthetic polypeptide
DEEEIRTTNPVATEQYGSVYTWNDQPTFGLVRA

SEQ ID NO: 57877 - protein, 33 aa, Artificial Sequence
  Description of Artificial Sequence: Synthetic polypeptide
DEEEIRTTNPVATEQYGSVYTYELSVRNGEERE

SEQ ID NO: 57878 - protein, 33 aa, Artificial Sequence
  Description of Artificial Sequence: Synthetic polypeptide
DEEEIRTTNPVATEQYGSVPPPNSLQPREQNLL

SEQ ID NO: 57879 - protein, 33 aa, Artificial Sequence
  Description of Artificial Sequence: Synthetic polypeptide
DEEEIRTTNPVATEQYGSVPPPNLVPRLGEERD

SEQ ID NO: 57880 - protein, 33 aa, Artificial Sequence
  Description of Artificial Sequence: Synthetic polypeptide
DEEEIRTTNPVATEQYGSVPPPNLQPTLGEQRD

SEQ ID NO: 57881 - protein, 32 aa, Artificial Sequence
  Description of Artificial Sequence: Synthetic polypeptide
DEEEIRTTNPVATEQYGSVPPPNLQPSLVERD

SEQ ID NO: 57882 - protein, 33 aa, Artificial Sequence
  Description of Artificial Sequence: Synthetic polypeptide
DEEEIRTTNPVATEQYGSVPPPNLQPREQNDEG

SEQ ID NO: 57883 - protein, 32 aa, Artificial Sequence
  Description of Artificial Sequence: Synthetic polypeptide
DEEEIRTTNPVATEQYGSVYVMGNLDQRDEMI

SEQ ID NO: 57884 - protein, 33 aa, Artificial Sequence
  Description of Artificial Sequence: Synthetic polypeptide
DEEEIRTTNPVATEQYGSVPPPNGQPRLGVERY

SEQ ID NO: 57885 - protein, 32 aa, Artificial Sequence
  Description of Artificial Sequence: Synthetic polypeptide
DEEEIRTTNPVATEQYGSVPPNIQRSGDEDTN

SEQ ID NO: 57886 - protein, 32 aa, Artificial Sequence
  Description of Artificial Sequence: Synthetic polypeptide
DEEEIRTTNPVATEQYGSVPNTTLETGMNEEI

SEQ ID NO: 57887 - protein, 33 aa, Artificial Sequence
  Description of Artificial Sequence: Synthetic polypeptide
DEEEIRTTNPVATEQYGSVYVWENGIQQKTGNR

SEQ ID NO: 57888 - protein, 31 aa, Artificial Sequence
  Description of Artificial Sequence: Synthetic polypeptide
DEEEIRTTNPVATEQYGSVYYDLEHDGQNEQ

SEQ ID NO: 57889 - protein, 34 aa, Artificial Sequence
  Description of Artificial Sequence: Synthetic polypeptide
DEEEIRTTNPVATEQYGSVYYTPNLHQQRQAEER

SEQ ID NO: 57890 - protein, 33 aa, Artificial Sequence
  Description of Artificial Sequence: Synthetic polypeptide
DEEEIRTTNPVATEQYGSVPMMNLQRQGEEGLM

SEQ ID NO: 57891 - protein, 32 aa, Artificial Sequence
  Description of Artificial Sequence: Synthetic polypeptide
DEEEIRTTNPVATEQYGSWCSSPNDLQRDSQQ

SEQ ID NO: 57892 - protein, 31 aa, Artificial Sequence
  Description of Artificial Sequence: Synthetic polypeptide
DEEEIRTTNPVATEQYGSWISTPLDLRNDQE

SEQ ID NO: 57893 - protein, 30 aa, Artificial Sequence
  Description of Artificial Sequence: Synthetic polypeptide
DEEEIRTTNPVATEQYGSWPLPVTLQTDNT

SEQ ID NO: 57894 - protein, 33 aa, Artificial Sequence
  Description of Artificial Sequence: Synthetic polypeptide
DEEEIRTTNPVATEQYGSVNTTNNAQGGGNQGQ

SEQ ID NO: 57895 - protein, 34 aa, Artificial Sequence
  Description of Artificial Sequence: Synthetic polypeptide
DEEEIRTTNPVATEQYGSVTSTANMTDQGGNNLT

SEQ ID NO: 57896 - protein, 32 aa, Artificial Sequence
  Description of Artificial Sequence: Synthetic polypeptide
DEEEIRTTNPVAYEQWGTSCSTGLLREGNDSR

SEQ ID NO: 57897 - protein, 34 aa, Artificial Sequence
  Description of Artificial Sequence: Synthetic polypeptide
DEEEIRTTNPVATEQYGSVISTVNLDEFGGNDDE

SEQ ID NO: 57898 - protein, 33 aa, Artificial Sequence
  Description of Artificial Sequence: Synthetic polypeptide
DEEEISTTNPVATEQYGCVCSTMNLQRFPSNQG

SEQ ID NO: 57899 - protein, 32 aa, Artificial Sequence
  Description of Artificial Sequence: Synthetic polypeptide
DEEEISTTNPVATEQYGCVCSTNDLQAFGSDQ

SEQ ID NO: 57900 - protein, 33 aa, Artificial Sequence
  Description of Artificial Sequence: Synthetic polypeptide
DEEEISTTNPVATEQYGCVCSTNDLQRFGSEQG

SEQ ID NO: 57901 - protein, 31 aa, Artificial Sequence
  Description of Artificial Sequence: Synthetic polypeptide
DEEEISTTNPVATEQYGCVCSTNHQHLGSDQ

SEQ ID NO: 57902 - protein, 32 aa, Artificial Sequence
  Description of Artificial Sequence: Synthetic polypeptide
DEEEISTTNPVATEQYGCVCSTNHQNSGSNQS

SEQ ID NO: 57903 - protein, 32 aa, Artificial Sequence
  Description of Artificial Sequence: Synthetic polypeptide
DEEEISTTNPVATEQYGCVCSTNHQRFTSNTQ

SEQ ID NO: 57904 - protein, 32 aa, Artificial Sequence
  Description of Artificial Sequence: Synthetic polypeptide
DEEEISTTNPVATEQYGCVCSTNLDQNGSDQS

SEQ ID NO: 57905 - protein, 32 aa, Artificial Sequence
  Description of Artificial Sequence: Synthetic polypeptide
DEEEISTTNPVATEQYGCVCSTNLINFGSNQS

SEQ ID NO: 57906 - protein, 32 aa, Artificial Sequence
  Description of Artificial Sequence: Synthetic polypeptide
DEEEISTTNPVATEQYGCVCSTNLNQNGSEQV

SEQ ID NO: 57907 - protein, 33 aa, Artificial Sequence
  Description of Artificial Sequence: Synthetic polypeptide
DEEEISTTNPVATEQYGCVCSTMNLQHFGSDRA

SEQ ID NO: 57908 - protein, 32 aa, Artificial Sequence
  Description of Artificial Sequence: Synthetic polypeptide
DEEEISTTNPVATEQYGCVCSTNLQASGSDQG

SEQ ID NO: 57909 - protein, 32 aa, Artificial Sequence
  Description of Artificial Sequence: Synthetic polypeptide
DEEEISTTNPVATEQYGCVCSTNLQNFNSNQM

SEQ ID NO: 57910 - protein, 33 aa, Artificial Sequence
  Description of Artificial Sequence: Synthetic polypeptide
DEEEISTTNPVATEQYGCVCSTNNLQFFGSNVV

SEQ ID NO: 57911 - protein, 31 aa, Artificial Sequence
  Description of Artificial Sequence: Synthetic polypeptide
DEEEISTTNPVATEQYGCVCSTNPQNFGSQQ

SEQ ID NO: 57912 - protein, 32 aa, Artificial Sequence
  Description of Artificial Sequence: Synthetic polypeptide
DEEEISTTNPVATEQYGCVCSTPLQNFGSNQI

SEQ ID NO: 57913 - protein, 31 aa, Artificial Sequence
  Description of Artificial Sequence: Synthetic polypeptide
DEEEISTTNPVATEQYGCVCSTTELQHGSEA

SEQ ID NO: 57914 - protein, 31 aa, Artificial Sequence
  Description of Artificial Sequence: Synthetic polypeptide
DEEEISTTNPVATEQYGCVCSTYLQHFGSQA

SEQ ID NO: 57915 - protein, 30 aa, Artificial Sequence
  Description of Artificial Sequence: Synthetic polypeptide
DEEEISTTNPVATEQYGCVCSWELQNNSND

SEQ ID NO: 57916 - protein, 31 aa, Artificial Sequence
  Description of Artificial Sequence: Synthetic polypeptide
DEEEISTTNPVATEQYGCVCSWNLANFGSNQ

SEQ ID NO: 57917 - protein, 32 aa, Artificial Sequence
  Description of Artificial Sequence: Synthetic polypeptide
DEEEISTTNPVATEQYGCVCSWNLQRSGSEQQ

SEQ ID NO: 57918 - protein, 32 aa, Artificial Sequence
  Description of Artificial Sequence: Synthetic polypeptide
DEEEISTTNPVATEQYGCVCSTNLQENFNSNQ

SEQ ID NO: 57919 - protein, 33 aa, Artificial Sequence
  Description of Artificial Sequence: Synthetic polypeptide
DEEEISTTNPVATEQYGCVSNTNLQENFGSNQL

SEQ ID NO: 57920 - protein, 33 aa, Artificial Sequence
  Description of Artificial Sequence: Synthetic polypeptide
DEEEISTTNPVATEQYGCVCSTGNLQYGSNNQG

SEQ ID NO: 57921 - protein, 32 aa, Artificial Sequence
  Description of Artificial Sequence: Synthetic polypeptide
DEEEISTTNPVATEQYGCVCSTGNLQNFSSNQ

SEQ ID NO: 57922 - protein, 32 aa, Artificial Sequence
  Description of Artificial Sequence: Synthetic polypeptide
DEEEISTTNPVATEQYGCVCSMTPLQRFGSEF

SEQ ID NO: 57923 - protein, 33 aa, Artificial Sequence
  Description of Artificial Sequence: Synthetic polypeptide
DEEEISTTNPVATEQYGCVCSNTGNLQNGSNND

SEQ ID NO: 57924 - protein, 34 aa, Artificial Sequence
  Description of Artificial Sequence: Synthetic polypeptide
DEEEISTTNPVATEQYGCVCSNTNLQEGSGSNRL

SEQ ID NO: 57925 - protein, 33 aa, Artificial Sequence
  Description of Artificial Sequence: Synthetic polypeptide
DEEEISTTNPVATEQYGCVCSNTNLQNFGSNQN

SEQ ID NO: 57926 - protein, 32 aa, Artificial Sequence
  Description of Artificial Sequence: Synthetic polypeptide
DEEEISTTNPVATEQYGCVCSSENLQNFGSNQ

SEQ ID NO: 57927 - protein, 31 aa, Artificial Sequence
  Description of Artificial Sequence: Synthetic polypeptide
DEEEISTTNPVATEQYGCVCSSNHQRNSNQT

SEQ ID NO: 57928 - protein, 32 aa, Artificial Sequence
  Description of Artificial Sequence: Synthetic polypeptide
DEEEISTTNPVATEQYGCVCSTALQERFNSDQ

SEQ ID NO: 57929 - protein, 32 aa, Artificial Sequence
  Description of Artificial Sequence: Synthetic polypeptide
DEEEISTTNPVATEQYGCVCSTALQGFGSQNQ

SEQ ID NO: 57930 - protein, 32 aa, Artificial Sequence
  Description of Artificial Sequence: Synthetic polypeptide
DEEEISTTNPVATEQYGCVCSTELNQGFGSNQ

SEQ ID NO: 57931 - protein, 32 aa, Artificial Sequence
  Description of Artificial Sequence: Synthetic polypeptide
DEEEISTTNPVATEQYGCVCSTGNLQNSNSQQ

SEQ ID NO: 57932 - protein, 33 aa, Artificial Sequence
  Description of Artificial Sequence: Synthetic polypeptide
DEEEIRTTNPVATEQYGSVGDDTNDDQENIGNG

SEQ ID NO: 57933 - protein, 31 aa, Artificial Sequence
  Description of Artificial Sequence: Synthetic polypeptide
DEEEISTTNPVATEQYGCVCSTELQNFISNQ

SEQ ID NO: 57934 - protein, 32 aa, Artificial Sequence
  Description of Artificial Sequence: Synthetic polypeptide
DEEEISTTNPVATEQYGCVCSTELQNGSNFQS

SEQ ID NO: 57935 - protein, 31 aa, Artificial Sequence
  Description of Artificial Sequence: Synthetic polypeptide
DEEEISTTNPVATEQYGCVCSTELQYLGSEQ

SEQ ID NO: 57936 - protein, 32 aa, Artificial Sequence
  Description of Artificial Sequence: Synthetic polypeptide
DEEEISTTNPVATEQYGCVCSTENLQNLGSDQ

SEQ ID NO: 57937 - protein, 32 aa, Artificial Sequence
  Description of Artificial Sequence: Synthetic polypeptide
DEEEISTTNPVATEQYGCVCSTEPLQYFGSNQ

SEQ ID NO: 57938 - protein, 31 aa, Artificial Sequence
  Description of Artificial Sequence: Synthetic polypeptide
DEEEISTTNPVATEQYGCVCSTETQSGSNQQ

SEQ ID NO: 57939 - protein, 33 aa, Artificial Sequence
  Description of Artificial Sequence: Synthetic polypeptide
DEEEISTTNPVATEQYGCVCSTGNDQRFGSNND

SEQ ID NO: 57940 - protein, 33 aa, Artificial Sequence
  Description of Artificial Sequence: Synthetic polypeptide
DEEEISTTNPVATEQYGCVCSTGNLQGFGSNTQ

SEQ ID NO: 57941 - protein, 33 aa, Artificial Sequence
  Description of Artificial Sequence: Synthetic polypeptide
DEEEISTTNPVATEQYGCVCSTGNLQNFGSNNA

SEQ ID NO: 57942 - protein, 31 aa, Artificial Sequence
  Description of Artificial Sequence: Synthetic polypeptide
DEEEISTTNPVATEQYGCVCSTELQNFGDQG

SEQ ID NO: 57943 - protein, 34 aa, Artificial Sequence
  Description of Artificial Sequence: Synthetic polypeptide
DEEEISTTNPVATEQYGCVCSMTNLQRFGSDNQV

SEQ ID NO: 57944 - protein, 31 aa, Artificial Sequence
  Description of Artificial Sequence: Synthetic polypeptide
DEEEISTTNPVATEQYGCVSSNLQYFGSEDG

SEQ ID NO: 57945 - protein, 32 aa, Artificial Sequence
  Description of Artificial Sequence: Synthetic polypeptide
DEEEISTTNPVATEQYGCVSTEDLQNFGSENQ

SEQ ID NO: 57946 - protein, 33 aa, Artificial Sequence
  Description of Artificial Sequence: Synthetic polypeptide
DEEEISTTNPVATEQYGSVCSNTNLQHFGSEQA

SEQ ID NO: 57947 - protein, 33 aa, Artificial Sequence
  Description of Artificial Sequence: Synthetic polypeptide
DEEEISTTNPVATEQYGSVCSTEELQHFNSNRD

SEQ ID NO: 57948 - protein, 32 aa, Artificial Sequence
  Description of Artificial Sequence: Synthetic polypeptide
DEEEISTTNPVATEQYGSVCSTEELQSGSEQI

SEQ ID NO: 57949 - protein, 32 aa, Artificial Sequence
  Description of Artificial Sequence: Synthetic polypeptide
DEEEISTTNPVATEQYGSVCSTEHARFGSNQA

SEQ ID NO: 57950 - protein, 31 aa, Artificial Sequence
  Description of Artificial Sequence: Synthetic polypeptide
DEEEISTTNPVATEQYGSVCSTEHQSGSEFP

SEQ ID NO: 57951 - protein, 33 aa, Artificial Sequence
  Description of Artificial Sequence: Synthetic polypeptide
DEEEISTTNPVATEQYGSVCSTELQEYFGSNQA

SEQ ID NO: 57952 - protein, 32 aa, Artificial Sequence
  Description of Artificial Sequence: Synthetic polypeptide
DEEEISTTNPVATEQYGSVCSTGAHQNFGSNI

SEQ ID NO: 57953 - protein, 33 aa, Artificial Sequence
  Description of Artificial Sequence: Synthetic polypeptide
DEEEISTTNPVATEQYGSVCSTGEHQRMGSNQG

SEQ ID NO: 57954 - protein, 32 aa, Artificial Sequence
  Description of Artificial Sequence: Synthetic polypeptide
DEEEISTTNPVATEQYGSVCSTGNHQHGSEQG

SEQ ID NO: 57955 - protein, 33 aa, Artificial Sequence
  Description of Artificial Sequence: Synthetic polypeptide
DEEEISTTNPVATEQYGQCVSTGNLQNFGSENQ

SEQ ID NO: 57956 - protein, 33 aa, Artificial Sequence
  Description of Artificial Sequence: Synthetic polypeptide
DEEEISTTNPVATEQYGSVCSTGNLQNFMSNNQ

SEQ ID NO: 57957 - protein, 32 aa, Artificial Sequence
  Description of Artificial Sequence: Synthetic polypeptide
DEEEISTTNPVATEQYGSVCSTNHNQSGSEQP

SEQ ID NO: 57958 - protein, 33 aa, Artificial Sequence
  Description of Artificial Sequence: Synthetic polypeptide
DEEEISTTNPVATEQYGSVCSTNHQYFGSNNQT

SEQ ID NO: 57959 - protein, 34 aa, Artificial Sequence
  Description of Artificial Sequence: Synthetic polypeptide
DEEEISTTNPVATEQYGSVCSTNSLFQVRGSEQA

SEQ ID NO: 57960 - protein, 31 aa, Artificial Sequence
  Description of Artificial Sequence: Synthetic polypeptide
DEEEISTTNPVATEQYGSVCSTPHQNFGSDF

SEQ ID NO: 57961 - protein, 32 aa, Artificial Sequence
  Description of Artificial Sequence: Synthetic polypeptide
DEEEISTTNPVATEQYGSVCSTPLQNFGSEFS

SEQ ID NO: 57962 - protein, 31 aa, Artificial Sequence
  Description of Artificial Sequence: Synthetic polypeptide
DEEEISTTNPVATEQYGSVCSVLDLDRFMHR

SEQ ID NO: 57963 - protein, 32 aa, Artificial Sequence
  Description of Artificial Sequence: Synthetic polypeptide
DEEEISTTNPVATEQYGSVESTGNLAMQSNHP

SEQ ID NO: 57964 - protein, 33 aa, Artificial Sequence
  Description of Artificial Sequence: Synthetic polypeptide
DEEEISTTNPVATEQYGSVSTNSLFQVHFGSEQ

SEQ ID NO: 57965 - protein, 32 aa, Artificial Sequence
  Description of Artificial Sequence: Synthetic polypeptide
DEEEISTTNPVATEQYGVSTTTTNNNQQGNHR

SEQ ID NO: 57966 - protein, 33 aa, Artificial Sequence
  Description of Artificial Sequence: Synthetic polypeptide
DEEEISTTNPVATEQYGSVCSTNHFQNFGSNAV

SEQ ID NO: 57967 - protein, 30 aa, Artificial Sequence
  Description of Artificial Sequence: Synthetic polypeptide
DEEEISTTNPVATEQYGCVSSPLQNFGSDQ

SEQ ID NO: 57968 - protein, 32 aa, Artificial Sequence
  Description of Artificial Sequence: Synthetic polypeptide
DEEEISTTNPVATEQYGQCVCSTNLQNFGSDQ

SEQ ID NO: 57969 - protein, 31 aa, Artificial Sequence
  Description of Artificial Sequence: Synthetic polypeptide
DEEEISTTNPVATEQYGDVASMELCVDGENR

SEQ ID NO: 57970 - protein, 30 aa, Artificial Sequence
  Description of Artificial Sequence: Synthetic polypeptide
DEEEISTTNPVATEQYGCVSTEHQNFGQQG

SEQ ID NO: 57971 - protein, 30 aa, Artificial Sequence
  Description of Artificial Sequence: Synthetic polypeptide
DEEEISTTNPVATEQYGCVSTELANNSNQS

SEQ ID NO: 57972 - protein, 32 aa, Artificial Sequence
  Description of Artificial Sequence: Synthetic polypeptide
DEEEISTTNPVATEQYGCVSTELQEYFGSNQY

SEQ ID NO: 57973 - protein, 30 aa, Artificial Sequence
  Description of Artificial Sequence: Synthetic polypeptide
DEEEISTTNPVATEQYGCVSTELQGSFSEQ

SEQ ID NO: 57974 - protein, 30 aa, Artificial Sequence
  Description of Artificial Sequence: Synthetic polypeptide
DEEEISTTNPVATEQYGCVSTELQNFSEQF

SEQ ID NO: 57975 - protein, 31 aa, Artificial Sequence
  Description of Artificial Sequence: Synthetic polypeptide
DEEEISTTNPVATEQYGCVSTELQRFFSEQM

SEQ ID NO: 57976 - protein, 31 aa, Artificial Sequence
  Description of Artificial Sequence: Synthetic polypeptide
DEEEISTTNPVATEQYGCVSTELQYFPSNQG

SEQ ID NO: 57977 - protein, 32 aa, Artificial Sequence
  Description of Artificial Sequence: Synthetic polypeptide
DEEEIRTTNPVATEQYGSVFWTWDHQRESQER

SEQ ID NO: 57978 - protein, 33 aa, Artificial Sequence
  Description of Artificial Sequence: Synthetic polypeptide
DEEEISTTNPVATEQYGCVSTGNLQHFGSNTDA

SEQ ID NO: 57979 - protein, 29 aa, Artificial Sequence
  Description of Artificial Sequence: Synthetic peptide
DEEEISTTNPVATEQYGMVSEDLMFPERY

SEQ ID NO: 57980 - protein, 32 aa, Artificial Sequence
  Description of Artificial Sequence: Synthetic polypeptide
DEEEISTTNPVATEQYGCVSTGNPQRFGSDQA

SEQ ID NO: 57981 - protein, 33 aa, Artificial Sequence
  Description of Artificial Sequence: Synthetic polypeptide
DEEEIRTTNPVATEQYGSVFVVDNDHQRDDGNI

SEQ ID NO: 57982 - protein, 32 aa, Artificial Sequence
  Description of Artificial Sequence: Synthetic polypeptide
DEEEISTTNPVATEQYGCVSTNLQNFQSENQS

SEQ ID NO: 57983 - protein, 32 aa, Artificial Sequence
  Description of Artificial Sequence: Synthetic polypeptide
DEEEISTTNPVATEQYGCVSTNSLFQVRISEQ

SEQ ID NO: 57984 - protein, 31 aa, Artificial Sequence
  Description of Artificial Sequence: Synthetic polypeptide
DEEEISTTNPVATEQYGCVSTPLQSFGSEQP

SEQ ID NO: 57985 - protein, 30 aa, Artificial Sequence
  Description of Artificial Sequence: Synthetic polypeptide
DEEEISTTNPVATEQYGCVSTPLTNFNSEQ

SEQ ID NO: 57986 - protein, 32 aa, Artificial Sequence
  Description of Artificial Sequence: Synthetic polypeptide
DEEEISTTNPVATEQYGCVSTTNHQHFGSNQF

SEQ ID NO: 57987 - protein, 30 aa, Artificial Sequence
  Description of Artificial Sequence: Synthetic polypeptide
DEEEISTTNPVATEQYGCVSTYDQFFGSDQ

SEQ ID NO: 57988 - protein, 32 aa, Artificial Sequence
  Description of Artificial Sequence: Synthetic polypeptide
DEEEISTTNPVATEQYGCVSTYLQNFGSENQI

SEQ ID NO: 57989 - protein, 32 aa, Artificial Sequence
  Description of Artificial Sequence: Synthetic polypeptide
DEEEISTTNPVATEQYGCVSWNLQENFGSNDG

SEQ ID NO: 57990 - protein, 32 aa, Artificial Sequence
  Description of Artificial Sequence: Synthetic polypeptide
DEEEISTTNPVATEQYGCVSTNHQERFGSDQS

SEQ ID NO: 57991 - protein, 32 aa, Artificial Sequence
  Description of Artificial Sequence: Synthetic polypeptide
DEEEISTTNPVATEQYGCVCSCTNLQNFGSDQ

SEQ ID NO: 57992 - protein, 32 aa, Artificial Sequence
  Description of Artificial Sequence: Synthetic polypeptide
DEEEISTTNPVATEQYGCVCQTNLQNFGSERT

SEQ ID NO: 57993 - protein, 31 aa, Artificial Sequence
  Description of Artificial Sequence: Synthetic polypeptide
DEEEISTTNPVATEQYGCVCQTELQENGSNQ

SEQ ID NO: 57994 - protein, 30 aa, Artificial Sequence
  Description of Artificial Sequence: Synthetic polypeptide
DEEEIRTTNPVSTEQYGSVTPFVNLQQIQT

SEQ ID NO: 57995 - protein, 31 aa, Artificial Sequence
  Description of Artificial Sequence: Synthetic polypeptide
DEEEIRTTNPVSTEQYGSVTPFVNTLQQGQM

SEQ ID NO: 57996 - protein, 31 aa, Artificial Sequence
  Description of Artificial Sequence: Synthetic polypeptide
DEEEIRTTNPVSTEQYGSVTPITNLQEVSQT

SEQ ID NO: 57997 - protein, 31 aa, Artificial Sequence
  Description of Artificial Sequence: Synthetic polypeptide
DEEEIRTTNPVSTEQYGSVTPSNLQEVEQNT

SEQ ID NO: 57998 - protein, 33 aa, Artificial Sequence
  Description of Artificial Sequence: Synthetic polypeptide
DEEEIRTTNPVATEQYGSVGPTNNGQRVTVARI

SEQ ID NO: 57999 - protein, 33 aa, Artificial Sequence
  Description of Artificial Sequence: Synthetic polypeptide
DEEEIRTTNPVATEQYGSVGPTNLMEPQMPETR

SEQ ID NO: 58000 - protein, 33 aa, Artificial Sequence
  Description of Artificial Sequence: Synthetic polypeptide
DEEEIRTTNPVATEQYGSVGPTNGQEGAQQNDN

SEQ ID NO: 58001 - protein, 33 aa, Artificial Sequence
  Description of Artificial Sequence: Synthetic polypeptide
DEEEIRTTNPVATEQYGSVGPTGNHQRMQVNEN

SEQ ID NO: 58002 - protein, 32 aa, Artificial Sequence
  Description of Artificial Sequence: Synthetic polypeptide
DEEEIRTTNPVATEQYGSVGPTFNLDQMNVVI

SEQ ID NO: 58003 - protein, 34 aa, Artificial Sequence
  Description of Artificial Sequence: Synthetic polypeptide
DEEEIRTTNPVATEQYGSVGPTVVLIQRGQNDDD

SEQ ID NO: 58004 - protein, 33 aa, Artificial Sequence
  Description of Artificial Sequence: Synthetic polypeptide
DEEEIRTTNPVATEQYGSVGPTANLERQNVNVT

SEQ ID NO: 58005 - protein, 33 aa, Artificial Sequence
  Description of Artificial Sequence: Synthetic polypeptide
DEEEIRTTNPVATEQYGSVGPNVVLQRGQMADD

SEQ ID NO: 58006 - protein, 32 aa, Artificial Sequence
  Description of Artificial Sequence: Synthetic polypeptide
DEEEIRTTNPVSTETYGSVSMVNEQRTGENEL

SEQ ID NO: 58007 - protein, 33 aa, Artificial Sequence
  Description of Artificial Sequence: Synthetic polypeptide
DEEEIRTTNPVATEQYGSVGPNSVLQRVFVNDQ

SEQ ID NO: 58008 - protein, 32 aa, Artificial Sequence
  Description of Artificial Sequence: Synthetic polypeptide
DEEEIRTTNPVSTETYGSVSMVNLDQREIVNL

SEQ ID NO: 58009 - protein, 31 aa, Artificial Sequence
  Description of Artificial Sequence: Synthetic polypeptide
DEEEIRTTNPVSYEHYGSVSCTNGSQPGGNG

SEQ ID NO: 58010 - protein, 32 aa, Artificial Sequence
  Description of Artificial Sequence: Synthetic polypeptide
DEEEIRTTNPVSYEPYGSTVSMPNLSQRGGNL

SEQ ID NO: 58011 - protein, 30 aa, Artificial Sequence
  Description of Artificial Sequence: Synthetic polypeptide
DEEEIRTTNPVSYEQYGSVCCENLQGGGQT

SEQ ID NO: 58012 - protein, 33 aa, Artificial Sequence
  Description of Artificial Sequence: Synthetic polypeptide
DEEEIRTTNPVSYEQYGSVSCTGNLPQSTGGNA

SEQ ID NO: 58013 - protein, 32 aa, Artificial Sequence
  Description of Artificial Sequence: Synthetic polypeptide
DEEEIRTTNPVSYERYGSVSCTLNGSQRGGNS

SEQ ID NO: 58014 - protein, 31 aa, Artificial Sequence
  Description of Artificial Sequence: Synthetic polypeptide
DEEEIRTTNPVSTEQYGTISMEDIMQRNGNR

SEQ ID NO: 58015 - protein, 32 aa, Artificial Sequence
  Description of Artificial Sequence: Synthetic polypeptide
DEEEIRTTNPVTTEIYGSVSTNVATQSGVNLP

SEQ ID NO: 58016 - protein, 31 aa, Artificial Sequence
  Description of Artificial Sequence: Synthetic polypeptide
DEEEIRTTNPVSTEQYGSVTPFTNLEQQQQT

SEQ ID NO: 58017 - protein, 30 aa, Artificial Sequence
  Description of Artificial Sequence: Synthetic polypeptide
DEEEIRTTNPVSTEQYGSVTGDNNQGMGQT

SEQ ID NO: 58018 - protein, 32 aa, Artificial Sequence
  Description of Artificial Sequence: Synthetic polypeptide
DEEEIRTTNPVSTEQYGSVSYTSNAILHEMNQ

SEQ ID NO: 58019 - protein, 34 aa, Artificial Sequence
  Description of Artificial Sequence: Synthetic polypeptide
DEEEIRTTNPVATEQYGSVGSNMNLFQNGGDNEG

SEQ ID NO: 58020 - protein, 33 aa, Artificial Sequence
  Description of Artificial Sequence: Synthetic polypeptide
DEEEIRTTNPVATEQYGSVGSNMNLFNIGGNEG

SEQ ID NO: 58021 - protein, 31 aa, Artificial Sequence
  Description of Artificial Sequence: Synthetic polypeptide
DEEEIRTTNPVSTEQYGSVTCANLSQGGGDT

SEQ ID NO: 58022 - protein, 33 aa, Artificial Sequence
  Description of Artificial Sequence: Synthetic polypeptide
DEEEIRTTNPVATEQYGSVGSIGNGHQARDMIR

SEQ ID NO: 58023 - protein, 30 aa, Artificial Sequence
  Description of Artificial Sequence: Synthetic polypeptide
DEEEIRTTNPVSTEQYGSVTDNGQTGEGQT

SEQ ID NO: 58024 - protein, 33 aa, Artificial Sequence
  Description of Artificial Sequence: Synthetic polypeptide
DEEEIRTTNPVATEQYGSVGSGTNNEQGEGGGQ

SEQ ID NO: 58025 - protein, 34 aa, Artificial Sequence
  Description of Artificial Sequence: Synthetic polypeptide
DEEEIRTTNPVATEQYGSVGSGTNMEQNEGGNSN

SEQ ID NO: 58026 - protein, 31 aa, Artificial Sequence
  Description of Artificial Sequence: Synthetic polypeptide
DEEEIRTTNPVSTEQYGSVTFNDLQQGGGGT

SEQ ID NO: 58027 - protein, 31 aa, Artificial Sequence
  Description of Artificial Sequence: Synthetic polypeptide
DEEEIRTTNPVSTEQYGSVTPFNLQEVQGQT

SEQ ID NO: 58028 - protein, 31 aa, Artificial Sequence
  Description of Artificial Sequence: Synthetic polypeptide
DEEEIRTTNPVSTEQYGSVTFNDLQSEQNTD

SEQ ID NO: 58029 - protein, 33 aa, Artificial Sequence
  Description of Artificial Sequence: Synthetic polypeptide
DEEEIRTTNPVATEQYGSVGSGTMDQGGGGNEG

SEQ ID NO: 58030 - protein, 29 aa, Artificial Sequence
  Description of Artificial Sequence: Synthetic peptide
DEEEIRTTNPVSTEQYGSVTFNLLGEQTD

SEQ ID NO: 58031 - protein, 32 aa, Artificial Sequence
  Description of Artificial Sequence: Synthetic polypeptide
DEEEIRTTNPVATEQYGSVGSGNNDNGGEGNQ

SEQ ID NO: 58032 - protein, 32 aa, Artificial Sequence
  Description of Artificial Sequence: Synthetic polypeptide
DEEEIRTTNPVATEQYGSVGSGNGTQTEGGGQ

SEQ ID NO: 58033 - protein, 29 aa, Artificial Sequence
  Description of Artificial Sequence: Synthetic peptide
DEEEIRTTNPVSTEQYGSVTFYIQGGQTG

SEQ ID NO: 58034 - protein, 29 aa, Artificial Sequence
  Description of Artificial Sequence: Synthetic peptide
DEEEIRTTNPVSTEQYGSVTFYLETGFQT

SEQ ID NO: 58035 - protein, 29 aa, Artificial Sequence
  Description of Artificial Sequence: Synthetic peptide
DEEEIRTTNPVSTEQYGSVTFYLQGFQTD

SEQ ID NO: 58036 - protein, 30 aa, Artificial Sequence
  Description of Artificial Sequence: Synthetic polypeptide
DEEEIRTTNPVSTEQYGSVTFYLQGSNQDT

SEQ ID NO: 58037 - protein, 31 aa, Artificial Sequence
  Description of Artificial Sequence: Synthetic polypeptide
DEEEIRTTNPVSTEQYGSVTFYNLQGFGQQT

SEQ ID NO: 58038 - protein, 34 aa, Artificial Sequence
  Description of Artificial Sequence: Synthetic polypeptide
DEEEIRTTNPVATEQYGSVGSGTMNGQEGGNGTE

SEQ ID NO: 58039 - protein, 31 aa, Artificial Sequence
  Description of Artificial Sequence: Synthetic polypeptide
DEEEIRTVNPVATEQYGCVATGLQSRDNQAE

SEQ ID NO: 58040 - protein, 31 aa, Artificial Sequence
  Description of Artificial Sequence: Synthetic polypeptide
DEEEIRTVNPVATEQYGCVSMTELQRNSQQG

SEQ ID NO: 58041 - protein, 32 aa, Artificial Sequence
  Description of Artificial Sequence: Synthetic polypeptide
DEEEIRTVNPVATEQYGCVSTELNQRFNSQQL

SEQ ID NO: 58042 - protein, 33 aa, Artificial Sequence
  Description of Artificial Sequence: Synthetic polypeptide
DEEEIRTTNPVATEQYGSVGDTNNFQEDGGNEQ

SEQ ID NO: 58043 - protein, 31 aa, Artificial Sequence
  Description of Artificial Sequence: Synthetic polypeptide
DEEEIRYTNPVATEQYGSVSVNQDRTSDSRV

SEQ ID NO: 58044 - protein, 31 aa, Artificial Sequence
  Description of Artificial Sequence: Synthetic polypeptide
DEEEIRYTNPVATEQYGSVSVNQDRYGSESV

SEQ ID NO: 58045 - protein, 31 aa, Artificial Sequence
  Description of Artificial Sequence: Synthetic polypeptide
DEEEISTTNPCATEQYGCVCPTNLQENGNNQ

SEQ ID NO: 58046 - protein, 32 aa, Artificial Sequence
  Description of Artificial Sequence: Synthetic polypeptide
DEEEISTTNPCATEQYGSVATTNLQHGNGNGG

SEQ ID NO: 58047 - protein, 33 aa, Artificial Sequence
  Description of Artificial Sequence: Synthetic polypeptide
DEEEIRTTNPVATEQYGSVGDTNNEQEDGGNQG

SEQ ID NO: 58048 - protein, 32 aa, Artificial Sequence
  Description of Artificial Sequence: Synthetic polypeptide
DEEEISTTNPCATEQYGSVPTNLQHGTVNGGE

SEQ ID NO: 58049 - protein, 32 aa, Artificial Sequence
  Description of Artificial Sequence: Synthetic polypeptide
DEEEISTTNPCATEQYGSVTTVNLQHGIGNGG

SEQ ID NO: 58050 - protein, 33 aa, Artificial Sequence
  Description of Artificial Sequence: Synthetic polypeptide
DEEEISTTNPMATEQYGCVCPTNLQERGSNGRS

SEQ ID NO: 58051 - protein, 31 aa, Artificial Sequence
  Description of Artificial Sequence: Synthetic polypeptide
DEEEIRYTNPVATEQYGSVSVNQDGGNNSTQ

SEQ ID NO: 58052 - protein, 32 aa, Artificial Sequence
  Description of Artificial Sequence: Synthetic polypeptide
DEEEISTTNPMATEQYGSVCPTNLQENFGNTQ

SEQ ID NO: 58053 - protein, 32 aa, Artificial Sequence
  Description of Artificial Sequence: Synthetic polypeptide
DEEEISTTNPVATEAYGSVMSNTDLQEMGDRG

SEQ ID NO: 58054 - protein, 31 aa, Artificial Sequence
  Description of Artificial Sequence: Synthetic polypeptide
DEEEISTTNPVATEGYGCVCSTNLQSGSEQP

SEQ ID NO: 58055 - protein, 33 aa, Artificial Sequence
  Description of Artificial Sequence: Synthetic polypeptide
DEEEIRTTNPVATEQYGSVGDTNMDQENGINGQ

SEQ ID NO: 58056 - protein, 32 aa, Artificial Sequence
  Description of Artificial Sequence: Synthetic polypeptide
DEEEIRTTNPVATEQYGSVGDTNDGENIGNQD

SEQ ID NO: 58057 - protein, 32 aa, Artificial Sequence
  Description of Artificial Sequence: Synthetic polypeptide
DEEEIRTTNPVATEQYGSVGDTNDDENIGNGG

SEQ ID NO: 58058 - protein, 33 aa, Artificial Sequence
  Description of Artificial Sequence: Synthetic polypeptide
DEEEISTTNPVATEQYGCQVCSTGNLQRFGSEQ

SEQ ID NO: 58059 - protein, 32 aa, Artificial Sequence
  Description of Artificial Sequence: Synthetic polypeptide
DEEEISTTNPVATEQYGCQVSTNLQNFGSEQI

SEQ ID NO: 58060 - protein, 33 aa, Artificial Sequence
  Description of Artificial Sequence: Synthetic polypeptide
DEEEISTTNPVATEQYGCTCSTNELQRFGSNQS

SEQ ID NO: 58061 - protein, 33 aa, Artificial Sequence
  Description of Artificial Sequence: Synthetic polypeptide
DEEEISTTNPVATEQYGCVCGTNLQRFGSENQD

SEQ ID NO: 58062 - protein, 31 aa, Artificial Sequence
  Description of Artificial Sequence: Synthetic polypeptide
DEEEISTTNPVATAQYGSIDSTPNAQHGQRN

SEQ ID NO: 58063 - protein, 31 aa, Artificial Sequence
  Description of Artificial Sequence: Synthetic polypeptide
DEEEIRYTNPVATEQYGSVSVNQDEGGENQT

SEQ ID NO: 58064 - protein, 33 aa, Artificial Sequence
  Description of Artificial Sequence: Synthetic polypeptide
DEEEIRTTNPVATEQYGSVGDTNQNIQDGGENQ

SEQ ID NO: 58065 - protein, 31 aa, Artificial Sequence
  Description of Artificial Sequence: Synthetic polypeptide
DEEEIRYTNPVATEQYGSVSVENQDGGGNQT

SEQ ID NO: 58066 - protein, 34 aa, Artificial Sequence
  Description of Artificial Sequence: Synthetic polypeptide
DEEEIRTTNPVATEQYGSVGNTGNLQGTGGNGGT

SEQ ID NO: 58067 - protein, 30 aa, Artificial Sequence
  Description of Artificial Sequence: Synthetic polypeptide
DEEEIRTVNPVATEQYGCVSTPHQNFNSQQ

SEQ ID NO: 58068 - protein, 33 aa, Artificial Sequence
  Description of Artificial Sequence: Synthetic polypeptide
DEEEIRTVNPVATEQYGSTVSCTDLSQRTVGGE

SEQ ID NO: 58069 - protein, 31 aa, Artificial Sequence
  Description of Artificial Sequence: Synthetic polypeptide
DEEEIRTVNPVATEQYGSVCSTTELQNNSQQ

SEQ ID NO: 58070 - protein, 31 aa, Artificial Sequence
  Description of Artificial Sequence: Synthetic polypeptide
DEEEIRTVNPVATEQYGSVSPTLLLDRNQVI

SEQ ID NO: 58071 - protein, 33 aa, Artificial Sequence
  Description of Artificial Sequence: Synthetic polypeptide
DEEEIRTVNPVATEQYGSVSPTLLLVERGNQDN

SEQ ID NO: 58072 - protein, 32 aa, Artificial Sequence
  Description of Artificial Sequence: Synthetic polypeptide
DEEEIRTTNPVATEQYGSVGNTDNIQDEGGET

SEQ ID NO: 58073 - protein, 33 aa, Artificial Sequence
  Description of Artificial Sequence: Synthetic polypeptide
DEEEIRTTNPVATEQYGSVGNTDNGQEEGENNS

SEQ ID NO: 58074 - protein, 34 aa, Artificial Sequence
  Description of Artificial Sequence: Synthetic polypeptide
DEEEIRTTNPVATEQYGSVGNGTMNLGQEGGGNI

SEQ ID NO: 58075 - protein, 31 aa, Artificial Sequence
  Description of Artificial Sequence: Synthetic polypeptide
DEEEIRTVNPVATEQYGSVSTDLQPNDQPEE

SEQ ID NO: 58076 - protein, 32 aa, Artificial Sequence
  Description of Artificial Sequence: Synthetic polypeptide
DEEEIRTVNPVATEQYGSVSTSLLPQRNSVSE

SEQ ID NO: 58077 - protein, 31 aa, Artificial Sequence
  Description of Artificial Sequence: Synthetic polypeptide
DEEEIRTVNPVATEQYGSVSVTLLLDRNEQK

SEQ ID NO: 58078 - protein, 34 aa, Artificial Sequence
  Description of Artificial Sequence: Synthetic polypeptide
DEEEIRTTNPVATEQYGSVGLTPNGLQQRGLVED

SEQ ID NO: 58079 - protein, 33 aa, Artificial Sequence
  Description of Artificial Sequence: Synthetic polypeptide
DEEEIRTVNPVATEYYGSIVYSTNALQNTQNRP

SEQ ID NO: 58080 - protein, 32 aa, Artificial Sequence
  Description of Artificial Sequence: Synthetic polypeptide
DEEEIRTVNPVAYEQYGQSVSCTRALQRVGQE

SEQ ID NO: 58081 - protein, 32 aa, Artificial Sequence
  Description of Artificial Sequence: Synthetic polypeptide
DEEEIRTVNPVAYEQYGSTVSTSELSQRPGQE

SEQ ID NO: 58082 - protein, 34 aa, Artificial Sequence
  Description of Artificial Sequence: Synthetic polypeptide
DEEEIRTTNPVATEQYGSVGDTVNLIQNEGGNGG

SEQ ID NO: 58083 - protein, 29 aa, Artificial Sequence
  Description of Artificial Sequence: Synthetic peptide
DEEEIRTVNPVCTEPYGTVSMENIQSGNH

SEQ ID NO: 58084 - protein, 31 aa, Artificial Sequence
  Description of Artificial Sequence: Synthetic polypeptide
DEEEIRTVNPVCTEQYGVVSDINLQSEGENQ

SEQ ID NO: 58085 - protein, 31 aa, Artificial Sequence
  Description of Artificial Sequence: Synthetic polypeptide
DEEEIRTVNPVSTEQYGTVSDENLQQQNGNH

SEQ ID NO: 58086 - protein, 31 aa, Artificial Sequence
  Description of Artificial Sequence: Synthetic polypeptide
DEEEIRYTNPVATEQYGSVSGNGQDGGETGT

SEQ ID NO: 58087 - protein, 31 aa, Artificial Sequence
  Description of Artificial Sequence: Synthetic polypeptide
DEEEISTTNPVATEQYGVVCSTELQGINSNQ

SEQ ID NO: 58088 - protein, 32 aa, Artificial Sequence
  Description of Artificial Sequence: Synthetic polypeptide
DEEEISTTNPVATEQYGVVCSTMPLQNFGSNQ

SEQ ID NO: 58089 - protein, 31 aa, Artificial Sequence
  Description of Artificial Sequence: Synthetic polypeptide
DEEEISTTNPVAWEQYSGAVSTNPDARNNRS

SEQ ID NO: 58090 - protein, 32 aa, Artificial Sequence
  Description of Artificial Sequence: Synthetic polypeptide
DEEEISTTNPVAYEQYGQSVSSNDLDQRGSQQ

SEQ ID NO: 58091 - protein, 32 aa, Artificial Sequence
  Description of Artificial Sequence: Synthetic polypeptide
DEEQIRTTNPVAYERYGSVSCTNEIQRPSGPR

SEQ ID NO: 58092 - protein, 30 aa, Artificial Sequence
  Description of Artificial Sequence: Synthetic polypeptide
DEESIACTNPVATECYGCVATNGLQREGNM

SEQ ID NO: 58093 - protein, 31 aa, Artificial Sequence
  Description of Artificial Sequence: Synthetic polypeptide
DEESIACTNPVATECYGSVATNSLQERGNES

SEQ ID NO: 58094 - protein, 31 aa, Artificial Sequence
  Description of Artificial Sequence: Synthetic polypeptide
DEEEIRTTNPVATEQYGSVEPTPMVQTGQVT

SEQ ID NO: 58095 - protein, 34 aa, Artificial Sequence
  Description of Artificial Sequence: Synthetic polypeptide
DEEEIRTTNPVATEQYGSVEPTNPLPSRGENETL

SEQ ID NO: 58096 - protein, 34 aa, Artificial Sequence
  Description of Artificial Sequence: Synthetic polypeptide
DEEEIRTTNPVATEQYGSVEPTNNLQRQNVNLVM

SEQ ID NO: 58097 - protein, 30 aa, Artificial Sequence
  Description of Artificial Sequence: Synthetic polypeptide
DEESIACTNPVATEIYGCVATNLQSGDNTR

SEQ ID NO: 58098 - protein, 28 aa, Artificial Sequence
  Description of Artificial Sequence: Synthetic peptide
DEESIACTNPVATEQYGCVATNDTDGNS

SEQ ID NO: 58099 - protein, 33 aa, Artificial Sequence
  Description of Artificial Sequence: Synthetic polypeptide
DEEEIRTTNPVATEQYGSVEPTNLLEHNIGNEQ

SEQ ID NO: 58100 - protein, 31 aa, Artificial Sequence
  Description of Artificial Sequence: Synthetic polypeptide
DEEQIRTTNPVAYEQYGSVSTHESTREGNNS

SEQ ID NO: 58101 - protein, 28 aa, Artificial Sequence
  Description of Artificial Sequence: Synthetic peptide
DEESIACTNPVATEQYGSVAMHGQPGNL

SEQ ID NO: 58102 - protein, 30 aa, Artificial Sequence
  Description of Artificial Sequence: Synthetic polypeptide
DEESIACTNPVATESYGSVATNGLQNGNEQ

SEQ ID NO: 58103 - protein, 31 aa, Artificial Sequence
  Description of Artificial Sequence: Synthetic polypeptide
DEESIATTNPVATECYGSVATNDGGQRGGNM

SEQ ID NO: 58104 - protein, 30 aa, Artificial Sequence
  Description of Artificial Sequence: Synthetic polypeptide
DEESIATTNPVATECYGSVNTDGGQRGNTM

SEQ ID NO: 58105 - protein, 33 aa, Artificial Sequence
  Description of Artificial Sequence: Synthetic polypeptide
DEEEIRTTNPVATEQYGSVEPTNALEQNIGEEI

SEQ ID NO: 58106 - protein, 30 aa, Artificial Sequence
  Description of Artificial Sequence: Synthetic polypeptide
DEESIATTNPVATECYGSVNTGDGQRGNDM

SEQ ID NO: 58107 - protein, 32 aa, Artificial Sequence
  Description of Artificial Sequence: Synthetic polypeptide
DEESIATTNPVATECYGSVNTNDGGQRGNEMR

SEQ ID NO: 58108 - protein, 34 aa, Artificial Sequence
  Description of Artificial Sequence: Synthetic polypeptide
DEEEIRTTNPVATEQYGSVEPTINLLPQEGELRD

SEQ ID NO: 58109 - protein, 34 aa, Artificial Sequence
  Description of Artificial Sequence: Synthetic polypeptide
DEEEIRTTNPVATEQYGSVEPTGNALPQIGELRD

SEQ ID NO: 58110 - protein, 33 aa, Artificial Sequence
  Description of Artificial Sequence: Synthetic polypeptide
DEEEIRTTNPVATEQYGSVEPTEGLQQPGQNQI

SEQ ID NO: 58111 - protein, 29 aa, Artificial Sequence
  Description of Artificial Sequence: Synthetic peptide
DEESIACTNPVATESYGSVATGELQQGNM

SEQ ID NO: 58112 - protein, 33 aa, Artificial Sequence
  Description of Artificial Sequence: Synthetic polypeptide
DEEEIRTTNPVATEQYGSVEPTDLLLIGRGTLR

SEQ ID NO: 58113 - protein, 31 aa, Artificial Sequence
  Description of Artificial Sequence: Synthetic polypeptide
DEEQIRTTNPVAYEQYGSVSCTHESTRGGNT

SEQ ID NO: 58114 - protein, 31 aa, Artificial Sequence
  Description of Artificial Sequence: Synthetic polypeptide
DEEQIRTTNPVATEQYGSVSYWEDLRGDNTP

SEQ ID NO: 58115 - protein, 29 aa, Artificial Sequence
  Description of Artificial Sequence: Synthetic peptide
DEEQIATTNPVAYEQYGSVSTPHELHGNT

SEQ ID NO: 58116 - protein, 31 aa, Artificial Sequence
  Description of Artificial Sequence: Synthetic polypeptide
DEEQIGTTNPVATEQYGSVSTGGQEEGGGNT

SEQ ID NO: 58117 - protein, 28 aa, Artificial Sequence
  Description of Artificial Sequence: Synthetic peptide
DEEQIRCTNPVATEQYGSQSWNTEGGVY

SEQ ID NO: 58118 - protein, 31 aa, Artificial Sequence
  Description of Artificial Sequence: Synthetic polypeptide
DEEQIRCTNPVATEQYGSVSTDHELRIGNNQ

SEQ ID NO: 58119 - protein, 31 aa, Artificial Sequence
  Description of Artificial Sequence: Synthetic polypeptide
DEEQIRCTNPVATEQYGSVSTLEELRGQNEN

SEQ ID NO: 58120 - protein, 31 aa, Artificial Sequence
  Description of Artificial Sequence: Synthetic polypeptide
DEEQIRCTNPVATEQYGSVSTLHDELRGNTN

SEQ ID NO: 58121 - protein, 31 aa, Artificial Sequence
  Description of Artificial Sequence: Synthetic polypeptide
DEEQIRTTNPVATEAYGSVSCTHPSTRGGNT

SEQ ID NO: 58122 - protein, 34 aa, Artificial Sequence
  Description of Artificial Sequence: Synthetic polypeptide
DEEQIRTTNPVATEQYGISVDSNTHLFQRGNDQA

SEQ ID NO: 58123 - protein, 30 aa, Artificial Sequence
  Description of Artificial Sequence: Synthetic polypeptide
DEEQIRTTNPVATEQYGSVCSTEELGGSET

SEQ ID NO: 58124 - protein, 34 aa, Artificial Sequence
  Description of Artificial Sequence: Synthetic polypeptide
DEEEIRTTNPVATEQYGSVEPTTNLWQPQDNLRE

SEQ ID NO: 58125 - protein, 30 aa, Artificial Sequence
  Description of Artificial Sequence: Synthetic polypeptide
DEEQIRTTNPVATEQYGSVCSWEELNGSNQ

SEQ ID NO: 58126 - protein, 31 aa, Artificial Sequence
  Description of Artificial Sequence: Synthetic polypeptide
DEEQIRTTNPVATEQYGSVSTGGEEDGGGNT

SEQ ID NO: 58127 - protein, 33 aa, Artificial Sequence
  Description of Artificial Sequence: Synthetic polypeptide
DEEEIRTTNPVATEQYGSVESTGLDTRLGVEEN

SEQ ID NO: 58128 - protein, 33 aa, Artificial Sequence
  Description of Artificial Sequence: Synthetic polypeptide
DEEEIRTTNPVATEQYGSVESTDYLQETQNDQQ

SEQ ID NO: 58129 - protein, 32 aa, Artificial Sequence
  Description of Artificial Sequence: Synthetic polypeptide
DEEEIRTTNPVATEQYGSVESSAENDDQTTDR

SEQ ID NO: 58130 - protein, 31 aa, Artificial Sequence
  Description of Artificial Sequence: Synthetic polypeptide
DEEQIRTTNPVATEQYGSVSTHELREENNTP

SEQ ID NO: 58131 - protein, 35 aa, Artificial Sequence
  Description of Artificial Sequence: Synthetic polypeptide
DEEEIRTTNPVATEQYGSVESETNNGLQQLEGNNA

SEQ ID NO: 58132 - protein, 33 aa, Artificial Sequence
  Description of Artificial Sequence: Synthetic polypeptide
DEEEIRTTNPVATEQYGSVESCPPIQQRGNVTE

SEQ ID NO: 58133 - protein, 31 aa, Artificial Sequence
  Description of Artificial Sequence: Synthetic polypeptide
DEEEIRTTNPVATEQYGSVEPTYDVRIVGDN

SEQ ID NO: 58134 - protein, 31 aa, Artificial Sequence
  Description of Artificial Sequence: Synthetic polypeptide
DEEQIRTTNPVATEQYGSVSYWEDLRDGNET

SEQ ID NO: 58135 - protein, 32 aa, Artificial Sequence
  Description of Artificial Sequence: Synthetic polypeptide
DEEQIRTTNPVATEQYGSVPSCTHHSLRGGNT

SEQ ID NO: 58136 - protein, 32 aa, Artificial Sequence
  Description of Artificial Sequence: Synthetic polypeptide
DEEEIRTTNPVATEQYGSVEPPYLLTQRDDPR

SEQ ID NO: 58137 - protein, 31 aa, Artificial Sequence
  Description of Artificial Sequence: Synthetic polypeptide
DEEEIRTTNPVATEQYGSVEPNNELATIVDR

SEQ ID NO: 58138 - protein, 31 aa, Artificial Sequence
  Description of Artificial Sequence: Synthetic polypeptide
DEESIATTNPVATECYGSVTNTNDGQRGNQM

SEQ ID NO: 58139 - protein, 29 aa, Artificial Sequence
  Description of Artificial Sequence: Synthetic peptide
DEESICTVNPVATESYGSVSVNLEQGNTS

SEQ ID NO: 58140 - protein, 31 aa, Artificial Sequence
  Description of Artificial Sequence: Synthetic polypeptide
DEEEIRTTNPVATEQYGSVEMMLQQEDPNLM

SEQ ID NO: 58141 - protein, 34 aa, Artificial Sequence
  Description of Artificial Sequence: Synthetic polypeptide
DEEEIRTTNPVATEQYGSVELTNMLQMQGEEERE

SEQ ID NO: 58142 - protein, 30 aa, Artificial Sequence
  Description of Artificial Sequence: Synthetic polypeptide
DEESIMTTNPVATECYGSVNEPTLQRGENE

SEQ ID NO: 58143 - protein, 33 aa, Artificial Sequence
  Description of Artificial Sequence: Synthetic polypeptide
DEEEIRTTNPVATEQYGSVEITNMLQENQEDRD

SEQ ID NO: 58144 - protein, 32 aa, Artificial Sequence
  Description of Artificial Sequence: Synthetic polypeptide
DEESIMTTNPVATECYGSVNETNTLQRIGNNM

SEQ ID NO: 58145 - protein, 31 aa, Artificial Sequence
  Description of Artificial Sequence: Synthetic polypeptide
DEEEIRTTNPVATEQYGSVEHTNGEQVTDQQ

SEQ ID NO: 58146 - protein, 30 aa, Artificial Sequence
  Description of Artificial Sequence: Synthetic polypeptide
DEESIMTTNPVATECYGSVNTNTLIRGQIM

SEQ ID NO: 58147 - protein, 31 aa, Artificial Sequence
  Description of Artificial Sequence: Synthetic polypeptide
DEESIMTTNPVATECYGSVNVDNTLQRGNNM

SEQ ID NO: 58148 - protein, 33 aa, Artificial Sequence
  Description of Artificial Sequence: Synthetic polypeptide
DEEEIRTTNPVATEQYGSVENDNLQEREQVNVD

SEQ ID NO: 58149 - protein, 30 aa, Artificial Sequence
  Description of Artificial Sequence: Synthetic polypeptide
DEESIMTTNPVATECYGSVNVDTLQTRGNM

SEQ ID NO: 58150 - protein, 32 aa, Artificial Sequence
  Description of Artificial Sequence: Synthetic polypeptide
DEEEIRTTNPVATEQYGSVEATGLQRMLIEVP

SEQ ID NO: 58151 - protein, 32 aa, Artificial Sequence
  Description of Artificial Sequence: Synthetic polypeptide
DEESIRCTNPVATEQWGSVAATNNLQTPGVNR

SEQ ID NO: 58152 - protein, 32 aa, Artificial Sequence
  Description of Artificial Sequence: Synthetic polypeptide
DEESIRTTNPVATEQYGEVSYPHNLNDPRDNR

SEQ ID NO: 58153 - protein, 34 aa, Artificial Sequence
  Description of Artificial Sequence: Synthetic polypeptide
DEESIRTTNPVATEQYGQSVDQTNYLNQRGMNTH

SEQ ID NO: 58154 - protein, 32 aa, Artificial Sequence
  Description of Artificial Sequence: Synthetic polypeptide
DEEEIRTTNPVATEQYGSVDTSNDMERQEFNV

SEQ ID NO: 58155 - protein, 32 aa, Artificial Sequence
  Description of Artificial Sequence: Synthetic polypeptide
DEESIRTTNPVAYEQWGSVATTNNLQLGENNR

SEQ ID NO: 58156 - protein, 29 aa, Artificial Sequence
  Description of Artificial Sequence: Synthetic peptide
DEETIATTNPVATECYGSVNTNTLIVGPM

SEQ ID NO: 58157 - protein, 32 aa, Artificial Sequence
  Description of Artificial Sequence: Synthetic polypeptide
DEETIATTNPVATESYGSVNTTNTLLQRQGNM

SEQ ID NO: 58158 - protein, 30 aa, Artificial Sequence
  Description of Artificial Sequence: Synthetic polypeptide
DEETICTTNPVANEQYGQVSTTNVNQNGNN

SEQ ID NO: 58159 - protein, 31 aa, Artificial Sequence
  Description of Artificial Sequence: Synthetic polypeptide
DEESIMTTNPVATECYGYSVNTNTLERGNMM

SEQ ID NO: 58160 - protein, 30 aa, Artificial Sequence
  Description of Artificial Sequence: Synthetic polypeptide
DEESICTTNPVAYEAYGSVNTNELSQRVNM

SEQ ID NO: 58161 - protein, 32 aa, Artificial Sequence
  Description of Artificial Sequence: Synthetic polypeptide
DEESICTTNPVATECYGSVCNTNTLDQRDGNM

SEQ ID NO: 58162 - protein, 31 aa, Artificial Sequence
  Description of Artificial Sequence: Synthetic polypeptide
DEESICTTNPVATEAYGSVVNTNTLQAGSNM

SEQ ID NO: 58163 - protein, 29 aa, Artificial Sequence
  Description of Artificial Sequence: Synthetic peptide
DEESIATTNPVATEPYSAEASTNLQNGNT

SEQ ID NO: 58164 - protein, 29 aa, Artificial Sequence
  Description of Artificial Sequence: Synthetic peptide
DEESIATTNPVATEQYGCVAATNDQDSNS

SEQ ID NO: 58165 - protein, 31 aa, Artificial Sequence
  Description of Artificial Sequence: Synthetic polypeptide
DEEEIRTTNPVATEQYGSVEPMNLLQLDSQE

SEQ ID NO: 58166 - protein, 30 aa, Artificial Sequence
  Description of Artificial Sequence: Synthetic polypeptide
DEESIATTNPVATEQYGCVATNDQDNGNSH

SEQ ID NO: 58167 - protein, 32 aa, Artificial Sequence
  Description of Artificial Sequence: Synthetic polypeptide
DEESIATTNPVATEQYGCVGVATFNLQEGNYR

SEQ ID NO: 58168 - protein, 31 aa, Artificial Sequence
  Description of Artificial Sequence: Synthetic polypeptide
DEESIATTNPVAYEAYGSVNCTNSLSQRGNS

SEQ ID NO: 58169 - protein, 32 aa, Artificial Sequence
  Description of Artificial Sequence: Synthetic polypeptide
DEEEIRTTNPVATEQYGSVEPELLQGRDAALR

SEQ ID NO: 58170 - protein, 31 aa, Artificial Sequence
  Description of Artificial Sequence: Synthetic polypeptide
DEESIATTNPVAYEPYGSVNTNELSQRTGNM

SEQ ID NO: 58171 - protein, 32 aa, Artificial Sequence
  Description of Artificial Sequence: Synthetic polypeptide
DEEEIRTTNPVATEQYGSVEPANLPPDGNDLY

SEQ ID NO: 58172 - protein, 29 aa, Artificial Sequence
  Description of Artificial Sequence: Synthetic peptide
DEESIATVNPVATEPYGSVSANLDRDNPY

SEQ ID NO: 58173 - protein, 30 aa, Artificial Sequence
  Description of Artificial Sequence: Synthetic polypeptide
DEESIATVNPVATEPYGSVSANLDRGNNNL

SEQ ID NO: 58174 - protein, 32 aa, Artificial Sequence
  Description of Artificial Sequence: Synthetic polypeptide
DEEEIRTTNPVATEQYGSVENTNMQAGEPIIS

SEQ ID NO: 58175 - protein, 30 aa, Artificial Sequence
  Description of Artificial Sequence: Synthetic polypeptide
DEESIATVNPVATEPYGSVSANLGERGNDV

SEQ ID NO: 58176 - protein, 33 aa, Artificial Sequence
  Description of Artificial Sequence: Synthetic polypeptide
DEEEIRTTNPVATEQYGSVENTNMLIQPDELER

SEQ ID NO: 58177 - protein, 32 aa, Artificial Sequence
  Description of Artificial Sequence: Synthetic polypeptide
DEEEIRTTNPVATEQYGSVENTNLINPENNEC

SEQ ID NO: 58178 - protein, 30 aa, Artificial Sequence
  Description of Artificial Sequence: Synthetic polypeptide
DEESIATVNPVATEPYGSVSANPLGERDNR

SEQ ID NO: 58179 - protein, 30 aa, Artificial Sequence
  Description of Artificial Sequence: Synthetic polypeptide
DEESIATVNPVATEPYGSVSAPNLGERGNM

SEQ ID NO: 58180 - protein, 31 aa, Artificial Sequence
  Description of Artificial Sequence: Synthetic polypeptide
DEESIATVNPVATEWYGCVSHDNLQERGNAR

SEQ ID NO: 58181 - protein, 31 aa, Artificial Sequence
  Description of Artificial Sequence: Synthetic polypeptide
DEESICTTNPVATEAYGSVNVTNTLQEGTNM

SEQ ID NO: 58182 - protein, 32 aa, Artificial Sequence
  Description of Artificial Sequence: Synthetic polypeptide
DEESICTTNPVATEAYGSVSNTNTLQLQGNMT

SEQ ID NO: 58183 - protein, 31 aa, Artificial Sequence
  Description of Artificial Sequence: Synthetic polypeptide
DEESICTTNPVATEAYGSVTNTNTLQAGNMG

SEQ ID NO: 58184 - protein, 34 aa, Artificial Sequence
  Description of Artificial Sequence: Synthetic polypeptide
DEEEIRTTNPVATEQYGSVESTPNGLGRVEVVRS

SEQ ID NO: 58185 - protein, 34 aa, Artificial Sequence
  Description of Artificial Sequence: Synthetic polypeptide
DEEEIRTTNPVATEQYGSVGSNMNLQQEQEGNEG

SEQ ID NO: 58186 - protein, 35 aa, Artificial Sequence
  Description of Artificial Sequence: Synthetic polypeptide
DEEEIRTTNPVATEQYGSVESTPNQLGPRGEELRS

SEQ ID NO: 58187 - protein, 29 aa, Artificial Sequence
  Description of Artificial Sequence: Synthetic peptide
DEEQIATTNPVATEQYGSVSTHGPLNENE

SEQ ID NO: 58188 - protein, 32 aa, Artificial Sequence
  Description of Artificial Sequence: Synthetic polypeptide
DEEEIVTTNPVAYEAYGSVSTNLSQGTGTNNF

SEQ ID NO: 58189 - protein, 31 aa, Artificial Sequence
  Description of Artificial Sequence: Synthetic polypeptide
DEEEIRTTNPVATEQYGSVEVTNEQLTVQQQ

SEQ ID NO: 58190 - protein, 33 aa, Artificial Sequence
  Description of Artificial Sequence: Synthetic polypeptide
DEEEIYTTNPVATEQYGSTPSMTENLSQKIGER

SEQ ID NO: 58191 - protein, 28 aa, Artificial Sequence
  Description of Artificial Sequence: Synthetic peptide
DEEEVASTNPVATEQYGEVAETCQRGER

SEQ ID NO: 58192 - protein, 30 aa, Artificial Sequence
  Description of Artificial Sequence: Synthetic polypeptide
DEEEVRCTNPVASEIYGCVAATNLEREGNR

SEQ ID NO: 58193 - protein, 29 aa, Artificial Sequence
  Description of Artificial Sequence: Synthetic peptide
DEEEVRSTNPVATEGYGNVANNIQSRGQR

SEQ ID NO: 58194 - protein, 33 aa, Artificial Sequence
  Description of Artificial Sequence: Synthetic polypeptide
DEEEIRTTNPVATEQYGSVETTNLQVEGEELKF

SEQ ID NO: 58195 - protein, 31 aa, Artificial Sequence
  Description of Artificial Sequence: Synthetic polypeptide
DEEGIRTTNPVATEQYGSVPSVTHETANGNT

SEQ ID NO: 58196 - protein, 31 aa, Artificial Sequence
  Description of Artificial Sequence: Synthetic polypeptide
DEEGIRTTNPVATEQYGSVPSVTHGEANGNE

SEQ ID NO: 58197 - protein, 32 aa, Artificial Sequence
  Description of Artificial Sequence: Synthetic polypeptide
DEEEIVTTNPVATEQYGTVCSTDGLVMFEGNR

SEQ ID NO: 58198 - protein, 33 aa, Artificial Sequence
  Description of Artificial Sequence: Synthetic polypeptide
DEEGIRTTNPVATEQYGSVSTVNLDDGNGQNDG

SEQ ID NO: 58199 - protein, 33 aa, Artificial Sequence
  Description of Artificial Sequence: Synthetic polypeptide
DEEGIRTTNPVATERYGSVSCTNAISQRPVGPR

SEQ ID NO: 58200 - protein, 34 aa, Artificial Sequence
  Description of Artificial Sequence: Synthetic polypeptide
DEEGIRTTNPVAYEQYGQSVSCQTNELSQRGGSR

SEQ ID NO: 58201 - protein, 34 aa, Artificial Sequence
  Description of Artificial Sequence: Synthetic polypeptide
DEEEIRTTNPVATEQYGSVETNTLEQNSNGNELP

SEQ ID NO: 58202 - protein, 30 aa, Artificial Sequence
  Description of Artificial Sequence: Synthetic polypeptide
DEEHIRTSNPVATESWGSVATNNLQLGVER

SEQ ID NO: 58203 - protein, 31 aa, Artificial Sequence
  Description of Artificial Sequence: Synthetic polypeptide
DEEHIRTTNPVANEQWGSVATNNLQLAGVER

SEQ ID NO: 58204 - protein, 33 aa, Artificial Sequence
  Description of Artificial Sequence: Synthetic polypeptide
DEEEIRTTNPVATEQYGSVETNQEQVRTLNHDN

SEQ ID NO: 58205 - protein, 33 aa, Artificial Sequence
  Description of Artificial Sequence: Synthetic polypeptide
DEEEIRTTNPVATEQYGSVETNQEQVRTEENDN

SEQ ID NO: 58206 - protein, 31 aa, Artificial Sequence
  Description of Artificial Sequence: Synthetic polypeptide
DEEHIRTTNPVATEQWGTVATNNLQLHGVER

SEQ ID NO: 58207 - protein, 32 aa, Artificial Sequence
  Description of Artificial Sequence: Synthetic polypeptide
DEEHIRTTNPVATEQYGCTVSCTNHSQFGGNE

SEQ ID NO: 58208 - protein, 31 aa, Artificial Sequence
  Description of Artificial Sequence: Synthetic polypeptide
DEEGIRTTNPVATEQYGSVSVTCHEAEVGNT

SEQ ID NO: 58209 - protein, 33 aa, Artificial Sequence
  Description of Artificial Sequence: Synthetic polypeptide
DEEEIRTTNPVATEQYGSVETNLTAVNISNQRV

SEQ ID NO: 58210 - protein, 32 aa, Artificial Sequence
  Description of Artificial Sequence: Synthetic polypeptide
DEEEIVTTNPVATEQYGTVCSATNLVEFEGNQ

SEQ ID NO: 58211 - protein, 33 aa, Artificial Sequence
  Description of Artificial Sequence: Synthetic polypeptide
DEEEIRTTNPVATEQYGSVFCTDNGGQRDGKDS

SEQ ID NO: 58212 - protein, 29 aa, Artificial Sequence
  Description of Artificial Sequence: Synthetic peptide
DEEEISTVNPVATEQYGCVSTPLQNNSQQ

SEQ ID NO: 58213 - protein, 33 aa, Artificial Sequence
  Description of Artificial Sequence: Synthetic polypeptide
DEEEITTTNPVATEQYGSVSPTNSLQAVRPEQV

SEQ ID NO: 58214 - protein, 33 aa, Artificial Sequence
  Description of Artificial Sequence: Synthetic polypeptide
DEEEITTTNPVATEQYGSVSPTNSLQQHRNEVG

SEQ ID NO: 58215 - protein, 33 aa, Artificial Sequence
  Description of Artificial Sequence: Synthetic polypeptide
DEEEITTTNPVATEQYGSVSVTNELQQVRPELV

SEQ ID NO: 58216 - protein, 33 aa, Artificial Sequence
  Description of Artificial Sequence: Synthetic polypeptide
DEEEIRTTNPVATEQYGSVFSPVDLQGRGPISG

SEQ ID NO: 58217 - protein, 31 aa, Artificial Sequence
  Description of Artificial Sequence: Synthetic polypeptide
DEEEIVCTNPIATEQYGTVSEDNLVEREGNR

SEQ ID NO: 58218 - protein, 35 aa, Artificial Sequence
  Description of Artificial Sequence: Synthetic polypeptide
DEEEIRTTNPVATEQYGSVFSPTDNLTQTRNSDNG

SEQ ID NO: 58219 - protein, 32 aa, Artificial Sequence
  Description of Artificial Sequence: Synthetic polypeptide
DEEEIVTTNPVATEPYGSVSTNLDQEGGSAST

SEQ ID NO: 58220 - protein, 29 aa, Artificial Sequence
  Description of Artificial Sequence: Synthetic peptide
DEEEIRTTNPVATEQYGSVFPGAGDEGPY

SEQ ID NO: 58221 - protein, 33 aa, Artificial Sequence
  Description of Artificial Sequence: Synthetic polypeptide
DEEEIVTTNPVATEQYGSVSTWLQASGMGEYNC

SEQ ID NO: 58222 - protein, 32 aa, Artificial Sequence
  Description of Artificial Sequence: Synthetic polypeptide
DEEEIRTTNPVATEQYGSVFNVNLDERINENQ

SEQ ID NO: 58223 - protein, 30 aa, Artificial Sequence
  Description of Artificial Sequence: Synthetic polypeptide
DEEEIVTTNPVATEQYGSVNSPNHVIMIDR

SEQ ID NO: 58224 - protein, 31 aa, Artificial Sequence
  Description of Artificial Sequence: Synthetic polypeptide
DEEEIRTTNPVATEQYGSVFMTVLQENVDVD

SEQ ID NO: 58225 - protein, 33 aa, Artificial Sequence
  Description of Artificial Sequence: Synthetic polypeptide
DEEEIRTTNPVATEQYGSVFLIHGGLQPRGNDE

SEQ ID NO: 58226 - protein, 33 aa, Artificial Sequence
  Description of Artificial Sequence: Synthetic polypeptide
DEEEIRTTNPVATEQYGSVFITGDDQIRIVNVR

SEQ ID NO: 58227 - protein, 33 aa, Artificial Sequence
  Description of Artificial Sequence: Synthetic polypeptide
DEEEIRTTNPVATEQYGSVFGTSNLNGGGENDG

SEQ ID NO: 58228 - protein, 31 aa, Artificial Sequence
  Description of Artificial Sequence: Synthetic polypeptide
DEEEIVTTNPVATEQYGSVSMNNLAGGGIIM

SEQ ID NO: 58229 - protein, 32 aa, Artificial Sequence
  Description of Artificial Sequence: Synthetic polypeptide
DEEEIRTTNPVATEQYGSVFFLIELQANGEPR

SEQ ID NO: 58230 - protein, 32 aa, Artificial Sequence
  Description of Artificial Sequence: Synthetic polypeptide
DEEEIVTTNPVATEQYGSVSTNNGLFPVNGEF

SEQ ID NO: 58231 - protein, 33 aa, Artificial Sequence
  Description of Artificial Sequence: Synthetic polypeptide
DEEEIRTTNPVATEQYGSVFCTDNHGQRPGHDF

SEQ ID NO: 58232 - protein, 31 aa, Artificial Sequence
  Description of Artificial Sequence: Synthetic polypeptide
DEEEIVTTNPVATEQYGSVNSPNHEVVMINR

SEQ ID NO: 58233 - protein, 30 aa, Artificial Sequence
  Description of Artificial Sequence: Synthetic polypeptide
DEEIIRCTNPVATEQYGCVSTNMQEFPENE

SEQ ID NO: 58234 - protein, 33 aa, Artificial Sequence
  Description of Artificial Sequence: Synthetic polypeptide
DEEIIRTTNPVATEQYGSVSVGNDADRTQGNYR

SEQ ID NO: 58235 - protein, 32 aa, Artificial Sequence
  Description of Artificial Sequence: Synthetic polypeptide
DEEKIRTTNPVATEIYGSVSTNLDDGVHGQIR

SEQ ID NO: 58236 - protein, 31 aa, Artificial Sequence
  Description of Artificial Sequence: Synthetic polypeptide
DEENIRTTNPVAYEQYGTVSTGDLNDNGQNR

SEQ ID NO: 58237 - protein, 30 aa, Artificial Sequence
  Description of Artificial Sequence: Synthetic polypeptide
DEEPIATTNPVATEPYSEEVSTNLQNGNTV

SEQ ID NO: 58238 - protein, 31 aa, Artificial Sequence
  Description of Artificial Sequence: Synthetic polypeptide
DEEPIATTNPVATEQYGCVSHTNDVQFQGNA

SEQ ID NO: 58239 - protein, 33 aa, Artificial Sequence
  Description of Artificial Sequence: Synthetic polypeptide
DEEPIRTTNPVATEIYGEVATGNLDQDRDGSNR

SEQ ID NO: 58240 - protein, 32 aa, Artificial Sequence
  Description of Artificial Sequence: Synthetic polypeptide
DEEPIRTTNPVATEQYGCVSHTNDDQGQGNAD

SEQ ID NO: 58241 - protein, 31 aa, Artificial Sequence
  Description of Artificial Sequence: Synthetic polypeptide
DEEPIRTTNPVATEQYGCVSHTNDHQGQGDA

SEQ ID NO: 58242 - protein, 32 aa, Artificial Sequence
  Description of Artificial Sequence: Synthetic polypeptide
DEEPIRTTNPVATEQYRWEVSTNELSQTGGNE

SEQ ID NO: 58243 - protein, 31 aa, Artificial Sequence
  Description of Artificial Sequence: Synthetic polypeptide
DEEPIRTTNPVAYEPYGTVSCTNELSQEGER

SEQ ID NO: 58244 - protein, 33 aa, Artificial Sequence
  Description of Artificial Sequence: Synthetic polypeptide
DEEPIRTTNPVAYEQYGSVSYNCALSQRGGNNE

SEQ ID NO: 58245 - protein, 31 aa, Artificial Sequence
  Description of Artificial Sequence: Synthetic polypeptide
DEENIRTTNPVAYEAYGVVACTNLSQRGTNS

SEQ ID NO: 58246 - protein, 29 aa, Artificial Sequence
  Description of Artificial Sequence: Synthetic peptide
DEEQIACTNPVATEQWGSVAMNDQRGNDL

SEQ ID NO: 58247 - protein, 30 aa, Artificial Sequence
  Description of Artificial Sequence: Synthetic polypeptide
DEEQIACTNPVATESYGCVATNLQDGSNRS

SEQ ID NO: 58248 - protein, 33 aa, Artificial Sequence
  Description of Artificial Sequence: Synthetic polypeptide
DEEQIATTNPVATEPYGSVSCTNAFQRNGGSNR

SEQ ID NO: 58249 - protein, 31 aa, Artificial Sequence
  Description of Artificial Sequence: Synthetic polypeptide
DEEQIATTNPVATEQWGSVADTNNDQPGVNR

SEQ ID NO: 58250 - protein, 29 aa, Artificial Sequence
  Description of Artificial Sequence: Synthetic peptide
DEEQIATTNPVATEQWGSVATHGLDMGNT

SEQ ID NO: 58251 - protein, 29 aa, Artificial Sequence
  Description of Artificial Sequence: Synthetic peptide
DEEQIATTNPVATEQWGSVSTHEANQGNT

SEQ ID NO: 58252 - protein, 30 aa, Artificial Sequence
  Description of Artificial Sequence: Synthetic polypeptide
DEEQIATTNPVATEQYGCVAATNDQDGNSM

SEQ ID NO: 58253 - protein, 30 aa, Artificial Sequence
  Description of Artificial Sequence: Synthetic polypeptide
DEEQIATTNPVATEQYGSVSTHEPLDNENQ

SEQ ID NO: 58254 - protein, 30 aa, Artificial Sequence
  Description of Artificial Sequence: Synthetic polypeptide
DEEQIATTNPVATEQYGSVSTHEPLNGENN

SEQ ID NO: 58255 - protein, 33 aa, Artificial Sequence
  Description of Artificial Sequence: Synthetic polypeptide
DEEEIRTTNPVATEQYGSVESWTGELQTEVNVN

SEQ ID NO: 58256 - protein, 30 aa, Artificial Sequence
  Description of Artificial Sequence: Synthetic polypeptide
DEEQIACTNPVATEQYGSVSTHELEAGNNN

SEQ ID NO: 58257 - protein, 31 aa, Artificial Sequence
  Description of Artificial Sequence: Synthetic polypeptide
DEENIRTTNPVATEQYGSVVSTVTAEIGSSR

SEQ ID NO: 58258 - protein, 33 aa, Artificial Sequence
  Description of Artificial Sequence: Synthetic polypeptide
DEEEIRTTNPVATEQYGSVETMNVLVQTGQELF

SEQ ID NO: 58259 - protein, 32 aa, Artificial Sequence
  Description of Artificial Sequence: Synthetic polypeptide
DEEEIRTTNPVATEQYGSVETMTLVQDGEEFQ

SEQ ID NO: 58260 - protein, 29 aa, Artificial Sequence
  Description of Artificial Sequence: Synthetic peptide
DEELIRCTNPVATEQYGMQSWNFLEGGNL

SEQ ID NO: 58261 - protein, 30 aa, Artificial Sequence
  Description of Artificial Sequence: Synthetic polypeptide
DEENIATTNPVATEIYGQVTTGNAQDGDNR

SEQ ID NO: 58262 - protein, 31 aa, Artificial Sequence
  Description of Artificial Sequence: Synthetic polypeptide
DEENICTTNPVATEAYGQVSTTNLQQGSNTE

SEQ ID NO: 58263 - protein, 30 aa, Artificial Sequence
  Description of Artificial Sequence: Synthetic polypeptide
DEENICTTNPVATEAYGSVNTNTQQPGDNM

SEQ ID NO: 58264 - protein, 30 aa, Artificial Sequence
  Description of Artificial Sequence: Synthetic polypeptide
DEENICTTNPVATEIYGVVTTNLQEGSNIT

SEQ ID NO: 58265 - protein, 30 aa, Artificial Sequence
  Description of Artificial Sequence: Synthetic polypeptide
DEENICTTNPVATEIYGVVTTNLQQGSNII

SEQ ID NO: 58266 - protein, 30 aa, Artificial Sequence
  Description of Artificial Sequence: Synthetic polypeptide
DEENICTTNPVATEIYGVVVTTNLQQGSER

SEQ ID NO: 58267 - protein, 33 aa, Artificial Sequence
  Description of Artificial Sequence: Synthetic polypeptide
DEENICTTNPVATEQYGSVSWTGLMQAEGGNSR

SEQ ID NO: 58268 - protein, 29 aa, Artificial Sequence
  Description of Artificial Sequence: Synthetic peptide
DEENICTVNPVATEQYGSVSTALQPNQQE

SEQ ID NO: 58269 - protein, 29 aa, Artificial Sequence
  Description of Artificial Sequence: Synthetic peptide
DEENICTVNPVATEQYGSVSTALQQNQEE

SEQ ID NO: 58270 - protein, 31 aa, Artificial Sequence
  Description of Artificial Sequence: Synthetic polypeptide
DEENIRTTNPCATEQYGSAVPTDLQGNGNQK

SEQ ID NO: 58271 - protein, 32 aa, Artificial Sequence
  Description of Artificial Sequence: Synthetic polypeptide
DEENIRTTNPVATEAYGQVPACTNLSQDGGNR

SEQ ID NO: 58272 - protein, 32 aa, Artificial Sequence
  Description of Artificial Sequence: Synthetic polypeptide
DEENIRTTNPVATEIYGEVATGNQQDRDGSNR

SEQ ID NO: 58273 - protein, 32 aa, Artificial Sequence
  Description of Artificial Sequence: Synthetic polypeptide
DEENIRTTNPVATEIYGQVCTTNSLQRGSERM

SEQ ID NO: 58274 - protein, 31 aa, Artificial Sequence
  Description of Artificial Sequence: Synthetic polypeptide
DEENIRTTNPVATEIYGQVTTNLERGSNQFS

SEQ ID NO: 58275 - protein, 31 aa, Artificial Sequence
  Description of Artificial Sequence: Synthetic polypeptide
DEENIRTTNPVATEIYGQVTTNVLERGSNQQ

SEQ ID NO: 58276 - protein, 33 aa, Artificial Sequence
  Description of Artificial Sequence: Synthetic polypeptide
DEENIRTTNPVATEPYGEVTTTNLQPRMGSNRV

SEQ ID NO: 58277 - protein, 32 aa, Artificial Sequence
  Description of Artificial Sequence: Synthetic polypeptide
DEENIRTTNPVATEPYGTVTTMNLQRQASNRE

SEQ ID NO: 58278 - protein, 31 aa, Artificial Sequence
  Description of Artificial Sequence: Synthetic polypeptide
DEENIRTTNPVATEPYGTVTTNLQRGGIGGE

SEQ ID NO: 58279 - protein, 32 aa, Artificial Sequence
  Description of Artificial Sequence: Synthetic polypeptide
DEEEIRTTNPVATEQYGSVETNEQQVDDNEPV

SEQ ID NO: 58280 - protein, 30 aa, Artificial Sequence
  Description of Artificial Sequence: Synthetic polypeptide
DEENIRTTNPVATEQWGSVATNNYQLGQDE

SEQ ID NO: 58281 - protein, 31 aa, Artificial Sequence
  Description of Artificial Sequence: Synthetic polypeptide
DEEQIATTNPVATESYGCVATNLQDGSNDRH

SEQ ID NO: 58282 - protein, 33 aa, Artificial Sequence
  Description of Artificial Sequence: Synthetic polypeptide
DEEEIRTTNPVATEQYGSVGSNQNGDQGGNNEN

SEQ ID NO: 58283 - protein, 33 aa, Artificial Sequence
  Description of Artificial Sequence: Synthetic polypeptide
DEEEIRTTNPVATEQYGSVGSNQNGQGEGGNNN

SEQ ID NO: 58284 - protein, 32 aa, Artificial Sequence
  Description of Artificial Sequence: Synthetic polypeptide
DEEEIRTTNPVSTEQYGSVSWNELDNRQGDGP

SEQ ID NO: 58285 - protein, 33 aa, Artificial Sequence
  Description of Artificial Sequence: Synthetic polypeptide
DEEEIRTTNPVAYEQYGQSVSTVDLLQRSIDVR

SEQ ID NO: 58286 - protein, 35 aa, Artificial Sequence
  Description of Artificial Sequence: Synthetic polypeptide
DEEEIRTTNPVATEQYGSVISGTDGNLQEDGQNEE

SEQ ID NO: 58287 - protein, 34 aa, Artificial Sequence
  Description of Artificial Sequence: Synthetic polypeptide
DEEEIRTTNPVATEQYGSVISGNLGQDEIGGNGE

SEQ ID NO: 58288 - protein, 33 aa, Artificial Sequence
  Description of Artificial Sequence: Synthetic polypeptide
DEEEIRTTNPVAYEQYGQSVSVNGLLGRGILRE

SEQ ID NO: 58289 - protein, 33 aa, Artificial Sequence
  Description of Artificial Sequence: Synthetic polypeptide
DEEEIRTTNPVAYEQYGQSVSWNDLDQNGSDRS

SEQ ID NO: 58290 - protein, 34 aa, Artificial Sequence
  Description of Artificial Sequence: Synthetic polypeptide
DEEEIRTTNPVAYEQYGQSVVACTNLSTNRGTNR

SEQ ID NO: 58291 - protein, 34 aa, Artificial Sequence
  Description of Artificial Sequence: Synthetic polypeptide
DEEEIRTTNPVATEQYGSVISDTSNTGQGGGNNG

SEQ ID NO: 58292 - protein, 34 aa, Artificial Sequence
  Description of Artificial Sequence: Synthetic polypeptide
DEEEIRTTNPVATEQYGSVISDTSNTGQGGENGD

SEQ ID NO: 58293 - protein, 35 aa, Artificial Sequence
  Description of Artificial Sequence: Synthetic polypeptide
DEEEIRTTNPVAYEQYGQSVVSCQTNMLSQRGGVR

SEQ ID NO: 58294 - protein, 34 aa, Artificial Sequence
  Description of Artificial Sequence: Synthetic polypeptide
DEEEIRTTNPVATEQYGSVISGTNNDIGQNDGNG

SEQ ID NO: 58295 - protein, 32 aa, Artificial Sequence
  Description of Artificial Sequence: Synthetic polypeptide
DEEEIRTTNPVAYEQYGQTVSTSALSQKGGDR

SEQ ID NO: 58296 - protein, 33 aa, Artificial Sequence
  Description of Artificial Sequence: Synthetic polypeptide
DEEEIRTTNPVATEQYGSVIPPTWVLQRGEQLM

SEQ ID NO: 58297 - protein, 33 aa, Artificial Sequence
  Description of Artificial Sequence: Synthetic polypeptide
DEEEIRTTNPVATEQYGSVIPPTNGQRQNIVNH

SEQ ID NO: 58298 - protein, 33 aa, Artificial Sequence
  Description of Artificial Sequence: Synthetic polypeptide
DEEEIRTTNPVATEQYGSVIPPTNGQRLNIVDN

SEQ ID NO: 58299 - protein, 32 aa, Artificial Sequence
  Description of Artificial Sequence: Synthetic polypeptide
DEEEIRTTNPVAYEQYGQVSCTFLSDETGGNR

SEQ ID NO: 58300 - protein, 34 aa, Artificial Sequence
  Description of Artificial Sequence: Synthetic polypeptide
DEEEIRTTNPVATEQYGSVIPPTGNEQRGNEVNL

SEQ ID NO: 58301 - protein, 32 aa, Artificial Sequence
  Description of Artificial Sequence: Synthetic polypeptide
DEEEIRTTNPVATEQYGSVIPNGQLRVGQVDF

SEQ ID NO: 58302 - protein, 33 aa, Artificial Sequence
  Description of Artificial Sequence: Synthetic polypeptide
DEEEIRTTNPVAYEQYGQVVGQTNDLLQRGIRG

SEQ ID NO: 58303 - protein, 33 aa, Artificial Sequence
  Description of Artificial Sequence: Synthetic polypeptide
DEEEIRTTNPVAYEQYGQVVSPNDALQPRGIIR

SEQ ID NO: 58304 - protein, 33 aa, Artificial Sequence
  Description of Artificial Sequence: Synthetic polypeptide
DEEEIRTTNPVAYEQYGQVVSQNDLLQRGIRGM

SEQ ID NO: 58305 - protein, 31 aa, Artificial Sequence
  Description of Artificial Sequence: Synthetic polypeptide
DEEEIRTTNPVATEQYGSVIPTLQIRQTEEQ

SEQ ID NO: 58306 - protein, 32 aa, Artificial Sequence
  Description of Artificial Sequence: Synthetic polypeptide
DEEEIRTTNPVAYEQYGQVVSQNDLLQRGQIM

SEQ ID NO: 58307 - protein, 34 aa, Artificial Sequence
  Description of Artificial Sequence: Synthetic polypeptide
DEEEIRTTNPVATEQYGSVISGTTNGLGDGEGNE

SEQ ID NO: 58308 - protein, 34 aa, Artificial Sequence
  Description of Artificial Sequence: Synthetic polypeptide
DEEEIRTTNPVAYEQYGQSVSTNDLLQRQGAPAW

SEQ ID NO: 58309 - protein, 33 aa, Artificial Sequence
  Description of Artificial Sequence: Synthetic polypeptide
DEEEIRTTNPVAYEQYGQSVSQNDLLQGGIIDR

SEQ ID NO: 58310 - protein, 32 aa, Artificial Sequence
  Description of Artificial Sequence: Synthetic polypeptide
DEEEIRTTNPVAYEQYGQSVSQNDLLQGGIIM

SEQ ID NO: 58311 - protein, 32 aa, Artificial Sequence
  Description of Artificial Sequence: Synthetic polypeptide
DEEEIRTTNPVAYEQYGQSVSQNDLLTRGEDS

SEQ ID NO: 58312 - protein, 34 aa, Artificial Sequence
  Description of Artificial Sequence: Synthetic polypeptide
DEEEIRTTNPVATEQYGSVISPENQLEQIGNVES

SEQ ID NO: 58313 - protein, 34 aa, Artificial Sequence
  Description of Artificial Sequence: Synthetic polypeptide
DEEEIRTTNPVAYEQYGQSVSQTNDLLQLGGIDR

SEQ ID NO: 58314 - protein, 33 aa, Artificial Sequence
  Description of Artificial Sequence: Synthetic polypeptide
DEEEIRTTNPVATEQYGSVISNTLQTQVLGNGV

SEQ ID NO: 58315 - protein, 32 aa, Artificial Sequence
  Description of Artificial Sequence: Synthetic polypeptide
DEEEIRTTNPVATEQYGSVISNLSGVGENFDD

SEQ ID NO: 58316 - protein, 34 aa, Artificial Sequence
  Description of Artificial Sequence: Synthetic polypeptide
DEEEIRTTNPVAYEQYGQSVSQVNDLLQRGISHR

SEQ ID NO: 58317 - protein, 33 aa, Artificial Sequence
  Description of Artificial Sequence: Synthetic polypeptide
DEEEIRTTNPVAYEQYGQSVSSENDLEQRGSQQ

SEQ ID NO: 58318 - protein, 34 aa, Artificial Sequence
  Description of Artificial Sequence: Synthetic polypeptide
DEEEIRTTNPVAYEQYGQSVSTNDLNQEYFGSER

SEQ ID NO: 58319 - protein, 33 aa, Artificial Sequence
  Description of Artificial Sequence: Synthetic polypeptide
DEEEIRTTNPVAYEQYGQSVSSENDLNQYGSQR

SEQ ID NO: 58320 - protein, 33 aa, Artificial Sequence
  Description of Artificial Sequence: Synthetic polypeptide
DEEEIRTTNPVATEQYGSVISMENLITRDNDND

SEQ ID NO: 58321 - protein, 32 aa, Artificial Sequence
  Description of Artificial Sequence: Synthetic polypeptide
DEEEIRTTNPVATEQYGSVISLNGERQNNDEI

SEQ ID NO: 58322 - protein, 34 aa, Artificial Sequence
  Description of Artificial Sequence: Synthetic polypeptide
DEEEIRTTNPVAYEQYGQSVSSMNDLNQERGSQR

SEQ ID NO: 58323 - protein, 32 aa, Artificial Sequence
  Description of Artificial Sequence: Synthetic polypeptide
DEEEIRTTNPVAYEQYGQSVSSNDLFQHGSQQ

SEQ ID NO: 58324 - protein, 33 aa, Artificial Sequence
  Description of Artificial Sequence: Synthetic polypeptide
DEEEIRTTNPVAYEQYGQSVSSNDLNQRGSELS

SEQ ID NO: 58325 - protein, 34 aa, Artificial Sequence
  Description of Artificial Sequence: Synthetic polypeptide
DEEEIRTTNPVAYEQYGQSVSSNNDLNQRGSQRS

SEQ ID NO: 58326 - protein, 33 aa, Artificial Sequence
  Description of Artificial Sequence: Synthetic polypeptide
DEEEIRTTNPVAYEQYGQSVSSVDLLQRGIIDR

SEQ ID NO: 58327 - protein, 32 aa, Artificial Sequence
  Description of Artificial Sequence: Synthetic polypeptide
DEEEIRTTNPVAYEQYGQSVSTNAQSQTGGDS

SEQ ID NO: 58328 - protein, 33 aa, Artificial Sequence
  Description of Artificial Sequence: Synthetic polypeptide
DEEEIRTTNPVAYEQYGQSVSTNDELQLVGEPV

SEQ ID NO: 58329 - protein, 36 aa, Artificial Sequence
  Description of Artificial Sequence: Synthetic polypeptide
DEEEIRTTNPVATEQYGSVISMTNELEQPRVGENNG

SEQ ID NO: 58330 - protein, 32 aa, Artificial Sequence
  Description of Artificial Sequence: Synthetic polypeptide
DEEEIRTTNPVAYEQYGQVVSQNDLLQRTIER

SEQ ID NO: 58331 - protein, 33 aa, Artificial Sequence
  Description of Artificial Sequence: Synthetic polypeptide
DEEEIRTTNPVAYEQYGQVVSQTNDLLQRGITP

SEQ ID NO: 58332 - protein, 33 aa, Artificial Sequence
  Description of Artificial Sequence: Synthetic polypeptide
DEEEIRTTNPVAYEQYGQVVSQTNELLQEGIIR

SEQ ID NO: 58333 - protein, 33 aa, Artificial Sequence
  Description of Artificial Sequence: Synthetic polypeptide
DEEEIRTTNPVAYEQYGSTVSCTNLSQSSSDRF

SEQ ID NO: 58334 - protein, 33 aa, Artificial Sequence
  Description of Artificial Sequence: Synthetic polypeptide
DEEEIRTTNPVATEQYGSVIGPTNLIRGEIEEG

SEQ ID NO: 58335 - protein, 35 aa, Artificial Sequence
  Description of Artificial Sequence: Synthetic polypeptide
DEEEIRTTNPVATEQYGSVIETTNQLQFVGEVNRP

SEQ ID NO: 58336 - protein, 34 aa, Artificial Sequence
  Description of Artificial Sequence: Synthetic polypeptide
DEEEIRTTNPVATEQYGSVIETTNLQLFVGEAER

SEQ ID NO: 58337 - protein, 32 aa, Artificial Sequence
  Description of Artificial Sequence: Synthetic polypeptide
DEEEIRTTNPVAYEQYGSTVWCTNALQGTESR

SEQ ID NO: 58338 - protein, 32 aa, Artificial Sequence
  Description of Artificial Sequence: Synthetic polypeptide
DEEEIRTTNPVAYEQYGSTVWTNALSQPTDSR

SEQ ID NO: 58339 - protein, 32 aa, Artificial Sequence
  Description of Artificial Sequence: Synthetic polypeptide
DEEEIRTTNPVAYEQYGSVACTGNLTTRGGTV

SEQ ID NO: 58340 - protein, 32 aa, Artificial Sequence
  Description of Artificial Sequence: Synthetic polypeptide
DEEEIRTTNPVAYEQYGSVACTGNMLSPSGND

SEQ ID NO: 58341 - protein, 32 aa, Artificial Sequence
  Description of Artificial Sequence: Synthetic polypeptide
DEEEIRTTNPVAYEQYGSVATNALSQVPDTSR

SEQ ID NO: 58342 - protein, 33 aa, Artificial Sequence
  Description of Artificial Sequence: Synthetic polypeptide
DEEEIRTTNPVAYEQYGSTVSCTNLSQERSSPF

SEQ ID NO: 58343 - protein, 31 aa, Artificial Sequence
  Description of Artificial Sequence: Synthetic polypeptide
DEEEIRTTNPVATEQYGSVIESTDQPVFQNE

SEQ ID NO: 58344 - protein, 32 aa, Artificial Sequence
  Description of Artificial Sequence: Synthetic polypeptide
DEEEIRTTNPVATEQYGSVIEPTNLVELGPIS

SEQ ID NO: 58345 - protein, 32 aa, Artificial Sequence
  Description of Artificial Sequence: Synthetic polypeptide
DEEEIRTTNPVATEQYGSVIEPTNEEPGENLE

SEQ ID NO: 58346 - protein, 32 aa, Artificial Sequence
  Description of Artificial Sequence: Synthetic polypeptide
DEEEIRTTNPVATEQYGSVIEPLLQPVGQNLT

SEQ ID NO: 58347 - protein, 32 aa, Artificial Sequence
  Description of Artificial Sequence: Synthetic polypeptide
DEEEIRTTNPVAYEQYGSVATNLQANGPTEHQ

SEQ ID NO: 58348 - protein, 32 aa, Artificial Sequence
  Description of Artificial Sequence: Synthetic polypeptide
DEEEIRTTNPVAYEQYGSVATNLQGNPAEGAD

SEQ ID NO: 58349 - protein, 32 aa, Artificial Sequence
  Description of Artificial Sequence: Synthetic polypeptide
DEEEIRTTNPVAYEQYGSVATNLQMNPDEGDD

SEQ ID NO: 58350 - protein, 32 aa, Artificial Sequence
  Description of Artificial Sequence: Synthetic polypeptide
DEEEIRTTNPVAYEQYGSVATNLQNNGDVMVM

SEQ ID NO: 58351 - protein, 31 aa, Artificial Sequence
  Description of Artificial Sequence: Synthetic polypeptide
DEEEIRTTNPVAYEQYGSVATNLQNNTADTH

SEQ ID NO: 58352 - protein, 32 aa, Artificial Sequence
  Description of Artificial Sequence: Synthetic polypeptide
DEEEIRTTNPVATEQYGSVIENSNIQQRGEIE

SEQ ID NO: 58353 - protein, 34 aa, Artificial Sequence
  Description of Artificial Sequence: Synthetic polypeptide
DEEEIRTTNPVATEQYGSVIEPTNNQQPRQNLER

SEQ ID NO: 58354 - protein, 33 aa, Artificial Sequence
  Description of Artificial Sequence: Synthetic polypeptide
DEEEIRTTNPVAYEQYGSTVSCTNELSQPSARF

SEQ ID NO: 58355 - protein, 33 aa, Artificial Sequence
  Description of Artificial Sequence: Synthetic polypeptide
DEEEIRTTNPVAYEQYGSTVSCTANLSARSSRF

SEQ ID NO: 58356 - protein, 32 aa, Artificial Sequence
  Description of Artificial Sequence: Synthetic polypeptide
DEEEIRTTNPVAYEQYGSTVSCINLSQVESRF

SEQ ID NO: 58357 - protein, 33 aa, Artificial Sequence
  Description of Artificial Sequence: Synthetic polypeptide
DEEEIRTTNPVATEQYGSVINIVNLMQREDERA

SEQ ID NO: 58358 - protein, 33 aa, Artificial Sequence
  Description of Artificial Sequence: Synthetic polypeptide
DEEEIRTTNPVAYEQYGQVVSTGNDLNQRGSEQ

SEQ ID NO: 58359 - protein, 33 aa, Artificial Sequence
  Description of Artificial Sequence: Synthetic polypeptide
DEEEIRTTNPVATEQYGSVINETSGLEQIVNRI

SEQ ID NO: 58360 - protein, 32 aa, Artificial Sequence
  Description of Artificial Sequence: Synthetic polypeptide
DEEEIRTTNPVAYEQYGSASTNLQNPGEDTAS

SEQ ID NO: 58361 - protein, 32 aa, Artificial Sequence
  Description of Artificial Sequence: Synthetic polypeptide
DEEEIRTTNPVATEQYGSVILTTSLQDDGELY

SEQ ID NO: 58362 - protein, 33 aa, Artificial Sequence
  Description of Artificial Sequence: Synthetic polypeptide
DEEEIRTTNPVATEQYGSVILTPLQRTLLDQNL

SEQ ID NO: 58363 - protein, 33 aa, Artificial Sequence
  Description of Artificial Sequence: Synthetic polypeptide
DEEEIRTTNPVATEQYGSVILTPLQRTLENFDL

SEQ ID NO: 58364 - protein, 33 aa, Artificial Sequence
  Description of Artificial Sequence: Synthetic polypeptide
DEEEIRTTNPVATEQYGSVILTNMLQQGEEQPT

SEQ ID NO: 58365 - protein, 33 aa, Artificial Sequence
  Description of Artificial Sequence: Synthetic polypeptide
DEEEIRTTNPVATEQYGSVILTNMLQQGEEEMN

SEQ ID NO: 58366 - protein, 34 aa, Artificial Sequence
  Description of Artificial Sequence: Synthetic polypeptide
DEEEIRTTNPVATEQYGSVILTNMLQEQGEEVRE

SEQ ID NO: 58367 - protein, 33 aa, Artificial Sequence
  Description of Artificial Sequence: Synthetic polypeptide
DEEEIRTTNPVAYEQYGSIPSLPNMLSQGDGNR

SEQ ID NO: 58368 - protein, 33 aa, Artificial Sequence
  Description of Artificial Sequence: Synthetic polypeptide
DEEEIRTTNPVATEQYGSVILTNMLGQGEEERF

SEQ ID NO: 58369 - protein, 33 aa, Artificial Sequence
  Description of Artificial Sequence: Synthetic polypeptide
DEEEIRTTNPVAYEQYGSTISCTNLSQRNSSRF

SEQ ID NO: 58370 - protein, 34 aa, Artificial Sequence
  Description of Artificial Sequence: Synthetic polypeptide
DEEEIRTTNPVAYEQYGSTSYTENMFSQRTGGNR

SEQ ID NO: 58371 - protein, 34 aa, Artificial Sequence
  Description of Artificial Sequence: Synthetic polypeptide
DEEEIRTTNPVAYEQYGSTVCCTGNLSYQRGGTR

SEQ ID NO: 58372 - protein, 34 aa, Artificial Sequence
  Description of Artificial Sequence: Synthetic polypeptide
DEEEIRTTNPVATEQYGSVILANSLEQERGVNQD

SEQ ID NO: 58373 - protein, 33 aa, Artificial Sequence
  Description of Artificial Sequence: Synthetic polypeptide
DEEEIRTTNPVATEQYGSVILANLEQEVQGNIQ

SEQ ID NO: 58374 - protein, 32 aa, Artificial Sequence
  Description of Artificial Sequence: Synthetic polypeptide
DEEEIRTTNPVAYEQYGSTVHCTNALQMTQSR

SEQ ID NO: 58375 - protein, 33 aa, Artificial Sequence
  Description of Artificial Sequence: Synthetic polypeptide
DEEEIRTTNPVATEQYGSVIITNLSQRPLVTEF

SEQ ID NO: 58376 - protein, 32 aa, Artificial Sequence
  Description of Artificial Sequence: Synthetic polypeptide
DEEEIRTTNPVAYEQYGSTVSCCNLSQDSSRF

SEQ ID NO: 58377 - protein, 32 aa, Artificial Sequence
  Description of Artificial Sequence: Synthetic polypeptide
DEEEIRTTNPVAYEQYGSTVSCCNLSQRESDF

SEQ ID NO: 58378 - protein, 33 aa, Artificial Sequence
  Description of Artificial Sequence: Synthetic polypeptide
DEEEIRTTNPVAYEQYGQSVSQNALSQRTGGPV

SEQ ID NO: 58379 - protein, 32 aa, Artificial Sequence
  Description of Artificial Sequence: Synthetic polypeptide
DEEEIRTTNPVAYEQYGSVATNLQVAGEGEDD

SEQ ID NO: 58380 - protein, 32 aa, Artificial Sequence
  Description of Artificial Sequence: Synthetic polypeptide
DEEEIRTTNPVATEQYGSVISPTNGIAEIENM

SEQ ID NO: 58381 - protein, 33 aa, Artificial Sequence
  Description of Artificial Sequence: Synthetic polypeptide
DEEEIRTTNPVATEQYGSVISPTNLGLAQTEHQ

SEQ ID NO: 58382 - protein, 31 aa, Artificial Sequence
  Description of Artificial Sequence: Synthetic polypeptide
DEEEIRTTNPVAYEQYGEVSATHNDDFGGRR

SEQ ID NO: 58383 - protein, 34 aa, Artificial Sequence
  Description of Artificial Sequence: Synthetic polypeptide
DEEEIRTTNPVATEQYGSVISTNMVDQIGVESRD

SEQ ID NO: 58384 - protein, 34 aa, Artificial Sequence
  Description of Artificial Sequence: Synthetic polypeptide
DEEEIRTTNPVAYEQYGHTVSYWTNLSDRTGGNR

SEQ ID NO: 58385 - protein, 34 aa, Artificial Sequence
  Description of Artificial Sequence: Synthetic polypeptide
DEEEIRTTNPVAYEQYGHVPSWTNLSDRTGGNNR

SEQ ID NO: 58386 - protein, 34 aa, Artificial Sequence
  Description of Artificial Sequence: Synthetic polypeptide
DEEEIRTTNPVATEQYGSVISTNLVGGNEGFTGN

SEQ ID NO: 58387 - protein, 34 aa, Artificial Sequence
  Description of Artificial Sequence: Synthetic polypeptide
DEEEIRTTNPVAYEQYGISTVSVPNELAQRGGER

SEQ ID NO: 58388 - protein, 33 aa, Artificial Sequence
  Description of Artificial Sequence: Synthetic polypeptide
DEEEIRTTNPVAYEQYGISVPSINQSQGTGNYR

SEQ ID NO: 58389 - protein, 34 aa, Artificial Sequence
  Description of Artificial Sequence: Synthetic polypeptide
DEEEIRTTNPVAYEQYGISVSEQNDLLQRGVGGR

SEQ ID NO: 58390 - protein, 34 aa, Artificial Sequence
  Description of Artificial Sequence: Synthetic polypeptide
DEEEIRTTNPVAYEQYGISVSGTGNMLQATGGSR

SEQ ID NO: 58391 - protein, 31 aa, Artificial Sequence
  Description of Artificial Sequence: Synthetic polypeptide
DEEEIRTTNPVAYEQYGCVSTETQGFGSNQT

SEQ ID NO: 58392 - protein, 34 aa, Artificial Sequence
  Description of Artificial Sequence: Synthetic polypeptide
DEEEIRTTNPVAYEQYGISVSIENSEPQDRTGNR

SEQ ID NO: 58393 - protein, 32 aa, Artificial Sequence
  Description of Artificial Sequence: Synthetic polypeptide
DEEEIRTTNPVAYEQYGKVFTNLSARNGGNQD

SEQ ID NO: 58394 - protein, 31 aa, Artificial Sequence
  Description of Artificial Sequence: Synthetic polypeptide
DEEEIRTTNPVAYEQYGKVPWTALSQRVTNS

SEQ ID NO: 58395 - protein, 33 aa, Artificial Sequence
  Description of Artificial Sequence: Synthetic polypeptide
DEEEIRTTNPVAYEQYGMSVMETNDLLQRGREQ

SEQ ID NO: 58396 - protein, 34 aa, Artificial Sequence
  Description of Artificial Sequence: Synthetic polypeptide
DEEEIRTTNPVAYEQYGMTVPSCTNLSDQRGGNY

SEQ ID NO: 58397 - protein, 34 aa, Artificial Sequence
  Description of Artificial Sequence: Synthetic polypeptide
DEEEIRTTNPVAYEQYGMTVPSITNLSGQSGGNR

SEQ ID NO: 58398 - protein, 33 aa, Artificial Sequence
  Description of Artificial Sequence: Synthetic polypeptide
DEEEIRTTNPVAYEQYGQCVSSNDLDQRFGSQR

SEQ ID NO: 58399 - protein, 33 aa, Artificial Sequence
  Description of Artificial Sequence: Synthetic polypeptide
DEEEIRTTNPVAYEQYGQCVSTNDLNQNGSERL

SEQ ID NO: 58400 - protein, 32 aa, Artificial Sequence
  Description of Artificial Sequence: Synthetic polypeptide
DEEEIRTTNPVAYEQYGQICSTNDLLQGGIRR

SEQ ID NO: 58401 - protein, 33 aa, Artificial Sequence
  Description of Artificial Sequence: Synthetic polypeptide
DEEEIRTTNPVAYEQYGQKTVSQNSLSQRGGIR

SEQ ID NO: 58402 - protein, 32 aa, Artificial Sequence
  Description of Artificial Sequence: Synthetic polypeptide
DEEEIRTTNPVAYEQYGKVFEGNLSARGGNQR

SEQ ID NO: 58403 - protein, 32 aa, Artificial Sequence
  Description of Artificial Sequence: Synthetic polypeptide
DEEEIRTTNPVAYEQYGQSASVNDALQPGVER

SEQ ID NO: 58404 - protein, 32 aa, Artificial Sequence
  Description of Artificial Sequence: Synthetic polypeptide
DEEEIRTTNPVAYEQYGCVSTENPQNFGSNDD

SEQ ID NO: 58405 - protein, 30 aa, Artificial Sequence
  Description of Artificial Sequence: Synthetic polypeptide
DEEEIRTTNPVAYEQYGCVGTELQVFDSDR

SEQ ID NO: 58406 - protein, 34 aa, Artificial Sequence
  Description of Artificial Sequence: Synthetic polypeptide
DEEEIRTTNPVATEQYGSVISTVLQQTEGINEEF

SEQ ID NO: 58407 - protein, 31 aa, Artificial Sequence
  Description of Artificial Sequence: Synthetic polypeptide
DEEEIRTTNPVAYEQWGTSVSTPLLDDDGNS

SEQ ID NO: 58408 - protein, 30 aa, Artificial Sequence
  Description of Artificial Sequence: Synthetic polypeptide
DEEEIRTTNPVAYEQWGTSYVTPLLDRGNS

SEQ ID NO: 58409 - protein, 31 aa, Artificial Sequence
  Description of Artificial Sequence: Synthetic polypeptide
DEEEIRTTNPVAYEQWGTTVSTGLLREGNDS

SEQ ID NO: 58410 - protein, 32 aa, Artificial Sequence
  Description of Artificial Sequence: Synthetic polypeptide
DEEEIRTTNPVAYEQWGVSVRQNDDLQRGDSR

SEQ ID NO: 58411 - protein, 35 aa, Artificial Sequence
  Description of Artificial Sequence: Synthetic polypeptide
DEEEIRTTNPVATEQYGSVISTTNLVQMEMGGNGD

SEQ ID NO: 58412 - protein, 31 aa, Artificial Sequence
  Description of Artificial Sequence: Synthetic polypeptide
DEEEIRTTNPVAYEQWGYTISRTNELQAGNA

SEQ ID NO: 58413 - protein, 32 aa, Artificial Sequence
  Description of Artificial Sequence: Synthetic polypeptide
DEEEIRTTNPVAYEQWGYTISTNELQQDGDNR

SEQ ID NO: 58414 - protein, 34 aa, Artificial Sequence
  Description of Artificial Sequence: Synthetic polypeptide
DEEEIRTTNPVAYEQYGATVSCTNMLQQSGGNPR

SEQ ID NO: 58415 - protein, 32 aa, Artificial Sequence
  Description of Artificial Sequence: Synthetic polypeptide
DEEEIRTTNPVATEQYGSVISTPQLQGQSLED

SEQ ID NO: 58416 - protein, 34 aa, Artificial Sequence
  Description of Artificial Sequence: Synthetic polypeptide
DEEEIRTTNPVAYEQYGAVVSGTNDLGQRGIRNQ

SEQ ID NO: 58417 - protein, 33 aa, Artificial Sequence
  Description of Artificial Sequence: Synthetic polypeptide
DEEEIRTTNPVAYEQYGAVVSQTNDLLQRGIEN

SEQ ID NO: 58418 - protein, 34 aa, Artificial Sequence
  Description of Artificial Sequence: Synthetic polypeptide
DEEEIRTTNPVAYEQYGCSVSSNLSQRAVGNNPP

SEQ ID NO: 58419 - protein, 33 aa, Artificial Sequence
  Description of Artificial Sequence: Synthetic polypeptide
DEEEIRTTNPVAYEQYGCVCSNTELQRFGSERF

SEQ ID NO: 58420 - protein, 32 aa, Artificial Sequence
  Description of Artificial Sequence: Synthetic polypeptide
DEEEIRTTNPVAYEQYGCVCSTELQNGNSNQM

SEQ ID NO: 58421 - protein, 32 aa, Artificial Sequence
  Description of Artificial Sequence: Synthetic polypeptide
DEEEIRTTNPVAYEQYGCVCSTGELQRGSEQY

SEQ ID NO: 58422 - protein, 33 aa, Artificial Sequence
  Description of Artificial Sequence: Synthetic polypeptide
DEEEIRTTNPVAYEQYGCVCSTGNLQYFGSNQE

SEQ ID NO: 58423 - protein, 32 aa, Artificial Sequence
  Description of Artificial Sequence: Synthetic polypeptide
DEEEIRTTNPVAYEQYGCVCSTNLQNFGSDAM

SEQ ID NO: 58424 - protein, 32 aa, Artificial Sequence
  Description of Artificial Sequence: Synthetic polypeptide
DEEEIRTTNPVAYEQYGCVCSTNLQYFGSDQP

SEQ ID NO: 58425 - protein, 30 aa, Artificial Sequence
  Description of Artificial Sequence: Synthetic polypeptide
DEEEIRTTNPVAYEQYGCVFTNLQYFDSDA

SEQ ID NO: 58426 - protein, 34 aa, Artificial Sequence
  Description of Artificial Sequence: Synthetic polypeptide
DEEEIRTTNPVAYEQYGAVVSQTNDLDQRGIRNG

SEQ ID NO: 58427 - protein, 33 aa, Artificial Sequence
  Description of Artificial Sequence: Synthetic polypeptide
DEEEIRTTNPVAYEQYGQSCSETNDLCQTGIER

SEQ ID NO: 58428 - protein, 34 aa, Artificial Sequence
  Description of Artificial Sequence: Synthetic polypeptide
DEEEIRTTNPVAYEQYGQSCSPTNDELQRQGVVR

SEQ ID NO: 58429 - protein, 33 aa, Artificial Sequence
  Description of Artificial Sequence: Synthetic polypeptide
DEEEIRTTNPVAYEQYGQSCSQNDALQRGIIDR

SEQ ID NO: 58430 - protein, 34 aa, Artificial Sequence
  Description of Artificial Sequence: Synthetic polypeptide
DEEEIRTTNPVATEQYGSVISTDNGPQRGSSQSL

SEQ ID NO: 58431 - protein, 32 aa, Artificial Sequence
  Description of Artificial Sequence: Synthetic polypeptide
DEEEIRTTNPVAYEQYGQSVSLNDLDQHMIER

SEQ ID NO: 58432 - protein, 34 aa, Artificial Sequence
  Description of Artificial Sequence: Synthetic polypeptide
DEEEIRTTNPVATEQYGSVISSTPNIGQTGGNNN

SEQ ID NO: 58433 - protein, 35 aa, Artificial Sequence
  Description of Artificial Sequence: Synthetic polypeptide
DEEEIRTTNPVAYEQYGQSVSLSTNNLLQRGILRE

SEQ ID NO: 58434 - protein, 33 aa, Artificial Sequence
  Description of Artificial Sequence: Synthetic polypeptide
DEEEIRTTNPVAYEQYGQSVSMENQLLQTGVER

SEQ ID NO: 58435 - protein, 32 aa, Artificial Sequence
  Description of Artificial Sequence: Synthetic polypeptide
DEEEIRTTNPVAYEQYGQSVSMNDAQQRGVEQ

SEQ ID NO: 58436 - protein, 34 aa, Artificial Sequence
  Description of Artificial Sequence: Synthetic polypeptide
DEEEIRTTNPVAYEQYGQSVSMTNQLLQRSVEER

SEQ ID NO: 58437 - protein, 33 aa, Artificial Sequence
  Description of Artificial Sequence: Synthetic polypeptide
DEEEIRTTNPVATEQYGSVISSNTDEGQEEGNI

SEQ ID NO: 58438 - protein, 33 aa, Artificial Sequence
  Description of Artificial Sequence: Synthetic polypeptide
DEEEIRTTNPVAYEQYGQSVSMVNDALQPGVER

SEQ ID NO: 58439 - protein, 34 aa, Artificial Sequence
  Description of Artificial Sequence: Synthetic polypeptide
DEEEIRTTNPVAYEQYGQSVSFTNDLLQLTGIDR

SEQ ID NO: 58440 - protein, 33 aa, Artificial Sequence
  Description of Artificial Sequence: Synthetic polypeptide
DEEEIRTTNPVATEQYGSVISPWNMPQDRENLL

SEQ ID NO: 58441 - protein, 35 aa, Artificial Sequence
  Description of Artificial Sequence: Synthetic polypeptide
DEEEIRTTNPVATEQYGSVISPTTTLQPRPGVSER

SEQ ID NO: 58442 - protein, 36 aa, Artificial Sequence
  Description of Artificial Sequence: Synthetic polypeptide
DEEEIRTTNPVATEQYGSVISPTTNLVVREGENERF

SEQ ID NO: 58443 - protein, 33 aa, Artificial Sequence
  Description of Artificial Sequence: Synthetic polypeptide
DEEEIRTTNPVATEQYGSVISPTPAVQIGVNQE

SEQ ID NO: 58444 - protein, 33 aa, Artificial Sequence
  Description of Artificial Sequence: Synthetic polypeptide
DEEEIRTTNPVAYEQYGQSVSPTNGELVRGVVL

SEQ ID NO: 58445 - protein, 33 aa, Artificial Sequence
  Description of Artificial Sequence: Synthetic polypeptide
DEEEIRTTNPVAYEQYGQSVSPTNSEWVRGVVR

SEQ ID NO: 58446 - protein, 34 aa, Artificial Sequence
  Description of Artificial Sequence: Synthetic polypeptide
DEEEIRTTNPVAYEQYGQSVSPVTNGLLVRGVER

SEQ ID NO: 58447 - protein, 35 aa, Artificial Sequence
  Description of Artificial Sequence: Synthetic polypeptide
DEEEIRTTNPVAYEQYGQSVSPVTNNLLQRGIEVR

SEQ ID NO: 58448 - protein, 34 aa, Artificial Sequence
  Description of Artificial Sequence: Synthetic polypeptide
DEEEIRTTNPVAYEQYGQSVSPVVNGELQRGVER

SEQ ID NO: 58449 - protein, 33 aa, Artificial Sequence
  Description of Artificial Sequence: Synthetic polypeptide
DEEEIRTTNPVAYEQYGQSVSQGNDLLERGILR

SEQ ID NO: 58450 - protein, 35 aa, Artificial Sequence
  Description of Artificial Sequence: Synthetic polypeptide
DEEEIRTTNPVATEQYGSVISPTVLQQQRGILEER

SEQ ID NO: 58451 - protein, 32 aa, Artificial Sequence
  Description of Artificial Sequence: Synthetic polypeptide
DEEEIRTTNPVAYEQYGQSVSEVDLLQRGIIP

SEQ ID NO: 58452 - protein, 34 aa, Artificial Sequence
  Description of Artificial Sequence: Synthetic polypeptide
DEEEIRTTNPVAYEQYGQSVSEQNDALQRGVERQ

SEQ ID NO: 58453 - protein, 33 aa, Artificial Sequence
  Description of Artificial Sequence: Synthetic polypeptide
DEEEIRTTNPVAYEQYGQSVSELNDLLQRGQIP

SEQ ID NO: 58454 - protein, 34 aa, Artificial Sequence
  Description of Artificial Sequence: Synthetic polypeptide
DEEEIRTTNPVAYEQYGQSTVATNMLSTTRGNNR

SEQ ID NO: 58455 - protein, 34 aa, Artificial Sequence
  Description of Artificial Sequence: Synthetic polypeptide
DEEEIRTTNPVATEQYGSVISTNLEEDEIGGNQG

SEQ ID NO: 58456 - protein, 33 aa, Artificial Sequence
  Description of Artificial Sequence: Synthetic polypeptide
DEEEIRTTNPVAYEQYGQSVACTNASTTRGNNR

SEQ ID NO: 58457 - protein, 34 aa, Artificial Sequence
  Description of Artificial Sequence: Synthetic polypeptide
DEEEIRTTNPVAYEQYGQSVCSQENDLDQRGSQR

SEQ ID NO: 58458 - protein, 34 aa, Artificial Sequence
  Description of Artificial Sequence: Synthetic polypeptide
DEEEIRTTNPVAYEQYGQSVCSTNDLDQRGSQQQ

SEQ ID NO: 58459 - protein, 34 aa, Artificial Sequence
  Description of Artificial Sequence: Synthetic polypeptide
DEEEIRTTNPVAYEQYGQSVCSTTNDLFQRGSDQ

SEQ ID NO: 58460 - protein, 32 aa, Artificial Sequence
  Description of Artificial Sequence: Synthetic polypeptide
DEEEIRTTNPVAYEQYGQSVEENDLFQRGIEQ

SEQ ID NO: 58461 - protein, 32 aa, Artificial Sequence
  Description of Artificial Sequence: Synthetic polypeptide
DEEEIRTTNPVAYEQYGQSVEQNDLLQRGVEF

SEQ ID NO: 58462 - protein, 34 aa, Artificial Sequence
  Description of Artificial Sequence: Synthetic polypeptide
DEEEIRTTNPVAYEQYGQSVGSDMNDLLQRGSTR

SEQ ID NO: 58463 - protein, 33 aa, Artificial Sequence
  Description of Artificial Sequence: Synthetic polypeptide
DEEEIRTTNPVAYEQYGQSVPITNDLLQRSQIR

SEQ ID NO: 58464 - protein, 33 aa, Artificial Sequence
  Description of Artificial Sequence: Synthetic polypeptide
DEEEIRTTNPVATEQYGSVISTMNIGQSGDEIE

SEQ ID NO: 58465 - protein, 33 aa, Artificial Sequence
  Description of Artificial Sequence: Synthetic polypeptide
DEEEIRTTNPVATEQYGSVISTMELGIGNGNTT

SEQ ID NO: 58466 - protein, 34 aa, Artificial Sequence
  Description of Artificial Sequence: Synthetic polypeptide
DEEEIRTTNPVAYEQYGQSVPSQGNELAQRGGIR

SEQ ID NO: 58467 - protein, 33 aa, Artificial Sequence
  Description of Artificial Sequence: Synthetic polypeptide
DEEEIRTTNPVAYEQYGQSVPSQNMASQRGGTR

SEQ ID NO: 58468 - protein, 35 aa, Artificial Sequence
  Description of Artificial Sequence: Synthetic polypeptide
DEEEIRTTNPVATEQYGSVISTLNLQEVGGGNEDG

SEQ ID NO: 58469 - protein, 35 aa, Artificial Sequence
  Description of Artificial Sequence: Synthetic polypeptide
DEEEIRTTNPVAYEQYGQSVSATNDLGQPRGIADR

SEQ ID NO: 58470 - protein, 34 aa, Artificial Sequence
  Description of Artificial Sequence: Synthetic polypeptide
DEEEIRTTNPVATEQYGSVISTLGLQEVGGGNEN

SEQ ID NO: 58471 - protein, 33 aa, Artificial Sequence
  Description of Artificial Sequence: Synthetic polypeptide
DEEEIRTTNPVATEQYGSVISTGNSNSTGGGNT

SEQ ID NO: 58472 - protein, 34 aa, Artificial Sequence
  Description of Artificial Sequence: Synthetic polypeptide
DEEEIRTTNPVAYEQYGQSVSCQTNELAQRGGSV

SEQ ID NO: 58473 - protein, 34 aa, Artificial Sequence
  Description of Artificial Sequence: Synthetic polypeptide
DEEEIRTTNPVAYEQYGQSVSCQTNELIQSGGSR

SEQ ID NO: 58474 - protein, 33 aa, Artificial Sequence
  Description of Artificial Sequence: Synthetic polypeptide
DEEEIRTTNPVATEQYGSVISTGNGGQNNQGGG

SEQ ID NO: 58475 - protein, 34 aa, Artificial Sequence
  Description of Artificial Sequence: Synthetic polypeptide
DEEEIRTTNPVAYEQYGQSVSQGNDLTQNRGITR

SEQ ID NO: 58476 - protein, 31 aa, Artificial Sequence
  Description of Artificial Sequence: Synthetic polypeptide
DEEEIRTTNPVAYEQWGTSIVSTPLLDHGNS

SEQ ID NO: 58477 - protein, 32 aa, Artificial Sequence
  Description of Artificial Sequence: Synthetic polypeptide
DEEEIRTTNPVATEQYGSVIENNGLQQQYMER

SEQ ID NO: 58478 - protein, 32 aa, Artificial Sequence
  Description of Artificial Sequence: Synthetic polypeptide
DEEEIRTTNPVAYEQYGSVATNLQVPDGSDHN

SEQ ID NO: 58479 - protein, 34 aa, Artificial Sequence
  Description of Artificial Sequence: Synthetic polypeptide
DEEEIRTTNPVATEQYGSVGSTMNQGQNGGGGNV

SEQ ID NO: 58480 - protein, 34 aa, Artificial Sequence
  Description of Artificial Sequence: Synthetic polypeptide
DEEEIRTTNPVATEQYGSVGSTMNNGQTEGGNED

SEQ ID NO: 58481 - protein, 33 aa, Artificial Sequence
  Description of Artificial Sequence: Synthetic polypeptide
DEEEIRTTNPVATEQYGSVGSTMNGTGGNGNVQ

SEQ ID NO: 58482 - protein, 31 aa, Artificial Sequence
  Description of Artificial Sequence: Synthetic polypeptide
DEEEIRTTNPVGTEQYGCVCSTNDLANGFQS

SEQ ID NO: 58483 - protein, 33 aa, Artificial Sequence
  Description of Artificial Sequence: Synthetic polypeptide
DEEEIRTTNPVATEQYGSVGSTMNGTGGEGNIS

SEQ ID NO: 58484 - protein, 34 aa, Artificial Sequence
  Description of Artificial Sequence: Synthetic polypeptide
DEEEIRTTNPVATEQYGSVGSTMNGGQTGGGGNT

SEQ ID NO: 58485 - protein, 32 aa, Artificial Sequence
  Description of Artificial Sequence: Synthetic polypeptide
DEEEIRTTNPVATEQYGSVGSTMGFGGEGNED

SEQ ID NO: 58486 - protein, 31 aa, Artificial Sequence
  Description of Artificial Sequence: Synthetic polypeptide
DEEEIRTTNPVGTEQYGCVSTNDLAHGSDQA

SEQ ID NO: 58487 - protein, 32 aa, Artificial Sequence
  Description of Artificial Sequence: Synthetic polypeptide
DEEEIRTTNPVGTEQYGCVTSTNDLARGSQQA

SEQ ID NO: 58488 - protein, 33 aa, Artificial Sequence
  Description of Artificial Sequence: Synthetic polypeptide
DEEEIRTTNPVATEQYGSVGSTMQNFEGGNEGT

SEQ ID NO: 58489 - protein, 32 aa, Artificial Sequence
  Description of Artificial Sequence: Synthetic polypeptide
DEEEIRTTNPVGTEQYGSVIITNFLGERGFPT

SEQ ID NO: 58490 - protein, 34 aa, Artificial Sequence
  Description of Artificial Sequence: Synthetic polypeptide
DEEEIRTTNPVATEQYGSVGSTGNGHQERMMIRY

SEQ ID NO: 58491 - protein, 31 aa, Artificial Sequence
  Description of Artificial Sequence: Synthetic polypeptide
DEEEIRTTNPVGTEQYGSVSPWNMLIENGFP

SEQ ID NO: 58492 - protein, 32 aa, Artificial Sequence
  Description of Artificial Sequence: Synthetic polypeptide
DEEEIRTTNPVATEQYGSVGSTEAQLTNENQQ

SEQ ID NO: 58493 - protein, 33 aa, Artificial Sequence
  Description of Artificial Sequence: Synthetic polypeptide
DEEEIRTTNPVATEQYGSVGSTDTGQTDGGNNT

SEQ ID NO: 58494 - protein, 32 aa, Artificial Sequence
  Description of Artificial Sequence: Synthetic polypeptide
DEEEIRTTNPVGTEQYGSVSTNGLGEEDGFQT

SEQ ID NO: 58495 - protein, 33 aa, Artificial Sequence
  Description of Artificial Sequence: Synthetic polypeptide
DEEEIRTTNPVGTEQYGSVSTNGLGEQGGFQET

SEQ ID NO: 58496 - protein, 32 aa, Artificial Sequence
  Description of Artificial Sequence: Synthetic polypeptide
DEEEIRTTNPVGTEQYGSVSTTNGLGEGGGQT

SEQ ID NO: 58497 - protein, 33 aa, Artificial Sequence
  Description of Artificial Sequence: Synthetic polypeptide
DEEEIRTTNPVATEQYGSVGSTDDIQEGGNDNE

SEQ ID NO: 58498 - protein, 34 aa, Artificial Sequence
  Description of Artificial Sequence: Synthetic polypeptide
DEEEIRTTNPVATEQYGSVGSQTNELQRVMEAFE

SEQ ID NO: 58499 - protein, 32 aa, Artificial Sequence
  Description of Artificial Sequence: Synthetic polypeptide
DEEEIRTTNPVGTEQYGSVISTNGLGEGGFGN

SEQ ID NO: 58500 - protein, 33 aa, Artificial Sequence
  Description of Artificial Sequence: Synthetic polypeptide
DEEEIRTTNPVATEQYGSVGSPNDLQIVDNTQF

SEQ ID NO: 58501 - protein, 31 aa, Artificial Sequence
  Description of Artificial Sequence: Synthetic polypeptide
DEEEIRTTNPVGTEQYGCVCSTNDLANFGEQ

SEQ ID NO: 58502 - protein, 30 aa, Artificial Sequence
  Description of Artificial Sequence: Synthetic polypeptide
DEEEIRTTNPVGTEQYGCVAANLQGEGQTD

SEQ ID NO: 58503 - protein, 33 aa, Artificial Sequence
  Description of Artificial Sequence: Synthetic polypeptide
DEEEIRTTNPVCTEHYGSVSTGPNDDQRQGNTE

SEQ ID NO: 58504 - protein, 33 aa, Artificial Sequence
  Description of Artificial Sequence: Synthetic polypeptide
DEEEIRTTNPVCTEHYGSVSTGPNDDQRREGNL

SEQ ID NO: 58505 - protein, 31 aa, Artificial Sequence
  Description of Artificial Sequence: Synthetic polypeptide
DEEEIRTTNPVCTEHYGSVSWPELQNGSNLS

SEQ ID NO: 58506 - protein, 30 aa, Artificial Sequence
  Description of Artificial Sequence: Synthetic polypeptide
DEEEIRTTNPVCTEHYGSVSWPLLDRGTLS

SEQ ID NO: 58507 - protein, 32 aa, Artificial Sequence
  Description of Artificial Sequence: Synthetic polypeptide
DEEEIRTTNPVCTEHYGVVSTGPNDDQRQGNA

SEQ ID NO: 58508 - protein, 33 aa, Artificial Sequence
  Description of Artificial Sequence: Synthetic polypeptide
DEEEIRTTNPVCTEPYGSVSCMPNLSQRVGNNS

SEQ ID NO: 58509 - protein, 29 aa, Artificial Sequence
  Description of Artificial Sequence: Synthetic peptide
DEEEIRTTNPVCTEPYGVVSMEDIQSGNQ

SEQ ID NO: 58510 - protein, 31 aa, Artificial Sequence
  Description of Artificial Sequence: Synthetic polypeptide
DEEEIRTTNPVCYEHYGSVSMPNLLQTQGND

SEQ ID NO: 58511 - protein, 31 aa, Artificial Sequence
  Description of Artificial Sequence: Synthetic polypeptide
DEEEIRTTNPVCYEHYGSVSMPQLQQRGGNL

SEQ ID NO: 58512 - protein, 31 aa, Artificial Sequence
  Description of Artificial Sequence: Synthetic polypeptide
DEEEIRTTNPVGTEQYGCVCSTEDLIRGSFQ

SEQ ID NO: 58513 - protein, 31 aa, Artificial Sequence
  Description of Artificial Sequence: Synthetic polypeptide
DEEEIRTTNPVCYEPWGSVSIPNLSQRGGNL

SEQ ID NO: 58514 - protein, 31 aa, Artificial Sequence
  Description of Artificial Sequence: Synthetic polypeptide
DEEEIRTTNPVGTEAYGSVNDINGQRGNNGE

SEQ ID NO: 58515 - protein, 32 aa, Artificial Sequence
  Description of Artificial Sequence: Synthetic polypeptide
DEEEIRTTNPVGTEAYGSVSCTNELPGRVGSP

SEQ ID NO: 58516 - protein, 32 aa, Artificial Sequence
  Description of Artificial Sequence: Synthetic polypeptide
DEEEIRTTNPVGTEFYGSVNMGNLQREGTNGD

SEQ ID NO: 58517 - protein, 32 aa, Artificial Sequence
  Description of Artificial Sequence: Synthetic polypeptide
DEEEIRTTNPVGTEGYGSVNMENLQREGGNGD

SEQ ID NO: 58518 - protein, 32 aa, Artificial Sequence
  Description of Artificial Sequence: Synthetic polypeptide
DEEEIRTTNPVGTEHYGSVSMVSTLQRGNELV

SEQ ID NO: 58519 - protein, 32 aa, Artificial Sequence
  Description of Artificial Sequence: Synthetic polypeptide
DEEEIRTTNPVGTEQWGSVSTANELGERGDIQ

SEQ ID NO: 58520 - protein, 31 aa, Artificial Sequence
  Description of Artificial Sequence: Synthetic polypeptide
DEEEIRTTNPVGTEQWGSVSTNELGGERDFP

SEQ ID NO: 58521 - protein, 31 aa, Artificial Sequence
  Description of Artificial Sequence: Synthetic polypeptide
DEEEIRTTNPVGTEQWGSVSTNELGGGPPDM

SEQ ID NO: 58522 - protein, 32 aa, Artificial Sequence
  Description of Artificial Sequence: Synthetic polypeptide
DEEEIRTTNPVGTEQWGSVSTNELGRDGPDQW

SEQ ID NO: 58523 - protein, 32 aa, Artificial Sequence
  Description of Artificial Sequence: Synthetic polypeptide
DEEEIRTTNPVCYEPYGSVSYMPNLSQRGGNL

SEQ ID NO: 58524 - protein, 33 aa, Artificial Sequence
  Description of Artificial Sequence: Synthetic polypeptide
DEEEIRTTNPVATEQYGSVGSNVNLVGMGGNET

SEQ ID NO: 58525 - protein, 34 aa, Artificial Sequence
  Description of Artificial Sequence: Synthetic polypeptide
DEEEIRTTNPVATEQYGSVGSNTVNLFGSGNEDI

SEQ ID NO: 58526 - protein, 34 aa, Artificial Sequence
  Description of Artificial Sequence: Synthetic polypeptide
DEEEIRTTNPVATEQYGSVGSNTQNLFENGGNEQ

SEQ ID NO: 58527 - protein, 31 aa, Artificial Sequence
  Description of Artificial Sequence: Synthetic polypeptide
DEEEIRTTNPVSTEQYGCVSTNFLHDGQFHP

SEQ ID NO: 58528 - protein, 34 aa, Artificial Sequence
  Description of Artificial Sequence: Synthetic polypeptide
DEEEIRTTNPVSTEQYGQCVPSTNLSPRTPGNNR

SEQ ID NO: 58529 - protein, 30 aa, Artificial Sequence
  Description of Artificial Sequence: Synthetic polypeptide
DEEEIRTTNPVSTEQYGQCVTSNLQGGSQQ

SEQ ID NO: 58530 - protein, 32 aa, Artificial Sequence
  Description of Artificial Sequence: Synthetic polypeptide
DEEEIRTTNPVSTEQYGSVACANLSQGGGQNT

SEQ ID NO: 58531 - protein, 31 aa, Artificial Sequence
  Description of Artificial Sequence: Synthetic polypeptide
DEEEIRTTNPVSTEQYGSVATGDNMQGGDQT

SEQ ID NO: 58532 - protein, 34 aa, Artificial Sequence
  Description of Artificial Sequence: Synthetic polypeptide
DEEEIRTTNPVATEQYGSVGSNTNLFENDGGNED

SEQ ID NO: 58533 - protein, 34 aa, Artificial Sequence
  Description of Artificial Sequence: Synthetic polypeptide
DEEEIRTTNPVATEQYGSVGSNTNLFANEGNEGE

SEQ ID NO: 58534 - protein, 33 aa, Artificial Sequence
  Description of Artificial Sequence: Synthetic polypeptide
DEEEIRTTNPVATEQYGSVGSNTNDLGNNFNVP

SEQ ID NO: 58535 - protein, 34 aa, Artificial Sequence
  Description of Artificial Sequence: Synthetic polypeptide
DEEEIRTTNPVATEQYGSVGSNTNDDQEGGGNQG

SEQ ID NO: 58536 - protein, 30 aa, Artificial Sequence
  Description of Artificial Sequence: Synthetic polypeptide
DEEEIRTTNPVSTEQYGCVQSNLQGFGQQS

SEQ ID NO: 58537 - protein, 34 aa, Artificial Sequence
  Description of Artificial Sequence: Synthetic polypeptide
DEEEIRTTNPVATEQYGSVGSNTMNLFNGGNGQG

SEQ ID NO: 58538 - protein, 31 aa, Artificial Sequence
  Description of Artificial Sequence: Synthetic polypeptide
DEEEIRTTNPVSTEQYGSVPAINLSQGGGQT

SEQ ID NO: 58539 - protein, 34 aa, Artificial Sequence
  Description of Artificial Sequence: Synthetic polypeptide
DEEEIRTTNPVATEQYGSVGSNTDNGLEEGNNTQ

SEQ ID NO: 58540 - protein, 31 aa, Artificial Sequence
  Description of Artificial Sequence: Synthetic polypeptide
DEEEIRTTNPVSTEQYGSVPANELSQGGGQT

SEQ ID NO: 58541 - protein, 34 aa, Artificial Sequence
  Description of Artificial Sequence: Synthetic polypeptide
DEEEIRTTNPVATEQYGSVGSNSNGLQSEGGNNE

SEQ ID NO: 58542 - protein, 31 aa, Artificial Sequence
  Description of Artificial Sequence: Synthetic polypeptide
DEEEIRTTNPVSTEQYGSVQPSNLQEVGQVT

SEQ ID NO: 58543 - protein, 31 aa, Artificial Sequence
  Description of Artificial Sequence: Synthetic polypeptide
DEEEIRTTNPVSTEQYGSVSPTLLISEGPLP

SEQ ID NO: 58544 - protein, 31 aa, Artificial Sequence
  Description of Artificial Sequence: Synthetic polypeptide
DEEEIRTTNPVSTEQYGSVSPTLLLSEGLPE

SEQ ID NO: 58545 - protein, 33 aa, Artificial Sequence
  Description of Artificial Sequence: Synthetic polypeptide
DEEEIRTTNPVSTEQYGSVSTPAGPNQRNGNPV

SEQ ID NO: 58546 - protein, 32 aa, Artificial Sequence
  Description of Artificial Sequence: Synthetic polypeptide
DEEEIRTTNPVSTEQYGSVSWNELDNREGQEP

SEQ ID NO: 58547 - protein, 32 aa, Artificial Sequence
  Description of Artificial Sequence: Synthetic polypeptide
DEEEIRTTNPVSTEQYGSVCGSENLQGGSQTS

SEQ ID NO: 58548 - protein, 30 aa, Artificial Sequence
  Description of Artificial Sequence: Synthetic polypeptide
DEEEIRTTNPVSTEQYGCVQNSNLQGGSQQ

SEQ ID NO: 58549 - protein, 33 aa, Artificial Sequence
  Description of Artificial Sequence: Synthetic polypeptide
DEEEIRTTNPVATEQYGSVGSNTNLFNSGDEGM

SEQ ID NO: 58550 - protein, 31 aa, Artificial Sequence
  Description of Artificial Sequence: Synthetic polypeptide
DEEEIRTTNPVSTEQYGCVGSGNLQGGSQQA

SEQ ID NO: 58551 - protein, 32 aa, Artificial Sequence
  Description of Artificial Sequence: Synthetic polypeptide
DEEEIRTTNPVGYEQYGSVPSCTNELGRVGQP

SEQ ID NO: 58552 - protein, 32 aa, Artificial Sequence
  Description of Artificial Sequence: Synthetic polypeptide
DEEEIRTTNPVGYEQYGSVSCTNELSGRPGSP

SEQ ID NO: 58553 - protein, 32 aa, Artificial Sequence
  Description of Artificial Sequence: Synthetic polypeptide
DEEEIRTTNPVSTDQYGSVSETNFLTRSGIEP

SEQ ID NO: 58554 - protein, 30 aa, Artificial Sequence
  Description of Artificial Sequence: Synthetic polypeptide
DEEEIRTTNPVSTEAYGSVAQNLSQGGGQT

SEQ ID NO: 58555 - protein, 32 aa, Artificial Sequence
  Description of Artificial Sequence: Synthetic polypeptide
DEEEIRTTNPVSTECYGSVSTENDLGRSGQFP

SEQ ID NO: 58556 - protein, 30 aa, Artificial Sequence
  Description of Artificial Sequence: Synthetic polypeptide
DEEEIRTTNPVSTEGYGSVCSTVFLETGFP

SEQ ID NO: 58557 - protein, 29 aa, Artificial Sequence
  Description of Artificial Sequence: Synthetic peptide
DEEEIRTTNPVSTEMYGTVTFENLQGGVT

SEQ ID NO: 58558 - protein, 33 aa, Artificial Sequence
  Description of Artificial Sequence: Synthetic polypeptide
DEEEIRTTNPVSTEPYGSVSCCPNELQRGGNNL

SEQ ID NO: 58559 - protein, 30 aa, Artificial Sequence
  Description of Artificial Sequence: Synthetic polypeptide
DEEEIRTTNPVSTEPYGSVSMDIQQQNGNH

SEQ ID NO: 58560 - protein, 35 aa, Artificial Sequence
  Description of Artificial Sequence: Synthetic polypeptide
DEEEIRTTNPVATEQYGSVGSNTNLQFNEGGNEGE

SEQ ID NO: 58561 - protein, 31 aa, Artificial Sequence
  Description of Artificial Sequence: Synthetic polypeptide
DEEEIRTTNPVSTEPYGTVSEEDLQQQQGNR

SEQ ID NO: 58562 - protein, 29 aa, Artificial Sequence
  Description of Artificial Sequence: Synthetic peptide
DEEEIRTTNPVSTEPYGTVTFYNLQGGTT

SEQ ID NO: 58563 - protein, 34 aa, Artificial Sequence
  Description of Artificial Sequence: Synthetic polypeptide
DEEEIRTTNPVATEQYGSVGSNTNLLFNGGNGQE

SEQ ID NO: 58564 - protein, 32 aa, Artificial Sequence
  Description of Artificial Sequence: Synthetic polypeptide
DEEEIRTTNPVSTEQYGAVSNLNLTQEEEGNW

SEQ ID NO: 58565 - protein, 34 aa, Artificial Sequence
  Description of Artificial Sequence: Synthetic polypeptide
DEEEIRTTNPVATEQYGSVGSNTNLLFESGNEDQ

SEQ ID NO: 58566 - protein, 31 aa, Artificial Sequence
  Description of Artificial Sequence: Synthetic polypeptide
DEEEIRTTNPVSTEQYGCVCGSENLQGGSQQ

SEQ ID NO: 58567 - protein, 30 aa, Artificial Sequence
  Description of Artificial Sequence: Synthetic polypeptide
DEEEIRTTNPVSTEQYGCVCGSNLQGSGQQ

SEQ ID NO: 58568 - protein, 31 aa, Artificial Sequence
  Description of Artificial Sequence: Synthetic polypeptide
DEEEIRTTNPVSTEQYGCVCTSNDLQGGSQQ

SEQ ID NO: 58569 - protein, 34 aa, Artificial Sequence
  Description of Artificial Sequence: Synthetic polypeptide
DEEEIRTTNPVATEQYGSVGSNTNLIMNGGNEQE

SEQ ID NO: 58570 - protein, 34 aa, Artificial Sequence
  Description of Artificial Sequence: Synthetic polypeptide
DEEEIRTTNPVATEQYGSVGSNTNLIFNSGNEGL

SEQ ID NO: 58571 - protein, 30 aa, Artificial Sequence
  Description of Artificial Sequence: Synthetic polypeptide
DEEEIRTTNPVSTEQYGCVESNLQGFGSQQ

SEQ ID NO: 58572 - protein, 34 aa, Artificial Sequence
  Description of Artificial Sequence: Synthetic polypeptide
DEEEIRTTNPVATEQYGSVGSTNNDGQETGNEGE

SEQ ID NO: 58573 - protein, 31 aa, Artificial Sequence
  Description of Artificial Sequence: Synthetic polypeptide
DEEEIRTTNPVAYEQYGSVATNLQVPDDSDH

SEQ ID NO: 58574 - protein, 31 aa, Artificial Sequence
  Description of Artificial Sequence: Synthetic polypeptide
DEEEIRTTNPVCTEHYGSVCSWPNLQSGSEL

SEQ ID NO: 58575 - protein, 30 aa, Artificial Sequence
  Description of Artificial Sequence: Synthetic polypeptide
DEEEIRTTNPVCTEHYGMVSWPNLEDRGTL

SEQ ID NO: 58576 - protein, 34 aa, Artificial Sequence
  Description of Artificial Sequence: Synthetic polypeptide
DEEEIRTTNPVAYEQYGSVPVCTGLSQERGGNNR

SEQ ID NO: 58577 - protein, 30 aa, Artificial Sequence
  Description of Artificial Sequence: Synthetic polypeptide
DEEEIRTTNPVAYEQYGSVPVNEQVFDVSR

SEQ ID NO: 58578 - protein, 32 aa, Artificial Sequence
  Description of Artificial Sequence: Synthetic polypeptide
DEEEIRTTNPVAYEQYGSVQACTHLSLKSGNR

SEQ ID NO: 58579 - protein, 33 aa, Artificial Sequence
  Description of Artificial Sequence: Synthetic polypeptide
DEEEIRTTNPVAYEQYGSVSCWDDLWQRDFGNN

SEQ ID NO: 58580 - protein, 33 aa, Artificial Sequence
  Description of Artificial Sequence: Synthetic polypeptide
DEEEIRTTNPVAYEQYGSVSTENMLSPSTGNND

SEQ ID NO: 58581 - protein, 33 aa, Artificial Sequence
  Description of Artificial Sequence: Synthetic polypeptide
DEEEIRTTNPVAYEQYGSVSVTGPEGSIRGGNR

SEQ ID NO: 58582 - protein, 33 aa, Artificial Sequence
  Description of Artificial Sequence: Synthetic polypeptide
DEEEIRTTNPVATEQYGSVHPTVVVQRGQNQDV

SEQ ID NO: 58583 - protein, 33 aa, Artificial Sequence
  Description of Artificial Sequence: Synthetic polypeptide
DEEEIRTTNPVAYEQYGSVSYNCAGSQRGGNNH

SEQ ID NO: 58584 - protein, 34 aa, Artificial Sequence
  Description of Artificial Sequence: Synthetic polypeptide
DEEEIRTTNPVAYEQYGSVVACTNLDQVRVGDRY

SEQ ID NO: 58585 - protein, 35 aa, Artificial Sequence
  Description of Artificial Sequence: Synthetic polypeptide
DEEEIRTTNPVATEQYGSVHTTENLQQMRENVEVR

SEQ ID NO: 58586 - protein, 33 aa, Artificial Sequence
  Description of Artificial Sequence: Synthetic polypeptide
DEEEIRTTNPVAYEQYGSVVSCTNAISQNVGSR

SEQ ID NO: 58587 - protein, 32 aa, Artificial Sequence
  Description of Artificial Sequence: Synthetic polypeptide
DEEEIRTTNPVATEQYGSVGTTNLQVIMELES

SEQ ID NO: 58588 - protein, 32 aa, Artificial Sequence
  Description of Artificial Sequence: Synthetic polypeptide
DEEEIRTTNPVAYEQYGSVVTNNDLLQNGIGD

SEQ ID NO: 58589 - protein, 33 aa, Artificial Sequence
  Description of Artificial Sequence: Synthetic polypeptide
DEEEIRTTNPVATEQYGSVGTSNDQVGIGGNED

SEQ ID NO: 58590 - protein, 33 aa, Artificial Sequence
  Description of Artificial Sequence: Synthetic polypeptide
DEEEIRTTNPVAYEQYGSVWTNALSQVTDGSND

SEQ ID NO: 58591 - protein, 31 aa, Artificial Sequence
  Description of Artificial Sequence: Synthetic polypeptide
DEEEIRTTNPVAYEQYGSVWTNEQPVFDVSR

SEQ ID NO: 58592 - protein, 33 aa, Artificial Sequence
  Description of Artificial Sequence: Synthetic polypeptide
DEEEIRTTNPVATEQYGSVGTNVGQEEFGNQDG

SEQ ID NO: 58593 - protein, 31 aa, Artificial Sequence
  Description of Artificial Sequence: Synthetic polypeptide
DEEEIRTTNPVAYEQYGSVWTNLQSFDSDQG

SEQ ID NO: 58594 - protein, 33 aa, Artificial Sequence
  Description of Artificial Sequence: Synthetic polypeptide
DEEEIRTTNPVATEQYGSVGTNTDNGQDEGNEG

SEQ ID NO: 58595 - protein, 31 aa, Artificial Sequence
  Description of Artificial Sequence: Synthetic polypeptide
DEEEIRTTNPVAYEQYGSVWTTNLQVFDSIF

SEQ ID NO: 58596 - protein, 33 aa, Artificial Sequence
  Description of Artificial Sequence: Synthetic polypeptide
DEEEIRTTNPVATEQYGSVGTVNNLDIFGNEGN

SEQ ID NO: 58597 - protein, 34 aa, Artificial Sequence
  Description of Artificial Sequence: Synthetic polypeptide
DEEEIRTTNPVAYEQYGSVYSCTNAIQNGTGGNR

SEQ ID NO: 58598 - protein, 34 aa, Artificial Sequence
  Description of Artificial Sequence: Synthetic polypeptide
DEEEIRTTNPVAYEQYGSVPSYNFLSQRGGNNDY

SEQ ID NO: 58599 - protein, 33 aa, Artificial Sequence
  Description of Artificial Sequence: Synthetic polypeptide
DEEEIRTTNPVAYEQYGSVPSYNCLSQSGGNNA

SEQ ID NO: 58600 - protein, 33 aa, Artificial Sequence
  Description of Artificial Sequence: Synthetic polypeptide
DEEEIRTTNPVAYEQYGSVCCTGNLSVNRGGTR

SEQ ID NO: 58601 - protein, 32 aa, Artificial Sequence
  Description of Artificial Sequence: Synthetic polypeptide
DEEEIRTTNPVATEQYGSVIDPPNLQTEVGEN

SEQ ID NO: 58602 - protein, 33 aa, Artificial Sequence
  Description of Artificial Sequence: Synthetic polypeptide
DEEEIRTTNPVAYEQYGSVCQTNLFGRDINNGR

SEQ ID NO: 58603 - protein, 32 aa, Artificial Sequence
  Description of Artificial Sequence: Synthetic polypeptide
DEEEIRTTNPVAYEQYGSVCSTNHQGFNSDQG

SEQ ID NO: 58604 - protein, 32 aa, Artificial Sequence
  Description of Artificial Sequence: Synthetic polypeptide
DEEEIRTTNPVAYEQYGSVCTNALSPVTDSNR

SEQ ID NO: 58605 - protein, 30 aa, Artificial Sequence
  Description of Artificial Sequence: Synthetic polypeptide
DEEEIRTTNPVAYEQYGSVCWTELQSFDDQ

SEQ ID NO: 58606 - protein, 30 aa, Artificial Sequence
  Description of Artificial Sequence: Synthetic polypeptide
DEEEIRTTNPVAYEQYGSVCWTNHQNFDDA

SEQ ID NO: 58607 - protein, 34 aa, Artificial Sequence
  Description of Artificial Sequence: Synthetic polypeptide
DEEEIRTTNPVAYEQYGSVCYNCALSQRGGNNRL

SEQ ID NO: 58608 - protein, 32 aa, Artificial Sequence
  Description of Artificial Sequence: Synthetic polypeptide
DEEEIRTTNPVAYEQYGSVITTNLQPVFDVAR

SEQ ID NO: 58609 - protein, 34 aa, Artificial Sequence
  Description of Artificial Sequence: Synthetic polypeptide
DEEEIRTTNPVAYEQYGSVPSYNCLSTRGGNNRS

SEQ ID NO: 58610 - protein, 33 aa, Artificial Sequence
  Description of Artificial Sequence: Synthetic polypeptide
DEEEIRTTNPVAYEQYGSVPCCTGNLSTTRGTR

SEQ ID NO: 58611 - protein, 33 aa, Artificial Sequence
  Description of Artificial Sequence: Synthetic polypeptide
DEEEIRTTNPVAYEQYGSVPSCTNEHQERTVDR

SEQ ID NO: 58612 - protein, 33 aa, Artificial Sequence
  Description of Artificial Sequence: Synthetic polypeptide
DEEEIRTTNPVATEQYGSVIAPTNMLPMRGIED

SEQ ID NO: 58613 - protein, 33 aa, Artificial Sequence
  Description of Artificial Sequence: Synthetic polypeptide
DEEEIRTTNPVATEQYGSVIAPTNLPGRDGIED

SEQ ID NO: 58614 - protein, 33 aa, Artificial Sequence
  Description of Artificial Sequence: Synthetic polypeptide
DEEEIRTTNPVATEQYGSVIAPTNLGRGVIEDQ

SEQ ID NO: 58615 - protein, 33 aa, Artificial Sequence
  Description of Artificial Sequence: Synthetic polypeptide
DEEEIRTTNPVATEQYGSVIAPTNLGQTQGIEP

SEQ ID NO: 58616 - protein, 34 aa, Artificial Sequence
  Description of Artificial Sequence: Synthetic polypeptide
DEEEIRTTNPVATEQYGSVIAPTNLGQRQNIEDQ

SEQ ID NO: 58617 - protein, 33 aa, Artificial Sequence
  Description of Artificial Sequence: Synthetic polypeptide
DEEEIRTTNPVAYEQYGSVPSTNEISQTTTGNN

SEQ ID NO: 58618 - protein, 33 aa, Artificial Sequence
  Description of Artificial Sequence: Synthetic polypeptide
DEEEIRTTNPVATEQYGSVIAPTNLGERNGIED

SEQ ID NO: 58619 - protein, 31 aa, Artificial Sequence
  Description of Artificial Sequence: Synthetic polypeptide
DEEEIRTTNPVATEQYGSVIAPTNEGLGIED

SEQ ID NO: 58620 - protein, 34 aa, Artificial Sequence
  Description of Artificial Sequence: Synthetic polypeptide
DEEEIRTTNPVAYEQYGSVPSCTGNLQPDGENNQ

SEQ ID NO: 58621 - protein, 34 aa, Artificial Sequence
  Description of Artificial Sequence: Synthetic polypeptide
DEEEIRTTNPVAYEQYGSVYSCTNAISQNKGTNR

SEQ ID NO: 58622 - protein, 31 aa, Artificial Sequence
  Description of Artificial Sequence: Synthetic polypeptide
DEEEIRTTNPVAYEQYGTCSTIDPLQNRENN

SEQ ID NO: 58623 - protein, 31 aa, Artificial Sequence
  Description of Artificial Sequence: Synthetic polypeptide
DEEEIRTTNPVAYEQYGTCSTINGLQDENNP

SEQ ID NO: 58624 - protein, 33 aa, Artificial Sequence
  Description of Artificial Sequence: Synthetic polypeptide
DEEEIRTTNPVAYEQYGVVVSNTNDLLQDGIRT

SEQ ID NO: 58625 - protein, 34 aa, Artificial Sequence
  Description of Artificial Sequence: Synthetic polypeptide
DEEEIRTTNPVAYEQYGVVVSTQTNDLLQRGIRN

SEQ ID NO: 58626 - protein, 32 aa, Artificial Sequence
  Description of Artificial Sequence: Synthetic polypeptide
DEEEIRTTNPVAYEQYGVVVSVNNLLQSGIRE

SEQ ID NO: 58627 - protein, 30 aa, Artificial Sequence
  Description of Artificial Sequence: Synthetic polypeptide
DEEEIRTTNPVAYEQYGVVWTNLQVFDSID

SEQ ID NO: 58628 - protein, 33 aa, Artificial Sequence
  Description of Artificial Sequence: Synthetic polypeptide
DEEEIRTTNPVAYEQYGYSVSQHNDLLERGIHR

SEQ ID NO: 58629 - protein, 33 aa, Artificial Sequence
  Description of Artificial Sequence: Synthetic polypeptide
DEEEIRTTNPVAYERWGSTVPSTNALPQFGANR

SEQ ID NO: 58630 - protein, 33 aa, Artificial Sequence
  Description of Artificial Sequence: Synthetic polypeptide
DEEEIRTTNPVAYERYGKTVSCTNLTRDGNNRV

SEQ ID NO: 58631 - protein, 32 aa, Artificial Sequence
  Description of Artificial Sequence: Synthetic polypeptide
DEEEIRTTNPVAYERYGKVAFTNDSQRPGNNR

SEQ ID NO: 58632 - protein, 31 aa, Artificial Sequence
  Description of Artificial Sequence: Synthetic polypeptide
DEEEIRTTNPVAYERYGSTVAFTNGSQNVNR

SEQ ID NO: 58633 - protein, 35 aa, Artificial Sequence
  Description of Artificial Sequence: Synthetic polypeptide
DEEEIRTTNPVATEQYGSVGSTVNLQQIIGGNMGG

SEQ ID NO: 58634 - protein, 31 aa, Artificial Sequence
  Description of Artificial Sequence: Synthetic polypeptide
DEEEIRTTNPVAYERYGSVATTELSQSGGMR

SEQ ID NO: 58635 - protein, 33 aa, Artificial Sequence
  Description of Artificial Sequence: Synthetic polypeptide
DEEEIRTTNPVAYESYGSTVQACTMLSQRSGNR

SEQ ID NO: 58636 - protein, 34 aa, Artificial Sequence
  Description of Artificial Sequence: Synthetic polypeptide
DEEEIRTTNPVAYESYGSVPSTVNALQRTGGSYR

SEQ ID NO: 58637 - protein, 33 aa, Artificial Sequence
  Description of Artificial Sequence: Synthetic polypeptide
DEEEIRTTNPVCTEAYGSVSCQPNELQRGGNNL

SEQ ID NO: 58638 - protein, 35 aa, Artificial Sequence
  Description of Artificial Sequence: Synthetic polypeptide
DEEEIRTTNPVATEQYGSVGSTVNLFQNEGGNDGQ

SEQ ID NO: 58639 - protein, 33 aa, Artificial Sequence
  Description of Artificial Sequence: Synthetic polypeptide
DEEEIRTTNPVCTEAYGSVSDPNLQREGGNEGQ

SEQ ID NO: 58640 - protein, 30 aa, Artificial Sequence
  Description of Artificial Sequence: Synthetic polypeptide
DEEEIRTTNPVCTEAYGSVSMPHGEQRGVE

SEQ ID NO: 58641 - protein, 34 aa, Artificial Sequence
  Description of Artificial Sequence: Synthetic polypeptide
DEEEIRTTNPVATEQYGSVGSTTLDQDIGGNNDD

SEQ ID NO: 58642 - protein, 32 aa, Artificial Sequence
  Description of Artificial Sequence: Synthetic polypeptide
DEEEIRTTNPVCTEHWGSVSTGPNDDQRQGNS

SEQ ID NO: 58643 - protein, 32 aa, Artificial Sequence
  Description of Artificial Sequence: Synthetic polypeptide
DEEEIRTTNPVCTEHWGSVSTMPNDDQRGNEL

SEQ ID NO: 58644 - protein, 32 aa, Artificial Sequence
  Description of Artificial Sequence: Synthetic polypeptide
DEEEIRTTNPVAYERYGSVSTNELSQFDGGSQ

SEQ ID NO: 58645 - protein, 32 aa, Artificial Sequence
  Description of Artificial Sequence: Synthetic polypeptide
DEEEIRTTNPVAYEQYGVVVSNNDLLQNGIGR

SEQ ID NO: 58646 - protein, 33 aa, Artificial Sequence
  Description of Artificial Sequence: Synthetic polypeptide
DEEEIRTTNPVAYEQYGVVSCTHNSQQRGGMNS

SEQ ID NO: 58647 - protein, 33 aa, Artificial Sequence
  Description of Artificial Sequence: Synthetic polypeptide
DEEEIRTTNPVAYEQYGVVSCTANSQRAGGMNS

SEQ ID NO: 58648 - protein, 33 aa, Artificial Sequence
  Description of Artificial Sequence: Synthetic polypeptide
DEEEIRTTNPVAYEQYGTISTINALSQREGNNN

SEQ ID NO: 58649 - protein, 33 aa, Artificial Sequence
  Description of Artificial Sequence: Synthetic polypeptide
DEEEIRTTNPVAYEQYGTSVSQGNDLLQEGIRR

SEQ ID NO: 58650 - protein, 34 aa, Artificial Sequence
  Description of Artificial Sequence: Synthetic polypeptide
DEEEIRTTNPVAYEQYGTSVSQTNDLLQDSGIRR

SEQ ID NO: 58651 - protein, 33 aa, Artificial Sequence
  Description of Artificial Sequence: Synthetic polypeptide
DEEEIRTTNPVAYEQYGTTPSTGELSQRGGNYR

SEQ ID NO: 58652 - protein, 32 aa, Artificial Sequence
  Description of Artificial Sequence: Synthetic polypeptide
DEEEIRTTNPVAYEQYGTTVSCTNLSQVSSRI

SEQ ID NO: 58653 - protein, 32 aa, Artificial Sequence
  Description of Artificial Sequence: Synthetic polypeptide
DEEEIRTTNPVAYEQYGTVPSTSLQGGENQEE

SEQ ID NO: 58654 - protein, 32 aa, Artificial Sequence
  Description of Artificial Sequence: Synthetic polypeptide
DEEEIRTTNPVAYEQYGTVSWTEEDNRGGMNR

SEQ ID NO: 58655 - protein, 33 aa, Artificial Sequence
  Description of Artificial Sequence: Synthetic polypeptide
DEEEIRTTNPVAYEQYGTVSWTELDDERGGDNR

SEQ ID NO: 58656 - protein, 33 aa, Artificial Sequence
  Description of Artificial Sequence: Synthetic polypeptide
DEEEIRTTNPVAYEQYGTVVSNTNDLLQEGIRE

SEQ ID NO: 58657 - protein, 32 aa, Artificial Sequence
  Description of Artificial Sequence: Synthetic polypeptide
DEEEIRTTNPVAYEQYGVSTLQNDLLQEGIRR

SEQ ID NO: 58658 - protein, 32 aa, Artificial Sequence
  Description of Artificial Sequence: Synthetic polypeptide
DEEEIRTTNPVAYEQYGVSVGQNDNHQRGDRR

SEQ ID NO: 58659 - protein, 33 aa, Artificial Sequence
  Description of Artificial Sequence: Synthetic polypeptide
DEEEIRTTNPVAYEQYGVSVITNDLLDDRGIRR

SEQ ID NO: 58660 - protein, 30 aa, Artificial Sequence
  Description of Artificial Sequence: Synthetic polypeptide
DEEEIRTTNPVATEQYGSVGTGLMPMVEQI

SEQ ID NO: 58661 - protein, 32 aa, Artificial Sequence
  Description of Artificial Sequence: Synthetic polypeptide
DEEEIRTTNPVAYEQYGVSVPQNDLLQEGDRR

SEQ ID NO: 58662 - protein, 33 aa, Artificial Sequence
  Description of Artificial Sequence: Synthetic polypeptide
DEEEIRTTNPVATEQYGSVGTDNGLGEGGNNNT

SEQ ID NO: 58663 - protein, 33 aa, Artificial Sequence
  Description of Artificial Sequence: Synthetic polypeptide
DEEEIRTTNPVATEQYGSVGTDNGGQGEGGNNN

SEQ ID NO: 58664 - protein, 33 aa, Artificial Sequence
  Description of Artificial Sequence: Synthetic polypeptide
DEEEIRTTNPVAYEQYGVSVSQGNDLLQPGERR

SEQ ID NO: 58665 - protein, 33 aa, Artificial Sequence
  Description of Artificial Sequence: Synthetic polypeptide
DEEEIRTTNPVAYEQYGVSVSQNDLLQDGGIRR

SEQ ID NO: 58666 - protein, 34 aa, Artificial Sequence
  Description of Artificial Sequence: Synthetic polypeptide
DEEEIRTTNPVATEQYGSVGSVLLGQDGTYNGRL

SEQ ID NO: 58667 - protein, 34 aa, Artificial Sequence
  Description of Artificial Sequence: Synthetic polypeptide
DEEEIRTTNPVAYEQYGVSVSQTNDLLQPDGIRR

SEQ ID NO: 58668 - protein, 33 aa, Artificial Sequence
  Description of Artificial Sequence: Synthetic polypeptide
DEEEIRTTNPVAYEQYGVVQSCTNNSQRAGMND

SEQ ID NO: 58669 - protein, 31 aa, Artificial Sequence
  Description of Artificial Sequence: Synthetic polypeptide
DEEEIRTTNPVCTEHYGSVCSWPNDQNGSNQ

SEQ ID NO: 58670 - protein, 34 aa, Artificial Sequence
  Description of Artificial Sequence: Synthetic polypeptide
DEEEIRTTNPVATEQYGSVTSNNLGQNEGGNDGN

SEQ ID NO: 58671 - protein, 33 aa, Artificial Sequence
  Description of Artificial Sequence: Synthetic polypeptide
DEEEIRTTNPVATEQYGSVTSNNLEENIGGNIE

SEQ ID NO: 58672 - protein, 34 aa, Artificial Sequence
  Description of Artificial Sequence: Synthetic polypeptide
DEEEIRTTNPVATEQYGSVTSNNLDQNGGGNQQE

SEQ ID NO: 58673 - protein, 33 aa, Artificial Sequence
  Description of Artificial Sequence: Synthetic polypeptide
DEEEIRTTNPVATEQYGSVSLTNLQNTESQAIN

SEQ ID NO: 58674 - protein, 33 aa, Artificial Sequence
  Description of Artificial Sequence: Synthetic polypeptide
DEEEIRTTNPVATEQYGSVSSTNGADRIDSENQ

SEQ ID NO: 58675 - protein, 34 aa, Artificial Sequence
  Description of Artificial Sequence: Synthetic polypeptide
DEEEIRTTNPVATEQYGSVSSTNGDQGQEGGNGQ

SEQ ID NO: 58676 - protein, 33 aa, Artificial Sequence
  Description of Artificial Sequence: Synthetic polypeptide
DEEEIRTTNPVATEQYGSVSSTNIDRIDSEGRM

SEQ ID NO: 58677 - protein, 34 aa, Artificial Sequence
  Description of Artificial Sequence: Synthetic polypeptide
DEEEIRTTNPVATEQYGSVSSTNNGQGEFGGNIT

SEQ ID NO: 58678 - protein, 34 aa, Artificial Sequence
  Description of Artificial Sequence: Synthetic polypeptide
DEEEIRTTNPVATEQYGSVSSTNPAGPQMRNGQV

SEQ ID NO: 58679 - protein, 33 aa, Artificial Sequence
  Description of Artificial Sequence: Synthetic polypeptide
DEEEIRTTNPVATEQYGSVSSTPAENMANGNPV

SEQ ID NO: 58680 - protein, 33 aa, Artificial Sequence
  Description of Artificial Sequence: Synthetic polypeptide
DEEEIRTTNPVATEQYGSVSSTPAENMRNGNPV

SEQ ID NO: 58681 - protein, 33 aa, Artificial Sequence
  Description of Artificial Sequence: Synthetic polypeptide
DEEEIRTTNPVATEQYGSVSSTPAGNMRGMNPV

SEQ ID NO: 58682 - protein, 34 aa, Artificial Sequence
  Description of Artificial Sequence: Synthetic polypeptide
DEEEIRTTNPVATEQYGSVSSTNDQVIGNGGGNT

SEQ ID NO: 58683 - protein, 33 aa, Artificial Sequence
  Description of Artificial Sequence: Synthetic polypeptide
DEEEIRTTNPVATEQYGSVSSTPAGNMRNGMNV

SEQ ID NO: 58684 - protein, 33 aa, Artificial Sequence
  Description of Artificial Sequence: Synthetic polypeptide
DEEEIRTTNPVATEQYGSVSSTPAGPNMRGNPV

SEQ ID NO: 58685 - protein, 33 aa, Artificial Sequence
  Description of Artificial Sequence: Synthetic polypeptide
DEEEIRTTNPVATEQYGSVSSTPAGPNRNGMNV

SEQ ID NO: 58686 - protein, 34 aa, Artificial Sequence
  Description of Artificial Sequence: Synthetic polypeptide
DEEEIRTTNPVATEQYGSVSLTNLEQPEGLELTD

SEQ ID NO: 58687 - protein, 34 aa, Artificial Sequence
  Description of Artificial Sequence: Synthetic polypeptide
DEEEIRTTNPVATEQYGSVSSTPNGPNMRNGMNV

SEQ ID NO: 58688 - protein, 33 aa, Artificial Sequence
  Description of Artificial Sequence: Synthetic polypeptide
DEEEIRTTNPVATEQYGSVSSTQGDQGQGGNND

SEQ ID NO: 58689 - protein, 34 aa, Artificial Sequence
  Description of Artificial Sequence: Synthetic polypeptide
DEEEIRTTNPVATEQYGSVSSTQNAEGQSGENGD

SEQ ID NO: 58690 - protein, 34 aa, Artificial Sequence
  Description of Artificial Sequence: Synthetic polypeptide
DEEEIRTTNPVATEQYGSVSSTQNDGQEQGGNNT

SEQ ID NO: 58691 - protein, 34 aa, Artificial Sequence
  Description of Artificial Sequence: Synthetic polypeptide
DEEEIRTTNPVATEQYGSVSSTQNDGQTQGGNNT

SEQ ID NO: 58692 - protein, 34 aa, Artificial Sequence
  Description of Artificial Sequence: Synthetic polypeptide
DEEEIRTTNPVATEQYGSVSSTTAGNMRNGMNPR

SEQ ID NO: 58693 - protein, 33 aa, Artificial Sequence
  Description of Artificial Sequence: Synthetic polypeptide
DEEEIRTTNPVATEQYGSVSSTPAGNMRNGNPV

SEQ ID NO: 58694 - protein, 33 aa, Artificial Sequence
  Description of Artificial Sequence: Synthetic polypeptide
DEEEIRTTNPVATEQYGSVSSTTAGNRNGMNPV

SEQ ID NO: 58695 - protein, 33 aa, Artificial Sequence
  Description of Artificial Sequence: Synthetic polypeptide
DEEEIRTTNPVATEQYGSVSSTMTLLERNENDQ

SEQ ID NO: 58696 - protein, 33 aa, Artificial Sequence
  Description of Artificial Sequence: Synthetic polypeptide
DEEEIRTTNPVATEQYGSVSSTLNQGENEGGNA

SEQ ID NO: 58697 - protein, 34 aa, Artificial Sequence
  Description of Artificial Sequence: Synthetic polypeptide
DEEEIRTTNPVATEQYGSVSLTNMLQHLANENQY

SEQ ID NO: 58698 - protein, 34 aa, Artificial Sequence
  Description of Artificial Sequence: Synthetic polypeptide
DEEEIRTTNPVATEQYGSVSSTEPAGPNRGMNPR

SEQ ID NO: 58699 - protein, 33 aa, Artificial Sequence
  Description of Artificial Sequence: Synthetic polypeptide
DEEEIRTTNPVATEQYGSVSSTEPAGPNRNGNV

SEQ ID NO: 58700 - protein, 34 aa, Artificial Sequence
  Description of Artificial Sequence: Synthetic polypeptide
DEEEIRTTNPVATEQYGSVSSTEPALPNMRGNPV

SEQ ID NO: 58701 - protein, 33 aa, Artificial Sequence
  Description of Artificial Sequence: Synthetic polypeptide
DEEEIRTTNPVATEQYGSVSLTNLSEISGIEDD

SEQ ID NO: 58702 - protein, 34 aa, Artificial Sequence
  Description of Artificial Sequence: Synthetic polypeptide
DEEEIRTTNPVATEQYGSVSSTEPALPNRNGMNV

SEQ ID NO: 58703 - protein, 34 aa, Artificial Sequence
  Description of Artificial Sequence: Synthetic polypeptide
DEEEIRTTNPVATEQYGSVSSTEPNGNMRNGNPV

SEQ ID NO: 58704 - protein, 34 aa, Artificial Sequence
  Description of Artificial Sequence: Synthetic polypeptide
DEEEIRTTNPVATEQYGSVSSTGLQQIGVGNGQT

SEQ ID NO: 58705 - protein, 34 aa, Artificial Sequence
  Description of Artificial Sequence: Synthetic polypeptide
DEEEIRTTNPVATEQYGSVSSTGLQSTGGGNEDD

SEQ ID NO: 58706 - protein, 33 aa, Artificial Sequence
  Description of Artificial Sequence: Synthetic polypeptide
DEEEIRTTNPVATEQYGSVSSTMMLELRIANTQ

SEQ ID NO: 58707 - protein, 34 aa, Artificial Sequence
  Description of Artificial Sequence: Synthetic polypeptide
DEEEIRTTNPVATEQYGSVSLTNLQSLIVLENQV

SEQ ID NO: 58708 - protein, 33 aa, Artificial Sequence
  Description of Artificial Sequence: Synthetic polypeptide
DEEEIRTTNPVATEQYGSVSSTGVGGQGGNEED

SEQ ID NO: 58709 - protein, 34 aa, Artificial Sequence
  Description of Artificial Sequence: Synthetic polypeptide
DEEEIRTTNPVATEQYGSVSSTIAEPQMREGENV

SEQ ID NO: 58710 - protein, 34 aa, Artificial Sequence
  Description of Artificial Sequence: Synthetic polypeptide
DEEEIRTTNPVATEQYGSVSSTIAEPQMRNGENV

SEQ ID NO: 58711 - protein, 34 aa, Artificial Sequence
  Description of Artificial Sequence: Synthetic polypeptide
DEEEIRTTNPVATEQYGSVSSTILPDSRTQQNRY

SEQ ID NO: 58712 - protein, 34 aa, Artificial Sequence
  Description of Artificial Sequence: Synthetic polypeptide
DEEEIRTTNPVATEQYGSVSSTINGPNMREGENG

SEQ ID NO: 58713 - protein, 34 aa, Artificial Sequence
  Description of Artificial Sequence: Synthetic polypeptide
DEEEIRTTNPVATEQYGSVSSTINGPNMRNGENG

SEQ ID NO: 58714 - protein, 34 aa, Artificial Sequence
  Description of Artificial Sequence: Synthetic polypeptide
DEEEIRTTNPVATEQYGSVSSTINGPNMRNGENV

SEQ ID NO: 58715 - protein, 34 aa, Artificial Sequence
  Description of Artificial Sequence: Synthetic polypeptide
DEEEIRTTNPVATEQYGSVSSTINGPNMRNGMNV

SEQ ID NO: 58716 - protein, 33 aa, Artificial Sequence
  Description of Artificial Sequence: Synthetic polypeptide
DEEEIRTTNPVATEQYGSVSSTLDQSNEMGGNG

SEQ ID NO: 58717 - protein, 34 aa, Artificial Sequence
  Description of Artificial Sequence: Synthetic polypeptide
DEEEIRTTNPVATEQYGSVSSTGNGEQTGNGNGI

SEQ ID NO: 58718 - protein, 33 aa, Artificial Sequence
  Description of Artificial Sequence: Synthetic polypeptide
DEEEIRTTNPVATEQYGSVSLTNMVQEEMANLD

SEQ ID NO: 58719 - protein, 33 aa, Artificial Sequence
  Description of Artificial Sequence: Synthetic polypeptide
DEEEIRTTNPVATEQYGSVSSTTAGPNRNGMNV

SEQ ID NO: 58720 - protein, 33 aa, Artificial Sequence
  Description of Artificial Sequence: Synthetic polypeptide
DEEEIRTTNPVATEQYGSVSSTTAGQGGGNNGQ

SEQ ID NO: 58721 - protein, 33 aa, Artificial Sequence
  Description of Artificial Sequence: Synthetic polypeptide
DEEEIRTTNPVATEQYGSVSLNNLQRDFVEEFV

SEQ ID NO: 58722 - protein, 35 aa, Artificial Sequence
  Description of Artificial Sequence: Synthetic polypeptide
DEEEIRTTNPVATEQYGSVSSTTPNLPNMRNGMNV

SEQ ID NO: 58723 - protein, 32 aa, Artificial Sequence
  Description of Artificial Sequence: Synthetic polypeptide
DEEEIRTTNPVATEQYGSVSSTWDLERNEQIN

SEQ ID NO: 58724 - protein, 32 aa, Artificial Sequence
  Description of Artificial Sequence: Synthetic polypeptide
DEEEIRTTNPVATEQYGSVSSVAQTSISNQRM

SEQ ID NO: 58725 - protein, 32 aa, Artificial Sequence
  Description of Artificial Sequence: Synthetic polypeptide
DEEEIRTTNPVATEQYGSVSTADLADGQEEEY

SEQ ID NO: 58726 - protein, 34 aa, Artificial Sequence
  Description of Artificial Sequence: Synthetic polypeptide
DEEEIRTTNPVATEQYGSVSTAGFGNEGQGGGNT

SEQ ID NO: 58727 - protein, 33 aa, Artificial Sequence
  Description of Artificial Sequence: Synthetic polypeptide
DEEEIRTTNPVATEQYGSVSTALQEDGGGGETI

SEQ ID NO: 58728 - protein, 32 aa, Artificial Sequence
  Description of Artificial Sequence: Synthetic polypeptide
DEEEIRTTNPVATEQYGSVSLNLPRQDVEEPS

SEQ ID NO: 58729 - protein, 32 aa, Artificial Sequence
  Description of Artificial Sequence: Synthetic polypeptide
DEEEIRTTNPVATEQYGSVSLNLPRDIVEEFS

SEQ ID NO: 58730 - protein, 34 aa, Artificial Sequence
  Description of Artificial Sequence: Synthetic polypeptide
DEEEIRTTNPVATEQYGSVSLNNPLQQRQDSELR

SEQ ID NO: 58731 - protein, 33 aa, Artificial Sequence
  Description of Artificial Sequence: Synthetic polypeptide
DEEEIRTTNPVATEQYGSVSTANMNNNGEGNEI

SEQ ID NO: 58732 - protein, 33 aa, Artificial Sequence
  Description of Artificial Sequence: Synthetic polypeptide
DEEEIRTTNPVATEQYGSVSLNLEQQSDVNEPV

SEQ ID NO: 58733 - protein, 34 aa, Artificial Sequence
  Description of Artificial Sequence: Synthetic polypeptide
DEEEIRTTNPVATEQYGSVSTANMNNQGTGENIT

SEQ ID NO: 58734 - protein, 33 aa, Artificial Sequence
  Description of Artificial Sequence: Synthetic polypeptide
DEEEIRTTNPVATEQYGSVSTANMTMTQGENQG

SEQ ID NO: 58735 - protein, 35 aa, Artificial Sequence
  Description of Artificial Sequence: Synthetic polypeptide
DEEEIRTTNPVATEQYGSVSTANVLGQGEGNNDTE

SEQ ID NO: 58736 - protein, 34 aa, Artificial Sequence
  Description of Artificial Sequence: Synthetic polypeptide
DEEEIRTTNPVATEQYGSVSTANYHQRFGEMFES

SEQ ID NO: 58737 - protein, 33 aa, Artificial Sequence
  Description of Artificial Sequence: Synthetic polypeptide
DEEEIRTTNPVATEQYGSVSTASNQDGPNEQDG

SEQ ID NO: 58738 - protein, 33 aa, Artificial Sequence
  Description of Artificial Sequence: Synthetic polypeptide
DEEEIRTTNPVATEQYGSVSTASNQTGPNEDDM

SEQ ID NO: 58739 - protein, 32 aa, Artificial Sequence
  Description of Artificial Sequence: Synthetic polypeptide
DEEEIRTTNPVATEQYGSVSTDADQQAVELVR

SEQ ID NO: 58740 - protein, 33 aa, Artificial Sequence
  Description of Artificial Sequence: Synthetic polypeptide
DEEEIRTTNPVATEQYGSVSLMTLQRVFQNIEE

SEQ ID NO: 58741 - protein, 34 aa, Artificial Sequence
  Description of Artificial Sequence: Synthetic polypeptide
DEEEIRTTNPVATEQYGSVSTANMNNQGGNGGNI

SEQ ID NO: 58742 - protein, 32 aa, Artificial Sequence
  Description of Artificial Sequence: Synthetic polypeptide
DEEEIRTTNPVATEQYGSVSLTMNSERNEILL

SEQ ID NO: 58743 - protein, 34 aa, Artificial Sequence
  Description of Artificial Sequence: Synthetic polypeptide
DEEEIRTTNPVATEQYGSVSSTTPNGPNRNGNPV

SEQ ID NO: 58744 - protein, 32 aa, Artificial Sequence
  Description of Artificial Sequence: Synthetic polypeptide
DEEEIRTTNPVATEQYGSVSLPLQQTVGVDID

SEQ ID NO: 58745 - protein, 33 aa, Artificial Sequence
  Description of Artificial Sequence: Synthetic polypeptide
DEEEIRTTNPVATEQYGSVSSTTDDQIGGGNNQ

SEQ ID NO: 58746 - protein, 33 aa, Artificial Sequence
  Description of Artificial Sequence: Synthetic polypeptide
DEEEIRTTNPVATEQYGSVSSTTDGQGQGEENE

SEQ ID NO: 58747 - protein, 33 aa, Artificial Sequence
  Description of Artificial Sequence: Synthetic polypeptide
DEEEIRTTNPVATEQYGSVSLTLPQRQGVEEFS

SEQ ID NO: 58748 - protein, 34 aa, Artificial Sequence
  Description of Artificial Sequence: Synthetic polypeptide
DEEEIRTTNPVATEQYGSVSSTTDLQNEGGNVTT

SEQ ID NO: 58749 - protein, 33 aa, Artificial Sequence
  Description of Artificial Sequence: Synthetic polypeptide
DEEEIRTTNPVATEQYGSVSSTTDQNGGNNGQE

SEQ ID NO: 58750 - protein, 35 aa, Artificial Sequence
  Description of Artificial Sequence: Synthetic polypeptide
DEEEIRTTNPVATEQYGSVSSTTINGPQMRNGENG

SEQ ID NO: 58751 - protein, 34 aa, Artificial Sequence
  Description of Artificial Sequence: Synthetic polypeptide
DEEEIRTTNPVATEQYGSVSSTTLGQGIGGNNQG

SEQ ID NO: 58752 - protein, 34 aa, Artificial Sequence
  Description of Artificial Sequence: Synthetic polypeptide
DEEEIRTTNPVATEQYGSVSLTFNGLQLANENQY

SEQ ID NO: 58753 - protein, 35 aa, Artificial Sequence
  Description of Artificial Sequence: Synthetic polypeptide
DEEEIRTTNPVATEQYGSVSSTTNGPQMRNGMNPV

SEQ ID NO: 58754 - protein, 34 aa, Artificial Sequence
  Description of Artificial Sequence: Synthetic polypeptide
DEEEIRTTNPVATEQYGSVSSTTPALPNRNGMNV

SEQ ID NO: 58755 - protein, 34 aa, Artificial Sequence
  Description of Artificial Sequence: Synthetic polypeptide
DEEEIRTTNPVATEQYGSVSSTTNLDPGSGNNDV

SEQ ID NO: 58756 - protein, 33 aa, Artificial Sequence
  Description of Artificial Sequence: Synthetic polypeptide
DEEEIRTTNPVATEQYGSVSSTTPAGNMANGNV

SEQ ID NO: 58757 - protein, 34 aa, Artificial Sequence
  Description of Artificial Sequence: Synthetic polypeptide
DEEEIRTTNPVATEQYGSVSSTTPAGNMRNGMNR

SEQ ID NO: 58758 - protein, 32 aa, Artificial Sequence
  Description of Artificial Sequence: Synthetic polypeptide
DEEEIRTTNPVATEQYGSVSLTANSDVRMMEQ

SEQ ID NO: 58759 - protein, 33 aa, Artificial Sequence
  Description of Artificial Sequence: Synthetic polypeptide
DEEEIRTTNPVATEQYGSVSSTTPAGPNRGMNV

SEQ ID NO: 58760 - protein, 34 aa, Artificial Sequence
  Description of Artificial Sequence: Synthetic polypeptide
DEEEIRTTNPVATEQYGSVSSTTPAGQMRNGNPV

SEQ ID NO: 58761 - protein, 34 aa, Artificial Sequence
  Description of Artificial Sequence: Synthetic polypeptide
DEEEIRTTNPVATEQYGSVSLPPVGLQQRGLVER

SEQ ID NO: 58762 - protein, 32 aa, Artificial Sequence
  Description of Artificial Sequence: Synthetic polypeptide
DEEEIRTTNPVATEQYGSVSLPNLTLGPELVD

SEQ ID NO: 58763 - protein, 34 aa, Artificial Sequence
  Description of Artificial Sequence: Synthetic polypeptide
DEEEIRTTNPVATEQYGSVSSTTPAIQMRNGNPV

SEQ ID NO: 58764 - protein, 34 aa, Artificial Sequence
  Description of Artificial Sequence: Synthetic polypeptide
DEEEIRTTNPVATEQYGSVSSTTPALPNMRGNPV

SEQ ID NO: 58765 - protein, 34 aa, Artificial Sequence
  Description of Artificial Sequence: Synthetic polypeptide
DEEEIRTTNPVATEQYGSVSLTENGLQQEMMNIE

SEQ ID NO: 58766 - protein, 33 aa, Artificial Sequence
  Description of Artificial Sequence: Synthetic polypeptide
DEEEIRTTNPVATEQYGSVSSTEPAGNRNGNPV

SEQ ID NO: 58767 - protein, 34 aa, Artificial Sequence
  Description of Artificial Sequence: Synthetic polypeptide
DEEEIRTTNPVATEQYGSVSSTENGLGGGGNQGT

SEQ ID NO: 58768 - protein, 34 aa, Artificial Sequence
  Description of Artificial Sequence: Synthetic polypeptide
DEEEIRTTNPVATEQYGSVSLTNNQHQERDQILR

SEQ ID NO: 58769 - protein, 32 aa, Artificial Sequence
  Description of Artificial Sequence: Synthetic polypeptide
DEEEIRTTNPVATEQYGSVSMPNLQQTPEIFL

SEQ ID NO: 58770 - protein, 32 aa, Artificial Sequence
  Description of Artificial Sequence: Synthetic polypeptide
DEEEIRTTNPVATEQYGSVSMPNLHQQTPEII

SEQ ID NO: 58771 - protein, 33 aa, Artificial Sequence
  Description of Artificial Sequence: Synthetic polypeptide
DEEEIRTTNPVATEQYGSVSQTNEQVNQMNDFT

SEQ ID NO: 58772 - protein, 34 aa, Artificial Sequence
  Description of Artificial Sequence: Synthetic polypeptide
DEEEIRTTNPVATEQYGSVSMNPLQVRPILEERM

SEQ ID NO: 58773 - protein, 34 aa, Artificial Sequence
  Description of Artificial Sequence: Synthetic polypeptide
DEEEIRTTNPVATEQYGSVSQTNLQPDFGEDQDE

SEQ ID NO: 58774 - protein, 33 aa, Artificial Sequence
  Description of Artificial Sequence: Synthetic polypeptide
DEEEIRTTNPVATEQYGSVSQTNLQPSIEEMVF

SEQ ID NO: 58775 - protein, 34 aa, Artificial Sequence
  Description of Artificial Sequence: Synthetic polypeptide
DEEEIRTTNPVATEQYGSVSQTNLQPTIGEMQLG

SEQ ID NO: 58776 - protein, 33 aa, Artificial Sequence
  Description of Artificial Sequence: Synthetic polypeptide
DEEEIRTTNPVATEQYGSVSQTNQLETSVLVLR

SEQ ID NO: 58777 - protein, 34 aa, Artificial Sequence
  Description of Artificial Sequence: Synthetic polypeptide
DEEEIRTTNPVATEQYGSVSQTNSLIGRGLPVLS

SEQ ID NO: 58778 - protein, 33 aa, Artificial Sequence
  Description of Artificial Sequence: Synthetic polypeptide
DEEEIRTTNPVATEQYGSVSQTNEQQSDPNEPV

SEQ ID NO: 58779 - protein, 33 aa, Artificial Sequence
  Description of Artificial Sequence: Synthetic polypeptide
DEEEIRTTNPVATEQYGSVSQTPLLQPILVERG

SEQ ID NO: 58780 - protein, 34 aa, Artificial Sequence
  Description of Artificial Sequence: Synthetic polypeptide
DEEEIRTTNPVATEQYGSVSQTPNEQPPGEELRG

SEQ ID NO: 58781 - protein, 33 aa, Artificial Sequence
  Description of Artificial Sequence: Synthetic polypeptide
DEEEIRTTNPVATEQYGSVSQTPVLQVPILVER

SEQ ID NO: 58782 - protein, 33 aa, Artificial Sequence
  Description of Artificial Sequence: Synthetic polypeptide
DEEEIRTTNPVATEQYGSVSQTTELQPTNEMQL

SEQ ID NO: 58783 - protein, 33 aa, Artificial Sequence
  Description of Artificial Sequence: Synthetic polypeptide
DEEEIRTTNPVATEQYGSVSQTTLQPTVGEEQL

SEQ ID NO: 58784 - protein, 33 aa, Artificial Sequence
  Description of Artificial Sequence: Synthetic polypeptide
DEEEIRTTNPVATEQYGSVSQTVNEQPVQNDFY

SEQ ID NO: 58785 - protein, 33 aa, Artificial Sequence
  Description of Artificial Sequence: Synthetic polypeptide
DEEEIRTTNPVATEQYGSVSSDNDQQGEGQENN

SEQ ID NO: 58786 - protein, 33 aa, Artificial Sequence
  Description of Artificial Sequence: Synthetic polypeptide
DEEEIRTTNPVATEQYGSVSSDNFQQGEGETNQ

SEQ ID NO: 58787 - protein, 33 aa, Artificial Sequence
  Description of Artificial Sequence: Synthetic polypeptide
DEEEIRTTNPVATEQYGSVSSDNLDDQNEGEGD

SEQ ID NO: 58788 - protein, 33 aa, Artificial Sequence
  Description of Artificial Sequence: Synthetic polypeptide
DEEEIRTTNPVATEQYGSVSSDNLDQFNEGEGQ

SEQ ID NO: 58789 - protein, 33 aa, Artificial Sequence
  Description of Artificial Sequence: Synthetic polypeptide
DEEEIRTTNPVATEQYGSVSQTPMLQEILVERL

SEQ ID NO: 58790 - protein, 33 aa, Artificial Sequence
  Description of Artificial Sequence: Synthetic polypeptide
DEEEIRTTNPVATEQYGSVSSDNLDQNEGEEDD

SEQ ID NO: 58791 - protein, 34 aa, Artificial Sequence
  Description of Artificial Sequence: Synthetic polypeptide
DEEEIRTTNPVATEQYGSVSQTHNFGQPRNVENS

SEQ ID NO: 58792 - protein, 32 aa, Artificial Sequence
  Description of Artificial Sequence: Synthetic polypeptide
DEEEIRTTNPVATEQYGSVSMPTLQGVENNIG

SEQ ID NO: 58793 - protein, 33 aa, Artificial Sequence
  Description of Artificial Sequence: Synthetic polypeptide
DEEEIRTTNPVATEQYGSVSPWFNLIQDSGEEL

SEQ ID NO: 58794 - protein, 33 aa, Artificial Sequence
  Description of Artificial Sequence: Synthetic polypeptide
DEEEIRTTNPVATEQYGSVSPWLNLMEMRLNDT

SEQ ID NO: 58795 - protein, 32 aa, Artificial Sequence
  Description of Artificial Sequence: Synthetic polypeptide
DEEEIRTTNPVATEQYGSVSPWMNNQDSGEEL

SEQ ID NO: 58796 - protein, 33 aa, Artificial Sequence
  Description of Artificial Sequence: Synthetic polypeptide
DEEEIRTTNPVATEQYGSVSPWNLPDETIDNRY

SEQ ID NO: 58797 - protein, 33 aa, Artificial Sequence
  Description of Artificial Sequence: Synthetic polypeptide
DEEEIRTTNPVATEQYGSVSPWNLPQDSGEFEL

SEQ ID NO: 58798 - protein, 33 aa, Artificial Sequence
  Description of Artificial Sequence: Synthetic polypeptide
DEEEIRTTNPVATEQYGSVSPYNEATEGNNSRN

SEQ ID NO: 58799 - protein, 33 aa, Artificial Sequence
  Description of Artificial Sequence: Synthetic polypeptide
DEEEIRTTNPVATEQYGSVSQAPNGLERSVFVR

SEQ ID NO: 58800 - protein, 33 aa, Artificial Sequence
  Description of Artificial Sequence: Synthetic polypeptide
DEEEIRTTNPVATEQYGSVSMTDLQVRTSSSQG

SEQ ID NO: 58801 - protein, 33 aa, Artificial Sequence
  Description of Artificial Sequence: Synthetic polypeptide
DEEEIRTTNPVATEQYGSVSQEPMLQRGEVFIN

SEQ ID NO: 58802 - protein, 35 aa, Artificial Sequence
  Description of Artificial Sequence: Synthetic polypeptide
DEEEIRTTNPVATEQYGSVSQTGNTLQQERNQVNE

SEQ ID NO: 58803 - protein, 32 aa, Artificial Sequence
  Description of Artificial Sequence: Synthetic polypeptide
DEEEIRTTNPVATEQYGSVSQINTVQEFLNLL

SEQ ID NO: 58804 - protein, 33 aa, Artificial Sequence
  Description of Artificial Sequence: Synthetic polypeptide
DEEEIRTTNPVATEQYGSVSQNNLQQEDPNLMG

SEQ ID NO: 58805 - protein, 32 aa, Artificial Sequence
  Description of Artificial Sequence: Synthetic polypeptide
DEEEIRTTNPVATEQYGSVSMTAMNEERLQEH

SEQ ID NO: 58806 - protein, 33 aa, Artificial Sequence
  Description of Artificial Sequence: Synthetic polypeptide
DEEEIRTTNPVATEQYGSVSQPLLQRSGEQEDL

SEQ ID NO: 58807 - protein, 32 aa, Artificial Sequence
  Description of Artificial Sequence: Synthetic polypeptide
DEEEIRTTNPVATEQYGSVSMSTTQRVEELRA

SEQ ID NO: 58808 - protein, 32 aa, Artificial Sequence
  Description of Artificial Sequence: Synthetic polypeptide
DEEEIRTTNPVATEQYGSVSQPNIQQLMLERV

SEQ ID NO: 58809 - protein, 32 aa, Artificial Sequence
  Description of Artificial Sequence: Synthetic polypeptide
DEEEIRTTNPVATEQYGSVSQPNLIAGLVEVQ

SEQ ID NO: 58810 - protein, 33 aa, Artificial Sequence
  Description of Artificial Sequence: Synthetic polypeptide
DEEEIRTTNPVATEQYGSVSMSNLQINNGTETD

SEQ ID NO: 58811 - protein, 33 aa, Artificial Sequence
  Description of Artificial Sequence: Synthetic polypeptide
DEEEIRTTNPVATEQYGSVSQPPNLQQVMLERP

SEQ ID NO: 58812 - protein, 33 aa, Artificial Sequence
  Description of Artificial Sequence: Synthetic polypeptide
DEEEIRTTNPVATEQYGSVSQPVNLQPVNMLEM

SEQ ID NO: 58813 - protein, 33 aa, Artificial Sequence
  Description of Artificial Sequence: Synthetic polypeptide
DEEEIRTTNPVATEQYGSVSQLMLQREDENFGD

SEQ ID NO: 58814 - protein, 33 aa, Artificial Sequence
  Description of Artificial Sequence: Synthetic polypeptide
DEEEIRTTNPVATEQYGSVSSDNLDQNEGEIGA

SEQ ID NO: 58815 - protein, 31 aa, Artificial Sequence
  Description of Artificial Sequence: Synthetic polypeptide
DEEEIRTTNPVATEQYGSVSMNLEEAEETDT

SEQ ID NO: 58816 - protein, 34 aa, Artificial Sequence
  Description of Artificial Sequence: Synthetic polypeptide
DEEEIRTTNPVATEQYGSVSSDNLQQGEGFEENP

SEQ ID NO: 58817 - protein, 33 aa, Artificial Sequence
  Description of Artificial Sequence: Synthetic polypeptide
DEEEIRTTNPVATEQYGSVSSQNIQSSGNNDTN

SEQ ID NO: 58818 - protein, 33 aa, Artificial Sequence
  Description of Artificial Sequence: Synthetic polypeptide
DEEEIRTTNPVATEQYGSVSLTPNNQPLGEDLT

SEQ ID NO: 58819 - protein, 34 aa, Artificial Sequence
  Description of Artificial Sequence: Synthetic polypeptide
DEEEIRTTNPVATEQYGSVSSSTMNGEQTGGGNE

SEQ ID NO: 58820 - protein, 35 aa, Artificial Sequence
  Description of Artificial Sequence: Synthetic polypeptide
DEEEIRTTNPVATEQYGSVSSTCINEPQDREGMNV

SEQ ID NO: 58821 - protein, 35 aa, Artificial Sequence
  Description of Artificial Sequence: Synthetic polypeptide
DEEEIRTTNPVATEQYGSVSSTCINEPQDRNGMNV

SEQ ID NO: 58822 - protein, 33 aa, Artificial Sequence
  Description of Artificial Sequence: Synthetic polypeptide
DEEEIRTTNPVATEQYGSVSSTDANVGGGNEDT

SEQ ID NO: 58823 - protein, 33 aa, Artificial Sequence
  Description of Artificial Sequence: Synthetic polypeptide
DEEEIRTTNPVATEQYGSVSLTPNLQQQLFEMD

SEQ ID NO: 58824 - protein, 33 aa, Artificial Sequence
  Description of Artificial Sequence: Synthetic polypeptide
DEEEIRTTNPVATEQYGSVSSTDDQGQEGGNQL

SEQ ID NO: 58825 - protein, 33 aa, Artificial Sequence
  Description of Artificial Sequence: Synthetic polypeptide
DEEEIRTTNPVATEQYGSVSSTDGQGQENGGNE

SEQ ID NO: 58826 - protein, 33 aa, Artificial Sequence
  Description of Artificial Sequence: Synthetic polypeptide
DEEEIRTTNPVATEQYGSVSSNTQDEFGQGNGG

SEQ ID NO: 58827 - protein, 33 aa, Artificial Sequence
  Description of Artificial Sequence: Synthetic polypeptide
DEEEIRTTNPVATEQYGSVSSTDLITDQGTNGM

SEQ ID NO: 58828 - protein, 35 aa, Artificial Sequence
  Description of Artificial Sequence: Synthetic polypeptide
DEEEIRTTNPVATEQYGSVSLTPNGLQQRALVART

SEQ ID NO: 58829 - protein, 33 aa, Artificial Sequence
  Description of Artificial Sequence: Synthetic polypeptide
DEEEIRTTNPVATEQYGSVSLTNSQVTESNAID

SEQ ID NO: 58830 - protein, 33 aa, Artificial Sequence
  Description of Artificial Sequence: Synthetic polypeptide
DEEEIRTTNPVATEQYGSVSLTNQHQERDQISQ

SEQ ID NO: 58831 - protein, 33 aa, Artificial Sequence
  Description of Artificial Sequence: Synthetic polypeptide
DEEEIRTTNPVATEQYGSVSLTNQHQERDQIMQ

SEQ ID NO: 58832 - protein, 33 aa, Artificial Sequence
  Description of Artificial Sequence: Synthetic polypeptide
DEEEIRTTNPVATEQYGSVSSTDNGQEQEENEQ

SEQ ID NO: 58833 - protein, 34 aa, Artificial Sequence
  Description of Artificial Sequence: Synthetic polypeptide
DEEEIRTTNPVATEQYGSVSSTDNMTQTNGANGT

SEQ ID NO: 58834 - protein, 33 aa, Artificial Sequence
  Description of Artificial Sequence: Synthetic polypeptide
DEEEIRTTNPVATEQYGSVSSTDNNVAEGNEGT

SEQ ID NO: 58835 - protein, 33 aa, Artificial Sequence
  Description of Artificial Sequence: Synthetic polypeptide
DEEEIRTTNPVATEQYGSVSSTDNNVANGNNGT

SEQ ID NO: 58836 - protein, 34 aa, Artificial Sequence
  Description of Artificial Sequence: Synthetic polypeptide
DEEEIRTTNPVATEQYGSVSSTEAIPNQRNGNPH

SEQ ID NO: 58837 - protein, 35 aa, Artificial Sequence
  Description of Artificial Sequence: Synthetic polypeptide
DEEEIRTTNPVATEQYGSVSSTDNGLDQEGEGNNE

SEQ ID NO: 58838 - protein, 32 aa, Artificial Sequence
  Description of Artificial Sequence: Synthetic polypeptide
DEEEIRTTNPVATEQYGSVSSNPMADGSDQRM

SEQ ID NO: 58839 - protein, 32 aa, Artificial Sequence
  Description of Artificial Sequence: Synthetic polypeptide
DEEEIRTTNPVATEQYGSVSSNLMMPRNEEED

SEQ ID NO: 58840 - protein, 33 aa, Artificial Sequence
  Description of Artificial Sequence: Synthetic polypeptide
DEEEIRTTNPVATEQYGSVSLTSQHQERDQIRF

SEQ ID NO: 58841 - protein, 33 aa, Artificial Sequence
  Description of Artificial Sequence: Synthetic polypeptide
DEEEIRTTNPVATEQYGSVSSDTNIGQGQGEES

SEQ ID NO: 58842 - protein, 32 aa, Artificial Sequence
  Description of Artificial Sequence: Synthetic polypeptide
DEEEIRTTNPVATEQYGSVSMNELVIRTAEED

SEQ ID NO: 58843 - protein, 33 aa, Artificial Sequence
  Description of Artificial Sequence: Synthetic polypeptide
DEEEIRTTNPVATEQYGSVSMNDLYQMGMPEID

SEQ ID NO: 58844 - protein, 32 aa, Artificial Sequence
  Description of Artificial Sequence: Synthetic polypeptide
DEEEIRTTNPVATEQYGSVSSEAGPNRNGNPV

SEQ ID NO: 58845 - protein, 31 aa, Artificial Sequence
  Description of Artificial Sequence: Synthetic polypeptide
DEEEIRTTNPVATEQYGSVSMMELIHDNDND

SEQ ID NO: 58846 - protein, 33 aa, Artificial Sequence
  Description of Artificial Sequence: Synthetic polypeptide
DEEEIRTTNPVATEQYGSVSSEPLQYQSGQNEI

SEQ ID NO: 58847 - protein, 31 aa, Artificial Sequence
  Description of Artificial Sequence: Synthetic polypeptide
DEEEIRTTNPVATEQYGSVSSFLTTVGVEIV

SEQ ID NO: 58848 - protein, 33 aa, Artificial Sequence
  Description of Artificial Sequence: Synthetic polypeptide
DEEEIRTTNPVATEQYGSVSMEVEDERGNSDRS

SEQ ID NO: 58849 - protein, 33 aa, Artificial Sequence
  Description of Artificial Sequence: Synthetic polypeptide
DEEEIRTTNPVATEQYGSVSMETNLPETQVDPI

SEQ ID NO: 58850 - protein, 33 aa, Artificial Sequence
  Description of Artificial Sequence: Synthetic polypeptide
DEEEIRTTNPVATEQYGSVSMENVLNRIEDERT

SEQ ID NO: 58851 - protein, 35 aa, Artificial Sequence
  Description of Artificial Sequence: Synthetic polypeptide
DEEEIRTTNPVATEQYGSVSSITGPLNQVRGDNPN

SEQ ID NO: 58852 - protein, 31 aa, Artificial Sequence
  Description of Artificial Sequence: Synthetic polypeptide
DEEEIRTTNPVATEQYGSVSMDNQIRLMELM

SEQ ID NO: 58853 - protein, 32 aa, Artificial Sequence
  Description of Artificial Sequence: Synthetic polypeptide
DEEEIRTTNPVATEQYGSVSSNAHQERFMSIQ

SEQ ID NO: 58854 - protein, 33 aa, Artificial Sequence
  Description of Artificial Sequence: Synthetic polypeptide
DEEEIRTTNPVATEQYGSVSMDDLEQMGGINID

SEQ ID NO: 58855 - protein, 32 aa, Artificial Sequence
  Description of Artificial Sequence: Synthetic polypeptide
DEEEIRTTNPVATEQYGSVSLVPNILQTTDQL

SEQ ID NO: 58856 - protein, 32 aa, Artificial Sequence
  Description of Artificial Sequence: Synthetic polypeptide
DEEEIRTTNPVATEQYGSVSLVPNGLQTPQIE

SEQ ID NO: 58857 - protein, 31 aa, Artificial Sequence
  Description of Artificial Sequence: Synthetic polypeptide
DEEEIRTTNPVATEQYGSVSSNDPSPDGQDE

SEQ ID NO: 58858 - protein, 31 aa, Artificial Sequence
  Description of Artificial Sequence: Synthetic polypeptide
DEEEIRTTNPVATEQYGSVSLTVQSDGEEGV

SEQ ID NO: 58859 - protein, 31 aa, Artificial Sequence
  Description of Artificial Sequence: Synthetic polypeptide
DEEEIRTTNPVATEQYGSVSSNHQENASMDI

SEQ ID NO: 58860 - protein, 31 aa, Artificial Sequence
  Description of Artificial Sequence: Synthetic polypeptide
DEEEIRTTNPVATEQYGSVSSNLDENASQDI

SEQ ID NO: 58861 - protein, 34 aa, Artificial Sequence
  Description of Artificial Sequence: Synthetic polypeptide
DEEEIRTTNPVATEQYGSVSLTSSLQRENLLIEP

SEQ ID NO: 58862 - protein, 31 aa, Artificial Sequence
  Description of Artificial Sequence: Synthetic polypeptide
DEEEIRTTNPVATEQYGSVSTDADYTFENVQ

SEQ ID NO: 58863 - protein, 34 aa, Artificial Sequence
  Description of Artificial Sequence: Synthetic polypeptide
DEEEIRTTNPVATEQYGSVSTDDLPQVRSGSQDD

SEQ ID NO: 58864 - protein, 34 aa, Artificial Sequence
  Description of Artificial Sequence: Synthetic polypeptide
DEEEIRTTNPVATEQYGSVSTDDMQNDVGNSDRQ

SEQ ID NO: 58865 - protein, 31 aa, Artificial Sequence
  Description of Artificial Sequence: Synthetic polypeptide
DEEEIRTTNPVATEQYGSVSTDDPLSLEMHY

SEQ ID NO: 58866 - protein, 34 aa, Artificial Sequence
  Description of Artificial Sequence: Synthetic polypeptide
DEEEIRTTNPVATEQYGSVSTGMGNQGQEGNGEI

SEQ ID NO: 58867 - protein, 33 aa, Artificial Sequence
  Description of Artificial Sequence: Synthetic polypeptide
DEEEIRTTNPVATEQYGSVSTGNGGNGQGNTTD

SEQ ID NO: 58868 - protein, 34 aa, Artificial Sequence
  Description of Artificial Sequence: Synthetic polypeptide
DEEEIRTTNPVATEQYGSVSTGNGGQGNDGNNNS

SEQ ID NO: 58869 - protein, 33 aa, Artificial Sequence
  Description of Artificial Sequence: Synthetic polypeptide
DEEEIRTTNPVATEQYGSVSTGNGGQGNEENND

SEQ ID NO: 58870 - protein, 33 aa, Artificial Sequence
  Description of Artificial Sequence: Synthetic polypeptide
DEEEIRTTNPVATEQYGSVSITNDDQGQGEIGE

SEQ ID NO: 58871 - protein, 33 aa, Artificial Sequence
  Description of Artificial Sequence: Synthetic polypeptide
DEEEIRTTNPVATEQYGSVSTGNGGQGNIGEET

SEQ ID NO: 58872 - protein, 34 aa, Artificial Sequence
  Description of Artificial Sequence: Synthetic polypeptide
DEEEIRTTNPVATEQYGSVSTGNLDDEGDEQNIG

SEQ ID NO: 58873 - protein, 34 aa, Artificial Sequence
  Description of Artificial Sequence: Synthetic polypeptide
DEEEIRTTNPVATEQYGSVSTGNLNVGMGGNNNT

SEQ ID NO: 58874 - protein, 33 aa, Artificial Sequence
  Description of Artificial Sequence: Synthetic polypeptide
DEEEIRTTNPVATEQYGSVSTGNMDNGGGENGE

SEQ ID NO: 58875 - protein, 32 aa, Artificial Sequence
  Description of Artificial Sequence: Synthetic polypeptide
DEEEIRTTNPVATEQYGSVSTGLVQQISVDVS

SEQ ID NO: 58876 - protein, 33 aa, Artificial Sequence
  Description of Artificial Sequence: Synthetic polypeptide
DEEEIRTTNPVATEQYGSVSTGNNGISGQGNTQ

SEQ ID NO: 58877 - protein, 33 aa, Artificial Sequence
  Description of Artificial Sequence: Synthetic polypeptide
DEEEIRTTNPVATEQYGSVSTGNTNGTGGNGNE

SEQ ID NO: 58878 - protein, 34 aa, Artificial Sequence
  Description of Artificial Sequence: Synthetic polypeptide
DEEEIRTTNPVATEQYGSVSTGTLNGQSNEGGNQ

SEQ ID NO: 58879 - protein, 34 aa, Artificial Sequence
  Description of Artificial Sequence: Synthetic polypeptide
DEEEIRTTNPVATEQYGSVSTGTLNGQSNEGGNT

SEQ ID NO: 58880 - protein, 35 aa, Artificial Sequence
  Description of Artificial Sequence: Synthetic polypeptide
DEEEIRTTNPVATEQYGSVSITGNNLQQERNFVNE

SEQ ID NO: 58881 - protein, 34 aa, Artificial Sequence
  Description of Artificial Sequence: Synthetic polypeptide
DEEEIRTTNPVATEQYGSVSTGVPNEQVGSNNDF

SEQ ID NO: 58882 - protein, 32 aa, Artificial Sequence
  Description of Artificial Sequence: Synthetic polypeptide
DEEEIRTTNPVATEQYGSVSTHGLETTDNQNE

SEQ ID NO: 58883 - protein, 33 aa, Artificial Sequence
  Description of Artificial Sequence: Synthetic polypeptide
DEEEIRTTNPVATEQYGSVSTHNGLIETDGVLE

SEQ ID NO: 58884 - protein, 34 aa, Artificial Sequence
  Description of Artificial Sequence: Synthetic polypeptide
DEEEIRTTNPVATEQYGSVSTHNLQSNMNLNPQV

SEQ ID NO: 58885 - protein, 33 aa, Artificial Sequence
  Description of Artificial Sequence: Synthetic polypeptide
DEEEIRTTNPVATEQYGSVSTIAEPNDRNGMNV

SEQ ID NO: 58886 - protein, 32 aa, Artificial Sequence
  Description of Artificial Sequence: Synthetic polypeptide
DEEEIRTTNPVATEQYGSVSTGNREDDDMNTI

SEQ ID NO: 58887 - protein, 33 aa, Artificial Sequence
  Description of Artificial Sequence: Synthetic polypeptide
DEEEIRTTNPVATEQYGSVSTIAGPNDRNGMNV

SEQ ID NO: 58888 - protein, 33 aa, Artificial Sequence
  Description of Artificial Sequence: Synthetic polypeptide
DEEEIRTTNPVATEQYGSVSTGLTGMGGQGNIT

SEQ ID NO: 58889 - protein, 33 aa, Artificial Sequence
  Description of Artificial Sequence: Synthetic polypeptide
DEEEIRTTNPVATEQYGSVSTGLNFNDEGGNEN

SEQ ID NO: 58890 - protein, 34 aa, Artificial Sequence
  Description of Artificial Sequence: Synthetic polypeptide
DEEEIRTTNPVATEQYGSVSTFNGQGTGNGNGNG

SEQ ID NO: 58891 - protein, 34 aa, Artificial Sequence
  Description of Artificial Sequence: Synthetic polypeptide
DEEEIRTTNPVATEQYGSVSTFNLFINNGNNGQG

SEQ ID NO: 58892 - protein, 34 aa, Artificial Sequence
  Description of Artificial Sequence: Synthetic polypeptide
DEEEIRTTNPVATEQYGSVSTFNLNGMEGGNEEE

SEQ ID NO: 58893 - protein, 34 aa, Artificial Sequence
  Description of Artificial Sequence: Synthetic polypeptide
DEEEIRTTNPVATEQYGSVSTFNLVNGMEGGNED

SEQ ID NO: 58894 - protein, 33 aa, Artificial Sequence
  Description of Artificial Sequence: Synthetic polypeptide
DEEEIRTTNPVATEQYGSVSTFNNEEGNGNGNG

SEQ ID NO: 58895 - protein, 33 aa, Artificial Sequence
  Description of Artificial Sequence: Synthetic polypeptide
DEEEIRTTNPVATEQYGSVSTFNQFGGNGNGGG

SEQ ID NO: 58896 - protein, 33 aa, Artificial Sequence
  Description of Artificial Sequence: Synthetic polypeptide
DEEEIRTTNPVATEQYGSVSTFNQSGNGGNGNG

SEQ ID NO: 58897 - protein, 33 aa, Artificial Sequence
  Description of Artificial Sequence: Synthetic polypeptide
DEEEIRTTNPVATEQYGSVSTFNQTEGNGNGEG

SEQ ID NO: 58898 - protein, 33 aa, Artificial Sequence
  Description of Artificial Sequence: Synthetic polypeptide
DEEEIRTTNPVATEQYGSVSTFNQTNGNGNGNG

SEQ ID NO: 58899 - protein, 33 aa, Artificial Sequence
  Description of Artificial Sequence: Synthetic polypeptide
DEEEIRTTNPVATEQYGSVSTGLTFNDGGNNEQ

SEQ ID NO: 58900 - protein, 33 aa, Artificial Sequence
  Description of Artificial Sequence: Synthetic polypeptide
DEEEIRTTNPVATEQYGSVSTFNTGGGNGGEIF

SEQ ID NO: 58901 - protein, 33 aa, Artificial Sequence
  Description of Artificial Sequence: Synthetic polypeptide
DEEEIRTTNPVATEQYGSVSTFVVNRVLENSRM

SEQ ID NO: 58902 - protein, 35 aa, Artificial Sequence
  Description of Artificial Sequence: Synthetic polypeptide
DEEEIRTTNPVATEQYGSVSTGDGNLQVNNGGNEG

SEQ ID NO: 58903 - protein, 34 aa, Artificial Sequence
  Description of Artificial Sequence: Synthetic polypeptide
DEEEIRTTNPVATEQYGSVSTGDLQNVEGGNEDN

SEQ ID NO: 58904 - protein, 32 aa, Artificial Sequence
  Description of Artificial Sequence: Synthetic polypeptide
DEEEIRTTNPVATEQYGSVSTGEHQGSGSDQV

SEQ ID NO: 58905 - protein, 33 aa, Artificial Sequence
  Description of Artificial Sequence: Synthetic polypeptide
DEEEIRTTNPVATEQYGSVSTGGLGQGEGQETG

SEQ ID NO: 58906 - protein, 33 aa, Artificial Sequence
  Description of Artificial Sequence: Synthetic polypeptide
DEEEIRTTNPVATEQYGSVSTGGLGQVGETDVV

SEQ ID NO: 58907 - protein, 33 aa, Artificial Sequence
  Description of Artificial Sequence: Synthetic polypeptide
DEEEIRTTNPVATEQYGSVSTGGQEDEGGETNS

SEQ ID NO: 58908 - protein, 33 aa, Artificial Sequence
  Description of Artificial Sequence: Synthetic polypeptide
DEEEIRTTNPVATEQYGSVSTGGQEDEGGGNNP

SEQ ID NO: 58909 - protein, 32 aa, Artificial Sequence
  Description of Artificial Sequence: Synthetic polypeptide
DEEEIRTTNPVATEQYGSVSTGLEVPLGMTLQ

SEQ ID NO: 58910 - protein, 34 aa, Artificial Sequence
  Description of Artificial Sequence: Synthetic polypeptide
DEEEIRTTNPVATEQYGSVSTFNTQANGNGNGGG

SEQ ID NO: 58911 - protein, 33 aa, Artificial Sequence
  Description of Artificial Sequence: Synthetic polypeptide
DEEEIRTTNPVATEQYGSVSTINDLGEQQMVET

SEQ ID NO: 58912 - protein, 33 aa, Artificial Sequence
  Description of Artificial Sequence: Synthetic polypeptide
DEEEIRTTNPVATEQYGSVSTIYNLQHFDEDQG

SEQ ID NO: 58913 - protein, 34 aa, Artificial Sequence
  Description of Artificial Sequence: Synthetic polypeptide
DEEEIRTTNPVATEQYGSVSITGNDEQNQGTNGD

SEQ ID NO: 58914 - protein, 32 aa, Artificial Sequence
  Description of Artificial Sequence: Synthetic polypeptide
DEEEIRTTNPVATEQYGSVSISLHFRADNQSV

SEQ ID NO: 58915 - protein, 32 aa, Artificial Sequence
  Description of Artificial Sequence: Synthetic polypeptide
DEEEIRTTNPVATEQYGSVSTLWESQQSNNNH

SEQ ID NO: 58916 - protein, 32 aa, Artificial Sequence
  Description of Artificial Sequence: Synthetic polypeptide
DEEEIRTTNPVATEQYGSVSTMDADQYTYDND

SEQ ID NO: 58917 - protein, 33 aa, Artificial Sequence
  Description of Artificial Sequence: Synthetic polypeptide
DEEEIRTTNPVATEQYGSVSTMDDQYTGGNNQG

SEQ ID NO: 58918 - protein, 33 aa, Artificial Sequence
  Description of Artificial Sequence: Synthetic polypeptide
DEEEIRTTNPVATEQYGSVSIQNDLQRQASVLD

SEQ ID NO: 58919 - protein, 33 aa, Artificial Sequence
  Description of Artificial Sequence: Synthetic polypeptide
DEEEIRTTNPVATEQYGSVSIQNDGNQGNGNGE

SEQ ID NO: 58920 - protein, 33 aa, Artificial Sequence
  Description of Artificial Sequence: Synthetic polypeptide
DEEEIRTTNPVATEQYGSVSTMDDQYTIGSENQ

SEQ ID NO: 58921 - protein, 34 aa, Artificial Sequence
  Description of Artificial Sequence: Synthetic polypeptide
DEEEIRTTNPVATEQYGSVSTMDELQQEGQGNFQ

SEQ ID NO: 58922 - protein, 33 aa, Artificial Sequence
  Description of Artificial Sequence: Synthetic polypeptide
DEEEIRTTNPVATEQYGSVSIPNLVPPRQAERG

SEQ ID NO: 58923 - protein, 33 aa, Artificial Sequence
  Description of Artificial Sequence: Synthetic polypeptide
DEEEIRTTNPVATEQYGSVSTLTLVQEGLIDEN

SEQ ID NO: 58924 - protein, 34 aa, Artificial Sequence
  Description of Artificial Sequence: Synthetic polypeptide
DEEEIRTTNPVATEQYGSVSTMDGLEQDEGGNNI

SEQ ID NO: 58925 - protein, 34 aa, Artificial Sequence
  Description of Artificial Sequence: Synthetic polypeptide
DEEEIRTTNPVATEQYGSVSTMDGLEQGIGENTQ

SEQ ID NO: 58926 - protein, 33 aa, Artificial Sequence
  Description of Artificial Sequence: Synthetic polypeptide
DEEEIRTTNPVATEQYGSVSTMDGNNEFTGNED

SEQ ID NO: 58927 - protein, 32 aa, Artificial Sequence
  Description of Artificial Sequence: Synthetic polypeptide
DEEEIRTTNPVATEQYGSVSTMDIHQESSNEV

SEQ ID NO: 58928 - protein, 32 aa, Artificial Sequence
  Description of Artificial Sequence: Synthetic polypeptide
DEEEIRTTNPVATEQYGSVSTMDIVTLGNQQD

SEQ ID NO: 58929 - protein, 34 aa, Artificial Sequence
  Description of Artificial Sequence: Synthetic polypeptide
DEEEIRTTNPVATEQYGSVSTMDLGVGGQQTGNQ

SEQ ID NO: 58930 - protein, 33 aa, Artificial Sequence
  Description of Artificial Sequence: Synthetic polypeptide
DEEEIRTTNPVATEQYGSVSTMDLLQESMEERL

SEQ ID NO: 58931 - protein, 33 aa, Artificial Sequence
  Description of Artificial Sequence: Synthetic polypeptide
DEEEIRTTNPVATEQYGSVSTMDLPNEDGGNTN

SEQ ID NO: 58932 - protein, 33 aa, Artificial Sequence
  Description of Artificial Sequence: Synthetic polypeptide
DEEEIRTTNPVATEQYGSVSTMDNFNEGGNDQQ

SEQ ID NO: 58933 - protein, 33 aa, Artificial Sequence
  Description of Artificial Sequence: Synthetic polypeptide
DEEEIRTTNPVATEQYGSVSTMDNFNGGGNDGE

SEQ ID NO: 58934 - protein, 33 aa, Artificial Sequence
  Description of Artificial Sequence: Synthetic polypeptide
DEEEIRTTNPVATEQYGSVSTMDGLEQGGGETI

SEQ ID NO: 58935 - protein, 33 aa, Artificial Sequence
  Description of Artificial Sequence: Synthetic polypeptide
DEEEIRTTNPVATEQYGSVSTLPLDTGIGENNI

SEQ ID NO: 58936 - protein, 33 aa, Artificial Sequence
  Description of Artificial Sequence: Synthetic polypeptide
DEEEIRTTNPVATEQYGSVSTLNQSDTGGNQGN

SEQ ID NO: 58937 - protein, 33 aa, Artificial Sequence
  Description of Artificial Sequence: Synthetic polypeptide
DEEEIRTTNPVATEQYGSVSTLNQDQEQTVNPG

SEQ ID NO: 58938 - protein, 34 aa, Artificial Sequence
  Description of Artificial Sequence: Synthetic polypeptide
DEEEIRTTNPVATEQYGSVSITGNDEMQGNGNNG

SEQ ID NO: 58939 - protein, 31 aa, Artificial Sequence
  Description of Artificial Sequence: Synthetic polypeptide
DEEEIRTTNPVATEQYGSVSTLDHDELELRD

SEQ ID NO: 58940 - protein, 33 aa, Artificial Sequence
  Description of Artificial Sequence: Synthetic polypeptide
DEEEIRTTNPVATEQYGSVSTLDLTQRSQIIFD

SEQ ID NO: 58941 - protein, 33 aa, Artificial Sequence
  Description of Artificial Sequence: Synthetic polypeptide
DEEEIRTTNPVATEQYGSVSTLDQSGQSNNNGQ

SEQ ID NO: 58942 - protein, 33 aa, Artificial Sequence
  Description of Artificial Sequence: Synthetic polypeptide
DEEEIRTTNPVATEQYGSVSTLELQIRDTEEGT

SEQ ID NO: 58943 - protein, 33 aa, Artificial Sequence
  Description of Artificial Sequence: Synthetic polypeptide
DEEEIRTTNPVATEQYGSVSTLGLDGGNIQNDG

SEQ ID NO: 58944 - protein, 33 aa, Artificial Sequence
  Description of Artificial Sequence: Synthetic polypeptide
DEEEIRTTNPVATEQYGSVSTLGLELIGGNQTD

SEQ ID NO: 58945 - protein, 33 aa, Artificial Sequence
  Description of Artificial Sequence: Synthetic polypeptide
DEEEIRTTNPVATEQYGSVSTLGLQNEMGETTT

SEQ ID NO: 58946 - protein, 31 aa, Artificial Sequence
  Description of Artificial Sequence: Synthetic polypeptide
DEEEIRTTNPVATEQYGSVSTLINDMTAIDN

SEQ ID NO: 58947 - protein, 33 aa, Artificial Sequence
  Description of Artificial Sequence: Synthetic polypeptide
DEEEIRTTNPVATEQYGSVSTLLDVNRDGEVGT

SEQ ID NO: 58948 - protein, 33 aa, Artificial Sequence
  Description of Artificial Sequence: Synthetic polypeptide
DEEEIRTTNPVATEQYGSVSTLLNQNEGMGETT

SEQ ID NO: 58949 - protein, 32 aa, Artificial Sequence
  Description of Artificial Sequence: Synthetic polypeptide
DEEEIRTTNPVATEQYGSVSTLLQDLETDEVV

SEQ ID NO: 58950 - protein, 33 aa, Artificial Sequence
  Description of Artificial Sequence: Synthetic polypeptide
DEEEIRTTNPVATEQYGSVSTLLQGVGMEEETT

SEQ ID NO: 58951 - protein, 33 aa, Artificial Sequence
  Description of Artificial Sequence: Synthetic polypeptide
DEEEIRTTNPVATEQYGSVSITEDAIQEDSNRM

SEQ ID NO: 58952 - protein, 33 aa, Artificial Sequence
  Description of Artificial Sequence: Synthetic polypeptide
DEEEIRTTNPVATEQYGSVSTLLSQTQQNEPQD

SEQ ID NO: 58953 - protein, 34 aa, Artificial Sequence
  Description of Artificial Sequence: Synthetic polypeptide
DEEEIRTTNPVATEQYGSVSITDNHTNAMGSNAR

SEQ ID NO: 58954 - protein, 34 aa, Artificial Sequence
  Description of Artificial Sequence: Synthetic polypeptide
DEEEIRTTNPVATEQYGSVSITDNDEQGNEGTNP

SEQ ID NO: 58955 - protein, 33 aa, Artificial Sequence
  Description of Artificial Sequence: Synthetic polypeptide
DEEEIRTTNPVATEQYGSVSITDDEQNQGTNGD

SEQ ID NO: 58956 - protein, 34 aa, Artificial Sequence
  Description of Artificial Sequence: Synthetic polypeptide
DEEEIRTTNPVATEQYGSVSTLNDVQGQYTQNRE

SEQ ID NO: 58957 - protein, 33 aa, Artificial Sequence
  Description of Artificial Sequence: Synthetic polypeptide
DEEEIRTTNPVATEQYGSVSISTLQDSGMGNIQ

SEQ ID NO: 58958 - protein, 33 aa, Artificial Sequence
  Description of Artificial Sequence: Synthetic polypeptide
DEEEIRTTNPVATEQYGSVSTLNNIDDEGANIQ

SEQ ID NO: 58959 - protein, 33 aa, Artificial Sequence
  Description of Artificial Sequence: Synthetic polypeptide
DEEEIRTTNPVATEQYGSVSTFNENAGNGNGNG

SEQ ID NO: 58960 - protein, 34 aa, Artificial Sequence
  Description of Artificial Sequence: Synthetic polypeptide
DEEEIRTTNPVATEQYGSVSMTENQDQRDGGDGI

SEQ ID NO: 58961 - protein, 33 aa, Artificial Sequence
  Description of Artificial Sequence: Synthetic polypeptide
DEEEIRTTNPVATEQYGSVSTFLNNRMEENNSD

SEQ ID NO: 58962 - protein, 33 aa, Artificial Sequence
  Description of Artificial Sequence: Synthetic polypeptide
DEEEIRTTNPVATEQYGSVSTFGQAGENGNGNG

SEQ ID NO: 58963 - protein, 33 aa, Artificial Sequence
  Description of Artificial Sequence: Synthetic polypeptide
DEEEIRTTNPVATEQYGSVSTDNGIQEEGGGII

SEQ ID NO: 58964 - protein, 35 aa, Artificial Sequence
  Description of Artificial Sequence: Synthetic polypeptide
DEEEIRTTNPVATEQYGSVSTDNGLDQEGDGNNGD

SEQ ID NO: 58965 - protein, 35 aa, Artificial Sequence
  Description of Artificial Sequence: Synthetic polypeptide
DEEEIRTTNPVATEQYGSVSTDNGLDQEGGNNQEQ

SEQ ID NO: 58966 - protein, 35 aa, Artificial Sequence
  Description of Artificial Sequence: Synthetic polypeptide
DEEEIRTTNPVATEQYGSVSTDNGLDQEVGNNDGT

SEQ ID NO: 58967 - protein, 34 aa, Artificial Sequence
  Description of Artificial Sequence: Synthetic polypeptide
DEEEIRTTNPVATEQYGSVSTDNGLDQGEDENDD

SEQ ID NO: 58968 - protein, 34 aa, Artificial Sequence
  Description of Artificial Sequence: Synthetic polypeptide
DEEEIRTTNPVATEQYGSVSTDNGLEEMGGNNTI

SEQ ID NO: 58969 - protein, 34 aa, Artificial Sequence
  Description of Artificial Sequence: Synthetic polypeptide
DEEEIRTTNPVATEQYGSVSTDNGLEGEDGGNTN

SEQ ID NO: 58970 - protein, 35 aa, Artificial Sequence
  Description of Artificial Sequence: Synthetic polypeptide
DEEEIRTTNPVATEQYGSVSTDNGLGQEGENNTIN

SEQ ID NO: 58971 - protein, 34 aa, Artificial Sequence
  Description of Artificial Sequence: Synthetic polypeptide
DEEEIRTTNPVATEQYGSVSTDNGMDQEEFGNNS

SEQ ID NO: 58972 - protein, 34 aa, Artificial Sequence
  Description of Artificial Sequence: Synthetic polypeptide
DEEEIRTTNPVATEQYGSVSTDNGFGQENIGNGG

SEQ ID NO: 58973 - protein, 33 aa, Artificial Sequence
  Description of Artificial Sequence: Synthetic polypeptide
DEEEIRTTNPVATEQYGSVSTDNGPTGEGGNEG

SEQ ID NO: 58974 - protein, 34 aa, Artificial Sequence
  Description of Artificial Sequence: Synthetic polypeptide
DEEEIRTTNPVATEQYGSVSTDNGVEQEGGENGD

SEQ ID NO: 58975 - protein, 32 aa, Artificial Sequence
  Description of Artificial Sequence: Synthetic polypeptide
DEEEIRTTNPVATEQYGSVSLALQQEGEATTQ

SEQ ID NO: 58976 - protein, 35 aa, Artificial Sequence
  Description of Artificial Sequence: Synthetic polypeptide
DEEEIRTTNPVATEQYGSVSTDNLGPQAGDGNESF

SEQ ID NO: 58977 - protein, 33 aa, Artificial Sequence
  Description of Artificial Sequence: Synthetic polypeptide
DEEEIRTTNPVATEQYGSVSTDNLQPPIVQAIL

SEQ ID NO: 58978 - protein, 33 aa, Artificial Sequence
  Description of Artificial Sequence: Synthetic polypeptide
DEEEIRTTNPVATEQYGSVSTDNMDTGEGGNEE

SEQ ID NO: 58979 - protein, 33 aa, Artificial Sequence
  Description of Artificial Sequence: Synthetic polypeptide
DEEEIRTTNPVATEQYGSVSTDNMIQGQGTFVG

SEQ ID NO: 58980 - protein, 34 aa, Artificial Sequence
  Description of Artificial Sequence: Synthetic polypeptide
DEEEIRTTNPVATEQYGSVSTDNMIQTGDGNEND

SEQ ID NO: 58981 - protein, 34 aa, Artificial Sequence
  Description of Artificial Sequence: Synthetic polypeptide
DEEEIRTTNPVATEQYGSVSTDNMQDQNIGNDQG

SEQ ID NO: 58982 - protein, 34 aa, Artificial Sequence
  Description of Artificial Sequence: Synthetic polypeptide
DEEEIRTTNPVATEQYGSVSTDNMQGQNIGENGD

SEQ ID NO: 58983 - protein, 34 aa, Artificial Sequence
  Description of Artificial Sequence: Synthetic polypeptide
DEEEIRTTNPVATEQYGSVSTDNGQSTGGENGQG

SEQ ID NO: 58984 - protein, 33 aa, Artificial Sequence
  Description of Artificial Sequence: Synthetic polypeptide
DEEEIRTTNPVATEQYGSVSIWNLQRVTEAQVD

SEQ ID NO: 58985 - protein, 32 aa, Artificial Sequence
  Description of Artificial Sequence: Synthetic polypeptide
DEEEIRTTNPVATEQYGSVSLDNQQLIVENQT

SEQ ID NO: 58986 - protein, 33 aa, Artificial Sequence
  Description of Artificial Sequence: Synthetic polypeptide
DEEEIRTTNPVATEQYGSVSTDNDLTARELEHN

SEQ ID NO: 58987 - protein, 32 aa, Artificial Sequence
  Description of Artificial Sequence: Synthetic polypeptide
DEEEIRTTNPVATEQYGSVSTDDQQLVSEMHR

SEQ ID NO: 58988 - protein, 33 aa, Artificial Sequence
  Description of Artificial Sequence: Synthetic polypeptide
DEEEIRTTNPVATEQYGSVSTDDQSQDIGNGNT

SEQ ID NO: 58989 - protein, 32 aa, Artificial Sequence
  Description of Artificial Sequence: Synthetic polypeptide
DEEEIRTTNPVATEQYGSVSTDDTAGVEEGRL

SEQ ID NO: 58990 - protein, 30 aa, Artificial Sequence
  Description of Artificial Sequence: Synthetic polypeptide
DEEEIRTTNPVATEQYGSVSTDDTAVEEGF

SEQ ID NO: 58991 - protein, 33 aa, Artificial Sequence
  Description of Artificial Sequence: Synthetic polypeptide
DEEEIRTTNPVATEQYGSVSTDEDFQGNNIERD

SEQ ID NO: 58992 - protein, 33 aa, Artificial Sequence
  Description of Artificial Sequence: Synthetic polypeptide
DEEEIRTTNPVATEQYGSVSTDGDDQNGEGGND

SEQ ID NO: 58993 - protein, 32 aa, Artificial Sequence
  Description of Artificial Sequence: Synthetic polypeptide
DEEEIRTTNPVATEQYGSVSTDGNMNEGETET

SEQ ID NO: 58994 - protein, 33 aa, Artificial Sequence
  Description of Artificial Sequence: Synthetic polypeptide
DEEEIRTTNPVATEQYGSVSTDGVEQEEGGGND

SEQ ID NO: 58995 - protein, 32 aa, Artificial Sequence
  Description of Artificial Sequence: Synthetic polypeptide
DEEEIRTTNPVATEQYGSVSTDGVGNLEGFGD

SEQ ID NO: 58996 - protein, 34 aa, Artificial Sequence
  Description of Artificial Sequence: Synthetic polypeptide
DEEEIRTTNPVATEQYGSVSTDNEGGQNQGNEEI

SEQ ID NO: 58997 - protein, 32 aa, Artificial Sequence
  Description of Artificial Sequence: Synthetic polypeptide
DEEEIRTTNPVATEQYGSVSTDHDQQDDEEKR

SEQ ID NO: 58998 - protein, 34 aa, Artificial Sequence
  Description of Artificial Sequence: Synthetic polypeptide
DEEEIRTTNPVATEQYGSVSLLPNSLQEFGPELR

SEQ ID NO: 58999 - protein, 34 aa, Artificial Sequence
  Description of Artificial Sequence: Synthetic polypeptide
DEEEIRTTNPVATEQYGSVSLLNLQARDGVEEFV

SEQ ID NO: 59000 - protein, 32 aa, Artificial Sequence
  Description of Artificial Sequence: Synthetic polypeptide
DEEEIRTTNPVATEQYGSVSTDLDQQVSDEEF

SEQ ID NO: 59001 - protein, 33 aa, Artificial Sequence
  Description of Artificial Sequence: Synthetic polypeptide
DEEEIRTTNPVATEQYGSVSLIVSLINSDGNRD

SEQ ID NO: 59002 - protein, 33 aa, Artificial Sequence
  Description of Artificial Sequence: Synthetic polypeptide
DEEEIRTTNPVATEQYGSVSTDLDTPNILEDRF

SEQ ID NO: 59003 - protein, 34 aa, Artificial Sequence
  Description of Artificial Sequence: Synthetic polypeptide
DEEEIRTTNPVATEQYGSVSTDLEQPGNGIMDNG

SEQ ID NO: 59004 - protein, 31 aa, Artificial Sequence
  Description of Artificial Sequence: Synthetic polypeptide
DEEEIRTTNPVATEQYGSVSLGTLEGSNEEQ

SEQ ID NO: 59005 - protein, 32 aa, Artificial Sequence
  Description of Artificial Sequence: Synthetic polypeptide
DEEEIRTTNPVATEQYGSVSLGTEEAGGNEVQ

SEQ ID NO: 59006 - protein, 33 aa, Artificial Sequence
  Description of Artificial Sequence: Synthetic polypeptide
DEEEIRTTNPVATEQYGSVSTDLQTTQMENMQE

SEQ ID NO: 59007 - protein, 30 aa, Artificial Sequence
  Description of Artificial Sequence: Synthetic polypeptide
DEEEIRTTNPVATEQYGSVSTDIITESSEQ

SEQ ID NO: 59008 - protein, 34 aa, Artificial Sequence
  Description of Artificial Sequence: Synthetic polypeptide
DEEEIRTTNPVATEQYGSVSTDNMQGQNNIGNIG

SEQ ID NO: 59009 - protein, 34 aa, Artificial Sequence
  Description of Artificial Sequence: Synthetic polypeptide
DEEEIRTTNPVATEQYGSVSTDNMQGQQNIGNGE

SEQ ID NO: 59010 - protein, 34 aa, Artificial Sequence
  Description of Artificial Sequence: Synthetic polypeptide
DEEEIRTTNPVATEQYGSVSTDNMQNQNIGDNDD

SEQ ID NO: 59011 - protein, 32 aa, Artificial Sequence
  Description of Artificial Sequence: Synthetic polypeptide
DEEEIRTTNPVATEQYGSVSTENDHTARSLEH

SEQ ID NO: 59012 - protein, 34 aa, Artificial Sequence
  Description of Artificial Sequence: Synthetic polypeptide
DEEEIRTTNPVATEQYGSVSTENDLQASAISEQR

SEQ ID NO: 59013 - protein, 34 aa, Artificial Sequence
  Description of Artificial Sequence: Synthetic polypeptide
DEEEIRTTNPVATEQYGSVSTENDLTDERGQFPQ

SEQ ID NO: 59014 - protein, 33 aa, Artificial Sequence
  Description of Artificial Sequence: Synthetic polypeptide
DEEEIRTTNPVATEQYGSVSTENDLTRILDQDI

SEQ ID NO: 59015 - protein, 32 aa, Artificial Sequence
  Description of Artificial Sequence: Synthetic polypeptide
DEEEIRTTNPVATEQYGSVSTENDPGAQINQE

SEQ ID NO: 59016 - protein, 32 aa, Artificial Sequence
  Description of Artificial Sequence: Synthetic polypeptide
DEEEIRTTNPVATEQYGSVSTENDPQVVEQQI

SEQ ID NO: 59017 - protein, 34 aa, Artificial Sequence
  Description of Artificial Sequence: Synthetic polypeptide
DEEEIRTTNPVATEQYGSVSTENDTQAGEGLESR

SEQ ID NO: 59018 - protein, 34 aa, Artificial Sequence
  Description of Artificial Sequence: Synthetic polypeptide
DEEEIRTTNPVATEQYGSVSTENGDAPQGGNEEH

SEQ ID NO: 59019 - protein, 34 aa, Artificial Sequence
  Description of Artificial Sequence: Synthetic polypeptide
DEEEIRTTNPVATEQYGSVSITNLTFNDGGNDEQ

SEQ ID NO: 59020 - protein, 32 aa, Artificial Sequence
  Description of Artificial Sequence: Synthetic polypeptide
DEEEIRTTNPVATEQYGSVSTENDDQDPSLPV

SEQ ID NO: 59021 - protein, 34 aa, Artificial Sequence
  Description of Artificial Sequence: Synthetic polypeptide
DEEEIRTTNPVATEQYGSVSTENGPNMRNGMNPV

SEQ ID NO: 59022 - protein, 33 aa, Artificial Sequence
  Description of Artificial Sequence: Synthetic polypeptide
DEEEIRTTNPVATEQYGSVSTENMTDEEGGNET

SEQ ID NO: 59023 - protein, 33 aa, Artificial Sequence
  Description of Artificial Sequence: Synthetic polypeptide
DEEEIRTTNPVATEQYGSVSTENMTMEEGGENE

SEQ ID NO: 59024 - protein, 34 aa, Artificial Sequence
  Description of Artificial Sequence: Synthetic polypeptide
DEEEIRTTNPVATEQYGSVSTENNDPQSGQNHES

SEQ ID NO: 59025 - protein, 32 aa, Artificial Sequence
  Description of Artificial Sequence: Synthetic polypeptide
DEEEIRTTNPVATEQYGSVSTEPDLVENNSQV

SEQ ID NO: 59026 - protein, 33 aa, Artificial Sequence
  Description of Artificial Sequence: Synthetic polypeptide
DEEEIRTTNPVATEQYGSVSTESDPQGTGNIQY

SEQ ID NO: 59027 - protein, 33 aa, Artificial Sequence
  Description of Artificial Sequence: Synthetic polypeptide
DEEEIRTTNPVATEQYGSVSTEVNQDTLGSDMR

SEQ ID NO: 59028 - protein, 33 aa, Artificial Sequence
  Description of Artificial Sequence: Synthetic polypeptide
DEEEIRTTNPVATEQYGSVSTFDGQDGNGNGNG

SEQ ID NO: 59029 - protein, 33 aa, Artificial Sequence
  Description of Artificial Sequence: Synthetic polypeptide
DEEEIRTTNPVATEQYGSVSTFDLFNGGGNNQG

SEQ ID NO: 59030 - protein, 32 aa, Artificial Sequence
  Description of Artificial Sequence: Synthetic polypeptide
DEEEIRTTNPVATEQYGSVSTFGFGGNGNQQD

SEQ ID NO: 59031 - protein, 33 aa, Artificial Sequence
  Description of Artificial Sequence: Synthetic polypeptide
DEEEIRTTNPVATEQYGSVSTENMTDEEGGNEG

SEQ ID NO: 59032 - protein, 34 aa, Artificial Sequence
  Description of Artificial Sequence: Synthetic polypeptide
DEEEIRTTNPVATEQYGSVSTEMNTLTVRGVEMN

SEQ ID NO: 59033 - protein, 33 aa, Artificial Sequence
  Description of Artificial Sequence: Synthetic polypeptide
DEEEIRTTNPVATEQYGSVSTEGDLTQSYNQEE

SEQ ID NO: 59034 - protein, 34 aa, Artificial Sequence
  Description of Artificial Sequence: Synthetic polypeptide
DEEEIRTTNPVATEQYGSVSTEGDLQQSGNQEDD

SEQ ID NO: 59035 - protein, 33 aa, Artificial Sequence
  Description of Artificial Sequence: Synthetic polypeptide
DEEEIRTTNPVATEQYGSVSTDNMQQNIGEGED

SEQ ID NO: 59036 - protein, 34 aa, Artificial Sequence
  Description of Artificial Sequence: Synthetic polypeptide
DEEEIRTTNPVATEQYGSVSTDNMQQNIGGNDPE

SEQ ID NO: 59037 - protein, 34 aa, Artificial Sequence
  Description of Artificial Sequence: Synthetic polypeptide
DEEEIRTTNPVATEQYGSVSTDNMQQNNIGNDDE

SEQ ID NO: 59038 - protein, 32 aa, Artificial Sequence
  Description of Artificial Sequence: Synthetic polypeptide
DEEEIRTTNPVATEQYGSVSITTNTERVTELQ

SEQ ID NO: 59039 - protein, 34 aa, Artificial Sequence
  Description of Artificial Sequence: Synthetic polypeptide
DEEEIRTTNPVATEQYGSVSTDNSNEQFEGGNEI

SEQ ID NO: 59040 - protein, 34 aa, Artificial Sequence
  Description of Artificial Sequence: Synthetic polypeptide
DEEEIRTTNPVATEQYGSVSTDPDLTFEGGNNRN

SEQ ID NO: 59041 - protein, 31 aa, Artificial Sequence
  Description of Artificial Sequence: Synthetic polypeptide
DEEEIRTTNPVATEQYGSVSTDPLAHDSIFQ

SEQ ID NO: 59042 - protein, 33 aa, Artificial Sequence
  Description of Artificial Sequence: Synthetic polypeptide
DEEEIRTTNPVATEQYGSVSTDPQVREGDEQIE

SEQ ID NO: 59043 - protein, 34 aa, Artificial Sequence
  Description of Artificial Sequence: Synthetic polypeptide
DEEEIRTTNPVATEQYGSVSTDQDLGQGEGGENG

SEQ ID NO: 59044 - protein, 34 aa, Artificial Sequence
  Description of Artificial Sequence: Synthetic polypeptide
DEEEIRTTNPVATEQYGSVSITQNQLQIFQEERE

SEQ ID NO: 59045 - protein, 34 aa, Artificial Sequence
  Description of Artificial Sequence: Synthetic polypeptide
DEEEIRTTNPVATEQYGSVSTDQVLQFEFGGNQG

SEQ ID NO: 59046 - protein, 32 aa, Artificial Sequence
  Description of Artificial Sequence: Synthetic polypeptide
DEEEIRTTNPVATEQYGSVSTDTGDEGEGGNN

SEQ ID NO: 59047 - protein, 34 aa, Artificial Sequence
  Description of Artificial Sequence: Synthetic polypeptide
DEEEIRTTNPVATEQYGSVSITPNLLQEQVETRQ

SEQ ID NO: 59048 - protein, 33 aa, Artificial Sequence
  Description of Artificial Sequence: Synthetic polypeptide
DEEEIRTTNPVATEQYGSVSITPNLLIDQTERQ

SEQ ID NO: 59049 - protein, 33 aa, Artificial Sequence
  Description of Artificial Sequence: Synthetic polypeptide
DEEEIRTTNPVATEQYGSVSTDTLDESGQDIRF

SEQ ID NO: 59050 - protein, 33 aa, Artificial Sequence
  Description of Artificial Sequence: Synthetic polypeptide
DEEEIRTTNPVATEQYGSVSTDVLQERMSSQQM

SEQ ID NO: 59051 - protein, 33 aa, Artificial Sequence
  Description of Artificial Sequence: Synthetic polypeptide
DEEEIRTTNPVATEQYGSVSTEAGPNMRNGMNH

SEQ ID NO: 59052 - protein, 33 aa, Artificial Sequence
  Description of Artificial Sequence: Synthetic polypeptide
DEEEIRTTNPVATEQYGSVSTEAGPNMRNGMNV

SEQ ID NO: 59053 - protein, 32 aa, Artificial Sequence
  Description of Artificial Sequence: Synthetic polypeptide
DEEEIRTTNPVATEQYGSVSTEDGNHADGEQS

SEQ ID NO: 59054 - protein, 32 aa, Artificial Sequence
  Description of Artificial Sequence: Synthetic polypeptide
DEEEIRTTNPVATEQYGSVSTEFDQMREEVEL

SEQ ID NO: 59055 - protein, 34 aa, Artificial Sequence
  Description of Artificial Sequence: Synthetic polypeptide
DEEEIRTTNPVATEQYGSVSTEGDLMQSGNQEET

SEQ ID NO: 59056 - protein, 32 aa, Artificial Sequence
  Description of Artificial Sequence: Synthetic polypeptide
DEEEIRTTNPVATEQYGSVSTFLNNREEVSSD

SEQ ID NO: 59057 - protein, 34 aa, Artificial Sequence
  Description of Artificial Sequence: Synthetic polypeptide
DEEEIRTTNPVATEQYGSVSPWDNLPQRNSDIRG

SEQ ID NO: 59058 - protein, 32 aa, Artificial Sequence
  Description of Artificial Sequence: Synthetic polypeptide
DEEEIRTTNPVATEQYGSVSMTGLMIINNEQL

SEQ ID NO: 59059 - protein, 31 aa, Artificial Sequence
  Description of Artificial Sequence: Synthetic polypeptide
DEEEIRTTNPVATEQYGSVSPWDLERNPVSE

SEQ ID NO: 59060 - protein, 34 aa, Artificial Sequence
  Description of Artificial Sequence: Synthetic polypeptide
DEEEIRTTNPVATEQYGSVSNTDNMDQNGGTTNV

SEQ ID NO: 59061 - protein, 34 aa, Artificial Sequence
  Description of Artificial Sequence: Synthetic polypeptide
DEEEIRTTNPVATEQYGSVSNTDNMDQGNGTTND

SEQ ID NO: 59062 - protein, 33 aa, Artificial Sequence
  Description of Artificial Sequence: Synthetic polypeptide
DEEEIRTTNPVATEQYGSVSNTDNFNIGGNEDT

SEQ ID NO: 59063 - protein, 33 aa, Artificial Sequence
  Description of Artificial Sequence: Synthetic polypeptide
DEEEIRTTNPVATEQYGSVSNTDNDLYARELEE

SEQ ID NO: 59064 - protein, 34 aa, Artificial Sequence
  Description of Artificial Sequence: Synthetic polypeptide
DEEEIRTTNPVATEQYGSVSNTDNDLNNIGGNID

SEQ ID NO: 59065 - protein, 33 aa, Artificial Sequence
  Description of Artificial Sequence: Synthetic polypeptide
DEEEIRTTNPVATEQYGSVSPNSNLTQLTGVEE

SEQ ID NO: 59066 - protein, 32 aa, Artificial Sequence
  Description of Artificial Sequence: Synthetic polypeptide
DEEEIRTTNPVATEQYGSVSPPPQVIAGNELD

SEQ ID NO: 59067 - protein, 33 aa, Artificial Sequence
  Description of Artificial Sequence: Synthetic polypeptide
DEEEIRTTNPVATEQYGSVSNTDGQDIIGENNQ

SEQ ID NO: 59068 - protein, 34 aa, Artificial Sequence
  Description of Artificial Sequence: Synthetic polypeptide
DEEEIRTTNPVATEQYGSVSPPYTNEQRPVNQNP

SEQ ID NO: 59069 - protein, 33 aa, Artificial Sequence
  Description of Artificial Sequence: Synthetic polypeptide
DEEEIRTTNPVATEQYGSVSNTDNMENIGGNND

SEQ ID NO: 59070 - protein, 33 aa, Artificial Sequence
  Description of Artificial Sequence: Synthetic polypeptide
DEEEIRTTNPVATEQYGSVSPQLQAERIINEED

SEQ ID NO: 59071 - protein, 31 aa, Artificial Sequence
  Description of Artificial Sequence: Synthetic polypeptide
DEEEIRTTNPVATEQYGSVSPSGLNVNNVVD

SEQ ID NO: 59072 - protein, 32 aa, Artificial Sequence
  Description of Artificial Sequence: Synthetic polypeptide
DEEEIRTTNPVATEQYGSVSPSNIEVVDNDRI

SEQ ID NO: 59073 - protein, 32 aa, Artificial Sequence
  Description of Artificial Sequence: Synthetic polypeptide
DEEEIRTTNPVATEQYGSVSPSNLQSMTLMPN

SEQ ID NO: 59074 - protein, 33 aa, Artificial Sequence
  Description of Artificial Sequence: Synthetic polypeptide
DEEEIRTTNPVATEQYGSVSPSNMLQILLDNVQ

SEQ ID NO: 59075 - protein, 33 aa, Artificial Sequence
  Description of Artificial Sequence: Synthetic polypeptide
DEEEIRTTNPVATEQYGSVSPSNYEQTGEENVM

SEQ ID NO: 59076 - protein, 34 aa, Artificial Sequence
  Description of Artificial Sequence: Synthetic polypeptide
DEEEIRTTNPVATEQYGSVSPTAHVIRNGVANRN

SEQ ID NO: 59077 - protein, 33 aa, Artificial Sequence
  Description of Artificial Sequence: Synthetic polypeptide
DEEEIRTTNPVATEQYGSVSPTALDQEFEAERA

SEQ ID NO: 59078 - protein, 33 aa, Artificial Sequence
  Description of Artificial Sequence: Synthetic polypeptide
DEEEIRTTNPVATEQYGSVSPTALEQQGLFPEN

SEQ ID NO: 59079 - protein, 33 aa, Artificial Sequence
  Description of Artificial Sequence: Synthetic polypeptide
DEEEIRTTNPVATEQYGSVSPTANLWPRMEELD

SEQ ID NO: 59080 - protein, 32 aa, Artificial Sequence
  Description of Artificial Sequence: Synthetic polypeptide
DEEEIRTTNPVATEQYGSVSPQVNEIDGLEIR

SEQ ID NO: 59081 - protein, 35 aa, Artificial Sequence
  Description of Artificial Sequence: Synthetic polypeptide
DEEEIRTTNPVATEQYGSVSPTANQLERVGGNEIL

SEQ ID NO: 59082 - protein, 34 aa, Artificial Sequence
  Description of Artificial Sequence: Synthetic polypeptide
DEEEIRTTNPVATEQYGSVSNTDNMGQEEFGNNG

SEQ ID NO: 59083 - protein, 33 aa, Artificial Sequence
  Description of Artificial Sequence: Synthetic polypeptide
DEEEIRTTNPVATEQYGSVSNTDNMNIIDGNGQ

SEQ ID NO: 59084 - protein, 33 aa, Artificial Sequence
  Description of Artificial Sequence: Synthetic polypeptide
DEEEIRTTNPVATEQYGSVSNTDNVEMEFGNEE

SEQ ID NO: 59085 - protein, 33 aa, Artificial Sequence
  Description of Artificial Sequence: Synthetic polypeptide
DEEEIRTTNPVATEQYGSVSPNMNEQRMGLTEE

SEQ ID NO: 59086 - protein, 34 aa, Artificial Sequence
  Description of Artificial Sequence: Synthetic polypeptide
DEEEIRTTNPVATEQYGSVSNTDNMTQQEGQNGT

SEQ ID NO: 59087 - protein, 34 aa, Artificial Sequence
  Description of Artificial Sequence: Synthetic polypeptide
DEEEIRTTNPVATEQYGSVSNTDNMTQGEGENGT

SEQ ID NO: 59088 - protein, 32 aa, Artificial Sequence
  Description of Artificial Sequence: Synthetic polypeptide
DEEEIRTTNPVATEQYGSVSPNMQRQFQVVQQ

SEQ ID NO: 59089 - protein, 34 aa, Artificial Sequence
  Description of Artificial Sequence: Synthetic polypeptide
DEEEIRTTNPVATEQYGSVSNTDNMTQENGNENG

SEQ ID NO: 59090 - protein, 31 aa, Artificial Sequence
  Description of Artificial Sequence: Synthetic polypeptide
DEEEIRTTNPVATEQYGSVSPNNIDNSGEFA

SEQ ID NO: 59091 - protein, 34 aa, Artificial Sequence
  Description of Artificial Sequence: Synthetic polypeptide
DEEEIRTTNPVATEQYGSVSNTDNMTQENGDNGT

SEQ ID NO: 59092 - protein, 34 aa, Artificial Sequence
  Description of Artificial Sequence: Synthetic polypeptide
DEEEIRTTNPVATEQYGSVSNTDNMTDQEGENQT

SEQ ID NO: 59093 - protein, 33 aa, Artificial Sequence
  Description of Artificial Sequence: Synthetic polypeptide
DEEEIRTTNPVATEQYGSVSNTDNMNEIGGNDN

SEQ ID NO: 59094 - protein, 33 aa, Artificial Sequence
  Description of Artificial Sequence: Synthetic polypeptide
DEEEIRTTNPVATEQYGSVSNTDNMNNNIGGND

SEQ ID NO: 59095 - protein, 31 aa, Artificial Sequence
  Description of Artificial Sequence: Synthetic polypeptide
DEEEIRTTNPVATEQYGSVSPNNLELEQVEM

SEQ ID NO: 59096 - protein, 33 aa, Artificial Sequence
  Description of Artificial Sequence: Synthetic polypeptide
DEEEIRTTNPVATEQYGSVSNTDNMNITGGNDG

SEQ ID NO: 59097 - protein, 34 aa, Artificial Sequence
  Description of Artificial Sequence: Synthetic polypeptide
DEEEIRTTNPVATEQYGSVSNTDNMNIQQGENED

SEQ ID NO: 59098 - protein, 34 aa, Artificial Sequence
  Description of Artificial Sequence: Synthetic polypeptide
DEEEIRTTNPVATEQYGSVSNTDNMNIIQGGNDQ

SEQ ID NO: 59099 - protein, 33 aa, Artificial Sequence
  Description of Artificial Sequence: Synthetic polypeptide
DEEEIRTTNPVATEQYGSVSNTDNMNIINGNGD

SEQ ID NO: 59100 - protein, 33 aa, Artificial Sequence
  Description of Artificial Sequence: Synthetic polypeptide
DEEEIRTTNPVATEQYGSVSNTDNMNIIGNQDQ

SEQ ID NO: 59101 - protein, 33 aa, Artificial Sequence
  Description of Artificial Sequence: Synthetic polypeptide
DEEEIRTTNPVATEQYGSVSNTDNMNIIGGNGD

SEQ ID NO: 59102 - protein, 33 aa, Artificial Sequence
  Description of Artificial Sequence: Synthetic polypeptide
DEEEIRTTNPVATEQYGSVSNTDNMNIIGGEND

SEQ ID NO: 59103 - protein, 33 aa, Artificial Sequence
  Description of Artificial Sequence: Synthetic polypeptide
DEEEIRTTNPVATEQYGSVSNTDNMNIIEGGNI

SEQ ID NO: 59104 - protein, 33 aa, Artificial Sequence
  Description of Artificial Sequence: Synthetic polypeptide
DEEEIRTTNPVATEQYGSVSNTDNMNNIIGNND

SEQ ID NO: 59105 - protein, 34 aa, Artificial Sequence
  Description of Artificial Sequence: Synthetic polypeptide
DEEEIRTTNPVATEQYGSVSPTDEVLQRMVENDQ

SEQ ID NO: 59106 - protein, 33 aa, Artificial Sequence
  Description of Artificial Sequence: Synthetic polypeptide
DEEEIRTTNPVATEQYGSVSPTDFGLIETGNLE

SEQ ID NO: 59107 - protein, 33 aa, Artificial Sequence
  Description of Artificial Sequence: Synthetic polypeptide
DEEEIRTTNPVATEQYGSVSPTDLAMRGGLEML

SEQ ID NO: 59108 - protein, 34 aa, Artificial Sequence
  Description of Artificial Sequence: Synthetic polypeptide
DEEEIRTTNPVATEQYGSVSPTEVLQREVENEDV

SEQ ID NO: 59109 - protein, 33 aa, Artificial Sequence
  Description of Artificial Sequence: Synthetic polypeptide
DEEEIRTTNPVATEQYGSVSPTEVLQRTLEIED

SEQ ID NO: 59110 - protein, 34 aa, Artificial Sequence
  Description of Artificial Sequence: Synthetic polypeptide
DEEEIRTTNPVATEQYGSVSPTFNLHIPDGLEIR

SEQ ID NO: 59111 - protein, 33 aa, Artificial Sequence
  Description of Artificial Sequence: Synthetic polypeptide
DEEEIRTTNPVATEQYGSVSNNTQDEGQGGENG

SEQ ID NO: 59112 - protein, 34 aa, Artificial Sequence
  Description of Artificial Sequence: Synthetic polypeptide
DEEEIRTTNPVATEQYGSVSNNTLIQEGGGNENT

SEQ ID NO: 59113 - protein, 31 aa, Artificial Sequence
  Description of Artificial Sequence: Synthetic polypeptide
DEEEIRTTNPVATEQYGSVSNNTGQSSQSIP

SEQ ID NO: 59114 - protein, 32 aa, Artificial Sequence
  Description of Artificial Sequence: Synthetic polypeptide
DEEEIRTTNPVATEQYGSVSNNTGHSSQEIQR

SEQ ID NO: 59115 - protein, 33 aa, Artificial Sequence
  Description of Artificial Sequence: Synthetic polypeptide
DEEEIRTTNPVATEQYGSVSNNTFGQSGGNQGT

SEQ ID NO: 59116 - protein, 31 aa, Artificial Sequence
  Description of Artificial Sequence: Synthetic polypeptide
DEEEIRTTNPVATEQYGSVSNNTEQSSQIMV

SEQ ID NO: 59117 - protein, 33 aa, Artificial Sequence
  Description of Artificial Sequence: Synthetic polypeptide
DEEEIRTTNPVATEQYGSVSPTEVLERMVENES

SEQ ID NO: 59118 - protein, 33 aa, Artificial Sequence
  Description of Artificial Sequence: Synthetic polypeptide
DEEEIRTTNPVATEQYGSVSNNTDQQTGQGNIG

SEQ ID NO: 59119 - protein, 34 aa, Artificial Sequence
  Description of Artificial Sequence: Synthetic polypeptide
DEEEIRTTNPVATEQYGSVSPTFNPGQEVGLNVE

SEQ ID NO: 59120 - protein, 34 aa, Artificial Sequence
  Description of Artificial Sequence: Synthetic polypeptide
DEEEIRTTNPVATEQYGSVSPTFQNIQRITENQD

SEQ ID NO: 59121 - protein, 32 aa, Artificial Sequence
  Description of Artificial Sequence: Synthetic polypeptide
DEEEIRTTNPVATEQYGSVSPTGNGEGNSEDM

SEQ ID NO: 59122 - protein, 35 aa, Artificial Sequence
  Description of Artificial Sequence: Synthetic polypeptide
DEEEIRTTNPVATEQYGSVSPTGNLGERQGEPERN

SEQ ID NO: 59123 - protein, 32 aa, Artificial Sequence
  Description of Artificial Sequence: Synthetic polypeptide
DEEEIRTTNPVATEQYGSVSPTGWPEHGNILD

SEQ ID NO: 59124 - protein, 33 aa, Artificial Sequence
  Description of Artificial Sequence: Synthetic polypeptide
DEEEIRTTNPVATEQYGSVSPTILVQETGEIMD

SEQ ID NO: 59125 - protein, 32 aa, Artificial Sequence
  Description of Artificial Sequence: Synthetic polypeptide
DEEEIRTTNPVATEQYGSVSPTINVLPGEEAD

SEQ ID NO: 59126 - protein, 32 aa, Artificial Sequence
  Description of Artificial Sequence: Synthetic polypeptide
DEEEIRTTNPVATEQYGSVSPTLDQGGGQFEI

SEQ ID NO: 59127 - protein, 34 aa, Artificial Sequence
  Description of Artificial Sequence: Synthetic polypeptide
DEEEIRTTNPVATEQYGSVSNNNNLQSVEGGNQT

SEQ ID NO: 59128 - protein, 32 aa, Artificial Sequence
  Description of Artificial Sequence: Synthetic polypeptide
DEEEIRTTNPVATEQYGSVSNNTDGEFGNNGD

SEQ ID NO: 59129 - protein, 35 aa, Artificial Sequence
  Description of Artificial Sequence: Synthetic polypeptide
DEEEIRTTNPVATEQYGSVSPTENLGEMRQGEPRD

SEQ ID NO: 59130 - protein, 34 aa, Artificial Sequence
  Description of Artificial Sequence: Synthetic polypeptide
DEEEIRTTNPVATEQYGSVSPTENGQQAQPVNRI

SEQ ID NO: 59131 - protein, 35 aa, Artificial Sequence
  Description of Artificial Sequence: Synthetic polypeptide
DEEEIRTTNPVATEQYGSVSPTENGLGQAIGEGRL

SEQ ID NO: 59132 - protein, 32 aa, Artificial Sequence
  Description of Artificial Sequence: Synthetic polypeptide
DEEEIRTTNPVATEQYGSVSPTDLEGRDSIMM

SEQ ID NO: 59133 - protein, 32 aa, Artificial Sequence
  Description of Artificial Sequence: Synthetic polypeptide
DEEEIRTTNPVATEQYGSVSPTDLEGRFDSGS

SEQ ID NO: 59134 - protein, 33 aa, Artificial Sequence
  Description of Artificial Sequence: Synthetic polypeptide
DEEEIRTTNPVATEQYGSVSNSVGLQFTNGNGD

SEQ ID NO: 59135 - protein, 33 aa, Artificial Sequence
  Description of Artificial Sequence: Synthetic polypeptide
DEEEIRTTNPVATEQYGSVSNSNLQVQGIVLQV

SEQ ID NO: 59136 - protein, 33 aa, Artificial Sequence
  Description of Artificial Sequence: Synthetic polypeptide
DEEEIRTTNPVATEQYGSVSPTDLERGGLDPIE

SEQ ID NO: 59137 - protein, 34 aa, Artificial Sequence
  Description of Artificial Sequence: Synthetic polypeptide
DEEEIRTTNPVATEQYGSVSNSNGLQSTGGNGNV

SEQ ID NO: 59138 - protein, 34 aa, Artificial Sequence
  Description of Artificial Sequence: Synthetic polypeptide
DEEEIRTTNPVATEQYGSVSNSNFLVQVDDENRE

SEQ ID NO: 59139 - protein, 31 aa, Artificial Sequence
  Description of Artificial Sequence: Synthetic polypeptide
DEEEIRTTNPVATEQYGSVSNSLDVNSGEGP

SEQ ID NO: 59140 - protein, 32 aa, Artificial Sequence
  Description of Artificial Sequence: Synthetic polypeptide
DEEEIRTTNPVATEQYGSVSPTDMLSGTAGVI

SEQ ID NO: 59141 - protein, 32 aa, Artificial Sequence
  Description of Artificial Sequence: Synthetic polypeptide
DEEEIRTTNPVATEQYGSVSNQVNMTGSGNIN

SEQ ID NO: 59142 - protein, 34 aa, Artificial Sequence
  Description of Artificial Sequence: Synthetic polypeptide
DEEEIRTTNPVATEQYGSVSNQTQGLGQEGGNGE

SEQ ID NO: 59143 - protein, 34 aa, Artificial Sequence
  Description of Artificial Sequence: Synthetic polypeptide
DEEEIRTTNPVATEQYGSVSNQTDLQEEGGNEGN

SEQ ID NO: 59144 - protein, 33 aa, Artificial Sequence
  Description of Artificial Sequence: Synthetic polypeptide
DEEEIRTTNPVATEQYGSVSPTDNLTTRNSDHG

SEQ ID NO: 59145 - protein, 30 aa, Artificial Sequence
  Description of Artificial Sequence: Synthetic polypeptide
DEEEIRTTNPVATEQYGSVSNPTDITMVEE

SEQ ID NO: 59146 - protein, 34 aa, Artificial Sequence
  Description of Artificial Sequence: Synthetic polypeptide
DEEEIRTTNPVATEQYGSVSPTDNNLETTREQNN

SEQ ID NO: 59147 - protein, 35 aa, Artificial Sequence
  Description of Artificial Sequence: Synthetic polypeptide
DEEEIRTTNPVATEQYGSVSPTDNNLTQRNSMDRG

SEQ ID NO: 59148 - protein, 31 aa, Artificial Sequence
  Description of Artificial Sequence: Synthetic polypeptide
DEEEIRTTNPVATEQYGSVSNPMEQRAQVEI

SEQ ID NO: 59149 - protein, 34 aa, Artificial Sequence
  Description of Artificial Sequence: Synthetic polypeptide
DEEEIRTTNPVATEQYGSVSPTEELGERQGEPER

SEQ ID NO: 59150 - protein, 32 aa, Artificial Sequence
  Description of Artificial Sequence: Synthetic polypeptide
DEEEIRTTNPVATEQYGSVSNPHGLQEGLEPE

SEQ ID NO: 59151 - protein, 31 aa, Artificial Sequence
  Description of Artificial Sequence: Synthetic polypeptide
DEEEIRTTNPVATEQYGSVSNPGVQDQVINS

SEQ ID NO: 59152 - protein, 35 aa, Artificial Sequence
  Description of Artificial Sequence: Synthetic polypeptide
DEEEIRTTNPVATEQYGSVSPTENEPQDRQTNQRI

SEQ ID NO: 59153 - protein, 34 aa, Artificial Sequence
  Description of Artificial Sequence: Synthetic polypeptide
DEEEIRTTNPVATEQYGSVSPNINNLERGDNNEE

SEQ ID NO: 59154 - protein, 33 aa, Artificial Sequence
  Description of Artificial Sequence: Synthetic polypeptide
DEEEIRTTNPVATEQYGSVSPTLLIQEDPENEF

SEQ ID NO: 59155 - protein, 34 aa, Artificial Sequence
  Description of Artificial Sequence: Synthetic polypeptide
DEEEIRTTNPVATEQYGSVSNTENFGQSTGGNGN

SEQ ID NO: 59156 - protein, 32 aa, Artificial Sequence
  Description of Artificial Sequence: Synthetic polypeptide
DEEEIRTTNPVATEQYGSVSPMTLIIPRGEEE

SEQ ID NO: 59157 - protein, 32 aa, Artificial Sequence
  Description of Artificial Sequence: Synthetic polypeptide
DEEEIRTTNPVATEQYGSVSPANLLGVRMELT

SEQ ID NO: 59158 - protein, 34 aa, Artificial Sequence
  Description of Artificial Sequence: Synthetic polypeptide
DEEEIRTTNPVATEQYGSVSNTNGVITRGENVEV

SEQ ID NO: 59159 - protein, 32 aa, Artificial Sequence
  Description of Artificial Sequence: Synthetic polypeptide
DEEEIRTTNPVATEQYGSVSPANLTMEQGQEL

SEQ ID NO: 59160 - protein, 33 aa, Artificial Sequence
  Description of Artificial Sequence: Synthetic polypeptide
DEEEIRTTNPVATEQYGSVSNTNGNQHFGSDFA

SEQ ID NO: 59161 - protein, 34 aa, Artificial Sequence
  Description of Artificial Sequence: Synthetic polypeptide
DEEEIRTTNPVATEQYGSVSPAPNLDQAIQNIRI

SEQ ID NO: 59162 - protein, 34 aa, Artificial Sequence
  Description of Artificial Sequence: Synthetic polypeptide
DEEEIRTTNPVATEQYGSVSNTNGFEQNNGNVGF

SEQ ID NO: 59163 - protein, 34 aa, Artificial Sequence
  Description of Artificial Sequence: Synthetic polypeptide
DEEEIRTTNPVATEQYGSVSNTNFPQVPSGNNEL

SEQ ID NO: 59164 - protein, 33 aa, Artificial Sequence
  Description of Artificial Sequence: Synthetic polypeptide
DEEEIRTTNPVATEQYGSVSPDMSLEEIGDNRE

SEQ ID NO: 59165 - protein, 33 aa, Artificial Sequence
  Description of Artificial Sequence: Synthetic polypeptide
DEEEIRTTNPVATEQYGSVSPDNLDERQDENNS

SEQ ID NO: 59166 - protein, 33 aa, Artificial Sequence
  Description of Artificial Sequence: Synthetic polypeptide
DEEEIRTTNPVATEQYGSVSPAINQQRGVQDHD

SEQ ID NO: 59167 - protein, 32 aa, Artificial Sequence
  Description of Artificial Sequence: Synthetic polypeptide
DEEEIRTTNPVATEQYGSVSPDNLETFGEFQY

SEQ ID NO: 59168 - protein, 34 aa, Artificial Sequence
  Description of Artificial Sequence: Synthetic polypeptide
DEEEIRTTNPVATEQYGSVSNTNDMQMQPPNLRE

SEQ ID NO: 59169 - protein, 32 aa, Artificial Sequence
  Description of Artificial Sequence: Synthetic polypeptide
DEEEIRTTNPVATEQYGSVSPEAVVQERLQNL

SEQ ID NO: 59170 - protein, 32 aa, Artificial Sequence
  Description of Artificial Sequence: Synthetic polypeptide
DEEEIRTTNPVATEQYGSVSNTNDLTSIPHIM

SEQ ID NO: 59171 - protein, 32 aa, Artificial Sequence
  Description of Artificial Sequence: Synthetic polypeptide
DEEEIRTTNPVATEQYGSVSPELDLQRTQDFI

SEQ ID NO: 59172 - protein, 33 aa, Artificial Sequence
  Description of Artificial Sequence: Synthetic polypeptide
DEEEIRTTNPVATEQYGSVSPELLPQMQGVERN

SEQ ID NO: 59173 - protein, 33 aa, Artificial Sequence
  Description of Artificial Sequence: Synthetic polypeptide
DEEEIRTTNPVATEQYGSVSNTNDLMSEGEEIE

SEQ ID NO: 59174 - protein, 32 aa, Artificial Sequence
  Description of Artificial Sequence: Synthetic polypeptide
DEEEIRTTNPVATEQYGSVSPENDEMSGEVRS

SEQ ID NO: 59175 - protein, 34 aa, Artificial Sequence
  Description of Artificial Sequence: Synthetic polypeptide
DEEEIRTTNPVATEQYGSVSNTNDFGQEQGNEED

SEQ ID NO: 59176 - protein, 32 aa, Artificial Sequence
  Description of Artificial Sequence: Synthetic polypeptide
DEEEIRTTNPVATEQYGSVSPENLELEQVVEE

SEQ ID NO: 59177 - protein, 33 aa, Artificial Sequence
  Description of Artificial Sequence: Synthetic polypeptide
DEEEIRTTNPVATEQYGSVSPDNLQRVTEAQVQ

SEQ ID NO: 59178 - protein, 32 aa, Artificial Sequence
  Description of Artificial Sequence: Synthetic polypeptide
DEEEIRTTNPVATEQYGSVSPETDLERTIQEI

SEQ ID NO: 59179 - protein, 32 aa, Artificial Sequence
  Description of Artificial Sequence: Synthetic polypeptide
DEEEIRTTNPVATEQYGSVSPAESDRGGDNQE

SEQ ID NO: 59180 - protein, 32 aa, Artificial Sequence
  Description of Artificial Sequence: Synthetic polypeptide
DEEEIRTTNPVATEQYGSVSPADNNLDENNNE

SEQ ID NO: 59181 - protein, 33 aa, Artificial Sequence
  Description of Artificial Sequence: Synthetic polypeptide
DEEEIRTTNPVATEQYGSVSNTNNDDEFGNDEA

SEQ ID NO: 59182 - protein, 34 aa, Artificial Sequence
  Description of Artificial Sequence: Synthetic polypeptide
DEEEIRTTNPVATEQYGSVSNTNNDGQQNGGNEN

SEQ ID NO: 59183 - protein, 34 aa, Artificial Sequence
  Description of Artificial Sequence: Synthetic polypeptide
DEEEIRTTNPVATEQYGSVSNTNNEQNVGGGNNE

SEQ ID NO: 59184 - protein, 34 aa, Artificial Sequence
  Description of Artificial Sequence: Synthetic polypeptide
DEEEIRTTNPVATEQYGSVSNTNNLDEFDGNEEE

SEQ ID NO: 59185 - protein, 34 aa, Artificial Sequence
  Description of Artificial Sequence: Synthetic polypeptide
DEEEIRTTNPVATEQYGSVSNTNNMQNSEGENEF

SEQ ID NO: 59186 - protein, 33 aa, Artificial Sequence
  Description of Artificial Sequence: Synthetic polypeptide
DEEEIRTTNPVATEQYGSVSNTNSNQTMGEDEN

SEQ ID NO: 59187 - protein, 33 aa, Artificial Sequence
  Description of Artificial Sequence: Synthetic polypeptide
DEEEIRTTNPVATEQYGSVSNTNTGGQGENNDD

SEQ ID NO: 59188 - protein, 33 aa, Artificial Sequence
  Description of Artificial Sequence: Synthetic polypeptide
DEEEIRTTNPVATEQYGSVSNTPDADQTGNMEV

SEQ ID NO: 59189 - protein, 32 aa, Artificial Sequence
  Description of Artificial Sequence: Synthetic polypeptide
DEEEIRTTNPVATEQYGSVSNTQPGIGGNGET

SEQ ID NO: 59190 - protein, 33 aa, Artificial Sequence
  Description of Artificial Sequence: Synthetic polypeptide
DEEEIRTTNPVATEQYGSVSPAEMLMRGENNPN

SEQ ID NO: 59191 - protein, 32 aa, Artificial Sequence
  Description of Artificial Sequence: Synthetic polypeptide
DEEEIRTTNPVATEQYGSVSNTSGLMREQELT

SEQ ID NO: 59192 - protein, 34 aa, Artificial Sequence
  Description of Artificial Sequence: Synthetic polypeptide
DEEEIRTTNPVATEQYGSVSNTSNVEQVMGPIRD

SEQ ID NO: 59193 - protein, 32 aa, Artificial Sequence
  Description of Artificial Sequence: Synthetic polypeptide
DEEEIRTTNPVATEQYGSVSNTVDLQAIESVN

SEQ ID NO: 59194 - protein, 34 aa, Artificial Sequence
  Description of Artificial Sequence: Synthetic polypeptide
DEEEIRTTNPVATEQYGSVSNTWATLDERGNEKN

SEQ ID NO: 59195 - protein, 34 aa, Artificial Sequence
  Description of Artificial Sequence: Synthetic polypeptide
DEEEIRTTNPVATEQYGSVSNTWLGQQPGPNENS

SEQ ID NO: 59196 - protein, 34 aa, Artificial Sequence
  Description of Artificial Sequence: Synthetic polypeptide
DEEEIRTTNPVATEQYGSVSNTNLLGSGGNNEND

SEQ ID NO: 59197 - protein, 34 aa, Artificial Sequence
  Description of Artificial Sequence: Synthetic polypeptide
DEEEIRTTNPVATEQYGSVSNTNLLGAPNVVERV

SEQ ID NO: 59198 - protein, 34 aa, Artificial Sequence
  Description of Artificial Sequence: Synthetic polypeptide
DEEEIRTTNPVATEQYGSVSNTWNLQQNRASDDG

SEQ ID NO: 59199 - protein, 33 aa, Artificial Sequence
  Description of Artificial Sequence: Synthetic polypeptide
DEEEIRTTNPVATEQYGSVSNTNLINEGSLEET

SEQ ID NO: 59200 - protein, 31 aa, Artificial Sequence
  Description of Artificial Sequence: Synthetic polypeptide
DEEEIRTTNPVATEQYGSVSNWIDSQYAGEQ

SEQ ID NO: 59201 - protein, 34 aa, Artificial Sequence
  Description of Artificial Sequence: Synthetic polypeptide
DEEEIRTTNPVATEQYGSVSNTSNGVEQVGPIRT

SEQ ID NO: 59202 - protein, 33 aa, Artificial Sequence
  Description of Artificial Sequence: Synthetic polypeptide
DEEEIRTTNPVATEQYGSVSPETNLIQQNSLPE

SEQ ID NO: 59203 - protein, 34 aa, Artificial Sequence
  Description of Artificial Sequence: Synthetic polypeptide
DEEEIRTTNPVATEQYGSVSPETNLIQQNSVFNS

SEQ ID NO: 59204 - protein, 32 aa, Artificial Sequence
  Description of Artificial Sequence: Synthetic polypeptide
DEEEIRTTNPVATEQYGSVSPEVGLQVEIELR

SEQ ID NO: 59205 - protein, 34 aa, Artificial Sequence
  Description of Artificial Sequence: Synthetic polypeptide
DEEEIRTTNPVATEQYGSVSPISNGLIQPIVNRI

SEQ ID NO: 59206 - protein, 33 aa, Artificial Sequence
  Description of Artificial Sequence: Synthetic polypeptide
DEEEIRTTNPVATEQYGSVSPITNLISVGEEEH

SEQ ID NO: 59207 - protein, 31 aa, Artificial Sequence
  Description of Artificial Sequence: Synthetic polypeptide
DEEEIRTTNPVATEQYGSVSPLELELEGVEE

SEQ ID NO: 59208 - protein, 30 aa, Artificial Sequence
  Description of Artificial Sequence: Synthetic polypeptide
DEEEIRTTNPVATEQYGSVSPLIQPPDIPE

SEQ ID NO: 59209 - protein, 33 aa, Artificial Sequence
  Description of Artificial Sequence: Synthetic polypeptide
DEEEIRTTNPVATEQYGSVSPLMLTADPGSNRT

SEQ ID NO: 59210 - protein, 32 aa, Artificial Sequence
  Description of Artificial Sequence: Synthetic polypeptide
DEEEIRTTNPVATEQYGSVSNTGGGQEGGEQG

SEQ ID NO: 59211 - protein, 33 aa, Artificial Sequence
  Description of Artificial Sequence: Synthetic polypeptide
DEEEIRTTNPVATEQYGSVSNTGDQDQEGGNGD

SEQ ID NO: 59212 - protein, 33 aa, Artificial Sequence
  Description of Artificial Sequence: Synthetic polypeptide
DEEEIRTTNPVATEQYGSVSNTGDENQEGGNFQ

SEQ ID NO: 59213 - protein, 34 aa, Artificial Sequence
  Description of Artificial Sequence: Synthetic polypeptide
DEEEIRTTNPVATEQYGSVSPLVMLMQRGQLVRD

SEQ ID NO: 59214 - protein, 32 aa, Artificial Sequence
  Description of Artificial Sequence: Synthetic polypeptide
DEEEIRTTNPVATEQYGSVSPIPLQDGVEELQ

SEQ ID NO: 59215 - protein, 34 aa, Artificial Sequence
  Description of Artificial Sequence: Synthetic polypeptide
DEEEIRTTNPVATEQYGSVSPLVNLAQAGVNNDL

SEQ ID NO: 59216 - protein, 33 aa, Artificial Sequence
  Description of Artificial Sequence: Synthetic polypeptide
DEEEIRTTNPVATEQYGSVSPMNLQPLPELPRT

SEQ ID NO: 59217 - protein, 34 aa, Artificial Sequence
  Description of Artificial Sequence: Synthetic polypeptide
DEEEIRTTNPVATEQYGSVSPMNLQPRVGEEEST

SEQ ID NO: 59218 - protein, 32 aa, Artificial Sequence
  Description of Artificial Sequence: Synthetic polypeptide
DEEEIRTTNPVATEQYGSVSNTFETGGNGNFE

SEQ ID NO: 59219 - protein, 33 aa, Artificial Sequence
  Description of Artificial Sequence: Synthetic polypeptide
DEEEIRTTNPVATEQYGSVSPMPGLQQRGEELQ

SEQ ID NO: 59220 - protein, 33 aa, Artificial Sequence
  Description of Artificial Sequence: Synthetic polypeptide
DEEEIRTTNPVATEQYGSVSNTENQLDRDEDGI

SEQ ID NO: 59221 - protein, 34 aa, Artificial Sequence
  Description of Artificial Sequence: Synthetic polypeptide
DEEEIRTTNPVATEQYGSVSPMPLQQRQGDNNEP

SEQ ID NO: 59222 - protein, 32 aa, Artificial Sequence
  Description of Artificial Sequence: Synthetic polypeptide
DEEEIRTTNPVATEQYGSVSPMPLQRFVEEDQ

SEQ ID NO: 59223 - protein, 32 aa, Artificial Sequence
  Description of Artificial Sequence: Synthetic polypeptide
DEEEIRTTNPVATEQYGSVSPMPMQQREEGRQ

SEQ ID NO: 59224 - protein, 34 aa, Artificial Sequence
  Description of Artificial Sequence: Synthetic polypeptide
DEEEIRTTNPVATEQYGSVSPMPTNISPQMQNDR

SEQ ID NO: 59225 - protein, 32 aa, Artificial Sequence
  Description of Artificial Sequence: Synthetic polypeptide
DEEEIRTTNPVATEQYGSVSPMLNQREDEEVF

SEQ ID NO: 59226 - protein, 31 aa, Artificial Sequence
  Description of Artificial Sequence: Synthetic polypeptide
DEEEIRTTNPVATEQYGSVSPINLVIPLLDV

SEQ ID NO: 59227 - protein, 34 aa, Artificial Sequence
  Description of Artificial Sequence: Synthetic polypeptide
DEEEIRTTNPVATEQYGSVSPINLTQLVIGLGND

SEQ ID NO: 59228 - protein, 34 aa, Artificial Sequence
  Description of Artificial Sequence: Synthetic polypeptide
DEEEIRTTNPVATEQYGSVSPINLDQPIGIEVRD

SEQ ID NO: 59229 - protein, 32 aa, Artificial Sequence
  Description of Artificial Sequence: Synthetic polypeptide
DEEEIRTTNPVATEQYGSVSNTMHQQETVLNL

SEQ ID NO: 59230 - protein, 34 aa, Artificial Sequence
  Description of Artificial Sequence: Synthetic polypeptide
DEEEIRTTNPVATEQYGSVSNTLNNIQGEGNQGN

SEQ ID NO: 59231 - protein, 34 aa, Artificial Sequence
  Description of Artificial Sequence: Synthetic polypeptide
DEEEIRTTNPVATEQYGSVSNTLNLNQNSGLEDD

SEQ ID NO: 59232 - protein, 33 aa, Artificial Sequence
  Description of Artificial Sequence: Synthetic polypeptide
DEEEIRTTNPVATEQYGSVSNTLMNLVSDGEEV

SEQ ID NO: 59233 - protein, 32 aa, Artificial Sequence
  Description of Artificial Sequence: Synthetic polypeptide
DEEEIRTTNPVATEQYGSVSPGNLQEEQFVDT

SEQ ID NO: 59234 - protein, 33 aa, Artificial Sequence
  Description of Artificial Sequence: Synthetic polypeptide
DEEEIRTTNPVATEQYGSVSNTLGLELEGGNEQ

SEQ ID NO: 59235 - protein, 34 aa, Artificial Sequence
  Description of Artificial Sequence: Synthetic polypeptide
DEEEIRTTNPVATEQYGSVSNTINEQPQGEELRY

SEQ ID NO: 59236 - protein, 35 aa, Artificial Sequence
  Description of Artificial Sequence: Synthetic polypeptide
DEEEIRTTNPVATEQYGSVSPGTNLQQNTGLEIRL

SEQ ID NO: 59237 - protein, 34 aa, Artificial Sequence
  Description of Artificial Sequence: Synthetic polypeptide
DEEEIRTTNPVATEQYGSVSPGWNSQERSQNGRE

SEQ ID NO: 59238 - protein, 32 aa, Artificial Sequence
  Description of Artificial Sequence: Synthetic polypeptide
DEEEIRTTNPVATEQYGSVSPHHDQRDNSNEM

SEQ ID NO: 59239 - protein, 34 aa, Artificial Sequence
  Description of Artificial Sequence: Synthetic polypeptide
DEEEIRTTNPVATEQYGSVSPIENEPQRGFGNEG

SEQ ID NO: 59240 - protein, 35 aa, Artificial Sequence
  Description of Artificial Sequence: Synthetic polypeptide
DEEEIRTTNPVATEQYGSVSPIENLDQPRGVLVRD

SEQ ID NO: 59241 - protein, 33 aa, Artificial Sequence
  Description of Artificial Sequence: Synthetic polypeptide
DEEEIRTTNPVATEQYGSVSPIGNLQIENNQLN

SEQ ID NO: 59242 - protein, 33 aa, Artificial Sequence
  Description of Artificial Sequence: Synthetic polypeptide
DEEEIRTTNPVATEQYGSVSPIGNLQLENNTGN

SEQ ID NO: 59243 - protein, 34 aa, Artificial Sequence
  Description of Artificial Sequence: Synthetic polypeptide
DEEEIRTTNPVATEQYGSVSPIGNLQREGTTTGN

SEQ ID NO: 59244 - protein, 33 aa, Artificial Sequence
  Description of Artificial Sequence: Synthetic polypeptide
DEEEIRTTNPVATEQYGSVSPILFQMRVVNEQT

SEQ ID NO: 59245 - protein, 31 aa, Artificial Sequence
  Description of Artificial Sequence: Synthetic polypeptide
DEEEIRTTNPVATEQYGSVSPILNLISMEEI

SEQ ID NO: 59246 - protein, 32 aa, Artificial Sequence
  Description of Artificial Sequence: Synthetic polypeptide
DEEEIRTTNPVATEQYGSVSPILNPLISGEMD

SEQ ID NO: 59247 - protein, 32 aa, Artificial Sequence
  Description of Artificial Sequence: Synthetic polypeptide
DEEEIRTTNPVATEQYGSVSPILQENSGDQIQ

SEQ ID NO: 59248 - protein, 33 aa, Artificial Sequence
  Description of Artificial Sequence: Synthetic polypeptide
DEEEIRTTNPVATEQYGSVSPIMNLQIENGTGN

SEQ ID NO: 59249 - protein, 34 aa, Artificial Sequence
  Description of Artificial Sequence: Synthetic polypeptide
DEEEIRTTNPVATEQYGSVSPINGVIMRNGANRS

SEQ ID NO: 59250 - protein, 33 aa, Artificial Sequence
  Description of Artificial Sequence: Synthetic polypeptide
DEEEIRTTNPVATEQYGSVSPNGVNLQRVELEQ

SEQ ID NO: 59251 - protein, 32 aa, Artificial Sequence
  Description of Artificial Sequence: Synthetic polypeptide
DEEEIRTTNPVATEQYGSVSINNLEMNMMPPR

SEQ ID NO: 59252 - protein, 32 aa, Artificial Sequence
  Description of Artificial Sequence: Synthetic polypeptide
DEEEIRTTNPVATEQYGSVSPTLLQGFQLEMY

SEQ ID NO: 59253 - protein, 33 aa, Artificial Sequence
  Description of Artificial Sequence: Synthetic polypeptide
DEEEIRTTNPVATEQYGSVSNNNLDDEFGENEA

SEQ ID NO: 59254 - protein, 33 aa, Artificial Sequence
  Description of Artificial Sequence: Synthetic polypeptide
DEEEIRTTNPVATEQYGSVSNGTDEGQGGNNLE

SEQ ID NO: 59255 - protein, 31 aa, Artificial Sequence
  Description of Artificial Sequence: Synthetic polypeptide
DEEEIRTTNPVATEQYGSVSPTQLESEEDQY

SEQ ID NO: 59256 - protein, 32 aa, Artificial Sequence
  Description of Artificial Sequence: Synthetic polypeptide
DEEEIRTTNPVATEQYGSVSNGLGMPGVENQI

SEQ ID NO: 59257 - protein, 33 aa, Artificial Sequence
  Description of Artificial Sequence: Synthetic polypeptide
DEEEIRTTNPVATEQYGSVSPTQNMIHRGEELI

SEQ ID NO: 59258 - protein, 34 aa, Artificial Sequence
  Description of Artificial Sequence: Synthetic polypeptide
DEEEIRTTNPVATEQYGSVSPTRNEQLVGNVFVS

SEQ ID NO: 59259 - protein, 34 aa, Artificial Sequence
  Description of Artificial Sequence: Synthetic polypeptide
DEEEIRTTNPVATEQYGSVSPTSNPLPRAENETL

SEQ ID NO: 59260 - protein, 32 aa, Artificial Sequence
  Description of Artificial Sequence: Synthetic polypeptide
DEEEIRTTNPVATEQYGSVSNDQVGQGEMGNG

SEQ ID NO: 59261 - protein, 32 aa, Artificial Sequence
  Description of Artificial Sequence: Synthetic polypeptide
DEEEIRTTNPVATEQYGSVSNDQTDSGQNPNT

SEQ ID NO: 59262 - protein, 34 aa, Artificial Sequence
  Description of Artificial Sequence: Synthetic polypeptide
DEEEIRTTNPVATEQYGSVSNDPNLQTNGGNING

SEQ ID NO: 59263 - protein, 32 aa, Artificial Sequence
  Description of Artificial Sequence: Synthetic polypeptide
DEEEIRTTNPVATEQYGSVSPTQLEHSEEDFR

SEQ ID NO: 59264 - protein, 35 aa, Artificial Sequence
  Description of Artificial Sequence: Synthetic polypeptide
DEEEIRTTNPVATEQYGSVSPTSWLEQEREQNGRE

SEQ ID NO: 59265 - protein, 32 aa, Artificial Sequence
  Description of Artificial Sequence: Synthetic polypeptide
DEEEIRTTNPVATEQYGSVSNDNLQSQSQVQD

SEQ ID NO: 59266 - protein, 33 aa, Artificial Sequence
  Description of Artificial Sequence: Synthetic polypeptide
DEEEIRTTNPVATEQYGSVSPTTLPQIGEAGFI

SEQ ID NO: 59267 - protein, 34 aa, Artificial Sequence
  Description of Artificial Sequence: Synthetic polypeptide
DEEEIRTTNPVATEQYGSVSPTTNLIQQENSNFE

SEQ ID NO: 59268 - protein, 33 aa, Artificial Sequence
  Description of Artificial Sequence: Synthetic polypeptide
DEEEIRTTNPVATEQYGSVSNDNLDQNEGMEGI

SEQ ID NO: 59269 - protein, 34 aa, Artificial Sequence
  Description of Artificial Sequence: Synthetic polypeptide
DEEEIRTTNPVATEQYGSVSNDNLDQNEGGENED

SEQ ID NO: 59270 - protein, 33 aa, Artificial Sequence
  Description of Artificial Sequence: Synthetic polypeptide
DEEEIRTTNPVATEQYGSVSPTTNLIQQNSPHE

SEQ ID NO: 59271 - protein, 33 aa, Artificial Sequence
  Description of Artificial Sequence: Synthetic polypeptide
DEEEIRTTNPVATEQYGSVSPTTNLPNNHENEM

SEQ ID NO: 59272 - protein, 32 aa, Artificial Sequence
  Description of Artificial Sequence: Synthetic polypeptide
DEEEIRTTNPVATEQYGSVSNDLQMMVNEIQQ

SEQ ID NO: 59273 - protein, 32 aa, Artificial Sequence
  Description of Artificial Sequence: Synthetic polypeptide
DEEEIRTTNPVATEQYGSVSNDGMNQTGENGE

SEQ ID NO: 59274 - protein, 33 aa, Artificial Sequence
  Description of Artificial Sequence: Synthetic polypeptide
DEEEIRTTNPVATEQYGSVSNDNNDGQGEGNDE

SEQ ID NO: 59275 - protein, 31 aa, Artificial Sequence
  Description of Artificial Sequence: Synthetic polypeptide
DEEEIRTTNPVATEQYGSVSNDELEQSTEVD

SEQ ID NO: 59276 - protein, 35 aa, Artificial Sequence
  Description of Artificial Sequence: Synthetic polypeptide
DEEEIRTTNPVATEQYGSVSNHSTNLQRVQENLVD

SEQ ID NO: 59277 - protein, 33 aa, Artificial Sequence
  Description of Artificial Sequence: Synthetic polypeptide
DEEEIRTTNPVATEQYGSVSNLFEIQSEGENEF

SEQ ID NO: 59278 - protein, 32 aa, Artificial Sequence
  Description of Artificial Sequence: Synthetic polypeptide
DEEEIRTTNPVATEQYGSVSPTPAQHRMSQEV

SEQ ID NO: 59279 - protein, 32 aa, Artificial Sequence
  Description of Artificial Sequence: Synthetic polypeptide
DEEEIRTTNPVATEQYGSVSNMNLDNGGQEDG

SEQ ID NO: 59280 - protein, 32 aa, Artificial Sequence
  Description of Artificial Sequence: Synthetic polypeptide
DEEEIRTTNPVATEQYGSVSNMNLDIGGQEED

SEQ ID NO: 59281 - protein, 32 aa, Artificial Sequence
  Description of Artificial Sequence: Synthetic polypeptide
DEEEIRTTNPVATEQYGSVSNMNLDEGGGQED

SEQ ID NO: 59282 - protein, 34 aa, Artificial Sequence
  Description of Artificial Sequence: Synthetic polypeptide
DEEEIRTTNPVATEQYGSVSNMNIQQRGGDNNEE

SEQ ID NO: 59283 - protein, 32 aa, Artificial Sequence
  Description of Artificial Sequence: Synthetic polypeptide
DEEEIRTTNPVATEQYGSVSPTPDQNRMYEVQ

SEQ ID NO: 59284 - protein, 33 aa, Artificial Sequence
  Description of Artificial Sequence: Synthetic polypeptide
DEEEIRTTNPVATEQYGSVSNMNGGEGQGGNEQ

SEQ ID NO: 59285 - protein, 33 aa, Artificial Sequence
  Description of Artificial Sequence: Synthetic polypeptide
DEEEIRTTNPVATEQYGSVSNMNFGQTGGNNQG

SEQ ID NO: 59286 - protein, 32 aa, Artificial Sequence
  Description of Artificial Sequence: Synthetic polypeptide
DEEEIRTTNPVATEQYGSVSNMNFGQTGGGQQ

SEQ ID NO: 59287 - protein, 32 aa, Artificial Sequence
  Description of Artificial Sequence: Synthetic polypeptide
DEEEIRTTNPVATEQYGSVSNILQTALENPLM

SEQ ID NO: 59288 - protein, 32 aa, Artificial Sequence
  Description of Artificial Sequence: Synthetic polypeptide
DEEEIRTTNPVATEQYGSVSPTPFLQIAIDQN

SEQ ID NO: 59289 - protein, 34 aa, Artificial Sequence
  Description of Artificial Sequence: Synthetic polypeptide
DEEEIRTTNPVATEQYGSVSNMNELDQNEGENID

SEQ ID NO: 59290 - protein, 32 aa, Artificial Sequence
  Description of Artificial Sequence: Synthetic polypeptide
DEEEIRTTNPVATEQYGSVSNMMLQVAGEPQV

SEQ ID NO: 59291 - protein, 33 aa, Artificial Sequence
  Description of Artificial Sequence: Synthetic polypeptide
DEEEIRTTNPVATEQYGSVSPTPLIQIVENGTD

SEQ ID NO: 59292 - protein, 33 aa, Artificial Sequence
  Description of Artificial Sequence: Synthetic polypeptide
DEEEIRTTNPVATEQYGSVSPTPLQQMGLFPEI

SEQ ID NO: 59293 - protein, 33 aa, Artificial Sequence
  Description of Artificial Sequence: Synthetic polypeptide
DEEEIRTTNPVATEQYGSVSNMDLGQIDEGGNA

SEQ ID NO: 59294 - protein, 33 aa, Artificial Sequence
  Description of Artificial Sequence: Synthetic polypeptide
DEEEIRTTNPVATEQYGSVSPTPMPEQRLNALV

SEQ ID NO: 59295 - protein, 32 aa, Artificial Sequence
  Description of Artificial Sequence: Synthetic polypeptide
DEEEIRTTNPVATEQYGSVSPTPQQIVENTLD

SEQ ID NO: 59296 - protein, 33 aa, Artificial Sequence
  Description of Artificial Sequence: Synthetic polypeptide
DEEEIRTTNPVATEQYGSVSPTPSLQNQIANEN

SEQ ID NO: 59297 - protein, 33 aa, Artificial Sequence
  Description of Artificial Sequence: Synthetic polypeptide
DEEEIRTTNPVATEQYGSVSNLGSGEQRGVILD

SEQ ID NO: 59298 - protein, 34 aa, Artificial Sequence
  Description of Artificial Sequence: Synthetic polypeptide
DEEEIRTTNPVATEQYGSVSNMNELGQEGGGNDT

SEQ ID NO: 59299 - protein, 34 aa, Artificial Sequence
  Description of Artificial Sequence: Synthetic polypeptide
DEEEIRTTNPVATEQYGSVSPTTNLVPTMVNERI

SEQ ID NO: 59300 - protein, 34 aa, Artificial Sequence
  Description of Artificial Sequence: Synthetic polypeptide
DEEEIRTTNPVATEQYGSVSPTTNQEQERFNNDP

SEQ ID NO: 59301 - protein, 34 aa, Artificial Sequence
  Description of Artificial Sequence: Synthetic polypeptide
DEEEIRTTNPVATEQYGSVSPTTNVIQQNGVFND

SEQ ID NO: 59302 - protein, 33 aa, Artificial Sequence
  Description of Artificial Sequence: Synthetic polypeptide
DEEEIRTTNPVATEQYGSVSPTVVMQIGENGLD

SEQ ID NO: 59303 - protein, 34 aa, Artificial Sequence
  Description of Artificial Sequence: Synthetic polypeptide
DEEEIRTTNPVATEQYGSVSPTWLAQPESQNMRQ

SEQ ID NO: 59304 - protein, 34 aa, Artificial Sequence
  Description of Artificial Sequence: Synthetic polypeptide
DEEEIRTTNPVATEQYGSVSPTWNEQERSQNDCE

SEQ ID NO: 59305 - protein, 34 aa, Artificial Sequence
  Description of Artificial Sequence: Synthetic polypeptide
DEEEIRTTNPVATEQYGSVSPTWNLPELVAVNRD

SEQ ID NO: 59306 - protein, 34 aa, Artificial Sequence
  Description of Artificial Sequence: Synthetic polypeptide
DEEEIRTTNPVATEQYGSVSPTWPLQVIGENGLD

SEQ ID NO: 59307 - protein, 33 aa, Artificial Sequence
  Description of Artificial Sequence: Synthetic polypeptide
DEEEIRTTNPVATEQYGSVSPTWVEHRSQNPRF

SEQ ID NO: 59308 - protein, 34 aa, Artificial Sequence
  Description of Artificial Sequence: Synthetic polypeptide
DEEEIRTTNPVATEQYGSVSPTYELQQRSENMSG

SEQ ID NO: 59309 - protein, 34 aa, Artificial Sequence
  Description of Artificial Sequence: Synthetic polypeptide
DEEEIRTTNPVATEQYGSVSPTYNLGQSFNEQIE

SEQ ID NO: 59310 - protein, 35 aa, Artificial Sequence
  Description of Artificial Sequence: Synthetic polypeptide
DEEEIRTTNPVATEQYGSVSPTYNLGQSRINEEII

SEQ ID NO: 59311 - protein, 33 aa, Artificial Sequence
  Description of Artificial Sequence: Synthetic polypeptide
DEEEIRTTNPVATEQYGSVSPTVSLNVRGVEQE

SEQ ID NO: 59312 - protein, 32 aa, Artificial Sequence
  Description of Artificial Sequence: Synthetic polypeptide
DEEEIRTTNPVATEQYGSVSPTYNTNRNETSD

SEQ ID NO: 59313 - protein, 31 aa, Artificial Sequence
  Description of Artificial Sequence: Synthetic polypeptide
DEEEIRTTNPVATEQYGSVSPTYWAEGESQK

SEQ ID NO: 59314 - protein, 33 aa, Artificial Sequence
  Description of Artificial Sequence: Synthetic polypeptide
DEEEIRTTNPVATEQYGSVSPVLGQMRVVNEQI

SEQ ID NO: 59315 - protein, 33 aa, Artificial Sequence
  Description of Artificial Sequence: Synthetic polypeptide
DEEEIRTTNPVATEQYGSVSPVLWEQTIVENRL

SEQ ID NO: 59316 - protein, 32 aa, Artificial Sequence
  Description of Artificial Sequence: Synthetic polypeptide
DEEEIRTTNPVATEQYGSVSPVMNMQTMENNM

SEQ ID NO: 59317 - protein, 33 aa, Artificial Sequence
  Description of Artificial Sequence: Synthetic polypeptide
DEEEIRTTNPVATEQYGSVSPVMTMQRMDENRD

SEQ ID NO: 59318 - protein, 34 aa, Artificial Sequence
  Description of Artificial Sequence: Synthetic polypeptide
DEEEIRTTNPVATEQYGSVSPVNLQAQEGVNHLD

SEQ ID NO: 59319 - protein, 34 aa, Artificial Sequence
  Description of Artificial Sequence: Synthetic polypeptide
DEEEIRTTNPVATEQYGSVSPVNLTQHRDNLQTI

SEQ ID NO: 59320 - protein, 33 aa, Artificial Sequence
  Description of Artificial Sequence: Synthetic polypeptide
DEEEIRTTNPVATEQYGSVSMTMNGGQTRNPPF

SEQ ID NO: 59321 - protein, 33 aa, Artificial Sequence
  Description of Artificial Sequence: Synthetic polypeptide
DEEEIRTTNPVATEQYGSVSPVTTLQPPPQGEF

SEQ ID NO: 59322 - protein, 34 aa, Artificial Sequence
  Description of Artificial Sequence: Synthetic polypeptide
DEEEIRTTNPVATEQYGSVSPTYSLQRMVENMPI

SEQ ID NO: 59323 - protein, 32 aa, Artificial Sequence
  Description of Artificial Sequence: Synthetic polypeptide
DEEEIRTTNPVATEQYGSVSPTVQQPTTQTVR

SEQ ID NO: 59324 - protein, 34 aa, Artificial Sequence
  Description of Artificial Sequence: Synthetic polypeptide
DEEEIRTTNPVATEQYGSVSMTNLQQQNGPEEEL

SEQ ID NO: 59325 - protein, 34 aa, Artificial Sequence
  Description of Artificial Sequence: Synthetic polypeptide
DEEEIRTTNPVATEQYGSVSPTVNVLERGSDQDM

SEQ ID NO: 59326 - protein, 34 aa, Artificial Sequence
  Description of Artificial Sequence: Synthetic polypeptide
DEEEIRTTNPVATEQYGSVSPTTQLIQRNSNFEH

SEQ ID NO: 59327 - protein, 33 aa, Artificial Sequence
  Description of Artificial Sequence: Synthetic polypeptide
DEEEIRTTNPVATEQYGSVSPTTTLQQTAQGEF

SEQ ID NO: 59328 - protein, 32 aa, Artificial Sequence
  Description of Artificial Sequence: Synthetic polypeptide
DEEEIRTTNPVATEQYGSVSPTVAMIDGLEIR

SEQ ID NO: 59329 - protein, 34 aa, Artificial Sequence
  Description of Artificial Sequence: Synthetic polypeptide
DEEEIRTTNPVATEQYGSVSNAHNLQRVGEDFGI

SEQ ID NO: 59330 - protein, 34 aa, Artificial Sequence
  Description of Artificial Sequence: Synthetic polypeptide
DEEEIRTTNPVATEQYGSVSPTVDIQMRSLENDR

SEQ ID NO: 59331 - protein, 33 aa, Artificial Sequence
  Description of Artificial Sequence: Synthetic polypeptide
DEEEIRTTNPVATEQYGSVSPTVEHLEIESNQR

SEQ ID NO: 59332 - protein, 33 aa, Artificial Sequence
  Description of Artificial Sequence: Synthetic polypeptide
DEEEIRTTNPVATEQYGSVSMYNEDQIEDNVRQ

SEQ ID NO: 59333 - protein, 33 aa, Artificial Sequence
  Description of Artificial Sequence: Synthetic polypeptide
DEEEIRTTNPVATEQYGSVSPTVEHLESEENNR

SEQ ID NO: 59334 - protein, 34 aa, Artificial Sequence
  Description of Artificial Sequence: Synthetic polypeptide
DEEEIRTTNPVATEQYGSVSPTVHLQVPEENVRQ

SEQ ID NO: 59335 - protein, 32 aa, Artificial Sequence
  Description of Artificial Sequence: Synthetic polypeptide
DEEEIRTTNPVATEQYGSVSPTVILIDGLEIV

SEQ ID NO: 59336 - protein, 34 aa, Artificial Sequence
  Description of Artificial Sequence: Synthetic polypeptide
DEEEIRTTNPVATEQYGSVSPTVLLEERGQEEND

SEQ ID NO: 59337 - protein, 33 aa, Artificial Sequence
  Description of Artificial Sequence: Synthetic polypeptide
DEEEIRTTNPVATEQYGSVSMTTPLQQDSSNEQ

SEQ ID NO: 59338 - protein, 32 aa, Artificial Sequence
  Description of Artificial Sequence: Synthetic polypeptide
DEEEIRTTNPVATEQYGSVSMTTPLQDSFEQA

SEQ ID NO: 59339 - protein, 34 aa, Artificial Sequence
  Description of Artificial Sequence: Synthetic polypeptide
DEEEIRTTNPVATEQYGSVSPTVNDQPRNGEEQQ

SEQ ID NO: 59340 - protein, 33 aa, Artificial Sequence
  Description of Artificial Sequence: Synthetic polypeptide
DEEEIRTTNPVATEQYGSVSPTVNLQVPEPVIQ

SEQ ID NO: 59341 - protein, 33 aa, Artificial Sequence
  Description of Artificial Sequence: Synthetic polypeptide
DEEEIRTTNPVATEQYGSVSMTPLEQEVTETRQ

SEQ ID NO: 59342 - protein, 34 aa, Artificial Sequence
  Description of Artificial Sequence: Synthetic polypeptide
DEEEIRTTNPVATEQYGSVSMTNPLQVEGEELKS

SEQ ID NO: 59343 - protein, 33 aa, Artificial Sequence
  Description of Artificial Sequence: Synthetic polypeptide
DEEEIRTTNPVATEQYGSVSMTNMTQESTQNPA

SEQ ID NO: 59344 - protein, 32 aa, Artificial Sequence
  Description of Artificial Sequence: Synthetic polypeptide
DEEEIRTTNPVATEQYGSVSPTVNLVDELEEE

SEQ ID NO: 59345 - protein, 32 aa, Artificial Sequence
  Description of Artificial Sequence: Synthetic polypeptide
DEEEIRTTNPVATEQYGSVSPTVNVENTVLND

SEQ ID NO: 59346 - protein, 34 aa, Artificial Sequence
  Description of Artificial Sequence: Synthetic polypeptide
DEEEIRTTNPVATEQYGSVSPTVNVEQRGQMQAD

SEQ ID NO: 59347 - protein, 33 aa, Artificial Sequence
  Description of Artificial Sequence: Synthetic polypeptide
DEEEIRTTNPVATEQYGSVSPTNWVQTFDNSEE

SEQ ID NO: 59348 - protein, 32 aa, Artificial Sequence
  Description of Artificial Sequence: Synthetic polypeptide
DEEEIRTTNPVATEQYGSVSNNNLEQQTPEIE

SEQ ID NO: 59349 - protein, 34 aa, Artificial Sequence
  Description of Artificial Sequence: Synthetic polypeptide
DEEEIRTTNPVATEQYGSVSNMNLDQGEGNNDQE

SEQ ID NO: 59350 - protein, 34 aa, Artificial Sequence
  Description of Artificial Sequence: Synthetic polypeptide
DEEEIRTTNPVATEQYGSVSPTNVQQRQMHEVRN

SEQ ID NO: 59351 - protein, 35 aa, Artificial Sequence
  Description of Artificial Sequence: Synthetic polypeptide
DEEEIRTTNPVATEQYGSVSPTNDLNEGRMENERE

SEQ ID NO: 59352 - protein, 32 aa, Artificial Sequence
  Description of Artificial Sequence: Synthetic polypeptide
DEEEIRTTNPVATEQYGSVSPTNGEGNGEEDN

SEQ ID NO: 59353 - protein, 32 aa, Artificial Sequence
  Description of Artificial Sequence: Synthetic polypeptide
DEEEIRTTNPVATEQYGSVSPTNGEGNSEYDD

SEQ ID NO: 59354 - protein, 32 aa, Artificial Sequence
  Description of Artificial Sequence: Synthetic polypeptide
DEEEIRTTNPVATEQYGSVSPTNGEGNSNEDA

SEQ ID NO: 59355 - protein, 35 aa, Artificial Sequence
  Description of Artificial Sequence: Synthetic polypeptide
DEEEIRTTNPVATEQYGSVSPTNGLQQRIVDEGEL

SEQ ID NO: 59356 - protein, 33 aa, Artificial Sequence
  Description of Artificial Sequence: Synthetic polypeptide
DEEEIRTTNPVATEQYGSVSPTNGMDNRGTQEI

SEQ ID NO: 59357 - protein, 34 aa, Artificial Sequence
  Description of Artificial Sequence: Synthetic polypeptide
DEEEIRTTNPVATEQYGSVSPTNGVIRNGVANMI

SEQ ID NO: 59358 - protein, 32 aa, Artificial Sequence
  Description of Artificial Sequence: Synthetic polypeptide
DEEEIRTTNPVATEQYGSVSPTNIEGNNQVED

SEQ ID NO: 59359 - protein, 33 aa, Artificial Sequence
  Description of Artificial Sequence: Synthetic polypeptide
DEEEIRTTNPVATEQYGSVSPTNIHEARNNQED

SEQ ID NO: 59360 - protein, 33 aa, Artificial Sequence
  Description of Artificial Sequence: Synthetic polypeptide
DEEEIRTTNPVATEQYGSVSPTNDLETIMNEHE

SEQ ID NO: 59361 - protein, 34 aa, Artificial Sequence
  Description of Artificial Sequence: Synthetic polypeptide
DEEEIRTTNPVATEQYGSVSPTNLDQSDMVEVRE

SEQ ID NO: 59362 - protein, 34 aa, Artificial Sequence
  Description of Artificial Sequence: Synthetic polypeptide
DEEEIRTTNPVATEQYGSVSPTNLDTTRVEEGHD

SEQ ID NO: 59363 - protein, 32 aa, Artificial Sequence
  Description of Artificial Sequence: Synthetic polypeptide
DEEEIRTTNPVATEQYGSVSPTNLELNYDQES

SEQ ID NO: 59364 - protein, 33 aa, Artificial Sequence
  Description of Artificial Sequence: Synthetic polypeptide
DEEEIRTTNPVATEQYGSVSPTNLETIGEFDGY

SEQ ID NO: 59365 - protein, 34 aa, Artificial Sequence
  Description of Artificial Sequence: Synthetic polypeptide
DEEEIRTTNPVATEQYGSVSPTNLLQMRIDDEEL

SEQ ID NO: 59366 - protein, 35 aa, Artificial Sequence
  Description of Artificial Sequence: Synthetic polypeptide
DEEEIRTTNPVATEQYGSVSPTNLLQQRINDNDEL

SEQ ID NO: 59367 - protein, 34 aa, Artificial Sequence
  Description of Artificial Sequence: Synthetic polypeptide
DEEEIRTTNPVATEQYGSVSPTNLLQQRIPDEGL

SEQ ID NO: 59368 - protein, 34 aa, Artificial Sequence
  Description of Artificial Sequence: Synthetic polypeptide
DEEEIRTTNPVATEQYGSVSPTNLLQQRPVFEEL

SEQ ID NO: 59369 - protein, 34 aa, Artificial Sequence
  Description of Artificial Sequence: Synthetic polypeptide
DEEEIRTTNPVATEQYGSVSPTNLLQQRQSDEEL

SEQ ID NO: 59370 - protein, 34 aa, Artificial Sequence
  Description of Artificial Sequence: Synthetic polypeptide
DEEEIRTTNPVATEQYGSVSPTNLLVIQEDPNLF

SEQ ID NO: 59371 - protein, 33 aa, Artificial Sequence
  Description of Artificial Sequence: Synthetic polypeptide
DEEEIRTTNPVATEQYGSVSNNLLQNVALEQRL

SEQ ID NO: 59372 - protein, 33 aa, Artificial Sequence
  Description of Artificial Sequence: Synthetic polypeptide
DEEEIRTTNPVATEQYGSVSPTNLMVIGSQEFQ

SEQ ID NO: 59373 - protein, 35 aa, Artificial Sequence
  Description of Artificial Sequence: Synthetic polypeptide
DEEEIRTTNPVATEQYGSVSPTNDIQMRSLDNDRF

SEQ ID NO: 59374 - protein, 33 aa, Artificial Sequence
  Description of Artificial Sequence: Synthetic polypeptide
DEEEIRTTNPVATEQYGSVSPTNDDETIMNERN

SEQ ID NO: 59375 - protein, 33 aa, Artificial Sequence
  Description of Artificial Sequence: Synthetic polypeptide
DEEEIRTTNPVATEQYGSVSNNNIGQSTGGGNE

SEQ ID NO: 59376 - protein, 33 aa, Artificial Sequence
  Description of Artificial Sequence: Synthetic polypeptide
DEEEIRTTNPVATEQYGSVSNNNIGQSGENGNV

SEQ ID NO: 59377 - protein, 33 aa, Artificial Sequence
  Description of Artificial Sequence: Synthetic polypeptide
DEEEIRTTNPVATEQYGSVSNNNIGQEGGNQGT

SEQ ID NO: 59378 - protein, 33 aa, Artificial Sequence
  Description of Artificial Sequence: Synthetic polypeptide
DEEEIRTTNPVATEQYGSVSNNNEQSGEGNQGG

SEQ ID NO: 59379 - protein, 33 aa, Artificial Sequence
  Description of Artificial Sequence: Synthetic polypeptide
DEEEIRTTNPVATEQYGSVSPTLNDMQRSTEPS

SEQ ID NO: 59380 - protein, 34 aa, Artificial Sequence
  Description of Artificial Sequence: Synthetic polypeptide
DEEEIRTTNPVATEQYGSVSPTLNHQIMGEENTF

SEQ ID NO: 59381 - protein, 32 aa, Artificial Sequence
  Description of Artificial Sequence: Synthetic polypeptide
DEEEIRTTNPVATEQYGSVSNNLTDSGGQEED

SEQ ID NO: 59382 - protein, 32 aa, Artificial Sequence
  Description of Artificial Sequence: Synthetic polypeptide
DEEEIRTTNPVATEQYGSVSPTLNLIPNEEDT

SEQ ID NO: 59383 - protein, 33 aa, Artificial Sequence
  Description of Artificial Sequence: Synthetic polypeptide
DEEEIRTTNPVATEQYGSVSPTLNLIPVGEEGD

SEQ ID NO: 59384 - protein, 34 aa, Artificial Sequence
  Description of Artificial Sequence: Synthetic polypeptide
DEEEIRTTNPVATEQYGSVSPTNDEENSGINVRS

SEQ ID NO: 59385 - protein, 32 aa, Artificial Sequence
  Description of Artificial Sequence: Synthetic polypeptide
DEEEIRTTNPVATEQYGSVSPTLNVQPDQQYQ

SEQ ID NO: 59386 - protein, 35 aa, Artificial Sequence
  Description of Artificial Sequence: Synthetic polypeptide
DEEEIRTTNPVATEQYGSVSPTMLNSQKRSDQENR

SEQ ID NO: 59387 - protein, 33 aa, Artificial Sequence
  Description of Artificial Sequence: Synthetic polypeptide
DEEEIRTTNPVATEQYGSVSPTMNEPVREVSER

SEQ ID NO: 59388 - protein, 33 aa, Artificial Sequence
  Description of Artificial Sequence: Synthetic polypeptide
DEEEIRTTNPVATEQYGSVSPTMNHPVREVPRD

SEQ ID NO: 59389 - protein, 32 aa, Artificial Sequence
  Description of Artificial Sequence: Synthetic polypeptide
DEEEIRTTNPVATEQYGSVSPTMNHQQTVDVL

SEQ ID NO: 59390 - protein, 34 aa, Artificial Sequence
  Description of Artificial Sequence: Synthetic polypeptide
DEEEIRTTNPVATEQYGSVSPTMNLPVRFGVEQE

SEQ ID NO: 59391 - protein, 33 aa, Artificial Sequence
  Description of Artificial Sequence: Synthetic polypeptide
DEEEIRTTNPVATEQYGSVSPTMNLTVTGVEQD

SEQ ID NO: 59392 - protein, 31 aa, Artificial Sequence
  Description of Artificial Sequence: Synthetic polypeptide
DEEEIRTTNPVATEQYGSVSPTMNTEPMEES

SEQ ID NO: 59393 - protein, 33 aa, Artificial Sequence
  Description of Artificial Sequence: Synthetic polypeptide
DEEEIRTTNPVATEQYGSVSPTNALEELFEEND

SEQ ID NO: 59394 - protein, 33 aa, Artificial Sequence
  Description of Artificial Sequence: Synthetic polypeptide
DEEEIRTTNPVATEQYGSVSPTNALEQEQEELD

SEQ ID NO: 59395 - protein, 33 aa, Artificial Sequence
  Description of Artificial Sequence: Synthetic polypeptide
DEEEIRTTNPVATEQYGSVSPTMGLNHQLVNGL

SEQ ID NO: 59396 - protein, 32 aa, Artificial Sequence
  Description of Artificial Sequence: Synthetic polypeptide
DEEEIRTTNPVATEQYGSVSPTNLPANEPEEI

SEQ ID NO: 59397 - protein, 34 aa, Artificial Sequence
  Description of Artificial Sequence: Synthetic polypeptide
DEEEIRTTNPVATEQYGSVSPTNLQERNEVDIEM

SEQ ID NO: 59398 - protein, 34 aa, Artificial Sequence
  Description of Artificial Sequence: Synthetic polypeptide
DEEEIRTTNPVATEQYGSVSPTNLQVVEGEELKS

SEQ ID NO: 59399 - protein, 35 aa, Artificial Sequence
  Description of Artificial Sequence: Synthetic polypeptide
DEEEIRTTNPVATEQYGSVSNMTNLEIQTGGNATV

SEQ ID NO: 59400 - protein, 35 aa, Artificial Sequence
  Description of Artificial Sequence: Synthetic polypeptide
DEEEIRTTNPVATEQYGSVSNMTNGLEGQTGNNTV

SEQ ID NO: 59401 - protein, 33 aa, Artificial Sequence
  Description of Artificial Sequence: Synthetic polypeptide
DEEEIRTTNPVATEQYGSVSNMTNGEMGDGNEQ

SEQ ID NO: 59402 - protein, 33 aa, Artificial Sequence
  Description of Artificial Sequence: Synthetic polypeptide
DEEEIRTTNPVATEQYGSVSNMTDEGQGGNNLD

SEQ ID NO: 59403 - protein, 32 aa, Artificial Sequence
  Description of Artificial Sequence: Synthetic polypeptide
DEEEIRTTNPVATEQYGSVSNMNTQQPIDNNE

SEQ ID NO: 59404 - protein, 33 aa, Artificial Sequence
  Description of Artificial Sequence: Synthetic polypeptide
DEEEIRTTNPVATEQYGSVSPTNPLQNAPTEHE

SEQ ID NO: 59405 - protein, 35 aa, Artificial Sequence
  Description of Artificial Sequence: Synthetic polypeptide
DEEEIRTTNPVATEQYGSVSNMNMLQNRNGNEEEL

SEQ ID NO: 59406 - protein, 33 aa, Artificial Sequence
  Description of Artificial Sequence: Synthetic polypeptide
DEEEIRTTNPVATEQYGSVSNMNLVNFEGGGNG

SEQ ID NO: 59407 - protein, 34 aa, Artificial Sequence
  Description of Artificial Sequence: Synthetic polypeptide
DEEEIRTTNPVATEQYGSVSNMNLVGQSGGNQDI

SEQ ID NO: 59408 - protein, 34 aa, Artificial Sequence
  Description of Artificial Sequence: Synthetic polypeptide
DEEEIRTTNPVATEQYGSVSPTNPLFPFGENESL

SEQ ID NO: 59409 - protein, 34 aa, Artificial Sequence
  Description of Artificial Sequence: Synthetic polypeptide
DEEEIRTTNPVATEQYGSVSPTNQNEDRGENNMN

SEQ ID NO: 59410 - protein, 32 aa, Artificial Sequence
  Description of Artificial Sequence: Synthetic polypeptide
DEEEIRTTNPVATEQYGSVSPTNTNQLNDEEE

SEQ ID NO: 59411 - protein, 34 aa, Artificial Sequence
  Description of Artificial Sequence: Synthetic polypeptide
DEEEIRTTNPVATEQYGSVSPTNTVIRNTVANRN

SEQ ID NO: 59412 - protein, 33 aa, Artificial Sequence
  Description of Artificial Sequence: Synthetic polypeptide
DEEEIRTTNPVATEQYGSVSNMNLNEEFGNNQG

SEQ ID NO: 59413 - protein, 32 aa, Artificial Sequence
  Description of Artificial Sequence: Synthetic polypeptide
DEEEIRTTNPVATEQYGSVSNMNLMMVGILQQ

SEQ ID NO: 59414 - protein, 34 aa, Artificial Sequence
  Description of Artificial Sequence: Synthetic polypeptide
DEEEIRTTNPVATEQYGSVSNMNLIVGQSGTNDD

SEQ ID NO: 59415 - protein, 34 aa, Artificial Sequence
  Description of Artificial Sequence: Synthetic polypeptide
DEEEIRTTNPVATEQYGSVSNMNLIQDEGQNSEE

SEQ ID NO: 59416 - protein, 34 aa, Artificial Sequence
  Description of Artificial Sequence: Synthetic polypeptide
DEEEIRTTNPVATEQYGSVSNMNLGQQGGNNGQG

SEQ ID NO: 59417 - protein, 32 aa, Artificial Sequence
  Description of Artificial Sequence: Synthetic polypeptide
DEEEIRTTNPVATEQYGSVSPTNVENRETQEI

SEQ ID NO: 59418 - protein, 34 aa, Artificial Sequence
  Description of Artificial Sequence: Synthetic polypeptide
DEEEIRTTNPVATEQYGSVSNMNLGQDNGENEED

SEQ ID NO: 59419 - protein, 34 aa, Artificial Sequence
  Description of Artificial Sequence: Synthetic polypeptide
DEEEIRTTNPVATEQYGSVSPTNSLWEREMPETR

SEQ ID NO: 59420 - protein, 36 aa, Artificial Sequence
  Description of Artificial Sequence: Synthetic polypeptide
DEEEIRTTNPVATEQYGSVSPTNNYLSQRQGDLNEE

SEQ ID NO: 59421 - protein, 33 aa, Artificial Sequence
  Description of Artificial Sequence: Synthetic polypeptide
DEEEIRTTNPVATEQYGSVSPTNNSEELGEENS

SEQ ID NO: 59422 - protein, 33 aa, Artificial Sequence
  Description of Artificial Sequence: Synthetic polypeptide
DEEEIRTTNPVATEQYGSVSNMTVGLGEIGNED

SEQ ID NO: 59423 - protein, 33 aa, Artificial Sequence
  Description of Artificial Sequence: Synthetic polypeptide
DEEEIRTTNPVATEQYGSVSPTNLVQEVSQDAD

SEQ ID NO: 59424 - protein, 34 aa, Artificial Sequence
  Description of Artificial Sequence: Synthetic polypeptide
DEEEIRTTNPVATEQYGSVSPTNMEPPRGENQEI

SEQ ID NO: 59425 - protein, 33 aa, Artificial Sequence
  Description of Artificial Sequence: Synthetic polypeptide
DEEEIRTTNPVATEQYGSVSPTNMEQLEMETRE

SEQ ID NO: 59426 - protein, 32 aa, Artificial Sequence
  Description of Artificial Sequence: Synthetic polypeptide
DEEEIRTTNPVATEQYGSVSNNLDDIFNVVVD

SEQ ID NO: 59427 - protein, 34 aa, Artificial Sequence
  Description of Artificial Sequence: Synthetic polypeptide
DEEEIRTTNPVATEQYGSVSPTNMMWQERGEEEG

SEQ ID NO: 59428 - protein, 32 aa, Artificial Sequence
  Description of Artificial Sequence: Synthetic polypeptide
DEEEIRTTNPVATEQYGSVSPTNMQTQMEEPD

SEQ ID NO: 59429 - protein, 33 aa, Artificial Sequence
  Description of Artificial Sequence: Synthetic polypeptide
DEEEIRTTNPVATEQYGSVSPTNMSENGNNEEG

SEQ ID NO: 59430 - protein, 33 aa, Artificial Sequence
  Description of Artificial Sequence: Synthetic polypeptide
DEEEIRTTNPVATEQYGSVSPTNNAQQQGEIDQ

SEQ ID NO: 59431 - protein, 32 aa, Artificial Sequence
  Description of Artificial Sequence: Synthetic polypeptide
DEEEIRTTNPVATEQYGSVSNNGLERNPEVQS

SEQ ID NO: 59432 - protein, 33 aa, Artificial Sequence
  Description of Artificial Sequence: Synthetic polypeptide
DEEEIRTTNPVATEQYGSVSPTNNEQNIDGMSM

SEQ ID NO: 59433 - protein, 32 aa, Artificial Sequence
  Description of Artificial Sequence: Synthetic polypeptide
DEEEIRTTNPVATEQYGSVSNNEQQEDPNLLG

SEQ ID NO: 59434 - protein, 33 aa, Artificial Sequence
  Description of Artificial Sequence: Synthetic polypeptide
DEEEIRTTNPVATEQYGSVSNNEQMVNGFVLRI

SEQ ID NO: 59435 - protein, 32 aa, Artificial Sequence
  Description of Artificial Sequence: Synthetic polypeptide
DEEEIRTTNPVATEQYGSVSNNEQMMVGEIQT

SEQ ID NO: 59436 - protein, 34 aa, Artificial Sequence
  Description of Artificial Sequence: Synthetic polypeptide
DEEEIRTTNPVATEQYGSVSPTNNLDQRVMVPLT

SEQ ID NO: 59437 - protein, 34 aa, Artificial Sequence
  Description of Artificial Sequence: Synthetic polypeptide
DEEEIRTTNPVATEQYGSVSPTNNLEFPNGDNIS

SEQ ID NO: 59438 - protein, 33 aa, Artificial Sequence
  Description of Artificial Sequence: Synthetic polypeptide
DEEEIRTTNPVATEQYGSVSPTNNLIPNMNEVD

SEQ ID NO: 59439 - protein, 33 aa, Artificial Sequence
  Description of Artificial Sequence: Synthetic polypeptide
DEEEIRTTNPVATEQYGSVSPTNNPQQVQGIHE

SEQ ID NO: 59440 - protein, 33 aa, Artificial Sequence
  Description of Artificial Sequence: Synthetic polypeptide
DEEEIRTTNPVATEQYGSVSPTNNQEEHGEELS

SEQ ID NO: 59441 - protein, 32 aa, Artificial Sequence
  Description of Artificial Sequence: Synthetic polypeptide
DEEEIRTTNPVATEQYGSVSNNDIVQTGSQFI

SEQ ID NO: 59442 - protein, 33 aa, Artificial Sequence
  Description of Artificial Sequence: Synthetic polypeptide
DEEEIRTTNPVATEQYGSVSPTNNQQRQAELPI

SEQ ID NO: 59443 - protein, 32 aa, Artificial Sequence
  Description of Artificial Sequence: Synthetic polypeptide
DEEEIRTTNPVATEQYGSVSNNDINEAGNEIS

SEQ ID NO: 59444 - protein, 34 aa, Artificial Sequence
  Description of Artificial Sequence: Synthetic polypeptide
DEEEIRTTNPVATEQYGSVSNMNLDQSNGGNVGQ

SEQ ID NO: 59445 - protein, 33 aa, Artificial Sequence
  Description of Artificial Sequence: Synthetic polypeptide
DEEEIRTTNPVATEQYGSVSINNGQGGGEINTN

SEQ ID NO: 59446 - protein, 32 aa, Artificial Sequence
  Description of Artificial Sequence: Synthetic polypeptide
DEEEIRTTNPVATEQYGSVSINMDDNIGNQQD

SEQ ID NO: 59447 - protein, 33 aa, Artificial Sequence
  Description of Artificial Sequence: Synthetic polypeptide
DEEEIRTTNPVATEQYGSVSTMELENGGGENDG

SEQ ID NO: 59448 - protein, 31 aa, Artificial Sequence
  Description of Artificial Sequence: Synthetic polypeptide
DEEEIRTTNPVATEQYGSVSTTSDMQENTIQ

SEQ ID NO: 59449 - protein, 33 aa, Artificial Sequence
  Description of Artificial Sequence: Synthetic polypeptide
DEEEIRTTNPVATEQYGSVSTTSVQDLGFNNGI

SEQ ID NO: 59450 - protein, 33 aa, Artificial Sequence
  Description of Artificial Sequence: Synthetic polypeptide
DEEEIRTTNPVATEQYGSVSTTTLEDNGGGNNS

SEQ ID NO: 59451 - protein, 33 aa, Artificial Sequence
  Description of Artificial Sequence: Synthetic polypeptide
DEEEIRTTNPVATEQYGSVSTTTLSDENIGANS

SEQ ID NO: 59452 - protein, 33 aa, Artificial Sequence
  Description of Artificial Sequence: Synthetic polypeptide
DEEEIRTTNPVATEQYGSVSTTTLSDGNEGGNI

SEQ ID NO: 59453 - protein, 33 aa, Artificial Sequence
  Description of Artificial Sequence: Synthetic polypeptide
DEEEIRTTNPVATEQYGSVSTTTLSDGNEGNAS

SEQ ID NO: 59454 - protein, 33 aa, Artificial Sequence
  Description of Artificial Sequence: Synthetic polypeptide
DEEEIRTTNPVATEQYGSVSTTTLSDGNTGGNS

SEQ ID NO: 59455 - protein, 33 aa, Artificial Sequence
  Description of Artificial Sequence: Synthetic polypeptide
DEEEIRTTNPVATEQYGSVSTTTLSDNEGGNGQ

SEQ ID NO: 59456 - protein, 33 aa, Artificial Sequence
  Description of Artificial Sequence: Synthetic polypeptide
DEEEIRTTNPVATEQYGSVSTTTLSDNNEGGND

SEQ ID NO: 59457 - protein, 33 aa, Artificial Sequence
  Description of Artificial Sequence: Synthetic polypeptide
DEEEIRTTNPVATEQYGSVSTTQVLLQLGVGQN

SEQ ID NO: 59458 - protein, 32 aa, Artificial Sequence
  Description of Artificial Sequence: Synthetic polypeptide
DEEEIRTTNPVATEQYGSVSCTNQGGLPGVQF

SEQ ID NO: 59459 - protein, 33 aa, Artificial Sequence
  Description of Artificial Sequence: Synthetic polypeptide
DEEEIRTTNPVATEQYGSVSTTVGPNRNGMNPV

SEQ ID NO: 59460 - protein, 32 aa, Artificial Sequence
  Description of Artificial Sequence: Synthetic polypeptide
DEEEIRTTNPVATEQYGSVSTTVLDGMGGGET

SEQ ID NO: 59461 - protein, 33 aa, Artificial Sequence
  Description of Artificial Sequence: Synthetic polypeptide
DEEEIRTTNPVATEQYGSVSTTVLDLMEDGGNE

SEQ ID NO: 59462 - protein, 33 aa, Artificial Sequence
  Description of Artificial Sequence: Synthetic polypeptide
DEEEIRTTNPVATEQYGSVSTTVLDLVEGGNQE

SEQ ID NO: 59463 - protein, 33 aa, Artificial Sequence
  Description of Artificial Sequence: Synthetic polypeptide
DEEEIRTTNPVATEQYGSVSTTVLEDPNYGNDS

SEQ ID NO: 59464 - protein, 34 aa, Artificial Sequence
  Description of Artificial Sequence: Synthetic polypeptide
DEEEIRTTNPVATEQYGSVSCTNNGLLIQQIVND

SEQ ID NO: 59465 - protein, 33 aa, Artificial Sequence
  Description of Artificial Sequence: Synthetic polypeptide
DEEEIRTTNPVATEQYGSVSTTVMLGSGGENNQ

SEQ ID NO: 59466 - protein, 33 aa, Artificial Sequence
  Description of Artificial Sequence: Synthetic polypeptide
DEEEIRTTNPVATEQYGSVSTTYGTYWQTGNEY

SEQ ID NO: 59467 - protein, 34 aa, Artificial Sequence
  Description of Artificial Sequence: Synthetic polypeptide
DEEEIRTTNPVATEQYGSVSTVDLGQMEFGTNDE

SEQ ID NO: 59468 - protein, 34 aa, Artificial Sequence
  Description of Artificial Sequence: Synthetic polypeptide
DEEEIRTTNPVATEQYGSVSTTTNGIQESGTNTD

SEQ ID NO: 59469 - protein, 32 aa, Artificial Sequence
  Description of Artificial Sequence: Synthetic polypeptide
DEEEIRTTNPVATEQYGSVSTVELTDEQQEPQ

SEQ ID NO: 59470 - protein, 33 aa, Artificial Sequence
  Description of Artificial Sequence: Synthetic polypeptide
DEEEIRTTNPVATEQYGSVSTTQQLLQNSQNGQ

SEQ ID NO: 59471 - protein, 33 aa, Artificial Sequence
  Description of Artificial Sequence: Synthetic polypeptide
DEEEIRTTNPVATEQYGSVSCTVNGPQTIGKQF

SEQ ID NO: 59472 - protein, 34 aa, Artificial Sequence
  Description of Artificial Sequence: Synthetic polypeptide
DEEEIRTTNPVATEQYGSVSTTNVIEQQGGNDGP

SEQ ID NO: 59473 - protein, 34 aa, Artificial Sequence
  Description of Artificial Sequence: Synthetic polypeptide
DEEEIRTTNPVATEQYGSVSTTNVIQGGGGNDDE

SEQ ID NO: 59474 - protein, 33 aa, Artificial Sequence
  Description of Artificial Sequence: Synthetic polypeptide
DEEEIRTTNPVATEQYGSVSTTPAEPNMANGNV

SEQ ID NO: 59475 - protein, 34 aa, Artificial Sequence
  Description of Artificial Sequence: Synthetic polypeptide
DEEEIRTTNPVATEQYGSVSTTPAEPQDRNGMNV

SEQ ID NO: 59476 - protein, 33 aa, Artificial Sequence
  Description of Artificial Sequence: Synthetic polypeptide
DEEEIRTTNPVATEQYGSVSDDTNMQGEGGEED

SEQ ID NO: 59477 - protein, 33 aa, Artificial Sequence
  Description of Artificial Sequence: Synthetic polypeptide
DEEEIRTTNPVATEQYGSVSTTPAGMMRNGNPV

SEQ ID NO: 59478 - protein, 34 aa, Artificial Sequence
  Description of Artificial Sequence: Synthetic polypeptide
DEEEIRTTNPVATEQYGSVSTTPAGPNMRNGNPR

SEQ ID NO: 59479 - protein, 32 aa, Artificial Sequence
  Description of Artificial Sequence: Synthetic polypeptide
DEEEIRTTNPVATEQYGSVSDDLDERQSENNS

SEQ ID NO: 59480 - protein, 32 aa, Artificial Sequence
  Description of Artificial Sequence: Synthetic polypeptide
DEEEIRTTNPVATEQYGSVSDDDLQYISQQRP

SEQ ID NO: 59481 - protein, 33 aa, Artificial Sequence
  Description of Artificial Sequence: Synthetic polypeptide
DEEEIRTTNPVATEQYGSVSTTQQLLQNQQNQE

SEQ ID NO: 59482 - protein, 34 aa, Artificial Sequence
  Description of Artificial Sequence: Synthetic polypeptide
DEEEIRTTNPVATEQYGSVSTTPALPNMRNGNPV

SEQ ID NO: 59483 - protein, 33 aa, Artificial Sequence
  Description of Artificial Sequence: Synthetic polypeptide
DEEEIRTTNPVATEQYGSVSDAVGLQGGENNTQ

SEQ ID NO: 59484 - protein, 35 aa, Artificial Sequence
  Description of Artificial Sequence: Synthetic polypeptide
DEEEIRTTNPVATEQYGSVSTTPNEPQDREGENPG

SEQ ID NO: 59485 - protein, 33 aa, Artificial Sequence
  Description of Artificial Sequence: Synthetic polypeptide
DEEEIRTTNPVATEQYGSVSDANLIPRIGEDEE

SEQ ID NO: 59486 - protein, 33 aa, Artificial Sequence
  Description of Artificial Sequence: Synthetic polypeptide
DEEEIRTTNPVATEQYGSVSTTQLLQNNSQNGI

SEQ ID NO: 59487 - protein, 33 aa, Artificial Sequence
  Description of Artificial Sequence: Synthetic polypeptide
DEEEIRTTNPVATEQYGSVSTTQLLQNSQNQQE

SEQ ID NO: 59488 - protein, 32 aa, Artificial Sequence
  Description of Artificial Sequence: Synthetic polypeptide
DEEEIRTTNPVATEQYGSVSCTWLYQTIEDQQ

SEQ ID NO: 59489 - protein, 34 aa, Artificial Sequence
  Description of Artificial Sequence: Synthetic polypeptide
DEEEIRTTNPVATEQYGSVSTTQNGNQEIGNTQE

SEQ ID NO: 59490 - protein, 34 aa, Artificial Sequence
  Description of Artificial Sequence: Synthetic polypeptide
DEEEIRTTNPVATEQYGSVSTTQNLLQGNNTQNV

SEQ ID NO: 59491 - protein, 34 aa, Artificial Sequence
  Description of Artificial Sequence: Synthetic polypeptide
DEEEIRTTNPVATEQYGSVSTTQNQGGQNGGNND

SEQ ID NO: 59492 - protein, 34 aa, Artificial Sequence
  Description of Artificial Sequence: Synthetic polypeptide
DEEEIRTTNPVATEQYGSVSTTPLQVQRQGQEQL

SEQ ID NO: 59493 - protein, 32 aa, Artificial Sequence
  Description of Artificial Sequence: Synthetic polypeptide
DEEEIRTTNPVATEQYGSVSTVEQTDGQGEEQ

SEQ ID NO: 59494 - protein, 33 aa, Artificial Sequence
  Description of Artificial Sequence: Synthetic polypeptide
DEEEIRTTNPVATEQYGSVSTVLGNQLQEDEEL

SEQ ID NO: 59495 - protein, 33 aa, Artificial Sequence
  Description of Artificial Sequence: Synthetic polypeptide
DEEEIRTTNPVATEQYGSVSTVLGNQLQEDEEQ

SEQ ID NO: 59496 - protein, 33 aa, Artificial Sequence
  Description of Artificial Sequence: Synthetic polypeptide
DEEEIRTTNPVATEQYGSVSTVTQSVGMGGGNG

SEQ ID NO: 59497 - protein, 35 aa, Artificial Sequence
  Description of Artificial Sequence: Synthetic polypeptide
DEEEIRTTNPVATEQYGSVSCTENLMQHRSSENDG

SEQ ID NO: 59498 - protein, 34 aa, Artificial Sequence
  Description of Artificial Sequence: Synthetic polypeptide
DEEEIRTTNPVATEQYGSVSTWNINQVRTGSIQQ

SEQ ID NO: 59499 - protein, 35 aa, Artificial Sequence
  Description of Artificial Sequence: Synthetic polypeptide
DEEEIRTTNPVATEQYGSVSTWNLEVQLTGGQNQK

SEQ ID NO: 59500 - protein, 34 aa, Artificial Sequence
  Description of Artificial Sequence: Synthetic polypeptide
DEEEIRTTNPVATEQYGSVSTWNLMENRAMPEIR

SEQ ID NO: 59501 - protein, 33 aa, Artificial Sequence
  Description of Artificial Sequence: Synthetic polypeptide
DEEEIRTTNPVATEQYGSVSTWNPMADGSDQRL

SEQ ID NO: 59502 - protein, 33 aa, Artificial Sequence
  Description of Artificial Sequence: Synthetic polypeptide
DEEEIRTTNPVATEQYGSVSTYDHVQDRNNQTD

SEQ ID NO: 59503 - protein, 33 aa, Artificial Sequence
  Description of Artificial Sequence: Synthetic polypeptide
DEEEIRTTNPVATEQYGSVSTYEDGQGNQGNGE

SEQ ID NO: 59504 - protein, 33 aa, Artificial Sequence
  Description of Artificial Sequence: Synthetic polypeptide
DEEEIRTTNPVATEQYGSVSTYGLGMEGIENQE

SEQ ID NO: 59505 - protein, 32 aa, Artificial Sequence
  Description of Artificial Sequence: Synthetic polypeptide
DEEEIRTTNPVATEQYGSVSTVTLEPSTEDRV

SEQ ID NO: 59506 - protein, 34 aa, Artificial Sequence
  Description of Artificial Sequence: Synthetic polypeptide
DEEEIRTTNPVATEQYGSVSTYGLQEMGGDNEDT

SEQ ID NO: 59507 - protein, 31 aa, Artificial Sequence
  Description of Artificial Sequence: Synthetic polypeptide
DEEEIRTTNPVATEQYGSVSCSVELQMTEDK

SEQ ID NO: 59508 - protein, 33 aa, Artificial Sequence
  Description of Artificial Sequence: Synthetic polypeptide
DEEEIRTTNPVATEQYGSVSTYGMGNTGQEGDE

SEQ ID NO: 59509 - protein, 32 aa, Artificial Sequence
  Description of Artificial Sequence: Synthetic polypeptide
DEEEIRTTNPVATEQYGSVSTYGTGDGNGNIN

SEQ ID NO: 59510 - protein, 34 aa, Artificial Sequence
  Description of Artificial Sequence: Synthetic polypeptide
DEEEIRTTNPVATEQYGSVSTYILQDEMGGENEF

SEQ ID NO: 59511 - protein, 34 aa, Artificial Sequence
  Description of Artificial Sequence: Synthetic polypeptide
DEEEIRTTNPVATEQYGSVSTYILQQEMGGGNET

SEQ ID NO: 59512 - protein, 31 aa, Artificial Sequence
  Description of Artificial Sequence: Synthetic polypeptide
DEEEIRTTNPVATEQYGSVSCSELQMTEDIF

SEQ ID NO: 59513 - protein, 31 aa, Artificial Sequence
  Description of Artificial Sequence: Synthetic polypeptide
DEEEIRTTNPVATEQYGSVSCSELQMTDEDQ

SEQ ID NO: 59514 - protein, 31 aa, Artificial Sequence
  Description of Artificial Sequence: Synthetic polypeptide
DEEEIRTTNPVATEQYGSVSCSELNQMSEDI

SEQ ID NO: 59515 - protein, 31 aa, Artificial Sequence
  Description of Artificial Sequence: Synthetic polypeptide
DEEEIRTTNPVATEQYGSVSCSDELDMTNDI

SEQ ID NO: 59516 - protein, 34 aa, Artificial Sequence
  Description of Artificial Sequence: Synthetic polypeptide
DEEEIRTTNPVATEQYGSVSTYGLSNDQNGGNNA

SEQ ID NO: 59517 - protein, 33 aa, Artificial Sequence
  Description of Artificial Sequence: Synthetic polypeptide
DEEEIRTTNPVATEQYGSVSTVNVGVGQGNQQE

SEQ ID NO: 59518 - protein, 33 aa, Artificial Sequence
  Description of Artificial Sequence: Synthetic polypeptide
DEEEIRTTNPVATEQYGSVSTVNVDSGFGGNDG

SEQ ID NO: 59519 - protein, 33 aa, Artificial Sequence
  Description of Artificial Sequence: Synthetic polypeptide
DEEEIRTTNPVATEQYGSVSTVNVDNSGGGQNI

SEQ ID NO: 59520 - protein, 32 aa, Artificial Sequence
  Description of Artificial Sequence: Synthetic polypeptide
DEEEIRTTNPVATEQYGSVSTVLGSGFEGEGF

SEQ ID NO: 59521 - protein, 32 aa, Artificial Sequence
  Description of Artificial Sequence: Synthetic polypeptide
DEEEIRTTNPVATEQYGSVSTVLNNNSGQTGG

SEQ ID NO: 59522 - protein, 33 aa, Artificial Sequence
  Description of Artificial Sequence: Synthetic polypeptide
DEEEIRTTNPVATEQYGSVSTVLQNGSGQTEED

SEQ ID NO: 59523 - protein, 33 aa, Artificial Sequence
  Description of Artificial Sequence: Synthetic polypeptide
DEEEIRTTNPVATEQYGSVSTVLQNQLQSEDEE

SEQ ID NO: 59524 - protein, 32 aa, Artificial Sequence
  Description of Artificial Sequence: Synthetic polypeptide
DEEEIRTTNPVATEQYGSVSTVLTGFGGDEGF

SEQ ID NO: 59525 - protein, 33 aa, Artificial Sequence
  Description of Artificial Sequence: Synthetic polypeptide
DEEEIRTTNPVATEQYGSVSCTNGPETRIGKQF

SEQ ID NO: 59526 - protein, 34 aa, Artificial Sequence
  Description of Artificial Sequence: Synthetic polypeptide
DEEEIRTTNPVATEQYGSVSTVNGFGQENIGENQ

SEQ ID NO: 59527 - protein, 34 aa, Artificial Sequence
  Description of Artificial Sequence: Synthetic polypeptide
DEEEIRTTNPVATEQYGSVSCTNGGQRSGSKQFD

SEQ ID NO: 59528 - protein, 34 aa, Artificial Sequence
  Description of Artificial Sequence: Synthetic polypeptide
DEEEIRTTNPVATEQYGSVSTVNLPQQLTGEIED

SEQ ID NO: 59529 - protein, 34 aa, Artificial Sequence
  Description of Artificial Sequence: Synthetic polypeptide
DEEEIRTTNPVATEQYGSVSTVNLQSNMNLNPQG

SEQ ID NO: 59530 - protein, 34 aa, Artificial Sequence
  Description of Artificial Sequence: Synthetic polypeptide
DEEEIRTTNPVATEQYGSVSTVNLQSSNGEGGQG

SEQ ID NO: 59531 - protein, 33 aa, Artificial Sequence
  Description of Artificial Sequence: Synthetic polypeptide
DEEEIRTTNPVATEQYGSVSTVNLSGFQGEIGF

SEQ ID NO: 59532 - protein, 33 aa, Artificial Sequence
  Description of Artificial Sequence: Synthetic polypeptide
DEEEIRTTNPVATEQYGSVSTVNMAQNVVFNDG

SEQ ID NO: 59533 - protein, 32 aa, Artificial Sequence
  Description of Artificial Sequence: Synthetic polypeptide
DEEEIRTTNPVATEQYGSVSTVNNDIEDTNST

SEQ ID NO: 59534 - protein, 33 aa, Artificial Sequence
  Description of Artificial Sequence: Synthetic polypeptide
DEEEIRTTNPVATEQYGSVSTVNPDQGEMGELQ

SEQ ID NO: 59535 - protein, 33 aa, Artificial Sequence
  Description of Artificial Sequence: Synthetic polypeptide
DEEEIRTTNPVATEQYGSVSTVNPNQLQIEDEE

SEQ ID NO: 59536 - protein, 33 aa, Artificial Sequence
  Description of Artificial Sequence: Synthetic polypeptide
DEEEIRTTNPVATEQYGSVSTVNTQNQEDEEIR

SEQ ID NO: 59537 - protein, 33 aa, Artificial Sequence
  Description of Artificial Sequence: Synthetic polypeptide
DEEEIRTTNPVATEQYGSVSCTMPLADVGEIRS

SEQ ID NO: 59538 - protein, 34 aa, Artificial Sequence
  Description of Artificial Sequence: Synthetic polypeptide
DEEEIRTTNPVATEQYGSVSTVNTQNQGTDEEIR

SEQ ID NO: 59539 - protein, 34 aa, Artificial Sequence
  Description of Artificial Sequence: Synthetic polypeptide
DEEEIRTTNPVATEQYGSVSCTINAEFQMTNDMR

SEQ ID NO: 59540 - protein, 33 aa, Artificial Sequence
  Description of Artificial Sequence: Synthetic polypeptide
DEEEIRTTNPVATEQYGSVSTVNTQQETDENIA

SEQ ID NO: 59541 - protein, 32 aa, Artificial Sequence
  Description of Artificial Sequence: Synthetic polypeptide
DEEEIRTTNPVATEQYGSVSDETFGGGNVGNG

SEQ ID NO: 59542 - protein, 34 aa, Artificial Sequence
  Description of Artificial Sequence: Synthetic polypeptide
DEEEIRTTNPVATEQYGSVSTYLGDVFNGGVNRF

SEQ ID NO: 59543 - protein, 33 aa, Artificial Sequence
  Description of Artificial Sequence: Synthetic polypeptide
DEEEIRTTNPVATEQYGSVSDGNTNEINDGNGP

SEQ ID NO: 59544 - protein, 32 aa, Artificial Sequence
  Description of Artificial Sequence: Synthetic polypeptide
DEEEIRTTNPVATEQYGSVSTTNTEFRVAELQ

SEQ ID NO: 59545 - protein, 33 aa, Artificial Sequence
  Description of Artificial Sequence: Synthetic polypeptide
DEEEIRTTNPVATEQYGSVSTTALTQYGAEMGL

SEQ ID NO: 59546 - protein, 33 aa, Artificial Sequence
  Description of Artificial Sequence: Synthetic polypeptide
DEEEIRTTNPVATEQYGSVSTTDLQQERTIPLE

SEQ ID NO: 59547 - protein, 33 aa, Artificial Sequence
  Description of Artificial Sequence: Synthetic polypeptide
DEEEIRTTNPVATEQYGSVSTTDLSDNGGGNGG

SEQ ID NO: 59548 - protein, 33 aa, Artificial Sequence
  Description of Artificial Sequence: Synthetic polypeptide
DEEEIRTTNPVATEQYGSVSTTDQQTVEGNEGG

SEQ ID NO: 59549 - protein, 34 aa, Artificial Sequence
  Description of Artificial Sequence: Synthetic polypeptide
DEEEIRTTNPVATEQYGSVSTTENNLQRQPVMDE

SEQ ID NO: 59550 - protein, 34 aa, Artificial Sequence
  Description of Artificial Sequence: Synthetic polypeptide
DEEEIRTTNPVATEQYGSVSTTEVLQRAVEENDY

SEQ ID NO: 59551 - protein, 34 aa, Artificial Sequence
  Description of Artificial Sequence: Synthetic polypeptide
DEEEIRTTNPVATEQYGSVSTTFGLEEQSGTNVS

SEQ ID NO: 59552 - protein, 31 aa, Artificial Sequence
  Description of Artificial Sequence: Synthetic polypeptide
DEEEIRTTNPVATEQYGSVSTTGEIVPGHFN

SEQ ID NO: 59553 - protein, 33 aa, Artificial Sequence
  Description of Artificial Sequence: Synthetic polypeptide
DEEEIRTTNPVATEQYGSVSTTGMGQEGGNGED

SEQ ID NO: 59554 - protein, 32 aa, Artificial Sequence
  Description of Artificial Sequence: Synthetic polypeptide
DEEEIRTTNPVATEQYGSVSDVTGGNGNGGGE

SEQ ID NO: 59555 - protein, 33 aa, Artificial Sequence
  Description of Artificial Sequence: Synthetic polypeptide
DEEEIRTTNPVATEQYGSVSTTGNMVEGFGNGT

SEQ ID NO: 59556 - protein, 33 aa, Artificial Sequence
  Description of Artificial Sequence: Synthetic polypeptide
DEEEIRTTNPVATEQYGSVSDTVGLQETQNNTQ

SEQ ID NO: 59557 - protein, 33 aa, Artificial Sequence
  Description of Artificial Sequence: Synthetic polypeptide
DEEEIRTTNPVATEQYGSVSTTHNIIQQQQEQR

SEQ ID NO: 59558 - protein, 33 aa, Artificial Sequence
  Description of Artificial Sequence: Synthetic polypeptide
DEEEIRTTNPVATEQYGSVSTTIENNAAGMNPA

SEQ ID NO: 59559 - protein, 34 aa, Artificial Sequence
  Description of Artificial Sequence: Synthetic polypeptide
DEEEIRTTNPVATEQYGSVSTTLDLNQIGFGNGG

SEQ ID NO: 59560 - protein, 33 aa, Artificial Sequence
  Description of Artificial Sequence: Synthetic polypeptide
DEEEIRTTNPVATEQYGSVSTTLDLQQENIENQ

SEQ ID NO: 59561 - protein, 33 aa, Artificial Sequence
  Description of Artificial Sequence: Synthetic polypeptide
DEEEIRTTNPVATEQYGSVSTTLGVGGGDINTT

SEQ ID NO: 59562 - protein, 33 aa, Artificial Sequence
  Description of Artificial Sequence: Synthetic polypeptide
DEEEIRTTNPVATEQYGSVSTTLLDEQGPNEEF

SEQ ID NO: 59563 - protein, 32 aa, Artificial Sequence
  Description of Artificial Sequence: Synthetic polypeptide
DEEEIRTTNPVATEQYGSVSTTLLENRNVEPE

SEQ ID NO: 59564 - protein, 33 aa, Artificial Sequence
  Description of Artificial Sequence: Synthetic polypeptide
DEEEIRTTNPVATEQYGSVSTTLLNEMGGGNEQ

SEQ ID NO: 59565 - protein, 33 aa, Artificial Sequence
  Description of Artificial Sequence: Synthetic polypeptide
DEEEIRTTNPVATEQYGSVSTTGNSDNGGGNQG

SEQ ID NO: 59566 - protein, 34 aa, Artificial Sequence
  Description of Artificial Sequence: Synthetic polypeptide
DEEEIRTTNPVATEQYGSVSTTLLNQLQLEDENQ

SEQ ID NO: 59567 - protein, 33 aa, Artificial Sequence
  Description of Artificial Sequence: Synthetic polypeptide
DEEEIRTTNPVATEQYGSVSTTAGPNMANGMNA

SEQ ID NO: 59568 - protein, 33 aa, Artificial Sequence
  Description of Artificial Sequence: Synthetic polypeptide
DEEEIRTTNPVATEQYGSVSDYNLQNISENMQM

SEQ ID NO: 59569 - protein, 32 aa, Artificial Sequence
  Description of Artificial Sequence: Synthetic polypeptide
DEEEIRTTNPVATEQYGSVSELIQPGEEEERQ

SEQ ID NO: 59570 - protein, 34 aa, Artificial Sequence
  Description of Artificial Sequence: Synthetic polypeptide
DEEEIRTTNPVATEQYGSVSTSNVDDQGGNNEFE

SEQ ID NO: 59571 - protein, 34 aa, Artificial Sequence
  Description of Artificial Sequence: Synthetic polypeptide
DEEEIRTTNPVATEQYGSVSTSNVDQGTGNNVTE

SEQ ID NO: 59572 - protein, 32 aa, Artificial Sequence
  Description of Artificial Sequence: Synthetic polypeptide
DEEEIRTTNPVATEQYGSVSEIPNEHATGVND

SEQ ID NO: 59573 - protein, 34 aa, Artificial Sequence
  Description of Artificial Sequence: Synthetic polypeptide
DEEEIRTTNPVATEQYGSVSTSNVGGQNQGENEP

SEQ ID NO: 59574 - protein, 34 aa, Artificial Sequence
  Description of Artificial Sequence: Synthetic polypeptide
DEEEIRTTNPVATEQYGSVSTSNVGQGGGNNDTE

SEQ ID NO: 59575 - protein, 30 aa, Artificial Sequence
  Description of Artificial Sequence: Synthetic polypeptide
DEEEIRTTNPVATEQYGSVSEILMNAAEDA

SEQ ID NO: 59576 - protein, 32 aa, Artificial Sequence
  Description of Artificial Sequence: Synthetic polypeptide
DEEEIRTTNPVATEQYGSVSEGLEEQMEVERE

SEQ ID NO: 59577 - protein, 33 aa, Artificial Sequence
  Description of Artificial Sequence: Synthetic polypeptide
DEEEIRTTNPVATEQYGSVSTSNVNGQGQGDEP

SEQ ID NO: 59578 - protein, 33 aa, Artificial Sequence
  Description of Artificial Sequence: Synthetic polypeptide
DEEEIRTTNPVATEQYGSVSTTAGPNDHEGNPV

SEQ ID NO: 59579 - protein, 34 aa, Artificial Sequence
  Description of Artificial Sequence: Synthetic polypeptide
DEEEIRTTNPVATEQYGSVSTSNVNGQQGGENEQ

SEQ ID NO: 59580 - protein, 32 aa, Artificial Sequence
  Description of Artificial Sequence: Synthetic polypeptide
DEEEIRTTNPVATEQYGSVSEEMNDQIINEEE

SEQ ID NO: 59581 - protein, 33 aa, Artificial Sequence
  Description of Artificial Sequence: Synthetic polypeptide
DEEEIRTTNPVATEQYGSVSEEMLSEQLLNERP

SEQ ID NO: 59582 - protein, 33 aa, Artificial Sequence
  Description of Artificial Sequence: Synthetic polypeptide
DEEEIRTTNPVATEQYGSVSTSNVTMEGGGNDE

SEQ ID NO: 59583 - protein, 33 aa, Artificial Sequence
  Description of Artificial Sequence: Synthetic polypeptide
DEEEIRTTNPVATEQYGSVSTSNVVGMGGNNTN

SEQ ID NO: 59584 - protein, 33 aa, Artificial Sequence
  Description of Artificial Sequence: Synthetic polypeptide
DEEEIRTTNPVATEQYGSVSTSTLQNVEGGEFT

SEQ ID NO: 59585 - protein, 31 aa, Artificial Sequence
  Description of Artificial Sequence: Synthetic polypeptide
DEEEIRTTNPVATEQYGSVSECNLIVLEQTE

SEQ ID NO: 59586 - protein, 33 aa, Artificial Sequence
  Description of Artificial Sequence: Synthetic polypeptide
DEEEIRTTNPVATEQYGSVSTSTNQDGPMEERG

SEQ ID NO: 59587 - protein, 31 aa, Artificial Sequence
  Description of Artificial Sequence: Synthetic polypeptide
DEEEIRTTNPVATEQYGSVSEAGLTVTNVVD

SEQ ID NO: 59588 - protein, 33 aa, Artificial Sequence
  Description of Artificial Sequence: Synthetic polypeptide
DEEEIRTTNPVATEQYGSVSTTAEPNMANGMNA

SEQ ID NO: 59589 - protein, 34 aa, Artificial Sequence
  Description of Artificial Sequence: Synthetic polypeptide
DEEEIRTTNPVATEQYGSVSEENLGIPIGENERI

SEQ ID NO: 59590 - protein, 33 aa, Artificial Sequence
  Description of Artificial Sequence: Synthetic polypeptide
DEEEIRTTNPVATEQYGSVSTTLLSDNEGNNST

SEQ ID NO: 59591 - protein, 33 aa, Artificial Sequence
  Description of Artificial Sequence: Synthetic polypeptide
DEEEIRTTNPVATEQYGSVSTTLLVGGGDTNIT

SEQ ID NO: 59592 - protein, 35 aa, Artificial Sequence
  Description of Artificial Sequence: Synthetic polypeptide
DEEEIRTTNPVATEQYGSVSDTNYLNQKGHDQGMR

SEQ ID NO: 59593 - protein, 32 aa, Artificial Sequence
  Description of Artificial Sequence: Synthetic polypeptide
DEEEIRTTNPVATEQYGSVSDTDLEQTTESQE

SEQ ID NO: 59594 - protein, 34 aa, Artificial Sequence
  Description of Artificial Sequence: Synthetic polypeptide
DEEEIRTTNPVATEQYGSVSDTDGTNEQTGENED

SEQ ID NO: 59595 - protein, 34 aa, Artificial Sequence
  Description of Artificial Sequence: Synthetic polypeptide
DEEEIRTTNPVATEQYGSVSDTDGTNEQGGGNED

SEQ ID NO: 59596 - protein, 34 aa, Artificial Sequence
  Description of Artificial Sequence: Synthetic polypeptide
DEEEIRTTNPVATEQYGSVSTTNLQNAEMFPIND

SEQ ID NO: 59597 - protein, 34 aa, Artificial Sequence
  Description of Artificial Sequence: Synthetic polypeptide
DEEEIRTTNPVATEQYGSVSTTNLQQEVGQLIID

SEQ ID NO: 59598 - protein, 34 aa, Artificial Sequence
  Description of Artificial Sequence: Synthetic polypeptide
DEEEIRTTNPVATEQYGSVSDSNSLQTGQMNQGI

SEQ ID NO: 59599 - protein, 32 aa, Artificial Sequence
  Description of Artificial Sequence: Synthetic polypeptide
DEEEIRTTNPVATEQYGSVSDSLGPRIGEDEE

SEQ ID NO: 59600 - protein, 32 aa, Artificial Sequence
  Description of Artificial Sequence: Synthetic polypeptide
DEEEIRTTNPVATEQYGSVSDSDMNQTGENSE

SEQ ID NO: 59601 - protein, 33 aa, Artificial Sequence
  Description of Artificial Sequence: Synthetic polypeptide
DEEEIRTTNPVATEQYGSVSDQDLIQRIQNNGI

SEQ ID NO: 59602 - protein, 33 aa, Artificial Sequence
  Description of Artificial Sequence: Synthetic polypeptide
DEEEIRTTNPVATEQYGSVSDTDNGGETGNGGE

SEQ ID NO: 59603 - protein, 33 aa, Artificial Sequence
  Description of Artificial Sequence: Synthetic polypeptide
DEEEIRTTNPVATEQYGSVSDQDLIQRIQGEGG

SEQ ID NO: 59604 - protein, 33 aa, Artificial Sequence
  Description of Artificial Sequence: Synthetic polypeptide
DEEEIRTTNPVATEQYGSVSTTNLVVSVGEDSS

SEQ ID NO: 59605 - protein, 33 aa, Artificial Sequence
  Description of Artificial Sequence: Synthetic polypeptide
DEEEIRTTNPVATEQYGSVSTTNMLNIDGEELD

SEQ ID NO: 59606 - protein, 35 aa, Artificial Sequence
  Description of Artificial Sequence: Synthetic polypeptide
DEEEIRTTNPVATEQYGSVSTTNMMWQERGEEERT

SEQ ID NO: 59607 - protein, 33 aa, Artificial Sequence
  Description of Artificial Sequence: Synthetic polypeptide
DEEEIRTTNPVATEQYGSVSTTNNDNQNTDEIR

SEQ ID NO: 59608 - protein, 34 aa, Artificial Sequence
  Description of Artificial Sequence: Synthetic polypeptide
DEEEIRTTNPVATEQYGSVSTTNNGGQQQGNQVN

SEQ ID NO: 59609 - protein, 34 aa, Artificial Sequence
  Description of Artificial Sequence: Synthetic polypeptide
DEEEIRTTNPVATEQYGSVSTTNNGQQQGNQNVN

SEQ ID NO: 59610 - protein, 33 aa, Artificial Sequence
  Description of Artificial Sequence: Synthetic polypeptide
DEEEIRTTNPVATEQYGSVSTTNNQGGQQGEQV

SEQ ID NO: 59611 - protein, 34 aa, Artificial Sequence
  Description of Artificial Sequence: Synthetic polypeptide
DEEEIRTTNPVATEQYGSVSTTNQLLQGNSQNQE

SEQ ID NO: 59612 - protein, 32 aa, Artificial Sequence
  Description of Artificial Sequence: Synthetic polypeptide
DEEEIRTTNPVATEQYGSVSDLLDEEQSNNDS

SEQ ID NO: 59613 - protein, 33 aa, Artificial Sequence
  Description of Artificial Sequence: Synthetic polypeptide
DEEEIRTTNPVATEQYGSVSDNNLDPRMDVERS

SEQ ID NO: 59614 - protein, 33 aa, Artificial Sequence
  Description of Artificial Sequence: Synthetic polypeptide
DEEEIRTTNPVATEQYGSVSTTNLPMQGMFPEI

SEQ ID NO: 59615 - protein, 32 aa, Artificial Sequence
  Description of Artificial Sequence: Synthetic polypeptide
DEEEIRTTNPVATEQYGSVSDTEHNQNFSSNQ

SEQ ID NO: 59616 - protein, 35 aa, Artificial Sequence
  Description of Artificial Sequence: Synthetic polypeptide
DEEEIRTTNPVATEQYGSVSTTNLGGQEQGTQGNG

SEQ ID NO: 59617 - protein, 33 aa, Artificial Sequence
  Description of Artificial Sequence: Synthetic polypeptide
DEEEIRTTNPVATEQYGSVSTTLNEMGVGNEGT

SEQ ID NO: 59618 - protein, 33 aa, Artificial Sequence
  Description of Artificial Sequence: Synthetic polypeptide
DEEEIRTTNPVATEQYGSVSDTNQNMNGGNGGE

SEQ ID NO: 59619 - protein, 34 aa, Artificial Sequence
  Description of Artificial Sequence: Synthetic polypeptide
DEEEIRTTNPVATEQYGSVSTTLNLQQGGQEEGG

SEQ ID NO: 59620 - protein, 34 aa, Artificial Sequence
  Description of Artificial Sequence: Synthetic polypeptide
DEEEIRTTNPVATEQYGSVSDTNNAEQNIGGNQG

SEQ ID NO: 59621 - protein, 33 aa, Artificial Sequence
  Description of Artificial Sequence: Synthetic polypeptide
DEEEIRTTNPVATEQYGSVSTTMDQNTGQGNIG

SEQ ID NO: 59622 - protein, 34 aa, Artificial Sequence
  Description of Artificial Sequence: Synthetic polypeptide
DEEEIRTTNPVATEQYGSVSTTMNFGQTGEGENI

SEQ ID NO: 59623 - protein, 34 aa, Artificial Sequence
  Description of Artificial Sequence: Synthetic polypeptide
DEEEIRTTNPVATEQYGSVSTTMNLELINGGNQG

SEQ ID NO: 59624 - protein, 33 aa, Artificial Sequence
  Description of Artificial Sequence: Synthetic polypeptide
DEEEIRTTNPVATEQYGSVSTTMNLGEQQFVET

SEQ ID NO: 59625 - protein, 35 aa, Artificial Sequence
  Description of Artificial Sequence: Synthetic polypeptide
DEEEIRTTNPVATEQYGSVSTTMNLGQIGFGGNTG

SEQ ID NO: 59626 - protein, 33 aa, Artificial Sequence
  Description of Artificial Sequence: Synthetic polypeptide
DEEEIRTTNPVATEQYGSVSTTMNTQEPMSNFG

SEQ ID NO: 59627 - protein, 33 aa, Artificial Sequence
  Description of Artificial Sequence: Synthetic polypeptide
DEEEIRTTNPVATEQYGSVSTTMSDQMVEAVNR

SEQ ID NO: 59628 - protein, 33 aa, Artificial Sequence
  Description of Artificial Sequence: Synthetic polypeptide
DEEEIRTTNPVATEQYGSVSTTNALEGGEEILD

SEQ ID NO: 59629 - protein, 33 aa, Artificial Sequence
  Description of Artificial Sequence: Synthetic polypeptide
DEEEIRTTNPVATEQYGSVSTTNDEHRQNEGEL

SEQ ID NO: 59630 - protein, 33 aa, Artificial Sequence
  Description of Artificial Sequence: Synthetic polypeptide
DEEEIRTTNPVATEQYGSVSDTNGTGETGNGGG

SEQ ID NO: 59631 - protein, 34 aa, Artificial Sequence
  Description of Artificial Sequence: Synthetic polypeptide
DEEEIRTTNPVATEQYGSVSTTNELAMENGNEIL

SEQ ID NO: 59632 - protein, 33 aa, Artificial Sequence
  Description of Artificial Sequence: Synthetic polypeptide
DEEEIRTTNPVATEQYGSVSDTMLHEFIDENRD

SEQ ID NO: 59633 - protein, 32 aa, Artificial Sequence
  Description of Artificial Sequence: Synthetic polypeptide
DEEEIRTTNPVATEQYGSVSDTLVQGGGSIIM

SEQ ID NO: 59634 - protein, 33 aa, Artificial Sequence
  Description of Artificial Sequence: Synthetic polypeptide
DEEEIRTTNPVATEQYGSVSTTNGLERLSMEQT

SEQ ID NO: 59635 - protein, 33 aa, Artificial Sequence
  Description of Artificial Sequence: Synthetic polypeptide
DEEEIRTTNPVATEQYGSVSTTNGLQQISVEDL

SEQ ID NO: 59636 - protein, 34 aa, Artificial Sequence
  Description of Artificial Sequence: Synthetic polypeptide
DEEEIRTTNPVATEQYGSVSTTNGNQQQLGNQVE

SEQ ID NO: 59637 - protein, 33 aa, Artificial Sequence
  Description of Artificial Sequence: Synthetic polypeptide
DEEEIRTTNPVATEQYGSVSDTGLDGGNEGNGD

SEQ ID NO: 59638 - protein, 31 aa, Artificial Sequence
  Description of Artificial Sequence: Synthetic polypeptide
DEEEIRTTNPVATEQYGSVSTTNTEFVEELQ

SEQ ID NO: 59639 - protein, 33 aa, Artificial Sequence
  Description of Artificial Sequence: Synthetic polypeptide
DEEEIRTTNPVATEQYGSVSTSNQTGPMIEDRG

SEQ ID NO: 59640 - protein, 35 aa, Artificial Sequence
  Description of Artificial Sequence: Synthetic polypeptide
DEEEIRTTNPVATEQYGSVSCPPNLQIRIGVNVHE

SEQ ID NO: 59641 - protein, 32 aa, Artificial Sequence
  Description of Artificial Sequence: Synthetic polypeptide
DEEEIRTTNPVATEQYGSVSCPALNMSNGNPV

SEQ ID NO: 59642 - protein, 31 aa, Artificial Sequence
  Description of Artificial Sequence: Synthetic polypeptide
DEEEIRTTNPVATEQYGSVSWPMTGPNSDRG

SEQ ID NO: 59643 - protein, 34 aa, Artificial Sequence
  Description of Artificial Sequence: Synthetic polypeptide
DEEEIRTTNPVATEQYGSVSWTENLVQNTGPEEM

SEQ ID NO: 59644 - protein, 32 aa, Artificial Sequence
  Description of Artificial Sequence: Synthetic polypeptide
DEEEIRTTNPVATEQYGSVSWTMGVARVGELF

SEQ ID NO: 59645 - protein, 31 aa, Artificial Sequence
  Description of Artificial Sequence: Synthetic polypeptide
DEEEIRTTNPVATEQYGSVSWTNPVTMETQQ

SEQ ID NO: 59646 - protein, 32 aa, Artificial Sequence
  Description of Artificial Sequence: Synthetic polypeptide
DEEEIRTTNPVATEQYGSVSWVGVLQRMVEEQ

SEQ ID NO: 59647 - protein, 32 aa, Artificial Sequence
  Description of Artificial Sequence: Synthetic polypeptide
DEEEIRTTNPVATEQYGSVSAEDLEDREGEDL

SEQ ID NO: 59648 - protein, 33 aa, Artificial Sequence
  Description of Artificial Sequence: Synthetic polypeptide
DEEEIRTTNPVATEQYGSVSAEDGLQLVEENRM

SEQ ID NO: 59649 - protein, 33 aa, Artificial Sequence
  Description of Artificial Sequence: Synthetic polypeptide
DEEEIRTTNPVATEQYGSVSYENNLEEPLVNER

SEQ ID NO: 59650 - protein, 33 aa, Artificial Sequence
  Description of Artificial Sequence: Synthetic polypeptide
DEEEIRTTNPVATEQYGSVSYENNLETPMLNER

SEQ ID NO: 59651 - protein, 30 aa, Artificial Sequence
  Description of Artificial Sequence: Synthetic polypeptide
DEEEIRTTNPVATEQYGSVSWPMTGGSDFG

SEQ ID NO: 59652 - protein, 33 aa, Artificial Sequence
  Description of Artificial Sequence: Synthetic polypeptide
DEEEIRTTNPVATEQYGSVSYEPGLQLMTNNRN

SEQ ID NO: 59653 - protein, 31 aa, Artificial Sequence
  Description of Artificial Sequence: Synthetic polypeptide
DEEEIRTTNPVATEQYGSVSADMTTTGSDRD

SEQ ID NO: 59654 - protein, 32 aa, Artificial Sequence
  Description of Artificial Sequence: Synthetic polypeptide
DEEEIRTTNPVATEQYGSVSYMNEEQNLVNQS

SEQ ID NO: 59655 - protein, 33 aa, Artificial Sequence
  Description of Artificial Sequence: Synthetic polypeptide
DEEEIRTTNPVATEQYGSVSYNDLLHDGINEEY

SEQ ID NO: 59656 - protein, 32 aa, Artificial Sequence
  Description of Artificial Sequence: Synthetic polypeptide
DEEEIRTTNPVATEQYGSVSYNLAIIENVLVQ

SEQ ID NO: 59657 - protein, 32 aa, Artificial Sequence
  Description of Artificial Sequence: Synthetic polypeptide
DEEEIRTTNPVATEQYGSVSYNLQVTTPIEDG

SEQ ID NO: 59658 - protein, 33 aa, Artificial Sequence
  Description of Artificial Sequence: Synthetic polypeptide
DEEEIRTTNPVATEQYGSVSYNMQTRLTIEGID

SEQ ID NO: 59659 - protein, 32 aa, Artificial Sequence
  Description of Artificial Sequence: Synthetic polypeptide
DEEEIRTTNPVATEQYGSVSYPEQTDGNQDDM

SEQ ID NO: 59660 - protein, 31 aa, Artificial Sequence
  Description of Artificial Sequence: Synthetic polypeptide
DEEEIRTTNPVATEQYGSVSYPGVIQRVEQE

SEQ ID NO: 59661 - protein, 33 aa, Artificial Sequence
  Description of Artificial Sequence: Synthetic polypeptide
DEEEIRTTNPVATEQYGSVSYPMEGLQQGLNIL

SEQ ID NO: 59662 - protein, 35 aa, Artificial Sequence
  Description of Artificial Sequence: Synthetic polypeptide
DEEEIRTTNPVATEQYGSVSYIPNLNQPRIGQENE

SEQ ID NO: 59663 - protein, 32 aa, Artificial Sequence
  Description of Artificial Sequence: Synthetic polypeptide
DEEEIRTTNPVATEQYGSVSYSNQDGQMEVRG

SEQ ID NO: 59664 - protein, 31 aa, Artificial Sequence
  Description of Artificial Sequence: Synthetic polypeptide
DEEEIRTTNPVATEQYGSVSWPMESFQGDIR

SEQ ID NO: 59665 - protein, 32 aa, Artificial Sequence
  Description of Artificial Sequence: Synthetic polypeptide
DEEEIRTTNPVATEQYGSVSWPAVLPQRVEEQ

SEQ ID NO: 59666 - protein, 34 aa, Artificial Sequence
  Description of Artificial Sequence: Synthetic polypeptide
DEEEIRTTNPVATEQYGSVSVTTVWIDRIGGENR

SEQ ID NO: 59667 - protein, 32 aa, Artificial Sequence
  Description of Artificial Sequence: Synthetic polypeptide
DEEEIRTTNPVATEQYGSVSVTVNDETQNHAS

SEQ ID NO: 59668 - protein, 33 aa, Artificial Sequence
  Description of Artificial Sequence: Synthetic polypeptide
DEEEIRTTNPVATEQYGSVSVTVNGTQVNVNPT

SEQ ID NO: 59669 - protein, 31 aa, Artificial Sequence
  Description of Artificial Sequence: Synthetic polypeptide
DEEEIRTTNPVATEQYGSVSVTYEYNDELER

SEQ ID NO: 59670 - protein, 33 aa, Artificial Sequence
  Description of Artificial Sequence: Synthetic polypeptide
DEEEIRTTNPVATEQYGSVSVTYNHQQLGDDEL

SEQ ID NO: 59671 - protein, 34 aa, Artificial Sequence
  Description of Artificial Sequence: Synthetic polypeptide
DEEEIRTTNPVATEQYGSVSVVENGLQRQNNNVL

SEQ ID NO: 59672 - protein, 32 aa, Artificial Sequence
  Description of Artificial Sequence: Synthetic polypeptide
DEEEIRTTNPVATEQYGSVSVVLYQDIMVNQQ

SEQ ID NO: 59673 - protein, 34 aa, Artificial Sequence
  Description of Artificial Sequence: Synthetic polypeptide
DEEEIRTTNPVATEQYGSVSVYNNSLQDRNENFE

SEQ ID NO: 59674 - protein, 30 aa, Artificial Sequence
  Description of Artificial Sequence: Synthetic polypeptide
DEEEIRTTNPVATEQYGSVSWGLAHDDQDD

SEQ ID NO: 59675 - protein, 32 aa, Artificial Sequence
  Description of Artificial Sequence: Synthetic polypeptide
DEEEIRTTNPVATEQYGSVSWPGVLQRVSEVQ

SEQ ID NO: 59676 - protein, 32 aa, Artificial Sequence
  Description of Artificial Sequence: Synthetic polypeptide
DEEEIRTTNPVATEQYGSVSWNDPQHQWGDIE

SEQ ID NO: 59677 - protein, 31 aa, Artificial Sequence
  Description of Artificial Sequence: Synthetic polypeptide
DEEEIRTTNPVATEQYGSVSAGSTVTQNVVG

SEQ ID NO: 59678 - protein, 33 aa, Artificial Sequence
  Description of Artificial Sequence: Synthetic polypeptide
DEEEIRTTNPVATEQYGSVSWNLQERVTEAQVN

SEQ ID NO: 59679 - protein, 33 aa, Artificial Sequence
  Description of Artificial Sequence: Synthetic polypeptide
DEEEIRTTNPVATEQYGSVSWNLQPVVGEAQVA

SEQ ID NO: 59680 - protein, 31 aa, Artificial Sequence
  Description of Artificial Sequence: Synthetic polypeptide
DEEEIRTTNPVATEQYGSVSWNLVDTPSQDD

SEQ ID NO: 59681 - protein, 32 aa, Artificial Sequence
  Description of Artificial Sequence: Synthetic polypeptide
DEEEIRTTNPVATEQYGSVSWNLVRVTEAQMV

SEQ ID NO: 59682 - protein, 33 aa, Artificial Sequence
  Description of Artificial Sequence: Synthetic polypeptide
DEEEIRTTNPVATEQYGSVSAEPVGLQLIENRD

SEQ ID NO: 59683 - protein, 32 aa, Artificial Sequence
  Description of Artificial Sequence: Synthetic polypeptide
DEEEIRTTNPVATEQYGSVSWNTHAERDMLRD

SEQ ID NO: 59684 - protein, 32 aa, Artificial Sequence
  Description of Artificial Sequence: Synthetic polypeptide
DEEEIRTTNPVATEQYGSVSAENYMQRQIIID

SEQ ID NO: 59685 - protein, 33 aa, Artificial Sequence
  Description of Artificial Sequence: Synthetic polypeptide
DEEEIRTTNPVATEQYGSVSWNTLQIVPEDPRL

SEQ ID NO: 59686 - protein, 32 aa, Artificial Sequence
  Description of Artificial Sequence: Synthetic polypeptide
DEEEIRTTNPVATEQYGSVSAHPLNNNENDRD

SEQ ID NO: 59687 - protein, 33 aa, Artificial Sequence
  Description of Artificial Sequence: Synthetic polypeptide
DEEEIRTTNPVATEQYGSVSYTDVLQVRSSQQY

SEQ ID NO: 59688 - protein, 34 aa, Artificial Sequence
  Description of Artificial Sequence: Synthetic polypeptide
DEEEIRTTNPVATEQYGSVSYTEPDQRMGGNMPD

SEQ ID NO: 59689 - protein, 33 aa, Artificial Sequence
  Description of Artificial Sequence: Synthetic polypeptide
DEEEIRTTNPVATEQYGSVSYTGNWLEQVMIAN

SEQ ID NO: 59690 - protein, 31 aa, Artificial Sequence
  Description of Artificial Sequence: Synthetic polypeptide
DEEEIRTTNPVATEQYGSVQTPLQEESETDA

SEQ ID NO: 59691 - protein, 32 aa, Artificial Sequence
  Description of Artificial Sequence: Synthetic polypeptide
DEEEIRTTNPVATEQYGSVQTPLGQEFGPEIE

SEQ ID NO: 59692 - protein, 33 aa, Artificial Sequence
  Description of Artificial Sequence: Synthetic polypeptide
DEEEIRTTNPVATEQYGSVQTPIMLQQRTINDE

SEQ ID NO: 59693 - protein, 32 aa, Artificial Sequence
  Description of Artificial Sequence: Synthetic polypeptide
DEEEIRTTNPVATEQYGSVTPHNLGQRNVFDA

SEQ ID NO: 59694 - protein, 32 aa, Artificial Sequence
  Description of Artificial Sequence: Synthetic polypeptide
DEEEIRTTNPVATEQYGSVQTNSLVPRELLDI

SEQ ID NO: 59695 - protein, 33 aa, Artificial Sequence
  Description of Artificial Sequence: Synthetic polypeptide
DEEEIRTTNPVATEQYGSVTPMNLQQRTEEENL

SEQ ID NO: 59696 - protein, 31 aa, Artificial Sequence
  Description of Artificial Sequence: Synthetic polypeptide
DEEEIRTTNPVATEQYGSVTPTDLERETYQI

SEQ ID NO: 59697 - protein, 33 aa, Artificial Sequence
  Description of Artificial Sequence: Synthetic polypeptide
DEEEIRTTNPVATEQYGSVTPTGNEQNMTVNER

SEQ ID NO: 59698 - protein, 34 aa, Artificial Sequence
  Description of Artificial Sequence: Synthetic polypeptide
DEEEIRTTNPVATEQYGSVTPTMNLIRLGELARN

SEQ ID NO: 59699 - protein, 33 aa, Artificial Sequence
  Description of Artificial Sequence: Synthetic polypeptide
DEEEIRTTNPVATEQYGSVTNTGNLQNGTEGTD

SEQ ID NO: 59700 - protein, 32 aa, Artificial Sequence
  Description of Artificial Sequence: Synthetic polypeptide
DEEEIRTTNPVATEQYGSVTPTPLPQRDQMAD

SEQ ID NO: 59701 - protein, 32 aa, Artificial Sequence
  Description of Artificial Sequence: Synthetic polypeptide
DEEEIRTTNPVATEQYGSVTQTNDQPRDEVVD

SEQ ID NO: 59702 - protein, 34 aa, Artificial Sequence
  Description of Artificial Sequence: Synthetic polypeptide
DEEEIRTTNPVATEQYGSVTQTPNDLFQRFPNEN

SEQ ID NO: 59703 - protein, 35 aa, Artificial Sequence
  Description of Artificial Sequence: Synthetic polypeptide
DEEEIRTTNPVATEQYGSVTSCTDNLSQPTGNNEE

SEQ ID NO: 59704 - protein, 35 aa, Artificial Sequence
  Description of Artificial Sequence: Synthetic polypeptide
DEEEIRTTNPVATEQYGSVTSCTENELSQPTGGNM

SEQ ID NO: 59705 - protein, 33 aa, Artificial Sequence
  Description of Artificial Sequence: Synthetic polypeptide
DEEEIRTTNPVATEQYGSVTSDTLNEENQGNEQ

SEQ ID NO: 59706 - protein, 32 aa, Artificial Sequence
  Description of Artificial Sequence: Synthetic polypeptide
DEEEIRTTNPVATEQYGSVTSENDPQRTEEIT

SEQ ID NO: 59707 - protein, 33 aa, Artificial Sequence
  Description of Artificial Sequence: Synthetic polypeptide
DEEEIRTTNPVATEQYGSVTSGTDDNQNEGGNG

SEQ ID NO: 59708 - protein, 34 aa, Artificial Sequence
  Description of Artificial Sequence: Synthetic polypeptide
DEEEIRTTNPVATEQYGSVTSNMNLNQNGGNITT

SEQ ID NO: 59709 - protein, 32 aa, Artificial Sequence
  Description of Artificial Sequence: Synthetic polypeptide
DEEEIRTTNPVATEQYGSVQTNLQNLTELALI

SEQ ID NO: 59710 - protein, 33 aa, Artificial Sequence
  Description of Artificial Sequence: Synthetic polypeptide
DEEEIRTTNPVATEQYGSVTPTSGLEQQGQDRQ

SEQ ID NO: 59711 - protein, 32 aa, Artificial Sequence
  Description of Artificial Sequence: Synthetic polypeptide
DEEEIRTTNPVATEQYGSVTMTNGIGEEDGNG

SEQ ID NO: 59712 - protein, 33 aa, Artificial Sequence
  Description of Artificial Sequence: Synthetic polypeptide
DEEEIRTTNPVATEQYGSVTMTNGGGQEDGNGF

SEQ ID NO: 59713 - protein, 32 aa, Artificial Sequence
  Description of Artificial Sequence: Synthetic polypeptide
DEEEIRTTNPVATEQYGSVQTTDLVRGEEELM

SEQ ID NO: 59714 - protein, 32 aa, Artificial Sequence
  Description of Artificial Sequence: Synthetic polypeptide
DEEEIRTTNPVATEQYGSVSYTGVWIEQRIAN

SEQ ID NO: 59715 - protein, 32 aa, Artificial Sequence
  Description of Artificial Sequence: Synthetic polypeptide
DEEEIRTTNPVATEQYGSVSYTLLEVENNSLF

SEQ ID NO: 59716 - protein, 33 aa, Artificial Sequence
  Description of Artificial Sequence: Synthetic polypeptide
DEEEIRTTNPVATEQYGSVQVTMMLQRGEAQDE

SEQ ID NO: 59717 - protein, 33 aa, Artificial Sequence
  Description of Artificial Sequence: Synthetic polypeptide
DEEEIRTTNPVATEQYGSVSYTNALENFGSQQD

SEQ ID NO: 59718 - protein, 31 aa, Artificial Sequence
  Description of Artificial Sequence: Synthetic polypeptide
DEEEIRTTNPVATEQYGSVQVPNQGQRDTQD

SEQ ID NO: 59719 - protein, 32 aa, Artificial Sequence
  Description of Artificial Sequence: Synthetic polypeptide
DEEEIRTTNPVATEQYGSVQTVNGQQIENEIG

SEQ ID NO: 59720 - protein, 33 aa, Artificial Sequence
  Description of Artificial Sequence: Synthetic polypeptide
DEEEIRTTNPVATEQYGSVSYTPNWLEQLEIEN

SEQ ID NO: 59721 - protein, 34 aa, Artificial Sequence
  Description of Artificial Sequence: Synthetic polypeptide
DEEEIRTTNPVATEQYGSVSYTVLDQTTQGDEQR

SEQ ID NO: 59722 - protein, 32 aa, Artificial Sequence
  Description of Artificial Sequence: Synthetic polypeptide
DEEEIRTTNPVATEQYGSVSYTYEDNQRAVDE

SEQ ID NO: 59723 - protein, 33 aa, Artificial Sequence
  Description of Artificial Sequence: Synthetic polypeptide
DEEEIRTTNPVATEQYGSVSYWNLESDMGNDVE

SEQ ID NO: 59724 - protein, 34 aa, Artificial Sequence
  Description of Artificial Sequence: Synthetic polypeptide
DEEEIRTTNPVATEQYGSVSYYDNLQEQVGEVRF

SEQ ID NO: 59725 - protein, 32 aa, Artificial Sequence
  Description of Artificial Sequence: Synthetic polypeptide
DEEEIRTTNPVATEQYGSVTCTDLQTREDQQD

SEQ ID NO: 59726 - protein, 34 aa, Artificial Sequence
  Description of Artificial Sequence: Synthetic polypeptide
DEEEIRTTNPVATEQYGSVTDDTMNLNQNGGNIQ

SEQ ID NO: 59727 - protein, 34 aa, Artificial Sequence
  Description of Artificial Sequence: Synthetic polypeptide
DEEEIRTTNPVATEQYGSVTDTNLNQNIGGNIQQ

SEQ ID NO: 59728 - protein, 33 aa, Artificial Sequence
  Description of Artificial Sequence: Synthetic polypeptide
DEEEIRTTNPVATEQYGSVTDTNLVNNGGNIQG

SEQ ID NO: 59729 - protein, 34 aa, Artificial Sequence
  Description of Artificial Sequence: Synthetic polypeptide
DEEEIRTTNPVATEQYGSVTDTNLVQNGGNNEQG

SEQ ID NO: 59730 - protein, 32 aa, Artificial Sequence
  Description of Artificial Sequence: Synthetic polypeptide
DEEEIRTTNPVATEQYGSVTENLQTIDNVESV

SEQ ID NO: 59731 - protein, 33 aa, Artificial Sequence
  Description of Artificial Sequence: Synthetic polypeptide
DEEEIRTTNPVATEQYGSVTGTNLIQGVGGDGE

SEQ ID NO: 59732 - protein, 33 aa, Artificial Sequence
  Description of Artificial Sequence: Synthetic polypeptide
DEEEIRTTNPVATEQYGSVQTTMNLEQTGEQII

SEQ ID NO: 59733 - protein, 31 aa, Artificial Sequence
  Description of Artificial Sequence: Synthetic polypeptide
DEEEIRTTNPVATEQYGSVTLTTTDQREQEP

SEQ ID NO: 59734 - protein, 32 aa, Artificial Sequence
  Description of Artificial Sequence: Synthetic polypeptide
DEEEIRTTNPVATEQYGSVTMANLGRQLVTRG

SEQ ID NO: 59735 - protein, 32 aa, Artificial Sequence
  Description of Artificial Sequence: Synthetic polypeptide
DEEEIRTTNPVATEQYGSVSVTTLQGDAILQE

SEQ ID NO: 59736 - protein, 33 aa, Artificial Sequence
  Description of Artificial Sequence: Synthetic polypeptide
DEEEIRTTNPVATEQYGSVSTYMTGDTGQGGNE

SEQ ID NO: 59737 - protein, 33 aa, Artificial Sequence
  Description of Artificial Sequence: Synthetic polypeptide
DEEEIRTTNPVATEQYGSVSVTTGGQRQGIVTI

SEQ ID NO: 59738 - protein, 34 aa, Artificial Sequence
  Description of Artificial Sequence: Synthetic polypeptide
DEEEIRTTNPVATEQYGSVSVTSMIEQRNGNEDI

SEQ ID NO: 59739 - protein, 31 aa, Artificial Sequence
  Description of Artificial Sequence: Synthetic polypeptide
DEEEIRTTNPVATEQYGSVSVMNEMETNIIL

SEQ ID NO: 59740 - protein, 33 aa, Artificial Sequence
  Description of Artificial Sequence: Synthetic polypeptide
DEEEIRTTNPVATEQYGSVSATVNGEETGNLVT

SEQ ID NO: 59741 - protein, 32 aa, Artificial Sequence
  Description of Artificial Sequence: Synthetic polypeptide
DEEEIRTTNPVATEQYGSVSVMNLVNTGVEQG

SEQ ID NO: 59742 - protein, 32 aa, Artificial Sequence
  Description of Artificial Sequence: Synthetic polypeptide
DEEEIRTTNPVATEQYGSVSVMNLVQVNEDDQ

SEQ ID NO: 59743 - protein, 32 aa, Artificial Sequence
  Description of Artificial Sequence: Synthetic polypeptide
DEEEIRTTNPVATEQYGSVSVMVLDVGSEDRL

SEQ ID NO: 59744 - protein, 32 aa, Artificial Sequence
  Description of Artificial Sequence: Synthetic polypeptide
DEEEIRTTNPVATEQYGSVSVNDASQTGGQEF

SEQ ID NO: 59745 - protein, 33 aa, Artificial Sequence
  Description of Artificial Sequence: Synthetic polypeptide
DEEEIRTTNPVATEQYGSVSVNDASQTGGQFRD

SEQ ID NO: 59746 - protein, 32 aa, Artificial Sequence
  Description of Artificial Sequence: Synthetic polypeptide
DEEEIRTTNPVATEQYGSVSVNDASTTGMQYR

SEQ ID NO: 59747 - protein, 34 aa, Artificial Sequence
  Description of Artificial Sequence: Synthetic polypeptide
DEEEIRTTNPVATEQYGSVSATPGLQRQMLIERP

SEQ ID NO: 59748 - protein, 34 aa, Artificial Sequence
  Description of Artificial Sequence: Synthetic polypeptide
DEEEIRTTNPVATEQYGSVSVMNDLQITEGNQEQ

SEQ ID NO: 59749 - protein, 32 aa, Artificial Sequence
  Description of Artificial Sequence: Synthetic polypeptide
DEEEIRTTNPVATEQYGSVSVNLNPEVGEDIS

SEQ ID NO: 59750 - protein, 34 aa, Artificial Sequence
  Description of Artificial Sequence: Synthetic polypeptide
DEEEIRTTNPVATEQYGSVSATNPAGPQMRNGQV

SEQ ID NO: 59751 - protein, 32 aa, Artificial Sequence
  Description of Artificial Sequence: Synthetic polypeptide
DEEEIRTTNPVATEQYGSVSVNNLEEEPLNEE

SEQ ID NO: 59752 - protein, 31 aa, Artificial Sequence
  Description of Artificial Sequence: Synthetic polypeptide
DEEEIRTTNPVATEQYGSVSVNNLEEPLSEL

SEQ ID NO: 59753 - protein, 31 aa, Artificial Sequence
  Description of Artificial Sequence: Synthetic polypeptide
DEEEIRTTNPVATEQYGSVSVNVEQANDDEC

SEQ ID NO: 59754 - protein, 34 aa, Artificial Sequence
  Description of Artificial Sequence: Synthetic polypeptide
DEEEIRTTNPVATEQYGSVSATNLQQMTISQEER

SEQ ID NO: 59755 - protein, 33 aa, Artificial Sequence
  Description of Artificial Sequence: Synthetic polypeptide
DEEEIRTTNPVATEQYGSVSVPDLNQEAENNRD

SEQ ID NO: 59756 - protein, 32 aa, Artificial Sequence
  Description of Artificial Sequence: Synthetic polypeptide
DEEEIRTTNPVATEQYGSVSVPNQDGPMEDRG

SEQ ID NO: 59757 - protein, 31 aa, Artificial Sequence
  Description of Artificial Sequence: Synthetic polypeptide
DEEEIRTTNPVATEQYGSVSVPSERGMSIGF

SEQ ID NO: 59758 - protein, 33 aa, Artificial Sequence
  Description of Artificial Sequence: Synthetic polypeptide
DEEEIRTTNPVATEQYGSVSVSFGDLLQRDDNI

SEQ ID NO: 59759 - protein, 32 aa, Artificial Sequence
  Description of Artificial Sequence: Synthetic polypeptide
DEEEIRTTNPVATEQYGSVSVNLNSEVGPKIS

SEQ ID NO: 59760 - protein, 33 aa, Artificial Sequence
  Description of Artificial Sequence: Synthetic polypeptide
DEEEIRTTNPVATEQYGSVSVSFGDLQRDTNTI

SEQ ID NO: 59761 - protein, 32 aa, Artificial Sequence
  Description of Artificial Sequence: Synthetic polypeptide
DEEEIRTTNPVATEQYGSVSVMMLPQREVVEA

SEQ ID NO: 59762 - protein, 33 aa, Artificial Sequence
  Description of Artificial Sequence: Synthetic polypeptide
DEEEIRTTNPVATEQYGSVSAVMNLQRVQELSD

SEQ ID NO: 59763 - protein, 34 aa, Artificial Sequence
  Description of Artificial Sequence: Synthetic polypeptide
DEEEIRTTNPVATEQYGSVSTYNDLGQQGEGQGG

SEQ ID NO: 59764 - protein, 34 aa, Artificial Sequence
  Description of Artificial Sequence: Synthetic polypeptide
DEEEIRTTNPVATEQYGSVSTYNGLSNINGGNGQ

SEQ ID NO: 59765 - protein, 34 aa, Artificial Sequence
  Description of Artificial Sequence: Synthetic polypeptide
DEEEIRTTNPVATEQYGSVSTYNLDNGENGGNEQ

SEQ ID NO: 59766 - protein, 34 aa, Artificial Sequence
  Description of Artificial Sequence: Synthetic polypeptide
DEEEIRTTNPVATEQYGSVSTYNLSNINGGNIQG

SEQ ID NO: 59767 - protein, 34 aa, Artificial Sequence
  Description of Artificial Sequence: Synthetic polypeptide
DEEEIRTTNPVATEQYGSVSTYNLSNNENGENGQ

SEQ ID NO: 59768 - protein, 34 aa, Artificial Sequence
  Description of Artificial Sequence: Synthetic polypeptide
DEEEIRTTNPVATEQYGSVSTYNNMQQENIGGNT

SEQ ID NO: 59769 - protein, 33 aa, Artificial Sequence
  Description of Artificial Sequence: Synthetic polypeptide
DEEEIRTTNPVATEQYGSVSCIAEPQMREGENV

SEQ ID NO: 59770 - protein, 32 aa, Artificial Sequence
  Description of Artificial Sequence: Synthetic polypeptide
DEEEIRTTNPVATEQYGSVSTYSLQDTESQED

SEQ ID NO: 59771 - protein, 31 aa, Artificial Sequence
  Description of Artificial Sequence: Synthetic polypeptide
DEEEIRTTNPVATEQYGSVSTYTETFENNNE

SEQ ID NO: 59772 - protein, 32 aa, Artificial Sequence
  Description of Artificial Sequence: Synthetic polypeptide
DEEEIRTTNPVATEQYGSVSVMDENQETNGRD

SEQ ID NO: 59773 - protein, 33 aa, Artificial Sequence
  Description of Artificial Sequence: Synthetic polypeptide
DEEEIRTTNPVATEQYGSVSTYTLLVGGGDNET

SEQ ID NO: 59774 - protein, 32 aa, Artificial Sequence
  Description of Artificial Sequence: Synthetic polypeptide
DEEEIRTTNPVATEQYGSVSCEANLQVSMVEV

SEQ ID NO: 59775 - protein, 32 aa, Artificial Sequence
  Description of Artificial Sequence: Synthetic polypeptide
DEEEIRTTNPVATEQYGSVSCDVGGQRGVVVF

SEQ ID NO: 59776 - protein, 32 aa, Artificial Sequence
  Description of Artificial Sequence: Synthetic polypeptide
DEEEIRTTNPVATEQYGSVSVEDADQRTINGD

SEQ ID NO: 59777 - protein, 32 aa, Artificial Sequence
  Description of Artificial Sequence: Synthetic polypeptide
DEEEIRTTNPVATEQYGSVSVEGELIREEENT

SEQ ID NO: 59778 - protein, 33 aa, Artificial Sequence
  Description of Artificial Sequence: Synthetic polypeptide
DEEEIRTTNPVATEQYGSVSVELGAQREMENQG

SEQ ID NO: 59779 - protein, 32 aa, Artificial Sequence
  Description of Artificial Sequence: Synthetic polypeptide
DEEEIRTTNPVATEQYGSVSVENLQIHEFQDT

SEQ ID NO: 59780 - protein, 34 aa, Artificial Sequence
  Description of Artificial Sequence: Synthetic polypeptide
DEEEIRTTNPVATEQYGSVSAWVGLQVLEGENRT

SEQ ID NO: 59781 - protein, 33 aa, Artificial Sequence
  Description of Artificial Sequence: Synthetic polypeptide
DEEEIRTTNPVATEQYGSVSVLMNEEQLLVNER

SEQ ID NO: 59782 - protein, 33 aa, Artificial Sequence
  Description of Artificial Sequence: Synthetic polypeptide
DEEEIRTTNPVATEQYGSVSVLNEEQVLVNQRT

SEQ ID NO: 59783 - protein, 33 aa, Artificial Sequence
  Description of Artificial Sequence: Synthetic polypeptide
DEEEIRTTNPVATEQYGSVSVANLAMRVVNEQT

SEQ ID NO: 59784 - protein, 33 aa, Artificial Sequence
  Description of Artificial Sequence: Synthetic polypeptide
DEEEIRTTNPVATEQYGSVSVSFNLEQGVENIE

SEQ ID NO: 59785 - protein, 32 aa, Artificial Sequence
  Description of Artificial Sequence: Synthetic polypeptide
DEEEIRTTNPVATEQYGSVSVSFNLEQIVTSI

SEQ ID NO: 59786 - protein, 34 aa, Artificial Sequence
  Description of Artificial Sequence: Synthetic polypeptide
DEEEIRTTNPVATEQYGSVSVSFNLEQRVENSIF

SEQ ID NO: 59787 - protein, 33 aa, Artificial Sequence
  Description of Artificial Sequence: Synthetic polypeptide
DEEEIRTTNPVATEQYGSVSVTGESQRGEEQEM

SEQ ID NO: 59788 - protein, 34 aa, Artificial Sequence
  Description of Artificial Sequence: Synthetic polypeptide
DEEEIRTTNPVATEQYGSVSVTGFLSIGTGGNNR

SEQ ID NO: 59789 - protein, 33 aa, Artificial Sequence
  Description of Artificial Sequence: Synthetic polypeptide
DEEEIRTTNPVATEQYGSVSVTGLLAQQENEES

SEQ ID NO: 59790 - protein, 34 aa, Artificial Sequence
  Description of Artificial Sequence: Synthetic polypeptide
DEEEIRTTNPVATEQYGSVSVTGLQMAEGENEQT

SEQ ID NO: 59791 - protein, 33 aa, Artificial Sequence
  Description of Artificial Sequence: Synthetic polypeptide
DEEEIRTTNPVATEQYGSVSVTGLVQVQNENDQ

SEQ ID NO: 59792 - protein, 34 aa, Artificial Sequence
  Description of Artificial Sequence: Synthetic polypeptide
DEEEIRTTNPVATEQYGSVSVTINLQPVGEQDDD

SEQ ID NO: 59793 - protein, 31 aa, Artificial Sequence
  Description of Artificial Sequence: Synthetic polypeptide
DEEEIRTTNPVATEQYGSVSVTLDLPEVVSV

SEQ ID NO: 59794 - protein, 31 aa, Artificial Sequence
  Description of Artificial Sequence: Synthetic polypeptide
DEEEIRTTNPVATEQYGSVSVTMETQENIGL

SEQ ID NO: 59795 - protein, 34 aa, Artificial Sequence
  Description of Artificial Sequence: Synthetic polypeptide
DEEEIRTTNPVATEQYGSVSVTMGDLSQRGVPEL

SEQ ID NO: 59796 - protein, 34 aa, Artificial Sequence
  Description of Artificial Sequence: Synthetic polypeptide
DEEEIRTTNPVATEQYGSVSVTFTDLQATPGNTQ

SEQ ID NO: 59797 - protein, 34 aa, Artificial Sequence
  Description of Artificial Sequence: Synthetic polypeptide
DEEEIRTTNPVATEQYGSVSVTMNLAENRVNNSD

SEQ ID NO: 59798 - protein, 34 aa, Artificial Sequence
  Description of Artificial Sequence: Synthetic polypeptide
DEEEIRTTNPVATEQYGSVSVTNDQQNSGQIVRS

SEQ ID NO: 59799 - protein, 35 aa, Artificial Sequence
  Description of Artificial Sequence: Synthetic polypeptide
DEEEIRTTNPVATEQYGSVSVTNLGDERTGSEQRL

SEQ ID NO: 59800 - protein, 32 aa, Artificial Sequence
  Description of Artificial Sequence: Synthetic polypeptide
DEEEIRTTNPVATEQYGSVSVTNLHGYSEIEI

SEQ ID NO: 59801 - protein, 33 aa, Artificial Sequence
  Description of Artificial Sequence: Synthetic polypeptide
DEEEIRTTNPVATEQYGSVSVTNLQNSLLEEVT

SEQ ID NO: 59802 - protein, 33 aa, Artificial Sequence
  Description of Artificial Sequence: Synthetic polypeptide
DEEEIRTTNPVATEQYGSVSVTNLQQQELLPTD

SEQ ID NO: 59803 - protein, 32 aa, Artificial Sequence
  Description of Artificial Sequence: Synthetic polypeptide
DEEEIRTTNPVATEQYGSVSVTNMIEINEPYH

SEQ ID NO: 59804 - protein, 32 aa, Artificial Sequence
  Description of Artificial Sequence: Synthetic polypeptide
DEEEIRTTNPVATEQYGSVSVTNMIRNEPTYT

SEQ ID NO: 59805 - protein, 33 aa, Artificial Sequence
  Description of Artificial Sequence: Synthetic polypeptide
DEEEIRTTNPVATEQYGSVSVTNNDLLRISEVQ

SEQ ID NO: 59806 - protein, 33 aa, Artificial Sequence
  Description of Artificial Sequence: Synthetic polypeptide
DEEEIRTTNPVATEQYGSVSVTPHLEQTENQND

SEQ ID NO: 59807 - protein, 34 aa, Artificial Sequence
  Description of Artificial Sequence: Synthetic polypeptide
DEEEIRTTNPVATEQYGSVSVTNDLQITPPVNTQ

SEQ ID NO: 59808 - protein, 33 aa, Artificial Sequence
  Description of Artificial Sequence: Synthetic polypeptide
DEEEIRTTNPVATEQYGSVSANNDGQNNGGNEG

SEQ ID NO: 59809 - protein, 32 aa, Artificial Sequence
  Description of Artificial Sequence: Synthetic polypeptide
DEEEIRTTNPVATEQYGSVSVTDMLQTIEETV

SEQ ID NO: 59810 - protein, 34 aa, Artificial Sequence
  Description of Artificial Sequence: Synthetic polypeptide
DEEEIRTTNPVATEQYGSVSANNLNQTNFGNGNG

SEQ ID NO: 59811 - protein, 33 aa, Artificial Sequence
  Description of Artificial Sequence: Synthetic polypeptide
DEEEIRTTNPVATEQYGSVSATMNGLERVELSD

SEQ ID NO: 59812 - protein, 33 aa, Artificial Sequence
  Description of Artificial Sequence: Synthetic polypeptide
DEEEIRTTNPVATEQYGSVSATLGLTRMLIERP

SEQ ID NO: 59813 - protein, 32 aa, Artificial Sequence
  Description of Artificial Sequence: Synthetic polypeptide
DEEEIRTTNPVATEQYGSVSVSFNLQGVVEEL

SEQ ID NO: 59814 - protein, 34 aa, Artificial Sequence
  Description of Artificial Sequence: Synthetic polypeptide
DEEEIRTTNPVATEQYGSVSATGNVGQEGGGGNT

SEQ ID NO: 59815 - protein, 33 aa, Artificial Sequence
  Description of Artificial Sequence: Synthetic polypeptide
DEEEIRTTNPVATEQYGSVSATGNGGQPQDANF

SEQ ID NO: 59816 - protein, 33 aa, Artificial Sequence
  Description of Artificial Sequence: Synthetic polypeptide
DEEEIRTTNPVATEQYGSVSVSGNHQRFVSNIA

SEQ ID NO: 59817 - protein, 34 aa, Artificial Sequence
  Description of Artificial Sequence: Synthetic polypeptide
DEEEIRTTNPVATEQYGSVSVSGNLSQSVGNNQW

SEQ ID NO: 59818 - protein, 32 aa, Artificial Sequence
  Description of Artificial Sequence: Synthetic polypeptide
DEEEIRTTNPVATEQYGSVSVSLNLEYDDNAF

SEQ ID NO: 59819 - protein, 32 aa, Artificial Sequence
  Description of Artificial Sequence: Synthetic polypeptide
DEEEIRTTNPVATEQYGSVSATDGEMREGEDV

SEQ ID NO: 59820 - protein, 32 aa, Artificial Sequence
  Description of Artificial Sequence: Synthetic polypeptide
DEEEIRTTNPVATEQYGSVSVSPNLDTRSEGH

SEQ ID NO: 59821 - protein, 32 aa, Artificial Sequence
  Description of Artificial Sequence: Synthetic polypeptide
DEEEIRTTNPVATEQYGSVSVSPNLNRQQEGH

SEQ ID NO: 59822 - protein, 32 aa, Artificial Sequence
  Description of Artificial Sequence: Synthetic polypeptide
DEEEIRTTNPVATEQYGSVSAQNMQSQGPELT

SEQ ID NO: 59823 - protein, 35 aa, Artificial Sequence
  Description of Artificial Sequence: Synthetic polypeptide
DEEEIRTTNPVATEQYGSVSVSTNLQSGTNNNTID

SEQ ID NO: 59824 - protein, 35 aa, Artificial Sequence
  Description of Artificial Sequence: Synthetic polypeptide
DEEEIRTTNPVATEQYGSVSVSTNNLQAGNNNGID

SEQ ID NO: 59825 - protein, 35 aa, Artificial Sequence
  Description of Artificial Sequence: Synthetic polypeptide
DEEEIRTTNPVATEQYGSVSVSTNNLQAGNNTNIA

SEQ ID NO: 59826 - protein, 35 aa, Artificial Sequence
  Description of Artificial Sequence: Synthetic polypeptide
DEEEIRTTNPVATEQYGSVSVSTNNLQQGNNNNVD

SEQ ID NO: 59827 - protein, 35 aa, Artificial Sequence
  Description of Artificial Sequence: Synthetic polypeptide
DEEEIRTTNPVATEQYGSVSVSTNQLQAGNNNNGG

SEQ ID NO: 59828 - protein, 33 aa, Artificial Sequence
  Description of Artificial Sequence: Synthetic polypeptide
DEEEIRTTNPVATEQYGSVSANYSELKIGNDQV

SEQ ID NO: 59829 - protein, 32 aa, Artificial Sequence
  Description of Artificial Sequence: Synthetic polypeptide
DEEEIRTTNPVATEQYGSVSANTYEGGGEDRM

SEQ ID NO: 59830 - protein, 32 aa, Artificial Sequence
  Description of Artificial Sequence: Synthetic polypeptide
DEEEIRTTNPVATEQYGSVSVTDLHERNPEQE

SEQ ID NO: 59831 - protein, 34 aa, Artificial Sequence
  Description of Artificial Sequence: Synthetic polypeptide
DEEEIRTTNPVATEQYGSVSVTDLQISVGENQNM

SEQ ID NO: 59832 - protein, 32 aa, Artificial Sequence
  Description of Artificial Sequence: Synthetic polypeptide
DEEEIRTTNPVATEQYGSVSVTTGGAQQGVVT

SEQ ID NO: 59833 - protein, 30 aa, Artificial Sequence
  Description of Artificial Sequence: Synthetic polypeptide
DEETICTTNPVATEAYGSVNTNTGQGEGNI

SEQ ID NO: 59834 - protein, 33 aa, Artificial Sequence
  Description of Artificial Sequence: Synthetic polypeptide
DEEEIRTTNPVATEQYGSVSTSNNMTMTQGENE

SEQ ID NO: 59835 - protein, 33 aa, Artificial Sequence
  Description of Artificial Sequence: Synthetic polypeptide
DEEEIRTTNPVATEQYGSVSTSNNMTMTGENID

SEQ ID NO: 59836 - protein, 33 aa, Artificial Sequence
  Description of Artificial Sequence: Synthetic polypeptide
DEEEIRTTNPVATEQYGSVSTMNNTEGITGNDG

SEQ ID NO: 59837 - protein, 33 aa, Artificial Sequence
  Description of Artificial Sequence: Synthetic polypeptide
DEEEIRTTNPVATEQYGSVSTMNTGLNNINEFQ

SEQ ID NO: 59838 - protein, 34 aa, Artificial Sequence
  Description of Artificial Sequence: Synthetic polypeptide
DEEEIRTTNPVATEQYGSVSTMNTLGQGEGGEIN

SEQ ID NO: 59839 - protein, 33 aa, Artificial Sequence
  Description of Artificial Sequence: Synthetic polypeptide
DEEEIRTTNPVATEQYGSVSTMNTNGEFGGNDE

SEQ ID NO: 59840 - protein, 33 aa, Artificial Sequence
  Description of Artificial Sequence: Synthetic polypeptide
DEEEIRTTNPVATEQYGSVSTMNTNGEFGGNNG

SEQ ID NO: 59841 - protein, 33 aa, Artificial Sequence
  Description of Artificial Sequence: Synthetic polypeptide
DEEEIRTTNPVATEQYGSVSTMNVGVIGLGNDQ

SEQ ID NO: 59842 - protein, 33 aa, Artificial Sequence
  Description of Artificial Sequence: Synthetic polypeptide
DEEEIRTTNPVATEQYGSVSTMPVDQFEGENFQ

SEQ ID NO: 59843 - protein, 32 aa, Artificial Sequence
  Description of Artificial Sequence: Synthetic polypeptide
DEEEIRTTNPVATEQYGSVSTMQDEQGETGED

SEQ ID NO: 59844 - protein, 32 aa, Artificial Sequence
  Description of Artificial Sequence: Synthetic polypeptide
DEEEIRTTNPVATEQYGSVSTMQDGFGGNEGG

SEQ ID NO: 59845 - protein, 33 aa, Artificial Sequence
  Description of Artificial Sequence: Synthetic polypeptide
DEEEIRTTNPVATEQYGSVSTMNNQEVGLEPQA

SEQ ID NO: 59846 - protein, 33 aa, Artificial Sequence
  Description of Artificial Sequence: Synthetic polypeptide
DEEEIRTTNPVATEQYGSVSTMQDTGQSEGGNI

SEQ ID NO: 59847 - protein, 32 aa, Artificial Sequence
  Description of Artificial Sequence: Synthetic polypeptide
DEEEIRTTNPVATEQYGSVSTMQTNEGGNEEE

SEQ ID NO: 59848 - protein, 33 aa, Artificial Sequence
  Description of Artificial Sequence: Synthetic polypeptide
DEEEIRTTNPVATEQYGSVSTMTGLSDNGGGNI

SEQ ID NO: 59849 - protein, 34 aa, Artificial Sequence
  Description of Artificial Sequence: Synthetic polypeptide
DEEEIRTTNPVATEQYGSVSTMTLGQMEGNNTTD

SEQ ID NO: 59850 - protein, 34 aa, Artificial Sequence
  Description of Artificial Sequence: Synthetic polypeptide
DEEEIRTTNPVATEQYGSVSTMTNGIQEGGGNQG

SEQ ID NO: 59851 - protein, 33 aa, Artificial Sequence
  Description of Artificial Sequence: Synthetic polypeptide
DEEEIRTTNPVATEQYGSVSTMTVGLGEIGNIE

SEQ ID NO: 59852 - protein, 33 aa, Artificial Sequence
  Description of Artificial Sequence: Synthetic polypeptide
DEEEIRTTNPVATEQYGSVSTNAHQNTGDSQQM

SEQ ID NO: 59853 - protein, 32 aa, Artificial Sequence
  Description of Artificial Sequence: Synthetic polypeptide
DEEEIRTTNPVATEQYGSVSTNDDHADEGDQE

SEQ ID NO: 59854 - protein, 34 aa, Artificial Sequence
  Description of Artificial Sequence: Synthetic polypeptide
DEEEIRTTNPVATEQYGSVSTNDDQTDSGQNHNP

SEQ ID NO: 59855 - protein, 33 aa, Artificial Sequence
  Description of Artificial Sequence: Synthetic polypeptide
DEEEIRTTNPVATEQYGSVSTNDEQTQEGGQHI

SEQ ID NO: 59856 - protein, 35 aa, Artificial Sequence
  Description of Artificial Sequence: Synthetic polypeptide
DEEEIRTTNPVATEQYGSVSTMQNLGQNGPGNGDE

SEQ ID NO: 59857 - protein, 32 aa, Artificial Sequence
  Description of Artificial Sequence: Synthetic polypeptide
DEEEIRTTNPVATEQYGSVSTNDGQENDEEIS

SEQ ID NO: 59858 - protein, 34 aa, Artificial Sequence
  Description of Artificial Sequence: Synthetic polypeptide
DEEEIRTTNPVATEQYGSVSTMNNGQNGQGENED

SEQ ID NO: 59859 - protein, 35 aa, Artificial Sequence
  Description of Artificial Sequence: Synthetic polypeptide
DEEEIRTTNPVATEQYGSVSTMNLVQQEQGENGQE

SEQ ID NO: 59860 - protein, 32 aa, Artificial Sequence
  Description of Artificial Sequence: Synthetic polypeptide
DEEEIRTTNPVATEQYGSVSTMNHQQDVVEVL

SEQ ID NO: 59861 - protein, 35 aa, Artificial Sequence
  Description of Artificial Sequence: Synthetic polypeptide
DEEEIRTTNPVATEQYGSVSGTNNLQNVENENGNT

SEQ ID NO: 59862 - protein, 34 aa, Artificial Sequence
  Description of Artificial Sequence: Synthetic polypeptide
DEEEIRTTNPVATEQYGSVSGTNNLQNVEGQEEG

SEQ ID NO: 59863 - protein, 34 aa, Artificial Sequence
  Description of Artificial Sequence: Synthetic polypeptide
DEEEIRTTNPVATEQYGSVSGTNNLQNVEGMEGE

SEQ ID NO: 59864 - protein, 34 aa, Artificial Sequence
  Description of Artificial Sequence: Synthetic polypeptide
DEEEIRTTNPVATEQYGSVSTMNIGQNIGGNGNE

SEQ ID NO: 59865 - protein, 34 aa, Artificial Sequence
  Description of Artificial Sequence: Synthetic polypeptide
DEEEIRTTNPVATEQYGSVSTMNIGQNNGDGNDN

SEQ ID NO: 59866 - protein, 35 aa, Artificial Sequence
  Description of Artificial Sequence: Synthetic polypeptide
DEEEIRTTNPVATEQYGSVSTMNLDQPEQGINEQE

SEQ ID NO: 59867 - protein, 34 aa, Artificial Sequence
  Description of Artificial Sequence: Synthetic polypeptide
DEEEIRTTNPVATEQYGSVSTMNLEEITGGNGGE

SEQ ID NO: 59868 - protein, 34 aa, Artificial Sequence
  Description of Artificial Sequence: Synthetic polypeptide
DEEEIRTTNPVATEQYGSVSTMNLFETGGGQNGQ

SEQ ID NO: 59869 - protein, 34 aa, Artificial Sequence
  Description of Artificial Sequence: Synthetic polypeptide
DEEEIRTTNPVATEQYGSVSTMNNGPQEGGGNNT

SEQ ID NO: 59870 - protein, 34 aa, Artificial Sequence
  Description of Artificial Sequence: Synthetic polypeptide
DEEEIRTTNPVATEQYGSVSGTNNIQNEGGNVGT

SEQ ID NO: 59871 - protein, 33 aa, Artificial Sequence
  Description of Artificial Sequence: Synthetic polypeptide
DEEEIRTTNPVATEQYGSVSTMNLGVEGQDEEG

SEQ ID NO: 59872 - protein, 34 aa, Artificial Sequence
  Description of Artificial Sequence: Synthetic polypeptide
DEEEIRTTNPVATEQYGSVSTMNLIEVNGGNDDQ

SEQ ID NO: 59873 - protein, 34 aa, Artificial Sequence
  Description of Artificial Sequence: Synthetic polypeptide
DEEEIRTTNPVATEQYGSVSGTNNDQGEMGNGET

SEQ ID NO: 59874 - protein, 34 aa, Artificial Sequence
  Description of Artificial Sequence: Synthetic polypeptide
DEEEIRTTNPVATEQYGSVSTMNLNDFEGGNNEE

SEQ ID NO: 59875 - protein, 34 aa, Artificial Sequence
  Description of Artificial Sequence: Synthetic polypeptide
DEEEIRTTNPVATEQYGSVSGTNMDQGIGGGNNV

SEQ ID NO: 59876 - protein, 34 aa, Artificial Sequence
  Description of Artificial Sequence: Synthetic polypeptide
DEEEIRTTNPVATEQYGSVSGTNLVVNDGGNNDD

SEQ ID NO: 59877 - protein, 34 aa, Artificial Sequence
  Description of Artificial Sequence: Synthetic polypeptide
DEEEIRTTNPVATEQYGSVSTMNLNEVGGGNDGQ

SEQ ID NO: 59878 - protein, 34 aa, Artificial Sequence
  Description of Artificial Sequence: Synthetic polypeptide
DEEEIRTTNPVATEQYGSVSGTNLVVNDGGNEGQ

SEQ ID NO: 59879 - protein, 35 aa, Artificial Sequence
  Description of Artificial Sequence: Synthetic polypeptide
DEEEIRTTNPVATEQYGSVSTMNLTDQEGFGQNGF

SEQ ID NO: 59880 - protein, 34 aa, Artificial Sequence
  Description of Artificial Sequence: Synthetic polypeptide
DEEEIRTTNPVATEQYGSVSTMNLGSDTGGNIGN

SEQ ID NO: 59881 - protein, 32 aa, Artificial Sequence
  Description of Artificial Sequence: Synthetic polypeptide
DEEEIRTTNPVATEQYGSVSTNDHQEYFMDQM

SEQ ID NO: 59882 - protein, 34 aa, Artificial Sequence
  Description of Artificial Sequence: Synthetic polypeptide
DEEEIRTTNPVATEQYGSVSTNDLDQLSFGEEEK

SEQ ID NO: 59883 - protein, 34 aa, Artificial Sequence
  Description of Artificial Sequence: Synthetic polypeptide
DEEEIRTTNPVATEQYGSVSTNDLDQLYGEMEFD

SEQ ID NO: 59884 - protein, 34 aa, Artificial Sequence
  Description of Artificial Sequence: Synthetic polypeptide
DEEEIRTTNPVATEQYGSVSGTNDNQGEMGNGDD

SEQ ID NO: 59885 - protein, 33 aa, Artificial Sequence
  Description of Artificial Sequence: Synthetic polypeptide
DEEEIRTTNPVATEQYGSVSGTNDIQGEGGGQT

SEQ ID NO: 59886 - protein, 33 aa, Artificial Sequence
  Description of Artificial Sequence: Synthetic polypeptide
DEEEIRTTNPVATEQYGSVSGTNDINGEGGGNT

SEQ ID NO: 59887 - protein, 33 aa, Artificial Sequence
  Description of Artificial Sequence: Synthetic polypeptide
DEEEIRTTNPVATEQYGSVSGTNDIGQGEGGGD

SEQ ID NO: 59888 - protein, 33 aa, Artificial Sequence
  Description of Artificial Sequence: Synthetic polypeptide
DEEEIRTTNPVATEQYGSVSGTNDGQININVID

SEQ ID NO: 59889 - protein, 34 aa, Artificial Sequence
  Description of Artificial Sequence: Synthetic polypeptide
DEEEIRTTNPVATEQYGSVSGTNDGQEGGGNETE

SEQ ID NO: 59890 - protein, 33 aa, Artificial Sequence
  Description of Artificial Sequence: Synthetic polypeptide
DEEEIRTTNPVATEQYGSVSGTNDGDEGGNDFN

SEQ ID NO: 59891 - protein, 32 aa, Artificial Sequence
  Description of Artificial Sequence: Synthetic polypeptide
DEEEIRTTNPVATEQYGSVSGTMTDGTGNGNE

SEQ ID NO: 59892 - protein, 31 aa, Artificial Sequence
  Description of Artificial Sequence: Synthetic polypeptide
DEEEIRTTNPVATEQYGSVSTNKHDETDMSM

SEQ ID NO: 59893 - protein, 33 aa, Artificial Sequence
  Description of Artificial Sequence: Synthetic polypeptide
DEEEIRTTNPVATEQYGSVSTNIGQIGVHEEQT

SEQ ID NO: 59894 - protein, 32 aa, Artificial Sequence
  Description of Artificial Sequence: Synthetic polypeptide
DEEEIRTTNPVATEQYGSVSTNKHQESDMILI

SEQ ID NO: 59895 - protein, 33 aa, Artificial Sequence
  Description of Artificial Sequence: Synthetic polypeptide
DEEEIRTTNPVATEQYGSVSGTMNDINQGGGED

SEQ ID NO: 59896 - protein, 32 aa, Artificial Sequence
  Description of Artificial Sequence: Synthetic polypeptide
DEEEIRTTNPVATEQYGSVSTNKHSQEADMIS

SEQ ID NO: 59897 - protein, 34 aa, Artificial Sequence
  Description of Artificial Sequence: Synthetic polypeptide
DEEEIRTTNPVATEQYGSVSGTMGLGQTNGNNGD

SEQ ID NO: 59898 - protein, 34 aa, Artificial Sequence
  Description of Artificial Sequence: Synthetic polypeptide
DEEEIRTTNPVATEQYGSVSGTMELQNGQGENDG

SEQ ID NO: 59899 - protein, 34 aa, Artificial Sequence
  Description of Artificial Sequence: Synthetic polypeptide
DEEEIRTTNPVATEQYGSVSTNKHSQERDMEINI

SEQ ID NO: 59900 - protein, 34 aa, Artificial Sequence
  Description of Artificial Sequence: Synthetic polypeptide
DEEEIRTTNPVATEQYGSVSGTLNIQNNGGGNEA

SEQ ID NO: 59901 - protein, 34 aa, Artificial Sequence
  Description of Artificial Sequence: Synthetic polypeptide
DEEEIRTTNPVATEQYGSVSGTLNGLGEGEGNGE

SEQ ID NO: 59902 - protein, 34 aa, Artificial Sequence
  Description of Artificial Sequence: Synthetic polypeptide
DEEEIRTTNPVATEQYGSVSGTGINNQTGGGNGG

SEQ ID NO: 59903 - protein, 33 aa, Artificial Sequence
  Description of Artificial Sequence: Synthetic polypeptide
DEEEIRTTNPVATEQYGSVSGTFNNEDNGGGNI

SEQ ID NO: 59904 - protein, 34 aa, Artificial Sequence
  Description of Artificial Sequence: Synthetic polypeptide
DEEEIRTTNPVATEQYGSVSTNKHSDERSMGSDR

SEQ ID NO: 59905 - protein, 34 aa, Artificial Sequence
  Description of Artificial Sequence: Synthetic polypeptide
DEEEIRTTNPVATEQYGSVSGTNGGQDEGGGNTG

SEQ ID NO: 59906 - protein, 33 aa, Artificial Sequence
  Description of Artificial Sequence: Synthetic polypeptide
DEEEIRTTNPVATEQYGSVSTNGPQYPSSEEER

SEQ ID NO: 59907 - protein, 33 aa, Artificial Sequence
  Description of Artificial Sequence: Synthetic polypeptide
DEEEIRTTNPVATEQYGSVSTNGPQQVEVEFRG

SEQ ID NO: 59908 - protein, 33 aa, Artificial Sequence
  Description of Artificial Sequence: Synthetic polypeptide
DEEEIRTTNPVATEQYGSVSTNDLEATDNIEEY

SEQ ID NO: 59909 - protein, 33 aa, Artificial Sequence
  Description of Artificial Sequence: Synthetic polypeptide
DEEEIRTTNPVATEQYGSVSTNDLMADGSDQQM

SEQ ID NO: 59910 - protein, 33 aa, Artificial Sequence
  Description of Artificial Sequence: Synthetic polypeptide
DEEEIRTTNPVATEQYGSVSTNDLMPGQGTQFQ

SEQ ID NO: 59911 - protein, 33 aa, Artificial Sequence
  Description of Artificial Sequence: Synthetic polypeptide
DEEEIRTTNPVATEQYGSVSTNDMTTRVQNHEV

SEQ ID NO: 59912 - protein, 31 aa, Artificial Sequence
  Description of Artificial Sequence: Synthetic polypeptide
DEEEIRTTNPVATEQYGSVSTNDPAHTVEEQ

SEQ ID NO: 59913 - protein, 32 aa, Artificial Sequence
  Description of Artificial Sequence: Synthetic polypeptide
DEEEIRTTNPVATEQYGSVSTNDPDQEVQEDI

SEQ ID NO: 59914 - protein, 32 aa, Artificial Sequence
  Description of Artificial Sequence: Synthetic polypeptide
DEEEIRTTNPVATEQYGSVSTNDQVSLEDTYM

SEQ ID NO: 59915 - protein, 34 aa, Artificial Sequence
  Description of Artificial Sequence: Synthetic polypeptide
DEEEIRTTNPVATEQYGSVSTNDVLQVRHSSQQY

SEQ ID NO: 59916 - protein, 32 aa, Artificial Sequence
  Description of Artificial Sequence: Synthetic polypeptide
DEEEIRTTNPVATEQYGSVSTNEAPMVRSSDQ

SEQ ID NO: 59917 - protein, 34 aa, Artificial Sequence
  Description of Artificial Sequence: Synthetic polypeptide
DEEEIRTTNPVATEQYGSVSTNEDLVTEGTQQHR

SEQ ID NO: 59918 - protein, 35 aa, Artificial Sequence
  Description of Artificial Sequence: Synthetic polypeptide
DEEEIRTTNPVATEQYGSVSGTNLIVGQGGGNDDV

SEQ ID NO: 59919 - protein, 33 aa, Artificial Sequence
  Description of Artificial Sequence: Synthetic polypeptide
DEEEIRTTNPVATEQYGSVSTNGEQQSDQNDPV

SEQ ID NO: 59920 - protein, 34 aa, Artificial Sequence
  Description of Artificial Sequence: Synthetic polypeptide
DEEEIRTTNPVATEQYGSVSTNGFGQGNEGGENS

SEQ ID NO: 59921 - protein, 33 aa, Artificial Sequence
  Description of Artificial Sequence: Synthetic polypeptide
DEEEIRTTNPVATEQYGSVSTNGGQELGEEQVA

SEQ ID NO: 59922 - protein, 33 aa, Artificial Sequence
  Description of Artificial Sequence: Synthetic polypeptide
DEEEIRTTNPVATEQYGSVSGTNINNGETGGNG

SEQ ID NO: 59923 - protein, 33 aa, Artificial Sequence
  Description of Artificial Sequence: Synthetic polypeptide
DEEEIRTTNPVATEQYGSVSTNGLESAEGIGTV

SEQ ID NO: 59924 - protein, 34 aa, Artificial Sequence
  Description of Artificial Sequence: Synthetic polypeptide
DEEEIRTTNPVATEQYGSVSGTNGQQNEGGGNTT

SEQ ID NO: 59925 - protein, 34 aa, Artificial Sequence
  Description of Artificial Sequence: Synthetic polypeptide
DEEEIRTTNPVATEQYGSVSTNGLQQSSGDAGEG

SEQ ID NO: 59926 - protein, 33 aa, Artificial Sequence
  Description of Artificial Sequence: Synthetic polypeptide
DEEEIRTTNPVATEQYGSVSTNGPMDFGSDQRM

SEQ ID NO: 59927 - protein, 33 aa, Artificial Sequence
  Description of Artificial Sequence: Synthetic polypeptide
DEEEIRTTNPVATEQYGSVSTNGPMTTGSDQRM

SEQ ID NO: 59928 - protein, 34 aa, Artificial Sequence
  Description of Artificial Sequence: Synthetic polypeptide
DEEEIRTTNPVATEQYGSVSGTNGINNQGTGGNG

SEQ ID NO: 59929 - protein, 32 aa, Artificial Sequence
  Description of Artificial Sequence: Synthetic polypeptide
DEEEIRTTNPVATEQYGSVSTMNHNQDVDEVN

SEQ ID NO: 59930 - protein, 34 aa, Artificial Sequence
  Description of Artificial Sequence: Synthetic polypeptide
DEEEIRTTNPVATEQYGSVSGTDQVLQESGNGGT

SEQ ID NO: 59931 - protein, 34 aa, Artificial Sequence
  Description of Artificial Sequence: Synthetic polypeptide
DEEEIRTTNPVATEQYGSVSTMNGQGGGGENGTV

SEQ ID NO: 59932 - protein, 34 aa, Artificial Sequence
  Description of Artificial Sequence: Synthetic polypeptide
DEEEIRTTNPVATEQYGSVSGTNNMEQNIGGNNM

SEQ ID NO: 59933 - protein, 33 aa, Artificial Sequence
  Description of Artificial Sequence: Synthetic polypeptide
DEEEIRTTNPVATEQYGSVSTMLDLDQSGEGEG

SEQ ID NO: 59934 - protein, 33 aa, Artificial Sequence
  Description of Artificial Sequence: Synthetic polypeptide
DEEEIRTTNPVATEQYGSVSTMLDSIESSQINR

SEQ ID NO: 59935 - protein, 34 aa, Artificial Sequence
  Description of Artificial Sequence: Synthetic polypeptide
DEEEIRTTNPVATEQYGSVSIEMMMLQRGPEQRD

SEQ ID NO: 59936 - protein, 33 aa, Artificial Sequence
  Description of Artificial Sequence: Synthetic polypeptide
DEEEIRTTNPVATEQYGSVSIELTPQMRGVFMN

SEQ ID NO: 59937 - protein, 34 aa, Artificial Sequence
  Description of Artificial Sequence: Synthetic polypeptide
DEEEIRTTNPVATEQYGSVSTMLGLDQGEGNNEG

SEQ ID NO: 59938 - protein, 32 aa, Artificial Sequence
  Description of Artificial Sequence: Synthetic polypeptide
DEEEIRTTNPVATEQYGSVSIELLPQMRSVIN

SEQ ID NO: 59939 - protein, 34 aa, Artificial Sequence
  Description of Artificial Sequence: Synthetic polypeptide
DEEEIRTTNPVATEQYGSVSIELLPQMRGGVGRY

SEQ ID NO: 59940 - protein, 34 aa, Artificial Sequence
  Description of Artificial Sequence: Synthetic polypeptide
DEEEIRTTNPVATEQYGSVSIELLPQMRDNVFRN

SEQ ID NO: 59941 - protein, 34 aa, Artificial Sequence
  Description of Artificial Sequence: Synthetic polypeptide
DEEEIRTTNPVATEQYGSVSTMLIGQEEGGNQVE

SEQ ID NO: 59942 - protein, 33 aa, Artificial Sequence
  Description of Artificial Sequence: Synthetic polypeptide
DEEEIRTTNPVATEQYGSVSIMDWLGMEGQNRQ

SEQ ID NO: 59943 - protein, 33 aa, Artificial Sequence
  Description of Artificial Sequence: Synthetic polypeptide
DEEEIRTTNPVATEQYGSVSTMLIGQQEGGEQV

SEQ ID NO: 59944 - protein, 34 aa, Artificial Sequence
  Description of Artificial Sequence: Synthetic polypeptide
DEEEIRTTNPVATEQYGSVSTMLIGQQEGGNQNG

SEQ ID NO: 59945 - protein, 34 aa, Artificial Sequence
  Description of Artificial Sequence: Synthetic polypeptide
DEEEIRTTNPVATEQYGSVSTMLIPEQNEGGNQG

SEQ ID NO: 59946 - protein, 34 aa, Artificial Sequence
  Description of Artificial Sequence: Synthetic polypeptide
DEEEIRTTNPVATEQYGSVSTMLIPGQEEGGNQD

SEQ ID NO: 59947 - protein, 33 aa, Artificial Sequence
  Description of Artificial Sequence: Synthetic polypeptide
DEEEIRTTNPVATEQYGSVSIAPALQRNVEDND

SEQ ID NO: 59948 - protein, 34 aa, Artificial Sequence
  Description of Artificial Sequence: Synthetic polypeptide
DEEEIRTTNPVATEQYGSVSTMLLDQSEGGNQGV

SEQ ID NO: 59949 - protein, 33 aa, Artificial Sequence
  Description of Artificial Sequence: Synthetic polypeptide
DEEEIRTTNPVATEQYGSVSTMLLDVEGGNNGD

SEQ ID NO: 59950 - protein, 34 aa, Artificial Sequence
  Description of Artificial Sequence: Synthetic polypeptide
DEEEIRTTNPVATEQYGSVSTMLLEQGGGENNGD

SEQ ID NO: 59951 - protein, 34 aa, Artificial Sequence
  Description of Artificial Sequence: Synthetic polypeptide
DEEEIRTTNPVATEQYGSVSTMLMPGQDEGNQGE

SEQ ID NO: 59952 - protein, 34 aa, Artificial Sequence
  Description of Artificial Sequence: Synthetic polypeptide
DEEEIRTTNPVATEQYGSVSTMLMPGQSGENQGQ

SEQ ID NO: 59953 - protein, 34 aa, Artificial Sequence
  Description of Artificial Sequence: Synthetic polypeptide
DEEEIRTTNPVATEQYGSVSTMLIGQQEGGNGDE

SEQ ID NO: 59954 - protein, 33 aa, Artificial Sequence
  Description of Artificial Sequence: Synthetic polypeptide
DEEEIRTTNPVATEQYGSVSTMLNFNEGGNQEI

SEQ ID NO: 59955 - protein, 32 aa, Artificial Sequence
  Description of Artificial Sequence: Synthetic polypeptide
DEEEIRTTNPVATEQYGSVSIMGLEQMMQAQR

SEQ ID NO: 59956 - protein, 34 aa, Artificial Sequence
  Description of Artificial Sequence: Synthetic polypeptide
DEEEIRTTNPVATEQYGSVSTMGTLDQGEGGNTT

SEQ ID NO: 59957 - protein, 33 aa, Artificial Sequence
  Description of Artificial Sequence: Synthetic polypeptide
DEEEIRTTNPVATEQYGSVSTMELIMNGGENDG

SEQ ID NO: 59958 - protein, 34 aa, Artificial Sequence
  Description of Artificial Sequence: Synthetic polypeptide
DEEEIRTTNPVATEQYGSVSTMELQNGEGENDGG

SEQ ID NO: 59959 - protein, 34 aa, Artificial Sequence
  Description of Artificial Sequence: Synthetic polypeptide
DEEEIRTTNPVATEQYGSVSTMELTQQVNGNSGG

SEQ ID NO: 59960 - protein, 32 aa, Artificial Sequence
  Description of Artificial Sequence: Synthetic polypeptide
DEEEIRTTNPVATEQYGSVSTMEMGPETGNAG

SEQ ID NO: 59961 - protein, 34 aa, Artificial Sequence
  Description of Artificial Sequence: Synthetic polypeptide
DEEEIRTTNPVATEQYGSVSTMGDLEQNIGGNDG

SEQ ID NO: 59962 - protein, 34 aa, Artificial Sequence
  Description of Artificial Sequence: Synthetic polypeptide
DEEEIRTTNPVATEQYGSVSTMGDLEQTGGGNQG

SEQ ID NO: 59963 - protein, 34 aa, Artificial Sequence
  Description of Artificial Sequence: Synthetic polypeptide
DEEEIRTTNPVATEQYGSVSTMGELGQTGGTNEN

SEQ ID NO: 59964 - protein, 32 aa, Artificial Sequence
  Description of Artificial Sequence: Synthetic polypeptide
DEEEIRTTNPVATEQYGSVSTMGFEGGNGNIN

SEQ ID NO: 59965 - protein, 33 aa, Artificial Sequence
  Description of Artificial Sequence: Synthetic polypeptide
DEEEIRTTNPVATEQYGSVSTMGFQGQGGNGEL

SEQ ID NO: 59966 - protein, 33 aa, Artificial Sequence
  Description of Artificial Sequence: Synthetic polypeptide
DEEEIRTTNPVATEQYGSVSIMNLIPRQAETRG

SEQ ID NO: 59967 - protein, 33 aa, Artificial Sequence
  Description of Artificial Sequence: Synthetic polypeptide
DEEEIRTTNPVATEQYGSVSTMGLDQPENINTP

SEQ ID NO: 59968 - protein, 33 aa, Artificial Sequence
  Description of Artificial Sequence: Synthetic polypeptide
DEEEIRTTNPVATEQYGSVSTMGLNFNGGNELD

SEQ ID NO: 59969 - protein, 33 aa, Artificial Sequence
  Description of Artificial Sequence: Synthetic polypeptide
DEEEIRTTNPVATEQYGSVSTMGLQNQGGGGEG

SEQ ID NO: 59970 - protein, 34 aa, Artificial Sequence
  Description of Artificial Sequence: Synthetic polypeptide
DEEEIRTTNPVATEQYGSVSTMGLQNVEGGNGQT

SEQ ID NO: 59971 - protein, 32 aa, Artificial Sequence
  Description of Artificial Sequence: Synthetic polypeptide
DEEEIRTTNPVATEQYGSVSINLQMTPEVDEF

SEQ ID NO: 59972 - protein, 34 aa, Artificial Sequence
  Description of Artificial Sequence: Synthetic polypeptide
DEEEIRTTNPVATEQYGSVSTMGLSNDQNGGNIN

SEQ ID NO: 59973 - protein, 33 aa, Artificial Sequence
  Description of Artificial Sequence: Synthetic polypeptide
DEEEIRTTNPVATEQYGSVSTMGLSNFNGGNVQ

SEQ ID NO: 59974 - protein, 32 aa, Artificial Sequence
  Description of Artificial Sequence: Synthetic polypeptide
DEEEIRTTNPVATEQYGSVSTMGLVNGEGQTG

SEQ ID NO: 59975 - protein, 32 aa, Artificial Sequence
  Description of Artificial Sequence: Synthetic polypeptide
DEEEIRTTNPVATEQYGSVSTMGMGEGENTGT

SEQ ID NO: 59976 - protein, 32 aa, Artificial Sequence
  Description of Artificial Sequence: Synthetic polypeptide
DEEEIRTTNPVATEQYGSVSTMGMGPGTGNGE

SEQ ID NO: 59977 - protein, 33 aa, Artificial Sequence
  Description of Artificial Sequence: Synthetic polypeptide
DEEEIRTTNPVATEQYGSVSTMGLGDPGEGNDA

SEQ ID NO: 59978 - protein, 33 aa, Artificial Sequence
  Description of Artificial Sequence: Synthetic polypeptide
DEEEIRTTNPVATEQYGSVSTMLNGMEGGNEDI

SEQ ID NO: 59979 - protein, 34 aa, Artificial Sequence
  Description of Artificial Sequence: Synthetic polypeptide
DEEEIRTTNPVATEQYGSVSTMLNIDQNEGGNEE

SEQ ID NO: 59980 - protein, 34 aa, Artificial Sequence
  Description of Artificial Sequence: Synthetic polypeptide
DEEEIRTTNPVATEQYGSVSTMLPGQSGGNNQGQ

SEQ ID NO: 59981 - protein, 34 aa, Artificial Sequence
  Description of Artificial Sequence: Synthetic polypeptide
DEEEIRTTNPVATEQYGSVSGTTNNMQEGTENDS

SEQ ID NO: 59982 - protein, 34 aa, Artificial Sequence
  Description of Artificial Sequence: Synthetic polypeptide
DEEEIRTTNPVATEQYGSVSTMNGFEQDEGQNTI

SEQ ID NO: 59983 - protein, 34 aa, Artificial Sequence
  Description of Artificial Sequence: Synthetic polypeptide
DEEEIRTTNPVATEQYGSVSTMNGFGQNGEGENV

SEQ ID NO: 59984 - protein, 33 aa, Artificial Sequence
  Description of Artificial Sequence: Synthetic polypeptide
DEEEIRTTNPVATEQYGSVSGTSNQGQGGGGET

SEQ ID NO: 59985 - protein, 34 aa, Artificial Sequence
  Description of Artificial Sequence: Synthetic polypeptide
DEEEIRTTNPVATEQYGSVSGTSNMTQDGGGNEG

SEQ ID NO: 59986 - protein, 33 aa, Artificial Sequence
  Description of Artificial Sequence: Synthetic polypeptide
DEEEIRTTNPVATEQYGSVSGTSNMTMEEGENG

SEQ ID NO: 59987 - protein, 33 aa, Artificial Sequence
  Description of Artificial Sequence: Synthetic polypeptide
DEEEIRTTNPVATEQYGSVSTMNGGQTGGDEGN

SEQ ID NO: 59988 - protein, 33 aa, Artificial Sequence
  Description of Artificial Sequence: Synthetic polypeptide
DEEEIRTTNPVATEQYGSVSTMNGGQTGGGEQQ

SEQ ID NO: 59989 - protein, 34 aa, Artificial Sequence
  Description of Artificial Sequence: Synthetic polypeptide
DEEEIRTTNPVATEQYGSVSTMNGIQGEFGDNED

SEQ ID NO: 59990 - protein, 32 aa, Artificial Sequence
  Description of Artificial Sequence: Synthetic polypeptide
DEEEIRTTNPVATEQYGSVSGTTNQETTYNAS

SEQ ID NO: 59991 - protein, 33 aa, Artificial Sequence
  Description of Artificial Sequence: Synthetic polypeptide
DEEEIRTTNPVATEQYGSVSTMNGIQTGEGGEV

SEQ ID NO: 59992 - protein, 35 aa, Artificial Sequence
  Description of Artificial Sequence: Synthetic polypeptide
DEEEIRTTNPVATEQYGSVSTMNGLDQIGQENIGQ

SEQ ID NO: 59993 - protein, 34 aa, Artificial Sequence
  Description of Artificial Sequence: Synthetic polypeptide
DEEEIRTTNPVATEQYGSVSTMNGLEGEFGNNTI

SEQ ID NO: 59994 - protein, 35 aa, Artificial Sequence
  Description of Artificial Sequence: Synthetic polypeptide
DEEEIRTTNPVATEQYGSVSTMNGLEQDEGGGNTI

SEQ ID NO: 59995 - protein, 32 aa, Artificial Sequence
  Description of Artificial Sequence: Synthetic polypeptide
DEEEIRTTNPVATEQYGSVSGTQGVGVGNNGQ

SEQ ID NO: 59996 - protein, 33 aa, Artificial Sequence
  Description of Artificial Sequence: Synthetic polypeptide
DEEEIRTTNPVATEQYGSVSTMNGLNNINEFGG

SEQ ID NO: 59997 - protein, 34 aa, Artificial Sequence
  Description of Artificial Sequence: Synthetic polypeptide
DEEEIRTTNPVATEQYGSVSTMNGLQTGGGGGEQ

SEQ ID NO: 59998 - protein, 34 aa, Artificial Sequence
  Description of Artificial Sequence: Synthetic polypeptide
DEEEIRTTNPVATEQYGSVSTMNGLSDTGGNGGE

SEQ ID NO: 59999 - protein, 33 aa, Artificial Sequence
  Description of Artificial Sequence: Synthetic polypeptide
DEEEIRTTNPVATEQYGSVSGTNNNQTGGEDEQ

SEQ ID NO: 60000 - protein, 34 aa, Artificial Sequence
  Description of Artificial Sequence: Synthetic polypeptide
DEEEIRTTNPVATEQYGSVSTMNGPDQSGNNELD

SEQ ID NO: 60001 - protein, 34 aa, Artificial Sequence
  Description of Artificial Sequence: Synthetic polypeptide
DEEEIRTTNPVATEQYGSVSGTSNGQGGGGENET

SEQ ID NO: 60002 - protein, 34 aa, Artificial Sequence
  Description of Artificial Sequence: Synthetic polypeptide
DEEEIRTTNPVATEQYGSVSTMNGDQTGEGGNNP

SEQ ID NO: 60003 - protein, 34 aa, Artificial Sequence
  Description of Artificial Sequence: Synthetic polypeptide
DEEEIRTTNPVATEQYGSVSTMNGDQQTGNNEEH

SEQ ID NO: 60004 - protein, 33 aa, Artificial Sequence
  Description of Artificial Sequence: Synthetic polypeptide
DEEEIRTTNPVATEQYGSVSTMNGDQGEIENEE

SEQ ID NO: 60005 - protein, 34 aa, Artificial Sequence
  Description of Artificial Sequence: Synthetic polypeptide
DEEEIRTTNPVATEQYGSVSTMLQLNQGEGFNGE

SEQ ID NO: 60006 - protein, 32 aa, Artificial Sequence
  Description of Artificial Sequence: Synthetic polypeptide
DEEEIRTTNPVATEQYGSVSGVTLNPNEGEGF

SEQ ID NO: 60007 - protein, 32 aa, Artificial Sequence
  Description of Artificial Sequence: Synthetic polypeptide
DEEEIRTTNPVATEQYGSVSGVNTTAVGGGNI

SEQ ID NO: 60008 - protein, 32 aa, Artificial Sequence
  Description of Artificial Sequence: Synthetic polypeptide
DEEEIRTTNPVATEQYGSVSGVNMTGVEGGNI

SEQ ID NO: 60009 - protein, 32 aa, Artificial Sequence
  Description of Artificial Sequence: Synthetic polypeptide
DEEEIRTTNPVATEQYGSVSGVNGQGEGGEIT

SEQ ID NO: 60010 - protein, 34 aa, Artificial Sequence
  Description of Artificial Sequence: Synthetic polypeptide
DEEEIRTTNPVATEQYGSVSTMLQPGQSEGNQGN

SEQ ID NO: 60011 - protein, 32 aa, Artificial Sequence
  Description of Artificial Sequence: Synthetic polypeptide
DEEEIRTTNPVATEQYGSVSGVNDTGVGGENE

SEQ ID NO: 60012 - protein, 33 aa, Artificial Sequence
  Description of Artificial Sequence: Synthetic polypeptide
DEEEIRTTNPVATEQYGSVSTMLTFEDEGGNEG

SEQ ID NO: 60013 - protein, 32 aa, Artificial Sequence
  Description of Artificial Sequence: Synthetic polypeptide
DEEEIRTTNPVATEQYGSVSTMMLGEQQQVET

SEQ ID NO: 60014 - protein, 34 aa, Artificial Sequence
  Description of Artificial Sequence: Synthetic polypeptide
DEEEIRTTNPVATEQYGSVSTMNDGVQQEGGNQE

SEQ ID NO: 60015 - protein, 34 aa, Artificial Sequence
  Description of Artificial Sequence: Synthetic polypeptide
DEEEIRTTNPVATEQYGSVSTMNDLDQRMVVPEL

SEQ ID NO: 60016 - protein, 35 aa, Artificial Sequence
  Description of Artificial Sequence: Synthetic polypeptide
DEEEIRTTNPVATEQYGSVSTMNDLEQGGGGENTS

SEQ ID NO: 60017 - protein, 35 aa, Artificial Sequence
  Description of Artificial Sequence: Synthetic polypeptide
DEEEIRTTNPVATEQYGSVSTMNDLGQQNNGGNEQ

SEQ ID NO: 60018 - protein, 33 aa, Artificial Sequence
  Description of Artificial Sequence: Synthetic polypeptide
DEEEIRTTNPVATEQYGSVSTMNDMAQSTTNDS

SEQ ID NO: 60019 - protein, 33 aa, Artificial Sequence
  Description of Artificial Sequence: Synthetic polypeptide
DEEEIRTTNPVATEQYGSVSTMNDMQDSTQNKS

SEQ ID NO: 60020 - protein, 33 aa, Artificial Sequence
  Description of Artificial Sequence: Synthetic polypeptide
DEEEIRTTNPVATEQYGSVSGVFNGQEGEGGND

SEQ ID NO: 60021 - protein, 32 aa, Artificial Sequence
  Description of Artificial Sequence: Synthetic polypeptide
DEEEIRTTNPVATEQYGSVSTMNDMQQSTDES

SEQ ID NO: 60022 - protein, 34 aa, Artificial Sequence
  Description of Artificial Sequence: Synthetic polypeptide
DEEEIRTTNPVATEQYGSVSTMNDQTPNGGGFNE

SEQ ID NO: 60023 - protein, 33 aa, Artificial Sequence
  Description of Artificial Sequence: Synthetic polypeptide
DEEEIRTTNPVATEQYGSVSTMNDTNEFGNDED

SEQ ID NO: 60024 - protein, 33 aa, Artificial Sequence
  Description of Artificial Sequence: Synthetic polypeptide
DEEEIRTTNPVATEQYGSVSTMNDTNEFGNNNG

SEQ ID NO: 60025 - protein, 34 aa, Artificial Sequence
  Description of Artificial Sequence: Synthetic polypeptide
DEEEIRTTNPVATEQYGSVSTMNEGVQQEGGENQ

SEQ ID NO: 60026 - protein, 34 aa, Artificial Sequence
  Description of Artificial Sequence: Synthetic polypeptide
DEEEIRTTNPVATEQYGSVSGTNNLTGPGGGNNN

SEQ ID NO: 60027 - protein, 32 aa, Artificial Sequence
  Description of Artificial Sequence: Synthetic polypeptide
DEEEIRTTNPVATEQYGSVSELNLDDVGSEEI

SEQ ID NO: 60028 - protein, 34 aa, Artificial Sequence
  Description of Artificial Sequence: Synthetic polypeptide
DEEEIRTTNPVATEQYGSVSGTDNNFQDEGGNEI

SEQ ID NO: 60029 - protein, 35 aa, Artificial Sequence
  Description of Artificial Sequence: Synthetic polypeptide
DEEEIRTTNPVATEQYGSVSGTDNLQNEMGNGEEN

SEQ ID NO: 60030 - protein, 33 aa, Artificial Sequence
  Description of Artificial Sequence: Synthetic polypeptide
DEEEIRTTNPVATEQYGSVSETLLQEDGVTEEA

SEQ ID NO: 60031 - protein, 34 aa, Artificial Sequence
  Description of Artificial Sequence: Synthetic polypeptide
DEEEIRTTNPVATEQYGSVSETGNSLQQEQLTRQ

SEQ ID NO: 60032 - protein, 35 aa, Artificial Sequence
  Description of Artificial Sequence: Synthetic polypeptide
DEEEIRTTNPVATEQYGSVSETGNSLDQRFIMERQ

SEQ ID NO: 60033 - protein, 34 aa, Artificial Sequence
  Description of Artificial Sequence: Synthetic polypeptide
DEEEIRTTNPVATEQYGSVSETGNLQFRSTVIEN

SEQ ID NO: 60034 - protein, 32 aa, Artificial Sequence
  Description of Artificial Sequence: Synthetic polypeptide
DEEEIRTTNPVATEQYGSVSETEYGNTHIENE

SEQ ID NO: 60035 - protein, 33 aa, Artificial Sequence
  Description of Artificial Sequence: Synthetic polypeptide
DEEEIRTTNPVATEQYGSVSETENGQVGVAGDF

SEQ ID NO: 60036 - protein, 31 aa, Artificial Sequence
  Description of Artificial Sequence: Synthetic polypeptide
DEEEIRTTNPVATEQYGSVSESMLEEEGELS

SEQ ID NO: 60037 - protein, 31 aa, Artificial Sequence
  Description of Artificial Sequence: Synthetic polypeptide
DEEEIRTTNPVATEQYGSVSESILIVLEQRE

SEQ ID NO: 60038 - protein, 32 aa, Artificial Sequence
  Description of Artificial Sequence: Synthetic polypeptide
DEEEIRTTNPVATEQYGSVSESFNLQSVVEIL

SEQ ID NO: 60039 - protein, 35 aa, Artificial Sequence
  Description of Artificial Sequence: Synthetic polypeptide
DEEEIRTTNPVATEQYGSVSETNLNQDITGGNENI

SEQ ID NO: 60040 - protein, 34 aa, Artificial Sequence
  Description of Artificial Sequence: Synthetic polypeptide
DEEEIRTTNPVATEQYGSVSEQPGLQSRNGEEQR

SEQ ID NO: 60041 - protein, 31 aa, Artificial Sequence
  Description of Artificial Sequence: Synthetic polypeptide
DEEEIRTTNPVATEQYGSVSEQNLTVLEQDE

SEQ ID NO: 60042 - protein, 33 aa, Artificial Sequence
  Description of Artificial Sequence: Synthetic polypeptide
DEEEIRTTNPVATEQYGSVSTPNQTIGMGGNGT

SEQ ID NO: 60043 - protein, 31 aa, Artificial Sequence
  Description of Artificial Sequence: Synthetic polypeptide
DEEEIRTTNPVATEQYGSVSTPPQTMETQQM

SEQ ID NO: 60044 - protein, 33 aa, Artificial Sequence
  Description of Artificial Sequence: Synthetic polypeptide
DEEEIRTTNPVATEQYGSVSTPQGAQTRQQNEL

SEQ ID NO: 60045 - protein, 32 aa, Artificial Sequence
  Description of Artificial Sequence: Synthetic polypeptide
DEEEIRTTNPVATEQYGSVSTPQLQQQPEEDH

SEQ ID NO: 60046 - protein, 33 aa, Artificial Sequence
  Description of Artificial Sequence: Synthetic polypeptide
DEEEIRTTNPVATEQYGSVSTPTDQQTEQGNEG

SEQ ID NO: 60047 - protein, 32 aa, Artificial Sequence
  Description of Artificial Sequence: Synthetic polypeptide
DEEEIRTTNPVATEQYGSVSEPGVPLQRVEEQ

SEQ ID NO: 60048 - protein, 32 aa, Artificial Sequence
  Description of Artificial Sequence: Synthetic polypeptide
DEEEIRTTNPVATEQYGSVSEPAGNMRAGMNV

SEQ ID NO: 60049 - protein, 32 aa, Artificial Sequence
  Description of Artificial Sequence: Synthetic polypeptide
DEEEIRTTNPVATEQYGSVSEPAGMNRAGMNV

SEQ ID NO: 60050 - protein, 34 aa, Artificial Sequence
  Description of Artificial Sequence: Synthetic polypeptide
DEEEIRTTNPVATEQYGSVSTPNQLQQVMLEVRG

SEQ ID NO: 60051 - protein, 32 aa, Artificial Sequence
  Description of Artificial Sequence: Synthetic polypeptide
DEEEIRTTNPVATEQYGSVSEPAGMMRAGMNV

SEQ ID NO: 60052 - protein, 34 aa, Artificial Sequence
  Description of Artificial Sequence: Synthetic polypeptide
DEEEIRTTNPVATEQYGSVSETNLPDEGWSEEIR

SEQ ID NO: 60053 - protein, 33 aa, Artificial Sequence
  Description of Artificial Sequence: Synthetic polypeptide
DEEEIRTTNPVATEQYGSVSTPNLDVEGEFEVT

SEQ ID NO: 60054 - protein, 32 aa, Artificial Sequence
  Description of Artificial Sequence: Synthetic polypeptide
DEEEIRTTNPVATEQYGSVSTPGFTGGNGNEN

SEQ ID NO: 60055 - protein, 34 aa, Artificial Sequence
  Description of Artificial Sequence: Synthetic polypeptide
DEEEIRTTNPVATEQYGSVSTPGLQNIGGENGQA

SEQ ID NO: 60056 - protein, 32 aa, Artificial Sequence
  Description of Artificial Sequence: Synthetic polypeptide
DEEEIRTTNPVATEQYGSVSTPGVAGETGGND

SEQ ID NO: 60057 - protein, 33 aa, Artificial Sequence
  Description of Artificial Sequence: Synthetic polypeptide
DEEEIRTTNPVATEQYGSVSTPHLSGSGQNDIL

SEQ ID NO: 60058 - protein, 34 aa, Artificial Sequence
  Description of Artificial Sequence: Synthetic polypeptide
DEEEIRTTNPVATEQYGSVSTPLDQTRSTQGVEV

SEQ ID NO: 60059 - protein, 32 aa, Artificial Sequence
  Description of Artificial Sequence: Synthetic polypeptide
DEEEIRTTNPVATEQYGSVSTPLLANSNQEEH

SEQ ID NO: 60060 - protein, 33 aa, Artificial Sequence
  Description of Artificial Sequence: Synthetic polypeptide
DEEEIRTTNPVATEQYGSVSTPLLEVSEGVNND

SEQ ID NO: 60061 - protein, 32 aa, Artificial Sequence
  Description of Artificial Sequence: Synthetic polypeptide
DEEEIRTTNPVATEQYGSVSTPLQAFSDQEEP

SEQ ID NO: 60062 - protein, 33 aa, Artificial Sequence
  Description of Artificial Sequence: Synthetic polypeptide
DEEEIRTTNPVATEQYGSVSTPLQYQSNMDSDY

SEQ ID NO: 60063 - protein, 34 aa, Artificial Sequence
  Description of Artificial Sequence: Synthetic polypeptide
DEEEIRTTNPVATEQYGSVSTPNLDVNFGENQNV

SEQ ID NO: 60064 - protein, 32 aa, Artificial Sequence
  Description of Artificial Sequence: Synthetic polypeptide
DEEEIRTTNPVATEQYGSVSTPMDQHNSNSKQ

SEQ ID NO: 60065 - protein, 34 aa, Artificial Sequence
  Description of Artificial Sequence: Synthetic polypeptide
DEEEIRTTNPVATEQYGSVSTPNAVQQMNDINER

SEQ ID NO: 60066 - protein, 32 aa, Artificial Sequence
  Description of Artificial Sequence: Synthetic polypeptide
DEEEIRTTNPVATEQYGSVSTPNDHGELGSFE

SEQ ID NO: 60067 - protein, 33 aa, Artificial Sequence
  Description of Artificial Sequence: Synthetic polypeptide
DEEEIRTTNPVATEQYGSVSTPNDNTLELQEDN

SEQ ID NO: 60068 - protein, 34 aa, Artificial Sequence
  Description of Artificial Sequence: Synthetic polypeptide
DEEEIRTTNPVATEQYGSVSTPNDQIGMGGENGT

SEQ ID NO: 60069 - protein, 33 aa, Artificial Sequence
  Description of Artificial Sequence: Synthetic polypeptide
DEEEIRTTNPVATEQYGSVSTPNEQPPGEEEQY

SEQ ID NO: 60070 - protein, 33 aa, Artificial Sequence
  Description of Artificial Sequence: Synthetic polypeptide
DEEEIRTTNPVATEQYGSVSTPNEQPQQEELRY

SEQ ID NO: 60071 - protein, 32 aa, Artificial Sequence
  Description of Artificial Sequence: Synthetic polypeptide
DEEEIRTTNPVATEQYGSVSTPNGLSTNQEVL

SEQ ID NO: 60072 - protein, 34 aa, Artificial Sequence
  Description of Artificial Sequence: Synthetic polypeptide
DEEEIRTTNPVATEQYGSVSTPNILDEFGNGNEE

SEQ ID NO: 60073 - protein, 34 aa, Artificial Sequence
  Description of Artificial Sequence: Synthetic polypeptide
DEEEIRTTNPVATEQYGSVSTPNLDPVIGGNGQE

SEQ ID NO: 60074 - protein, 33 aa, Artificial Sequence
  Description of Artificial Sequence: Synthetic polypeptide
DEEEIRTTNPVATEQYGSVSTPMNLHIAGQLIE

SEQ ID NO: 60075 - protein, 32 aa, Artificial Sequence
  Description of Artificial Sequence: Synthetic polypeptide
DEEEIRTTNPVATEQYGSVSTPTQHQTQGPEN

SEQ ID NO: 60076 - protein, 32 aa, Artificial Sequence
  Description of Artificial Sequence: Synthetic polypeptide
DEEEIRTTNPVATEQYGSVSTPTSVGDGGGNG

SEQ ID NO: 60077 - protein, 32 aa, Artificial Sequence
  Description of Artificial Sequence: Synthetic polypeptide
DEEEIRTTNPVATEQYGSVSENYDDRGELEHT

SEQ ID NO: 60078 - protein, 34 aa, Artificial Sequence
  Description of Artificial Sequence: Synthetic polypeptide
DEEEIRTTNPVATEQYGSVSTQNLDDEMGQNEQI

SEQ ID NO: 60079 - protein, 32 aa, Artificial Sequence
  Description of Artificial Sequence: Synthetic polypeptide
DEEEIRTTNPVATEQYGSVSENLPELMVSLRL

SEQ ID NO: 60080 - protein, 33 aa, Artificial Sequence
  Description of Artificial Sequence: Synthetic polypeptide
DEEEIRTTNPVATEQYGSVSTQNMMHQESGQIN

SEQ ID NO: 60081 - protein, 34 aa, Artificial Sequence
  Description of Artificial Sequence: Synthetic polypeptide
DEEEIRTTNPVATEQYGSVSTQNNGDQNEGGNNE

SEQ ID NO: 60082 - protein, 33 aa, Artificial Sequence
  Description of Artificial Sequence: Synthetic polypeptide
DEEEIRTTNPVATEQYGSVSENGNLQEEGAELD

SEQ ID NO: 60083 - protein, 33 aa, Artificial Sequence
  Description of Artificial Sequence: Synthetic polypeptide
DEEEIRTTNPVATEQYGSVSTQSVGGQTGGGNT

SEQ ID NO: 60084 - protein, 34 aa, Artificial Sequence
  Description of Artificial Sequence: Synthetic polypeptide
DEEEIRTTNPVATEQYGSVSTQTLGQSIGGNDQE

SEQ ID NO: 60085 - protein, 32 aa, Artificial Sequence
  Description of Artificial Sequence: Synthetic polypeptide
DEEEIRTTNPVATEQYGSVSTQVGIGGNDGQT

SEQ ID NO: 60086 - protein, 32 aa, Artificial Sequence
  Description of Artificial Sequence: Synthetic polypeptide
DEEEIRTTNPVATEQYGSVSTQYEQENMFDRD

SEQ ID NO: 60087 - protein, 33 aa, Artificial Sequence
  Description of Artificial Sequence: Synthetic polypeptide
DEEEIRTTNPVATEQYGSVSTQNGTGGGQNGEG

SEQ ID NO: 60088 - protein, 31 aa, Artificial Sequence
  Description of Artificial Sequence: Synthetic polypeptide
DEEEIRTTNPVATEQYGSVSTSDPQFLDTSN

SEQ ID NO: 60089 - protein, 32 aa, Artificial Sequence
  Description of Artificial Sequence: Synthetic polypeptide
DEEEIRTTNPVATEQYGSVSTSIERLTVDVNI

SEQ ID NO: 60090 - protein, 33 aa, Artificial Sequence
  Description of Artificial Sequence: Synthetic polypeptide
DEEEIRTTNPVATEQYGSVSTSIIQDGPMEDRG

SEQ ID NO: 60091 - protein, 32 aa, Artificial Sequence
  Description of Artificial Sequence: Synthetic polypeptide
DEEEIRTTNPVATEQYGSVSENAIQNFGILEI

SEQ ID NO: 60092 - protein, 34 aa, Artificial Sequence
  Description of Artificial Sequence: Synthetic polypeptide
DEEEIRTTNPVATEQYGSVSTSNDQVGIGGNDDE

SEQ ID NO: 60093 - protein, 33 aa, Artificial Sequence
  Description of Artificial Sequence: Synthetic polypeptide
DEEEIRTTNPVATEQYGSVSEMNLQPEFGIPPL

SEQ ID NO: 60094 - protein, 33 aa, Artificial Sequence
  Description of Artificial Sequence: Synthetic polypeptide
DEEEIRTTNPVATEQYGSVSTSNGFTGEGGNNP

SEQ ID NO: 60095 - protein, 34 aa, Artificial Sequence
  Description of Artificial Sequence: Synthetic polypeptide
DEEEIRTTNPVATEQYGSVSTSNGQVGIGGNQGQ

SEQ ID NO: 60096 - protein, 34 aa, Artificial Sequence
  Description of Artificial Sequence: Synthetic polypeptide
DEEEIRTTNPVATEQYGSVSTSNLDDPEGGNGQQ

SEQ ID NO: 60097 - protein, 33 aa, Artificial Sequence
  Description of Artificial Sequence: Synthetic polypeptide
DEEEIRTTNPVATEQYGSVSTSNMTDEIGGNGD

SEQ ID NO: 60098 - protein, 31 aa, Artificial Sequence
  Description of Artificial Sequence: Synthetic polypeptide
DEEEIRTTNPVATEQYGSVSTSEDGHDGEQS

SEQ ID NO: 60099 - protein, 34 aa, Artificial Sequence
  Description of Artificial Sequence: Synthetic polypeptide
DEEEIRTTNPVATEQYGSVSTQNGQSGQGGNEEE

SEQ ID NO: 60100 - protein, 33 aa, Artificial Sequence
  Description of Artificial Sequence: Synthetic polypeptide
DEEEIRTTNPVATEQYGSVSTQNGGQSEGELVD

SEQ ID NO: 60101 - protein, 33 aa, Artificial Sequence
  Description of Artificial Sequence: Synthetic polypeptide
DEEEIRTTNPVATEQYGSVSTQNGGQETGEEVD

SEQ ID NO: 60102 - protein, 33 aa, Artificial Sequence
  Description of Artificial Sequence: Synthetic polypeptide
DEEEIRTTNPVATEQYGSVSTPWSIEQTGDNLY

SEQ ID NO: 60103 - protein, 32 aa, Artificial Sequence
  Description of Artificial Sequence: Synthetic polypeptide
DEEEIRTTNPVATEQYGSVSTQDDNLEGFEDN

SEQ ID NO: 60104 - protein, 32 aa, Artificial Sequence
  Description of Artificial Sequence: Synthetic polypeptide
DEEEIRTTNPVATEQYGSVSTQDGGNQGENED

SEQ ID NO: 60105 - protein, 31 aa, Artificial Sequence
  Description of Artificial Sequence: Synthetic polypeptide
DEEEIRTTNPVATEQYGSVSENSQQTVQEEE

SEQ ID NO: 60106 - protein, 31 aa, Artificial Sequence
  Description of Artificial Sequence: Synthetic polypeptide
DEEEIRTTNPVATEQYGSVSENSQQIMSEDE

SEQ ID NO: 60107 - protein, 32 aa, Artificial Sequence
  Description of Artificial Sequence: Synthetic polypeptide
DEEEIRTTNPVATEQYGSVSTQGLMPGVEEDI

SEQ ID NO: 60108 - protein, 32 aa, Artificial Sequence
  Description of Artificial Sequence: Synthetic polypeptide
DEEEIRTTNPVATEQYGSVSENQQGLMVSLRQ

SEQ ID NO: 60109 - protein, 33 aa, Artificial Sequence
  Description of Artificial Sequence: Synthetic polypeptide
DEEEIRTTNPVATEQYGSVSTQGLQNEIGQGQD

SEQ ID NO: 60110 - protein, 32 aa, Artificial Sequence
  Description of Artificial Sequence: Synthetic polypeptide
DEEEIRTTNPVATEQYGSVSENPNEQVVNEFE

SEQ ID NO: 60111 - protein, 32 aa, Artificial Sequence
  Description of Artificial Sequence: Synthetic polypeptide
DEEEIRTTNPVATEQYGSVSENMNDQIVINLE

SEQ ID NO: 60112 - protein, 33 aa, Artificial Sequence
  Description of Artificial Sequence: Synthetic polypeptide
DEEEIRTTNPVATEQYGSVSTQLFQAGGQEEGG

SEQ ID NO: 60113 - protein, 32 aa, Artificial Sequence
  Description of Artificial Sequence: Synthetic polypeptide
DEEEIRTTNPVATEQYGSVSENLQVQIVDLIS

SEQ ID NO: 60114 - protein, 32 aa, Artificial Sequence
  Description of Artificial Sequence: Synthetic polypeptide
DEEEIRTTNPVATEQYGSVSENLQSTQVEDFP

SEQ ID NO: 60115 - protein, 34 aa, Artificial Sequence
  Description of Artificial Sequence: Synthetic polypeptide
DEEEIRTTNPVATEQYGSVSTQNDGDQNNGNGEE

SEQ ID NO: 60116 - protein, 34 aa, Artificial Sequence
  Description of Artificial Sequence: Synthetic polypeptide
DEEEIRTTNPVATEQYGSVSTQNDNLIGGGENGD

SEQ ID NO: 60117 - protein, 34 aa, Artificial Sequence
  Description of Artificial Sequence: Synthetic polypeptide
DEEEIRTTNPVATEQYGSVSTQNDNLIGGGNDDE

SEQ ID NO: 60118 - protein, 34 aa, Artificial Sequence
  Description of Artificial Sequence: Synthetic polypeptide
DEEEIRTTNPVATEQYGSVSTQNDNLISGGGNDD

SEQ ID NO: 60119 - protein, 34 aa, Artificial Sequence
  Description of Artificial Sequence: Synthetic polypeptide
DEEEIRTTNPVATEQYGSVSTQNDNLLGSGGNGD

SEQ ID NO: 60120 - protein, 33 aa, Artificial Sequence
  Description of Artificial Sequence: Synthetic polypeptide
DEEEIRTTNPVATEQYGSVSTQNDNTGEGGGND

SEQ ID NO: 60121 - protein, 34 aa, Artificial Sequence
  Description of Artificial Sequence: Synthetic polypeptide
DEEEIRTTNPVATEQYGSVSTQNGDQNEGGNGEE

SEQ ID NO: 60122 - protein, 33 aa, Artificial Sequence
  Description of Artificial Sequence: Synthetic polypeptide
DEEEIRTTNPVATEQYGSVSTQNGGNENNGGND

SEQ ID NO: 60123 - protein, 33 aa, Artificial Sequence
  Description of Artificial Sequence: Synthetic polypeptide
DEEEIRTTNPVATEQYGSVSTPGFGQDEFGNEF

SEQ ID NO: 60124 - protein, 35 aa, Artificial Sequence
  Description of Artificial Sequence: Synthetic polypeptide
DEEEIRTTNPVATEQYGSVSGTDNLQNGGGNNGQG

SEQ ID NO: 60125 - protein, 35 aa, Artificial Sequence
  Description of Artificial Sequence: Synthetic polypeptide
DEEEIRTTNPVATEQYGSVSTPGDLQPMGVNDDRF

SEQ ID NO: 60126 - protein, 34 aa, Artificial Sequence
  Description of Artificial Sequence: Synthetic polypeptide
DEEEIRTTNPVATEQYGSVSETNLTDITGGNENE

SEQ ID NO: 60127 - protein, 33 aa, Artificial Sequence
  Description of Artificial Sequence: Synthetic polypeptide
DEEEIRTTNPVATEQYGSVSTNLPDLQTEDEVV

SEQ ID NO: 60128 - protein, 33 aa, Artificial Sequence
  Description of Artificial Sequence: Synthetic polypeptide
DEEEIRTTNPVATEQYGSVSGNLDEVGGGNDGQ

SEQ ID NO: 60129 - protein, 33 aa, Artificial Sequence
  Description of Artificial Sequence: Synthetic polypeptide
DEEEIRTTNPVATEQYGSVSGNGNIQQTSGTND

SEQ ID NO: 60130 - protein, 33 aa, Artificial Sequence
  Description of Artificial Sequence: Synthetic polypeptide
DEEEIRTTNPVATEQYGSVSGNFGQQGGGEFNI

SEQ ID NO: 60131 - protein, 32 aa, Artificial Sequence
  Description of Artificial Sequence: Synthetic polypeptide
DEEEIRTTNPVATEQYGSVSGINNEINIGGNP

SEQ ID NO: 60132 - protein, 33 aa, Artificial Sequence
  Description of Artificial Sequence: Synthetic polypeptide
DEEEIRTTNPVATEQYGSVSGGNGQEGGGNTNG

SEQ ID NO: 60133 - protein, 33 aa, Artificial Sequence
  Description of Artificial Sequence: Synthetic polypeptide
DEEEIRTTNPVATEQYGSVSGGNGGQGGENTQG

SEQ ID NO: 60134 - protein, 32 aa, Artificial Sequence
  Description of Artificial Sequence: Synthetic polypeptide
DEEEIRTTNPVATEQYGSVSGGNDTGGGEGNE

SEQ ID NO: 60135 - protein, 33 aa, Artificial Sequence
  Description of Artificial Sequence: Synthetic polypeptide
DEEEIRTTNPVATEQYGSVSGDQLQEIGGNGQD

SEQ ID NO: 60136 - protein, 33 aa, Artificial Sequence
  Description of Artificial Sequence: Synthetic polypeptide
DEEEIRTTNPVATEQYGSVSTNLGQSQVPFVVV

SEQ ID NO: 60137 - protein, 33 aa, Artificial Sequence
  Description of Artificial Sequence: Synthetic polypeptide
DEEEIRTTNPVATEQYGSVSGDNNILTDGGNDG

SEQ ID NO: 60138 - protein, 33 aa, Artificial Sequence
  Description of Artificial Sequence: Synthetic polypeptide
DEEEIRTTNPVATEQYGSVSGDNGQGEMGNGGT

SEQ ID NO: 60139 - protein, 32 aa, Artificial Sequence
  Description of Artificial Sequence: Synthetic polypeptide
DEEEIRTTNPVATEQYGSVSGDNGQGEGGEGG

SEQ ID NO: 60140 - protein, 33 aa, Artificial Sequence
  Description of Artificial Sequence: Synthetic polypeptide
DEEEIRTTNPVATEQYGSVSGDGNIQNTGGENE

SEQ ID NO: 60141 - protein, 32 aa, Artificial Sequence
  Description of Artificial Sequence: Synthetic polypeptide
DEEEIRTTNPVATEQYGSVSGDGNDQNTGEGG

SEQ ID NO: 60142 - protein, 32 aa, Artificial Sequence
  Description of Artificial Sequence: Synthetic polypeptide
DEEEIRTTNPVATEQYGSVSGDGNDQNQGEGT

SEQ ID NO: 60143 - protein, 32 aa, Artificial Sequence
  Description of Artificial Sequence: Synthetic polypeptide
DEEEIRTTNPVATEQYGSVSGDDNDQNTGEIE

SEQ ID NO: 60144 - protein, 32 aa, Artificial Sequence
  Description of Artificial Sequence: Synthetic polypeptide
DEEEIRTTNPVATEQYGSVSGDDNDQNTGEDG

SEQ ID NO: 60145 - protein, 33 aa, Artificial Sequence
  Description of Artificial Sequence: Synthetic polypeptide
DEEEIRTTNPVATEQYGSVSGANDDEQGEGGNG

SEQ ID NO: 60146 - protein, 32 aa, Artificial Sequence
  Description of Artificial Sequence: Synthetic polypeptide
DEEEIRTTNPVATEQYGSVSFVDLDFRDGDEN

SEQ ID NO: 60147 - protein, 32 aa, Artificial Sequence
  Description of Artificial Sequence: Synthetic polypeptide
DEEEIRTTNPVATEQYGSVSGDNGQNTGEGGG

SEQ ID NO: 60148 - protein, 32 aa, Artificial Sequence
  Description of Artificial Sequence: Synthetic polypeptide
DEEEIRTTNPVATEQYGSVSFTTLQMPPQEEF

SEQ ID NO: 60149 - protein, 34 aa, Artificial Sequence
  Description of Artificial Sequence: Synthetic polypeptide
DEEEIRTTNPVATEQYGSVSGNMNLGQGGGNGNE

SEQ ID NO: 60150 - protein, 32 aa, Artificial Sequence
  Description of Artificial Sequence: Synthetic polypeptide
DEEEIRTTNPVATEQYGSVSGNNENVVIGNEE

SEQ ID NO: 60151 - protein, 34 aa, Artificial Sequence
  Description of Artificial Sequence: Synthetic polypeptide
DEEEIRTTNPVATEQYGSVSGTDNGGQENQGNEG

SEQ ID NO: 60152 - protein, 34 aa, Artificial Sequence
  Description of Artificial Sequence: Synthetic polypeptide
DEEEIRTTNPVATEQYGSVSGSTNLQVIEGVGEE

SEQ ID NO: 60153 - protein, 34 aa, Artificial Sequence
  Description of Artificial Sequence: Synthetic polypeptide
DEEEIRTTNPVATEQYGSVSGSTNLQVIEGEDEQ

SEQ ID NO: 60154 - protein, 31 aa, Artificial Sequence
  Description of Artificial Sequence: Synthetic polypeptide
DEEEIRTTNPVATEQYGSVSGSLNDIGPPQT

SEQ ID NO: 60155 - protein, 34 aa, Artificial Sequence
  Description of Artificial Sequence: Synthetic polypeptide
DEEEIRTTNPVATEQYGSVSGSGTQNGLGEGGNI

SEQ ID NO: 60156 - protein, 33 aa, Artificial Sequence
  Description of Artificial Sequence: Synthetic polypeptide
DEEEIRTTNPVATEQYGSVSGSGGNGQTGGGNT

SEQ ID NO: 60157 - protein, 34 aa, Artificial Sequence
  Description of Artificial Sequence: Synthetic polypeptide
DEEEIRTTNPVATEQYGSVSGQTNNLDEFGGNGG

SEQ ID NO: 60158 - protein, 33 aa, Artificial Sequence
  Description of Artificial Sequence: Synthetic polypeptide
DEEEIRTTNPVATEQYGSVSTNLDPVIGGGDQE

SEQ ID NO: 60159 - protein, 34 aa, Artificial Sequence
  Description of Artificial Sequence: Synthetic polypeptide
DEEEIRTTNPVATEQYGSVSGQTNGLDEMGENIG

SEQ ID NO: 60160 - protein, 34 aa, Artificial Sequence
  Description of Artificial Sequence: Synthetic polypeptide
DEEEIRTTNPVATEQYGSVSTNLGPGITGGNGQE

SEQ ID NO: 60161 - protein, 34 aa, Artificial Sequence
  Description of Artificial Sequence: Synthetic polypeptide
DEEEIRTTNPVATEQYGSVSGQTNGLDEFGNTGG

SEQ ID NO: 60162 - protein, 33 aa, Artificial Sequence
  Description of Artificial Sequence: Synthetic polypeptide
DEEEIRTTNPVATEQYGSVSGNTNLGNDNTNVP

SEQ ID NO: 60163 - protein, 33 aa, Artificial Sequence
  Description of Artificial Sequence: Synthetic polypeptide
DEEEIRTTNPVATEQYGSVSGNTNDGENEGNVP

SEQ ID NO: 60164 - protein, 33 aa, Artificial Sequence
  Description of Artificial Sequence: Synthetic polypeptide
DEEEIRTTNPVATEQYGSVSGNTDQGGGEGNEQ

SEQ ID NO: 60165 - protein, 34 aa, Artificial Sequence
  Description of Artificial Sequence: Synthetic polypeptide
DEEEIRTTNPVATEQYGSVSGNTDNNEQGGGNGQ

SEQ ID NO: 60166 - protein, 33 aa, Artificial Sequence
  Description of Artificial Sequence: Synthetic polypeptide
DEEEIRTTNPVATEQYGSVSGNSNDDQFTIGNT

SEQ ID NO: 60167 - protein, 33 aa, Artificial Sequence
  Description of Artificial Sequence: Synthetic polypeptide
DEEEIRTTNPVATEQYGSVSGNNNLDNEGENIP

SEQ ID NO: 60168 - protein, 34 aa, Artificial Sequence
  Description of Artificial Sequence: Synthetic polypeptide
DEEEIRTTNPVATEQYGSVSGNNLQESGGENIGQ

SEQ ID NO: 60169 - protein, 34 aa, Artificial Sequence
  Description of Artificial Sequence: Synthetic polypeptide
DEEEIRTTNPVATEQYGSVSTNLGDEQLSGQIVE

SEQ ID NO: 60170 - protein, 35 aa, Artificial Sequence
  Description of Artificial Sequence: Synthetic polypeptide
DEEEIRTTNPVATEQYGSVSTNLGLSQERPFFNTV

SEQ ID NO: 60171 - protein, 33 aa, Artificial Sequence
  Description of Artificial Sequence: Synthetic polypeptide
DEEEIRTTNPVATEQYGSVSGQGNLDVFEGNGG

SEQ ID NO: 60172 - protein, 33 aa, Artificial Sequence
  Description of Artificial Sequence: Synthetic polypeptide
DEEEIRTTNPVATEQYGSVSFTNGLIETGPLEI

SEQ ID NO: 60173 - protein, 34 aa, Artificial Sequence
  Description of Artificial Sequence: Synthetic polypeptide
DEEEIRTTNPVATEQYGSVSFTNDIQWGTGSNDM

SEQ ID NO: 60174 - protein, 32 aa, Artificial Sequence
  Description of Artificial Sequence: Synthetic polypeptide
DEEEIRTTNPVATEQYGSVSFTNDIQGSLSDM

SEQ ID NO: 60175 - protein, 33 aa, Artificial Sequence
  Description of Artificial Sequence: Synthetic polypeptide
DEEEIRTTNPVATEQYGSVSTNSEQVTMNEVEI

SEQ ID NO: 60176 - protein, 33 aa, Artificial Sequence
  Description of Artificial Sequence: Synthetic polypeptide
DEEEIRTTNPVATEQYGSVSTNSNQTDGEDEEN

SEQ ID NO: 60177 - protein, 34 aa, Artificial Sequence
  Description of Artificial Sequence: Synthetic polypeptide
DEEEIRTTNPVATEQYGSVSTNTDGQTGQGENIG

SEQ ID NO: 60178 - protein, 33 aa, Artificial Sequence
  Description of Artificial Sequence: Synthetic polypeptide
DEEEIRTTNPVATEQYGSVSETPYMLQTGVETV

SEQ ID NO: 60179 - protein, 33 aa, Artificial Sequence
  Description of Artificial Sequence: Synthetic polypeptide
DEEEIRTTNPVATEQYGSVSTNTGDGEMGNNGA

SEQ ID NO: 60180 - protein, 34 aa, Artificial Sequence
  Description of Artificial Sequence: Synthetic polypeptide
DEEEIRTTNPVATEQYGSVSETPWILDQYRDDRN

SEQ ID NO: 60181 - protein, 33 aa, Artificial Sequence
  Description of Artificial Sequence: Synthetic polypeptide
DEEEIRTTNPVATEQYGSVSTNTGDQNIGGGET

SEQ ID NO: 60182 - protein, 33 aa, Artificial Sequence
  Description of Artificial Sequence: Synthetic polypeptide
DEEEIRTTNPVATEQYGSVSTNTNVGMGGGNQG

SEQ ID NO: 60183 - protein, 33 aa, Artificial Sequence
  Description of Artificial Sequence: Synthetic polypeptide
DEEEIRTTNPVATEQYGSVSTNTQLQETDEEIE

SEQ ID NO: 60184 - protein, 34 aa, Artificial Sequence
  Description of Artificial Sequence: Synthetic polypeptide
DEEEIRTTNPVATEQYGSVSETWNLQQTEGSLFQ

SEQ ID NO: 60185 - protein, 33 aa, Artificial Sequence
  Description of Artificial Sequence: Synthetic polypeptide
DEEEIRTTNPVATEQYGSVSETPNEHATMVNRI

SEQ ID NO: 60186 - protein, 35 aa, Artificial Sequence
  Description of Artificial Sequence: Synthetic polypeptide
DEEEIRTTNPVATEQYGSVSETNTEQMRAIVGNEI

SEQ ID NO: 60187 - protein, 34 aa, Artificial Sequence
  Description of Artificial Sequence: Synthetic polypeptide
DEEEIRTTNPVATEQYGSVSETNNLQPTAVNETI

SEQ ID NO: 60188 - protein, 33 aa, Artificial Sequence
  Description of Artificial Sequence: Synthetic polypeptide
DEEEIRTTNPVATEQYGSVSTPAGPNMRNGNPV

SEQ ID NO: 60189 - protein, 32 aa, Artificial Sequence
  Description of Artificial Sequence: Synthetic polypeptide
DEEEIRTTNPVATEQYGSVSTPAGPNMSGMNV

SEQ ID NO: 60190 - protein, 33 aa, Artificial Sequence
  Description of Artificial Sequence: Synthetic polypeptide
DEEEIRTTNPVATEQYGSVSETNNLMRDVSVVD

SEQ ID NO: 60191 - protein, 33 aa, Artificial Sequence
  Description of Artificial Sequence: Synthetic polypeptide
DEEEIRTTNPVATEQYGSVSTPAGPNMSNGNPV

SEQ ID NO: 60192 - protein, 33 aa, Artificial Sequence
  Description of Artificial Sequence: Synthetic polypeptide
DEEEIRTTNPVATEQYGSVSTPAGPNRNGMNPV

SEQ ID NO: 60193 - protein, 33 aa, Artificial Sequence
  Description of Artificial Sequence: Synthetic polypeptide
DEEEIRTTNPVATEQYGSVSTPDHQPMVNDDRP

SEQ ID NO: 60194 - protein, 33 aa, Artificial Sequence
  Description of Artificial Sequence: Synthetic polypeptide
DEEEIRTTNPVATEQYGSVSTPDLLMHNGEDRI

SEQ ID NO: 60195 - protein, 33 aa, Artificial Sequence
  Description of Artificial Sequence: Synthetic polypeptide
DEEEIRTTNPVATEQYGSVSTNTSNQTMGEDQE

SEQ ID NO: 60196 - protein, 32 aa, Artificial Sequence
  Description of Artificial Sequence: Synthetic polypeptide
DEEEIRTTNPVATEQYGSVSTNPQQNATTEHE

SEQ ID NO: 60197 - protein, 31 aa, Artificial Sequence
  Description of Artificial Sequence: Synthetic polypeptide
DEEEIRTTNPVATEQYGSVSTNPFTMETQQG

SEQ ID NO: 60198 - protein, 33 aa, Artificial Sequence
  Description of Artificial Sequence: Synthetic polypeptide
DEEEIRTTNPVATEQYGSVSTNPDEQRTSQEDI

SEQ ID NO: 60199 - protein, 31 aa, Artificial Sequence
  Description of Artificial Sequence: Synthetic polypeptide
DEEEIRTTNPVATEQYGSVSTNMDPEHALDE

SEQ ID NO: 60200 - protein, 34 aa, Artificial Sequence
  Description of Artificial Sequence: Synthetic polypeptide
DEEEIRTTNPVATEQYGSVSTNMHGERSVENMRN

SEQ ID NO: 60201 - protein, 31 aa, Artificial Sequence
  Description of Artificial Sequence: Synthetic polypeptide
DEEEIRTTNPVATEQYGSVSTNMPEHALDDI

SEQ ID NO: 60202 - protein, 31 aa, Artificial Sequence
  Description of Artificial Sequence: Synthetic polypeptide
DEEEIRTTNPVATEQYGSVSTNMPEHASDHF

SEQ ID NO: 60203 - protein, 33 aa, Artificial Sequence
  Description of Artificial Sequence: Synthetic polypeptide
DEEEIRTTNPVATEQYGSVSTNMTMNGGNGGNE

SEQ ID NO: 60204 - protein, 32 aa, Artificial Sequence
  Description of Artificial Sequence: Synthetic polypeptide
DEEEIRTTNPVATEQYGSVSTNMTNESTQNFA

SEQ ID NO: 60205 - protein, 34 aa, Artificial Sequence
  Description of Artificial Sequence: Synthetic polypeptide
DEEEIRTTNPVATEQYGSVSTNNDGQNNGGNNEE

SEQ ID NO: 60206 - protein, 34 aa, Artificial Sequence
  Description of Artificial Sequence: Synthetic polypeptide
DEEEIRTTNPVATEQYGSVSTNNDNLTQSGEDTY

SEQ ID NO: 60207 - protein, 36 aa, Artificial Sequence
  Description of Artificial Sequence: Synthetic polypeptide
DEEEIRTTNPVATEQYGSVSTNNGLDQTRMGENNND

SEQ ID NO: 60208 - protein, 34 aa, Artificial Sequence
  Description of Artificial Sequence: Synthetic polypeptide
DEEEIRTTNPVATEQYGSVSTNNGLQQSNGLDTQ

SEQ ID NO: 60209 - protein, 33 aa, Artificial Sequence
  Description of Artificial Sequence: Synthetic polypeptide
DEEEIRTTNPVATEQYGSVSTNNLGEPMDENPP

SEQ ID NO: 60210 - protein, 34 aa, Artificial Sequence
  Description of Artificial Sequence: Synthetic polypeptide
DEEEIRTTNPVATEQYGSVSTNNLNTSSGNVAEF

SEQ ID NO: 60211 - protein, 33 aa, Artificial Sequence
  Description of Artificial Sequence: Synthetic polypeptide
DEEEIRTTNPVATEQYGSVSFNDLTYRGEVDGD

SEQ ID NO: 60212 - protein, 33 aa, Artificial Sequence
  Description of Artificial Sequence: Synthetic polypeptide
DEEEIRTTNPVATEQYGSVSFLDLTQTRGGQDN

SEQ ID NO: 60213 - protein, 33 aa, Artificial Sequence
  Description of Artificial Sequence: Synthetic polypeptide
DEEEIRTTNPVATEQYGSVSTNNMADPTGENQD

SEQ ID NO: 60214 - protein, 33 aa, Artificial Sequence
  Description of Artificial Sequence: Synthetic polypeptide
DEEEIRTTNPVATEQYGSVSFEWLEQRAMELRD

SEQ ID NO: 60215 - protein, 34 aa, Artificial Sequence
  Description of Artificial Sequence: Synthetic polypeptide
DEEEIRTTNPVATEQYGSVSTNNMGQGENGNQDI

SEQ ID NO: 60216 - protein, 33 aa, Artificial Sequence
  Description of Artificial Sequence: Synthetic polypeptide
DEEEIRTTNPVATEQYGSVSTNNNLDTYMQNGQ

SEQ ID NO: 60217 - protein, 32 aa, Artificial Sequence
  Description of Artificial Sequence: Synthetic polypeptide
DEEEIRTTNPVATEQYGSVSEWPNQQNSELRQ

SEQ ID NO: 60218 - protein, 34 aa, Artificial Sequence
  Description of Artificial Sequence: Synthetic polypeptide
DEEEIRTTNPVATEQYGSVSTNNTNLQETDEEIR

SEQ ID NO: 60219 - protein, 33 aa, Artificial Sequence
  Description of Artificial Sequence: Synthetic polypeptide
DEEEIRTTNPVATEQYGSVSEVYFLQRGEQQIL

SEQ ID NO: 60220 - protein, 31 aa, Artificial Sequence
  Description of Artificial Sequence: Synthetic polypeptide
DEEEIRTTNPVATEQYGSVSTPDQTESEDFF

SEQ ID NO: 60221 - protein, 32 aa, Artificial Sequence
  Description of Artificial Sequence: Synthetic polypeptide
NEEEIRTTNPVAYEQYGSIPSTHLSQSQGGNR

SEQ ID NO: 60222 - protein, 31 aa, Artificial Sequence
  Description of Artificial Sequence: Synthetic polypeptide
DEETICTTNPVATECYGSVVNTNTGQNRGNM

SEQ ID NO: 60223 - protein, 30 aa, Artificial Sequence
  Description of Artificial Sequence: Synthetic polypeptide
DEETIITTNPVATECYGSVNTNTLQEMNEM

SEQ ID NO: 60224 - protein, 31 aa, Artificial Sequence
  Description of Artificial Sequence: Synthetic polypeptide
DEVEIATTNPVAYEQWGSVSTNGQRDGNNAN

SEQ ID NO: 60225 - protein, 31 aa, Artificial Sequence
  Description of Artificial Sequence: Synthetic polypeptide
DEVEIATTNPVAYEQWGSVSTNLQGDGHGNV

SEQ ID NO: 60226 - protein, 31 aa, Artificial Sequence
  Description of Artificial Sequence: Synthetic polypeptide
DEVEIATTNPVAYEQWGSVSTNLQGGTGNVD

SEQ ID NO: 60227 - protein, 31 aa, Artificial Sequence
  Description of Artificial Sequence: Synthetic polypeptide
DEVEIATTNPVAYEQWGSVSTNLQGMGMGNV

SEQ ID NO: 60228 - protein, 31 aa, Artificial Sequence
  Description of Artificial Sequence: Synthetic polypeptide
DEVEIATTNPVAYEQWGSVSTNLQHDGGNVP

SEQ ID NO: 60229 - protein, 31 aa, Artificial Sequence
  Description of Artificial Sequence: Synthetic polypeptide
DEVEIATTNPVAYEQWGSVSTNLQHEGGGND

SEQ ID NO: 60230 - protein, 31 aa, Artificial Sequence
  Description of Artificial Sequence: Synthetic polypeptide
DEVEIATTNPVAYEQWGSVSTNLQSGGPNDA

SEQ ID NO: 60231 - protein, 31 aa, Artificial Sequence
  Description of Artificial Sequence: Synthetic polypeptide
DEVEIATTNPVAYEQWGSVSTNLQSGQGNDN

SEQ ID NO: 60232 - protein, 31 aa, Artificial Sequence
  Description of Artificial Sequence: Synthetic polypeptide
DEVEIATTNPVAYEQWGSVSTNLQSNGMGNV

SEQ ID NO: 60233 - protein, 29 aa, Artificial Sequence
  Description of Artificial Sequence: Synthetic peptide
DEVEIATTNPVAYEPYGNVATNLQDGNDH

SEQ ID NO: 60234 - protein, 31 aa, Artificial Sequence
  Description of Artificial Sequence: Synthetic polypeptide
DEVEIATTNPVAYEQWGSVSTNLQVGGENEE

SEQ ID NO: 60235 - protein, 33 aa, Artificial Sequence
  Description of Artificial Sequence: Synthetic polypeptide
DEEEIRTTNPVATEQYGSLSPTNIGLRFGNLNE

SEQ ID NO: 60236 - protein, 33 aa, Artificial Sequence
  Description of Artificial Sequence: Synthetic polypeptide
DEEEIRTTNPVATEQYGSLSLTNLQLIVVENQT

SEQ ID NO: 60237 - protein, 33 aa, Artificial Sequence
  Description of Artificial Sequence: Synthetic polypeptide
DEVEIATTNPVAYEQYGQSVSATNDLDQRGIER

SEQ ID NO: 60238 - protein, 31 aa, Artificial Sequence
  Description of Artificial Sequence: Synthetic polypeptide
DEVEIATTNPVAYEQYGSVSTNDQSGGENEP

SEQ ID NO: 60239 - protein, 31 aa, Artificial Sequence
  Description of Artificial Sequence: Synthetic polypeptide
DEVEIATTNPVAYEQYGSVSTNLQDGGGDTI

SEQ ID NO: 60240 - protein, 31 aa, Artificial Sequence
  Description of Artificial Sequence: Synthetic polypeptide
DEVEIATTNPVAYEQYGSVSTNLQEGGGQEA

SEQ ID NO: 60241 - protein, 33 aa, Artificial Sequence
  Description of Artificial Sequence: Synthetic polypeptide
DEEEIRTTNPVATEQYGSIVTATHLEQRVENNM

SEQ ID NO: 60242 - protein, 31 aa, Artificial Sequence
  Description of Artificial Sequence: Synthetic polypeptide
DEVEIATTNPVAYEQYGSVVTNPQGLGENNR

SEQ ID NO: 60243 - protein, 31 aa, Artificial Sequence
  Description of Artificial Sequence: Synthetic polypeptide
DEVEIATTNPVAYEQYGTVATNLQEGGNNGR

SEQ ID NO: 60244 - protein, 30 aa, Artificial Sequence
  Description of Artificial Sequence: Synthetic polypeptide
DEVEIATTNPVAYEQWGSVVTNPQGEGENR

SEQ ID NO: 60245 - protein, 30 aa, Artificial Sequence
  Description of Artificial Sequence: Synthetic polypeptide
DEVEIATTNPVAYEQYGTVSTNLNDGDDGR

SEQ ID NO: 60246 - protein, 31 aa, Artificial Sequence
  Description of Artificial Sequence: Synthetic polypeptide
DEVEIATTNPVATTQYGTVSTALQGDGDNDR

SEQ ID NO: 60247 - protein, 29 aa, Artificial Sequence
  Description of Artificial Sequence: Synthetic peptide
DEVEIATTNPVATTQYGMVSTAPQTGNQF

SEQ ID NO: 60248 - protein, 31 aa, Artificial Sequence
  Description of Artificial Sequence: Synthetic polypeptide
DEVEIATTNPVATEQYGSVVTNPGGLGENRP

SEQ ID NO: 60249 - protein, 31 aa, Artificial Sequence
  Description of Artificial Sequence: Synthetic polypeptide
DEVEIATTNPVATEQYGSVVTNPGLGENQNR

SEQ ID NO: 60250 - protein, 32 aa, Artificial Sequence
  Description of Artificial Sequence: Synthetic polypeptide
DEVEIATTNPVATEQYGVVSTNLNNGDINGRE

SEQ ID NO: 60251 - protein, 31 aa, Artificial Sequence
  Description of Artificial Sequence: Synthetic polypeptide
DEVEIATTNPVATETWGSVSTNLQSGGDNSH

SEQ ID NO: 60252 - protein, 32 aa, Artificial Sequence
  Description of Artificial Sequence: Synthetic polypeptide
DEVEIATTNPVATEVYGSVSTNLQGDSGGGTR

SEQ ID NO: 60253 - protein, 31 aa, Artificial Sequence
  Description of Artificial Sequence: Synthetic polypeptide
DEEEIRTTNPVATEQYGSMATPAGPQHNGNV

SEQ ID NO: 60254 - protein, 33 aa, Artificial Sequence
  Description of Artificial Sequence: Synthetic polypeptide
DEVEIATTNPVATEVYGSVSTNLQGQDSGGNER

SEQ ID NO: 60255 - protein, 31 aa, Artificial Sequence
  Description of Artificial Sequence: Synthetic polypeptide
DEEEIRTTNPVATEQYGSMATPAGPNRNGNV

SEQ ID NO: 60256 - protein, 32 aa, Artificial Sequence
  Description of Artificial Sequence: Synthetic polypeptide
DEVEIATTNPVATEVYGSVSTNLQLGGDNGED

SEQ ID NO: 60257 - protein, 30 aa, Artificial Sequence
  Description of Artificial Sequence: Synthetic polypeptide
DEVEIATTNPVATTQYGMVSTAQQGDGNER

SEQ ID NO: 60258 - protein, 32 aa, Artificial Sequence
  Description of Artificial Sequence: Synthetic polypeptide
DEVEIATTNPVATEWYGSVSTNLQGNDSGDSR

SEQ ID NO: 60259 - protein, 32 aa, Artificial Sequence
  Description of Artificial Sequence: Synthetic polypeptide
DEEEIRTTNPVATEQYGSLVSVNENQMTDNEQ

SEQ ID NO: 60260 - protein, 32 aa, Artificial Sequence
  Description of Artificial Sequence: Synthetic polypeptide
DEVEIATTNPVATEWYGSVSTNLQLGGDNGGS

SEQ ID NO: 60261 - protein, 32 aa, Artificial Sequence
  Description of Artificial Sequence: Synthetic polypeptide
DEVEIATTNPVATEWYGSVSTNLQLGGDQGNM

SEQ ID NO: 60262 - protein, 30 aa, Artificial Sequence
  Description of Artificial Sequence: Synthetic polypeptide
DEVEIATTNPVATIGYGMVSSTPELQGGNR

SEQ ID NO: 60263 - protein, 30 aa, Artificial Sequence
  Description of Artificial Sequence: Synthetic polypeptide
DEVEIATTNPVATIGYGMVSTPALDQGGNR

SEQ ID NO: 60264 - protein, 31 aa, Artificial Sequence
  Description of Artificial Sequence: Synthetic polypeptide
DEVEIATTNPVATIQYGMVSTAALQRGNQQE

SEQ ID NO: 60265 - protein, 28 aa, Artificial Sequence
  Description of Artificial Sequence: Synthetic peptide
DEVEIATTNPVATIQYGMVSTAPQPGTQ

SEQ ID NO: 60266 - protein, 29 aa, Artificial Sequence
  Description of Artificial Sequence: Synthetic peptide
DEVEIATTNPVATIQYGMVSTAPQRTGTD

SEQ ID NO: 60267 - protein, 29 aa, Artificial Sequence
  Description of Artificial Sequence: Synthetic peptide
DEVEIATTNPVATIQYGMVSTAPQVGNQQ

SEQ ID NO: 60268 - protein, 32 aa, Artificial Sequence
  Description of Artificial Sequence: Synthetic polypeptide
DEVEIATTNPVATEWYGSVSTNLQLGEDNGNA

SEQ ID NO: 60269 - protein, 31 aa, Artificial Sequence
  Description of Artificial Sequence: Synthetic polypeptide
DEVEIATTNPVATEQYGSVVTNPGGLGENRM

SEQ ID NO: 60270 - protein, 31 aa, Artificial Sequence
  Description of Artificial Sequence: Synthetic polypeptide
DEVEIATTNPVAYEQYGTVSTNLQANGGNDT

SEQ ID NO: 60271 - protein, 30 aa, Artificial Sequence
  Description of Artificial Sequence: Synthetic polypeptide
DEVEIATTNPVAYEQYGTVSTNLQEGGDHG

SEQ ID NO: 60272 - protein, 32 aa, Artificial Sequence
  Description of Artificial Sequence: Synthetic polypeptide
DEVEIRTTNPVATECWGSVSTNLQGDSGGGMR

SEQ ID NO: 60273 - protein, 33 aa, Artificial Sequence
  Description of Artificial Sequence: Synthetic polypeptide
DEVEIRTTNPVATECYGSVSTGGNLGQDGGNEV

SEQ ID NO: 60274 - protein, 33 aa, Artificial Sequence
  Description of Artificial Sequence: Synthetic polypeptide
DEVEIRTTNPVATECYGSVSTGNDLQLGGDNES

SEQ ID NO: 60275 - protein, 32 aa, Artificial Sequence
  Description of Artificial Sequence: Synthetic polypeptide
DEVEIRTTNPVATECYGSVSTGNGNQQMGDNS

SEQ ID NO: 60276 - protein, 33 aa, Artificial Sequence
  Description of Artificial Sequence: Synthetic polypeptide
DEVEIRTTNPVATECYGSVSTNPNQGEDGDNER

SEQ ID NO: 60277 - protein, 32 aa, Artificial Sequence
  Description of Artificial Sequence: Synthetic polypeptide
DEVEIRTTNPVATEQYGCVCSTEELQHFGSNQ

SEQ ID NO: 60278 - protein, 33 aa, Artificial Sequence
  Description of Artificial Sequence: Synthetic polypeptide
DEVEIRTTNPVATEQYGCVSTDNGLNGDAGNER

SEQ ID NO: 60279 - protein, 33 aa, Artificial Sequence
  Description of Artificial Sequence: Synthetic polypeptide
DEVEIRTTNPVATEQYGCVSTDNMLGDAGGNER

SEQ ID NO: 60280 - protein, 32 aa, Artificial Sequence
  Description of Artificial Sequence: Synthetic polypeptide
DEVEIRTTNPVATEQYGCVSTGNAGDAQGNER

SEQ ID NO: 60281 - protein, 31 aa, Artificial Sequence
  Description of Artificial Sequence: Synthetic polypeptide
DEVEIRTTNPVATDQYGSVNMQGLDQRGQND

SEQ ID NO: 60282 - protein, 32 aa, Artificial Sequence
  Description of Artificial Sequence: Synthetic polypeptide
DEVEIRTTNPVATEQYGCVSTNGNGDVGGNER

SEQ ID NO: 60283 - protein, 32 aa, Artificial Sequence
  Description of Artificial Sequence: Synthetic polypeptide
DEVEIRTTNPVATEQYGDVSGNLQEGGGNEGE

SEQ ID NO: 60284 - protein, 33 aa, Artificial Sequence
  Description of Artificial Sequence: Synthetic polypeptide
DEVEIRTTNPVATEQYGDVSTNLQFNEGGNEDN

SEQ ID NO: 60285 - protein, 31 aa, Artificial Sequence
  Description of Artificial Sequence: Synthetic polypeptide
DEVEIRTTNPVATEQYGEVSTGGDAQNGNHQ

SEQ ID NO: 60286 - protein, 30 aa, Artificial Sequence
  Description of Artificial Sequence: Synthetic polypeptide
DEVEIRTTNPVATEQYGSLSECELNRQEVR

SEQ ID NO: 60287 - protein, 33 aa, Artificial Sequence
  Description of Artificial Sequence: Synthetic polypeptide
DEVEIRTTNPVATEQYGSVATGPDQNRGGDNER

SEQ ID NO: 60288 - protein, 32 aa, Artificial Sequence
  Description of Artificial Sequence: Synthetic polypeptide
DEVEIRTTNPVATEQYGSVCSNTNHQNFGSEQ

SEQ ID NO: 60289 - protein, 33 aa, Artificial Sequence
  Description of Artificial Sequence: Synthetic polypeptide
DEVEIRTTNPVATEQYGSVISTQNTGQREGGQQ

SEQ ID NO: 60290 - protein, 33 aa, Artificial Sequence
  Description of Artificial Sequence: Synthetic polypeptide
DEVEIRTTNPVATEQYGSVSGTNGQSNGGGGNT

SEQ ID NO: 60291 - protein, 31 aa, Artificial Sequence
  Description of Artificial Sequence: Synthetic polypeptide
DEVEIRTTNPVATEQYGSVSMNDQFVQEDRI

SEQ ID NO: 60292 - protein, 33 aa, Artificial Sequence
  Description of Artificial Sequence: Synthetic polypeptide
DEVEIRTTNPVATEQYGCVSTQNDLGDAGNNER

SEQ ID NO: 60293 - protein, 35 aa, Artificial Sequence
  Description of Artificial Sequence: Synthetic polypeptide
DEEEIRTTNPVATEQYGSIVSTTNMQMRIGVEEND

SEQ ID NO: 60294 - protein, 29 aa, Artificial Sequence
  Description of Artificial Sequence: Synthetic peptide
DEVEIRTTNPCATEQYGSVCTTNQTENPN

SEQ ID NO: 60295 - protein, 33 aa, Artificial Sequence
  Description of Artificial Sequence: Synthetic polypeptide
DEVEIGTTNPVATEQYGSVSNTNQDLQEEMGNL

SEQ ID NO: 60296 - protein, 30 aa, Artificial Sequence
  Description of Artificial Sequence: Synthetic polypeptide
DEVEIATTNPVAYEQYGTVSTNLQEGGMGP

SEQ ID NO: 60297 - protein, 30 aa, Artificial Sequence
  Description of Artificial Sequence: Synthetic polypeptide
DEVEIATTNPVAYEQYGTVSTNLQGDDNHE

SEQ ID NO: 60298 - protein, 32 aa, Artificial Sequence
  Description of Artificial Sequence: Synthetic polypeptide
DEVEIATTNPVAYEQYGTVSTNLQGDRGGNGP

SEQ ID NO: 60299 - protein, 31 aa, Artificial Sequence
  Description of Artificial Sequence: Synthetic polypeptide
DEVEIATTNPVAYEQYGTVSTNLQHDQGNGP

SEQ ID NO: 60300 - protein, 31 aa, Artificial Sequence
  Description of Artificial Sequence: Synthetic polypeptide
DEVEIATTNPVAYEQYGTVSTNLQHNGGNNG

SEQ ID NO: 60301 - protein, 31 aa, Artificial Sequence
  Description of Artificial Sequence: Synthetic polypeptide
DEVEIATTNPVAYEQYGTVSTNLQIGGGNTS

SEQ ID NO: 60302 - protein, 31 aa, Artificial Sequence
  Description of Artificial Sequence: Synthetic polypeptide
DEVEIATTNPVAYERYGTVSTNLQRGGDNGA

SEQ ID NO: 60303 - protein, 30 aa, Artificial Sequence
  Description of Artificial Sequence: Synthetic polypeptide
DEVEIATTNPVAYTQYGTVSTALQGGGDNR

SEQ ID NO: 60304 - protein, 32 aa, Artificial Sequence
  Description of Artificial Sequence: Synthetic polypeptide
DEVEICTTNPVATECYGSVSTDNGNQRDGNDL

SEQ ID NO: 60305 - protein, 29 aa, Artificial Sequence
  Description of Artificial Sequence: Synthetic peptide
DEVEIKTTNPVATDQYGVVSTDGIQGGNN

SEQ ID NO: 60306 - protein, 35 aa, Artificial Sequence
  Description of Artificial Sequence: Synthetic polypeptide
DEEEIRTTNPVATEQYGSIVSSTNLQMRIGVEEYF

SEQ ID NO: 60307 - protein, 34 aa, Artificial Sequence
  Description of Artificial Sequence: Synthetic polypeptide
DEEEIRTTNPVATEQYGSIVPSTVNLPERTQTER

SEQ ID NO: 60308 - protein, 31 aa, Artificial Sequence
  Description of Artificial Sequence: Synthetic polypeptide
DEVEICTTNPVATECYGSVSTNNQGDGQNDL

SEQ ID NO: 60309 - protein, 31 aa, Artificial Sequence
  Description of Artificial Sequence: Synthetic polypeptide
DEVEICTTNPVATEQYGCVSTNGNGDGDNER

SEQ ID NO: 60310 - protein, 34 aa, Artificial Sequence
  Description of Artificial Sequence: Synthetic polypeptide
DEEEIRTTNPVATEQYGSIVCSTGNHQNFGSNAS

SEQ ID NO: 60311 - protein, 32 aa, Artificial Sequence
  Description of Artificial Sequence: Synthetic polypeptide
DEVEICTTNPVATEQYGSVSTGNGQDMGNSEP

SEQ ID NO: 60312 - protein, 33 aa, Artificial Sequence
  Description of Artificial Sequence: Synthetic polypeptide
DEEEIRTTNPVATEQYGSITTENDLQARSSQNE

SEQ ID NO: 60313 - protein, 30 aa, Artificial Sequence
  Description of Artificial Sequence: Synthetic polypeptide
DEEEIRTTNPVATEQYGSISVDIQTSMNNE

SEQ ID NO: 60314 - protein, 32 aa, Artificial Sequence
  Description of Artificial Sequence: Synthetic polypeptide
DEVEICTTNPVATEQYGSVSWTEQMQERMGNA

SEQ ID NO: 60315 - protein, 31 aa, Artificial Sequence
  Description of Artificial Sequence: Synthetic polypeptide
DEVEICTTNPVAYEQYGTVSTNLQGEDGNAG

SEQ ID NO: 60316 - protein, 32 aa, Artificial Sequence
  Description of Artificial Sequence: Synthetic polypeptide
DEVEICTTNPVATECYGSVSTGNLGQEGGNGE

SEQ ID NO: 60317 - protein, 31 aa, Artificial Sequence
  Description of Artificial Sequence: Synthetic polypeptide
DEVEIATTNPVATEQYGSVVTNPGDLGENHR

SEQ ID NO: 60318 - protein, 33 aa, Artificial Sequence
  Description of Artificial Sequence: Synthetic polypeptide
DEVEIATTNPVATEQYGSVVSTENLGAMGDNNR

SEQ ID NO: 60319 - protein, 31 aa, Artificial Sequence
  Description of Artificial Sequence: Synthetic polypeptide
DEVEIATTNPVATEQYGSVTSTNGGDNGNTM

SEQ ID NO: 60320 - protein, 32 aa, Artificial Sequence
  Description of Artificial Sequence: Synthetic polypeptide
DEVEIATTNPCATEEYGSVSTNLQRDGGNGDM

SEQ ID NO: 60321 - protein, 29 aa, Artificial Sequence
  Description of Artificial Sequence: Synthetic peptide
DEVEIATTNPVATAQWGNVATGALQRGNA

SEQ ID NO: 60322 - protein, 30 aa, Artificial Sequence
  Description of Artificial Sequence: Synthetic polypeptide
DEVEIATTNPVATAQWGNVSTGALQNGENR

SEQ ID NO: 60323 - protein, 34 aa, Artificial Sequence
  Description of Artificial Sequence: Synthetic polypeptide
DEEEIRTTNPVATEQYGSQVCSTNPNTRNLSNIR

SEQ ID NO: 60324 - protein, 31 aa, Artificial Sequence
  Description of Artificial Sequence: Synthetic polypeptide
DEVEIATTNPVATAQWGTVSTGALGQRDGNR

SEQ ID NO: 60325 - protein, 30 aa, Artificial Sequence
  Description of Artificial Sequence: Synthetic polypeptide
DEVEIATTNPVATCQYGCVSTAHQRSGSNQ

SEQ ID NO: 60326 - protein, 33 aa, Artificial Sequence
  Description of Artificial Sequence: Synthetic polypeptide
DEEEIRTTNPVATEQYGSQVCSTNHQNFGSDQA

SEQ ID NO: 60327 - protein, 29 aa, Artificial Sequence
  Description of Artificial Sequence: Synthetic peptide
DEVEIATTNPVATCQYGCVSTALQFNSNQ

SEQ ID NO: 60328 - protein, 30 aa, Artificial Sequence
  Description of Artificial Sequence: Synthetic polypeptide
DEVEIATTNPVATCQYGCVSTALQNGSNQL

SEQ ID NO: 60329 - protein, 31 aa, Artificial Sequence
  Description of Artificial Sequence: Synthetic polypeptide
DEVEIATTNPCATECYGSVSTNLQGQDDGSR

SEQ ID NO: 60330 - protein, 30 aa, Artificial Sequence
  Description of Artificial Sequence: Synthetic polypeptide
DEVEIATTNPVATDQYGEVSTADDQRNGDR

SEQ ID NO: 60331 - protein, 29 aa, Artificial Sequence
  Description of Artificial Sequence: Synthetic peptide
DEVEIATTNPVATDQYGVVSTDGQGGNIG

SEQ ID NO: 60332 - protein, 29 aa, Artificial Sequence
  Description of Artificial Sequence: Synthetic peptide
DEVEIATTNPVATDQYGVVSTDGQTGGNI

SEQ ID NO: 60333 - protein, 31 aa, Artificial Sequence
  Description of Artificial Sequence: Synthetic polypeptide
DEVEIATTNPVATEAWGSVSTNLQGADNDTR

SEQ ID NO: 60334 - protein, 31 aa, Artificial Sequence
  Description of Artificial Sequence: Synthetic polypeptide
DEVEIATTNPVATEAWGSVSTNLQHAGNNET

SEQ ID NO: 60335 - protein, 33 aa, Artificial Sequence
  Description of Artificial Sequence: Synthetic polypeptide
DEEEIRTTNPVATEQYGSQSNNLSQPVGEVNSF

SEQ ID NO: 60336 - protein, 32 aa, Artificial Sequence
  Description of Artificial Sequence: Synthetic polypeptide
DEVEIATTNPVATEAYGSVSTNLNQGEDTDNR

SEQ ID NO: 60337 - protein, 32 aa, Artificial Sequence
  Description of Artificial Sequence: Synthetic polypeptide
DEVEIATTNPVATEAYGSVSTNLNQGNDNDGR

SEQ ID NO: 60338 - protein, 32 aa, Artificial Sequence
  Description of Artificial Sequence: Synthetic polypeptide
DEVEIATTNPVATECYGCVSTNLQLGGDNGER

SEQ ID NO: 60339 - protein, 32 aa, Artificial Sequence
  Description of Artificial Sequence: Synthetic polypeptide
DEEEIRTTNPVATEQYGSQQVTEGLQRGVIED

SEQ ID NO: 60340 - protein, 30 aa, Artificial Sequence
  Description of Artificial Sequence: Synthetic polypeptide
DEVEIATTNPVATDQYGEVSTAGQGMGNER

SEQ ID NO: 60341 - protein, 32 aa, Artificial Sequence
  Description of Artificial Sequence: Synthetic polypeptide
DEVEIATTNPVATECYGSVAATNLDQRGNDQD

SEQ ID NO: 60342 - protein, 31 aa, Artificial Sequence
  Description of Artificial Sequence: Synthetic polypeptide
DETTIRTTNPVATEQYGSVADFTNLIGIGNA

SEQ ID NO: 60343 - protein, 32 aa, Artificial Sequence
  Description of Artificial Sequence: Synthetic polypeptide
DEEEIRTTNPVATEQYGSQVSSTNNDNREDQI

SEQ ID NO: 60344 - protein, 30 aa, Artificial Sequence
  Description of Artificial Sequence: Synthetic polypeptide
DETEISTTNPVATECYGSVSTVDLAGRDTR

SEQ ID NO: 60345 - protein, 31 aa, Artificial Sequence
  Description of Artificial Sequence: Synthetic polypeptide
DETEIYTTNPVATEQYGSVSTQILTQIGEES

SEQ ID NO: 60346 - protein, 29 aa, Artificial Sequence
  Description of Artificial Sequence: Synthetic peptide
DETGIRTTNPCATEQWGSVSVNEQPSGVR

SEQ ID NO: 60347 - protein, 30 aa, Artificial Sequence
  Description of Artificial Sequence: Synthetic polypeptide
DETGIRTTNPCATEQWGSVSVVNGEQSGNR

SEQ ID NO: 60348 - protein, 29 aa, Artificial Sequence
  Description of Artificial Sequence: Synthetic peptide
DETSICTTNPCATEQWGSVSNNLQAGNQT

SEQ ID NO: 60349 - protein, 30 aa, Artificial Sequence
  Description of Artificial Sequence: Synthetic polypeptide
DETSICTTNPCATEQWGSVSTNNLQSGNIN

SEQ ID NO: 60350 - protein, 29 aa, Artificial Sequence
  Description of Artificial Sequence: Synthetic peptide
DETSIGTTNPCATEQWGSVSENLQSGENN

SEQ ID NO: 60351 - protein, 29 aa, Artificial Sequence
  Description of Artificial Sequence: Synthetic peptide
DETSIGTTNPCATEQWGSVSNNLQSGNQG

SEQ ID NO: 60352 - protein, 29 aa, Artificial Sequence
  Description of Artificial Sequence: Synthetic peptide
DETSIGTTNPCATEQWGSVSNNNLQSGNS

SEQ ID NO: 60353 - protein, 32 aa, Artificial Sequence
  Description of Artificial Sequence: Synthetic polypeptide
DETTIRTTNPVATEQYGDVSVDINGQGRGDNR

SEQ ID NO: 60354 - protein, 30 aa, Artificial Sequence
  Description of Artificial Sequence: Synthetic polypeptide
DETSIGTTNPCATEQWGSVSTENLQSGNQE

SEQ ID NO: 60355 - protein, 30 aa, Artificial Sequence
  Description of Artificial Sequence: Synthetic polypeptide
DETSIRTTNPCATEQWGSVSNVNNLQSGNG

SEQ ID NO: 60356 - protein, 29 aa, Artificial Sequence
  Description of Artificial Sequence: Synthetic peptide
DETSIRTTNPLATEQFGEVSFNLQIGDNQ

SEQ ID NO: 60357 - protein, 29 aa, Artificial Sequence
  Description of Artificial Sequence: Synthetic peptide
DETSIRTTNPLATEQFGSVSFNNLQGNNS

SEQ ID NO: 60358 - protein, 29 aa, Artificial Sequence
  Description of Artificial Sequence: Synthetic peptide
DETSIRTTNPLATEQFGSVSFNQEMGGNR

SEQ ID NO: 60359 - protein, 29 aa, Artificial Sequence
  Description of Artificial Sequence: Synthetic peptide
DETSIRTTNPLATEQWGCVSWNLQSGSNQ

SEQ ID NO: 60360 - protein, 29 aa, Artificial Sequence
  Description of Artificial Sequence: Synthetic peptide
DETSIRTTNPLATEQWGSVSQNNQSGDND

SEQ ID NO: 60361 - protein, 29 aa, Artificial Sequence
  Description of Artificial Sequence: Synthetic peptide
DETSIRTTNPTATECFGSVSFNLQGSGNQ

SEQ ID NO: 60362 - protein, 31 aa, Artificial Sequence
  Description of Artificial Sequence: Synthetic polypeptide
DETTIRGTNPVATEQYGSVSANNFGQERGNT

SEQ ID NO: 60363 - protein, 31 aa, Artificial Sequence
  Description of Artificial Sequence: Synthetic polypeptide
DETTIRTTNPVATEQYGCVETNGEDQRGNGG

SEQ ID NO: 60364 - protein, 29 aa, Artificial Sequence
  Description of Artificial Sequence: Synthetic peptide
DETSIRCTNPLATEQWGSVAANLQDGNDR

SEQ ID NO: 60365 - protein, 32 aa, Artificial Sequence
  Description of Artificial Sequence: Synthetic polypeptide
DEVEIATTNPVATECYGSVSTNLNQGEDNDSR

SEQ ID NO: 60366 - protein, 33 aa, Artificial Sequence
  Description of Artificial Sequence: Synthetic polypeptide
DEEEIRTTNPVATEQYGSQCYTNLQQRSMAENE

SEQ ID NO: 60367 - protein, 33 aa, Artificial Sequence
  Description of Artificial Sequence: Synthetic polypeptide
DEVEIATTNPVATECYGSVSTNLQGNDMGGNSR

SEQ ID NO: 60368 - protein, 32 aa, Artificial Sequence
  Description of Artificial Sequence: Synthetic polypeptide
DEVEIATTNPVATEQYGCVSTNLNGEDLGNER

SEQ ID NO: 60369 - protein, 31 aa, Artificial Sequence
  Description of Artificial Sequence: Synthetic polypeptide
DEVEIATTNPVATEQYGDVSCTDLQCQAGNA

SEQ ID NO: 60370 - protein, 30 aa, Artificial Sequence
  Description of Artificial Sequence: Synthetic polypeptide
DEVEIATTNPVATEQYGEVSTNLNGDVNDE

SEQ ID NO: 60371 - protein, 32 aa, Artificial Sequence
  Description of Artificial Sequence: Synthetic polypeptide
DEVEIATTNPVATEQYGEVSTNLNNGDINGRE

SEQ ID NO: 60372 - protein, 30 aa, Artificial Sequence
  Description of Artificial Sequence: Synthetic polypeptide
DEVEIATTNPVATEQYGSVANNNLQDGTQE

SEQ ID NO: 60373 - protein, 31 aa, Artificial Sequence
  Description of Artificial Sequence: Synthetic polypeptide
DEEEIRTTNPVATEQYGSNVCDDDLDRTGEV

SEQ ID NO: 60374 - protein, 30 aa, Artificial Sequence
  Description of Artificial Sequence: Synthetic polypeptide
DEVEIATTNPVATEQYGSVATNLQDATPEE

SEQ ID NO: 60375 - protein, 32 aa, Artificial Sequence
  Description of Artificial Sequence: Synthetic polypeptide
DEVEIATTNPVATEQYGSVCSTDNLGDNGNTQ

SEQ ID NO: 60376 - protein, 33 aa, Artificial Sequence
  Description of Artificial Sequence: Synthetic polypeptide
DEVEIATTNPVATEQYGSVSAGNLDQDRGENQD

SEQ ID NO: 60377 - protein, 30 aa, Artificial Sequence
  Description of Artificial Sequence: Synthetic polypeptide
DEVEIATTNPVATEQYGCVSTAEQDRIGAM

SEQ ID NO: 60378 - protein, 32 aa, Artificial Sequence
  Description of Artificial Sequence: Synthetic polypeptide
DEEEIRTTNPVATEQYGSMVSTESHEERDMIR

SEQ ID NO: 60379 - protein, 33 aa, Artificial Sequence
  Description of Artificial Sequence: Synthetic polypeptide
DEVEIATTNPVATEQYGSVSTTNGNQNHGDNQR

SEQ ID NO: 60380 - protein, 33 aa, Artificial Sequence
  Description of Artificial Sequence: Synthetic polypeptide
DEEEIRTTNPVATEQYGSMTSMTELLSQRIDNQ

SEQ ID NO: 60381 - protein, 34 aa, Artificial Sequence
  Description of Artificial Sequence: Synthetic polypeptide
DEEEIRTTNPVATEQYGSMTSMTELDLGQRIGNT

SEQ ID NO: 60382 - protein, 33 aa, Artificial Sequence
  Description of Artificial Sequence: Synthetic polypeptide
DEEEIRTTNPVATEQYGSMTSMTDLLSQDIGNQ

SEQ ID NO: 60383 - protein, 35 aa, Artificial Sequence
  Description of Artificial Sequence: Synthetic polypeptide
DEEEIRTTNPVATEQYGSMTSDTEGLGQQRIGNRG

SEQ ID NO: 60384 - protein, 32 aa, Artificial Sequence
  Description of Artificial Sequence: Synthetic polypeptide
DEEEIRTTNPVATEQYGSMSTPAGPNMRNGNV

SEQ ID NO: 60385 - protein, 32 aa, Artificial Sequence
  Description of Artificial Sequence: Synthetic polypeptide
DEVEIATTNPVATEQYGSVSTVLQHGQGNNQS

SEQ ID NO: 60386 - protein, 31 aa, Artificial Sequence
  Description of Artificial Sequence: Synthetic polypeptide
DEVEIATTNPVATEQYGSVSWNEQMQDGNTE

SEQ ID NO: 60387 - protein, 31 aa, Artificial Sequence
  Description of Artificial Sequence: Synthetic polypeptide
DEVEIATTNPVATEQYGSVSWNEQVDQGNTQ

SEQ ID NO: 60388 - protein, 34 aa, Artificial Sequence
  Description of Artificial Sequence: Synthetic polypeptide
DEVEIATTNPVATEQYGSVSTTNGDQERNGGNAR

SEQ ID NO: 60389 - protein, 32 aa, Artificial Sequence
  Description of Artificial Sequence: Synthetic polypeptide
DEVEIATTNPVATEQYGAVSTNLNQGGGTNDQ

SEQ ID NO: 60390 - protein, 31 aa, Artificial Sequence
  Description of Artificial Sequence: Synthetic polypeptide
DEVEIATTNPVATEQWGAVSTNLQGGGQNDQ

SEQ ID NO: 60391 - protein, 32 aa, Artificial Sequence
  Description of Artificial Sequence: Synthetic polypeptide
DEVEIATTNPVATENYGSVSTNLQQMGDNNSM

SEQ ID NO: 60392 - protein, 31 aa, Artificial Sequence
  Description of Artificial Sequence: Synthetic polypeptide
DEVEIATTNPVATECYGSVSTNLQGQDNGSI

SEQ ID NO: 60393 - protein, 32 aa, Artificial Sequence
  Description of Artificial Sequence: Synthetic polypeptide
DEEEIRTTNPVATEQYGSQCSNTNLQVTAEED

SEQ ID NO: 60394 - protein, 33 aa, Artificial Sequence
  Description of Artificial Sequence: Synthetic polypeptide
DEVEIATTNPVATECYGSVSTNLQGQDTGGNMR

SEQ ID NO: 60395 - protein, 32 aa, Artificial Sequence
  Description of Artificial Sequence: Synthetic polypeptide
DEVEIATTNPVATECYGSVSTNLQLGGDNGQK

SEQ ID NO: 60396 - protein, 31 aa, Artificial Sequence
  Description of Artificial Sequence: Synthetic polypeptide
DEVEIATTNPVATECYGVVSTNLQGQDNDSR

SEQ ID NO: 60397 - protein, 32 aa, Artificial Sequence
  Description of Artificial Sequence: Synthetic polypeptide
DEVEIATTNPVATECYGVVSTNLQGQDTGDNR

SEQ ID NO: 60398 - protein, 30 aa, Artificial Sequence
  Description of Artificial Sequence: Synthetic polypeptide
DEVEIATTNPVATEEWGSVSTNLQGGMDGH

SEQ ID NO: 60399 - protein, 32 aa, Artificial Sequence
  Description of Artificial Sequence: Synthetic polypeptide
DEVEIATTNPVATEEYGTVSTNLQGNDSGGNR

SEQ ID NO: 60400 - protein, 31 aa, Artificial Sequence
  Description of Artificial Sequence: Synthetic polypeptide
DEVEIATTNPVATEHYGEVSTNLQGADNDNR

SEQ ID NO: 60401 - protein, 31 aa, Artificial Sequence
  Description of Artificial Sequence: Synthetic polypeptide
DEVEIATTNPVATEHYGSVSTNLQGADDDQR

SEQ ID NO: 60402 - protein, 31 aa, Artificial Sequence
  Description of Artificial Sequence: Synthetic polypeptide
DEVEIATTNPVATEIWGSVSTNLQGNDDDPR

SEQ ID NO: 60403 - protein, 29 aa, Artificial Sequence
  Description of Artificial Sequence: Synthetic peptide
DEVEIATTNPVATEIYGCVSTNGQGADDR

SEQ ID NO: 60404 - protein, 30 aa, Artificial Sequence
  Description of Artificial Sequence: Synthetic polypeptide
DEVEIATTNPVATEIYGCVSTNLQGADNDM

SEQ ID NO: 60405 - protein, 32 aa, Artificial Sequence
  Description of Artificial Sequence: Synthetic polypeptide
DEVEIATTNPVATEIYGSVSTNLNQGGQGNNS

SEQ ID NO: 60406 - protein, 31 aa, Artificial Sequence
  Description of Artificial Sequence: Synthetic polypeptide
DEVEIATTNPVATEIYGSVSTNLQGADNDAE

SEQ ID NO: 60407 - protein, 32 aa, Artificial Sequence
  Description of Artificial Sequence: Synthetic polypeptide
DEVEIATTNPVATEIYGSVSTNLQGGADGDAR

SEQ ID NO: 60408 - protein, 31 aa, Artificial Sequence
  Description of Artificial Sequence: Synthetic polypeptide
DEVEIATTNPVATEIYGSVSTNLQGQDDDRR

SEQ ID NO: 60409 - protein, 31 aa, Artificial Sequence
  Description of Artificial Sequence: Synthetic polypeptide
DEVEIATTNPVATEIYGVVSTNLNQGADDNR

SEQ ID NO: 60410 - protein, 31 aa, Artificial Sequence
  Description of Artificial Sequence: Synthetic polypeptide
DEVEIATTNPVATEIYGVVSTNLQGNDMDNR

SEQ ID NO: 60411 - protein, 32 aa, Artificial Sequence
  Description of Artificial Sequence: Synthetic polypeptide
DEVEIATTNPVATENYGSVSTNLNQQMGDNES

SEQ ID NO: 60412 - protein, 32 aa, Artificial Sequence
  Description of Artificial Sequence: Synthetic polypeptide
DEVEIATTNPVATENYGSVSTNLQQMDGGNTS

SEQ ID NO: 60413 - protein, 32 aa, Artificial Sequence
  Description of Artificial Sequence: Synthetic polypeptide
DEVEIRTTNPVATEQYGSVSNNDAQTNGDNEM

SEQ ID NO: 60414 - protein, 33 aa, Artificial Sequence
  Description of Artificial Sequence: Synthetic polypeptide
DEVEIRTTNPVATEQYGSVSNNDMQTRGSNQEM

SEQ ID NO: 60415 - protein, 32 aa, Artificial Sequence
  Description of Artificial Sequence: Synthetic polypeptide
DEVEIRTTNPVATEQYGSVSNTDEGQGGNNLG

SEQ ID NO: 60416 - protein, 32 aa, Artificial Sequence
  Description of Artificial Sequence: Synthetic polypeptide
DEVEIRTTNPVATEQYGSVSPNYNSDHGNERG

SEQ ID NO: 60417 - protein, 31 aa, Artificial Sequence
  Description of Artificial Sequence: Synthetic polypeptide
DQEEIATTNPVATTQYGVVSTDNGDQNGNHR

SEQ ID NO: 60418 - protein, 31 aa, Artificial Sequence
  Description of Artificial Sequence: Synthetic polypeptide
DQEEIATTNPVAYMQYGSVSTNGVQQNGNHR

SEQ ID NO: 60419 - protein, 30 aa, Artificial Sequence
  Description of Artificial Sequence: Synthetic polypeptide
DQEEIATTNPVGTEQWGMVSITNLQSGGER

SEQ ID NO: 60420 - protein, 32 aa, Artificial Sequence
  Description of Artificial Sequence: Synthetic polypeptide
DQEEICTTNPVAYEQYGTVVSCTNELSQAGNR

SEQ ID NO: 60421 - protein, 32 aa, Artificial Sequence
  Description of Artificial Sequence: Synthetic polypeptide
DQEEIRSTNPVATEQYGSVCSTNLQEHSGSQQ

SEQ ID NO: 60422 - protein, 33 aa, Artificial Sequence
  Description of Artificial Sequence: Synthetic polypeptide
DQEEIRTTNPVATDQYGSVSCTNGVSQNGGNNR

SEQ ID NO: 60423 - protein, 30 aa, Artificial Sequence
  Description of Artificial Sequence: Synthetic polypeptide
DQEEIRTTNPVATDQYGSVSTVGVADGNQV

SEQ ID NO: 60424 - protein, 31 aa, Artificial Sequence
  Description of Artificial Sequence: Synthetic polypeptide
DQEEIRTTNPVATDQYGSVSTVGVIQNGNQV

SEQ ID NO: 60425 - protein, 32 aa, Artificial Sequence
  Description of Artificial Sequence: Synthetic polypeptide
DQEEIRTTNPVATEQYGCVCSTNLQNFNSNQA

SEQ ID NO: 60426 - protein, 29 aa, Artificial Sequence
  Description of Artificial Sequence: Synthetic peptide
DQAEIRTTNPVAYEQYGVCSTVDQHGDNR

SEQ ID NO: 60427 - protein, 31 aa, Artificial Sequence
  Description of Artificial Sequence: Synthetic polypeptide
DQEEIRTTNPVATEQYGCVSTNLENILDNQE

SEQ ID NO: 60428 - protein, 31 aa, Artificial Sequence
  Description of Artificial Sequence: Synthetic polypeptide
DQEEIRTTNPVATHGYGSVPSTNGVENGNDR

SEQ ID NO: 60429 - protein, 32 aa, Artificial Sequence
  Description of Artificial Sequence: Synthetic polypeptide
DQEEIRTTNPVATHQYGCVSNTNGVQNGSNNR

SEQ ID NO: 60430 - protein, 31 aa, Artificial Sequence
  Description of Artificial Sequence: Synthetic polypeptide
DQEEIRTTNPVATHQYGCVSTNGDQNGSDNQ

SEQ ID NO: 60431 - protein, 31 aa, Artificial Sequence
  Description of Artificial Sequence: Synthetic polypeptide
DQEEIRTTNPVATHQYGCVSTNGDQNGSNTV

SEQ ID NO: 60432 - protein, 32 aa, Artificial Sequence
  Description of Artificial Sequence: Synthetic polypeptide
DQEEIRTTNPVATHQYGCVSTNGHNQNFGNTR

SEQ ID NO: 60433 - protein, 32 aa, Artificial Sequence
  Description of Artificial Sequence: Synthetic polypeptide
DQEEIRTTNPVATHQYGCVSTNGTQNFGSNNR

SEQ ID NO: 60434 - protein, 31 aa, Artificial Sequence
  Description of Artificial Sequence: Synthetic polypeptide
DEEEIRTTNPVATEQYGSFAMTDFLGEGSND

SEQ ID NO: 60435 - protein, 33 aa, Artificial Sequence
  Description of Artificial Sequence: Synthetic polypeptide
DQEEIRTTNPVATHQYGSVCSTNGVQNFGSDNR

SEQ ID NO: 60436 - protein, 33 aa, Artificial Sequence
  Description of Artificial Sequence: Synthetic polypeptide
DQEEIRTTNPVATHQYGSVSCTGNEHQNGGNNR

SEQ ID NO: 60437 - protein, 32 aa, Artificial Sequence
  Description of Artificial Sequence: Synthetic polypeptide
DQEEIRTTNPVATEQYGSVSWTDIEQIRDTDR

SEQ ID NO: 60438 - protein, 32 aa, Artificial Sequence
  Description of Artificial Sequence: Synthetic polypeptide
DQEEIRTTNPVATHQYGSVSSNGVQENGNHRV

SEQ ID NO: 60439 - protein, 30 aa, Artificial Sequence
  Description of Artificial Sequence: Synthetic polypeptide
DQAEIRTTNPVAYEQYGVCSTLDDLQHGNR

SEQ ID NO: 60440 - protein, 31 aa, Artificial Sequence
  Description of Artificial Sequence: Synthetic polypeptide
DQAEIRTTNPVATEQYGCSCSTVLQHGNDEQ

SEQ ID NO: 60441 - protein, 31 aa, Artificial Sequence
  Description of Artificial Sequence: Synthetic polypeptide
DEEEIRTTNPVATEQYGSFVCTPQQANNPAI

SEQ ID NO: 60442 - protein, 33 aa, Artificial Sequence
  Description of Artificial Sequence: Synthetic polypeptide
DEEEIRTTNPVATEQYGSFTSVINPMERFGNRE

SEQ ID NO: 60443 - protein, 30 aa, Artificial Sequence
  Description of Artificial Sequence: Synthetic polypeptide
DNNEIRTTNPVATEQYGSCSTLLQEHHNET

SEQ ID NO: 60444 - protein, 28 aa, Artificial Sequence
  Description of Artificial Sequence: Synthetic peptide
DQAEIACTNPVATEQYGCASTVLQHGNA

SEQ ID NO: 60445 - protein, 29 aa, Artificial Sequence
  Description of Artificial Sequence: Synthetic peptide
DQAEIACTNPVATEQYGCCSTVLQHGNDR

SEQ ID NO: 60446 - protein, 29 aa, Artificial Sequence
  Description of Artificial Sequence: Synthetic peptide
DQAEIATTNPVATEQYGCCSTVLQHGNEQ

SEQ ID NO: 60447 - protein, 28 aa, Artificial Sequence
  Description of Artificial Sequence: Synthetic peptide
DQAEIATTNPVATEQYGCCYTVDQHGNR

SEQ ID NO: 60448 - protein, 30 aa, Artificial Sequence
  Description of Artificial Sequence: Synthetic polypeptide
DQAEICTTNPVATEQYGCCSTVLQHGNDRD

SEQ ID NO: 60449 - protein, 29 aa, Artificial Sequence
  Description of Artificial Sequence: Synthetic peptide
DQAEIRTTNPVATEGYGCCSTVLQHGNIK

SEQ ID NO: 60450 - protein, 29 aa, Artificial Sequence
  Description of Artificial Sequence: Synthetic peptide
DQAEIRTTNPVAYEQYGCCSTHLSQHGND

SEQ ID NO: 60451 - protein, 29 aa, Artificial Sequence
  Description of Artificial Sequence: Synthetic peptide
DQAEIRTTNPVATEQWGCCSTDDQHGNDR

SEQ ID NO: 60452 - protein, 31 aa, Artificial Sequence
  Description of Artificial Sequence: Synthetic polypeptide
DQAEIRTTNPVATEQYGCCISTVLQEHGNQR

SEQ ID NO: 60453 - protein, 29 aa, Artificial Sequence
  Description of Artificial Sequence: Synthetic peptide
DQAEIRTTNPVATEQYGCCSTALQHGSVQ

SEQ ID NO: 60454 - protein, 31 aa, Artificial Sequence
  Description of Artificial Sequence: Synthetic polypeptide
DQAEIRTTNPVATEQYGCCSTGSLSQHGGNR

SEQ ID NO: 60455 - protein, 30 aa, Artificial Sequence
  Description of Artificial Sequence: Synthetic polypeptide
DQAEIRTTNPVATEQYGCCSTVHQHGSNRS

SEQ ID NO: 60456 - protein, 30 aa, Artificial Sequence
  Description of Artificial Sequence: Synthetic polypeptide
DQAEIRTTNPVATEQYGCCSTVILQHGERP

SEQ ID NO: 60457 - protein, 29 aa, Artificial Sequence
  Description of Artificial Sequence: Synthetic peptide
DQAEIRTTNPVATEQYGCCSTVLEDGNNQ

SEQ ID NO: 60458 - protein, 30 aa, Artificial Sequence
  Description of Artificial Sequence: Synthetic polypeptide
DQAEIRTTNPVATEQYGCCSTVLQHGENDD

SEQ ID NO: 60459 - protein, 30 aa, Artificial Sequence
  Description of Artificial Sequence: Synthetic polypeptide
DQAEIRTTNPVATEQYGCCSTVLQPGQERP

SEQ ID NO: 60460 - protein, 31 aa, Artificial Sequence
  Description of Artificial Sequence: Synthetic polypeptide
DQAEIRTTNPVATEQYGCSCSTELQHFGGNQ

SEQ ID NO: 60461 - protein, 30 aa, Artificial Sequence
  Description of Artificial Sequence: Synthetic polypeptide
DQAEIRTTNPVATEQYGCCCSTALQHFGDR

SEQ ID NO: 60462 - protein, 32 aa, Artificial Sequence
  Description of Artificial Sequence: Synthetic polypeptide
DQEEIRTTNPVATHQYGSVSTNGHQNFGSNNV

SEQ ID NO: 60463 - protein, 31 aa, Artificial Sequence
  Description of Artificial Sequence: Synthetic polypeptide
DQEEIRTTNPVATHQYGSVSTNGVENMGNHG

SEQ ID NO: 60464 - protein, 31 aa, Artificial Sequence
  Description of Artificial Sequence: Synthetic polypeptide
DQEEIRTTNPVATHQYGSVSTNGVIENGEHR

SEQ ID NO: 60465 - protein, 33 aa, Artificial Sequence
  Description of Artificial Sequence: Synthetic polypeptide
DSEEICTTNPVAYEQYGSTVSTNGSQTRGGNRM

SEQ ID NO: 60466 - protein, 31 aa, Artificial Sequence
  Description of Artificial Sequence: Synthetic polypeptide
DEEEIRTTNPVATEQYGSCSWVILQRFETQG

SEQ ID NO: 60467 - protein, 31 aa, Artificial Sequence
  Description of Artificial Sequence: Synthetic polypeptide
DSEEIKTTNPVATESYGSVVACTNLQSVGSR

SEQ ID NO: 60468 - protein, 33 aa, Artificial Sequence
  Description of Artificial Sequence: Synthetic polypeptide
DEEEIRTTNPVATEQYGSCSWPNMLESGNHERI

SEQ ID NO: 60469 - protein, 29 aa, Artificial Sequence
  Description of Artificial Sequence: Synthetic peptide
DSEEIQTTNPVGNEQWGMVSITNLQGGER

SEQ ID NO: 60470 - protein, 33 aa, Artificial Sequence
  Description of Artificial Sequence: Synthetic polypeptide
DSEEIRATNPVATEAYGSVSCTNLSQARTGGQR

SEQ ID NO: 60471 - protein, 31 aa, Artificial Sequence
  Description of Artificial Sequence: Synthetic polypeptide
DSEEIRATNPVATEQWGSVSENLQQGDNEQE

SEQ ID NO: 60472 - protein, 33 aa, Artificial Sequence
  Description of Artificial Sequence: Synthetic polypeptide
DSEEIRATNPVATEQYGKTVSCTNLSQGGGNRL

SEQ ID NO: 60473 - protein, 33 aa, Artificial Sequence
  Description of Artificial Sequence: Synthetic polypeptide
DSEEIRCTNPVATEPYGSTVSCTNMLQSGGNPR

SEQ ID NO: 60474 - protein, 34 aa, Artificial Sequence
  Description of Artificial Sequence: Synthetic polypeptide
DSEEICTTNPVATEQYGSVSTNALSDRNGGNNRC

SEQ ID NO: 60475 - protein, 31 aa, Artificial Sequence
  Description of Artificial Sequence: Synthetic polypeptide
DSEEIRCTNPVATEQYGCQVSTNLQNFGSQQ

SEQ ID NO: 60476 - protein, 30 aa, Artificial Sequence
  Description of Artificial Sequence: Synthetic polypeptide
DSEEIRSTNPVATEQWGSSSTNMQGNGNEN

SEQ ID NO: 60477 - protein, 32 aa, Artificial Sequence
  Description of Artificial Sequence: Synthetic polypeptide
DSEEIRSTNPVATEQYGSISCTNEHSQRGGNP

SEQ ID NO: 60478 - protein, 33 aa, Artificial Sequence
  Description of Artificial Sequence: Synthetic polypeptide
DEEEIRTTNPVATEQYGSCSVAPDLWGRAGNVR

SEQ ID NO: 60479 - protein, 31 aa, Artificial Sequence
  Description of Artificial Sequence: Synthetic polypeptide
DSEEIRSTNPVATEQYGSISCTNHSTRVGNF

SEQ ID NO: 60480 - protein, 32 aa, Artificial Sequence
  Description of Artificial Sequence: Synthetic polypeptide
DSEEIRSTNPVATEQYGSISCTNSSQRGGNNN

SEQ ID NO: 60481 - protein, 32 aa, Artificial Sequence
  Description of Artificial Sequence: Synthetic polypeptide
DSEEIRSTNPVATEQYGSVVSTNLSQNTGGDE

SEQ ID NO: 60482 - protein, 31 aa, Artificial Sequence
  Description of Artificial Sequence: Synthetic polypeptide
DEEEIRTTNPVATEQYGSCSTVELQTFETQG

SEQ ID NO: 60483 - protein, 32 aa, Artificial Sequence
  Description of Artificial Sequence: Synthetic polypeptide
DSEEIRSTNPVAYEAYGSVSTNLSQARTGGQR

SEQ ID NO: 60484 - protein, 32 aa, Artificial Sequence
  Description of Artificial Sequence: Synthetic polypeptide
DSEEIRSTNPVAYEPYGSVSCTNLQARTGGQR

SEQ ID NO: 60485 - protein, 33 aa, Artificial Sequence
  Description of Artificial Sequence: Synthetic polypeptide
DSEEIRPTNPVATEQYGKVSCTNALSDRGGNNR

SEQ ID NO: 60486 - protein, 29 aa, Artificial Sequence
  Description of Artificial Sequence: Synthetic peptide
DSEEIATTNPVCTEFWGMVSITNLQGGER

SEQ ID NO: 60487 - protein, 31 aa, Artificial Sequence
  Description of Artificial Sequence: Synthetic polypeptide
DSEEIATTNPVAYTQYGSVSTNPSMRGTNNR

SEQ ID NO: 60488 - protein, 31 aa, Artificial Sequence
  Description of Artificial Sequence: Synthetic polypeptide
DSEEIATTNPVAYTQYGSVSCTNASSRGGNR

SEQ ID NO: 60489 - protein, 31 aa, Artificial Sequence
  Description of Artificial Sequence: Synthetic polypeptide
DQEEIRTTNPVATHQYGSVSTNGVQLNGEHG

SEQ ID NO: 60490 - protein, 33 aa, Artificial Sequence
  Description of Artificial Sequence: Synthetic polypeptide
DQEEIRTTNPVATHQYGSVSTNGVTQPNNGNHR

SEQ ID NO: 60491 - protein, 31 aa, Artificial Sequence
  Description of Artificial Sequence: Synthetic polypeptide
DQEEIRTTNPVATRQYGSVSTNGDDENGTHR

SEQ ID NO: 60492 - protein, 30 aa, Artificial Sequence
  Description of Artificial Sequence: Synthetic polypeptide
DQQEIRTTNPVATEQYGCVSTNNQEGVDIL

SEQ ID NO: 60493 - protein, 30 aa, Artificial Sequence
  Description of Artificial Sequence: Synthetic polypeptide
DEEEIRTTNPVATEQYGSCYSTTDERNVDQ

SEQ ID NO: 60494 - protein, 30 aa, Artificial Sequence
  Description of Artificial Sequence: Synthetic polypeptide
DSAEIRTTNPVATEQYGCCPSTVHSQHGNR

SEQ ID NO: 60495 - protein, 31 aa, Artificial Sequence
  Description of Artificial Sequence: Synthetic polypeptide
DEEEIRTTNPVATEQYGSCYSTTDEREVDQR

SEQ ID NO: 60496 - protein, 30 aa, Artificial Sequence
  Description of Artificial Sequence: Synthetic polypeptide
DSAEIRTTNPVATEQYGCCSTHHSQHGNNR

SEQ ID NO: 60497 - protein, 31 aa, Artificial Sequence
  Description of Artificial Sequence: Synthetic polypeptide
DSAEIRTTNPVATEQYGCTCSTVSLSQHGNR

SEQ ID NO: 60498 - protein, 31 aa, Artificial Sequence
  Description of Artificial Sequence: Synthetic polypeptide
DSDEIRTTNPLAYEHYGSVSCINLSQREGNR

SEQ ID NO: 60499 - protein, 31 aa, Artificial Sequence
  Description of Artificial Sequence: Synthetic polypeptide
DSECIRTTNPVAYEQYGQVSTGNVSQRGNNN

SEQ ID NO: 60500 - protein, 34 aa, Artificial Sequence
  Description of Artificial Sequence: Synthetic polypeptide
DEEEIRTTNPVATEQYGSCVYSDNEWQRSDNEDR

SEQ ID NO: 60501 - protein, 29 aa, Artificial Sequence
  Description of Artificial Sequence: Synthetic peptide
DSEDIATTNPVATEQYGCVATNDQRVNLD

SEQ ID NO: 60502 - protein, 29 aa, Artificial Sequence
  Description of Artificial Sequence: Synthetic peptide
DSEDIATTNPVATEQYGCVATNGQRDNLH

SEQ ID NO: 60503 - protein, 29 aa, Artificial Sequence
  Description of Artificial Sequence: Synthetic peptide
DSEDIATTNPVATEQYGCVSTNEQRVDDL

SEQ ID NO: 60504 - protein, 29 aa, Artificial Sequence
  Description of Artificial Sequence: Synthetic peptide
DSEDIATTNPVATEQYGCVSTNHGRDSNN

SEQ ID NO: 60505 - protein, 29 aa, Artificial Sequence
  Description of Artificial Sequence: Synthetic peptide
DSEDIATTNPVATEQYGCVSTNHQRDSDS

SEQ ID NO: 60506 - protein, 32 aa, Artificial Sequence
  Description of Artificial Sequence: Synthetic polypeptide
DEEEIRTTNPVATEQYGSCVSTMADDRSLDHR

SEQ ID NO: 60507 - protein, 30 aa, Artificial Sequence
  Description of Artificial Sequence: Synthetic polypeptide
DSEEIATTNPVAYESYGSVSTDLSQRVNNS

SEQ ID NO: 60508 - protein, 31 aa, Artificial Sequence
  Description of Artificial Sequence: Synthetic polypeptide
DSEEIATTNPVAYESYGSVSTNVSQRGGNQS

SEQ ID NO: 60509 - protein, 33 aa, Artificial Sequence
  Description of Artificial Sequence: Synthetic polypeptide
DEEEIRTTNPVATEQYGSCTTQNDVQRVGDNDQ

SEQ ID NO: 60510 - protein, 33 aa, Artificial Sequence
  Description of Artificial Sequence: Synthetic polypeptide
DEEEIRTTNPVATEQYGSFVNSENDQNGNDQMD

SEQ ID NO: 60511 - protein, 30 aa, Artificial Sequence
  Description of Artificial Sequence: Synthetic polypeptide
DETEIRTTNPVAYEQYGTVSTTNQDGQDSR

SEQ ID NO: 60512 - protein, 33 aa, Artificial Sequence
  Description of Artificial Sequence: Synthetic polypeptide
DEEEIRTTNPVATEQYGSFVNSEVDDQRGNISI

SEQ ID NO: 60513 - protein, 35 aa, Artificial Sequence
  Description of Artificial Sequence: Synthetic polypeptide
DEEEIRTTNPVATEQYGSFVSDTPNVLNRVGPVNL

SEQ ID NO: 60514 - protein, 33 aa, Artificial Sequence
  Description of Artificial Sequence: Synthetic polypeptide
DEVEIRTTNPVATEQYGSVSTTNNPGNHGDNNR

SEQ ID NO: 60515 - protein, 31 aa, Artificial Sequence
  Description of Artificial Sequence: Synthetic polypeptide
DEVEIRTTNPVATEQYGSVSVSNGENFGSDR

SEQ ID NO: 60516 - protein, 33 aa, Artificial Sequence
  Description of Artificial Sequence: Synthetic polypeptide
DEVEIRTTNPVATEQYGSVTSTDLQNNGGNEEE

SEQ ID NO: 60517 - protein, 34 aa, Artificial Sequence
  Description of Artificial Sequence: Synthetic polypeptide
DEVEIRTTNPVATEQYGSVTSTNLQGDNGNNTVV

SEQ ID NO: 60518 - protein, 33 aa, Artificial Sequence
  Description of Artificial Sequence: Synthetic polypeptide
DEVEIRTTNPVATEQYGSVTSTNMGQGNGGGNI

SEQ ID NO: 60519 - protein, 32 aa, Artificial Sequence
  Description of Artificial Sequence: Synthetic polypeptide
DEVEIRTTNPVATEQYGSVYSMNDQMVGNDQI

SEQ ID NO: 60520 - protein, 32 aa, Artificial Sequence
  Description of Artificial Sequence: Synthetic polypeptide
DEVEIRTTNPVATEQYGTVSSTNTLQNLEANP

SEQ ID NO: 60521 - protein, 32 aa, Artificial Sequence
  Description of Artificial Sequence: Synthetic polypeptide
DEVEIRTTNPVATESWGSVSTNGQRPGDNGDM

SEQ ID NO: 60522 - protein, 32 aa, Artificial Sequence
  Description of Artificial Sequence: Synthetic polypeptide
DEVEIRTTNPVAYEQWGSVSTNLEQGGTGNDN

SEQ ID NO: 60523 - protein, 34 aa, Artificial Sequence
  Description of Artificial Sequence: Synthetic polypeptide
DEVEIRTTNPVATEQYGSVSTTNLQGTGGENENI

SEQ ID NO: 60524 - protein, 31 aa, Artificial Sequence
  Description of Artificial Sequence: Synthetic polypeptide
DEVEIRTTNPVAYEQWGVVSTNLQSGGGNDN

SEQ ID NO: 60525 - protein, 31 aa, Artificial Sequence
  Description of Artificial Sequence: Synthetic polypeptide
DEVEIRTTNPVAYERYGTVSTNLQEGGDNTG

SEQ ID NO: 60526 - protein, 29 aa, Artificial Sequence
  Description of Artificial Sequence: Synthetic peptide
DEVEISTTNPVATDQYGVVSTDGQGGGNE

SEQ ID NO: 60527 - protein, 30 aa, Artificial Sequence
  Description of Artificial Sequence: Synthetic polypeptide
DEVVIGTTNPVATEQFGTVSTDFGDQRGNR

SEQ ID NO: 60528 - protein, 30 aa, Artificial Sequence
  Description of Artificial Sequence: Synthetic polypeptide
DEVVIGTTNPVATEQFGTVSTGDFLQDGNR

SEQ ID NO: 60529 - protein, 31 aa, Artificial Sequence
  Description of Artificial Sequence: Synthetic polypeptide
DEYEICTTNPAATEQYGSVPTNLQMGGNGDI

SEQ ID NO: 60530 - protein, 33 aa, Artificial Sequence
  Description of Artificial Sequence: Synthetic polypeptide
DEEEIRTTNPVATEQYGSGVSAMNLIRNEEERD

SEQ ID NO: 60531 - protein, 32 aa, Artificial Sequence
  Description of Artificial Sequence: Synthetic polypeptide
DEEEIRTTNPVATEQYGSGVNTNNEQFNEERQ

SEQ ID NO: 60532 - protein, 33 aa, Artificial Sequence
  Description of Artificial Sequence: Synthetic polypeptide
DEYEIGTTNPVATEQYGSVSNTNQLQEEMGNLT

SEQ ID NO: 60533 - protein, 30 aa, Artificial Sequence
  Description of Artificial Sequence: Synthetic polypeptide
DEYEIGTTNPVATEQYGSVSTGGMEGGNTT

SEQ ID NO: 60534 - protein, 31 aa, Artificial Sequence
  Description of Artificial Sequence: Synthetic polypeptide
DEVEIRTTNPVAYEQYGTVSTNLNMGGDDGR

SEQ ID NO: 60535 - protein, 33 aa, Artificial Sequence
  Description of Artificial Sequence: Synthetic polypeptide
DEEEIRTTNPVATEQYGSGSTTNLVQQEMVNFD

SEQ ID NO: 60536 - protein, 32 aa, Artificial Sequence
  Description of Artificial Sequence: Synthetic polypeptide
DEVEIRTTNPVATEQYGSVSTTANGMGNEGNI

SEQ ID NO: 60537 - protein, 33 aa, Artificial Sequence
  Description of Artificial Sequence: Synthetic polypeptide
DEEEIRTTNPVATEQYGSIESTMNMMQGRTINM

SEQ ID NO: 60538 - protein, 33 aa, Artificial Sequence
  Description of Artificial Sequence: Synthetic polypeptide
DEVEIRTTNPVATEQYGSVSSDTNNGQTGGNNT

SEQ ID NO: 60539 - protein, 34 aa, Artificial Sequence
  Description of Artificial Sequence: Synthetic polypeptide
DEVEIRTTNPVATEQYGSVSSTNLQFNEGGNEDT

SEQ ID NO: 60540 - protein, 33 aa, Artificial Sequence
  Description of Artificial Sequence: Synthetic polypeptide
DEVEIRTTNPVATEQYGSVSTDNGQQEGEGNIE

SEQ ID NO: 60541 - protein, 32 aa, Artificial Sequence
  Description of Artificial Sequence: Synthetic polypeptide
DEVEIRTTNPVATEQYGSVSTGGDAQNGGNEP

SEQ ID NO: 60542 - protein, 32 aa, Artificial Sequence
  Description of Artificial Sequence: Synthetic polypeptide
DEVEIRTTNPVATEQYGSVSTGGGEHQNDGNV

SEQ ID NO: 60543 - protein, 33 aa, Artificial Sequence
  Description of Artificial Sequence: Synthetic polypeptide
DEVEIRTTNPVATEQYGSVSTGNGGQANGGNNY

SEQ ID NO: 60544 - protein, 33 aa, Artificial Sequence
  Description of Artificial Sequence: Synthetic polypeptide
DEVEIRTTNPVATEQYGSVSTLNIQNTGGGNED

SEQ ID NO: 60545 - protein, 33 aa, Artificial Sequence
  Description of Artificial Sequence: Synthetic polypeptide
DEVEIRTTNPVATEQYGSVSTMNDQIMVGEDRI

SEQ ID NO: 60546 - protein, 32 aa, Artificial Sequence
  Description of Artificial Sequence: Synthetic polypeptide
DEEEIRTTNPVATEQYGSISPTDLSLGTDERE

SEQ ID NO: 60547 - protein, 33 aa, Artificial Sequence
  Description of Artificial Sequence: Synthetic polypeptide
DEVEIRTTNPVATEQYGSVSTQNGNGNHGDNGR

SEQ ID NO: 60548 - protein, 31 aa, Artificial Sequence
  Description of Artificial Sequence: Synthetic polypeptide
DEEEIRTTNPVATEQYGSISLMPMLQITENA

SEQ ID NO: 60549 - protein, 31 aa, Artificial Sequence
  Description of Artificial Sequence: Synthetic polypeptide
DEEEIRTTNPVATEQYGSISLMPMLQIDNAP

SEQ ID NO: 60550 - protein, 32 aa, Artificial Sequence
  Description of Artificial Sequence: Synthetic polypeptide
DEEEIRTTNPVATEQYGSISLLSLIRDVNERE

SEQ ID NO: 60551 - protein, 34 aa, Artificial Sequence
  Description of Artificial Sequence: Synthetic polypeptide
DEVEIRTTNPVATEQYGSVSTNNGDDERNGGNGR

SEQ ID NO: 60552 - protein, 34 aa, Artificial Sequence
  Description of Artificial Sequence: Synthetic polypeptide
DEEEIRTTNPVATEQYGSIPSCLPNMLSQHDGNR

SEQ ID NO: 60553 - protein, 32 aa, Artificial Sequence
  Description of Artificial Sequence: Synthetic polypeptide
DEEEIRTTNPVATEQYGSINSTNEQSVIENDD

SEQ ID NO: 60554 - protein, 34 aa, Artificial Sequence
  Description of Artificial Sequence: Synthetic polypeptide
DEEEIRTTNPVATEQYGSINCTSNLQSVGEENRQ

SEQ ID NO: 60555 - protein, 33 aa, Artificial Sequence
  Description of Artificial Sequence: Synthetic polypeptide
DEEEIRTTNPVATEQYGSIIYTPNLQQRENVED

SEQ ID NO: 60556 - protein, 33 aa, Artificial Sequence
  Description of Artificial Sequence: Synthetic polypeptide
DEEEIRTTNPVATEQYGSIIYPTENLQQTGNLF

SEQ ID NO: 60557 - protein, 31 aa, Artificial Sequence
  Description of Artificial Sequence: Synthetic polypeptide
DEEEIRTTNPVATEQYGSIISGDELQQPGDH

SEQ ID NO: 60558 - protein, 32 aa, Artificial Sequence
  Description of Artificial Sequence: Synthetic polypeptide
DEEEIRTTNPVATEQYGSISLMPMLQIDNDRA

SEQ ID NO: 60559 - protein, 31 aa, Artificial Sequence
  Description of Artificial Sequence: Synthetic polypeptide
DEYEIGTTNPVATEQYGSVSTNAGMENGNNT

SEQ ID NO: 60560 - protein, 31 aa, Artificial Sequence
  Description of Artificial Sequence: Synthetic polypeptide
DEYEIHTTNPVATEQYGSVSTNAGMEGGGNT

SEQ ID NO: 60561 - protein, 31 aa, Artificial Sequence
  Description of Artificial Sequence: Synthetic polypeptide
DEYEIRTTNPVATEQYGCVSTVLDPNGEDRF

SEQ ID NO: 60562 - protein, 30 aa, Artificial Sequence
  Description of Artificial Sequence: Synthetic polypeptide
DMEEIRCTNPVATEQYGCSCSTEDQNGSNQ

SEQ ID NO: 60563 - protein, 30 aa, Artificial Sequence
  Description of Artificial Sequence: Synthetic polypeptide
DMEEIRSTNPVATEQYGCSSTEHQRGSNQS

SEQ ID NO: 60564 - protein, 30 aa, Artificial Sequence
  Description of Artificial Sequence: Synthetic polypeptide
DMEEIRSTNPVATEQYGSSSTNMTLEGNDN

SEQ ID NO: 60565 - protein, 30 aa, Artificial Sequence
  Description of Artificial Sequence: Synthetic polypeptide
DMEEIRSTNPVATEQYGSSSTYNMTQEGDN

SEQ ID NO: 60566 - protein, 31 aa, Artificial Sequence
  Description of Artificial Sequence: Synthetic polypeptide
DMEEIRSTNPVATEQYGSVSTYCLETGNGQE

SEQ ID NO: 60567 - protein, 33 aa, Artificial Sequence
  Description of Artificial Sequence: Synthetic polypeptide
DEEEIRTTNPVATEQYGSFVSQTNLQPQTPEPD

SEQ ID NO: 60568 - protein, 34 aa, Artificial Sequence
  Description of Artificial Sequence: Synthetic polypeptide
DEEEIRTTNPVATEQYGSFVSQLTNEQSGPELRI

SEQ ID NO: 60569 - protein, 32 aa, Artificial Sequence
  Description of Artificial Sequence: Synthetic polypeptide
DNEEIATTNPVATEQYGSVCSTNAEFRGLPRL

SEQ ID NO: 60570 - protein, 31 aa, Artificial Sequence
  Description of Artificial Sequence: Synthetic polypeptide
DNEEIRSTNPVATEQYGSVSPTNLETRNEQE

SEQ ID NO: 60571 - protein, 31 aa, Artificial Sequence
  Description of Artificial Sequence: Synthetic polypeptide
DMEEIGTTNPVATEQYGCVSTNQLEERMGSL

SEQ ID NO: 60572 - protein, 33 aa, Artificial Sequence
  Description of Artificial Sequence: Synthetic polypeptide
DNEEIRTTNPVATEQYGSTVSTNDYQRTTNDMD

SEQ ID NO: 60573 - protein, 31 aa, Artificial Sequence
  Description of Artificial Sequence: Synthetic polypeptide
DNEEIRTTNPVGTEQWGAVSPTNELVRVGVR

SEQ ID NO: 60574 - protein, 32 aa, Artificial Sequence
  Description of Artificial Sequence: Synthetic polypeptide
DNEEISTTNPVATAQYGSVSTNNGPMRGNDRL

SEQ ID NO: 60575 - protein, 33 aa, Artificial Sequence
  Description of Artificial Sequence: Synthetic polypeptide
DEEEIRTTNPVATEQYGSFVSPTNLGNITDNTI

SEQ ID NO: 60576 - protein, 30 aa, Artificial Sequence
  Description of Artificial Sequence: Synthetic polypeptide
DNEEISTTNPVATCQYGCVSTNPINFGSNR

SEQ ID NO: 60577 - protein, 31 aa, Artificial Sequence
  Description of Artificial Sequence: Synthetic polypeptide
DNEEISTTNPVATDQYGSVSTNPEVENGNRQ

SEQ ID NO: 60578 - protein, 32 aa, Artificial Sequence
  Description of Artificial Sequence: Synthetic polypeptide
DNEEISTTNPVATTQYGSVSTNNGPMRGNNRN

SEQ ID NO: 60579 - protein, 31 aa, Artificial Sequence
  Description of Artificial Sequence: Synthetic polypeptide
DNEEISTTNPVATTQYGSVSTNNGPMRGTER

SEQ ID NO: 60580 - protein, 32 aa, Artificial Sequence
  Description of Artificial Sequence: Synthetic polypeptide
DNEEISTTNPVATTQYGSVSTNNGPMRGTNTR

SEQ ID NO: 60581 - protein, 31 aa, Artificial Sequence
  Description of Artificial Sequence: Synthetic polypeptide
DNEEISTTNPVATTQYGSVSTNNGPMTRVNR

SEQ ID NO: 60582 - protein, 33 aa, Artificial Sequence
  Description of Artificial Sequence: Synthetic polypeptide
DNEEIRTTNPVATEQYGSVSCTNGGQRGSKQFE

SEQ ID NO: 60583 - protein, 32 aa, Artificial Sequence
  Description of Artificial Sequence: Synthetic polypeptide
DMEEIGTTNPVATEQYGCVSTNLLQERMGSIL

SEQ ID NO: 60584 - protein, 33 aa, Artificial Sequence
  Description of Artificial Sequence: Synthetic polypeptide
DMEEIGTTNPVATEQYGCVSTNLLQERMGNLQE

SEQ ID NO: 60585 - protein, 32 aa, Artificial Sequence
  Description of Artificial Sequence: Synthetic polypeptide
DMEEIGTTNPVATEQYGCVSTNALQERMGVQQ

SEQ ID NO: 60586 - protein, 31 aa, Artificial Sequence
  Description of Artificial Sequence: Synthetic polypeptide
DEYEIRTTNPVATEQYGSVETDLVQRTEDDQ

SEQ ID NO: 60587 - protein, 32 aa, Artificial Sequence
  Description of Artificial Sequence: Synthetic polypeptide
DEYEIRTTNPVATEQYGSVSFTPLQRLQPPQQ

SEQ ID NO: 60588 - protein, 31 aa, Artificial Sequence
  Description of Artificial Sequence: Synthetic polypeptide
DEYEIRTTNPVATEQYGSVSTDLETRTEDDA

SEQ ID NO: 60589 - protein, 32 aa, Artificial Sequence
  Description of Artificial Sequence: Synthetic polypeptide
DEEEIRTTNPVATEQYGSGSTNGVQGGSQIES

SEQ ID NO: 60590 - protein, 31 aa, Artificial Sequence
  Description of Artificial Sequence: Synthetic polypeptide
DEYEIRTTNPVATEQYGSVSTHMVMLLPGDE

SEQ ID NO: 60591 - protein, 31 aa, Artificial Sequence
  Description of Artificial Sequence: Synthetic polypeptide
DEYEIRTTNPVATEQYGSVSTLDLHEGDEDG

SEQ ID NO: 60592 - protein, 31 aa, Artificial Sequence
  Description of Artificial Sequence: Synthetic polypeptide
DEYEIRTTNPVATEQYGSVSTLDTEQEGEGV

SEQ ID NO: 60593 - protein, 33 aa, Artificial Sequence
  Description of Artificial Sequence: Synthetic polypeptide
DEEEIRTTNPVATEQYGSGSAENLQINGNDEQV

SEQ ID NO: 60594 - protein, 32 aa, Artificial Sequence
  Description of Artificial Sequence: Synthetic polypeptide
DEYEIRTTNPVATEQYGSVSVTDLVQRTEDDV

SEQ ID NO: 60595 - protein, 32 aa, Artificial Sequence
  Description of Artificial Sequence: Synthetic polypeptide
DEYEIRTTNPVATEQYGSVYSETPLSDSEGNQ

SEQ ID NO: 60596 - protein, 32 aa, Artificial Sequence
  Description of Artificial Sequence: Synthetic polypeptide
DEEEIRTTNPVATEQYGSFYPTNEQHDVNIRE

SEQ ID NO: 60597 - protein, 33 aa, Artificial Sequence
  Description of Artificial Sequence: Synthetic polypeptide
DEEEIRTTNPVATEQYGSFVSVNHIIRQGINTH

SEQ ID NO: 60598 - protein, 30 aa, Artificial Sequence
  Description of Artificial Sequence: Synthetic polypeptide
DGEEIATTNPVATEQWGSCTSTLDQDRGTR

SEQ ID NO: 60599 - protein, 30 aa, Artificial Sequence
  Description of Artificial Sequence: Synthetic polypeptide
DGEEIATTNPVATEQWGSVTWTEGDQRGTR

SEQ ID NO: 60600 - protein, 30 aa, Artificial Sequence
  Description of Artificial Sequence: Synthetic polypeptide
DGEEIATTNPVAYEQWGSVTSTLLQEGETR

SEQ ID NO: 60601 - protein, 30 aa, Artificial Sequence
  Description of Artificial Sequence: Synthetic polypeptide
DGEEIKTTNPVATEQWGSVTSTLLQGEGEH

SEQ ID NO: 60602 - protein, 31 aa, Artificial Sequence
  Description of Artificial Sequence: Synthetic polypeptide
DGEEIRTTNPVATEQWGCVTTTLLQRGDERQ

SEQ ID NO: 60603 - protein, 31 aa, Artificial Sequence
  Description of Artificial Sequence: Synthetic polypeptide
DGEEIRTTNPVATEQWGSCTTWLLQRGTQRM

SEQ ID NO: 60604 - protein, 30 aa, Artificial Sequence
  Description of Artificial Sequence: Synthetic polypeptide
DGEEIRTTNPVATEQWGSVTFTPLLQGMTR

SEQ ID NO: 60605 - protein, 31 aa, Artificial Sequence
  Description of Artificial Sequence: Synthetic polypeptide
DGEEIRTTNPVATEQWGSVTSTLLQGEGTAA

SEQ ID NO: 60606 - protein, 30 aa, Artificial Sequence
  Description of Artificial Sequence: Synthetic polypeptide
DGNEIRTTNPVATEQWGSLTSTLLQGEGTR

SEQ ID NO: 60607 - protein, 32 aa, Artificial Sequence
  Description of Artificial Sequence: Synthetic polypeptide
DNEEISTTNPVATTQYGSVSTPNPEVRTGNRG

SEQ ID NO: 60608 - protein, 31 aa, Artificial Sequence
  Description of Artificial Sequence: Synthetic polypeptide
DETEIRTTNPVAYEQYGTVSTTNNQDGEGSR

SEQ ID NO: 60609 - protein, 31 aa, Artificial Sequence
  Description of Artificial Sequence: Synthetic polypeptide
DETEIRTTNPVAYEQYGTVSTTGNDQDGGSR

SEQ ID NO: 60610 - protein, 32 aa, Artificial Sequence
  Description of Artificial Sequence: Synthetic polypeptide
DETEIRTTNPVAYEQYGTVSTNLQGDQGNNQS

SEQ ID NO: 60611 - protein, 31 aa, Artificial Sequence
  Description of Artificial Sequence: Synthetic polypeptide
DESEIRTTNPVATEQWGSVSCINEPMDRGNG

SEQ ID NO: 60612 - protein, 32 aa, Artificial Sequence
  Description of Artificial Sequence: Synthetic polypeptide
DESEIRTTNPVATEQWGSVSCINEPQREGENG

SEQ ID NO: 60613 - protein, 32 aa, Artificial Sequence
  Description of Artificial Sequence: Synthetic polypeptide
DESEIRTTNPVATEQWGSVSCINEQDREGENL

SEQ ID NO: 60614 - protein, 33 aa, Artificial Sequence
  Description of Artificial Sequence: Synthetic polypeptide
DESEIRTTNPVATEQWGSVSCINLPQDREGENG

SEQ ID NO: 60615 - protein, 32 aa, Artificial Sequence
  Description of Artificial Sequence: Synthetic polypeptide
DESEIRTTNPVATEQWGSVSCNEPQDREGENG

SEQ ID NO: 60616 - protein, 32 aa, Artificial Sequence
  Description of Artificial Sequence: Synthetic polypeptide
DESEIRTTNPVATEQWGSVSCNEPQNRAGENG

SEQ ID NO: 60617 - protein, 32 aa, Artificial Sequence
  Description of Artificial Sequence: Synthetic polypeptide
DESEIRTTNPVATEQWGSVSEINEPQDREGNG

SEQ ID NO: 60618 - protein, 32 aa, Artificial Sequence
  Description of Artificial Sequence: Synthetic polypeptide
DESEIRTTNPVATEQYGCVSAGNLQRGSDQQD

SEQ ID NO: 60619 - protein, 32 aa, Artificial Sequence
  Description of Artificial Sequence: Synthetic polypeptide
DESEIRTTNPVATEQYGCVSNTNLQNFGSEQS

SEQ ID NO: 60620 - protein, 32 aa, Artificial Sequence
  Description of Artificial Sequence: Synthetic polypeptide
DESEIRTTNPVATEQWGSVSACDLQDREGNDG

SEQ ID NO: 60621 - protein, 30 aa, Artificial Sequence
  Description of Artificial Sequence: Synthetic polypeptide
DESEIRTTNPVATEQYGCVSSVLNRESNQF

SEQ ID NO: 60622 - protein, 32 aa, Artificial Sequence
  Description of Artificial Sequence: Synthetic polypeptide
DESEIRTTNPVATEQYGDVSTLNLHIMGNEVE

SEQ ID NO: 60623 - protein, 32 aa, Artificial Sequence
  Description of Artificial Sequence: Synthetic polypeptide
DESEIRTTNPVATEQYGHVSTNDTQIRGEDVS

SEQ ID NO: 60624 - protein, 33 aa, Artificial Sequence
  Description of Artificial Sequence: Synthetic polypeptide
DESEIRTTNPVATEQYGHVSWTDLDNRQGMNER

SEQ ID NO: 60625 - protein, 33 aa, Artificial Sequence
  Description of Artificial Sequence: Synthetic polypeptide
DESEIRTTNPVATEQYGISVPSTNQSQGVGNLY

SEQ ID NO: 60626 - protein, 35 aa, Artificial Sequence
  Description of Artificial Sequence: Synthetic polypeptide
DESEIRTTNPVATEQYGKVPSCTGNLQRTGTANRS

SEQ ID NO: 60627 - protein, 31 aa, Artificial Sequence
  Description of Artificial Sequence: Synthetic polypeptide
DESEIRTTNPVATEQYGQTVSTNGSGFGGNE

SEQ ID NO: 60628 - protein, 34 aa, Artificial Sequence
  Description of Artificial Sequence: Synthetic polypeptide
DESEIRTTNPVATEQYGSTISTGNTSQREGGSNR

SEQ ID NO: 60629 - protein, 32 aa, Artificial Sequence
  Description of Artificial Sequence: Synthetic polypeptide
DESEIRTTNPVATEQYGSTVSATNHSGHGGNE

SEQ ID NO: 60630 - protein, 33 aa, Artificial Sequence
  Description of Artificial Sequence: Synthetic polypeptide
DESEIRTTNPVATEQYGSVASAVLTQAVGDNRQ

SEQ ID NO: 60631 - protein, 32 aa, Artificial Sequence
  Description of Artificial Sequence: Synthetic polypeptide
DESEIRTTNPVATEQYGCVSTNLQENFNSNQS

SEQ ID NO: 60632 - protein, 33 aa, Artificial Sequence
  Description of Artificial Sequence: Synthetic polypeptide
DESEIRTTNPVATEQYGSVASVDNLSVELGDNR

SEQ ID NO: 60633 - protein, 31 aa, Artificial Sequence
  Description of Artificial Sequence: Synthetic polypeptide
DESEIRTTNPVATEQWGSVSACDEQDREGNG

SEQ ID NO: 60634 - protein, 32 aa, Artificial Sequence
  Description of Artificial Sequence: Synthetic polypeptide
DESEIRTTNPVATEQWGSASCNLPQDREGENG

SEQ ID NO: 60635 - protein, 31 aa, Artificial Sequence
  Description of Artificial Sequence: Synthetic polypeptide
DESEIRTTNPVATECYGSVSCICEQDRGENG

SEQ ID NO: 60636 - protein, 31 aa, Artificial Sequence
  Description of Artificial Sequence: Synthetic polypeptide
DESEIRTTNPVATECYGSVSCICLQDHGENG

SEQ ID NO: 60637 - protein, 30 aa, Artificial Sequence
  Description of Artificial Sequence: Synthetic polypeptide
DESEIRTTNPVATECYGSVSCICLQHGEEG

SEQ ID NO: 60638 - protein, 32 aa, Artificial Sequence
  Description of Artificial Sequence: Synthetic polypeptide
DESEIRTTNPVATECYGSVSCINEPQDREGNG

SEQ ID NO: 60639 - protein, 33 aa, Artificial Sequence
  Description of Artificial Sequence: Synthetic polypeptide
DESEIRTTNPVATECYGSVSCINLPQDREGENG

SEQ ID NO: 60640 - protein, 33 aa, Artificial Sequence
  Description of Artificial Sequence: Synthetic polypeptide
DESEIRTTNPVATECYGSVSCINLPQDREGENQ

SEQ ID NO: 60641 - protein, 32 aa, Artificial Sequence
  Description of Artificial Sequence: Synthetic polypeptide
DESEIRTTNPVATECYGSVSCNEPQDREGENG

SEQ ID NO: 60642 - protein, 30 aa, Artificial Sequence
  Description of Artificial Sequence: Synthetic polypeptide
DESEIRTTNPVATECYGSVSSITEQHEGNG

SEQ ID NO: 60643 - protein, 30 aa, Artificial Sequence
  Description of Artificial Sequence: Synthetic polypeptide
DESEIRTTNPVATECYGSVSWNEMQDGDTA

SEQ ID NO: 60644 - protein, 32 aa, Artificial Sequence
  Description of Artificial Sequence: Synthetic polypeptide
DESEIRTTNPVATEQWGSVCSTINPPEREGNG

SEQ ID NO: 60645 - protein, 31 aa, Artificial Sequence
  Description of Artificial Sequence: Synthetic polypeptide
DESEIRTTNPVATECYGSVSWNEQDDHGTNA

SEQ ID NO: 60646 - protein, 32 aa, Artificial Sequence
  Description of Artificial Sequence: Synthetic polypeptide
DESEIRTTNPVATEEYGSTVSCSNLSQQGGNQ

SEQ ID NO: 60647 - protein, 31 aa, Artificial Sequence
  Description of Artificial Sequence: Synthetic polypeptide
DESEIRTTNPVATEGWGSVSCNEPQREGENG

SEQ ID NO: 60648 - protein, 32 aa, Artificial Sequence
  Description of Artificial Sequence: Synthetic polypeptide
DESEIRTTNPVATEGYGKTVSTNLSQSTGNNV

SEQ ID NO: 60649 - protein, 32 aa, Artificial Sequence
  Description of Artificial Sequence: Synthetic polypeptide
DESEIRTTNPVATEGYGSVSCINEQSRVGEQR

SEQ ID NO: 60650 - protein, 31 aa, Artificial Sequence
  Description of Artificial Sequence: Synthetic polypeptide
DESEIRTTNPVATEGYGVVSSNLPQDRGEDI

SEQ ID NO: 60651 - protein, 31 aa, Artificial Sequence
  Description of Artificial Sequence: Synthetic polypeptide
DESEIRTTNPVATEHYGSTVSTNQSGFGGNE

SEQ ID NO: 60652 - protein, 32 aa, Artificial Sequence
  Description of Artificial Sequence: Synthetic polypeptide
DESEIRTTNPVATEPYGMSVCFTNQTNRGGNR

SEQ ID NO: 60653 - protein, 31 aa, Artificial Sequence
  Description of Artificial Sequence: Synthetic polypeptide
DESEIRTTNPVATEPYGVVPSTTLSGRPGND

SEQ ID NO: 60654 - protein, 28 aa, Artificial Sequence
  Description of Artificial Sequence: Synthetic peptide
DESEIRTTNPVATEQWGDMSSTLQHGDA

SEQ ID NO: 60655 - protein, 30 aa, Artificial Sequence
  Description of Artificial Sequence: Synthetic polypeptide
DESEIRTTNPVATEEWGSVASDNLSQLDNK

SEQ ID NO: 60656 - protein, 33 aa, Artificial Sequence
  Description of Artificial Sequence: Synthetic polypeptide
DESEIRTTNPVATEQYGSVESTMNVVQTQTNAR

SEQ ID NO: 60657 - protein, 31 aa, Artificial Sequence
  Description of Artificial Sequence: Synthetic polypeptide
DESEIRTTNPVATEQYGSVMGNLFGNGNGGD

SEQ ID NO: 60658 - protein, 33 aa, Artificial Sequence
  Description of Artificial Sequence: Synthetic polypeptide
DESEIRTTNPVATEQYGSVNNTNLNEREEDNNR

SEQ ID NO: 60659 - protein, 32 aa, Artificial Sequence
  Description of Artificial Sequence: Synthetic polypeptide
DEEEIRTTNPVATEQYGSTVSTNHSGFGGDLE

SEQ ID NO: 60660 - protein, 32 aa, Artificial Sequence
  Description of Artificial Sequence: Synthetic polypeptide
DESEIRTTNPVATEYYGSVSYTTNLGAEGNVD

SEQ ID NO: 60661 - protein, 30 aa, Artificial Sequence
  Description of Artificial Sequence: Synthetic polypeptide
DESEIRTTNPVATKHYGSVSTLNDLTRTDM

SEQ ID NO: 60662 - protein, 29 aa, Artificial Sequence
  Description of Artificial Sequence: Synthetic peptide
DESEIRTTNPVATWHYGSVTTNQEVRTNN

SEQ ID NO: 60663 - protein, 33 aa, Artificial Sequence
  Description of Artificial Sequence: Synthetic polypeptide
DEEEIRTTNPVATEQYGSTVSTGNHSGEFGGNE

SEQ ID NO: 60664 - protein, 32 aa, Artificial Sequence
  Description of Artificial Sequence: Synthetic polypeptide
DESEIRTTNPVAYDHYGSTVPSTNLSQRTGNM

SEQ ID NO: 60665 - protein, 32 aa, Artificial Sequence
  Description of Artificial Sequence: Synthetic polypeptide
DESEIRTTNPVAYDHYGSVPSCTNALQRVGNM

SEQ ID NO: 60666 - protein, 31 aa, Artificial Sequence
  Description of Artificial Sequence: Synthetic polypeptide
DESEIRTTNPVAYDQYGKTVSTNLSERGDNP

SEQ ID NO: 60667 - protein, 31 aa, Artificial Sequence
  Description of Artificial Sequence: Synthetic polypeptide
DESEIRTTNPVAYDQYGSVNTGQLSQRGGND

SEQ ID NO: 60668 - protein, 33 aa, Artificial Sequence
  Description of Artificial Sequence: Synthetic polypeptide
DEEEIRTTNPVATEQYGSTVSTNHSGFGGNEEP

SEQ ID NO: 60669 - protein, 30 aa, Artificial Sequence
  Description of Artificial Sequence: Synthetic polypeptide
DESEIRTTNPVAYEEYGVVSTNLNGGDNGG

SEQ ID NO: 60670 - protein, 32 aa, Artificial Sequence
  Description of Artificial Sequence: Synthetic polypeptide
DESEIRTTNPVAYEQWGSVSTNLQGDQGGNSG

SEQ ID NO: 60671 - protein, 32 aa, Artificial Sequence
  Description of Artificial Sequence: Synthetic polypeptide
DESEIRTTNPVAYEQWGSVSTNLQGDTGGNNA

SEQ ID NO: 60672 - protein, 32 aa, Artificial Sequence
  Description of Artificial Sequence: Synthetic polypeptide
DESEIRTTNPVAYEQWGSVSTNLQNQGGNDDS

SEQ ID NO: 60673 - protein, 30 aa, Artificial Sequence
  Description of Artificial Sequence: Synthetic polypeptide
DESEIRTTNPVAYEQWGSVSTNNDEGNDDT

SEQ ID NO: 60674 - protein, 31 aa, Artificial Sequence
  Description of Artificial Sequence: Synthetic polypeptide
DESEIRTTNPVAYEQWGSVWSLDNMLQGDNR

SEQ ID NO: 60675 - protein, 31 aa, Artificial Sequence
  Description of Artificial Sequence: Synthetic polypeptide
DESEIRTTNPVAYEQWGTVSTNDGNQGGNTR

SEQ ID NO: 60676 - protein, 29 aa, Artificial Sequence
  Description of Artificial Sequence: Synthetic peptide
DESEIRTTNPVAYEQWGVCSTTLQRPNDA

SEQ ID NO: 60677 - protein, 32 aa, Artificial Sequence
  Description of Artificial Sequence: Synthetic polypeptide
DEEEIRTTNPVATEQYGSTVSCTNHSGHGDDE

SEQ ID NO: 60678 - protein, 32 aa, Artificial Sequence
  Description of Artificial Sequence: Synthetic polypeptide
DEEEIRTTNPVATEQYGSTVSCTNHSGFVDNI

SEQ ID NO: 60679 - protein, 32 aa, Artificial Sequence
  Description of Artificial Sequence: Synthetic polypeptide
DESEIRTTNPVAYEQWGSVSTNLEQGDGGNNN

SEQ ID NO: 60680 - protein, 32 aa, Artificial Sequence
  Description of Artificial Sequence: Synthetic polypeptide
DESEIRTTNPVATEQYGVVVTDLQRGAGNEDT

SEQ ID NO: 60681 - protein, 31 aa, Artificial Sequence
  Description of Artificial Sequence: Synthetic polypeptide
DESEIRTTNPVATEQYGVVVTDLQRGAGDDQ

SEQ ID NO: 60682 - protein, 32 aa, Artificial Sequence
  Description of Artificial Sequence: Synthetic polypeptide
DESEIRTTNPVATEQYGVVVTDLQREQGNEDQ

SEQ ID NO: 60683 - protein, 34 aa, Artificial Sequence
  Description of Artificial Sequence: Synthetic polypeptide
DESEIRTTNPVATEQYGSVQMTDNPLQEASGNRM

SEQ ID NO: 60684 - protein, 32 aa, Artificial Sequence
  Description of Artificial Sequence: Synthetic polypeptide
DESEIRTTNPVATEQYGSVSACDLEDREGNDG

SEQ ID NO: 60685 - protein, 30 aa, Artificial Sequence
  Description of Artificial Sequence: Synthetic polypeptide
DESEIRTTNPVATEQYGSVSCDEQDHEGEG

SEQ ID NO: 60686 - protein, 31 aa, Artificial Sequence
  Description of Artificial Sequence: Synthetic polypeptide
DESEIRTTNPVATEQYGSVSCDEQDREGEEG

SEQ ID NO: 60687 - protein, 32 aa, Artificial Sequence
  Description of Artificial Sequence: Synthetic polypeptide
DESEIRTTNPVATEQYGSVSCINEQDREGEEG

SEQ ID NO: 60688 - protein, 33 aa, Artificial Sequence
  Description of Artificial Sequence: Synthetic polypeptide
DESEIRTTNPVATEQYGSVSCINGPQMREGENG

SEQ ID NO: 60689 - protein, 31 aa, Artificial Sequence
  Description of Artificial Sequence: Synthetic polypeptide
DESEIRTTNPVATEQYGSVSEAPDGHRVDNR

SEQ ID NO: 60690 - protein, 31 aa, Artificial Sequence
  Description of Artificial Sequence: Synthetic polypeptide
DESEIRTTNPVATEQYGSVSPTDQQNFGDGQ

SEQ ID NO: 60691 - protein, 33 aa, Artificial Sequence
  Description of Artificial Sequence: Synthetic polypeptide
DESEIRTTNPVATEQYGSVSPTNLENFGDINQE

SEQ ID NO: 60692 - protein, 33 aa, Artificial Sequence
  Description of Artificial Sequence: Synthetic polypeptide
DESEIRTTNPVATEQYGSVSSLNLLHDGGNQRR

SEQ ID NO: 60693 - protein, 32 aa, Artificial Sequence
  Description of Artificial Sequence: Synthetic polypeptide
DESEIRTTNPVATEQYGSVSSYNDQPQHSGNI

SEQ ID NO: 60694 - protein, 33 aa, Artificial Sequence
  Description of Artificial Sequence: Synthetic polypeptide
DESEIRTTNPVATEQYGSVSTIAGPQMREGENG

SEQ ID NO: 60695 - protein, 33 aa, Artificial Sequence
  Description of Artificial Sequence: Synthetic polypeptide
DESEIRTTNPVATEQYGSVSTIAGPQMREGMNG

SEQ ID NO: 60696 - protein, 32 aa, Artificial Sequence
  Description of Artificial Sequence: Synthetic polypeptide
DESEIRTTNPVATEQYGSVSTVTNLEIRPSDE

SEQ ID NO: 60697 - protein, 31 aa, Artificial Sequence
  Description of Artificial Sequence: Synthetic polypeptide
DESEIRTTNPVATEQYGSVSYDNTETYGLNE

SEQ ID NO: 60698 - protein, 34 aa, Artificial Sequence
  Description of Artificial Sequence: Synthetic polypeptide
DESEIRTTNPVATEQYGSVVSYTGNISQHGGNRF

SEQ ID NO: 60699 - protein, 33 aa, Artificial Sequence
  Description of Artificial Sequence: Synthetic polypeptide
DESEIRTTNPVATEQYGSVWYTWNLNQSDINDR

SEQ ID NO: 60700 - protein, 31 aa, Artificial Sequence
  Description of Artificial Sequence: Synthetic polypeptide
DESEIRTTNPVATEQYGSVYAVLLQRGDQED

SEQ ID NO: 60701 - protein, 31 aa, Artificial Sequence
  Description of Artificial Sequence: Synthetic polypeptide
DESEIRTTNPVATEQYGTVYMDHNNNQRGER

SEQ ID NO: 60702 - protein, 32 aa, Artificial Sequence
  Description of Artificial Sequence: Synthetic polypeptide
DESEIRTTNPVATEQYGVVSTGDLQENGNGDD

SEQ ID NO: 60703 - protein, 33 aa, Artificial Sequence
  Description of Artificial Sequence: Synthetic polypeptide
DESEIRTTNPVATEQYGVVVSTDLQRGEDNGDD

SEQ ID NO: 60704 - protein, 32 aa, Artificial Sequence
  Description of Artificial Sequence: Synthetic polypeptide
DESEIRTTNPVATECYGEVSCINLPQDRGEGR

SEQ ID NO: 60705 - protein, 33 aa, Artificial Sequence
  Description of Artificial Sequence: Synthetic polypeptide
DESEIRTTNPVAYEQYGSISCTNATSQREGLNR

SEQ ID NO: 60706 - protein, 29 aa, Artificial Sequence
  Description of Artificial Sequence: Synthetic peptide
DESEIRTTNPVATECWGVVASITEQRGNG

SEQ ID NO: 60707 - protein, 29 aa, Artificial Sequence
  Description of Artificial Sequence: Synthetic peptide
DESEIRTTNPVATECWGVMASITLQRGNG

SEQ ID NO: 60708 - protein, 33 aa, Artificial Sequence
  Description of Artificial Sequence: Synthetic polypeptide
DESEICTTNPVATEQYGSVSTNLGQNEGGDNGD

SEQ ID NO: 60709 - protein, 31 aa, Artificial Sequence
  Description of Artificial Sequence: Synthetic polypeptide
DESEICTTNPVAYEQYGKVSCTNLSQAEGNG

SEQ ID NO: 60710 - protein, 31 aa, Artificial Sequence
  Description of Artificial Sequence: Synthetic polypeptide
DESEICTTNPVAYEQYGKVSCTNLSQAGEER

SEQ ID NO: 60711 - protein, 31 aa, Artificial Sequence
  Description of Artificial Sequence: Synthetic polypeptide
DESEICTVNPVATEQYGSVSTNELSTNEGNH

SEQ ID NO: 60712 - protein, 31 aa, Artificial Sequence
  Description of Artificial Sequence: Synthetic polypeptide
DESEICTVNPVATEQYGSVVSCTNELTEGNH

SEQ ID NO: 60713 - protein, 31 aa, Artificial Sequence
  Description of Artificial Sequence: Synthetic polypeptide
DESEICTVNPVATEQYGSVVSTNALSTEGNH

SEQ ID NO: 60714 - protein, 31 aa, Artificial Sequence
  Description of Artificial Sequence: Synthetic polypeptide
DESEIKTTNPVATEQYGTVLITNEDQLGGNR

SEQ ID NO: 60715 - protein, 30 aa, Artificial Sequence
  Description of Artificial Sequence: Synthetic polypeptide
DESEIRCTNPIATECYGSVSEINLPMRGNG

SEQ ID NO: 60716 - protein, 29 aa, Artificial Sequence
  Description of Artificial Sequence: Synthetic peptide
DESEIRCTNPVATECYGEVSEINEQRGGG

SEQ ID NO: 60717 - protein, 33 aa, Artificial Sequence
  Description of Artificial Sequence: Synthetic polypeptide
DESEICTTNPVATEQYGSVSTGNGLGQDSGNNA

SEQ ID NO: 60718 - protein, 31 aa, Artificial Sequence
  Description of Artificial Sequence: Synthetic polypeptide
DESEIRCTNPVATEQWGEASCNLPQREGENR

SEQ ID NO: 60719 - protein, 29 aa, Artificial Sequence
  Description of Artificial Sequence: Synthetic peptide
DESEIRCTNPVATEQYGNVANNIMSRGQR

SEQ ID NO: 60720 - protein, 29 aa, Artificial Sequence
  Description of Artificial Sequence: Synthetic peptide
DESEIRCTNPVATEQYGNVANTIMSRGQR

SEQ ID NO: 60721 - protein, 31 aa, Artificial Sequence
  Description of Artificial Sequence: Synthetic polypeptide
DESEIRPTNPVATEQWGSVSCNEQDREGENG

SEQ ID NO: 60722 - protein, 30 aa, Artificial Sequence
  Description of Artificial Sequence: Synthetic polypeptide
DESEIRSTNPIATEQYGSVAAETIQRVGNR

SEQ ID NO: 60723 - protein, 31 aa, Artificial Sequence
  Description of Artificial Sequence: Synthetic polypeptide
DESEIRSTNPVATECYGSVSCNEQDREGENG

SEQ ID NO: 60724 - protein, 31 aa, Artificial Sequence
  Description of Artificial Sequence: Synthetic polypeptide
DESEIRSTNPVATEGYGSVSCNEQDREGENG

SEQ ID NO: 60725 - protein, 30 aa, Artificial Sequence
  Description of Artificial Sequence: Synthetic polypeptide
DESEIRSTNPVATEGYGSVSCTEQDRGENG

SEQ ID NO: 60726 - protein, 30 aa, Artificial Sequence
  Description of Artificial Sequence: Synthetic polypeptide
DESEIRSTNPVATEQWGVVSDINLQDSGNQ

SEQ ID NO: 60727 - protein, 33 aa, Artificial Sequence
  Description of Artificial Sequence: Synthetic polypeptide
DESEIRSTNPVATEQYGSVSTSALPQMRNGMNI

SEQ ID NO: 60728 - protein, 31 aa, Artificial Sequence
  Description of Artificial Sequence: Synthetic polypeptide
DESEIRCTNPVATEQWGSVSEINLPMRGENG

SEQ ID NO: 60729 - protein, 31 aa, Artificial Sequence
  Description of Artificial Sequence: Synthetic polypeptide
DESEIRSTNPVCTEQWGSVSCINLPQDRGNG

SEQ ID NO: 60730 - protein, 33 aa, Artificial Sequence
  Description of Artificial Sequence: Synthetic polypeptide
DESEICTTNPVATEQYGSVSASINLQDRNPNDR

SEQ ID NO: 60731 - protein, 31 aa, Artificial Sequence
  Description of Artificial Sequence: Synthetic polypeptide
DESEICTTNPVATEPYGSVSTGNGQDSGNQD

SEQ ID NO: 60732 - protein, 31 aa, Artificial Sequence
  Description of Artificial Sequence: Synthetic polypeptide
DESEIATTNPVAYEQWGSVSTNLQAQGDNDS

SEQ ID NO: 60733 - protein, 31 aa, Artificial Sequence
  Description of Artificial Sequence: Synthetic polypeptide
DESEIATTNPVAYEQWGSVSTNLQGDAGNDE

SEQ ID NO: 60734 - protein, 31 aa, Artificial Sequence
  Description of Artificial Sequence: Synthetic polypeptide
DESEIATTNPVAYEQYGSTVSCTNLSMYGNT

SEQ ID NO: 60735 - protein, 32 aa, Artificial Sequence
  Description of Artificial Sequence: Synthetic polypeptide
DESEIATTNPVAYEQYGSVAATNLQRGDNLEM

SEQ ID NO: 60736 - protein, 31 aa, Artificial Sequence
  Description of Artificial Sequence: Synthetic polypeptide
DESEIATTNPVAYEQYGSVAATNLQVGNDTD

SEQ ID NO: 60737 - protein, 31 aa, Artificial Sequence
  Description of Artificial Sequence: Synthetic polypeptide
DESEIATTNPVAYEQYGSVAITNLQVGDNDQ

SEQ ID NO: 60738 - protein, 30 aa, Artificial Sequence
  Description of Artificial Sequence: Synthetic polypeptide
DESEIATTNPVAYEQYGSVATNLQDPQNDN

SEQ ID NO: 60739 - protein, 32 aa, Artificial Sequence
  Description of Artificial Sequence: Synthetic polypeptide
DESEIATTNPVAYEQYGSVSTQNGSQEGGNRF

SEQ ID NO: 60740 - protein, 30 aa, Artificial Sequence
  Description of Artificial Sequence: Synthetic polypeptide
DESEIATTNPVGTEQYGSVSTSAGNRGMNI

SEQ ID NO: 60741 - protein, 31 aa, Artificial Sequence
  Description of Artificial Sequence: Synthetic polypeptide
DESEICTTNPVATEQWGSVATNLQHAGNNAW

SEQ ID NO: 60742 - protein, 32 aa, Artificial Sequence
  Description of Artificial Sequence: Synthetic polypeptide
DESEIATTNPVSTEQYGSVATNLQRDGDGTND

SEQ ID NO: 60743 - protein, 32 aa, Artificial Sequence
  Description of Artificial Sequence: Synthetic polypeptide
DEEEIRTTNPVATEQYGSVAAPTNDQTRNPSD

SEQ ID NO: 60744 - protein, 31 aa, Artificial Sequence
  Description of Artificial Sequence: Synthetic polypeptide
DEEEIRTTNPVATEQYGSVAANNDTDAGGNQ

SEQ ID NO: 60745 - protein, 30 aa, Artificial Sequence
  Description of Artificial Sequence: Synthetic polypeptide
DESEIATVNPVATEQYGVVSDNLQDSEGNQ

SEQ ID NO: 60746 - protein, 31 aa, Artificial Sequence
  Description of Artificial Sequence: Synthetic polypeptide
DESEICTTNPAATEQYGSVPTNLQHMGNGGT

SEQ ID NO: 60747 - protein, 29 aa, Artificial Sequence
  Description of Artificial Sequence: Synthetic peptide
DESEICTTNPVATAHWGSVSTNLQHTNNM

SEQ ID NO: 60748 - protein, 32 aa, Artificial Sequence
  Description of Artificial Sequence: Synthetic polypeptide
DESEICTTNPVATEHYGSVSTNGGQDTGGNER

SEQ ID NO: 60749 - protein, 31 aa, Artificial Sequence
  Description of Artificial Sequence: Synthetic polypeptide
DESEICTTNPVATEPYGSVSAANLDQQGNEM

SEQ ID NO: 60750 - protein, 32 aa, Artificial Sequence
  Description of Artificial Sequence: Synthetic polypeptide
DESEICTTNPVATEPYGSVSTGNGLGQDSGNA

SEQ ID NO: 60751 - protein, 31 aa, Artificial Sequence
  Description of Artificial Sequence: Synthetic polypeptide
DESEICTTNPVATEPYGSVSTGNGQDSGGNE

SEQ ID NO: 60752 - protein, 31 aa, Artificial Sequence
  Description of Artificial Sequence: Synthetic polypeptide
DESEIATTNPVSTEQYGSVSANDLQDHEGER

SEQ ID NO: 60753 - protein, 30 aa, Artificial Sequence
  Description of Artificial Sequence: Synthetic polypeptide
DESEIRSTNPVCTEQWGVVSDNLPQRGENG

SEQ ID NO: 60754 - protein, 28 aa, Artificial Sequence
  Description of Artificial Sequence: Synthetic peptide
DESEIRSTNPVGTECYGSVASTLQHGDI

SEQ ID NO: 60755 - protein, 29 aa, Artificial Sequence
  Description of Artificial Sequence: Synthetic peptide
DESEIRTTNPAATEQYGSVPTDLANGQGE

SEQ ID NO: 60756 - protein, 31 aa, Artificial Sequence
  Description of Artificial Sequence: Synthetic polypeptide
DESEIRTTNPVATECWGSVSCINEQDRGENG

SEQ ID NO: 60757 - protein, 30 aa, Artificial Sequence
  Description of Artificial Sequence: Synthetic polypeptide
DESEIRTTNPVATECWGSVSCINEQDRGGG

SEQ ID NO: 60758 - protein, 30 aa, Artificial Sequence
  Description of Artificial Sequence: Synthetic polypeptide
DESEIRTTNPVATECWGSVSCINEQREENL

SEQ ID NO: 60759 - protein, 33 aa, Artificial Sequence
  Description of Artificial Sequence: Synthetic polypeptide
DESEIRTTNPVATECWGSVSCINLPQDREGENR

SEQ ID NO: 60760 - protein, 32 aa, Artificial Sequence
  Description of Artificial Sequence: Synthetic polypeptide
DESEIRTTNPVATECWGSVSCINLPQDRGENG

SEQ ID NO: 60761 - protein, 33 aa, Artificial Sequence
  Description of Artificial Sequence: Synthetic polypeptide
DEEEIRTTNPVATEQYGSTVSTVPAQELVTNYR

SEQ ID NO: 60762 - protein, 32 aa, Artificial Sequence
  Description of Artificial Sequence: Synthetic polypeptide
DESEIRTTNPVATECWGSVSCINLQDREGENG

SEQ ID NO: 60763 - protein, 30 aa, Artificial Sequence
  Description of Artificial Sequence: Synthetic polypeptide
DESEIRTTNPVATECWGSVSCNEPQDHGNL

SEQ ID NO: 60764 - protein, 32 aa, Artificial Sequence
  Description of Artificial Sequence: Synthetic polypeptide
DESEIRTTNPVATECWGSVSCNEPQDREGENR

SEQ ID NO: 60765 - protein, 32 aa, Artificial Sequence
  Description of Artificial Sequence: Synthetic polypeptide
DESEIRTTNPVATECWGSVSCINEQDREGENR

SEQ ID NO: 60766 - protein, 31 aa, Artificial Sequence
  Description of Artificial Sequence: Synthetic polypeptide
DESEIRTTNPVATECWGSVSCNEPQDREGNG

SEQ ID NO: 60767 - protein, 30 aa, Artificial Sequence
  Description of Artificial Sequence: Synthetic polypeptide
DESEIRTTNPVATECWGSVSEIEQDRAGNA

SEQ ID NO: 60768 - protein, 31 aa, Artificial Sequence
  Description of Artificial Sequence: Synthetic polypeptide
DESEIRTTNPVATECWGSVSEINEQDRAGNA

SEQ ID NO: 60769 - protein, 31 aa, Artificial Sequence
  Description of Artificial Sequence: Synthetic polypeptide
DESEIRTTNPVATECWGSVSEINEQDRAGNG

SEQ ID NO: 60770 - protein, 32 aa, Artificial Sequence
  Description of Artificial Sequence: Synthetic polypeptide
DESEIRTTNPVATECWGSVSEINEQDREGENR

SEQ ID NO: 60771 - protein, 30 aa, Artificial Sequence
  Description of Artificial Sequence: Synthetic polypeptide
DESEIRTTNPVATECWGSVSENEQHEGENG

SEQ ID NO: 60772 - protein, 32 aa, Artificial Sequence
  Description of Artificial Sequence: Synthetic polypeptide
DESEIRTTNPVATECWGSVSNINEPQDREGNR

SEQ ID NO: 60773 - protein, 31 aa, Artificial Sequence
  Description of Artificial Sequence: Synthetic polypeptide
DESEIRTTNPVATECWGSVSTDNEPEREGNG

SEQ ID NO: 60774 - protein, 32 aa, Artificial Sequence
  Description of Artificial Sequence: Synthetic polypeptide
DESEIRTTNPVATECWGSVSTDNEPQREGENG

SEQ ID NO: 60775 - protein, 32 aa, Artificial Sequence
  Description of Artificial Sequence: Synthetic polypeptide
DESEIRTTNPVATECWGSVSTNEPQDREGENG

SEQ ID NO: 60776 - protein, 31 aa, Artificial Sequence
  Description of Artificial Sequence: Synthetic polypeptide
DESEIRTTNPVATECWGSVSCNEPQREGENG

SEQ ID NO: 60777 - protein, 31 aa, Artificial Sequence
  Description of Artificial Sequence: Synthetic polypeptide
DESEIRTTNPVATECWGSVSCINEPQRGENG

SEQ ID NO: 60778 - protein, 31 aa, Artificial Sequence
  Description of Artificial Sequence: Synthetic polypeptide
DESEIRTTNPVATECWGSVSCINEPQREGNG

SEQ ID NO: 60779 - protein, 31 aa, Artificial Sequence
  Description of Artificial Sequence: Synthetic polypeptide
DESEIRTTNPVATECWGSVSCINEPQDRGNG

SEQ ID NO: 60780 - protein, 33 aa, Artificial Sequence
  Description of Artificial Sequence: Synthetic polypeptide
DESEIRTTNPIAYEQYGSVVSTNALSQRPGNNQ

SEQ ID NO: 60781 - protein, 29 aa, Artificial Sequence
  Description of Artificial Sequence: Synthetic peptide
DESEIRTTNPVAIKHYGSVSTNQSERTNN

SEQ ID NO: 60782 - protein, 30 aa, Artificial Sequence
  Description of Artificial Sequence: Synthetic polypeptide
DESEIRTTNPVASECWGSVSCINEQREGNG

SEQ ID NO: 60783 - protein, 30 aa, Artificial Sequence
  Description of Artificial Sequence: Synthetic polypeptide
DESEIRTTNPVATCHYGCVSTNLQEGTSDQ

SEQ ID NO: 60784 - protein, 31 aa, Artificial Sequence
  Description of Artificial Sequence: Synthetic polypeptide
DESEIRTTNPVATCHYGCVSTNLQERTSNNQ

SEQ ID NO: 60785 - protein, 30 aa, Artificial Sequence
  Description of Artificial Sequence: Synthetic polypeptide
DESEIRTTNPVATCHYGCVSTNLQHTSNAG

SEQ ID NO: 60786 - protein, 31 aa, Artificial Sequence
  Description of Artificial Sequence: Synthetic polypeptide
DESEIRTTNPVATCHYGSVCSTNLQFTSNQA

SEQ ID NO: 60787 - protein, 31 aa, Artificial Sequence
  Description of Artificial Sequence: Synthetic polypeptide
DESEIRTTNPVATDAYGSVSTNGQGQTGNGD

SEQ ID NO: 60788 - protein, 32 aa, Artificial Sequence
  Description of Artificial Sequence: Synthetic polypeptide
DESEIRTTNPVATDHYGSTVSTNLSQSAVGNM

SEQ ID NO: 60789 - protein, 32 aa, Artificial Sequence
  Description of Artificial Sequence: Synthetic polypeptide
DESEIRTTNPVATDHYGSVPSCTNLSQRVTNM

SEQ ID NO: 60790 - protein, 32 aa, Artificial Sequence
  Description of Artificial Sequence: Synthetic polypeptide
DESEIRTTNPVATDQYGSVNPTGLQRGGNIDQ

SEQ ID NO: 60791 - protein, 31 aa, Artificial Sequence
  Description of Artificial Sequence: Synthetic polypeptide
DESEIRTTNPVATDQYGSVNTGLQRFGGGGD

SEQ ID NO: 60792 - protein, 32 aa, Artificial Sequence
  Description of Artificial Sequence: Synthetic polypeptide
DESEIRTTNPVATDQYGSVNTGLQRVGGNIDE

SEQ ID NO: 60793 - protein, 32 aa, Artificial Sequence
  Description of Artificial Sequence: Synthetic polypeptide
DESEIRTTNPVATDQYGSVVNTGLQREGGNID

SEQ ID NO: 60794 - protein, 31 aa, Artificial Sequence
  Description of Artificial Sequence: Synthetic polypeptide
DESEIRTTNPVATDSYGSVSTDLQRMTINEM

SEQ ID NO: 60795 - protein, 31 aa, Artificial Sequence
  Description of Artificial Sequence: Synthetic polypeptide
DESEIRTTNPVATDSYGSVSTENGQGTGNGD

SEQ ID NO: 60796 - protein, 33 aa, Artificial Sequence
  Description of Artificial Sequence: Synthetic polypeptide
DESEIRTTNPVATEAYGSVCSTTNILSAIGNTR

SEQ ID NO: 60797 - protein, 34 aa, Artificial Sequence
  Description of Artificial Sequence: Synthetic polypeptide
DESEIRTTNPVATEAYGSVSTDNNQSGRGGMNRR

SEQ ID NO: 60798 - protein, 29 aa, Artificial Sequence
  Description of Artificial Sequence: Synthetic peptide
DESEIRTTNPVATECWGEVSCINEQRGGG

SEQ ID NO: 60799 - protein, 32 aa, Artificial Sequence
  Description of Artificial Sequence: Synthetic polypeptide
DESEIRTTNPVATECWGSVSCINEPQDREGNR

SEQ ID NO: 60800 - protein, 32 aa, Artificial Sequence
  Description of Artificial Sequence: Synthetic polypeptide
DESEIRTTNPVATECWGSVSCINEPQDRGENR

SEQ ID NO: 60801 - protein, 30 aa, Artificial Sequence
  Description of Artificial Sequence: Synthetic polypeptide
DESEIRTTNPVATECWGVVASINEQREGNG

SEQ ID NO: 60802 - protein, 34 aa, Artificial Sequence
  Description of Artificial Sequence: Synthetic polypeptide
DEEEIRTTNPVATEQYGSCSTTNLITDRNIENER

SEQ ID NO: 60803 - protein, 32 aa, Artificial Sequence
  Description of Artificial Sequence: Synthetic polypeptide
DESEIRTTNPVAYEQYGSISCTNDSQREVLNR

SEQ ID NO: 60804 - protein, 35 aa, Artificial Sequence
  Description of Artificial Sequence: Synthetic polypeptide
DEEEIRTTNPVATEQYGSTVSCTGNMLQQSGGNPG

SEQ ID NO: 60805 - protein, 31 aa, Artificial Sequence
  Description of Artificial Sequence: Synthetic polypeptide
DETEIRTTNPVATDQYGSVNTMQLQRQGGDE

SEQ ID NO: 60806 - protein, 31 aa, Artificial Sequence
  Description of Artificial Sequence: Synthetic polypeptide
DETEIRTTNPVATDQYGSVNTMQVQRQGQND

SEQ ID NO: 60807 - protein, 31 aa, Artificial Sequence
  Description of Artificial Sequence: Synthetic polypeptide
DETEIRTTNPVATECWGSVSCINEQDREGNG

SEQ ID NO: 60808 - protein, 34 aa, Artificial Sequence
  Description of Artificial Sequence: Synthetic polypeptide
DEEEIRTTNPVATEQYGSTPSATENIWQRIGERE

SEQ ID NO: 60809 - protein, 34 aa, Artificial Sequence
  Description of Artificial Sequence: Synthetic polypeptide
DETEIRTTNPVATECYGSVSTTDNGLDQRGENQD

SEQ ID NO: 60810 - protein, 33 aa, Artificial Sequence
  Description of Artificial Sequence: Synthetic polypeptide
DETEIRTTNPVATECYGSVSTTGNDNDQRGNQD

SEQ ID NO: 60811 - protein, 33 aa, Artificial Sequence
  Description of Artificial Sequence: Synthetic polypeptide
DETEIRTTNPVATECYGSVSTTNDEDQRGNGQD

SEQ ID NO: 60812 - protein, 32 aa, Artificial Sequence
  Description of Artificial Sequence: Synthetic polypeptide
DETEIRTTNPVATECYGSVSTTNGDQDQGNQD

SEQ ID NO: 60813 - protein, 33 aa, Artificial Sequence
  Description of Artificial Sequence: Synthetic polypeptide
DETEIRTTNPVATECYGSVSTTNGDQRDGGNQD

SEQ ID NO: 60814 - protein, 30 aa, Artificial Sequence
  Description of Artificial Sequence: Synthetic polypeptide
DETEIRTTNPVATDQYGSVNLLQLQRQAND

SEQ ID NO: 60815 - protein, 33 aa, Artificial Sequence
  Description of Artificial Sequence: Synthetic polypeptide
DETEIRTTNPVATECYGSVSTTNGGDQRGGNQD

SEQ ID NO: 60816 - protein, 32 aa, Artificial Sequence
  Description of Artificial Sequence: Synthetic polypeptide
DETEIRTTNPVATEFYGSVVFTNLIRGGNGNI

SEQ ID NO: 60817 - protein, 34 aa, Artificial Sequence
  Description of Artificial Sequence: Synthetic polypeptide
DEEEIRTTNPVATEQYGSTCSMTENLNQGIGSNV

SEQ ID NO: 60818 - protein, 33 aa, Artificial Sequence
  Description of Artificial Sequence: Synthetic polypeptide
DEEEIRTTNPVATEQYGSTCSMTEELSQFIGNQ

SEQ ID NO: 60819 - protein, 32 aa, Artificial Sequence
  Description of Artificial Sequence: Synthetic polypeptide
DETEIRTTNPVATEMWGSVSTNLQGQNGENED

SEQ ID NO: 60820 - protein, 31 aa, Artificial Sequence
  Description of Artificial Sequence: Synthetic polypeptide
DETEIRTTNPVATENYGSVVNTTVLYEGGNR

SEQ ID NO: 60821 - protein, 32 aa, Artificial Sequence
  Description of Artificial Sequence: Synthetic polypeptide
DETEIRTTNPVATEQYGAVSTTDGNQGGGNAR

SEQ ID NO: 60822 - protein, 33 aa, Artificial Sequence
  Description of Artificial Sequence: Synthetic polypeptide
DEEEIRTTNPVATEQYGSTCAMTENLEARDGER

SEQ ID NO: 60823 - protein, 35 aa, Artificial Sequence
  Description of Artificial Sequence: Synthetic polypeptide
DEEEIRTTNPVATEQYGSTASCTENHSQRTGGNNR

SEQ ID NO: 60824 - protein, 31 aa, Artificial Sequence
  Description of Artificial Sequence: Synthetic polypeptide
DETEIRTTNPVATEQYGSVATNPGQNNGDDA

SEQ ID NO: 60825 - protein, 33 aa, Artificial Sequence
  Description of Artificial Sequence: Synthetic polypeptide
DETEIRTTNPVATECYGSVSTTNLDGDRGGNQD

SEQ ID NO: 60826 - protein, 31 aa, Artificial Sequence
  Description of Artificial Sequence: Synthetic polypeptide
DETEIRTTNPVATEQYGSVCTPDYQEGGDND

SEQ ID NO: 60827 - protein, 31 aa, Artificial Sequence
  Description of Artificial Sequence: Synthetic polypeptide
DETEIRTTNPVATDQYGSVCNTQLQRQAAND

SEQ ID NO: 60828 - protein, 31 aa, Artificial Sequence
  Description of Artificial Sequence: Synthetic polypeptide
DETEICTTNPVAYEQYGTVSTNLQSNGNGDA

SEQ ID NO: 60829 - protein, 30 aa, Artificial Sequence
  Description of Artificial Sequence: Synthetic polypeptide
DETEIATTNPVAYERWGSVSTNLQDGNGDS

SEQ ID NO: 60830 - protein, 30 aa, Artificial Sequence
  Description of Artificial Sequence: Synthetic polypeptide
DETEIATTNPVAYETWGSVSTNLQMGGDNH

SEQ ID NO: 60831 - protein, 31 aa, Artificial Sequence
  Description of Artificial Sequence: Synthetic polypeptide
DETEICTTNPVATECYGSVSTNLNGNAGNDD

SEQ ID NO: 60832 - protein, 32 aa, Artificial Sequence
  Description of Artificial Sequence: Synthetic polypeptide
DETEICTTNPVATEQYGSVSTNLNGENGGDND

SEQ ID NO: 60833 - protein, 32 aa, Artificial Sequence
  Description of Artificial Sequence: Synthetic polypeptide
DETEICTTNPVATEQYGSVSTNLNGNAGNTDD

SEQ ID NO: 60834 - protein, 32 aa, Artificial Sequence
  Description of Artificial Sequence: Synthetic polypeptide
DETEICTTNPVATEQYGSVSTNLNGNDGDNQD

SEQ ID NO: 60835 - protein, 34 aa, Artificial Sequence
  Description of Artificial Sequence: Synthetic polypeptide
DEEEIRTTNPVATEQYGSTSMTENLSQTIENQRE

SEQ ID NO: 60836 - protein, 32 aa, Artificial Sequence
  Description of Artificial Sequence: Synthetic polypeptide
DETEICTTNPVATEQYGSVSTNLNGNEGNNDN

SEQ ID NO: 60837 - protein, 32 aa, Artificial Sequence
  Description of Artificial Sequence: Synthetic polypeptide
DETEICTTNPVATEQYGSVSTNLNGNMGQNDT

SEQ ID NO: 60838 - protein, 30 aa, Artificial Sequence
  Description of Artificial Sequence: Synthetic polypeptide
DETEIRCTNPIATEQWGSVWSENLAERGPR

SEQ ID NO: 60839 - protein, 32 aa, Artificial Sequence
  Description of Artificial Sequence: Synthetic polypeptide
DETEICTTNPVATEQYGSVSTNLQGNMGQGDQ

SEQ ID NO: 60840 - protein, 31 aa, Artificial Sequence
  Description of Artificial Sequence: Synthetic polypeptide
DETEICTTNPVAYEQWGSVSTNLQGNDGDTR

SEQ ID NO: 60841 - protein, 34 aa, Artificial Sequence
  Description of Artificial Sequence: Synthetic polypeptide
DEEEIRTTNPVATEQYGSTSMTENLNQGIGSNQG

SEQ ID NO: 60842 - protein, 31 aa, Artificial Sequence
  Description of Artificial Sequence: Synthetic polypeptide
DETEICTTNPVAYEQYGKVSCTNLSPAGTNR

SEQ ID NO: 60843 - protein, 32 aa, Artificial Sequence
  Description of Artificial Sequence: Synthetic polypeptide
DETEICTTNPVAYEQYGSVSTGNLQPPDGNAN

SEQ ID NO: 60844 - protein, 31 aa, Artificial Sequence
  Description of Artificial Sequence: Synthetic polypeptide
DETEICTTNPVAYEQYGSVSTNLGGNSGNDQ

SEQ ID NO: 60845 - protein, 32 aa, Artificial Sequence
  Description of Artificial Sequence: Synthetic polypeptide
DETEICTTNPVAYEQYGSVSTNLNGNDGDNDR

SEQ ID NO: 60846 - protein, 34 aa, Artificial Sequence
  Description of Artificial Sequence: Synthetic polypeptide
DEEEIRTTNPVATEQYGSTSMTENELSQTIENNR

SEQ ID NO: 60847 - protein, 31 aa, Artificial Sequence
  Description of Artificial Sequence: Synthetic polypeptide
DETEICTTNPVAYEQYGTVSTNLQGDTGNQS

SEQ ID NO: 60848 - protein, 35 aa, Artificial Sequence
  Description of Artificial Sequence: Synthetic polypeptide
DEEEIRTTNPVATEQYGSTSMTENAPSQRIGNQRP

SEQ ID NO: 60849 - protein, 31 aa, Artificial Sequence
  Description of Artificial Sequence: Synthetic polypeptide
DETEICTTNPVAYEQWGSVSTGNLQGDGMER

SEQ ID NO: 60850 - protein, 31 aa, Artificial Sequence
  Description of Artificial Sequence: Synthetic polypeptide
DETEIRTTNPVATEQYGSVQTGLIRGMGGQT

SEQ ID NO: 60851 - protein, 32 aa, Artificial Sequence
  Description of Artificial Sequence: Synthetic polypeptide
DETEIRTTNPVATEQYGSVRTNMHREINDVRQ

SEQ ID NO: 60852 - protein, 31 aa, Artificial Sequence
  Description of Artificial Sequence: Synthetic polypeptide
DETEIRTTNPVATEQYGSVSPANLEQVMVTV

SEQ ID NO: 60853 - protein, 31 aa, Artificial Sequence
  Description of Artificial Sequence: Synthetic polypeptide
DETEIRTTNPVAYEQWGSVSTNLNGGANDEQ

SEQ ID NO: 60854 - protein, 30 aa, Artificial Sequence
  Description of Artificial Sequence: Synthetic polypeptide
DETEIRTTNPVAYEQWGSVSTNLNGGEGDM

SEQ ID NO: 60855 - protein, 32 aa, Artificial Sequence
  Description of Artificial Sequence: Synthetic polypeptide
DETEIRTTNPVAYEQWGSVSTNLQHDNGGMQR

SEQ ID NO: 60856 - protein, 33 aa, Artificial Sequence
  Description of Artificial Sequence: Synthetic polypeptide
DETEIRTTNPVAYEQWGSVSTNLQLGDRGGEGR

SEQ ID NO: 60857 - protein, 32 aa, Artificial Sequence
  Description of Artificial Sequence: Synthetic polypeptide
DETEIRTTNPVAYEQWGSVSTNLQNGLGNDDS

SEQ ID NO: 60858 - protein, 31 aa, Artificial Sequence
  Description of Artificial Sequence: Synthetic polypeptide
DETEIRTTNPVAYEQWGSVSTNPQGEGGEGR

SEQ ID NO: 60859 - protein, 31 aa, Artificial Sequence
  Description of Artificial Sequence: Synthetic polypeptide
DETEIRTTNPVAYEQWGSVSTNPQGQMGEGR

SEQ ID NO: 60860 - protein, 32 aa, Artificial Sequence
  Description of Artificial Sequence: Synthetic polypeptide
DETEIRTTNPVAYEQWGSVSTNQQGDRGGEGR

SEQ ID NO: 60861 - protein, 32 aa, Artificial Sequence
  Description of Artificial Sequence: Synthetic polypeptide
DETEIRTTNPVAYEQWGSVSTTNDGQNGGNTR

SEQ ID NO: 60862 - protein, 31 aa, Artificial Sequence
  Description of Artificial Sequence: Synthetic polypeptide
DETEIRTTNPVAYEQWGSVSTNLNGEDNDER

SEQ ID NO: 60863 - protein, 30 aa, Artificial Sequence
  Description of Artificial Sequence: Synthetic polypeptide
DETEIRTTNPVAYEQWGTVSTNLNGGNLDA

SEQ ID NO: 60864 - protein, 31 aa, Artificial Sequence
  Description of Artificial Sequence: Synthetic polypeptide
DETEIRTTNPVAYEQWGTVSTNLQANGNGDM

SEQ ID NO: 60865 - protein, 31 aa, Artificial Sequence
  Description of Artificial Sequence: Synthetic polypeptide
DETEIRTTNPVAYEQWGTVSTNLQHDGGNQE

SEQ ID NO: 60866 - protein, 31 aa, Artificial Sequence
  Description of Artificial Sequence: Synthetic polypeptide
DETEIRTTNPVAYEQWGTVSTNLQLGGDDDR

SEQ ID NO: 60867 - protein, 31 aa, Artificial Sequence
  Description of Artificial Sequence: Synthetic polypeptide
DETEIRTTNPVAYEQWGTVSTNLQPDGGNTQ

SEQ ID NO: 60868 - protein, 32 aa, Artificial Sequence
  Description of Artificial Sequence: Synthetic polypeptide
DETEIRTTNPVAYEQYGNVSTGNLDQHNGNQS

SEQ ID NO: 60869 - protein, 31 aa, Artificial Sequence
  Description of Artificial Sequence: Synthetic polypeptide
DETEIRTTNPVAYEQYGTVATNLQGDGNTQS

SEQ ID NO: 60870 - protein, 31 aa, Artificial Sequence
  Description of Artificial Sequence: Synthetic polypeptide
DETEIRTTNPVAYEQYGTVATNLQGNGNGDA

SEQ ID NO: 60871 - protein, 31 aa, Artificial Sequence
  Description of Artificial Sequence: Synthetic polypeptide
DETEIRTTNPVAYEQYGTVSTDTGNQGGNSR

SEQ ID NO: 60872 - protein, 32 aa, Artificial Sequence
  Description of Artificial Sequence: Synthetic polypeptide
DETEIRTTNPVAYEQYGTVSTNLQGANGNGDQ

SEQ ID NO: 60873 - protein, 31 aa, Artificial Sequence
  Description of Artificial Sequence: Synthetic polypeptide
DETEIRTTNPVAYEQWGTVSTNLQADGNNSQ

SEQ ID NO: 60874 - protein, 30 aa, Artificial Sequence
  Description of Artificial Sequence: Synthetic polypeptide
DETEIRTTNPVAYEQWGSVSTNLNGDNNNM

SEQ ID NO: 60875 - protein, 30 aa, Artificial Sequence
  Description of Artificial Sequence: Synthetic polypeptide
DETEIRTTNPVAYEQWGSVSTNINGGNEDM

SEQ ID NO: 60876 - protein, 30 aa, Artificial Sequence
  Description of Artificial Sequence: Synthetic polypeptide
DETEIRTTNPVAYEQWGSVSTNANGGNGMM

SEQ ID NO: 60877 - protein, 31 aa, Artificial Sequence
  Description of Artificial Sequence: Synthetic polypeptide
DEEEIRTTNPVATEQYGSSSTYGNQEGDGVF

SEQ ID NO: 60878 - protein, 31 aa, Artificial Sequence
  Description of Artificial Sequence: Synthetic polypeptide
DEEEIRTTNPVATEQYGSSSTVDDRGEQEHT

SEQ ID NO: 60879 - protein, 32 aa, Artificial Sequence
  Description of Artificial Sequence: Synthetic polypeptide
DEEEIRTTNPVATEQYGSSSTNNALDNESNQE

SEQ ID NO: 60880 - protein, 31 aa, Artificial Sequence
  Description of Artificial Sequence: Synthetic polypeptide
DETEIRTTNPVATEQYGTVSTTDNQGNGESR

SEQ ID NO: 60881 - protein, 32 aa, Artificial Sequence
  Description of Artificial Sequence: Synthetic polypeptide
DETEIRTTNPVATESYGSVSTNLMETIGEARD

SEQ ID NO: 60882 - protein, 31 aa, Artificial Sequence
  Description of Artificial Sequence: Synthetic polypeptide
DETEIRTTNPVATQQYGTVSTNNLTVGVNTP

SEQ ID NO: 60883 - protein, 33 aa, Artificial Sequence
  Description of Artificial Sequence: Synthetic polypeptide
DEEEIRTTNPVATEQYGSSSTNIDPQRGGEDGQ

SEQ ID NO: 60884 - protein, 31 aa, Artificial Sequence
  Description of Artificial Sequence: Synthetic polypeptide
DETEIRTTNPVAVEQYGSISTTNLERELPRQ

SEQ ID NO: 60885 - protein, 31 aa, Artificial Sequence
  Description of Artificial Sequence: Synthetic polypeptide
DETEIRTTNPVAVEQYGSVIITNGLGGGNNG

SEQ ID NO: 60886 - protein, 32 aa, Artificial Sequence
  Description of Artificial Sequence: Synthetic polypeptide
DETEIRTTNPVAVEQYGSVISTNGGERGNNQG

SEQ ID NO: 60887 - protein, 32 aa, Artificial Sequence
  Description of Artificial Sequence: Synthetic polypeptide
DETEIRTTNPVAVEQYGSVISTNGLEGGNNEG

SEQ ID NO: 60888 - protein, 32 aa, Artificial Sequence
  Description of Artificial Sequence: Synthetic polypeptide
DETEIRTTNPVAVEQYGSVISTNGQERNQGEG

SEQ ID NO: 60889 - protein, 31 aa, Artificial Sequence
  Description of Artificial Sequence: Synthetic polypeptide
DEEEIRTTNPVATEQYGSSMSSGGLTRVNQQ

SEQ ID NO: 60890 - protein, 33 aa, Artificial Sequence
  Description of Artificial Sequence: Synthetic polypeptide
DETEIRTTNPVAVEQYGSVISTNNGLQEGGNNG

SEQ ID NO: 60891 - protein, 30 aa, Artificial Sequence
  Description of Artificial Sequence: Synthetic polypeptide
DETEIRTTNPVAYEAWGVVTTNLQMGDGNR

SEQ ID NO: 60892 - protein, 32 aa, Artificial Sequence
  Description of Artificial Sequence: Synthetic polypeptide
DEEEIRTTNPVATEQYGSSCSSPNMLQSFDNQ

SEQ ID NO: 60893 - protein, 30 aa, Artificial Sequence
  Description of Artificial Sequence: Synthetic polypeptide
DETEIRTTNPVAYEQWGEVSTNLNGGNLNM

SEQ ID NO: 60894 - protein, 30 aa, Artificial Sequence
  Description of Artificial Sequence: Synthetic polypeptide
DETEIRTTNPVAYEQWGNVSTNLQGDGGQS

SEQ ID NO: 60895 - protein, 30 aa, Artificial Sequence
  Description of Artificial Sequence: Synthetic polypeptide
DETEIRTTNPVAYEQWGSVATNLNGGNDEM

SEQ ID NO: 60896 - protein, 32 aa, Artificial Sequence
  Description of Artificial Sequence: Synthetic polypeptide
DETEIRTTNPVAYEQWGSVSTANPGQDGMGNR

SEQ ID NO: 60897 - protein, 31 aa, Artificial Sequence
  Description of Artificial Sequence: Synthetic polypeptide
DETEIRTTNPVAYEQWGSVSTDNLNDSGNFG

SEQ ID NO: 60898 - protein, 30 aa, Artificial Sequence
  Description of Artificial Sequence: Synthetic polypeptide
DETEIATTNPVAYEQYGTVTTNLQGQGDDR

SEQ ID NO: 60899 - protein, 32 aa, Artificial Sequence
  Description of Artificial Sequence: Synthetic polypeptide
DESEIRTTNPVAYEQYGSVSINSLSFDVGNNR

SEQ ID NO: 60900 - protein, 29 aa, Artificial Sequence
  Description of Artificial Sequence: Synthetic peptide
DETEIATTNPVAYEQYGTVSTTEQGGDSR

SEQ ID NO: 60901 - protein, 33 aa, Artificial Sequence
  Description of Artificial Sequence: Synthetic polypeptide
DETEIATTNPVAYEQYGSVSTPNGLGQGDGNKR

SEQ ID NO: 60902 - protein, 33 aa, Artificial Sequence
  Description of Artificial Sequence: Synthetic polypeptide
DEEEIRTTNPVATEQYGSTVPNTAELSTRTVNR

SEQ ID NO: 60903 - protein, 29 aa, Artificial Sequence
  Description of Artificial Sequence: Synthetic peptide
DESSIRTTNPTAYEQWGSVSFNDQSGQNR

SEQ ID NO: 60904 - protein, 31 aa, Artificial Sequence
  Description of Artificial Sequence: Synthetic polypeptide
DESSVIATTNPVATEQWGSVSTDDLQRGNDF

SEQ ID NO: 60905 - protein, 30 aa, Artificial Sequence
  Description of Artificial Sequence: Synthetic polypeptide
DESTICTTNPVATEQWGSVSTDELQAGNNM

SEQ ID NO: 60906 - protein, 30 aa, Artificial Sequence
  Description of Artificial Sequence: Synthetic polypeptide
DESTICTTNPVATEQWGSVSTDLLEQNGNM

SEQ ID NO: 60907 - protein, 30 aa, Artificial Sequence
  Description of Artificial Sequence: Synthetic polypeptide
DESTICTTNPVATEQWGSVSTDLLQEGNMD

SEQ ID NO: 60908 - protein, 30 aa, Artificial Sequence
  Description of Artificial Sequence: Synthetic polypeptide
DESTICTTNPVATEQWGSVSTDLLQTNGNM

SEQ ID NO: 60909 - protein, 30 aa, Artificial Sequence
  Description of Artificial Sequence: Synthetic polypeptide
DESTICTTNPVATEQWGSVSTDVLQQGTNM

SEQ ID NO: 60910 - protein, 31 aa, Artificial Sequence
  Description of Artificial Sequence: Synthetic polypeptide
DESTIRTTNPVATEQYGCVETNDGDQRGNGD

SEQ ID NO: 60911 - protein, 31 aa, Artificial Sequence
  Description of Artificial Sequence: Synthetic polypeptide
DESSIRTTNPLATEQWGSVSFNLSQSTGGNR

SEQ ID NO: 60912 - protein, 31 aa, Artificial Sequence
  Description of Artificial Sequence: Synthetic polypeptide
DESTIRTTNPVATEQYGCVETNGDQRGNGDG

SEQ ID NO: 60913 - protein, 31 aa, Artificial Sequence
  Description of Artificial Sequence: Synthetic polypeptide
DESTIRTTNPVATEQYGCVETTNGDQRGNGQ

SEQ ID NO: 60914 - protein, 34 aa, Artificial Sequence
  Description of Artificial Sequence: Synthetic polypeptide
DEEEIRTTNPVATEQYGSTVFCTTGLSQRTGGMR

SEQ ID NO: 60915 - protein, 30 aa, Artificial Sequence
  Description of Artificial Sequence: Synthetic polypeptide
DESVIATTNPVATEPYSEEVSTNLQFGNSR

SEQ ID NO: 60916 - protein, 29 aa, Artificial Sequence
  Description of Artificial Sequence: Synthetic peptide
DESVIATTNPVATEPYSEEVSTNQQNGNR

SEQ ID NO: 60917 - protein, 29 aa, Artificial Sequence
  Description of Artificial Sequence: Synthetic peptide
DESVIATTNPVATGHYGSVSTNLQRDTDM

SEQ ID NO: 60918 - protein, 31 aa, Artificial Sequence
  Description of Artificial Sequence: Synthetic polypeptide
DESVIATTNPVAYEQDGSVVSTDELQRGTNR

SEQ ID NO: 60919 - protein, 33 aa, Artificial Sequence
  Description of Artificial Sequence: Synthetic polypeptide
DEEEIRTTNPVATEQYGSTVASTGLSTHGGNND

SEQ ID NO: 60920 - protein, 28 aa, Artificial Sequence
  Description of Artificial Sequence: Synthetic peptide
DESVIRTTNPVAYEQWGCVETNPGNGNR

SEQ ID NO: 60921 - protein, 29 aa, Artificial Sequence
  Description of Artificial Sequence: Synthetic peptide
DESVIRTTNPVAYEQWGCVYETNPQTGNR

SEQ ID NO: 60922 - protein, 32 aa, Artificial Sequence
  Description of Artificial Sequence: Synthetic polypeptide
DESTIRTTNPVATEQYGCVETNNGPEQRGNTR

SEQ ID NO: 60923 - protein, 31 aa, Artificial Sequence
  Description of Artificial Sequence: Synthetic polypeptide
DESVIRTTNPVAYEQYGCVACTNEPSQRGNR

SEQ ID NO: 60924 - protein, 28 aa, Artificial Sequence
  Description of Artificial Sequence: Synthetic peptide
DESSIATTNPTAYEQWGSVSHNDQSGNR

SEQ ID NO: 60925 - protein, 31 aa, Artificial Sequence
  Description of Artificial Sequence: Synthetic polypeptide
DESHIATTNPVATEQYGAVCSTNLQFIGNGV

SEQ ID NO: 60926 - protein, 32 aa, Artificial Sequence
  Description of Artificial Sequence: Synthetic polypeptide
DESEIRTTNPVAYEQYGTVSTNGGNQGEGNAR

SEQ ID NO: 60927 - protein, 34 aa, Artificial Sequence
  Description of Artificial Sequence: Synthetic polypeptide
DEEEIRTTNPVATEQYGSTVSCTFLSIDPGGNNR

SEQ ID NO: 60928 - protein, 32 aa, Artificial Sequence
  Description of Artificial Sequence: Synthetic polypeptide
DESEIRTTNPVAYEQYGTVSTNNGNQGGMGNR

SEQ ID NO: 60929 - protein, 32 aa, Artificial Sequence
  Description of Artificial Sequence: Synthetic polypeptide
DESEIRTTNPVAYEQYGTVSWTELDNRGMNTR

SEQ ID NO: 60930 - protein, 33 aa, Artificial Sequence
  Description of Artificial Sequence: Synthetic polypeptide
DEEEIRTTNPVATEQYGSTVSCEGNDSHRTVNR

SEQ ID NO: 60931 - protein, 31 aa, Artificial Sequence
  Description of Artificial Sequence: Synthetic polypeptide
DESEIRTTNPVAYQQYGKVPSTNLSERGNNP

SEQ ID NO: 60932 - protein, 31 aa, Artificial Sequence
  Description of Artificial Sequence: Synthetic polypeptide
DESEIRTTNPVAYQQYGKVSCTNALSERGNP

SEQ ID NO: 60933 - protein, 29 aa, Artificial Sequence
  Description of Artificial Sequence: Synthetic peptide
DESEIRTTNPVCTECWGVVSCINLQSGNQ

SEQ ID NO: 60934 - protein, 29 aa, Artificial Sequence
  Description of Artificial Sequence: Synthetic peptide
DESEIRTTNPVCTECWGVVSDINLQSGNQ

SEQ ID NO: 60935 - protein, 32 aa, Artificial Sequence
  Description of Artificial Sequence: Synthetic polypeptide
DESKIRTTNPVATEQYGSTVFTNIQPTGGNRC

SEQ ID NO: 60936 - protein, 31 aa, Artificial Sequence
  Description of Artificial Sequence: Synthetic polypeptide
DESEIRTTNPVGTECWGSVSSINLQDRGENG

SEQ ID NO: 60937 - protein, 30 aa, Artificial Sequence
  Description of Artificial Sequence: Synthetic polypeptide
DESEIRTTNPVGTECYGSVSSITLQHEGNI

SEQ ID NO: 60938 - protein, 28 aa, Artificial Sequence
  Description of Artificial Sequence: Synthetic peptide
DESEIRTTNPVGTEGYGTIASTLQHGNH

SEQ ID NO: 60939 - protein, 28 aa, Artificial Sequence
  Description of Artificial Sequence: Synthetic peptide
DESEIRTTNPVGTEGYGVMSSTLQRGDI

SEQ ID NO: 60940 - protein, 28 aa, Artificial Sequence
  Description of Artificial Sequence: Synthetic peptide
DESEIRTTNPVSTEGYGTIASTLQHGNH

SEQ ID NO: 60941 - protein, 32 aa, Artificial Sequence
  Description of Artificial Sequence: Synthetic polypeptide
DESEIRTTNPVSTEQYGNVSTTTGQSRNGNPR

SEQ ID NO: 60942 - protein, 33 aa, Artificial Sequence
  Description of Artificial Sequence: Synthetic polypeptide
DEEEIRTTNPVATEQYGSTVPSTNHSGHKGGNE

SEQ ID NO: 60943 - protein, 33 aa, Artificial Sequence
  Description of Artificial Sequence: Synthetic polypeptide
DEEEIRTTNPVATEQYGSTVPSTNHSGFGGNEW

SEQ ID NO: 60944 - protein, 29 aa, Artificial Sequence
  Description of Artificial Sequence: Synthetic peptide
DESEVACTNPISTEGYGSVSANNLQRGNR

SEQ ID NO: 60945 - protein, 29 aa, Artificial Sequence
  Description of Artificial Sequence: Synthetic peptide
DESEVASTNPVATEQYGNASENLQSRGGR

SEQ ID NO: 60946 - protein, 30 aa, Artificial Sequence
  Description of Artificial Sequence: Synthetic polypeptide
DESEIRTTNPVGTECYGSVSSITLQHEGNG

SEQ ID NO: 60947 - protein, 32 aa, Artificial Sequence
  Description of Artificial Sequence: Synthetic polypeptide
DESVISTTNPVATEQDGSVPSTDELSQRGGNR

SEQ ID NO: 60948 - protein, 31 aa, Artificial Sequence
  Description of Artificial Sequence: Synthetic polypeptide
DETAEIASTNPVAYEQYGSVATNDQRGNDRL

SEQ ID NO: 60949 - protein, 30 aa, Artificial Sequence
  Description of Artificial Sequence: Synthetic polypeptide
DETAEIASTNPVAYEQYGSVATNDQRGNDS

SEQ ID NO: 60950 - protein, 31 aa, Artificial Sequence
  Description of Artificial Sequence: Synthetic polypeptide
DETEIATTNPVATEQYGCVATNLQRDNNTEQ

SEQ ID NO: 60951 - protein, 30 aa, Artificial Sequence
  Description of Artificial Sequence: Synthetic polypeptide
DETEIATTNPVATEQYGSVAMNLQDQNNEE

SEQ ID NO: 60952 - protein, 31 aa, Artificial Sequence
  Description of Artificial Sequence: Synthetic polypeptide
DETEIATTNPVATEQYGSVATALPQRNPNEQ

SEQ ID NO: 60953 - protein, 32 aa, Artificial Sequence
  Description of Artificial Sequence: Synthetic polypeptide
DETEIATTNPVATEQYGSVSTNLNGNDGPNDA

SEQ ID NO: 60954 - protein, 30 aa, Artificial Sequence
  Description of Artificial Sequence: Synthetic polypeptide
DETEIATTNPVATEQYGTVSTTNQGDGMSR

SEQ ID NO: 60955 - protein, 30 aa, Artificial Sequence
  Description of Artificial Sequence: Synthetic polypeptide
DETEIATTNPVATEQYGTVSWNELMDGNTQ

SEQ ID NO: 60956 - protein, 31 aa, Artificial Sequence
  Description of Artificial Sequence: Synthetic polypeptide
DETEIATTNPVATETWGSVSTNLQQSGGDNH

SEQ ID NO: 60957 - protein, 31 aa, Artificial Sequence
  Description of Artificial Sequence: Synthetic polypeptide
DETEIATTNPVATETYGCVSTNLQSNGGDNH

SEQ ID NO: 60958 - protein, 31 aa, Artificial Sequence
  Description of Artificial Sequence: Synthetic polypeptide
DETEIATTNPVATEVWGSVSTNLQVDGGNNH

SEQ ID NO: 60959 - protein, 31 aa, Artificial Sequence
  Description of Artificial Sequence: Synthetic polypeptide
DETEIATTNPVATEQWGSVSENLTNPGNSRD

SEQ ID NO: 60960 - protein, 32 aa, Artificial Sequence
  Description of Artificial Sequence: Synthetic polypeptide
DETEIATTNPVATEVYGSVSTNLQGDLGNNGS

SEQ ID NO: 60961 - protein, 31 aa, Artificial Sequence
  Description of Artificial Sequence: Synthetic polypeptide
DETEIATTNPVAYEHYGEVSTNPQRGGENDR

SEQ ID NO: 60962 - protein, 32 aa, Artificial Sequence
  Description of Artificial Sequence: Synthetic polypeptide
DETEIATTNPVAYEPYGSVSTNLSQRGGNQSA

SEQ ID NO: 60963 - protein, 30 aa, Artificial Sequence
  Description of Artificial Sequence: Synthetic polypeptide
DETEIATTNPVAYEQWGSVSTNLNGGNAQM

SEQ ID NO: 60964 - protein, 30 aa, Artificial Sequence
  Description of Artificial Sequence: Synthetic polypeptide
DETEIATTNPVAYEQWGSVSTNLNGGNDDA

SEQ ID NO: 60965 - protein, 31 aa, Artificial Sequence
  Description of Artificial Sequence: Synthetic polypeptide
DETEIATTNPVAYEQWGSVSTNLQGDLGNEE

SEQ ID NO: 60966 - protein, 31 aa, Artificial Sequence
  Description of Artificial Sequence: Synthetic polypeptide
DETEIATTNPVAYEQWGSVSTNLQHDGGNST

SEQ ID NO: 60967 - protein, 31 aa, Artificial Sequence
  Description of Artificial Sequence: Synthetic polypeptide
DETEIATTNPVAYEQWGSVSTPNLGQGDGND

SEQ ID NO: 60968 - protein, 31 aa, Artificial Sequence
  Description of Artificial Sequence: Synthetic polypeptide
DETEIATTNPVAYEQWGSVSTTNGGQDNGNR

SEQ ID NO: 60969 - protein, 31 aa, Artificial Sequence
  Description of Artificial Sequence: Synthetic polypeptide
DETEIATTNPVAYEQYGSVSTNNGQDGDNSD

SEQ ID NO: 60970 - protein, 31 aa, Artificial Sequence
  Description of Artificial Sequence: Synthetic polypeptide
DETEIATTNPVAYDQYGVVSCTALSQRGGNR

SEQ ID NO: 60971 - protein, 32 aa, Artificial Sequence
  Description of Artificial Sequence: Synthetic polypeptide
DETEIATTNPVATEQWGSVSATANLQSDGNHE

SEQ ID NO: 60972 - protein, 32 aa, Artificial Sequence
  Description of Artificial Sequence: Synthetic polypeptide
DETEIATTNPVATEPYGSVSTNLNQGDLGNGS

SEQ ID NO: 60973 - protein, 31 aa, Artificial Sequence
  Description of Artificial Sequence: Synthetic polypeptide
DETEIATTNPVATEIYGSVSTNLNGEGQNEQ

SEQ ID NO: 60974 - protein, 30 aa, Artificial Sequence
  Description of Artificial Sequence: Synthetic polypeptide
DETAEIATTNPVAYEQYGSVATNDQRENEN

SEQ ID NO: 60975 - protein, 31 aa, Artificial Sequence
  Description of Artificial Sequence: Synthetic polypeptide
DETAEIATTNPVAYEQYGSVATNDQRGNDLQ

SEQ ID NO: 60976 - protein, 30 aa, Artificial Sequence
  Description of Artificial Sequence: Synthetic polypeptide
DETAEIATTNPVAYEQYGSVATNLQSGDPV

SEQ ID NO: 60977 - protein, 29 aa, Artificial Sequence
  Description of Artificial Sequence: Synthetic peptide
DETAIRTTNPLATEHFGEVCSENLQSGNR

SEQ ID NO: 60978 - protein, 30 aa, Artificial Sequence
  Description of Artificial Sequence: Synthetic polypeptide
DETAIRTTNPLATEQFGSVSWNLQSGSNAS

SEQ ID NO: 60979 - protein, 28 aa, Artificial Sequence
  Description of Artificial Sequence: Synthetic peptide
DETAIRTTNPLATEQFGSVVFNEQSGQR

SEQ ID NO: 60980 - protein, 30 aa, Artificial Sequence
  Description of Artificial Sequence: Synthetic polypeptide
DETAIRTTNPVATEQYGSFCSTNHIIGSNQ

SEQ ID NO: 60981 - protein, 31 aa, Artificial Sequence
  Description of Artificial Sequence: Synthetic polypeptide
DETCIRTTNPLATEQFGSVSCINLSQSGGNR

SEQ ID NO: 60982 - protein, 29 aa, Artificial Sequence
  Description of Artificial Sequence: Synthetic peptide
DETCIRTTNPLATEQFGSVSFNLQEGEKN

SEQ ID NO: 60983 - protein, 30 aa, Artificial Sequence
  Description of Artificial Sequence: Synthetic polypeptide
DETCIRTTNPLATEQFGSVSWNTQSFGSNR

SEQ ID NO: 60984 - protein, 31 aa, Artificial Sequence
  Description of Artificial Sequence: Synthetic polypeptide
DETCIRTTNPLATEQWGSVSCFNLSQSGNNR

SEQ ID NO: 60985 - protein, 29 aa, Artificial Sequence
  Description of Artificial Sequence: Synthetic peptide
DETCIRTTNPTAYEQWGSVSFNDQSGNNR

SEQ ID NO: 60986 - protein, 28 aa, Artificial Sequence
  Description of Artificial Sequence: Synthetic peptide
DETDIRTTNPCATEQWGSVSVTEVSGNR

SEQ ID NO: 60987 - protein, 30 aa, Artificial Sequence
  Description of Artificial Sequence: Synthetic polypeptide
DETEIACTNPVATEPYGSVATNLQQGNDTA

SEQ ID NO: 60988 - protein, 28 aa, Artificial Sequence
  Description of Artificial Sequence: Synthetic peptide
DETEIACTNPVATEQWGETAENLQRGGR

SEQ ID NO: 60989 - protein, 30 aa, Artificial Sequence
  Description of Artificial Sequence: Synthetic polypeptide
DETEIACTNPVATEQYGSVATNLQADNNPN

SEQ ID NO: 60990 - protein, 30 aa, Artificial Sequence
  Description of Artificial Sequence: Synthetic polypeptide
DETEIACTNPVATEQYGSVATNLQDAGEGQ

SEQ ID NO: 60991 - protein, 32 aa, Artificial Sequence
  Description of Artificial Sequence: Synthetic polypeptide
DETEIACTNPVATEQYGSVATNLQDRPGNDEI

SEQ ID NO: 60992 - protein, 31 aa, Artificial Sequence
  Description of Artificial Sequence: Synthetic polypeptide
DETEIACTNPVATEQYGSVATNLQNIGNEGV

SEQ ID NO: 60993 - protein, 31 aa, Artificial Sequence
  Description of Artificial Sequence: Synthetic polypeptide
DETEIACTNPVATEQYGSVSTNLQPGDTPEE

SEQ ID NO: 60994 - protein, 32 aa, Artificial Sequence
  Description of Artificial Sequence: Synthetic polypeptide
DETEIATTNPVATECYGSVAATNLDQDRGNQM

SEQ ID NO: 60995 - protein, 31 aa, Artificial Sequence
  Description of Artificial Sequence: Synthetic polypeptide
DETEIATTNPVAYEQYGTVSTNLQHDGGNTI

SEQ ID NO: 60996 - protein, 31 aa, Artificial Sequence
  Description of Artificial Sequence: Synthetic polypeptide
DESEIATTNPVATHHWGSTVSTNLSQRVGNM

SEQ ID NO: 60997 - protein, 33 aa, Artificial Sequence
  Description of Artificial Sequence: Synthetic polypeptide
DEEEIRTTNPVATEQYGSCSTTMLDDRNIENER

SEQ ID NO: 60998 - protein, 33 aa, Artificial Sequence
  Description of Artificial Sequence: Synthetic polypeptide
DSEEIRSTNPVAYEQYGSTVSTNELQARTGGQR

SEQ ID NO: 60999 - protein, 31 aa, Artificial Sequence
  Description of Artificial Sequence: Synthetic polypeptide
MEEEIRTTNPVATEQWGSVCIQTILENGNFR

SEQ ID NO: 61000 - protein, 32 aa, Artificial Sequence
  Description of Artificial Sequence: Synthetic polypeptide
MEEEIRTTNPVATEQYGCVCSMTNHQNGSNQS

SEQ ID NO: 61001 - protein, 31 aa, Artificial Sequence
  Description of Artificial Sequence: Synthetic polypeptide
MEEEIRTTNPVATEQYGCVSTENHQNGSEQS

SEQ ID NO: 61002 - protein, 32 aa, Artificial Sequence
  Description of Artificial Sequence: Synthetic polypeptide
MEEEIRTTNPVATEQYGGVSITTTILENGNFR

SEQ ID NO: 61003 - protein, 32 aa, Artificial Sequence
  Description of Artificial Sequence: Synthetic polypeptide
MEEEIRTTNPVATEQYGSCSPTNLETQPGEQF

SEQ ID NO: 61004 - protein, 31 aa, Artificial Sequence
  Description of Artificial Sequence: Synthetic polypeptide
MEEEIRTTNPVATEQYGSVATTILWENGSMR

SEQ ID NO: 61005 - protein, 33 aa, Artificial Sequence
  Description of Artificial Sequence: Synthetic polypeptide
DEEEIRTTNPVATEQYGQVSTMELNQEGGGNIT

SEQ ID NO: 61006 - protein, 33 aa, Artificial Sequence
  Description of Artificial Sequence: Synthetic polypeptide
MEEEIRTTNPVATEQYGSVNTSNQLLQNGENYY

SEQ ID NO: 61007 - protein, 33 aa, Artificial Sequence
  Description of Artificial Sequence: Synthetic polypeptide
DEEEIRTTNPVATEQYGQVSGTGLQELGQINYD

SEQ ID NO: 61008 - protein, 32 aa, Artificial Sequence
  Description of Artificial Sequence: Synthetic polypeptide
MEEEIRTTNPVATEIYGQSSSTENNQERGENQ

SEQ ID NO: 61009 - protein, 34 aa, Artificial Sequence
  Description of Artificial Sequence: Synthetic polypeptide
MEEEIRTTNPVATEQYGSVSPTYLQPRMGELANL

SEQ ID NO: 61010 - protein, 33 aa, Artificial Sequence
  Description of Artificial Sequence: Synthetic polypeptide
DEEEIRTTNPVATEQYGQVSCTNEVSQSGSNKD

SEQ ID NO: 61011 - protein, 32 aa, Artificial Sequence
  Description of Artificial Sequence: Synthetic polypeptide
MEEEIRTTNPVATEQYGSVSTNDNTDELGENF

SEQ ID NO: 61012 - protein, 31 aa, Artificial Sequence
  Description of Artificial Sequence: Synthetic polypeptide
DEEEIRTTNPVATEQYGQVMSTYPLQNNITQ

SEQ ID NO: 61013 - protein, 33 aa, Artificial Sequence
  Description of Artificial Sequence: Synthetic polypeptide
MEEEIRTTNPVATEQYGSVSTTSLPQSTNPTNR

SEQ ID NO: 61014 - protein, 31 aa, Artificial Sequence
  Description of Artificial Sequence: Synthetic polypeptide
MEEEIRTTNPVATEQYGSYSNTNNDQSQNNY

SEQ ID NO: 61015 - protein, 35 aa, Artificial Sequence
  Description of Artificial Sequence: Synthetic polypeptide
DEEEIRTTNPVATEQYGQTVPSCTNMQSQRGTNRM

SEQ ID NO: 61016 - protein, 34 aa, Artificial Sequence
  Description of Artificial Sequence: Synthetic polypeptide
DEEEIRTTNPVATEQYGQTSCSTGNPLQRFNSNQ

SEQ ID NO: 61017 - protein, 29 aa, Artificial Sequence
  Description of Artificial Sequence: Synthetic peptide
MEEEIRTTNPVATESYGSVATTWTENGFR

SEQ ID NO: 61018 - protein, 33 aa, Artificial Sequence
  Description of Artificial Sequence: Synthetic polypeptide
MEEEIRTTNPVATEYYGSVSVENELSQDRGGQR

SEQ ID NO: 61019 - protein, 34 aa, Artificial Sequence
  Description of Artificial Sequence: Synthetic polypeptide
MEEEIRTTNPVATEQYGSVSTMNLGVGGQQTGNV

SEQ ID NO: 61020 - protein, 31 aa, Artificial Sequence
  Description of Artificial Sequence: Synthetic polypeptide
MEEEIRTTNPVATFQYGSVATTILENGNFRT

SEQ ID NO: 61021 - protein, 29 aa, Artificial Sequence
  Description of Artificial Sequence: Synthetic peptide
MEEEIRTTNPVATAQYGAVATTWLENGFR

SEQ ID NO: 61022 - protein, 31 aa, Artificial Sequence
  Description of Artificial Sequence: Synthetic polypeptide
MEEEIRCTNPAATEQYGSVSIENMLMREGNG

SEQ ID NO: 61023 - protein, 29 aa, Artificial Sequence
  Description of Artificial Sequence: Synthetic peptide
MEEEIASVNPVCTEQYGVVSTDNLQTGNQ

SEQ ID NO: 61024 - protein, 30 aa, Artificial Sequence
  Description of Artificial Sequence: Synthetic polypeptide
MEEEIATTNPVATEQYGCVAATHLQSDNRN

SEQ ID NO: 61025 - protein, 30 aa, Artificial Sequence
  Description of Artificial Sequence: Synthetic polypeptide
MEEEIATTNPVATEQYGCVAATMLQGDNDR

SEQ ID NO: 61026 - protein, 31 aa, Artificial Sequence
  Description of Artificial Sequence: Synthetic polypeptide
MEEEIATTNPVATEQYGCVSVTELQGGSNNA

SEQ ID NO: 61027 - protein, 31 aa, Artificial Sequence
  Description of Artificial Sequence: Synthetic polypeptide
MEEEIATTNPVATEQYGCVSVTELQGGSNVA

SEQ ID NO: 61028 - protein, 32 aa, Artificial Sequence
  Description of Artificial Sequence: Synthetic polypeptide
DEEEIRTTNPVATEQYGQVVSTEDQNFGSNQE

SEQ ID NO: 61029 - protein, 33 aa, Artificial Sequence
  Description of Artificial Sequence: Synthetic polypeptide
MEEEIATTNPVATEQYGNVSHTMNDAQRGNGNR

SEQ ID NO: 61030 - protein, 32 aa, Artificial Sequence
  Description of Artificial Sequence: Synthetic polypeptide
MEEEIATTNPVATEQYGNVSHTMNDQQGGGNR

SEQ ID NO: 61031 - protein, 32 aa, Artificial Sequence
  Description of Artificial Sequence: Synthetic polypeptide
MEEEIATTNPVATEQYGNVSVTGMGLQGDGNR

SEQ ID NO: 61032 - protein, 31 aa, Artificial Sequence
  Description of Artificial Sequence: Synthetic polypeptide
MEEEIRTTNCVATEQYGSVVSSTNDNNHGNN

SEQ ID NO: 61033 - protein, 32 aa, Artificial Sequence
  Description of Artificial Sequence: Synthetic polypeptide
MEEEIATTNPVATEQYGNVSVTNMDQGNGNER

SEQ ID NO: 61034 - protein, 31 aa, Artificial Sequence
  Description of Artificial Sequence: Synthetic polypeptide
MEEEIGTTNPVATEQYGCVCSVTELQGGNQL

SEQ ID NO: 61035 - protein, 31 aa, Artificial Sequence
  Description of Artificial Sequence: Synthetic polypeptide
MEEEIGTTNPVATEQYGCVSVTALQGGSNQM

SEQ ID NO: 61036 - protein, 30 aa, Artificial Sequence
  Description of Artificial Sequence: Synthetic polypeptide
MEEEIGTTNPVATEQYGMVSVTMLVQGDNG

SEQ ID NO: 61037 - protein, 30 aa, Artificial Sequence
  Description of Artificial Sequence: Synthetic polypeptide
MEEEIKTTNPVATEQYGQVSVTGGQGGGNE

SEQ ID NO: 61038 - protein, 30 aa, Artificial Sequence
  Description of Artificial Sequence: Synthetic polypeptide
MEEEIMTTNPVATEQYGNVSVSMLEGGENR

SEQ ID NO: 61039 - protein, 31 aa, Artificial Sequence
  Description of Artificial Sequence: Synthetic polypeptide
MEEEIMTTNPVATEQYGNVSVTEMLVQGGNQ

SEQ ID NO: 61040 - protein, 29 aa, Artificial Sequence
  Description of Artificial Sequence: Synthetic peptide
MEEEIMTTNPVATEQYGNVSVTMLEGMNS

SEQ ID NO: 61041 - protein, 31 aa, Artificial Sequence
  Description of Artificial Sequence: Synthetic polypeptide
MEEEIMTTNPVATEQYGNVSVTMLQGGNDFF

SEQ ID NO: 61042 - protein, 34 aa, Artificial Sequence
  Description of Artificial Sequence: Synthetic polypeptide
DEEEIRTTNPVATEQYGQVSTQNLQGSGGNNENP

SEQ ID NO: 61043 - protein, 33 aa, Artificial Sequence
  Description of Artificial Sequence: Synthetic polypeptide
MEEEIATTNPVATEQYGSVNTNNLPQEAGENGR

SEQ ID NO: 61044 - protein, 28 aa, Artificial Sequence
  Description of Artificial Sequence: Synthetic peptide
MEEEIASVNPVCTEQYGVVSDNLQTGNQ

SEQ ID NO: 61045 - protein, 30 aa, Artificial Sequence
  Description of Artificial Sequence: Synthetic polypeptide
MEEEIRTTNPVGTEQYGSVMTDFLGRGFPE

SEQ ID NO: 61046 - protein, 30 aa, Artificial Sequence
  Description of Artificial Sequence: Synthetic polypeptide
MEEEIRTTNPVGTEQYGSVTSTDFLGPGFP

SEQ ID NO: 61047 - protein, 31 aa, Artificial Sequence
  Description of Artificial Sequence: Synthetic polypeptide
MTEEIRTTNPVATEQWGTVSTTNNLQEGNNE

SEQ ID NO: 61048 - protein, 31 aa, Artificial Sequence
  Description of Artificial Sequence: Synthetic polypeptide
MTEEIRTTNPVATEQWGTVSTTTNLQEGNDN

SEQ ID NO: 61049 - protein, 30 aa, Artificial Sequence
  Description of Artificial Sequence: Synthetic polypeptide
MTEEIRYTNPVATEQYGCFVSTNLENGTQR

SEQ ID NO: 61050 - protein, 34 aa, Artificial Sequence
  Description of Artificial Sequence: Synthetic polypeptide
DEEEIRTTNPVATEQYGQSVMTNLEQARGGIEQQ

SEQ ID NO: 61051 - protein, 30 aa, Artificial Sequence
  Description of Artificial Sequence: Synthetic polypeptide
NAEEIASTNPVATEQYGVVSTVNLDERGER

SEQ ID NO: 61052 - protein, 34 aa, Artificial Sequence
  Description of Artificial Sequence: Synthetic polypeptide
DEEEIRTTNPVATEQYGQSVDSTENHQNFGSNDA

SEQ ID NO: 61053 - protein, 30 aa, Artificial Sequence
  Description of Artificial Sequence: Synthetic polypeptide
NAEEIATTNPVATEQYGCVATNLQAGPNEE

SEQ ID NO: 61054 - protein, 31 aa, Artificial Sequence
  Description of Artificial Sequence: Synthetic polypeptide
NAEEIATTNPVATEQYGVVATNLQDGPNNRM

SEQ ID NO: 61055 - protein, 31 aa, Artificial Sequence
  Description of Artificial Sequence: Synthetic polypeptide
NAEEIATTNPVATEQYGVVSTNLQDQGPNDN

SEQ ID NO: 61056 - protein, 31 aa, Artificial Sequence
  Description of Artificial Sequence: Synthetic polypeptide
MTEEIRTTNPVATEQWGTVSTTNLQEGNNTN

SEQ ID NO: 61057 - protein, 33 aa, Artificial Sequence
  Description of Artificial Sequence: Synthetic polypeptide
DEEEIRTTNPVATEQYGQSVCSWELQNFGSNQL

SEQ ID NO: 61058 - protein, 34 aa, Artificial Sequence
  Description of Artificial Sequence: Synthetic polypeptide
DEEEIRTTNPVATEQYGQSVCSTPLQEYFGSNQP

SEQ ID NO: 61059 - protein, 33 aa, Artificial Sequence
  Description of Artificial Sequence: Synthetic polypeptide
DEEEIRTTNPVATEQYGQSVCSTNTQAFNSNQA

SEQ ID NO: 61060 - protein, 32 aa, Artificial Sequence
  Description of Artificial Sequence: Synthetic polypeptide
NDEEIRTTNPVATEQYGCVCSTNLNQYSGSNQ

SEQ ID NO: 61061 - protein, 31 aa, Artificial Sequence
  Description of Artificial Sequence: Synthetic polypeptide
NDEEIRTTNPVATEQYGCVSTNLQENFGSDQ

SEQ ID NO: 61062 - protein, 31 aa, Artificial Sequence
  Description of Artificial Sequence: Synthetic polypeptide
NDEEIRTTNPVATEQYGVVSTELQENGSNQS

SEQ ID NO: 61063 - protein, 31 aa, Artificial Sequence
  Description of Artificial Sequence: Synthetic polypeptide
NDEEIRTTNPVATEQYGVVSTGPLQNGSNQS

SEQ ID NO: 61064 - protein, 32 aa, Artificial Sequence
  Description of Artificial Sequence: Synthetic polypeptide
NDEEIRTTNPVATEQYGVVSTNLQENFGSNTQ

SEQ ID NO: 61065 - protein, 33 aa, Artificial Sequence
  Description of Artificial Sequence: Synthetic polypeptide
DEEEIRTTNPVATEQYGQSVCSTNLASFGSEQS

SEQ ID NO: 61066 - protein, 34 aa, Artificial Sequence
  Description of Artificial Sequence: Synthetic polypeptide
DEEEIRTTNPVATEQYGQSVCSTNHQNFGSDTRL

SEQ ID NO: 61067 - protein, 33 aa, Artificial Sequence
  Description of Artificial Sequence: Synthetic polypeptide
DEEEIRTTNPVATEQYGQSVCSTSNTNQHTQNE

SEQ ID NO: 61068 - protein, 34 aa, Artificial Sequence
  Description of Artificial Sequence: Synthetic polypeptide
DEEEIRTTNPVATEQYGQSVVATNALSTTGGNNR

SEQ ID NO: 61069 - protein, 31 aa, Artificial Sequence
  Description of Artificial Sequence: Synthetic polypeptide
MTEEIRTTNPVATEQWGTVSTTNLQEGNNNT

SEQ ID NO: 61070 - protein, 33 aa, Artificial Sequence
  Description of Artificial Sequence: Synthetic polypeptide
MESEIRTTNPVATEQYGSVSPTYNLDIRGENYQ

SEQ ID NO: 61071 - protein, 29 aa, Artificial Sequence
  Description of Artificial Sequence: Synthetic peptide
MEEEIRTTNPVSTEIYGTVNTFNLQGGQT

SEQ ID NO: 61072 - protein, 31 aa, Artificial Sequence
  Description of Artificial Sequence: Synthetic polypeptide
MEEEISTTNPVATEQYGCVSVTETQGGSNRM

SEQ ID NO: 61073 - protein, 30 aa, Artificial Sequence
  Description of Artificial Sequence: Synthetic polypeptide
MEEEITTTNPVATEQYGDVSVTTGGQGGNE

SEQ ID NO: 61074 - protein, 31 aa, Artificial Sequence
  Description of Artificial Sequence: Synthetic polypeptide
MEEEITTTNPVATEQYGNVSVTDGQGGGNER

SEQ ID NO: 61075 - protein, 31 aa, Artificial Sequence
  Description of Artificial Sequence: Synthetic polypeptide
MEEEITTTNPVATEQYGNVSVTDLQGGGGNP

SEQ ID NO: 61076 - protein, 30 aa, Artificial Sequence
  Description of Artificial Sequence: Synthetic polypeptide
MEEEITTTNPVATEQYGNVSVTGGGQGGNI

SEQ ID NO: 61077 - protein, 33 aa, Artificial Sequence
  Description of Artificial Sequence: Synthetic polypeptide
MEEEVRTTNPVATEQYGSVSTWNNLDETRIGNQ

SEQ ID NO: 61078 - protein, 30 aa, Artificial Sequence
  Description of Artificial Sequence: Synthetic polypeptide
MEGEIRTTNPVATEEYGCCKSINLQRGDNQ

SEQ ID NO: 61079 - protein, 31 aa, Artificial Sequence
  Description of Artificial Sequence: Synthetic polypeptide
MEGEIRTTNPVATEQYGSVQTTALIERMENR

SEQ ID NO: 61080 - protein, 31 aa, Artificial Sequence
  Description of Artificial Sequence: Synthetic polypeptide
MTEEIRTTNPVATEQWGTVSTNLQEGNNNNE

SEQ ID NO: 61081 - protein, 31 aa, Artificial Sequence
  Description of Artificial Sequence: Synthetic polypeptide
MEGTIRTTNPVATEQYGSVTSTNLDIGIGNG

SEQ ID NO: 61082 - protein, 28 aa, Artificial Sequence
  Description of Artificial Sequence: Synthetic peptide
MENEIACTNPVASEQYGEASENLQRGGR

SEQ ID NO: 61083 - protein, 28 aa, Artificial Sequence
  Description of Artificial Sequence: Synthetic peptide
MENEIACTNPVATEQFGEASENLQRGGR

SEQ ID NO: 61084 - protein, 30 aa, Artificial Sequence
  Description of Artificial Sequence: Synthetic polypeptide
MENEIRATNPVATEQYGSVSTDLQNEGEDS

SEQ ID NO: 61085 - protein, 31 aa, Artificial Sequence
  Description of Artificial Sequence: Synthetic polypeptide
MENEIRTTNPVATEIYGSVSNENDLQRGTWE

SEQ ID NO: 61086 - protein, 33 aa, Artificial Sequence
  Description of Artificial Sequence: Synthetic polypeptide
MENEIRTTNPVATEQYGSVSDTSNLEQRSENMQ

SEQ ID NO: 61087 - protein, 32 aa, Artificial Sequence
  Description of Artificial Sequence: Synthetic polypeptide
MEQEIRTTNPVATEQYGCVSTNLENREENERD

SEQ ID NO: 61088 - protein, 31 aa, Artificial Sequence
  Description of Artificial Sequence: Synthetic polypeptide
MEQEIRTTNPVATEQYGCVSTNLENRTENID

SEQ ID NO: 61089 - protein, 34 aa, Artificial Sequence
  Description of Artificial Sequence: Synthetic polypeptide
MESEIRTTNPVATEQYGSVSPTPNLDQRIGENNQ

SEQ ID NO: 61090 - protein, 34 aa, Artificial Sequence
  Description of Artificial Sequence: Synthetic polypeptide
MESEIRTTNPVATEQYGSVSPTSNLDQRIGENYE

SEQ ID NO: 61091 - protein, 30 aa, Artificial Sequence
  Description of Artificial Sequence: Synthetic polypeptide
MEGTIRTTNPVATEQYGSYTSTNLIIGNGN

SEQ ID NO: 61092 - protein, 28 aa, Artificial Sequence
  Description of Artificial Sequence: Synthetic peptide
MEEEIASVNPVCTEQYGVVSDNLQSGNQ

SEQ ID NO: 61093 - protein, 28 aa, Artificial Sequence
  Description of Artificial Sequence: Synthetic peptide
MEEEIASVNPVCTEQYGVVSDNLQAGNQ

SEQ ID NO: 61094 - protein, 28 aa, Artificial Sequence
  Description of Artificial Sequence: Synthetic peptide
MEEEIASVNPVCTEQYGTVSDNLQSGNQ

SEQ ID NO: 61095 - protein, 33 aa, Artificial Sequence
  Description of Artificial Sequence: Synthetic polypeptide
FEEEIRTTNPVATEQYGSVSTTMNNGQQGNGNE

SEQ ID NO: 61096 - protein, 34 aa, Artificial Sequence
  Description of Artificial Sequence: Synthetic polypeptide
FEEEIRTTNPVATEQYGSVSTTNLQEGGGENDND

SEQ ID NO: 61097 - protein, 34 aa, Artificial Sequence
  Description of Artificial Sequence: Synthetic polypeptide
FEEEIRTTNPVATEQYGSVSTTNLQIGFGENTGQ

SEQ ID NO: 61098 - protein, 32 aa, Artificial Sequence
  Description of Artificial Sequence: Synthetic polypeptide
FEEEIRTTNPVATEQYGSVSTVMNGISGGGNT

SEQ ID NO: 61099 - protein, 33 aa, Artificial Sequence
  Description of Artificial Sequence: Synthetic polypeptide
FEEEIRTTNPVATEQYGSVSTVNGGQTGGNGNE

SEQ ID NO: 61100 - protein, 33 aa, Artificial Sequence
  Description of Artificial Sequence: Synthetic polypeptide
FEEEIRTTNPVATEQYGSVSTVNMQNIGLGNEQ

SEQ ID NO: 61101 - protein, 33 aa, Artificial Sequence
  Description of Artificial Sequence: Synthetic polypeptide
FEEEIRTTNPVATEQYGSVSVNGLGVVVGPNER

SEQ ID NO: 61102 - protein, 32 aa, Artificial Sequence
  Description of Artificial Sequence: Synthetic polypeptide
FEEEIRTTNPVATEQYGSVSVTTLGQTGEMSQ

SEQ ID NO: 61103 - protein, 33 aa, Artificial Sequence
  Description of Artificial Sequence: Synthetic polypeptide
FEEEIRTTNPVATEQYGSVTDGTGNLQENGNVD

SEQ ID NO: 61104 - protein, 34 aa, Artificial Sequence
  Description of Artificial Sequence: Synthetic polypeptide
FEEEIRTTNPVATEQYGSVSTTMNLQEGSGENDN

SEQ ID NO: 61105 - protein, 33 aa, Artificial Sequence
  Description of Artificial Sequence: Synthetic polypeptide
FEEEIRTTNPVATEQYGSVTISTNTGQGGGNEG

SEQ ID NO: 61106 - protein, 32 aa, Artificial Sequence
  Description of Artificial Sequence: Synthetic polypeptide
FEEEIRTTNPVATEQYGSVVGTNGQERNANGD

SEQ ID NO: 61107 - protein, 30 aa, Artificial Sequence
  Description of Artificial Sequence: Synthetic polypeptide
FEEEIRTTNPVATEQYGSVWTNMTESTQNM

SEQ ID NO: 61108 - protein, 31 aa, Artificial Sequence
  Description of Artificial Sequence: Synthetic polypeptide
FEEEIRTTNPVATEQYGTVSTMIGQERTNEA

SEQ ID NO: 61109 - protein, 33 aa, Artificial Sequence
  Description of Artificial Sequence: Synthetic polypeptide
FEEEIRTTNPVATEQYGTVTSTNLQNGGGNEGN

SEQ ID NO: 61110 - protein, 32 aa, Artificial Sequence
  Description of Artificial Sequence: Synthetic polypeptide
FEEEIRTTNPVATEQYGVVNSDTNGQGEGGNA

SEQ ID NO: 61111 - protein, 32 aa, Artificial Sequence
  Description of Artificial Sequence: Synthetic polypeptide
FEEEIRTTNPVATEQYGVVSTDNGQTEGGNED

SEQ ID NO: 61112 - protein, 31 aa, Artificial Sequence
  Description of Artificial Sequence: Synthetic polypeptide
FEEEIRTTNPVATEQYGVVSTNMDGEGGNEG

SEQ ID NO: 61113 - protein, 32 aa, Artificial Sequence
  Description of Artificial Sequence: Synthetic polypeptide
FEEEIRTTNPVATEQYGVVTSTELQNGGNGNG

SEQ ID NO: 61114 - protein, 32 aa, Artificial Sequence
  Description of Artificial Sequence: Synthetic polypeptide
FEEEIRTTNPVATESYGSVSNTVNLHRGVGQN

SEQ ID NO: 61115 - protein, 33 aa, Artificial Sequence
  Description of Artificial Sequence: Synthetic polypeptide
FEEEIRTTNPVATEQYGSVTSTTQNGGQNGGNI

SEQ ID NO: 61116 - protein, 31 aa, Artificial Sequence
  Description of Artificial Sequence: Synthetic polypeptide
FEEGITTTNPVATEQYGSVSSVNDQERGENS

SEQ ID NO: 61117 - protein, 33 aa, Artificial Sequence
  Description of Artificial Sequence: Synthetic polypeptide
FEEEIRTTNPVATEQYGSVSTTMNGQEGGTNDN

SEQ ID NO: 61118 - protein, 33 aa, Artificial Sequence
  Description of Artificial Sequence: Synthetic polypeptide
FEEEIRTTNPVATEQYGSVSTTLNGQEGGGNDG

SEQ ID NO: 61119 - protein, 33 aa, Artificial Sequence
  Description of Artificial Sequence: Synthetic polypeptide
DEEEIRTTNPVATEQYGSASPTPNDQQRGSEPQ

SEQ ID NO: 61120 - protein, 31 aa, Artificial Sequence
  Description of Artificial Sequence: Synthetic polypeptide
DEEEIRTTNPVATEQYGSASPTNVDTRVQMD

SEQ ID NO: 61121 - protein, 33 aa, Artificial Sequence
  Description of Artificial Sequence: Synthetic polypeptide
FEEEIRTTNPVATEQYGSVSTPNEQPQGEELRV

SEQ ID NO: 61122 - protein, 33 aa, Artificial Sequence
  Description of Artificial Sequence: Synthetic polypeptide
DEEEIRTTNPVATEQYGSASPTNLIQMREMEDA

SEQ ID NO: 61123 - protein, 34 aa, Artificial Sequence
  Description of Artificial Sequence: Synthetic polypeptide
DEEEIRTTNPVATEQYGSASPTNLIQMREGEDEG

SEQ ID NO: 61124 - protein, 34 aa, Artificial Sequence
  Description of Artificial Sequence: Synthetic polypeptide
FEEEIRTTNPVATEQYGSVSTPNLQFNGGENQNE

SEQ ID NO: 61125 - protein, 33 aa, Artificial Sequence
  Description of Artificial Sequence: Synthetic polypeptide
DEEEIRTTNPVATEQYGSASPTMNLTERGVEQE

SEQ ID NO: 61126 - protein, 34 aa, Artificial Sequence
  Description of Artificial Sequence: Synthetic polypeptide
DEEEIRTTNPVATEQYGSASPTFNNIQNRITNAR

SEQ ID NO: 61127 - protein, 34 aa, Artificial Sequence
  Description of Artificial Sequence: Synthetic polypeptide
DEEEIRTTNPVATEQYGSASPTFNHIQIRHGEAR

SEQ ID NO: 61128 - protein, 32 aa, Artificial Sequence
  Description of Artificial Sequence: Synthetic polypeptide
FEEEIRTTNPVATEQYGSVSTTMNGGNGNDDE

SEQ ID NO: 61129 - protein, 32 aa, Artificial Sequence
  Description of Artificial Sequence: Synthetic polypeptide
FEEEIRTTNPVATEQYGSVSTPNVNVIGVNGQ

SEQ ID NO: 61130 - protein, 34 aa, Artificial Sequence
  Description of Artificial Sequence: Synthetic polypeptide
DEEEIRTTNPVATEQYGSASPTENHIQQRIGNAQ

SEQ ID NO: 61131 - protein, 34 aa, Artificial Sequence
  Description of Artificial Sequence: Synthetic polypeptide
DEEEIRTTNPVATEQYGSASPTENHIERIGNMRS

SEQ ID NO: 61132 - protein, 33 aa, Artificial Sequence
  Description of Artificial Sequence: Synthetic polypeptide
FEEEIRTTNPVATEQYGSVSTQNLNIGDGNEQE

SEQ ID NO: 61133 - protein, 34 aa, Artificial Sequence
  Description of Artificial Sequence: Synthetic polypeptide
FEEEIRTTNPVATEQYGSVSTQNLQGDEGNNDQD

SEQ ID NO: 61134 - protein, 32 aa, Artificial Sequence
  Description of Artificial Sequence: Synthetic polypeptide
DEEEIRTTNPVATEQYGSASPANLEQPGILEN

SEQ ID NO: 61135 - protein, 33 aa, Artificial Sequence
  Description of Artificial Sequence: Synthetic polypeptide
DEEEIRTTNPVATEQYGSASNTNLDQSETNLFQ

SEQ ID NO: 61136 - protein, 34 aa, Artificial Sequence
  Description of Artificial Sequence: Synthetic polypeptide
FEEEIRTTNPVATEQYGSVSTTANLQEGGGNDNI

SEQ ID NO: 61137 - protein, 33 aa, Artificial Sequence
  Description of Artificial Sequence: Synthetic polypeptide
FEEEIRTTNPVATEQYGSVSTTDNGQEQGNEFE

SEQ ID NO: 61138 - protein, 34 aa, Artificial Sequence
  Description of Artificial Sequence: Synthetic polypeptide
FEEEIRTTNPVATEQYGSVSTTDNLQEGGNNDNI

SEQ ID NO: 61139 - protein, 34 aa, Artificial Sequence
  Description of Artificial Sequence: Synthetic polypeptide
FEEEIRTTNPVATEQYGSVSTQNGLEGQGGNNED

SEQ ID NO: 61140 - protein, 30 aa, Artificial Sequence
  Description of Artificial Sequence: Synthetic polypeptide
FEETIRTTNPVATEQYGAVSTNQQFQGTGW

SEQ ID NO: 61141 - protein, 32 aa, Artificial Sequence
  Description of Artificial Sequence: Synthetic polypeptide
FEETIRTTNPVATEQYGSVSTNLEDYGMEFRD

SEQ ID NO: 61142 - protein, 31 aa, Artificial Sequence
  Description of Artificial Sequence: Synthetic polypeptide
FEETITTTNPVATEQYGSVSSMNSQRGENSM

SEQ ID NO: 61143 - protein, 28 aa, Artificial Sequence
  Description of Artificial Sequence: Synthetic peptide
IEEEIASVNPVCTEQYGVVSRNLQSGNQ

SEQ ID NO: 61144 - protein, 31 aa, Artificial Sequence
  Description of Artificial Sequence: Synthetic polypeptide
DEEEIRTTNPVATEQYGSAAHTNLVVINELS

SEQ ID NO: 61145 - protein, 32 aa, Artificial Sequence
  Description of Artificial Sequence: Synthetic polypeptide
IEEEIRTTNPVATEQYGSVSTMQLGETQEDNE

SEQ ID NO: 61146 - protein, 34 aa, Artificial Sequence
  Description of Artificial Sequence: Synthetic polypeptide
IEEEIRTTNPVATEQYGSVSTPNLEQPQGEELRL

SEQ ID NO: 61147 - protein, 32 aa, Artificial Sequence
  Description of Artificial Sequence: Synthetic polypeptide
IEEEIRTTNPVATEQYGSVSTQLGQETQEDNE

SEQ ID NO: 61148 - protein, 29 aa, Artificial Sequence
  Description of Artificial Sequence: Synthetic peptide
IENEIACTNPVATEQYGETSENLQRIGGR

SEQ ID NO: 61149 - protein, 30 aa, Artificial Sequence
  Description of Artificial Sequence: Synthetic polypeptide
INEEIRTTNPVATEFYGVVSTNGQDGGNDG

SEQ ID NO: 61150 - protein, 31 aa, Artificial Sequence
  Description of Artificial Sequence: Synthetic polypeptide
INEEIRTTNPVATEQYGTVVSTNGQDEGGNG

SEQ ID NO: 61151 - protein, 30 aa, Artificial Sequence
  Description of Artificial Sequence: Synthetic polypeptide
INEEIRTTNPVATEQYGVVVGTNGQGGGNG

SEQ ID NO: 61152 - protein, 28 aa, Artificial Sequence
  Description of Artificial Sequence: Synthetic peptide
IEEEIASVNPVCTEQYGVVSDNLQSGNQ

SEQ ID NO: 61153 - protein, 28 aa, Artificial Sequence
  Description of Artificial Sequence: Synthetic peptide
KEEEIASVNPVCTEQYGVVSDNLQSGNQ

SEQ ID NO: 61154 - protein, 34 aa, Artificial Sequence
  Description of Artificial Sequence: Synthetic polypeptide
LEAEIRTTNPVATEQYGSVSTTNLEQWHGMNEDR

SEQ ID NO: 61155 - protein, 28 aa, Artificial Sequence
  Description of Artificial Sequence: Synthetic peptide
LEEEIASVNPVCTEQYGTVSDNLQSGNQ

SEQ ID NO: 61156 - protein, 28 aa, Artificial Sequence
  Description of Artificial Sequence: Synthetic peptide
LEEEIASVNPVCTEQYGVVSDNLQSGNQ

SEQ ID NO: 61157 - protein, 28 aa, Artificial Sequence
  Description of Artificial Sequence: Synthetic peptide
LENCIACTNPVATEQYGECSENLQRGGR

SEQ ID NO: 61158 - protein, 29 aa, Artificial Sequence
  Description of Artificial Sequence: Synthetic peptide
LENEIACTNPVATEQYGEWASENLQRGGR

SEQ ID NO: 61159 - protein, 31 aa, Artificial Sequence
  Description of Artificial Sequence: Synthetic polypeptide
LGEEIRTTNPVATEQWGSVTSTPLLYQGGTR

SEQ ID NO: 61160 - protein, 32 aa, Artificial Sequence
  Description of Artificial Sequence: Synthetic polypeptide
MEAEIRTTNPVATEQYGSSCVYPNLFRGGNER

SEQ ID NO: 61161 - protein, 30 aa, Artificial Sequence
  Description of Artificial Sequence: Synthetic polypeptide
MEAEIRTTNPVCTEQYGSVATTILENGNFR

SEQ ID NO: 61162 - protein, 30 aa, Artificial Sequence
  Description of Artificial Sequence: Synthetic polypeptide
MEECIRTTNPVATEQYGSVATTALNENGFR

SEQ ID NO: 61163 - protein, 28 aa, Artificial Sequence
  Description of Artificial Sequence: Synthetic peptide
KESEIACTNPVATEQYGEASENIQRGGR

SEQ ID NO: 61164 - protein, 28 aa, Artificial Sequence
  Description of Artificial Sequence: Synthetic peptide
IEEEIASVNPVCTEQYGVVSDNLQSGNM

SEQ ID NO: 61165 - protein, 32 aa, Artificial Sequence
  Description of Artificial Sequence: Synthetic polypeptide
HSEEIRTTNPVATWQYGSVSVTPTLQRGNQFV

SEQ ID NO: 61166 - protein, 33 aa, Artificial Sequence
  Description of Artificial Sequence: Synthetic polypeptide
HETEIRTTNPVATEQYGSVSVTNLQGRNANFYV

SEQ ID NO: 61167 - protein, 31 aa, Artificial Sequence
  Description of Artificial Sequence: Synthetic polypeptide
DEEEIRTTNPVATEQYGSAPVNLVQRDTIQE

SEQ ID NO: 61168 - protein, 32 aa, Artificial Sequence
  Description of Artificial Sequence: Synthetic polypeptide
DEEEIRTTNPVATEQYGSAPVNLVQRDNDIQE

SEQ ID NO: 61169 - protein, 31 aa, Artificial Sequence
  Description of Artificial Sequence: Synthetic polypeptide
FSEEIQTTNPVATEQYGSVSTNALSQFGMQT

SEQ ID NO: 61170 - protein, 28 aa, Artificial Sequence
  Description of Artificial Sequence: Synthetic peptide
GEEEIASVNPVCTEQYGVVSDNLQSGNQ

SEQ ID NO: 61171 - protein, 30 aa, Artificial Sequence
  Description of Artificial Sequence: Synthetic polypeptide
GEEGICTTNPVATEQYGSVSMNVFIQTGND

SEQ ID NO: 61172 - protein, 28 aa, Artificial Sequence
  Description of Artificial Sequence: Synthetic peptide
GENEIACTNPVATENYGEASENLQRGGR

SEQ ID NO: 61173 - protein, 28 aa, Artificial Sequence
  Description of Artificial Sequence: Synthetic peptide
GENEIACTNPVATEQYGEASENFQRGGR

SEQ ID NO: 61174 - protein, 28 aa, Artificial Sequence
  Description of Artificial Sequence: Synthetic peptide
GENEIACTNPVATEQYGEASENLQRGGS

SEQ ID NO: 61175 - protein, 28 aa, Artificial Sequence
  Description of Artificial Sequence: Synthetic peptide
GENEICCTNPVATEQYGEASENLQRVGR

SEQ ID NO: 61176 - protein, 30 aa, Artificial Sequence
  Description of Artificial Sequence: Synthetic polypeptide
GQEEIATTNPVATTQYGSVSTNGDGNGNHR

SEQ ID NO: 61177 - protein, 30 aa, Artificial Sequence
  Description of Artificial Sequence: Synthetic polypeptide
HEAEIRTTNPVATEQYGSVSTVLQENALFY

SEQ ID NO: 61178 - protein, 28 aa, Artificial Sequence
  Description of Artificial Sequence: Synthetic peptide
HEEEIASVNPVCTEQYGVVSDNLQSGNQ

SEQ ID NO: 61179 - protein, 28 aa, Artificial Sequence
  Description of Artificial Sequence: Synthetic peptide
HEEEIASVNPVCTEQYGVVSGNLQSGNQ

SEQ ID NO: 61180 - protein, 28 aa, Artificial Sequence
  Description of Artificial Sequence: Synthetic peptide
HEEEIAVVNPVCTEQYGVVSDNLQSGNQ

SEQ ID NO: 61181 - protein, 31 aa, Artificial Sequence
  Description of Artificial Sequence: Synthetic polypeptide
HEEEIRTTNPVATEQYGSVSETQDLSNEVRL

SEQ ID NO: 61182 - protein, 32 aa, Artificial Sequence
  Description of Artificial Sequence: Synthetic polypeptide
HEEEIRTTNPVATEQYGSVSETSLQRNEETYP

SEQ ID NO: 61183 - protein, 33 aa, Artificial Sequence
  Description of Artificial Sequence: Synthetic polypeptide
HEEEIRTTNPVATEQYGSVSLTNLQNINAPFYD

SEQ ID NO: 61184 - protein, 31 aa, Artificial Sequence
  Description of Artificial Sequence: Synthetic polypeptide
HEGEIRTTNPVATEQYGSVSTNDLQENQEFP

SEQ ID NO: 61185 - protein, 33 aa, Artificial Sequence
  Description of Artificial Sequence: Synthetic polypeptide
HEGEIRTTNPVATEQYGSVSTNDLQRFNQNEFG

SEQ ID NO: 61186 - protein, 28 aa, Artificial Sequence
  Description of Artificial Sequence: Synthetic peptide
HENEIACTNPVATEQFGEASENLQRGGR

SEQ ID NO: 61187 - protein, 31 aa, Artificial Sequence
  Description of Artificial Sequence: Synthetic polypeptide
DEEEIRTTNPVATEQYGSACTNLNPNLNLQE

SEQ ID NO: 61188 - protein, 32 aa, Artificial Sequence
  Description of Artificial Sequence: Synthetic polypeptide
NEAEIRTTNPVATEMWGSVSTNLQGNMGNTDR

SEQ ID NO: 61189 - protein, 34 aa, Artificial Sequence
  Description of Artificial Sequence: Synthetic polypeptide
DEEEIRTTNPVATEQYGQSVCSTNHDQRFGSEQM

SEQ ID NO: 61190 - protein, 31 aa, Artificial Sequence
  Description of Artificial Sequence: Synthetic polypeptide
NEAEIRTTNPVATEQWGAVSTNLQHAGNNDH

SEQ ID NO: 61191 - protein, 33 aa, Artificial Sequence
  Description of Artificial Sequence: Synthetic polypeptide
DEEEIRTTNPVATEQYGQSVCSTNDQGFGSDQM

SEQ ID NO: 61192 - protein, 32 aa, Artificial Sequence
  Description of Artificial Sequence: Synthetic polypeptide
NEEEIRTTNPVATEQWGSVSAWNLNDEFGDNR

SEQ ID NO: 61193 - protein, 31 aa, Artificial Sequence
  Description of Artificial Sequence: Synthetic polypeptide
NEEEIRTTNPVATEQYGCICSTELQRFQSGR

SEQ ID NO: 61194 - protein, 29 aa, Artificial Sequence
  Description of Artificial Sequence: Synthetic peptide
NEEEIRTTNPVATEQYGCLSTHLEGQGVE

SEQ ID NO: 61195 - protein, 31 aa, Artificial Sequence
  Description of Artificial Sequence: Synthetic polypeptide
NEEEIRTTNPVATEQYGCSCSTELQRQSEQS

SEQ ID NO: 61196 - protein, 30 aa, Artificial Sequence
  Description of Artificial Sequence: Synthetic polypeptide
NEEEIRTTNPVATEQYGCSCSTETQRQSDQ

SEQ ID NO: 61197 - protein, 29 aa, Artificial Sequence
  Description of Artificial Sequence: Synthetic peptide
NEEEIRTTNPVATEQYGCSSTEHQRQSEQ

SEQ ID NO: 61198 - protein, 31 aa, Artificial Sequence
  Description of Artificial Sequence: Synthetic polypeptide
NEEEIRTTNPVATEQYGCVCSSGNLDEFGNA

SEQ ID NO: 61199 - protein, 30 aa, Artificial Sequence
  Description of Artificial Sequence: Synthetic polypeptide
NEEEIRTTNPVATEQYGCVGTALQNGSDQS

SEQ ID NO: 61200 - protein, 32 aa, Artificial Sequence
  Description of Artificial Sequence: Synthetic polypeptide
NEEEIRTTNPVATEQYGCVLSWEHGQRGQGNR

SEQ ID NO: 61201 - protein, 34 aa, Artificial Sequence
  Description of Artificial Sequence: Synthetic polypeptide
DEEEIRTTNPVATEQYGNVVSTMNLNQEDGGGNT

SEQ ID NO: 61202 - protein, 32 aa, Artificial Sequence
  Description of Artificial Sequence: Synthetic polypeptide
NEEEIRTTNPVATEQYGCVSWWNLDEFGSNRQ

SEQ ID NO: 61203 - protein, 31 aa, Artificial Sequence
  Description of Artificial Sequence: Synthetic polypeptide
NEEEIRTTNPVATEQYGSCGSTGDLQREQGD

SEQ ID NO: 61204 - protein, 32 aa, Artificial Sequence
  Description of Artificial Sequence: Synthetic polypeptide
NEEEIRTTNPVATEQYGSCSDNLQEEGNIQID

SEQ ID NO: 61205 - protein, 30 aa, Artificial Sequence
  Description of Artificial Sequence: Synthetic polypeptide
NEEEIRTTNPVATEQYGSFCSTELQHQSDQ

SEQ ID NO: 61206 - protein, 32 aa, Artificial Sequence
  Description of Artificial Sequence: Synthetic polypeptide
NEEEIRTTNPVATEQYGSFCSTELQRFQSGQA

SEQ ID NO: 61207 - protein, 31 aa, Artificial Sequence
  Description of Artificial Sequence: Synthetic polypeptide
NEEEIRTTNPVATEQYGSLSPTHLEVERQGR

SEQ ID NO: 61208 - protein, 31 aa, Artificial Sequence
  Description of Artificial Sequence: Synthetic polypeptide
NEEEIRTTNPVATEQYGSLSTHLQDEIQGQD

SEQ ID NO: 61209 - protein, 30 aa, Artificial Sequence
  Description of Artificial Sequence: Synthetic polypeptide
NEEEIRTTNPVATEQYGSSSTELQYFQSDQ

SEQ ID NO: 61210 - protein, 32 aa, Artificial Sequence
  Description of Artificial Sequence: Synthetic polypeptide
NEEEIRTTNPVATEQYGSVCSTGQLGQREQGT

SEQ ID NO: 61211 - protein, 32 aa, Artificial Sequence
  Description of Artificial Sequence: Synthetic polypeptide
NEEEIRTTNPVATEQYGSVCSWGNLDEFGNAS

SEQ ID NO: 61212 - protein, 32 aa, Artificial Sequence
  Description of Artificial Sequence: Synthetic polypeptide
DEEEIRTTNPVATEQYGNVVGTNGQGGNGNTS

SEQ ID NO: 61213 - protein, 33 aa, Artificial Sequence
  Description of Artificial Sequence: Synthetic polypeptide
NEEEIRTTNPVATEQYGSVCTSTGELQREQGDG

SEQ ID NO: 61214 - protein, 31 aa, Artificial Sequence
  Description of Artificial Sequence: Synthetic polypeptide
NEEEIRTTNPVATEQWGSALKTDHLQRQGQR

SEQ ID NO: 61215 - protein, 32 aa, Artificial Sequence
  Description of Artificial Sequence: Synthetic polypeptide
NEEEIRTTNPVATEPYGYSVCFTNQHNRGGNR

SEQ ID NO: 61216 - protein, 32 aa, Artificial Sequence
  Description of Artificial Sequence: Synthetic polypeptide
DEEEIRTTNPVATEQYGQCVCSTEDLQFGSDQ

SEQ ID NO: 61217 - protein, 33 aa, Artificial Sequence
  Description of Artificial Sequence: Synthetic polypeptide
DEEEIRTTNPVATEQYGQCVCSTALQRFGSDQS

SEQ ID NO: 61218 - protein, 33 aa, Artificial Sequence
  Description of Artificial Sequence: Synthetic polypeptide
DEEEIRTTNPVATEQYGQCVCSSNLQRFNSNAS

SEQ ID NO: 61219 - protein, 32 aa, Artificial Sequence
  Description of Artificial Sequence: Synthetic polypeptide
NEEEIATTNPVAYEQYGSVAITNLQRNPEGNN

SEQ ID NO: 61220 - protein, 32 aa, Artificial Sequence
  Description of Artificial Sequence: Synthetic polypeptide
DEEEIRTTNPVATEQYGQCVCSSELQRFGSDA

SEQ ID NO: 61221 - protein, 31 aa, Artificial Sequence
  Description of Artificial Sequence: Synthetic polypeptide
NEEEIATTNPVAYEQYGSVATNLNRNGQEPR

SEQ ID NO: 61222 - protein, 31 aa, Artificial Sequence
  Description of Artificial Sequence: Synthetic polypeptide
NEEEIATTNPVAYEQYGSVATNLQDDGNDNH

SEQ ID NO: 61223 - protein, 30 aa, Artificial Sequence
  Description of Artificial Sequence: Synthetic polypeptide
NEEEIATTNPVAYEQYGSVATNLQDNPDRN

SEQ ID NO: 61224 - protein, 32 aa, Artificial Sequence
  Description of Artificial Sequence: Synthetic polypeptide
NEEEIATTNPVAYEQYGSVATNLQDRGENGDM

SEQ ID NO: 61225 - protein, 33 aa, Artificial Sequence
  Description of Artificial Sequence: Synthetic polypeptide
NEEEIRTTNPVATEQWGCVNKTDNLGQRGENMR

SEQ ID NO: 61226 - protein, 31 aa, Artificial Sequence
  Description of Artificial Sequence: Synthetic polypeptide
NEEEIATTNPVAYEQYGSVATNLQNDGGNVH

SEQ ID NO: 61227 - protein, 31 aa, Artificial Sequence
  Description of Artificial Sequence: Synthetic polypeptide
NEEEIATTNPVAYEQYGSVATNLQRNPPDPR

SEQ ID NO: 61228 - protein, 30 aa, Artificial Sequence
  Description of Artificial Sequence: Synthetic polypeptide
NEEEIATTNPVAYEQYGSVATNLQRNPPGD

SEQ ID NO: 61229 - protein, 30 aa, Artificial Sequence
  Description of Artificial Sequence: Synthetic polypeptide
NEEEIATTNPVAYEQYGSVATNLQRNPTPE

SEQ ID NO: 61230 - protein, 31 aa, Artificial Sequence
  Description of Artificial Sequence: Synthetic polypeptide
NEEEIATTNPVAYEQYGSVATNLQRPPAEPR

SEQ ID NO: 61231 - protein, 30 aa, Artificial Sequence
  Description of Artificial Sequence: Synthetic polypeptide
NEEEIATTNPVAYEQYGSVATNLTNPGENH

SEQ ID NO: 61232 - protein, 30 aa, Artificial Sequence
  Description of Artificial Sequence: Synthetic polypeptide
NEEEIATTNPVAYEQYGSVSAGNPDEAGNR

SEQ ID NO: 61233 - protein, 34 aa, Artificial Sequence
  Description of Artificial Sequence: Synthetic polypeptide
DEEEIRTTNPVATEQYGQCVCSMTNHQRFGSDRS

SEQ ID NO: 61234 - protein, 29 aa, Artificial Sequence
  Description of Artificial Sequence: Synthetic peptide
NEEEIATTNPVCTETYGSVANPNLQDGNF

SEQ ID NO: 61235 - protein, 30 aa, Artificial Sequence
  Description of Artificial Sequence: Synthetic polypeptide
NEEEIRCTNPIATEHYGSVSENMLMRDGNG

SEQ ID NO: 61236 - protein, 30 aa, Artificial Sequence
  Description of Artificial Sequence: Synthetic polypeptide
NEEEIATTNPVAYEQYGSVATNLQQPENGV

SEQ ID NO: 61237 - protein, 32 aa, Artificial Sequence
  Description of Artificial Sequence: Synthetic polypeptide
NEEEIRTTNPVATEQYGSVCYAWNLDEGGNNR

SEQ ID NO: 61238 - protein, 31 aa, Artificial Sequence
  Description of Artificial Sequence: Synthetic polypeptide
NEEEIRTTNPVATEQYGSVISWEHGQRQGTQ

SEQ ID NO: 61239 - protein, 32 aa, Artificial Sequence
  Description of Artificial Sequence: Synthetic polypeptide
NEEEIRTTNPVATEQYGSVLSWEHDLQRDQGR

SEQ ID NO: 61240 - protein, 32 aa, Artificial Sequence
  Description of Artificial Sequence: Synthetic polypeptide
NEEEIRTTNPVATEQYGSVSPMWLLQDEFGNV

SEQ ID NO: 61241 - protein, 32 aa, Artificial Sequence
  Description of Artificial Sequence: Synthetic polypeptide
NEEEIRTTNPVATEQYGSVSPWNLPEFPMNRE

SEQ ID NO: 61242 - protein, 32 aa, Artificial Sequence
  Description of Artificial Sequence: Synthetic polypeptide
NEEEIRTTNPVATEQYGSVSPWNSLVEFGMNG

SEQ ID NO: 61243 - protein, 33 aa, Artificial Sequence
  Description of Artificial Sequence: Synthetic polypeptide
NEEEIRTTNPVATEQYGSVSTAGNLDEFGGNIG

SEQ ID NO: 61244 - protein, 33 aa, Artificial Sequence
  Description of Artificial Sequence: Synthetic polypeptide
NEEEIRTTNPVATEQYGSVSTAGNLDEFGNNGQ

SEQ ID NO: 61245 - protein, 32 aa, Artificial Sequence
  Description of Artificial Sequence: Synthetic polypeptide
NEEEIRTTNPVATEQYGSVSTNEIINDGNPMM

SEQ ID NO: 61246 - protein, 34 aa, Artificial Sequence
  Description of Artificial Sequence: Synthetic polypeptide
DEEEIRTTNPVATEQYGNVACWTNELSGRTGGNR

SEQ ID NO: 61247 - protein, 33 aa, Artificial Sequence
  Description of Artificial Sequence: Synthetic polypeptide
NEEEIRTTNPVATEQYGSVSTNSLNQRDAAMWD

SEQ ID NO: 61248 - protein, 32 aa, Artificial Sequence
  Description of Artificial Sequence: Synthetic polypeptide
NEEEIRTTNPVATEQYGSVSTNVLDEGGGVGI

SEQ ID NO: 61249 - protein, 33 aa, Artificial Sequence
  Description of Artificial Sequence: Synthetic polypeptide
DEEEIRTTNPVATEQYGNVSSTVNMQDEGVGNA

SEQ ID NO: 61250 - protein, 32 aa, Artificial Sequence
  Description of Artificial Sequence: Synthetic polypeptide
NEEEIRTTNPVATEQYGSVSWAWNLDEEFGNY

SEQ ID NO: 61251 - protein, 33 aa, Artificial Sequence
  Description of Artificial Sequence: Synthetic polypeptide
NEEEIRTTNPVATEQYGSVYSTMELNQREQGGE

SEQ ID NO: 61252 - protein, 34 aa, Artificial Sequence
  Description of Artificial Sequence: Synthetic polypeptide
NEEEIRTTNPVATEQYGSVYSTVNDLTRSGNEDI

SEQ ID NO: 61253 - protein, 30 aa, Artificial Sequence
  Description of Artificial Sequence: Synthetic polypeptide
NEEEIRTTNPVATEQYGSYCSTELQYQSQQ

SEQ ID NO: 61254 - protein, 33 aa, Artificial Sequence
  Description of Artificial Sequence: Synthetic polypeptide
DEEEIRTTNPVATEQYGNTIAMTNEGLQGVGNR

SEQ ID NO: 61255 - protein, 32 aa, Artificial Sequence
  Description of Artificial Sequence: Synthetic polypeptide
NEEEIRTTNPVATEQYGSYGTMELNQREQGNG

SEQ ID NO: 61256 - protein, 34 aa, Artificial Sequence
  Description of Artificial Sequence: Synthetic polypeptide
DEEEIRTTNPVATEQYGNSVVFTNGSQRIGGNTV

SEQ ID NO: 61257 - protein, 32 aa, Artificial Sequence
  Description of Artificial Sequence: Synthetic polypeptide
NEEEIRTTNPVATEQYGSYSTMELQREQEGED

SEQ ID NO: 61258 - protein, 32 aa, Artificial Sequence
  Description of Artificial Sequence: Synthetic polypeptide
NEEEIRTTNPVAYEQWGSISTHLSQREGENRF

SEQ ID NO: 61259 - protein, 33 aa, Artificial Sequence
  Description of Artificial Sequence: Synthetic polypeptide
NEEEIRTTNPVAYEQWGSVNKTDNLDQRGNNER

SEQ ID NO: 61260 - protein, 31 aa, Artificial Sequence
  Description of Artificial Sequence: Synthetic polypeptide
NEEEIRTTNPVATEQYGSVYAWNLDEHDDNR

SEQ ID NO: 61261 - protein, 33 aa, Artificial Sequence
  Description of Artificial Sequence: Synthetic polypeptide
NEEEIRTTNPVATEQYGSVSPAINLDEFLGNVR

SEQ ID NO: 61262 - protein, 33 aa, Artificial Sequence
  Description of Artificial Sequence: Synthetic polypeptide
DEEEIRTTNPVATEQYGNVSTMTNGQEGGENIA

SEQ ID NO: 61263 - protein, 33 aa, Artificial Sequence
  Description of Artificial Sequence: Synthetic polypeptide
DEEEIRTTNPVATEQYGNVSTNLDIGFGNNEQE

SEQ ID NO: 61264 - protein, 32 aa, Artificial Sequence
  Description of Artificial Sequence: Synthetic polypeptide
NEEEIRTTNPVATEQYGSVLSWEHDQNRQGPR

SEQ ID NO: 61265 - protein, 31 aa, Artificial Sequence
  Description of Artificial Sequence: Synthetic polypeptide
NEEEIRTTNPVATEQYGSVLSWEHEQRQGDM

SEQ ID NO: 61266 - protein, 31 aa, Artificial Sequence
  Description of Artificial Sequence: Synthetic polypeptide
NEEEIRTTNPVATEQYGSVLSWEHGQRGQGS

SEQ ID NO: 61267 - protein, 31 aa, Artificial Sequence
  Description of Artificial Sequence: Synthetic polypeptide
NEEEIRTTNPVATEQYGSVLSWEHGQRQEDR

SEQ ID NO: 61268 - protein, 31 aa, Artificial Sequence
  Description of Artificial Sequence: Synthetic polypeptide
NEEEIRTTNPVATEQYGSVLSWEHLQDRQGS

SEQ ID NO: 61269 - protein, 33 aa, Artificial Sequence
  Description of Artificial Sequence: Synthetic polypeptide
DEEEIRTTNPVATEQYGNVSTVNLDQEMGQDEI

SEQ ID NO: 61270 - protein, 33 aa, Artificial Sequence
  Description of Artificial Sequence: Synthetic polypeptide
DEEEIRTTNPVATEQYGNVSTVNLDIFDGENEQ

SEQ ID NO: 61271 - protein, 33 aa, Artificial Sequence
  Description of Artificial Sequence: Synthetic polypeptide
NEEEIRTTNPVATEQYGSVNETSNIDQRGENYQ

SEQ ID NO: 61272 - protein, 34 aa, Artificial Sequence
  Description of Artificial Sequence: Synthetic polypeptide
NEEEIRTTNPVATEQYGSVNGTSNLNQRGENEGE

SEQ ID NO: 61273 - protein, 33 aa, Artificial Sequence
  Description of Artificial Sequence: Synthetic polypeptide
NEEEIRTTNPVATEQYGSVNLTSNLNQGGENEG

SEQ ID NO: 61274 - protein, 32 aa, Artificial Sequence
  Description of Artificial Sequence: Synthetic polypeptide
NEEEIRTTNPVATEQYGSVNYVTPPDRGENRH

SEQ ID NO: 61275 - protein, 31 aa, Artificial Sequence
  Description of Artificial Sequence: Synthetic polypeptide
NEEEIRTTNPVATEQYGSVSAEELDEFGSNA

SEQ ID NO: 61276 - protein, 32 aa, Artificial Sequence
  Description of Artificial Sequence: Synthetic polypeptide
NEEEIRTTNPVATEQYGSVSAGNLDEFGGNGG

SEQ ID NO: 61277 - protein, 32 aa, Artificial Sequence
  Description of Artificial Sequence: Synthetic polypeptide
NEEEIRTTNPVATEQYGSVSAGNLDEFGNNEF

SEQ ID NO: 61278 - protein, 32 aa, Artificial Sequence
  Description of Artificial Sequence: Synthetic polypeptide
NEEEIRTTNPVATEQYGSVSAGNLDEFGNNGD

SEQ ID NO: 61279 - protein, 32 aa, Artificial Sequence
  Description of Artificial Sequence: Synthetic polypeptide
NEEEIRTTNPVATEQYGSVSAGNLDEFGNNGG

SEQ ID NO: 61280 - protein, 32 aa, Artificial Sequence
  Description of Artificial Sequence: Synthetic polypeptide
NEEEIRTTNPVATEQYGSVSAGNLDEFGSNAM

SEQ ID NO: 61281 - protein, 32 aa, Artificial Sequence
  Description of Artificial Sequence: Synthetic polypeptide
NEEEIRTTNPVATEQYGSVSAGNLTDEFGNEN

SEQ ID NO: 61282 - protein, 31 aa, Artificial Sequence
  Description of Artificial Sequence: Synthetic polypeptide
NEEEIRTTNPVATEQYGSVSAWCLDEFGSQR

SEQ ID NO: 61283 - protein, 31 aa, Artificial Sequence
  Description of Artificial Sequence: Synthetic polypeptide
NEEEIRTTNPVATEQYGSVSAWNLDEFENIN

SEQ ID NO: 61284 - protein, 32 aa, Artificial Sequence
  Description of Artificial Sequence: Synthetic polypeptide
NEEEIRTTNPVATEQYGSVSAWNLDEFENQRP

SEQ ID NO: 61285 - protein, 33 aa, Artificial Sequence
  Description of Artificial Sequence: Synthetic polypeptide
DEEEIRTTNPVATEQYGQCVCSTEEHQRGSNAS

SEQ ID NO: 61286 - protein, 32 aa, Artificial Sequence
  Description of Artificial Sequence: Synthetic polypeptide
FEEEIRTTNPVATEQYGSVSTNVANGVGNNGQ

SEQ ID NO: 61287 - protein, 32 aa, Artificial Sequence
  Description of Artificial Sequence: Synthetic polypeptide
DEEEIRTTNPVATEQYGQCVCSTEHQHGNSDD

SEQ ID NO: 61288 - protein, 32 aa, Artificial Sequence
  Description of Artificial Sequence: Synthetic polypeptide
DEEEIRTTNPVATEQYGQCVCSTEHQYFGSNV

SEQ ID NO: 61289 - protein, 32 aa, Artificial Sequence
  Description of Artificial Sequence: Synthetic polypeptide
DEEEIRTTNPVATEQYGQCVSTNPQFFNSEQS

SEQ ID NO: 61290 - protein, 30 aa, Artificial Sequence
  Description of Artificial Sequence: Synthetic polypeptide
NEEEIACTNPVATEQYGSVAATNLQQGDTL

SEQ ID NO: 61291 - protein, 31 aa, Artificial Sequence
  Description of Artificial Sequence: Synthetic polypeptide
NEEEIACTNPVATEQYGSVATNLQAEDSNRV

SEQ ID NO: 61292 - protein, 30 aa, Artificial Sequence
  Description of Artificial Sequence: Synthetic polypeptide
NEEEIACTNPVATEQYGSVATNLQAEPQND

SEQ ID NO: 61293 - protein, 32 aa, Artificial Sequence
  Description of Artificial Sequence: Synthetic polypeptide
DEEEIRTTNPVATEQYGQCVSTNLENFGSDQS

SEQ ID NO: 61294 - protein, 31 aa, Artificial Sequence
  Description of Artificial Sequence: Synthetic polypeptide
NEEEIACTNPVATEQYGSVATNLQAGPNNQM

SEQ ID NO: 61295 - protein, 31 aa, Artificial Sequence
  Description of Artificial Sequence: Synthetic polypeptide
NEEEIACTNPVATEQYGSVATNLQAGPNPEE

SEQ ID NO: 61296 - protein, 32 aa, Artificial Sequence
  Description of Artificial Sequence: Synthetic polypeptide
DEEEIRTTNPVATEQYGQCVSTNHQHFNSDQT

SEQ ID NO: 61297 - protein, 32 aa, Artificial Sequence
  Description of Artificial Sequence: Synthetic polypeptide
DEEEIRTTNPVATEQYGQCVSTNHQGFGSDQA

SEQ ID NO: 61298 - protein, 30 aa, Artificial Sequence
  Description of Artificial Sequence: Synthetic polypeptide
NEEEIACTNPVATEQYGSCSTHLQDQGDRM

SEQ ID NO: 61299 - protein, 30 aa, Artificial Sequence
  Description of Artificial Sequence: Synthetic polypeptide
NEEEIACTNPVATEQYGSVATNLQAPEDTR

SEQ ID NO: 61300 - protein, 31 aa, Artificial Sequence
  Description of Artificial Sequence: Synthetic polypeptide
NEEEIACTNPVATEQYGSVATNLQDAGPNEH

SEQ ID NO: 61301 - protein, 30 aa, Artificial Sequence
  Description of Artificial Sequence: Synthetic polypeptide
NEEEIACTNPVATEQYGSVATNLQDGHTDM

SEQ ID NO: 61302 - protein, 30 aa, Artificial Sequence
  Description of Artificial Sequence: Synthetic polypeptide
NEEEIACTNPVATEQYGSVATNLQDGPTDM

SEQ ID NO: 61303 - protein, 30 aa, Artificial Sequence
  Description of Artificial Sequence: Synthetic polypeptide
NEEEIACTNPVATEQYGSVATNLQDNANEL

SEQ ID NO: 61304 - protein, 30 aa, Artificial Sequence
  Description of Artificial Sequence: Synthetic polypeptide
NEEEIACTNPVATEQYGSVATNLQDQNDTA

SEQ ID NO: 61305 - protein, 31 aa, Artificial Sequence
  Description of Artificial Sequence: Synthetic polypeptide
NEEEIACTNPVATEQYGSVATNLQDSGDDRN

SEQ ID NO: 61306 - protein, 31 aa, Artificial Sequence
  Description of Artificial Sequence: Synthetic polypeptide
NEEEIACTNPVATEQYGSVATNLQEAGGNEN

SEQ ID NO: 61307 - protein, 32 aa, Artificial Sequence
  Description of Artificial Sequence: Synthetic polypeptide
NEEEIACTNPVATEQYGSVATNLQGAEGNTRD

SEQ ID NO: 61308 - protein, 31 aa, Artificial Sequence
  Description of Artificial Sequence: Synthetic polypeptide
NEEEIACTNPVATEQYGSVATNLQNNGDNDP

SEQ ID NO: 61309 - protein, 31 aa, Artificial Sequence
  Description of Artificial Sequence: Synthetic polypeptide
NEEEIACTNPVATEQYGSVATNLQDADGDNN

SEQ ID NO: 61310 - protein, 31 aa, Artificial Sequence
  Description of Artificial Sequence: Synthetic polypeptide
NEEEIACTNPVATEQYGSVATNLQPPGNAEE

SEQ ID NO: 61311 - protein, 29 aa, Artificial Sequence
  Description of Artificial Sequence: Synthetic peptide
NEEEIACTNPVATEQYGSCSTDLQPDQGR

SEQ ID NO: 61312 - protein, 30 aa, Artificial Sequence
  Description of Artificial Sequence: Synthetic polypeptide
NEEEIACTNPVATEQWGSVSTNDERGNDAS

SEQ ID NO: 61313 - protein, 31 aa, Artificial Sequence
  Description of Artificial Sequence: Synthetic polypeptide
NEAEIRTTNPVATEQYGCVSTNLQHAGGDDA

SEQ ID NO: 61314 - protein, 31 aa, Artificial Sequence
  Description of Artificial Sequence: Synthetic polypeptide
NEAEIRTTNPVATEQYGSVTTNMQGNDGGAR

SEQ ID NO: 61315 - protein, 31 aa, Artificial Sequence
  Description of Artificial Sequence: Synthetic polypeptide
NEAEIRTTNPVAYEQWGSVSTNLQQGEGNAN

SEQ ID NO: 61316 - protein, 34 aa, Artificial Sequence
  Description of Artificial Sequence: Synthetic polypeptide
DEEEIRTTNPVATEQYGQSVCSTENHQHGGSNDL

SEQ ID NO: 61317 - protein, 29 aa, Artificial Sequence
  Description of Artificial Sequence: Synthetic peptide
NEDEIACTNPVATEQYGSVATNLQDPGEH

SEQ ID NO: 61318 - protein, 33 aa, Artificial Sequence
  Description of Artificial Sequence: Synthetic polypeptide
DEEEIRTTNPVATEQYGQSVCSTEHQHGGSNDN

SEQ ID NO: 61319 - protein, 33 aa, Artificial Sequence
  Description of Artificial Sequence: Synthetic polypeptide
DEEEIRTTNPVATEQYGQSVCSTEHQEHGGSNQ

SEQ ID NO: 61320 - protein, 31 aa, Artificial Sequence
  Description of Artificial Sequence: Synthetic polypeptide
NEDEIRTTNPVATEQYGSVDTDLQGIGQNGD

SEQ ID NO: 61321 - protein, 30 aa, Artificial Sequence
  Description of Artificial Sequence: Synthetic polypeptide
NEDEIRTTNPVATEQYGSVDTDLQNIGGQG

SEQ ID NO: 61322 - protein, 30 aa, Artificial Sequence
  Description of Artificial Sequence: Synthetic polypeptide
NEEEIACTNPVATEQYGCVATNLQQGGNPE

SEQ ID NO: 61323 - protein, 33 aa, Artificial Sequence
  Description of Artificial Sequence: Synthetic polypeptide
DEEEIRTTNPVATEQYGQSVCSSELQNSGSNQP

SEQ ID NO: 61324 - protein, 31 aa, Artificial Sequence
  Description of Artificial Sequence: Synthetic polypeptide
NEDEIRTTNPVATEQYGSVDTNLQNIGGQGT

SEQ ID NO: 61325 - protein, 31 aa, Artificial Sequence
  Description of Artificial Sequence: Synthetic polypeptide
NEDEIRTTNPVATEQYGSVDTNLQNIGQGGA

SEQ ID NO: 61326 - protein, 31 aa, Artificial Sequence
  Description of Artificial Sequence: Synthetic polypeptide
NEDEIRTTNPVATEQYGSVDTNLTQIGGGGI

SEQ ID NO: 61327 - protein, 31 aa, Artificial Sequence
  Description of Artificial Sequence: Synthetic polypeptide
NEDEIRTTNPVATEQYGSVDTPNLQIGGGQG

SEQ ID NO: 61328 - protein, 35 aa, Artificial Sequence
  Description of Artificial Sequence: Synthetic polypeptide
DEEEIRTTNPVATEQYGQSTISCLPNMLSQRDGNR

SEQ ID NO: 61329 - protein, 33 aa, Artificial Sequence
  Description of Artificial Sequence: Synthetic polypeptide
DEEEIRTTNPVATEQYGQSGVQFTVNPNQGGNL

SEQ ID NO: 61330 - protein, 30 aa, Artificial Sequence
  Description of Artificial Sequence: Synthetic polypeptide
NEEEIACTNPVATEAYGSVATNLQDGNENY

SEQ ID NO: 61331 - protein, 30 aa, Artificial Sequence
  Description of Artificial Sequence: Synthetic polypeptide
NEEEIACTNPVATEMYGSVATNLQEAGNQD

SEQ ID NO: 61332 - protein, 31 aa, Artificial Sequence
  Description of Artificial Sequence: Synthetic polypeptide
NEEEIACTNPVATEPYGSVATNLQRDQDNRD

SEQ ID NO: 61333 - protein, 35 aa, Artificial Sequence
  Description of Artificial Sequence: Synthetic polypeptide
DEEEIRTTNPVATEQYGQSVCSNTENLQRFGSQQT

SEQ ID NO: 61334 - protein, 30 aa, Artificial Sequence
  Description of Artificial Sequence: Synthetic polypeptide
NEEEIACTNPVATEQYGSVSANNLDENGNQ

SEQ ID NO: 61335 - protein, 28 aa, Artificial Sequence
  Description of Artificial Sequence: Synthetic peptide
NEEEIASVNPVCTEQYGVVSCNLQDGNQ

SEQ ID NO: 61336 - protein, 28 aa, Artificial Sequence
  Description of Artificial Sequence: Synthetic peptide
NEEEIASVNPVCTEQYGVVSDNLQSGNQ

SEQ ID NO: 61337 - protein, 34 aa, Artificial Sequence
  Description of Artificial Sequence: Synthetic polypeptide
DEEEIRTTNPVATEQYGQCVCSTNLQNFGSENQQ

SEQ ID NO: 61338 - protein, 32 aa, Artificial Sequence
  Description of Artificial Sequence: Synthetic polypeptide
NEEEIATTNPVATEQYGSVATNLQREGDTDAV

SEQ ID NO: 61339 - protein, 34 aa, Artificial Sequence
  Description of Artificial Sequence: Synthetic polypeptide
DEEEIRTTNPVATEQYGQCVCSTNLNQYFGSNQE

SEQ ID NO: 61340 - protein, 33 aa, Artificial Sequence
  Description of Artificial Sequence: Synthetic polypeptide
NEEEIATTNPVATEQYGSVATNNLPQRGGENDQ

SEQ ID NO: 61341 - protein, 31 aa, Artificial Sequence
  Description of Artificial Sequence: Synthetic polypeptide
NEEEIATTNPVATEQYGSVATNNQENGNDPA

SEQ ID NO: 61342 - protein, 30 aa, Artificial Sequence
  Description of Artificial Sequence: Synthetic polypeptide
NEEEIATTNPVATEQYGSVISWEHGQRQGR

SEQ ID NO: 61343 - protein, 31 aa, Artificial Sequence
  Description of Artificial Sequence: Synthetic polypeptide
NEEEIATTNPVATEQYGSVLSWEHEQRQGSR

SEQ ID NO: 61344 - protein, 34 aa, Artificial Sequence
  Description of Artificial Sequence: Synthetic polypeptide
DEEEIRTTNPVATEQYGQCVCSTNHQNFGSNPRL

SEQ ID NO: 61345 - protein, 33 aa, Artificial Sequence
  Description of Artificial Sequence: Synthetic polypeptide
DEEEIRTTNPVATEQYGQCVCSTNDQNFGSNQI

SEQ ID NO: 61346 - protein, 33 aa, Artificial Sequence
  Description of Artificial Sequence: Synthetic polypeptide
DEEEIRTTNPVATEQYGQCVCSTNLQNPSNNQS

SEQ ID NO: 61347 - protein, 33 aa, Artificial Sequence
  Description of Artificial Sequence: Synthetic polypeptide
DEEEIRTTNPVATEQYGQCVCSTNDQHFGSNTQ

SEQ ID NO: 61348 - protein, 31 aa, Artificial Sequence
  Description of Artificial Sequence: Synthetic polypeptide
NEEEIATTNPVATEQYGSVSATNPDEAGGNH

SEQ ID NO: 61349 - protein, 33 aa, Artificial Sequence
  Description of Artificial Sequence: Synthetic polypeptide
DEEEIRTTNPVATEQYGQCVCSTGELQRGSEQG

SEQ ID NO: 61350 - protein, 30 aa, Artificial Sequence
  Description of Artificial Sequence: Synthetic polypeptide
NEEEIATTNPVATESYGCIAANLQDRGGNR

SEQ ID NO: 61351 - protein, 34 aa, Artificial Sequence
  Description of Artificial Sequence: Synthetic polypeptide
DEEEIRTTNPVATEQYGQCVCSTENLDQNGSNQT

SEQ ID NO: 61352 - protein, 33 aa, Artificial Sequence
  Description of Artificial Sequence: Synthetic polypeptide
DEEEIRTTNPVATEQYGQCVCSTELQSMGSNQA

SEQ ID NO: 61353 - protein, 33 aa, Artificial Sequence
  Description of Artificial Sequence: Synthetic polypeptide
DEEEIRTTNPVATEQYGQCVCSTELQHFGSNQE

SEQ ID NO: 61354 - protein, 32 aa, Artificial Sequence
  Description of Artificial Sequence: Synthetic polypeptide
DEEEIRTTNPVATEQYGQCVCSTELQGGSEQQ

SEQ ID NO: 61355 - protein, 31 aa, Artificial Sequence
  Description of Artificial Sequence: Synthetic polypeptide
NEEEIATTNPVAYEQYGSVAATNLQNDGNVQ

SEQ ID NO: 61356 - protein, 32 aa, Artificial Sequence
  Description of Artificial Sequence: Synthetic polypeptide
DEEEIRTTNPVATEQYGQCVCSTELERGSDDM

SEQ ID NO: 61357 - protein, 31 aa, Artificial Sequence
  Description of Artificial Sequence: Synthetic polypeptide
NEEEIATTNPVATEQYGSVSAGNLDEAGNSS

SEQ ID NO: 61358 - protein, 32 aa, Artificial Sequence
  Description of Artificial Sequence: Synthetic polypeptide
NEEEIATTNPVATEQYGSVATNLQAEDPGEND

SEQ ID NO: 61359 - protein, 34 aa, Artificial Sequence
  Description of Artificial Sequence: Synthetic polypeptide
DEEEIRTTNPVATEQYGQCVCSTNLQYFGSDNQL

SEQ ID NO: 61360 - protein, 31 aa, Artificial Sequence
  Description of Artificial Sequence: Synthetic polypeptide
NEEEIATTNPVATEQYGSVATNLQAEAANND

SEQ ID NO: 61361 - protein, 28 aa, Artificial Sequence
  Description of Artificial Sequence: Synthetic peptide
NEEEIASVNPVGTEQYGVVSGNLQSGNH

SEQ ID NO: 61362 - protein, 28 aa, Artificial Sequence
  Description of Artificial Sequence: Synthetic peptide
NEEEIASVNPVGTEQYGVVSSNLQHGNQ

SEQ ID NO: 61363 - protein, 30 aa, Artificial Sequence
  Description of Artificial Sequence: Synthetic polypeptide
NEEEIATTNPVATEQWGAVAATENLQQGND

SEQ ID NO: 61364 - protein, 30 aa, Artificial Sequence
  Description of Artificial Sequence: Synthetic polypeptide
NEEEIATTNPVATEQWGAVATNLQRNPNPE

SEQ ID NO: 61365 - protein, 30 aa, Artificial Sequence
  Description of Artificial Sequence: Synthetic polypeptide
NEEEIATTNPVATEQWGNVSVTDLQGGNDS

SEQ ID NO: 61366 - protein, 32 aa, Artificial Sequence
  Description of Artificial Sequence: Synthetic polypeptide
DEEEIRTTNPVATEQYGQCVSTELQNFGSQFP

SEQ ID NO: 61367 - protein, 32 aa, Artificial Sequence
  Description of Artificial Sequence: Synthetic polypeptide
DEEEIRTTNPVATEQYGQCVSTELQHFGSDQG

SEQ ID NO: 61368 - protein, 31 aa, Artificial Sequence
  Description of Artificial Sequence: Synthetic polypeptide
NEEEIATTNPVATEQWGSVSAENLQRVNPLT

SEQ ID NO: 61369 - protein, 32 aa, Artificial Sequence
  Description of Artificial Sequence: Synthetic polypeptide
NEEEIATTNPVATEQYGNVSHTMNDQQGNGNR

SEQ ID NO: 61370 - protein, 32 aa, Artificial Sequence
  Description of Artificial Sequence: Synthetic polypeptide
NEEEIATTNPVATEQYGNVSVTMLQDGNGENR

SEQ ID NO: 61371 - protein, 29 aa, Artificial Sequence
  Description of Artificial Sequence: Synthetic peptide
NEEEIATTNPVATEQYGSCATHLQDHQGR

SEQ ID NO: 61372 - protein, 32 aa, Artificial Sequence
  Description of Artificial Sequence: Synthetic polypeptide
DEEEIRTTNPVATEQYGQCVSSELQNFGSNQL

SEQ ID NO: 61373 - protein, 32 aa, Artificial Sequence
  Description of Artificial Sequence: Synthetic polypeptide
DEEEIRTTNPVATEQYGQCVSSEHQRFGSERQ

SEQ ID NO: 61374 - protein, 32 aa, Artificial Sequence
  Description of Artificial Sequence: Synthetic polypeptide
NEEEIATTNPVATEQYGSCSTHLEQRDQGDRH

SEQ ID NO: 61375 - protein, 30 aa, Artificial Sequence
  Description of Artificial Sequence: Synthetic polypeptide
NEEEIATTNPVATEQYGSCSTHLQDDQGGD

SEQ ID NO: 61376 - protein, 33 aa, Artificial Sequence
  Description of Artificial Sequence: Synthetic polypeptide
DEEEIRTTNPVATEQYGQCVSMTNTQNFGSNQA

SEQ ID NO: 61377 - protein, 32 aa, Artificial Sequence
  Description of Artificial Sequence: Synthetic polypeptide
NEEEIATTNPVATEQYGSVAITNLQVGDNPDE

SEQ ID NO: 61378 - protein, 31 aa, Artificial Sequence
  Description of Artificial Sequence: Synthetic polypeptide
NEEEIATTNPVATEQYGSVATNIQENGNELA

SEQ ID NO: 61379 - protein, 32 aa, Artificial Sequence
  Description of Artificial Sequence: Synthetic polypeptide
DEEEIRTTNPVATEQYGQCVCSTYDQFFGSNA

SEQ ID NO: 61380 - protein, 29 aa, Artificial Sequence
  Description of Artificial Sequence: Synthetic peptide
NEEEIATTNPVATEQYGSVATNLEDPDAE

SEQ ID NO: 61381 - protein, 32 aa, Artificial Sequence
  Description of Artificial Sequence: Synthetic polypeptide
NEEEIATTNPVATEQYGSVATNLPQDSGGERN

SEQ ID NO: 61382 - protein, 32 aa, Artificial Sequence
  Description of Artificial Sequence: Synthetic polypeptide
DEEEIRTTNPVATEQYGQCVCSTEHQRFTSNQ

SEQ ID NO: 61383 - protein, 33 aa, Artificial Sequence
  Description of Artificial Sequence: Synthetic polypeptide
FEEEIRTTNPVATEQYGSVSTNNPTQTEIGNET

SEQ ID NO: 61384 - protein, 34 aa, Artificial Sequence
  Description of Artificial Sequence: Synthetic polypeptide
DEEEIRTTNPVATEQYGSASQTTNTLQRMVENDL

SEQ ID NO: 61385 - protein, 31 aa, Artificial Sequence
  Description of Artificial Sequence: Synthetic polypeptide
DEEEIRTTNPVATEQYGSASSNHQGSDTDRI

SEQ ID NO: 61386 - protein, 32 aa, Artificial Sequence
  Description of Artificial Sequence: Synthetic polypeptide
DEEEIRTTNPVATEQYGSCSTNLFDSNFEDDF

SEQ ID NO: 61387 - protein, 30 aa, Artificial Sequence
  Description of Artificial Sequence: Synthetic polypeptide
DTEEIRTTNPQATEHYGSVSFNLQRETQFE

SEQ ID NO: 61388 - protein, 32 aa, Artificial Sequence
  Description of Artificial Sequence: Synthetic polypeptide
DTEEIRTTNPQATEHYGSVSFNLTQREENMRE

SEQ ID NO: 61389 - protein, 29 aa, Artificial Sequence
  Description of Artificial Sequence: Synthetic peptide
DTEEIRTTNPQATEHYGSVSFPLERQVNV

SEQ ID NO: 61390 - protein, 30 aa, Artificial Sequence
  Description of Artificial Sequence: Synthetic polypeptide
DTEEIRTTNPSATETYGSVSVVLEAQAENR

SEQ ID NO: 61391 - protein, 34 aa, Artificial Sequence
  Description of Artificial Sequence: Synthetic polypeptide
DTEEIRTTNPVATEPYGCSVVSCTNELQRPTNIR

SEQ ID NO: 61392 - protein, 32 aa, Artificial Sequence
  Description of Artificial Sequence: Synthetic polypeptide
DEEEIRTTNPVATEQYGSCSTNILDPGGVDDD

SEQ ID NO: 61393 - protein, 31 aa, Artificial Sequence
  Description of Artificial Sequence: Synthetic polypeptide
DTEEIRTTNPVATEQWGSVTVTLLQQGNTEE

SEQ ID NO: 61394 - protein, 30 aa, Artificial Sequence
  Description of Artificial Sequence: Synthetic polypeptide
DTEEIRTTNPVATEQWGSVTVTTLLQGGTD

SEQ ID NO: 61395 - protein, 30 aa, Artificial Sequence
  Description of Artificial Sequence: Synthetic polypeptide
DTEEIRTTNPQATEHYGSVSFNLQREETEM

SEQ ID NO: 61396 - protein, 30 aa, Artificial Sequence
  Description of Artificial Sequence: Synthetic polypeptide
DTEEIRTTNPVATEQWGSVTVTTLLQSGTT

SEQ ID NO: 61397 - protein, 30 aa, Artificial Sequence
  Description of Artificial Sequence: Synthetic polypeptide
DTEEIRTTNPVATEQWGVVTVTNLNQQGTE

SEQ ID NO: 61398 - protein, 32 aa, Artificial Sequence
  Description of Artificial Sequence: Synthetic polypeptide
DTEEIRTTNPVATEQYGSVAVTNMDQMGGNNN

SEQ ID NO: 61399 - protein, 30 aa, Artificial Sequence
  Description of Artificial Sequence: Synthetic polypeptide
DTEEIRTTNPVATEQYGVVNNTVPEQSGNA

SEQ ID NO: 61400 - protein, 31 aa, Artificial Sequence
  Description of Artificial Sequence: Synthetic polypeptide
DTEEIRTTNPVATTQYGSVSTDNGVENGNGG

SEQ ID NO: 61401 - protein, 32 aa, Artificial Sequence
  Description of Artificial Sequence: Synthetic polypeptide
DTEEIRTTNPVATTQYGSVSTSNGTQNGNNTD

SEQ ID NO: 61402 - protein, 32 aa, Artificial Sequence
  Description of Artificial Sequence: Synthetic polypeptide
DTEEIRTTNPVATTQYGSVSTTNGNQNGNGQD

SEQ ID NO: 61403 - protein, 32 aa, Artificial Sequence
  Description of Artificial Sequence: Synthetic polypeptide
DTEEIRTTNPVATTQYGSVSTTNGTQNGNNGT

SEQ ID NO: 61404 - protein, 32 aa, Artificial Sequence
  Description of Artificial Sequence: Synthetic polypeptide
DTEEIRTTNPVATTQYGSVSTVNGTNQNGNNG

SEQ ID NO: 61405 - protein, 33 aa, Artificial Sequence
  Description of Artificial Sequence: Synthetic polypeptide
DEEEIRTTNPVATEQYGSCSTNDQHVFGENSSI

SEQ ID NO: 61406 - protein, 34 aa, Artificial Sequence
  Description of Artificial Sequence: Synthetic polypeptide
DEEEIRTTNPVATEQYGSCSTNFLFPRVGDEERI

SEQ ID NO: 61407 - protein, 33 aa, Artificial Sequence
  Description of Artificial Sequence: Synthetic polypeptide
DEEEIRTTNPVATEQYGSCSTNDQHRSLENSSI

SEQ ID NO: 61408 - protein, 32 aa, Artificial Sequence
  Description of Artificial Sequence: Synthetic polypeptide
DTEEIRTTNPQATEHYGSVSFNLQFREENFRE

SEQ ID NO: 61409 - protein, 30 aa, Artificial Sequence
  Description of Artificial Sequence: Synthetic polypeptide
DTEEIRTTNPCATETYGSVSVNTAQIAENR

SEQ ID NO: 61410 - protein, 32 aa, Artificial Sequence
  Description of Artificial Sequence: Synthetic polypeptide
DTEEIRSTNPVAYEAYGSVVSCTNLQNGGTNR

SEQ ID NO: 61411 - protein, 31 aa, Artificial Sequence
  Description of Artificial Sequence: Synthetic polypeptide
DTEEIRSTNPVAYEQWGCSDVSTNLQNGTDR

SEQ ID NO: 61412 - protein, 30 aa, Artificial Sequence
  Description of Artificial Sequence: Synthetic polypeptide
DTEEIRSTNPVAYEQWGSNVSTNDQNGMTR

SEQ ID NO: 61413 - protein, 30 aa, Artificial Sequence
  Description of Artificial Sequence: Synthetic polypeptide
DTEEIRSTNPVAYEQWGSNVSTNLDGNGTR

SEQ ID NO: 61414 - protein, 30 aa, Artificial Sequence
  Description of Artificial Sequence: Synthetic polypeptide
DTEEIRTTNPCATEAYGSVSNVNLQNEENQ

SEQ ID NO: 61415 - protein, 31 aa, Artificial Sequence
  Description of Artificial Sequence: Synthetic polypeptide
DTEEIRTTNPCATEAYGSVSTVNLDQQNENQ

SEQ ID NO: 61416 - protein, 31 aa, Artificial Sequence
  Description of Artificial Sequence: Synthetic polypeptide
DTEEIRTTNPCATEAYGSVSTVNLQLEENNQ

SEQ ID NO: 61417 - protein, 31 aa, Artificial Sequence
  Description of Artificial Sequence: Synthetic polypeptide
DTEEIRTTNPCATEAYGSVSTVNNLQEEENQ

SEQ ID NO: 61418 - protein, 32 aa, Artificial Sequence
  Description of Artificial Sequence: Synthetic polypeptide
DTEEIRTTNPCATEAYGSVSTVNNLQREENNE

SEQ ID NO: 61419 - protein, 30 aa, Artificial Sequence
  Description of Artificial Sequence: Synthetic polypeptide
DTEEIRTTNPQATEHYGSVSFNLEREENTS

SEQ ID NO: 61420 - protein, 32 aa, Artificial Sequence
  Description of Artificial Sequence: Synthetic polypeptide
DTEEIRTTNPCATEAYGSVSTVNNNLQRENNQ

SEQ ID NO: 61421 - protein, 30 aa, Artificial Sequence
  Description of Artificial Sequence: Synthetic polypeptide
DTEEIRTTNPCATEHWGSVYFNDQREGNGR

SEQ ID NO: 61422 - protein, 31 aa, Artificial Sequence
  Description of Artificial Sequence: Synthetic polypeptide
DTEEIRTTNPCATEHWGSVYFNLDQRNEGNR

SEQ ID NO: 61423 - protein, 29 aa, Artificial Sequence
  Description of Artificial Sequence: Synthetic peptide
DTEEIRTTNPCATEHWGSVYFNLQDENDR

SEQ ID NO: 61424 - protein, 30 aa, Artificial Sequence
  Description of Artificial Sequence: Synthetic polypeptide
DTEEIRTTNPCATEHWGSVYFNLQDRENNR

SEQ ID NO: 61425 - protein, 30 aa, Artificial Sequence
  Description of Artificial Sequence: Synthetic polypeptide
DTEEIRTTNPCATEHWGSVYYFNDQRGENR

SEQ ID NO: 61426 - protein, 29 aa, Artificial Sequence
  Description of Artificial Sequence: Synthetic peptide
DTEEIRTTNPCATEHYGCVCSWNDQRNNQ

SEQ ID NO: 61427 - protein, 29 aa, Artificial Sequence
  Description of Artificial Sequence: Synthetic peptide
DTEEIRTTNPCATEHYGCVSWELQRNSNQ

SEQ ID NO: 61428 - protein, 29 aa, Artificial Sequence
  Description of Artificial Sequence: Synthetic peptide
DTEEIRTTNPCATEMYGSVSVIAQAPENR

SEQ ID NO: 61429 - protein, 29 aa, Artificial Sequence
  Description of Artificial Sequence: Synthetic peptide
DTEEIRTTNPCATEMYGSVSVNEAEAENR

SEQ ID NO: 61430 - protein, 29 aa, Artificial Sequence
  Description of Artificial Sequence: Synthetic peptide
DTEEIRTTNPCATEAYGSVSVETAQAENR

SEQ ID NO: 61431 - protein, 32 aa, Artificial Sequence
  Description of Artificial Sequence: Synthetic polypeptide
DEEEIRTTNPVATEQYGSCSTNDQHRSETSSI

SEQ ID NO: 61432 - protein, 33 aa, Artificial Sequence
  Description of Artificial Sequence: Synthetic polypeptide
DEEEIRTTNPVATEQYGSCSTNDQHGGSENSSI

SEQ ID NO: 61433 - protein, 33 aa, Artificial Sequence
  Description of Artificial Sequence: Synthetic polypeptide
DEEEIRTTNPVATEQYGSCSTNDQHAVGENSQI

SEQ ID NO: 61434 - protein, 31 aa, Artificial Sequence
  Description of Artificial Sequence: Synthetic polypeptide
EEEEIACTNPVATEQYGSVATNHQEREGNEN

SEQ ID NO: 61435 - protein, 31 aa, Artificial Sequence
  Description of Artificial Sequence: Synthetic polypeptide
EEEEIACTNPVATEQYGSVATNLQDAGNPEE

SEQ ID NO: 61436 - protein, 28 aa, Artificial Sequence
  Description of Artificial Sequence: Synthetic peptide
EEEEIASVNPVCTEQYGVVSDNLQGGNQ

SEQ ID NO: 61437 - protein, 28 aa, Artificial Sequence
  Description of Artificial Sequence: Synthetic peptide
EEEEIASVNPVCTEQYGVVSDNLQSGNL

SEQ ID NO: 61438 - protein, 28 aa, Artificial Sequence
  Description of Artificial Sequence: Synthetic peptide
EEEEIASVNPVCTEQYGVVSDNLQSGNQ

SEQ ID NO: 61439 - protein, 28 aa, Artificial Sequence
  Description of Artificial Sequence: Synthetic peptide
EEEEIASVNPVCTEQYGVVSSNLQSGNT

SEQ ID NO: 61440 - protein, 30 aa, Artificial Sequence
  Description of Artificial Sequence: Synthetic polypeptide
EEEEIATTNPVATEQYGSVATALQNGDLDM

SEQ ID NO: 61441 - protein, 32 aa, Artificial Sequence
  Description of Artificial Sequence: Synthetic polypeptide
EEEEIATTNPVATEQYGSVATNLQDGGDNPEM

SEQ ID NO: 61442 - protein, 31 aa, Artificial Sequence
  Description of Artificial Sequence: Synthetic polypeptide
DEEEIRTTNPVATEQYGSCSTDDQYNGEIPQ

SEQ ID NO: 61443 - protein, 30 aa, Artificial Sequence
  Description of Artificial Sequence: Synthetic polypeptide
EEAEIRTTNPVAYEQYGTVSTNLQGNGGEA

SEQ ID NO: 61444 - protein, 31 aa, Artificial Sequence
  Description of Artificial Sequence: Synthetic polypeptide
EEEEIATTNPVATEQYGSVATNLQIATNPEE

SEQ ID NO: 61445 - protein, 33 aa, Artificial Sequence
  Description of Artificial Sequence: Synthetic polypeptide
DEEEIRTTNPVATEQYGSCSTAPPLDRIGENNE

SEQ ID NO: 61446 - protein, 32 aa, Artificial Sequence
  Description of Artificial Sequence: Synthetic polypeptide
DEEEIRTTNPVATEQYGSCSSTNIEMGMIDRQ

SEQ ID NO: 61447 - protein, 33 aa, Artificial Sequence
  Description of Artificial Sequence: Synthetic polypeptide
EEEEIRTTNPCATEQYGCVSTGNGNMQRGENDR

SEQ ID NO: 61448 - protein, 32 aa, Artificial Sequence
  Description of Artificial Sequence: Synthetic polypeptide
EEEEIRTTNPVATEAYGSVASTFNLDNAGNVQ

SEQ ID NO: 61449 - protein, 33 aa, Artificial Sequence
  Description of Artificial Sequence: Synthetic polypeptide
EEEEIRTTNPVATEQWGSVSATSGLQQSGNMER

SEQ ID NO: 61450 - protein, 33 aa, Artificial Sequence
  Description of Artificial Sequence: Synthetic polypeptide
DEEEIRTTNPVATEQYGSCSPTTMQQRGEEARQ

SEQ ID NO: 61451 - protein, 34 aa, Artificial Sequence
  Description of Artificial Sequence: Synthetic polypeptide
DEEEIRTTNPVATEQYGSCSPTPTLQRDGQNSQE

SEQ ID NO: 61452 - protein, 33 aa, Artificial Sequence
  Description of Artificial Sequence: Synthetic polypeptide
DEEEIRTTNPVATEQYGSCSPTNWEWNRSGSDR

SEQ ID NO: 61453 - protein, 32 aa, Artificial Sequence
  Description of Artificial Sequence: Synthetic polypeptide
DEEEIRTTNPVATEQYGSCSPTNTNMRNMENE

SEQ ID NO: 61454 - protein, 32 aa, Artificial Sequence
  Description of Artificial Sequence: Synthetic polypeptide
EEEEIATTNPVAYEQYGSVSCTNNISQIGSNR

SEQ ID NO: 61455 - protein, 32 aa, Artificial Sequence
  Description of Artificial Sequence: Synthetic polypeptide
DEEEIRTTNPVATEQYGSCSTDNDLTETNEPQ

SEQ ID NO: 61456 - protein, 32 aa, Artificial Sequence
  Description of Artificial Sequence: Synthetic polypeptide
EEAEIRTTNPVATEQYGSVSTNLNGEHGNNSN

SEQ ID NO: 61457 - protein, 31 aa, Artificial Sequence
  Description of Artificial Sequence: Synthetic polypeptide
EDEEIRTTNPVATEQYGVVSTTNLQGDNPNS

SEQ ID NO: 61458 - protein, 31 aa, Artificial Sequence
  Description of Artificial Sequence: Synthetic polypeptide
DTEEIRVTNPVAYEQWGSNVSTNLQDNGGTR

SEQ ID NO: 61459 - protein, 31 aa, Artificial Sequence
  Description of Artificial Sequence: Synthetic polypeptide
DTEEIRYTNPVATEQYGCSVSTNLENIGTQI

SEQ ID NO: 61460 - protein, 32 aa, Artificial Sequence
  Description of Artificial Sequence: Synthetic polypeptide
DTEEIRYTNPVATEQYGNKVSTMNLPQNGTRP

SEQ ID NO: 61461 - protein, 31 aa, Artificial Sequence
  Description of Artificial Sequence: Synthetic polypeptide
DTEEIRYTNPVATEQYGSKVCSTNLENGTQI

SEQ ID NO: 61462 - protein, 31 aa, Artificial Sequence
  Description of Artificial Sequence: Synthetic polypeptide
DTEEIRYTNPVATEQYGSNCSTNLENNGTQR

SEQ ID NO: 61463 - protein, 28 aa, Artificial Sequence
  Description of Artificial Sequence: Synthetic peptide
DTGEIATTNPCAYEPYGSVSANLQREPR

SEQ ID NO: 61464 - protein, 31 aa, Artificial Sequence
  Description of Artificial Sequence: Synthetic polypeptide
DTTEIRTTNPVATEQYGSVSTNTEQLGEEEA

SEQ ID NO: 61465 - protein, 31 aa, Artificial Sequence
  Description of Artificial Sequence: Synthetic polypeptide
DTTEIRTTNPVATEQYGSVSTNTQEQLGEMA

SEQ ID NO: 61466 - protein, 33 aa, Artificial Sequence
  Description of Artificial Sequence: Synthetic polypeptide
DTTEIRTTNPVATEQYGSVSTTNTLNQLGGNAD

SEQ ID NO: 61467 - protein, 32 aa, Artificial Sequence
  Description of Artificial Sequence: Synthetic polypeptide
DTTEIRTTNPVATEQYGVVNSTVNLQAGNNAD

SEQ ID NO: 61468 - protein, 31 aa, Artificial Sequence
  Description of Artificial Sequence: Synthetic polypeptide
DTTEIRTTNPVATEQYGVVNSTVTLQAGTNQ

SEQ ID NO: 61469 - protein, 30 aa, Artificial Sequence
  Description of Artificial Sequence: Synthetic polypeptide
DTTEIRTTNPVATEQYGVVNSTVTQAGNLQ

SEQ ID NO: 61470 - protein, 31 aa, Artificial Sequence
  Description of Artificial Sequence: Synthetic polypeptide
DTTEIRTTNPVATEQYGVVNVSTVLQAGNQQ

SEQ ID NO: 61471 - protein, 31 aa, Artificial Sequence
  Description of Artificial Sequence: Synthetic polypeptide
DTTEIRTTNPVATEQYGVVVNSTVLQAGNQS

SEQ ID NO: 61472 - protein, 31 aa, Artificial Sequence
  Description of Artificial Sequence: Synthetic polypeptide
DVEEIRTTNPVATEQYGSVSFNLDNNLGDET

SEQ ID NO: 61473 - protein, 30 aa, Artificial Sequence
  Description of Artificial Sequence: Synthetic polypeptide
EDEEICTTNPVATEQWGTVSTNLQQEQGNE

SEQ ID NO: 61474 - protein, 32 aa, Artificial Sequence
  Description of Artificial Sequence: Synthetic polypeptide
DEEEIRTTNPVATEQYGSCSTENDLDRAFEIL

SEQ ID NO: 61475 - protein, 31 aa, Artificial Sequence
  Description of Artificial Sequence: Synthetic polypeptide
EDEEICTTNPVATEQYGVVSTVNLQLGQNST

SEQ ID NO: 61476 - protein, 31 aa, Artificial Sequence
  Description of Artificial Sequence: Synthetic polypeptide
EDEEIRTTNPVATEQYGVVSTNLNQNDNPNS

SEQ ID NO: 61477 - protein, 31 aa, Artificial Sequence
  Description of Artificial Sequence: Synthetic polypeptide
EDEEIRTTNPVATEQYGVVSTNLQDNPNNST

SEQ ID NO: 61478 - protein, 31 aa, Artificial Sequence
  Description of Artificial Sequence: Synthetic polypeptide
EDEEIRTTNPVATEQYGVVSTNLQQDNPNSE

SEQ ID NO: 61479 - protein, 34 aa, Artificial Sequence
  Description of Artificial Sequence: Synthetic polypeptide
DTEEIRCTNPVATEQYGSVVSTNELSQNTGGTNR

SEQ ID NO: 61480 - protein, 34 aa, Artificial Sequence
  Description of Artificial Sequence: Synthetic polypeptide
DEEEIRTTNPVATEQYGSCSPTNPLPERGENETL

SEQ ID NO: 61481 - protein, 32 aa, Artificial Sequence
  Description of Artificial Sequence: Synthetic polypeptide
DTEEIRATNPVATEQYGSVVVTTTNLQNGNTD

SEQ ID NO: 61482 - protein, 32 aa, Artificial Sequence
  Description of Artificial Sequence: Synthetic polypeptide
DTEEIRATNPVATEQYGSVVVSTTNLQQNGTE

SEQ ID NO: 61483 - protein, 34 aa, Artificial Sequence
  Description of Artificial Sequence: Synthetic polypeptide
DSEEIRTTNPVATEQYGSVSCTGNALSDTGGNVR

SEQ ID NO: 61484 - protein, 33 aa, Artificial Sequence
  Description of Artificial Sequence: Synthetic polypeptide
DSEEIRTTNPVATERYGKVSCTNALSDRGGNDR

SEQ ID NO: 61485 - protein, 33 aa, Artificial Sequence
  Description of Artificial Sequence: Synthetic polypeptide
DSEEIRTTNPVATHQYGSVVSTNEVSQNGGNNR

SEQ ID NO: 61486 - protein, 31 aa, Artificial Sequence
  Description of Artificial Sequence: Synthetic polypeptide
DSEEIRTTNPVAYEQWGSVPSCTLLQSGGTR

SEQ ID NO: 61487 - protein, 31 aa, Artificial Sequence
  Description of Artificial Sequence: Synthetic polypeptide
DSEEIRTTNPVAYEQWGSVPSTGELQRVGTD

SEQ ID NO: 61488 - protein, 31 aa, Artificial Sequence
  Description of Artificial Sequence: Synthetic polypeptide
DSEEIRTTNPVAYEQWGSVVSTLLSQSGGTR

SEQ ID NO: 61489 - protein, 31 aa, Artificial Sequence
  Description of Artificial Sequence: Synthetic polypeptide
DSEEIRTTNPVAYEQYGKVVFTNLGNGGNNR

SEQ ID NO: 61490 - protein, 30 aa, Artificial Sequence
  Description of Artificial Sequence: Synthetic polypeptide
DSEEIRTTNPVCTEQWGMVSTNLLQREVQG

SEQ ID NO: 61491 - protein, 31 aa, Artificial Sequence
  Description of Artificial Sequence: Synthetic polypeptide
DSEEIRTTNPVGTEHWGMVSTGNDLQDRGVR

SEQ ID NO: 61492 - protein, 33 aa, Artificial Sequence
  Description of Artificial Sequence: Synthetic polypeptide
DSEEIRTTNPVATEQYGSVNSTNDQQNGNNEQG

SEQ ID NO: 61493 - protein, 31 aa, Artificial Sequence
  Description of Artificial Sequence: Synthetic polypeptide
DSEEIRTTNPVGTEQWGCVCSMTNLQRGSVQ

SEQ ID NO: 61494 - protein, 30 aa, Artificial Sequence
  Description of Artificial Sequence: Synthetic polypeptide
DSEEIRTTNPVGTEQWGCVCSTNHQRFGVA

SEQ ID NO: 61495 - protein, 31 aa, Artificial Sequence
  Description of Artificial Sequence: Synthetic polypeptide
DSEEIRTTNPVGTEQWGCVCSTNLQNFGVRA

SEQ ID NO: 61496 - protein, 30 aa, Artificial Sequence
  Description of Artificial Sequence: Synthetic polypeptide
DSEEIRTTNPVGTEQWGCVSTNHQRGSVAS

SEQ ID NO: 61497 - protein, 32 aa, Artificial Sequence
  Description of Artificial Sequence: Synthetic polypeptide
DSEEIRTTNPVGTEQWGKVPSCTNELQRGGVR

SEQ ID NO: 61498 - protein, 31 aa, Artificial Sequence
  Description of Artificial Sequence: Synthetic polypeptide
DSEEIRTTNPVGTEQWGMCVSTNLQREEVSR

SEQ ID NO: 61499 - protein, 31 aa, Artificial Sequence
  Description of Artificial Sequence: Synthetic polypeptide
DSEEIRTTNPVGTEQWGMCVSTSNLQRGEQD

SEQ ID NO: 61500 - protein, 32 aa, Artificial Sequence
  Description of Artificial Sequence: Synthetic polypeptide
DSEEIRTTNPVGTEQWGMVCSTNDLQRDGEVR

SEQ ID NO: 61501 - protein, 30 aa, Artificial Sequence
  Description of Artificial Sequence: Synthetic polypeptide
DSEEIRTTNPVGTEQWGTVSTNLQGGPDQQ

SEQ ID NO: 61502 - protein, 29 aa, Artificial Sequence
  Description of Artificial Sequence: Synthetic peptide
DSEEIRTTNPVGTEQWGTVSTNLQHDDEQ

SEQ ID NO: 61503 - protein, 32 aa, Artificial Sequence
  Description of Artificial Sequence: Synthetic polypeptide
DSEEIRTTNPVGTEQWGCVCSTNDLQRFGSVR

SEQ ID NO: 61504 - protein, 31 aa, Artificial Sequence
  Description of Artificial Sequence: Synthetic polypeptide
DSEEIRTTNPVGTEQWGTVSTNLQHGDDMAR

SEQ ID NO: 61505 - protein, 30 aa, Artificial Sequence
  Description of Artificial Sequence: Synthetic polypeptide
DEEEIRTTNPVATEQYGSCSTPPQSETEED

SEQ ID NO: 61506 - protein, 33 aa, Artificial Sequence
  Description of Artificial Sequence: Synthetic polypeptide
DSEEIRTTNPVATEQYGKVSCTNALSDRVTNDR

SEQ ID NO: 61507 - protein, 30 aa, Artificial Sequence
  Description of Artificial Sequence: Synthetic polypeptide
DSEEIRTTNPCATEAYGSVACTNHSGRGNA

SEQ ID NO: 61508 - protein, 33 aa, Artificial Sequence
  Description of Artificial Sequence: Synthetic polypeptide
DSEEIRTTNPCATEHYGSVSCFNLSQRPEGNNR

SEQ ID NO: 61509 - protein, 31 aa, Artificial Sequence
  Description of Artificial Sequence: Synthetic polypeptide
DSEEIRTTNPMAYEHYGSVSCINLSQMEGNR

SEQ ID NO: 61510 - protein, 32 aa, Artificial Sequence
  Description of Artificial Sequence: Synthetic polypeptide
DSEEIRTTNPMAYEQYGSVPATNLSQRGGNQA

SEQ ID NO: 61511 - protein, 32 aa, Artificial Sequence
  Description of Artificial Sequence: Synthetic polypeptide
DSEEIRTTNPTAYEHYGQSVSCINLSQRSGNR

SEQ ID NO: 61512 - protein, 31 aa, Artificial Sequence
  Description of Artificial Sequence: Synthetic polypeptide
DSEEIRTTNPTAYEHYGSVSCFNLSQRENNR

SEQ ID NO: 61513 - protein, 32 aa, Artificial Sequence
  Description of Artificial Sequence: Synthetic polypeptide
DSEEIRTTNPVATEAWGSVMCTNLSQSSGNRV

SEQ ID NO: 61514 - protein, 32 aa, Artificial Sequence
  Description of Artificial Sequence: Synthetic polypeptide
DSEEIRTTNPVATEAWGSVPSCTLLSQRGTTR

SEQ ID NO: 61515 - protein, 32 aa, Artificial Sequence
  Description of Artificial Sequence: Synthetic polypeptide
DSEEIRTTNPVATEAWGSVPSTLLSQPGTTNR

SEQ ID NO: 61516 - protein, 33 aa, Artificial Sequence
  Description of Artificial Sequence: Synthetic polypeptide
DSEEIRTTNPVATEQYGQVSCTNALSDRGGSLR

SEQ ID NO: 61517 - protein, 32 aa, Artificial Sequence
  Description of Artificial Sequence: Synthetic polypeptide
DSEEIRTTNPVATEPWGSVSVTNLSQENGGSR

SEQ ID NO: 61518 - protein, 30 aa, Artificial Sequence
  Description of Artificial Sequence: Synthetic polypeptide
DSEEIRTTNPVATEQWGAVTWTLLQRDTQR

SEQ ID NO: 61519 - protein, 33 aa, Artificial Sequence
  Description of Artificial Sequence: Synthetic polypeptide
DSEEIRTTNPVATEQWGSVAYTHSLLQRTGDNR

SEQ ID NO: 61520 - protein, 33 aa, Artificial Sequence
  Description of Artificial Sequence: Synthetic polypeptide
DSEEIRTTNPVATEQWGSVPSCTTMLSQRGTTR

SEQ ID NO: 61521 - protein, 32 aa, Artificial Sequence
  Description of Artificial Sequence: Synthetic polypeptide
DSEEIRTTNPVATEQWGSVSTNMHSPQTGGNH

SEQ ID NO: 61522 - protein, 32 aa, Artificial Sequence
  Description of Artificial Sequence: Synthetic polypeptide
DSEEIRTTNPVATEQWGSVTSTALLQRGTQDM

SEQ ID NO: 61523 - protein, 32 aa, Artificial Sequence
  Description of Artificial Sequence: Synthetic polypeptide
DSEEIRTTNPVATEQWGSVTTNTLLQRGTQYM

SEQ ID NO: 61524 - protein, 31 aa, Artificial Sequence
  Description of Artificial Sequence: Synthetic polypeptide
DSEEIRTTNPVATEQWGVVTSTLLQIGTQRM

SEQ ID NO: 61525 - protein, 32 aa, Artificial Sequence
  Description of Artificial Sequence: Synthetic polypeptide
DSEEIRTTNPVATEQYGCVSTNLQPNGDEDKI

SEQ ID NO: 61526 - protein, 33 aa, Artificial Sequence
  Description of Artificial Sequence: Synthetic polypeptide
DSEEIRTTNPVATEQYGEVSCTNALSDRGGNLE

SEQ ID NO: 61527 - protein, 33 aa, Artificial Sequence
  Description of Artificial Sequence: Synthetic polypeptide
DSEEIRTTNPVATEPYGSVSCTNALSDTGGNLR

SEQ ID NO: 61528 - protein, 30 aa, Artificial Sequence
  Description of Artificial Sequence: Synthetic polypeptide
DSEEIRTTNPVGTEQWGTVSTNLQHGDGSL

SEQ ID NO: 61529 - protein, 30 aa, Artificial Sequence
  Description of Artificial Sequence: Synthetic polypeptide
DSEEIRTTNPVGTEQWGTVSTNLQHPGDED

SEQ ID NO: 61530 - protein, 30 aa, Artificial Sequence
  Description of Artificial Sequence: Synthetic polypeptide
DSEEIRTTNPVGTEQWGTVSTNLQRADEQM

SEQ ID NO: 61531 - protein, 30 aa, Artificial Sequence
  Description of Artificial Sequence: Synthetic polypeptide
DTEEICTTNPVATTQYGSVSTNNNEMGGNV

SEQ ID NO: 61532 - protein, 30 aa, Artificial Sequence
  Description of Artificial Sequence: Synthetic polypeptide
DTEEICTTNPVATTQYGSVSTNPETGGNND

SEQ ID NO: 61533 - protein, 30 aa, Artificial Sequence
  Description of Artificial Sequence: Synthetic polypeptide
DTEEICTTNPVATTQYGSVSTNPNNGGNVD

SEQ ID NO: 61534 - protein, 30 aa, Artificial Sequence
  Description of Artificial Sequence: Synthetic polypeptide
DTEEICTTNPVATTQYGSVSTNPNNGTNQV

SEQ ID NO: 61535 - protein, 31 aa, Artificial Sequence
  Description of Artificial Sequence: Synthetic polypeptide
DTEEICTTNPVATTQYGSVSTNVATQGGNQN

SEQ ID NO: 61536 - protein, 31 aa, Artificial Sequence
  Description of Artificial Sequence: Synthetic polypeptide
DEEEIRTTNPVATEQYGSCSTNMMTRVVDDN

SEQ ID NO: 61537 - protein, 32 aa, Artificial Sequence
  Description of Artificial Sequence: Synthetic polypeptide
DTEEIRATNPVATEQYGSVSTNTDNGQQGNNE

SEQ ID NO: 61538 - protein, 32 aa, Artificial Sequence
  Description of Artificial Sequence: Synthetic polypeptide
DTEEIRATNPVATEQYGSVSTNTNEQQGANNE

SEQ ID NO: 61539 - protein, 32 aa, Artificial Sequence
  Description of Artificial Sequence: Synthetic polypeptide
DTEEIRATNPVATEQYGSVSTNTNNQQGNDNE

SEQ ID NO: 61540 - protein, 29 aa, Artificial Sequence
  Description of Artificial Sequence: Synthetic peptide
DTEEIATTNPIATEHWGSVSFNLQDENRQ

SEQ ID NO: 61541 - protein, 32 aa, Artificial Sequence
  Description of Artificial Sequence: Synthetic polypeptide
DTEEIRATNPVATEQYGSVSTNTNQQQGNQNM

SEQ ID NO: 61542 - protein, 33 aa, Artificial Sequence
  Description of Artificial Sequence: Synthetic polypeptide
DTEEIRATNPVATEQYGSVSTTNNLQAGNGQTF

SEQ ID NO: 61543 - protein, 33 aa, Artificial Sequence
  Description of Artificial Sequence: Synthetic polypeptide
DTEEIRATNPVATEQYGSVSTTTNLQAGNGNQF

SEQ ID NO: 61544 - protein, 33 aa, Artificial Sequence
  Description of Artificial Sequence: Synthetic polypeptide
DTEEIRATNPVATEQYGSVSTVNNLQAGNGQFN

SEQ ID NO: 61545 - protein, 32 aa, Artificial Sequence
  Description of Artificial Sequence: Synthetic polypeptide
DTEEIRATNPVATEQYGSVSVSTNMQIGTNNI

SEQ ID NO: 61546 - protein, 32 aa, Artificial Sequence
  Description of Artificial Sequence: Synthetic polypeptide
DTEEIRATNPVATEQYGSVVVSTNLQNGETEE

SEQ ID NO: 61547 - protein, 33 aa, Artificial Sequence
  Description of Artificial Sequence: Synthetic polypeptide
DTEEIRATNPVATEQYGSVVVSTNLQQGNQGTE

SEQ ID NO: 61548 - protein, 32 aa, Artificial Sequence
  Description of Artificial Sequence: Synthetic polypeptide
DTEEIRATNPVATEQYGSVVVSTTNLQGNGTE

SEQ ID NO: 61549 - protein, 32 aa, Artificial Sequence
  Description of Artificial Sequence: Synthetic polypeptide
DTEEIRATNPVATEQYGSVVVSTTNLQNGTDE

SEQ ID NO: 61550 - protein, 32 aa, Artificial Sequence
  Description of Artificial Sequence: Synthetic polypeptide
DTEEIRATNPVATEQYGSVVVSTTNLQNGTTD

SEQ ID NO: 61551 - protein, 33 aa, Artificial Sequence
  Description of Artificial Sequence: Synthetic polypeptide
DTEEIRATNPVATEQYGSVSTTNLQQMNGNQEG

SEQ ID NO: 61552 - protein, 28 aa, Artificial Sequence
  Description of Artificial Sequence: Synthetic peptide
DTEEIATTNPCAYEPYGTVSGNLQRENQ

SEQ ID NO: 61553 - protein, 29 aa, Artificial Sequence
  Description of Artificial Sequence: Synthetic peptide
DTEEIATTNPCAYEPYGSVSANLQRENDQ

SEQ ID NO: 61554 - protein, 28 aa, Artificial Sequence
  Description of Artificial Sequence: Synthetic peptide
DTEEIATTNPCAYEPYGNVSANLQRDNS

SEQ ID NO: 61555 - protein, 29 aa, Artificial Sequence
  Description of Artificial Sequence: Synthetic peptide
DSEEIRTTNPVGYECWGMVSTNLQGGEVR

SEQ ID NO: 61556 - protein, 30 aa, Artificial Sequence
  Description of Artificial Sequence: Synthetic polypeptide
DSEEIRTTNPVGYEQWGMVSTNLQGGDVGR

SEQ ID NO: 61557 - protein, 31 aa, Artificial Sequence
  Description of Artificial Sequence: Synthetic polypeptide
DSEEIRTTNPVGYEQWGMVSTNLSQRGGSTR

SEQ ID NO: 61558 - protein, 34 aa, Artificial Sequence
  Description of Artificial Sequence: Synthetic polypeptide
DSEEIRTTNPVSTEQYGEVASPTNLSQRTGNPRH

SEQ ID NO: 61559 - protein, 31 aa, Artificial Sequence
  Description of Artificial Sequence: Synthetic polypeptide
DSEEISTTNPVAYDQYGSVSTNEPSMRGTNR

SEQ ID NO: 61560 - protein, 31 aa, Artificial Sequence
  Description of Artificial Sequence: Synthetic polypeptide
DSEEISTTNPVAYTQYGISVSTNPSTRGGNR

SEQ ID NO: 61561 - protein, 31 aa, Artificial Sequence
  Description of Artificial Sequence: Synthetic polypeptide
DSGEICTTNPVATEQWGISLVNTNNLQRGNM

SEQ ID NO: 61562 - protein, 32 aa, Artificial Sequence
  Description of Artificial Sequence: Synthetic polypeptide
DSGEIRTTNPVATEPYGSVSTGNMLSQLGGMR

SEQ ID NO: 61563 - protein, 33 aa, Artificial Sequence
  Description of Artificial Sequence: Synthetic polypeptide
DSGEIRTTNPVATEPYGSVVSTNMLSQTGTMNR

SEQ ID NO: 61564 - protein, 32 aa, Artificial Sequence
  Description of Artificial Sequence: Synthetic polypeptide
DSGEIRTTNPVATEQYGSVHCTALSDRVGNNR

SEQ ID NO: 61565 - protein, 32 aa, Artificial Sequence
  Description of Artificial Sequence: Synthetic polypeptide
DSGEIRTTNPVATEQYGSVSCTNMLSQFGGMG

SEQ ID NO: 61566 - protein, 32 aa, Artificial Sequence
  Description of Artificial Sequence: Synthetic polypeptide
DSGEIRTTNPVAYEQYGSTVSTNMLSQPTGMR

SEQ ID NO: 61567 - protein, 31 aa, Artificial Sequence
  Description of Artificial Sequence: Synthetic polypeptide
DSPEITTTNPVAYEQYGTVHTGNLQRGGNRG

SEQ ID NO: 61568 - protein, 33 aa, Artificial Sequence
  Description of Artificial Sequence: Synthetic polypeptide
DSSEIRTTNPVATEQYGSVVSTNALSDRGGNLQ

SEQ ID NO: 61569 - protein, 30 aa, Artificial Sequence
  Description of Artificial Sequence: Synthetic polypeptide
DTAEIATTNPVAYEQYGSVATNLQQGNEQM

SEQ ID NO: 61570 - protein, 30 aa, Artificial Sequence
  Description of Artificial Sequence: Synthetic polypeptide
DTAEIATTNPVAYMQYGSVSTNGVQNGNHR

SEQ ID NO: 61571 - protein, 31 aa, Artificial Sequence
  Description of Artificial Sequence: Synthetic polypeptide
DTEAEIATTNPVAYEQYGSVATNLETGDNDR

SEQ ID NO: 61572 - protein, 31 aa, Artificial Sequence
  Description of Artificial Sequence: Synthetic polypeptide
DTEAEIATTNPVAYEQYGSVATNLQNGGDRG

SEQ ID NO: 61573 - protein, 31 aa, Artificial Sequence
  Description of Artificial Sequence: Synthetic polypeptide
DTEAEIATTNPVAYEQYGSVATNLQNRNDRM

SEQ ID NO: 61574 - protein, 31 aa, Artificial Sequence
  Description of Artificial Sequence: Synthetic polypeptide
DEEEIRTTNPVATEQYGSCSTNWYDRDSFDD

SEQ ID NO: 61575 - protein, 29 aa, Artificial Sequence
  Description of Artificial Sequence: Synthetic peptide
DTEEIATTNPCATEHYGSVAFNLQDEHNR

SEQ ID NO: 61576 - protein, 32 aa, Artificial Sequence
  Description of Artificial Sequence: Synthetic polypeptide
DTEEIRATNPVATEQYGSVVVTSTNLQNGTDG

SEQ ID NO: 61577 - protein, 33 aa, Artificial Sequence
  Description of Artificial Sequence: Synthetic polypeptide
DSEEIRSTNPVAYEQYGISVSCTNLQARNGGSR

SEQ ID NO: 61578 - protein, 33 aa, Artificial Sequence
  Description of Artificial Sequence: Synthetic polypeptide
DEEEIRTTNPVATEQYGSCSPTNLQAQREETYV

SEQ ID NO: 61579 - protein, 32 aa, Artificial Sequence
  Description of Artificial Sequence: Synthetic polypeptide
EEEEIRTTNPVATEQYGCVCSTNLQYFGSEQV

SEQ ID NO: 61580 - protein, 33 aa, Artificial Sequence
  Description of Artificial Sequence: Synthetic polypeptide
FEEEIRTTNPVATEQYGSVGSNTNGQGEGGNQT

SEQ ID NO: 61581 - protein, 33 aa, Artificial Sequence
  Description of Artificial Sequence: Synthetic polypeptide
FEEEIRTTNPVATEQYGSVGSTDLGQGGENEDD

SEQ ID NO: 61582 - protein, 30 aa, Artificial Sequence
  Description of Artificial Sequence: Synthetic polypeptide
DEEEIRTTNPVATEQYGSCALPGMLQDDNN

SEQ ID NO: 61583 - protein, 32 aa, Artificial Sequence
  Description of Artificial Sequence: Synthetic polypeptide
FEEEIRTTNPVATEQYGSVGSTMNGGEDGGNT

SEQ ID NO: 61584 - protein, 32 aa, Artificial Sequence
  Description of Artificial Sequence: Synthetic polypeptide
FEEEIRTTNPVATEQYGSVGTGEIRMGLNPRD

SEQ ID NO: 61585 - protein, 33 aa, Artificial Sequence
  Description of Artificial Sequence: Synthetic polypeptide
FEEEIRTTNPVATEQYGSVGTNLEQQNGGNIQG

SEQ ID NO: 61586 - protein, 33 aa, Artificial Sequence
  Description of Artificial Sequence: Synthetic polypeptide
FEEEIRTTNPVATEQYGSVISTDLQSGEGNEEG

SEQ ID NO: 61587 - protein, 34 aa, Artificial Sequence
  Description of Artificial Sequence: Synthetic polypeptide
FEEEIRTTNPVATEQYGSVISTNLQSQTGNNNEG

SEQ ID NO: 61588 - protein, 33 aa, Artificial Sequence
  Description of Artificial Sequence: Synthetic polypeptide
FEEEIRTTNPVATEQYGSVISTQNIGQSGGNNE

SEQ ID NO: 61589 - protein, 32 aa, Artificial Sequence
  Description of Artificial Sequence: Synthetic polypeptide
FEEEIRTTNPVATEQYGSVGSNQNGQGEGNDN

SEQ ID NO: 61590 - protein, 34 aa, Artificial Sequence
  Description of Artificial Sequence: Synthetic polypeptide
FEEEIRTTNPVATEQYGSVISTTNLQSQTGNEGG

SEQ ID NO: 61591 - protein, 33 aa, Artificial Sequence
  Description of Artificial Sequence: Synthetic polypeptide
FEEEIRTTNPVATEQYGSVITTNEEQRPGNPIQ

SEQ ID NO: 61592 - protein, 34 aa, Artificial Sequence
  Description of Artificial Sequence: Synthetic polypeptide
FEEEIRTTNPVATEQYGSVNSDTNLQNDGVTNDD

SEQ ID NO: 61593 - protein, 34 aa, Artificial Sequence
  Description of Artificial Sequence: Synthetic polypeptide
FEEEIRTTNPVATEQYGSVNSGSTNLQNDGVNID

SEQ ID NO: 61594 - protein, 34 aa, Artificial Sequence
  Description of Artificial Sequence: Synthetic polypeptide
FEEEIRTTNPVATEQYGSVNSSTNLQNDGVENED

SEQ ID NO: 61595 - protein, 34 aa, Artificial Sequence
  Description of Artificial Sequence: Synthetic polypeptide
DEEEIRTTNPVATEQYGSAVSTNEDQVRENDEDG

SEQ ID NO: 61596 - protein, 33 aa, Artificial Sequence
  Description of Artificial Sequence: Synthetic polypeptide
FEEEIRTTNPVATEQYGSVNSTMELQSGTGGNV

SEQ ID NO: 61597 - protein, 33 aa, Artificial Sequence
  Description of Artificial Sequence: Synthetic polypeptide
FEEEIRTTNPVATEQYGSVPPTSNVVQRGLQER

SEQ ID NO: 61598 - protein, 32 aa, Artificial Sequence
  Description of Artificial Sequence: Synthetic polypeptide
FEEEIRTTNPVATEQYGSVPTSVVVQRGEEYR

SEQ ID NO: 61599 - protein, 32 aa, Artificial Sequence
  Description of Artificial Sequence: Synthetic polypeptide
FEEEIRTTNPVATEQYGSVSATGNGEGNGNTV

SEQ ID NO: 61600 - protein, 32 aa, Artificial Sequence
  Description of Artificial Sequence: Synthetic polypeptide
FEEEIRTTNPVATEQYGSVITGNGQGNAGNGG

SEQ ID NO: 61601 - protein, 32 aa, Artificial Sequence
  Description of Artificial Sequence: Synthetic polypeptide
FEEEIRTTNPVATEQYGSVSATGNGGNGNGNI

SEQ ID NO: 61602 - protein, 31 aa, Artificial Sequence
  Description of Artificial Sequence: Synthetic polypeptide
FEEEIRTTNPVATEQYGSVDSNTDSTQRQES

SEQ ID NO: 61603 - protein, 32 aa, Artificial Sequence
  Description of Artificial Sequence: Synthetic polypeptide
DEEEIRTTNPVATEQYGSCCSTTNMDQLGDEQ

SEQ ID NO: 61604 - protein, 33 aa, Artificial Sequence
  Description of Artificial Sequence: Synthetic polypeptide
DEEEIRTTNPVATEQYGSCNSTSLDQQREGEED

SEQ ID NO: 61605 - protein, 32 aa, Artificial Sequence
  Description of Artificial Sequence: Synthetic polypeptide
ENEEIATTNPVATEQYGVVSTNLQGDGPNGRH

SEQ ID NO: 61606 - protein, 32 aa, Artificial Sequence
  Description of Artificial Sequence: Synthetic polypeptide
DEEEIRTTNPVATEQYGSCNSTNDSVIGSQER

SEQ ID NO: 61607 - protein, 30 aa, Artificial Sequence
  Description of Artificial Sequence: Synthetic polypeptide
ENEEISTTNPVATTQYGSVSTNPMGEGNQR

SEQ ID NO: 61608 - protein, 33 aa, Artificial Sequence
  Description of Artificial Sequence: Synthetic polypeptide
DEEEIRTTNPVATEQYGSCNSANLNQGNEVNRS

SEQ ID NO: 61609 - protein, 31 aa, Artificial Sequence
  Description of Artificial Sequence: Synthetic polypeptide
FAGEISTTNPVATEQYGSIVSTNPLQLGEHR

SEQ ID NO: 61610 - protein, 29 aa, Artificial Sequence
  Description of Artificial Sequence: Synthetic peptide
FEDIIRTTNPVATEQYGCVSTNCEFGNCF

SEQ ID NO: 61611 - protein, 28 aa, Artificial Sequence
  Description of Artificial Sequence: Synthetic peptide
FEEEIASVNPVCTEQYGVVSDNLQSGNQ

SEQ ID NO: 61612 - protein, 33 aa, Artificial Sequence
  Description of Artificial Sequence: Synthetic polypeptide
FEEEIRTTNPAATEQYGSVIATNLIQREGGNGG

SEQ ID NO: 61613 - protein, 33 aa, Artificial Sequence
  Description of Artificial Sequence: Synthetic polypeptide
FEEEIRTTNPVATEQYGSVASTPNDNQENGTNI

SEQ ID NO: 61614 - protein, 31 aa, Artificial Sequence
  Description of Artificial Sequence: Synthetic polypeptide
FEEEIRTTNPVATEGYGCTSNMNLGQGRGNT

SEQ ID NO: 61615 - protein, 32 aa, Artificial Sequence
  Description of Artificial Sequence: Synthetic polypeptide
FEEEIRTTNPVATEQYGAVSTTDLQDGGGNEG

SEQ ID NO: 61616 - protein, 33 aa, Artificial Sequence
  Description of Artificial Sequence: Synthetic polypeptide
DEEEIRTTNPVATEQYGSCISTNTGDTWRGNTE

SEQ ID NO: 61617 - protein, 32 aa, Artificial Sequence
  Description of Artificial Sequence: Synthetic polypeptide
FEEEIRTTNPVATEQYGDVSTDNGQGEGNENI

SEQ ID NO: 61618 - protein, 33 aa, Artificial Sequence
  Description of Artificial Sequence: Synthetic polypeptide
FEEEIRTTNPVATEQYGDVSTGDNGQRFQGNEQ

SEQ ID NO: 61619 - protein, 33 aa, Artificial Sequence
  Description of Artificial Sequence: Synthetic polypeptide
DEEEIRTTNPVATEQYGSCISFVNNQRMGNNQA

SEQ ID NO: 61620 - protein, 32 aa, Artificial Sequence
  Description of Artificial Sequence: Synthetic polypeptide
FEEEIRTTNPVATEQYGDVSTNVINGQGGNDD

SEQ ID NO: 61621 - protein, 32 aa, Artificial Sequence
  Description of Artificial Sequence: Synthetic polypeptide
DEEEIRTTNPVATEQYGSCGSMMILGQRLTNN

SEQ ID NO: 61622 - protein, 30 aa, Artificial Sequence
  Description of Artificial Sequence: Synthetic polypeptide
DEEEIRTTNPVATEQYGSCEPTNMDTQGED

SEQ ID NO: 61623 - protein, 33 aa, Artificial Sequence
  Description of Artificial Sequence: Synthetic polypeptide
DEEEIRTTNPVATEQYGSCEPTNLMDRQGNVPI

SEQ ID NO: 61624 - protein, 33 aa, Artificial Sequence
  Description of Artificial Sequence: Synthetic polypeptide
FEEEIRTTNPVATEGYGSVSGTNLQGSGGNGNI

SEQ ID NO: 61625 - protein, 32 aa, Artificial Sequence
  Description of Artificial Sequence: Synthetic polypeptide
FEEEIRTTNPVATEQYGSVSGNFGQGNGNNTL

SEQ ID NO: 61626 - protein, 32 aa, Artificial Sequence
  Description of Artificial Sequence: Synthetic polypeptide
FEEEIRTTNPVATEQYGSVSGNGQEGGEGNET

SEQ ID NO: 61627 - protein, 32 aa, Artificial Sequence
  Description of Artificial Sequence: Synthetic polypeptide
FEEEIRTTNPVATEQYGSVSGTGVNNVGGNGQ

SEQ ID NO: 61628 - protein, 33 aa, Artificial Sequence
  Description of Artificial Sequence: Synthetic polypeptide
FEEEIRTTNPVATEQYGSVSTDNGQSNDGENEF

SEQ ID NO: 61629 - protein, 32 aa, Artificial Sequence
  Description of Artificial Sequence: Synthetic polypeptide
FEEEIRTTNPVATEQYGSVSTDTGLNGEGGNN

SEQ ID NO: 61630 - protein, 32 aa, Artificial Sequence
  Description of Artificial Sequence: Synthetic polypeptide
FEEEIRTTNPVATEQYGSVSTGGQGQEEGGNG

SEQ ID NO: 61631 - protein, 33 aa, Artificial Sequence
  Description of Artificial Sequence: Synthetic polypeptide
FEEEIRTTNPVATEQYGSVSTGLQQNEGGNENE

SEQ ID NO: 61632 - protein, 32 aa, Artificial Sequence
  Description of Artificial Sequence: Synthetic polypeptide
FEEEIRTTNPVATEQYGSVSTGVGNVDGGNGQ

SEQ ID NO: 61633 - protein, 32 aa, Artificial Sequence
  Description of Artificial Sequence: Synthetic polypeptide
FEEEIRTTNPVATEQYGSVSTLNQTNGGGNED

SEQ ID NO: 61634 - protein, 33 aa, Artificial Sequence
  Description of Artificial Sequence: Synthetic polypeptide
FEEEIRTTNPVATEQYGSVSTMNDGQQQGEFNI

SEQ ID NO: 61635 - protein, 34 aa, Artificial Sequence
  Description of Artificial Sequence: Synthetic polypeptide
FEEEIRTTNPVATEQYGSVSTMNGLQEEGGNVGD

SEQ ID NO: 61636 - protein, 34 aa, Artificial Sequence
  Description of Artificial Sequence: Synthetic polypeptide
FEEEIRTTNPVATEQYGSVSTMNGLQNQGGNGNE

SEQ ID NO: 61637 - protein, 33 aa, Artificial Sequence
  Description of Artificial Sequence: Synthetic polypeptide
FEEEIRTTNPVATEQYGSVSTDNGNQNEGGNTQ

SEQ ID NO: 61638 - protein, 34 aa, Artificial Sequence
  Description of Artificial Sequence: Synthetic polypeptide
FEEEIRTTNPVATEQYGSVSTMNLDQDEGGNQGD

SEQ ID NO: 61639 - protein, 32 aa, Artificial Sequence
  Description of Artificial Sequence: Synthetic polypeptide
DEEEIRTTNPVATEQYGSASTNLEQETLTEDV

SEQ ID NO: 61640 - protein, 34 aa, Artificial Sequence
  Description of Artificial Sequence: Synthetic polypeptide
FEEEIRTTNPVATEQYGSVSTMNLEQDEGGNQGE

SEQ ID NO: 61641 - protein, 34 aa, Artificial Sequence
  Description of Artificial Sequence: Synthetic polypeptide
FEEEIRTTNPVATEQYGSVSTMNLVEQGGGNDDV

SEQ ID NO: 61642 - protein, 34 aa, Artificial Sequence
  Description of Artificial Sequence: Synthetic polypeptide
FEEEIRTTNPVATEQYGSVSTMNLVQQEEGNGQE

SEQ ID NO: 61643 - protein, 34 aa, Artificial Sequence
  Description of Artificial Sequence: Synthetic polypeptide
FEEEIRTTNPVATEQYGSVSTMNLVQQEGGNGQN

SEQ ID NO: 61644 - protein, 33 aa, Artificial Sequence
  Description of Artificial Sequence: Synthetic polypeptide
FEEEIRTTNPVATEQYGSVSTMNNGQEGGGNQT

SEQ ID NO: 61645 - protein, 33 aa, Artificial Sequence
  Description of Artificial Sequence: Synthetic polypeptide
FEEEIRTTNPVATEQYGSVSTMNNLITGGENIG

SEQ ID NO: 61646 - protein, 32 aa, Artificial Sequence
  Description of Artificial Sequence: Synthetic polypeptide
FEEEIRTTNPVATEQYGSVSTNAGNTGEGGNG

SEQ ID NO: 61647 - protein, 32 aa, Artificial Sequence
  Description of Artificial Sequence: Synthetic polypeptide
FEEEIRTTNPVATEQYGSVSTNGFGDGEENED

SEQ ID NO: 61648 - protein, 34 aa, Artificial Sequence
  Description of Artificial Sequence: Synthetic polypeptide
FEEEIRTTNPVATEQYGSVSTMNLDQEGGGENDN

SEQ ID NO: 61649 - protein, 32 aa, Artificial Sequence
  Description of Artificial Sequence: Synthetic polypeptide
FEEEIRTTNPVATEQYGSVSTDGVEQNQGENI

SEQ ID NO: 61650 - protein, 32 aa, Artificial Sequence
  Description of Artificial Sequence: Synthetic polypeptide
FEEEIRTTNPVATEQYGSVSTDDGQNQGENEF

SEQ ID NO: 61651 - protein, 33 aa, Artificial Sequence
  Description of Artificial Sequence: Synthetic polypeptide
FEEEIRTTNPVATEQYGSVSSTQNEGQTGGGND

SEQ ID NO: 61652 - protein, 33 aa, Artificial Sequence
  Description of Artificial Sequence: Synthetic polypeptide
FEEEIRTTNPVATEQYGSVSGTNGQGEGGGNTM

SEQ ID NO: 61653 - protein, 34 aa, Artificial Sequence
  Description of Artificial Sequence: Synthetic polypeptide
FEEEIRTTNPVATEQYGSVSGTNLQFGGGNNGQG

SEQ ID NO: 61654 - protein, 33 aa, Artificial Sequence
  Description of Artificial Sequence: Synthetic polypeptide
FEEEIRTTNPVATEQYGSVSITNGQEGGGENTI

SEQ ID NO: 61655 - protein, 33 aa, Artificial Sequence
  Description of Artificial Sequence: Synthetic polypeptide
FEEEIRTTNPVATEQYGSVSITVNEQTGGNGNE

SEQ ID NO: 61656 - protein, 32 aa, Artificial Sequence
  Description of Artificial Sequence: Synthetic polypeptide
FEEEIRTTNPVATEQYGSVSLTSNLQINAAGH

SEQ ID NO: 61657 - protein, 32 aa, Artificial Sequence
  Description of Artificial Sequence: Synthetic polypeptide
FEEEIRTTNPVATEQYGSVSNNTGQGEFGNTG

SEQ ID NO: 61658 - protein, 33 aa, Artificial Sequence
  Description of Artificial Sequence: Synthetic polypeptide
FEEEIRTTNPVATEQYGSVSNTENFGQGTGNGG

SEQ ID NO: 61659 - protein, 33 aa, Artificial Sequence
  Description of Artificial Sequence: Synthetic polypeptide
FEEEIRTTNPVATEQYGSVSNTNNQGQNEGGNT

SEQ ID NO: 61660 - protein, 33 aa, Artificial Sequence
  Description of Artificial Sequence: Synthetic polypeptide
FEEEIRTTNPVATEQYGSVSPAINALDEFGNDR

SEQ ID NO: 61661 - protein, 33 aa, Artificial Sequence
  Description of Artificial Sequence: Synthetic polypeptide
FEEEIRTTNPVATEQYGSVSPAVNEQEQGENER

SEQ ID NO: 61662 - protein, 32 aa, Artificial Sequence
  Description of Artificial Sequence: Synthetic polypeptide
FEEEIRTTNPVATEQYGSVSPAVNLQQGEMEE

SEQ ID NO: 61663 - protein, 33 aa, Artificial Sequence
  Description of Artificial Sequence: Synthetic polypeptide
FEEEIRTTNPVATEQYGSVSPTPPLIQQGNVDE

SEQ ID NO: 61664 - protein, 32 aa, Artificial Sequence
  Description of Artificial Sequence: Synthetic polypeptide
FEEEIRTTNPVATEQYGSVSSDNMGQGEGENG

SEQ ID NO: 61665 - protein, 33 aa, Artificial Sequence
  Description of Artificial Sequence: Synthetic polypeptide
FEEEIRTTNPVATEQYGSVSSTGLQNEGGNITT

SEQ ID NO: 61666 - protein, 33 aa, Artificial Sequence
  Description of Artificial Sequence: Synthetic polypeptide
FEEEIRTTNPVATEQYGSVSSTNDQVQGNGGNT

SEQ ID NO: 61667 - protein, 33 aa, Artificial Sequence
  Description of Artificial Sequence: Synthetic polypeptide
FEEEIRTTNPVATEQYGSVSSTNFGQGEGGNDG

SEQ ID NO: 61668 - protein, 32 aa, Artificial Sequence
  Description of Artificial Sequence: Synthetic polypeptide
DEEEIRTTNPVATEQYGSASTTVGPNRGMNPV

SEQ ID NO: 61669 - protein, 33 aa, Artificial Sequence
  Description of Artificial Sequence: Synthetic polypeptide
FEEEIRTTNPVATEQYGSVSSTNGDEDQGNGNI

SEQ ID NO: 61670 - protein, 34 aa, Artificial Sequence
  Description of Artificial Sequence: Synthetic polypeptide
DEEEIRTTNPVATEQYGSASTTNSLEPEREQVNR

SEQ ID NO: 61671 - protein, 33 aa, Artificial Sequence
  Description of Artificial Sequence: Synthetic polypeptide
FEEEIRTTNPVATEQYGSVSSTNGDQGGNGNGD

SEQ ID NO: 61672 - protein, 33 aa, Artificial Sequence
  Description of Artificial Sequence: Synthetic polypeptide
DEEEIRTTNPVATEQYGSASTTAGNMRNGMNPR

SEQ ID NO: 61673 - protein, 30 aa, Artificial Sequence
  Description of Artificial Sequence: Synthetic polypeptide
EGEEIATTNPVAYEQWGSVTSTLLQDRGTR

SEQ ID NO: 61674 - protein, 32 aa, Artificial Sequence
  Description of Artificial Sequence: Synthetic polypeptide
DEEEIRTTNPVATEQYGSCSPTNDQPIEPERE

SEQ ID NO: 61675 - protein, 30 aa, Artificial Sequence
  Description of Artificial Sequence: Synthetic polypeptide
EENEIRTTNPVATEQYGSVWVEVLQIGESR

SEQ ID NO: 61676 - protein, 31 aa, Artificial Sequence
  Description of Artificial Sequence: Synthetic polypeptide
EENEIRTTNPVATEGYGSVSNNLQEVGDTNP

SEQ ID NO: 61677 - protein, 31 aa, Artificial Sequence
  Description of Artificial Sequence: Synthetic polypeptide
EEEEIRTTNPVATEQYGSVSENLIVLEQARE

SEQ ID NO: 61678 - protein, 31 aa, Artificial Sequence
  Description of Artificial Sequence: Synthetic polypeptide
EEEEIRTTNPVATEQYGSVSETQDQSNENDY

SEQ ID NO: 61679 - protein, 33 aa, Artificial Sequence
  Description of Artificial Sequence: Synthetic polypeptide
EEEEIRTTNPVATEQYGSVSFVNLAQQAENYRI

SEQ ID NO: 61680 - protein, 31 aa, Artificial Sequence
  Description of Artificial Sequence: Synthetic polypeptide
EEEEIRTTNPVATEQYGSVSLTNLELNLTPD

SEQ ID NO: 61681 - protein, 32 aa, Artificial Sequence
  Description of Artificial Sequence: Synthetic polypeptide
DEEEIRTTNPVATEQYGSCSLNANMLQRDLIQ

SEQ ID NO: 61682 - protein, 32 aa, Artificial Sequence
  Description of Artificial Sequence: Synthetic polypeptide
DEEEIRTTNPVATEQYGSCSLMNLQVQGQMQD

SEQ ID NO: 61683 - protein, 32 aa, Artificial Sequence
  Description of Artificial Sequence: Synthetic polypeptide
EEEEIRTTNPVATEQYGSVSPTELGVEGIERE

SEQ ID NO: 61684 - protein, 32 aa, Artificial Sequence
  Description of Artificial Sequence: Synthetic polypeptide
EEEEIRTTNPVATEQYGSVSPTNEELDQLTLD

SEQ ID NO: 61685 - protein, 33 aa, Artificial Sequence
  Description of Artificial Sequence: Synthetic polypeptide
EEEEIRTTNPVATEQYGSVSPTNGQNEQLNPRE

SEQ ID NO: 61686 - protein, 35 aa, Artificial Sequence
  Description of Artificial Sequence: Synthetic polypeptide
EEEEIRTTNPVATEQYGSVQSTVNLAQRGAEEYRI

SEQ ID NO: 61687 - protein, 32 aa, Artificial Sequence
  Description of Artificial Sequence: Synthetic polypeptide
EEEEIRTTNPVATEQYGSVSPTNLPEPNLEPE

SEQ ID NO: 61688 - protein, 32 aa, Artificial Sequence
  Description of Artificial Sequence: Synthetic polypeptide
EEEEIRTTNPVATEQYGSVSTALNNNDEAGND

SEQ ID NO: 61689 - protein, 33 aa, Artificial Sequence
  Description of Artificial Sequence: Synthetic polypeptide
EEEEIRTTNPVATEQYGSVSTENLQINGVLEDI

SEQ ID NO: 61690 - protein, 33 aa, Artificial Sequence
  Description of Artificial Sequence: Synthetic polypeptide
EEEEIRTTNPVATEQYGSVSTGLPQFRVVNEDP

SEQ ID NO: 61691 - protein, 32 aa, Artificial Sequence
  Description of Artificial Sequence: Synthetic polypeptide
EEEEIRTTNPVATEQYGSVSTGSPQRVHNEDP

SEQ ID NO: 61692 - protein, 34 aa, Artificial Sequence
  Description of Artificial Sequence: Synthetic polypeptide
DEEEIRTTNPVATEQYGSCSETNLDQVVGEEIRN

SEQ ID NO: 61693 - protein, 32 aa, Artificial Sequence
  Description of Artificial Sequence: Synthetic polypeptide
EEEEIRTTNPVATEQYGSVSTNAINGPSEVRD

SEQ ID NO: 61694 - protein, 32 aa, Artificial Sequence
  Description of Artificial Sequence: Synthetic polypeptide
EEEEIRTTNPVATEQYGSVSTNLEENLETPRL

SEQ ID NO: 61695 - protein, 30 aa, Artificial Sequence
  Description of Artificial Sequence: Synthetic polypeptide
DEEEIRTTNPVATEQYGSCSEITLDANGES

SEQ ID NO: 61696 - protein, 32 aa, Artificial Sequence
  Description of Artificial Sequence: Synthetic polypeptide
EEEEIRTTNPVATEQYGSVSTNLINGESEVTD

SEQ ID NO: 61697 - protein, 33 aa, Artificial Sequence
  Description of Artificial Sequence: Synthetic polypeptide
EEEEIRTTNPVATEQYGSVSSVDLAQRAENYRI

SEQ ID NO: 61698 - protein, 33 aa, Artificial Sequence
  Description of Artificial Sequence: Synthetic polypeptide
EEEEIRTTNPVATEQYGSVSTNLNLGDEAGNDQ

SEQ ID NO: 61699 - protein, 33 aa, Artificial Sequence
  Description of Artificial Sequence: Synthetic polypeptide
EEEEIRTTNPVATEQYGSVNTVNLQGQEGENND

SEQ ID NO: 61700 - protein, 34 aa, Artificial Sequence
  Description of Artificial Sequence: Synthetic polypeptide
DEEEIRTTNPVATEQYGSCSLTNLQPRENVLEPP

SEQ ID NO: 61701 - protein, 32 aa, Artificial Sequence
  Description of Artificial Sequence: Synthetic polypeptide
EEEEIRTTNPVATEQYGSASTNLNQRILVEEK

SEQ ID NO: 61702 - protein, 32 aa, Artificial Sequence
  Description of Artificial Sequence: Synthetic polypeptide
EEEEIRTTNPVATEQYGSTSTLLQAGNQNGNE

SEQ ID NO: 61703 - protein, 31 aa, Artificial Sequence
  Description of Artificial Sequence: Synthetic polypeptide
EEEEIRTTNPVATEQYGSTSTLLQGNQIGEG

SEQ ID NO: 61704 - protein, 32 aa, Artificial Sequence
  Description of Artificial Sequence: Synthetic polypeptide
EEEEIRTTNPVATEQYGSTSTTLLQQGNQNGE

SEQ ID NO: 61705 - protein, 30 aa, Artificial Sequence
  Description of Artificial Sequence: Synthetic polypeptide
EEEEIRTTNPVATEQYGSTSTTLQQNQEGE

SEQ ID NO: 61706 - protein, 30 aa, Artificial Sequence
  Description of Artificial Sequence: Synthetic polypeptide
EEEEIRTTNPVATEQYGSTSTTNQNQQQGE

SEQ ID NO: 61707 - protein, 33 aa, Artificial Sequence
  Description of Artificial Sequence: Synthetic polypeptide
DEEEIRTTNPVATEQYGSCSPPNWEQNRSGENQ

SEQ ID NO: 61708 - protein, 31 aa, Artificial Sequence
  Description of Artificial Sequence: Synthetic polypeptide
EEEEIRTTNPVATEQYGSVATAELQGNTNFE

SEQ ID NO: 61709 - protein, 32 aa, Artificial Sequence
  Description of Artificial Sequence: Synthetic polypeptide
DEEEIRTTNPVATEQYGSCSPNDQHFGENSSI

SEQ ID NO: 61710 - protein, 32 aa, Artificial Sequence
  Description of Artificial Sequence: Synthetic polypeptide
EEEEIRTTNPVATEQYGSVITTNQQDRVNEIG

SEQ ID NO: 61711 - protein, 30 aa, Artificial Sequence
  Description of Artificial Sequence: Synthetic polypeptide
DEEEIRTTNPVATEQYGSCSPDEDQQGIDG

SEQ ID NO: 61712 - protein, 31 aa, Artificial Sequence
  Description of Artificial Sequence: Synthetic polypeptide
EEEEIRTTNPVATEQYGSVATALQGNENFEE

SEQ ID NO: 61713 - protein, 31 aa, Artificial Sequence
  Description of Artificial Sequence: Synthetic polypeptide
DEEEIRTTNPVATEQYGSCSNTNDERTDVDI

SEQ ID NO: 61714 - protein, 32 aa, Artificial Sequence
  Description of Artificial Sequence: Synthetic polypeptide
EEEEIRTTNPVATEQYGSVATALQQGNTNQFE

SEQ ID NO: 61715 - protein, 31 aa, Artificial Sequence
  Description of Artificial Sequence: Synthetic polypeptide
EEEEIRTTNPVATEQYGSVATALQQNENFET

SEQ ID NO: 61716 - protein, 31 aa, Artificial Sequence
  Description of Artificial Sequence: Synthetic polypeptide
EEEEIRTTNPVATEQYGSVATLLDQEQASFR

SEQ ID NO: 61717 - protein, 31 aa, Artificial Sequence
  Description of Artificial Sequence: Synthetic polypeptide
EEEEIRTTNPVATEQYGSVATQALQTNNEQE

SEQ ID NO: 61718 - protein, 32 aa, Artificial Sequence
  Description of Artificial Sequence: Synthetic polypeptide
EEEEIRTTNPVATEQYGSVATTALQQGNENFE

SEQ ID NO: 61719 - protein, 34 aa, Artificial Sequence
  Description of Artificial Sequence: Synthetic polypeptide
EEEEIRTTNPVATEQYGSVATTNANLQNGNDERE

SEQ ID NO: 61720 - protein, 32 aa, Artificial Sequence
  Description of Artificial Sequence: Synthetic polypeptide
EEEEIRTTNPVATEQYGSVISTNLEPNLTPRM

SEQ ID NO: 61721 - protein, 32 aa, Artificial Sequence
  Description of Artificial Sequence: Synthetic polypeptide
DEEEIRTTNPVATEQYGSCSPALEQRNEENVM

SEQ ID NO: 61722 - protein, 33 aa, Artificial Sequence
  Description of Artificial Sequence: Synthetic polypeptide
EEEEIRTTNPVATEQYGSVSTNLNLNDETGNED

SEQ ID NO: 61723 - protein, 32 aa, Artificial Sequence
  Description of Artificial Sequence: Synthetic polypeptide
EEEEIRTTNPVATEQYGSVSTNLQQNDTTETV

SEQ ID NO: 61724 - protein, 33 aa, Artificial Sequence
  Description of Artificial Sequence: Synthetic polypeptide
EEEEIRTTNPVATEQYGSVSTNLQQQLQNANEQ

SEQ ID NO: 61725 - protein, 31 aa, Artificial Sequence
  Description of Artificial Sequence: Synthetic polypeptide
DEEEIRTTNPVATEQYGSCSANDEQAEQNEK

SEQ ID NO: 61726 - protein, 31 aa, Artificial Sequence
  Description of Artificial Sequence: Synthetic polypeptide
DEEEIRTTNPVATEQYGSCSAGVAEGQADNR

SEQ ID NO: 61727 - protein, 33 aa, Artificial Sequence
  Description of Artificial Sequence: Synthetic polypeptide
DEEEIRTTNPVATEQYGSCSAGNMIGQERDDNR

SEQ ID NO: 61728 - protein, 31 aa, Artificial Sequence
  Description of Artificial Sequence: Synthetic polypeptide
EEEEIRTTNPVATESYGSVSNTNEHRTGFQG

SEQ ID NO: 61729 - protein, 33 aa, Artificial Sequence
  Description of Artificial Sequence: Synthetic polypeptide
EEEEIRTTNPVATESYGSVSTTNLTQQGNNDQD

SEQ ID NO: 61730 - protein, 31 aa, Artificial Sequence
  Description of Artificial Sequence: Synthetic polypeptide
DEEEIRTTNPVATEQYGSCSAGNFLQTDMMN

SEQ ID NO: 61731 - protein, 32 aa, Artificial Sequence
  Description of Artificial Sequence: Synthetic polypeptide
EEEELRTTNPVATEQYGSVSTQNGDQQIGNNL

SEQ ID NO: 61732 - protein, 33 aa, Artificial Sequence
  Description of Artificial Sequence: Synthetic polypeptide
EEEELRTTNPVATEQYGSVSTQNLDQNQIGNNV

SEQ ID NO: 61733 - protein, 33 aa, Artificial Sequence
  Description of Artificial Sequence: Synthetic polypeptide
EEEELRTTNPVATEQYGSVSTQNLDQQIGNGNN

SEQ ID NO: 61734 - protein, 34 aa, Artificial Sequence
  Description of Artificial Sequence: Synthetic polypeptide
EEEEIRTTNPVATEQYGSVVYPTPNLQPVMGNER

SEQ ID NO: 61735 - protein, 33 aa, Artificial Sequence
  Description of Artificial Sequence: Synthetic polypeptide
EEEELRTTNPVATEQYGSVSTQNLDQQIGTNNQ

SEQ ID NO: 61736 - protein, 31 aa, Artificial Sequence
  Description of Artificial Sequence: Synthetic polypeptide
EEETICTTNPVATEQYGSVSNTNSQLGTNTS

SEQ ID NO: 61737 - protein, 28 aa, Artificial Sequence
  Description of Artificial Sequence: Synthetic peptide
EENEIACTNPVATEQYGEASENIQRGGR

SEQ ID NO: 61738 - protein, 28 aa, Artificial Sequence
  Description of Artificial Sequence: Synthetic peptide
EENEIACTNPVATEQYGEASENLQDGGR

SEQ ID NO: 61739 - protein, 29 aa, Artificial Sequence
  Description of Artificial Sequence: Synthetic peptide
EENEIACTNPVATEQYGEASENLQRGGAR

SEQ ID NO: 61740 - protein, 29 aa, Artificial Sequence
  Description of Artificial Sequence: Synthetic peptide
EENEIACTNPVATEQYGEASENLQRGGQR

SEQ ID NO: 61741 - protein, 33 aa, Artificial Sequence
  Description of Artificial Sequence: Synthetic polypeptide
DEEEIRTTNPVATEQYGSCQSPTNLQNTPGLLL

SEQ ID NO: 61742 - protein, 34 aa, Artificial Sequence
  Description of Artificial Sequence: Synthetic polypeptide
DEEEIRTTNPVATEQYGSCQSPTNLQNRPGLLEV

SEQ ID NO: 61743 - protein, 29 aa, Artificial Sequence
  Description of Artificial Sequence: Synthetic peptide
EENEIACTNPVATEQYGEAWSENLQRGGR

SEQ ID NO: 61744 - protein, 30 aa, Artificial Sequence
  Description of Artificial Sequence: Synthetic polypeptide
DEEEIRTTNPVATEQYGSCPTDLERNPEQE

SEQ ID NO: 61745 - protein, 33 aa, Artificial Sequence
  Description of Artificial Sequence: Synthetic polypeptide
EEEELRTTNPVATEQYGSVSTTQNLDQAIGNLN

SEQ ID NO: 61746 - protein, 33 aa, Artificial Sequence
  Description of Artificial Sequence: Synthetic polypeptide
EEEEIRTTNPVATEQYGSVVTSTNLLQGNQNGE

SEQ ID NO: 61747 - protein, 34 aa, Artificial Sequence
  Description of Artificial Sequence: Synthetic polypeptide
EEEEIRTTNPVATEQYGSVTVTSTNLQQGNQNGE

SEQ ID NO: 61748 - protein, 34 aa, Artificial Sequence
  Description of Artificial Sequence: Synthetic polypeptide
EEEEIRTTNPVATEQYGSVTVSTNLQQGNQQGEG

SEQ ID NO: 61749 - protein, 34 aa, Artificial Sequence
  Description of Artificial Sequence: Synthetic polypeptide
EEEEIRTTNPVATEQYGSVSTNNQLNQQGENNEA

SEQ ID NO: 61750 - protein, 31 aa, Artificial Sequence
  Description of Artificial Sequence: Synthetic polypeptide
EEEEIRTTNPVATEQYGSVSTNVINLSEVVD

SEQ ID NO: 61751 - protein, 34 aa, Artificial Sequence
  Description of Artificial Sequence: Synthetic polypeptide
EEEEIRTTNPVATEQYGSVSTQNNLQQGNNVNED

SEQ ID NO: 61752 - protein, 34 aa, Artificial Sequence
  Description of Artificial Sequence: Synthetic polypeptide
EEEEIRTTNPVATEQYGSVSTSNLNNQQQGENTD

SEQ ID NO: 61753 - protein, 34 aa, Artificial Sequence
  Description of Artificial Sequence: Synthetic polypeptide
EEEEIRTTNPVATEQYGSVSTSNLNQQQGENQNE

SEQ ID NO: 61754 - protein, 34 aa, Artificial Sequence
  Description of Artificial Sequence: Synthetic polypeptide
EEEEIRTTNPVATEQYGSVSTSNLNQQQGEQQNE

SEQ ID NO: 61755 - protein, 33 aa, Artificial Sequence
  Description of Artificial Sequence: Synthetic polypeptide
EEEEIRTTNPVATEQYGSVSTSNNANQQGENTV

SEQ ID NO: 61756 - protein, 34 aa, Artificial Sequence
  Description of Artificial Sequence: Synthetic polypeptide
EEEEIRTTNPVATEQYGSVSTSNNLNQQGEEQNE

SEQ ID NO: 61757 - protein, 33 aa, Artificial Sequence
  Description of Artificial Sequence: Synthetic polypeptide
EEEEIRTTNPVATEQYGSVSTSNNNQQQGENTS

SEQ ID NO: 61758 - protein, 34 aa, Artificial Sequence
  Description of Artificial Sequence: Synthetic polypeptide
EEEEIRTTNPVATEQYGSVSTSNQLNQNQGENQN

SEQ ID NO: 61759 - protein, 34 aa, Artificial Sequence
  Description of Artificial Sequence: Synthetic polypeptide
EEEEIRTTNPVATEQYGSVSTTNLQQQLGNANED

SEQ ID NO: 61760 - protein, 34 aa, Artificial Sequence
  Description of Artificial Sequence: Synthetic polypeptide
EEEEIRTTNPVATEQYGSVSTTNNNLQQGNVNEY

SEQ ID NO: 61761 - protein, 34 aa, Artificial Sequence
  Description of Artificial Sequence: Synthetic polypeptide
EEEEIRTTNPVATEQYGSVSTTTNLQQGNNVNEY

SEQ ID NO: 61762 - protein, 34 aa, Artificial Sequence
  Description of Artificial Sequence: Synthetic polypeptide
EEEEIRTTNPVATEQYGSVSTVNLAQDRAENYGI

SEQ ID NO: 61763 - protein, 34 aa, Artificial Sequence
  Description of Artificial Sequence: Synthetic polypeptide
EEEEIRTTNPVATEQYGSVSTVNLAQQRAETYRI

SEQ ID NO: 61764 - protein, 34 aa, Artificial Sequence
  Description of Artificial Sequence: Synthetic polypeptide
EEEEIRTTNPVATEQYGSVSVTTNLGQQGENQDD

SEQ ID NO: 61765 - protein, 33 aa, Artificial Sequence
  Description of Artificial Sequence: Synthetic polypeptide
EEEEIRTTNPVATEQYGSVTSNNLLQGNQNGNE

SEQ ID NO: 61766 - protein, 33 aa, Artificial Sequence
  Description of Artificial Sequence: Synthetic polypeptide
EEEEIRTTNPVATEQYGSVTSTLLQAGNQAGEE

SEQ ID NO: 61767 - protein, 32 aa, Artificial Sequence
  Description of Artificial Sequence: Synthetic polypeptide
EEEEIRTTNPVATEQYGSVTSTQLQQLQQGES

SEQ ID NO: 61768 - protein, 34 aa, Artificial Sequence
  Description of Artificial Sequence: Synthetic polypeptide
EEEEIRTTNPVATEQYGSVTVSTNLQLQGNQNTE

SEQ ID NO: 61769 - protein, 34 aa, Artificial Sequence
  Description of Artificial Sequence: Synthetic polypeptide
EEEEIRTTNPVATEQYGSVTVSTNLQQGNQNGSE

SEQ ID NO: 61770 - protein, 30 aa, Artificial Sequence
  Description of Artificial Sequence: Synthetic polypeptide
EENEIRTTNPVATEIYGSVSINLQEVGETG

SEQ ID NO: 61771 - protein, 31 aa, Artificial Sequence
  Description of Artificial Sequence: Synthetic polypeptide
DESEIATTNPVATGHYGSVSTNLQRDTNDML

SEQ ID NO: 61772 - protein, 32 aa, Artificial Sequence
  Description of Artificial Sequence: Synthetic polypeptide
DESEIATTNPVATEQYGWTVSCTGNSSQRVNR

SEQ ID NO: 61773 - protein, 33 aa, Artificial Sequence
  Description of Artificial Sequence: Synthetic polypeptide
DESEIATTNPVATEQYGWTVSCTGNSQRGGNYR

SEQ ID NO: 61774 - protein, 32 aa, Artificial Sequence
  Description of Artificial Sequence: Synthetic polypeptide
DEHEIRTTNPVAYEQWGSVSTNLQGPGGNNSS

SEQ ID NO: 61775 - protein, 32 aa, Artificial Sequence
  Description of Artificial Sequence: Synthetic polypeptide
DEHEIRTTNPVAYEQWGSVSTNLQGQMGDDGR

SEQ ID NO: 61776 - protein, 32 aa, Artificial Sequence
  Description of Artificial Sequence: Synthetic polypeptide
DEHEIRTTNPVAYEQWGSVSTNLQLGEGGGDR

SEQ ID NO: 61777 - protein, 32 aa, Artificial Sequence
  Description of Artificial Sequence: Synthetic polypeptide
DEHEIRTTNPVAYEQWGSVSTNLQLGGDNGDS

SEQ ID NO: 61778 - protein, 33 aa, Artificial Sequence
  Description of Artificial Sequence: Synthetic polypeptide
DEEEIRTTNPVATEQYGSVCSTNHSDRVDDDQR

SEQ ID NO: 61779 - protein, 32 aa, Artificial Sequence
  Description of Artificial Sequence: Synthetic polypeptide
DEHEIRTTNPVAYEQWGSVSTNLQMDGGNNAQ

SEQ ID NO: 61780 - protein, 32 aa, Artificial Sequence
  Description of Artificial Sequence: Synthetic polypeptide
DEHEIRTTNPVAYEQWGSVSTNLQNGDGNNAQ

SEQ ID NO: 61781 - protein, 32 aa, Artificial Sequence
  Description of Artificial Sequence: Synthetic polypeptide
DEHEIRTTNPVAYEQWGSVSTNLQNPGGDNDQ

SEQ ID NO: 61782 - protein, 32 aa, Artificial Sequence
  Description of Artificial Sequence: Synthetic polypeptide
DEHEIRTTNPVAYEQWGSVSTNLQPGGDNNEH

SEQ ID NO: 61783 - protein, 32 aa, Artificial Sequence
  Description of Artificial Sequence: Synthetic polypeptide
DEHEIRTTNPVAYEQWGSVSTNLQGPGGDNGH

SEQ ID NO: 61784 - protein, 32 aa, Artificial Sequence
  Description of Artificial Sequence: Synthetic polypeptide
DEHEIRTTNPVAYEQWGSVSTNLQPMGDNGSQ

SEQ ID NO: 61785 - protein, 32 aa, Artificial Sequence
  Description of Artificial Sequence: Synthetic polypeptide
DEHEIRTTNPVAYEQWGSVSTNLQQQGGDNDS

SEQ ID NO: 61786 - protein, 32 aa, Artificial Sequence
  Description of Artificial Sequence: Synthetic polypeptide
DEHEIRTTNPVAYEQWGSVSTNLQQQGGDNGS

SEQ ID NO: 61787 - protein, 30 aa, Artificial Sequence
  Description of Artificial Sequence: Synthetic polypeptide
DEHEIRTTNPVAYEQWGSVSTNMQPGGDDS

SEQ ID NO: 61788 - protein, 31 aa, Artificial Sequence
  Description of Artificial Sequence: Synthetic polypeptide
DEHEIRTTNPVAYEQWGSVSTNNQDGQNNAQ

SEQ ID NO: 61789 - protein, 32 aa, Artificial Sequence
  Description of Artificial Sequence: Synthetic polypeptide
DEHEIRTTNPVAYEQWGSVSTNQDQGEAGDNR

SEQ ID NO: 61790 - protein, 33 aa, Artificial Sequence
  Description of Artificial Sequence: Synthetic polypeptide
DEEEIRTTNPVATEQYGSVCSTNHQNSNSDTQP

SEQ ID NO: 61791 - protein, 32 aa, Artificial Sequence
  Description of Artificial Sequence: Synthetic polypeptide
DEHEIRTTNPVAYEQWGTVSTNLQGDAGNDRG

SEQ ID NO: 61792 - protein, 31 aa, Artificial Sequence
  Description of Artificial Sequence: Synthetic polypeptide
DEHEIRTTNPVAYEQWGTVSTNLQLGGDNGS

SEQ ID NO: 61793 - protein, 30 aa, Artificial Sequence
  Description of Artificial Sequence: Synthetic polypeptide
DEHEIRTTNPVAYEQWGVVSTNLNDGNLDM

SEQ ID NO: 61794 - protein, 31 aa, Artificial Sequence
  Description of Artificial Sequence: Synthetic polypeptide
DEHEIRTTNPVAYEQWGSVSTNLQQGGMDDM

SEQ ID NO: 61795 - protein, 31 aa, Artificial Sequence
  Description of Artificial Sequence: Synthetic polypeptide
DEHEIRTTNPVAYEQWGVVSTNLQAGGDNDS

SEQ ID NO: 61796 - protein, 31 aa, Artificial Sequence
  Description of Artificial Sequence: Synthetic polypeptide
DEHEIRTTNPVAYEQWGSVSTNLQGNMGQGN

SEQ ID NO: 61797 - protein, 32 aa, Artificial Sequence
  Description of Artificial Sequence: Synthetic polypeptide
DEEEIRTTNPVATEQYGSVCSTNLDLMEILGE

SEQ ID NO: 61798 - protein, 32 aa, Artificial Sequence
  Description of Artificial Sequence: Synthetic polypeptide
DEHEIRTTNPVAYEQWGEVSTNLQPGGDNGSR

SEQ ID NO: 61799 - protein, 29 aa, Artificial Sequence
  Description of Artificial Sequence: Synthetic peptide
DEHEIRTTNPVAYEQWGSIATNTQGEGDR

SEQ ID NO: 61800 - protein, 31 aa, Artificial Sequence
  Description of Artificial Sequence: Synthetic polypeptide
DEHEIRTTNPVAYEQWGSISTNTQREGDDGR

SEQ ID NO: 61801 - protein, 33 aa, Artificial Sequence
  Description of Artificial Sequence: Synthetic polypeptide
DEHEIRTTNPVAYEQWGSVSETNNLQGGNGNAR

SEQ ID NO: 61802 - protein, 32 aa, Artificial Sequence
  Description of Artificial Sequence: Synthetic polypeptide
DEHEIRTTNPVAYEQWGSVSHGNLDDRNGNGR

SEQ ID NO: 61803 - protein, 31 aa, Artificial Sequence
  Description of Artificial Sequence: Synthetic polypeptide
DEHEIRTTNPVAYEQWGSVSHNLDDRNTNAR

SEQ ID NO: 61804 - protein, 31 aa, Artificial Sequence
  Description of Artificial Sequence: Synthetic polypeptide
DEHEIRTTNPVAYEQWGSVSHPLDDRNGNVR

SEQ ID NO: 61805 - protein, 32 aa, Artificial Sequence
  Description of Artificial Sequence: Synthetic polypeptide
DEHEIRTTNPVAYEQWGSVSHTNLDDRNMNER

SEQ ID NO: 61806 - protein, 31 aa, Artificial Sequence
  Description of Artificial Sequence: Synthetic polypeptide
DEHEIRTTNPVAYEQWGSVSTNAQQDGDNEE

SEQ ID NO: 61807 - protein, 32 aa, Artificial Sequence
  Description of Artificial Sequence: Synthetic polypeptide
DEHEIRTTNPVAYEQWGSVSTNLQGNMGDNEH

SEQ ID NO: 61808 - protein, 31 aa, Artificial Sequence
  Description of Artificial Sequence: Synthetic polypeptide
DEHEIRTTNPVAYEQWGSVSTNIQPGGDNGE

SEQ ID NO: 61809 - protein, 32 aa, Artificial Sequence
  Description of Artificial Sequence: Synthetic polypeptide
DEHEIRTTNPVAYEQWGSVSTNLEQGGGNNAQ

SEQ ID NO: 61810 - protein, 31 aa, Artificial Sequence
  Description of Artificial Sequence: Synthetic polypeptide
DEHEIRTTNPVAYEQWGSVSTNLEQPGGDMS

SEQ ID NO: 61811 - protein, 32 aa, Artificial Sequence
  Description of Artificial Sequence: Synthetic polypeptide
DEHEIRTTNPVAYEQWGSVSTNLNDGNMGDMR

SEQ ID NO: 61812 - protein, 32 aa, Artificial Sequence
  Description of Artificial Sequence: Synthetic polypeptide
DEHEIRTTNPVAYEQWGSVSTNLNGEDGNNDR

SEQ ID NO: 61813 - protein, 31 aa, Artificial Sequence
  Description of Artificial Sequence: Synthetic polypeptide
DEHEIRTTNPVAYEQWGSVSTNLNGEGNEGQ

SEQ ID NO: 61814 - protein, 32 aa, Artificial Sequence
  Description of Artificial Sequence: Synthetic polypeptide
DEHEIRTTNPVAYEQWGSVSTNLNQGEMGDGR

SEQ ID NO: 61815 - protein, 32 aa, Artificial Sequence
  Description of Artificial Sequence: Synthetic polypeptide
DEHEIRTTNPVAYEQWGSVSTNLNQGTDGNMP

SEQ ID NO: 61816 - protein, 32 aa, Artificial Sequence
  Description of Artificial Sequence: Synthetic polypeptide
DEHEIRTTNPVAYEQWGSVSTNLQGGGTGNAQ

SEQ ID NO: 61817 - protein, 31 aa, Artificial Sequence
  Description of Artificial Sequence: Synthetic polypeptide
DEHEIRTTNPVAYEQWGSVSTNLQGGMGGAQ

SEQ ID NO: 61818 - protein, 32 aa, Artificial Sequence
  Description of Artificial Sequence: Synthetic polypeptide
DEHEIRTTNPVAYEQWGSVSTNLEQGEGGSER

SEQ ID NO: 61819 - protein, 31 aa, Artificial Sequence
  Description of Artificial Sequence: Synthetic polypeptide
DEHEIRTTNPVAYEQWGEVSTNLQLGGNDDQ

SEQ ID NO: 61820 - protein, 31 aa, Artificial Sequence
  Description of Artificial Sequence: Synthetic polypeptide
DEHEIRTTNPVAYEQWGVVSTNLQHQGNGNE

SEQ ID NO: 61821 - protein, 31 aa, Artificial Sequence
  Description of Artificial Sequence: Synthetic polypeptide
DEHEIRTTNPVAYEQYGEVVSTNNLGDHGER

SEQ ID NO: 61822 - protein, 30 aa, Artificial Sequence
  Description of Artificial Sequence: Synthetic polypeptide
DEMAIRTTNPVATEQYGCFSTNLINGSNQM

SEQ ID NO: 61823 - protein, 29 aa, Artificial Sequence
  Description of Artificial Sequence: Synthetic peptide
DEMEIATTNPVATCQYGCVSTALQNGSEQ

SEQ ID NO: 61824 - protein, 28 aa, Artificial Sequence
  Description of Artificial Sequence: Synthetic peptide
DEMEIATTNPVATECYGDVSEGLQHGEL

SEQ ID NO: 61825 - protein, 31 aa, Artificial Sequence
  Description of Artificial Sequence: Synthetic polypeptide
DEMEIATTNPVATECYGSVPTNNQDQGGYNR

SEQ ID NO: 61826 - protein, 29 aa, Artificial Sequence
  Description of Artificial Sequence: Synthetic peptide
DEMEIATTNPVATECYGTVSECLVQHGNL

SEQ ID NO: 61827 - protein, 29 aa, Artificial Sequence
  Description of Artificial Sequence: Synthetic peptide
DEMEIATTNPVATECYGTVSEDCLQHGNL

SEQ ID NO: 61828 - protein, 30 aa, Artificial Sequence
  Description of Artificial Sequence: Synthetic polypeptide
DEMEIATTNPVATEQYGEASEDGLVQFGNR

SEQ ID NO: 61829 - protein, 31 aa, Artificial Sequence
  Description of Artificial Sequence: Synthetic polypeptide
DEMEIATTNPVATEQYGSVSATDLEDHEGNL

SEQ ID NO: 61830 - protein, 30 aa, Artificial Sequence
  Description of Artificial Sequence: Synthetic polypeptide
DEMEIATTNPVATEQYGTVSAECLVQFGNL

SEQ ID NO: 61831 - protein, 30 aa, Artificial Sequence
  Description of Artificial Sequence: Synthetic polypeptide
DEKEIYTTNPVATEQYGSVYPTNLMYSGET

SEQ ID NO: 61832 - protein, 29 aa, Artificial Sequence
  Description of Artificial Sequence: Synthetic peptide
DEMEIATTNPVATEQYGTVSEDCLEHGNL

SEQ ID NO: 61833 - protein, 28 aa, Artificial Sequence
  Description of Artificial Sequence: Synthetic peptide
DEMEICTTNPVATEIYGQVSTPDQMGDQ

SEQ ID NO: 61834 - protein, 31 aa, Artificial Sequence
  Description of Artificial Sequence: Synthetic polypeptide
DEMEICTVNPVATEQYGSVCSNTNLFYGSNQ

SEQ ID NO: 61835 - protein, 32 aa, Artificial Sequence
  Description of Artificial Sequence: Synthetic polypeptide
DEEEIRTTNPVATEQYGSVCSTNHANSGSEQD

SEQ ID NO: 61836 - protein, 30 aa, Artificial Sequence
  Description of Artificial Sequence: Synthetic polypeptide
DEMEIRCTNPVATEQYGSVSAEGPMFEGNR

SEQ ID NO: 61837 - protein, 31 aa, Artificial Sequence
  Description of Artificial Sequence: Synthetic polypeptide
DEMEIRCTNPVATEQYGSVSVNQNDRGSNSG

SEQ ID NO: 61838 - protein, 31 aa, Artificial Sequence
  Description of Artificial Sequence: Synthetic polypeptide
DEMEIRCTNPVATEQYGSVSVVNHDRGSNSG

SEQ ID NO: 61839 - protein, 31 aa, Artificial Sequence
  Description of Artificial Sequence: Synthetic polypeptide
DEMEIRTTNPVATCHYGCVSTNLQERFTSNQ

SEQ ID NO: 61840 - protein, 30 aa, Artificial Sequence
  Description of Artificial Sequence: Synthetic polypeptide
DEMEIRTTNPVATCQYGCVCNTPLQYGSND

SEQ ID NO: 61841 - protein, 31 aa, Artificial Sequence
  Description of Artificial Sequence: Synthetic polypeptide
DEMEIRTTNPVATCQYGCVCQTELQRGSNTQ

SEQ ID NO: 61842 - protein, 29 aa, Artificial Sequence
  Description of Artificial Sequence: Synthetic peptide
DEMEIATTNPVSSEQYGTVSATGLQFGTR

SEQ ID NO: 61843 - protein, 31 aa, Artificial Sequence
  Description of Artificial Sequence: Synthetic polypeptide
DEHEIRTTNPVAYEQWGVVSTNLQPGGDNSD

SEQ ID NO: 61844 - protein, 30 aa, Artificial Sequence
  Description of Artificial Sequence: Synthetic polypeptide
DEIVIGTTNPVATEQWGTVSTWDDMQRGNR

SEQ ID NO: 61845 - protein, 30 aa, Artificial Sequence
  Description of Artificial Sequence: Synthetic polypeptide
DEIEICTVNPVATEQYGSVSTNVEFQGVNE

SEQ ID NO: 61846 - protein, 32 aa, Artificial Sequence
  Description of Artificial Sequence: Synthetic polypeptide
DEEEIRTTNPVATEQYGSVCSTNHQNFFSQDT

SEQ ID NO: 61847 - protein, 32 aa, Artificial Sequence
  Description of Artificial Sequence: Synthetic polypeptide
DEHEIRTTNPVAYEQYGKVSCTNIQHTGGNRF

SEQ ID NO: 61848 - protein, 33 aa, Artificial Sequence
  Description of Artificial Sequence: Synthetic polypeptide
DEHEIRTTNPVAYEQYGSISTNATSQREGGSNR

SEQ ID NO: 61849 - protein, 32 aa, Artificial Sequence
  Description of Artificial Sequence: Synthetic polypeptide
DEHEIRTTNPVAYEQYGSVSSNNDLQGGGNTD

SEQ ID NO: 61850 - protein, 32 aa, Artificial Sequence
  Description of Artificial Sequence: Synthetic polypeptide
DEHEIRTTNPVAYEQYGSVVSANDESRAGNSR

SEQ ID NO: 61851 - protein, 32 aa, Artificial Sequence
  Description of Artificial Sequence: Synthetic polypeptide
DEHEIRTTNPVAYEQYGTVSTNLQNDGGNGNH

SEQ ID NO: 61852 - protein, 31 aa, Artificial Sequence
  Description of Artificial Sequence: Synthetic polypeptide
DEHEIRTTNPVAYEQYGTVSTNNQGDGGNAQ

SEQ ID NO: 61853 - protein, 32 aa, Artificial Sequence
  Description of Artificial Sequence: Synthetic polypeptide
DEHEIRTTNPVAYEQYGTVVSTDNLGDQGNER

SEQ ID NO: 61854 - protein, 30 aa, Artificial Sequence
  Description of Artificial Sequence: Synthetic polypeptide
DEHEIRTTNPVAYEQYGVCSTQLQRPQNDN

SEQ ID NO: 61855 - protein, 33 aa, Artificial Sequence
  Description of Artificial Sequence: Synthetic polypeptide
DEIEIRTTNPVAYEQYGSTVQACTHLSQRSGNR

SEQ ID NO: 61856 - protein, 31 aa, Artificial Sequence
  Description of Artificial Sequence: Synthetic polypeptide
DEHEIRTTNPVAYERWGSVSTNLQGQGGNTS

SEQ ID NO: 61857 - protein, 30 aa, Artificial Sequence
  Description of Artificial Sequence: Synthetic polypeptide
DEHEIRTTNPVAYQQYGCVSTDNDERGNPS

SEQ ID NO: 61858 - protein, 30 aa, Artificial Sequence
  Description of Artificial Sequence: Synthetic polypeptide
DEHEIRTTNPVAYQQYGCVSTNDEGRGNDS

SEQ ID NO: 61859 - protein, 32 aa, Artificial Sequence
  Description of Artificial Sequence: Synthetic polypeptide
DEHEISTTNPVAYEQWGSVSTNLNQGEDGNTR

SEQ ID NO: 61860 - protein, 32 aa, Artificial Sequence
  Description of Artificial Sequence: Synthetic polypeptide
DEHVIGTTNPVATEQWGTVSKTDNLDQRDGNR

SEQ ID NO: 61861 - protein, 33 aa, Artificial Sequence
  Description of Artificial Sequence: Synthetic polypeptide
DEEEIRTTNPVATEQYGSVCSTNHQEYSGSEQD

SEQ ID NO: 61862 - protein, 30 aa, Artificial Sequence
  Description of Artificial Sequence: Synthetic polypeptide
DEIEICTTNPVATEQYGTCASVTALQGGNI

SEQ ID NO: 61863 - protein, 33 aa, Artificial Sequence
  Description of Artificial Sequence: Synthetic polypeptide
DEEEIRTTNPVATEQYGSVCSTNHQENMGSEQI

SEQ ID NO: 61864 - protein, 31 aa, Artificial Sequence
  Description of Artificial Sequence: Synthetic polypeptide
DEIEICTVNPVATEQYGSVSTNLEFPQLVNE

SEQ ID NO: 61865 - protein, 32 aa, Artificial Sequence
  Description of Artificial Sequence: Synthetic polypeptide
DEIEICTVNPVATEQYGSVSTNLQFQGNNPHE

SEQ ID NO: 61866 - protein, 31 aa, Artificial Sequence
  Description of Artificial Sequence: Synthetic polypeptide
DEHEIRTTNPVAYERYGEVSTNLQHNGNNEQ

SEQ ID NO: 61867 - protein, 31 aa, Artificial Sequence
  Description of Artificial Sequence: Synthetic polypeptide
DEHEIRTTNPVAYEQWGEVSTNLQIGGNNED

SEQ ID NO: 61868 - protein, 31 aa, Artificial Sequence
  Description of Artificial Sequence: Synthetic polypeptide
DEHEIRTTNPVAYEQWGAVSTNLQGGDGNNS

SEQ ID NO: 61869 - protein, 31 aa, Artificial Sequence
  Description of Artificial Sequence: Synthetic polypeptide
DEHEIRTTNPVAYEHWGSVSTNLQGDGNNDL

SEQ ID NO: 61870 - protein, 31 aa, Artificial Sequence
  Description of Artificial Sequence: Synthetic polypeptide
DEHEIRTTNPVATDQWGSVNTDLQRGENGDP

SEQ ID NO: 61871 - protein, 31 aa, Artificial Sequence
  Description of Artificial Sequence: Synthetic polypeptide
DEHEIRTTNPVATDQWGSVNTHALSQRGGND

SEQ ID NO: 61872 - protein, 31 aa, Artificial Sequence
  Description of Artificial Sequence: Synthetic polypeptide
DEHEIRTTNPVATDQYGSVINTQDLQRIGED

SEQ ID NO: 61873 - protein, 31 aa, Artificial Sequence
  Description of Artificial Sequence: Synthetic polypeptide
DEHEIRTTNPVATDQYGSVNCTPLSQRGGSD

SEQ ID NO: 61874 - protein, 30 aa, Artificial Sequence
  Description of Artificial Sequence: Synthetic polypeptide
DEHEIRTTNPVATDQYGSVNMQLQRGITDG

SEQ ID NO: 61875 - protein, 30 aa, Artificial Sequence
  Description of Artificial Sequence: Synthetic polypeptide
DEHEIRTTNPVATDQYGSVNTQDLQRNEYD

SEQ ID NO: 61876 - protein, 30 aa, Artificial Sequence
  Description of Artificial Sequence: Synthetic polypeptide
DEHEIRTTNPVATDQYGSVNTQLQRTSTDD

SEQ ID NO: 61877 - protein, 31 aa, Artificial Sequence
  Description of Artificial Sequence: Synthetic polypeptide
DEHEIRTTNPVATDQYGSVNTSQLQRGGTDD

SEQ ID NO: 61878 - protein, 28 aa, Artificial Sequence
  Description of Artificial Sequence: Synthetic peptide
DEHEIRTTNPVATDQYGSVNYQLERTED

SEQ ID NO: 61879 - protein, 30 aa, Artificial Sequence
  Description of Artificial Sequence: Synthetic polypeptide
DEHEIRTTNPVATDQWGSVATQLQGDGNND

SEQ ID NO: 61880 - protein, 32 aa, Artificial Sequence
  Description of Artificial Sequence: Synthetic polypeptide
DEHEIRTTNPVATDQYGSVNYTGLSQRTGGND

SEQ ID NO: 61881 - protein, 32 aa, Artificial Sequence
  Description of Artificial Sequence: Synthetic polypeptide
DEHEIRTTNPVATEAWGSVSTGNLAQGDGNKS

SEQ ID NO: 61882 - protein, 31 aa, Artificial Sequence
  Description of Artificial Sequence: Synthetic polypeptide
DEHEIRTTNPVATECWGSVTTNLQGEDGNDE

SEQ ID NO: 61883 - protein, 33 aa, Artificial Sequence
  Description of Artificial Sequence: Synthetic polypeptide
DEHEIRTTNPVATEFWGSVSTTNDLGQDGGNER

SEQ ID NO: 61884 - protein, 31 aa, Artificial Sequence
  Description of Artificial Sequence: Synthetic polypeptide
DEHEIRTTNPVATEFWGVVSTNLQLGGDNGG

SEQ ID NO: 61885 - protein, 32 aa, Artificial Sequence
  Description of Artificial Sequence: Synthetic polypeptide
DEHEIRTTNPVATEHYGATVSNTQNLQIEGDR

SEQ ID NO: 61886 - protein, 31 aa, Artificial Sequence
  Description of Artificial Sequence: Synthetic polypeptide
DEHEIRTTNPVATENYGMVSTNPQILGSNEN

SEQ ID NO: 61887 - protein, 32 aa, Artificial Sequence
  Description of Artificial Sequence: Synthetic polypeptide
DEHEIRTTNPVATENYGSVSLTDGLNNRGNIH

SEQ ID NO: 61888 - protein, 32 aa, Artificial Sequence
  Description of Artificial Sequence: Synthetic polypeptide
DEHEIRTTNPVATEPYGCVSTNLQGNDDNGRG

SEQ ID NO: 61889 - protein, 30 aa, Artificial Sequence
  Description of Artificial Sequence: Synthetic polypeptide
DEHEIRTTNPVATEQWGSISTGTQGEGLDR

SEQ ID NO: 61890 - protein, 32 aa, Artificial Sequence
  Description of Artificial Sequence: Synthetic polypeptide
DEHEIRTTNPVATEAWGSISHTDNTQREGNER

SEQ ID NO: 61891 - protein, 30 aa, Artificial Sequence
  Description of Artificial Sequence: Synthetic polypeptide
DEHEIRTTNPVATEQWGSVSQNDHRNMDDR

SEQ ID NO: 61892 - protein, 30 aa, Artificial Sequence
  Description of Artificial Sequence: Synthetic polypeptide
DEHEIRTTNPVATDEYGSVNTQDLQRGEDA

SEQ ID NO: 61893 - protein, 31 aa, Artificial Sequence
  Description of Artificial Sequence: Synthetic polypeptide
DEHEIRTTNPCATESWGSVSTNNDGQDGGNR

SEQ ID NO: 61894 - protein, 32 aa, Artificial Sequence
  Description of Artificial Sequence: Synthetic polypeptide
DEHEICTTNPVATEQYGSVSTMNYLDRGGDHS

SEQ ID NO: 61895 - protein, 33 aa, Artificial Sequence
  Description of Artificial Sequence: Synthetic polypeptide
DEHEIRATNPVATEQYGSVSTPLKQASGDNERE

SEQ ID NO: 61896 - protein, 33 aa, Artificial Sequence
  Description of Artificial Sequence: Synthetic polypeptide
DEHEIRTTNPCATECYGSVSTTNGLGQDAGNER

SEQ ID NO: 61897 - protein, 31 aa, Artificial Sequence
  Description of Artificial Sequence: Synthetic polypeptide
DEHEIRTTNPCATEHYGEVSTNLQHQGNNES

SEQ ID NO: 61898 - protein, 31 aa, Artificial Sequence
  Description of Artificial Sequence: Synthetic polypeptide
DEHEIRTTNPCATEHYGSVSTGNLGDGMDND

SEQ ID NO: 61899 - protein, 33 aa, Artificial Sequence
  Description of Artificial Sequence: Synthetic polypeptide
DEHEIRTTNPCATEHYGSVSTGNLQDAQGNNNR

SEQ ID NO: 61900 - protein, 32 aa, Artificial Sequence
  Description of Artificial Sequence: Synthetic polypeptide
DEHEIRTTNPCATEQYGSVATNLQGDAGNNSD

SEQ ID NO: 61901 - protein, 33 aa, Artificial Sequence
  Description of Artificial Sequence: Synthetic polypeptide
DEHEIRTTNPCATEQYGSVSTGDNLQNDPNDNR

SEQ ID NO: 61902 - protein, 33 aa, Artificial Sequence
  Description of Artificial Sequence: Synthetic polypeptide
DEHEIRTTNPCATEQYGSVSTGNDLGQDDGGMR

SEQ ID NO: 61903 - protein, 31 aa, Artificial Sequence
  Description of Artificial Sequence: Synthetic polypeptide
DEHEIRTTNPCATETYGSVSTNLQGNGDDDK

SEQ ID NO: 61904 - protein, 34 aa, Artificial Sequence
  Description of Artificial Sequence: Synthetic polypeptide
DEHEIRTTNPCATEQYGSVSTGNDLQDAQGDNNR

SEQ ID NO: 61905 - protein, 33 aa, Artificial Sequence
  Description of Artificial Sequence: Synthetic polypeptide
DEHEIRTTNPCATEQYGSVSTGNGGQAQGDNDR

SEQ ID NO: 61906 - protein, 34 aa, Artificial Sequence
  Description of Artificial Sequence: Synthetic polypeptide
DEHEIRTTNPCATEQYGSVSTGNGLQGAQGNNDR

SEQ ID NO: 61907 - protein, 32 aa, Artificial Sequence
  Description of Artificial Sequence: Synthetic polypeptide
DEHEIRTTNPCATEQYGSVSTGNGQAQDNNDR

SEQ ID NO: 61908 - protein, 33 aa, Artificial Sequence
  Description of Artificial Sequence: Synthetic polypeptide
DEHEIRTTNPCATEQYGSVSTGNLGDAQGNNDR

SEQ ID NO: 61909 - protein, 34 aa, Artificial Sequence
  Description of Artificial Sequence: Synthetic polypeptide
DEHEIRTTNPCATEQYGSVSTGNQLQGDQGNNIR

SEQ ID NO: 61910 - protein, 33 aa, Artificial Sequence
  Description of Artificial Sequence: Synthetic polypeptide
DEEEIRTTNPVATEQYGSVCSTNLLQVQFTELE

SEQ ID NO: 61911 - protein, 32 aa, Artificial Sequence
  Description of Artificial Sequence: Synthetic polypeptide
DEHEIRTTNPCATEQYGSVSTNLNGDHGNEMG

SEQ ID NO: 61912 - protein, 33 aa, Artificial Sequence
  Description of Artificial Sequence: Synthetic polypeptide
DEHEIRTTNPCATEQYGSVSTNLNQGDAGQNND

SEQ ID NO: 61913 - protein, 33 aa, Artificial Sequence
  Description of Artificial Sequence: Synthetic polypeptide
DEHEIRTTNPCATEQYGSVSTNLNQGDVGNGSD

SEQ ID NO: 61914 - protein, 34 aa, Artificial Sequence
  Description of Artificial Sequence: Synthetic polypeptide
DEHEIRTTNPCATEQYGSVSTGNDLQDAQGNGSR

SEQ ID NO: 61915 - protein, 31 aa, Artificial Sequence
  Description of Artificial Sequence: Synthetic polypeptide
DEHEIRTTNPVATEQYGCVATNNQFGGGDER

SEQ ID NO: 61916 - protein, 30 aa, Artificial Sequence
  Description of Artificial Sequence: Synthetic polypeptide
DEHEIRTTNPVATEQYGCVCSSNLINNSNQ

SEQ ID NO: 61917 - protein, 31 aa, Artificial Sequence
  Description of Artificial Sequence: Synthetic polypeptide
DEHEIRTTNPVATEQYGEVSTNLNGDTNGGE

SEQ ID NO: 61918 - protein, 31 aa, Artificial Sequence
  Description of Artificial Sequence: Synthetic polypeptide
DEHEIRTTNPVATEQYGSVSWNEDPRNMNMG

SEQ ID NO: 61919 - protein, 32 aa, Artificial Sequence
  Description of Artificial Sequence: Synthetic polypeptide
DEHEIRTTNPVATEQYGSVVSQNLSFSVGNNE

SEQ ID NO: 61920 - protein, 34 aa, Artificial Sequence
  Description of Artificial Sequence: Synthetic polypeptide
DEHEIRTTNPVATEQYGSVVSTENLAGEMGDNNR

SEQ ID NO: 61921 - protein, 33 aa, Artificial Sequence
  Description of Artificial Sequence: Synthetic polypeptide
DEHEIRTTNPVATEQYGSVYKWTNDIQKGGNRD

SEQ ID NO: 61922 - protein, 30 aa, Artificial Sequence
  Description of Artificial Sequence: Synthetic polypeptide
DEHEIRTTNPVATETWGSVSTNMQGDGDTE

SEQ ID NO: 61923 - protein, 32 aa, Artificial Sequence
  Description of Artificial Sequence: Synthetic polypeptide
DEHEIRTTNPVATETYGVVSTNLQGDLGNGGE

SEQ ID NO: 61924 - protein, 33 aa, Artificial Sequence
  Description of Artificial Sequence: Synthetic polypeptide
DEHEIRTTNPVATEYYGSCSTNDLNSRGQENRD

SEQ ID NO: 61925 - protein, 30 aa, Artificial Sequence
  Description of Artificial Sequence: Synthetic polypeptide
DEHEIRTTNPVAYDQWGSVNTGLQRGGNND

SEQ ID NO: 61926 - protein, 30 aa, Artificial Sequence
  Description of Artificial Sequence: Synthetic polypeptide
DEHEIRTTNPVAYDQYGSVTTQGLQGDGND

SEQ ID NO: 61927 - protein, 33 aa, Artificial Sequence
  Description of Artificial Sequence: Synthetic polypeptide
DEHEIRTTNPVATEQYGSVSVTANLSPDYNPRD

SEQ ID NO: 61928 - protein, 30 aa, Artificial Sequence
  Description of Artificial Sequence: Synthetic polypeptide
DEHEIRTTNPVAYEAWGEVSTNLQDGDNQD

SEQ ID NO: 61929 - protein, 31 aa, Artificial Sequence
  Description of Artificial Sequence: Synthetic polypeptide
DEHEIRTTNPVAYEAWGSVSTNLGQGDGNGS

SEQ ID NO: 61930 - protein, 31 aa, Artificial Sequence
  Description of Artificial Sequence: Synthetic polypeptide
DEHEIRTTNPVAYECWGSVSTNLQGNDGNAN

SEQ ID NO: 61931 - protein, 31 aa, Artificial Sequence
  Description of Artificial Sequence: Synthetic polypeptide
DEHEIRTTNPVAYECYGSVSTNLQGNDGDMK

SEQ ID NO: 61932 - protein, 31 aa, Artificial Sequence
  Description of Artificial Sequence: Synthetic polypeptide
DEHEIRTTNPVAYEEYGSVVSTNLDGGQGER

SEQ ID NO: 61933 - protein, 31 aa, Artificial Sequence
  Description of Artificial Sequence: Synthetic polypeptide
DEHEIRTTNPVAYEHWGSVSTDNLQDGQNND

SEQ ID NO: 61934 - protein, 30 aa, Artificial Sequence
  Description of Artificial Sequence: Synthetic polypeptide
DEHEIRTTNPVAYEHWGSVSTNIQDGNNDT

SEQ ID NO: 61935 - protein, 30 aa, Artificial Sequence
  Description of Artificial Sequence: Synthetic polypeptide
DEHEIRTTNPVAYEHWGSVSTNLNDGNNND

SEQ ID NO: 61936 - protein, 31 aa, Artificial Sequence
  Description of Artificial Sequence: Synthetic polypeptide
DEHEIRTTNPVAYEHWGSVSTNLQDGGGNND

SEQ ID NO: 61937 - protein, 31 aa, Artificial Sequence
  Description of Artificial Sequence: Synthetic polypeptide
DEHEIRTTNPVAYEHWGSVSTNLQDGHNNDN

SEQ ID NO: 61938 - protein, 30 aa, Artificial Sequence
  Description of Artificial Sequence: Synthetic polypeptide
DEHEIRTTNPVAYEAWGEVSTNLQHDGNQE

SEQ ID NO: 61939 - protein, 33 aa, Artificial Sequence
  Description of Artificial Sequence: Synthetic polypeptide
DEHEIRTTNPVATEQYGSVSTTNGGNSQGENDR

SEQ ID NO: 61940 - protein, 33 aa, Artificial Sequence
  Description of Artificial Sequence: Synthetic polypeptide
DEHEIRTTNPVATEQYGSVSTTNGGDQRGGDGY

SEQ ID NO: 61941 - protein, 32 aa, Artificial Sequence
  Description of Artificial Sequence: Synthetic polypeptide
DEHEIRTTNPVATEQYGSVSTTGPQGQDGNGS

SEQ ID NO: 61942 - protein, 32 aa, Artificial Sequence
  Description of Artificial Sequence: Synthetic polypeptide
DEHEIRTTNPVATEQYGEVSTNLNNGDINGNE

SEQ ID NO: 61943 - protein, 33 aa, Artificial Sequence
  Description of Artificial Sequence: Synthetic polypeptide
DEHEIRTTNPVATEQYGSIPSCTNSSQREGGSR

SEQ ID NO: 61944 - protein, 31 aa, Artificial Sequence
  Description of Artificial Sequence: Synthetic polypeptide
DEHEIRTTNPVATEQYGSISTGETQGGEGLR

SEQ ID NO: 61945 - protein, 31 aa, Artificial Sequence
  Description of Artificial Sequence: Synthetic polypeptide
DEHEIRTTNPVATEQYGSSSTDTQQREGEDN

SEQ ID NO: 61946 - protein, 31 aa, Artificial Sequence
  Description of Artificial Sequence: Synthetic polypeptide
DEHEIRTTNPVATEQYGSSSTNTQQEEGETN

SEQ ID NO: 61947 - protein, 33 aa, Artificial Sequence
  Description of Artificial Sequence: Synthetic polypeptide
DEHEIRTTNPVATEQYGSTISCTNHSQREGGDR

SEQ ID NO: 61948 - protein, 31 aa, Artificial Sequence
  Description of Artificial Sequence: Synthetic polypeptide
DEHEIRTTNPVATEQYGSVCSAMLFPGNMNH

SEQ ID NO: 61949 - protein, 31 aa, Artificial Sequence
  Description of Artificial Sequence: Synthetic polypeptide
DEHEIRTTNPVATEQYGSVCSPTNDELEDNQ

SEQ ID NO: 61950 - protein, 33 aa, Artificial Sequence
  Description of Artificial Sequence: Synthetic polypeptide
DEHEIRTTNPVATEQYGSVCYTNDHQERDDINR

SEQ ID NO: 61951 - protein, 33 aa, Artificial Sequence
  Description of Artificial Sequence: Synthetic polypeptide
DEHEIRTTNPVATEQYGSVCYTNDHQERDMGDR

SEQ ID NO: 61952 - protein, 33 aa, Artificial Sequence
  Description of Artificial Sequence: Synthetic polypeptide
DEHEIRTTNPVATEQYGSVCYTNDHQERDMGKR

SEQ ID NO: 61953 - protein, 31 aa, Artificial Sequence
  Description of Artificial Sequence: Synthetic polypeptide
DEHEIRTTNPVATEQYGSVNTDLQNEEINND

SEQ ID NO: 61954 - protein, 33 aa, Artificial Sequence
  Description of Artificial Sequence: Synthetic polypeptide
DEHEIRTTNPVATEQYGSVSCTNISTHGGNNRF

SEQ ID NO: 61955 - protein, 34 aa, Artificial Sequence
  Description of Artificial Sequence: Synthetic polypeptide
DEHEIRTTNPVATEQYGSVSCTQNEQDRSGEERN

SEQ ID NO: 61956 - protein, 32 aa, Artificial Sequence
  Description of Artificial Sequence: Synthetic polypeptide
DEHEIRTTNPVATEQYGSVSPTNIERNNTQED

SEQ ID NO: 61957 - protein, 30 aa, Artificial Sequence
  Description of Artificial Sequence: Synthetic polypeptide
DEHEIRTTNPVATEQYGSVSQMLFPENMIE

SEQ ID NO: 61958 - protein, 31 aa, Artificial Sequence
  Description of Artificial Sequence: Synthetic polypeptide
DEHEIRTTNPVATEQYGSVSQNNLTENMNDE

SEQ ID NO: 61959 - protein, 33 aa, Artificial Sequence
  Description of Artificial Sequence: Synthetic polypeptide
DEHEIRTTNPVATEQYGSVSSTNLGEMGGGNNN

SEQ ID NO: 61960 - protein, 32 aa, Artificial Sequence
  Description of Artificial Sequence: Synthetic polypeptide
DEHEIRTTNPVATEQYGSVSTNNGDGRGGDLY

SEQ ID NO: 61961 - protein, 33 aa, Artificial Sequence
  Description of Artificial Sequence: Synthetic polypeptide
DEHEIRTTNPVATEQYGSVSTTGNPQGNMGNGQ

SEQ ID NO: 61962 - protein, 32 aa, Artificial Sequence
  Description of Artificial Sequence: Synthetic polypeptide
DEHEIRTTNPVATEQYGSVSTTGPQGEGQNNG

SEQ ID NO: 61963 - protein, 31 aa, Artificial Sequence
  Description of Artificial Sequence: Synthetic polypeptide
DEMEIRTTNPVATCQYGCVCSTNLERGSDQS

SEQ ID NO: 61964 - protein, 31 aa, Artificial Sequence
  Description of Artificial Sequence: Synthetic polypeptide
DEMEIRTTNPVATCQYGCVCSTNPERGSNQA

SEQ ID NO: 61965 - protein, 34 aa, Artificial Sequence
  Description of Artificial Sequence: Synthetic polypeptide
DEEEIRTTNPVATEQYGSVCSTNELILRSVEENQ

SEQ ID NO: 61966 - protein, 31 aa, Artificial Sequence
  Description of Artificial Sequence: Synthetic polypeptide
DEMEIRTTNPVATCQYGCVSTINLERGDGQQ

SEQ ID NO: 61967 - protein, 32 aa, Artificial Sequence
  Description of Artificial Sequence: Synthetic polypeptide
DEEEIRTTNPVATEQYGSVCSTGNLIMEDEMI

SEQ ID NO: 61968 - protein, 31 aa, Artificial Sequence
  Description of Artificial Sequence: Synthetic polypeptide
DEMEIRTTNPVATEQYGVVSSELQRQPENDL

SEQ ID NO: 61969 - protein, 34 aa, Artificial Sequence
  Description of Artificial Sequence: Synthetic polypeptide
DEEEIRTTNPVATEQYGSVCSTGNLEHFGSNNQP

SEQ ID NO: 61970 - protein, 31 aa, Artificial Sequence
  Description of Artificial Sequence: Synthetic polypeptide
DEMEIRTTNPVATEQYGVVSSVTLQRPENQD

SEQ ID NO: 61971 - protein, 31 aa, Artificial Sequence
  Description of Artificial Sequence: Synthetic polypeptide
DEMEIRTTNPVATEQYGVVSTVTLTIGPNND

SEQ ID NO: 61972 - protein, 33 aa, Artificial Sequence
  Description of Artificial Sequence: Synthetic polypeptide
DEEEIRTTNPVATEQYGSVCSTGNHQGSNSDQP

SEQ ID NO: 61973 - protein, 34 aa, Artificial Sequence
  Description of Artificial Sequence: Synthetic polypeptide
DEEEIRTTNPVATEQYGSVCSTGNHQENGSNNQL

SEQ ID NO: 61974 - protein, 32 aa, Artificial Sequence
  Description of Artificial Sequence: Synthetic polypeptide
DEMEIRTTNPVATQQYGCVCSTENLERGSNQE

SEQ ID NO: 61975 - protein, 34 aa, Artificial Sequence
  Description of Artificial Sequence: Synthetic polypeptide
DEEEIRTTNPVATEQYGSVCSTGNDQNFGSNFQS

SEQ ID NO: 61976 - protein, 34 aa, Artificial Sequence
  Description of Artificial Sequence: Synthetic polypeptide
DEEEIRTTNPVATEQYGSVCSTGNLLQNFGSDDL

SEQ ID NO: 61977 - protein, 31 aa, Artificial Sequence
  Description of Artificial Sequence: Synthetic polypeptide
DEMEIRTTNPVATQQYGCVCSTGNLEGGSNQ

SEQ ID NO: 61978 - protein, 33 aa, Artificial Sequence
  Description of Artificial Sequence: Synthetic polypeptide
DEEEIRTTNPVATEQYGSVCSTGNDQGFGSEDA

SEQ ID NO: 61979 - protein, 31 aa, Artificial Sequence
  Description of Artificial Sequence: Synthetic polypeptide
DEMEIRTTNPVATQQYGCVSFTENLERGEPT

SEQ ID NO: 61980 - protein, 34 aa, Artificial Sequence
  Description of Artificial Sequence: Synthetic polypeptide
DEEEIRTTNPVATEQYGSVCSTGNDLQHFNSNQL

SEQ ID NO: 61981 - protein, 34 aa, Artificial Sequence
  Description of Artificial Sequence: Synthetic polypeptide
DEEEIRTTNPVATEQYGSVCSTGNDHQRSGSDQP

SEQ ID NO: 61982 - protein, 32 aa, Artificial Sequence
  Description of Artificial Sequence: Synthetic polypeptide
DEEEIRTTNPVATEQYGSVCSTGLQVIEPSMQ

SEQ ID NO: 61983 - protein, 31 aa, Artificial Sequence
  Description of Artificial Sequence: Synthetic polypeptide
DEMEIRTTNPVATQQYGTVSTNLEVVQGNEP

SEQ ID NO: 61984 - protein, 31 aa, Artificial Sequence
  Description of Artificial Sequence: Synthetic polypeptide
DEMEIRYTNPVATEQYGSVSVNQDHGSNSRD

SEQ ID NO: 61985 - protein, 33 aa, Artificial Sequence
  Description of Artificial Sequence: Synthetic polypeptide
DEEEIRTTNPVATEQYGSVCSTGEPQGFGSNQN

SEQ ID NO: 61986 - protein, 31 aa, Artificial Sequence
  Description of Artificial Sequence: Synthetic polypeptide
DEMEIRYTNPVATEQYGSVSVNQDRGSNSNV

SEQ ID NO: 61987 - protein, 31 aa, Artificial Sequence
  Description of Artificial Sequence: Synthetic polypeptide
DEMEIRTTNPVATQQYGCVCSTNLEYGSNQP

SEQ ID NO: 61988 - protein, 33 aa, Artificial Sequence
  Description of Artificial Sequence: Synthetic polypeptide
DEEEIRTTNPVATEQYGSVCSTGELQGFNSDQV

SEQ ID NO: 61989 - protein, 32 aa, Artificial Sequence
  Description of Artificial Sequence: Synthetic polypeptide
DEMEIRTTNPVATEQYGTVCSTDGPVEREGNR

SEQ ID NO: 61990 - protein, 31 aa, Artificial Sequence
  Description of Artificial Sequence: Synthetic polypeptide
DEMEIRTTNPVATEQYGSVWPNHQRASDEDR

SEQ ID NO: 61991 - protein, 31 aa, Artificial Sequence
  Description of Artificial Sequence: Synthetic polypeptide
DEMEIRTTNPVATEQYGSVSTSMDQEGGEQN

SEQ ID NO: 61992 - protein, 34 aa, Artificial Sequence
  Description of Artificial Sequence: Synthetic polypeptide
DEMEIRTTNPVATEQYGSVSTTMNNLQSFGSDQR

SEQ ID NO: 61993 - protein, 34 aa, Artificial Sequence
  Description of Artificial Sequence: Synthetic polypeptide
DEEEIRTTNPVATEQYGSVCSTLNLEVGEENINS

SEQ ID NO: 61994 - protein, 33 aa, Artificial Sequence
  Description of Artificial Sequence: Synthetic polypeptide
DEEEIRTTNPVATEQYGSVCSTLNLETQENIES

SEQ ID NO: 61995 - protein, 33 aa, Artificial Sequence
  Description of Artificial Sequence: Synthetic polypeptide
DEEEIRTTNPVATEQYGSVCSTLNLEGAENIDD

SEQ ID NO: 61996 - protein, 33 aa, Artificial Sequence
  Description of Artificial Sequence: Synthetic polypeptide
DEMEIRTTNPVATEQYGSVSTTNDLNNNGSNQE

SEQ ID NO: 61997 - protein, 32 aa, Artificial Sequence
  Description of Artificial Sequence: Synthetic polypeptide
DEMEIRTTNPVATEQYGSVSVELQMFGNESQN

SEQ ID NO: 61998 - protein, 33 aa, Artificial Sequence
  Description of Artificial Sequence: Synthetic polypeptide
DEEEIRTTNPVATEQYGSVCSTGVLDIRGVEEN

SEQ ID NO: 61999 - protein, 31 aa, Artificial Sequence
  Description of Artificial Sequence: Synthetic polypeptide
DEMEIRTTNPVATEQYGSVSVELQMPNESQN

SEQ ID NO: 62000 - protein, 31 aa, Artificial Sequence
  Description of Artificial Sequence: Synthetic polypeptide
DEMEIRTTNPVATEQYGSWSVPNMLQEDFER

SEQ ID NO: 62001 - protein, 33 aa, Artificial Sequence
  Description of Artificial Sequence: Synthetic polypeptide
DEEEIRTTNPVATEQYGSVCSTGPLQFFGSDQA

SEQ ID NO: 62002 - protein, 32 aa, Artificial Sequence
  Description of Artificial Sequence: Synthetic polypeptide
DEMEIRTTNPVATEQYGSVSVPDLQNTGNFQE

SEQ ID NO: 62003 - protein, 34 aa, Artificial Sequence
  Description of Artificial Sequence: Synthetic polypeptide
DEMEIRTTNPVATEQYGSVSVTALNLQEGNNDQD

SEQ ID NO: 62004 - protein, 33 aa, Artificial Sequence
  Description of Artificial Sequence: Synthetic polypeptide
DEMEIRTTNPVATEQYGSVSVTNDLERFAENNQ

SEQ ID NO: 62005 - protein, 33 aa, Artificial Sequence
  Description of Artificial Sequence: Synthetic polypeptide
DEMEIRTTNPVATEQYGSVSVTNLDETTGDDRQ

SEQ ID NO: 62006 - protein, 33 aa, Artificial Sequence
  Description of Artificial Sequence: Synthetic polypeptide
DEMEIRTTNPVATEQYGSVSVTNLTQEETQNDQ

SEQ ID NO: 62007 - protein, 30 aa, Artificial Sequence
  Description of Artificial Sequence: Synthetic polypeptide
DEMEIRTTNPVATEQYGSVSVTNMEGELEQ

SEQ ID NO: 62008 - protein, 30 aa, Artificial Sequence
  Description of Artificial Sequence: Synthetic polypeptide
DEMEIRTTNPVATEQYGSVSVTVMEGGEFV

SEQ ID NO: 62009 - protein, 32 aa, Artificial Sequence
  Description of Artificial Sequence: Synthetic polypeptide
DEMEIRTTNPVATEQYGSVSWDTITTRGDQRM

SEQ ID NO: 62010 - protein, 32 aa, Artificial Sequence
  Description of Artificial Sequence: Synthetic polypeptide
DEMEIRTTNPVATEQYGSVTSTEPLERDDNSQ

SEQ ID NO: 62011 - protein, 32 aa, Artificial Sequence
  Description of Artificial Sequence: Synthetic polypeptide
DEMEIRTTNPVATEQYGSVSVNTLNQETNDQL

SEQ ID NO: 62012 - protein, 33 aa, Artificial Sequence
  Description of Artificial Sequence: Synthetic polypeptide
DEEEIRTTNPVATEQYGSVCSTGELQGFGSQDA

SEQ ID NO: 62013 - protein, 32 aa, Artificial Sequence
  Description of Artificial Sequence: Synthetic polypeptide
DEMEISTTNPVATEQYGCVCSTNLQNFGSNQG

SEQ ID NO: 62014 - protein, 34 aa, Artificial Sequence
  Description of Artificial Sequence: Synthetic polypeptide
DEEEIRTTNPVATEQYGSVCSTGELQEGFGSNAN

SEQ ID NO: 62015 - protein, 28 aa, Artificial Sequence
  Description of Artificial Sequence: Synthetic peptide
DEMEIVTTNPVATEQYGTVSTGPEFGED

SEQ ID NO: 62016 - protein, 29 aa, Artificial Sequence
  Description of Artificial Sequence: Synthetic peptide
DEMEIVTTNPVATEQYGTVSTIPEFEGND

SEQ ID NO: 62017 - protein, 31 aa, Artificial Sequence
  Description of Artificial Sequence: Synthetic polypeptide
DEMEIVTTNPVSTEQYGTVSATGLVQFEGNR

SEQ ID NO: 62018 - protein, 30 aa, Artificial Sequence
  Description of Artificial Sequence: Synthetic polypeptide
DEMVIGTTNPVATEQWGSVSTDLLQRGSQQ

SEQ ID NO: 62019 - protein, 33 aa, Artificial Sequence
  Description of Artificial Sequence: Synthetic polypeptide
DEEEIRTTNPVATEQYGSVCSTENPHQNNSNQL

SEQ ID NO: 62020 - protein, 33 aa, Artificial Sequence
  Description of Artificial Sequence: Synthetic polypeptide
DENEAEIRTTNPVAYEAWGSVSTNLQGENGNGR

SEQ ID NO: 62021 - protein, 33 aa, Artificial Sequence
  Description of Artificial Sequence: Synthetic polypeptide
DENEAEIRTTNPVAYEHYGVVSTNLQGEDGNNR

SEQ ID NO: 62022 - protein, 33 aa, Artificial Sequence
  Description of Artificial Sequence: Synthetic polypeptide
DENEAEIRTTNPVAYEKWGSVSTNLQGEDGNNR

SEQ ID NO: 62023 - protein, 31 aa, Artificial Sequence
  Description of Artificial Sequence: Synthetic polypeptide
DENEIACTNPVATECYGEVSENLPQREGENR

SEQ ID NO: 62024 - protein, 31 aa, Artificial Sequence
  Description of Artificial Sequence: Synthetic polypeptide
DEMEIVTTNPVATEQYGTVSTDNPVEFEGNR

SEQ ID NO: 62025 - protein, 28 aa, Artificial Sequence
  Description of Artificial Sequence: Synthetic peptide
DENEIACTNPVATEGYGEASENIQRGGR

SEQ ID NO: 62026 - protein, 28 aa, Artificial Sequence
  Description of Artificial Sequence: Synthetic peptide
DENEIACTNPVATEQWGDASENLQREGR

SEQ ID NO: 62027 - protein, 34 aa, Artificial Sequence
  Description of Artificial Sequence: Synthetic polypeptide
DEEEIRTTNPVATEQYGSVCSTENLEFFGSENQA

SEQ ID NO: 62028 - protein, 29 aa, Artificial Sequence
  Description of Artificial Sequence: Synthetic peptide
DENEIACTNPVATEQYGDASENLMNRGDR

SEQ ID NO: 62029 - protein, 33 aa, Artificial Sequence
  Description of Artificial Sequence: Synthetic polypeptide
DEEEIRTTNPVATEQYGSVCSTENHQSFGSDQM

SEQ ID NO: 62030 - protein, 29 aa, Artificial Sequence
  Description of Artificial Sequence: Synthetic peptide
DENEIACTNPVATEQYGDVSENLMNRGDA

SEQ ID NO: 62031 - protein, 29 aa, Artificial Sequence
  Description of Artificial Sequence: Synthetic peptide
DENEIACTNPVATEQYGEASEDNPQRGGR

SEQ ID NO: 62032 - protein, 34 aa, Artificial Sequence
  Description of Artificial Sequence: Synthetic polypeptide
DEEEIRTTNPVATEQYGSVCSTENHQGFGSNTQV

SEQ ID NO: 62033 - protein, 33 aa, Artificial Sequence
  Description of Artificial Sequence: Synthetic polypeptide
DEEEIRTTNPVATEQYGSVCSTENHNQNGSEQA

SEQ ID NO: 62034 - protein, 29 aa, Artificial Sequence
  Description of Artificial Sequence: Synthetic peptide
DENEIACTNPVATEQYGEASENLMNRGDR

SEQ ID NO: 62035 - protein, 29 aa, Artificial Sequence
  Description of Artificial Sequence: Synthetic peptide
DENEIACTNPVATEGYGEASENLQSRGGR

SEQ ID NO: 62036 - protein, 29 aa, Artificial Sequence
  Description of Artificial Sequence: Synthetic peptide
DEMEIVTTNPVATEQYGTVSTDCPEFGND

SEQ ID NO: 62037 - protein, 33 aa, Artificial Sequence
  Description of Artificial Sequence: Synthetic polypeptide
DEEEIRTTNPVATEQYGSVCSTEPDQFFGSNQI

SEQ ID NO: 62038 - protein, 29 aa, Artificial Sequence
  Description of Artificial Sequence: Synthetic peptide
DEMEIVTTNPVATEQYGTVSATGPEFGND

SEQ ID NO: 62039 - protein, 29 aa, Artificial Sequence
  Description of Artificial Sequence: Synthetic peptide
DEMEIVCTNPIATEQYGTVSEDNLEFGNR

SEQ ID NO: 62040 - protein, 29 aa, Artificial Sequence
  Description of Artificial Sequence: Synthetic peptide
DEMEIVCTNPVATEQYGEASEDGLQFGNR

SEQ ID NO: 62041 - protein, 29 aa, Artificial Sequence
  Description of Artificial Sequence: Synthetic peptide
DEMEIVCTNPVATEQYGEASEDNLQFGGR

SEQ ID NO: 62042 - protein, 32 aa, Artificial Sequence
  Description of Artificial Sequence: Synthetic polypeptide
DEEEIRTTNPVATEQYGSVCSTGEHQGFGDQV

SEQ ID NO: 62043 - protein, 31 aa, Artificial Sequence
  Description of Artificial Sequence: Synthetic polypeptide
DEMEIVCTNPVATEQYGSVCSTDGPVERGNR

SEQ ID NO: 62044 - protein, 29 aa, Artificial Sequence
  Description of Artificial Sequence: Synthetic peptide
DEMEIVCTNPVATEQYGTVCSEGLMFGNR

SEQ ID NO: 62045 - protein, 34 aa, Artificial Sequence
  Description of Artificial Sequence: Synthetic polypeptide
DEEEIRTTNPVATEQYGSVCSTGAHQRFGSNTQS

SEQ ID NO: 62046 - protein, 32 aa, Artificial Sequence
  Description of Artificial Sequence: Synthetic polypeptide
DEMEIVTTNPIATEQYGSVSATDGLVEREGNR

SEQ ID NO: 62047 - protein, 33 aa, Artificial Sequence
  Description of Artificial Sequence: Synthetic polypeptide
DEEEIRTTNPVATEQYGSVCSTGAHQNFGSNQM

SEQ ID NO: 62048 - protein, 32 aa, Artificial Sequence
  Description of Artificial Sequence: Synthetic polypeptide
DEMEIVTTNPIATEQYGSVSATDGLVMREGNR

SEQ ID NO: 62049 - protein, 30 aa, Artificial Sequence
  Description of Artificial Sequence: Synthetic polypeptide
DEMEIVTTNPIATEQYGTVCSEDNLEFGNR

SEQ ID NO: 62050 - protein, 30 aa, Artificial Sequence
  Description of Artificial Sequence: Synthetic polypeptide
DEMEIVTTNPIATEQYGTVCSTDNLEFGND

SEQ ID NO: 62051 - protein, 34 aa, Artificial Sequence
  Description of Artificial Sequence: Synthetic polypeptide
DEEEIRTTNPVATEQYGSVCSTEYLQEYFGSNQP

SEQ ID NO: 62052 - protein, 31 aa, Artificial Sequence
  Description of Artificial Sequence: Synthetic polypeptide
DEMEIVTTNPVATEQYGSVCSATDLEHEGNL

SEQ ID NO: 62053 - protein, 32 aa, Artificial Sequence
  Description of Artificial Sequence: Synthetic polypeptide
DEEEIRTTNPVATEQYGSVCSTETQNFGSEFI

SEQ ID NO: 62054 - protein, 32 aa, Artificial Sequence
  Description of Artificial Sequence: Synthetic polypeptide
DEEEIRTTNPVATEQYGSVCSTEPQYSGSDQP

SEQ ID NO: 62055 - protein, 31 aa, Artificial Sequence
  Description of Artificial Sequence: Synthetic polypeptide
DEMEIVTTNPVATEQYGSVSATDLEDHEGNL

SEQ ID NO: 62056 - protein, 32 aa, Artificial Sequence
  Description of Artificial Sequence: Synthetic polypeptide
DEMEIVTTNPVATEQYGTVCSATDNLMFEGNR

SEQ ID NO: 62057 - protein, 30 aa, Artificial Sequence
  Description of Artificial Sequence: Synthetic polypeptide
DEMEIVTTNPVATEQYGTVCSTGPMREGND

SEQ ID NO: 62058 - protein, 34 aa, Artificial Sequence
  Description of Artificial Sequence: Synthetic polypeptide
DEEEIRTTNPVATEQYGSVCSTEPLQNFGSENQN

SEQ ID NO: 62059 - protein, 31 aa, Artificial Sequence
  Description of Artificial Sequence: Synthetic polypeptide
DEMEIVTTNPVATEQYGTVCSTNPVEREGND

SEQ ID NO: 62060 - protein, 33 aa, Artificial Sequence
  Description of Artificial Sequence: Synthetic polypeptide
DEEEIRTTNPVATEQYGSVCSTMEHQSFGSNQT

SEQ ID NO: 62061 - protein, 29 aa, Artificial Sequence
  Description of Artificial Sequence: Synthetic peptide
DEHEIATTNPVCTETYGSVANPNLQDGND

SEQ ID NO: 62062 - protein, 33 aa, Artificial Sequence
  Description of Artificial Sequence: Synthetic polypeptide
DEEEIRTTNPVATEQYGSVCSTMELQHFGSDQT

SEQ ID NO: 62063 - protein, 31 aa, Artificial Sequence
  Description of Artificial Sequence: Synthetic polypeptide
DEMEIRTTNPVATEQYGSVSTPLNNRDDQQD

SEQ ID NO: 62064 - protein, 32 aa, Artificial Sequence
  Description of Artificial Sequence: Synthetic polypeptide
DEMEIRTTNPVATEQYGCVSTNLLQRVQDDSL

SEQ ID NO: 62065 - protein, 32 aa, Artificial Sequence
  Description of Artificial Sequence: Synthetic polypeptide
DEMEIRTTNPVATEQYGCVSTNLLTQNGLEDE

SEQ ID NO: 62066 - protein, 30 aa, Artificial Sequence
  Description of Artificial Sequence: Synthetic polypeptide
DEMEIRTTNPVATEQYGCVSTNNQESTEQN

SEQ ID NO: 62067 - protein, 31 aa, Artificial Sequence
  Description of Artificial Sequence: Synthetic polypeptide
DEMEIRTTNPVATEQYGCVSTVNHQEENNQG

SEQ ID NO: 62068 - protein, 31 aa, Artificial Sequence
  Description of Artificial Sequence: Synthetic polypeptide
DEMEIRTTNPVATEQYGCVSTVNHQEENQEY

SEQ ID NO: 62069 - protein, 31 aa, Artificial Sequence
  Description of Artificial Sequence: Synthetic polypeptide
DEMEIRTTNPVATEQYGCVSTVNLEFDGEGF

SEQ ID NO: 62070 - protein, 32 aa, Artificial Sequence
  Description of Artificial Sequence: Synthetic polypeptide
DEMEIRTTNPVATEQYGCVSTVVNLDQRDDQE

SEQ ID NO: 62071 - protein, 30 aa, Artificial Sequence
  Description of Artificial Sequence: Synthetic polypeptide
DEMEIRTTNPVATEQYGETSTNHQHFGSDQ

SEQ ID NO: 62072 - protein, 32 aa, Artificial Sequence
  Description of Artificial Sequence: Synthetic polypeptide
DEMEIRTTNPVATEQYGSCSAPNLNQGNENRD

SEQ ID NO: 62073 - protein, 32 aa, Artificial Sequence
  Description of Artificial Sequence: Synthetic polypeptide
DEMEIRTTNPVATEQYGCVSTNLLQFNGLDSN

SEQ ID NO: 62074 - protein, 31 aa, Artificial Sequence
  Description of Artificial Sequence: Synthetic polypeptide
DEMEIRTTNPVATEQYGSCSTDALQHGSEDM

SEQ ID NO: 62075 - protein, 31 aa, Artificial Sequence
  Description of Artificial Sequence: Synthetic polypeptide
DEMEIRTTNPVATEQYGSCSTLDLMEGENPQ

SEQ ID NO: 62076 - protein, 31 aa, Artificial Sequence
  Description of Artificial Sequence: Synthetic polypeptide
DEMEIRTTNPVATEQYGSCSTPLQRSTIDMI

SEQ ID NO: 62077 - protein, 34 aa, Artificial Sequence
  Description of Artificial Sequence: Synthetic polypeptide
DEEEIRTTNPVATEQYGSVCSTNDHQERDDDIRR

SEQ ID NO: 62078 - protein, 32 aa, Artificial Sequence
  Description of Artificial Sequence: Synthetic polypeptide
DEMEIRTTNPVATEQYGSICSTNTQRFGSEQS

SEQ ID NO: 62079 - protein, 31 aa, Artificial Sequence
  Description of Artificial Sequence: Synthetic polypeptide
DEMEIRTTNPVATEQYGSISTNTQHEGSEQS

SEQ ID NO: 62080 - protein, 32 aa, Artificial Sequence
  Description of Artificial Sequence: Synthetic polypeptide
DEMEIRTTNPVATEQYGSSSNYELQRGNEDPQ

SEQ ID NO: 62081 - protein, 31 aa, Artificial Sequence
  Description of Artificial Sequence: Synthetic polypeptide
DEMEIRTTNPVATEQYGSSSTVFQQDEGERI

SEQ ID NO: 62082 - protein, 33 aa, Artificial Sequence
  Description of Artificial Sequence: Synthetic polypeptide
DEMEIRTTNPVATEQYGSVAAVPLQNRPGNNQR

SEQ ID NO: 62083 - protein, 32 aa, Artificial Sequence
  Description of Artificial Sequence: Synthetic polypeptide
DEMEIRTTNPVATEQYGSVATNLESGGTNELN

SEQ ID NO: 62084 - protein, 33 aa, Artificial Sequence
  Description of Artificial Sequence: Synthetic polypeptide
DEEEIRTTNPVATEQYGSVCSTNDHQNSGSDAP

SEQ ID NO: 62085 - protein, 29 aa, Artificial Sequence
  Description of Artificial Sequence: Synthetic peptide
DEMEIRTTNPVATEQYGSVCQTAHIRMEQ

SEQ ID NO: 62086 - protein, 32 aa, Artificial Sequence
  Description of Artificial Sequence: Synthetic polypeptide
DEMEIRTTNPVATEQYGCVSTNFLERGEEYQD

SEQ ID NO: 62087 - protein, 32 aa, Artificial Sequence
  Description of Artificial Sequence: Synthetic polypeptide
DEMEIRTTNPVATEQYGCVSTNALQQSGEESN

SEQ ID NO: 62088 - protein, 31 aa, Artificial Sequence
  Description of Artificial Sequence: Synthetic polypeptide
DEMEIRTTNPVATDQYGCVSNTNTLERGEPM

SEQ ID NO: 62089 - protein, 30 aa, Artificial Sequence
  Description of Artificial Sequence: Synthetic polypeptide
DEMEIRTTNPVATDQYGCVSTNVLERNQPP

SEQ ID NO: 62090 - protein, 33 aa, Artificial Sequence
  Description of Artificial Sequence: Synthetic polypeptide
DEEEIRTTNPVATEQYGSVCSTNDQHFGSEFQS

SEQ ID NO: 62091 - protein, 31 aa, Artificial Sequence
  Description of Artificial Sequence: Synthetic polypeptide
DEMEIRTTNPVATDQYGCVSTTNLERFGEPM

SEQ ID NO: 62092 - protein, 31 aa, Artificial Sequence
  Description of Artificial Sequence: Synthetic polypeptide
DEMEIRTTNPVATDQYGCVSTVLERTGNNPM

SEQ ID NO: 62093 - protein, 31 aa, Artificial Sequence
  Description of Artificial Sequence: Synthetic polypeptide
DEMEIRTTNPVATDQYGSVNTELQNFGSNDA

SEQ ID NO: 62094 - protein, 31 aa, Artificial Sequence
  Description of Artificial Sequence: Synthetic polypeptide
DEMEIRTTNPVATECWGSVSTDNEPEREGNG

SEQ ID NO: 62095 - protein, 31 aa, Artificial Sequence
  Description of Artificial Sequence: Synthetic polypeptide
DEMEIRTTNPVATEEYGCVNDTNTQQGVNRV

SEQ ID NO: 62096 - protein, 31 aa, Artificial Sequence
  Description of Artificial Sequence: Synthetic polypeptide
DEMEIRTTNPVATEQFGTSVTTYLLRGGNES

SEQ ID NO: 62097 - protein, 32 aa, Artificial Sequence
  Description of Artificial Sequence: Synthetic polypeptide
DEMEIRTTNPVATEQYGCVSTNDMQNRGQDEG

SEQ ID NO: 62098 - protein, 32 aa, Artificial Sequence
  Description of Artificial Sequence: Synthetic polypeptide
DEMEIRTTNPVATEQWGTVSTINEPQREGENG

SEQ ID NO: 62099 - protein, 30 aa, Artificial Sequence
  Description of Artificial Sequence: Synthetic polypeptide
DEMEIRTTNPVATEQYGCICSTPTQRFGDQ

SEQ ID NO: 62100 - protein, 31 aa, Artificial Sequence
  Description of Artificial Sequence: Synthetic polypeptide
DEMEIRTTNPVATEQYGCITSTNTQNFGSDR

SEQ ID NO: 62101 - protein, 31 aa, Artificial Sequence
  Description of Artificial Sequence: Synthetic polypeptide
DEMEIRTTNPVATEQYGCTSTGNLQHGSDQA

SEQ ID NO: 62102 - protein, 31 aa, Artificial Sequence
  Description of Artificial Sequence: Synthetic polypeptide
DEMEIRTTNPVATEQYGCVCSSNLIERNSNQ

SEQ ID NO: 62103 - protein, 31 aa, Artificial Sequence
  Description of Artificial Sequence: Synthetic polypeptide
DEMEIRTTNPVATEQYGCVCSWNLANFNSNR

SEQ ID NO: 62104 - protein, 31 aa, Artificial Sequence
  Description of Artificial Sequence: Synthetic polypeptide
DEMEIRTTNPVATEQYGCVSDWWLEQRSQDR

SEQ ID NO: 62105 - protein, 32 aa, Artificial Sequence
  Description of Artificial Sequence: Synthetic polypeptide
DEMEIRTTNPVATEQYGCVSNTELQNFGSNQS

SEQ ID NO: 62106 - protein, 31 aa, Artificial Sequence
  Description of Artificial Sequence: Synthetic polypeptide
DEMEIRTTNPVATEQYGCVSSVNLQYDDNDE

SEQ ID NO: 62107 - protein, 30 aa, Artificial Sequence
  Description of Artificial Sequence: Synthetic polypeptide
DEMEIRTTNPVATEQYGCVSTLNQETNENN

SEQ ID NO: 62108 - protein, 30 aa, Artificial Sequence
  Description of Artificial Sequence: Synthetic polypeptide
DEMEIRTTNPVATEQYGCICSTNTQNFGDA

SEQ ID NO: 62109 - protein, 32 aa, Artificial Sequence
  Description of Artificial Sequence: Synthetic polypeptide
DEMEIRTTNPVATEQYGSVCSCDGPVQREGNG

SEQ ID NO: 62110 - protein, 32 aa, Artificial Sequence
  Description of Artificial Sequence: Synthetic polypeptide
DEMEIRTTNPVATEQYGSVCSCIGPVQREGNG

SEQ ID NO: 62111 - protein, 32 aa, Artificial Sequence
  Description of Artificial Sequence: Synthetic polypeptide
DEMEIRTTNPVATEQYGSVCSDANNTQRQNHT

SEQ ID NO: 62112 - protein, 33 aa, Artificial Sequence
  Description of Artificial Sequence: Synthetic polypeptide
DEMEIRTTNPVATEQYGSVSPTNLETRAEEQNH

SEQ ID NO: 62113 - protein, 32 aa, Artificial Sequence
  Description of Artificial Sequence: Synthetic polypeptide
DEMEIRTTNPVATEQYGSVSPTNLETRTEEQE

SEQ ID NO: 62114 - protein, 31 aa, Artificial Sequence
  Description of Artificial Sequence: Synthetic polypeptide
DEMEIRTTNPVATEQYGSVSPTPLENRDDEK

SEQ ID NO: 62115 - protein, 31 aa, Artificial Sequence
  Description of Artificial Sequence: Synthetic polypeptide
DEMEIRTTNPVATEQYGSVSPTYLDREEQFE

SEQ ID NO: 62116 - protein, 32 aa, Artificial Sequence
  Description of Artificial Sequence: Synthetic polypeptide
DEMEIRTTNPVATEQYGSVSPWNLDEYRGEDQ

SEQ ID NO: 62117 - protein, 31 aa, Artificial Sequence
  Description of Artificial Sequence: Synthetic polypeptide
DEMEIRTTNPVATEQYGSVSSTDLESTENQG

SEQ ID NO: 62118 - protein, 31 aa, Artificial Sequence
  Description of Artificial Sequence: Synthetic polypeptide
DEMEIRTTNPVATEQYGSVSTDEQIDDGDAQ

SEQ ID NO: 62119 - protein, 30 aa, Artificial Sequence
  Description of Artificial Sequence: Synthetic polypeptide
DEMEIRTTNPVATEQYGSVSTDNNDNETDQ

SEQ ID NO: 62120 - protein, 32 aa, Artificial Sequence
  Description of Artificial Sequence: Synthetic polypeptide
DEMEIRTTNPVATEQYGSVSTENYDQRTDTAM

SEQ ID NO: 62121 - protein, 34 aa, Artificial Sequence
  Description of Artificial Sequence: Synthetic polypeptide
DEMEIRTTNPVATEQYGSVSPTNLDQERFGSIED

SEQ ID NO: 62122 - protein, 31 aa, Artificial Sequence
  Description of Artificial Sequence: Synthetic polypeptide
DEMEIRTTNPVATEQYGSVSTGEHQNFGSEQ

SEQ ID NO: 62123 - protein, 32 aa, Artificial Sequence
  Description of Artificial Sequence: Synthetic polypeptide
DEMEIRTTNPVATEQYGSVSTLEDLQIGDQEG

SEQ ID NO: 62124 - protein, 35 aa, Artificial Sequence
  Description of Artificial Sequence: Synthetic polypeptide
DEMEIRTTNPVATEQYGSVSTLNALQTGTQNEERQ

SEQ ID NO: 62125 - protein, 33 aa, Artificial Sequence
  Description of Artificial Sequence: Synthetic polypeptide
DEMEIRTTNPVATEQYGSVSTLNLQIRSLDDIE

SEQ ID NO: 62126 - protein, 34 aa, Artificial Sequence
  Description of Artificial Sequence: Synthetic polypeptide
DEMEIRTTNPVATEQYGSVSTNDLLQGEGQDERN

SEQ ID NO: 62127 - protein, 31 aa, Artificial Sequence
  Description of Artificial Sequence: Synthetic polypeptide
DEMEIRTTNPVATEQYGSVSTNHNQDESEDP

SEQ ID NO: 62128 - protein, 32 aa, Artificial Sequence
  Description of Artificial Sequence: Synthetic polypeptide
DEMEIRTTNPVATEQYGSVSTNNDEQLGSDVE

SEQ ID NO: 62129 - protein, 31 aa, Artificial Sequence
  Description of Artificial Sequence: Synthetic polypeptide
DEMEIRTTNPVATEQYGSVSTNNNFNEGMDQ

SEQ ID NO: 62130 - protein, 30 aa, Artificial Sequence
  Description of Artificial Sequence: Synthetic polypeptide
DEMEIRTTNPVATEQYGSVSTPLNEDQDQQ

SEQ ID NO: 62131 - protein, 34 aa, Artificial Sequence
  Description of Artificial Sequence: Synthetic polypeptide
DEEEIRTTNPVATEQYGSVCSTMNHQERFGSDQT

SEQ ID NO: 62132 - protein, 33 aa, Artificial Sequence
  Description of Artificial Sequence: Synthetic polypeptide
DEMEIRTTNPVATEQYGSVSTINLTTRNNEQDD

SEQ ID NO: 62133 - protein, 32 aa, Artificial Sequence
  Description of Artificial Sequence: Synthetic polypeptide
DEMEIRTTNPVATEQYGSVSPTNGQEGEEEQQ

SEQ ID NO: 62134 - protein, 32 aa, Artificial Sequence
  Description of Artificial Sequence: Synthetic polypeptide
DEMEIRTTNPVATEQYGSVSPTLNVDYIGNEQ

SEQ ID NO: 62135 - protein, 33 aa, Artificial Sequence
  Description of Artificial Sequence: Synthetic polypeptide
DEMEIRTTNPVATEQYGSVSPTDNAEQGRDSQR

SEQ ID NO: 62136 - protein, 31 aa, Artificial Sequence
  Description of Artificial Sequence: Synthetic polypeptide
DEMEIRTTNPVATEQYGSVCSPTNLEGEEFN

SEQ ID NO: 62137 - protein, 31 aa, Artificial Sequence
  Description of Artificial Sequence: Synthetic polypeptide
DEMEIRTTNPVATEQYGSVCSTNTHEVNENE

SEQ ID NO: 62138 - protein, 30 aa, Artificial Sequence
  Description of Artificial Sequence: Synthetic polypeptide
DEMEIRTTNPVATEQYGSVQTALIGMSNQM

SEQ ID NO: 62139 - protein, 31 aa, Artificial Sequence
  Description of Artificial Sequence: Synthetic polypeptide
DEMEIRTTNPVATEQYGSVSADLTNRGGDDL

SEQ ID NO: 62140 - protein, 31 aa, Artificial Sequence
  Description of Artificial Sequence: Synthetic polypeptide
DEMEIRTTNPVATEQYGSVSAEVQQQLGTRN

SEQ ID NO: 62141 - protein, 31 aa, Artificial Sequence
  Description of Artificial Sequence: Synthetic polypeptide
DEMEIRTTNPVATEQYGSVSAPLLQEGIEDG

SEQ ID NO: 62142 - protein, 33 aa, Artificial Sequence
  Description of Artificial Sequence: Synthetic polypeptide
DEMEIRTTNPVATEQYGSVSCTLLQQIGNNEDI

SEQ ID NO: 62143 - protein, 33 aa, Artificial Sequence
  Description of Artificial Sequence: Synthetic polypeptide
DEMEIRTTNPVATEQYGSVSCTQNEQDRSGEGN

SEQ ID NO: 62144 - protein, 32 aa, Artificial Sequence
  Description of Artificial Sequence: Synthetic polypeptide
DEEEIRTTNPVATEQYGSVCSTNDENFGSDQM

SEQ ID NO: 62145 - protein, 34 aa, Artificial Sequence
  Description of Artificial Sequence: Synthetic polypeptide
DEEEIRTTNPVATEQYGSVCSTNATTRPGDDQRD

SEQ ID NO: 62146 - protein, 32 aa, Artificial Sequence
  Description of Artificial Sequence: Synthetic polypeptide
DEMEIRTTNPVATEQYGSVSDTWLEQDSQNGG

SEQ ID NO: 62147 - protein, 30 aa, Artificial Sequence
  Description of Artificial Sequence: Synthetic polypeptide
DEMEIRTTNPVATEQYGSVSFTVNSESDDE

SEQ ID NO: 62148 - protein, 30 aa, Artificial Sequence
  Description of Artificial Sequence: Synthetic polypeptide
DEMEIRTTNPVATEQYGSVSMDLERIEDQT

SEQ ID NO: 62149 - protein, 30 aa, Artificial Sequence
  Description of Artificial Sequence: Synthetic polypeptide
DEMEIRTTNPVATEQYGSVSMDLNRFEVDG

SEQ ID NO: 62150 - protein, 30 aa, Artificial Sequence
  Description of Artificial Sequence: Synthetic polypeptide
DEMEIRTTNPVATEQYGSVSMDNDNEIGDN

SEQ ID NO: 62151 - protein, 31 aa, Artificial Sequence
  Description of Artificial Sequence: Synthetic polypeptide
DEMEIRTTNPVATEQYGSVSNTDLEGESDQR

SEQ ID NO: 62152 - protein, 33 aa, Artificial Sequence
  Description of Artificial Sequence: Synthetic polypeptide
DEMEIRTTNPVATEQYGSVSNTENTIIRGNEDQ

SEQ ID NO: 62153 - protein, 33 aa, Artificial Sequence
  Description of Artificial Sequence: Synthetic polypeptide
DEMEIRTTNPVATEQYGSVSNTHLEQGGSDQRE

SEQ ID NO: 62154 - protein, 31 aa, Artificial Sequence
  Description of Artificial Sequence: Synthetic polypeptide
DEMEIRTTNPVATEQYGSVSNTNTNQEQSEG

SEQ ID NO: 62155 - protein, 32 aa, Artificial Sequence
  Description of Artificial Sequence: Synthetic polypeptide
DEMEIRTTNPVATEQYGSVSNVLLEQGGIDRQ

SEQ ID NO: 62156 - protein, 31 aa, Artificial Sequence
  Description of Artificial Sequence: Synthetic polypeptide
DEMEIRTTNPVATEQYGSVSPPLENRDDQRE

SEQ ID NO: 62157 - protein, 33 aa, Artificial Sequence
  Description of Artificial Sequence: Synthetic polypeptide
DEMEIRTTNPVATEQYGSVSTPNDLQNFPSSIR

SEQ ID NO: 62158 - protein, 30 aa, Artificial Sequence
  Description of Artificial Sequence: Synthetic polypeptide
DEHEIATTNPVAYEQYGTVSTNLQAGGDPP

SEQ ID NO: 62159 - protein, 31 aa, Artificial Sequence
  Description of Artificial Sequence: Synthetic polypeptide
DEHEIATTNPVAYEQYGSVVSTNLGDQGETR

SEQ ID NO: 62160 - protein, 32 aa, Artificial Sequence
  Description of Artificial Sequence: Synthetic polypeptide
DEHEIATTNPVAYEQYGSVSTNLQNDGDDNEM

SEQ ID NO: 62161 - protein, 31 aa, Artificial Sequence
  Description of Artificial Sequence: Synthetic polypeptide
DEEVIRTTNPVATEQYGSVSTVLEDYGMEYP

SEQ ID NO: 62162 - protein, 32 aa, Artificial Sequence
  Description of Artificial Sequence: Synthetic polypeptide
DEEVIRTTNPVAYEQWGSVATPNELSQLGGNR

SEQ ID NO: 62163 - protein, 32 aa, Artificial Sequence
  Description of Artificial Sequence: Synthetic polypeptide
DEEVIRTTNPVAYEQYGKTVSCTNELSQEGER

SEQ ID NO: 62164 - protein, 33 aa, Artificial Sequence
  Description of Artificial Sequence: Synthetic polypeptide
DEEVIRTTNPVAYEQYGSTVSCTNLRDNTVGNR

SEQ ID NO: 62165 - protein, 33 aa, Artificial Sequence
  Description of Artificial Sequence: Synthetic polypeptide
DEEVIRTTNPVAYEQYGSVVSTNLSDNTGQNNR

SEQ ID NO: 62166 - protein, 31 aa, Artificial Sequence
  Description of Artificial Sequence: Synthetic polypeptide
DEEVIRTTNPVAYEQYGVTVSTNWSDNVGNR

SEQ ID NO: 62167 - protein, 33 aa, Artificial Sequence
  Description of Artificial Sequence: Synthetic polypeptide
DEEVIRTTNPVAYERYGSVSCTNIPQRPGGPNR

SEQ ID NO: 62168 - protein, 31 aa, Artificial Sequence
  Description of Artificial Sequence: Synthetic polypeptide
DEEVIRTTNPVTTEPYGSVSTNLDDGGGQGR

SEQ ID NO: 62169 - protein, 31 aa, Artificial Sequence
  Description of Artificial Sequence: Synthetic polypeptide
DEEYIGTTNPVATEQYGDVSTNGQSGGGNEG

SEQ ID NO: 62170 - protein, 33 aa, Artificial Sequence
  Description of Artificial Sequence: Synthetic polypeptide
DEEVIRTTNPVATEQYGSVSTTNLRDSNSGQNI

SEQ ID NO: 62171 - protein, 31 aa, Artificial Sequence
  Description of Artificial Sequence: Synthetic polypeptide
DEFEIATVNPVATEQYGSVSTNGLMETGNDH

SEQ ID NO: 62172 - protein, 30 aa, Artificial Sequence
  Description of Artificial Sequence: Synthetic polypeptide
DEFEIATVNPVAYEQYGSVSTNELSTEGNH

SEQ ID NO: 62173 - protein, 30 aa, Artificial Sequence
  Description of Artificial Sequence: Synthetic polypeptide
DEFEICTVNPVATEQYGCVCSTNLINFGNA

SEQ ID NO: 62174 - protein, 30 aa, Artificial Sequence
  Description of Artificial Sequence: Synthetic polypeptide
DEFEICTVNPVATEQYGCVSTNLEFEGLND

SEQ ID NO: 62175 - protein, 30 aa, Artificial Sequence
  Description of Artificial Sequence: Synthetic polypeptide
DEFEICTVNPVATEQYGSVNSTMNLFEINH

SEQ ID NO: 62176 - protein, 31 aa, Artificial Sequence
  Description of Artificial Sequence: Synthetic polypeptide
DEFEICTVNPVATEQYGSVSTGNDLGEGNTH

SEQ ID NO: 62177 - protein, 30 aa, Artificial Sequence
  Description of Artificial Sequence: Synthetic polypeptide
DEFEICTVNPVATEQYGSVSTLNLEFEGEH

SEQ ID NO: 62178 - protein, 31 aa, Artificial Sequence
  Description of Artificial Sequence: Synthetic polypeptide
DEFEICTVNPVATEQYGSVSTLNLFEGNEHI

SEQ ID NO: 62179 - protein, 31 aa, Artificial Sequence
  Description of Artificial Sequence: Synthetic polypeptide
DEFEICTVNPVATEQYGSVSTNDLGGEHGNH

SEQ ID NO: 62180 - protein, 30 aa, Artificial Sequence
  Description of Artificial Sequence: Synthetic polypeptide
DEFEICTVNPVATEQYGSVSTNLEFEGEVE

SEQ ID NO: 62181 - protein, 30 aa, Artificial Sequence
  Description of Artificial Sequence: Synthetic polypeptide
DEFEIATVNPVATEQYGSVSWNDLHEGNTH

SEQ ID NO: 62182 - protein, 31 aa, Artificial Sequence
  Description of Artificial Sequence: Synthetic polypeptide
DEFEICTVNPVATEQYGSVSTNLNFGEGNIA

SEQ ID NO: 62183 - protein, 32 aa, Artificial Sequence
  Description of Artificial Sequence: Synthetic polypeptide
DEEVIRTTNPVATEQYGSVSTTNLHDNINQND

SEQ ID NO: 62184 - protein, 33 aa, Artificial Sequence
  Description of Artificial Sequence: Synthetic polypeptide
DEEVIRTTNPVATEQYGSVSTNLTPTNGQNHNG

SEQ ID NO: 62185 - protein, 31 aa, Artificial Sequence
  Description of Artificial Sequence: Synthetic polypeptide
DEEVIATTNPVAYEQYGSTVSTNHSQPGGNP

SEQ ID NO: 62186 - protein, 33 aa, Artificial Sequence
  Description of Artificial Sequence: Synthetic polypeptide
DEEEIRTTNPVATEQYGSVCTSLQQETGELLRL

SEQ ID NO: 62187 - protein, 32 aa, Artificial Sequence
  Description of Artificial Sequence: Synthetic polypeptide
DEEEIRTTNPVATEQYGSVCTSLQQEMGLLDL

SEQ ID NO: 62188 - protein, 32 aa, Artificial Sequence
  Description of Artificial Sequence: Synthetic polypeptide
DEEEIRTTNPVATEQYGSVCTSLQGETELLRL

SEQ ID NO: 62189 - protein, 33 aa, Artificial Sequence
  Description of Artificial Sequence: Synthetic polypeptide
DEEEIRTTNPVATEQYGSVCTSLGQEEGELLRL

SEQ ID NO: 62190 - protein, 31 aa, Artificial Sequence
  Description of Artificial Sequence: Synthetic polypeptide
DEEVICTTNPVATEQWGSVAAANNLQPGVNR

SEQ ID NO: 62191 - protein, 32 aa, Artificial Sequence
  Description of Artificial Sequence: Synthetic polypeptide
DEEVINTTNPVATEQYGSVSTNSEFQVRGEFE

SEQ ID NO: 62192 - protein, 32 aa, Artificial Sequence
  Description of Artificial Sequence: Synthetic polypeptide
DEEVIRTTNPVAGEIYGSVSVTNLDDGNGQGR

SEQ ID NO: 62193 - protein, 31 aa, Artificial Sequence
  Description of Artificial Sequence: Synthetic polypeptide
DEEVIRTTNPVAMEIYGSVSTNLDHGGGQGR

SEQ ID NO: 62194 - protein, 32 aa, Artificial Sequence
  Description of Artificial Sequence: Synthetic polypeptide
DEEVIRTTNPVATEQYGSVSTNPDQYNSGEVE

SEQ ID NO: 62195 - protein, 32 aa, Artificial Sequence
  Description of Artificial Sequence: Synthetic polypeptide
DEEVIRTTNPVATEAWGSVATNNELSQDGGNR

SEQ ID NO: 62196 - protein, 32 aa, Artificial Sequence
  Description of Artificial Sequence: Synthetic polypeptide
DEEVIRTTNPVATEIYGSVSTNLDDGGHGLYR

SEQ ID NO: 62197 - protein, 31 aa, Artificial Sequence
  Description of Artificial Sequence: Synthetic polypeptide
DEEVIRTTNPVATEIYGSVSTNLDDLNGQGG

SEQ ID NO: 62198 - protein, 31 aa, Artificial Sequence
  Description of Artificial Sequence: Synthetic polypeptide
DEEVIRTTNPVATEQYGCVCSTNLNDNNSQQ

SEQ ID NO: 62199 - protein, 32 aa, Artificial Sequence
  Description of Artificial Sequence: Synthetic polypeptide
DEEVIRTTNPVATEQYGCVSTNLNDNFGSNQG

SEQ ID NO: 62200 - protein, 31 aa, Artificial Sequence
  Description of Artificial Sequence: Synthetic polypeptide
DEEVIRTTNPVATEQYGCVSTNLNDNSGSQQ

SEQ ID NO: 62201 - protein, 33 aa, Artificial Sequence
  Description of Artificial Sequence: Synthetic polypeptide
DEEVIRTTNPVATEQYGCVVSTNLSDNTGGNNR

SEQ ID NO: 62202 - protein, 32 aa, Artificial Sequence
  Description of Artificial Sequence: Synthetic polypeptide
DEEVIRTTNPVATEQYGSVCSTELNDNGSNQA

SEQ ID NO: 62203 - protein, 32 aa, Artificial Sequence
  Description of Artificial Sequence: Synthetic polypeptide
DEEVIRTTNPVATEQYGSVSSTNLRDSSSQNE

SEQ ID NO: 62204 - protein, 32 aa, Artificial Sequence
  Description of Artificial Sequence: Synthetic polypeptide
DEEVIRTTNPVATEQYGSVSTNLGDTGSGQME

SEQ ID NO: 62205 - protein, 34 aa, Artificial Sequence
  Description of Artificial Sequence: Synthetic polypeptide
DEEVIRTTNPVATEAYGSTVSTNNALSQRGGEYR

SEQ ID NO: 62206 - protein, 31 aa, Artificial Sequence
  Description of Artificial Sequence: Synthetic polypeptide
DEFEICTVNPVATEQYGSVSTNLPHGEGNNH

SEQ ID NO: 62207 - protein, 30 aa, Artificial Sequence
  Description of Artificial Sequence: Synthetic polypeptide
DEFEICTVNPVATEQYGSVSTNLSGEVNNH

SEQ ID NO: 62208 - protein, 29 aa, Artificial Sequence
  Description of Artificial Sequence: Synthetic peptide
DEFEICTVNPVATEQYGSVSTPLFEDFNH

SEQ ID NO: 62209 - protein, 30 aa, Artificial Sequence
  Description of Artificial Sequence: Synthetic polypeptide
DEGAIRTTNPVATEQYGSFITGNLIIGSER

SEQ ID NO: 62210 - protein, 29 aa, Artificial Sequence
  Description of Artificial Sequence: Synthetic peptide
DEGAIRTTNPVATEQYGSFSEGNHIIGER

SEQ ID NO: 62211 - protein, 30 aa, Artificial Sequence
  Description of Artificial Sequence: Synthetic polypeptide
DEGAIRTTNPVATEQYGSFSELLIEIGNQR

SEQ ID NO: 62212 - protein, 33 aa, Artificial Sequence
  Description of Artificial Sequence: Synthetic polypeptide
DEGAIRTTNPVATEQYGSISCTNELGQTGGNNR

SEQ ID NO: 62213 - protein, 32 aa, Artificial Sequence
  Description of Artificial Sequence: Synthetic polypeptide
DEGAIRTTNPVATEQYGSISCTNLSTITVGNR

SEQ ID NO: 62214 - protein, 30 aa, Artificial Sequence
  Description of Artificial Sequence: Synthetic polypeptide
DEGAIRTTNPVAYEQWGSCSTNLIIDGNDR

SEQ ID NO: 62215 - protein, 30 aa, Artificial Sequence
  Description of Artificial Sequence: Synthetic polypeptide
DEGAIRTTNPVAYEQWGSFSTPNLDIEGNR

SEQ ID NO: 62216 - protein, 31 aa, Artificial Sequence
  Description of Artificial Sequence: Synthetic polypeptide
DEGAIRTTNPVAYEQYGQSISTNLSGIGGNR

SEQ ID NO: 62217 - protein, 31 aa, Artificial Sequence
  Description of Artificial Sequence: Synthetic polypeptide
DEGAIRTTNPVAYEQYGSTISTNELSGIGNR

SEQ ID NO: 62218 - protein, 29 aa, Artificial Sequence
  Description of Artificial Sequence: Synthetic peptide
DEGAIRTTNPVATEQYGNFSTGDLIIGER

SEQ ID NO: 62219 - protein, 30 aa, Artificial Sequence
  Description of Artificial Sequence: Synthetic polypeptide
DEGCIRTTNPVAYEAYGKTVSTNFSQDGNR

SEQ ID NO: 62220 - protein, 31 aa, Artificial Sequence
  Description of Artificial Sequence: Synthetic polypeptide
DEGEIACTNPVATEQYGSVATNLERGGNPQP

SEQ ID NO: 62221 - protein, 30 aa, Artificial Sequence
  Description of Artificial Sequence: Synthetic polypeptide
DEGEIACTNPVATEQYGSVATNLQDGGDDA

SEQ ID NO: 62222 - protein, 31 aa, Artificial Sequence
  Description of Artificial Sequence: Synthetic polypeptide
DEGEIACTNPVATEQYGSVATNLQERGQPEE

SEQ ID NO: 62223 - protein, 31 aa, Artificial Sequence
  Description of Artificial Sequence: Synthetic polypeptide
DEEEIRTTNPVATEQYGSVCTDLVSEGELVQ

SEQ ID NO: 62224 - protein, 30 aa, Artificial Sequence
  Description of Artificial Sequence: Synthetic polypeptide
DEGEIACTNPVATEQYGSVATNLQGAGEGD

SEQ ID NO: 62225 - protein, 29 aa, Artificial Sequence
  Description of Artificial Sequence: Synthetic peptide
DEGEIACTNPVSTEQYGSVAANLQGGNQT

SEQ ID NO: 62226 - protein, 28 aa, Artificial Sequence
  Description of Artificial Sequence: Synthetic peptide
DEGEIAPTNPCSSEQYGIVSCNLQSGNR

SEQ ID NO: 62227 - protein, 29 aa, Artificial Sequence
  Description of Artificial Sequence: Synthetic peptide
DEGEIAPTNPCSSEQYGSVSCINLQRGTR

SEQ ID NO: 62228 - protein, 29 aa, Artificial Sequence
  Description of Artificial Sequence: Synthetic peptide
DEGEIAPTNPCSSEQYGSVSSCNLQSGNR

SEQ ID NO: 62229 - protein, 31 aa, Artificial Sequence
  Description of Artificial Sequence: Synthetic polypeptide
DEGEIACTNPVATEQYGSVATNLERGENTDE

SEQ ID NO: 62230 - protein, 29 aa, Artificial Sequence
  Description of Artificial Sequence: Synthetic peptide
DEGAIRCTNPVATEQYGSTFSENLIIENR

SEQ ID NO: 62231 - protein, 30 aa, Artificial Sequence
  Description of Artificial Sequence: Synthetic polypeptide
DEGAICTTNPVATEQYGSCSTNLIIPGDND

SEQ ID NO: 62232 - protein, 30 aa, Artificial Sequence
  Description of Artificial Sequence: Synthetic polypeptide
DEGAIATTNPVATEQWGSCSTNLIIDGSNR

SEQ ID NO: 62233 - protein, 29 aa, Artificial Sequence
  Description of Artificial Sequence: Synthetic peptide
DEFEICTVNPVATEQYGSVSTPLFEGLEH

SEQ ID NO: 62234 - protein, 30 aa, Artificial Sequence
  Description of Artificial Sequence: Synthetic polypeptide
DEFEICTVNPVATESYGSVSTTMNLFEGNS

SEQ ID NO: 62235 - protein, 30 aa, Artificial Sequence
  Description of Artificial Sequence: Synthetic polypeptide
DEFEIGTVNPVATEQYGCVCSNTNLFNGNQ

SEQ ID NO: 62236 - protein, 31 aa, Artificial Sequence
  Description of Artificial Sequence: Synthetic polypeptide
DEFEIGTVNPVATEQYGSVSTTMNLIFEGNH

SEQ ID NO: 62237 - protein, 32 aa, Artificial Sequence
  Description of Artificial Sequence: Synthetic polypeptide
DEFEIRTTNPVATEQYGSVSVNLDIGDPGNQL

SEQ ID NO: 62238 - protein, 31 aa, Artificial Sequence
  Description of Artificial Sequence: Synthetic polypeptide
DEFEISTVNPVATEQYGSVSTNLIEFGSNNQ

SEQ ID NO: 62239 - protein, 31 aa, Artificial Sequence
  Description of Artificial Sequence: Synthetic polypeptide
DEFTVIGTTNPVATEQWGTVSTGDDLQRGNR

SEQ ID NO: 62240 - protein, 31 aa, Artificial Sequence
  Description of Artificial Sequence: Synthetic polypeptide
DEFVIATTNPVAYEQDGSVSTDELSQRGGNR

SEQ ID NO: 62241 - protein, 30 aa, Artificial Sequence
  Description of Artificial Sequence: Synthetic polypeptide
DEFVIGTTNPVATEQDGSVSETDDLERGER

SEQ ID NO: 62242 - protein, 30 aa, Artificial Sequence
  Description of Artificial Sequence: Synthetic polypeptide
DEFVIGTTNPVATEQHGSMVSTDFLQGGGR

SEQ ID NO: 62243 - protein, 30 aa, Artificial Sequence
  Description of Artificial Sequence: Synthetic polypeptide
DEFVIGTTNPVATEQHGSVSTDFLPQGGNG

SEQ ID NO: 62244 - protein, 31 aa, Artificial Sequence
  Description of Artificial Sequence: Synthetic polypeptide
DEFVIGTTNPVATEQWGCVSTTDDLQRGSNR

SEQ ID NO: 62245 - protein, 31 aa, Artificial Sequence
  Description of Artificial Sequence: Synthetic polypeptide
DEFVIGTTNPVATEQWGSVSTDPLQRGSNQD

SEQ ID NO: 62246 - protein, 32 aa, Artificial Sequence
  Description of Artificial Sequence: Synthetic polypeptide
DEFVIRTTNPVATEQYGCVACTNPSQRGGSNR

SEQ ID NO: 62247 - protein, 29 aa, Artificial Sequence
  Description of Artificial Sequence: Synthetic peptide
DEFVIRTTNPVATEQYGCVCETLPERGGR

SEQ ID NO: 62248 - protein, 30 aa, Artificial Sequence
  Description of Artificial Sequence: Synthetic polypeptide
DEFVIRTTNPVATEQYGCVCETNPERPNRD

SEQ ID NO: 62249 - protein, 33 aa, Artificial Sequence
  Description of Artificial Sequence: Synthetic polypeptide
DEEEIRTTNPVATEQYGSVCTNIFQNTIGDFRD

SEQ ID NO: 62250 - protein, 31 aa, Artificial Sequence
  Description of Artificial Sequence: Synthetic polypeptide
DEFVIRTTNPVATEQYGCVENTDPQRGNQRL

SEQ ID NO: 62251 - protein, 29 aa, Artificial Sequence
  Description of Artificial Sequence: Synthetic peptide
DEFVIRTTNPVATEQYGCVETCPQQENQR

SEQ ID NO: 62252 - protein, 31 aa, Artificial Sequence
  Description of Artificial Sequence: Synthetic polypeptide
DEFVIRTTNPVATEQYGCVETDPQRFGNQRP

SEQ ID NO: 62253 - protein, 31 aa, Artificial Sequence
  Description of Artificial Sequence: Synthetic polypeptide
DEFVIRTTNPVATEQYGCVETDSPQRGNQRE

SEQ ID NO: 62254 - protein, 31 aa, Artificial Sequence
  Description of Artificial Sequence: Synthetic polypeptide
DEEVIATTNPVATEQYGSVATPNLPDNEQNR

SEQ ID NO: 62255 - protein, 30 aa, Artificial Sequence
  Description of Artificial Sequence: Synthetic polypeptide
DEGEIAPTNPVASEQYGIVCSTNLVQFGTR

SEQ ID NO: 62256 - protein, 33 aa, Artificial Sequence
  Description of Artificial Sequence: Synthetic polypeptide
DEEEIRTTNPVATEQYGSVCTTNLQPNTATNEI

SEQ ID NO: 62257 - protein, 31 aa, Artificial Sequence
  Description of Artificial Sequence: Synthetic polypeptide
DEEVIATTNPVATEQYGCVSTNLPDNSENRD

SEQ ID NO: 62258 - protein, 32 aa, Artificial Sequence
  Description of Artificial Sequence: Synthetic polypeptide
DEETIRTTNPVATEQWGSVATTNNLQLGNNGS

SEQ ID NO: 62259 - protein, 32 aa, Artificial Sequence
  Description of Artificial Sequence: Synthetic polypeptide
DEETIRTTNPVATEQWGSVATTNNLQQGVNNQ

SEQ ID NO: 62260 - protein, 32 aa, Artificial Sequence
  Description of Artificial Sequence: Synthetic polypeptide
DEETIRTTNPVATEQWGSVATTNNNLQLGNDD

SEQ ID NO: 62261 - protein, 32 aa, Artificial Sequence
  Description of Artificial Sequence: Synthetic polypeptide
DEETIRTTNPVATEQWGSVATTNNNLQQGVNL

SEQ ID NO: 62262 - protein, 31 aa, Artificial Sequence
  Description of Artificial Sequence: Synthetic polypeptide
DEETIRTTNPVATEQYGAVSTNQMVFQGNPC

SEQ ID NO: 62263 - protein, 33 aa, Artificial Sequence
  Description of Artificial Sequence: Synthetic polypeptide
DEETIRTTNPVATEQYGCVSTTNQQLQAGNNEE

SEQ ID NO: 62264 - protein, 32 aa, Artificial Sequence
  Description of Artificial Sequence: Synthetic polypeptide
DEETIRTTNPVATEQYGDVSGTNGQGGGNGQE

SEQ ID NO: 62265 - protein, 34 aa, Artificial Sequence
  Description of Artificial Sequence: Synthetic polypeptide
DEEEIRTTNPVATEQYGSVDSTILQQERAENDAE

SEQ ID NO: 62266 - protein, 32 aa, Artificial Sequence
  Description of Artificial Sequence: Synthetic polypeptide
DEETIRTTNPVATEQYGDVSVGIMNGQRGDND

SEQ ID NO: 62267 - protein, 31 aa, Artificial Sequence
  Description of Artificial Sequence: Synthetic polypeptide
DEETIRTTNPVATEQWGSVATTNNEQLGNND

SEQ ID NO: 62268 - protein, 32 aa, Artificial Sequence
  Description of Artificial Sequence: Synthetic polypeptide
DEETIRTTNPVATEQYGDVSVSINIQGGDNGD

SEQ ID NO: 62269 - protein, 33 aa, Artificial Sequence
  Description of Artificial Sequence: Synthetic polypeptide
DEETIRTTNPVATEQYGQYSVSIMNGQRGDNDI

SEQ ID NO: 62270 - protein, 33 aa, Artificial Sequence
  Description of Artificial Sequence: Synthetic polypeptide
DEETIRTTNPVATEQYGSIWSTNNDLQNGNNAT

SEQ ID NO: 62271 - protein, 32 aa, Artificial Sequence
  Description of Artificial Sequence: Synthetic polypeptide
DEETIRTTNPVATEQYGSVISPLVTELRQGNT

SEQ ID NO: 62272 - protein, 31 aa, Artificial Sequence
  Description of Artificial Sequence: Synthetic polypeptide
DEETIRTTNPVATEQYGSVPTHELRQGENLI

SEQ ID NO: 62273 - protein, 32 aa, Artificial Sequence
  Description of Artificial Sequence: Synthetic polypeptide
DEEEIRTTNPVATEQYGSVDSTEEHQSFGSEQ

SEQ ID NO: 62274 - protein, 33 aa, Artificial Sequence
  Description of Artificial Sequence: Synthetic polypeptide
DEEEIRTTNPVATEQYGSVDSTEEHQNFGSNDS

SEQ ID NO: 62275 - protein, 34 aa, Artificial Sequence
  Description of Artificial Sequence: Synthetic polypeptide
DEETIRTTNPVATEQYGSVSTNQQELQGGNNQTD

SEQ ID NO: 62276 - protein, 32 aa, Artificial Sequence
  Description of Artificial Sequence: Synthetic polypeptide
DEEEIRTTNPVATEQYGSVDSPTNDVRSLEFD

SEQ ID NO: 62277 - protein, 32 aa, Artificial Sequence
  Description of Artificial Sequence: Synthetic polypeptide
DEETIRTTNPVATEQYGSVSTSQGEQLGGNTE

SEQ ID NO: 62278 - protein, 32 aa, Artificial Sequence
  Description of Artificial Sequence: Synthetic polypeptide
DEETIRTTNPVATEQYGQYSVSIGGQRGDNGD

SEQ ID NO: 62279 - protein, 34 aa, Artificial Sequence
  Description of Artificial Sequence: Synthetic polypeptide
DEEEIRTTNPVATEQYGSVDSPLNLLQRQGEDQD

SEQ ID NO: 62280 - protein, 31 aa, Artificial Sequence
  Description of Artificial Sequence: Synthetic polypeptide
DEETIRTTNPVATEQWGSVATNNNQQGVNPT

SEQ ID NO: 62281 - protein, 32 aa, Artificial Sequence
  Description of Artificial Sequence: Synthetic polypeptide
DEETIRTTNPVATEQWGAVATTVNLQLVGVNR

SEQ ID NO: 62282 - protein, 31 aa, Artificial Sequence
  Description of Artificial Sequence: Synthetic polypeptide
DEETIRATNPVATEQYGSVSNVNENQQQGNL

SEQ ID NO: 62283 - protein, 33 aa, Artificial Sequence
  Description of Artificial Sequence: Synthetic polypeptide
DEETIRATNPVATEQYGSVSTMNNQLQLGNNLE

SEQ ID NO: 62284 - protein, 31 aa, Artificial Sequence
  Description of Artificial Sequence: Synthetic polypeptide
DEEEIRTTNPVATEQYGSVDTNDLESFEQQD

SEQ ID NO: 62285 - protein, 32 aa, Artificial Sequence
  Description of Artificial Sequence: Synthetic polypeptide
DEEEIRTTNPVATEQYGSVDTMNQGGEGDQIR

SEQ ID NO: 62286 - protein, 32 aa, Artificial Sequence
  Description of Artificial Sequence: Synthetic polypeptide
DEETIRATNPVATEQYGSVSTMNQQLGGNELG

SEQ ID NO: 62287 - protein, 32 aa, Artificial Sequence
  Description of Artificial Sequence: Synthetic polypeptide
DEETIRATNPVATEQYGSVSTMNQQLGGNNNL

SEQ ID NO: 62288 - protein, 32 aa, Artificial Sequence
  Description of Artificial Sequence: Synthetic polypeptide
DEEEIRTTNPVATEQYGSVDTDNEGQGEDNID

SEQ ID NO: 62289 - protein, 32 aa, Artificial Sequence
  Description of Artificial Sequence: Synthetic polypeptide
DEETIRATNPVATEQYGSVSTMNQQQLGGNLT

SEQ ID NO: 62290 - protein, 32 aa, Artificial Sequence
  Description of Artificial Sequence: Synthetic polypeptide
DEETIRATNPVATEQYGSVSTMNQQQLGNNLG

SEQ ID NO: 62291 - protein, 31 aa, Artificial Sequence
  Description of Artificial Sequence: Synthetic polypeptide
DEETIRTTNPVATEQWGAVATVNLQNVGVNV

SEQ ID NO: 62292 - protein, 33 aa, Artificial Sequence
  Description of Artificial Sequence: Synthetic polypeptide
DEETIRATNPVATEQYGSVSTVNQELQPGNNEL

SEQ ID NO: 62293 - protein, 31 aa, Artificial Sequence
  Description of Artificial Sequence: Synthetic polypeptide
DEETIRGTNPVATEQYGSVSINGQGGGGNEG

SEQ ID NO: 62294 - protein, 30 aa, Artificial Sequence
  Description of Artificial Sequence: Synthetic polypeptide
DEETIRTTNPVACEQYGTVSEIVVQRGNNE

SEQ ID NO: 62295 - protein, 34 aa, Artificial Sequence
  Description of Artificial Sequence: Synthetic polypeptide
DEEEIRTTNPVATEQYGSVDSTTDNGQGGGNDDE

SEQ ID NO: 62296 - protein, 31 aa, Artificial Sequence
  Description of Artificial Sequence: Synthetic polypeptide
DEETIRTTNPVAGEQYGEVSTINVQTRVNGN

SEQ ID NO: 62297 - protein, 31 aa, Artificial Sequence
  Description of Artificial Sequence: Synthetic polypeptide
DEETIRTTNPVAGEQYGVVSTINGVQRVNNV

SEQ ID NO: 62298 - protein, 33 aa, Artificial Sequence
  Description of Artificial Sequence: Synthetic polypeptide
DEEEIRTTNPVATEQYGSVDSTPLTEQMLVPRQ

SEQ ID NO: 62299 - protein, 31 aa, Artificial Sequence
  Description of Artificial Sequence: Synthetic polypeptide
DEETIRTTNPVATEIYGVVTTNLQQLQGSNG

SEQ ID NO: 62300 - protein, 31 aa, Artificial Sequence
  Description of Artificial Sequence: Synthetic polypeptide
DEETIRTTNPVATEQWGAVATENLQLGVNVC

SEQ ID NO: 62301 - protein, 31 aa, Artificial Sequence
  Description of Artificial Sequence: Synthetic polypeptide
DEETIRTTNPVATEQWGAVATTNNLQLDVNR

SEQ ID NO: 62302 - protein, 32 aa, Artificial Sequence
  Description of Artificial Sequence: Synthetic polypeptide
DEETIRGTNPVATEQYGSVSIMNNGQGRGNGG

SEQ ID NO: 62303 - protein, 33 aa, Artificial Sequence
  Description of Artificial Sequence: Synthetic polypeptide
DEETIRTTNPVATEQYGSVSTTLQELGGNNQTE

SEQ ID NO: 62304 - protein, 34 aa, Artificial Sequence
  Description of Artificial Sequence: Synthetic polypeptide
DEEEIRTTNPVATEQYGSVDSPANLLQRQGEILD

SEQ ID NO: 62305 - protein, 34 aa, Artificial Sequence
  Description of Artificial Sequence: Synthetic polypeptide
DEEEIRTTNPVATEQYGSVDSNVLSLQQRDGVRE

SEQ ID NO: 62306 - protein, 33 aa, Artificial Sequence
  Description of Artificial Sequence: Synthetic polypeptide
DEETIRTTNPVATEQYGTVTVSTTNLQIGTNTE

SEQ ID NO: 62307 - protein, 33 aa, Artificial Sequence
  Description of Artificial Sequence: Synthetic polypeptide
DEETIRTTNPVATEQYGTVVTVSTNLQIGNNQE

SEQ ID NO: 62308 - protein, 33 aa, Artificial Sequence
  Description of Artificial Sequence: Synthetic polypeptide
DEETIRTTNPVATEQYGTVVTVSTTNLQQIGNE

SEQ ID NO: 62309 - protein, 32 aa, Artificial Sequence
  Description of Artificial Sequence: Synthetic polypeptide
DEETIRTTNPVATEQYGVVSTTNNQQFGNQET

SEQ ID NO: 62310 - protein, 34 aa, Artificial Sequence
  Description of Artificial Sequence: Synthetic polypeptide
DEEEIRTTNPVATEQYGSVDAPTPPQLQRDNQRQ

SEQ ID NO: 62311 - protein, 32 aa, Artificial Sequence
  Description of Artificial Sequence: Synthetic polypeptide
DEETIRTTNPVATEQYGVVSTTNQQQFGNDEE

SEQ ID NO: 62312 - protein, 33 aa, Artificial Sequence
  Description of Artificial Sequence: Synthetic polypeptide
DEEEIRTTNPVATEQYGSVCYTNDHQEHDMGIR

SEQ ID NO: 62313 - protein, 32 aa, Artificial Sequence
  Description of Artificial Sequence: Synthetic polypeptide
DEETIRTTNPVATEQYGVVSTTNQQQFGNDET

SEQ ID NO: 62314 - protein, 32 aa, Artificial Sequence
  Description of Artificial Sequence: Synthetic polypeptide
DEETIRTTNPVATEQYGVVSTTNQQQFGNEEE

SEQ ID NO: 62315 - protein, 33 aa, Artificial Sequence
  Description of Artificial Sequence: Synthetic polypeptide
DEETIRTTNPVATEQYGTVTVSTNLQQIGTNEQ

SEQ ID NO: 62316 - protein, 32 aa, Artificial Sequence
  Description of Artificial Sequence: Synthetic polypeptide
DEETIRTTNPVATEQYGVVSVSNNLQQIGDEV

SEQ ID NO: 62317 - protein, 32 aa, Artificial Sequence
  Description of Artificial Sequence: Synthetic polypeptide
DEEEIRTTNPVATEQYGSVCVTNLPVFNWDDG

SEQ ID NO: 62318 - protein, 33 aa, Artificial Sequence
  Description of Artificial Sequence: Synthetic polypeptide
DEEEIRTTNPVATEQYGSVCVTFDNHGRGDTER

SEQ ID NO: 62319 - protein, 32 aa, Artificial Sequence
  Description of Artificial Sequence: Synthetic polypeptide
DEEEIRTTNPVATEQYGSVCVLENLQIEMENP

SEQ ID NO: 62320 - protein, 30 aa, Artificial Sequence
  Description of Artificial Sequence: Synthetic polypeptide
DEETITTTNPVATECYGSVNTDTMGQRGNM

SEQ ID NO: 62321 - protein, 31 aa, Artificial Sequence
  Description of Artificial Sequence: Synthetic polypeptide
DEETITTTNPVATECYGSVNTNTDDQRGNGQ

SEQ ID NO: 62322 - protein, 31 aa, Artificial Sequence
  Description of Artificial Sequence: Synthetic polypeptide
DEEVIACTNPVATEAYGCVATNLQDRGGNRE

SEQ ID NO: 62323 - protein, 31 aa, Artificial Sequence
  Description of Artificial Sequence: Synthetic polypeptide
DEEVIACTNPVATEGYGCVATNLQDRGGNDR

SEQ ID NO: 62324 - protein, 31 aa, Artificial Sequence
  Description of Artificial Sequence: Synthetic polypeptide
DEEVIATTNPVATEQWGSIATNNLQEAGGNR

SEQ ID NO: 62325 - protein, 31 aa, Artificial Sequence
  Description of Artificial Sequence: Synthetic polypeptide
DEEVIATTNPVATEQWGSVAANNLQVGDNRE

SEQ ID NO: 62326 - protein, 33 aa, Artificial Sequence
  Description of Artificial Sequence: Synthetic polypeptide
DEETIRTTNPVATEQYGVVSVSNNNLQIGDNVT

SEQ ID NO: 62327 - protein, 32 aa, Artificial Sequence
  Description of Artificial Sequence: Synthetic polypeptide
DEETIRTTNPVATEQYGTVSVSNNLQQQGDEE

SEQ ID NO: 62328 - protein, 34 aa, Artificial Sequence
  Description of Artificial Sequence: Synthetic polypeptide
DEETIRTTNPVATEQYGTVSTVSTNNNLQQGDER

SEQ ID NO: 62329 - protein, 32 aa, Artificial Sequence
  Description of Artificial Sequence: Synthetic polypeptide
DEETIRTTNPVATEQYGTVSTTNQQQFGNNEQ

SEQ ID NO: 62330 - protein, 34 aa, Artificial Sequence
  Description of Artificial Sequence: Synthetic polypeptide
DEETIRTTNPVATEQYGSVSTTNLQDNNNGQNNQ

SEQ ID NO: 62331 - protein, 34 aa, Artificial Sequence
  Description of Artificial Sequence: Synthetic polypeptide
DEETIRTTNPVATEQYGSVSTTNNLQDNNQGQNS

SEQ ID NO: 62332 - protein, 33 aa, Artificial Sequence
  Description of Artificial Sequence: Synthetic polypeptide
DEETIRTTNPVATEQYGSVSTTNQELGIGNQTT

SEQ ID NO: 62333 - protein, 34 aa, Artificial Sequence
  Description of Artificial Sequence: Synthetic polypeptide
DEEEIRTTNPVATEQYGSVDSNTMNLQELNENEQ

SEQ ID NO: 62334 - protein, 34 aa, Artificial Sequence
  Description of Artificial Sequence: Synthetic polypeptide
DEETIRTTNPVATEQYGSVSTTNQELQGNGNDTD

SEQ ID NO: 62335 - protein, 34 aa, Artificial Sequence
  Description of Artificial Sequence: Synthetic polypeptide
DEETIRTTNPVATEQYGSVSTTNQLQDNNGQNNQ

SEQ ID NO: 62336 - protein, 33 aa, Artificial Sequence
  Description of Artificial Sequence: Synthetic polypeptide
DEETIRTTNPVATEQYGSVSTTNQQELGGNQTE

SEQ ID NO: 62337 - protein, 32 aa, Artificial Sequence
  Description of Artificial Sequence: Synthetic polypeptide
DEETIRTTNPVATEQYGSVSTTQELGQGNQTE

SEQ ID NO: 62338 - protein, 32 aa, Artificial Sequence
  Description of Artificial Sequence: Synthetic polypeptide
DEETIRTTNPVATEQYGSVSTTVDEQLGGNTE

SEQ ID NO: 62339 - protein, 32 aa, Artificial Sequence
  Description of Artificial Sequence: Synthetic polypeptide
DEEEIRTTNPVATEQYGSVDPTVNLIDGLEIE

SEQ ID NO: 62340 - protein, 31 aa, Artificial Sequence
  Description of Artificial Sequence: Synthetic polypeptide
DEETIRTTNPVATEQYGSVSTTVGELGGNTQ

SEQ ID NO: 62341 - protein, 32 aa, Artificial Sequence
  Description of Artificial Sequence: Synthetic polypeptide
DEETIRTTNPVATEQYGSVSTVATLRQDVNNT

SEQ ID NO: 62342 - protein, 32 aa, Artificial Sequence
  Description of Artificial Sequence: Synthetic polypeptide
DEETIRTTNPVATEQYGSVSTVTTLRQGDDNT

SEQ ID NO: 62343 - protein, 31 aa, Artificial Sequence
  Description of Artificial Sequence: Synthetic polypeptide
DEETIRTTNPVATEQYGSVSTVVELGGNNTE

SEQ ID NO: 62344 - protein, 33 aa, Artificial Sequence
  Description of Artificial Sequence: Synthetic polypeptide
DEEEIRTTNPVATEQYGSVDNPTNLTNFVNERD

SEQ ID NO: 62345 - protein, 34 aa, Artificial Sequence
  Description of Artificial Sequence: Synthetic polypeptide
DEETIRTTNPVATEQYGSVSVTTNNLQDNGQNSE

SEQ ID NO: 62346 - protein, 30 aa, Artificial Sequence
  Description of Artificial Sequence: Synthetic polypeptide
DEETIRTTNPVATEQYGSVTVWGNRGVNVL

SEQ ID NO: 62347 - protein, 32 aa, Artificial Sequence
  Description of Artificial Sequence: Synthetic polypeptide
DEEEIRTTNPVATEQYGSVDFTNEGQGEDNED

SEQ ID NO: 62348 - protein, 32 aa, Artificial Sequence
  Description of Artificial Sequence: Synthetic polypeptide
DEEEIRTTNPVATEQYGSVDETVNDVRSLERD

SEQ ID NO: 62349 - protein, 33 aa, Artificial Sequence
  Description of Artificial Sequence: Synthetic polypeptide
DEETIRTTNPVATEQYGTVSTTNLQLQFGNDEQ

SEQ ID NO: 62350 - protein, 33 aa, Artificial Sequence
  Description of Artificial Sequence: Synthetic polypeptide
DEETIRTTNPVATEQYGTVSTTNNQLQFGNEEM

SEQ ID NO: 62351 - protein, 32 aa, Artificial Sequence
  Description of Artificial Sequence: Synthetic polypeptide
DEEVIATTNPVATEQYGSCSTNLQDENPGENN

SEQ ID NO: 62352 - protein, 29 aa, Artificial Sequence
  Description of Artificial Sequence: Synthetic peptide
DENEIACTNPVATEQYGEASENLQQQGGR

SEQ ID NO: 62353 - protein, 28 aa, Artificial Sequence
  Description of Artificial Sequence: Synthetic peptide
DEGEIAPTNPVSSEQYGIVSCNLQFGTR

SEQ ID NO: 62354 - protein, 29 aa, Artificial Sequence
  Description of Artificial Sequence: Synthetic peptide
DEGEIAPTNPVSTEQYGNVSCNLQSSGQR

SEQ ID NO: 62355 - protein, 34 aa, Artificial Sequence
  Description of Artificial Sequence: Synthetic polypeptide
DEGEIRTTNPVATEQYGSVCSTIYNLQTADGSQR

SEQ ID NO: 62356 - protein, 32 aa, Artificial Sequence
  Description of Artificial Sequence: Synthetic polypeptide
DEGEIRTTNPVATEQYGSVFCTAALSTRVNNR

SEQ ID NO: 62357 - protein, 34 aa, Artificial Sequence
  Description of Artificial Sequence: Synthetic polypeptide
DEGEIRTTNPVATEQYGSVNSTSLDQQEEGEENR

SEQ ID NO: 62358 - protein, 31 aa, Artificial Sequence
  Description of Artificial Sequence: Synthetic polypeptide
DEGEIRTTNPVATEQYGSVPSMVNSDPGDRS

SEQ ID NO: 62359 - protein, 29 aa, Artificial Sequence
  Description of Artificial Sequence: Synthetic peptide
DEGEIRTTNPVATEQYGSVQTAAIETQNE

SEQ ID NO: 62360 - protein, 30 aa, Artificial Sequence
  Description of Artificial Sequence: Synthetic polypeptide
DEGEIRTTNPVATEQYGSVQTALENRIMSE

SEQ ID NO: 62361 - protein, 32 aa, Artificial Sequence
  Description of Artificial Sequence: Synthetic polypeptide
DEGEIRTTNPVATEQYGSVQTAPLIRFENQRE

SEQ ID NO: 62362 - protein, 32 aa, Artificial Sequence
  Description of Artificial Sequence: Synthetic polypeptide
DEGEIRTTNPVATEQYGSVQTYFLNRFENQRS

SEQ ID NO: 62363 - protein, 34 aa, Artificial Sequence
  Description of Artificial Sequence: Synthetic polypeptide
DEGEIRTTNPVATEQYGSVSDTNDLQERSNEDEF

SEQ ID NO: 62364 - protein, 31 aa, Artificial Sequence
  Description of Artificial Sequence: Synthetic polypeptide
DEGEIRTTNPVATEQYGSVAQTALIGEMNSR

SEQ ID NO: 62365 - protein, 32 aa, Artificial Sequence
  Description of Artificial Sequence: Synthetic polypeptide
DEGEIRTTNPVATEQYGSVSTDLNQEGTQDDI

SEQ ID NO: 62366 - protein, 32 aa, Artificial Sequence
  Description of Artificial Sequence: Synthetic polypeptide
DEGEIRTTNPVATEQYGSVSTGLQSENNEDKN

SEQ ID NO: 62367 - protein, 34 aa, Artificial Sequence
  Description of Artificial Sequence: Synthetic polypeptide
DEEEIRTTNPVATEQYGSVCSTNPELQEHDDNHG

SEQ ID NO: 62368 - protein, 33 aa, Artificial Sequence
  Description of Artificial Sequence: Synthetic polypeptide
DEGEIRTTNPVATEQYGSVSTILISQEGNDEEQ

SEQ ID NO: 62369 - protein, 32 aa, Artificial Sequence
  Description of Artificial Sequence: Synthetic polypeptide
DEGEIRTTNPVATEQYGSVSTLLETGGNNEDG

SEQ ID NO: 62370 - protein, 33 aa, Artificial Sequence
  Description of Artificial Sequence: Synthetic polypeptide
DEGEIRTTNPVATEQYGSVSTNDLTQETGEDGD

SEQ ID NO: 62371 - protein, 32 aa, Artificial Sequence
  Description of Artificial Sequence: Synthetic polypeptide
DEGEIRTTNPVATEQYGSVSTNGLEGGGTQDG

SEQ ID NO: 62372 - protein, 33 aa, Artificial Sequence
  Description of Artificial Sequence: Synthetic polypeptide
DEGEIRTTNPVATEQYGSVSVSTNTLEQRVQDE

SEQ ID NO: 62373 - protein, 31 aa, Artificial Sequence
  Description of Artificial Sequence: Synthetic polypeptide
DEGEIRTTNPVATEQYGSVSYTSLEQEDDDH

SEQ ID NO: 62374 - protein, 32 aa, Artificial Sequence
  Description of Artificial Sequence: Synthetic polypeptide
DEEEIRTTNPVATEQYGSVCSTNNLLVNEQSM

SEQ ID NO: 62375 - protein, 32 aa, Artificial Sequence
  Description of Artificial Sequence: Synthetic polypeptide
DEGEIRTTNPVATEQYGSVSTDLTQHEGTEDD

SEQ ID NO: 62376 - protein, 30 aa, Artificial Sequence
  Description of Artificial Sequence: Synthetic polypeptide
DEGEIRTTNPVATEQYGSVWTTVLDGSGEQ

SEQ ID NO: 62377 - protein, 29 aa, Artificial Sequence
  Description of Artificial Sequence: Synthetic peptide
DEGEIRTTNPVATEQYGIVSCIEQNAGDA

SEQ ID NO: 62378 - protein, 31 aa, Artificial Sequence
  Description of Artificial Sequence: Synthetic polypeptide
DEGEIRTTNPVATEQYGCWSTINNLERENND

SEQ ID NO: 62379 - protein, 28 aa, Artificial Sequence
  Description of Artificial Sequence: Synthetic peptide
DEGEIRTTNPCSTEQYGIVSCNLMSETR

SEQ ID NO: 62380 - protein, 30 aa, Artificial Sequence
  Description of Artificial Sequence: Synthetic polypeptide
DEGEIRTTNPVASECWGIVSCINLQREGNG

SEQ ID NO: 62381 - protein, 30 aa, Artificial Sequence
  Description of Artificial Sequence: Synthetic polypeptide
DEGEIRTTNPVASECWGSVSCINEQREGNG

SEQ ID NO: 62382 - protein, 32 aa, Artificial Sequence
  Description of Artificial Sequence: Synthetic polypeptide
DEGEIRTTNPVATEAYGSVSTQPPNQRTNNDR

SEQ ID NO: 62383 - protein, 32 aa, Artificial Sequence
  Description of Artificial Sequence: Synthetic polypeptide
DEGEIRTTNPVATEIYGVSVCSNVLQRGNEDI

SEQ ID NO: 62384 - protein, 33 aa, Artificial Sequence
  Description of Artificial Sequence: Synthetic polypeptide
DEEEIRTTNPVATEQYGSVCSTPELQENFNSDQ

SEQ ID NO: 62385 - protein, 32 aa, Artificial Sequence
  Description of Artificial Sequence: Synthetic polypeptide
DEGEIRTTNPVATEQWGYTISKTNEDQRGNTR

SEQ ID NO: 62386 - protein, 31 aa, Artificial Sequence
  Description of Artificial Sequence: Synthetic polypeptide
DEGEIRTTNPVATEQYGCVSTELQGGGTEDG

SEQ ID NO: 62387 - protein, 31 aa, Artificial Sequence
  Description of Artificial Sequence: Synthetic polypeptide
DEGEIRTTNPVATEQYGCVSTNFLENGSEQI

SEQ ID NO: 62388 - protein, 30 aa, Artificial Sequence
  Description of Artificial Sequence: Synthetic polypeptide
DEGEIRTTNPVATEQYGCWSYINPLERENE

SEQ ID NO: 62389 - protein, 30 aa, Artificial Sequence
  Description of Artificial Sequence: Synthetic polypeptide
DEGEIRTTNPVATEQYGCVSTNLEMIQDEI

SEQ ID NO: 62390 - protein, 32 aa, Artificial Sequence
  Description of Artificial Sequence: Synthetic polypeptide
DEGEIRTTNPVATEQYGCVSTNNQIGPNQQHI

SEQ ID NO: 62391 - protein, 33 aa, Artificial Sequence
  Description of Artificial Sequence: Synthetic polypeptide
DEEEIRTTNPVATEQYGSVCSTNVQFLTENEIT

SEQ ID NO: 62392 - protein, 32 aa, Artificial Sequence
  Description of Artificial Sequence: Synthetic polypeptide
DEGEIRTTNPVATEQYGCVSTPNDQEGNEDHF

SEQ ID NO: 62393 - protein, 31 aa, Artificial Sequence
  Description of Artificial Sequence: Synthetic polypeptide
DEGEIRTTNPVATEQYGCVSTTNLQELEDEL

SEQ ID NO: 62394 - protein, 30 aa, Artificial Sequence
  Description of Artificial Sequence: Synthetic polypeptide
DEGEIRTTNPVATEQYGCVSTVLQMLEDEG

SEQ ID NO: 62395 - protein, 31 aa, Artificial Sequence
  Description of Artificial Sequence: Synthetic polypeptide
DEGEIRTTNPVATEQYGCVSTVNQIGLIDRG

SEQ ID NO: 62396 - protein, 31 aa, Artificial Sequence
  Description of Artificial Sequence: Synthetic polypeptide
DEGEIRTTNPVATEQYGCVSWNFLERGDEDQ

SEQ ID NO: 62397 - protein, 33 aa, Artificial Sequence
  Description of Artificial Sequence: Synthetic polypeptide
DEGEIRTTNPVATEQYGCVSYTNLDQEGDEDRN

SEQ ID NO: 62398 - protein, 32 aa, Artificial Sequence
  Description of Artificial Sequence: Synthetic polypeptide
DEGEIRTTNPVATEQYGCVVTNYLQRYGVSSQ

SEQ ID NO: 62399 - protein, 31 aa, Artificial Sequence
  Description of Artificial Sequence: Synthetic polypeptide
DEGEIRTTNPVATEQYGCVSTNNDNRGQDQE

SEQ ID NO: 62400 - protein, 32 aa, Artificial Sequence
  Description of Artificial Sequence: Synthetic polypeptide
DEGEIRTTNPVATEQYGVAIVTNLQHRQGTNV

SEQ ID NO: 62401 - protein, 32 aa, Artificial Sequence
  Description of Artificial Sequence: Synthetic polypeptide
DEGEIRTTNPVATEQYGYTWSWTINPLQRENN

SEQ ID NO: 62402 - protein, 31 aa, Artificial Sequence
  Description of Artificial Sequence: Synthetic polypeptide
DEGEIRTTNPVATESYGSVDTQLNQVTGTGR

SEQ ID NO: 62403 - protein, 31 aa, Artificial Sequence
  Description of Artificial Sequence: Synthetic polypeptide
DEHEIATTNPVATEAYGSVSQNLSFAVGNNR

SEQ ID NO: 62404 - protein, 30 aa, Artificial Sequence
  Description of Artificial Sequence: Synthetic polypeptide
DEHEIATTNPVATENYGSVSTNPNGNDNQR

SEQ ID NO: 62405 - protein, 32 aa, Artificial Sequence
  Description of Artificial Sequence: Synthetic polypeptide
DEHEIATTNPVATEPYGSVSTGNLSMGDGSNR

SEQ ID NO: 62406 - protein, 30 aa, Artificial Sequence
  Description of Artificial Sequence: Synthetic polypeptide
DEHEIATTNPVATEQYGSCSTNPQDEGGDL

SEQ ID NO: 62407 - protein, 31 aa, Artificial Sequence
  Description of Artificial Sequence: Synthetic polypeptide
DEHEIATTNPVATEQYGSVSAGALERNNMNR

SEQ ID NO: 62408 - protein, 31 aa, Artificial Sequence
  Description of Artificial Sequence: Synthetic polypeptide
DEHEIATTNPVATEQYGSVSAGNLFRNMDRM

SEQ ID NO: 62409 - protein, 31 aa, Artificial Sequence
  Description of Artificial Sequence: Synthetic polypeptide
DEHEIATTNPVATEQYGSVSTDIWIVGNNRD

SEQ ID NO: 62410 - protein, 32 aa, Artificial Sequence
  Description of Artificial Sequence: Synthetic polypeptide
DEHEIATTNPVATEQYGSVSTTQGDRNGNNDR

SEQ ID NO: 62411 - protein, 31 aa, Artificial Sequence
  Description of Artificial Sequence: Synthetic polypeptide
DEHEIATTNPVATEQYGVVSTTNAGDVGNER

SEQ ID NO: 62412 - protein, 31 aa, Artificial Sequence
  Description of Artificial Sequence: Synthetic polypeptide
DEHEIATTNPVATDQYGSVANTQGLQRDGND

SEQ ID NO: 62413 - protein, 32 aa, Artificial Sequence
  Description of Artificial Sequence: Synthetic polypeptide
DEHEIATTNPVATESYGVVSTNLQGEHGQNDR

SEQ ID NO: 62414 - protein, 30 aa, Artificial Sequence
  Description of Artificial Sequence: Synthetic polypeptide
DEHEIATTNPVAYEQWGAVSTNLQGDENDR

SEQ ID NO: 62415 - protein, 30 aa, Artificial Sequence
  Description of Artificial Sequence: Synthetic polypeptide
DEHEIATTNPVAYEQWGSVSTNGQRGEDDS

SEQ ID NO: 62416 - protein, 30 aa, Artificial Sequence
  Description of Artificial Sequence: Synthetic polypeptide
DEHEIATTNPVAYEQWGSVSTNHQGGGNTD

SEQ ID NO: 62417 - protein, 31 aa, Artificial Sequence
  Description of Artificial Sequence: Synthetic polypeptide
DEHEIATTNPVAYEQWGSVSTNLQDGGENEP

SEQ ID NO: 62418 - protein, 31 aa, Artificial Sequence
  Description of Artificial Sequence: Synthetic polypeptide
DEHEIATTNPVAYEQWGSVSTNLQGNMGDPR

SEQ ID NO: 62419 - protein, 31 aa, Artificial Sequence
  Description of Artificial Sequence: Synthetic polypeptide
DEHEIATTNPVAYEQWGSVSTNQQRDGDNEI

SEQ ID NO: 62420 - protein, 30 aa, Artificial Sequence
  Description of Artificial Sequence: Synthetic polypeptide
DEHEIATTNPVAYEQYGSVATHLQDRGDEH

SEQ ID NO: 62421 - protein, 30 aa, Artificial Sequence
  Description of Artificial Sequence: Synthetic polypeptide
DEHEIATTNPVAYEQYGSVSANPGRNNMNR

SEQ ID NO: 62422 - protein, 32 aa, Artificial Sequence
  Description of Artificial Sequence: Synthetic polypeptide
DEHEIATTNPVAYEQYGSVSTNLQGNMGGDGR

SEQ ID NO: 62423 - protein, 31 aa, Artificial Sequence
  Description of Artificial Sequence: Synthetic polypeptide
DEHEIATTNPVATETYGTVSTNLQGNDDNQR

SEQ ID NO: 62424 - protein, 29 aa, Artificial Sequence
  Description of Artificial Sequence: Synthetic peptide
DEHEIATTNPVATAQWGSVATALTRQGND

SEQ ID NO: 62425 - protein, 29 aa, Artificial Sequence
  Description of Artificial Sequence: Synthetic peptide
DEHEIATTNPVATAQWGSVATALQGGNQD

SEQ ID NO: 62426 - protein, 30 aa, Artificial Sequence
  Description of Artificial Sequence: Synthetic polypeptide
DEHEIATTNPVATAQWGSVATALPQRTGND

SEQ ID NO: 62427 - protein, 30 aa, Artificial Sequence
  Description of Artificial Sequence: Synthetic polypeptide
DEGEIRTTNPVATKHYGSVSTDNLQETQDD

SEQ ID NO: 62428 - protein, 32 aa, Artificial Sequence
  Description of Artificial Sequence: Synthetic polypeptide
DEGEIRTTNPVATKHYGSVSTDNNLQRTQNEM

SEQ ID NO: 62429 - protein, 31 aa, Artificial Sequence
  Description of Artificial Sequence: Synthetic polypeptide
DEGEIRTTNPVATYHYGSVSTDNLQETQNDN

SEQ ID NO: 62430 - protein, 30 aa, Artificial Sequence
  Description of Artificial Sequence: Synthetic polypeptide
DEGEIRTTNPVAYEQWGSVCTELVREMNNR

SEQ ID NO: 62431 - protein, 32 aa, Artificial Sequence
  Description of Artificial Sequence: Synthetic polypeptide
DEGEIRTTNPVAYEQWGYTISTNELQRGDNER

SEQ ID NO: 62432 - protein, 28 aa, Artificial Sequence
  Description of Artificial Sequence: Synthetic peptide
DEGEIRTTNPVSTEQYGTISMNIQQGTH

SEQ ID NO: 62433 - protein, 31 aa, Artificial Sequence
  Description of Artificial Sequence: Synthetic polypeptide
DEGEIYTTNPVATEQYGSVSTDNAGMENGNT

SEQ ID NO: 62434 - protein, 31 aa, Artificial Sequence
  Description of Artificial Sequence: Synthetic polypeptide
DEGLIRTTNPVATEQYGYSFSTGNLVINGER

SEQ ID NO: 62435 - protein, 30 aa, Artificial Sequence
  Description of Artificial Sequence: Synthetic polypeptide
DEGMIRTTNPVATEQYGSISLTFNEINGNT

SEQ ID NO: 62436 - protein, 31 aa, Artificial Sequence
  Description of Artificial Sequence: Synthetic polypeptide
DEGMIRTTNPVATEQYGSISLTNEINTGNER

SEQ ID NO: 62437 - protein, 30 aa, Artificial Sequence
  Description of Artificial Sequence: Synthetic polypeptide
DEGTIRTTNPVATEQYGSVTDTNLIIGEGG

SEQ ID NO: 62438 - protein, 30 aa, Artificial Sequence
  Description of Artificial Sequence: Synthetic polypeptide
DEGVIACTNPVATEQYGCVATNHQRDGNPR

SEQ ID NO: 62439 - protein, 30 aa, Artificial Sequence
  Description of Artificial Sequence: Synthetic polypeptide
DEGVIACTNPVATEQYGCVATNPQRDGNRV

SEQ ID NO: 62440 - protein, 29 aa, Artificial Sequence
  Description of Artificial Sequence: Synthetic peptide
DEGVIATTNPVATEQYGCVAGTNPQDGNP

SEQ ID NO: 62441 - protein, 29 aa, Artificial Sequence
  Description of Artificial Sequence: Synthetic peptide
DEGVIATTNPVATEQYGCVATNHQADGNN

SEQ ID NO: 62442 - protein, 29 aa, Artificial Sequence
  Description of Artificial Sequence: Synthetic peptide
DEGVIATTNPVATEQYGCVATNPQDHGNF

SEQ ID NO: 62443 - protein, 30 aa, Artificial Sequence
  Description of Artificial Sequence: Synthetic polypeptide
DEGVIATTNPVATEQYGSCSTNLIDIGNEM

SEQ ID NO: 62444 - protein, 30 aa, Artificial Sequence
  Description of Artificial Sequence: Synthetic polypeptide
DEGVIATTNPVATEQYGSCSTNLIDISMNR

SEQ ID NO: 62445 - protein, 31 aa, Artificial Sequence
  Description of Artificial Sequence: Synthetic polypeptide
DEGVIATTNPVATEQYGSCSTNPLIDNGENR

SEQ ID NO: 62446 - protein, 31 aa, Artificial Sequence
  Description of Artificial Sequence: Synthetic polypeptide
DEGVICTTNPVATEQYGSCSTNLIIGDNTRD

SEQ ID NO: 62447 - protein, 30 aa, Artificial Sequence
  Description of Artificial Sequence: Synthetic polypeptide
DEHEIACTNPVATEQYGSVATNLERNPERN

SEQ ID NO: 62448 - protein, 33 aa, Artificial Sequence
  Description of Artificial Sequence: Synthetic polypeptide
DEGEIRTTNPCATEQYGIVSSTTNLPQRNGTPR

SEQ ID NO: 62449 - protein, 28 aa, Artificial Sequence
  Description of Artificial Sequence: Synthetic peptide
DEGEIAPTNPVSSEQYGIVSCNLQSGTR

SEQ ID NO: 62450 - protein, 29 aa, Artificial Sequence
  Description of Artificial Sequence: Synthetic peptide
DEGEIRTTNPCATEPYGSCAATNLAAGNN

SEQ ID NO: 62451 - protein, 29 aa, Artificial Sequence
  Description of Artificial Sequence: Synthetic peptide
DEGEIRPTNPVSTEQYGDVSCNEQNAGDR

SEQ ID NO: 62452 - protein, 31 aa, Artificial Sequence
  Description of Artificial Sequence: Synthetic polypeptide
DEGEIATTNPVATEQWGSVSMSGNLQDRVNI

SEQ ID NO: 62453 - protein, 32 aa, Artificial Sequence
  Description of Artificial Sequence: Synthetic polypeptide
DEEEIRTTNPVATEQYGSVCSWELQFFNSDDY

SEQ ID NO: 62454 - protein, 31 aa, Artificial Sequence
  Description of Artificial Sequence: Synthetic polypeptide
DEGEIATTNPVATEQWGSVSTNLNNRDNPTA

SEQ ID NO: 62455 - protein, 33 aa, Artificial Sequence
  Description of Artificial Sequence: Synthetic polypeptide
DEEEIRTTNPVATEQYGSVCSWEHQRFGSENQS

SEQ ID NO: 62456 - protein, 32 aa, Artificial Sequence
  Description of Artificial Sequence: Synthetic polypeptide
DEEEIRTTNPVATEQYGSVCSWEEHQSGSNQS

SEQ ID NO: 62457 - protein, 33 aa, Artificial Sequence
  Description of Artificial Sequence: Synthetic polypeptide
DEEEIRTTNPVATEQYGSVCSWEDLQERFGSEQ

SEQ ID NO: 62458 - protein, 31 aa, Artificial Sequence
  Description of Artificial Sequence: Synthetic polypeptide
DEGEIATTNPVATEQWGSVSVNLQHGDNSAQ

SEQ ID NO: 62459 - protein, 31 aa, Artificial Sequence
  Description of Artificial Sequence: Synthetic polypeptide
DEGEIATTNPVATEQYGCVATNLQERAGEDD

SEQ ID NO: 62460 - protein, 32 aa, Artificial Sequence
  Description of Artificial Sequence: Synthetic polypeptide
DEGEIATTNPVATEQYGCVATNLQGTEGNDRE

SEQ ID NO: 62461 - protein, 31 aa, Artificial Sequence
  Description of Artificial Sequence: Synthetic polypeptide
DEGEIATTNPVATEQWGSVATNLERGENDQN

SEQ ID NO: 62462 - protein, 29 aa, Artificial Sequence
  Description of Artificial Sequence: Synthetic peptide
DEGEIATTNPVATEQYGSVAGTALINMNM

SEQ ID NO: 62463 - protein, 33 aa, Artificial Sequence
  Description of Artificial Sequence: Synthetic polypeptide
DEEEIRTTNPVATEQYGSVCSVSGNLQRFVSDQ

SEQ ID NO: 62464 - protein, 30 aa, Artificial Sequence
  Description of Artificial Sequence: Synthetic polypeptide
DEGEIATTNPVATEQYGSVAMNNQEAGNDP

SEQ ID NO: 62465 - protein, 30 aa, Artificial Sequence
  Description of Artificial Sequence: Synthetic polypeptide
DEGEIATTNPVATEQYGSVATALIGMDNRW

SEQ ID NO: 62466 - protein, 30 aa, Artificial Sequence
  Description of Artificial Sequence: Synthetic polypeptide
DEGEIATTNPVATEQYGSVATALIGMNDRQ

SEQ ID NO: 62467 - protein, 31 aa, Artificial Sequence
  Description of Artificial Sequence: Synthetic polypeptide
DEGEIATTNPVATEQYGSVATNLEAAENNRM

SEQ ID NO: 62468 - protein, 29 aa, Artificial Sequence
  Description of Artificial Sequence: Synthetic peptide
DEGEIATTNPVATEQYGSVATNLEDPDAN

SEQ ID NO: 62469 - protein, 30 aa, Artificial Sequence
  Description of Artificial Sequence: Synthetic polypeptide
DEGEIATTNPVATEQYGSVATNLEDPNHAE

SEQ ID NO: 62470 - protein, 32 aa, Artificial Sequence
  Description of Artificial Sequence: Synthetic polypeptide
DEGEIATTNPVATEQYGSVATNLERPGENMGN

SEQ ID NO: 62471 - protein, 31 aa, Artificial Sequence
  Description of Artificial Sequence: Synthetic polypeptide
DEGEIATTNPVATEQYGSVATNLERTENNSM

SEQ ID NO: 62472 - protein, 33 aa, Artificial Sequence
  Description of Artificial Sequence: Synthetic polypeptide
DEEEIRTTNPVATEQYGSVCSVTGLDTREVDNI

SEQ ID NO: 62473 - protein, 31 aa, Artificial Sequence
  Description of Artificial Sequence: Synthetic polypeptide
DEGEIATTNPVATEQYGSVATNLQANPQNEH

SEQ ID NO: 62474 - protein, 30 aa, Artificial Sequence
  Description of Artificial Sequence: Synthetic polypeptide
DEGEIATTNPVATEQWGSVAMNLQDQGDRY

SEQ ID NO: 62475 - protein, 33 aa, Artificial Sequence
  Description of Artificial Sequence: Synthetic polypeptide
DEEEIRTTNPVATEQYGSVCSWENLQFFNSNDY

SEQ ID NO: 62476 - protein, 33 aa, Artificial Sequence
  Description of Artificial Sequence: Synthetic polypeptide
DEGEIAPTNPVSTEQYGSVSSTTNLPQMRGNPR

SEQ ID NO: 62477 - protein, 32 aa, Artificial Sequence
  Description of Artificial Sequence: Synthetic polypeptide
DEGEIAPTNPVSTEQYGSVSSTTNLQMSGNPR

SEQ ID NO: 62478 - protein, 30 aa, Artificial Sequence
  Description of Artificial Sequence: Synthetic polypeptide
DEGEIATTNPCATECWGIVSCNLQREGENR

SEQ ID NO: 62479 - protein, 28 aa, Artificial Sequence
  Description of Artificial Sequence: Synthetic peptide
DEGEIATTNPCATEQYGDVSCNLMSGTA

SEQ ID NO: 62480 - protein, 29 aa, Artificial Sequence
  Description of Artificial Sequence: Synthetic peptide
DEGEIATTNPCATEQYGDVSENLQSAGTA

SEQ ID NO: 62481 - protein, 33 aa, Artificial Sequence
  Description of Artificial Sequence: Synthetic polypeptide
DEEEIRTTNPVATEQYGSVCSWNLQEFFNSNQY

SEQ ID NO: 62482 - protein, 33 aa, Artificial Sequence
  Description of Artificial Sequence: Synthetic polypeptide
DEEEIRTTNPVATEQYGSVCSWNHQNFGSNNQN

SEQ ID NO: 62483 - protein, 30 aa, Artificial Sequence
  Description of Artificial Sequence: Synthetic polypeptide
DEGEIATTNPCATEQYGSVSTNLEDHGEDL

SEQ ID NO: 62484 - protein, 33 aa, Artificial Sequence
  Description of Artificial Sequence: Synthetic polypeptide
DEEEIRTTNPVATEQYGSVCSWMNLQFFGSEDG

SEQ ID NO: 62485 - protein, 31 aa, Artificial Sequence
  Description of Artificial Sequence: Synthetic polypeptide
DEGEIATTNPVATEPYGSVCATNLTRGGNLH

SEQ ID NO: 62486 - protein, 28 aa, Artificial Sequence
  Description of Artificial Sequence: Synthetic peptide
DEGEIATTNPCSSEQYGIVSCNLQSGTR

SEQ ID NO: 62487 - protein, 31 aa, Artificial Sequence
  Description of Artificial Sequence: Synthetic polypeptide
DEGEIATTNPCSTEQYGSVSSTNLPNSGMNR

SEQ ID NO: 62488 - protein, 33 aa, Artificial Sequence
  Description of Artificial Sequence: Synthetic polypeptide
DEEEIRTTNPVATEQYGSVCSWGNLEGFGSNDP

SEQ ID NO: 62489 - protein, 32 aa, Artificial Sequence
  Description of Artificial Sequence: Synthetic polypeptide
DEEEIRTTNPVATEQYGSVCSWGNHQNGSEQY

SEQ ID NO: 62490 - protein, 29 aa, Artificial Sequence
  Description of Artificial Sequence: Synthetic peptide
DEGEIATTNPVATAQYGCVATNLETGDNP

SEQ ID NO: 62491 - protein, 30 aa, Artificial Sequence
  Description of Artificial Sequence: Synthetic polypeptide
DEGEIATTNPVATECYGVVSTNLQAPNDDN

SEQ ID NO: 62492 - protein, 32 aa, Artificial Sequence
  Description of Artificial Sequence: Synthetic polypeptide
DEEEIRTTNPVATEQYGSVCSWGELQGFGSDD

SEQ ID NO: 62493 - protein, 33 aa, Artificial Sequence
  Description of Artificial Sequence: Synthetic polypeptide
DEEEIRTTNPVATEQYGSVCSWGEHQRFGSNNQ

SEQ ID NO: 62494 - protein, 30 aa, Artificial Sequence
  Description of Artificial Sequence: Synthetic polypeptide
DEGEIATTNPVATECYGVVSTNLQNNPNHN

SEQ ID NO: 62495 - protein, 31 aa, Artificial Sequence
  Description of Artificial Sequence: Synthetic polypeptide
DEGEIATTNPVATEPYGSVAITNLQQGNDQF

SEQ ID NO: 62496 - protein, 30 aa, Artificial Sequence
  Description of Artificial Sequence: Synthetic polypeptide
DEGEIATTNPCSTEQWGIVSCNLQREGENR

SEQ ID NO: 62497 - protein, 32 aa, Artificial Sequence
  Description of Artificial Sequence: Synthetic polypeptide
DEGEIATTNPVATEQYGSVATNLQDAGDNNED

SEQ ID NO: 62498 - protein, 34 aa, Artificial Sequence
  Description of Artificial Sequence: Synthetic polypeptide
DEEEIRTTNPVATEQYGSVCSTYLQEFFGSNFQN

SEQ ID NO: 62499 - protein, 33 aa, Artificial Sequence
  Description of Artificial Sequence: Synthetic polypeptide
DEEEIRTTNPVATEQYGSVCSTYLQDTADDNQQ

SEQ ID NO: 62500 - protein, 31 aa, Artificial Sequence
  Description of Artificial Sequence: Synthetic polypeptide
DEGEIATTNPVAYEQYGSVCATNLQRGPLQD

SEQ ID NO: 62501 - protein, 32 aa, Artificial Sequence
  Description of Artificial Sequence: Synthetic polypeptide
DEGEIATTNPVAYEQYGVSVSTNDLAQHGIAR

SEQ ID NO: 62502 - protein, 33 aa, Artificial Sequence
  Description of Artificial Sequence: Synthetic polypeptide
DEEEIRTTNPVATEQYGSVCSTTGELQNFGSEQ

SEQ ID NO: 62503 - protein, 31 aa, Artificial Sequence
  Description of Artificial Sequence: Synthetic polypeptide
DEGEIATTNPVSSEQYGSVSCINLPQREGTR

SEQ ID NO: 62504 - protein, 30 aa, Artificial Sequence
  Description of Artificial Sequence: Synthetic polypeptide
DEGEIATTNPVSTECYGSVSCNEQDREGNG

SEQ ID NO: 62505 - protein, 33 aa, Artificial Sequence
  Description of Artificial Sequence: Synthetic polypeptide
DEEEIRTTNPVATEQYGSVCSTTDAGVNREGND

SEQ ID NO: 62506 - protein, 29 aa, Artificial Sequence
  Description of Artificial Sequence: Synthetic peptide
DEGEIATTNPVSTEQYGIVSATNLEHGEL

SEQ ID NO: 62507 - protein, 30 aa, Artificial Sequence
  Description of Artificial Sequence: Synthetic polypeptide
DEGEIATTNPVSTEQYGSVAMNLQGMGNQT

SEQ ID NO: 62508 - protein, 32 aa, Artificial Sequence
  Description of Artificial Sequence: Synthetic polypeptide
DEGEIATTNPVSTEQYGSVATNLQDRGPNDEA

SEQ ID NO: 62509 - protein, 30 aa, Artificial Sequence
  Description of Artificial Sequence: Synthetic polypeptide
DEGEIATTNPVAYEQYGSVATNLQVGDQEH

SEQ ID NO: 62510 - protein, 34 aa, Artificial Sequence
  Description of Artificial Sequence: Synthetic polypeptide
DEEEIRTTNPVATEQYGSVCSTSNLEMRQGLILG

SEQ ID NO: 62511 - protein, 30 aa, Artificial Sequence
  Description of Artificial Sequence: Synthetic polypeptide
DEGEIATTNPVSTEQYGSVSACNLQDSGTL

SEQ ID NO: 62512 - protein, 29 aa, Artificial Sequence
  Description of Artificial Sequence: Synthetic peptide
DEGEIATVNPVATEQYGCVATNLDDGNHQ

SEQ ID NO: 62513 - protein, 29 aa, Artificial Sequence
  Description of Artificial Sequence: Synthetic peptide
DEGEIATVNPVATEQYGSVATNLEEDGGH

SEQ ID NO: 62514 - protein, 30 aa, Artificial Sequence
  Description of Artificial Sequence: Synthetic polypeptide
DEGEIATVNPVATEQYGSVATNLEEEGNHN

SEQ ID NO: 62515 - protein, 33 aa, Artificial Sequence
  Description of Artificial Sequence: Synthetic polypeptide
DEEEIRTTNPVATEQYGSVCSTPQQEHPGENVE

SEQ ID NO: 62516 - protein, 34 aa, Artificial Sequence
  Description of Artificial Sequence: Synthetic polypeptide
DEEEIRTTNPVATEQYGSVCSTPNLQFQMELVRI

SEQ ID NO: 62517 - protein, 29 aa, Artificial Sequence
  Description of Artificial Sequence: Synthetic peptide
DEGEIRATNGCAYYQYGSVSTNLQQGDRE

SEQ ID NO: 62518 - protein, 29 aa, Artificial Sequence
  Description of Artificial Sequence: Synthetic peptide
DEGEIRMTNPVATEMYGCVSTQLQQGLDN

SEQ ID NO: 62519 - protein, 29 aa, Artificial Sequence
  Description of Artificial Sequence: Synthetic peptide
DEGEIRPTNPVASEQYGSVSCPALNSGTR

SEQ ID NO: 62520 - protein, 30 aa, Artificial Sequence
  Description of Artificial Sequence: Synthetic polypeptide
DEGEIATTNPVSTEQYGSVSACNLQDHGTL

SEQ ID NO: 62521 - protein, 32 aa, Artificial Sequence
  Description of Artificial Sequence: Synthetic polypeptide
DEGEIATTNPVAYEQYGSVATNLQRVGDNLDI

SEQ ID NO: 62522 - protein, 31 aa, Artificial Sequence
  Description of Artificial Sequence: Synthetic polypeptide
DEGEIATTNPVAYEQYGSVATNLQRDDQTRE

SEQ ID NO: 62523 - protein, 33 aa, Artificial Sequence
  Description of Artificial Sequence: Synthetic polypeptide
DEEEIRTTNPVATEQYGSVCSTTNDQLGGDEVL

SEQ ID NO: 62524 - protein, 33 aa, Artificial Sequence
  Description of Artificial Sequence: Synthetic polypeptide
DEEEIRTTNPVATEQYGSVCSTYLDQFFGSDQD

SEQ ID NO: 62525 - protein, 32 aa, Artificial Sequence
  Description of Artificial Sequence: Synthetic polypeptide
DEEEIRTTNPVATEQYGSVCSTYDQHFNSNQL

SEQ ID NO: 62526 - protein, 32 aa, Artificial Sequence
  Description of Artificial Sequence: Synthetic polypeptide
DEGEIATTNPVATEQYGSVATNLQNGENEPAW

SEQ ID NO: 62527 - protein, 34 aa, Artificial Sequence
  Description of Artificial Sequence: Synthetic polypeptide
DEEEIRTTNPVATEQYGSVCSTVVLQNIGSNFQE

SEQ ID NO: 62528 - protein, 32 aa, Artificial Sequence
  Description of Artificial Sequence: Synthetic polypeptide
DEEEIRTTNPVATEQYGSVCSTVQYERNIDRQ

SEQ ID NO: 62529 - protein, 31 aa, Artificial Sequence
  Description of Artificial Sequence: Synthetic polypeptide
DEGEIATTNPVATEQYGSVATNLQSADNNTE

SEQ ID NO: 62530 - protein, 30 aa, Artificial Sequence
  Description of Artificial Sequence: Synthetic polypeptide
DEGEIATTNPVATEQYGSVATNPPDNGNEL

SEQ ID NO: 62531 - protein, 30 aa, Artificial Sequence
  Description of Artificial Sequence: Synthetic polypeptide
DEGEIATTNPVATEQYGSVATPAIQDGNDQ

SEQ ID NO: 62532 - protein, 32 aa, Artificial Sequence
  Description of Artificial Sequence: Synthetic polypeptide
DEGEIATTNPVATEQYGSVCATNLGATEGDNR

SEQ ID NO: 62533 - protein, 32 aa, Artificial Sequence
  Description of Artificial Sequence: Synthetic polypeptide
DEGEIATTNPVATEQYGSVCATNLGRNGDNQD

SEQ ID NO: 62534 - protein, 31 aa, Artificial Sequence
  Description of Artificial Sequence: Synthetic polypeptide
DEGEIATTNPVATEQYGSVSTNLEDHEGEDL

SEQ ID NO: 62535 - protein, 31 aa, Artificial Sequence
  Description of Artificial Sequence: Synthetic polypeptide
DEGEIATTNPVATEQYGSVSTNPDNRGTPEE

SEQ ID NO: 62536 - protein, 34 aa, Artificial Sequence
  Description of Artificial Sequence: Synthetic polypeptide
DEGEIATTNPVATEQYGSVYSTTNDLIERNGNRD

SEQ ID NO: 62537 - protein, 28 aa, Artificial Sequence
  Description of Artificial Sequence: Synthetic peptide
DEGEIATTNPVAYDHYGAVSTNLQHDNM

SEQ ID NO: 62538 - protein, 30 aa, Artificial Sequence
  Description of Artificial Sequence: Synthetic polypeptide
DEGEIATTNPVAYEPYGSVATNLQDDGNDN

SEQ ID NO: 62539 - protein, 30 aa, Artificial Sequence
  Description of Artificial Sequence: Synthetic polypeptide
DEGEIATTNPVAYEQYGCVATNLQVGDNDQ

SEQ ID NO: 62540 - protein, 33 aa, Artificial Sequence
  Description of Artificial Sequence: Synthetic polypeptide
DEGEIATTNPVAYEQYGQSVSTNDLLQDRGIGR

SEQ ID NO: 62541 - protein, 30 aa, Artificial Sequence
  Description of Artificial Sequence: Synthetic polypeptide
DEGEIATTNPVAYEQYGSVAITNLQVTDRE

SEQ ID NO: 62542 - protein, 31 aa, Artificial Sequence
  Description of Artificial Sequence: Synthetic polypeptide
DEGEIATTNPVAYEQYGSVATNLQDGDGNDM

SEQ ID NO: 62543 - protein, 30 aa, Artificial Sequence
  Description of Artificial Sequence: Synthetic polypeptide
DEGEIATTNPVAYEQYGSVATNLQDTGETH

SEQ ID NO: 62544 - protein, 32 aa, Artificial Sequence
  Description of Artificial Sequence: Synthetic polypeptide
DEGEIATTNPVAYEQYGSVATNLQESGDNVRM

SEQ ID NO: 62545 - protein, 28 aa, Artificial Sequence
  Description of Artificial Sequence: Synthetic peptide
DEGEIRPTNPVSTEQYGTISMNIQQGTR

SEQ ID NO: 62546 - protein, 29 aa, Artificial Sequence
  Description of Artificial Sequence: Synthetic peptide
DENEIACTNPVATEQYGEASENLQQRGGH

SEQ ID NO: 62547 - protein, 28 aa, Artificial Sequence
  Description of Artificial Sequence: Synthetic peptide
DENEIACTNPVATEQYGEVSENLEHGGL

SEQ ID NO: 62548 - protein, 30 aa, Artificial Sequence
  Description of Artificial Sequence: Synthetic polypeptide
DENEIACTNPVATEQYGEVSENLQMRGGPV

SEQ ID NO: 62549 - protein, 29 aa, Artificial Sequence
  Description of Artificial Sequence: Synthetic peptide
DEQEIASVNPVATEQYGVVSTNLEDSGNQ

SEQ ID NO: 62550 - protein, 28 aa, Artificial Sequence
  Description of Artificial Sequence: Synthetic peptide
DEQEIASVNPVCTEQYGVVSTNLESGNQ

SEQ ID NO: 62551 - protein, 28 aa, Artificial Sequence
  Description of Artificial Sequence: Synthetic peptide
DEQEIATTNPCSTEQYGIVSTDLQSGTL

SEQ ID NO: 62552 - protein, 30 aa, Artificial Sequence
  Description of Artificial Sequence: Synthetic polypeptide
DEQEIATTNPIATEQYGSVSATDLMDRGEL

SEQ ID NO: 62553 - protein, 31 aa, Artificial Sequence
  Description of Artificial Sequence: Synthetic polypeptide
DEQEIATTNPMATEQWGSVPTNDLQHDGNGR

SEQ ID NO: 62554 - protein, 31 aa, Artificial Sequence
  Description of Artificial Sequence: Synthetic polypeptide
DEQEIATTNPVATECYGAVATNLQRGGGNDA

SEQ ID NO: 62555 - protein, 31 aa, Artificial Sequence
  Description of Artificial Sequence: Synthetic polypeptide
DEQEIATTNPVATECYGSVSCINLEDREGNG

SEQ ID NO: 62556 - protein, 31 aa, Artificial Sequence
  Description of Artificial Sequence: Synthetic polypeptide
DEQEIATTNPVATECYGVVSTNLQGADNDAR

SEQ ID NO: 62557 - protein, 28 aa, Artificial Sequence
  Description of Artificial Sequence: Synthetic peptide
DEQEIATTNPVATEGYGSVATDLEHGDL

SEQ ID NO: 62558 - protein, 30 aa, Artificial Sequence
  Description of Artificial Sequence: Synthetic polypeptide
DEQEIASVNPVATEQYGSVSATNLEDSGNQ

SEQ ID NO: 62559 - protein, 28 aa, Artificial Sequence
  Description of Artificial Sequence: Synthetic peptide
DEQEIATTNPVATEGYGSVATDLEHGEL

SEQ ID NO: 62560 - protein, 32 aa, Artificial Sequence
  Description of Artificial Sequence: Synthetic polypeptide
DEQEIATTNPVATEGYGSVSANDLQSRVGEDR

SEQ ID NO: 62561 - protein, 29 aa, Artificial Sequence
  Description of Artificial Sequence: Synthetic peptide
DEQEIATTNPVATEGYGSVSTDLEHEGEL

SEQ ID NO: 62562 - protein, 30 aa, Artificial Sequence
  Description of Artificial Sequence: Synthetic polypeptide
DEQEIATTNPVATEMWGSVATNLERGDNAD

SEQ ID NO: 62563 - protein, 31 aa, Artificial Sequence
  Description of Artificial Sequence: Synthetic polypeptide
DEQEIATTNPVATEQWGSVSENLTNPGDNRP

SEQ ID NO: 62564 - protein, 30 aa, Artificial Sequence
  Description of Artificial Sequence: Synthetic polypeptide
DEQEIATTNPVATEQWGSVSENLTNPGNES

SEQ ID NO: 62565 - protein, 31 aa, Artificial Sequence
  Description of Artificial Sequence: Synthetic polypeptide
DEQEIATTNPVATEQYGAVATNLQDGGQNDT

SEQ ID NO: 62566 - protein, 31 aa, Artificial Sequence
  Description of Artificial Sequence: Synthetic polypeptide
DEQEIATTNPVATEQYGCVAATNLQDNGTNQ

SEQ ID NO: 62567 - protein, 31 aa, Artificial Sequence
  Description of Artificial Sequence: Synthetic polypeptide
DEQEIATTNPVATEQYGCVATNLQNNGDNDF

SEQ ID NO: 62568 - protein, 30 aa, Artificial Sequence
  Description of Artificial Sequence: Synthetic polypeptide
DEQEIATTNPVATEQYGEVSTDLEDREGEL

SEQ ID NO: 62569 - protein, 28 aa, Artificial Sequence
  Description of Artificial Sequence: Synthetic peptide
DEQEIATTNPVATEGYGSVATTLEHGDL

SEQ ID NO: 62570 - protein, 31 aa, Artificial Sequence
  Description of Artificial Sequence: Synthetic polypeptide
DEQEIATTNPVATEQYGNVSANDLQDREGQL

SEQ ID NO: 62571 - protein, 29 aa, Artificial Sequence
  Description of Artificial Sequence: Synthetic peptide
DEQEIASTNPVATEQYGSVSDDLQDSGEQ

SEQ ID NO: 62572 - protein, 30 aa, Artificial Sequence
  Description of Artificial Sequence: Synthetic polypeptide
DEQEIASTNPVATEQYGSVSATDLQDHGEQ

SEQ ID NO: 62573 - protein, 32 aa, Artificial Sequence
  Description of Artificial Sequence: Synthetic polypeptide
DEPEIRTTNPVATEQYGSVSMMNLFEEVNERN

SEQ ID NO: 62574 - protein, 33 aa, Artificial Sequence
  Description of Artificial Sequence: Synthetic polypeptide
DEPEIRTTNPVATEQYGSVSMMNLFRDEVNERV

SEQ ID NO: 62575 - protein, 32 aa, Artificial Sequence
  Description of Artificial Sequence: Synthetic polypeptide
DEPEIRTTNPVATEQYGSVSMPNLAREVNEAV

SEQ ID NO: 62576 - protein, 32 aa, Artificial Sequence
  Description of Artificial Sequence: Synthetic polypeptide
DEPEIRTTNPVATEQYGSVSPTTLERMNSPQT

SEQ ID NO: 62577 - protein, 31 aa, Artificial Sequence
  Description of Artificial Sequence: Synthetic polypeptide
DEPEIRTTNPVATEQYGSVSTDLLIPGDEDG

SEQ ID NO: 62578 - protein, 32 aa, Artificial Sequence
  Description of Artificial Sequence: Synthetic polypeptide
DEPEIRTTNPVATEQYGSVSTDLQIDDGDDIQ

SEQ ID NO: 62579 - protein, 33 aa, Artificial Sequence
  Description of Artificial Sequence: Synthetic polypeptide
DEPEIRTTNPVATEQYGSVSTPNDQERLVFENV

SEQ ID NO: 62580 - protein, 34 aa, Artificial Sequence
  Description of Artificial Sequence: Synthetic polypeptide
DEPEIRTTNPVATEQYGSVSTPPLQERLVFGNVT

SEQ ID NO: 62581 - protein, 32 aa, Artificial Sequence
  Description of Artificial Sequence: Synthetic polypeptide
DEPEIRTTNPVATEQYGSVWVPLNLQEGFENG

SEQ ID NO: 62582 - protein, 29 aa, Artificial Sequence
  Description of Artificial Sequence: Synthetic peptide
DEQEIASTNPVATEQYGSVSDDLQDHGEQ

SEQ ID NO: 62583 - protein, 30 aa, Artificial Sequence
  Description of Artificial Sequence: Synthetic polypeptide
DEPEIRTTNPVATEQYGSVYTNGGFGTDPH

SEQ ID NO: 62584 - protein, 30 aa, Artificial Sequence
  Description of Artificial Sequence: Synthetic polypeptide
DEQAICTTNPVATEQYGSVFTTNLNIIGNT

SEQ ID NO: 62585 - protein, 34 aa, Artificial Sequence
  Description of Artificial Sequence: Synthetic polypeptide
DEQEAEIRTTNPVAYEQWGSVSTNLQHDGGDNER

SEQ ID NO: 62586 - protein, 31 aa, Artificial Sequence
  Description of Artificial Sequence: Synthetic polypeptide
DEQEIAATNPVAYEQYGTVSCTNLSQDVGNR

SEQ ID NO: 62587 - protein, 30 aa, Artificial Sequence
  Description of Artificial Sequence: Synthetic polypeptide
DEQEIACTNPIATEQYGSVSATNLEDHGER

SEQ ID NO: 62588 - protein, 29 aa, Artificial Sequence
  Description of Artificial Sequence: Synthetic peptide
DEQEIACTNPVATEQYGEASTDLEDRGER

SEQ ID NO: 62589 - protein, 30 aa, Artificial Sequence
  Description of Artificial Sequence: Synthetic polypeptide
DEQEIACTNPVATEQYGEVSATDLQREGEL

SEQ ID NO: 62590 - protein, 29 aa, Artificial Sequence
  Description of Artificial Sequence: Synthetic peptide
DEQEIACTNPVATEQYGEVSTDLEDRGEL

SEQ ID NO: 62591 - protein, 30 aa, Artificial Sequence
  Description of Artificial Sequence: Synthetic polypeptide
DEQEIACTNPVATEQYGSVSAEDLMHGNDR

SEQ ID NO: 62592 - protein, 29 aa, Artificial Sequence
  Description of Artificial Sequence: Synthetic peptide
DEQEIACTNPVATEQYGSVSTDLEHGEDL

SEQ ID NO: 62593 - protein, 30 aa, Artificial Sequence
  Description of Artificial Sequence: Synthetic polypeptide
DEPEIYTTNPVATEQYGSVSSNLIMEVGPT

SEQ ID NO: 62594 - protein, 30 aa, Artificial Sequence
  Description of Artificial Sequence: Synthetic polypeptide
DEQEIATTNPVATEQYGSMSTDLQHEGEDL

SEQ ID NO: 62595 - protein, 30 aa, Artificial Sequence
  Description of Artificial Sequence: Synthetic polypeptide
DEQEIATTNPVATEQYGSVATNLEDGDTDI

SEQ ID NO: 62596 - protein, 31 aa, Artificial Sequence
  Description of Artificial Sequence: Synthetic polypeptide
DEQEIATTNPVATEQYGSVATNLQGANEPGE

SEQ ID NO: 62597 - protein, 30 aa, Artificial Sequence
  Description of Artificial Sequence: Synthetic polypeptide
DEQEIATTNPVATEQYGSVSATGPEHEGND

SEQ ID NO: 62598 - protein, 31 aa, Artificial Sequence
  Description of Artificial Sequence: Synthetic polypeptide
DEQEIATTNPVATEQYGSVSATNLEDHEGEL

SEQ ID NO: 62599 - protein, 32 aa, Artificial Sequence
  Description of Artificial Sequence: Synthetic polypeptide
DEQEIATTNPVATEQYGSVSATNLEDHEGERL

SEQ ID NO: 62600 - protein, 32 aa, Artificial Sequence
  Description of Artificial Sequence: Synthetic polypeptide
DEQEIATTNPVATEQYGSVSATNLEDSEGNDL

SEQ ID NO: 62601 - protein, 31 aa, Artificial Sequence
  Description of Artificial Sequence: Synthetic polypeptide
DEQEIATTNPVATEQYGSVSATNLEHEGTDL

SEQ ID NO: 62602 - protein, 32 aa, Artificial Sequence
  Description of Artificial Sequence: Synthetic polypeptide
DEQEIATTNPVATEQYGSVSATNLQDHEGEDL

SEQ ID NO: 62603 - protein, 30 aa, Artificial Sequence
  Description of Artificial Sequence: Synthetic polypeptide
DEQEIATTNPVATEQYGSVSDDLQDHEGEL

SEQ ID NO: 62604 - protein, 29 aa, Artificial Sequence
  Description of Artificial Sequence: Synthetic peptide
DEQEIATTNPVATEQYGSVSEDLQHEEDK

SEQ ID NO: 62605 - protein, 31 aa, Artificial Sequence
  Description of Artificial Sequence: Synthetic polypeptide
DEQEIATTNPVATEQYGSVSENLQDHEGEDL

SEQ ID NO: 62606 - protein, 31 aa, Artificial Sequence
  Description of Artificial Sequence: Synthetic polypeptide
DEQEIATTNPVATEQYGSVSATGLEDHEGNL

SEQ ID NO: 62607 - protein, 31 aa, Artificial Sequence
  Description of Artificial Sequence: Synthetic polypeptide
DEQEIATTNPVATEQYGSVSTDLEDHEGEDR

SEQ ID NO: 62608 - protein, 30 aa, Artificial Sequence
  Description of Artificial Sequence: Synthetic polypeptide
DEQEIATTNPVATEQYGSVSTDLEDHEGEL

SEQ ID NO: 62609 - protein, 31 aa, Artificial Sequence
  Description of Artificial Sequence: Synthetic polypeptide
DEQEIATTNPVATEQYGSVSTDLEDHEGNDL

SEQ ID NO: 62610 - protein, 30 aa, Artificial Sequence
  Description of Artificial Sequence: Synthetic polypeptide
DEQEIATTNPVATEQYGSVSTDLEDHGEDL

SEQ ID NO: 62611 - protein, 30 aa, Artificial Sequence
  Description of Artificial Sequence: Synthetic polypeptide
DEQEIATTNPVATEQYGSVSTDLEDSEGEL

SEQ ID NO: 62612 - protein, 31 aa, Artificial Sequence
  Description of Artificial Sequence: Synthetic polypeptide
DEQEIATTNPVATEQYGSVSTDLPQDHEGEG

SEQ ID NO: 62613 - protein, 31 aa, Artificial Sequence
  Description of Artificial Sequence: Synthetic polypeptide
DEQEIATTNPVATEQYGSVSTIDLEDHEGNL

SEQ ID NO: 62614 - protein, 32 aa, Artificial Sequence
  Description of Artificial Sequence: Synthetic polypeptide
DEQEIATTNPVATEQYGSVSTIDLPQDHEGNG

SEQ ID NO: 62615 - protein, 31 aa, Artificial Sequence
  Description of Artificial Sequence: Synthetic polypeptide
DEQEIATTNPVATEQYGSVSTNLEDHEGEDL

SEQ ID NO: 62616 - protein, 32 aa, Artificial Sequence
  Description of Artificial Sequence: Synthetic polypeptide
DEQEIATTNPVATEQYGSVSTNLNMDGNGNNN

SEQ ID NO: 62617 - protein, 30 aa, Artificial Sequence
  Description of Artificial Sequence: Synthetic polypeptide
DEQEIATTNPVATEQYGSVSTDLEDHEGEK

SEQ ID NO: 62618 - protein, 31 aa, Artificial Sequence
  Description of Artificial Sequence: Synthetic polypeptide
DEQEIATTNPVATEQYGSVSATDLQHEGEDL

SEQ ID NO: 62619 - protein, 32 aa, Artificial Sequence
  Description of Artificial Sequence: Synthetic polypeptide
DEQEIATTNPVATEQYGSVSATDLQDREGEDL

SEQ ID NO: 62620 - protein, 32 aa, Artificial Sequence
  Description of Artificial Sequence: Synthetic polypeptide
DEQEIATTNPVATEQYGSVSATDLQDHEGEDR

SEQ ID NO: 62621 - protein, 30 aa, Artificial Sequence
  Description of Artificial Sequence: Synthetic polypeptide
DEQEIATTNPVATEQYGSVATPNLQDAPES

SEQ ID NO: 62622 - protein, 31 aa, Artificial Sequence
  Description of Artificial Sequence: Synthetic polypeptide
DEQEIATTNPVATEQYGSVSACDLEDREGNG

SEQ ID NO: 62623 - protein, 30 aa, Artificial Sequence
  Description of Artificial Sequence: Synthetic polypeptide
DEQEIATTNPVATEQYGSVSACDLQHGEDL

SEQ ID NO: 62624 - protein, 30 aa, Artificial Sequence
  Description of Artificial Sequence: Synthetic polypeptide
DEQEIATTNPVATEQYGSVSACDLQHGTDL

SEQ ID NO: 62625 - protein, 30 aa, Artificial Sequence
  Description of Artificial Sequence: Synthetic polypeptide
DEQEIATTNPVATEQYGSVSACDLQSGTDL

SEQ ID NO: 62626 - protein, 31 aa, Artificial Sequence
  Description of Artificial Sequence: Synthetic polypeptide
DEQEIATTNPVATEQYGSVSADNLEDSEGNL

SEQ ID NO: 62627 - protein, 31 aa, Artificial Sequence
  Description of Artificial Sequence: Synthetic polypeptide
DEQEIATTNPVATEQYGSVSADNLEDSEGNQ

SEQ ID NO: 62628 - protein, 31 aa, Artificial Sequence
  Description of Artificial Sequence: Synthetic polypeptide
DEQEIATTNPVATEQYGSVSAENLQDHGGDL

SEQ ID NO: 62629 - protein, 32 aa, Artificial Sequence
  Description of Artificial Sequence: Synthetic polypeptide
DEQEIATTNPVATEQYGSVSANDLQDHVGEDR

SEQ ID NO: 62630 - protein, 32 aa, Artificial Sequence
  Description of Artificial Sequence: Synthetic polypeptide
DEQEIATTNPVATEQYGSVSANDLQDREGQDL

SEQ ID NO: 62631 - protein, 30 aa, Artificial Sequence
  Description of Artificial Sequence: Synthetic polypeptide
DEQEIATTNPVATEQYGSVSASTLQDHGEI

SEQ ID NO: 62632 - protein, 30 aa, Artificial Sequence
  Description of Artificial Sequence: Synthetic polypeptide
DEQEIATTNPVATEQYGSVSASTLQDHGEL

SEQ ID NO: 62633 - protein, 29 aa, Artificial Sequence
  Description of Artificial Sequence: Synthetic peptide
DEQEIATTNPVATEQYGSVSATCLEHEEL

SEQ ID NO: 62634 - protein, 30 aa, Artificial Sequence
  Description of Artificial Sequence: Synthetic polypeptide
DEQEIATTNPVATEQYGSVSATCLQHEEEL

SEQ ID NO: 62635 - protein, 31 aa, Artificial Sequence
  Description of Artificial Sequence: Synthetic polypeptide
DEQEIATTNPVATEQYGSVSATDIQDHEGQR

SEQ ID NO: 62636 - protein, 31 aa, Artificial Sequence
  Description of Artificial Sequence: Synthetic polypeptide
DEQEIATTNPVATEQYGSVSATDLEDHEGER

SEQ ID NO: 62637 - protein, 31 aa, Artificial Sequence
  Description of Artificial Sequence: Synthetic polypeptide
DEQEIATTNPVATEQYGSVSATDLEDHEGQR

SEQ ID NO: 62638 - protein, 30 aa, Artificial Sequence
  Description of Artificial Sequence: Synthetic polypeptide
DEQEIATTNPVATEQYGSVSATDLEDHGEL

SEQ ID NO: 62639 - protein, 31 aa, Artificial Sequence
  Description of Artificial Sequence: Synthetic polypeptide
DEQEIATTNPVATEQYGSVSATDLEDSGNDL

SEQ ID NO: 62640 - protein, 30 aa, Artificial Sequence
  Description of Artificial Sequence: Synthetic polypeptide
DEQEIATTNPVATEQYGSVSATDLEHEGED

SEQ ID NO: 62641 - protein, 30 aa, Artificial Sequence
  Description of Artificial Sequence: Synthetic polypeptide
DEQEIATTNPVATEQYGSVSATDLMDHGEL

SEQ ID NO: 62642 - protein, 32 aa, Artificial Sequence
  Description of Artificial Sequence: Synthetic polypeptide
DEPEIRTTNPVATEQYGSVSLMMNLARNVNED

SEQ ID NO: 62643 - protein, 32 aa, Artificial Sequence
  Description of Artificial Sequence: Synthetic polypeptide
DEQEIATTNPVATEQYGSVSTNLNMEGGENND

SEQ ID NO: 62644 - protein, 32 aa, Artificial Sequence
  Description of Artificial Sequence: Synthetic polypeptide
DEPEIRTTNPVATEQYGSVSDTWLENRSQGRN

SEQ ID NO: 62645 - protein, 32 aa, Artificial Sequence
  Description of Artificial Sequence: Synthetic polypeptide
DEPEIRTTNPVATEQYGSVNTPNLQIRQTEED

SEQ ID NO: 62646 - protein, 31 aa, Artificial Sequence
  Description of Artificial Sequence: Synthetic polypeptide
DENEIRTTNPVATEQYGVVSTVLTIGPANNQ

SEQ ID NO: 62647 - protein, 31 aa, Artificial Sequence
  Description of Artificial Sequence: Synthetic polypeptide
DENEIRTTNPVATEQYGVVSTVMLTIGPEND

SEQ ID NO: 62648 - protein, 33 aa, Artificial Sequence
  Description of Artificial Sequence: Synthetic polypeptide
DENEIRTTNPVATEQYGYTISTNELTQRTQNRG

SEQ ID NO: 62649 - protein, 29 aa, Artificial Sequence
  Description of Artificial Sequence: Synthetic peptide
DENEIRTTNPVATETYGSVSINDVEVGTP

SEQ ID NO: 62650 - protein, 31 aa, Artificial Sequence
  Description of Artificial Sequence: Synthetic polypeptide
DENEIRTTNPVATETYGSVSLNNLQNEVNTP

SEQ ID NO: 62651 - protein, 30 aa, Artificial Sequence
  Description of Artificial Sequence: Synthetic polypeptide
DENEIRTTNPVATWHYGSVSTNLEHRTVMF

SEQ ID NO: 62652 - protein, 31 aa, Artificial Sequence
  Description of Artificial Sequence: Synthetic polypeptide
DENEIRTTNPVATWPYGSVSTNLEEHRTGEM

SEQ ID NO: 62653 - protein, 31 aa, Artificial Sequence
  Description of Artificial Sequence: Synthetic polypeptide
DENEIRTTNPVAVEQYGSISTNLEVEELNER

SEQ ID NO: 62654 - protein, 31 aa, Artificial Sequence
  Description of Artificial Sequence: Synthetic polypeptide
DENEIRTTNPVAVEQYGSISTNLEVELVNLR

SEQ ID NO: 62655 - protein, 29 aa, Artificial Sequence
  Description of Artificial Sequence: Synthetic peptide
DENEIRTTNPVATEQYGVVSTTVLTIFTD

SEQ ID NO: 62656 - protein, 32 aa, Artificial Sequence
  Description of Artificial Sequence: Synthetic polypeptide
DENEIRTTNPVAVEQYGSVISTNGLERNENGD

SEQ ID NO: 62657 - protein, 31 aa, Artificial Sequence
  Description of Artificial Sequence: Synthetic polypeptide
DENEIRTTNPVAVEQYGSVSTTNLEDEENTG

SEQ ID NO: 62658 - protein, 31 aa, Artificial Sequence
  Description of Artificial Sequence: Synthetic polypeptide
DENEIRTTNPVAVEQYGSVSTTNLENDENGG

SEQ ID NO: 62659 - protein, 31 aa, Artificial Sequence
  Description of Artificial Sequence: Synthetic polypeptide
DENEIRTTNPVAVEQYGSVSTTNNLEDENGE

SEQ ID NO: 62660 - protein, 31 aa, Artificial Sequence
  Description of Artificial Sequence: Synthetic polypeptide
DENEIRTTNPVAVEQYGSVSTTNNLEDENGT

SEQ ID NO: 62661 - protein, 31 aa, Artificial Sequence
  Description of Artificial Sequence: Synthetic polypeptide
DENEIRTTNPVAVEQYGSVSTTTNLEDEENG

SEQ ID NO: 62662 - protein, 30 aa, Artificial Sequence
  Description of Artificial Sequence: Synthetic polypeptide
DENEIRTTNPVAVEQYGSVTTTNLEDEENS

SEQ ID NO: 62663 - protein, 30 aa, Artificial Sequence
  Description of Artificial Sequence: Synthetic polypeptide
DENEIRTTNPVAVEQYGSVTTTNLEDENNG

SEQ ID NO: 62664 - protein, 30 aa, Artificial Sequence
  Description of Artificial Sequence: Synthetic polypeptide
DENEIRTTNPVAVEQYGSVTTTNLNEDENM

SEQ ID NO: 62665 - protein, 30 aa, Artificial Sequence
  Description of Artificial Sequence: Synthetic polypeptide
DENEIRTTNPVAVEQYGSVTTTNNLEDENV

SEQ ID NO: 62666 - protein, 30 aa, Artificial Sequence
  Description of Artificial Sequence: Synthetic polypeptide
DENEIRTTNPVAVEQYGSVNTTNNDEDENR

SEQ ID NO: 62667 - protein, 31 aa, Artificial Sequence
  Description of Artificial Sequence: Synthetic polypeptide
DENEIRTTNPVAYEAYGSTVSNNLSQRGGSQ

SEQ ID NO: 62668 - protein, 29 aa, Artificial Sequence
  Description of Artificial Sequence: Synthetic peptide
DENEIRTTNPVATEQYGVVSEIEQNSGDA

SEQ ID NO: 62669 - protein, 31 aa, Artificial Sequence
  Description of Artificial Sequence: Synthetic polypeptide
DENEIRTTNPVATEQYGTVVSTLLIERPNLD

SEQ ID NO: 62670 - protein, 34 aa, Artificial Sequence
  Description of Artificial Sequence: Synthetic polypeptide
DEEEIRTTNPVATEQYGSVCAANDLPQDHQGNDR

SEQ ID NO: 62671 - protein, 33 aa, Artificial Sequence
  Description of Artificial Sequence: Synthetic polypeptide
DENEIRTTNPVATEQYGSVSTYNDMQDNGQNEV

SEQ ID NO: 62672 - protein, 30 aa, Artificial Sequence
  Description of Artificial Sequence: Synthetic polypeptide
DEEEIRTTNPVATEQYGSVCAAEDQQGDDL

SEQ ID NO: 62673 - protein, 32 aa, Artificial Sequence
  Description of Artificial Sequence: Synthetic polypeptide
DEEEIRTTNPVATEQYGSVAYTESIDRGQQRQ

SEQ ID NO: 62674 - protein, 32 aa, Artificial Sequence
  Description of Artificial Sequence: Synthetic polypeptide
DENEIRTTNPVATEQYGSVSVMDLTEEGENRG

SEQ ID NO: 62675 - protein, 32 aa, Artificial Sequence
  Description of Artificial Sequence: Synthetic polypeptide
DENEIRTTNPVATEQYGSVSVMDNHQEGENMN

SEQ ID NO: 62676 - protein, 32 aa, Artificial Sequence
  Description of Artificial Sequence: Synthetic polypeptide
DENEIRTTNPVATEQYGSVSVTDMIQEGNEHV

SEQ ID NO: 62677 - protein, 33 aa, Artificial Sequence
  Description of Artificial Sequence: Synthetic polypeptide
DEEEIRTTNPVATEQYGSVATTLPNQLQENNNE

SEQ ID NO: 62678 - protein, 32 aa, Artificial Sequence
  Description of Artificial Sequence: Synthetic polypeptide
DENEIRTTNPVATEQYGSVSVWPNDQEGENDG

SEQ ID NO: 62679 - protein, 31 aa, Artificial Sequence
  Description of Artificial Sequence: Synthetic polypeptide
DENEIRTTNPVATEQYGTVVSTLLQEEPNDN

SEQ ID NO: 62680 - protein, 31 aa, Artificial Sequence
  Description of Artificial Sequence: Synthetic polypeptide
DENEIRTTNPVATEQYGSVSWNKHQEDDNIE

SEQ ID NO: 62681 - protein, 33 aa, Artificial Sequence
  Description of Artificial Sequence: Synthetic polypeptide
DENEIRTTNPVATEQYGSVSWPLQFRSGNEEMG

SEQ ID NO: 62682 - protein, 31 aa, Artificial Sequence
  Description of Artificial Sequence: Synthetic polypeptide
DENEIRTTNPVATEQYGSVSWPNDSEGMNDG

SEQ ID NO: 62683 - protein, 32 aa, Artificial Sequence
  Description of Artificial Sequence: Synthetic polypeptide
DENEIRTTNPVATEQYGSVSWPNDSQEGNDGC

SEQ ID NO: 62684 - protein, 32 aa, Artificial Sequence
  Description of Artificial Sequence: Synthetic polypeptide
DENEIRTTNPVATEQYGSVSWTLQDRSGMESG

SEQ ID NO: 62685 - protein, 32 aa, Artificial Sequence
  Description of Artificial Sequence: Synthetic polypeptide
DENEIRTTNPVATEQYGSVTTNDLEQGGQEGV

SEQ ID NO: 62686 - protein, 33 aa, Artificial Sequence
  Description of Artificial Sequence: Synthetic polypeptide
DENEIRTTNPVATEQYGSVVSTVDNLQRESQQD

SEQ ID NO: 62687 - protein, 31 aa, Artificial Sequence
  Description of Artificial Sequence: Synthetic polypeptide
DENEIRTTNPVATEQYGSVWTNMTESGENEY

SEQ ID NO: 62688 - protein, 33 aa, Artificial Sequence
  Description of Artificial Sequence: Synthetic polypeptide
DENEIRTTNPVATEQYGSVYSTDNIQRQGDQDN

SEQ ID NO: 62689 - protein, 30 aa, Artificial Sequence
  Description of Artificial Sequence: Synthetic polypeptide
DENEIRTTNPVATEQYGTVVSPLLQQRPSD

SEQ ID NO: 62690 - protein, 32 aa, Artificial Sequence
  Description of Artificial Sequence: Synthetic polypeptide
DENEIRTTNPVATEQYGSVSWPLQDDGGDNQE

SEQ ID NO: 62691 - protein, 32 aa, Artificial Sequence
  Description of Artificial Sequence: Synthetic polypeptide
DENEIRTTNPVAYEAYGSVSCGNLSQRGGTNQ

SEQ ID NO: 62692 - protein, 32 aa, Artificial Sequence
  Description of Artificial Sequence: Synthetic polypeptide
DENEIRTTNPVAYEAYGSVSNNLSQRGGTNED

SEQ ID NO: 62693 - protein, 31 aa, Artificial Sequence
  Description of Artificial Sequence: Synthetic polypeptide
DENEIRTTNPVAYEAYGSVSNNLSQRTGGTQ

SEQ ID NO: 62694 - protein, 30 aa, Artificial Sequence
  Description of Artificial Sequence: Synthetic polypeptide
DEPEIATTNPVATEQYGSVSSNLMEDNNTD

SEQ ID NO: 62695 - protein, 29 aa, Artificial Sequence
  Description of Artificial Sequence: Synthetic peptide
DEPEIATTNPVATEQYGSVSSNLMEVTVT

SEQ ID NO: 62696 - protein, 28 aa, Artificial Sequence
  Description of Artificial Sequence: Synthetic peptide
DEPEIATTNPVATEQYGVVSTLLEEPVD

SEQ ID NO: 62697 - protein, 32 aa, Artificial Sequence
  Description of Artificial Sequence: Synthetic polypeptide
DEPEIGTTNPVATEQYGSVSTGLQLQEEMGNL

SEQ ID NO: 62698 - protein, 31 aa, Artificial Sequence
  Description of Artificial Sequence: Synthetic polypeptide
DEPEIRTTNPVATDQYGCVSTNGQGEGGGNT

SEQ ID NO: 62699 - protein, 31 aa, Artificial Sequence
  Description of Artificial Sequence: Synthetic polypeptide
DEPEIRTTNPVATDQYGCVSTNGQGEGGNNP

SEQ ID NO: 62700 - protein, 31 aa, Artificial Sequence
  Description of Artificial Sequence: Synthetic polypeptide
DEPEIRTTNPVATDQYGDVSTDNGQGEGGNG

SEQ ID NO: 62701 - protein, 31 aa, Artificial Sequence
  Description of Artificial Sequence: Synthetic polypeptide
DEPEIRTTNPVATDQYGDVSTNGLEGEGNEE

SEQ ID NO: 62702 - protein, 31 aa, Artificial Sequence
  Description of Artificial Sequence: Synthetic polypeptide
DEPEIRTTNPVATDQYGTVSTNGLGEGGGNT

SEQ ID NO: 62703 - protein, 31 aa, Artificial Sequence
  Description of Artificial Sequence: Synthetic polypeptide
DEPEIATTNPVATEQYGSVSSNLDMEVGNTF

SEQ ID NO: 62704 - protein, 31 aa, Artificial Sequence
  Description of Artificial Sequence: Synthetic polypeptide
DEPEIRTTNPVATDQYGVVSTNGLEEGGGNI

SEQ ID NO: 62705 - protein, 30 aa, Artificial Sequence
  Description of Artificial Sequence: Synthetic polypeptide
DEPEIRTTNPVATDQYGVVVDDTNGERGNP

SEQ ID NO: 62706 - protein, 33 aa, Artificial Sequence
  Description of Artificial Sequence: Synthetic polypeptide
DEPEIRTTNPVATEQYGCVSTDTLIQNGGNEDR

SEQ ID NO: 62707 - protein, 31 aa, Artificial Sequence
  Description of Artificial Sequence: Synthetic polypeptide
DEPEIRTTNPVATEQYGESCTTNLQRTIDSA

SEQ ID NO: 62708 - protein, 32 aa, Artificial Sequence
  Description of Artificial Sequence: Synthetic polypeptide
DEPEIRTTNPVATEQYGETSTPNLQIRQGDSV

SEQ ID NO: 62709 - protein, 32 aa, Artificial Sequence
  Description of Artificial Sequence: Synthetic polypeptide
DEPEIRTTNPVATEQYGETTSETNLQRGDVDG

SEQ ID NO: 62710 - protein, 30 aa, Artificial Sequence
  Description of Artificial Sequence: Synthetic polypeptide
DEPEIRTTNPVATEQYGQVDTELVQSSSNG

SEQ ID NO: 62711 - protein, 31 aa, Artificial Sequence
  Description of Artificial Sequence: Synthetic polypeptide
DEPEIRTTNPVATEQYGSVILTNTGQGEGGG

SEQ ID NO: 62712 - protein, 32 aa, Artificial Sequence
  Description of Artificial Sequence: Synthetic polypeptide
DEPEIRTTNPVATEQYGSVISTNTGQDEGEGI

SEQ ID NO: 62713 - protein, 32 aa, Artificial Sequence
  Description of Artificial Sequence: Synthetic polypeptide
DEPEIRTTNPVATEQYGSVISTQNTGQGEGED

SEQ ID NO: 62714 - protein, 31 aa, Artificial Sequence
  Description of Artificial Sequence: Synthetic polypeptide
DEPEIRTTNPVATDQYGVVSTNGLGEGQGNT

SEQ ID NO: 62715 - protein, 29 aa, Artificial Sequence
  Description of Artificial Sequence: Synthetic peptide
DEPEIATTNPVATDQYGMVSSTEQFLGNR

SEQ ID NO: 62716 - protein, 30 aa, Artificial Sequence
  Description of Artificial Sequence: Synthetic polypeptide
DENVIRVTNPVATEQYGMVIETNQQRQGER

SEQ ID NO: 62717 - protein, 30 aa, Artificial Sequence
  Description of Artificial Sequence: Synthetic polypeptide
DENVIRTTNPVATHQYGNVSNTNDQEGNNQ

SEQ ID NO: 62718 - protein, 32 aa, Artificial Sequence
  Description of Artificial Sequence: Synthetic polypeptide
DENEIRTTNPVAYEPYGQSVSTNSSQRVGTRS

SEQ ID NO: 62719 - protein, 34 aa, Artificial Sequence
  Description of Artificial Sequence: Synthetic polypeptide
DENEIRTTNPVAYEQYGESVSTENELQRTQNYRE

SEQ ID NO: 62720 - protein, 29 aa, Artificial Sequence
  Description of Artificial Sequence: Synthetic peptide
DENEIRTTNPVCTEPYGVVSMDLQQQGNH

SEQ ID NO: 62721 - protein, 31 aa, Artificial Sequence
  Description of Artificial Sequence: Synthetic polypeptide
DENEIRTTNPVSTEPYGSISMEDLQQQRGNR

SEQ ID NO: 62722 - protein, 30 aa, Artificial Sequence
  Description of Artificial Sequence: Synthetic polypeptide
DENEIRTTNPVSTEQYGIVSCDLQQQNGNH

SEQ ID NO: 62723 - protein, 29 aa, Artificial Sequence
  Description of Artificial Sequence: Synthetic peptide
DENEIRTTNPVSTEQYGTISMNIQQQGNH

SEQ ID NO: 62724 - protein, 29 aa, Artificial Sequence
  Description of Artificial Sequence: Synthetic peptide
DENEIRTVNPVATEQYGVVSEIEQNSGNQ

SEQ ID NO: 62725 - protein, 28 aa, Artificial Sequence
  Description of Artificial Sequence: Synthetic peptide
DENEIRTVNPVCTEQYGVVSEIEQSGNQ

SEQ ID NO: 62726 - protein, 31 aa, Artificial Sequence
  Description of Artificial Sequence: Synthetic polypeptide
DENEISTTNPVATEQYGSAVSGNLQIEPNQM

SEQ ID NO: 62727 - protein, 30 aa, Artificial Sequence
  Description of Artificial Sequence: Synthetic polypeptide
DENEIVCTNPVATEQYGTVSAENPVQFGNR

SEQ ID NO: 62728 - protein, 28 aa, Artificial Sequence
  Description of Artificial Sequence: Synthetic peptide
DENEIVTTNPVATECYGDVSECLQHGEL

SEQ ID NO: 62729 - protein, 28 aa, Artificial Sequence
  Description of Artificial Sequence: Synthetic peptide
DENEIVTTNPVATEQYGDVSECLEHGEL

SEQ ID NO: 62730 - protein, 29 aa, Artificial Sequence
  Description of Artificial Sequence: Synthetic peptide
DENEIVTTNPVATEQYGDVSTCLVEHGEL

SEQ ID NO: 62731 - protein, 30 aa, Artificial Sequence
  Description of Artificial Sequence: Synthetic polypeptide
DENEIVTTNPVATEQYGEASTNPVEFEGNR

SEQ ID NO: 62732 - protein, 29 aa, Artificial Sequence
  Description of Artificial Sequence: Synthetic peptide
DENEIVTTNPVATEQYGTVSTIPEFEGND

SEQ ID NO: 62733 - protein, 29 aa, Artificial Sequence
  Description of Artificial Sequence: Synthetic peptide
DENNICTTNPVATEQYGCVETNPQAGNTG

SEQ ID NO: 62734 - protein, 29 aa, Artificial Sequence
  Description of Artificial Sequence: Synthetic peptide
DENNICTTNPVATEQYGCVETNPQQIGNN

SEQ ID NO: 62735 - protein, 29 aa, Artificial Sequence
  Description of Artificial Sequence: Synthetic peptide
DENTICTTNPVATEQYGCVETNPNQIGNG

SEQ ID NO: 62736 - protein, 31 aa, Artificial Sequence
  Description of Artificial Sequence: Synthetic polypeptide
DENTIRTTNPVATEQYGSFGSEPNLIEIGNR

SEQ ID NO: 62737 - protein, 29 aa, Artificial Sequence
  Description of Artificial Sequence: Synthetic peptide
DENVICTTNPVATEQYGVVETNPQAGNQT

SEQ ID NO: 62738 - protein, 30 aa, Artificial Sequence
  Description of Artificial Sequence: Synthetic polypeptide
DENVIRTTNPVATEQYGCVETENPQYGSNQ

SEQ ID NO: 62739 - protein, 32 aa, Artificial Sequence
  Description of Artificial Sequence: Synthetic polypeptide
DEPEIRTTNPVATEQYGSVSDPNGEQRVVNDN

SEQ ID NO: 62740 - protein, 32 aa, Artificial Sequence
  Description of Artificial Sequence: Synthetic polypeptide
DENEIRTTNPVATEQYGSVSTWVEDQDGGQNE

SEQ ID NO: 62741 - protein, 29 aa, Artificial Sequence
  Description of Artificial Sequence: Synthetic peptide
DEQEIATTNPVATEQYGSVSTVLEDHEEK

SEQ ID NO: 62742 - protein, 29 aa, Artificial Sequence
  Description of Artificial Sequence: Synthetic peptide
DEQEIATTNPVATEQYGVMSTDLQHEGDL

SEQ ID NO: 62743 - protein, 33 aa, Artificial Sequence
  Description of Artificial Sequence: Synthetic polypeptide
DEEEIRTTNPVATEQYGSVANTGNLDGAPGGTR

SEQ ID NO: 62744 - protein, 33 aa, Artificial Sequence
  Description of Artificial Sequence: Synthetic polypeptide
DEEEIRTTNPVATEQYGSVANTGNLDGAAATNR

SEQ ID NO: 62745 - protein, 32 aa, Artificial Sequence
  Description of Artificial Sequence: Synthetic polypeptide
DEREIRTTNPVATEQYGSVSTNDQVRVSDEDQ

SEQ ID NO: 62746 - protein, 33 aa, Artificial Sequence
  Description of Artificial Sequence: Synthetic polypeptide
DEREIRTTNPVATEQYGSVSTNEEEQDHGTSRS

SEQ ID NO: 62747 - protein, 33 aa, Artificial Sequence
  Description of Artificial Sequence: Synthetic polypeptide
DEEEIRTTNPVATEQYGSVANTDNPLAGPGETR

SEQ ID NO: 62748 - protein, 32 aa, Artificial Sequence
  Description of Artificial Sequence: Synthetic polypeptide
DEREIVTTNPVATEWYGSVCSDTPLEQRFNRD

SEQ ID NO: 62749 - protein, 29 aa, Artificial Sequence
  Description of Artificial Sequence: Synthetic peptide
DESCIETVNPVATEWYGSVSVCNLERGTR

SEQ ID NO: 62750 - protein, 28 aa, Artificial Sequence
  Description of Artificial Sequence: Synthetic peptide
DESCIRCTNPVATEQYGSVSWNFEPGVL

SEQ ID NO: 62751 - protein, 29 aa, Artificial Sequence
  Description of Artificial Sequence: Synthetic peptide
DESCIRCTNPVATEQYGSVSWNMFERGGQ

SEQ ID NO: 62752 - protein, 31 aa, Artificial Sequence
  Description of Artificial Sequence: Synthetic polypeptide
DEREIRTTNPVATEQYGSVSTNDMPMTQEVR

SEQ ID NO: 62753 - protein, 31 aa, Artificial Sequence
  Description of Artificial Sequence: Synthetic polypeptide
DEEEIRTTNPVATEQYGSVANMGNLNGAATR

SEQ ID NO: 62754 - protein, 31 aa, Artificial Sequence
  Description of Artificial Sequence: Synthetic polypeptide
DEEEIRTTNPVATEQYGSVANAGNLTGAAMR

SEQ ID NO: 62755 - protein, 29 aa, Artificial Sequence
  Description of Artificial Sequence: Synthetic peptide
DESCIRTTNPVAYEQWGCVETNPQTGNDR

SEQ ID NO: 62756 - protein, 30 aa, Artificial Sequence
  Description of Artificial Sequence: Synthetic polypeptide
DESCIRTTNPVAYEQYGAQVSTIDVQRGNQ

SEQ ID NO: 62757 - protein, 32 aa, Artificial Sequence
  Description of Artificial Sequence: Synthetic polypeptide
DESCISTTNPVATEQDGSVSTDELSQRTVGNR

SEQ ID NO: 62758 - protein, 31 aa, Artificial Sequence
  Description of Artificial Sequence: Synthetic polypeptide
DESEIACTNPVATEQWGSVSCINLPQDRGNG

SEQ ID NO: 62759 - protein, 33 aa, Artificial Sequence
  Description of Artificial Sequence: Synthetic polypeptide
DEEEIRTTNPVATEQYGSVALGNADSHRTGGNR

SEQ ID NO: 62760 - protein, 30 aa, Artificial Sequence
  Description of Artificial Sequence: Synthetic polypeptide
DESEIACTNPVATEQYGNVAENLQSRVGQR

SEQ ID NO: 62761 - protein, 28 aa, Artificial Sequence
  Description of Artificial Sequence: Synthetic peptide
DESEIAPTNPCSSEQYGIVSNNLQRGTR

SEQ ID NO: 62762 - protein, 28 aa, Artificial Sequence
  Description of Artificial Sequence: Synthetic peptide
DESEIAPTNPVSTEQYGIVSCTIQRGTR

SEQ ID NO: 62763 - protein, 30 aa, Artificial Sequence
  Description of Artificial Sequence: Synthetic polypeptide
DESCIRTTNPVAYEQWGCVETNPQRGENER

SEQ ID NO: 62764 - protein, 28 aa, Artificial Sequence
  Description of Artificial Sequence: Synthetic peptide
DESEIAPTNPVSTEQYGIVSNTIQRGTR

SEQ ID NO: 62765 - protein, 32 aa, Artificial Sequence
  Description of Artificial Sequence: Synthetic polypeptide
DEREIRTTNPVATEQYGSVSTNDMPGSGEVRI

SEQ ID NO: 62766 - protein, 32 aa, Artificial Sequence
  Description of Artificial Sequence: Synthetic polypeptide
DEREIRTTNPVATEQYGSVASTTSNIQGEVNL

SEQ ID NO: 62767 - protein, 33 aa, Artificial Sequence
  Description of Artificial Sequence: Synthetic polypeptide
DEEEIRTTNPVATEQYGSVASPNGNLQQDVPER

SEQ ID NO: 62768 - protein, 33 aa, Artificial Sequence
  Description of Artificial Sequence: Synthetic polypeptide
DEQEIRTTNPVATEQYGYTISTNEALEQEGNER

SEQ ID NO: 62769 - protein, 33 aa, Artificial Sequence
  Description of Artificial Sequence: Synthetic polypeptide
DEQEIRTTNPVATEQYGYTISTNELNQRGQNEQ

SEQ ID NO: 62770 - protein, 33 aa, Artificial Sequence
  Description of Artificial Sequence: Synthetic polypeptide
DEQEIRTTNPVATEQYGYTISTNELQEGNEDHR

SEQ ID NO: 62771 - protein, 33 aa, Artificial Sequence
  Description of Artificial Sequence: Synthetic polypeptide
DEQEIRTTNPVATEQYGYTISTNELQQEGNERA

SEQ ID NO: 62772 - protein, 35 aa, Artificial Sequence
  Description of Artificial Sequence: Synthetic polypeptide
DEEEIRTTNPVATEQYGSVASGTNNLIQEDGNGGE

SEQ ID NO: 62773 - protein, 32 aa, Artificial Sequence
  Description of Artificial Sequence: Synthetic polypeptide
DEQEIRTTNPVATEQYGYTISTNEMLQGGNEH

SEQ ID NO: 62774 - protein, 34 aa, Artificial Sequence
  Description of Artificial Sequence: Synthetic polypeptide
DEQEIRTTNPVAYEQYGCSTVACTNELSQRGNRE

SEQ ID NO: 62775 - protein, 33 aa, Artificial Sequence
  Description of Artificial Sequence: Synthetic polypeptide
DEQEIRTTNPVAYEQYGCVPSTNLSQRPGGNEA

SEQ ID NO: 62776 - protein, 31 aa, Artificial Sequence
  Description of Artificial Sequence: Synthetic polypeptide
DEREIRTTNPVATEQYGSVCSWNHQNFGSEQ

SEQ ID NO: 62777 - protein, 33 aa, Artificial Sequence
  Description of Artificial Sequence: Synthetic polypeptide
DEQEIRTTNPVAYEQYGEVSCTNLSQRPGGNAA

SEQ ID NO: 62778 - protein, 32 aa, Artificial Sequence
  Description of Artificial Sequence: Synthetic polypeptide
DEEEIRTTNPVATEQYGSVAQTMGLQNTQVNL

SEQ ID NO: 62779 - protein, 33 aa, Artificial Sequence
  Description of Artificial Sequence: Synthetic polypeptide
DEEEIRTTNPVATEQYGSVAQPTNLQPELGATF

SEQ ID NO: 62780 - protein, 29 aa, Artificial Sequence
  Description of Artificial Sequence: Synthetic peptide
DEQTICTTNPVATEQYGVVETNPQAGGNI

SEQ ID NO: 62781 - protein, 32 aa, Artificial Sequence
  Description of Artificial Sequence: Synthetic polypeptide
DEEEIRTTNPVATEQYGSVAQEGLQRGVQLFD

SEQ ID NO: 62782 - protein, 32 aa, Artificial Sequence
  Description of Artificial Sequence: Synthetic polypeptide
DEEEIRTTNPVATEQYGSVAQEGLQNGVNLDD

SEQ ID NO: 62783 - protein, 30 aa, Artificial Sequence
  Description of Artificial Sequence: Synthetic polypeptide
DEQTIVTTNPVATEQYGSVSTNLEDYGMEI

SEQ ID NO: 62784 - protein, 30 aa, Artificial Sequence
  Description of Artificial Sequence: Synthetic polypeptide
DEQVIATTNPVATEQWGSVSTDGNQRGNDQ

SEQ ID NO: 62785 - protein, 33 aa, Artificial Sequence
  Description of Artificial Sequence: Synthetic polypeptide
DEREINTTNPVATEQYGSVSTDNSLFQVRGEFE

SEQ ID NO: 62786 - protein, 31 aa, Artificial Sequence
  Description of Artificial Sequence: Synthetic polypeptide
DEREIRTTNPVATENYGSVSTDGVLQTGQTV

SEQ ID NO: 62787 - protein, 31 aa, Artificial Sequence
  Description of Artificial Sequence: Synthetic polypeptide
DEQQIRTTNPVATEQYGVVSTENLVERFTDR

SEQ ID NO: 62788 - protein, 30 aa, Artificial Sequence
  Description of Artificial Sequence: Synthetic polypeptide
DESEIASTNPIATEQYGSVAANTIQRVGNR

SEQ ID NO: 62789 - protein, 32 aa, Artificial Sequence
  Description of Artificial Sequence: Synthetic polypeptide
DEEEIRTTNPVATEQYGSVAITNDPTTANGNE

SEQ ID NO: 62790 - protein, 29 aa, Artificial Sequence
  Description of Artificial Sequence: Synthetic peptide
DESEIASTNPVATEGYGSVSATDLQHGEI

SEQ ID NO: 62791 - protein, 29 aa, Artificial Sequence
  Description of Artificial Sequence: Synthetic peptide
DEEEIRTTNPVATEQYGSVADFVGAMDVR

SEQ ID NO: 62792 - protein, 31 aa, Artificial Sequence
  Description of Artificial Sequence: Synthetic polypeptide
DESEIATTNPVATEQYGNVSANGIVQREGND

SEQ ID NO: 62793 - protein, 33 aa, Artificial Sequence
  Description of Artificial Sequence: Synthetic polypeptide
DESEIATTNPVATEQYGQTTVSCTGNSSQRGNR

SEQ ID NO: 62794 - protein, 32 aa, Artificial Sequence
  Description of Artificial Sequence: Synthetic polypeptide
DESEIATTNPVATEQYGSMSTPTLPQMRNGNV

SEQ ID NO: 62795 - protein, 32 aa, Artificial Sequence
  Description of Artificial Sequence: Synthetic polypeptide
DESEIATTNPVATEQYGSTVSCTNLSMGGNNT

SEQ ID NO: 62796 - protein, 32 aa, Artificial Sequence
  Description of Artificial Sequence: Synthetic polypeptide
DESEIATTNPVATEQYGSVAATNLQSGDNHTT

SEQ ID NO: 62797 - protein, 29 aa, Artificial Sequence
  Description of Artificial Sequence: Synthetic peptide
DESEIATTNPVATEQYGSVPEVCQREGEK

SEQ ID NO: 62798 - protein, 30 aa, Artificial Sequence
  Description of Artificial Sequence: Synthetic polypeptide
DESEIATTNPVATEQYGSVPEVEQREGENG

SEQ ID NO: 62799 - protein, 32 aa, Artificial Sequence
  Description of Artificial Sequence: Synthetic polypeptide
DESEIATTNPVATEQYGSVSANDLQDHEGEDR

SEQ ID NO: 62800 - protein, 30 aa, Artificial Sequence
  Description of Artificial Sequence: Synthetic polypeptide
DEEEIRTTNPVATEQYGSVADNLIWPTAQF

SEQ ID NO: 62801 - protein, 30 aa, Artificial Sequence
  Description of Artificial Sequence: Synthetic polypeptide
DESEIATTNPVATEQYGSVSATDLEHGEDL

SEQ ID NO: 62802 - protein, 32 aa, Artificial Sequence
  Description of Artificial Sequence: Synthetic polypeptide
DESEIATTNPVATEQYGSVSCINEPQDREGNG

SEQ ID NO: 62803 - protein, 31 aa, Artificial Sequence
  Description of Artificial Sequence: Synthetic polypeptide
DESEIATTNPVATEQYGSVSCINEPQSEGNG

SEQ ID NO: 62804 - protein, 33 aa, Artificial Sequence
  Description of Artificial Sequence: Synthetic polypeptide
DESEIATTNPVATEQYGSVSSTNLGDNQNGNVD

SEQ ID NO: 62805 - protein, 32 aa, Artificial Sequence
  Description of Artificial Sequence: Synthetic polypeptide
DESEIATTNPVATEQYGSVSTIDLPQDHEGNG

SEQ ID NO: 62806 - protein, 33 aa, Artificial Sequence
  Description of Artificial Sequence: Synthetic polypeptide
DESEIATTNPVATEQYGSVSTIDLPQDREGENG

SEQ ID NO: 62807 - protein, 32 aa, Artificial Sequence
  Description of Artificial Sequence: Synthetic polypeptide
DESEIATTNPVATEQYGSVSTPTGPQMRNGNV

SEQ ID NO: 62808 - protein, 31 aa, Artificial Sequence
  Description of Artificial Sequence: Synthetic polypeptide
DESEIATTNPVATEQYGSVSTTAGNMRGMNI

SEQ ID NO: 62809 - protein, 31 aa, Artificial Sequence
  Description of Artificial Sequence: Synthetic polypeptide
DESEIATTNPVATEQYGTVSANGIVQREGND

SEQ ID NO: 62810 - protein, 29 aa, Artificial Sequence
  Description of Artificial Sequence: Synthetic peptide
DESEIATTNPVATEQYGVVATDLQHEGDL

SEQ ID NO: 62811 - protein, 32 aa, Artificial Sequence
  Description of Artificial Sequence: Synthetic polypeptide
DESEIATTNPVATEQYGSVSATNLQDHEGEDL

SEQ ID NO: 62812 - protein, 31 aa, Artificial Sequence
  Description of Artificial Sequence: Synthetic polypeptide
DESEIATTNPVATEQYGCVSTNLNGDMGSNG

SEQ ID NO: 62813 - protein, 33 aa, Artificial Sequence
  Description of Artificial Sequence: Synthetic polypeptide
DESEIATTNPVATEQWGSVSTINLPQDREGENG

SEQ ID NO: 62814 - protein, 31 aa, Artificial Sequence
  Description of Artificial Sequence: Synthetic polypeptide
DESEIATTNPVATEQWGSVSENEPQDRGENG

SEQ ID NO: 62815 - protein, 30 aa, Artificial Sequence
  Description of Artificial Sequence: Synthetic polypeptide
DESEIASTNPVATEQWGSVSDNEPQREGNQ

SEQ ID NO: 62816 - protein, 30 aa, Artificial Sequence
  Description of Artificial Sequence: Synthetic polypeptide
DESEIASTNPVATEQYGSMSTTLQMRNGDV

SEQ ID NO: 62817 - protein, 31 aa, Artificial Sequence
  Description of Artificial Sequence: Synthetic polypeptide
DESEIASTNPVATEQYGSVATSTLPQMRGNI

SEQ ID NO: 62818 - protein, 29 aa, Artificial Sequence
  Description of Artificial Sequence: Synthetic peptide
DESEIASTNPVATEQYGSVSATDLEHGEI

SEQ ID NO: 62819 - protein, 28 aa, Artificial Sequence
  Description of Artificial Sequence: Synthetic peptide
DESEIASVNPVCTEQYGVVSDNLQSGNQ

SEQ ID NO: 62820 - protein, 31 aa, Artificial Sequence
  Description of Artificial Sequence: Synthetic polypeptide
DESEIATTNPCATEVYGSVSTNLQGEGGNNH

SEQ ID NO: 62821 - protein, 32 aa, Artificial Sequence
  Description of Artificial Sequence: Synthetic polypeptide
DEEEIRTTNPVATEQYGSVAGNGQEDEGGNTN

SEQ ID NO: 62822 - protein, 32 aa, Artificial Sequence
  Description of Artificial Sequence: Synthetic polypeptide
DEEEIRTTNPVATEQYGSVAFMNLQQTTPEND

SEQ ID NO: 62823 - protein, 30 aa, Artificial Sequence
  Description of Artificial Sequence: Synthetic polypeptide
DESEIATTNPVATEAWGSVSTNAQGDGNET

SEQ ID NO: 62824 - protein, 32 aa, Artificial Sequence
  Description of Artificial Sequence: Synthetic polypeptide
DESEIATTNPVATEAYGCTVSTGNASQRGNNR

SEQ ID NO: 62825 - protein, 31 aa, Artificial Sequence
  Description of Artificial Sequence: Synthetic polypeptide
DESEIATTNPVATEAYGCVSTNLQHNGDNET

SEQ ID NO: 62826 - protein, 30 aa, Artificial Sequence
  Description of Artificial Sequence: Synthetic polypeptide
DESEIATTNPVATECWGSVSCNEPQREGNG

SEQ ID NO: 62827 - protein, 28 aa, Artificial Sequence
  Description of Artificial Sequence: Synthetic peptide
DESEIATTNPVATEGYGSVATTLEHGDL

SEQ ID NO: 62828 - protein, 32 aa, Artificial Sequence
  Description of Artificial Sequence: Synthetic polypeptide
DESEIATTNPVATEGYGSVSANDLQSRVGEDR

SEQ ID NO: 62829 - protein, 31 aa, Artificial Sequence
  Description of Artificial Sequence: Synthetic polypeptide
DESEIATTNPVATEGYGSVSCINEQSREGQR

SEQ ID NO: 62830 - protein, 31 aa, Artificial Sequence
  Description of Artificial Sequence: Synthetic polypeptide
DESEIATTNPVATEGYGSVSCINEQSRVGQR

SEQ ID NO: 62831 - protein, 32 aa, Artificial Sequence
  Description of Artificial Sequence: Synthetic polypeptide
DESEIATTNPVATEPYGWTVSTGNHSQRTGNR

SEQ ID NO: 62832 - protein, 31 aa, Artificial Sequence
  Description of Artificial Sequence: Synthetic polypeptide
DESEIATTNPVATEQWGSASEINEPQDRGNR

SEQ ID NO: 62833 - protein, 31 aa, Artificial Sequence
  Description of Artificial Sequence: Synthetic polypeptide
DESEIATTNPVATEQWGSVSATNLQDHEGEL

SEQ ID NO: 62834 - protein, 31 aa, Artificial Sequence
  Description of Artificial Sequence: Synthetic polypeptide
DESEIATTNPVATEQWGSVSCINEPQDRGNG

SEQ ID NO: 62835 - protein, 30 aa, Artificial Sequence
  Description of Artificial Sequence: Synthetic polypeptide
DESEIATTNPVATEQWGSVSCNLQDHEGEL

SEQ ID NO: 62836 - protein, 33 aa, Artificial Sequence
  Description of Artificial Sequence: Synthetic polypeptide
DEEEIRTTNPVATEQYGSVASPNLENRQGEPDI

SEQ ID NO: 62837 - protein, 30 aa, Artificial Sequence
  Description of Artificial Sequence: Synthetic polypeptide
DEQEIATTNPVATEQYGSVSTVLEDHGEDK

SEQ ID NO: 62838 - protein, 32 aa, Artificial Sequence
  Description of Artificial Sequence: Synthetic polypeptide
DEQEIRTTNPVATEQYGYTISDTNENQEGNER

SEQ ID NO: 62839 - protein, 33 aa, Artificial Sequence
  Description of Artificial Sequence: Synthetic polypeptide
DEQEIRTTNPVATEQYGVVSTGNDLQDNGNNES

SEQ ID NO: 62840 - protein, 29 aa, Artificial Sequence
  Description of Artificial Sequence: Synthetic peptide
DEQEIATTNPVGTEQYGSVASTLQDHGEL

SEQ ID NO: 62841 - protein, 29 aa, Artificial Sequence
  Description of Artificial Sequence: Synthetic peptide
DEQEIATTNPVGTEQYGSVATTLQDHGEL

SEQ ID NO: 62842 - protein, 30 aa, Artificial Sequence
  Description of Artificial Sequence: Synthetic polypeptide
DEQEIATTNPVSSEQYGSVSTNLEDHGEDR

SEQ ID NO: 62843 - protein, 30 aa, Artificial Sequence
  Description of Artificial Sequence: Synthetic polypeptide
DEQEIATTNPVSTEQYGSVSATNLEDHGEL

SEQ ID NO: 62844 - protein, 30 aa, Artificial Sequence
  Description of Artificial Sequence: Synthetic polypeptide
DEQEIATVNPVATEQYGVVSADNLQDSGNQ

SEQ ID NO: 62845 - protein, 32 aa, Artificial Sequence
  Description of Artificial Sequence: Synthetic polypeptide
DEQEICTTNPCATEQYGSVPTNELQHDQGNGR

SEQ ID NO: 62846 - protein, 31 aa, Artificial Sequence
  Description of Artificial Sequence: Synthetic polypeptide
DEQEICTTNPIATEQWGSVPTNLQHDGDNGR

SEQ ID NO: 62847 - protein, 31 aa, Artificial Sequence
  Description of Artificial Sequence: Synthetic polypeptide
DEQEICTTNPVAYEQWGSVSTNLQSGGGNDN

SEQ ID NO: 62848 - protein, 31 aa, Artificial Sequence
  Description of Artificial Sequence: Synthetic polypeptide
DEQEIRCTNPIATEQYGSVSATNLMHEGEDR

SEQ ID NO: 62849 - protein, 30 aa, Artificial Sequence
  Description of Artificial Sequence: Synthetic polypeptide
DEQEIATTNPVCTEQYGSVSTDLEHEGNDL

SEQ ID NO: 62850 - protein, 29 aa, Artificial Sequence
  Description of Artificial Sequence: Synthetic peptide
DEQEIRCTNPIATEQYGSVSENLMHEGEL

SEQ ID NO: 62851 - protein, 31 aa, Artificial Sequence
  Description of Artificial Sequence: Synthetic polypeptide
DEQEIRCTNPVATEQYGSVSATDLMHEGNDL

SEQ ID NO: 62852 - protein, 30 aa, Artificial Sequence
  Description of Artificial Sequence: Synthetic polypeptide
DEQEIRCTNPVATEQYGSVSENLMHEGEDL

SEQ ID NO: 62853 - protein, 30 aa, Artificial Sequence
  Description of Artificial Sequence: Synthetic polypeptide
DEQEIRTTNPVATCQYGAVSTNLEVEQLNP

SEQ ID NO: 62854 - protein, 32 aa, Artificial Sequence
  Description of Artificial Sequence: Synthetic polypeptide
DEQEIRTTNPVATECWGSVSCINLQDREGENG

SEQ ID NO: 62855 - protein, 33 aa, Artificial Sequence
  Description of Artificial Sequence: Synthetic polypeptide
DEEEIRTTNPVATEQYGSVASTVTDDQEGNGDE

SEQ ID NO: 62856 - protein, 34 aa, Artificial Sequence
  Description of Artificial Sequence: Synthetic polypeptide
DEQEIRTTNPVATECYGSVSTGNDLQDERGGNHS

SEQ ID NO: 62857 - protein, 32 aa, Artificial Sequence
  Description of Artificial Sequence: Synthetic polypeptide
DEQEIRTTNPVATEQWGSVSTINEEDREGENG

SEQ ID NO: 62858 - protein, 33 aa, Artificial Sequence
  Description of Artificial Sequence: Synthetic polypeptide
DEQEIRTTNPVATEQWGSVSTINEPQDREGENG

SEQ ID NO: 62859 - protein, 31 aa, Artificial Sequence
  Description of Artificial Sequence: Synthetic polypeptide
DEQEIRTTNPVATEQYGCVSTNLEMDDNDEI

SEQ ID NO: 62860 - protein, 31 aa, Artificial Sequence
  Description of Artificial Sequence: Synthetic polypeptide
DEQEIRCTNPVATEQYGSVSATDLEHEGNDL

SEQ ID NO: 62861 - protein, 32 aa, Artificial Sequence
  Description of Artificial Sequence: Synthetic polypeptide
DEQEIRTTNPVATEQYGCVSTNLLHEDGENSG

SEQ ID NO: 62862 - protein, 29 aa, Artificial Sequence
  Description of Artificial Sequence: Synthetic peptide
DEQEIATTNPVCTEQYGSVSDNLESEGEL

SEQ ID NO: 62863 - protein, 30 aa, Artificial Sequence
  Description of Artificial Sequence: Synthetic polypeptide
DEQEIATTNPVAYERYGSVSTNPQGDGNME

SEQ ID NO: 62864 - protein, 29 aa, Artificial Sequence
  Description of Artificial Sequence: Synthetic peptide
DEQEIATTNPVATEQYGVMSTDLQHEGEL

SEQ ID NO: 62865 - protein, 29 aa, Artificial Sequence
  Description of Artificial Sequence: Synthetic peptide
DEQEIATTNPVATEQYGVMSTTLQHEGDL

SEQ ID NO: 62866 - protein, 29 aa, Artificial Sequence
  Description of Artificial Sequence: Synthetic peptide
DEQEIATTNPVATEQYGVVSTDLEHEGEL

SEQ ID NO: 62867 - protein, 31 aa, Artificial Sequence
  Description of Artificial Sequence: Synthetic polypeptide
DEQEIATTNPVATETYGTVSTNLQGNTGDNQ

SEQ ID NO: 62868 - protein, 31 aa, Artificial Sequence
  Description of Artificial Sequence: Synthetic polypeptide
DEQEIATTNPVAYEQWGSVSTNLQEGGENEH

SEQ ID NO: 62869 - protein, 30 aa, Artificial Sequence
  Description of Artificial Sequence: Synthetic polypeptide
DEQEIATTNPVAYEQWGSVSTNLQGDSNDN

SEQ ID NO: 62870 - protein, 30 aa, Artificial Sequence
  Description of Artificial Sequence: Synthetic polypeptide
DEQEIATTNPVAYEQWGVVSTGNLQDSGNE

SEQ ID NO: 62871 - protein, 29 aa, Artificial Sequence
  Description of Artificial Sequence: Synthetic peptide
DEQEIATTNPVAYEQYGSVAAANDQMGND

SEQ ID NO: 62872 - protein, 31 aa, Artificial Sequence
  Description of Artificial Sequence: Synthetic polypeptide
DEQEIATTNPVAYEQYGSVAAANNLQAGNRQ

SEQ ID NO: 62873 - protein, 30 aa, Artificial Sequence
  Description of Artificial Sequence: Synthetic polypeptide
DEQEIATTNPVAYERYGSVSTNPQGGMNMG

SEQ ID NO: 62874 - protein, 30 aa, Artificial Sequence
  Description of Artificial Sequence: Synthetic polypeptide
DEQEIATTNPVAYEQYGSVAATNDDRGNDF

SEQ ID NO: 62875 - protein, 31 aa, Artificial Sequence
  Description of Artificial Sequence: Synthetic polypeptide
DEQEIATTNPVAYEQYGSVAATNDQRGDNTD

SEQ ID NO: 62876 - protein, 30 aa, Artificial Sequence
  Description of Artificial Sequence: Synthetic polypeptide
DEQEIATTNPVAYEQYGSVAATNDQRTNDQ

SEQ ID NO: 62877 - protein, 31 aa, Artificial Sequence
  Description of Artificial Sequence: Synthetic polypeptide
DEQEIATTNPVAYEQYGSVAATNDQSGNPRF

SEQ ID NO: 62878 - protein, 31 aa, Artificial Sequence
  Description of Artificial Sequence: Synthetic polypeptide
DEQEIATTNPVAYEQYGSVSTGNLPGEDGNV

SEQ ID NO: 62879 - protein, 31 aa, Artificial Sequence
  Description of Artificial Sequence: Synthetic polypeptide
DEQEIATTNPVAYEQYGSVSTGNLPQDDNNS

SEQ ID NO: 62880 - protein, 32 aa, Artificial Sequence
  Description of Artificial Sequence: Synthetic polypeptide
DEQEIATTNPVAYEQYGSVSTGNLPQGEHGNV

SEQ ID NO: 62881 - protein, 31 aa, Artificial Sequence
  Description of Artificial Sequence: Synthetic polypeptide
DEQEIATTNPVAYEQYGTVSTNLQAQGGNDA

SEQ ID NO: 62882 - protein, 29 aa, Artificial Sequence
  Description of Artificial Sequence: Synthetic peptide
DEQEIATTNPVAYERYGEVSTNPQGNGNM

SEQ ID NO: 62883 - protein, 30 aa, Artificial Sequence
  Description of Artificial Sequence: Synthetic polypeptide
DEQEIATTNPVAYERYGSVSTNPQDAGNME

SEQ ID NO: 62884 - protein, 30 aa, Artificial Sequence
  Description of Artificial Sequence: Synthetic polypeptide
DEQEIATTNPVAYEQYGSVAATNDQQGNDT

SEQ ID NO: 62885 - protein, 31 aa, Artificial Sequence
  Description of Artificial Sequence: Synthetic polypeptide
DEQEIRTTNPVATEQYGDTSTNLQQEGVDSV

SEQ ID NO: 62886 - protein, 30 aa, Artificial Sequence
  Description of Artificial Sequence: Synthetic polypeptide
DEQEIRTTNPVATEQYGDVSTDLEDHAGEL

SEQ ID NO: 62887 - protein, 30 aa, Artificial Sequence
  Description of Artificial Sequence: Synthetic polypeptide
DEQEIRTTNPVATEQYGNTSNTNLGGTTQR

SEQ ID NO: 62888 - protein, 34 aa, Artificial Sequence
  Description of Artificial Sequence: Synthetic polypeptide
DEQEIRTTNPVATEQYGSVSTQNLNQLREGTLVF

SEQ ID NO: 62889 - protein, 32 aa, Artificial Sequence
  Description of Artificial Sequence: Synthetic polypeptide
DEQEIRTTNPVATEQYGSVSTTALEDHEGNDL

SEQ ID NO: 62890 - protein, 32 aa, Artificial Sequence
  Description of Artificial Sequence: Synthetic polypeptide
DEQEIRTTNPVATEQYGSVSTTNLEQELEVDS

SEQ ID NO: 62891 - protein, 33 aa, Artificial Sequence
  Description of Artificial Sequence: Synthetic polypeptide
DEQEIRTTNPVATEQYGSVSTTVLNLEFRGDGQ

SEQ ID NO: 62892 - protein, 30 aa, Artificial Sequence
  Description of Artificial Sequence: Synthetic polypeptide
DEQEIRTTNPVATEQYGSVSVDEQELNNSV

SEQ ID NO: 62893 - protein, 33 aa, Artificial Sequence
  Description of Artificial Sequence: Synthetic polypeptide
DEEEIRTTNPVATEQYGSVASTHNQDPSTPNDR

SEQ ID NO: 62894 - protein, 31 aa, Artificial Sequence
  Description of Artificial Sequence: Synthetic polypeptide
DEQEIRTTNPVATEQYGSVSVTDIERGTEFD

SEQ ID NO: 62895 - protein, 32 aa, Artificial Sequence
  Description of Artificial Sequence: Synthetic polypeptide
DEQEIRTTNPVATEQYGSVSVTMLDQEVINNQ

SEQ ID NO: 62896 - protein, 32 aa, Artificial Sequence
  Description of Artificial Sequence: Synthetic polypeptide
DEQEIRTTNPVATEQYGSVSVTMLDQEVNNEN

SEQ ID NO: 62897 - protein, 32 aa, Artificial Sequence
  Description of Artificial Sequence: Synthetic polypeptide
DEQEIRTTNPVATEQYGSVSTPNDLERESVQG

SEQ ID NO: 62898 - protein, 34 aa, Artificial Sequence
  Description of Artificial Sequence: Synthetic polypeptide
DEEEIRTTNPVATEQYGSVASTGNGVQTGGNGGG

SEQ ID NO: 62899 - protein, 31 aa, Artificial Sequence
  Description of Artificial Sequence: Synthetic polypeptide
DEQEIRTTNPVATEQYGSVSWTWPLQETEEQ

SEQ ID NO: 62900 - protein, 34 aa, Artificial Sequence
  Description of Artificial Sequence: Synthetic polypeptide
DEQEIRTTNPVATEQYGSVTTNNGVQREGNEERL

SEQ ID NO: 62901 - protein, 31 aa, Artificial Sequence
  Description of Artificial Sequence: Synthetic polypeptide
DEQEIRTTNPVATEQYGSVTVNLVIVGENTD

SEQ ID NO: 62902 - protein, 32 aa, Artificial Sequence
  Description of Artificial Sequence: Synthetic polypeptide
DEQEIRTTNPVATEQYGSVWPTNLEPGDNNQG

SEQ ID NO: 62903 - protein, 32 aa, Artificial Sequence
  Description of Artificial Sequence: Synthetic polypeptide
DEQEIRTTNPVATEQYGSVWVTMLDQEENNDR

SEQ ID NO: 62904 - protein, 30 aa, Artificial Sequence
  Description of Artificial Sequence: Synthetic polypeptide
DEQEIRTTNPVATEQYGTVGAANLEDAENR

SEQ ID NO: 62905 - protein, 32 aa, Artificial Sequence
  Description of Artificial Sequence: Synthetic polypeptide
DEQEIRTTNPVATEQYGTVSATDLQDHNGNDH

SEQ ID NO: 62906 - protein, 34 aa, Artificial Sequence
  Description of Artificial Sequence: Synthetic polypeptide
DEEEIRTTNPVATEQYGSVASPTGNLGQNPNVNN

SEQ ID NO: 62907 - protein, 31 aa, Artificial Sequence
  Description of Artificial Sequence: Synthetic polypeptide
DEQEIRTTNPVATEQYGVVSCEMNLCQGNDY

SEQ ID NO: 62908 - protein, 31 aa, Artificial Sequence
  Description of Artificial Sequence: Synthetic polypeptide
DEQEIRTTNPVATEQYGSVSWTWPLQDTEQI

SEQ ID NO: 62909 - protein, 31 aa, Artificial Sequence
  Description of Artificial Sequence: Synthetic polypeptide
DEQEIRTTNPVATEQYGSVSTILEDAEGEDA

SEQ ID NO: 62910 - protein, 31 aa, Artificial Sequence
  Description of Artificial Sequence: Synthetic polypeptide
DEQEIRTTNPVATEQYGSVSTIDEEDHEGNG

SEQ ID NO: 62911 - protein, 32 aa, Artificial Sequence
  Description of Artificial Sequence: Synthetic polypeptide
DEQEIRTTNPVATEQYGSVSTDNMNDERIQNN

SEQ ID NO: 62912 - protein, 30 aa, Artificial Sequence
  Description of Artificial Sequence: Synthetic polypeptide
DEQEIRTTNPVATEQYGSCSNAPLQEGIDM

SEQ ID NO: 62913 - protein, 31 aa, Artificial Sequence
  Description of Artificial Sequence: Synthetic polypeptide
DEQEIRTTNPVATEQYGSCSTTNLHEGGEDG

SEQ ID NO: 62914 - protein, 31 aa, Artificial Sequence
  Description of Artificial Sequence: Synthetic polypeptide
DEQEIRTTNPVATEQYGSSSTNTSQHEGEDN

SEQ ID NO: 62915 - protein, 33 aa, Artificial Sequence
  Description of Artificial Sequence: Synthetic polypeptide
DEQEIRTTNPVATEQYGSVNTVNLQPIGPEERV

SEQ ID NO: 62916 - protein, 32 aa, Artificial Sequence
  Description of Artificial Sequence: Synthetic polypeptide
DEQEIRTTNPVATEQYGSVNTWALQEGNMFDQ

SEQ ID NO: 62917 - protein, 32 aa, Artificial Sequence
  Description of Artificial Sequence: Synthetic polypeptide
DEQEIRTTNPVATEQYGSVSACNLEDHEGENG

SEQ ID NO: 62918 - protein, 31 aa, Artificial Sequence
  Description of Artificial Sequence: Synthetic polypeptide
DEQEIRTTNPVATEQYGSVSAEDLEDHGNDL

SEQ ID NO: 62919 - protein, 31 aa, Artificial Sequence
  Description of Artificial Sequence: Synthetic polypeptide
DEQEIRTTNPVATEQYGSVSAEDLMDHGNDL

SEQ ID NO: 62920 - protein, 31 aa, Artificial Sequence
  Description of Artificial Sequence: Synthetic polypeptide
DEQEIRTTNPVATEQYGSVSAENLMHEGEDL

SEQ ID NO: 62921 - protein, 31 aa, Artificial Sequence
  Description of Artificial Sequence: Synthetic polypeptide
DEQEIRTTNPVATEQYGSVSATDEQDHEGEG

SEQ ID NO: 62922 - protein, 31 aa, Artificial Sequence
  Description of Artificial Sequence: Synthetic polypeptide
DEQEIRTTNPVATEQYGSVSATDLEDHEGEG

SEQ ID NO: 62923 - protein, 32 aa, Artificial Sequence
  Description of Artificial Sequence: Synthetic polypeptide
DEQEIRTTNPVATEQYGSVSATDLEDHEGNDL

SEQ ID NO: 62924 - protein, 32 aa, Artificial Sequence
  Description of Artificial Sequence: Synthetic polypeptide
DEQEIRTTNPVATEQYGSVSATDLEDREGEDL

SEQ ID NO: 62925 - protein, 32 aa, Artificial Sequence
  Description of Artificial Sequence: Synthetic polypeptide
DEQEIRTTNPVATEQYGSVSATDLQDHEGEDG

SEQ ID NO: 62926 - protein, 32 aa, Artificial Sequence
  Description of Artificial Sequence: Synthetic polypeptide
DEQEIRTTNPVATEQYGSVSATDLQDHEGEDL

SEQ ID NO: 62927 - protein, 30 aa, Artificial Sequence
  Description of Artificial Sequence: Synthetic polypeptide
DEQEIRTTNPVATEQYGSVSCDEQDHEGEG

SEQ ID NO: 62928 - protein, 33 aa, Artificial Sequence
  Description of Artificial Sequence: Synthetic polypeptide
DEQEIRTTNPVATEQYGSVSINLEQMEGENTEE

SEQ ID NO: 62929 - protein, 32 aa, Artificial Sequence
  Description of Artificial Sequence: Synthetic polypeptide
DEQEIRTTNPVATEQYGSVSINLEVPEGNTEE

SEQ ID NO: 62930 - protein, 33 aa, Artificial Sequence
  Description of Artificial Sequence: Synthetic polypeptide
DEQEIRTTNPVATEQYGSVSMNGVQEEGQNDRL

SEQ ID NO: 62931 - protein, 31 aa, Artificial Sequence
  Description of Artificial Sequence: Synthetic polypeptide
DEQEIRTTNPVATEQYGSVSPTDLEQESQEQ

SEQ ID NO: 62932 - protein, 33 aa, Artificial Sequence
  Description of Artificial Sequence: Synthetic polypeptide
DEQEIRTTNPVATEQYGSVSSTIWNNQEGQDNE

SEQ ID NO: 62933 - protein, 34 aa, Artificial Sequence
  Description of Artificial Sequence: Synthetic polypeptide
DEEEIRTTNPVATEQYGSVASPQGNELTQDVNER

SEQ ID NO: 62934 - protein, 31 aa, Artificial Sequence
  Description of Artificial Sequence: Synthetic polypeptide
DEETICTTNPVATEFYGSVNTNTGQGRGQNI

SEQ ID NO: 62935 - protein, 32 aa, Artificial Sequence
  Description of Artificial Sequence: Synthetic polypeptide
DENEIRTTNPVATEQYGSVSTWNMTENGENFP

SEQ ID NO: 62936 - protein, 33 aa, Artificial Sequence
  Description of Artificial Sequence: Synthetic polypeptide
DEEEIRTTNPVATEQYGSVCAANPLQEADNERQ

SEQ ID NO: 62937 - protein, 32 aa, Artificial Sequence
  Description of Artificial Sequence: Synthetic polypeptide
DEEEIRTTNPVATEQYGSVCSPTLLEDPGDED

SEQ ID NO: 62938 - protein, 31 aa, Artificial Sequence
  Description of Artificial Sequence: Synthetic polypeptide
DEEEIRTTNPVATEQYGSVCSPTDLENIDFT

SEQ ID NO: 62939 - protein, 32 aa, Artificial Sequence
  Description of Artificial Sequence: Synthetic polypeptide
DEEEIRTTNPVATEQYGSVCSPTALEHREDID

SEQ ID NO: 62940 - protein, 29 aa, Artificial Sequence
  Description of Artificial Sequence: Synthetic peptide
DENEIATTNPVATESYGSVPNNLQEHGTS

SEQ ID NO: 62941 - protein, 32 aa, Artificial Sequence
  Description of Artificial Sequence: Synthetic polypeptide
DEEEIRTTNPVATEQYGSVCSPNLPFVIENVH

SEQ ID NO: 62942 - protein, 34 aa, Artificial Sequence
  Description of Artificial Sequence: Synthetic polypeptide
DEEEIRTTNPVATEQYGSVCSPNKLQMRSQHSRD

SEQ ID NO: 62943 - protein, 33 aa, Artificial Sequence
  Description of Artificial Sequence: Synthetic polypeptide
DEEEIRTTNPVATEQYGSVCSPMNLERENGDFD

SEQ ID NO: 62944 - protein, 30 aa, Artificial Sequence
  Description of Artificial Sequence: Synthetic polypeptide
DENEIATTNPVAYDPHYGSVSTNLQRNNDM

SEQ ID NO: 62945 - protein, 30 aa, Artificial Sequence
  Description of Artificial Sequence: Synthetic polypeptide
DENEIATTNPVAYEPYGSVAATNLQQGNDQ

SEQ ID NO: 62946 - protein, 33 aa, Artificial Sequence
  Description of Artificial Sequence: Synthetic polypeptide
DEEEIRTTNPVATEQYGSVCSPTLLEGRNGEFQ

SEQ ID NO: 62947 - protein, 30 aa, Artificial Sequence
  Description of Artificial Sequence: Synthetic polypeptide
DENEIATTNPVAYEPYGSVATNLQDGDNND

SEQ ID NO: 62948 - protein, 31 aa, Artificial Sequence
  Description of Artificial Sequence: Synthetic polypeptide
DENEIATTNPVAYEQYGSVAITNLQRTNDQE

SEQ ID NO: 62949 - protein, 30 aa, Artificial Sequence
  Description of Artificial Sequence: Synthetic polypeptide
DENEIATTNPVAYEQYGSVATNLQGVENDD

SEQ ID NO: 62950 - protein, 33 aa, Artificial Sequence
  Description of Artificial Sequence: Synthetic polypeptide
DEEEIRTTNPVATEQYGSVCSNWNTQNFGSNQS

SEQ ID NO: 62951 - protein, 30 aa, Artificial Sequence
  Description of Artificial Sequence: Synthetic polypeptide
DENEIATTNPVAYEQYGSVATNLTDDGNDA

SEQ ID NO: 62952 - protein, 34 aa, Artificial Sequence
  Description of Artificial Sequence: Synthetic polypeptide
DEEEIRTTNPVATEQYGSVCSNWGELQNFGSNRG

SEQ ID NO: 62953 - protein, 30 aa, Artificial Sequence
  Description of Artificial Sequence: Synthetic polypeptide
DENEIATTNPVSTEQYGSVATNLQDGGDQP

SEQ ID NO: 62954 - protein, 28 aa, Artificial Sequence
  Description of Artificial Sequence: Synthetic peptide
DENEIATVNPVATEQYGDVSDNLMAGDA

SEQ ID NO: 62955 - protein, 33 aa, Artificial Sequence
  Description of Artificial Sequence: Synthetic polypeptide
DEEEIRTTNPVATEQYGSVCSNTPLQENGSDQS

SEQ ID NO: 62956 - protein, 28 aa, Artificial Sequence
  Description of Artificial Sequence: Synthetic peptide
DENEIATVNPVATEQYGDVSENLMAGDA

SEQ ID NO: 62957 - protein, 30 aa, Artificial Sequence
  Description of Artificial Sequence: Synthetic polypeptide
DENEIATTNPVAYEQYGSVAATNDDRGNDQ

SEQ ID NO: 62958 - protein, 28 aa, Artificial Sequence
  Description of Artificial Sequence: Synthetic peptide
DENEIATVNPVCTEQYGDVSDNLQAGDA

SEQ ID NO: 62959 - protein, 30 aa, Artificial Sequence
  Description of Artificial Sequence: Synthetic polypeptide
DENEIATTNPVATEQYGSVSTILENAAGDA

SEQ ID NO: 62960 - protein, 35 aa, Artificial Sequence
  Description of Artificial Sequence: Synthetic polypeptide
DEEEIRTTNPVATEQYGSVCSPTNLDQTRVEDNND

SEQ ID NO: 62961 - protein, 31 aa, Artificial Sequence
  Description of Artificial Sequence: Synthetic polypeptide
DENEIATTNPVATEQYGSVATNLQGAGEGHH

SEQ ID NO: 62962 - protein, 32 aa, Artificial Sequence
  Description of Artificial Sequence: Synthetic polypeptide
DENEIATTNPVATEQYGSVATNLQNGDNEAQN

SEQ ID NO: 62963 - protein, 32 aa, Artificial Sequence
  Description of Artificial Sequence: Synthetic polypeptide
DENEIATTNPVATEQYGSVATNLQNGENELAN

SEQ ID NO: 62964 - protein, 32 aa, Artificial Sequence
  Description of Artificial Sequence: Synthetic polypeptide
DENEIATTNPVATEQYGSVATNLQNGNNEDAH

SEQ ID NO: 62965 - protein, 32 aa, Artificial Sequence
  Description of Artificial Sequence: Synthetic polypeptide
DENEIATTNPVATEQYGSVATNLQNGNNNDQW

SEQ ID NO: 62966 - protein, 34 aa, Artificial Sequence
  Description of Artificial Sequence: Synthetic polypeptide
DEEEIRTTNPVATEQYGSVCSPTNLHERNGSDID

SEQ ID NO: 62967 - protein, 33 aa, Artificial Sequence
  Description of Artificial Sequence: Synthetic polypeptide
DEEEIRTTNPVATEQYGSVCSPTNLERNVEQEP

SEQ ID NO: 62968 - protein, 33 aa, Artificial Sequence
  Description of Artificial Sequence: Synthetic polypeptide
DENEIATTNPVATEQYGSVCSATNLPQEHGNDQ

SEQ ID NO: 62969 - protein, 32 aa, Artificial Sequence
  Description of Artificial Sequence: Synthetic polypeptide
DENEIATTNPVATEQYGSVCSGTNGLERESND

SEQ ID NO: 62970 - protein, 30 aa, Artificial Sequence
  Description of Artificial Sequence: Synthetic polypeptide
DENEIATTNPVATEQYGSVSTDLEHEGEDL

SEQ ID NO: 62971 - protein, 33 aa, Artificial Sequence
  Description of Artificial Sequence: Synthetic polypeptide
DENEIATTNPVATEQYGSVCSPTNGLQTRDGDL

SEQ ID NO: 62972 - protein, 31 aa, Artificial Sequence
  Description of Artificial Sequence: Synthetic polypeptide
DENEIATTNPVATEQYGSVSAEDLEDRGGDR

SEQ ID NO: 62973 - protein, 31 aa, Artificial Sequence
  Description of Artificial Sequence: Synthetic polypeptide
DENEIATTNPVATEQYGSVSAEDLQDRGEDL

SEQ ID NO: 62974 - protein, 31 aa, Artificial Sequence
  Description of Artificial Sequence: Synthetic polypeptide
DENEIATTNPVATEQYGSVSAENLQDHGGDL

SEQ ID NO: 62975 - protein, 33 aa, Artificial Sequence
  Description of Artificial Sequence: Synthetic polypeptide
DEEEIRTTNPVATEQYGSVCSPTNLERESEIDI

SEQ ID NO: 62976 - protein, 31 aa, Artificial Sequence
  Description of Artificial Sequence: Synthetic polypeptide
DENEIATTNPVATEQYGSVSATNLEDHEGEL

SEQ ID NO: 62977 - protein, 29 aa, Artificial Sequence
  Description of Artificial Sequence: Synthetic peptide
DENEIATTNPVATEQYGSVSEPAGQHGEL

SEQ ID NO: 62978 - protein, 32 aa, Artificial Sequence
  Description of Artificial Sequence: Synthetic polypeptide
DEEEIRTTNPVATEQYGSVCSPTNLELEEQFI

SEQ ID NO: 62979 - protein, 30 aa, Artificial Sequence
  Description of Artificial Sequence: Synthetic polypeptide
DENEIATTNPVATEQYGSVSSEPAGQHGNL

SEQ ID NO: 62980 - protein, 29 aa, Artificial Sequence
  Description of Artificial Sequence: Synthetic peptide
DENEIATTNPVATEQYGSVSTDLEDHEEL

SEQ ID NO: 62981 - protein, 34 aa, Artificial Sequence
  Description of Artificial Sequence: Synthetic polypeptide
DENEIATTNPVATEQYGSVCSTNPLQQMGENERP

SEQ ID NO: 62982 - protein, 28 aa, Artificial Sequence
  Description of Artificial Sequence: Synthetic peptide
DENEIATVNPVCTEQYGDVSDNLQSGDA

SEQ ID NO: 62983 - protein, 32 aa, Artificial Sequence
  Description of Artificial Sequence: Synthetic polypeptide
DENEIGTTNPVATEQYGQVITNQLQERMGNWT

SEQ ID NO: 62984 - protein, 30 aa, Artificial Sequence
  Description of Artificial Sequence: Synthetic polypeptide
DENEIRCTNPIATEPYGSVSEDLQMRNGNH

SEQ ID NO: 62985 - protein, 29 aa, Artificial Sequence
  Description of Artificial Sequence: Synthetic peptide
DENEIRTTNPIATEQYGDVSENEMRAENA

SEQ ID NO: 62986 - protein, 32 aa, Artificial Sequence
  Description of Artificial Sequence: Synthetic polypeptide
DEEEIRTTNPVATEQYGSVCSNTELQSNSDQA

SEQ ID NO: 62987 - protein, 33 aa, Artificial Sequence
  Description of Artificial Sequence: Synthetic polypeptide
DEEEIRTTNPVATEQYGSVCSNTELQNIGSDQE

SEQ ID NO: 62988 - protein, 30 aa, Artificial Sequence
  Description of Artificial Sequence: Synthetic polypeptide
DENEIRTTNPVATDQYGAVSTNVEVRQMNP

SEQ ID NO: 62989 - protein, 31 aa, Artificial Sequence
  Description of Artificial Sequence: Synthetic polypeptide
DENEIRTTNPVATDQYGSVNTQLEQVRQLND

SEQ ID NO: 62990 - protein, 31 aa, Artificial Sequence
  Description of Artificial Sequence: Synthetic polypeptide
DENEIRTTNPVATDQYGSVNTQLQHIRQAND

SEQ ID NO: 62991 - protein, 33 aa, Artificial Sequence
  Description of Artificial Sequence: Synthetic polypeptide
DEEEIRTTNPVATEQYGSVCSNSNHQFFGSDRD

SEQ ID NO: 62992 - protein, 34 aa, Artificial Sequence
  Description of Artificial Sequence: Synthetic polypeptide
DEEEIRTTNPVATEQYGSVCSNSEELQRFGSNQG

SEQ ID NO: 62993 - protein, 32 aa, Artificial Sequence
  Description of Artificial Sequence: Synthetic polypeptide
DENEIRTTNPVATEAYGSTVSCANLSQRGGTV

SEQ ID NO: 62994 - protein, 34 aa, Artificial Sequence
  Description of Artificial Sequence: Synthetic polypeptide
DEEEIRTTNPVATEQYGSVCSNTENLQGFGSQQS

SEQ ID NO: 62995 - protein, 33 aa, Artificial Sequence
  Description of Artificial Sequence: Synthetic polypeptide
DEEEIRTTNPVATEQYGSVCSNNLEQVRPMEET

SEQ ID NO: 62996 - protein, 28 aa, Artificial Sequence
  Description of Artificial Sequence: Synthetic peptide
DENEIRTTNPVATECWGDVSECLQHENL

SEQ ID NO: 62997 - protein, 33 aa, Artificial Sequence
  Description of Artificial Sequence: Synthetic polypeptide
DEEEIRTTNPVATEQYGSVCSMTNHQYFGSQQA

SEQ ID NO: 62998 - protein, 34 aa, Artificial Sequence
  Description of Artificial Sequence: Synthetic polypeptide
DEEEIRTTNPVATEQYGSVCSMTNDLQYFGSEQA

SEQ ID NO: 62999 - protein, 29 aa, Artificial Sequence
  Description of Artificial Sequence: Synthetic peptide
DENEIRTTNPVATECWGDVSENLPQHGEL

SEQ ID NO: 63000 - protein, 31 aa, Artificial Sequence
  Description of Artificial Sequence: Synthetic polypeptide
DENEIRTTNPVATECWGEVSCNLPQREGENG

SEQ ID NO: 63001 - protein, 33 aa, Artificial Sequence
  Description of Artificial Sequence: Synthetic polypeptide
DEEEIRTTNPVATEQYGSVCSMSNLQHFGSDQS

SEQ ID NO: 63002 - protein, 30 aa, Artificial Sequence
  Description of Artificial Sequence: Synthetic polypeptide
DENEIRTTNPVATECWGSVSCIEQDREGNG

SEQ ID NO: 63003 - protein, 33 aa, Artificial Sequence
  Description of Artificial Sequence: Synthetic polypeptide
DEEEIRTTNPVATEQYGSVCSMNNNLPRDVPNA

SEQ ID NO: 63004 - protein, 30 aa, Artificial Sequence
  Description of Artificial Sequence: Synthetic polypeptide
DENEIRTTNPVATECWGSVSCINEQHEGNG

SEQ ID NO: 63005 - protein, 32 aa, Artificial Sequence
  Description of Artificial Sequence: Synthetic polypeptide
DENEIRTTNPVATEAYGSVSNTNLQQGSTTTN

SEQ ID NO: 63006 - protein, 33 aa, Artificial Sequence
  Description of Artificial Sequence: Synthetic polypeptide
DEEEIRTTNPVATEQYGSVCSNTETQNFGSNQT

SEQ ID NO: 63007 - protein, 34 aa, Artificial Sequence
  Description of Artificial Sequence: Synthetic polypeptide
DEEEIRTTNPVATEQYGSVCSNTGNHEQHFGSNQ

SEQ ID NO: 63008 - protein, 30 aa, Artificial Sequence
  Description of Artificial Sequence: Synthetic polypeptide
DENEIRTTNPIATEQWGSVSENLMNAAGDR

SEQ ID NO: 63009 - protein, 29 aa, Artificial Sequence
  Description of Artificial Sequence: Synthetic peptide
DENEIRCTNPIATEQYGSVSENEMRAENA

SEQ ID NO: 63010 - protein, 30 aa, Artificial Sequence
  Description of Artificial Sequence: Synthetic polypeptide
DENEIRCTNPVATECYGEVSCINEQREGGR

SEQ ID NO: 63011 - protein, 28 aa, Artificial Sequence
  Description of Artificial Sequence: Synthetic peptide
DENEIRCTNPVATEQWGDVSEILMREDR

SEQ ID NO: 63012 - protein, 30 aa, Artificial Sequence
  Description of Artificial Sequence: Synthetic polypeptide
DENEIRCTNPVATEQYGDVSENLMNRAGDA

SEQ ID NO: 63013 - protein, 30 aa, Artificial Sequence
  Description of Artificial Sequence: Synthetic polypeptide
DENEIRCTNPVATEQYGEASEINLQREGGG

SEQ ID NO: 63014 - protein, 29 aa, Artificial Sequence
  Description of Artificial Sequence: Synthetic peptide
DENEIRCTNPVATEQYGEVSEILQNREGA

SEQ ID NO: 63015 - protein, 30 aa, Artificial Sequence
  Description of Artificial Sequence: Synthetic polypeptide
DENEIRCTNPVATEQYGSASSEALQMRGGV

SEQ ID NO: 63016 - protein, 30 aa, Artificial Sequence
  Description of Artificial Sequence: Synthetic polypeptide
DENEIRCTNPVATEQYGSISEEDIQMQGNR

SEQ ID NO: 63017 - protein, 31 aa, Artificial Sequence
  Description of Artificial Sequence: Synthetic polypeptide
DENEIRCTNPVATEQYGSVSEPNGQMRGGPV

SEQ ID NO: 63018 - protein, 33 aa, Artificial Sequence
  Description of Artificial Sequence: Synthetic polypeptide
DEEEIRTTNPVATEQYGSVCSNTNHQSSGSDQP

SEQ ID NO: 63019 - protein, 33 aa, Artificial Sequence
  Description of Artificial Sequence: Synthetic polypeptide
DEEEIRTTNPVATEQYGSVCSNTNHQHFNSNNQ

SEQ ID NO: 63020 - protein, 34 aa, Artificial Sequence
  Description of Artificial Sequence: Synthetic polypeptide
DEEEIRTTNPVATEQYGSVCSNTNHQEYFGSNQP

SEQ ID NO: 63021 - protein, 33 aa, Artificial Sequence
  Description of Artificial Sequence: Synthetic polypeptide
DEEEIRTTNPVATEQYGSVCSNTNHQENFLSNQ

SEQ ID NO: 63022 - protein, 34 aa, Artificial Sequence
  Description of Artificial Sequence: Synthetic polypeptide
DENEIRCTNPVATEQYGSVSTTNLPQMRNGMNPV

SEQ ID NO: 63023 - protein, 30 aa, Artificial Sequence
  Description of Artificial Sequence: Synthetic polypeptide
DENEIRGTNPVATESYGSVMTGLIRGMGNG

SEQ ID NO: 63024 - protein, 33 aa, Artificial Sequence
  Description of Artificial Sequence: Synthetic polypeptide
DEEEIRTTNPVATEQYGSVCSNTNDQGFGSDQA

SEQ ID NO: 63025 - protein, 28 aa, Artificial Sequence
  Description of Artificial Sequence: Synthetic peptide
DENEIRPTNPVASEQYGIVSCNEQAGTA

SEQ ID NO: 63026 - protein, 29 aa, Artificial Sequence
  Description of Artificial Sequence: Synthetic peptide
DENEIRPTNPVATEQYGIVSENEQNAGTA

SEQ ID NO: 63027 - protein, 29 aa, Artificial Sequence
  Description of Artificial Sequence: Synthetic peptide
DENEIRSTNPVCTEPYGVVSDNLQQSGNQ

SEQ ID NO: 63028 - protein, 31 aa, Artificial Sequence
  Description of Artificial Sequence: Synthetic polypeptide
DENEIRTTNPIATEPYGTVSEENLQMRNGNH

SEQ ID NO: 63029 - protein, 28 aa, Artificial Sequence
  Description of Artificial Sequence: Synthetic peptide
DENEIRTTNPIATEQWGDVSEILMAGNA

SEQ ID NO: 63030 - protein, 34 aa, Artificial Sequence
  Description of Artificial Sequence: Synthetic polypeptide
DEEEIRTTNPVATEQYGSVCSPTNNVQRQMEEPR

SEQ ID NO: 63031 - protein, 30 aa, Artificial Sequence
  Description of Artificial Sequence: Synthetic polypeptide
DENEIRTTNPVATECWGSVSCINEQHEGNL

SEQ ID NO: 63032 - protein, 32 aa, Artificial Sequence
  Description of Artificial Sequence: Synthetic polypeptide
DEEEIRTTNPVATEQYGSVCSPTNSLETEEFI

SEQ ID NO: 63033 - protein, 36 aa, Artificial Sequence
  Description of Artificial Sequence: Synthetic polypeptide
DEEEIRTTNPVATEQYGSVCSPTVNLDQERFGNIED

SEQ ID NO: 63034 - protein, 31 aa, Artificial Sequence
  Description of Artificial Sequence: Synthetic polypeptide
DEEEIRTTNPVATEQYGSVCSTELEHNSEQS

SEQ ID NO: 63035 - protein, 30 aa, Artificial Sequence
  Description of Artificial Sequence: Synthetic polypeptide
DENEIATTNPVATAQWGCVSTGALQVGDNR

SEQ ID NO: 63036 - protein, 29 aa, Artificial Sequence
  Description of Artificial Sequence: Synthetic peptide
DENEIATTNPVATDQYGVVSTDGQGGGNT

SEQ ID NO: 63037 - protein, 30 aa, Artificial Sequence
  Description of Artificial Sequence: Synthetic polypeptide
DENEIATTNPVATEAYGSVSNNLNNRMGTM

SEQ ID NO: 63038 - protein, 31 aa, Artificial Sequence
  Description of Artificial Sequence: Synthetic polypeptide
DENEIATTNPVATECWGSASEINLQREGENR

SEQ ID NO: 63039 - protein, 32 aa, Artificial Sequence
  Description of Artificial Sequence: Synthetic polypeptide
DEEEIRTTNPVATEQYGSVCSTEHQNGSDDQV

SEQ ID NO: 63040 - protein, 32 aa, Artificial Sequence
  Description of Artificial Sequence: Synthetic polypeptide
DEEEIRTTNPVATEQYGSVCSTEHQNFNSEQA

SEQ ID NO: 63041 - protein, 29 aa, Artificial Sequence
  Description of Artificial Sequence: Synthetic peptide
DENEIATTNPVATECYGATSEDLQRGGYR

SEQ ID NO: 63042 - protein, 33 aa, Artificial Sequence
  Description of Artificial Sequence: Synthetic polypeptide
DEEEIRTTNPVATEQYGSVCSTEHQFFGSDTRY

SEQ ID NO: 63043 - protein, 28 aa, Artificial Sequence
  Description of Artificial Sequence: Synthetic peptide
DENEIATTNPCATEQYGDVSCNLMSGTA

SEQ ID NO: 63044 - protein, 33 aa, Artificial Sequence
  Description of Artificial Sequence: Synthetic polypeptide
DEEEIRTTNPVATEQYGSVCSTEHQERFGSQIS

SEQ ID NO: 63045 - protein, 33 aa, Artificial Sequence
  Description of Artificial Sequence: Synthetic polypeptide
DEEEIRTTNPVATEQYGSVCSTEHNQYFGSNQI

SEQ ID NO: 63046 - protein, 28 aa, Artificial Sequence
  Description of Artificial Sequence: Synthetic peptide
DENEIATTNPVATECYGDVSECLQHENL

SEQ ID NO: 63047 - protein, 33 aa, Artificial Sequence
  Description of Artificial Sequence: Synthetic polypeptide
DEEEIRTTNPVATEQYGSVCSTEEPQERGSEQE

SEQ ID NO: 63048 - protein, 28 aa, Artificial Sequence
  Description of Artificial Sequence: Synthetic peptide
DENEIATTNPVATECYGDVSECLQHGEL

SEQ ID NO: 63049 - protein, 32 aa, Artificial Sequence
  Description of Artificial Sequence: Synthetic polypeptide
DEEEIRTTNPVATEQYGSVCSTEEHQYGSDQG

SEQ ID NO: 63050 - protein, 32 aa, Artificial Sequence
  Description of Artificial Sequence: Synthetic polypeptide
DENEIATTNPVATECYGEVSENLPQDREGENR

SEQ ID NO: 63051 - protein, 28 aa, Artificial Sequence
  Description of Artificial Sequence: Synthetic peptide
DENEIATTNPVATECYGSVSCCLQHEEL

SEQ ID NO: 63052 - protein, 28 aa, Artificial Sequence
  Description of Artificial Sequence: Synthetic peptide
DENEIATTNPVATECYGSVSECLQHEEL

SEQ ID NO: 63053 - protein, 33 aa, Artificial Sequence
  Description of Artificial Sequence: Synthetic polypeptide
DEEEIRTTNPVATEQYGSVCSTEEHQHFGSNQV

SEQ ID NO: 63054 - protein, 28 aa, Artificial Sequence
  Description of Artificial Sequence: Synthetic peptide
DENEIATTNPVATECYGAVSECLQHGEL

SEQ ID NO: 63055 - protein, 28 aa, Artificial Sequence
  Description of Artificial Sequence: Synthetic peptide
DENEIATTNPVATECYGSVSEDLQHEEL

SEQ ID NO: 63056 - protein, 33 aa, Artificial Sequence
  Description of Artificial Sequence: Synthetic polypeptide
DEEEIRTTNPVATEQYGSVCSTELEQFFISNQI

SEQ ID NO: 63057 - protein, 28 aa, Artificial Sequence
  Description of Artificial Sequence: Synthetic peptide
DENEIASVNPVCTEQYGVVSDNLQSGNQ

SEQ ID NO: 63058 - protein, 31 aa, Artificial Sequence
  Description of Artificial Sequence: Synthetic polypeptide
DENEIACTNPVATEQYGEVSTEPNGPQRGNV

SEQ ID NO: 63059 - protein, 32 aa, Artificial Sequence
  Description of Artificial Sequence: Synthetic polypeptide
DEEEIRTTNPVATEQYGSVCSTELQNFISETQ

SEQ ID NO: 63060 - protein, 30 aa, Artificial Sequence
  Description of Artificial Sequence: Synthetic polypeptide
DENEIACTNPVATEQYGSASAENLQRGEDL

SEQ ID NO: 63061 - protein, 30 aa, Artificial Sequence
  Description of Artificial Sequence: Synthetic polypeptide
DENEIACTNPVATEQYGSASTDLEREGGDR

SEQ ID NO: 63062 - protein, 32 aa, Artificial Sequence
  Description of Artificial Sequence: Synthetic polypeptide
DEEEIRTTNPVATEQYGSVCSTELQHNSETQL

SEQ ID NO: 63063 - protein, 31 aa, Artificial Sequence
  Description of Artificial Sequence: Synthetic polypeptide
DENEIACTNPVATEQYGSVSATNLEDHEGER

SEQ ID NO: 63064 - protein, 31 aa, Artificial Sequence
  Description of Artificial Sequence: Synthetic polypeptide
DENEIACTNPVATEQYGSVSEPNLQMRGGPV

SEQ ID NO: 63065 - protein, 31 aa, Artificial Sequence
  Description of Artificial Sequence: Synthetic polypeptide
DENEIACTNPVATEQYGSVSTNGPNMRGGPR

SEQ ID NO: 63066 - protein, 33 aa, Artificial Sequence
  Description of Artificial Sequence: Synthetic polypeptide
DEEEIRTTNPVATEQYGSVCSTELQEYFGSQQS

SEQ ID NO: 63067 - protein, 28 aa, Artificial Sequence
  Description of Artificial Sequence: Synthetic peptide
DENEIATTNPCATEQYGDVSCNLMSGDA

SEQ ID NO: 63068 - protein, 34 aa, Artificial Sequence
  Description of Artificial Sequence: Synthetic polypeptide
DEEEIRTTNPVATEQYGSVCSTELQEYFGSENQP

SEQ ID NO: 63069 - protein, 33 aa, Artificial Sequence
  Description of Artificial Sequence: Synthetic polypeptide
DEEEIRTTNPVATEQYGSVCSTELQEHFGSQQS

SEQ ID NO: 63070 - protein, 33 aa, Artificial Sequence
  Description of Artificial Sequence: Synthetic polypeptide
DEEEIRTTNPVATEQYGSVCSTELQEFFSSNQY

SEQ ID NO: 63071 - protein, 29 aa, Artificial Sequence
  Description of Artificial Sequence: Synthetic peptide
DENEIACTNPVATEQYGTASENPQREGGR

SEQ ID NO: 63072 - protein, 33 aa, Artificial Sequence
  Description of Artificial Sequence: Synthetic polypeptide
DEEEIRTTNPVATEQYGSVCSTELNQNFNSNQI

SEQ ID NO: 63073 - protein, 33 aa, Artificial Sequence
  Description of Artificial Sequence: Synthetic polypeptide
DEEEIRTTNPVATEQYGSVCSTELNQNFGSVQA

SEQ ID NO: 63074 - protein, 33 aa, Artificial Sequence
  Description of Artificial Sequence: Synthetic polypeptide
DEEEIRTTNPVATEQYGSVCSTELNQNFGSEQI

SEQ ID NO: 63075 - protein, 29 aa, Artificial Sequence
  Description of Artificial Sequence: Synthetic peptide
DENEIACTNPVATEQYGTISMNLQQRGGH

SEQ ID NO: 63076 - protein, 33 aa, Artificial Sequence
  Description of Artificial Sequence: Synthetic polypeptide
DEEEIRTTNPVATEQYGSVCSTELNQFFGSEAI

SEQ ID NO: 63077 - protein, 28 aa, Artificial Sequence
  Description of Artificial Sequence: Synthetic peptide
DENEIACTNPVSTEQYGEASENLQQGGR

SEQ ID NO: 63078 - protein, 33 aa, Artificial Sequence
  Description of Artificial Sequence: Synthetic polypeptide
DEEEIRTTNPVATEQYGSVCSTELQENFGSVDY

SEQ ID NO: 63079 - protein, 30 aa, Artificial Sequence
  Description of Artificial Sequence: Synthetic polypeptide
DENEIATTNPVATECYGSVSTEALQREMEL

SEQ ID NO: 63080 - protein, 29 aa, Artificial Sequence
  Description of Artificial Sequence: Synthetic peptide
DENEIATTNPVATECYGTVSEDCLQHGNL

SEQ ID NO: 63081 - protein, 29 aa, Artificial Sequence
  Description of Artificial Sequence: Synthetic peptide
DENEIATTNPVATECYGTVSEDLQQHGNL

SEQ ID NO: 63082 - protein, 28 aa, Artificial Sequence
  Description of Artificial Sequence: Synthetic peptide
DENEIATTNPVATEQYGDVSEILQHEDL

SEQ ID NO: 63083 - protein, 30 aa, Artificial Sequence
  Description of Artificial Sequence: Synthetic polypeptide
DENEIATTNPVATEQYGDVSENLQNAAGTA

SEQ ID NO: 63084 - protein, 30 aa, Artificial Sequence
  Description of Artificial Sequence: Synthetic polypeptide
DENEIATTNPVATEQYGDVSENLQNSAGTA

SEQ ID NO: 63085 - protein, 33 aa, Artificial Sequence
  Description of Artificial Sequence: Synthetic polypeptide
DEEEIRTTNPVATEQYGSVCSTAHQERFGSDQA

SEQ ID NO: 63086 - protein, 33 aa, Artificial Sequence
  Description of Artificial Sequence: Synthetic polypeptide
DEEEIRTTNPVATEQYGSVCSTAHNQFFGSNQP

SEQ ID NO: 63087 - protein, 33 aa, Artificial Sequence
  Description of Artificial Sequence: Synthetic polypeptide
DEEEIRTTNPVATEQYGSVCSTADQNFGSNFQP

SEQ ID NO: 63088 - protein, 30 aa, Artificial Sequence
  Description of Artificial Sequence: Synthetic polypeptide
DENEIATTNPVATEQYGEASEDGLVQFGNR

SEQ ID NO: 63089 - protein, 29 aa, Artificial Sequence
  Description of Artificial Sequence: Synthetic peptide
DENEIATTNPVATEQYGEASNEDLARGPR

SEQ ID NO: 63090 - protein, 30 aa, Artificial Sequence
  Description of Artificial Sequence: Synthetic polypeptide
DENEIATTNPVATEQYGEASSEPNGQRGGR

SEQ ID NO: 63091 - protein, 31 aa, Artificial Sequence
  Description of Artificial Sequence: Synthetic polypeptide
DEEEIRTTNPVATEQYGSVCSTALEDTEDQD

SEQ ID NO: 63092 - protein, 30 aa, Artificial Sequence
  Description of Artificial Sequence: Synthetic polypeptide
DENEIATTNPVATEQYGSASAEDLEDRGGR

SEQ ID NO: 63093 - protein, 33 aa, Artificial Sequence
  Description of Artificial Sequence: Synthetic polypeptide
DEEEIRTTNPVATEQYGSVCSSGNHQGFGSNDS

SEQ ID NO: 63094 - protein, 31 aa, Artificial Sequence
  Description of Artificial Sequence: Synthetic polypeptide
DEEEIRTTNPVATEQYGSVCSSGELQNNSDQ

SEQ ID NO: 63095 - protein, 30 aa, Artificial Sequence
  Description of Artificial Sequence: Synthetic polypeptide
DENEIATTNPVATEQYGSVAMHLQQGGNQV

SEQ ID NO: 63096 - protein, 31 aa, Artificial Sequence
  Description of Artificial Sequence: Synthetic polypeptide
DENEIATTNPVATEQYGSVAMNLQEAGENVY

SEQ ID NO: 63097 - protein, 32 aa, Artificial Sequence
  Description of Artificial Sequence: Synthetic polypeptide
DEEEIRTTNPVATEQYGSVCSSELQSFGSDQD

SEQ ID NO: 63098 - protein, 32 aa, Artificial Sequence
  Description of Artificial Sequence: Synthetic polypeptide
DEEEIRTTNPVATEQYGSVCSSEDQFFGSNQP

SEQ ID NO: 63099 - protein, 30 aa, Artificial Sequence
  Description of Artificial Sequence: Synthetic polypeptide
DENEIATTNPVATEQYGSVAMNLQQANNEQ

SEQ ID NO: 63100 - protein, 29 aa, Artificial Sequence
  Description of Artificial Sequence: Synthetic peptide
DENEIATTNPVATEQYGSVAMNLQQNDES

SEQ ID NO: 63101 - protein, 30 aa, Artificial Sequence
  Description of Artificial Sequence: Synthetic polypeptide
DENEIATTNPVATEQYGSVAMNLQQNDNEE

SEQ ID NO: 63102 - protein, 30 aa, Artificial Sequence
  Description of Artificial Sequence: Synthetic polypeptide
DENEIATTNPVATEQYGSASTDLEREGEDL

SEQ ID NO: 63103 - protein, 32 aa, Artificial Sequence
  Description of Artificial Sequence: Synthetic polypeptide
DEEEIRTTNPVATEQYGSVCSTALENFGSDQP

SEQ ID NO: 63104 - protein, 28 aa, Artificial Sequence
  Description of Artificial Sequence: Synthetic peptide
DENEIATTNPVATEQYGDVSEILQHEDA

SEQ ID NO: 63105 - protein, 33 aa, Artificial Sequence
  Description of Artificial Sequence: Synthetic polypeptide
DEEEIRTTNPVATEQYGSVCSTALQEYFGSEQA

SEQ ID NO: 63106 - protein, 29 aa, Artificial Sequence
  Description of Artificial Sequence: Synthetic peptide
DENEIATTNPVATECYGTVSEDLQQQGNL

SEQ ID NO: 63107 - protein, 32 aa, Artificial Sequence
  Description of Artificial Sequence: Synthetic polypeptide
DEEEIRTTNPVATEQYGSVCSTEDQGFGSVDY

SEQ ID NO: 63108 - protein, 33 aa, Artificial Sequence
  Description of Artificial Sequence: Synthetic polypeptide
DEEEIRTTNPVATEQYGSVCSTEDQERFGSQQT

SEQ ID NO: 63109 - protein, 33 aa, Artificial Sequence
  Description of Artificial Sequence: Synthetic polypeptide
DEEEIRTTNPVATEQYGSVCSTEDPQENGSNQS

SEQ ID NO: 63110 - protein, 30 aa, Artificial Sequence
  Description of Artificial Sequence: Synthetic polypeptide
DENEIATTNPVATEGYGSVSGNNLQDGTQD

SEQ ID NO: 63111 - protein, 29 aa, Artificial Sequence
  Description of Artificial Sequence: Synthetic peptide
DENEIATTNPVATEGYGSVSNNDQQDGTQ

SEQ ID NO: 63112 - protein, 29 aa, Artificial Sequence
  Description of Artificial Sequence: Synthetic peptide
DENEIATTNPVATEIYGCVSNNLQDGDTS

SEQ ID NO: 63113 - protein, 29 aa, Artificial Sequence
  Description of Artificial Sequence: Synthetic peptide
DENEIATTNPVATEIYGSVANNLQQPGTQ

SEQ ID NO: 63114 - protein, 32 aa, Artificial Sequence
  Description of Artificial Sequence: Synthetic polypeptide
DEEEIRTTNPVATEQYGSVCSTEDHQNFGSEQ

SEQ ID NO: 63115 - protein, 30 aa, Artificial Sequence
  Description of Artificial Sequence: Synthetic polypeptide
DENEIATTNPVATEIYGSVSNNLQGDGDTQ

SEQ ID NO: 63116 - protein, 31 aa, Artificial Sequence
  Description of Artificial Sequence: Synthetic polypeptide
DENEIATTNPVATEPYGSVAATANLQQGNQS

SEQ ID NO: 63117 - protein, 31 aa, Artificial Sequence
  Description of Artificial Sequence: Synthetic polypeptide
DENEIATTNPVATEPYGSVAATNLQQGNEQV

SEQ ID NO: 63118 - protein, 28 aa, Artificial Sequence
  Description of Artificial Sequence: Synthetic peptide
DENEIATTNPVATEQWGDASENEQREGR

SEQ ID NO: 63119 - protein, 29 aa, Artificial Sequence
  Description of Artificial Sequence: Synthetic peptide
DENEIATTNPVATEQWGDVSEILMRAGDR

SEQ ID NO: 63120 - protein, 29 aa, Artificial Sequence
  Description of Artificial Sequence: Synthetic peptide
DENEIATTNPVATEQWGSVAMNLQQNNEE

SEQ ID NO: 63121 - protein, 30 aa, Artificial Sequence
  Description of Artificial Sequence: Synthetic polypeptide
DENEIATTNPVATEQYGCVATNLQALDNDE

SEQ ID NO: 63122 - protein, 29 aa, Artificial Sequence
  Description of Artificial Sequence: Synthetic peptide
DENEIATTNPVATEQYGDVCSEGLQHENL

SEQ ID NO: 63123 - protein, 29 aa, Artificial Sequence
  Description of Artificial Sequence: Synthetic peptide
DENEIATTNPVATEQYGDVCSTGLEHENL

SEQ ID NO: 63124 - protein, 28 aa, Artificial Sequence
  Description of Artificial Sequence: Synthetic peptide
DENEIATTNPVATEQYGDVSEALQHEEL

SEQ ID NO: 63125 - protein, 28 aa, Artificial Sequence
  Description of Artificial Sequence: Synthetic peptide
DENEIATTNPVATEQYGDVSECLQHEEL

SEQ ID NO: 63126 - protein, 29 aa, Artificial Sequence
  Description of Artificial Sequence: Synthetic peptide
DENEIATTNPVATEQYGDVSEILMNAGNA

SEQ ID NO: 63127 - protein, 30 aa, Artificial Sequence
  Description of Artificial Sequence: Synthetic polypeptide
DENEIATTNPVATEQYGSVAMNLQQNNGEL

SEQ ID NO: 63128 - protein, 33 aa, Artificial Sequence
  Description of Artificial Sequence: Synthetic polypeptide
DENEIRTTNPVATEQYGSVSTWNLNEFRNGDDE

SEQ ID NO: 63129 - protein, 30 aa, Artificial Sequence
  Description of Artificial Sequence: Synthetic polypeptide
DENEIRTTNPVATECWGSVSCNEPQDHGNL

SEQ ID NO: 63130 - protein, 31 aa, Artificial Sequence
  Description of Artificial Sequence: Synthetic polypeptide
DENEIRTTNPVATECWGSVSCNEPQREGENG

SEQ ID NO: 63131 - protein, 34 aa, Artificial Sequence
  Description of Artificial Sequence: Synthetic polypeptide
DEEEIRTTNPVATEQYGSVCGTNMLDQNLGDNSE

SEQ ID NO: 63132 - protein, 32 aa, Artificial Sequence
  Description of Artificial Sequence: Synthetic polypeptide
DENEIRTTNPVATEQYGSVIYQTDELQPGERQ

SEQ ID NO: 63133 - protein, 33 aa, Artificial Sequence
  Description of Artificial Sequence: Synthetic polypeptide
DEEEIRTTNPVATEQYGSVCGTNLQPLGVTIQE

SEQ ID NO: 63134 - protein, 30 aa, Artificial Sequence
  Description of Artificial Sequence: Synthetic polypeptide
DENEIRTTNPVATEQYGSVMSQNLFENMDG

SEQ ID NO: 63135 - protein, 31 aa, Artificial Sequence
  Description of Artificial Sequence: Synthetic polypeptide
DEEEIRTTNPVATEQYGSVCGTEHQNNSNQA

SEQ ID NO: 63136 - protein, 31 aa, Artificial Sequence
  Description of Artificial Sequence: Synthetic polypeptide
DENEIRTTNPVATEQYGSVMSQNLIFENMNE

SEQ ID NO: 63137 - protein, 31 aa, Artificial Sequence
  Description of Artificial Sequence: Synthetic polypeptide
DENEIRTTNPVATEQYGSVMSQNLIMNMNGD

SEQ ID NO: 63138 - protein, 33 aa, Artificial Sequence
  Description of Artificial Sequence: Synthetic polypeptide
DENEIRTTNPVATEQYGSVMTGLIQRGMGNDGI

SEQ ID NO: 63139 - protein, 32 aa, Artificial Sequence
  Description of Artificial Sequence: Synthetic polypeptide
DENEIRTTNPVATEQYGSVMTGLIREMGNEGI

SEQ ID NO: 63140 - protein, 31 aa, Artificial Sequence
  Description of Artificial Sequence: Synthetic polypeptide
DENEIRTTNPVATEQYGSVCWPTLTERGDNE

SEQ ID NO: 63141 - protein, 30 aa, Artificial Sequence
  Description of Artificial Sequence: Synthetic polypeptide
DENEIRTTNPVATEQYGSVQTANEILEMQR

SEQ ID NO: 63142 - protein, 30 aa, Artificial Sequence
  Description of Artificial Sequence: Synthetic polypeptide
DENEIRTTNPVATEQYGSVSANDAEGSEEH

SEQ ID NO: 63143 - protein, 31 aa, Artificial Sequence
  Description of Artificial Sequence: Synthetic polypeptide
DENEIRTTNPVATEQYGSVSDWNIDIGNNIE

SEQ ID NO: 63144 - protein, 31 aa, Artificial Sequence
  Description of Artificial Sequence: Synthetic polypeptide
DENEIRTTNPVATEQYGSVSEAGNMHNGMNV

SEQ ID NO: 63145 - protein, 31 aa, Artificial Sequence
  Description of Artificial Sequence: Synthetic polypeptide
DENEIRTTNPVATEQYGSVSEAGNMRNGMNV

SEQ ID NO: 63146 - protein, 29 aa, Artificial Sequence
  Description of Artificial Sequence: Synthetic peptide
DENEIRTTNPVATEQYGSVSECGNHNENV

SEQ ID NO: 63147 - protein, 31 aa, Artificial Sequence
  Description of Artificial Sequence: Synthetic polypeptide
DENEIRTTNPVATEQYGSVSFNDEQESIEGN

SEQ ID NO: 63148 - protein, 32 aa, Artificial Sequence
  Description of Artificial Sequence: Synthetic polypeptide
DENEIRTTNPVATEQYGSVSFVDNTQRGGQDN

SEQ ID NO: 63149 - protein, 32 aa, Artificial Sequence
  Description of Artificial Sequence: Synthetic polypeptide
DEEEIRTTNPVATEQYGSVCETLLQNEGVVLI

SEQ ID NO: 63150 - protein, 33 aa, Artificial Sequence
  Description of Artificial Sequence: Synthetic polypeptide
DENEIRTTNPVATEQYGSVSITNTQEEGSQENF

SEQ ID NO: 63151 - protein, 31 aa, Artificial Sequence
  Description of Artificial Sequence: Synthetic polypeptide
DENEIRTTNPVATEQYGSVQTGLIRGMGQGG

SEQ ID NO: 63152 - protein, 30 aa, Artificial Sequence
  Description of Artificial Sequence: Synthetic polypeptide
DENEIRTTNPVATEQYGSVSMDLNEREDET

SEQ ID NO: 63153 - protein, 34 aa, Artificial Sequence
  Description of Artificial Sequence: Synthetic polypeptide
DEEEIRTTNPVATEQYGSVCIPTNLEQLRGDEDQ

SEQ ID NO: 63154 - protein, 32 aa, Artificial Sequence
  Description of Artificial Sequence: Synthetic polypeptide
DENEIRTTNPVATEQYGSVCSTNHQNFGSEQI

SEQ ID NO: 63155 - protein, 32 aa, Artificial Sequence
  Description of Artificial Sequence: Synthetic polypeptide
DENEIRTTNPVATEQYGSASSTPAGQRNGMNV

SEQ ID NO: 63156 - protein, 32 aa, Artificial Sequence
  Description of Artificial Sequence: Synthetic polypeptide
DENEIRTTNPVATEQYGSCSTNDADQEGQNDG

SEQ ID NO: 63157 - protein, 32 aa, Artificial Sequence
  Description of Artificial Sequence: Synthetic polypeptide
DENEIRTTNPVATEQYGSCSTTNLHEGFGEDR

SEQ ID NO: 63158 - protein, 32 aa, Artificial Sequence
  Description of Artificial Sequence: Synthetic polypeptide
DEEEIRTTNPVATEQYGSVCNPNLEQRMLDQN

SEQ ID NO: 63159 - protein, 32 aa, Artificial Sequence
  Description of Artificial Sequence: Synthetic polypeptide
DEEEIRTTNPVATEQYGSVCNAGNLDGAIGTR

SEQ ID NO: 63160 - protein, 32 aa, Artificial Sequence
  Description of Artificial Sequence: Synthetic polypeptide
DEEEIRTTNPVATEQYGSVCMTRDYERNGDRQ

SEQ ID NO: 63161 - protein, 33 aa, Artificial Sequence
  Description of Artificial Sequence: Synthetic polypeptide
DENEIRTTNPVATEQYGSCWSTMNDMQEGNERT

SEQ ID NO: 63162 - protein, 30 aa, Artificial Sequence
  Description of Artificial Sequence: Synthetic polypeptide
DENEIRTTNPVATEQYGSISLTCTINEGLR

SEQ ID NO: 63163 - protein, 34 aa, Artificial Sequence
  Description of Artificial Sequence: Synthetic polypeptide
DENEIRTTNPVATEQYGSTSSMTENLSQRIGNQE

SEQ ID NO: 63164 - protein, 33 aa, Artificial Sequence
  Description of Artificial Sequence: Synthetic polypeptide
DENEIRTTNPVATEQYGSVCSTNNLTRSVQDER

SEQ ID NO: 63165 - protein, 31 aa, Artificial Sequence
  Description of Artificial Sequence: Synthetic polypeptide
DENEIRTTNPVATEQYGSVCSNVLEFGNNEQ

SEQ ID NO: 63166 - protein, 32 aa, Artificial Sequence
  Description of Artificial Sequence: Synthetic polypeptide
DEEEIRTTNPVATEQYGSVCITNMIMEMGNVE

SEQ ID NO: 63167 - protein, 33 aa, Artificial Sequence
  Description of Artificial Sequence: Synthetic polypeptide
DENEIRTTNPVATEQYGSVCSPTLLERGGDNAE

SEQ ID NO: 63168 - protein, 32 aa, Artificial Sequence
  Description of Artificial Sequence: Synthetic polypeptide
DENEIRTTNPVATEQYGSVCSPTNLENGEEFI

SEQ ID NO: 63169 - protein, 32 aa, Artificial Sequence
  Description of Artificial Sequence: Synthetic polypeptide
DEEEIRTTNPVATEQYGSVCITNEGGMGEDRD

SEQ ID NO: 63170 - protein, 32 aa, Artificial Sequence
  Description of Artificial Sequence: Synthetic polypeptide
DENEIRTTNPVATEQYGSVCSPTNLEREEDII

SEQ ID NO: 63171 - protein, 31 aa, Artificial Sequence
  Description of Artificial Sequence: Synthetic polypeptide
DENEIRTTNPVATEQYGSVCSQDNLTENMNE

SEQ ID NO: 63172 - protein, 33 aa, Artificial Sequence
  Description of Artificial Sequence: Synthetic polypeptide
DEEEIRTTNPVATEQYGSVCITNDQGREETERG

SEQ ID NO: 63173 - protein, 32 aa, Artificial Sequence
  Description of Artificial Sequence: Synthetic polypeptide
DEEEIRTTNPVATEQYGSVCITNDQGRDVEDG

SEQ ID NO: 63174 - protein, 32 aa, Artificial Sequence
  Description of Artificial Sequence: Synthetic polypeptide
DENEIRTTNPVATEQYGSVCSTGYAQRVENDV

SEQ ID NO: 63175 - protein, 32 aa, Artificial Sequence
  Description of Artificial Sequence: Synthetic polypeptide
DEEEIRTTNPVATEQYGSVCITSGQRGQTQEM

SEQ ID NO: 63176 - protein, 30 aa, Artificial Sequence
  Description of Artificial Sequence: Synthetic polypeptide
DENEIRTTNPVATEQYGSVSMDLNREDQTD

SEQ ID NO: 63177 - protein, 29 aa, Artificial Sequence
  Description of Artificial Sequence: Synthetic peptide
DENEIRTTNPVATEQYGSVSMDNDEGEGV

SEQ ID NO: 63178 - protein, 31 aa, Artificial Sequence
  Description of Artificial Sequence: Synthetic polypeptide
DENEIRTTNPVATEQYGSVSPNHDQEDEERD

SEQ ID NO: 63179 - protein, 33 aa, Artificial Sequence
  Description of Artificial Sequence: Synthetic polypeptide
DEEEIRTTNPVATEQYGSVCATNPLQDAGDPDQ

SEQ ID NO: 63180 - protein, 33 aa, Artificial Sequence
  Description of Artificial Sequence: Synthetic polypeptide
DENEIRTTNPVATEQYGSVSTLPNLNHRDTQDR

SEQ ID NO: 63181 - protein, 33 aa, Artificial Sequence
  Description of Artificial Sequence: Synthetic polypeptide
DENEIRTTNPVATEQYGSVSTLPNLQHFDTDRQ

SEQ ID NO: 63182 - protein, 34 aa, Artificial Sequence
  Description of Artificial Sequence: Synthetic polypeptide
DENEIRTTNPVATEQYGSVSTLPNLQHRDTFDRL

SEQ ID NO: 63183 - protein, 31 aa, Artificial Sequence
  Description of Artificial Sequence: Synthetic polypeptide
DENEIRTTNPVATEQYGSVSTMDEQEGDDTF

SEQ ID NO: 63184 - protein, 32 aa, Artificial Sequence
  Description of Artificial Sequence: Synthetic polypeptide
DEEEIRTTNPVATEQYGSVCATNLQHNPMDDD

SEQ ID NO: 63185 - protein, 34 aa, Artificial Sequence
  Description of Artificial Sequence: Synthetic polypeptide
DENEIRTTNPVATEQYGSVSTNLLDFTSGDENPR

SEQ ID NO: 63186 - protein, 33 aa, Artificial Sequence
  Description of Artificial Sequence: Synthetic polypeptide
DEEEIRTTNPVATEQYGSVCATNLEAEEGDNGQ

SEQ ID NO: 63187 - protein, 34 aa, Artificial Sequence
  Description of Artificial Sequence: Synthetic polypeptide
DEEEIRTTNPVATEQYGSVCATNLDTRGGDNPDA

SEQ ID NO: 63188 - protein, 33 aa, Artificial Sequence
  Description of Artificial Sequence: Synthetic polypeptide
DEEEIRTTNPVATEQYGSVCATNPLQDALNDNP

SEQ ID NO: 63189 - protein, 33 aa, Artificial Sequence
  Description of Artificial Sequence: Synthetic polypeptide
DENEIRTTNPVATEQYGSVSTNNLDRFDNNSMG

SEQ ID NO: 63190 - protein, 32 aa, Artificial Sequence
  Description of Artificial Sequence: Synthetic polypeptide
DEEEIRTTNPVATEQYGSVCATNDEAGDGENN

SEQ ID NO: 63191 - protein, 31 aa, Artificial Sequence
  Description of Artificial Sequence: Synthetic polypeptide
DENEIRTTNPVATEQYGSVSTVLPNNIDNQE

SEQ ID NO: 63192 - protein, 33 aa, Artificial Sequence
  Description of Artificial Sequence: Synthetic polypeptide
DENEIRTTNPVATEQYGSVSTVMNMQEMDENRI

SEQ ID NO: 63193 - protein, 32 aa, Artificial Sequence
  Description of Artificial Sequence: Synthetic polypeptide
DENEIRTTNPVATEQYGSVSTVNQQSGPEDGQ

SEQ ID NO: 63194 - protein, 31 aa, Artificial Sequence
  Description of Artificial Sequence: Synthetic polypeptide
DENEIRTTNPVATEQYGSVSTWDVQEGQEDQ

SEQ ID NO: 63195 - protein, 32 aa, Artificial Sequence
  Description of Artificial Sequence: Synthetic polypeptide
DEEEIRTTNPVATEQYGSVCAAVPLQNDQGNE

SEQ ID NO: 63196 - protein, 34 aa, Artificial Sequence
  Description of Artificial Sequence: Synthetic polypeptide
DEEEIRTTNPVATEQYGSVCAATNPLQEMDNQRQ

SEQ ID NO: 63197 - protein, 34 aa, Artificial Sequence
  Description of Artificial Sequence: Synthetic polypeptide
DEEEIRTTNPVATEQYGSVCAATNLDQDSGMNMM

SEQ ID NO: 63198 - protein, 33 aa, Artificial Sequence
  Description of Artificial Sequence: Synthetic polypeptide
DEEEIRTTNPVATEQYGSVCAATNDQDLPGNTN

SEQ ID NO: 63199 - protein, 32 aa, Artificial Sequence
  Description of Artificial Sequence: Synthetic polypeptide
DENEIRTTNPVATEQYGSVSTPQDLQESDDRF

SEQ ID NO: 63200 - protein, 33 aa, Artificial Sequence
  Description of Artificial Sequence: Synthetic polypeptide
DEEEIRTTNPVATEQYGSVCATNPLQDSGGEAD

SEQ ID NO: 63201 - protein, 34 aa, Artificial Sequence
  Description of Artificial Sequence: Synthetic polypeptide
DEEEIRTTNPVATEQYGSVCATNPLQRAEANGDP

SEQ ID NO: 63202 - protein, 33 aa, Artificial Sequence
  Description of Artificial Sequence: Synthetic polypeptide
DEEEIRTTNPVATEQYGSVCATTNGLQEQGDVH

SEQ ID NO: 63203 - protein, 32 aa, Artificial Sequence
  Description of Artificial Sequence: Synthetic polypeptide
DENEIRTTNPVATEQYGSVSPTDLERGDEQGE

SEQ ID NO: 63204 - protein, 34 aa, Artificial Sequence
  Description of Artificial Sequence: Synthetic polypeptide
DEEEIRTTNPVATEQYGSVCDTNLIQQRMVSNEE

SEQ ID NO: 63205 - protein, 34 aa, Artificial Sequence
  Description of Artificial Sequence: Synthetic polypeptide
DENEIRTTNPVATEQYGSVSPTVLLEQFRIGDNQ

SEQ ID NO: 63206 - protein, 31 aa, Artificial Sequence
  Description of Artificial Sequence: Synthetic polypeptide
DENEIRTTNPVATEQYGSVSSEPAGQHNGNL

SEQ ID NO: 63207 - protein, 32 aa, Artificial Sequence
  Description of Artificial Sequence: Synthetic polypeptide
DENEIRTTNPVATEQYGSVSTADELQEGGEFQ

SEQ ID NO: 63208 - protein, 32 aa, Artificial Sequence
  Description of Artificial Sequence: Synthetic polypeptide
DENEIRTTNPVATEQYGSVSTAGNMRNGMNPV

SEQ ID NO: 63209 - protein, 32 aa, Artificial Sequence
  Description of Artificial Sequence: Synthetic polypeptide
DENEIRTTNPVATEQYGSVSTAGPNRNGMNPV

SEQ ID NO: 63210 - protein, 31 aa, Artificial Sequence
  Description of Artificial Sequence: Synthetic polypeptide
DENEIRTTNPVATEQYGSVSTALGEDTFGEQ

SEQ ID NO: 63211 - protein, 32 aa, Artificial Sequence
  Description of Artificial Sequence: Synthetic polypeptide
DEEEIRTTNPVATEQYGSVCCNTGNLIEGGQQ

SEQ ID NO: 63212 - protein, 32 aa, Artificial Sequence
  Description of Artificial Sequence: Synthetic polypeptide
DENEIRTTNPVATEQYGSVSTDEQQNRGSQID

SEQ ID NO: 63213 - protein, 31 aa, Artificial Sequence
  Description of Artificial Sequence: Synthetic polypeptide
DENEIRTTNPVATEQYGSVSTDLQFTESQGD

SEQ ID NO: 63214 - protein, 32 aa, Artificial Sequence
  Description of Artificial Sequence: Synthetic polypeptide
DENEIRTTNPVATEQYGSVSTDNNFEGSQNPQ

SEQ ID NO: 63215 - protein, 32 aa, Artificial Sequence
  Description of Artificial Sequence: Synthetic polypeptide
DENEIRTTNPVATEQYGSVSTDNNQEGSIDPQ

SEQ ID NO: 63216 - protein, 32 aa, Artificial Sequence
  Description of Artificial Sequence: Synthetic polypeptide
DENEIRTTNPVATEQYGSVSTDTDPTRIGEDR

SEQ ID NO: 63217 - protein, 32 aa, Artificial Sequence
  Description of Artificial Sequence: Synthetic polypeptide
DENEIRTTNPVATEQYGSVSTDWLVNGENLQE

SEQ ID NO: 63218 - protein, 33 aa, Artificial Sequence
  Description of Artificial Sequence: Synthetic polypeptide
DENEIRTTNPVATEQYGSVSTEGDLQQSGNQEE

SEQ ID NO: 63219 - protein, 32 aa, Artificial Sequence
  Description of Artificial Sequence: Synthetic polypeptide
DENEIRTTNPVATEQYGSVSTGPNLDSIGPVE

SEQ ID NO: 63220 - protein, 30 aa, Artificial Sequence
  Description of Artificial Sequence: Synthetic polypeptide
DENEIRTTNPVATEQYGSVSTIEMNANGDV

SEQ ID NO: 63221 - protein, 30 aa, Artificial Sequence
  Description of Artificial Sequence: Synthetic polypeptide
DENEIRTTNPVATEQYGSVSTIGMNANGDV

SEQ ID NO: 63222 - protein, 33 aa, Artificial Sequence
  Description of Artificial Sequence: Synthetic polypeptide
DENEIRTTNPVATEQYGSVSTILEELRNGNEVF

SEQ ID NO: 63223 - protein, 33 aa, Artificial Sequence
  Description of Artificial Sequence: Synthetic polypeptide
DENEIRTTNPVATEQYGSVSTLDLQEGGNSEYT

SEQ ID NO: 63224 - protein, 33 aa, Artificial Sequence
  Description of Artificial Sequence: Synthetic polypeptide
DEEEIRTTNPVATEQYGSVCNTDNPLAGPIGTR

SEQ ID NO: 63225 - protein, 31 aa, Artificial Sequence
  Description of Artificial Sequence: Synthetic polypeptide
DENEIRTTNPVATECWGSVSCNEPQDREGNG

SEQ ID NO: 63226 - protein, 33 aa, Artificial Sequence
  Description of Artificial Sequence: Synthetic polypeptide
DENEIRTTNPVATEQYGHVCTWTNLNNRGDNDR

SEQ ID NO: 63227 - protein, 31 aa, Artificial Sequence
  Description of Artificial Sequence: Synthetic polypeptide
DENEIRTTNPVATEQYGEASSEPNGQRNGGR

SEQ ID NO: 63228 - protein, 30 aa, Artificial Sequence
  Description of Artificial Sequence: Synthetic polypeptide
DENEIRTTNPVATEIYGCVCSSNLQNGSDA

SEQ ID NO: 63229 - protein, 31 aa, Artificial Sequence
  Description of Artificial Sequence: Synthetic polypeptide
DENEIRTTNPVATEIYGCVCSWNDLQRGSEQ

SEQ ID NO: 63230 - protein, 33 aa, Artificial Sequence
  Description of Artificial Sequence: Synthetic polypeptide
DEEEIRTTNPVATEQYGSVCSDTELYQHFSSNQ

SEQ ID NO: 63231 - protein, 33 aa, Artificial Sequence
  Description of Artificial Sequence: Synthetic polypeptide
DEEEIRTTNPVATEQYGSVCSDTEDLQYFGSEQ

SEQ ID NO: 63232 - protein, 31 aa, Artificial Sequence
  Description of Artificial Sequence: Synthetic polypeptide
DENEIRTTNPVATEIYGCVCSWNLQRGSQQN

SEQ ID NO: 63233 - protein, 31 aa, Artificial Sequence
  Description of Artificial Sequence: Synthetic polypeptide
DENEIRTTNPVATEIYGCVSTNNLQDGDTGS

SEQ ID NO: 63234 - protein, 33 aa, Artificial Sequence
  Description of Artificial Sequence: Synthetic polypeptide
DENEIRTTNPVATEIYGESVTSFNVLQRGNEKQ

SEQ ID NO: 63235 - protein, 32 aa, Artificial Sequence
  Description of Artificial Sequence: Synthetic polypeptide
DEEEIRTTNPVATEQYGSVCSDALQNHGTVAQ

SEQ ID NO: 63236 - protein, 32 aa, Artificial Sequence
  Description of Artificial Sequence: Synthetic polypeptide
DEEEIRTTNPVATEQYGSVCSCWNDNQHGSDF

SEQ ID NO: 63237 - protein, 33 aa, Artificial Sequence
  Description of Artificial Sequence: Synthetic polypeptide
DENEIRTTNPVATEGYGSAVSWENLNQRGLEFR

SEQ ID NO: 63238 - protein, 32 aa, Artificial Sequence
  Description of Artificial Sequence: Synthetic polypeptide
DENEIRTTNPVATEIYGSVCSNDNNQRDGTNM

SEQ ID NO: 63239 - protein, 33 aa, Artificial Sequence
  Description of Artificial Sequence: Synthetic polypeptide
DEEEIRTTNPVATEQYGSVCSATNLNVVQEQSM

SEQ ID NO: 63240 - protein, 32 aa, Artificial Sequence
  Description of Artificial Sequence: Synthetic polypeptide
DENEIRTTNPVATEIYGSVSNNDLIQEGGGNI

SEQ ID NO: 63241 - protein, 33 aa, Artificial Sequence
  Description of Artificial Sequence: Synthetic polypeptide
DENEIRTTNPVATEIYGSVSNNDLQERGGNGNI

SEQ ID NO: 63242 - protein, 32 aa, Artificial Sequence
  Description of Artificial Sequence: Synthetic polypeptide
DENEIRTTNPVATEIYGSVSNNDLQNGGDTNQ

SEQ ID NO: 63243 - protein, 32 aa, Artificial Sequence
  Description of Artificial Sequence: Synthetic polypeptide
DEEEIRTTNPVATEQYGSVCSANNDDQGENDE

SEQ ID NO: 63244 - protein, 29 aa, Artificial Sequence
  Description of Artificial Sequence: Synthetic peptide
DENEIRTTNPVATEIYGSVSNNEMLVGTP

SEQ ID NO: 63245 - protein, 31 aa, Artificial Sequence
  Description of Artificial Sequence: Synthetic polypeptide
DENEIRTTNPVATEIYGSVSNNLDQEGGEDT

SEQ ID NO: 63246 - protein, 31 aa, Artificial Sequence
  Description of Artificial Sequence: Synthetic polypeptide
DENEIRTTNPVATEIYGSVSNNLDQEGGGQQ

SEQ ID NO: 63247 - protein, 31 aa, Artificial Sequence
  Description of Artificial Sequence: Synthetic polypeptide
DENEIRTTNPVATEIYGSVSNNLGQQGTTTT

SEQ ID NO: 63248 - protein, 31 aa, Artificial Sequence
  Description of Artificial Sequence: Synthetic polypeptide
DENEIRTTNPVATEIYGSVCSWGELQRGSDQ

SEQ ID NO: 63249 - protein, 33 aa, Artificial Sequence
  Description of Artificial Sequence: Synthetic polypeptide
DEEEIRTTNPVATEQYGSVCQTEEHQNFGSNRA

SEQ ID NO: 63250 - protein, 30 aa, Artificial Sequence
  Description of Artificial Sequence: Synthetic polypeptide
DENEIRTTNPVATEGYGCVCSWNHQRGSDQ

SEQ ID NO: 63251 - protein, 33 aa, Artificial Sequence
  Description of Artificial Sequence: Synthetic polypeptide
DENEIRTTNPVATECYGSVSTEPCLQRNGMNPV

SEQ ID NO: 63252 - protein, 30 aa, Artificial Sequence
  Description of Artificial Sequence: Synthetic polypeptide
DENEIRTTNPVATECWGSVSEIEQDRAGNA

SEQ ID NO: 63253 - protein, 30 aa, Artificial Sequence
  Description of Artificial Sequence: Synthetic polypeptide
DENEIRTTNPVATECWGSVSEIEQNRAGNA

SEQ ID NO: 63254 - protein, 30 aa, Artificial Sequence
  Description of Artificial Sequence: Synthetic polypeptide
DENEIRTTNPVATECWGSVSEINEQHEGNL

SEQ ID NO: 63255 - protein, 29 aa, Artificial Sequence
  Description of Artificial Sequence: Synthetic peptide
DENEIRTTNPVATECWGSVSEINEQHGEL

SEQ ID NO: 63256 - protein, 33 aa, Artificial Sequence
  Description of Artificial Sequence: Synthetic polypeptide
DEEEIRTTNPVATEQYGSVCSLGNLERSGEDDN

SEQ ID NO: 63257 - protein, 32 aa, Artificial Sequence
  Description of Artificial Sequence: Synthetic polypeptide
DEEEIRTTNPVATEQYGSVCSLALERGGEDDN

SEQ ID NO: 63258 - protein, 31 aa, Artificial Sequence
  Description of Artificial Sequence: Synthetic polypeptide
DENEIRTTNPVATECWGSVSEINLQDREGEL

SEQ ID NO: 63259 - protein, 29 aa, Artificial Sequence
  Description of Artificial Sequence: Synthetic peptide
DENEIRTTNPVATECYGATSEDLARGGYR

SEQ ID NO: 63260 - protein, 31 aa, Artificial Sequence
  Description of Artificial Sequence: Synthetic polypeptide
DEEEIRTTNPVATEQYGSVCSIPLQNEMVEE

SEQ ID NO: 63261 - protein, 29 aa, Artificial Sequence
  Description of Artificial Sequence: Synthetic peptide
DENEIRTTNPVATECYGTISMCLQQHGNH

SEQ ID NO: 63262 - protein, 28 aa, Artificial Sequence
  Description of Artificial Sequence: Synthetic peptide
DENEIRTTNPVATECYGDVSECLQHEEL

SEQ ID NO: 63263 - protein, 34 aa, Artificial Sequence
  Description of Artificial Sequence: Synthetic polypeptide
DEEEIRTTNPVATEQYGSVCSGTGLDTRGVEENV

SEQ ID NO: 63264 - protein, 28 aa, Artificial Sequence
  Description of Artificial Sequence: Synthetic peptide
DENEIRTTNPVATECYGDVSEDLQHEEL

SEQ ID NO: 63265 - protein, 32 aa, Artificial Sequence
  Description of Artificial Sequence: Synthetic polypeptide
DENEIRTTNPVATECYGEVSCINLPQDRGEGR

SEQ ID NO: 63266 - protein, 30 aa, Artificial Sequence
  Description of Artificial Sequence: Synthetic polypeptide
DENEIRTTNPVATECYGSVSCICLQHGEEG

SEQ ID NO: 63267 - protein, 30 aa, Artificial Sequence
  Description of Artificial Sequence: Synthetic polypeptide
DENEIRTTNPVATECYGSVSEAGQHGMNPV

SEQ ID NO: 63268 - protein, 30 aa, Artificial Sequence
  Description of Artificial Sequence: Synthetic polypeptide
DENEIRTTNPVATECYGSVSEALQHEMNPV

SEQ ID NO: 63269 - protein, 33 aa, Artificial Sequence
  Description of Artificial Sequence: Synthetic polypeptide
DEEEIRTTNPVATEQYGSVCSETNLAELTENEQ

SEQ ID NO: 63270 - protein, 30 aa, Artificial Sequence
  Description of Artificial Sequence: Synthetic polypeptide
DENEIRTTNPVATECYGSVSTAGNHGMNPV

SEQ ID NO: 63271 - protein, 31 aa, Artificial Sequence
  Description of Artificial Sequence: Synthetic polypeptide
DENEIRTTNPVATECYGSVSTAGPNRGMNPV

SEQ ID NO: 63272 - protein, 29 aa, Artificial Sequence
  Description of Artificial Sequence: Synthetic peptide
DENEIRTTNPVATECYGDVSECLQQQGEL

SEQ ID NO: 63273 - protein, 32 aa, Artificial Sequence
  Description of Artificial Sequence: Synthetic polypeptide
DEEEIRTTNPVATEQYGSVCQMTEHQRFGSDQ

SEQ ID NO: 63274 - protein, 33 aa, Artificial Sequence
  Description of Artificial Sequence: Synthetic polypeptide
DEEEIRTTNPVATEQYGSVCPWLNQNAGHNQRC

SEQ ID NO: 63275 - protein, 34 aa, Artificial Sequence
  Description of Artificial Sequence: Synthetic polypeptide
DEEEIRTTNPVATEQYGSVCPTIILQDRVIENRE

SEQ ID NO: 63276 - protein, 31 aa, Artificial Sequence
  Description of Artificial Sequence: Synthetic polypeptide
DENEIRTTNPVATEQWGSVSCIIEQNRAGNA

SEQ ID NO: 63277 - protein, 31 aa, Artificial Sequence
  Description of Artificial Sequence: Synthetic polypeptide
DENEIRTTNPVATEQWGSVSCIIEQNRAGNG

SEQ ID NO: 63278 - protein, 31 aa, Artificial Sequence
  Description of Artificial Sequence: Synthetic polypeptide
DENEIRTTNPVATEQWGSVSEIIEQNRAGNA

SEQ ID NO: 63279 - protein, 28 aa, Artificial Sequence
  Description of Artificial Sequence: Synthetic peptide
DENEIRTTNPVATEQWGSVSEILMAEDA

SEQ ID NO: 63280 - protein, 33 aa, Artificial Sequence
  Description of Artificial Sequence: Synthetic polypeptide
DEEEIRTTNPVATEQYGSVCNTFNLYGREETRD

SEQ ID NO: 63281 - protein, 33 aa, Artificial Sequence
  Description of Artificial Sequence: Synthetic polypeptide
DEEEIRTTNPVATEQYGSVCNTFNLYGREEIIR

SEQ ID NO: 63282 - protein, 31 aa, Artificial Sequence
  Description of Artificial Sequence: Synthetic polypeptide
DENEIRTTNPVATEQYGCVCSTNLQNFISEQ

SEQ ID NO: 63283 - protein, 30 aa, Artificial Sequence
  Description of Artificial Sequence: Synthetic polypeptide
DENEIRTTNPVATEQYGCVCSWNLFRNSQQ

SEQ ID NO: 63284 - protein, 33 aa, Artificial Sequence
  Description of Artificial Sequence: Synthetic polypeptide
DEEEIRTTNPVATEQYGSVCNTFNLMYGRETQR

SEQ ID NO: 63285 - protein, 32 aa, Artificial Sequence
  Description of Artificial Sequence: Synthetic polypeptide
DEEEIRTTNPVATEQYGSVCNTFNVDGGGGTR

SEQ ID NO: 63286 - protein, 31 aa, Artificial Sequence
  Description of Artificial Sequence: Synthetic polypeptide
DENEIRTTNPVATEQYGCVSTMNHQNFGSEQ

SEQ ID NO: 63287 - protein, 30 aa, Artificial Sequence
  Description of Artificial Sequence: Synthetic polypeptide
DENEIRTTNPVATEQYGCVSWPTLTRDENQ

SEQ ID NO: 63288 - protein, 33 aa, Artificial Sequence
  Description of Artificial Sequence: Synthetic polypeptide
DEEEIRTTNPVATEQYGSVCNTFNLDGTGGTER

SEQ ID NO: 63289 - protein, 31 aa, Artificial Sequence
  Description of Artificial Sequence: Synthetic polypeptide
DENEIRTTNPVATEQYGCVSWTTVLTRGSQE

SEQ ID NO: 63290 - protein, 30 aa, Artificial Sequence
  Description of Artificial Sequence: Synthetic polypeptide
DENEIRTTNPVATEQYGCVWTNNHERNNYF

SEQ ID NO: 63291 - protein, 29 aa, Artificial Sequence
  Description of Artificial Sequence: Synthetic peptide
DENEIRTTNPVATEQYGDVSECLNHNENL

SEQ ID NO: 63292 - protein, 29 aa, Artificial Sequence
  Description of Artificial Sequence: Synthetic peptide
DENEIRTTNPVATEQYGDVSEILMNAENA

SEQ ID NO: 63293 - protein, 31 aa, Artificial Sequence
  Description of Artificial Sequence: Synthetic polypeptide
DEEEIRTTNPVATEQYGSVCNTFGDYGGGTR

SEQ ID NO: 63294 - protein, 33 aa, Artificial Sequence
  Description of Artificial Sequence: Synthetic polypeptide
DEEEIRTTNPVATEQYGSVCNTFDPLYGRSGTR

SEQ ID NO: 63295 - protein, 30 aa, Artificial Sequence
  Description of Artificial Sequence: Synthetic polypeptide
DENEIRTTNPVATEQYGDVSENLMNRAEGA

SEQ ID NO: 63296 - protein, 32 aa, Artificial Sequence
  Description of Artificial Sequence: Synthetic polypeptide
DENEIRTTNPVATEQYGCVSTNLLQFVQDDNL

SEQ ID NO: 63297 - protein, 30 aa, Artificial Sequence
  Description of Artificial Sequence: Synthetic polypeptide
DENEIRTTNPVATEQWGDVSENLQNAAGTA

SEQ ID NO: 63298 - protein, 30 aa, Artificial Sequence
  Description of Artificial Sequence: Synthetic polypeptide
DENEIRTTNPVATEQWGDVSENLMNAAGDR

SEQ ID NO: 63299 - protein, 29 aa, Artificial Sequence
  Description of Artificial Sequence: Synthetic peptide
DENEIRTTNPVATEQWGDVSENEMNRENA

SEQ ID NO: 63300 - protein, 31 aa, Artificial Sequence
  Description of Artificial Sequence: Synthetic polypeptide
DEEEIRTTNPVATEQYGSVCPTDLPVMLVPR

SEQ ID NO: 63301 - protein, 30 aa, Artificial Sequence
  Description of Artificial Sequence: Synthetic polypeptide
DEEEIRTTNPVATEQYGSVCPDVLQETEEQ

SEQ ID NO: 63302 - protein, 31 aa, Artificial Sequence
  Description of Artificial Sequence: Synthetic polypeptide
DENEIRTTNPVATEIYGSVSNVNLQQGTETN

SEQ ID NO: 63303 - protein, 30 aa, Artificial Sequence
  Description of Artificial Sequence: Synthetic polypeptide
DENEIRTTNPVATEIYGSVSPNLVEVGDTP

SEQ ID NO: 63304 - protein, 31 aa, Artificial Sequence
  Description of Artificial Sequence: Synthetic polypeptide
DEEEIRTTNPVATEQYGSVCNTNPLELTQHS

SEQ ID NO: 63305 - protein, 32 aa, Artificial Sequence
  Description of Artificial Sequence: Synthetic polypeptide
DENEIRTTNPVATEIYGSVSTNNNLQSGTTTQ

SEQ ID NO: 63306 - protein, 32 aa, Artificial Sequence
  Description of Artificial Sequence: Synthetic polypeptide
DENEIRTTNPVATEIYGSVSTNTNLQQGTTTN

SEQ ID NO: 63307 - protein, 33 aa, Artificial Sequence
  Description of Artificial Sequence: Synthetic polypeptide
DENEIRTTNPVATEIYGSVSTNVNLQQGNTTTE

SEQ ID NO: 63308 - protein, 33 aa, Artificial Sequence
  Description of Artificial Sequence: Synthetic polypeptide
DENEIRTTNPVATEIYGSVVSTNVLDQAEGNEH

SEQ ID NO: 63309 - protein, 28 aa, Artificial Sequence
  Description of Artificial Sequence: Synthetic peptide
DENEIRTTNPVATEPYGEISMDIQQGNH

SEQ ID NO: 63310 - protein, 30 aa, Artificial Sequence
  Description of Artificial Sequence: Synthetic polypeptide
DENEIRTTNPVATEPYGEISMENIQRNGNH

SEQ ID NO: 63311 - protein, 30 aa, Artificial Sequence
  Description of Artificial Sequence: Synthetic polypeptide
DENEIRTTNPVATEPYGSVCFTNLTHGGEH

SEQ ID NO: 63312 - protein, 31 aa, Artificial Sequence
  Description of Artificial Sequence: Synthetic polypeptide
DENEIRTTNPVATEPYGSVSNNLQELVGTVG

SEQ ID NO: 63313 - protein, 31 aa, Artificial Sequence
  Description of Artificial Sequence: Synthetic polypeptide
DENEIRTTNPVATEPYGSVSNNLVIVGNTPE

SEQ ID NO: 63314 - protein, 29 aa, Artificial Sequence
  Description of Artificial Sequence: Synthetic peptide
DENEIRTTNPVATEPYGTISMCLQQHGNH

SEQ ID NO: 63315 - protein, 30 aa, Artificial Sequence
  Description of Artificial Sequence: Synthetic polypeptide
DENEIRTTNPVATEQWGDVSCIEQDREGNG

SEQ ID NO: 63316 - protein, 30 aa, Artificial Sequence
  Description of Artificial Sequence: Synthetic polypeptide
DENEIRTTNPVATEQWGDVSCIEQNRAGNG

SEQ ID NO: 63317 - protein, 30 aa, Artificial Sequence
  Description of Artificial Sequence: Synthetic polypeptide
DENEIRTTNPVATEQWGDVSCIEQNREGNG

SEQ ID NO: 63318 - protein, 28 aa, Artificial Sequence
  Description of Artificial Sequence: Synthetic peptide
DENEIRTTNPVATEQWGDVSEIEMAGNA

SEQ ID NO: 63319 - protein, 28 aa, Artificial Sequence
  Description of Artificial Sequence: Synthetic peptide
DENEIRTTNPVATEQWGDVSEIEMREDR

SEQ ID NO: 63320 - protein, 33 aa, Artificial Sequence
  Description of Artificial Sequence: Synthetic polypeptide
DEEEIRTTNPVATEQYGSVCNTGNLIERFGDQF

SEQ ID NO: 63321 - protein, 29 aa, Artificial Sequence
  Description of Artificial Sequence: Synthetic peptide
DENEIRTTNPVATEQYGEVSEIEQNREGA

SEQ ID NO: 63322 - protein, 28 aa, Artificial Sequence
  Description of Artificial Sequence: Synthetic peptide
AACEIACTNPVATEQYGEASENLQRGGR

SEQ ID NO: 63323 - protein, 33 aa, Artificial Sequence
  Description of Artificial Sequence: Synthetic polypeptide
YVEEIRTTNPVAVEQYGYSVVSTTNQQARGNRY

SEQ ID NO: 63324 - protein, 29 aa, Artificial Sequence
  Description of Artificial Sequence: Synthetic peptide
AELEIACTNPVATEQYGEASENLQRGQGR

SEQ ID NO: 63325 - protein, 33 aa, Artificial Sequence
  Description of Artificial Sequence: Synthetic polypeptide
DEEEIATTNPVATEQYGSVCSTNNQQAGEGNDD

SEQ ID NO: 63326 - protein, 32 aa, Artificial Sequence
  Description of Artificial Sequence: Synthetic polypeptide
DEAEICTTNPVATECYGSVSTNLQGDTGNNEN

SEQ ID NO: 63327 - protein, 33 aa, Artificial Sequence
  Description of Artificial Sequence: Synthetic polypeptide
DEAEICTTNPVATECYGSVSTNPGLQDLGGNQR

SEQ ID NO: 63328 - protein, 31 aa, Artificial Sequence
  Description of Artificial Sequence: Synthetic polypeptide
DEAEIATTNPVATEQYGSVANNLQDPGEEGR

SEQ ID NO: 63329 - protein, 30 aa, Artificial Sequence
  Description of Artificial Sequence: Synthetic polypeptide
DEAEIATTNPVATEQYGSVANNLQDGGTQH

SEQ ID NO: 63330 - protein, 34 aa, Artificial Sequence
  Description of Artificial Sequence: Synthetic polypeptide
AEEEIRTTNPVATEQYGSVSTTNQLQQGNINENT

SEQ ID NO: 63331 - protein, 33 aa, Artificial Sequence
  Description of Artificial Sequence: Synthetic polypeptide
AEEEIRTTNPVATEQYGSVVVVTTNLQLGGNES

SEQ ID NO: 63332 - protein, 30 aa, Artificial Sequence
  Description of Artificial Sequence: Synthetic polypeptide
DEAEIATTNPVATEQYGSVAMNLTTDDNDR

SEQ ID NO: 63333 - protein, 33 aa, Artificial Sequence
  Description of Artificial Sequence: Synthetic polypeptide
AEEEIRTTNPVATEQYGSVVVVTTNLQLGGNLE

SEQ ID NO: 63334 - protein, 33 aa, Artificial Sequence
  Description of Artificial Sequence: Synthetic polypeptide
AEEEIRTTNPVATEQYGSVVVVTTNLQLGGNQA

SEQ ID NO: 63335 - protein, 33 aa, Artificial Sequence
  Description of Artificial Sequence: Synthetic polypeptide
AEEEIRTTNPVATEQYGSVSTTNQLQQQEEGGG

SEQ ID NO: 63336 - protein, 30 aa, Artificial Sequence
  Description of Artificial Sequence: Synthetic polypeptide
DEAEIATTNPVATEQYGSVAMNLQEAPNDP

SEQ ID NO: 63337 - protein, 33 aa, Artificial Sequence
  Description of Artificial Sequence: Synthetic polypeptide
AEEEIRTTNPVATEQYGSVVVVTTNLQQGGNNT

SEQ ID NO: 63338 - protein, 32 aa, Artificial Sequence
  Description of Artificial Sequence: Synthetic polypeptide
DEEEIATTNPVATEQYGSVCSTNPLQDSLEDQ

SEQ ID NO: 63339 - protein, 31 aa, Artificial Sequence
  Description of Artificial Sequence: Synthetic polypeptide
DEEEIATTNPVATEQYGSVCSTNPQEEDLDD

SEQ ID NO: 63340 - protein, 33 aa, Artificial Sequence
  Description of Artificial Sequence: Synthetic polypeptide
AEEEIRTTNPVATEQYGSVVVVTTNNLQQGGNT

SEQ ID NO: 63341 - protein, 33 aa, Artificial Sequence
  Description of Artificial Sequence: Synthetic polypeptide
AEEEIRTTNPVATEAYGVVSVSVTNLQGNGNDQ

SEQ ID NO: 63342 - protein, 30 aa, Artificial Sequence
  Description of Artificial Sequence: Synthetic polypeptide
DEAEIATTNPVATEQYGSVAMNLNIAGNDN

SEQ ID NO: 63343 - protein, 29 aa, Artificial Sequence
  Description of Artificial Sequence: Synthetic peptide
DEAEIATTNPVATEQYGSVAMNLEDPNAE

SEQ ID NO: 63344 - protein, 32 aa, Artificial Sequence
  Description of Artificial Sequence: Synthetic polypeptide
DEAEICTTNPVATECYGSVSTNLQGDTGGNQD

SEQ ID NO: 63345 - protein, 30 aa, Artificial Sequence
  Description of Artificial Sequence: Synthetic polypeptide
DDEEIRTTNPVATEQWGCVTSTELQNGQQQ

SEQ ID NO: 63346 - protein, 32 aa, Artificial Sequence
  Description of Artificial Sequence: Synthetic polypeptide
DEAEICTTNPVATECYGSVSTNLQGDTGGNEQ

SEQ ID NO: 63347 - protein, 34 aa, Artificial Sequence
  Description of Artificial Sequence: Synthetic polypeptide
AEEEIRTTNPVATEQYGSVSTTNQLQEQNGTNTE

SEQ ID NO: 63348 - protein, 32 aa, Artificial Sequence
  Description of Artificial Sequence: Synthetic polypeptide
DEEEIATTNPVATEQYGSVCSTDLQSDDQNAE

SEQ ID NO: 63349 - protein, 33 aa, Artificial Sequence
  Description of Artificial Sequence: Synthetic polypeptide
AEEEIRTTNPVATEQYGSVVVVTSNLQNGNNAE

SEQ ID NO: 63350 - protein, 33 aa, Artificial Sequence
  Description of Artificial Sequence: Synthetic polypeptide
AEEEIRTTNPVATEQYGSVSTTNQEQGIGNQEA

SEQ ID NO: 63351 - protein, 33 aa, Artificial Sequence
  Description of Artificial Sequence: Synthetic polypeptide
AEEEIRTTNPVATEQYGSVSTTNQGNEQQGNQN

SEQ ID NO: 63352 - protein, 33 aa, Artificial Sequence
  Description of Artificial Sequence: Synthetic polypeptide
AEEEIRTTNPVATEQYGSVSTTNQLENTEGGNA

SEQ ID NO: 63353 - protein, 34 aa, Artificial Sequence
  Description of Artificial Sequence: Synthetic polypeptide
AEEEIRTTNPVATEQYGSVSTTNQLEQGNQGNNN

SEQ ID NO: 63354 - protein, 34 aa, Artificial Sequence
  Description of Artificial Sequence: Synthetic polypeptide
AEEEIRTTNPVATEQYGSVSTTNQLEQQGNNTND

SEQ ID NO: 63355 - protein, 28 aa, Artificial Sequence
  Description of Artificial Sequence: Synthetic peptide
AESEIASTNPVATEQYGEAAENLQRGGR

SEQ ID NO: 63356 - protein, 34 aa, Artificial Sequence
  Description of Artificial Sequence: Synthetic polypeptide
DEEEIRTTNCVATEQYGSVSTGNLNQNEMGENIG

SEQ ID NO: 63357 - protein, 33 aa, Artificial Sequence
  Description of Artificial Sequence: Synthetic polypeptide
AEEEIRTTNPVATEQYGSVSTTNQNNQEGNQEI

SEQ ID NO: 63358 - protein, 32 aa, Artificial Sequence
  Description of Artificial Sequence: Synthetic polypeptide
DEEEIACTNPVATEQYGSASTEPNGPQRGMNV

SEQ ID NO: 63359 - protein, 33 aa, Artificial Sequence
  Description of Artificial Sequence: Synthetic polypeptide
AEEEIRTTNPVATEQYGSVVVVTTNLENQGGNQ

SEQ ID NO: 63360 - protein, 34 aa, Artificial Sequence
  Description of Artificial Sequence: Synthetic polypeptide
AEEEIRTTNPVATEQYGSVSTTNQLNQEGTENST

SEQ ID NO: 63361 - protein, 33 aa, Artificial Sequence
  Description of Artificial Sequence: Synthetic polypeptide
DEEEIATTNPVATEQYGSVCSTNGLQDSDDNAD

SEQ ID NO: 63362 - protein, 32 aa, Artificial Sequence
  Description of Artificial Sequence: Synthetic polypeptide
DEEEIATTNPVATEQYGSVCSTNLEHGDLDVM

SEQ ID NO: 63363 - protein, 28 aa, Artificial Sequence
  Description of Artificial Sequence: Synthetic peptide
AESEIACTNPVSTEQYGEASENLQRGGR

SEQ ID NO: 63364 - protein, 34 aa, Artificial Sequence
  Description of Artificial Sequence: Synthetic polypeptide
AEEEIRTTNPVATEQYGSVSTTNQLNQTNNGNND

SEQ ID NO: 63365 - protein, 33 aa, Artificial Sequence
  Description of Artificial Sequence: Synthetic polypeptide
DEAEICTTNPVATECYGSVSTNLNQGDVGDNER

SEQ ID NO: 63366 - protein, 32 aa, Artificial Sequence
  Description of Artificial Sequence: Synthetic polypeptide
DEAEICTTNPVATECYGSVSTNLQGDLGNNDH

SEQ ID NO: 63367 - protein, 33 aa, Artificial Sequence
  Description of Artificial Sequence: Synthetic polypeptide
AEEEIRTTNPVATEQYGSVVVVTTNLLQAGNDE

SEQ ID NO: 63368 - protein, 33 aa, Artificial Sequence
  Description of Artificial Sequence: Synthetic polypeptide
AEEEIRTTNPVATEQYGSVVVVTTNLDEQGGNQ

SEQ ID NO: 63369 - protein, 32 aa, Artificial Sequence
  Description of Artificial Sequence: Synthetic polypeptide
DEEEIATTNPVATEQYGSVCSTNQQEAENNDF

SEQ ID NO: 63370 - protein, 32 aa, Artificial Sequence
  Description of Artificial Sequence: Synthetic polypeptide
DEEEIATTNPVATEQYGSVCSTPLNDQEEGRP

SEQ ID NO: 63371 - protein, 32 aa, Artificial Sequence
  Description of Artificial Sequence: Synthetic polypeptide
AEEEIRTTNPVATEAYGVVSVSVNNLQNQGNQ

SEQ ID NO: 63372 - protein, 31 aa, Artificial Sequence
  Description of Artificial Sequence: Synthetic polypeptide
DDEEIRTTNPVATEQWGSVTSTELQNGSDAF

SEQ ID NO: 63373 - protein, 32 aa, Artificial Sequence
  Description of Artificial Sequence: Synthetic polypeptide
DEEEIRTCNPVATEQYGSVTSTGGQGGNQEEI

SEQ ID NO: 63374 - protein, 31 aa, Artificial Sequence
  Description of Artificial Sequence: Synthetic polypeptide
DDEEIRTTNPVATEQWGSVTSTLHQRGSQQQ

SEQ ID NO: 63375 - protein, 31 aa, Artificial Sequence
  Description of Artificial Sequence: Synthetic polypeptide
DEEEIRTCNPVATEQYGSVSTGGQGGQGQGE

SEQ ID NO: 63376 - protein, 31 aa, Artificial Sequence
  Description of Artificial Sequence: Synthetic polypeptide
AEEEIRTTNPVATEQYGSVSVSNNDEVGNQA

SEQ ID NO: 63377 - protein, 31 aa, Artificial Sequence
  Description of Artificial Sequence: Synthetic polypeptide
DEAEICTTNPVATECYGVVSTNLQGDMGNEN

SEQ ID NO: 63378 - protein, 32 aa, Artificial Sequence
  Description of Artificial Sequence: Synthetic polypeptide
DEEEIRTCNPVATEQYGSVSTGGQGGNQQEEA

SEQ ID NO: 63379 - protein, 32 aa, Artificial Sequence
  Description of Artificial Sequence: Synthetic polypeptide
AEEEIRTTNPVATEQYGSVSVSNENQQGTGNS

SEQ ID NO: 63380 - protein, 32 aa, Artificial Sequence
  Description of Artificial Sequence: Synthetic polypeptide
DEAEICTTNPVATECYGVVSTNLQGDRGGNES

SEQ ID NO: 63381 - protein, 32 aa, Artificial Sequence
  Description of Artificial Sequence: Synthetic polypeptide
DEAEISTTNPVATEQYGSVCSTNLMYFGSNTA

SEQ ID NO: 63382 - protein, 28 aa, Artificial Sequence
  Description of Artificial Sequence: Synthetic peptide
AESEIACTNPVATEQYGVAAENLQRGGR

SEQ ID NO: 63383 - protein, 32 aa, Artificial Sequence
  Description of Artificial Sequence: Synthetic polypeptide
DDEEIRTTNPVATEQWGSVVSTLGGQREGETR

SEQ ID NO: 63384 - protein, 28 aa, Artificial Sequence
  Description of Artificial Sequence: Synthetic peptide
AESEIACTNPVATEQYGEASSNLQRGDI

SEQ ID NO: 63385 - protein, 28 aa, Artificial Sequence
  Description of Artificial Sequence: Synthetic peptide
AESEIACTNPVATEQYGEASENLQRGGL

SEQ ID NO: 63386 - protein, 28 aa, Artificial Sequence
  Description of Artificial Sequence: Synthetic peptide
AESEIACTNPVATEQYGEASENLQRGDI

SEQ ID NO: 63387 - protein, 31 aa, Artificial Sequence
  Description of Artificial Sequence: Synthetic polypeptide
DEEEIRTTNPVATEAYGTVSSTTNDEQGNNF

SEQ ID NO: 63388 - protein, 29 aa, Artificial Sequence
  Description of Artificial Sequence: Synthetic peptide
AESEIACTNPVATEQYGEASENLQREGGR

SEQ ID NO: 63389 - protein, 31 aa, Artificial Sequence
  Description of Artificial Sequence: Synthetic polypeptide
DEEEIRTTNPVATEAYGTVSSTVNGEQGNNF

SEQ ID NO: 63390 - protein, 30 aa, Artificial Sequence
  Description of Artificial Sequence: Synthetic polypeptide
CEEEIATTNPVATECYGVVSTNLQNPNDDF

SEQ ID NO: 63391 - protein, 29 aa, Artificial Sequence
  Description of Artificial Sequence: Synthetic peptide
AESEIACTNPVATEQYGEASENLQRAGGR

SEQ ID NO: 63392 - protein, 31 aa, Artificial Sequence
  Description of Artificial Sequence: Synthetic polypeptide
DEEEIATTNPVATEQYGSVCTNLDIDAGDDD

SEQ ID NO: 63393 - protein, 31 aa, Artificial Sequence
  Description of Artificial Sequence: Synthetic polypeptide
AEEEIRTTNPVATEQYGSVSTTNNVNLGTTG

SEQ ID NO: 63394 - protein, 32 aa, Artificial Sequence
  Description of Artificial Sequence: Synthetic polypeptide
DDEEIRTTNPVATEQWGSVTSNEGLLQREGTR

SEQ ID NO: 63395 - protein, 31 aa, Artificial Sequence
  Description of Artificial Sequence: Synthetic polypeptide
DEEEIATTNPVATEQYGSVCSTVDNNDGNED

SEQ ID NO: 63396 - protein, 32 aa, Artificial Sequence
  Description of Artificial Sequence: Synthetic polypeptide
DDEEIRTTNPVATEQWGMSVTSTLLQQRVTRE

SEQ ID NO: 63397 - protein, 33 aa, Artificial Sequence
  Description of Artificial Sequence: Synthetic polypeptide
AEEEIRTTNPVATEQYGSVVVVTVNLEQGGNQE

SEQ ID NO: 63398 - protein, 33 aa, Artificial Sequence
  Description of Artificial Sequence: Synthetic polypeptide
AEEEIRTTNPVATEAYGVVSVSTVTNLQNGNNQ

SEQ ID NO: 63399 - protein, 33 aa, Artificial Sequence
  Description of Artificial Sequence: Synthetic polypeptide
AEEEIRTTNPVATEAYGVVSVSTVNNLQNGNQD

SEQ ID NO: 63400 - protein, 28 aa, Artificial Sequence
  Description of Artificial Sequence: Synthetic peptide
CEEEIASVNPVGTEQYGVVSGNLQHGNS

SEQ ID NO: 63401 - protein, 31 aa, Artificial Sequence
  Description of Artificial Sequence: Synthetic polypeptide
DEAEIATTNPVATEQYGSVAMNEQNGNPPVR

SEQ ID NO: 63402 - protein, 32 aa, Artificial Sequence
  Description of Artificial Sequence: Synthetic polypeptide
AEEEIRTTNPVATEAYGVVSTSVVNLQNGNQN

SEQ ID NO: 63403 - protein, 31 aa, Artificial Sequence
  Description of Artificial Sequence: Synthetic polypeptide
DEAEIATTNPVATEQYGSVAMNDQDRGNTES

SEQ ID NO: 63404 - protein, 28 aa, Artificial Sequence
  Description of Artificial Sequence: Synthetic peptide
DEAEIATTNPVATEQYGSVAMNDDRVDG

SEQ ID NO: 63405 - protein, 32 aa, Artificial Sequence
  Description of Artificial Sequence: Synthetic polypeptide
DDEEIRTTNPVATEQWGSVSSTLDQDRNGTRG

SEQ ID NO: 63406 - protein, 33 aa, Artificial Sequence
  Description of Artificial Sequence: Synthetic polypeptide
AEEEIRTTNPVATEQYGSVSTTNQNQQGNGEND

SEQ ID NO: 63407 - protein, 32 aa, Artificial Sequence
  Description of Artificial Sequence: Synthetic polypeptide
DDEEIRTTNPVATEQWGSQTSTVLLQRQGTTR

SEQ ID NO: 63408 - protein, 30 aa, Artificial Sequence
  Description of Artificial Sequence: Synthetic polypeptide
DDEEIRTTNPVATEQWGSQTSVLLQRQGTG

SEQ ID NO: 63409 - protein, 30 aa, Artificial Sequence
  Description of Artificial Sequence: Synthetic polypeptide
DEAEISTTNPVATEQYGVVSTELQNFPSNQ

SEQ ID NO: 63410 - protein, 32 aa, Artificial Sequence
  Description of Artificial Sequence: Synthetic polypeptide
AEEEIRTTNPVATEQYGSVSVSNNEQDEGNEA

SEQ ID NO: 63411 - protein, 31 aa, Artificial Sequence
  Description of Artificial Sequence: Synthetic polypeptide
AEEEIRTTNPVATEAYGVVSSVNNLQNGNQQ

SEQ ID NO: 63412 - protein, 31 aa, Artificial Sequence
  Description of Artificial Sequence: Synthetic polypeptide
AEEEIRTTNPVATEAYGVVSSVNLQNQGTNQ

SEQ ID NO: 63413 - protein, 31 aa, Artificial Sequence
  Description of Artificial Sequence: Synthetic polypeptide
AEEEIRTTNPVATEAYGVVSSVNLQNNEGNQ

SEQ ID NO: 63414 - protein, 31 aa, Artificial Sequence
  Description of Artificial Sequence: Synthetic polypeptide
AEEEIRTTNPVATEAYGVVSSVNLQNGNNVQ

SEQ ID NO: 63415 - protein, 33 aa, Artificial Sequence
  Description of Artificial Sequence: Synthetic polypeptide
DEAEISTTNPVATEQYGSVPNTNMLSQRPGGNS

SEQ ID NO: 63416 - protein, 33 aa, Artificial Sequence
  Description of Artificial Sequence: Synthetic polypeptide
AEEEIRTTNPVATEQYGSVSVSNNLQEEGNNQI

SEQ ID NO: 63417 - protein, 32 aa, Artificial Sequence
  Description of Artificial Sequence: Synthetic polypeptide
AEEEIRTTNPVATEQYGSVVVVTNNQNGNPVG

SEQ ID NO: 63418 - protein, 30 aa, Artificial Sequence
  Description of Artificial Sequence: Synthetic polypeptide
AEEEIRTTNPVATEEWGCFSINDLQGGQNR

SEQ ID NO: 63419 - protein, 33 aa, Artificial Sequence
  Description of Artificial Sequence: Synthetic polypeptide
AEEEIRTTNPVATEQYGSVSTTNNTNQLGNEEV

SEQ ID NO: 63420 - protein, 31 aa, Artificial Sequence
  Description of Artificial Sequence: Synthetic polypeptide
DEEEIACTNPVATEQYGSVATNLEADENDRQ

SEQ ID NO: 63421 - protein, 31 aa, Artificial Sequence
  Description of Artificial Sequence: Synthetic polypeptide
DEEEIACTNPVATEQYGSVATNLDQDDGPEM

SEQ ID NO: 63422 - protein, 32 aa, Artificial Sequence
  Description of Artificial Sequence: Synthetic polypeptide
DEEEIACTNPVATEQYGSVATNLDDRGPNEDA

SEQ ID NO: 63423 - protein, 31 aa, Artificial Sequence
  Description of Artificial Sequence: Synthetic polypeptide
DEEEIRTTNPAATEQYGSVPTDLTRGQGAED

SEQ ID NO: 63424 - protein, 31 aa, Artificial Sequence
  Description of Artificial Sequence: Synthetic polypeptide
DEEEIRTTNPAATEQYGSVPTDLANGQGGEQ

SEQ ID NO: 63425 - protein, 31 aa, Artificial Sequence
  Description of Artificial Sequence: Synthetic polypeptide
DEEEIACTNPVATEQYGSVATNDQRDENDNN

SEQ ID NO: 63426 - protein, 33 aa, Artificial Sequence
  Description of Artificial Sequence: Synthetic polypeptide
DEAEICTTNPVATECYGSVSTGNLQGDRGDNET

SEQ ID NO: 63427 - protein, 31 aa, Artificial Sequence
  Description of Artificial Sequence: Synthetic polypeptide
CEEEIACTNPVATEQYGSVATNLQRNNNMVY

SEQ ID NO: 63428 - protein, 31 aa, Artificial Sequence
  Description of Artificial Sequence: Synthetic polypeptide
CEEEIACTNPVATEQYGSVATNLQTEDGNEN

SEQ ID NO: 63429 - protein, 31 aa, Artificial Sequence
  Description of Artificial Sequence: Synthetic polypeptide
DEEEIACTNPVATEQYGSVATNLEDGDNNDD

SEQ ID NO: 63430 - protein, 32 aa, Artificial Sequence
  Description of Artificial Sequence: Synthetic polypeptide
CEEEIACTNPVATEQYGSVATNNLENRGENDR

SEQ ID NO: 63431 - protein, 31 aa, Artificial Sequence
  Description of Artificial Sequence: Synthetic polypeptide
AESEIATTNPVATEQYGEVSENLPQDRGENG

SEQ ID NO: 63432 - protein, 31 aa, Artificial Sequence
  Description of Artificial Sequence: Synthetic polypeptide
DEEEIACTNPVATEQYGSVATGLQNNDGNDQ

SEQ ID NO: 63433 - protein, 31 aa, Artificial Sequence
  Description of Artificial Sequence: Synthetic polypeptide
DEEEIATTNPVATEQYGSVCATPLDNRMGDD

SEQ ID NO: 63434 - protein, 33 aa, Artificial Sequence
  Description of Artificial Sequence: Synthetic polypeptide
AEEEIRTTNPVATEQYGSVSTTNNQQQQIGTNG

SEQ ID NO: 63435 - protein, 30 aa, Artificial Sequence
  Description of Artificial Sequence: Synthetic polypeptide
AESEIATTNPVATEQYGEASENLPQDRGNG

SEQ ID NO: 63436 - protein, 33 aa, Artificial Sequence
  Description of Artificial Sequence: Synthetic polypeptide
DEEEIATTNPVATEQYGSVCATVLQEREGNEST

SEQ ID NO: 63437 - protein, 33 aa, Artificial Sequence
  Description of Artificial Sequence: Synthetic polypeptide
DEEEIATTNPVATEQYGSVCATVLQREGPNESQ

SEQ ID NO: 63438 - protein, 33 aa, Artificial Sequence
  Description of Artificial Sequence: Synthetic polypeptide
DEEEIATTNPVATEQYGSVCENLQDQGGGNDRS

SEQ ID NO: 63439 - protein, 30 aa, Artificial Sequence
  Description of Artificial Sequence: Synthetic polypeptide
DEEEIRTTNPAATEQYGSVNGNIGDGGNDQ

SEQ ID NO: 63440 - protein, 32 aa, Artificial Sequence
  Description of Artificial Sequence: Synthetic polypeptide
DEEEIATTNPVATEQYGSVCATPELQNQGNQD

SEQ ID NO: 63441 - protein, 32 aa, Artificial Sequence
  Description of Artificial Sequence: Synthetic polypeptide
DEEEIATTNPVATEQYGSVCGTADIPQDNGNR

SEQ ID NO: 63442 - protein, 31 aa, Artificial Sequence
  Description of Artificial Sequence: Synthetic polypeptide
DEAEIATTNPVATEQYGSVASGNLEQTAGSD

SEQ ID NO: 63443 - protein, 31 aa, Artificial Sequence
  Description of Artificial Sequence: Synthetic polypeptide
DEEEIRTTNPAATEQYGSVSDGNGGDGNEDD

SEQ ID NO: 63444 - protein, 31 aa, Artificial Sequence
  Description of Artificial Sequence: Synthetic polypeptide
DEEEIACTNPVATEQYGSVATNLQANNPNGE

SEQ ID NO: 63445 - protein, 31 aa, Artificial Sequence
  Description of Artificial Sequence: Synthetic polypeptide
DEEEIACTNPVATEQYGSVATNLQAEPNDNN

SEQ ID NO: 63446 - protein, 30 aa, Artificial Sequence
  Description of Artificial Sequence: Synthetic polypeptide
AESEIRCTNPVATECYGEVSCNEQDRGENR

SEQ ID NO: 63447 - protein, 33 aa, Artificial Sequence
  Description of Artificial Sequence: Synthetic polypeptide
DEEEIATTNPVATEQYGSVCATNPLQDQGSNEF

SEQ ID NO: 63448 - protein, 31 aa, Artificial Sequence
  Description of Artificial Sequence: Synthetic polypeptide
DEEEIRTTNPAATEQYGTTSTGNTDGVDGNR

SEQ ID NO: 63449 - protein, 31 aa, Artificial Sequence
  Description of Artificial Sequence: Synthetic polypeptide
DEEEIACTNPVATEQYGSVATNLQAEDNEDN

SEQ ID NO: 63450 - protein, 32 aa, Artificial Sequence
  Description of Artificial Sequence: Synthetic polypeptide
DEEEIATTNPVATEQYGSVCATNPLQSDQNNE

SEQ ID NO: 63451 - protein, 32 aa, Artificial Sequence
  Description of Artificial Sequence: Synthetic polypeptide
DEAEICTTNPVATECYGSVSTGNLQGDMGNED

SEQ ID NO: 63452 - protein, 31 aa, Artificial Sequence
  Description of Artificial Sequence: Synthetic polypeptide
CEEEIACTNPVATEQYGSVATNLQHNGNQPE

SEQ ID NO: 63453 - protein, 31 aa, Artificial Sequence
  Description of Artificial Sequence: Synthetic polypeptide
CEEEIACTNPVATEQYGSVATNLQRNANMLW

SEQ ID NO: 63454 - protein, 31 aa, Artificial Sequence
  Description of Artificial Sequence: Synthetic polypeptide
CEEEIACTNPVATEQYGSVATNLQNDGNESF

SEQ ID NO: 63455 - protein, 30 aa, Artificial Sequence
  Description of Artificial Sequence: Synthetic polypeptide
CEEEIACTNPVATEQYGSVATNLQNNNNPV

SEQ ID NO: 63456 - protein, 32 aa, Artificial Sequence
  Description of Artificial Sequence: Synthetic polypeptide
AEEEIRTTNPVATEQYGSVSTTNNQQQQGDQG

SEQ ID NO: 63457 - protein, 31 aa, Artificial Sequence
  Description of Artificial Sequence: Synthetic polypeptide
CEEEIACTNPVATEQYGSVATNLQNQGNEGL

SEQ ID NO: 63458 - protein, 31 aa, Artificial Sequence
  Description of Artificial Sequence: Synthetic polypeptide
DEEEIACTNPVATEQYGSVATNLQADENDNY

SEQ ID NO: 63459 - protein, 31 aa, Artificial Sequence
  Description of Artificial Sequence: Synthetic polypeptide
DEEEIACTNPVATEQYGSVATNLQADENAEE

SEQ ID NO: 63460 - protein, 31 aa, Artificial Sequence
  Description of Artificial Sequence: Synthetic polypeptide
DEEEIRTTNPAATEQYGSVSGNIFNDGGNID

SEQ ID NO: 63461 - protein, 31 aa, Artificial Sequence
  Description of Artificial Sequence: Synthetic polypeptide
DEEEIRTTNPAATEQYGSVSGNIFDQGNEDN

SEQ ID NO: 63462 - protein, 32 aa, Artificial Sequence
  Description of Artificial Sequence: Synthetic polypeptide
DEEEIACTNPVATEQYGSVATNLERPQENDRE

SEQ ID NO: 63463 - protein, 32 aa, Artificial Sequence
  Description of Artificial Sequence: Synthetic polypeptide
DEEEIACTNPVATEQYGSVATNLERPGPEPRT

SEQ ID NO: 63464 - protein, 30 aa, Artificial Sequence
  Description of Artificial Sequence: Synthetic polypeptide
DEAEISTTNPVAYEQYGSISTNLENPSNRS

SEQ ID NO: 63465 - protein, 28 aa, Artificial Sequence
  Description of Artificial Sequence: Synthetic peptide
AESEIACTNPVATEQYGEASENLQHGGR

SEQ ID NO: 63466 - protein, 34 aa, Artificial Sequence
  Description of Artificial Sequence: Synthetic polypeptide
DEEEIRTTNPAATEQYGSVIQTDNGLQRNGNGGE

SEQ ID NO: 63467 - protein, 33 aa, Artificial Sequence
  Description of Artificial Sequence: Synthetic polypeptide
DEEEIRTTNPAATEQYGSVILTNLQREGEGGAT

SEQ ID NO: 63468 - protein, 33 aa, Artificial Sequence
  Description of Artificial Sequence: Synthetic polypeptide
AEEEIRTTNPVATEQYGSVSTTNNQQQTGTNED

SEQ ID NO: 63469 - protein, 33 aa, Artificial Sequence
  Description of Artificial Sequence: Synthetic polypeptide
AEEEIRTTNPVATEQYGSVVVVTNLQLGGNNAN

SEQ ID NO: 63470 - protein, 33 aa, Artificial Sequence
  Description of Artificial Sequence: Synthetic polypeptide
AEEEIRTTNPVATEQYGSVVVVTNLQNGNNTAE

SEQ ID NO: 63471 - protein, 33 aa, Artificial Sequence
  Description of Artificial Sequence: Synthetic polypeptide
AEEEIRTTNPVATEQYGSVVVVTNLQQGGNATE

SEQ ID NO: 63472 - protein, 33 aa, Artificial Sequence
  Description of Artificial Sequence: Synthetic polypeptide
AEEEIRTTNPVATEQYGSVVVVTNLQQGQGNTG

SEQ ID NO: 63473 - protein, 31 aa, Artificial Sequence
  Description of Artificial Sequence: Synthetic polypeptide
DEEEIRTTNPVATEAYGTCSMTGNEQHGNGF

SEQ ID NO: 63474 - protein, 33 aa, Artificial Sequence
  Description of Artificial Sequence: Synthetic polypeptide
DEEEIRTTNPVATEAYGTISYTGNELSQREGNN

SEQ ID NO: 63475 - protein, 31 aa, Artificial Sequence
  Description of Artificial Sequence: Synthetic polypeptide
DDEEIRTTNPVATEQFGTVSIMNLQVRFGED

SEQ ID NO: 63476 - protein, 33 aa, Artificial Sequence
  Description of Artificial Sequence: Synthetic polypeptide
AEEEIRTTNPVATEQYGSVVVVTNLQQGTGNGT

SEQ ID NO: 63477 - protein, 33 aa, Artificial Sequence
  Description of Artificial Sequence: Synthetic polypeptide
AEEEIRTTNPVATEQYGSVVVVTNLQDNGNTGN

SEQ ID NO: 63478 - protein, 30 aa, Artificial Sequence
  Description of Artificial Sequence: Synthetic polypeptide
AEEEIRTTNPVATEEYGCITSSNHQRGSNQ

SEQ ID NO: 63479 - protein, 33 aa, Artificial Sequence
  Description of Artificial Sequence: Synthetic polypeptide
AEEEIRTTNPVATEQYGSVSTTNNQQTQGTNLD

SEQ ID NO: 63480 - protein, 32 aa, Artificial Sequence
  Description of Artificial Sequence: Synthetic polypeptide
AEEEIRTTNPVATEQYGSVSTTNNSEQGNNNS

SEQ ID NO: 63481 - protein, 32 aa, Artificial Sequence
  Description of Artificial Sequence: Synthetic polypeptide
AEEEIRTTNPVATEQYGSVSTTNNSNGTVGNV

SEQ ID NO: 63482 - protein, 33 aa, Artificial Sequence
  Description of Artificial Sequence: Synthetic polypeptide
AEEEIRTTNPVATEQYGSVSTTNNSTTQAGTNY

SEQ ID NO: 63483 - protein, 31 aa, Artificial Sequence
  Description of Artificial Sequence: Synthetic polypeptide
AEEEIRTTNPVATEEYGCFSINLQRFGSNQG

SEQ ID NO: 63484 - protein, 33 aa, Artificial Sequence
  Description of Artificial Sequence: Synthetic polypeptide
AEEEIRTTNPVATEQYGSVVVVTNNLQLGGNDE

SEQ ID NO: 63485 - protein, 30 aa, Artificial Sequence
  Description of Artificial Sequence: Synthetic polypeptide
AEEEIRTTNPVATEEYGCCKSINLERGENQ

SEQ ID NO: 63486 - protein, 32 aa, Artificial Sequence
  Description of Artificial Sequence: Synthetic polypeptide
AEEEIRTTNPVATEQYGSVSTTNNTILGNENV

SEQ ID NO: 63487 - protein, 32 aa, Artificial Sequence
  Description of Artificial Sequence: Synthetic polypeptide
DEDEIRTTNPVATEIYGCVSTGNDLQDAGNDQ

SEQ ID NO: 63488 - protein, 32 aa, Artificial Sequence
  Description of Artificial Sequence: Synthetic polypeptide
DDEEIRTTNPVATEQWGAVTSNTLLQEREGTR

SEQ ID NO: 63489 - protein, 33 aa, Artificial Sequence
  Description of Artificial Sequence: Synthetic polypeptide
DEEEIRTTNPAATEQYGSVIMTNGQERGQGGNV

SEQ ID NO: 63490 - protein, 33 aa, Artificial Sequence
  Description of Artificial Sequence: Synthetic polypeptide
AEEEIRTTNPVATEQYGSVVVVTNLQAGANNDG

SEQ ID NO: 63491 - protein, 33 aa, Artificial Sequence
  Description of Artificial Sequence: Synthetic polypeptide
DEDEIRTTNPVATEHYGSVSTNLQPQGGDDDRN

SEQ ID NO: 63492 - protein, 31 aa, Artificial Sequence
  Description of Artificial Sequence: Synthetic polypeptide
DEEEIRTTNPAATEQYGSVCTDLARGQGDED

SEQ ID NO: 63493 - protein, 32 aa, Artificial Sequence
  Description of Artificial Sequence: Synthetic polypeptide
DEEEIRTTNPAATEGYGSVNVNTNLAREGNGD

SEQ ID NO: 63494 - protein, 32 aa, Artificial Sequence
  Description of Artificial Sequence: Synthetic polypeptide
DEEEIRTTNPAATEGYGSVNSTNLAREGGGDT

SEQ ID NO: 63495 - protein, 28 aa, Artificial Sequence
  Description of Artificial Sequence: Synthetic peptide
CEEEIACVNPVGTEQYGVVSDNLQNGNS

SEQ ID NO: 63496 - protein, 29 aa, Artificial Sequence
  Description of Artificial Sequence: Synthetic peptide
DEEEIRTTNPAATEFYGSVAGTGTGNGNA

SEQ ID NO: 63497 - protein, 33 aa, Artificial Sequence
  Description of Artificial Sequence: Synthetic polypeptide
AEEEIRTTNPVATEQYGSVVVVSTDNQQIGNNL

SEQ ID NO: 63498 - protein, 32 aa, Artificial Sequence
  Description of Artificial Sequence: Synthetic polypeptide
DEEEIATTNPVATEQYGSVCSATNDQDLPGEN

SEQ ID NO: 63499 - protein, 33 aa, Artificial Sequence
  Description of Artificial Sequence: Synthetic polypeptide
DEEEIATTNPVATEQYGSVCSATVLDQDSGPMR

SEQ ID NO: 63500 - protein, 34 aa, Artificial Sequence
  Description of Artificial Sequence: Synthetic polypeptide
AEEEIRTTNPVATEQYGSVVVVSTTNLEQGGNDQ

SEQ ID NO: 63501 - protein, 28 aa, Artificial Sequence
  Description of Artificial Sequence: Synthetic peptide
CEEEIASVNPVCTEQYGVVSDNLQSGNQ

SEQ ID NO: 63502 - protein, 33 aa, Artificial Sequence
  Description of Artificial Sequence: Synthetic polypeptide
AEEEIRTTNPVATEQYGSVSVSTNDQQQNGNLG

SEQ ID NO: 63503 - protein, 34 aa, Artificial Sequence
  Description of Artificial Sequence: Synthetic polypeptide
AEEEIRTTNPVATEQYGSVVVVSTVNLQNGNNAQ

SEQ ID NO: 63504 - protein, 32 aa, Artificial Sequence
  Description of Artificial Sequence: Synthetic polypeptide
AEEEIRTTNPVATEQYGSVVVVTNLGGNGGNE

SEQ ID NO: 63505 - protein, 32 aa, Artificial Sequence
  Description of Artificial Sequence: Synthetic polypeptide
AEEEIRTTNPVATEQYGSVVVVTNLGGNGNDN

SEQ ID NO: 63506 - protein, 32 aa, Artificial Sequence
  Description of Artificial Sequence: Synthetic polypeptide
AEEEIRTTNPVATEQYGSVVVVTNLGGNGTNE

SEQ ID NO: 63507 - protein, 33 aa, Artificial Sequence
  Description of Artificial Sequence: Synthetic polypeptide
AEEEIRTTNPVATEQYGSVSTTNNQQQTEGNDE

SEQ ID NO: 63508 - protein, 28 aa, Artificial Sequence
  Description of Artificial Sequence: Synthetic peptide
CEEEIASVNPVCTEQYGVVSDNLQSGNE

SEQ ID NO: 63509 - protein, 32 aa, Artificial Sequence
  Description of Artificial Sequence: Synthetic polypeptide
AEEEIRTTNPVATEQYGSVVVVTNLGGTQGNG

SEQ ID NO: 63510 - protein, 33 aa, Artificial Sequence
  Description of Artificial Sequence: Synthetic polypeptide
AEEEIRTTNPVATEQYGSVVVVTNLGQQGEGNT

SEQ ID NO: 63511 - protein, 31 aa, Artificial Sequence
  Description of Artificial Sequence: Synthetic polypeptide
AEEEIRTTNPVATEEYGCSCSSELQRGSNAA

SEQ ID NO: 63512 - protein, 33 aa, Artificial Sequence
  Description of Artificial Sequence: Synthetic polypeptide
AEEEIRTTNPVATEQYGSVVVVSTTNQQEGNQT

SEQ ID NO: 63513 - protein, 29 aa, Artificial Sequence
  Description of Artificial Sequence: Synthetic peptide
DEEEIRTTNPCATAQWGQVPTADDQRGNQ

SEQ ID NO: 63514 - protein, 29 aa, Artificial Sequence
  Description of Artificial Sequence: Synthetic peptide
AESEIACTNPVATEQYGEASENLQDRGNG

SEQ ID NO: 63515 - protein, 33 aa, Artificial Sequence
  Description of Artificial Sequence: Synthetic polypeptide
AEEEIRTTNPVATEQYGSVSTTNQNQQTNGNED

SEQ ID NO: 63516 - protein, 33 aa, Artificial Sequence
  Description of Artificial Sequence: Synthetic polypeptide
DEAEICTTNPVATEQYGSVSTNLQGDHGRNGDA

SEQ ID NO: 63517 - protein, 32 aa, Artificial Sequence
  Description of Artificial Sequence: Synthetic polypeptide
DEAEICTTNPVATEQYGSVSTNLQGDTGGQDA

SEQ ID NO: 63518 - protein, 33 aa, Artificial Sequence
  Description of Artificial Sequence: Synthetic polypeptide
AEEEIRTTNPVATEQYGVVSTTNLQQAQGNNVE

SEQ ID NO: 63519 - protein, 33 aa, Artificial Sequence
  Description of Artificial Sequence: Synthetic polypeptide
DEAEICTTNPVATEQYGSVSTNLQGNNGGMDMR

SEQ ID NO: 63520 - protein, 31 aa, Artificial Sequence
  Description of Artificial Sequence: Synthetic polypeptide
DEAEICTTNPVATEQYGSVSTNNGGNGMDLR

SEQ ID NO: 63521 - protein, 32 aa, Artificial Sequence
  Description of Artificial Sequence: Synthetic polypeptide
DEAEIATTNPVATEQYGSVAATANLQVGDNDT

SEQ ID NO: 63522 - protein, 32 aa, Artificial Sequence
  Description of Artificial Sequence: Synthetic polypeptide
DEAEIATTNPVATEQYGSVAATANLQAEGPNE

SEQ ID NO: 63523 - protein, 31 aa, Artificial Sequence
  Description of Artificial Sequence: Synthetic polypeptide
DEAEIATTNPVATEQYGSVAATANLEMGMNL

SEQ ID NO: 63524 - protein, 31 aa, Artificial Sequence
  Description of Artificial Sequence: Synthetic polypeptide
DEAEICTTNPVATEQYGSVSTNPGNGGMDMR

SEQ ID NO: 63525 - protein, 31 aa, Artificial Sequence
  Description of Artificial Sequence: Synthetic polypeptide
DEAEICTTNPVATEQYGSVSTQNGDVPGNDQ

SEQ ID NO: 63526 - protein, 33 aa, Artificial Sequence
  Description of Artificial Sequence: Synthetic polypeptide
AEEEIRTTNPVATEQYGSVSTTNSNQQGNGNQE

SEQ ID NO: 63527 - protein, 31 aa, Artificial Sequence
  Description of Artificial Sequence: Synthetic polypeptide
DEEEIACTNPVATEQYGCVATNLQPRNQGEH

SEQ ID NO: 63528 - protein, 30 aa, Artificial Sequence
  Description of Artificial Sequence: Synthetic polypeptide
AEEEIRTTNPCATEQYGSVIMTQAPFGINR

SEQ ID NO: 63529 - protein, 32 aa, Artificial Sequence
  Description of Artificial Sequence: Synthetic polypeptide
DEAEICTTNPVATEQYGSVSTSNDNSNQGNER

SEQ ID NO: 63530 - protein, 32 aa, Artificial Sequence
  Description of Artificial Sequence: Synthetic polypeptide
AEEEIRSTNPVATEQYGSVGSTNLTHEVSNRD

SEQ ID NO: 63531 - protein, 33 aa, Artificial Sequence
  Description of Artificial Sequence: Synthetic polypeptide
AEEEIRTTNPVATEQYGSVSTTNSNQQQGNNEV

SEQ ID NO: 63532 - protein, 32 aa, Artificial Sequence
  Description of Artificial Sequence: Synthetic polypeptide
AEEEIRTTNPVATEQYGSVSTTNSNSEQGTNS

SEQ ID NO: 63533 - protein, 31 aa, Artificial Sequence
  Description of Artificial Sequence: Synthetic polypeptide
DEAEIATTNPVATEQYGSVAANLQEAGNDPE

SEQ ID NO: 63534 - protein, 32 aa, Artificial Sequence
  Description of Artificial Sequence: Synthetic polypeptide
AEEEIRTTNPVATEQYGSVSTTNSQGTNNVTE

SEQ ID NO: 63535 - protein, 33 aa, Artificial Sequence
  Description of Artificial Sequence: Synthetic polypeptide
DEAEICTTNPVATEQYGSVSTNLQGDHGQGGNA

SEQ ID NO: 63536 - protein, 32 aa, Artificial Sequence
  Description of Artificial Sequence: Synthetic polypeptide
AEEEIRTTNPVATEQYGSVSTTNQVQGQTNVE

SEQ ID NO: 63537 - protein, 31 aa, Artificial Sequence
  Description of Artificial Sequence: Synthetic polypeptide
DEAEIATTNPVATEQYGSVAATNLADGNSED

SEQ ID NO: 63538 - protein, 32 aa, Artificial Sequence
  Description of Artificial Sequence: Synthetic polypeptide
AEEEIRTTNPVATEQYGSVSTTNQSNEQGNQS

SEQ ID NO: 63539 - protein, 30 aa, Artificial Sequence
  Description of Artificial Sequence: Synthetic polypeptide
AEEEIRTTNPVATEQYGSVSVNNTETINNN

SEQ ID NO: 63540 - protein, 32 aa, Artificial Sequence
  Description of Artificial Sequence: Synthetic polypeptide
AEEEIRTTNPVATEQYGSVSVNNNLGIIQGNG

SEQ ID NO: 63541 - protein, 33 aa, Artificial Sequence
  Description of Artificial Sequence: Synthetic polypeptide
AEEEIRTTNPVATEQYGSVSTTNQQQQTGTNET

SEQ ID NO: 63542 - protein, 29 aa, Artificial Sequence
  Description of Artificial Sequence: Synthetic peptide
AEQEIACTNPVATEQYGEASENLQRGDRG

SEQ ID NO: 63543 - protein, 29 aa, Artificial Sequence
  Description of Artificial Sequence: Synthetic peptide
AEQEIACTNPVATEQYGEASENLQREGGR

SEQ ID NO: 63544 - protein, 31 aa, Artificial Sequence
  Description of Artificial Sequence: Synthetic polypeptide
DEAEICTTNPVATEQYGSVSTNGGGNGMDSR

SEQ ID NO: 63545 - protein, 32 aa, Artificial Sequence
  Description of Artificial Sequence: Synthetic polypeptide
DEEEIACTNPVATEQYGCVATNLQTEDGNERE

SEQ ID NO: 63546 - protein, 30 aa, Artificial Sequence
  Description of Artificial Sequence: Synthetic polypeptide
AEEEIRTTNPVATEAWGCFSINDHQRGNGR

SEQ ID NO: 63547 - protein, 31 aa, Artificial Sequence
  Description of Artificial Sequence: Synthetic polypeptide
DEEEIACTNPVATEQYGCVATNLQTDGNESE

SEQ ID NO: 63548 - protein, 28 aa, Artificial Sequence
  Description of Artificial Sequence: Synthetic peptide
AEQCIACTNPVATEQYGEASENLQRGGR

SEQ ID NO: 63549 - protein, 33 aa, Artificial Sequence
  Description of Artificial Sequence: Synthetic polypeptide
DEAEIATTNPVATEQYGSVAATNLQEGPGNPRS

SEQ ID NO: 63550 - protein, 32 aa, Artificial Sequence
  Description of Artificial Sequence: Synthetic polypeptide
DEAEICTTNPVATEQYGSVSTNLNGNDGHNDA

SEQ ID NO: 63551 - protein, 33 aa, Artificial Sequence
  Description of Artificial Sequence: Synthetic polypeptide
AEEEIRTTNPVATEQYGSVSTTNQQQQTQGNNE

SEQ ID NO: 63552 - protein, 28 aa, Artificial Sequence
  Description of Artificial Sequence: Synthetic peptide
AEQEIACTNPVATEQYGEASENLERGGR

SEQ ID NO: 63553 - protein, 31 aa, Artificial Sequence
  Description of Artificial Sequence: Synthetic polypeptide
DEEEIACTNPVATEQYGCVATNLQTAGNDEE

SEQ ID NO: 63554 - protein, 33 aa, Artificial Sequence
  Description of Artificial Sequence: Synthetic polypeptide
AEEEIRTTNPVATEQYGSVSTTNQQQTQGENEE

SEQ ID NO: 63555 - protein, 31 aa, Artificial Sequence
  Description of Artificial Sequence: Synthetic polypeptide
DEEEIRSTNPVAYEAYGTVCTNSLSQRGGSR

SEQ ID NO: 63556 - protein, 33 aa, Artificial Sequence
  Description of Artificial Sequence: Synthetic polypeptide
DEAEICTTNPVATEQYGSVSTNLNQGADGGNAM

SEQ ID NO: 63557 - protein, 33 aa, Artificial Sequence
  Description of Artificial Sequence: Synthetic polypeptide
DEAEICTTNPVATEQYGSVSTNLNQGDHGGNDA

SEQ ID NO: 63558 - protein, 31 aa, Artificial Sequence
  Description of Artificial Sequence: Synthetic polypeptide
DEAEIATTNPVATEQYGSVAATNLARDINEN

SEQ ID NO: 63559 - protein, 31 aa, Artificial Sequence
  Description of Artificial Sequence: Synthetic polypeptide
DEAEICTTNPVATEQYGSVSTNGNGNGMDQR

SEQ ID NO: 63560 - protein, 32 aa, Artificial Sequence
  Description of Artificial Sequence: Synthetic polypeptide
AEEEIRCTNPVATEQYGSASTENGPQMRNGGR

SEQ ID NO: 63561 - protein, 30 aa, Artificial Sequence
  Description of Artificial Sequence: Synthetic polypeptide
DEAEIATTNPVATEQYGSVAANLQDQVNDD

SEQ ID NO: 63562 - protein, 31 aa, Artificial Sequence
  Description of Artificial Sequence: Synthetic polypeptide
DEEEIACTNPVATEQYGCVATNLQPDGGERE

SEQ ID NO: 63563 - protein, 33 aa, Artificial Sequence
  Description of Artificial Sequence: Synthetic polypeptide
AEEEIRATNPVATEQWGSVSTGNPLGQHGENGR

SEQ ID NO: 63564 - protein, 32 aa, Artificial Sequence
  Description of Artificial Sequence: Synthetic polypeptide
DEAEIATTNPVATEQYGSVAAATNQQRGPDRQ

SEQ ID NO: 63565 - protein, 28 aa, Artificial Sequence
  Description of Artificial Sequence: Synthetic peptide
AENSIACTNPVATEQYGEASENLQRGGR

SEQ ID NO: 63566 - protein, 32 aa, Artificial Sequence
  Description of Artificial Sequence: Synthetic polypeptide
DEAEICTTNPVATEQYGSVSTTNGAQNDNDER

SEQ ID NO: 63567 - protein, 30 aa, Artificial Sequence
  Description of Artificial Sequence: Synthetic polypeptide
DEEEIACTNPVATEQYGCVATNLQGDNDSH

SEQ ID NO: 63568 - protein, 28 aa, Artificial Sequence
  Description of Artificial Sequence: Synthetic peptide
AENRIACTNPVATEQYGNASENLQRGGR

SEQ ID NO: 63569 - protein, 28 aa, Artificial Sequence
  Description of Artificial Sequence: Synthetic peptide
AENRIACTNPVATEQYGEASENLQRGGR

SEQ ID NO: 63570 - protein, 28 aa, Artificial Sequence
  Description of Artificial Sequence: Synthetic peptide
AENQIACTNPVATEQYGEFSENLQRGGR

SEQ ID NO: 63571 - protein, 28 aa, Artificial Sequence
  Description of Artificial Sequence: Synthetic peptide
AENQIACTNPVATEQYGEASENLQRGGR

SEQ ID NO: 63572 - protein, 32 aa, Artificial Sequence
  Description of Artificial Sequence: Synthetic polypeptide
AEEEIRTTNPVATEQYGSVSTTNTNGTVGNID

SEQ ID NO: 63573 - protein, 28 aa, Artificial Sequence
  Description of Artificial Sequence: Synthetic peptide
AENPIACTNPVATEQYGEASENLQRGGR

SEQ ID NO: 63574 - protein, 28 aa, Artificial Sequence
  Description of Artificial Sequence: Synthetic peptide
AENNIACTNPVATEQYGEASENLQRGGR

SEQ ID NO: 63575 - protein, 33 aa, Artificial Sequence
  Description of Artificial Sequence: Synthetic polypeptide
DEAEICTTNPVATEQYGSVSTTNGLQGNMDDER

SEQ ID NO: 63576 - protein, 28 aa, Artificial Sequence
  Description of Artificial Sequence: Synthetic peptide
AENMIACTNPVATEQYGFASENLQRGGR

SEQ ID NO: 63577 - protein, 32 aa, Artificial Sequence
  Description of Artificial Sequence: Synthetic polypeptide
DEAEIATTNPVATEQYGSTVSCTNLMPTGGNT

SEQ ID NO: 63578 - protein, 32 aa, Artificial Sequence
  Description of Artificial Sequence: Synthetic polypeptide
DEAEICTTNPVATEQYGSVSTTNGQDNRDDER

SEQ ID NO: 63579 - protein, 32 aa, Artificial Sequence
  Description of Artificial Sequence: Synthetic polypeptide
DEAEICTTNPVATEQYGSVSTTNGQDNRQDER

SEQ ID NO: 63580 - protein, 28 aa, Artificial Sequence
  Description of Artificial Sequence: Synthetic peptide
AENMIACTNPVATEQYGEASENLQRGGR

SEQ ID NO: 63581 - protein, 32 aa, Artificial Sequence
  Description of Artificial Sequence: Synthetic polypeptide
DEAEICTTNPVATEQYGSVSTTNGQGNDTDER

SEQ ID NO: 63582 - protein, 30 aa, Artificial Sequence
  Description of Artificial Sequence: Synthetic polypeptide
AEEEIRATNPCATEQYGSVSVENLMQGNSV

SEQ ID NO: 63583 - protein, 32 aa, Artificial Sequence
  Description of Artificial Sequence: Synthetic polypeptide
DEAEIATTNPVATEQYGSTVSCTNLSDYGGNT

SEQ ID NO: 63584 - protein, 33 aa, Artificial Sequence
  Description of Artificial Sequence: Synthetic polypeptide
AEEEIRTTNPVATEAYGSVSTNLQQQQGNQNVE

SEQ ID NO: 63585 - protein, 33 aa, Artificial Sequence
  Description of Artificial Sequence: Synthetic polypeptide
AEEEIRTTNPVATEQYGSVSTTNTNDQQGNQDN

SEQ ID NO: 63586 - protein, 28 aa, Artificial Sequence
  Description of Artificial Sequence: Synthetic peptide
AENTIACTNPVATEQYGEASENLQRGGR

SEQ ID NO: 63587 - protein, 30 aa, Artificial Sequence
  Description of Artificial Sequence: Synthetic polypeptide
AEEEIRCTNPVATEQYGSASENGNMRGGPR

SEQ ID NO: 63588 - protein, 31 aa, Artificial Sequence
  Description of Artificial Sequence: Synthetic polypeptide
AEEEIRCTNPVATEQYGEASTTNLNMRGMGR

SEQ ID NO: 63589 - protein, 31 aa, Artificial Sequence
  Description of Artificial Sequence: Synthetic polypeptide
DEAEIATTNPVATEQYGSVAANLEQSGNQEE

SEQ ID NO: 63590 - protein, 33 aa, Artificial Sequence
  Description of Artificial Sequence: Synthetic polypeptide
DEAEICTTNPVATEQYGSVSTTNALQGNDNDER

SEQ ID NO: 63591 - protein, 31 aa, Artificial Sequence
  Description of Artificial Sequence: Synthetic polypeptide
DEAEISTTNPVATEQYGCVCSTNLMYFGNTQ

SEQ ID NO: 63592 - protein, 32 aa, Artificial Sequence
  Description of Artificial Sequence: Synthetic polypeptide
AEEEIRTTNPVATEQYGSVSTTNSSTGSNGNI

SEQ ID NO: 63593 - protein, 29 aa, Artificial Sequence
  Description of Artificial Sequence: Synthetic peptide
AEPEIACTNPVATEQYGEASENLQRIGGR

SEQ ID NO: 63594 - protein, 30 aa, Artificial Sequence
  Description of Artificial Sequence: Synthetic polypeptide
DEAEIATTNPVATEQYGSVAANDQRGPPDQ

SEQ ID NO: 63595 - protein, 34 aa, Artificial Sequence
  Description of Artificial Sequence: Synthetic polypeptide
AEEEIRATNPVATEQYGSVSTGNPLGQNGGENGR

SEQ ID NO: 63596 - protein, 33 aa, Artificial Sequence
  Description of Artificial Sequence: Synthetic polypeptide
AEEEIRTTNPVATEQYGSVSTTNTLNLNGNGNG

SEQ ID NO: 63597 - protein, 28 aa, Artificial Sequence
  Description of Artificial Sequence: Synthetic peptide
AEPEIACTNPVATEQYGEARENLQRGGR

SEQ ID NO: 63598 - protein, 28 aa, Artificial Sequence
  Description of Artificial Sequence: Synthetic peptide
AENYIACTNPVATEQYGEASENLQRGGR

SEQ ID NO: 63599 - protein, 32 aa, Artificial Sequence
  Description of Artificial Sequence: Synthetic polypeptide
AEEEIRTTNPVATEQYGSVSTTNSSTSGNNIA

SEQ ID NO: 63600 - protein, 32 aa, Artificial Sequence
  Description of Artificial Sequence: Synthetic polypeptide
AEEEIRATNPVATEQYGSVATNLQANGENTEE

SEQ ID NO: 63601 - protein, 28 aa, Artificial Sequence
  Description of Artificial Sequence: Synthetic peptide
AENVIACTNPVATEQYGEASENLQRGGR

SEQ ID NO: 63602 - protein, 31 aa, Artificial Sequence
  Description of Artificial Sequence: Synthetic polypeptide
DEEEIACTNPVATEQYGCVATNLQNNGDNEP

SEQ ID NO: 63603 - protein, 33 aa, Artificial Sequence
  Description of Artificial Sequence: Synthetic polypeptide
AEEEIRTTNPVATEQYGSVSTTNTEQGNQGGNT

SEQ ID NO: 63604 - protein, 28 aa, Artificial Sequence
  Description of Artificial Sequence: Synthetic peptide
AENTIACTNPVATEQYGEASSNLQRGGR

SEQ ID NO: 63605 - protein, 31 aa, Artificial Sequence
  Description of Artificial Sequence: Synthetic polypeptide
DEAEISTTNPVATEQYGCVCSTNLAYGSNAS

SEQ ID NO: 63606 - protein, 31 aa, Artificial Sequence
  Description of Artificial Sequence: Synthetic polypeptide
DEEEIACTNPVATEQYGCVATNLQMDGNESV

SEQ ID NO: 63607 - protein, 32 aa, Artificial Sequence
  Description of Artificial Sequence: Synthetic polypeptide
AEEEIRTTNPVATEQYGSVSTTNSSTSEGNNI

SEQ ID NO: 63608 - protein, 33 aa, Artificial Sequence
  Description of Artificial Sequence: Synthetic polypeptide
AEEEIRTTNPVATEAYGSVSTNNNLQQGNSNIN

SEQ ID NO: 63609 - protein, 32 aa, Artificial Sequence
  Description of Artificial Sequence: Synthetic polypeptide
AEEEIRTTNPVATEAYGSVSTNNNQQQGSNIA

SEQ ID NO: 63610 - protein, 32 aa, Artificial Sequence
  Description of Artificial Sequence: Synthetic polypeptide
DEAEICTTNPVATEQYGSVSTGNMQDQGQNQN

SEQ ID NO: 63611 - protein, 30 aa, Artificial Sequence
  Description of Artificial Sequence: Synthetic polypeptide
AEEEIRTTNPVATEQYGSYGTNQADLANER

SEQ ID NO: 63612 - protein, 29 aa, Artificial Sequence
  Description of Artificial Sequence: Synthetic peptide
DEEEIRSVNPVATEQWGVVSNDNLQSGPI

SEQ ID NO: 63613 - protein, 34 aa, Artificial Sequence
  Description of Artificial Sequence: Synthetic polypeptide
AEEEIRTTNPVATEQYGSVSTTNQQLQNGNIETE

SEQ ID NO: 63614 - protein, 32 aa, Artificial Sequence
  Description of Artificial Sequence: Synthetic polypeptide
DEEEIATTNPVATEQYGSVSATDLNDREGEDL

SEQ ID NO: 63615 - protein, 28 aa, Artificial Sequence
  Description of Artificial Sequence: Synthetic peptide
AERKIACTNPVATEQYGEASENLQRGGR

SEQ ID NO: 63616 - protein, 31 aa, Artificial Sequence
  Description of Artificial Sequence: Synthetic polypeptide
DEAEIATTNPVATEQYGSVAITNLQRAEPPE

SEQ ID NO: 63617 - protein, 32 aa, Artificial Sequence
  Description of Artificial Sequence: Synthetic polypeptide
DEAEIATTNPVATEQYGSVAITNLQPDPGDND

SEQ ID NO: 63618 - protein, 31 aa, Artificial Sequence
  Description of Artificial Sequence: Synthetic polypeptide
DEAEIATTNPVATEQYGSVAITNLETRGGTQ

SEQ ID NO: 63619 - protein, 30 aa, Artificial Sequence
  Description of Artificial Sequence: Synthetic polypeptide
DEAEIATTNPVATEQYGSVAITNLERQPYQ

SEQ ID NO: 63620 - protein, 31 aa, Artificial Sequence
  Description of Artificial Sequence: Synthetic polypeptide
DEEEIATTNPVATEQYGSVSATDLEHEGEDL

SEQ ID NO: 63621 - protein, 30 aa, Artificial Sequence
  Description of Artificial Sequence: Synthetic polypeptide
DEAEIATTNPVATEQYGSVAITNLEDGGPE

SEQ ID NO: 63622 - protein, 32 aa, Artificial Sequence
  Description of Artificial Sequence: Synthetic polypeptide
AEEEIRTTNPVATEQYGTVSTNNNLQQEQENS

SEQ ID NO: 63623 - protein, 32 aa, Artificial Sequence
  Description of Artificial Sequence: Synthetic polypeptide
AEEEIRTTNPVATEQYGSVSVNTNDQNENDNT

SEQ ID NO: 63624 - protein, 31 aa, Artificial Sequence
  Description of Artificial Sequence: Synthetic polypeptide
DEEEIATTNPVATEQYGSVSCAGPNRNGMNV

SEQ ID NO: 63625 - protein, 31 aa, Artificial Sequence
  Description of Artificial Sequence: Synthetic polypeptide
DEEEIATTNPVATEQYGSVSCALPNRNGMTV

SEQ ID NO: 63626 - protein, 31 aa, Artificial Sequence
  Description of Artificial Sequence: Synthetic polypeptide
DEAEIATTNPVATEQYGSVAITNDQDGNDES

SEQ ID NO: 63627 - protein, 35 aa, Artificial Sequence
  Description of Artificial Sequence: Synthetic polypeptide
DEEEIATTNPVATEQYGSVSCTDNMLPVRTGGDNR

SEQ ID NO: 63628 - protein, 28 aa, Artificial Sequence
  Description of Artificial Sequence: Synthetic peptide
AEREIACTNPVCTEQYGEASENLQRGGR

SEQ ID NO: 63629 - protein, 33 aa, Artificial Sequence
  Description of Artificial Sequence: Synthetic polypeptide
AEEEIRTTNPVATEQYGSVSTTNQQNDEAGNED

SEQ ID NO: 63630 - protein, 32 aa, Artificial Sequence
  Description of Artificial Sequence: Synthetic polypeptide
AEEEIRTTNPVATEQYGSVSTTNQQNNIENNQ

SEQ ID NO: 63631 - protein, 30 aa, Artificial Sequence
  Description of Artificial Sequence: Synthetic polypeptide
DEAEIATTNPVATEQYGSVAITNLEAGGEQ

SEQ ID NO: 63632 - protein, 32 aa, Artificial Sequence
  Description of Artificial Sequence: Synthetic polypeptide
AEEEIRTTNPVATEQYGSVSTTNQQNNQENQD

SEQ ID NO: 63633 - protein, 33 aa, Artificial Sequence
  Description of Artificial Sequence: Synthetic polypeptide
AEEEIRTTNPVATEQYGSVSTTNQQLQGNVNVD

SEQ ID NO: 63634 - protein, 31 aa, Artificial Sequence
  Description of Artificial Sequence: Synthetic polypeptide
DEEEIATTNPVATEQYGSVSATDLEDHEGEL

SEQ ID NO: 63635 - protein, 33 aa, Artificial Sequence
  Description of Artificial Sequence: Synthetic polypeptide
AEEEIRTTNPVATEQYGSVSTTNQQAGIENGND

SEQ ID NO: 63636 - protein, 33 aa, Artificial Sequence
  Description of Artificial Sequence: Synthetic polypeptide
DEEEIATTNPVATEQYGSVCTNPLQAEMGNELH

SEQ ID NO: 63637 - protein, 32 aa, Artificial Sequence
  Description of Artificial Sequence: Synthetic polypeptide
AEEEIRTTNPVATEQYGSVSTTNQQENQENTL

SEQ ID NO: 63638 - protein, 33 aa, Artificial Sequence
  Description of Artificial Sequence: Synthetic polypeptide
DEEEIATTNPVATEQYGSVCTNQLPQEPMGENL

SEQ ID NO: 63639 - protein, 32 aa, Artificial Sequence
  Description of Artificial Sequence: Synthetic polypeptide
AEEEIRTTNPVATEQYGSVSTTNQQGNPNNQN

SEQ ID NO: 63640 - protein, 33 aa, Artificial Sequence
  Description of Artificial Sequence: Synthetic polypeptide
AEEEIRTTNPVATEQYGSVSTTNQQGNQGNTEL

SEQ ID NO: 63641 - protein, 28 aa, Artificial Sequence
  Description of Artificial Sequence: Synthetic peptide
AESEIACTNPVATEQYGEAAENLQRGGR

SEQ ID NO: 63642 - protein, 32 aa, Artificial Sequence
  Description of Artificial Sequence: Synthetic polypeptide
AEEEIRTTNPVATEQYGSVSTTNQQGVQNNVD

SEQ ID NO: 63643 - protein, 31 aa, Artificial Sequence
  Description of Artificial Sequence: Synthetic polypeptide
DEEEIATTNPVATEQYGSVFVVDNDHQRQNI

SEQ ID NO: 63644 - protein, 29 aa, Artificial Sequence
  Description of Artificial Sequence: Synthetic peptide
DEEEIRSVNPVATEQWGVVSNDNLQSGPQ

SEQ ID NO: 63645 - protein, 33 aa, Artificial Sequence
  Description of Artificial Sequence: Synthetic polypeptide
DEEEIATTNPVATEQYGSVMSTGLIQKGSDNPA

SEQ ID NO: 63646 - protein, 29 aa, Artificial Sequence
  Description of Artificial Sequence: Synthetic peptide
DEEEIATTNPVATEQYGSVPTVLEDHEEL

SEQ ID NO: 63647 - protein, 31 aa, Artificial Sequence
  Description of Artificial Sequence: Synthetic polypeptide
DEEEIATTNPVATEQYGSVSADDLQDSGEDL

SEQ ID NO: 63648 - protein, 31 aa, Artificial Sequence
  Description of Artificial Sequence: Synthetic polypeptide
DEAEICTTNPVATENYGEVSTNLQHQGNNEG

SEQ ID NO: 63649 - protein, 32 aa, Artificial Sequence
  Description of Artificial Sequence: Synthetic polypeptide
DEAEICTTNPVATENYGSVSTGNLQGDAGNEN

SEQ ID NO: 63650 - protein, 32 aa, Artificial Sequence
  Description of Artificial Sequence: Synthetic polypeptide
DEAEICTTNPVATENYGSVSTNLQGDHGNDEN

SEQ ID NO: 63651 - protein, 31 aa, Artificial Sequence
  Description of Artificial Sequence: Synthetic polypeptide
DEAEICTTNPVATEPYGEVSTNLQIGDGNEP

SEQ ID NO: 63652 - protein, 33 aa, Artificial Sequence
  Description of Artificial Sequence: Synthetic polypeptide
DEEEIRSVNPVATEQYGSVSSTDNGPQMRGNPV

SEQ ID NO: 63653 - protein, 30 aa, Artificial Sequence
  Description of Artificial Sequence: Synthetic polypeptide
DEAEIATTNPVATEQYGSVAITPLQGSDNP

SEQ ID NO: 63654 - protein, 30 aa, Artificial Sequence
  Description of Artificial Sequence: Synthetic polypeptide
DEAEIATTNPVATEQYGSVAITNPQGPNVH

SEQ ID NO: 63655 - protein, 29 aa, Artificial Sequence
  Description of Artificial Sequence: Synthetic peptide
AESEIACTNPVATEQWGEVSENLQDRGNG

SEQ ID NO: 63656 - protein, 29 aa, Artificial Sequence
  Description of Artificial Sequence: Synthetic peptide
AESEIACTNPVATEQYGEASENLQDRGGR

SEQ ID NO: 63657 - protein, 28 aa, Artificial Sequence
  Description of Artificial Sequence: Synthetic peptide
DEEEIRSTNPVCTEQYGVVSDIEMAGNQ

SEQ ID NO: 63658 - protein, 33 aa, Artificial Sequence
  Description of Artificial Sequence: Synthetic polypeptide
DEAEIATTNPVATEQYGSVAITANLQNRGENDQ

SEQ ID NO: 63659 - protein, 33 aa, Artificial Sequence
  Description of Artificial Sequence: Synthetic polypeptide
AEEEIRTTNPVATEQYGVVSTSTNLQQGNNQGS

SEQ ID NO: 63660 - protein, 30 aa, Artificial Sequence
  Description of Artificial Sequence: Synthetic polypeptide
DEEEIACTNPVATEQYGEVSEPAGNRNGNR

SEQ ID NO: 63661 - protein, 33 aa, Artificial Sequence
  Description of Artificial Sequence: Synthetic polypeptide
DEAEICTTNPVATEQYGSVSTDNLGGDRNGDLR

SEQ ID NO: 63662 - protein, 33 aa, Artificial Sequence
  Description of Artificial Sequence: Synthetic polypeptide
AEEEIRTTNPVATEQYGSVSVNNVLGNQQGNND

SEQ ID NO: 63663 - protein, 31 aa, Artificial Sequence
  Description of Artificial Sequence: Synthetic polypeptide
DEAEICTTNPVATEQYGSVSTGGLGNGMDDR

SEQ ID NO: 63664 - protein, 32 aa, Artificial Sequence
  Description of Artificial Sequence: Synthetic polypeptide
AEEEIRTTNPVATEQYGSVSTTNQQQQQGEDN

SEQ ID NO: 63665 - protein, 31 aa, Artificial Sequence
  Description of Artificial Sequence: Synthetic polypeptide
DEAEICTTNPVATEQYGSVSTGLGNMGMDGR

SEQ ID NO: 63666 - protein, 31 aa, Artificial Sequence
  Description of Artificial Sequence: Synthetic polypeptide
DEAEIATTNPVATEQYGSVAATTNLARGDEE

SEQ ID NO: 63667 - protein, 29 aa, Artificial Sequence
  Description of Artificial Sequence: Synthetic peptide
AEQEIACTNPVATEQYGQTSENLQRGGRA

SEQ ID NO: 63668 - protein, 33 aa, Artificial Sequence
  Description of Artificial Sequence: Synthetic polypeptide
AEEEIRTTNPVATEQYGVVSTSTNLQEGNNNGN

SEQ ID NO: 63669 - protein, 31 aa, Artificial Sequence
  Description of Artificial Sequence: Synthetic polypeptide
DEAEISTTNPVATEQYGCVSTNLNAYGSNQA

SEQ ID NO: 63670 - protein, 29 aa, Artificial Sequence
  Description of Artificial Sequence: Synthetic peptide
AEQEIACTNPVATEQYGEVSEDLQREGER

SEQ ID NO: 63671 - protein, 31 aa, Artificial Sequence
  Description of Artificial Sequence: Synthetic polypeptide
AEQEIACTNPVATEQYGEVSATNLQDRGGDR

SEQ ID NO: 63672 - protein, 31 aa, Artificial Sequence
  Description of Artificial Sequence: Synthetic polypeptide
DEAEICTTNPVATEQYGSVSTGNGQNQQDER

SEQ ID NO: 63673 - protein, 31 aa, Artificial Sequence
  Description of Artificial Sequence: Synthetic polypeptide
AEQEIACTNPVATEQYGEVSATNLQDRGEDR

SEQ ID NO: 63674 - protein, 30 aa, Artificial Sequence
  Description of Artificial Sequence: Synthetic polypeptide
AEQEIACTNPVATEQYGEVSAENLQRGGDR

SEQ ID NO: 63675 - protein, 28 aa, Artificial Sequence
  Description of Artificial Sequence: Synthetic peptide
AEQEIACTNPVATEQYGEQSENLQAGGR

SEQ ID NO: 63676 - protein, 33 aa, Artificial Sequence
  Description of Artificial Sequence: Synthetic polypeptide
DEAEICTTNPVATEQYGSVSTGNLGNMDGENDR

SEQ ID NO: 63677 - protein, 28 aa, Artificial Sequence
  Description of Artificial Sequence: Synthetic peptide
AEQEIACTNPVATEQYGEASENLQRGGH

SEQ ID NO: 63678 - protein, 32 aa, Artificial Sequence
  Description of Artificial Sequence: Synthetic polypeptide
DEAEICTTNPVATEQYGSVSTGNMQDHQGNQN

SEQ ID NO: 63679 - protein, 32 aa, Artificial Sequence
  Description of Artificial Sequence: Synthetic polypeptide
DEAEICTTNPVATEQYGSVSTGNDVGDRGEER

SEQ ID NO: 63680 - protein, 28 aa, Artificial Sequence
  Description of Artificial Sequence: Synthetic peptide
AEREIACTNPVATEQYGEASENLQRGGT

SEQ ID NO: 63681 - protein, 33 aa, Artificial Sequence
  Description of Artificial Sequence: Synthetic polypeptide
DEEEIATTNPVATEQYGSVSSTDPAGQRNGMNV

SEQ ID NO: 63682 - protein, 28 aa, Artificial Sequence
  Description of Artificial Sequence: Synthetic peptide
AEQEIACTNPVAYEQYGEASENLQRGGR

SEQ ID NO: 63683 - protein, 32 aa, Artificial Sequence
  Description of Artificial Sequence: Synthetic polypeptide
DEAEICTTNPVATEQYGCVSTNGGQDGGNTRE

SEQ ID NO: 63684 - protein, 30 aa, Artificial Sequence
  Description of Artificial Sequence: Synthetic polypeptide
DEEEIRSTNPVCTEQWGVVSDINLQDSGNQ

SEQ ID NO: 63685 - protein, 31 aa, Artificial Sequence
  Description of Artificial Sequence: Synthetic polypeptide
DEAEIATTNPVATEQYGSVAISANLQRVDDI

SEQ ID NO: 63686 - protein, 34 aa, Artificial Sequence
  Description of Artificial Sequence: Synthetic polypeptide
AEEEIRTTNPVATEQYGVVDDTTNGLVQLRGNDR

SEQ ID NO: 63687 - protein, 32 aa, Artificial Sequence
  Description of Artificial Sequence: Synthetic polypeptide
AEEEIRTTNPVATEQYGVVSSTNNNNQIGNTE

SEQ ID NO: 63688 - protein, 28 aa, Artificial Sequence
  Description of Artificial Sequence: Synthetic peptide
AEQEIRCTNPVATEQYGEAVENIQRGGR

SEQ ID NO: 63689 - protein, 29 aa, Artificial Sequence
  Description of Artificial Sequence: Synthetic peptide
DEEEIRSTNPVCTEPYGVVSMEDLQSGNQ

SEQ ID NO: 63690 - protein, 29 aa, Artificial Sequence
  Description of Artificial Sequence: Synthetic peptide
DEEEIRSTNPVCTEPYGVVSDEDLQSGNQ

SEQ ID NO: 63691 - protein, 33 aa, Artificial Sequence
  Description of Artificial Sequence: Synthetic polypeptide
AEEEIRTTNPVATEQYGSVSTTNQQQEGNGNGN

SEQ ID NO: 63692 - protein, 33 aa, Artificial Sequence
  Description of Artificial Sequence: Synthetic polypeptide
DEAEICTTNPVATEQYGSVSTDNLGGDRGGEDR

SEQ ID NO: 63693 - protein, 31 aa, Artificial Sequence
  Description of Artificial Sequence: Synthetic polypeptide
DEAEICTTNPVATEQYGEVATNLQSNGDNGS

SEQ ID NO: 63694 - protein, 31 aa, Artificial Sequence
  Description of Artificial Sequence: Synthetic polypeptide
DEAEICTTNPVATEQYGEVSTDNLGNDGMDR

SEQ ID NO: 63695 - protein, 31 aa, Artificial Sequence
  Description of Artificial Sequence: Synthetic polypeptide
DEAEICTTNPVATEQYGEVSTGNLDQNNDER

SEQ ID NO: 63696 - protein, 33 aa, Artificial Sequence
  Description of Artificial Sequence: Synthetic polypeptide
DEEEIATTNPVATEQYGSVSKTNDPNQQRGGEK

SEQ ID NO: 63697 - protein, 30 aa, Artificial Sequence
  Description of Artificial Sequence: Synthetic polypeptide
DEAEIATTNPVATEQYGSVAGTNLERAEQM

SEQ ID NO: 63698 - protein, 30 aa, Artificial Sequence
  Description of Artificial Sequence: Synthetic polypeptide
DEEEIATTNPVATEQYGSVSNSGDQRPVMG

SEQ ID NO: 63699 - protein, 34 aa, Artificial Sequence
  Description of Artificial Sequence: Synthetic polypeptide
DEEEIATTNPVATEQYGSVSPTNQLQERMQDNVL

SEQ ID NO: 63700 - protein, 33 aa, Artificial Sequence
  Description of Artificial Sequence: Synthetic polypeptide
AEEEIRTTNPVATEQYGSVSTTNQQQLNQEENS

SEQ ID NO: 63701 - protein, 34 aa, Artificial Sequence
  Description of Artificial Sequence: Synthetic polypeptide
DEEEIATTNPVATEQYGSVSQTNQEEQERMGENL

SEQ ID NO: 63702 - protein, 32 aa, Artificial Sequence
  Description of Artificial Sequence: Synthetic polypeptide
DEAEICTTNPVATEQYGSVNCTNLSQNPGGNS

SEQ ID NO: 63703 - protein, 29 aa, Artificial Sequence
  Description of Artificial Sequence: Synthetic peptide
AEQEIATTNPVATEQYGSVSTDLEDHGEL

SEQ ID NO: 63704 - protein, 32 aa, Artificial Sequence
  Description of Artificial Sequence: Synthetic polypeptide
DEEEIATTNPVATEQYGSVCATNPLQDQGPEM

SEQ ID NO: 63705 - protein, 32 aa, Artificial Sequence
  Description of Artificial Sequence: Synthetic polypeptide
DEEEIACTNPVATEQYGSVATNLQAPGENGNH

SEQ ID NO: 63706 - protein, 33 aa, Artificial Sequence
  Description of Artificial Sequence: Synthetic polypeptide
DEEEIATTNPVATEQYGSVCATNPLQDQGNTES

SEQ ID NO: 63707 - protein, 31 aa, Artificial Sequence
  Description of Artificial Sequence: Synthetic polypeptide
DEAEICTTNPVATEAYGSVSTNLNGDAGNEN

SEQ ID NO: 63708 - protein, 31 aa, Artificial Sequence
  Description of Artificial Sequence: Synthetic polypeptide
DEDEIRTTNPCATEQYGSVSTNPNGNGNMNA

SEQ ID NO: 63709 - protein, 32 aa, Artificial Sequence
  Description of Artificial Sequence: Synthetic polypeptide
DEAEICTTNPVATEAYGSVSTNLQGDQGGNEN

SEQ ID NO: 63710 - protein, 33 aa, Artificial Sequence
  Description of Artificial Sequence: Synthetic polypeptide
AEEEIRTTNPVATEQYGSVSVSTTNNQQGTNGT

SEQ ID NO: 63711 - protein, 31 aa, Artificial Sequence
  Description of Artificial Sequence: Synthetic polypeptide
DEAEICTTNPVATEAYGSVSTNQQGDGDNEN

SEQ ID NO: 63712 - protein, 34 aa, Artificial Sequence
  Description of Artificial Sequence: Synthetic polypeptide
AEEEIRTTNPVATEQYGSVSVSTTNLQQGSNQQT

SEQ ID NO: 63713 - protein, 34 aa, Artificial Sequence
  Description of Artificial Sequence: Synthetic polypeptide
AEEEIRTTNPVATEQYGSVSVSTTNLQQGSNNQD

SEQ ID NO: 63714 - protein, 34 aa, Artificial Sequence
  Description of Artificial Sequence: Synthetic polypeptide
DEEEIRTTNPVATEAYGSVSTTNNLLQGGTNNTD

SEQ ID NO: 63715 - protein, 33 aa, Artificial Sequence
  Description of Artificial Sequence: Synthetic polypeptide
AEEEIRTTNPVATEQYGSVSVSTNNQQQGNGTQ

SEQ ID NO: 63716 - protein, 33 aa, Artificial Sequence
  Description of Artificial Sequence: Synthetic polypeptide
AEEEIRTTNPVATEQYGSVSVSTNNQQQGNGTD

SEQ ID NO: 63717 - protein, 30 aa, Artificial Sequence
  Description of Artificial Sequence: Synthetic polypeptide
DECEIATTNPVATENYGSVSTNPAFNDNQR

SEQ ID NO: 63718 - protein, 32 aa, Artificial Sequence
  Description of Artificial Sequence: Synthetic polypeptide
DDEEIRCTNPVATEQYGSVCSTNLQANSGSQQ

SEQ ID NO: 63719 - protein, 31 aa, Artificial Sequence
  Description of Artificial Sequence: Synthetic polypeptide
DEAEICTTNPVATECWGSVSTNLQHDGGNEN

SEQ ID NO: 63720 - protein, 33 aa, Artificial Sequence
  Description of Artificial Sequence: Synthetic polypeptide
AEEEIRTTNPVATEQYGSVSVSTNNNQQGDNGT

SEQ ID NO: 63721 - protein, 33 aa, Artificial Sequence
  Description of Artificial Sequence: Synthetic polypeptide
AEEEIRTTNPVATEQYGSVSTTNNNQQVEIGNQ

SEQ ID NO: 63722 - protein, 33 aa, Artificial Sequence
  Description of Artificial Sequence: Synthetic polypeptide
AEEEIRTTNPVATEQYGSVVVTTNLNQQGGNET

SEQ ID NO: 63723 - protein, 33 aa, Artificial Sequence
  Description of Artificial Sequence: Synthetic polypeptide
AEEEIRTTNPVATEQYGSVSTTNNNQQVGNNSA

SEQ ID NO: 63724 - protein, 33 aa, Artificial Sequence
  Description of Artificial Sequence: Synthetic polypeptide
AEEEIRTTNPVATEQYGSVSTTNNNQTNIGNQE

SEQ ID NO: 63725 - protein, 33 aa, Artificial Sequence
  Description of Artificial Sequence: Synthetic polypeptide
AEEEIRTTNPVATEQYGSVVVTTNLQDQNGNNG

SEQ ID NO: 63726 - protein, 30 aa, Artificial Sequence
  Description of Artificial Sequence: Synthetic polypeptide
DEEEIACTNPVATEQYGSVSTDLEDHEGEL

SEQ ID NO: 63727 - protein, 31 aa, Artificial Sequence
  Description of Artificial Sequence: Synthetic polypeptide
DEEEIACTNPVATEQYGSVSTDNHQENDMGN

SEQ ID NO: 63728 - protein, 32 aa, Artificial Sequence
  Description of Artificial Sequence: Synthetic polypeptide
DEEEIACTNPVATEQYGSVSTNGPNMRNGGPR

SEQ ID NO: 63729 - protein, 31 aa, Artificial Sequence
  Description of Artificial Sequence: Synthetic polypeptide
DEEEIACTNPVATEQYGSVTTNNPTRGLNEW

SEQ ID NO: 63730 - protein, 30 aa, Artificial Sequence
  Description of Artificial Sequence: Synthetic polypeptide
DEAEIATTNPVSTEQYGSVATNLQDGPDQH

SEQ ID NO: 63731 - protein, 33 aa, Artificial Sequence
  Description of Artificial Sequence: Synthetic polypeptide
AEEEIRTTNPVATEQYGSVVVTTGTNLQSGTNM

SEQ ID NO: 63732 - protein, 31 aa, Artificial Sequence
  Description of Artificial Sequence: Synthetic polypeptide
DECEIATTNPVATEQWGEVSTNLQLGGNDMG

SEQ ID NO: 63733 - protein, 33 aa, Artificial Sequence
  Description of Artificial Sequence: Synthetic polypeptide
AEEEIRTTNPVATEQYGSVVVTTNGNLQQGNIN

SEQ ID NO: 63734 - protein, 32 aa, Artificial Sequence
  Description of Artificial Sequence: Synthetic polypeptide
DEEEIRTTNPCATEEYGSVATDNDHGGRGNAR

SEQ ID NO: 63735 - protein, 33 aa, Artificial Sequence
  Description of Artificial Sequence: Synthetic polypeptide
AEEEIRTTNPVATEQYGSVVVTTNGNNQEGENR

SEQ ID NO: 63736 - protein, 33 aa, Artificial Sequence
  Description of Artificial Sequence: Synthetic polypeptide
AEEEIRTTNPVATEQYGSVVVTTNLEQGGNNQQ

SEQ ID NO: 63737 - protein, 34 aa, Artificial Sequence
  Description of Artificial Sequence: Synthetic polypeptide
DEEEIRTTNPVATEAYGSVSTTNLTNQGGTNNTD

SEQ ID NO: 63738 - protein, 33 aa, Artificial Sequence
  Description of Artificial Sequence: Synthetic polypeptide
DEDEIRTTNPCATEQYGSVSTGNGLNQDGDNED

SEQ ID NO: 63739 - protein, 34 aa, Artificial Sequence
  Description of Artificial Sequence: Synthetic polypeptide
DEEEIRTTNPVATEAYGSVSTTQNLNTQGGNNTD

SEQ ID NO: 63740 - protein, 30 aa, Artificial Sequence
  Description of Artificial Sequence: Synthetic polypeptide
DEAEIATVNPVATEQYGSVSKNEQFQEGNH

SEQ ID NO: 63741 - protein, 32 aa, Artificial Sequence
  Description of Artificial Sequence: Synthetic polypeptide
DDEEIRCTNPVATEQYGCVCSTNLQERSGGQQ

SEQ ID NO: 63742 - protein, 33 aa, Artificial Sequence
  Description of Artificial Sequence: Synthetic polypeptide
DEDEIRTTNPCATEQYGSVSTGNLNQDDGDNES

SEQ ID NO: 63743 - protein, 32 aa, Artificial Sequence
  Description of Artificial Sequence: Synthetic polypeptide
DEDEIRTTNPCATEQYGSVSTNGNQGDGDNEV

SEQ ID NO: 63744 - protein, 29 aa, Artificial Sequence
  Description of Artificial Sequence: Synthetic peptide
DEEEIRTTNPCATEEYGCVCVTNHGRGDA

SEQ ID NO: 63745 - protein, 32 aa, Artificial Sequence
  Description of Artificial Sequence: Synthetic polypeptide
DEDEIRTTNPCATEQYGSVSTNLNGGDGDNEK

SEQ ID NO: 63746 - protein, 31 aa, Artificial Sequence
  Description of Artificial Sequence: Synthetic polypeptide
DEAEICTTNPVATEAYGCVSTNLQGAGDNGS

SEQ ID NO: 63747 - protein, 31 aa, Artificial Sequence
  Description of Artificial Sequence: Synthetic polypeptide
CEEEIACTNPVATEQYGEVSTNLQHGDNQDE

SEQ ID NO: 63748 - protein, 33 aa, Artificial Sequence
  Description of Artificial Sequence: Synthetic polypeptide
DEDEIRTTNPCATEQYGSVSTNLNQGDHGDNQE

SEQ ID NO: 63749 - protein, 31 aa, Artificial Sequence
  Description of Artificial Sequence: Synthetic polypeptide
DDEEIRCTNPVATEQYGCVVSTNNLENGTQR

SEQ ID NO: 63750 - protein, 32 aa, Artificial Sequence
  Description of Artificial Sequence: Synthetic polypeptide
AEEEIRTTNPVATEQYGSVVVTTNLGGNLGNE

SEQ ID NO: 63751 - protein, 32 aa, Artificial Sequence
  Description of Artificial Sequence: Synthetic polypeptide
AEEEIRTTNPVATEQYGSVSTTNNNSEQGNVS

SEQ ID NO: 63752 - protein, 30 aa, Artificial Sequence
  Description of Artificial Sequence: Synthetic polypeptide
DECEIATTNPVATEIYGTVITTNLQDAGNW

SEQ ID NO: 63753 - protein, 33 aa, Artificial Sequence
  Description of Artificial Sequence: Synthetic polypeptide
AEEEIRTTNPVATEQYGSVVVTTNLQEQGGNQA

SEQ ID NO: 63754 - protein, 29 aa, Artificial Sequence
  Description of Artificial Sequence: Synthetic peptide
DEEEIRTTNPCATEEYGCVATNHGGEGNA

SEQ ID NO: 63755 - protein, 33 aa, Artificial Sequence
  Description of Artificial Sequence: Synthetic polypeptide
AEEEIRTTNPVATEQYGSVVVTTNLQTGQENDT

SEQ ID NO: 63756 - protein, 32 aa, Artificial Sequence
  Description of Artificial Sequence: Synthetic polypeptide
AEEEIRTTNPVATEQYGSVVVTTNNGNLQGNI

SEQ ID NO: 63757 - protein, 29 aa, Artificial Sequence
  Description of Artificial Sequence: Synthetic peptide
DEEEIRTTNPCATEEYGCVATEHGRFGNA

SEQ ID NO: 63758 - protein, 34 aa, Artificial Sequence
  Description of Artificial Sequence: Synthetic polypeptide
AEEEIRTTNPVATEQYGSVSTTNNQLNQEGTENS

SEQ ID NO: 63759 - protein, 32 aa, Artificial Sequence
  Description of Artificial Sequence: Synthetic polypeptide
DEDEIRTTNPTATEQYGEVSTNLGQGGGDNQQ

SEQ ID NO: 63760 - protein, 30 aa, Artificial Sequence
  Description of Artificial Sequence: Synthetic polypeptide
DDEEIRSTNPVATEQYGCSSTNHNQYGSNQ

SEQ ID NO: 63761 - protein, 31 aa, Artificial Sequence
  Description of Artificial Sequence: Synthetic polypeptide
DEEEIRTTNPCATECYGSVCSKTNDAVQGNH

SEQ ID NO: 63762 - protein, 32 aa, Artificial Sequence
  Description of Artificial Sequence: Synthetic polypeptide
DEEEIRTTNPCATECYGSVCSKTNDARQGNEQ

SEQ ID NO: 63763 - protein, 33 aa, Artificial Sequence
  Description of Artificial Sequence: Synthetic polypeptide
AEEEIRTTNPVATEQYGSVVVTTNLQSNEEGNN

SEQ ID NO: 63764 - protein, 32 aa, Artificial Sequence
  Description of Artificial Sequence: Synthetic polypeptide
DEEEIRTTNPCATECYGSVCSKTNDAQHQGNA

SEQ ID NO: 63765 - protein, 33 aa, Artificial Sequence
  Description of Artificial Sequence: Synthetic polypeptide
AEEEIRTTNPVATEQYGSVVVTTNNLQTGEGND

SEQ ID NO: 63766 - protein, 31 aa, Artificial Sequence
  Description of Artificial Sequence: Synthetic polypeptide
AEEEIRTTNPVATEQYGSVVVTTNNQEEENN

SEQ ID NO: 63767 - protein, 32 aa, Artificial Sequence
  Description of Artificial Sequence: Synthetic polypeptide
DEEEIRTTNPCATECYGSVCSKTENQDARGNS

SEQ ID NO: 63768 - protein, 33 aa, Artificial Sequence
  Description of Artificial Sequence: Synthetic polypeptide
DEEEIRTTNPCATECYGSVCSKTDNDARQGNDR

SEQ ID NO: 63769 - protein, 34 aa, Artificial Sequence
  Description of Artificial Sequence: Synthetic polypeptide
AEEEIRTTNPVATEQYGSVSTTNNQLQGNGGNLD

SEQ ID NO: 63770 - protein, 33 aa, Artificial Sequence
  Description of Artificial Sequence: Synthetic polypeptide
AEEEIRTTNPVATEQYGSVVVTTNQLEQGGNQE

SEQ ID NO: 63771 - protein, 30 aa, Artificial Sequence
  Description of Artificial Sequence: Synthetic polypeptide
DEAVIRTTNPVATEQYGCVETAPQRGSNQS

SEQ ID NO: 63772 - protein, 34 aa, Artificial Sequence
  Description of Artificial Sequence: Synthetic polypeptide
AEEEIRTTNPVATEQYGSVSTTNNQLQGTGGINT

SEQ ID NO: 63773 - protein, 31 aa, Artificial Sequence
  Description of Artificial Sequence: Synthetic polypeptide
DEAVIRTTNPVATEQYGCVCETNPQRLGSNQ

SEQ ID NO: 63774 - protein, 32 aa, Artificial Sequence
  Description of Artificial Sequence: Synthetic polypeptide
DEEEIRTTNPCATECYGSVCSKTNDANRQGNV

SEQ ID NO: 63775 - protein, 31 aa, Artificial Sequence
  Description of Artificial Sequence: Synthetic polypeptide
DEAEIATTNPVSTEQYGSVATNLQDDGNTDD

SEQ ID NO: 63776 - protein, 33 aa, Artificial Sequence
  Description of Artificial Sequence: Synthetic polypeptide
AEEEIRTTNPVATEQYGSVVVTTNLQQTGEEND

SEQ ID NO: 63777 - protein, 33 aa, Artificial Sequence
  Description of Artificial Sequence: Synthetic polypeptide
AEEEIRTTNPVATEQYGSVVVTTNLQQNEGNQG

SEQ ID NO: 63778 - protein, 33 aa, Artificial Sequence
  Description of Artificial Sequence: Synthetic polypeptide
AEEEIRTTNPVATEQYGSVVVTTNLQGSTGGNG

SEQ ID NO: 63779 - protein, 34 aa, Artificial Sequence
  Description of Artificial Sequence: Synthetic polypeptide
DEEEIRTTNPVATEAYGSVSTTTNLLNQGGNNTD

SEQ ID NO: 63780 - protein, 34 aa, Artificial Sequence
  Description of Artificial Sequence: Synthetic polypeptide
DEEEIRTTNPVATEAYGSVSTTVNLTQGQGNNTD

SEQ ID NO: 63781 - protein, 33 aa, Artificial Sequence
  Description of Artificial Sequence: Synthetic polypeptide
AEEEIRTTNPVATEQYGSVVVTTNLQLEEGTNG

SEQ ID NO: 63782 - protein, 33 aa, Artificial Sequence
  Description of Artificial Sequence: Synthetic polypeptide
AEEEIRTTNPVATEQYGSVSTTNNQDEQGNNVD

SEQ ID NO: 63783 - protein, 33 aa, Artificial Sequence
  Description of Artificial Sequence: Synthetic polypeptide
AEEEIRTTNPVATEQYGSVVVTTNLQLGGNESG

SEQ ID NO: 63784 - protein, 33 aa, Artificial Sequence
  Description of Artificial Sequence: Synthetic polypeptide
AEEEIRTTNPVATEQYGSVVVTTNLQNGNENAE

SEQ ID NO: 63785 - protein, 31 aa, Artificial Sequence
  Description of Artificial Sequence: Synthetic polypeptide
DDEEIRSTNPVATEQYGCSCSTEMQRFGSNQ

SEQ ID NO: 63786 - protein, 32 aa, Artificial Sequence
  Description of Artificial Sequence: Synthetic polypeptide
DEEEIACTNPVATEQYGSVCATNPLQDQGNEN

SEQ ID NO: 63787 - protein, 33 aa, Artificial Sequence
  Description of Artificial Sequence: Synthetic polypeptide
AEEEIRTTNPVATEQYGSVVVTTNLQQQGGNTD

SEQ ID NO: 63788 - protein, 33 aa, Artificial Sequence
  Description of Artificial Sequence: Synthetic polypeptide
AEEEIRTTNPVATEQYGSVVVTTNLQNGNNAAE

SEQ ID NO: 63789 - protein, 32 aa, Artificial Sequence
  Description of Artificial Sequence: Synthetic polypeptide
AEEEIRTTNPVATEQYGSVVVTTNLQQEENLG

SEQ ID NO: 63790 - protein, 33 aa, Artificial Sequence
  Description of Artificial Sequence: Synthetic polypeptide
AEEEIRTTNPVATEQYGSVVVTTNLQQGEGENS

SEQ ID NO: 63791 - protein, 32 aa, Artificial Sequence
  Description of Artificial Sequence: Synthetic polypeptide
AEEEIRTTNPVATEQYGSVVVTTNLQQGEMES

SEQ ID NO: 63792 - protein, 33 aa, Artificial Sequence
  Description of Artificial Sequence: Synthetic polypeptide
AEEEIRTTNPVATEQYGSVVVTTNLQQGGNDTE

SEQ ID NO: 63793 - protein, 33 aa, Artificial Sequence
  Description of Artificial Sequence: Synthetic polypeptide
AEEEIRTTNPVATEQYGSVVVTTNLQQGGNDTN

SEQ ID NO: 63794 - protein, 32 aa, Artificial Sequence
  Description of Artificial Sequence: Synthetic polypeptide
DEEEIACTNPVATEQYGSVCATGNLQEAGNQE

SEQ ID NO: 63795 - protein, 33 aa, Artificial Sequence
  Description of Artificial Sequence: Synthetic polypeptide
AEEEIRTTNPVATEQYGSVVVTTNLQQGNGNNS

SEQ ID NO: 63796 - protein, 33 aa, Artificial Sequence
  Description of Artificial Sequence: Synthetic polypeptide
AEEEIRTTNPVATEQYGSVSTTNNQLGNTEGNA

SEQ ID NO: 63797 - protein, 29 aa, Artificial Sequence
  Description of Artificial Sequence: Synthetic peptide
DEAVIYTTNPVATEQYGSVSTNGMTYVNT

SEQ ID NO: 63798 - protein, 33 aa, Artificial Sequence
  Description of Artificial Sequence: Synthetic polypeptide
AEEEIRTTNPVATEQYGSVVVTTNLQNGNNQAQ

SEQ ID NO: 63799 - protein, 29 aa, Artificial Sequence
  Description of Artificial Sequence: Synthetic peptide
DEAEIATTNPVSTEQYGSVAMNLTQGGQT

SEQ ID NO: 63800 - protein, 32 aa, Artificial Sequence
  Description of Artificial Sequence: Synthetic polypeptide
DEEEIRTTNPCATEEYGSVATGNDDGRQGNAR

SEQ ID NO: 63801 - protein, 32 aa, Artificial Sequence
  Description of Artificial Sequence: Synthetic polypeptide
AEEEIRTTNPVATEQYGCVCSSNLQRFGSEDP

SEQ ID NO: 63802 - protein, 31 aa, Artificial Sequence
  Description of Artificial Sequence: Synthetic polypeptide
DECEIATTNPVATEQYGVVSTTNGNSGENDR

SEQ ID NO: 63803 - protein, 33 aa, Artificial Sequence
  Description of Artificial Sequence: Synthetic polypeptide
DEEEIRTTNPVATEAYGSTFCTNALSQRGGNEY

SEQ ID NO: 63804 - protein, 29 aa, Artificial Sequence
  Description of Artificial Sequence: Synthetic peptide
DECEIATTNPVATEQYGVVSGKLQDPNDA

SEQ ID NO: 63805 - protein, 30 aa, Artificial Sequence
  Description of Artificial Sequence: Synthetic polypeptide
DEDEIRSTNPVATEMYGCVTSTNGDERGNF

SEQ ID NO: 63806 - protein, 31 aa, Artificial Sequence
  Description of Artificial Sequence: Synthetic polypeptide
DEEEIACTNPVAYEQYGSVATNLQAEPGERP

SEQ ID NO: 63807 - protein, 31 aa, Artificial Sequence
  Description of Artificial Sequence: Synthetic polypeptide
DECEIATTNPVATEQYGSVSWNEQTDEGNTQ

SEQ ID NO: 63808 - protein, 32 aa, Artificial Sequence
  Description of Artificial Sequence: Synthetic polypeptide
AEEEIRTTNPVATEQYGSVVVTNLGGNEGNNE

SEQ ID NO: 63809 - protein, 32 aa, Artificial Sequence
  Description of Artificial Sequence: Synthetic polypeptide
AEEEIRTTNPVATEQYGSVVVTNLGGNGNEET

SEQ ID NO: 63810 - protein, 32 aa, Artificial Sequence
  Description of Artificial Sequence: Synthetic polypeptide
AEEEIRTTNPVATEQYGSVSTTNNNNQTGIIF

SEQ ID NO: 63811 - protein, 32 aa, Artificial Sequence
  Description of Artificial Sequence: Synthetic polypeptide
DECEIATTNPVATETYGTVSTNLQGDLGDNDR

SEQ ID NO: 63812 - protein, 32 aa, Artificial Sequence
  Description of Artificial Sequence: Synthetic polypeptide
AEEEIRTTNPVATEQYGSVVVTNLGGNNGNND

SEQ ID NO: 63813 - protein, 32 aa, Artificial Sequence
  Description of Artificial Sequence: Synthetic polypeptide
DDEEIRATNPVATEQYGDVSTNLQARNGDQGI

SEQ ID NO: 63814 - protein, 30 aa, Artificial Sequence
  Description of Artificial Sequence: Synthetic polypeptide
DEEEIRTTNPCATEEYGSVATTNHGNEGNA

SEQ ID NO: 63815 - protein, 33 aa, Artificial Sequence
  Description of Artificial Sequence: Synthetic polypeptide
AEEEIRTTNPVATEQYGSVSTTNNNQDQGNNVA

SEQ ID NO: 63816 - protein, 32 aa, Artificial Sequence
  Description of Artificial Sequence: Synthetic polypeptide
AEEEIRTTNPVATEQYGSVVVTNLGGNNGNQE

SEQ ID NO: 63817 - protein, 34 aa, Artificial Sequence
  Description of Artificial Sequence: Synthetic polypeptide
DEEEIRTTNPVATEAYGSTVASCTNMLLNGGNNR

SEQ ID NO: 63818 - protein, 33 aa, Artificial Sequence
  Description of Artificial Sequence: Synthetic polypeptide
AEEEIRTTNPVATEQYGSVSTTNNNQGDEGNNS

SEQ ID NO: 63819 - protein, 31 aa, Artificial Sequence
  Description of Artificial Sequence: Synthetic polypeptide
AEEEIRTTNPVATEQYGSVVVTNLGGNQNDD

SEQ ID NO: 63820 - protein, 33 aa, Artificial Sequence
  Description of Artificial Sequence: Synthetic polypeptide
AEEEIRTTNPVATEQYGSVSTTNNNQGTVGNVE

SEQ ID NO: 63821 - protein, 32 aa, Artificial Sequence
  Description of Artificial Sequence: Synthetic polypeptide
AEEEIRTTNPVATEQYGSVVVTNLNQEGVEDE

SEQ ID NO: 63822 - protein, 33 aa, Artificial Sequence
  Description of Artificial Sequence: Synthetic polypeptide
AEEEIRTTNPVATEQYGSVSTTNNNQAGIGNQE

SEQ ID NO: 63823 - protein, 34 aa, Artificial Sequence
  Description of Artificial Sequence: Synthetic polypeptide
AEEEIRTTNPVATEQYGSVSTTNNNQLQAGNQEE

SEQ ID NO: 63824 - protein, 30 aa, Artificial Sequence
  Description of Artificial Sequence: Synthetic polypeptide
DEEEIACTNPVAYEQYGSVATNLQNNPGEL

SEQ ID NO: 63825 - protein, 34 aa, Artificial Sequence
  Description of Artificial Sequence: Synthetic polypeptide
DEAEIATTNPVAYEQYGVSVSATNDLGQMRGNAR

SEQ ID NO: 63826 - protein, 28 aa, Artificial Sequence
  Description of Artificial Sequence: Synthetic peptide
AEYEIACTNPVATEMYGEASENLQRGGR

SEQ ID NO: 63827 - protein, 34 aa, Artificial Sequence
  Description of Artificial Sequence: Synthetic polypeptide
AEEEIRTTNPVATEQYGSVSTTNNNNLQQIGNEG

SEQ ID NO: 63828 - protein, 29 aa, Artificial Sequence
  Description of Artificial Sequence: Synthetic peptide
AEWEIACTNPVATEQYGEASENLQQRGGR

SEQ ID NO: 63829 - protein, 29 aa, Artificial Sequence
  Description of Artificial Sequence: Synthetic peptide
DEEEIRTTNPCATEGYGCCCSTNLAYGEQ

SEQ ID NO: 63830 - protein, 32 aa, Artificial Sequence
  Description of Artificial Sequence: Synthetic polypeptide
AEEEIRTTNPVATEQYGCVCSTYLQGFGSNDP

SEQ ID NO: 63831 - protein, 29 aa, Artificial Sequence
  Description of Artificial Sequence: Synthetic peptide
AEVEIACTNPVATEQYGEASENLQQRGGR

SEQ ID NO: 63832 - protein, 33 aa, Artificial Sequence
  Description of Artificial Sequence: Synthetic polypeptide
AEEEIRTTNPVATEQYGSVVVTMNLMNTAGNNR

SEQ ID NO: 63833 - protein, 33 aa, Artificial Sequence
  Description of Artificial Sequence: Synthetic polypeptide
AEEEIRTTNPVATEQYGSVVVTNANLNQEGNVE

SEQ ID NO: 63834 - protein, 31 aa, Artificial Sequence
  Description of Artificial Sequence: Synthetic polypeptide
AEEEIRTTNPVATEQYGSVVVTNDDEGVNNT

SEQ ID NO: 63835 - protein, 34 aa, Artificial Sequence
  Description of Artificial Sequence: Synthetic polypeptide
AEEEIRTTNPVATEQYGSVSVSVTTNLQQGNNQL

SEQ ID NO: 63836 - protein, 32 aa, Artificial Sequence
  Description of Artificial Sequence: Synthetic polypeptide
AEEEIRTTNPVATEQYGCVCSTNDQHFGSNDA

SEQ ID NO: 63837 - protein, 30 aa, Artificial Sequence
  Description of Artificial Sequence: Synthetic polypeptide
DEEEIAPTNPCSTEQYGIVSTCNLQSNGTR

SEQ ID NO: 63838 - protein, 33 aa, Artificial Sequence
  Description of Artificial Sequence: Synthetic polypeptide
AEEEIRTTNPVATEQYGSVSVTENGNQNGNNND

SEQ ID NO: 63839 - protein, 33 aa, Artificial Sequence
  Description of Artificial Sequence: Synthetic polypeptide
AEEEIRTTNPVATEQYGSVSTTNNNNQEQIGNG

SEQ ID NO: 63840 - protein, 32 aa, Artificial Sequence
  Description of Artificial Sequence: Synthetic polypeptide
AEEEIRTTNPVATEQYGSVVVTNDQNQQIGNL

SEQ ID NO: 63841 - protein, 31 aa, Artificial Sequence
  Description of Artificial Sequence: Synthetic polypeptide
DEAEIATTNPVAYEQYGTVSTTNLQGNDDER

SEQ ID NO: 63842 - protein, 31 aa, Artificial Sequence
  Description of Artificial Sequence: Synthetic polypeptide
DEEEIAPTNPCATEQYGIVSTCPNLQSNGTR

SEQ ID NO: 63843 - protein, 31 aa, Artificial Sequence
  Description of Artificial Sequence: Synthetic polypeptide
AEEEIRTTNPVATEQYGCVCSTEPQSGSNQP

SEQ ID NO: 63844 - protein, 32 aa, Artificial Sequence
  Description of Artificial Sequence: Synthetic polypeptide
DEEEIAPTNPCATEQYGIVSTCPNLQRNGTPR

SEQ ID NO: 63845 - protein, 33 aa, Artificial Sequence
  Description of Artificial Sequence: Synthetic polypeptide
AEEEIRTTNPVATEQYGSVSTTNNNNQQGSNQE

SEQ ID NO: 63846 - protein, 33 aa, Artificial Sequence
  Description of Artificial Sequence: Synthetic polypeptide
DEEEIAPTNPVATEQYGISVSCTNIPREGTNNR

SEQ ID NO: 63847 - protein, 28 aa, Artificial Sequence
  Description of Artificial Sequence: Synthetic peptide
AETEIACTNPVAYEQYGEASENLQRGGR

SEQ ID NO: 63848 - protein, 32 aa, Artificial Sequence
  Description of Artificial Sequence: Synthetic polypeptide
AEEEIRTTNPVATEQYGSVVVTNLNQELQNGI

SEQ ID NO: 63849 - protein, 33 aa, Artificial Sequence
  Description of Artificial Sequence: Synthetic polypeptide
DEEEIRTTNPVATEAYGSVACTNMSSQPNGTNR

SEQ ID NO: 63850 - protein, 34 aa, Artificial Sequence
  Description of Artificial Sequence: Synthetic polypeptide
DECEIATTNPVATEQYGSVSTTNQLGQEAGENDR

SEQ ID NO: 63851 - protein, 33 aa, Artificial Sequence
  Description of Artificial Sequence: Synthetic polypeptide
DDEEIRATNPVATEQYGSVSTNLQARNGEQGGI

SEQ ID NO: 63852 - protein, 33 aa, Artificial Sequence
  Description of Artificial Sequence: Synthetic polypeptide
AEEEIRTTNPVATEQYGSVSTTNNNQQIGNNGE

SEQ ID NO: 63853 - protein, 33 aa, Artificial Sequence
  Description of Artificial Sequence: Synthetic polypeptide
DDEEIRATNPVATEQYGSVSTTNLQARNGEQGI

SEQ ID NO: 63854 - protein, 33 aa, Artificial Sequence
  Description of Artificial Sequence: Synthetic polypeptide
AEEEIRTTNPVATEQYGSVSTTNNNQQIGTNTG

SEQ ID NO: 63855 - protein, 32 aa, Artificial Sequence
  Description of Artificial Sequence: Synthetic polypeptide
DECEIATTNPVATEQYGSVSTNLMMNEGNDTQ

SEQ ID NO: 63856 - protein, 32 aa, Artificial Sequence
  Description of Artificial Sequence: Synthetic polypeptide
DEDEIRTTNPCATECYGSVSTGNGNQDGSNER

SEQ ID NO: 63857 - protein, 30 aa, Artificial Sequence
  Description of Artificial Sequence: Synthetic polypeptide
DEEEIRTTNPCATEEYGSVATTNGGTQGNA

SEQ ID NO: 63858 - protein, 32 aa, Artificial Sequence
  Description of Artificial Sequence: Synthetic polypeptide
DDEEIRATNPVATEQYGSVVSTALQNDGQTRA

SEQ ID NO: 63859 - protein, 33 aa, Artificial Sequence
  Description of Artificial Sequence: Synthetic polypeptide
DDEEIRATNPVATEQYGSVSTDLQARNGNQGGQ

SEQ ID NO: 63860 - protein, 33 aa, Artificial Sequence
  Description of Artificial Sequence: Synthetic polypeptide
AEEEIRTTNPVATEQYGSVSTTNNNQQNIGNDE

SEQ ID NO: 63861 - protein, 31 aa, Artificial Sequence
  Description of Artificial Sequence: Synthetic polypeptide
DECEIATTNPVATEQYGSVATGNGQDAGGNA

SEQ ID NO: 63862 - protein, 32 aa, Artificial Sequence
  Description of Artificial Sequence: Synthetic polypeptide
AEEEIRTTNPVATEQYGSVVVTNQLGGNGGNE

SEQ ID NO: 63863 - protein, 30 aa, Artificial Sequence
  Description of Artificial Sequence: Synthetic polypeptide
DDEEIRCTNPVATEQYGCIVCSTNHQNGQQ

SEQ ID NO: 63864 - protein, 32 aa, Artificial Sequence
  Description of Artificial Sequence: Synthetic polypeptide
DECEIATTNPVATEQYGEVSTNLQGLNDGNDM

SEQ ID NO: 63865 - protein, 31 aa, Artificial Sequence
  Description of Artificial Sequence: Synthetic polypeptide
DEEEIRTTNPCATEEYGSVATGNGHNGRGNA

SEQ ID NO: 63866 - protein, 32 aa, Artificial Sequence
  Description of Artificial Sequence: Synthetic polypeptide
DECEIATTNPVATEQYGCVSTNLDQQGGGERD

SEQ ID NO: 63867 - protein, 31 aa, Artificial Sequence
  Description of Artificial Sequence: Synthetic polypeptide
DEEEIRTTNPCATEEYGSVATGNDSGGRGNA

SEQ ID NO: 63868 - protein, 33 aa, Artificial Sequence
  Description of Artificial Sequence: Synthetic polypeptide
AEEEIRTTNPVATEQYGSVSTTNNNQQQIGNEE

SEQ ID NO: 63869 - protein, 31 aa, Artificial Sequence
  Description of Artificial Sequence: Synthetic polypeptide
DEEEIRTTNPCATEEYGSVATGNDGRQGGNA

SEQ ID NO: 63870 - protein, 31 aa, Artificial Sequence
  Description of Artificial Sequence: Synthetic polypeptide
AEEEIRTTNPVATEQYGCVCSTEHQHGSNTQ

SEQ ID NO: 63871 - protein, 32 aa, Artificial Sequence
  Description of Artificial Sequence: Synthetic polypeptide
DEEEIRTTNPVATEAYGSTVSYTNHSGFGDNE

SEQ ID NO: 63872 - protein, 32 aa, Artificial Sequence
  Description of Artificial Sequence: Synthetic polypeptide
DECEIATTNPVATEQYGSVSTVLQQGGEGNAM

SEQ ID NO: 63873 - protein, 33 aa, Artificial Sequence
  Description of Artificial Sequence: Synthetic polypeptide
AEEEIRTTNPVATEQYGSVSTTNNNQQGNNQEF

SEQ ID NO: 63874 - protein, 33 aa, Artificial Sequence
  Description of Artificial Sequence: Synthetic polypeptide
AEEEIRTTNPVATEQYGSVVVTNLQNQEGTNSG

SEQ ID NO: 63875 - protein, 32 aa, Artificial Sequence
  Description of Artificial Sequence: Synthetic polypeptide
AEEEIRTTNPVATEQYGCVCSTELQSFGSNLA

SEQ ID NO: 63876 - protein, 31 aa, Artificial Sequence
  Description of Artificial Sequence: Synthetic polypeptide
AEEEIRTTNPVATEQYGCVCSTELQRNSDQD

SEQ ID NO: 63877 - protein, 34 aa, Artificial Sequence
  Description of Artificial Sequence: Synthetic polypeptide
AEEEIRTTNPVATEQYGSVSTTNNNQLQIGENQG

SEQ ID NO: 63878 - protein, 34 aa, Artificial Sequence
  Description of Artificial Sequence: Synthetic polypeptide
AEEEIRTTNPVATEQYGSVSTTNNNQLQIGTNED

SEQ ID NO: 63879 - protein, 32 aa, Artificial Sequence
  Description of Artificial Sequence: Synthetic polypeptide
AEEEIRTTNPVATEQYGCVCSTELQRGGSDQS

SEQ ID NO: 63880 - protein, 33 aa, Artificial Sequence
  Description of Artificial Sequence: Synthetic polypeptide
AEEEIRTTNPVATEQYGSVVVTNLQSNEGTNND

SEQ ID NO: 63881 - protein, 31 aa, Artificial Sequence
  Description of Artificial Sequence: Synthetic polypeptide
DECEIATTNPVATEQYGSVSWNELNMDGNTT

SEQ ID NO: 63882 - protein, 32 aa, Artificial Sequence
  Description of Artificial Sequence: Synthetic polypeptide
AEEEIRTTNPVATEQYGSVVVTNNLGGNTGNE

SEQ ID NO: 63883 - protein, 33 aa, Artificial Sequence
  Description of Artificial Sequence: Synthetic polypeptide
AEEEIRTTNPVATEQYGSVVVTNNLQQGNGNET

SEQ ID NO: 63884 - protein, 31 aa, Artificial Sequence
  Description of Artificial Sequence: Synthetic polypeptide
DECEIATTNPVATEQYGSVSWNELGDGNNTQ

SEQ ID NO: 63885 - protein, 31 aa, Artificial Sequence
  Description of Artificial Sequence: Synthetic polypeptide
DECEIATTNPVATEQYGSVSWNEGERDGNTQ

SEQ ID NO: 63886 - protein, 33 aa, Artificial Sequence
  Description of Artificial Sequence: Synthetic polypeptide
AEEEIRTTNPVATEQYGSVVVTNNLNNQQGNND

SEQ ID NO: 63887 - protein, 31 aa, Artificial Sequence
  Description of Artificial Sequence: Synthetic polypeptide
AEEEIRTTNPVATEQYGCVCSTELQHNSNQL

SEQ ID NO: 63888 - protein, 32 aa, Artificial Sequence
  Description of Artificial Sequence: Synthetic polypeptide
DDEEIRATNPVATEQYGSVDTNLQARNIGQGE

SEQ ID NO: 63889 - protein, 30 aa, Artificial Sequence
  Description of Artificial Sequence: Synthetic polypeptide
DEAEIATTNPVAYERYGSVATNDQSGGNQR

SEQ ID NO: 63890 - protein, 33 aa, Artificial Sequence
  Description of Artificial Sequence: Synthetic polypeptide
AEEEIRTTNPVATEQYGSVVVTNNLQGSTGNLE

SEQ ID NO: 63891 - protein, 33 aa, Artificial Sequence
  Description of Artificial Sequence: Synthetic polypeptide
AEEEIRTTNPVATEQYGSVVVTNNLQNQEGTNG

SEQ ID NO: 63892 - protein, 33 aa, Artificial Sequence
  Description of Artificial Sequence: Synthetic polypeptide
AEEEIRTTNPVATEQYGSVVVTNNLQQGGNQTE

SEQ ID NO: 63893 - protein, 33 aa, Artificial Sequence
  Description of Artificial Sequence: Synthetic polypeptide
AEEEIRTTNPVATEQYGSVVVTNNLQQGGNTTD

SEQ ID NO: 63894 - protein, 33 aa, Artificial Sequence
  Description of Artificial Sequence: Synthetic polypeptide
AEEEIRTTNPVATEQYGSVSTTNNNQQEIGNNQ

SEQ ID NO: 63895 - protein, 34 aa, Artificial Sequence
  Description of Artificial Sequence: Synthetic polypeptide
AEEEIRTTNPVATEQYGSVSTTNNQLQNNGTNIE

SEQ ID NO: 63896 - protein, 32 aa, Artificial Sequence
  Description of Artificial Sequence: Synthetic polypeptide
DEAEICTTNPVATECYGSVSTGGNLQDMGNEN

SEQ ID NO: 63897 - protein, 32 aa, Artificial Sequence
  Description of Artificial Sequence: Synthetic polypeptide
DEAEICTTNPVATECYGSVSTGNDDQRGNTDS

SEQ ID NO: 63898 - protein, 31 aa, Artificial Sequence
  Description of Artificial Sequence: Synthetic polypeptide
DEEEIACTNPVATEQYGSVATNLQTEGEEDT

SEQ ID NO: 63899 - protein, 30 aa, Artificial Sequence
  Description of Artificial Sequence: Synthetic polypeptide
AESEIRCTNPVATEQWGEASCNLQREGENR

SEQ ID NO: 63900 - protein, 31 aa, Artificial Sequence
  Description of Artificial Sequence: Synthetic polypeptide
CEEEIACTNPVATEQYGSVATNLQENPGENQ

SEQ ID NO: 63901 - protein, 30 aa, Artificial Sequence
  Description of Artificial Sequence: Synthetic polypeptide
AESEIRCTNPVATECYGSASCNLPQDRGNG

SEQ ID NO: 63902 - protein, 30 aa, Artificial Sequence
  Description of Artificial Sequence: Synthetic polypeptide
DEEEIRTTNPCATEAYGSVATTNDGQGNQT

SEQ ID NO: 63903 - protein, 31 aa, Artificial Sequence
  Description of Artificial Sequence: Synthetic polypeptide
DEEEIRTTNPCATEAYGSVATTNDGQGGNAN

SEQ ID NO: 63904 - protein, 31 aa, Artificial Sequence
  Description of Artificial Sequence: Synthetic polypeptide
DEEEIRTTNPCATEAYGSVATTNDGNQEGNA

SEQ ID NO: 63905 - protein, 29 aa, Artificial Sequence
  Description of Artificial Sequence: Synthetic peptide
AEEEIRTTNPVATEEYGCYSWNHQGGSNQ

SEQ ID NO: 63906 - protein, 32 aa, Artificial Sequence
  Description of Artificial Sequence: Synthetic polypeptide
DEEEIACTNPVATEQYGSVATNLQTADGGEND

SEQ ID NO: 63907 - protein, 32 aa, Artificial Sequence
  Description of Artificial Sequence: Synthetic polypeptide
AEEEIRTTNPVATEEYGVISCINLSQRGGNNR

SEQ ID NO: 63908 - protein, 31 aa, Artificial Sequence
  Description of Artificial Sequence: Synthetic polypeptide
DEEEIACTNPVATEQYGSVATNLQRNPTPEQ

SEQ ID NO: 63909 - protein, 30 aa, Artificial Sequence
  Description of Artificial Sequence: Synthetic polypeptide
AESEIRCTNPVATECYGEVSCNLQDRGEGR

SEQ ID NO: 63910 - protein, 31 aa, Artificial Sequence
  Description of Artificial Sequence: Synthetic polypeptide
DEEEIRTTNPCATEAYGSVATNLDGEQGNNA

SEQ ID NO: 63911 - protein, 31 aa, Artificial Sequence
  Description of Artificial Sequence: Synthetic polypeptide
DEEEIACTNPVATEQYGSVATNLQQDGEHTD

SEQ ID NO: 63912 - protein, 30 aa, Artificial Sequence
  Description of Artificial Sequence: Synthetic polypeptide
CEEEIACTNPVATEQYGSVATNLQGGDDHG

SEQ ID NO: 63913 - protein, 33 aa, Artificial Sequence
  Description of Artificial Sequence: Synthetic polypeptide
DEEEIATTNPVATEQYGSVCATNPLEQDSGNES

SEQ ID NO: 63914 - protein, 31 aa, Artificial Sequence
  Description of Artificial Sequence: Synthetic polypeptide
DEEEIACTNPVATEQYGSVATNLQPDQHNDD

SEQ ID NO: 63915 - protein, 30 aa, Artificial Sequence
  Description of Artificial Sequence: Synthetic polypeptide
DEEEIRTTNPCATEAYGSVALTNHERGVEQ

SEQ ID NO: 63916 - protein, 31 aa, Artificial Sequence
  Description of Artificial Sequence: Synthetic polypeptide
DEEEIACTNPVATEQYGSVATNLQPDGQHTD

SEQ ID NO: 63917 - protein, 31 aa, Artificial Sequence
  Description of Artificial Sequence: Synthetic polypeptide
DEEEIRTTNPCATEAYGSVALTNHEETRGNE

SEQ ID NO: 63918 - protein, 30 aa, Artificial Sequence
  Description of Artificial Sequence: Synthetic polypeptide
AESEIRCTNPVATECYGEVSENLQDRGEGR

SEQ ID NO: 63919 - protein, 31 aa, Artificial Sequence
  Description of Artificial Sequence: Synthetic polypeptide
DEAEIATTNPVATEQYGSVATNLEDPGENPN

SEQ ID NO: 63920 - protein, 30 aa, Artificial Sequence
  Description of Artificial Sequence: Synthetic polypeptide
AESEIRCTNPVATEQYGEASCNLPQDRGNG

SEQ ID NO: 63921 - protein, 32 aa, Artificial Sequence
  Description of Artificial Sequence: Synthetic polypeptide
DEEEIATTNPVATEQYGSVCATNLTQDGGDSL

SEQ ID NO: 63922 - protein, 32 aa, Artificial Sequence
  Description of Artificial Sequence: Synthetic polypeptide
DEAEICTTNPVATECYGSVSTGNLPQDDGNEN

SEQ ID NO: 63923 - protein, 31 aa, Artificial Sequence
  Description of Artificial Sequence: Synthetic polypeptide
DEEEIACTNPVATEQYGSVATNLTGTENDRE

SEQ ID NO: 63924 - protein, 30 aa, Artificial Sequence
  Description of Artificial Sequence: Synthetic polypeptide
DEEEIATTNPVATEQYGSVCATNLADLEDD

SEQ ID NO: 63925 - protein, 30 aa, Artificial Sequence
  Description of Artificial Sequence: Synthetic polypeptide
AESEIRTTNPVATECWGEVSCNEQDRGENR

SEQ ID NO: 63926 - protein, 32 aa, Artificial Sequence
  Description of Artificial Sequence: Synthetic polypeptide
DEEEIATTNPVATEQYGSVCATNLADNAGDGR

SEQ ID NO: 63927 - protein, 30 aa, Artificial Sequence
  Description of Artificial Sequence: Synthetic polypeptide
CEEEIACTNPVATEQYGSVATNLQATNPEE

SEQ ID NO: 63928 - protein, 32 aa, Artificial Sequence
  Description of Artificial Sequence: Synthetic polypeptide
DEEEIATTNPVATEQYGSVCATNLAPDNGNQE

SEQ ID NO: 63929 - protein, 31 aa, Artificial Sequence
  Description of Artificial Sequence: Synthetic polypeptide
DEEEIACTNPVATEQYGSVATNLQTGAGEGS

SEQ ID NO: 63930 - protein, 33 aa, Artificial Sequence
  Description of Artificial Sequence: Synthetic polypeptide
AEEEIRTTNPVATEQYGSVSTTNNQQQDEGNNE

SEQ ID NO: 63931 - protein, 30 aa, Artificial Sequence
  Description of Artificial Sequence: Synthetic polypeptide
AESEIRCTNPVATEQYGEASENLPQDRGNG

SEQ ID NO: 63932 - protein, 31 aa, Artificial Sequence
  Description of Artificial Sequence: Synthetic polypeptide
CEEEIACTNPVATEQYGSVATNLQEAGNMDN

SEQ ID NO: 63933 - protein, 32 aa, Artificial Sequence
  Description of Artificial Sequence: Synthetic polypeptide
DEEEIRTTNPVATEAYGSVVDFTNLTDGGNEQ

SEQ ID NO: 63934 - protein, 30 aa, Artificial Sequence
  Description of Artificial Sequence: Synthetic polypeptide
AEEEIRTTNPVATEGYGCTGSINGQQRGNI

SEQ ID NO: 63935 - protein, 31 aa, Artificial Sequence
  Description of Artificial Sequence: Synthetic polypeptide
CEEEIACTNPVATEQYGSVATNLQEAGNPED

SEQ ID NO: 63936 - protein, 31 aa, Artificial Sequence
  Description of Artificial Sequence: Synthetic polypeptide
DEEEIACTNPVATEQYGSVATNLQTENPNVE

SEQ ID NO: 63937 - protein, 33 aa, Artificial Sequence
  Description of Artificial Sequence: Synthetic polypeptide
DEEEIATTNPVATEQYGSVCATNLEAREGDNHQ

SEQ ID NO: 63938 - protein, 32 aa, Artificial Sequence
  Description of Artificial Sequence: Synthetic polypeptide
DEEEIATTNPVATEQYGSVCATNLEAREMDNQ

SEQ ID NO: 63939 - protein, 35 aa, Artificial Sequence
  Description of Artificial Sequence: Synthetic polypeptide
DEEEIRTTNPVATEAYGSVVISMTNLTGRSGSNRM

SEQ ID NO: 63940 - protein, 33 aa, Artificial Sequence
  Description of Artificial Sequence: Synthetic polypeptide
AEEEIRTTNPVATEQYGSVVVTVTNLQEGNNLT

SEQ ID NO: 63941 - protein, 32 aa, Artificial Sequence
  Description of Artificial Sequence: Synthetic polypeptide
DEEEIATTNPVATEQYGSVCATNLQDNPEEGR

SEQ ID NO: 63942 - protein, 32 aa, Artificial Sequence
  Description of Artificial Sequence: Synthetic polypeptide
DEEEIRTTNPVATEAYGSVVDFTNEQTEGGNE

SEQ ID NO: 63943 - protein, 31 aa, Artificial Sequence
  Description of Artificial Sequence: Synthetic polypeptide
DDEEIRTTNPVATDQYGSVSTNGVTGNGNGG

SEQ ID NO: 63944 - protein, 33 aa, Artificial Sequence
  Description of Artificial Sequence: Synthetic polypeptide
DEEEIATTNPVATEQYGSVCATNPLQDADNNRQ

SEQ ID NO: 63945 - protein, 32 aa, Artificial Sequence
  Description of Artificial Sequence: Synthetic polypeptide
DEEEIACTNPVATEQYGSVATNLQNGEPEGNP

SEQ ID NO: 63946 - protein, 31 aa, Artificial Sequence
  Description of Artificial Sequence: Synthetic polypeptide
DEEEIRTTNPCATDQYGVVPTLDLQRGVNQF

SEQ ID NO: 63947 - protein, 31 aa, Artificial Sequence
  Description of Artificial Sequence: Synthetic polypeptide
AEEEIRTTNPVATEEYGCSSWNDLQRFGSNA

SEQ ID NO: 63948 - protein, 32 aa, Artificial Sequence
  Description of Artificial Sequence: Synthetic polypeptide
DEEEIACTNPVATEQYGSVATNLQDRNAPNNE

SEQ ID NO: 63949 - protein, 29 aa, Artificial Sequence
  Description of Artificial Sequence: Synthetic peptide
DEEEIRTTNPCATDQYGTVATTDEQAGNF

SEQ ID NO: 63950 - protein, 29 aa, Artificial Sequence
  Description of Artificial Sequence: Synthetic peptide
DEEEIRTTNPCATDQYGTVATDEQTGTNF

SEQ ID NO: 63951 - protein, 29 aa, Artificial Sequence
  Description of Artificial Sequence: Synthetic peptide
DEEEIRTTNPCATDQYGTVATDEQGGNNF

SEQ ID NO: 63952 - protein, 31 aa, Artificial Sequence
  Description of Artificial Sequence: Synthetic polypeptide
DEEEIRTTNPCATDQYGQVVTEDLQRGVNQF

SEQ ID NO: 63953 - protein, 33 aa, Artificial Sequence
  Description of Artificial Sequence: Synthetic polypeptide
DEEEIACTNPVATEQYGSVATNLQDRMGPNNEI

SEQ ID NO: 63954 - protein, 31 aa, Artificial Sequence
  Description of Artificial Sequence: Synthetic polypeptide
DEEEIRTTNPCATDQYGQVPVTDLQRGVNQF

SEQ ID NO: 63955 - protein, 29 aa, Artificial Sequence
  Description of Artificial Sequence: Synthetic peptide
DEAEIATTNPVATEQYGSVASNDQRDTDD

SEQ ID NO: 63956 - protein, 31 aa, Artificial Sequence
  Description of Artificial Sequence: Synthetic polypeptide
DEEEIRTTNPCATDQYGQVPTDELSQRGGNE

SEQ ID NO: 63957 - protein, 31 aa, Artificial Sequence
  Description of Artificial Sequence: Synthetic polypeptide
DEEEIACTNPVATEQYGSVATNLQDPMNNEE

SEQ ID NO: 63958 - protein, 30 aa, Artificial Sequence
  Description of Artificial Sequence: Synthetic polypeptide
DEEEIRTTNPCATDQYGQVPLVLQRGVNQF

SEQ ID NO: 63959 - protein, 32 aa, Artificial Sequence
  Description of Artificial Sequence: Synthetic polypeptide
DEEEIACTNPVATEQYGSVATNLQDGQDDNND

SEQ ID NO: 63960 - protein, 30 aa, Artificial Sequence
  Description of Artificial Sequence: Synthetic polypeptide
DEEEIRTTNPCATDPYGQVPTDLSQRGGNF

SEQ ID NO: 63961 - protein, 31 aa, Artificial Sequence
  Description of Artificial Sequence: Synthetic polypeptide
DEEEIACTNPVATEQYGSVATNLQDGMGMED

SEQ ID NO: 63962 - protein, 30 aa, Artificial Sequence
  Description of Artificial Sequence: Synthetic polypeptide
DEEEIRTTNPCATDAYGQTVPTDLSQRGNF

SEQ ID NO: 63963 - protein, 32 aa, Artificial Sequence
  Description of Artificial Sequence: Synthetic polypeptide
DEAEICTTNPVATECYGSVSTGNLQGDGNTEN

SEQ ID NO: 63964 - protein, 30 aa, Artificial Sequence
  Description of Artificial Sequence: Synthetic polypeptide
AEEEIRTTNPVATEEYGCSCSWNLQNGSEA

SEQ ID NO: 63965 - protein, 31 aa, Artificial Sequence
  Description of Artificial Sequence: Synthetic polypeptide
DEEEIACTNPVATEQYGSVATNLQDADDNAY

SEQ ID NO: 63966 - protein, 32 aa, Artificial Sequence
  Description of Artificial Sequence: Synthetic polypeptide
DEEEIATTNPVATEQYGSVCATNPLQDQDNDN

SEQ ID NO: 63967 - protein, 32 aa, Artificial Sequence
  Description of Artificial Sequence: Synthetic polypeptide
DEEEIACTNPVATEQYGSVATNLQNGNPMEVH

SEQ ID NO: 63968 - protein, 31 aa, Artificial Sequence
  Description of Artificial Sequence: Synthetic polypeptide
DEEEIATTNPVATEQYGSVCATNPLQDPPDQ

SEQ ID NO: 63969 - protein, 32 aa, Artificial Sequence
  Description of Artificial Sequence: Synthetic polypeptide
DEAEIATTNPVATEQYGSVATAGNLQEAGNDN

SEQ ID NO: 63970 - protein, 30 aa, Artificial Sequence
  Description of Artificial Sequence: Synthetic polypeptide
DEAEIATTNPVATEQYGSVATNLADGGEDN

SEQ ID NO: 63971 - protein, 32 aa, Artificial Sequence
  Description of Artificial Sequence: Synthetic polypeptide
DEEEIACTNPVATEQYGSVATNLQNDGNNENF

SEQ ID NO: 63972 - protein, 32 aa, Artificial Sequence
  Description of Artificial Sequence: Synthetic polypeptide
DEEEIATTNPVATEQYGSVCATNPLQDAGPDE

SEQ ID NO: 63973 - protein, 31 aa, Artificial Sequence
  Description of Artificial Sequence: Synthetic polypeptide
DEEEIACTNPVATEQYGSVATNLQGAGAEGF

SEQ ID NO: 63974 - protein, 32 aa, Artificial Sequence
  Description of Artificial Sequence: Synthetic polypeptide
DEEEIACTNPVATEQYGSVATNLQETGNDVES

SEQ ID NO: 63975 - protein, 32 aa, Artificial Sequence
  Description of Artificial Sequence: Synthetic polypeptide
DEAEIATTNPVATEQYGSVATNDQRTGPNDQF

SEQ ID NO: 63976 - protein, 31 aa, Artificial Sequence
  Description of Artificial Sequence: Synthetic polypeptide
DEEEIACTNPVATEQYGSVATNLQESGGDPM

SEQ ID NO: 63977 - protein, 32 aa, Artificial Sequence
  Description of Artificial Sequence: Synthetic polypeptide
DEAEIATTNPVATEQYGSVATNDQDRPGENDQ

SEQ ID NO: 63978 - protein, 32 aa, Artificial Sequence
  Description of Artificial Sequence: Synthetic polypeptide
DEEEIATTNPVATEQYGSVCATNPLQDGPEAQ

SEQ ID NO: 63979 - protein, 31 aa, Artificial Sequence
  Description of Artificial Sequence: Synthetic polypeptide
DEEEIRTTNPCATEAYGSTVACTNHGRGGNA

SEQ ID NO: 63980 - protein, 31 aa, Artificial Sequence
  Description of Artificial Sequence: Synthetic polypeptide
DEEEIACTNPVATEQYGSVATNLQENGTEGA

SEQ ID NO: 63981 - protein, 30 aa, Artificial Sequence
  Description of Artificial Sequence: Synthetic polypeptide
DEEEIACTNPVATEQYGSVATNLQEDPMDI

SEQ ID NO: 63982 - protein, 31 aa, Artificial Sequence
  Description of Artificial Sequence: Synthetic polypeptide
DEEEIACTNPVATEQYGSVATNLQEAPGEEH

SEQ ID NO: 63983 - protein, 31 aa, Artificial Sequence
  Description of Artificial Sequence: Synthetic polypeptide
DEEEIACTNPVATEQYGSVATNLQEAPEPGN

SEQ ID NO: 63984 - protein, 31 aa, Artificial Sequence
  Description of Artificial Sequence: Synthetic polypeptide
DEEEIACTNPVATEQYGSVATNLQEANNNVE

SEQ ID NO: 63985 - protein, 32 aa, Artificial Sequence
  Description of Artificial Sequence: Synthetic polypeptide
DEEEIACTNPVATEQYGSVATNLQEADGNDGF

SEQ ID NO: 63986 - protein, 31 aa, Artificial Sequence
  Description of Artificial Sequence: Synthetic polypeptide
DEEEIACTNPVATEQYGSVATNLQEADGGEH

SEQ ID NO: 63987 - protein, 30 aa, Artificial Sequence
  Description of Artificial Sequence: Synthetic polypeptide
DEAEIATTNPVATEQYGSVATGLEEGRGQE

SEQ ID NO: 63988 - protein, 33 aa, Artificial Sequence
  Description of Artificial Sequence: Synthetic polypeptide
AEEEIRTTNPVATEEYGCVFYSINDLDQRGENR

SEQ ID NO: 63989 - protein, 30 aa, Artificial Sequence
  Description of Artificial Sequence: Synthetic polypeptide
DEAEIATTNPVATEQYGSVATALQNHDNQE

SEQ ID NO: 63990 - protein, 31 aa, Artificial Sequence
  Description of Artificial Sequence: Synthetic polypeptide
DEEEIACTNPVATEQYGSVATNLQEGGTPEH

SEQ ID NO: 63991 - protein, 30 aa, Artificial Sequence
  Description of Artificial Sequence: Synthetic polypeptide
AEEEIRATNPCATEQYGSVSVENLMLGNNM

SEQ ID NO: 63992 - protein, 35 aa, Artificial Sequence
  Description of Artificial Sequence: Synthetic polypeptide
DEEEIRTTNPVATEAYGSVTSYTENELSQGTGGNR

SEQ ID NO: 63993 - protein, 35 aa, Artificial Sequence
  Description of Artificial Sequence: Synthetic polypeptide
DEEEIRTTNPVATEAYGSVTASYTENLSARTGGNR

SEQ ID NO: 63994 - protein, 28 aa, Artificial Sequence
  Description of Artificial Sequence: Synthetic peptide
AETEIACTNPVATEQYGEASENLQGGGR

SEQ ID NO: 63995 - protein, 28 aa, Artificial Sequence
  Description of Artificial Sequence: Synthetic peptide
AETEIACTNPVATEQYGEASANWQRGPR

SEQ ID NO: 63996 - protein, 33 aa, Artificial Sequence
  Description of Artificial Sequence: Synthetic polypeptide
DDEEIRSTNPVATEQYGSVSSTNNMDQRGNGNI

SEQ ID NO: 63997 - protein, 28 aa, Artificial Sequence
  Description of Artificial Sequence: Synthetic peptide
AETEIACTNPVATEQYGEAFENLQRGGR

SEQ ID NO: 63998 - protein, 33 aa, Artificial Sequence
  Description of Artificial Sequence: Synthetic polypeptide
DEDEIRTTNPVATEAYGYVSGTNNLDQGMGTNR

SEQ ID NO: 63999 - protein, 32 aa, Artificial Sequence
  Description of Artificial Sequence: Synthetic polypeptide
DDEEIRSTNPVATEQYGSVSSTNNMQEGGGNN

SEQ ID NO: 64000 - protein, 33 aa, Artificial Sequence
  Description of Artificial Sequence: Synthetic polypeptide
AEEEIRTTNPVATEQYGSVVVTTVNGNLQQGNI

SEQ ID NO: 64001 - protein, 30 aa, Artificial Sequence
  Description of Artificial Sequence: Synthetic polypeptide
DDEEIRSTNPVATEQYGSVSTNQIAHNGQS

SEQ ID NO: 64002 - protein, 32 aa, Artificial Sequence
  Description of Artificial Sequence: Synthetic polypeptide
DDEEIRTTNCVATEQWGSVVSTLLNQREGETR

SEQ ID NO: 64003 - protein, 33 aa, Artificial Sequence
  Description of Artificial Sequence: Synthetic polypeptide
AEEEIRTTNPVATEQYGSVVVTTTNLQQGNQDN

SEQ ID NO: 64004 - protein, 32 aa, Artificial Sequence
  Description of Artificial Sequence: Synthetic polypeptide
DDEEIRTTNCVATEQWGSVVTNGLLDQREGTR

SEQ ID NO: 64005 - protein, 28 aa, Artificial Sequence
  Description of Artificial Sequence: Synthetic peptide
AETEIACTNPVATEQYGEAAENLQRGGR

SEQ ID NO: 64006 - protein, 31 aa, Artificial Sequence
  Description of Artificial Sequence: Synthetic polypeptide
DEDEIRTTNPVATECYGSVATNLQETNTPDE

SEQ ID NO: 64007 - protein, 31 aa, Artificial Sequence
  Description of Artificial Sequence: Synthetic polypeptide
DEAEICTTNPVATECYGSVSTGNGQDEGNEN

SEQ ID NO: 64008 - protein, 33 aa, Artificial Sequence
  Description of Artificial Sequence: Synthetic polypeptide
AEEEIRTTNPVATEQYGSVVVTTVNNNQEGENR

SEQ ID NO: 64009 - protein, 32 aa, Artificial Sequence
  Description of Artificial Sequence: Synthetic polypeptide
DEDEIRTTNPVATECYGSVSTNLNGEAGENSD

SEQ ID NO: 64010 - protein, 32 aa, Artificial Sequence
  Description of Artificial Sequence: Synthetic polypeptide
AEEEIRTTNPVATEPYGSVSTNLNQNNNINNG

SEQ ID NO: 64011 - protein, 33 aa, Artificial Sequence
  Description of Artificial Sequence: Synthetic polypeptide
DEDEIRTTNPVATECYGSVSTTNLNGDVGENRQ

SEQ ID NO: 64012 - protein, 31 aa, Artificial Sequence
  Description of Artificial Sequence: Synthetic polypeptide
DEDEIRTTNPVATECYGSVVTGNGGNAGENR

SEQ ID NO: 64013 - protein, 31 aa, Artificial Sequence
  Description of Artificial Sequence: Synthetic polypeptide
DEDEIRTTNPVATEEYGSVSTESLDHPNDRY

SEQ ID NO: 64014 - protein, 32 aa, Artificial Sequence
  Description of Artificial Sequence: Synthetic polypeptide
DDEEIRTTNCVATEQWGSVVTSGLLQREGNTR

SEQ ID NO: 64015 - protein, 29 aa, Artificial Sequence
  Description of Artificial Sequence: Synthetic peptide
DEASIRTTNPTAYEQWGSVSFNDQSGNNR

SEQ ID NO: 64016 - protein, 33 aa, Artificial Sequence
  Description of Artificial Sequence: Synthetic polypeptide
DDEEIRSTNPVATEQYGSVSSTNMDQRGGNGNG

SEQ ID NO: 64017 - protein, 33 aa, Artificial Sequence
  Description of Artificial Sequence: Synthetic polypeptide
AEEEIRTTNPVATEQYGSVVVTTTNLQDNGNTG

SEQ ID NO: 64018 - protein, 32 aa, Artificial Sequence
  Description of Artificial Sequence: Synthetic polypeptide
DEAEICTTNPVATECYGSVSTGNDLQDAGNEM

SEQ ID NO: 64019 - protein, 31 aa, Artificial Sequence
  Description of Artificial Sequence: Synthetic polypeptide
DEDEIRTTNPVATEAWGSVSTNLNGEHGNSD

SEQ ID NO: 64020 - protein, 31 aa, Artificial Sequence
  Description of Artificial Sequence: Synthetic polypeptide
DDEEIRSTNPVATEQYGCVSTNLQNNSGSQQ

SEQ ID NO: 64021 - protein, 30 aa, Artificial Sequence
  Description of Artificial Sequence: Synthetic polypeptide
DDEEIRSTNPVATEQYGSSSLTNNVVTGNN

SEQ ID NO: 64022 - protein, 32 aa, Artificial Sequence
  Description of Artificial Sequence: Synthetic polypeptide
DDEEIRSTNPVATEQYGSVCSNTNHQERSGQQ

SEQ ID NO: 64023 - protein, 32 aa, Artificial Sequence
  Description of Artificial Sequence: Synthetic polypeptide
AEEEIRTTNPVATEQYGSVVVTTNQQEGNNAD

SEQ ID NO: 64024 - protein, 32 aa, Artificial Sequence
  Description of Artificial Sequence: Synthetic polypeptide
AEEEIRTTNPVATEQYGSVVVTTNQQEGTNQV

SEQ ID NO: 64025 - protein, 33 aa, Artificial Sequence
  Description of Artificial Sequence: Synthetic polypeptide
DDEEIRSTNPVATEQYGSVCSTNLQARNGQGGQ

SEQ ID NO: 64026 - protein, 32 aa, Artificial Sequence
  Description of Artificial Sequence: Synthetic polypeptide
DDEEIRSTNPVATEQYGSVNTNLQARNGDQGI

SEQ ID NO: 64027 - protein, 33 aa, Artificial Sequence
  Description of Artificial Sequence: Synthetic polypeptide
AEEEIRTTNPVATEQYGSVVVTTTNLQQGGNTQ

SEQ ID NO: 64028 - protein, 32 aa, Artificial Sequence
  Description of Artificial Sequence: Synthetic polypeptide
AEEEIRTTNPVATEQYGSVVVTTNQQEQEGNQ

SEQ ID NO: 64029 - protein, 31 aa, Artificial Sequence
  Description of Artificial Sequence: Synthetic polypeptide
DEAVIGTTNPVATEQWGSVSTDALQRGSNQS

SEQ ID NO: 64030 - protein, 30 aa, Artificial Sequence
  Description of Artificial Sequence: Synthetic polypeptide
DEAVIGTTNPVATEQWGSVCSTDLLQYGNQ

SEQ ID NO: 64031 - protein, 29 aa, Artificial Sequence
  Description of Artificial Sequence: Synthetic peptide
DEAVICTTNGVAYYQYGSVSTNLQRGDQM

SEQ ID NO: 64032 - protein, 34 aa, Artificial Sequence
  Description of Artificial Sequence: Synthetic polypeptide
AEEEIRTTNPVATEQYGSVSTTNNQLQTNGNIDT

SEQ ID NO: 64033 - protein, 30 aa, Artificial Sequence
  Description of Artificial Sequence: Synthetic polypeptide
CEQEICTTNPVATEQWGSVSTANLQESQND

SEQ ID NO: 64034 - protein, 34 aa, Artificial Sequence
  Description of Artificial Sequence: Synthetic polypeptide
AEEEIRTTNPVATEQYGSVSVSTNNNLQQGNNSD

SEQ ID NO: 64035 - protein, 33 aa, Artificial Sequence
  Description of Artificial Sequence: Synthetic polypeptide
AEEEIRTTNPVATEQYGSVVVTTTNLNQEGQNE

SEQ ID NO: 64036 - protein, 32 aa, Artificial Sequence
  Description of Artificial Sequence: Synthetic polypeptide
DEAEICTTNPVATECYGSVSTGNGLQGDGNEN

SEQ ID NO: 64037 - protein, 33 aa, Artificial Sequence
  Description of Artificial Sequence: Synthetic polypeptide
DEDEIRTTNPVATEAYGSVSTNLNQGETGGNSD

SEQ ID NO: 64038 - protein, 32 aa, Artificial Sequence
  Description of Artificial Sequence: Synthetic polypeptide
AEEEIRTTNPVATEQYGSVVVTTNQQQEGNVD

SEQ ID NO: 64039 - protein, 31 aa, Artificial Sequence
  Description of Artificial Sequence: Synthetic polypeptide
DEEEIACTNPVATEQYGSVATNQLQEVMGGL

SEQ ID NO: 64040 - protein, 30 aa, Artificial Sequence
  Description of Artificial Sequence: Synthetic polypeptide
DEASIRTTNPLATEQFGSVCSWNLQSGSNQ

SEQ ID NO: 64041 - protein, 33 aa, Artificial Sequence
  Description of Artificial Sequence: Synthetic polypeptide
AEEEIRTTNPVATEQYGSVVVTVNLQGTEGTNG

SEQ ID NO: 64042 - protein, 30 aa, Artificial Sequence
  Description of Artificial Sequence: Synthetic polypeptide
DEAEIYTTNPVATEAYGSVSTNLTPGSGET

SEQ ID NO: 64043 - protein, 32 aa, Artificial Sequence
  Description of Artificial Sequence: Synthetic polypeptide
DEAEICTTNPVATECYGSVSTGNLGQDGQNEE

SEQ ID NO: 64044 - protein, 30 aa, Artificial Sequence
  Description of Artificial Sequence: Synthetic polypeptide
AEEEIRTTNPVATEHWGCFSINDDQRMGNR

SEQ ID NO: 64045 - protein, 32 aa, Artificial Sequence
  Description of Artificial Sequence: Synthetic polypeptide
DEEEIATTNPVATEQYGSVCATDLQPDSGGER

SEQ ID NO: 64046 - protein, 34 aa, Artificial Sequence
  Description of Artificial Sequence: Synthetic polypeptide
DEDEIRTTNPVATEGYGSVPSTTNLSQETVGNRW

SEQ ID NO: 64047 - protein, 32 aa, Artificial Sequence
  Description of Artificial Sequence: Synthetic polypeptide
CENEIRTTNPVATEQYGSVCSTNLQFFGSEQL

SEQ ID NO: 64048 - protein, 30 aa, Artificial Sequence
  Description of Artificial Sequence: Synthetic polypeptide
DDEEIRTTNPVATDQYGSVSTDGVGNGNND

SEQ ID NO: 64049 - protein, 31 aa, Artificial Sequence
  Description of Artificial Sequence: Synthetic polypeptide
DEEEIACTNPVATEQYGSVATNSLFQVAGED

SEQ ID NO: 64050 - protein, 30 aa, Artificial Sequence
  Description of Artificial Sequence: Synthetic polypeptide
CENEIRTTNPVATEQYGSISTNQQQEGLIV

SEQ ID NO: 64051 - protein, 33 aa, Artificial Sequence
  Description of Artificial Sequence: Synthetic polypeptide
AEEEIRTTNPVATEQYGSVSTTNNQQEQNGNQD

SEQ ID NO: 64052 - protein, 31 aa, Artificial Sequence
  Description of Artificial Sequence: Synthetic polypeptide
AESEIRTTNPVATECYGSVSENEPQDRGEGR

SEQ ID NO: 64053 - protein, 30 aa, Artificial Sequence
  Description of Artificial Sequence: Synthetic polypeptide
CEEEIACTNPVATEQYGSVATNLQAAHNMD

SEQ ID NO: 64054 - protein, 31 aa, Artificial Sequence
  Description of Artificial Sequence: Synthetic polypeptide
AESEIRTTNPVATECWGSVSCNLPQDRGENG

SEQ ID NO: 64055 - protein, 32 aa, Artificial Sequence
  Description of Artificial Sequence: Synthetic polypeptide
DEEEIATTNPVATEQYGSVCATNDEFDDGNRQ

SEQ ID NO: 64056 - protein, 30 aa, Artificial Sequence
  Description of Artificial Sequence: Synthetic polypeptide
AESEIRTTNPVATECWGSASCNLPQDRGNG

SEQ ID NO: 64057 - protein, 32 aa, Artificial Sequence
  Description of Artificial Sequence: Synthetic polypeptide
DEEEIATTNPVATEQYGSVCATNDLQDDLGAQ

SEQ ID NO: 64058 - protein, 31 aa, Artificial Sequence
  Description of Artificial Sequence: Synthetic polypeptide
DDEEIRTTNPVATDQYGSVSTNGVENGGNDT

SEQ ID NO: 64059 - protein, 32 aa, Artificial Sequence
  Description of Artificial Sequence: Synthetic polypeptide
DDEEIRTTNPVATDQYGSVSTNGVQGNGNDNQ

SEQ ID NO: 64060 - protein, 31 aa, Artificial Sequence
  Description of Artificial Sequence: Synthetic polypeptide
DDEEIRTTNPVATDQYGSVSTNGVTGNGNED

SEQ ID NO: 64061 - protein, 29 aa, Artificial Sequence
  Description of Artificial Sequence: Synthetic peptide
CENEIRTTNPVATEQYGSISTLQQQEGLV

SEQ ID NO: 64062 - protein, 32 aa, Artificial Sequence
  Description of Artificial Sequence: Synthetic polypeptide
AESEIRTTNPVATECYGSVSEINEPQDRGENR

SEQ ID NO: 64063 - protein, 28 aa, Artificial Sequence
  Description of Artificial Sequence: Synthetic peptide
CEPEIACTNPVATEQYGEASENLQDGGR

SEQ ID NO: 64064 - protein, 31 aa, Artificial Sequence
  Description of Artificial Sequence: Synthetic polypeptide
DEAEIYTTNPVATEQYGSVCSTNLAYFGSDQ

SEQ ID NO: 64065 - protein, 28 aa, Artificial Sequence
  Description of Artificial Sequence: Synthetic peptide
DDEEIRTTNPQATEHYGCVSWNHQHNNQ

SEQ ID NO: 64066 - protein, 33 aa, Artificial Sequence
  Description of Artificial Sequence: Synthetic polypeptide
AEEEIRTTNPVATEQYGSVVVTVNLQNNEGQNE

SEQ ID NO: 64067 - protein, 29 aa, Artificial Sequence
  Description of Artificial Sequence: Synthetic peptide
DDEEIRTTNPCATEHYGCVCSWNLQRNDQ

SEQ ID NO: 64068 - protein, 33 aa, Artificial Sequence
  Description of Artificial Sequence: Synthetic polypeptide
AEEEIRTTNPVATEQYGSVVVTVNLQQGNGNDN

SEQ ID NO: 64069 - protein, 29 aa, Artificial Sequence
  Description of Artificial Sequence: Synthetic peptide
DEASIRTTNPCAYEQWGSVSFNLPDSGNR

SEQ ID NO: 64070 - protein, 28 aa, Artificial Sequence
  Description of Artificial Sequence: Synthetic peptide
AETEIACTNPVATEQWGAASENLQRGGR

SEQ ID NO: 64071 - protein, 33 aa, Artificial Sequence
  Description of Artificial Sequence: Synthetic polypeptide
AEEEIRTTNPVATEQYGSVVVTVNLQTGEENDT

SEQ ID NO: 64072 - protein, 30 aa, Artificial Sequence
  Description of Artificial Sequence: Synthetic polypeptide
DEASIATTNPVATESYGSVATNELQDSGNM

SEQ ID NO: 64073 - protein, 30 aa, Artificial Sequence
  Description of Artificial Sequence: Synthetic polypeptide
DEEEIACTNPVATEQYGSVATTNDDAGEND

SEQ ID NO: 64074 - protein, 33 aa, Artificial Sequence
  Description of Artificial Sequence: Synthetic polypeptide
DEEEIACTNPVATEQYGSVATPNLQEQGENDRL

SEQ ID NO: 64075 - protein, 32 aa, Artificial Sequence
  Description of Artificial Sequence: Synthetic polypeptide
AEEEIRTTNPVATEQYGSVSTTNNQQEGETEE

SEQ ID NO: 64076 - protein, 32 aa, Artificial Sequence
  Description of Artificial Sequence: Synthetic polypeptide
DEEEIRTTNPCATEAYGSVTVSTNLEAGNENT

SEQ ID NO: 64077 - protein, 31 aa, Artificial Sequence
  Description of Artificial Sequence: Synthetic polypeptide
DEANEIATTNPVAYEQYGSVATNLQVGDNDQ

SEQ ID NO: 64078 - protein, 33 aa, Artificial Sequence
  Description of Artificial Sequence: Synthetic polypeptide
DEEEIRTTNPCATEAYGSVTSTNLQAGTTNVTE

SEQ ID NO: 64079 - protein, 31 aa, Artificial Sequence
  Description of Artificial Sequence: Synthetic polypeptide
DEAIIRTTNPVATEQWGSVSTPNQLGDNGNP

SEQ ID NO: 64080 - protein, 30 aa, Artificial Sequence
  Description of Artificial Sequence: Synthetic polypeptide
DEEEIRTTNPCATEAYGSVSYNIFRGFQDP

SEQ ID NO: 64081 - protein, 30 aa, Artificial Sequence
  Description of Artificial Sequence: Synthetic polypeptide
DEAHIRTTNPVAFEEYGQSISTNLERPNFR

SEQ ID NO: 64082 - protein, 30 aa, Artificial Sequence
  Description of Artificial Sequence: Synthetic polypeptide
DEAELCTTNPLATERYGSVPCTNLQRGNNM

SEQ ID NO: 64083 - protein, 33 aa, Artificial Sequence
  Description of Artificial Sequence: Synthetic polypeptide
DEEEIRTTNPCATEAYGSVSVSTNLQAGTTNTE

SEQ ID NO: 64084 - protein, 30 aa, Artificial Sequence
  Description of Artificial Sequence: Synthetic polypeptide
DEAEIYTTNPVATEQYGSVSTDPYMGYENT

SEQ ID NO: 64085 - protein, 32 aa, Artificial Sequence
  Description of Artificial Sequence: Synthetic polypeptide
DEEEIRTTNPCATEAYGSVSVSTNLEAGNNTA

SEQ ID NO: 64086 - protein, 31 aa, Artificial Sequence
  Description of Artificial Sequence: Synthetic polypeptide
DEEEIRTTNPCATEAYGSVTSTNQLAGNNTD

SEQ ID NO: 64087 - protein, 33 aa, Artificial Sequence
  Description of Artificial Sequence: Synthetic polypeptide
AEEEIRTTNPVATEQYGSVSVTENGQNGNNNNG

SEQ ID NO: 64088 - protein, 31 aa, Artificial Sequence
  Description of Artificial Sequence: Synthetic polypeptide
AEEEIRTTNPVATEQYGSVSTTNTNLGQEEV

SEQ ID NO: 64089 - protein, 28 aa, Artificial Sequence
  Description of Artificial Sequence: Synthetic peptide
AENLIACTNPVATEQYGEASENLQRGGR

SEQ ID NO: 64090 - protein, 31 aa, Artificial Sequence
  Description of Artificial Sequence: Synthetic polypeptide
DEAEIRTTNPVAYEQYGVVVSTNIDHDGNER

SEQ ID NO: 64091 - protein, 30 aa, Artificial Sequence
  Description of Artificial Sequence: Synthetic polypeptide
AEEEIATTNPVATEQYGCVATNLQQDGDDI

SEQ ID NO: 64092 - protein, 31 aa, Artificial Sequence
  Description of Artificial Sequence: Synthetic polypeptide
AEEEIATTNPVATEQYGCVATNLQNNGDNQM

SEQ ID NO: 64093 - protein, 31 aa, Artificial Sequence
  Description of Artificial Sequence: Synthetic polypeptide
AEEEIATTNPVATEQYGCVATNLQNNGDNPM

SEQ ID NO: 64094 - protein, 29 aa, Artificial Sequence
  Description of Artificial Sequence: Synthetic peptide
AENEICCTNPVATEQYGEFSENLQRGEGR

SEQ ID NO: 64095 - protein, 31 aa, Artificial Sequence
  Description of Artificial Sequence: Synthetic polypeptide
DEAEIRTTNPVAYEQYGVVVSTNDEHHGNER

SEQ ID NO: 64096 - protein, 29 aa, Artificial Sequence
  Description of Artificial Sequence: Synthetic peptide
AENEICCTNPVATEQYGEASENLQCRGGR

SEQ ID NO: 64097 - protein, 31 aa, Artificial Sequence
  Description of Artificial Sequence: Synthetic polypeptide
DEAEIATTNPVATEHWGSVSTNLQGDGDNDI

SEQ ID NO: 64098 - protein, 32 aa, Artificial Sequence
  Description of Artificial Sequence: Synthetic polypeptide
DEAEIRTTNPVAYEQYGVVSVTGVLSQRVGND

SEQ ID NO: 64099 - protein, 31 aa, Artificial Sequence
  Description of Artificial Sequence: Synthetic polypeptide
DEAEIRTTNPVAYEQYGVVAVTALSQRPGND

SEQ ID NO: 64100 - protein, 28 aa, Artificial Sequence
  Description of Artificial Sequence: Synthetic peptide
AENEICCTNPVASEQYGEASENLQRGGR

SEQ ID NO: 64101 - protein, 32 aa, Artificial Sequence
  Description of Artificial Sequence: Synthetic polypeptide
DEAEIRTTNPVAYEQYGVSHSQNDDLQRGIGR

SEQ ID NO: 64102 - protein, 29 aa, Artificial Sequence
  Description of Artificial Sequence: Synthetic peptide
DEAEIATTNPVATECYGSVATNLQDLDAE

SEQ ID NO: 64103 - protein, 31 aa, Artificial Sequence
  Description of Artificial Sequence: Synthetic polypeptide
DEAEIATTNPVATECWGSVSTNLQGNDDDSR

SEQ ID NO: 64104 - protein, 30 aa, Artificial Sequence
  Description of Artificial Sequence: Synthetic polypeptide
DEAEIRTTNPVAYEQYGTVSTVLQNGDGEA

SEQ ID NO: 64105 - protein, 31 aa, Artificial Sequence
  Description of Artificial Sequence: Synthetic polypeptide
DEAEIATTNPVATEAWGSTVNTNLSQRPGNS

SEQ ID NO: 64106 - protein, 29 aa, Artificial Sequence
  Description of Artificial Sequence: Synthetic peptide
AENEICATNPVATEQYGVVASENLQRGGG

SEQ ID NO: 64107 - protein, 31 aa, Artificial Sequence
  Description of Artificial Sequence: Synthetic polypeptide
DEAEIRTTNPVAYEQYGTVSTNLQVNGGDEA

SEQ ID NO: 64108 - protein, 33 aa, Artificial Sequence
  Description of Artificial Sequence: Synthetic polypeptide
AEEEIRTTNPVATEQYGSVSTTTNQQQGNIENQ

SEQ ID NO: 64109 - protein, 30 aa, Artificial Sequence
  Description of Artificial Sequence: Synthetic polypeptide
AENEICCTNPVATEQYGESCSENLQRIGGR

SEQ ID NO: 64110 - protein, 34 aa, Artificial Sequence
  Description of Artificial Sequence: Synthetic polypeptide
AEEEIRTTNPVATEQYGSVSTTTNQLQGNGTNSG

SEQ ID NO: 64111 - protein, 28 aa, Artificial Sequence
  Description of Artificial Sequence: Synthetic peptide
AENEICCTNPVATEQYGESSENLQRGGD

SEQ ID NO: 64112 - protein, 33 aa, Artificial Sequence
  Description of Artificial Sequence: Synthetic polypeptide
DEAEIRTTNPVAYEQYGVVVSTNLDQHEGGNER

SEQ ID NO: 64113 - protein, 29 aa, Artificial Sequence
  Description of Artificial Sequence: Synthetic peptide
AENEICSTNPVATEQYGTVASENLQDGGR

SEQ ID NO: 64114 - protein, 31 aa, Artificial Sequence
  Description of Artificial Sequence: Synthetic polypeptide
AEEEIRTTNPVATEQYGVVVVTTNNQQGNGQ

SEQ ID NO: 64115 - protein, 28 aa, Artificial Sequence
  Description of Artificial Sequence: Synthetic peptide
AENEICSTNPVATEQYGTASENLQEGER

SEQ ID NO: 64116 - protein, 31 aa, Artificial Sequence
  Description of Artificial Sequence: Synthetic polypeptide
DEAEIRTTNPVAYERYGSVSTGNLDGGGDYR

SEQ ID NO: 64117 - protein, 32 aa, Artificial Sequence
  Description of Artificial Sequence: Synthetic polypeptide
DEAEIRTTNPVAYERYGSVSTGNDQEEGGNDR

SEQ ID NO: 64118 - protein, 29 aa, Artificial Sequence
  Description of Artificial Sequence: Synthetic peptide
AENEICCTNPVATEQYGVVASENLQRGTE

SEQ ID NO: 64119 - protein, 32 aa, Artificial Sequence
  Description of Artificial Sequence: Synthetic polypeptide
DEAEIATTNPVATEPYGSVAATNLQQGGNDRN

SEQ ID NO: 64120 - protein, 29 aa, Artificial Sequence
  Description of Artificial Sequence: Synthetic peptide
AENEICCTNPVATEQYGVVASENLQREER

SEQ ID NO: 64121 - protein, 31 aa, Artificial Sequence
  Description of Artificial Sequence: Synthetic polypeptide
DEAEIRTTNPVAYERYGEVSTNLQIGGNDEQ

SEQ ID NO: 64122 - protein, 31 aa, Artificial Sequence
  Description of Artificial Sequence: Synthetic polypeptide
DEAEIRTTNPVAYEQYGTVSTNLQMDGGGEA

SEQ ID NO: 64123 - protein, 31 aa, Artificial Sequence
  Description of Artificial Sequence: Synthetic polypeptide
DEAEIRTTNPVAYERWGSVSTNLQEGNGNGE

SEQ ID NO: 64124 - protein, 30 aa, Artificial Sequence
  Description of Artificial Sequence: Synthetic polypeptide
DEAEIRTTNPVAYERWGSVSTGDQEGGNDR

SEQ ID NO: 64125 - protein, 29 aa, Artificial Sequence
  Description of Artificial Sequence: Synthetic peptide
AENEICCTNPVATEQYGSVASENLQTGGT

SEQ ID NO: 64126 - protein, 32 aa, Artificial Sequence
  Description of Artificial Sequence: Synthetic polypeptide
DEAEIRTTNPVAYEQYGVVVSTNMQHEGNNER

SEQ ID NO: 64127 - protein, 32 aa, Artificial Sequence
  Description of Artificial Sequence: Synthetic polypeptide
DEAEIRTTNPVAYEQYGVVVSTNLQHDGDNEQ

SEQ ID NO: 64128 - protein, 33 aa, Artificial Sequence
  Description of Artificial Sequence: Synthetic polypeptide
DEAEIRTTNPVAYEQYGVVVSTNLQGHEGDNER

SEQ ID NO: 64129 - protein, 32 aa, Artificial Sequence
  Description of Artificial Sequence: Synthetic polypeptide
DEAEIATTNPVATENYGTVSTNLQRGGDGGRQ

SEQ ID NO: 64130 - protein, 31 aa, Artificial Sequence
  Description of Artificial Sequence: Synthetic polypeptide
DEAEIATTNPVATENYGTVSTNLQGDGDGAR

SEQ ID NO: 64131 - protein, 28 aa, Artificial Sequence
  Description of Artificial Sequence: Synthetic peptide
AENEICCTNPVATEQYGETSENLQAGER

SEQ ID NO: 64132 - protein, 32 aa, Artificial Sequence
  Description of Artificial Sequence: Synthetic polypeptide
DEAEIRTTNPVAYEQYGVVVSTNLQGDGNDSE

SEQ ID NO: 64133 - protein, 28 aa, Artificial Sequence
  Description of Artificial Sequence: Synthetic peptide
AENEICCTNPVATEQYGVASENLQRGVD

SEQ ID NO: 64134 - protein, 32 aa, Artificial Sequence
  Description of Artificial Sequence: Synthetic polypeptide
DEAEIRTTNPVAYEQYGTVSTNLQGNGGDNNM

SEQ ID NO: 64135 - protein, 32 aa, Artificial Sequence
  Description of Artificial Sequence: Synthetic polypeptide
DEAEIRTTNPVAYEQYGTVSTNLNQDGGMGNK

SEQ ID NO: 64136 - protein, 30 aa, Artificial Sequence
  Description of Artificial Sequence: Synthetic polypeptide
DEAEIRTTNPVAYEQYGTVSTNLENGGQEA

SEQ ID NO: 64137 - protein, 30 aa, Artificial Sequence
  Description of Artificial Sequence: Synthetic polypeptide
DEAEIATTNPVATCQYGCVCSTALQNGNQG

SEQ ID NO: 64138 - protein, 32 aa, Artificial Sequence
  Description of Artificial Sequence: Synthetic polypeptide
DEAEIRTTNPVAYEQYGSIPSTPNLSDRTVNR

SEQ ID NO: 64139 - protein, 32 aa, Artificial Sequence
  Description of Artificial Sequence: Synthetic polypeptide
DEAEIRTTNPVAYEQYGSIPSTGNLSERVNNR

SEQ ID NO: 64140 - protein, 31 aa, Artificial Sequence
  Description of Artificial Sequence: Synthetic polypeptide
DEEEIATTNPVAYEQWGSVSTNLNGDAGGNA

SEQ ID NO: 64141 - protein, 31 aa, Artificial Sequence
  Description of Artificial Sequence: Synthetic polypeptide
DEAEIRTTNPVAYEQYGSICSTNLENPSNNR

SEQ ID NO: 64142 - protein, 29 aa, Artificial Sequence
  Description of Artificial Sequence: Synthetic peptide
AENEICATNPVATEQYGVASENLLQRGER

SEQ ID NO: 64143 - protein, 28 aa, Artificial Sequence
  Description of Artificial Sequence: Synthetic peptide
AENEICATNPVATEQYGVASDNLQRGEL

SEQ ID NO: 64144 - protein, 31 aa, Artificial Sequence
  Description of Artificial Sequence: Synthetic polypeptide
DEEEIATTNPVAYEQWGSVSTNLNGDANDNR

SEQ ID NO: 64145 - protein, 28 aa, Artificial Sequence
  Description of Artificial Sequence: Synthetic peptide
AENEICATNPVATEQYGTASENLQRGEN

SEQ ID NO: 64146 - protein, 31 aa, Artificial Sequence
  Description of Artificial Sequence: Synthetic polypeptide
DEAEIRTTNPVAYEQYGSISWTNLERPENFD

SEQ ID NO: 64147 - protein, 34 aa, Artificial Sequence
  Description of Artificial Sequence: Synthetic polypeptide
AEEEIRTTNPVATEQYGSVSTTTVNLQQGNNEDN

SEQ ID NO: 64148 - protein, 32 aa, Artificial Sequence
  Description of Artificial Sequence: Synthetic polypeptide
DEEEIATTNPVAYEQWGSVSTNLNGDGMGNNR

SEQ ID NO: 64149 - protein, 32 aa, Artificial Sequence
  Description of Artificial Sequence: Synthetic polypeptide
DEAEIRTCNPVATEQYGCVSTYPLQRGNQHEY

SEQ ID NO: 64150 - protein, 31 aa, Artificial Sequence
  Description of Artificial Sequence: Synthetic polypeptide
AENEICATNPVATEQYGSVASVENLQRGEQR

SEQ ID NO: 64151 - protein, 34 aa, Artificial Sequence
  Description of Artificial Sequence: Synthetic polypeptide
DEDEIRTTNPVATEQYGSVCSTDNDQGGHQGENR

SEQ ID NO: 64152 - protein, 32 aa, Artificial Sequence
  Description of Artificial Sequence: Synthetic polypeptide
DEEEIATTNPVAYEQWGSVSTNLNGDMGGNER

SEQ ID NO: 64153 - protein, 30 aa, Artificial Sequence
  Description of Artificial Sequence: Synthetic polypeptide
AENEICATNPVATEQYGSVASENLQSGGND

SEQ ID NO: 64154 - protein, 32 aa, Artificial Sequence
  Description of Artificial Sequence: Synthetic polypeptide
DEAEIRTCNPVATEQYGCVSTYPLQRGNSQEW

SEQ ID NO: 64155 - protein, 32 aa, Artificial Sequence
  Description of Artificial Sequence: Synthetic polypeptide
DEAEIRTTNCVAYAAYGSVSTNELSQRGGDNR

SEQ ID NO: 64156 - protein, 33 aa, Artificial Sequence
  Description of Artificial Sequence: Synthetic polypeptide
AEEEIRTTNPVATEQYGSVSTTVNGLGNQEGED

SEQ ID NO: 64157 - protein, 30 aa, Artificial Sequence
  Description of Artificial Sequence: Synthetic polypeptide
AENEICATNPVATEQYGSVAVSENLQRTER

SEQ ID NO: 64158 - protein, 28 aa, Artificial Sequence
  Description of Artificial Sequence: Synthetic peptide
AEEEIATTNPVATEQYGEAPENCQHGGR

SEQ ID NO: 64159 - protein, 31 aa, Artificial Sequence
  Description of Artificial Sequence: Synthetic polypeptide
DEAEIRTTNPVAYEQYGSIWCTTLTRTVGNR

SEQ ID NO: 64160 - protein, 32 aa, Artificial Sequence
  Description of Artificial Sequence: Synthetic polypeptide
AEEEIRTTNPVATESYGSVSTTNLSNNGTDQR

SEQ ID NO: 64161 - protein, 33 aa, Artificial Sequence
  Description of Artificial Sequence: Synthetic polypeptide
AEEEIRTTNPVATEQYGSVSTTTNQQQQGENDN

SEQ ID NO: 64162 - protein, 32 aa, Artificial Sequence
  Description of Artificial Sequence: Synthetic polypeptide
AEEEIRTTNPVATEQYGSVSTTTNSSTSGNGI

SEQ ID NO: 64163 - protein, 33 aa, Artificial Sequence
  Description of Artificial Sequence: Synthetic polypeptide
AEEEIRTTNPVATEQYGSVSTTTNTNQQTGNLD

SEQ ID NO: 64164 - protein, 32 aa, Artificial Sequence
  Description of Artificial Sequence: Synthetic polypeptide
DEEEIATTNPVAYEQWGSVSTDNLQSGGENEP

SEQ ID NO: 64165 - protein, 33 aa, Artificial Sequence
  Description of Artificial Sequence: Synthetic polypeptide
AEEEIRTTNPVATERYGSTVSTGNAHSQFQGNR

SEQ ID NO: 64166 - protein, 31 aa, Artificial Sequence
  Description of Artificial Sequence: Synthetic polypeptide
DEAEIRTTNPVAYEQYGSTVSTNHSGFGDNE

SEQ ID NO: 64167 - protein, 30 aa, Artificial Sequence
  Description of Artificial Sequence: Synthetic polypeptide
DEEEIATTNPVAYEQWGSVSTGNGQAGDAM

SEQ ID NO: 64168 - protein, 28 aa, Artificial Sequence
  Description of Artificial Sequence: Synthetic peptide
AENEICATNPVATEQYGVNSENLQRGED

SEQ ID NO: 64169 - protein, 32 aa, Artificial Sequence
  Description of Artificial Sequence: Synthetic polypeptide
DEEEIATTNPVAYEQWGSVSTGNLQPPDGNAN

SEQ ID NO: 64170 - protein, 33 aa, Artificial Sequence
  Description of Artificial Sequence: Synthetic polypeptide
AEEEIATTNPVATEQWGSVSATANLQDQGENPR

SEQ ID NO: 64171 - protein, 31 aa, Artificial Sequence
  Description of Artificial Sequence: Synthetic polypeptide
DEEEIATTNPVAYEQWGSVSTNAQSGGGDMR

SEQ ID NO: 64172 - protein, 31 aa, Artificial Sequence
  Description of Artificial Sequence: Synthetic polypeptide
AEEEIRTTNPVATESYGSVSNTNLNNQGDQT

SEQ ID NO: 64173 - protein, 31 aa, Artificial Sequence
  Description of Artificial Sequence: Synthetic polypeptide
AEEEIRTTNPVATESYGSVSNTNLNQGDQDT

SEQ ID NO: 64174 - protein, 32 aa, Artificial Sequence
  Description of Artificial Sequence: Synthetic polypeptide
AEEEIRTTNPVATESYGSVSNTNNLNQQGDQD

SEQ ID NO: 64175 - protein, 32 aa, Artificial Sequence
  Description of Artificial Sequence: Synthetic polypeptide
AEEEIRTTNPVATEQYGSVSTTTQQLGIENNT

SEQ ID NO: 64176 - protein, 31 aa, Artificial Sequence
  Description of Artificial Sequence: Synthetic polypeptide
AEEEIRTTNPVATESYGSVSNTNQLNQGDQS

SEQ ID NO: 64177 - protein, 32 aa, Artificial Sequence
  Description of Artificial Sequence: Synthetic polypeptide
AEEEIRTTNPVATESYGSVSTNNLQQNTGGEE

SEQ ID NO: 64178 - protein, 30 aa, Artificial Sequence
  Description of Artificial Sequence: Synthetic polypeptide
DEEEIATTNPVAYEQWGSVSTNGQAEGDAG

SEQ ID NO: 64179 - protein, 33 aa, Artificial Sequence
  Description of Artificial Sequence: Synthetic polypeptide
AEEEIRTTNPVATESYGSVSTTNLQQGTTTTNG

SEQ ID NO: 64180 - protein, 31 aa, Artificial Sequence
  Description of Artificial Sequence: Synthetic polypeptide
AEEEIATTNPVATEQWGSVSTNLQHPGEEQA

SEQ ID NO: 64181 - protein, 28 aa, Artificial Sequence
  Description of Artificial Sequence: Synthetic peptide
AENEICATNPVATEQYGVASNNLQNGER

SEQ ID NO: 64182 - protein, 29 aa, Artificial Sequence
  Description of Artificial Sequence: Synthetic peptide
AENEICSTNPVATEQYGVASNENLQRGER

SEQ ID NO: 64183 - protein, 32 aa, Artificial Sequence
  Description of Artificial Sequence: Synthetic polypeptide
DEAEIRTTNPVAYERYGSVSTGNPDQEHGNDR

SEQ ID NO: 64184 - protein, 29 aa, Artificial Sequence
  Description of Artificial Sequence: Synthetic peptide
DEECISTVNPVATEAYGSVCSWNLEHGNQ

SEQ ID NO: 64185 - protein, 33 aa, Artificial Sequence
  Description of Artificial Sequence: Synthetic polypeptide
AEEEIATTNPVATEQYGSVCSATNLQDSNGNDM

SEQ ID NO: 64186 - protein, 33 aa, Artificial Sequence
  Description of Artificial Sequence: Synthetic polypeptide
DDEEIRTTNPVATEQYGSVSTGLQNGQGGGNEG

SEQ ID NO: 64187 - protein, 32 aa, Artificial Sequence
  Description of Artificial Sequence: Synthetic polypeptide
AEEEIATTNPVATEQYGSVCADTALQGGDNRP

SEQ ID NO: 64188 - protein, 29 aa, Artificial Sequence
  Description of Artificial Sequence: Synthetic peptide
DEECISTVNPVATEWYGSVCSWNHERGNQ

SEQ ID NO: 64189 - protein, 29 aa, Artificial Sequence
  Description of Artificial Sequence: Synthetic peptide
DEECISTVNPVATEGYGSVSWNLENGNQS

SEQ ID NO: 64190 - protein, 34 aa, Artificial Sequence
  Description of Artificial Sequence: Synthetic polypeptide
AEEEIRTTNPVATEQYGSVSTTTNLQQQEGEANN

SEQ ID NO: 64191 - protein, 33 aa, Artificial Sequence
  Description of Artificial Sequence: Synthetic polypeptide
DEEEIRPTNPVATEQYGSVPSVNQSTRTGGNNR

SEQ ID NO: 64192 - protein, 28 aa, Artificial Sequence
  Description of Artificial Sequence: Synthetic peptide
CENEIACTNPVATEQYGEASENLQRYGR

SEQ ID NO: 64193 - protein, 32 aa, Artificial Sequence
  Description of Artificial Sequence: Synthetic polypeptide
AEEEIATTNPVATEQYGSVATNLQNGQDDNDM

SEQ ID NO: 64194 - protein, 33 aa, Artificial Sequence
  Description of Artificial Sequence: Synthetic polypeptide
DEAEIRATNPVATEQYGFVMSMTNLFQGGENRQ

SEQ ID NO: 64195 - protein, 30 aa, Artificial Sequence
  Description of Artificial Sequence: Synthetic polypeptide
DEAEIRTTNPVCTEQWGTVSGNIAQERGER

SEQ ID NO: 64196 - protein, 31 aa, Artificial Sequence
  Description of Artificial Sequence: Synthetic polypeptide
AEEEIATTNPVATEQYGSVATNLQGMGDDTQ

SEQ ID NO: 64197 - protein, 32 aa, Artificial Sequence
  Description of Artificial Sequence: Synthetic polypeptide
DEDEIRTTNPVATEQYGSCATNDQREGPQDNM

SEQ ID NO: 64198 - protein, 32 aa, Artificial Sequence
  Description of Artificial Sequence: Synthetic polypeptide
AEEEIATTNPVATEQYGSVATNLQDANGDNNY

SEQ ID NO: 64199 - protein, 34 aa, Artificial Sequence
  Description of Artificial Sequence: Synthetic polypeptide
DDEEIRTTNPVATEQYGSVSTGTNLQGTGGNEDG

SEQ ID NO: 64200 - protein, 31 aa, Artificial Sequence
  Description of Artificial Sequence: Synthetic polypeptide
AEEEIATTNPVATEQYGSVATNLADAGGNNS

SEQ ID NO: 64201 - protein, 30 aa, Artificial Sequence
  Description of Artificial Sequence: Synthetic polypeptide
DEEEIATTNPVAYEQWGSTVSTNHSQPPNP

SEQ ID NO: 64202 - protein, 34 aa, Artificial Sequence
  Description of Artificial Sequence: Synthetic polypeptide
AEEEIRTTNPVATEQYGSVSTTTNLQSGNQQEED

SEQ ID NO: 64203 - protein, 29 aa, Artificial Sequence
  Description of Artificial Sequence: Synthetic peptide
AENEIGSTNPVATEQYGEASENLQRVGGR

SEQ ID NO: 64204 - protein, 33 aa, Artificial Sequence
  Description of Artificial Sequence: Synthetic polypeptide
AEEEIRTTNPVATEQYGVVVVSTNLQGNGNNAE

SEQ ID NO: 64205 - protein, 29 aa, Artificial Sequence
  Description of Artificial Sequence: Synthetic peptide
AENEIHCTNPVATEQYGEASMNLQRGGER

SEQ ID NO: 64206 - protein, 33 aa, Artificial Sequence
  Description of Artificial Sequence: Synthetic polypeptide
AEEEIRTTNPVATEQYGVVVVSTNLQNGNTNVA

SEQ ID NO: 64207 - protein, 29 aa, Artificial Sequence
  Description of Artificial Sequence: Synthetic peptide
AENEIKCTNPVATEQYGEASENLQRGGGR

SEQ ID NO: 64208 - protein, 31 aa, Artificial Sequence
  Description of Artificial Sequence: Synthetic polypeptide
AEEEIRTTNPVATEQYGVVVTTNSNQGGNST

SEQ ID NO: 64209 - protein, 34 aa, Artificial Sequence
  Description of Artificial Sequence: Synthetic polypeptide
AEEEIRTTNPVATEQYGSVSTTTNLQNDEGNETN

SEQ ID NO: 64210 - protein, 29 aa, Artificial Sequence
  Description of Artificial Sequence: Synthetic peptide
AENEIRCTNPVATEQYGEASEDLQRKGPR

SEQ ID NO: 64211 - protein, 34 aa, Artificial Sequence
  Description of Artificial Sequence: Synthetic polypeptide
AEEEIRTTNPVATEQYGSVSTTTNLQNQQGNITE

SEQ ID NO: 64212 - protein, 30 aa, Artificial Sequence
  Description of Artificial Sequence: Synthetic polypeptide
DEECLRTTNPCAYEQYGCVCSTNLQYGNQM

SEQ ID NO: 64213 - protein, 34 aa, Artificial Sequence
  Description of Artificial Sequence: Synthetic polypeptide
AEEEIRTTNPVATEQYGSVSTTTNLQQGEEENAG

SEQ ID NO: 64214 - protein, 32 aa, Artificial Sequence
  Description of Artificial Sequence: Synthetic polypeptide
AEEEIATTNPVATEQYGSVSWTDNHQRNGDKY

SEQ ID NO: 64215 - protein, 33 aa, Artificial Sequence
  Description of Artificial Sequence: Synthetic polypeptide
AEEEIATTNPVATEQYGSVSTTNPQAREGNDQV

SEQ ID NO: 64216 - protein, 32 aa, Artificial Sequence
  Description of Artificial Sequence: Synthetic polypeptide
AEEEIATTNPVATEQYGSVSTNLQGAGADVSS

SEQ ID NO: 64217 - protein, 34 aa, Artificial Sequence
  Description of Artificial Sequence: Synthetic polypeptide
DEEEIRPTNPVATERYGSVSCTGNELSQRPGGNM

SEQ ID NO: 64218 - protein, 31 aa, Artificial Sequence
  Description of Artificial Sequence: Synthetic polypeptide
DEAEIRATNPVATEQYGCVSTTNEFQGSENR

SEQ ID NO: 64219 - protein, 34 aa, Artificial Sequence
  Description of Artificial Sequence: Synthetic polypeptide
DEDEIRTTNPVATEQYGQVPSCTNMLSQRTENNR

SEQ ID NO: 64220 - protein, 33 aa, Artificial Sequence
  Description of Artificial Sequence: Synthetic polypeptide
AEEEIRTTNPVATEQYGVVVTSTTNLQNGNNAA

SEQ ID NO: 64221 - protein, 34 aa, Artificial Sequence
  Description of Artificial Sequence: Synthetic polypeptide
DEEEIRPTNPVATERYGSVSCTGNALQRPGGNNM

SEQ ID NO: 64222 - protein, 33 aa, Artificial Sequence
  Description of Artificial Sequence: Synthetic polypeptide
AEEEIRTTNPVATEQYGVVVTSTTNLQNGNNAN

SEQ ID NO: 64223 - protein, 29 aa, Artificial Sequence
  Description of Artificial Sequence: Synthetic peptide
AENEIRCTNPVATECYGEASENLQDRGGR

SEQ ID NO: 64224 - protein, 32 aa, Artificial Sequence
  Description of Artificial Sequence: Synthetic polypeptide
AEEEIRTTNPVATEQYGVVVTTNNLQQEGNQG

SEQ ID NO: 64225 - protein, 31 aa, Artificial Sequence
  Description of Artificial Sequence: Synthetic polypeptide
AEEEIRTTNPVATEQYGVVVTTNSNQGGNGE

SEQ ID NO: 64226 - protein, 32 aa, Artificial Sequence
  Description of Artificial Sequence: Synthetic polypeptide
DEAEIRATNPVATEQYGCVMSMTNLFQGGENY

SEQ ID NO: 64227 - protein, 33 aa, Artificial Sequence
  Description of Artificial Sequence: Synthetic polypeptide
DDEEIRTTNPVATEQYGSVSTDNNGQGEGNEGN

SEQ ID NO: 64228 - protein, 31 aa, Artificial Sequence
  Description of Artificial Sequence: Synthetic polypeptide
AEEEIRTTNPVATEQYGVVVTTNSNQGGNNQ

SEQ ID NO: 64229 - protein, 33 aa, Artificial Sequence
  Description of Artificial Sequence: Synthetic polypeptide
AEEEIRTTNPVATEQYGVVVTSTTNLQNGNEAG

SEQ ID NO: 64230 - protein, 32 aa, Artificial Sequence
  Description of Artificial Sequence: Synthetic polypeptide
DEAEIRTTNCVAYAQYGSVVPSTNLSQRGGDR

SEQ ID NO: 64231 - protein, 32 aa, Artificial Sequence
  Description of Artificial Sequence: Synthetic polypeptide
AEEEIATTNPVATEQYGSVASATNLQDSNNMD

SEQ ID NO: 64232 - protein, 29 aa, Artificial Sequence
  Description of Artificial Sequence: Synthetic peptide
AENEIGCTNPVATEQYGESSENLQRGGRE

SEQ ID NO: 64233 - protein, 34 aa, Artificial Sequence
  Description of Artificial Sequence: Synthetic polypeptide
DDEEIRTTNPVATEQYGSVSTVNLQQENGNNGQG

SEQ ID NO: 64234 - protein, 32 aa, Artificial Sequence
  Description of Artificial Sequence: Synthetic polypeptide
AEEEIRTTNPVATEQYGVVVVTNLQQEGENAG

SEQ ID NO: 64235 - protein, 31 aa, Artificial Sequence
  Description of Artificial Sequence: Synthetic polypeptide
DDEEIRTTNPVATEQYGSVSVNNATREGDQE

SEQ ID NO: 64236 - protein, 31 aa, Artificial Sequence
  Description of Artificial Sequence: Synthetic polypeptide
DEAEIRTTNPVAYERYGSVSTNPQGEHGNDS

SEQ ID NO: 64237 - protein, 28 aa, Artificial Sequence
  Description of Artificial Sequence: Synthetic peptide
AENEIFCTNPVATEQYGEASENLQRGGV

SEQ ID NO: 64238 - protein, 31 aa, Artificial Sequence
  Description of Artificial Sequence: Synthetic polypeptide
DEAEIATTNPVATEPYGSVSTNLGGMGNNTG

SEQ ID NO: 64239 - protein, 33 aa, Artificial Sequence
  Description of Artificial Sequence: Synthetic polypeptide
AEEEIRTTNPVATEQYGVVVVTSTTNLQNGNAT

SEQ ID NO: 64240 - protein, 28 aa, Artificial Sequence
  Description of Artificial Sequence: Synthetic peptide
AENEIFCTNPVATEQYGEASENLQRGGC

SEQ ID NO: 64241 - protein, 32 aa, Artificial Sequence
  Description of Artificial Sequence: Synthetic polypeptide
AEEEIRTTNPVATEQYGVVVVTTNLEQGGNQV

SEQ ID NO: 64242 - protein, 34 aa, Artificial Sequence
  Description of Artificial Sequence: Synthetic polypeptide
DDEEIRTTNPVATEQYGSVSTVNLQFNGNENEQG

SEQ ID NO: 64243 - protein, 34 aa, Artificial Sequence
  Description of Artificial Sequence: Synthetic polypeptide
DEEEIRPTNPVATEAYGSTVSTGNELSQRPGGNM

SEQ ID NO: 64244 - protein, 28 aa, Artificial Sequence
  Description of Artificial Sequence: Synthetic peptide
AENEIFCTNPVATEQYGEASENLQREGR

SEQ ID NO: 64245 - protein, 31 aa, Artificial Sequence
  Description of Artificial Sequence: Synthetic polypeptide
AEEEIATTNPVATEQYGEASSTTNLNRGMNV

SEQ ID NO: 64246 - protein, 28 aa, Artificial Sequence
  Description of Artificial Sequence: Synthetic peptide
AEEEIATTNPVATEQYGEASEVLQHEER

SEQ ID NO: 64247 - protein, 32 aa, Artificial Sequence
  Description of Artificial Sequence: Synthetic polypeptide
DEAEIRTTNPVAYERYGSVSTNDQGEGGGNDR

SEQ ID NO: 64248 - protein, 28 aa, Artificial Sequence
  Description of Artificial Sequence: Synthetic peptide
AEEEIATTNPVATEQYGEASEVCQRGEK

SEQ ID NO: 64249 - protein, 29 aa, Artificial Sequence
  Description of Artificial Sequence: Synthetic peptide
AENEICSTNPVATEQYGVVASENLQRGEQ

SEQ ID NO: 64250 - protein, 28 aa, Artificial Sequence
  Description of Artificial Sequence: Synthetic peptide
AEEEIATTNPVATEQYGEASENCQHEGR

SEQ ID NO: 64251 - protein, 28 aa, Artificial Sequence
  Description of Artificial Sequence: Synthetic peptide
AEEEIATTNPVATEQYGEASENCQHEER

SEQ ID NO: 64252 - protein, 33 aa, Artificial Sequence
  Description of Artificial Sequence: Synthetic polypeptide
AEEEIRTTNPVATEQYGSVSTTTNNNLETGNAA

SEQ ID NO: 64253 - protein, 31 aa, Artificial Sequence
  Description of Artificial Sequence: Synthetic polypeptide
DEAEIATTNPVATEPYGSVATNLQDQGNEQM

SEQ ID NO: 64254 - protein, 31 aa, Artificial Sequence
  Description of Artificial Sequence: Synthetic polypeptide
AEEEIATTNPVATEQYGSVAMNDQDGGDNRM

SEQ ID NO: 64255 - protein, 34 aa, Artificial Sequence
  Description of Artificial Sequence: Synthetic polypeptide
DDEEIRTTNPVATEQYGSVSTVNLDQNGNENGQG

SEQ ID NO: 64256 - protein, 32 aa, Artificial Sequence
  Description of Artificial Sequence: Synthetic polypeptide
AEEEIATTNPVATEQYGNVSHTDMDLQDGGNR

SEQ ID NO: 64257 - protein, 34 aa, Artificial Sequence
  Description of Artificial Sequence: Synthetic polypeptide
AEEEIRTTNPVATEQYGSVSTTTNLQYGNIGNNE

SEQ ID NO: 64258 - protein, 34 aa, Artificial Sequence
  Description of Artificial Sequence: Synthetic polypeptide
AEEEIRTTNPVATEQYGSVSTTTNLQYGNINTNM

SEQ ID NO: 64259 - protein, 34 aa, Artificial Sequence
  Description of Artificial Sequence: Synthetic polypeptide
AEEEIRTTNPVATEQYGSVSTTTNLQYGNNNEND

SEQ ID NO: 64260 - protein, 32 aa, Artificial Sequence
  Description of Artificial Sequence: Synthetic polypeptide
AEEEIATTNPVATEQYGSVAITNLQNLNNERH

SEQ ID NO: 64261 - protein, 31 aa, Artificial Sequence
  Description of Artificial Sequence: Synthetic polypeptide
AEEEIATTNPVATEQYGSVAITNDTDRGNQL

SEQ ID NO: 64262 - protein, 31 aa, Artificial Sequence
  Description of Artificial Sequence: Synthetic polypeptide
DEAEIRTTNPVCTEGYGSVSMPNLQEGSNEL

SEQ ID NO: 64263 - protein, 30 aa, Artificial Sequence
  Description of Artificial Sequence: Synthetic polypeptide
AEEEIATTNPVATEQYGSVAATNLADPNGP

SEQ ID NO: 64264 - protein, 31 aa, Artificial Sequence
  Description of Artificial Sequence: Synthetic polypeptide
AEEEIATTNPVATEQYGSVAATNLADGNNSP

SEQ ID NO: 64265 - protein, 30 aa, Artificial Sequence
  Description of Artificial Sequence: Synthetic polypeptide
AEEEIATTNPVATEQYGSVAATNLADGDTP

SEQ ID NO: 64266 - protein, 28 aa, Artificial Sequence
  Description of Artificial Sequence: Synthetic peptide
CENEIACTNPVATDQYGEASENLQRGGR

SEQ ID NO: 64267 - protein, 34 aa, Artificial Sequence
  Description of Artificial Sequence: Synthetic polypeptide
DEEEIRPTNPVATEAYGSVSTGNGLSQRTGGNNM

SEQ ID NO: 64268 - protein, 29 aa, Artificial Sequence
  Description of Artificial Sequence: Synthetic peptide
DEAEIRTTNPVAYQQYGCVSTNDEGGNAP

SEQ ID NO: 64269 - protein, 29 aa, Artificial Sequence
  Description of Artificial Sequence: Synthetic peptide
AENEIGCTNPVATEQYGEASENLQRGDGR

SEQ ID NO: 64270 - protein, 31 aa, Artificial Sequence
  Description of Artificial Sequence: Synthetic polypeptide
DEDEIRTTNPVATEQYGSCSTNDPREGPQDN

SEQ ID NO: 64271 - protein, 31 aa, Artificial Sequence
  Description of Artificial Sequence: Synthetic polypeptide
DEDEIRTTNPVATEQYGSCSTNDQAEGPQEN

SEQ ID NO: 64272 - protein, 33 aa, Artificial Sequence
  Description of Artificial Sequence: Synthetic polypeptide
DEAEIRATNPVATEQYGFVTSMTNLFQGGENER

SEQ ID NO: 64273 - protein, 28 aa, Artificial Sequence
  Description of Artificial Sequence: Synthetic peptide
CENEIACTNPVATEQYGEASENLQRPGR

SEQ ID NO: 64274 - protein, 32 aa, Artificial Sequence
  Description of Artificial Sequence: Synthetic polypeptide
DEDEIRTTNPVATEQYGSCSTNDTQREGPQDN

SEQ ID NO: 64275 - protein, 29 aa, Artificial Sequence
  Description of Artificial Sequence: Synthetic peptide
CENEIACTNPVATEQYGEASANLQRGGQR

SEQ ID NO: 64276 - protein, 32 aa, Artificial Sequence
  Description of Artificial Sequence: Synthetic polypeptide
AEEEIATTNPVATEQYGNVSVTMLQDGHGTNR

SEQ ID NO: 64277 - protein, 32 aa, Artificial Sequence
  Description of Artificial Sequence: Synthetic polypeptide
DDEEIRTTNPVATEQYGSVSTMLSIESDQENR

SEQ ID NO: 64278 - protein, 34 aa, Artificial Sequence
  Description of Artificial Sequence: Synthetic polypeptide
AEEEIRTTNPVATEQYGSVSTVVVNLQEDEGTND

SEQ ID NO: 64279 - protein, 30 aa, Artificial Sequence
  Description of Artificial Sequence: Synthetic polypeptide
AENEICATNPVATEQYGSVASENLQRTGGD

SEQ ID NO: 64280 - protein, 32 aa, Artificial Sequence
  Description of Artificial Sequence: Synthetic polypeptide
DEEEIATTNPVAYEQWGSVSTNLNGGADGNNR

SEQ ID NO: 64281 - protein, 32 aa, Artificial Sequence
  Description of Artificial Sequence: Synthetic polypeptide
DEAEIRTTNPVAYEQWGSVTTNLNGQEGENDR

SEQ ID NO: 64282 - protein, 31 aa, Artificial Sequence
  Description of Artificial Sequence: Synthetic polypeptide
AEEEIACTNPVATEQYGSVATNLQDSGNDIS

SEQ ID NO: 64283 - protein, 32 aa, Artificial Sequence
  Description of Artificial Sequence: Synthetic polypeptide
AEEEIACTNPVATEQYGSVATNLQDRGNDPVS

SEQ ID NO: 64284 - protein, 30 aa, Artificial Sequence
  Description of Artificial Sequence: Synthetic polypeptide
AEEEIACTNPVATEQYGSVATNLQDGPEDH

SEQ ID NO: 64285 - protein, 30 aa, Artificial Sequence
  Description of Artificial Sequence: Synthetic polypeptide
AEEEIACTNPVATEQYGSVATNLQDGGTLH

SEQ ID NO: 64286 - protein, 30 aa, Artificial Sequence
  Description of Artificial Sequence: Synthetic polypeptide
AEEEIACTNPVATEQYGSVATNLQDDMPRL

SEQ ID NO: 64287 - protein, 31 aa, Artificial Sequence
  Description of Artificial Sequence: Synthetic polypeptide
AEEEIACTNPVATEQYGSVATNLQDDGPTRM

SEQ ID NO: 64288 - protein, 32 aa, Artificial Sequence
  Description of Artificial Sequence: Synthetic polypeptide
DEAEIACTNPVATEQYGSVATNLQNRNGNPVP

SEQ ID NO: 64289 - protein, 30 aa, Artificial Sequence
  Description of Artificial Sequence: Synthetic polypeptide
DEAEIACTNPVATEQYGSVATNLQNLNNTS

SEQ ID NO: 64290 - protein, 30 aa, Artificial Sequence
  Description of Artificial Sequence: Synthetic polypeptide
DEAEIACTNPVATEQYGSVATNLQNIENTQ

SEQ ID NO: 64291 - protein, 31 aa, Artificial Sequence
  Description of Artificial Sequence: Synthetic polypeptide
AEEEIACTNPVATEQYGSVATNLQANGDQNY

SEQ ID NO: 64292 - protein, 31 aa, Artificial Sequence
  Description of Artificial Sequence: Synthetic polypeptide
DEAEIACTNPVATEQYGSVATNLQNDGNEGL

SEQ ID NO: 64293 - protein, 31 aa, Artificial Sequence
  Description of Artificial Sequence: Synthetic polypeptide
DEAEIRTTNPVAYEQWGSVSTQPNGDHGNDR

SEQ ID NO: 64294 - protein, 30 aa, Artificial Sequence
  Description of Artificial Sequence: Synthetic polypeptide
AEEEIACTNPVATEQYGSVATNLQAMNTEH

SEQ ID NO: 64295 - protein, 31 aa, Artificial Sequence
  Description of Artificial Sequence: Synthetic polypeptide
DEAEIRTTNPVAYEQWGSVSTPNGGQQGDMR

SEQ ID NO: 64296 - protein, 30 aa, Artificial Sequence
  Description of Artificial Sequence: Synthetic polypeptide
AEEEIACTNPVATEQYGSVATNLQAEDNED

SEQ ID NO: 64297 - protein, 30 aa, Artificial Sequence
  Description of Artificial Sequence: Synthetic polypeptide
DEAEIACTNPVATEQYGSVATNLQGEGEED

SEQ ID NO: 64298 - protein, 30 aa, Artificial Sequence
  Description of Artificial Sequence: Synthetic polypeptide
DEAEIACTNPVATEQYGSVATNLQGDDDRN

SEQ ID NO: 64299 - protein, 31 aa, Artificial Sequence
  Description of Artificial Sequence: Synthetic polypeptide
DEAEIACTNPVATEQYGSVATNLQDQGGNNQ

SEQ ID NO: 64300 - protein, 30 aa, Artificial Sequence
  Description of Artificial Sequence: Synthetic polypeptide
DEAEIACTNPVATEQYGSVATNLQREAHMV

SEQ ID NO: 64301 - protein, 30 aa, Artificial Sequence
  Description of Artificial Sequence: Synthetic polypeptide
AEEEIACTNPVATEQYGSVATNLQGMNDEL

SEQ ID NO: 64302 - protein, 31 aa, Artificial Sequence
  Description of Artificial Sequence: Synthetic polypeptide
DEAEIACTNPVATEQYGSVATNLQRGEEGTE

SEQ ID NO: 64303 - protein, 31 aa, Artificial Sequence
  Description of Artificial Sequence: Synthetic polypeptide
DEAEIACTNPVATEQYGSVATNLQRPGTPEQ

SEQ ID NO: 64304 - protein, 34 aa, Artificial Sequence
  Description of Artificial Sequence: Synthetic polypeptide
DEDEIRTTNPVATEQYGSVSTTGNIGEQRDGNNQ

SEQ ID NO: 64305 - protein, 28 aa, Artificial Sequence
  Description of Artificial Sequence: Synthetic peptide
AEEEIASTNPVCTEQYGVASDNLQSGNQ

SEQ ID NO: 64306 - protein, 28 aa, Artificial Sequence
  Description of Artificial Sequence: Synthetic peptide
AEEEIACTNPVCTEQYGVASDNLQRGGQ

SEQ ID NO: 64307 - protein, 35 aa, Artificial Sequence
  Description of Artificial Sequence: Synthetic polypeptide
DEDEIRTTNPVATEQYGSVSTTGNPGEQRDGNGRQ

SEQ ID NO: 64308 - protein, 32 aa, Artificial Sequence
  Description of Artificial Sequence: Synthetic polypeptide
DEEEIATTNPVAYEQYGCVSYTNLSQGGGGRD

SEQ ID NO: 64309 - protein, 32 aa, Artificial Sequence
  Description of Artificial Sequence: Synthetic polypeptide
DEDEIRTTNPVATEQYGSVSTTLNGDSGQNQQ

SEQ ID NO: 64310 - protein, 29 aa, Artificial Sequence
  Description of Artificial Sequence: Synthetic peptide
DDEEISTTNPVATEQWGCVTSTELQHGDQ

SEQ ID NO: 64311 - protein, 30 aa, Artificial Sequence
  Description of Artificial Sequence: Synthetic polypeptide
DDEEISTTNPVATEQWGCVTSTLLQRFGEQ

SEQ ID NO: 64312 - protein, 29 aa, Artificial Sequence
  Description of Artificial Sequence: Synthetic peptide
DEAEIRTTNPVAYEQWGSYSRNMDERPNR

SEQ ID NO: 64313 - protein, 30 aa, Artificial Sequence
  Description of Artificial Sequence: Synthetic polypeptide
AEEEIACTNPVATEQYGSVATNDTRGVNDD

SEQ ID NO: 64314 - protein, 31 aa, Artificial Sequence
  Description of Artificial Sequence: Synthetic polypeptide
AEEEIACTNPVATEQYGSVSTALPNRNGMGR

SEQ ID NO: 64315 - protein, 32 aa, Artificial Sequence
  Description of Artificial Sequence: Synthetic polypeptide
DEEEIATTNPVAYEQYGQSVCNNDLNQRGIER

SEQ ID NO: 64316 - protein, 31 aa, Artificial Sequence
  Description of Artificial Sequence: Synthetic polypeptide
DEAEIACTNPVATEQYGSVATNLQTVGNPEP

SEQ ID NO: 64317 - protein, 32 aa, Artificial Sequence
  Description of Artificial Sequence: Synthetic polypeptide
DEEEIATTNPVAYEQYGQSVSQNDLGQRGIDM

SEQ ID NO: 64318 - protein, 32 aa, Artificial Sequence
  Description of Artificial Sequence: Synthetic polypeptide
AEEEIACTNPVATEQYGSVATNLQRDNDNTRM

SEQ ID NO: 64319 - protein, 34 aa, Artificial Sequence
  Description of Artificial Sequence: Synthetic polypeptide
DEEEIATTNPVAYEQYGQSVSQTNDLGQRAGIAR

SEQ ID NO: 64320 - protein, 34 aa, Artificial Sequence
  Description of Artificial Sequence: Synthetic polypeptide
DEDEIRTTNPVATEQYGSVSTTNGLQGDGGNGIK

SEQ ID NO: 64321 - protein, 33 aa, Artificial Sequence
  Description of Artificial Sequence: Synthetic polypeptide
DEEEIATTNPVAYEQYGQSVSTNDLDQDRGIGM

SEQ ID NO: 64322 - protein, 33 aa, Artificial Sequence
  Description of Artificial Sequence: Synthetic polypeptide
DEEEIATTNPVAYEQYGQSVSTNDLDQHGIDER

SEQ ID NO: 64323 - protein, 33 aa, Artificial Sequence
  Description of Artificial Sequence: Synthetic polypeptide
DEEEIATTNPVAYEQYGQSVSTNDLLQTEGIGR

SEQ ID NO: 64324 - protein, 32 aa, Artificial Sequence
  Description of Artificial Sequence: Synthetic polypeptide
DEDEIRTTNPVATEQYGSVSTTLNGEDGQNNQ

SEQ ID NO: 64325 - protein, 31 aa, Artificial Sequence
  Description of Artificial Sequence: Synthetic polypeptide
DEAEIRTTNPVAYEQWGSVSTNSGQNGDNNM

SEQ ID NO: 64326 - protein, 29 aa, Artificial Sequence
  Description of Artificial Sequence: Synthetic peptide
AEEEIACTNPVATEQYGSVATNDQDVNMD

SEQ ID NO: 64327 - protein, 30 aa, Artificial Sequence
  Description of Artificial Sequence: Synthetic polypeptide
DEAEIACTNPVATEQYGSVATNLQADEGRE

SEQ ID NO: 64328 - protein, 31 aa, Artificial Sequence
  Description of Artificial Sequence: Synthetic polypeptide
AEEEIACTNPVATEQYGSASTEPNGPQRGNV

SEQ ID NO: 64329 - protein, 33 aa, Artificial Sequence
  Description of Artificial Sequence: Synthetic polypeptide
AEEEIRTTNPVATEQYGSVSTVDNQNNQEEGNE

SEQ ID NO: 64330 - protein, 32 aa, Artificial Sequence
  Description of Artificial Sequence: Synthetic polypeptide
DEAEIRTTNPVAYEQWGSVSTNLQGNQGGDNA

SEQ ID NO: 64331 - protein, 32 aa, Artificial Sequence
  Description of Artificial Sequence: Synthetic polypeptide
DEAEIRTTNPVAYEQWGSVSTNLQGNMGGNSM

SEQ ID NO: 64332 - protein, 30 aa, Artificial Sequence
  Description of Artificial Sequence: Synthetic polypeptide
DEAEIRTTNGVAYCQYGCVSTNLQRGSDFP

SEQ ID NO: 64333 - protein, 32 aa, Artificial Sequence
  Description of Artificial Sequence: Synthetic polypeptide
DEAEIRTTNPVAYEQWGSVSTNLQGNMGDGGR

SEQ ID NO: 64334 - protein, 31 aa, Artificial Sequence
  Description of Artificial Sequence: Synthetic polypeptide
DEAEIRTTNPVAYEQWGSVSTNLQGNMGDEA

SEQ ID NO: 64335 - protein, 33 aa, Artificial Sequence
  Description of Artificial Sequence: Synthetic polypeptide
DEDEIRTTNPVATEQYGSVSTTNTGQEQEGTNQ

SEQ ID NO: 64336 - protein, 30 aa, Artificial Sequence
  Description of Artificial Sequence: Synthetic polypeptide
DEAEIRTTNGVAYCQYGSVCSTNLQGGDAS

SEQ ID NO: 64337 - protein, 32 aa, Artificial Sequence
  Description of Artificial Sequence: Synthetic polypeptide
AEEEIRTTNPVATEQYGSVSTVDNNNQQEENV

SEQ ID NO: 64338 - protein, 31 aa, Artificial Sequence
  Description of Artificial Sequence: Synthetic polypeptide
DEAEIRTTNPVAYEQWGSVSTNLQGNDGDEA

SEQ ID NO: 64339 - protein, 32 aa, Artificial Sequence
  Description of Artificial Sequence: Synthetic polypeptide
DEAEIRTTNPVAYEQWGSVSTNLQGNAGDDNM

SEQ ID NO: 64340 - protein, 29 aa, Artificial Sequence
  Description of Artificial Sequence: Synthetic peptide
DEAEIRTTNGVAYCQYGSVPTNLERGDDD

SEQ ID NO: 64341 - protein, 31 aa, Artificial Sequence
  Description of Artificial Sequence: Synthetic polypeptide
DEAEIRTTNGVAYCQYGSVSFTNDLQRGEDE

SEQ ID NO: 64342 - protein, 31 aa, Artificial Sequence
  Description of Artificial Sequence: Synthetic polypeptide
DEAEIRTTNPVAYEQWGSVSTNLQGGGDMGG

SEQ ID NO: 64343 - protein, 32 aa, Artificial Sequence
  Description of Artificial Sequence: Synthetic polypeptide
DEAEIRTTNPVAYEQWGSVSTNLQGDHGNNDG

SEQ ID NO: 64344 - protein, 31 aa, Artificial Sequence
  Description of Artificial Sequence: Synthetic polypeptide
AEEEIACTNPVATEQYGEASSTENLQRGGPR

SEQ ID NO: 64345 - protein, 32 aa, Artificial Sequence
  Description of Artificial Sequence: Synthetic polypeptide
DEAEIRTTNPVAYEQWGSVSTNLQANEGDNNH

SEQ ID NO: 64346 - protein, 31 aa, Artificial Sequence
  Description of Artificial Sequence: Synthetic polypeptide
DEAEIRTTNGVAYCQYGSVSTLDLQRGIDRQ

SEQ ID NO: 64347 - protein, 31 aa, Artificial Sequence
  Description of Artificial Sequence: Synthetic polypeptide
DEAEIRTTNGVAYCQYGSVSTNLQSFGSDRS

SEQ ID NO: 64348 - protein, 32 aa, Artificial Sequence
  Description of Artificial Sequence: Synthetic polypeptide
DEAEIRTTNGVAYCQYGSVCSTNLQRSGSDRA

SEQ ID NO: 64349 - protein, 33 aa, Artificial Sequence
  Description of Artificial Sequence: Synthetic polypeptide
DEDEIRTTNPVATEQYGSVSTTGLNGDGQNQRQ

SEQ ID NO: 64350 - protein, 30 aa, Artificial Sequence
  Description of Artificial Sequence: Synthetic polypeptide
AEEEIACTNPVATEQYGSCATNLQAEDGER

SEQ ID NO: 64351 - protein, 32 aa, Artificial Sequence
  Description of Artificial Sequence: Synthetic polypeptide
DEAEIRTTNPVAYEQWGSVSTNLQHNGGDNNM

SEQ ID NO: 64352 - protein, 29 aa, Artificial Sequence
  Description of Artificial Sequence: Synthetic peptide
DEAEIACTNPVATEQYGSVATNLQAAAGE

SEQ ID NO: 64353 - protein, 31 aa, Artificial Sequence
  Description of Artificial Sequence: Synthetic polypeptide
DEAEIACTNPVATEQYGSVATNLNNRGNPTA

SEQ ID NO: 64354 - protein, 30 aa, Artificial Sequence
  Description of Artificial Sequence: Synthetic polypeptide
DEAEIACTNPVATEQYGSVATNLNMGNENL

SEQ ID NO: 64355 - protein, 31 aa, Artificial Sequence
  Description of Artificial Sequence: Synthetic polypeptide
DEAEIRTTNPVAYEQWGSVSTNMQGEGGDQR

SEQ ID NO: 64356 - protein, 30 aa, Artificial Sequence
  Description of Artificial Sequence: Synthetic polypeptide
AENEIATTNPVATEQYGSASTDLEREGEDR

SEQ ID NO: 64357 - protein, 30 aa, Artificial Sequence
  Description of Artificial Sequence: Synthetic polypeptide
AEEEIACTNPVATEQYGSVATNDQDSGNDE

SEQ ID NO: 64358 - protein, 32 aa, Artificial Sequence
  Description of Artificial Sequence: Synthetic polypeptide
DEAEIRTTNPVAYEQWGSVSTNLQSNGDNNNQ

SEQ ID NO: 64359 - protein, 32 aa, Artificial Sequence
  Description of Artificial Sequence: Synthetic polypeptide
DEAEIRTTNPVAYEQWGSVSTNLQQQDGDMGR

SEQ ID NO: 64360 - protein, 32 aa, Artificial Sequence
  Description of Artificial Sequence: Synthetic polypeptide
DEAEIRTTNPVAYEQWGSVSTNLQQGTDGNDN

SEQ ID NO: 64361 - protein, 28 aa, Artificial Sequence
  Description of Artificial Sequence: Synthetic peptide
AENEIATTNPVATEQYGEVSECLQHEGR

SEQ ID NO: 64362 - protein, 31 aa, Artificial Sequence
  Description of Artificial Sequence: Synthetic polypeptide
DEAEIRTTNPVAYEQWGSVSTNLQPEGGDEA

SEQ ID NO: 64363 - protein, 31 aa, Artificial Sequence
  Description of Artificial Sequence: Synthetic polypeptide
AEEEIACTNPVATEQYGSVATNDQDRGGNDQ

SEQ ID NO: 64364 - protein, 31 aa, Artificial Sequence
  Description of Artificial Sequence: Synthetic polypeptide
DEAEIRTTNPVAYEQWGSVSTNLQNEGGDEE

SEQ ID NO: 64365 - protein, 30 aa, Artificial Sequence
  Description of Artificial Sequence: Synthetic polypeptide
AENEIATTNPVATEQYGSASEDLQREGEDR

SEQ ID NO: 64366 - protein, 30 aa, Artificial Sequence
  Description of Artificial Sequence: Synthetic polypeptide
AENEIATTNPVATEQYGSASAENLEDRGGR

SEQ ID NO: 64367 - protein, 29 aa, Artificial Sequence
  Description of Artificial Sequence: Synthetic peptide
AENEIATTNPVATEQYGSASAEDLERGER

SEQ ID NO: 64368 - protein, 29 aa, Artificial Sequence
  Description of Artificial Sequence: Synthetic peptide
AEEEIACTNPVATEQYGSVASNDQRIDNA

SEQ ID NO: 64369 - protein, 29 aa, Artificial Sequence
  Description of Artificial Sequence: Synthetic peptide
AEEEIACTNPVATEQYGSVAMNDQDSGNQ

SEQ ID NO: 64370 - protein, 32 aa, Artificial Sequence
  Description of Artificial Sequence: Synthetic polypeptide
DEAEIRTTNPVAYEQWGSVSTNLQNEGDGNEA

SEQ ID NO: 64371 - protein, 30 aa, Artificial Sequence
  Description of Artificial Sequence: Synthetic polypeptide
AENEIATTNPVATEQYGEVSSEPALNRGNR

SEQ ID NO: 64372 - protein, 31 aa, Artificial Sequence
  Description of Artificial Sequence: Synthetic polypeptide
AEEEIACTNPVATEQYGSVATNDQDRGPNEQ

SEQ ID NO: 64373 - protein, 29 aa, Artificial Sequence
  Description of Artificial Sequence: Synthetic peptide
DEAEIRTTNPVAYEQWGTVSTNLNMGGEA

SEQ ID NO: 64374 - protein, 28 aa, Artificial Sequence
  Description of Artificial Sequence: Synthetic peptide
AEEEIASVNPVATEQYGVVSDNLQSGGQ

SEQ ID NO: 64375 - protein, 30 aa, Artificial Sequence
  Description of Artificial Sequence: Synthetic polypeptide
DEAEIACTNPVATEQYGSVATNNQDSGNQE

SEQ ID NO: 64376 - protein, 32 aa, Artificial Sequence
  Description of Artificial Sequence: Synthetic polypeptide
DEEEIATTNPVAYEQWGSVSTNLQGQMGDNES

SEQ ID NO: 64377 - protein, 30 aa, Artificial Sequence
  Description of Artificial Sequence: Synthetic polypeptide
AENEICATNPVATEQYGSVASENLQFGNGD

SEQ ID NO: 64378 - protein, 30 aa, Artificial Sequence
  Description of Artificial Sequence: Synthetic polypeptide
AENEICATNPVATEQYGSVANSENLQRGET

SEQ ID NO: 64379 - protein, 33 aa, Artificial Sequence
  Description of Artificial Sequence: Synthetic polypeptide
AEEEIRTTNPVATEQYGSVSTTVNLQTIAEGGV

SEQ ID NO: 64380 - protein, 31 aa, Artificial Sequence
  Description of Artificial Sequence: Synthetic polypeptide
DEDEIRTTNPVATEQYGSVSDTSLEQEDEDI

SEQ ID NO: 64381 - protein, 32 aa, Artificial Sequence
  Description of Artificial Sequence: Synthetic polypeptide
DEDEIRTTNPVATEQYGSVSHTNNDQNGGGEQ

SEQ ID NO: 64382 - protein, 32 aa, Artificial Sequence
  Description of Artificial Sequence: Synthetic polypeptide
AEEEIATTNPVATEAYGSVSANLQDQAGNDRH

SEQ ID NO: 64383 - protein, 33 aa, Artificial Sequence
  Description of Artificial Sequence: Synthetic polypeptide
DEDEIRTTNPVATEQYGSVSMTNALTQNTMNMP

SEQ ID NO: 64384 - protein, 30 aa, Artificial Sequence
  Description of Artificial Sequence: Synthetic polypeptide
DEAEIATTNCVAYCQYGSVATNLQRGDDRD

SEQ ID NO: 64385 - protein, 32 aa, Artificial Sequence
  Description of Artificial Sequence: Synthetic polypeptide
DEEEIATTNPVAYEQWGSVSTNLQGNNDNGNE

SEQ ID NO: 64386 - protein, 32 aa, Artificial Sequence
  Description of Artificial Sequence: Synthetic polypeptide
DEDEIRTTNPVATEQYGSVSMTQPLQRQITEQ

SEQ ID NO: 64387 - protein, 33 aa, Artificial Sequence
  Description of Artificial Sequence: Synthetic polypeptide
AEEEIRTTNPVATEQYGSVSTTVNNGEQGGNTP

SEQ ID NO: 64388 - protein, 29 aa, Artificial Sequence
  Description of Artificial Sequence: Synthetic peptide
AEEEIASVNPVTTEQYGVVSTNNLQSGNQ

SEQ ID NO: 64389 - protein, 30 aa, Artificial Sequence
  Description of Artificial Sequence: Synthetic polypeptide
DEAEIASTNPVAYEQYGSVATNLQRGDGTQ

SEQ ID NO: 64390 - protein, 32 aa, Artificial Sequence
  Description of Artificial Sequence: Synthetic polypeptide
DEEEIATTNPVAYEQWGSVSTNLQLGDNGNTE

SEQ ID NO: 64391 - protein, 32 aa, Artificial Sequence
  Description of Artificial Sequence: Synthetic polypeptide
DEEEIATTNPVAYEQWGSVSTNLQNGQTNDDS

SEQ ID NO: 64392 - protein, 29 aa, Artificial Sequence
  Description of Artificial Sequence: Synthetic peptide
DDEEISCTNPVATCQYGCVSTNPARFGNQ

SEQ ID NO: 64393 - protein, 30 aa, Artificial Sequence
  Description of Artificial Sequence: Synthetic polypeptide
DEAEIACTNPVAYEQYGSVATNLVRGEDRE

SEQ ID NO: 64394 - protein, 29 aa, Artificial Sequence
  Description of Artificial Sequence: Synthetic peptide
DEAEIACTNPVAYEQYGSVATNLVRGDGL

SEQ ID NO: 64395 - protein, 31 aa, Artificial Sequence
  Description of Artificial Sequence: Synthetic polypeptide
DEEEIATTNPVAYEQWGSVSTNMQHQGNNDS

SEQ ID NO: 64396 - protein, 31 aa, Artificial Sequence
  Description of Artificial Sequence: Synthetic polypeptide
DEDEIRTTNPVATEQYGSVSNQNLFGNNNNS

SEQ ID NO: 64397 - protein, 31 aa, Artificial Sequence
  Description of Artificial Sequence: Synthetic polypeptide
DEEEIATTNPVAYEQWGSVSTNSQNGGNDDS

SEQ ID NO: 64398 - protein, 30 aa, Artificial Sequence
  Description of Artificial Sequence: Synthetic polypeptide
AENEICATNPVATEQYGSVASENLQNGEER

SEQ ID NO: 64399 - protein, 32 aa, Artificial Sequence
  Description of Artificial Sequence: Synthetic polypeptide
DEDEIRTTNPVATEQYGSVQTTQNLIRTTNNA

SEQ ID NO: 64400 - protein, 33 aa, Artificial Sequence
  Description of Artificial Sequence: Synthetic polypeptide
DEDEIRTTNPVATEQYGSVPSCTTMLSGRENNR

SEQ ID NO: 64401 - protein, 34 aa, Artificial Sequence
  Description of Artificial Sequence: Synthetic polypeptide
AEEEIRTTNPVATEQYGSVSTTVNLGQNDEGNIA

SEQ ID NO: 64402 - protein, 29 aa, Artificial Sequence
  Description of Artificial Sequence: Synthetic peptide
DDEEIRTTNPVAYCQYGCIVSTEHQIGSR

SEQ ID NO: 64403 - protein, 30 aa, Artificial Sequence
  Description of Artificial Sequence: Synthetic polypeptide
DEDEIRTTNPVATEQYGSVQTALILEMNED

SEQ ID NO: 64404 - protein, 31 aa, Artificial Sequence
  Description of Artificial Sequence: Synthetic polypeptide
CEEEIATTNPVATESYGSVATNLQDSGNDEE

SEQ ID NO: 64405 - protein, 32 aa, Artificial Sequence
  Description of Artificial Sequence: Synthetic polypeptide
DEDEIRTTNPVATEQYGSVQTALLQIGTTNNQ

SEQ ID NO: 64406 - protein, 32 aa, Artificial Sequence
  Description of Artificial Sequence: Synthetic polypeptide
DEEEIATTNPVAYEQWGSVSTNLNGGMGDNDR

SEQ ID NO: 64407 - protein, 31 aa, Artificial Sequence
  Description of Artificial Sequence: Synthetic polypeptide
DEDEIRTTNPVATEQYGSVQTALTIRTTNND

SEQ ID NO: 64408 - protein, 31 aa, Artificial Sequence
  Description of Artificial Sequence: Synthetic polypeptide
DEEEIATTNPVAYEQWGSVSTNLNGNDMDNR

SEQ ID NO: 64409 - protein, 32 aa, Artificial Sequence
  Description of Artificial Sequence: Synthetic polypeptide
DEEEIATTNPVAYEQWGSVSTNLQGNDGNNMQ

SEQ ID NO: 64410 - protein, 31 aa, Artificial Sequence
  Description of Artificial Sequence: Synthetic polypeptide
DEDEIRTTNPVATEQYGSVQTQALLIGTNNA

SEQ ID NO: 64411 - protein, 31 aa, Artificial Sequence
  Description of Artificial Sequence: Synthetic polypeptide
AEEEIRTTNPVATESYGSVTDTNTSLNGNRF

SEQ ID NO: 64412 - protein, 31 aa, Artificial Sequence
  Description of Artificial Sequence: Synthetic polypeptide
DEDEIRTTNPVATEQYGSVQTQAQQIRTNNA

SEQ ID NO: 64413 - protein, 32 aa, Artificial Sequence
  Description of Artificial Sequence: Synthetic polypeptide
DEEEIATTNPVAYEQWGSVSTNLQADNGNGET

SEQ ID NO: 64414 - protein, 31 aa, Artificial Sequence
  Description of Artificial Sequence: Synthetic polypeptide
DEEEIATTNPVAYEQWGSVSTNLQAQGGMDQ

SEQ ID NO: 64415 - protein, 30 aa, Artificial Sequence
  Description of Artificial Sequence: Synthetic polypeptide
DEDEIRTTNPVATEQYGSVQTTALIGTNNT

SEQ ID NO: 64416 - protein, 31 aa, Artificial Sequence
  Description of Artificial Sequence: Synthetic polypeptide
DEDEIRTTNPVATEQYGSVQTTQALIRTENN

SEQ ID NO: 64417 - protein, 32 aa, Artificial Sequence
  Description of Artificial Sequence: Synthetic polypeptide
DEEEIATTNPVAYEQWGSVSTNLQAQGGNNDS

SEQ ID NO: 64418 - protein, 31 aa, Artificial Sequence
  Description of Artificial Sequence: Synthetic polypeptide
DEEEIATTNPVAYEQWGSVSTNLQGNAGEEE

SEQ ID NO: 64419 - protein, 30 aa, Artificial Sequence
  Description of Artificial Sequence: Synthetic polypeptide
AEEEIRTTNPVATEWYGACPSSTEQRGNRQ

SEQ ID NO: 64420 - protein, 32 aa, Artificial Sequence
  Description of Artificial Sequence: Synthetic polypeptide
DEEEIATTNPVAYEQWGSVSTNLNGNMGNNNR

SEQ ID NO: 64421 - protein, 34 aa, Artificial Sequence
  Description of Artificial Sequence: Synthetic polypeptide
AEEEIRTTNPVATEQYGSVSTTVNGNLQQGTNID

SEQ ID NO: 64422 - protein, 29 aa, Artificial Sequence
  Description of Artificial Sequence: Synthetic peptide
AENEICATNPVATEQYGQVASENLQRGEI

SEQ ID NO: 64423 - protein, 32 aa, Artificial Sequence
  Description of Artificial Sequence: Synthetic polypeptide
DEAEIRTTNPVAYEQYGKVFTNELSARGGNQR

SEQ ID NO: 64424 - protein, 29 aa, Artificial Sequence
  Description of Artificial Sequence: Synthetic peptide
AENEICATNPVATEAYGVVASENLQRGER

SEQ ID NO: 64425 - protein, 33 aa, Artificial Sequence
  Description of Artificial Sequence: Synthetic polypeptide
AEEEIRTTNPVATEQYGSVSTTVNNNQQTGNVD

SEQ ID NO: 64426 - protein, 31 aa, Artificial Sequence
  Description of Artificial Sequence: Synthetic polypeptide
DEECISTTNPVATEQYSACVCSTNLQIGSNQ

SEQ ID NO: 64427 - protein, 30 aa, Artificial Sequence
  Description of Artificial Sequence: Synthetic polypeptide
DEAEIACTNPVATEQYGSVSTPNLQNADEA

SEQ ID NO: 64428 - protein, 31 aa, Artificial Sequence
  Description of Artificial Sequence: Synthetic polypeptide
DEAEIRTTNPVAYEQWGVVSTNLQNGDNNMS

SEQ ID NO: 64429 - protein, 32 aa, Artificial Sequence
  Description of Artificial Sequence: Synthetic polypeptide
DEDEIRTTNPVATEQYGSVSTQLNGDHGQNGQ

SEQ ID NO: 64430 - protein, 28 aa, Artificial Sequence
  Description of Artificial Sequence: Synthetic peptide
AENEIAVTNPVATEQYGEASENLQKGGR

SEQ ID NO: 64431 - protein, 28 aa, Artificial Sequence
  Description of Artificial Sequence: Synthetic peptide
DDEEISTTNPVATCQYGCVSTNPIHGQQ

SEQ ID NO: 64432 - protein, 28 aa, Artificial Sequence
  Description of Artificial Sequence: Synthetic peptide
AENEIATTNPVSTEQYGEASENLQRGGH

SEQ ID NO: 64433 - protein, 28 aa, Artificial Sequence
  Description of Artificial Sequence: Synthetic peptide
AENEICATNPVATEQYGAASENLQEGDR

SEQ ID NO: 64434 - protein, 32 aa, Artificial Sequence
  Description of Artificial Sequence: Synthetic polypeptide
DEDEIRTTNPVATEQYGSVSTQNLFGNNNNDI

SEQ ID NO: 64435 - protein, 34 aa, Artificial Sequence
  Description of Artificial Sequence: Synthetic polypeptide
DEDEIRTTNPVATEQYGSVSTQNNLQFGNNNNDQ

SEQ ID NO: 64436 - protein, 31 aa, Artificial Sequence
  Description of Artificial Sequence: Synthetic polypeptide
DDEEISTTNPVATCQYGSVSTTNPIRFGSNQ

SEQ ID NO: 64437 - protein, 31 aa, Artificial Sequence
  Description of Artificial Sequence: Synthetic polypeptide
DDEEISTTNPVATCQYGSVTSTNPIRGSNQN

SEQ ID NO: 64438 - protein, 33 aa, Artificial Sequence
  Description of Artificial Sequence: Synthetic polypeptide
DEDEIRTTNPVATEQYGSVSTQNNQLFGNNNNS

SEQ ID NO: 64439 - protein, 31 aa, Artificial Sequence
  Description of Artificial Sequence: Synthetic polypeptide
DEEEIATTNPVAYEQWGVVSTNLQGDAGNAT

SEQ ID NO: 64440 - protein, 34 aa, Artificial Sequence
  Description of Artificial Sequence: Synthetic polypeptide
AEEEIRTTNPVATEQYGSVSTTVNTNLQEGNNEI

SEQ ID NO: 64441 - protein, 31 aa, Artificial Sequence
  Description of Artificial Sequence: Synthetic polypeptide
AEEEIRTTNPVATEQYGSVSTTVQQQQTNGN

SEQ ID NO: 64442 - protein, 31 aa, Artificial Sequence
  Description of Artificial Sequence: Synthetic polypeptide
AEEEIRTTNPVATEQYGSVSTTVQQQQTNVN

SEQ ID NO: 64443 - protein, 34 aa, Artificial Sequence
  Description of Artificial Sequence: Synthetic polypeptide
DEDEIRTTNPVATEQYGSVSTQNQLQFGNNNNNS

SEQ ID NO: 64444 - protein, 34 aa, Artificial Sequence
  Description of Artificial Sequence: Synthetic polypeptide
DEDEIRTTNPVATEQYGSVSTQNLQFGNNNNEDD

SEQ ID NO: 64445 - protein, 29 aa, Artificial Sequence
  Description of Artificial Sequence: Synthetic peptide
AEEEIASVNPVCTEQYGVVSTDNLQSGNS

SEQ ID NO: 64446 - protein, 30 aa, Artificial Sequence
  Description of Artificial Sequence: Synthetic polypeptide
DEAEIACTNPVATETYGSVSTNLQDGDTMA

SEQ ID NO: 64447 - protein, 33 aa, Artificial Sequence
  Description of Artificial Sequence: Synthetic polypeptide
AEEEIRTTNPVAYEQWGSVTKTDNLDQRGGNDR

SEQ ID NO: 64448 - protein, 32 aa, Artificial Sequence
  Description of Artificial Sequence: Synthetic polypeptide
DEAEIRTTNPVAYEQYGEVVSTNLQIGGGNDE

SEQ ID NO: 64449 - protein, 32 aa, Artificial Sequence
  Description of Artificial Sequence: Synthetic polypeptide
DEAEIRTTNPVAYEQYGEVVSTNLQGMGNNTE

SEQ ID NO: 64450 - protein, 32 aa, Artificial Sequence
  Description of Artificial Sequence: Synthetic polypeptide
DEAEIRTTNPVAYEQYGEVVSTNLQGGQGNTE

SEQ ID NO: 64451 - protein, 32 aa, Artificial Sequence
  Description of Artificial Sequence: Synthetic polypeptide
DEAEIRTTNPVAYEQYGEVVSTNLQGGGDNTE

SEQ ID NO: 64452 - protein, 32 aa, Artificial Sequence
  Description of Artificial Sequence: Synthetic polypeptide
DEAEIRTTNPVAYEQYGEVVSTNFAQRMNYRQ

SEQ ID NO: 64453 - protein, 34 aa, Artificial Sequence
  Description of Artificial Sequence: Synthetic polypeptide
DEAEIRTTNPVAYEQYGCSVACTDNLSQRGGNRE

SEQ ID NO: 64454 - protein, 29 aa, Artificial Sequence
  Description of Artificial Sequence: Synthetic peptide
DEAEIRTTNPVAYEQYGCISTNLENFPER

SEQ ID NO: 64455 - protein, 29 aa, Artificial Sequence
  Description of Artificial Sequence: Synthetic peptide
DEAEIRTTNPVAYEQYGCICSTNLENINQ

SEQ ID NO: 64456 - protein, 28 aa, Artificial Sequence
  Description of Artificial Sequence: Synthetic peptide
AENEICATNPVATEQYGNASENLQDGQR

SEQ ID NO: 64457 - protein, 30 aa, Artificial Sequence
  Description of Artificial Sequence: Synthetic polypeptide
DEECISTTNPVATEYYGCVNTNGLQNGSNQ

SEQ ID NO: 64458 - protein, 30 aa, Artificial Sequence
  Description of Artificial Sequence: Synthetic polypeptide
DEAEIRTTNPVAYEQYGCICSNTNLENPNR

SEQ ID NO: 64459 - protein, 31 aa, Artificial Sequence
  Description of Artificial Sequence: Synthetic polypeptide
DEEEIATTNPVAYEQWGSVTTDLGQGGGNAR

SEQ ID NO: 64460 - protein, 28 aa, Artificial Sequence
  Description of Artificial Sequence: Synthetic peptide
AEEEIASVNPVCTEQYGVVSDNLQSGNQ

SEQ ID NO: 64461 - protein, 31 aa, Artificial Sequence
  Description of Artificial Sequence: Synthetic polypeptide
DEAEIRTTNPVAYEQWGVVVSTNMQHDGNER

SEQ ID NO: 64462 - protein, 31 aa, Artificial Sequence
  Description of Artificial Sequence: Synthetic polypeptide
DEEEIATTNPVAYEQWGSVTTNLQGDAGNEA

SEQ ID NO: 64463 - protein, 28 aa, Artificial Sequence
  Description of Artificial Sequence: Synthetic peptide
AENEICATNPVATEQYGEISENLQEGER

SEQ ID NO: 64464 - protein, 31 aa, Artificial Sequence
  Description of Artificial Sequence: Synthetic polypeptide
DEEEIATTNPVAYEQWGSVVTGDGLQNGNRG

SEQ ID NO: 64465 - protein, 33 aa, Artificial Sequence
  Description of Artificial Sequence: Synthetic polypeptide
DEDEIRTTNPVATEQYGSVSSVTNTNQNEGNLQ

SEQ ID NO: 64466 - protein, 31 aa, Artificial Sequence
  Description of Artificial Sequence: Synthetic polypeptide
DEDEIRTTNPVATEQYGSVSSVTNTQQEELQ

SEQ ID NO: 64467 - protein, 28 aa, Artificial Sequence
  Description of Artificial Sequence: Synthetic peptide
AEEEIASVNPVCTEQYGVVSDNLQAGNV

SEQ ID NO: 64468 - protein, 28 aa, Artificial Sequence
  Description of Artificial Sequence: Synthetic peptide
AEEEIASVNPVCTEQYGVVSDNLQVGNQ

SEQ ID NO: 64469 - protein, 34 aa, Artificial Sequence
  Description of Artificial Sequence: Synthetic polypeptide
AEEEIRTTNPVATEQYGSVSTTTNLQGNVGTNDT

SEQ ID NO: 64470 - protein, 34 aa, Artificial Sequence
  Description of Artificial Sequence: Synthetic polypeptide
DEEEIRQTNPVATEQYGSVSVTGGLVEDRGDNDR

SEQ ID NO: 64471 - protein, 32 aa, Artificial Sequence
  Description of Artificial Sequence: Synthetic polypeptide
DEEEIRSTNPAATEFYGSVCSTNLAREGGNNG

SEQ ID NO: 64472 - protein, 30 aa, Artificial Sequence
  Description of Artificial Sequence: Synthetic polypeptide
AEEEIRATNPCATEQYGSVSENLMQGNNDV

SEQ ID NO: 64473 - protein, 31 aa, Artificial Sequence
  Description of Artificial Sequence: Synthetic polypeptide
AEEEIRATNPCATEQYGSVSENLMEQIGTNV

SEQ ID NO: 64474 - protein, 30 aa, Artificial Sequence
  Description of Artificial Sequence: Synthetic polypeptide
AEEEIRATNPCATEQYGSVSENLMEQGNVV

SEQ ID NO: 64475 - protein, 31 aa, Artificial Sequence
  Description of Artificial Sequence: Synthetic polypeptide
AEEEIKTTNPVATEQYGTVALTNWLERGNQT

SEQ ID NO: 64476 - protein, 32 aa, Artificial Sequence
  Description of Artificial Sequence: Synthetic polypeptide
DEDEIRTTNPVATEPYGSVCATNLTDAGGNER

SEQ ID NO: 64477 - protein, 30 aa, Artificial Sequence
  Description of Artificial Sequence: Synthetic polypeptide
DEAEIATTNPVATEQYGCVAATNLTAEGND

SEQ ID NO: 64478 - protein, 31 aa, Artificial Sequence
  Description of Artificial Sequence: Synthetic polypeptide
DEAEIATTNPVATEQYGCVAATNLQQPNPRN

SEQ ID NO: 64479 - protein, 31 aa, Artificial Sequence
  Description of Artificial Sequence: Synthetic polypeptide
DEAEIATTNPVATEQYGCVAATNLQNGPLRE

SEQ ID NO: 64480 - protein, 34 aa, Artificial Sequence
  Description of Artificial Sequence: Synthetic polypeptide
DEEEIATTNPVATEQYGSVVSTNNLGQDNGMNGD

SEQ ID NO: 64481 - protein, 30 aa, Artificial Sequence
  Description of Artificial Sequence: Synthetic polypeptide
DEEEIACTNPVATEQWGSVATNLERGDTLA

SEQ ID NO: 64482 - protein, 31 aa, Artificial Sequence
  Description of Artificial Sequence: Synthetic polypeptide
DEEEIATTNPVATEQYGSVVTGMGDMNGGNR

SEQ ID NO: 64483 - protein, 32 aa, Artificial Sequence
  Description of Artificial Sequence: Synthetic polypeptide
DEAEIATTNPVATEQYGCVAATNLQEAGNPRV

SEQ ID NO: 64484 - protein, 33 aa, Artificial Sequence
  Description of Artificial Sequence: Synthetic polypeptide
DEDEIRTTNPVATEPYGSVSTNLNQNGDTNGGA

SEQ ID NO: 64485 - protein, 32 aa, Artificial Sequence
  Description of Artificial Sequence: Synthetic polypeptide
DEEEIATTNPVATEQYGSVVTGMGDQNGGNTR

SEQ ID NO: 64486 - protein, 32 aa, Artificial Sequence
  Description of Artificial Sequence: Synthetic polypeptide
DEEEIATTNPVATEQYGSVVTGMGDVQGNGNR

SEQ ID NO: 64487 - protein, 33 aa, Artificial Sequence
  Description of Artificial Sequence: Synthetic polypeptide
DEEEIATTNPVATEQYGSVVVTGNGMQDAGNHR

SEQ ID NO: 64488 - protein, 31 aa, Artificial Sequence
  Description of Artificial Sequence: Synthetic polypeptide
DEEEIATTNPVATEQYGSVYPTGDEQLRDNG

SEQ ID NO: 64489 - protein, 32 aa, Artificial Sequence
  Description of Artificial Sequence: Synthetic polypeptide
AEEEIRTTNPVATEQYGSVSVNNAENQETGNE

SEQ ID NO: 64490 - protein, 32 aa, Artificial Sequence
  Description of Artificial Sequence: Synthetic polypeptide
AEEEIRTTNPVATEQYGVVSTTNQSNQGNGNS

SEQ ID NO: 64491 - protein, 29 aa, Artificial Sequence
  Description of Artificial Sequence: Synthetic peptide
AEEEIRATNPCATEQYGSVSENLMQGTTV

SEQ ID NO: 64492 - protein, 34 aa, Artificial Sequence
  Description of Artificial Sequence: Synthetic polypeptide
DEEEIATTNPVATEQYGSVVSTNNLGQDDGNTGD

SEQ ID NO: 64493 - protein, 30 aa, Artificial Sequence
  Description of Artificial Sequence: Synthetic polypeptide
AEEEIRATNPCATEQYGSVSENNLMEGTNM

SEQ ID NO: 64494 - protein, 34 aa, Artificial Sequence
  Description of Artificial Sequence: Synthetic polypeptide
DEEEIATTNPVATEQYGSVVSTGNMLGDAGGNHR

SEQ ID NO: 64495 - protein, 28 aa, Artificial Sequence
  Description of Artificial Sequence: Synthetic peptide
AENEIVCTNPVATEQYGEAWENLQRGGR

SEQ ID NO: 64496 - protein, 29 aa, Artificial Sequence
  Description of Artificial Sequence: Synthetic peptide
AENEIVCTNPVATEQYGEASENLQRGGPR

SEQ ID NO: 64497 - protein, 33 aa, Artificial Sequence
  Description of Artificial Sequence: Synthetic polypeptide
DDEEIRTTNPVATEQYGCVCSTEELQRFGSNQS

SEQ ID NO: 64498 - protein, 28 aa, Artificial Sequence
  Description of Artificial Sequence: Synthetic peptide
AENEIVCTNPVATEQYGEASENLQFGGR

SEQ ID NO: 64499 - protein, 32 aa, Artificial Sequence
  Description of Artificial Sequence: Synthetic polypeptide
AEEEIRTTNPVATEQYGSVSVNNELGNTQGNN

SEQ ID NO: 64500 - protein, 32 aa, Artificial Sequence
  Description of Artificial Sequence: Synthetic polypeptide
AEEEIRATNPCATEQYGSVSTEGNLQMTGTNM

SEQ ID NO: 64501 - protein, 34 aa, Artificial Sequence
  Description of Artificial Sequence: Synthetic polypeptide
DEEEIATTNPVATEQYGSVVPSTNSLSQVRGGEQ

SEQ ID NO: 64502 - protein, 32 aa, Artificial Sequence
  Description of Artificial Sequence: Synthetic polypeptide
AEEEIRTTNPVATEQYGVVSTTNNSNQGGNTE

SEQ ID NO: 64503 - protein, 28 aa, Artificial Sequence
  Description of Artificial Sequence: Synthetic peptide
AENEITCTNPVATEQYGEASENLQRIGR

SEQ ID NO: 64504 - protein, 32 aa, Artificial Sequence
  Description of Artificial Sequence: Synthetic polypeptide
AEEEIRTTNPVATEQYGSVSVENTGEQGGNTG

SEQ ID NO: 64505 - protein, 32 aa, Artificial Sequence
  Description of Artificial Sequence: Synthetic polypeptide
DDEEIRTTNPVATEQYGCVCSTEHQGGGSNRS

SEQ ID NO: 64506 - protein, 30 aa, Artificial Sequence
  Description of Artificial Sequence: Synthetic polypeptide
AEEEIRATNPCATEQYGSVSNVNLMQGNVN

SEQ ID NO: 64507 - protein, 32 aa, Artificial Sequence
  Description of Artificial Sequence: Synthetic polypeptide
AEEEIRTTNPVATEQYGSVSTTQLQGTQIGGT

SEQ ID NO: 64508 - protein, 31 aa, Artificial Sequence
  Description of Artificial Sequence: Synthetic polypeptide
DEEEIACTNPVATEQWGSVATNLQEAGNMEE

SEQ ID NO: 64509 - protein, 28 aa, Artificial Sequence
  Description of Artificial Sequence: Synthetic peptide
AENEITCTNPVATEQYGEASENLQRGGN

SEQ ID NO: 64510 - protein, 30 aa, Artificial Sequence
  Description of Artificial Sequence: Synthetic polypeptide
DEEEIACTNPVATEQWGSVATNLQDGPDEQ

SEQ ID NO: 64511 - protein, 30 aa, Artificial Sequence
  Description of Artificial Sequence: Synthetic polypeptide
AEEEIRATNPCATEQYGSVSNENLMQGNEM

SEQ ID NO: 64512 - protein, 31 aa, Artificial Sequence
  Description of Artificial Sequence: Synthetic polypeptide
DEAEICTTNPVAYEQWGSTVNTNLSQRPGNS

SEQ ID NO: 64513 - protein, 30 aa, Artificial Sequence
  Description of Artificial Sequence: Synthetic polypeptide
AEEEIRATNPCATEQYGSVSNENLMGGTNM

SEQ ID NO: 64514 - protein, 30 aa, Artificial Sequence
  Description of Artificial Sequence: Synthetic polypeptide
AEEEIRATNPCATEQYGSVSNENLEQGNVD

SEQ ID NO: 64515 - protein, 32 aa, Artificial Sequence
  Description of Artificial Sequence: Synthetic polypeptide
DDEEIRTTNPVATEQYGCVCSTEHQRFGSNAS

SEQ ID NO: 64516 - protein, 31 aa, Artificial Sequence
  Description of Artificial Sequence: Synthetic polypeptide
AEEEICTTNPVATEQYGVVSVTTLEQGNGNA

SEQ ID NO: 64517 - protein, 31 aa, Artificial Sequence
  Description of Artificial Sequence: Synthetic polypeptide
AEEEICTTNPVATEQYGVVSVTTDLQGGNAD

SEQ ID NO: 64518 - protein, 32 aa, Artificial Sequence
  Description of Artificial Sequence: Synthetic polypeptide
AEEEIRTTNPVATEQYGVVSTTNSNQGEGNNQ

SEQ ID NO: 64519 - protein, 33 aa, Artificial Sequence
  Description of Artificial Sequence: Synthetic polypeptide
DDEEIRTTNPVATEQYGCVCSTENLQNFGSNDE

SEQ ID NO: 64520 - protein, 32 aa, Artificial Sequence
  Description of Artificial Sequence: Synthetic polypeptide
DEDEIRTTNPVATEQWGETSTNALSQRGGDNS

SEQ ID NO: 64521 - protein, 32 aa, Artificial Sequence
  Description of Artificial Sequence: Synthetic polypeptide
AEEEIRTTNPVATEQYGSVSVENLQQNTNNTT

SEQ ID NO: 64522 - protein, 33 aa, Artificial Sequence
  Description of Artificial Sequence: Synthetic polypeptide
DEDEIRTTNPVATEQWGEVSTTNLNQGDGNMGR

SEQ ID NO: 64523 - protein, 32 aa, Artificial Sequence
  Description of Artificial Sequence: Synthetic polypeptide
AEEEIRTTNPVATEQYGSVSTTQNNINDEGND

SEQ ID NO: 64524 - protein, 32 aa, Artificial Sequence
  Description of Artificial Sequence: Synthetic polypeptide
AEEEIRTTNPVATEQYGSVSVENLQQNNQNNT

SEQ ID NO: 64525 - protein, 31 aa, Artificial Sequence
  Description of Artificial Sequence: Synthetic polypeptide
DEEEIRSTNPVATEQYGSVPHNDIQGHVGNS

SEQ ID NO: 64526 - protein, 32 aa, Artificial Sequence
  Description of Artificial Sequence: Synthetic polypeptide
DEEEIATTNPVATESWGSTVSCTNLSGRGNQS

SEQ ID NO: 64527 - protein, 31 aa, Artificial Sequence
  Description of Artificial Sequence: Synthetic polypeptide
DEAEICTTNPVAYEQYGSVSTNDSDPPGGNR

SEQ ID NO: 64528 - protein, 34 aa, Artificial Sequence
  Description of Artificial Sequence: Synthetic polypeptide
AEEEIRTTNPVATEQYGSVSTTQNLQSGTTENSE

SEQ ID NO: 64529 - protein, 31 aa, Artificial Sequence
  Description of Artificial Sequence: Synthetic polypeptide
DEEEIACTNPVATEPYGSVATNLQATADNRN

SEQ ID NO: 64530 - protein, 30 aa, Artificial Sequence
  Description of Artificial Sequence: Synthetic polypeptide
DEEEIACTNPVATECYGVVSTNLQDGGDLI

SEQ ID NO: 64531 - protein, 33 aa, Artificial Sequence
  Description of Artificial Sequence: Synthetic polypeptide
AEEEIRTTNPVATEQYGSVSTTQNNQQTGNNNE

SEQ ID NO: 64532 - protein, 32 aa, Artificial Sequence
  Description of Artificial Sequence: Synthetic polypeptide
DEEEIATTNPVATESWGSVSTNLNRGEDDNGS

SEQ ID NO: 64533 - protein, 34 aa, Artificial Sequence
  Description of Artificial Sequence: Synthetic polypeptide
DEEEIRSTNPVATEQYGSVISCLPNMLSQHSGNR

SEQ ID NO: 64534 - protein, 29 aa, Artificial Sequence
  Description of Artificial Sequence: Synthetic peptide
DEEEIATTNPVATESYGCIATANDQRDNF

SEQ ID NO: 64535 - protein, 29 aa, Artificial Sequence
  Description of Artificial Sequence: Synthetic peptide
DEEEIATTNPVATESYGCIATNDQRDNDP

SEQ ID NO: 64536 - protein, 34 aa, Artificial Sequence
  Description of Artificial Sequence: Synthetic polypeptide
DEEEIATTNPVATESYGISVVSGNGLQDRIGNRA

SEQ ID NO: 64537 - protein, 33 aa, Artificial Sequence
  Description of Artificial Sequence: Synthetic polypeptide
DEEEIATTNPVATESYGSTVSCTNAVSQRGNQS

SEQ ID NO: 64538 - protein, 34 aa, Artificial Sequence
  Description of Artificial Sequence: Synthetic polypeptide
DEEEIATTNPVATESYGSTVSCTNLSQRGTNQSH

SEQ ID NO: 64539 - protein, 32 aa, Artificial Sequence
  Description of Artificial Sequence: Synthetic polypeptide
DEEEIACTNPVATEPYGSVAATNLTTRGGNER

SEQ ID NO: 64540 - protein, 28 aa, Artificial Sequence
  Description of Artificial Sequence: Synthetic peptide
AENEIVCTNPVATEQYGVASENLQRGGV

SEQ ID NO: 64541 - protein, 28 aa, Artificial Sequence
  Description of Artificial Sequence: Synthetic peptide
AENEISCTNPVATEQYGEALENLQRGGR

SEQ ID NO: 64542 - protein, 32 aa, Artificial Sequence
  Description of Artificial Sequence: Synthetic polypeptide
DEEEIATTNPVATEQYGVVSTNLNGDAGNGAT

SEQ ID NO: 64543 - protein, 33 aa, Artificial Sequence
  Description of Artificial Sequence: Synthetic polypeptide
DEEEIRSTNPVATEQYGSVSTLVDLVNRGVNEG

SEQ ID NO: 64544 - protein, 32 aa, Artificial Sequence
  Description of Artificial Sequence: Synthetic polypeptide
AEEEIRTTNPVATEQYGSVSVENNLQNDEINA

SEQ ID NO: 64545 - protein, 32 aa, Artificial Sequence
  Description of Artificial Sequence: Synthetic polypeptide
DEDEIRTTNPVATEQWGAVSTNLQGDTGGNNV

SEQ ID NO: 64546 - protein, 32 aa, Artificial Sequence
  Description of Artificial Sequence: Synthetic polypeptide
DEEEIATTNPVATEQYGTPSTGNPLQAGEENN

SEQ ID NO: 64547 - protein, 33 aa, Artificial Sequence
  Description of Artificial Sequence: Synthetic polypeptide
DEEEIATTNPVATEQYGTPSTGNPLQARGENDS

SEQ ID NO: 64548 - protein, 34 aa, Artificial Sequence
  Description of Artificial Sequence: Synthetic polypeptide
DEEEIRSTNPVATEQYGSVSSTTPAIQMRNGNPR

SEQ ID NO: 64549 - protein, 32 aa, Artificial Sequence
  Description of Artificial Sequence: Synthetic polypeptide
AEEEIRTTNPVATEQYGSVSTTQLQQISTNNE

SEQ ID NO: 64550 - protein, 31 aa, Artificial Sequence
  Description of Artificial Sequence: Synthetic polypeptide
AEEEIRTTNPVATEQYGSVSTTQLQQQTEGG

SEQ ID NO: 64551 - protein, 31 aa, Artificial Sequence
  Description of Artificial Sequence: Synthetic polypeptide
AEEEIRTTNPVATEQYGSVSTTQLQQTTIGG

SEQ ID NO: 64552 - protein, 28 aa, Artificial Sequence
  Description of Artificial Sequence: Synthetic peptide
AENEISCTNPVATEQYGEASENLQGGGR

SEQ ID NO: 64553 - protein, 32 aa, Artificial Sequence
  Description of Artificial Sequence: Synthetic polypeptide
AEEEIRTTNPVATEQYGVVSTTNSNQTGGNQE

SEQ ID NO: 64554 - protein, 32 aa, Artificial Sequence
  Description of Artificial Sequence: Synthetic polypeptide
AEEEIRTTNPVATEQYGSVSTTQNDNQQQENT

SEQ ID NO: 64555 - protein, 30 aa, Artificial Sequence
  Description of Artificial Sequence: Synthetic polypeptide
DEAEIATTNPVATEQYGCVAATNLATGNEN

SEQ ID NO: 64556 - protein, 30 aa, Artificial Sequence
  Description of Artificial Sequence: Synthetic polypeptide
DEEEIATTNPVATEQYGTVSANNDRENPEN

SEQ ID NO: 64557 - protein, 30 aa, Artificial Sequence
  Description of Artificial Sequence: Synthetic polypeptide
DEEEIATTNPVATEQYGTVSTNLVHDDTDQ

SEQ ID NO: 64558 - protein, 32 aa, Artificial Sequence
  Description of Artificial Sequence: Synthetic polypeptide
AEEEIRTTNPVATEQYGSVSVENNLGQNQNNT

SEQ ID NO: 64559 - protein, 29 aa, Artificial Sequence
  Description of Artificial Sequence: Synthetic peptide
AENEISCTNPVATEQYGEASENLQMRGGR

SEQ ID NO: 64560 - protein, 32 aa, Artificial Sequence
  Description of Artificial Sequence: Synthetic polypeptide
AEEEIRTTNPVATEQYGSVSTTQNLQDEDEEV

SEQ ID NO: 64561 - protein, 33 aa, Artificial Sequence
  Description of Artificial Sequence: Synthetic polypeptide
AEEEIRTTNPVATEQYGSVSTTQNLQNNNNNAD

SEQ ID NO: 64562 - protein, 33 aa, Artificial Sequence
  Description of Artificial Sequence: Synthetic polypeptide
DDEEIRTTNPVATEQYGCVCSTENLQFFGSNQF

SEQ ID NO: 64563 - protein, 33 aa, Artificial Sequence
  Description of Artificial Sequence: Synthetic polypeptide
DEEEIRSTNPVATEQYGSVSSTDLQQGEGGNIT

SEQ ID NO: 64564 - protein, 28 aa, Artificial Sequence
  Description of Artificial Sequence: Synthetic peptide
AENEIVTTNPVATEQYGEASENPQFGGR

SEQ ID NO: 64565 - protein, 32 aa, Artificial Sequence
  Description of Artificial Sequence: Synthetic polypeptide
DEEEIRSTNPVATEQYGSVSTTPAGNMRVGNV

SEQ ID NO: 64566 - protein, 32 aa, Artificial Sequence
  Description of Artificial Sequence: Synthetic polypeptide
AEEEIRATNPCATEQYGSVSTENALLQIGTNV

SEQ ID NO: 64567 - protein, 28 aa, Artificial Sequence
  Description of Artificial Sequence: Synthetic peptide
AENHIACTNPVATEQYGETSENLQRGGR

SEQ ID NO: 64568 - protein, 31 aa, Artificial Sequence
  Description of Artificial Sequence: Synthetic polypeptide
DEEEIATTNPVATEQYGSVSTDLEDHEGEDL

SEQ ID NO: 64569 - protein, 28 aa, Artificial Sequence
  Description of Artificial Sequence: Synthetic peptide
AENHIACTNPVATEQYGEASENLQRGGR

SEQ ID NO: 64570 - protein, 32 aa, Artificial Sequence
  Description of Artificial Sequence: Synthetic polypeptide
DEEEIATTNPVATEQYGSVSTDNHGNTGNVNV

SEQ ID NO: 64571 - protein, 28 aa, Artificial Sequence
  Description of Artificial Sequence: Synthetic peptide
AENGIACTNPVATEQYGEASENLQRGGR

SEQ ID NO: 64572 - protein, 33 aa, Artificial Sequence
  Description of Artificial Sequence: Synthetic polypeptide
AEEEIRTTNPVATEQYGSVSTTNTNQQAGNQED

SEQ ID NO: 64573 - protein, 31 aa, Artificial Sequence
  Description of Artificial Sequence: Synthetic polypeptide
DEAEICTTNPVATEQYGTVSTNLGGNDGMDR

SEQ ID NO: 64574 - protein, 31 aa, Artificial Sequence
  Description of Artificial Sequence: Synthetic polypeptide
AEEEIRATNPCATEQYGSVSTENNLMTGENM

SEQ ID NO: 64575 - protein, 31 aa, Artificial Sequence
  Description of Artificial Sequence: Synthetic polypeptide
AEEEIRATNPCATEQYGSVSTENNLMSGNGM

SEQ ID NO: 64576 - protein, 28 aa, Artificial Sequence
  Description of Artificial Sequence: Synthetic peptide
AENHIAPTNPVATEQYGEASENLQRGGR

SEQ ID NO: 64577 - protein, 32 aa, Artificial Sequence
  Description of Artificial Sequence: Synthetic polypeptide
DEAEIATTNPVATEQYGEVSTNLQGDAGNNDM

SEQ ID NO: 64578 - protein, 28 aa, Artificial Sequence
  Description of Artificial Sequence: Synthetic peptide
AENGIACTNPVATEQYGCASENLQRGGR

SEQ ID NO: 64579 - protein, 33 aa, Artificial Sequence
  Description of Artificial Sequence: Synthetic polypeptide
AEEEIRTTNPVATEQYGSVSTTNTQNQQGNEEV

SEQ ID NO: 64580 - protein, 31 aa, Artificial Sequence
  Description of Artificial Sequence: Synthetic polypeptide
AEEEIRATNPCATEQYGSVSTENNLMGTGNM

SEQ ID NO: 64581 - protein, 31 aa, Artificial Sequence
  Description of Artificial Sequence: Synthetic polypeptide
AEEEIRATNPCATEQYGSVSTENNLMESGNM

SEQ ID NO: 64582 - protein, 32 aa, Artificial Sequence
  Description of Artificial Sequence: Synthetic polypeptide
AEEEIRTTNPVATEQYGSVSTTNTTNLGNEED

SEQ ID NO: 64583 - protein, 28 aa, Artificial Sequence
  Description of Artificial Sequence: Synthetic peptide
AENEVASTNPVATEQYGEASENLQRGGR

SEQ ID NO: 64584 - protein, 31 aa, Artificial Sequence
  Description of Artificial Sequence: Synthetic polypeptide
DEEEIATTNPVATEQYGSVSTGPPQDNQNGM

SEQ ID NO: 64585 - protein, 33 aa, Artificial Sequence
  Description of Artificial Sequence: Synthetic polypeptide
DEEEIRSTNPVATERYGSTVASTNLSTRGGNND

SEQ ID NO: 64586 - protein, 32 aa, Artificial Sequence
  Description of Artificial Sequence: Synthetic polypeptide
AEEEIRATNPCATEQYGSVSTENLTQQGENVE

SEQ ID NO: 64587 - protein, 32 aa, Artificial Sequence
  Description of Artificial Sequence: Synthetic polypeptide
AEEEIRATNPCATEQYGSVSTENNLMQIGTNE

SEQ ID NO: 64588 - protein, 32 aa, Artificial Sequence
  Description of Artificial Sequence: Synthetic polypeptide
DEAEIATTNPVATEQYGCVSTNLQERGDEEQA

SEQ ID NO: 64589 - protein, 33 aa, Artificial Sequence
  Description of Artificial Sequence: Synthetic polypeptide
AEEEIRTTNPVATEQYGSVSTTNTNQLQVNNNM

SEQ ID NO: 64590 - protein, 30 aa, Artificial Sequence
  Description of Artificial Sequence: Synthetic polypeptide
DEEEIACTNPVATEQYGCVATNLQADNDGE

SEQ ID NO: 64591 - protein, 28 aa, Artificial Sequence
  Description of Artificial Sequence: Synthetic peptide
AENKIACTNPVATEQYGVASENLQRGGR

SEQ ID NO: 64592 - protein, 28 aa, Artificial Sequence
  Description of Artificial Sequence: Synthetic peptide
AENKIACTNPVATEQYGHASENLQRGGR

SEQ ID NO: 64593 - protein, 29 aa, Artificial Sequence
  Description of Artificial Sequence: Synthetic peptide
DEEEIACTNPVATEQYGCVATNLQDSDDG

SEQ ID NO: 64594 - protein, 32 aa, Artificial Sequence
  Description of Artificial Sequence: Synthetic polypeptide
DEAEICTTNPVATEQYGSVSTTNGQNQGDERD

SEQ ID NO: 64595 - protein, 28 aa, Artificial Sequence
  Description of Artificial Sequence: Synthetic peptide
AENKIACTNPVATEQYGEASSNLQRGGR

SEQ ID NO: 64596 - protein, 28 aa, Artificial Sequence
  Description of Artificial Sequence: Synthetic peptide
AENKIACTNPVATEQYGEASENLQRGGR

SEQ ID NO: 64597 - protein, 32 aa, Artificial Sequence
  Description of Artificial Sequence: Synthetic polypeptide
DEAEICTTNPVATEQYGSVSTTNLGDNGMDMR

SEQ ID NO: 64598 - protein, 31 aa, Artificial Sequence
  Description of Artificial Sequence: Synthetic polypeptide
DEEEIACTNPVATEQYGCVATNLQDAGPNEM

SEQ ID NO: 64599 - protein, 34 aa, Artificial Sequence
  Description of Artificial Sequence: Synthetic polypeptide
DEEEIATTNPVATEQYGSVSSTTPNLPNMSGMNR

SEQ ID NO: 64600 - protein, 31 aa, Artificial Sequence
  Description of Artificial Sequence: Synthetic polypeptide
DEEEIATTNPVATEQYGSVSTAGPNMSGMNV

SEQ ID NO: 64601 - protein, 32 aa, Artificial Sequence
  Description of Artificial Sequence: Synthetic polypeptide
DEAEICTTNPVATEQYGSVSTTNLGGNDDDER

SEQ ID NO: 64602 - protein, 33 aa, Artificial Sequence
  Description of Artificial Sequence: Synthetic polypeptide
DEAEICTTNPVATEQYGSVSTTNLQDNDHGDER

SEQ ID NO: 64603 - protein, 31 aa, Artificial Sequence
  Description of Artificial Sequence: Synthetic polypeptide
AEEEIRATNPCATEQYGSVSTETNLMQGNDT

SEQ ID NO: 64604 - protein, 31 aa, Artificial Sequence
  Description of Artificial Sequence: Synthetic polypeptide
DEEEIACTNPVATEQYGCVATNLQAEPGNEN

SEQ ID NO: 64605 - protein, 30 aa, Artificial Sequence
  Description of Artificial Sequence: Synthetic polypeptide
DEEEIACTNPVATEQYGCVATNLQAEDQNE

SEQ ID NO: 64606 - protein, 34 aa, Artificial Sequence
  Description of Artificial Sequence: Synthetic polypeptide
AEEEIRTTNPVATEQYGSVSTTNTNLQYGNNNDN

SEQ ID NO: 64607 - protein, 28 aa, Artificial Sequence
  Description of Artificial Sequence: Synthetic peptide
AENIIACTNPVATEQYGEASENLQRGGR

SEQ ID NO: 64608 - protein, 33 aa, Artificial Sequence
  Description of Artificial Sequence: Synthetic polypeptide
DEAEISTTNPVATEQYGCVCSTEELQRFGSNRA

SEQ ID NO: 64609 - protein, 31 aa, Artificial Sequence
  Description of Artificial Sequence: Synthetic polypeptide
DEAEICTTNPVATEQYGSVTTNLQGNDDNNM

SEQ ID NO: 64610 - protein, 32 aa, Artificial Sequence
  Description of Artificial Sequence: Synthetic polypeptide
AEEEIRTTNPVATEQYGSVSVNNEQYGTNNEG

SEQ ID NO: 64611 - protein, 33 aa, Artificial Sequence
  Description of Artificial Sequence: Synthetic polypeptide
DEAEICTTNPVATEQYGSVSTTNLGQNDNDDER

SEQ ID NO: 64612 - protein, 33 aa, Artificial Sequence
  Description of Artificial Sequence: Synthetic polypeptide
DEEEIATTNPVATESYGSTVSCTNLSQRVNQSW

SEQ ID NO: 64613 - protein, 33 aa, Artificial Sequence
  Description of Artificial Sequence: Synthetic polypeptide
DEEEIATTNPVATEQYGSVSTMNLNEIASTNGR

SEQ ID NO: 64614 - protein, 29 aa, Artificial Sequence
  Description of Artificial Sequence: Synthetic peptide
AENEVACTNPVATEQYGEVSNNLQRVGQR

SEQ ID NO: 64615 - protein, 28 aa, Artificial Sequence
  Description of Artificial Sequence: Synthetic peptide
DEEEIRSTNPVATEQYGVVSDIEMAENQ

SEQ ID NO: 64616 - protein, 28 aa, Artificial Sequence
  Description of Artificial Sequence: Synthetic peptide
DEEEIRSTNPVATEQYGVVSDIEMAENA

SEQ ID NO: 64617 - protein, 32 aa, Artificial Sequence
  Description of Artificial Sequence: Synthetic polypeptide
AEEEIRATNPCATEQYGSVSTENLLMQTGTNM

SEQ ID NO: 64618 - protein, 32 aa, Artificial Sequence
  Description of Artificial Sequence: Synthetic polypeptide
AEEEIRATNPCATEQYGSVSTENLLMQQGDNV

SEQ ID NO: 64619 - protein, 32 aa, Artificial Sequence
  Description of Artificial Sequence: Synthetic polypeptide
AEEEIRTTNPVATEQYGSVSTTQLAGTQIGTG

SEQ ID NO: 64620 - protein, 29 aa, Artificial Sequence
  Description of Artificial Sequence: Synthetic peptide
DEEEIATTNPVATEQYGSVSTVCEDHEEK

SEQ ID NO: 64621 - protein, 30 aa, Artificial Sequence
  Description of Artificial Sequence: Synthetic polypeptide
DEAEIATTNPVATEQYGCVATNLTDGINND

SEQ ID NO: 64622 - protein, 31 aa, Artificial Sequence
  Description of Artificial Sequence: Synthetic polypeptide
DEAEIATTNPVATEQYGCVATNLQTGAGNDN

SEQ ID NO: 64623 - protein, 30 aa, Artificial Sequence
  Description of Artificial Sequence: Synthetic polypeptide
DEAEIATTNPVATEQYGCVATNLQGAGTDN

SEQ ID NO: 64624 - protein, 31 aa, Artificial Sequence
  Description of Artificial Sequence: Synthetic polypeptide
AENEIVTTNPVATEQYGEVCSEDGLVQRGNR

SEQ ID NO: 64625 - protein, 32 aa, Artificial Sequence
  Description of Artificial Sequence: Synthetic polypeptide
AEEEIRATNPCATEQYGSVSTENLGNQQGNVE

SEQ ID NO: 64626 - protein, 32 aa, Artificial Sequence
  Description of Artificial Sequence: Synthetic polypeptide
DEAEIATTNPVATEQYGCVATNLQERGGDNQA

SEQ ID NO: 64627 - protein, 32 aa, Artificial Sequence
  Description of Artificial Sequence: Synthetic polypeptide
AEEEIRATNPCATEQYGSVSTENLAQLGGNEM

SEQ ID NO: 64628 - protein, 35 aa, Artificial Sequence
  Description of Artificial Sequence: Synthetic polypeptide
DEEEIATTNPVATEQYGSVSVTGNPLDDQGGNGRE

SEQ ID NO: 64629 - protein, 29 aa, Artificial Sequence
  Description of Artificial Sequence: Synthetic peptide
AENEIVTTNPVATEQYGEASTGPVQRGGR

SEQ ID NO: 64630 - protein, 33 aa, Artificial Sequence
  Description of Artificial Sequence: Synthetic polypeptide
DEEEIATTNPVATEQYGSVSVTNEDQNRTNGWQ

SEQ ID NO: 64631 - protein, 30 aa, Artificial Sequence
  Description of Artificial Sequence: Synthetic polypeptide
AENEIVTTNPVATEQYGEASTDGPVQRGNR

SEQ ID NO: 64632 - protein, 33 aa, Artificial Sequence
  Description of Artificial Sequence: Synthetic polypeptide
DEEEIATTNPVATEQYGSVSWTEDLEQERQGEK

SEQ ID NO: 64633 - protein, 32 aa, Artificial Sequence
  Description of Artificial Sequence: Synthetic polypeptide
DEEEIATTNPVATEQYGSVSWTEQHQERMGDS

SEQ ID NO: 64634 - protein, 33 aa, Artificial Sequence
  Description of Artificial Sequence: Synthetic polypeptide
DEEEIATTNPVATEQYGSVSWTNDTEQERGGEK

SEQ ID NO: 64635 - protein, 30 aa, Artificial Sequence
  Description of Artificial Sequence: Synthetic polypeptide
DEAEIATTNPVATEQYGCVATNLQGAGGEG

SEQ ID NO: 64636 - protein, 32 aa, Artificial Sequence
  Description of Artificial Sequence: Synthetic polypeptide
DEEEIATTNPVATEQYGSVSTNNEHGNTGNNS

SEQ ID NO: 64637 - protein, 32 aa, Artificial Sequence
  Description of Artificial Sequence: Synthetic polypeptide
DEEEIATTNPVATEQYGSVSTTNPDGMDGSER

SEQ ID NO: 64638 - protein, 31 aa, Artificial Sequence
  Description of Artificial Sequence: Synthetic polypeptide
DEAEICTTNPVAVEQYGSVSTTNLEGQGTNG

SEQ ID NO: 64639 - protein, 31 aa, Artificial Sequence
  Description of Artificial Sequence: Synthetic polypeptide
AEEEIRATNPCATEQYGSVSTENLNMTGGNM

SEQ ID NO: 64640 - protein, 31 aa, Artificial Sequence
  Description of Artificial Sequence: Synthetic polypeptide
AEEEIRATNPCATEQYGSVSTENLMTGGNDM

SEQ ID NO: 64641 - protein, 32 aa, Artificial Sequence
  Description of Artificial Sequence: Synthetic polypeptide
AEEEIRATNPCATEQYGSVSTENLMQSGTNQM

SEQ ID NO: 64642 - protein, 32 aa, Artificial Sequence
  Description of Artificial Sequence: Synthetic polypeptide
AEEEIRATNPCATEQYGSVSTENLMQQGSNVD

SEQ ID NO: 64643 - protein, 32 aa, Artificial Sequence
  Description of Artificial Sequence: Synthetic polypeptide
AEEEIRATNPCATEQYGSVSTENLMQQGENGV

SEQ ID NO: 64644 - protein, 32 aa, Artificial Sequence
  Description of Artificial Sequence: Synthetic polypeptide
DEAEICTTNPVATEVYGSVSTNLNQGDAGNEN

SEQ ID NO: 64645 - protein, 32 aa, Artificial Sequence
  Description of Artificial Sequence: Synthetic polypeptide
DEAEICTTNPVATEVYGSVSTNLQGDPGNGEN

SEQ ID NO: 64646 - protein, 28 aa, Artificial Sequence
  Description of Artificial Sequence: Synthetic peptide
AENEVACTNPVATEQYGEASNNLQRGGR

SEQ ID NO: 64647 - protein, 28 aa, Artificial Sequence
  Description of Artificial Sequence: Synthetic peptide
AENEVACTNPVATEQYGEASENLQRGGR

SEQ ID NO: 64648 - protein, 33 aa, Artificial Sequence
  Description of Artificial Sequence: Synthetic polypeptide
DEEEIATTNPVATEQYGSVSTTNNQQGNTENDN

SEQ ID NO: 64649 - protein, 31 aa, Artificial Sequence
  Description of Artificial Sequence: Synthetic polypeptide
AEEEIRATNPCATEQYGSVSTENLMGSNGNM

SEQ ID NO: 64650 - protein, 31 aa, Artificial Sequence
  Description of Artificial Sequence: Synthetic polypeptide
AEEEIRATNPCATEQYGSVSTENLMELGNMG

SEQ ID NO: 64651 - protein, 28 aa, Artificial Sequence
  Description of Artificial Sequence: Synthetic peptide
AENELACTNPVATEQYGEASENLQRGGR

SEQ ID NO: 64652 - protein, 33 aa, Artificial Sequence
  Description of Artificial Sequence: Synthetic polypeptide
AEEEIRTTNPVATEQYGSVSTTNVNQNTGGNTE

SEQ ID NO: 64653 - protein, 32 aa, Artificial Sequence
  Description of Artificial Sequence: Synthetic polypeptide
DEEEIATTNPVATEQYGSVSTTDLNDREGEPL

SEQ ID NO: 64654 - protein, 32 aa, Artificial Sequence
  Description of Artificial Sequence: Synthetic polypeptide
DEEEIATTNPVATEQYGSVSTTDLNDRNGEPV

SEQ ID NO: 64655 - protein, 33 aa, Artificial Sequence
  Description of Artificial Sequence: Synthetic polypeptide
DEEEIATTNPVATEQYGSVSTTDLNDRNGMNPV

SEQ ID NO: 64656 - protein, 33 aa, Artificial Sequence
  Description of Artificial Sequence: Synthetic polypeptide
DEEEIATTNPVATEQYGSVSTTNLGGQDAGDAV

SEQ ID NO: 64657 - protein, 31 aa, Artificial Sequence
  Description of Artificial Sequence: Synthetic polypeptide
AEEEIRATNPCATEQYGSVSTENLMAGNNEN

SEQ ID NO: 64658 - protein, 32 aa, Artificial Sequence
  Description of Artificial Sequence: Synthetic polypeptide
DEAEICTTNPVAVEQYGSVSTSTNLEQGTGNG

SEQ ID NO: 64659 - protein, 31 aa, Artificial Sequence
  Description of Artificial Sequence: Synthetic polypeptide
AEEEIRATNPCATEQYGSVSTENLMEMGENM

SEQ ID NO: 64660 - protein, 33 aa, Artificial Sequence
  Description of Artificial Sequence: Synthetic polypeptide
DEEEIATTNPVATESYGSTVSTNSLSTRGGNQS

SEQ ID NO: 64661 - protein, 33 aa, Artificial Sequence
  Description of Artificial Sequence: Synthetic polypeptide
DDEEIRTTNPVATEQYGCVCSTGELQRFGSNVD

SEQ ID NO: 64662 - protein, 30 aa, Artificial Sequence
  Description of Artificial Sequence: Synthetic polypeptide
DEEEIATTNPVATETWGEVSTNAQGGGDNH

SEQ ID NO: 64663 - protein, 31 aa, Artificial Sequence
  Description of Artificial Sequence: Synthetic polypeptide
DEDEIRTTNPVATEQYGCVSTPNLQMLEDEI

SEQ ID NO: 64664 - protein, 30 aa, Artificial Sequence
  Description of Artificial Sequence: Synthetic polypeptide
DEAEIATTNPVATEQWGSVATNLEPHGNEQ

SEQ ID NO: 64665 - protein, 29 aa, Artificial Sequence
  Description of Artificial Sequence: Synthetic peptide
DEECNATTNPIAYEQWGEVSTNLQGGENR

SEQ ID NO: 64666 - protein, 31 aa, Artificial Sequence
  Description of Artificial Sequence: Synthetic polypeptide
DEEEIATTNPVAYEHDGSVPFTNSSQRGNNR

SEQ ID NO: 64667 - protein, 33 aa, Artificial Sequence
  Description of Artificial Sequence: Synthetic polypeptide
DEDEIRTTNPVATEQYGDVSTNNNGDQRNGGNG

SEQ ID NO: 64668 - protein, 33 aa, Artificial Sequence
  Description of Artificial Sequence: Synthetic polypeptide
DDEEIRTTNPVATEQYGSVCSTENLQNFGSEVA

SEQ ID NO: 64669 - protein, 33 aa, Artificial Sequence
  Description of Artificial Sequence: Synthetic polypeptide
DDEEIRTTNPVATEQYGSVCSTGELQNFGSNIM

SEQ ID NO: 64670 - protein, 33 aa, Artificial Sequence
  Description of Artificial Sequence: Synthetic polypeptide
DDEEIRTTNPVATEQYGSVCSTMEHQRFGSNQD

SEQ ID NO: 64671 - protein, 31 aa, Artificial Sequence
  Description of Artificial Sequence: Synthetic polypeptide
DEAEIATTNPVATEQWGNVATNLQGGDNTRQ

SEQ ID NO: 64672 - protein, 31 aa, Artificial Sequence
  Description of Artificial Sequence: Synthetic polypeptide
DEAEIATTNPVATEQWGSVATNLQRDDNLEH

SEQ ID NO: 64673 - protein, 28 aa, Artificial Sequence
  Description of Artificial Sequence: Synthetic peptide
AEEEIATTNPVATESYGCTANNLQDGNQ

SEQ ID NO: 64674 - protein, 29 aa, Artificial Sequence
  Description of Artificial Sequence: Synthetic peptide
DEDEIRTTNPVATEQYGEIVTNGQGGDGG

SEQ ID NO: 64675 - protein, 32 aa, Artificial Sequence
  Description of Artificial Sequence: Synthetic polypeptide
DEAEIKTTNPVATEPYGSTVNCTNLSQRPGNS

SEQ ID NO: 64676 - protein, 28 aa, Artificial Sequence
  Description of Artificial Sequence: Synthetic peptide
AEEEIATTNPVATESYGCIAQNDQEGNR

SEQ ID NO: 64677 - protein, 31 aa, Artificial Sequence
  Description of Artificial Sequence: Synthetic polypeptide
DEDEIRTTNPVATEQYGELSTNDLQEGEDSF

SEQ ID NO: 64678 - protein, 28 aa, Artificial Sequence
  Description of Artificial Sequence: Synthetic peptide
AEEEIATTNPVATESYGCIANNLQVDNR

SEQ ID NO: 64679 - protein, 30 aa, Artificial Sequence
  Description of Artificial Sequence: Synthetic polypeptide
DEDEIRTTNPVATEQYGELSTNNQMGDESI

SEQ ID NO: 64680 - protein, 30 aa, Artificial Sequence
  Description of Artificial Sequence: Synthetic polypeptide
DEDEIRTTNPVATEQYGELTTEDLQRGDSQ

SEQ ID NO: 64681 - protein, 31 aa, Artificial Sequence
  Description of Artificial Sequence: Synthetic polypeptide
DEAEIATTNPVATEQWGAVSTNLQGNGDPRN

SEQ ID NO: 64682 - protein, 32 aa, Artificial Sequence
  Description of Artificial Sequence: Synthetic polypeptide
DEDEIRTTNPVATEQYGETSCTNLSQEGGDNS

SEQ ID NO: 64683 - protein, 29 aa, Artificial Sequence
  Description of Artificial Sequence: Synthetic peptide
DEDEIRTTNPVATEQYGECSTNMQETEDS

SEQ ID NO: 64684 - protein, 31 aa, Artificial Sequence
  Description of Artificial Sequence: Synthetic polypeptide
DEDEIRTTNPVATEQYGETSTNLQGNGDDGS

SEQ ID NO: 64685 - protein, 32 aa, Artificial Sequence
  Description of Artificial Sequence: Synthetic polypeptide
DEAEIATTNPVATEQWGSVNTNELSQRPGGNS

SEQ ID NO: 64686 - protein, 31 aa, Artificial Sequence
  Description of Artificial Sequence: Synthetic polypeptide
AEEEIATTNPVAYEQWGSVSTNLQGDAGNEE

SEQ ID NO: 64687 - protein, 31 aa, Artificial Sequence
  Description of Artificial Sequence: Synthetic polypeptide
DEDEIRTTNPVATEQYGCTSTNDLQHFGSDQ

SEQ ID NO: 64688 - protein, 32 aa, Artificial Sequence
  Description of Artificial Sequence: Synthetic polypeptide
AEEEICTTNPVATEQYGTVSVTNMNLQGGNNA

SEQ ID NO: 64689 - protein, 32 aa, Artificial Sequence
  Description of Artificial Sequence: Synthetic polypeptide
AEEEICTTNPVATEQYGNVSVTTNLQGGNNTA

SEQ ID NO: 64690 - protein, 30 aa, Artificial Sequence
  Description of Artificial Sequence: Synthetic polypeptide
DEDEIRTTNPVATEQYGCTSTNHQHGSDQG

SEQ ID NO: 64691 - protein, 30 aa, Artificial Sequence
  Description of Artificial Sequence: Synthetic polypeptide
DEDEIRTTNPVATEQYGCVAANGLQMPNDN

SEQ ID NO: 64692 - protein, 32 aa, Artificial Sequence
  Description of Artificial Sequence: Synthetic polypeptide
AEEEICTTNPVATEQYGNVSVTTNLQAGNVAT

SEQ ID NO: 64693 - protein, 29 aa, Artificial Sequence
  Description of Artificial Sequence: Synthetic peptide
DEAEIGTTNPVCTEGYGSVSMPDLQRGQL

SEQ ID NO: 64694 - protein, 30 aa, Artificial Sequence
  Description of Artificial Sequence: Synthetic polypeptide
AEEEICTTNPVATEQYGNVSVTTDEQGGNA

SEQ ID NO: 64695 - protein, 30 aa, Artificial Sequence
  Description of Artificial Sequence: Synthetic polypeptide
DEDEIRTTNPVATEQYGCVATHLQDTPNED

SEQ ID NO: 64696 - protein, 30 aa, Artificial Sequence
  Description of Artificial Sequence: Synthetic polypeptide
DEECNATTNPIAYEQYGEVSTGNDQRGNER

SEQ ID NO: 64697 - protein, 32 aa, Artificial Sequence
  Description of Artificial Sequence: Synthetic polypeptide
DEDEIRTTNPVATEQYGCVATNLQDRNPEGDI

SEQ ID NO: 64698 - protein, 30 aa, Artificial Sequence
  Description of Artificial Sequence: Synthetic polypeptide
AEEEIATTNPVAYEQYGSVSTGGDQHGNHP

SEQ ID NO: 64699 - protein, 30 aa, Artificial Sequence
  Description of Artificial Sequence: Synthetic polypeptide
AEEEIATTNPVAYEQYGSVATNLQDGPTDQ

SEQ ID NO: 64700 - protein, 31 aa, Artificial Sequence
  Description of Artificial Sequence: Synthetic polypeptide
DEDEIRTTNPVATEQYGCVATNLVQDGDTEA

SEQ ID NO: 64701 - protein, 33 aa, Artificial Sequence
  Description of Artificial Sequence: Synthetic polypeptide
AEEEIRTTNPVATEQYGSVSTTSTQLQGTIGNG

SEQ ID NO: 64702 - protein, 29 aa, Artificial Sequence
  Description of Artificial Sequence: Synthetic peptide
DEECSRTTNPIAYEQYGEVTSTNLLRGDT

SEQ ID NO: 64703 - protein, 32 aa, Artificial Sequence
  Description of Artificial Sequence: Synthetic polypeptide
DEEEIATTNPVAYEEYGSTVSWNELSQQGGNR

SEQ ID NO: 64704 - protein, 30 aa, Artificial Sequence
  Description of Artificial Sequence: Synthetic polypeptide
DEECSRTTNPIAYEQYGEVSTNNLDRIGNQ

SEQ ID NO: 64705 - protein, 30 aa, Artificial Sequence
  Description of Artificial Sequence: Synthetic polypeptide
DEECSRTTNPIAYEGYGEVSTNLDERGNRD

SEQ ID NO: 64706 - protein, 29 aa, Artificial Sequence
  Description of Artificial Sequence: Synthetic peptide
DEECSATTNPIAYEQYGEVATNLQRGNDV

SEQ ID NO: 64707 - protein, 28 aa, Artificial Sequence
  Description of Artificial Sequence: Synthetic peptide
AEEEICSVNPVCTEQYGVVSNNLQSGNQ

SEQ ID NO: 64708 - protein, 33 aa, Artificial Sequence
  Description of Artificial Sequence: Synthetic polypeptide
AEEEIRTTNPVATEQYGSVSTTSNQQNDEGNET

SEQ ID NO: 64709 - protein, 30 aa, Artificial Sequence
  Description of Artificial Sequence: Synthetic polypeptide
DEDEIRTTNPVATEQYGETSTSSEQRGDGS

SEQ ID NO: 64710 - protein, 31 aa, Artificial Sequence
  Description of Artificial Sequence: Synthetic polypeptide
DEAEIATTNPVATEQWGAVSTNLQGNAGEPR

SEQ ID NO: 64711 - protein, 31 aa, Artificial Sequence
  Description of Artificial Sequence: Synthetic polypeptide
DEDEIRTTNPVATEQYGEVTSTDNGQGGGDG

SEQ ID NO: 64712 - protein, 33 aa, Artificial Sequence
  Description of Artificial Sequence: Synthetic polypeptide
AEEEIRTTNPVATEQYGSVSTTTNLLQNENDEG

SEQ ID NO: 64713 - protein, 29 aa, Artificial Sequence
  Description of Artificial Sequence: Synthetic peptide
AENEIRCTNPVATEQYGSASENEQDRGGG

SEQ ID NO: 64714 - protein, 28 aa, Artificial Sequence
  Description of Artificial Sequence: Synthetic peptide
CENEIACTNPVATEQYGEASENPQRGGR

SEQ ID NO: 64715 - protein, 30 aa, Artificial Sequence
  Description of Artificial Sequence: Synthetic polypeptide
DEAEIRYTNPVATEQYGSVSVNQDLGSNSD

SEQ ID NO: 64716 - protein, 32 aa, Artificial Sequence
  Description of Artificial Sequence: Synthetic polypeptide
DEEEIATTNPVAYEPYGSTVSMNLSQRGGNQS

SEQ ID NO: 64717 - protein, 30 aa, Artificial Sequence
  Description of Artificial Sequence: Synthetic polypeptide
DEEEIATTNPVAYEPYGSVATNLQDDSNDD

SEQ ID NO: 64718 - protein, 32 aa, Artificial Sequence
  Description of Artificial Sequence: Synthetic polypeptide
DEEEIATTNPVAYEPYGSVSINLSQRGGNQSN

SEQ ID NO: 64719 - protein, 32 aa, Artificial Sequence
  Description of Artificial Sequence: Synthetic polypeptide
DEEEIATTNPVAYEPYGSVSTPLSQRGGNQMG

SEQ ID NO: 64720 - protein, 29 aa, Artificial Sequence
  Description of Artificial Sequence: Synthetic peptide
DDEEIRTTNPVATEQYGSVISAPVDVGVE

SEQ ID NO: 64721 - protein, 33 aa, Artificial Sequence
  Description of Artificial Sequence: Synthetic polypeptide
DEEEIRTTNPVATEAYGTVSVSTNLEQGTNNQF

SEQ ID NO: 64722 - protein, 33 aa, Artificial Sequence
  Description of Artificial Sequence: Synthetic polypeptide
DEEEIATTNPVAYEPYGSVVSTGNLSQRGGNQS

SEQ ID NO: 64723 - protein, 29 aa, Artificial Sequence
  Description of Artificial Sequence: Synthetic peptide
AENEIRCTNPVATEQYGEISENLQQRGGH

SEQ ID NO: 64724 - protein, 32 aa, Artificial Sequence
  Description of Artificial Sequence: Synthetic polypeptide
DEAEIRTTNSVAYDQYGSVSCTNLSQSVGDNR

SEQ ID NO: 64725 - protein, 29 aa, Artificial Sequence
  Description of Artificial Sequence: Synthetic peptide
AENEIRCTNPVATEQYGEISEDLQRNGGR

SEQ ID NO: 64726 - protein, 30 aa, Artificial Sequence
  Description of Artificial Sequence: Synthetic polypeptide
DEDEIRTTNPVATEQYGMTSTNGQGGGDED

SEQ ID NO: 64727 - protein, 29 aa, Artificial Sequence
  Description of Artificial Sequence: Synthetic peptide
AENEIRCTNPVATEQYGEASENEQDRGGR

SEQ ID NO: 64728 - protein, 28 aa, Artificial Sequence
  Description of Artificial Sequence: Synthetic peptide
AENEIRCTNPVATEQYGEASEILQRGGA

SEQ ID NO: 64729 - protein, 31 aa, Artificial Sequence
  Description of Artificial Sequence: Synthetic polypeptide
DEAEIRTTNSVAYDAYGSVSCTNLSQRVGDR

SEQ ID NO: 64730 - protein, 30 aa, Artificial Sequence
  Description of Artificial Sequence: Synthetic polypeptide
DEEEIRSTNPISTEQYGSVANNIQSRVGQR

SEQ ID NO: 64731 - protein, 29 aa, Artificial Sequence
  Description of Artificial Sequence: Synthetic peptide
AENEIRCTNPVATEQYGEVSEILQNRGGA

SEQ ID NO: 64732 - protein, 31 aa, Artificial Sequence
  Description of Artificial Sequence: Synthetic polypeptide
DEAEIATTNPVATEQWGAVSTNLQGNDGDTR

SEQ ID NO: 64733 - protein, 28 aa, Artificial Sequence
  Description of Artificial Sequence: Synthetic peptide
CENEIACTNPVATEQYGVASENLQRGGM

SEQ ID NO: 64734 - protein, 34 aa, Artificial Sequence
  Description of Artificial Sequence: Synthetic polypeptide
AEEEIRTTNPVATEQYGSVSTTTNLLQNEGTNGN

SEQ ID NO: 64735 - protein, 31 aa, Artificial Sequence
  Description of Artificial Sequence: Synthetic polypeptide
DEECLRTTNPTAYEQYGEVSTNLQGDTGDNR

SEQ ID NO: 64736 - protein, 33 aa, Artificial Sequence
  Description of Artificial Sequence: Synthetic polypeptide
DEAEINTTNPVATEQYGSTVNCTNLSQRPGGNQ

SEQ ID NO: 64737 - protein, 28 aa, Artificial Sequence
  Description of Artificial Sequence: Synthetic peptide
AENEIRCTNPVSTEPYGEASENLQRGGR

SEQ ID NO: 64738 - protein, 31 aa, Artificial Sequence
  Description of Artificial Sequence: Synthetic polypeptide
DEAEINTTNPVAYEQWGSVNTNLSQRPGGND

SEQ ID NO: 64739 - protein, 34 aa, Artificial Sequence
  Description of Artificial Sequence: Synthetic polypeptide
DDEEIRTTNPVATEQYGSVGSNGTNLQFNGGNDD

SEQ ID NO: 64740 - protein, 33 aa, Artificial Sequence
  Description of Artificial Sequence: Synthetic polypeptide
AENEIRCTNPVATEQYGSVSTNLPQMRNGMNPV

SEQ ID NO: 64741 - protein, 33 aa, Artificial Sequence
  Description of Artificial Sequence: Synthetic polypeptide
AEEEIRTTNPVATEQYGVVSVTNNLQGNLGINN

SEQ ID NO: 64742 - protein, 33 aa, Artificial Sequence
  Description of Artificial Sequence: Synthetic polypeptide
AENEIRCTNPVATEQYGSASTNLPQMRNGMNPR

SEQ ID NO: 64743 - protein, 30 aa, Artificial Sequence
  Description of Artificial Sequence: Synthetic polypeptide
DEECLRTTNPIAYEQYGCVSTNLQENGSNA

SEQ ID NO: 64744 - protein, 28 aa, Artificial Sequence
  Description of Artificial Sequence: Synthetic peptide
CENEIACTNPVATESYGEASENLQRGGR

SEQ ID NO: 64745 - protein, 33 aa, Artificial Sequence
  Description of Artificial Sequence: Synthetic polypeptide
DEDEIRTTNPVATEQYGETTSCTNALSQRGDNS

SEQ ID NO: 64746 - protein, 28 aa, Artificial Sequence
  Description of Artificial Sequence: Synthetic peptide
CENEIAGTNPVATEQYGEASENQQRGGR

SEQ ID NO: 64747 - protein, 31 aa, Artificial Sequence
  Description of Artificial Sequence: Synthetic polypeptide
DEECLRTTNPIAYEQYGCVSNTNLQRFGSNQ

SEQ ID NO: 64748 - protein, 30 aa, Artificial Sequence
  Description of Artificial Sequence: Synthetic polypeptide
DEECLRTTNPIAYEQYGCVCSTNLQRNSNQ

SEQ ID NO: 64749 - protein, 31 aa, Artificial Sequence
  Description of Artificial Sequence: Synthetic polypeptide
DEECLRTTNPIAYEQYGCVCSTNLQRFGSDR

SEQ ID NO: 64750 - protein, 32 aa, Artificial Sequence
  Description of Artificial Sequence: Synthetic polypeptide
AEEEIRTTNPVATEQYGVVSVTNSTNTIATNR

SEQ ID NO: 64751 - protein, 32 aa, Artificial Sequence
  Description of Artificial Sequence: Synthetic polypeptide
AEEEIRTTNPVATEQYGSVSTTTNLLQNEETG

SEQ ID NO: 64752 - protein, 28 aa, Artificial Sequence
  Description of Artificial Sequence: Synthetic peptide
DEAEISATNGCAYMPYGSVSTNLQRGDR

SEQ ID NO: 64753 - protein, 31 aa, Artificial Sequence
  Description of Artificial Sequence: Synthetic polypeptide
DEEEIATTNPVAYEPYGCVSTNLSQQGGGRD

SEQ ID NO: 64754 - protein, 33 aa, Artificial Sequence
  Description of Artificial Sequence: Synthetic polypeptide
DEDEIRTTNPVATEQYGEVTPSCTNALSQRGDS

SEQ ID NO: 64755 - protein, 32 aa, Artificial Sequence
  Description of Artificial Sequence: Synthetic polypeptide
AENEIRCTNPVATEQYGSASTNLPQMRGMGPR

SEQ ID NO: 64756 - protein, 32 aa, Artificial Sequence
  Description of Artificial Sequence: Synthetic polypeptide
AEEEIRTTNPVATEQYGSVSTTNTNLLGNEEE

SEQ ID NO: 64757 - protein, 32 aa, Artificial Sequence
  Description of Artificial Sequence: Synthetic polypeptide
AEEEICTTNPVATEQYGTVSVTNMNLQGNGNQ

SEQ ID NO: 64758 - protein, 32 aa, Artificial Sequence
  Description of Artificial Sequence: Synthetic polypeptide
AEEEIRTTNPVATEQYGVVSTVTNSNQDGGNS

SEQ ID NO: 64759 - protein, 32 aa, Artificial Sequence
  Description of Artificial Sequence: Synthetic polypeptide
AEEEIRTTNPVATEQYGVVSTVNENQNQGNNE

SEQ ID NO: 64760 - protein, 32 aa, Artificial Sequence
  Description of Artificial Sequence: Synthetic polypeptide
AEEEIRTTNPVATEQYGVVSTVNEQQNNQGNQ

SEQ ID NO: 64761 - protein, 28 aa, Artificial Sequence
  Description of Artificial Sequence: Synthetic peptide
AENEIRTTNPVATEQYGTASMDLQQGGH

SEQ ID NO: 64762 - protein, 33 aa, Artificial Sequence
  Description of Artificial Sequence: Synthetic polypeptide
AENEIRTTNPVATEQYGSVSSTTNLPNMRGMNV

SEQ ID NO: 64763 - protein, 32 aa, Artificial Sequence
  Description of Artificial Sequence: Synthetic polypeptide
AENEIRTTNPVATEQYGSVSSTPAGPNRGMNR

SEQ ID NO: 64764 - protein, 32 aa, Artificial Sequence
  Description of Artificial Sequence: Synthetic polypeptide
AENEIRTTNPVATEQYGSASSTTNLNMRGMNV

SEQ ID NO: 64765 - protein, 30 aa, Artificial Sequence
  Description of Artificial Sequence: Synthetic polypeptide
AENEIRTTNPVATEQYGEVSENLMNRAEGR

SEQ ID NO: 64766 - protein, 31 aa, Artificial Sequence
  Description of Artificial Sequence: Synthetic polypeptide
DDEEIRTTNPVATEQYGCVCSWNLQNFGSDQ

SEQ ID NO: 64767 - protein, 30 aa, Artificial Sequence
  Description of Artificial Sequence: Synthetic polypeptide
DEEEIACTNPIATEQYGSVSTDLMDHEGNL

SEQ ID NO: 64768 - protein, 32 aa, Artificial Sequence
  Description of Artificial Sequence: Synthetic polypeptide
AEEEIRTTNPVATEQYGSVSTTQQQLGIENGN

SEQ ID NO: 64769 - protein, 32 aa, Artificial Sequence
  Description of Artificial Sequence: Synthetic polypeptide
DEEEIAATNPVAYEQYGMVSCTNLSQGVGNNR

SEQ ID NO: 64770 - protein, 33 aa, Artificial Sequence
  Description of Artificial Sequence: Synthetic polypeptide
AEEEIRTTNPVATEQYGSVSTTSGNLQIQNNTT

SEQ ID NO: 64771 - protein, 33 aa, Artificial Sequence
  Description of Artificial Sequence: Synthetic polypeptide
AEEEIRTTNPVATEQYGSVSTTSGNLQQIQTNE

SEQ ID NO: 64772 - protein, 32 aa, Artificial Sequence
  Description of Artificial Sequence: Synthetic polypeptide
DEEEIRSTNPVATEQYGNVATNPAIQMRVGNV

SEQ ID NO: 64773 - protein, 32 aa, Artificial Sequence
  Description of Artificial Sequence: Synthetic polypeptide
DDEEIRTTNPVATEQYGCVSTMNHQNFGSNQS

SEQ ID NO: 64774 - protein, 32 aa, Artificial Sequence
  Description of Artificial Sequence: Synthetic polypeptide
AEEEIRTTNPVATEQYGVVSTVNNLTNETGNN

SEQ ID NO: 64775 - protein, 31 aa, Artificial Sequence
  Description of Artificial Sequence: Synthetic polypeptide
AENEIRTTNPVATEQYGEASSTENLNRGMNV

SEQ ID NO: 64776 - protein, 33 aa, Artificial Sequence
  Description of Artificial Sequence: Synthetic polypeptide
AEEEIRTTNPVATEQYGSVSVENLQQNIGNNTE

SEQ ID NO: 64777 - protein, 29 aa, Artificial Sequence
  Description of Artificial Sequence: Synthetic peptide
AENEIRTTNPVATEQWGEVSENLQAAGDA

SEQ ID NO: 64778 - protein, 33 aa, Artificial Sequence
  Description of Artificial Sequence: Synthetic polypeptide
AEEEIRTTNPVATEQYGSVSTTSNENQEEGNNV

SEQ ID NO: 64779 - protein, 28 aa, Artificial Sequence
  Description of Artificial Sequence: Synthetic peptide
AENEIRTTNPVATEQYGEISMDIQQGNH

SEQ ID NO: 64780 - protein, 33 aa, Artificial Sequence
  Description of Artificial Sequence: Synthetic polypeptide
AEEEIRTTNPVATEQYGSVSTTSNENQEGTNTV

SEQ ID NO: 64781 - protein, 31 aa, Artificial Sequence
  Description of Artificial Sequence: Synthetic polypeptide
AEEEIRTTNPVATEQYGSVSTTQQNNIENQE

SEQ ID NO: 64782 - protein, 31 aa, Artificial Sequence
  Description of Artificial Sequence: Synthetic polypeptide
DEEEIRTTNPVATEAYGTVSTSTNTEQGNNQ

SEQ ID NO: 64783 - protein, 31 aa, Artificial Sequence
  Description of Artificial Sequence: Synthetic polypeptide
DEEEIATTNPVATETWGEVSTNLQGDGDNTH

SEQ ID NO: 64784 - protein, 32 aa, Artificial Sequence
  Description of Artificial Sequence: Synthetic polypeptide
CEEEIATTNPVATEQYGSVATPNLQDAGDNQL

SEQ ID NO: 64785 - protein, 32 aa, Artificial Sequence
  Description of Artificial Sequence: Synthetic polypeptide
AEEEIRTTNPVATEQYGSVSTTQNQNQIENQD

SEQ ID NO: 64786 - protein, 29 aa, Artificial Sequence
  Description of Artificial Sequence: Synthetic peptide
AENEIRTTNPVSTEQYGEISMDLQRNGGR

SEQ ID NO: 64787 - protein, 32 aa, Artificial Sequence
  Description of Artificial Sequence: Synthetic polypeptide
DEEEIATTNPVATETWGTVSTNLQGDHGQNER

SEQ ID NO: 64788 - protein, 31 aa, Artificial Sequence
  Description of Artificial Sequence: Synthetic polypeptide
DEEEIATTNPVATETYGCVSTGLQMNGGDNH

SEQ ID NO: 64789 - protein, 33 aa, Artificial Sequence
  Description of Artificial Sequence: Synthetic polypeptide
AEEEIRTTNPVATEQYGSVSTTQNSTTNQAGNY

SEQ ID NO: 64790 - protein, 32 aa, Artificial Sequence
  Description of Artificial Sequence: Synthetic polypeptide
AEEEIRTTNPVATEQYGVVSTTTNSNQGGGNQ

SEQ ID NO: 64791 - protein, 32 aa, Artificial Sequence
  Description of Artificial Sequence: Synthetic polypeptide
DDEEIRTTNPVATEQYGCVCSTNHQGFGSNQA

SEQ ID NO: 64792 - protein, 32 aa, Artificial Sequence
  Description of Artificial Sequence: Synthetic polypeptide
DEEEIRTTNPVATEAYGTVSTSTQNEQNGNNF

SEQ ID NO: 64793 - protein, 32 aa, Artificial Sequence
  Description of Artificial Sequence: Synthetic polypeptide
DEEEIATTNPVATETYGCVSTGNLQGSGGGNH

SEQ ID NO: 64794 - protein, 31 aa, Artificial Sequence
  Description of Artificial Sequence: Synthetic polypeptide
DEEEIATTNPVATETYGCVSTNLNGMGGGNH

SEQ ID NO: 64795 - protein, 32 aa, Artificial Sequence
  Description of Artificial Sequence: Synthetic polypeptide
AEEEIRTTNPVATEQYGSVSTTQQLGIENENN

SEQ ID NO: 64796 - protein, 28 aa, Artificial Sequence
  Description of Artificial Sequence: Synthetic peptide
AENEIRTTNPVSTEPYGTISENLQRGGH

SEQ ID NO: 64797 - protein, 33 aa, Artificial Sequence
  Description of Artificial Sequence: Synthetic polypeptide
DEEEIATTNPVATETYGEVSTNLNQGNTGDNGR

SEQ ID NO: 64798 - protein, 31 aa, Artificial Sequence
  Description of Artificial Sequence: Synthetic polypeptide
DEAEICTTNPVAYEQYGTVSTTNLQGDNDER

SEQ ID NO: 64799 - protein, 33 aa, Artificial Sequence
  Description of Artificial Sequence: Synthetic polypeptide
AEEEIRTTNPVATEQYGVVSTTVNLQQGVEENQ

SEQ ID NO: 64800 - protein, 32 aa, Artificial Sequence
  Description of Artificial Sequence: Synthetic polypeptide
DEEEIATTNPVATEVWGSVSTNLQGNEGNDNH

SEQ ID NO: 64801 - protein, 33 aa, Artificial Sequence
  Description of Artificial Sequence: Synthetic polypeptide
DDEEIRTTNPVATEQYGCVCSTNNLQSFGSNQD

SEQ ID NO: 64802 - protein, 32 aa, Artificial Sequence
  Description of Artificial Sequence: Synthetic polypeptide
DEEEIRTTNPVATEAYGTVSTSTNNEQGGNNF

SEQ ID NO: 64803 - protein, 31 aa, Artificial Sequence
  Description of Artificial Sequence: Synthetic polypeptide
DDEEIRTTNPVATEQYGCVCSTNHQGGSEIA

SEQ ID NO: 64804 - protein, 30 aa, Artificial Sequence
  Description of Artificial Sequence: Synthetic polypeptide
DEDEIRTTNPVATEQYGCTSNTNHQNFGDQ

SEQ ID NO: 64805 - protein, 32 aa, Artificial Sequence
  Description of Artificial Sequence: Synthetic polypeptide
DEEEIAATNPVAYEQYGCIVSCTNLSQGVGNR

SEQ ID NO: 64806 - protein, 32 aa, Artificial Sequence
  Description of Artificial Sequence: Synthetic polypeptide
AEEEIRTTNPVATEQYGSVSVENLQQNDEIND

SEQ ID NO: 64807 - protein, 28 aa, Artificial Sequence
  Description of Artificial Sequence: Synthetic peptide
AENEIRCTNPVSTEPYGEASMNLQRGGR

SEQ ID NO: 64808 - protein, 33 aa, Artificial Sequence
  Description of Artificial Sequence: Synthetic polypeptide
DDEEIRTTNPVATEQYGQCVCSTELQNGGSNRS

SEQ ID NO: 64809 - protein, 32 aa, Artificial Sequence
  Description of Artificial Sequence: Synthetic polypeptide
AEEEIRTTNPVATEQYGSVSVENLGQNINNTN

SEQ ID NO: 64810 - protein, 33 aa, Artificial Sequence
  Description of Artificial Sequence: Synthetic polypeptide
DDEEIRTTNPVATEQYGQCVCSTNHQRFGSNAA

SEQ ID NO: 64811 - protein, 33 aa, Artificial Sequence
  Description of Artificial Sequence: Synthetic polypeptide
DDEEIRTTNPVATEQYGQCVCSTNLQEYFGSNQ

SEQ ID NO: 64812 - protein, 33 aa, Artificial Sequence
  Description of Artificial Sequence: Synthetic polypeptide
AEEEIRTTNPVATEQYGSVSTTSNNEQEGNNVT

SEQ ID NO: 64813 - protein, 33 aa, Artificial Sequence
  Description of Artificial Sequence: Synthetic polypeptide
DDEEIRTTNPVATEQYGQCVCSTNLQRFGSQQA

SEQ ID NO: 64814 - protein, 29 aa, Artificial Sequence
  Description of Artificial Sequence: Synthetic peptide
DEDEIRTTNPVATEQYGATVTNGQGGGDG

SEQ ID NO: 64815 - protein, 30 aa, Artificial Sequence
  Description of Artificial Sequence: Synthetic polypeptide
DEDEIRTTNPVATEQYGCCSTNQQPEGEDS

SEQ ID NO: 64816 - protein, 33 aa, Artificial Sequence
  Description of Artificial Sequence: Synthetic polypeptide
AEEEIRTTNPVATEQYGSVSTTSNLQQENGEAN

SEQ ID NO: 64817 - protein, 33 aa, Artificial Sequence
  Description of Artificial Sequence: Synthetic polypeptide
AEEEIRTTNPVATEQYGSVSTTSNNNNQQIGNG

SEQ ID NO: 64818 - protein, 31 aa, Artificial Sequence
  Description of Artificial Sequence: Synthetic polypeptide
DEAEIATTNPVATEQWGSVSENLDDQGGNLD

SEQ ID NO: 64819 - protein, 33 aa, Artificial Sequence
  Description of Artificial Sequence: Synthetic polypeptide
AEEEIRTTNPVATEQYGSVSTTSNNQQGENGNV

SEQ ID NO: 64820 - protein, 29 aa, Artificial Sequence
  Description of Artificial Sequence: Synthetic peptide
DEDEIRTTNPVATEQYGCSATNHQAEPPR

SEQ ID NO: 64821 - protein, 32 aa, Artificial Sequence
  Description of Artificial Sequence: Synthetic polypeptide
AEEEIRTTNPVATEQYGSVSVDNVNQNEEGNE

SEQ ID NO: 64822 - protein, 30 aa, Artificial Sequence
  Description of Artificial Sequence: Synthetic polypeptide
DEDEIRTTNPVATEQYGCTATNLQRPDEAE

SEQ ID NO: 64823 - protein, 30 aa, Artificial Sequence
  Description of Artificial Sequence: Synthetic polypeptide
DEAEIGTTNPVATEQYGSVSTDLYMYENQT

SEQ ID NO: 64824 - protein, 30 aa, Artificial Sequence
  Description of Artificial Sequence: Synthetic polypeptide
DEAEIGTTNPVATEQYGSVTTNLYMYEENT

SEQ ID NO: 64825 - protein, 30 aa, Artificial Sequence
  Description of Artificial Sequence: Synthetic polypeptide
DEEEIRSTNPVATEQYGDVSDNLMNSAENA

SEQ ID NO: 64826 - protein, 33 aa, Artificial Sequence
  Description of Artificial Sequence: Synthetic polypeptide
DDEEIRTTNPVATEQYGQSVCSTELQENGSNQA

SEQ ID NO: 64827 - protein, 33 aa, Artificial Sequence
  Description of Artificial Sequence: Synthetic polypeptide
AEEEIRTTNPVATEQYGSVSVENLGQNGIGNNT

SEQ ID NO: 64828 - protein, 28 aa, Artificial Sequence
  Description of Artificial Sequence: Synthetic peptide
AENEIRTTNPVATEQWGDASENLQREDA

SEQ ID NO: 64829 - protein, 31 aa, Artificial Sequence
  Description of Artificial Sequence: Synthetic polypeptide
DEECVRTTNPIAYEQYGETVSTNLSQSGGNR

SEQ ID NO: 64830 - protein, 33 aa, Artificial Sequence
  Description of Artificial Sequence: Synthetic polypeptide
AEEEIRTTNPVATEQYGSVSTTSNLQNQEQANV

SEQ ID NO: 64831 - protein, 33 aa, Artificial Sequence
  Description of Artificial Sequence: Synthetic polypeptide
AEEEIRTTNPVATEQYGSVSTTSNENQENGNVT

SEQ ID NO: 64832 - protein, 33 aa, Artificial Sequence
  Description of Artificial Sequence: Synthetic polypeptide
AEEEIRTTNPVATEQYGSVSTTSNENQQEGNNV

SEQ ID NO: 64833 - protein, 29 aa, Artificial Sequence
  Description of Artificial Sequence: Synthetic peptide
AENEIRTTNPVATEPYGEISMNIQRNGNH

SEQ ID NO: 64834 - protein, 29 aa, Artificial Sequence
  Description of Artificial Sequence: Synthetic peptide
DEEEIAATNPCATEQYGCVSATTVQRGQF

SEQ ID NO: 64835 - protein, 30 aa, Artificial Sequence
  Description of Artificial Sequence: Synthetic polypeptide
DEAEIATTNPVATEQWGSVSVNLETGPNPQ

SEQ ID NO: 64836 - protein, 29 aa, Artificial Sequence
  Description of Artificial Sequence: Synthetic peptide
AENEIRTTNPVATEPYGEASMNIQRNGNH

SEQ ID NO: 64837 - protein, 31 aa, Artificial Sequence
  Description of Artificial Sequence: Synthetic polypeptide
AENEIRTTNPVATECYGEVSEINLQDRGEGR

SEQ ID NO: 64838 - protein, 31 aa, Artificial Sequence
  Description of Artificial Sequence: Synthetic polypeptide
AENEIRTTNPVATECYGEVSCINLQDRGEGR

SEQ ID NO: 64839 - protein, 33 aa, Artificial Sequence
  Description of Artificial Sequence: Synthetic polypeptide
AEEEIRTTNPVATEQYGSVSVENLNQQNIGNNG

SEQ ID NO: 64840 - protein, 34 aa, Artificial Sequence
  Description of Artificial Sequence: Synthetic polypeptide
AEEEIRTTNPVATEQYGSVSTTSNLQQEGEAGNE

SEQ ID NO: 64841 - protein, 30 aa, Artificial Sequence
  Description of Artificial Sequence: Synthetic polypeptide
AENEIRTTNPVATECWGEVSCINEPQRGNR

SEQ ID NO: 64842 - protein, 32 aa, Artificial Sequence
  Description of Artificial Sequence: Synthetic polypeptide
AEEEIRTTNPVATEQYGSVSTTSNLNEQQNEV

SEQ ID NO: 64843 - protein, 31 aa, Artificial Sequence
  Description of Artificial Sequence: Synthetic polypeptide
DEEDIRTTNPVATEQYGSTMSTNSSTIGNNQ

SEQ ID NO: 64844 - protein, 32 aa, Artificial Sequence
  Description of Artificial Sequence: Synthetic polypeptide
AEEEIRTTNPVATEQYGSVSTTSNLNNEANTV

SEQ ID NO: 64845 - protein, 30 aa, Artificial Sequence
  Description of Artificial Sequence: Synthetic polypeptide
DEECYATTNPIAYEQYGEVSTNLQRGDNDV

SEQ ID NO: 64846 - protein, 33 aa, Artificial Sequence
  Description of Artificial Sequence: Synthetic polypeptide
AEEEIRTTNPVATEQYGSVSTTSNLNQEQATNM

SEQ ID NO: 64847 - protein, 34 aa, Artificial Sequence
  Description of Artificial Sequence: Synthetic polypeptide
AEEEIRTTNPVATEQYGSVSTTSNLQEQEGNGNG

SEQ ID NO: 64848 - protein, 32 aa, Artificial Sequence
  Description of Artificial Sequence: Synthetic polypeptide
DEECVRTTNPIAYEQYGKVVSTNELSQRGGNR

SEQ ID NO: 64849 - protein, 33 aa, Artificial Sequence
  Description of Artificial Sequence: Synthetic polypeptide
AEEEIRTTNPVATEQYGSVSTTSNLQNQEANEM

SEQ ID NO: 64850 - protein, 31 aa, Artificial Sequence
  Description of Artificial Sequence: Synthetic polypeptide
DEECVRTTNPIAYEQYGEVSCTNLSQHGGNR

SEQ ID NO: 64851 - protein, 32 aa, Artificial Sequence
  Description of Artificial Sequence: Synthetic polypeptide
AEEEIRTTNPVATEQYGSVSVENLNQNEINND

SEQ ID NO: 64852 - protein, 29 aa, Artificial Sequence
  Description of Artificial Sequence: Synthetic peptide
AEEEIRTTNPVATEQYGCVQTADQNFGEQ

SEQ ID NO: 64853 - protein, 33 aa, Artificial Sequence
  Description of Artificial Sequence: Synthetic polypeptide
AEEEIRTTNPVATEQYGSVSVTENGQQGNGNNN

SEQ ID NO: 64854 - protein, 30 aa, Artificial Sequence
  Description of Artificial Sequence: Synthetic polypeptide
AEEEIRTTNPVATEQYGCVSTEPQHFGSEQ

SEQ ID NO: 64855 - protein, 33 aa, Artificial Sequence
  Description of Artificial Sequence: Synthetic polypeptide
AEEEIRTTNPVATEQYGSVSVTVNLNQQVENGT

SEQ ID NO: 64856 - protein, 31 aa, Artificial Sequence
  Description of Artificial Sequence: Synthetic polypeptide
DEAEIATTNPVATEQYGSVATPLGRSENDRE

SEQ ID NO: 64857 - protein, 34 aa, Artificial Sequence
  Description of Artificial Sequence: Synthetic polypeptide
AEEEIRTTNPVATEQYGSVSVTVNLNQEQGTNEA

SEQ ID NO: 64858 - protein, 30 aa, Artificial Sequence
  Description of Artificial Sequence: Synthetic polypeptide
DEAEIATTNPVATEQYGSVATPDQRMPQER

SEQ ID NO: 64859 - protein, 31 aa, Artificial Sequence
  Description of Artificial Sequence: Synthetic polypeptide
DEEEIATTNPVATEQYGSVAMNLQESDNPTE

SEQ ID NO: 64860 - protein, 30 aa, Artificial Sequence
  Description of Artificial Sequence: Synthetic polypeptide
DEDEIATTNPVATEQYGCVATNLQAEANNH

SEQ ID NO: 64861 - protein, 31 aa, Artificial Sequence
  Description of Artificial Sequence: Synthetic polypeptide
DEAEIATTNPVATEQYGSVATNPEQIGNTEP

SEQ ID NO: 64862 - protein, 31 aa, Artificial Sequence
  Description of Artificial Sequence: Synthetic polypeptide
DEDEIATTNPVATEQYGCVATNLQAGPENQH

SEQ ID NO: 64863 - protein, 31 aa, Artificial Sequence
  Description of Artificial Sequence: Synthetic polypeptide
DEEEIATTNPVATEQYGSVANNLETEGGNEH

SEQ ID NO: 64864 - protein, 30 aa, Artificial Sequence
  Description of Artificial Sequence: Synthetic polypeptide
DEDEIATTNPVATEQYGCVATNLQRATPEE

SEQ ID NO: 64865 - protein, 33 aa, Artificial Sequence
  Description of Artificial Sequence: Synthetic polypeptide
AEEEIRTTNPVATEQYGSVSVTVNENQEQGNQN

SEQ ID NO: 64866 - protein, 32 aa, Artificial Sequence
  Description of Artificial Sequence: Synthetic polypeptide
DEEEIRTTNPCATEQYGSVCATNLQSGDEAAM

SEQ ID NO: 64867 - protein, 31 aa, Artificial Sequence
  Description of Artificial Sequence: Synthetic polypeptide
DEAEIATTNPVATEQYGSVATNNLDRGTPES

SEQ ID NO: 64868 - protein, 30 aa, Artificial Sequence
  Description of Artificial Sequence: Synthetic polypeptide
DEEEIRTTNPCATEQYGSVATWLANDGDEQ

SEQ ID NO: 64869 - protein, 30 aa, Artificial Sequence
  Description of Artificial Sequence: Synthetic polypeptide
DEDEIATTNPVATEQYGETSTNLQLGGDDS

SEQ ID NO: 64870 - protein, 31 aa, Artificial Sequence
  Description of Artificial Sequence: Synthetic polypeptide
DEAEIATTNPVATEQYGSVATNLTSDGNDLI

SEQ ID NO: 64871 - protein, 31 aa, Artificial Sequence
  Description of Artificial Sequence: Synthetic polypeptide
DEAEIATTNPVATEQYGSVATNLTGAENDRE

SEQ ID NO: 64872 - protein, 33 aa, Artificial Sequence
  Description of Artificial Sequence: Synthetic polypeptide
AEEEIRTTNPVATEQYGSVSTNNVLGGNNQGNQ

SEQ ID NO: 64873 - protein, 33 aa, Artificial Sequence
  Description of Artificial Sequence: Synthetic polypeptide
AEEEIRTTNPVATEQYGSVSVTVNDQGNGNEQG

SEQ ID NO: 64874 - protein, 33 aa, Artificial Sequence
  Description of Artificial Sequence: Synthetic polypeptide
AEEEIRTTNPVATEQYGSVVTVANLNQENGNNV

SEQ ID NO: 64875 - protein, 31 aa, Artificial Sequence
  Description of Artificial Sequence: Synthetic polypeptide
DAEEIASTNPVATEQYGSVSWNEQERNGTER

SEQ ID NO: 64876 - protein, 32 aa, Artificial Sequence
  Description of Artificial Sequence: Synthetic polypeptide
DEEEIRTTNPCATEQYGSVCYNIEQRDGHNDS

SEQ ID NO: 64877 - protein, 30 aa, Artificial Sequence
  Description of Artificial Sequence: Synthetic polypeptide
DEDEIATTNPVATEQYGCVATHLQDRDIND

SEQ ID NO: 64878 - protein, 31 aa, Artificial Sequence
  Description of Artificial Sequence: Synthetic polypeptide
DEEEIATTNPVATEQYGCVAATNLTDGDNND

SEQ ID NO: 64879 - protein, 32 aa, Artificial Sequence
  Description of Artificial Sequence: Synthetic polypeptide
DEEEIATTNPVATEQYGCVAATNLQDQGGNNQ

SEQ ID NO: 64880 - protein, 30 aa, Artificial Sequence
  Description of Artificial Sequence: Synthetic polypeptide
DAEEIASTNPVATEQYGSVSWNEQAQEGQR

SEQ ID NO: 64881 - protein, 33 aa, Artificial Sequence
  Description of Artificial Sequence: Synthetic polypeptide
AEEEIRTTNPVATEQYGSVSTNSNENQETGNTT

SEQ ID NO: 64882 - protein, 32 aa, Artificial Sequence
  Description of Artificial Sequence: Synthetic polypeptide
DEEEIRTTNPCATEQYGSVIATGNLQVGDHAD

SEQ ID NO: 64883 - protein, 33 aa, Artificial Sequence
  Description of Artificial Sequence: Synthetic polypeptide
DEEEIRTTNPCATEQYGSVIATDNHDQRQGNEA

SEQ ID NO: 64884 - protein, 33 aa, Artificial Sequence
  Description of Artificial Sequence: Synthetic polypeptide
DEEEIRTTNPCATEQYGSVIATDNHDQRGHNDA

SEQ ID NO: 64885 - protein, 30 aa, Artificial Sequence
  Description of Artificial Sequence: Synthetic polypeptide
DAEEIASTNPVATEQYGSVSWNEQDTNGQR

SEQ ID NO: 64886 - protein, 31 aa, Artificial Sequence
  Description of Artificial Sequence: Synthetic polypeptide
DEEEIRTTNPIAYEQYGSVPCTHLSARGSNE

SEQ ID NO: 64887 - protein, 30 aa, Artificial Sequence
  Description of Artificial Sequence: Synthetic polypeptide
DEDEIATTNPVATEQYGSTAATANLMDGND

SEQ ID NO: 64888 - protein, 31 aa, Artificial Sequence
  Description of Artificial Sequence: Synthetic polypeptide
DECEICTVNPVATEQYGSVSTQNNLEEGNET

SEQ ID NO: 64889 - protein, 29 aa, Artificial Sequence
  Description of Artificial Sequence: Synthetic peptide
DEDEIATTNPVATEQYGCVATGLQDPNDH

SEQ ID NO: 64890 - protein, 32 aa, Artificial Sequence
  Description of Artificial Sequence: Synthetic polypeptide
DECEICTVNPVATEQYGSVSTNLQEDEEGNNE

SEQ ID NO: 64891 - protein, 30 aa, Artificial Sequence
  Description of Artificial Sequence: Synthetic polypeptide
DEEEIRTTNPISTEQYGTISEDIMQRNGNR

SEQ ID NO: 64892 - protein, 33 aa, Artificial Sequence
  Description of Artificial Sequence: Synthetic polypeptide
DEEEIRTTNPCATEQYGSVIANGNLQREGGNGG

SEQ ID NO: 64893 - protein, 30 aa, Artificial Sequence
  Description of Artificial Sequence: Synthetic polypeptide
DEEEIRTTNPISTEQYGTISMDIMQRNGNR

SEQ ID NO: 64894 - protein, 31 aa, Artificial Sequence
  Description of Artificial Sequence: Synthetic polypeptide
DECEICTVNPVATEQYGSVSTNLEEGNNDTT

SEQ ID NO: 64895 - protein, 33 aa, Artificial Sequence
  Description of Artificial Sequence: Synthetic polypeptide
DEEEIATTNPVATEQYGCVAATGLQERPGENRN

SEQ ID NO: 64896 - protein, 31 aa, Artificial Sequence
  Description of Artificial Sequence: Synthetic polypeptide
DEEEIRTTNPCATEQYGSVCYNQEDRGHNDK

SEQ ID NO: 64897 - protein, 32 aa, Artificial Sequence
  Description of Artificial Sequence: Synthetic polypeptide
AEEEIRTTNPVATEQYGSVSTNQNQEQNANED

SEQ ID NO: 64898 - protein, 33 aa, Artificial Sequence
  Description of Artificial Sequence: Synthetic polypeptide
DEEEIRTTNPCATEQYGSVIATDNDQHRGNNGA

SEQ ID NO: 64899 - protein, 31 aa, Artificial Sequence
  Description of Artificial Sequence: Synthetic polypeptide
DEAEIATTNPVAYEPYGNVSATNNLQEGDNR

SEQ ID NO: 64900 - protein, 30 aa, Artificial Sequence
  Description of Artificial Sequence: Synthetic polypeptide
DEEEIRTTNPCATEQYGSVATWLADHGDQE

SEQ ID NO: 64901 - protein, 31 aa, Artificial Sequence
  Description of Artificial Sequence: Synthetic polypeptide
DEAEIATTNPVATEQYGSVATNLTADQGNND

SEQ ID NO: 64902 - protein, 32 aa, Artificial Sequence
  Description of Artificial Sequence: Synthetic polypeptide
DEEEIATTNPVATEQWGSVSVSGNLQAGVNEI

SEQ ID NO: 64903 - protein, 32 aa, Artificial Sequence
  Description of Artificial Sequence: Synthetic polypeptide
DEAEIATTNPVATEQYGSVATNLQPRQDNSDD

SEQ ID NO: 64904 - protein, 31 aa, Artificial Sequence
  Description of Artificial Sequence: Synthetic polypeptide
DEDEIATTNPVATEQYGSVATNLEDGDNNDM

SEQ ID NO: 64905 - protein, 32 aa, Artificial Sequence
  Description of Artificial Sequence: Synthetic polypeptide
DEEEIATTNPVATEQYGSVATGLEQENGENVT

SEQ ID NO: 64906 - protein, 33 aa, Artificial Sequence
  Description of Artificial Sequence: Synthetic polypeptide
AEEEIRTTNPVATEQYGSVSTNNQNQTNGNNSA

SEQ ID NO: 64907 - protein, 33 aa, Artificial Sequence
  Description of Artificial Sequence: Synthetic polypeptide
DEEEIRTTNPLATEQYGSVGTTGNTQRFGENPP

SEQ ID NO: 64908 - protein, 32 aa, Artificial Sequence
  Description of Artificial Sequence: Synthetic polypeptide
DEDEIATTNPVATEQYGSVATNLEDPGENDRN

SEQ ID NO: 64909 - protein, 32 aa, Artificial Sequence
  Description of Artificial Sequence: Synthetic polypeptide
DEDEIATTNPVATEQYGSVATNLEDRPGENEN

SEQ ID NO: 64910 - protein, 33 aa, Artificial Sequence
  Description of Artificial Sequence: Synthetic polypeptide
DEEEIATTNPVATEQWGSVSTNELQENGENTED

SEQ ID NO: 64911 - protein, 30 aa, Artificial Sequence
  Description of Artificial Sequence: Synthetic polypeptide
DEDEIATTNPVATEQYGSVANNLQDGPGEM

SEQ ID NO: 64912 - protein, 30 aa, Artificial Sequence
  Description of Artificial Sequence: Synthetic polypeptide
DEAEIATTNPVATEQYGSVATNLQNSEMEQ

SEQ ID NO: 64913 - protein, 30 aa, Artificial Sequence
  Description of Artificial Sequence: Synthetic polypeptide
DEAEIATTNPVATEQYGSVATNLQDVVDGM

SEQ ID NO: 64914 - protein, 29 aa, Artificial Sequence
  Description of Artificial Sequence: Synthetic peptide
DEAEIATTNPVAYEPYGVVAASNLQEGNR

SEQ ID NO: 64915 - protein, 32 aa, Artificial Sequence
  Description of Artificial Sequence: Synthetic polypeptide
DEEEIATTNPVATEQWGSVSPNPQDRGPNDQD

SEQ ID NO: 64916 - protein, 31 aa, Artificial Sequence
  Description of Artificial Sequence: Synthetic polypeptide
DEDEIATTNPVATEQYGSVATNLERGGQDSD

SEQ ID NO: 64917 - protein, 32 aa, Artificial Sequence
  Description of Artificial Sequence: Synthetic polypeptide
DEEEIATTNPVATEQWGSVSPNEPQERGNDQT

SEQ ID NO: 64918 - protein, 34 aa, Artificial Sequence
  Description of Artificial Sequence: Synthetic polypeptide
AEEEIRTTNPVATEQYGSVSTNNQLQGTEQGNDT

SEQ ID NO: 64919 - protein, 34 aa, Artificial Sequence
  Description of Artificial Sequence: Synthetic polypeptide
AEEEIRTTNPVATEQYGSVSTNNQLNQQGTNNSG

SEQ ID NO: 64920 - protein, 32 aa, Artificial Sequence
  Description of Artificial Sequence: Synthetic polypeptide
DEDEIATTNPVATEQYGSVATNLERPGDNPLT

SEQ ID NO: 64921 - protein, 30 aa, Artificial Sequence
  Description of Artificial Sequence: Synthetic polypeptide
DAEEIATTNPVATAQWGSVSTGNPDRGNPE

SEQ ID NO: 64922 - protein, 31 aa, Artificial Sequence
  Description of Artificial Sequence: Synthetic polypeptide
DEDEIATTNPVATEQYGSVATNLERGDQTDQ

SEQ ID NO: 64923 - protein, 32 aa, Artificial Sequence
  Description of Artificial Sequence: Synthetic polypeptide
DEEEIATTNPVATEQYGCVAATPNLQDGNDDD

SEQ ID NO: 64924 - protein, 30 aa, Artificial Sequence
  Description of Artificial Sequence: Synthetic polypeptide
DEDEIATTNPVATEQYGSVAMNLQQNDNEQ

SEQ ID NO: 64925 - protein, 32 aa, Artificial Sequence
  Description of Artificial Sequence: Synthetic polypeptide
DEDEIATTNPVATEQYGSVAITNLQQGDNPDA

SEQ ID NO: 64926 - protein, 31 aa, Artificial Sequence
  Description of Artificial Sequence: Synthetic polypeptide
DEDEIATTNPVATEQYGSVAANLQDQGGNNQ

SEQ ID NO: 64927 - protein, 34 aa, Artificial Sequence
  Description of Artificial Sequence: Synthetic polypeptide
AEEEIRTTNPVATEQYGSVSTTNLLNQQNGTNTQ

SEQ ID NO: 64928 - protein, 32 aa, Artificial Sequence
  Description of Artificial Sequence: Synthetic polypeptide
DEAEIATTNPVATEQYGSVATNLQTRNPQNEN

SEQ ID NO: 64929 - protein, 31 aa, Artificial Sequence
  Description of Artificial Sequence: Synthetic polypeptide
DEDEIATTNPVATEQYGSVAATANLADMGNT

SEQ ID NO: 64930 - protein, 31 aa, Artificial Sequence
  Description of Artificial Sequence: Synthetic polypeptide
DECEICTVNPVATEQYGSVSTALQQGNTQTE

SEQ ID NO: 64931 - protein, 31 aa, Artificial Sequence
  Description of Artificial Sequence: Synthetic polypeptide
DEDEIATTNPVATEQYGSVAATANLMMGNQD

SEQ ID NO: 64932 - protein, 32 aa, Artificial Sequence
  Description of Artificial Sequence: Synthetic polypeptide
AEEEIRTTNPVATEQYGSVSTNNTNLGGNEEV

SEQ ID NO: 64933 - protein, 33 aa, Artificial Sequence
  Description of Artificial Sequence: Synthetic polypeptide
AEEEIRTTNPVATEQYGSVSTNNSNLQAGETTT

SEQ ID NO: 64934 - protein, 31 aa, Artificial Sequence
  Description of Artificial Sequence: Synthetic polypeptide
DEEEIATTNPVATEQWGTVSATANLQIGEDN

SEQ ID NO: 64935 - protein, 31 aa, Artificial Sequence
  Description of Artificial Sequence: Synthetic polypeptide
DEDEIATTNPVATEQYGSVAMNGQDQGNDRD

SEQ ID NO: 64936 - protein, 31 aa, Artificial Sequence
  Description of Artificial Sequence: Synthetic polypeptide
DEDEIATTNPVATEQYGSVAATANLNMGNTP

SEQ ID NO: 64937 - protein, 31 aa, Artificial Sequence
  Description of Artificial Sequence: Synthetic polypeptide
DEAEIATTNPVATEQYGSVATNLQQDGGPLM

SEQ ID NO: 64938 - protein, 30 aa, Artificial Sequence
  Description of Artificial Sequence: Synthetic polypeptide
DEEEIATTNPVATEQWGTSVSAYLLSGNDS

SEQ ID NO: 64939 - protein, 34 aa, Artificial Sequence
  Description of Artificial Sequence: Synthetic polypeptide
AEEEIRTTNPVATEQYGSVSTTNLLQGNQGNEEG

SEQ ID NO: 64940 - protein, 31 aa, Artificial Sequence
  Description of Artificial Sequence: Synthetic polypeptide
DEAEIATTNPVATEQYGSVATNLQQDGGEDA

SEQ ID NO: 64941 - protein, 32 aa, Artificial Sequence
  Description of Artificial Sequence: Synthetic polypeptide
DEDEIATTNPVATEQYGSVAATNLERNPQNPR

SEQ ID NO: 64942 - protein, 28 aa, Artificial Sequence
  Description of Artificial Sequence: Synthetic peptide
DEAEIATTNPVAYEPYGSIATNLPAPNR

SEQ ID NO: 64943 - protein, 31 aa, Artificial Sequence
  Description of Artificial Sequence: Synthetic polypeptide
DEDEIATTNPVATEQYGSVAGTNDQNQGNQD

SEQ ID NO: 64944 - protein, 30 aa, Artificial Sequence
  Description of Artificial Sequence: Synthetic polypeptide
DECEICTVNPVATEQYGSVSTALQGQNQDE

SEQ ID NO: 64945 - protein, 34 aa, Artificial Sequence
  Description of Artificial Sequence: Synthetic polypeptide
AEEEIRTTNPVATEQYGSVSTTNLLQGQNGTTNT

SEQ ID NO: 64946 - protein, 31 aa, Artificial Sequence
  Description of Artificial Sequence: Synthetic polypeptide
DEAEIATTNPVATEQYGSVATNLQQDNDTEA

SEQ ID NO: 64947 - protein, 32 aa, Artificial Sequence
  Description of Artificial Sequence: Synthetic polypeptide
AEEEIRTTNPVATEQYGSVSTTNLLGNSEGET

SEQ ID NO: 64948 - protein, 32 aa, Artificial Sequence
  Description of Artificial Sequence: Synthetic polypeptide
DEEEIRTTNPIATEQYGTVCSATDNPEREGND

SEQ ID NO: 64949 - protein, 33 aa, Artificial Sequence
  Description of Artificial Sequence: Synthetic polypeptide
AEEEIRTTNPVATEQYGSVSTTNLGQNENNQND

SEQ ID NO: 64950 - protein, 33 aa, Artificial Sequence
  Description of Artificial Sequence: Synthetic polypeptide
DEEEIRTTNPCATEQYGSVIEPTNHQRGVNLLI

SEQ ID NO: 64951 - protein, 32 aa, Artificial Sequence
  Description of Artificial Sequence: Synthetic polypeptide
DEEEIRTTNPCATEQYGSVIEPTNHQREVNEC

SEQ ID NO: 64952 - protein, 32 aa, Artificial Sequence
  Description of Artificial Sequence: Synthetic polypeptide
DAAEIATTNPVAYEQYGSVATNLQNRHGNDRP

SEQ ID NO: 64953 - protein, 31 aa, Artificial Sequence
  Description of Artificial Sequence: Synthetic polypeptide
DEEEIATTNPVATEQYGCVSTNSIFQVDGEF

SEQ ID NO: 64954 - protein, 33 aa, Artificial Sequence
  Description of Artificial Sequence: Synthetic polypeptide
DEEEIATTNPVATEQYGCVSTNLQQGDIGGDSR

SEQ ID NO: 64955 - protein, 32 aa, Artificial Sequence
  Description of Artificial Sequence: Synthetic polypeptide
DEEEIATTNPVATEQYGCVSTNDLFQVNGSEF

SEQ ID NO: 64956 - protein, 31 aa, Artificial Sequence
  Description of Artificial Sequence: Synthetic polypeptide
DECEICTVNPVATEQYGSVSTTQNLEEGTNT

SEQ ID NO: 64957 - protein, 33 aa, Artificial Sequence
  Description of Artificial Sequence: Synthetic polypeptide
AEEEIRTTNPVATEQYGSVSTQNNNQEIGNNNQ

SEQ ID NO: 64958 - protein, 33 aa, Artificial Sequence
  Description of Artificial Sequence: Synthetic polypeptide
AEEEIRTTNPVATEQYGSVSVTVNQQQGNNQNS

SEQ ID NO: 64959 - protein, 33 aa, Artificial Sequence
  Description of Artificial Sequence: Synthetic polypeptide
DEEEIATTNPVATEQYGCVVSYTNLSQQGGGRD

SEQ ID NO: 64960 - protein, 31 aa, Artificial Sequence
  Description of Artificial Sequence: Synthetic polypeptide
DEDEIATTNPVATEQWGSVSMNLQDQGDDRN

SEQ ID NO: 64961 - protein, 34 aa, Artificial Sequence
  Description of Artificial Sequence: Synthetic polypeptide
AEEEIRTTNPVATEQYGSVSVTVNQLQIGTNGND

SEQ ID NO: 64962 - protein, 32 aa, Artificial Sequence
  Description of Artificial Sequence: Synthetic polypeptide
AEEEIRTTNPVATEQYGSVSTQNNDEGGNQEE

SEQ ID NO: 64963 - protein, 30 aa, Artificial Sequence
  Description of Artificial Sequence: Synthetic polypeptide
DEEEIRTTNPIATEQWGDVSENLMNRAEDR

SEQ ID NO: 64964 - protein, 31 aa, Artificial Sequence
  Description of Artificial Sequence: Synthetic polypeptide
DEEEIATTNPVATEQYGCVCSTNHQNSGSDQ

SEQ ID NO: 64965 - protein, 33 aa, Artificial Sequence
  Description of Artificial Sequence: Synthetic polypeptide
AEEEIRTTNPVATEQYGSVSTQNLQQQISTNNE

SEQ ID NO: 64966 - protein, 33 aa, Artificial Sequence
  Description of Artificial Sequence: Synthetic polypeptide
AEEEIRTTNPVATEQYGSVSTTNGQEQQGVNSN

SEQ ID NO: 64967 - protein, 33 aa, Artificial Sequence
  Description of Artificial Sequence: Synthetic polypeptide
DEEEIATTNPVATEQYGSVAITNLPEARAGNDE

SEQ ID NO: 64968 - protein, 31 aa, Artificial Sequence
  Description of Artificial Sequence: Synthetic polypeptide
CTGEIRTTNPVATEQYGSVSTENNLQLGMEQ

SEQ ID NO: 64969 - protein, 33 aa, Artificial Sequence
  Description of Artificial Sequence: Synthetic polypeptide
DEEEIATTNPVATEQYGSVAITNLQDQMGPNEI

SEQ ID NO: 64970 - protein, 32 aa, Artificial Sequence
  Description of Artificial Sequence: Synthetic polypeptide
DEEEIATTNPVATEQYGCVCSTNLQNFNSNAS

SEQ ID NO: 64971 - protein, 33 aa, Artificial Sequence
  Description of Artificial Sequence: Synthetic polypeptide
AEEEIRTTNPVATEQYGSVSTNTQLGNEGGNGE

SEQ ID NO: 64972 - protein, 29 aa, Artificial Sequence
  Description of Artificial Sequence: Synthetic peptide
DEDEIATTNPVATEQWGSVATNLERTTDD

SEQ ID NO: 64973 - protein, 29 aa, Artificial Sequence
  Description of Artificial Sequence: Synthetic peptide
DEEEIATTNPVATEQYGDVSEALQHEEPL

SEQ ID NO: 64974 - protein, 32 aa, Artificial Sequence
  Description of Artificial Sequence: Synthetic polypeptide
AEEEIRTTNPVATEQYGSVSTSNLGANNQNEG

SEQ ID NO: 64975 - protein, 31 aa, Artificial Sequence
  Description of Artificial Sequence: Synthetic polypeptide
DEEEIATTNPVATEQYGSVAGTNPDNNGNEL

SEQ ID NO: 64976 - protein, 33 aa, Artificial Sequence
  Description of Artificial Sequence: Synthetic polypeptide
AEEEIRTTNPVATEQYGSVSTSNLANQEQGTIG

SEQ ID NO: 64977 - protein, 33 aa, Artificial Sequence
  Description of Artificial Sequence: Synthetic polypeptide
AEEEIRTTNPVATEQYGSVSTSNENQQTGENNT

SEQ ID NO: 64978 - protein, 29 aa, Artificial Sequence
  Description of Artificial Sequence: Synthetic peptide
DEEEIATTNPVATEQYGEAPEAGQRNGNV

SEQ ID NO: 64979 - protein, 33 aa, Artificial Sequence
  Description of Artificial Sequence: Synthetic polypeptide
AEEEIRTTNPVATEQYGSVSTTNGNQQTGTNLQ

SEQ ID NO: 64980 - protein, 33 aa, Artificial Sequence
  Description of Artificial Sequence: Synthetic polypeptide
AEEEIRTTNPVATEQYGSVSTSNENQQTGENNN

SEQ ID NO: 64981 - protein, 33 aa, Artificial Sequence
  Description of Artificial Sequence: Synthetic polypeptide
AEEEIRTTNPVATEQYGSVSTSLQSGTTNNQND

SEQ ID NO: 64982 - protein, 28 aa, Artificial Sequence
  Description of Artificial Sequence: Synthetic peptide
DEEEIATTNPVATEQYGEAPEAGQRGEV

SEQ ID NO: 64983 - protein, 33 aa, Artificial Sequence
  Description of Artificial Sequence: Synthetic polypeptide
DEEEIRTTNPCATEQYGSVIEPTNNEQRGVNVD

SEQ ID NO: 64984 - protein, 30 aa, Artificial Sequence
  Description of Artificial Sequence: Synthetic polypeptide
DEEEIRTTNPIATECWGSTSEEDLARGNYR

SEQ ID NO: 64985 - protein, 30 aa, Artificial Sequence
  Description of Artificial Sequence: Synthetic polypeptide
DEDEIATTNPVATEQWGSVAATANLMMGNN

SEQ ID NO: 64986 - protein, 32 aa, Artificial Sequence
  Description of Artificial Sequence: Synthetic polypeptide
DEEEIRTTNPIATECWGSVSCNEPQDREGENR

SEQ ID NO: 64987 - protein, 33 aa, Artificial Sequence
  Description of Artificial Sequence: Synthetic polypeptide
DEEEIATTNPVATEQYGSVAGTNPLQAEMGNSL

SEQ ID NO: 64988 - protein, 32 aa, Artificial Sequence
  Description of Artificial Sequence: Synthetic polypeptide
DEEEIATTNPVATEQYGSVAGTNPQDGTENGM

SEQ ID NO: 64989 - protein, 33 aa, Artificial Sequence
  Description of Artificial Sequence: Synthetic polypeptide
AEEEIRTTNPVATEQYGSVSTSGNEQAGNNTNI

SEQ ID NO: 64990 - protein, 33 aa, Artificial Sequence
  Description of Artificial Sequence: Synthetic polypeptide
AEEEIRTTNPVATEQYGSVSTSGNENQAGNENI

SEQ ID NO: 64991 - protein, 31 aa, Artificial Sequence
  Description of Artificial Sequence: Synthetic polypeptide
DEEEIRTTNPIATECYGSCSTGNDDRTGNAS

SEQ ID NO: 64992 - protein, 31 aa, Artificial Sequence
  Description of Artificial Sequence: Synthetic polypeptide
DEEEIATTNPVATEQYGDVSTEPALNRENPL

SEQ ID NO: 64993 - protein, 31 aa, Artificial Sequence
  Description of Artificial Sequence: Synthetic polypeptide
DEEEIATTNPVATEQYGDVSTEPAGNRGNPL

SEQ ID NO: 64994 - protein, 32 aa, Artificial Sequence
  Description of Artificial Sequence: Synthetic polypeptide
AEEEIRTTNPVATEQYGSVSVTVSNTESGNNI

SEQ ID NO: 64995 - protein, 34 aa, Artificial Sequence
  Description of Artificial Sequence: Synthetic polypeptide
AEEEIRTTNPVATEQYGSVSVTTVNLQQNTEGNL

SEQ ID NO: 64996 - protein, 31 aa, Artificial Sequence
  Description of Artificial Sequence: Synthetic polypeptide
DECEICTVNPVATEQYGSVSTTNLEEGENNT

SEQ ID NO: 64997 - protein, 33 aa, Artificial Sequence
  Description of Artificial Sequence: Synthetic polypeptide
AEEEIRTTNPVATEQYGSVSTNTNQQAIGNTNI

SEQ ID NO: 64998 - protein, 30 aa, Artificial Sequence
  Description of Artificial Sequence: Synthetic polypeptide
DAEEIACTNPVATEQYGSTVATNLQDGTEE

SEQ ID NO: 64999 - protein, 31 aa, Artificial Sequence
  Description of Artificial Sequence: Synthetic polypeptide
DEEEIATTNPVATEQYGCVATNLQAEDPNNI

SEQ ID NO: 65000 - protein, 31 aa, Artificial Sequence
  Description of Artificial Sequence: Synthetic polypeptide
DEEEIATTNPVATEQYGCVATNLDTDGNEEA

SEQ ID NO: 65001 - protein, 33 aa, Artificial Sequence
  Description of Artificial Sequence: Synthetic polypeptide
AEEEIRTTNPVATEQYGSVSTTNLENDNGNETN

SEQ ID NO: 65002 - protein, 31 aa, Artificial Sequence
  Description of Artificial Sequence: Synthetic polypeptide
DAEEIACTNPVATEQYGSVATNLQAMGGGER

SEQ ID NO: 65003 - protein, 33 aa, Artificial Sequence
  Description of Artificial Sequence: Synthetic polypeptide
DEEEIRTTNPIATEQYGSVSSTTPAGPNRNGNR

SEQ ID NO: 65004 - protein, 33 aa, Artificial Sequence
  Description of Artificial Sequence: Synthetic polypeptide
AEEEIRTTNPVATEQYGSVSVTVNLQQVEENIL

SEQ ID NO: 65005 - protein, 34 aa, Artificial Sequence
  Description of Artificial Sequence: Synthetic polypeptide
AEEEIRTTNPVATEQYGSVSTTNLENQNGTNATN

SEQ ID NO: 65006 - protein, 34 aa, Artificial Sequence
  Description of Artificial Sequence: Synthetic polypeptide
AEEEIRTTNPVATEQYGSVSTTNLEQGEEEGNAG

SEQ ID NO: 65007 - protein, 31 aa, Artificial Sequence
  Description of Artificial Sequence: Synthetic polypeptide
DEEEIATTNPVATEQYGCVATNLQAEPNENP

SEQ ID NO: 65008 - protein, 34 aa, Artificial Sequence
  Description of Artificial Sequence: Synthetic polypeptide
AEEEIRTTNPVATEQYGSVSTTNLEQGTESGTNQ

SEQ ID NO: 65009 - protein, 32 aa, Artificial Sequence
  Description of Artificial Sequence: Synthetic polypeptide
AEEEIRTTNPVATEQYGSVSTNTNDGGTVGNA

SEQ ID NO: 65010 - protein, 34 aa, Artificial Sequence
  Description of Artificial Sequence: Synthetic polypeptide
AEEEIRTTNPVATEQYGSVSVTVNLQQGTVNTNA

SEQ ID NO: 65011 - protein, 33 aa, Artificial Sequence
  Description of Artificial Sequence: Synthetic polypeptide
AEEEIRTTNPVATEQYGSVSTNTNDENQETGNT

SEQ ID NO: 65012 - protein, 34 aa, Artificial Sequence
  Description of Artificial Sequence: Synthetic polypeptide
AEEEIRTTNPVATEQYGSVSVTVNLQQGENQNQE

SEQ ID NO: 65013 - protein, 29 aa, Artificial Sequence
  Description of Artificial Sequence: Synthetic peptide
CEDEIRTTNPVATEQYGVTSTNGQGGDDE

SEQ ID NO: 65014 - protein, 31 aa, Artificial Sequence
  Description of Artificial Sequence: Synthetic polypeptide
DECEICTVNPVATEQYGSVSTTANLQQQNQE

SEQ ID NO: 65015 - protein, 32 aa, Artificial Sequence
  Description of Artificial Sequence: Synthetic polypeptide
AEEEIRTTNPVATEQYGSVSTNTNDEIGGNND

SEQ ID NO: 65016 - protein, 33 aa, Artificial Sequence
  Description of Artificial Sequence: Synthetic polypeptide
AEEEIRTTNPVATEQYGSVSTNTLNLGNNGGNG

SEQ ID NO: 65017 - protein, 31 aa, Artificial Sequence
  Description of Artificial Sequence: Synthetic polypeptide
DEEEIRTTNPIATEQYGSWSLPNMLQGDERN

SEQ ID NO: 65018 - protein, 33 aa, Artificial Sequence
  Description of Artificial Sequence: Synthetic polypeptide
AEEEIRTTNPVATEQYGSVSTTNLEQQNNNDGE

SEQ ID NO: 65019 - protein, 30 aa, Artificial Sequence
  Description of Artificial Sequence: Synthetic polypeptide
DAAEIRTTNPVATEGYGCCSTVLQHSGNIR

SEQ ID NO: 65020 - protein, 31 aa, Artificial Sequence
  Description of Artificial Sequence: Synthetic polypeptide
DEEEIATTNPVATEQYGCVATNLQDDPEPRH

SEQ ID NO: 65021 - protein, 30 aa, Artificial Sequence
  Description of Artificial Sequence: Synthetic polypeptide
DEDEIATTNPVATEQYGCTATNLQQGNGDS

SEQ ID NO: 65022 - protein, 31 aa, Artificial Sequence
  Description of Artificial Sequence: Synthetic polypeptide
DAAEIRTTNPVAYEQYGIEVSTNLQTTGNVD

SEQ ID NO: 65023 - protein, 30 aa, Artificial Sequence
  Description of Artificial Sequence: Synthetic polypeptide
DADEIGTTNPVATEQYGSVSTQNNDQLGMT

SEQ ID NO: 65024 - protein, 34 aa, Artificial Sequence
  Description of Artificial Sequence: Synthetic polypeptide
AEEEIRTTNPVATEQYGSVSTNTNQLQTGEQGNN

SEQ ID NO: 65025 - protein, 33 aa, Artificial Sequence
  Description of Artificial Sequence: Synthetic polypeptide
AEEEIRTTNPVATEQYGSVSTTNGTNQDNGNIG

SEQ ID NO: 65026 - protein, 33 aa, Artificial Sequence
  Description of Artificial Sequence: Synthetic polypeptide
DADEIRTTNPVATEQYGSVSWTDNDLQDTGTMR

SEQ ID NO: 65027 - protein, 28 aa, Artificial Sequence
  Description of Artificial Sequence: Synthetic peptide
DEDEIATTNPVATEQYGCTATNLQGEDT

SEQ ID NO: 65028 - protein, 30 aa, Artificial Sequence
  Description of Artificial Sequence: Synthetic polypeptide
DAEEIAATNPVATEQYGSVVATNLQANDTR

SEQ ID NO: 65029 - protein, 29 aa, Artificial Sequence
  Description of Artificial Sequence: Synthetic peptide
DEDEIATTNPVATEQYGCTATNLQGMGDQ

SEQ ID NO: 65030 - protein, 33 aa, Artificial Sequence
  Description of Artificial Sequence: Synthetic polypeptide
AEEEIRTTNPVATEQYGSVSTNTNQAGNQQGNN

SEQ ID NO: 65031 - protein, 31 aa, Artificial Sequence
  Description of Artificial Sequence: Synthetic polypeptide
DEEEIATTNPVATEQYGCVATNLQVDDNDLE

SEQ ID NO: 65032 - protein, 32 aa, Artificial Sequence
  Description of Artificial Sequence: Synthetic polypeptide
DEEEIRTTNPIATEQYGSTVSCINISGRGGND

SEQ ID NO: 65033 - protein, 30 aa, Artificial Sequence
  Description of Artificial Sequence: Synthetic polypeptide
DAEEIACTNPVATEQYGCVATNLQADPGER

SEQ ID NO: 65034 - protein, 34 aa, Artificial Sequence
  Description of Artificial Sequence: Synthetic polypeptide
AEEEIRTTNPVATEQYGSVSTTNLDNQQGENTTE

SEQ ID NO: 65035 - protein, 31 aa, Artificial Sequence
  Description of Artificial Sequence: Synthetic polypeptide
CTGEIRTTNPVATEQYGSVSTENNLQLGMDE

SEQ ID NO: 65036 - protein, 32 aa, Artificial Sequence
  Description of Artificial Sequence: Synthetic polypeptide
DEEEIRTTNPIATEQYGSVCSYNIEDDRGNDH

SEQ ID NO: 65037 - protein, 32 aa, Artificial Sequence
  Description of Artificial Sequence: Synthetic polypeptide
DEEEIRTTNPIATEQYGSVCSYNIEDRDGNDH

SEQ ID NO: 65038 - protein, 31 aa, Artificial Sequence
  Description of Artificial Sequence: Synthetic polypeptide
DEEEIRTTNPIATEQYGSVSAEDLEDRGEDL

SEQ ID NO: 65039 - protein, 30 aa, Artificial Sequence
  Description of Artificial Sequence: Synthetic polypeptide
DAEEIACTNPVATEQYGCVATNLQARGGEF

SEQ ID NO: 65040 - protein, 29 aa, Artificial Sequence
  Description of Artificial Sequence: Synthetic peptide
DEDEIATTNPVATEQYGCTATNLQQAGDP

SEQ ID NO: 65041 - protein, 34 aa, Artificial Sequence
  Description of Artificial Sequence: Synthetic polypeptide
AEEEIRTTNPVATEQYGSVSVTVNLQSNEQGNTN

SEQ ID NO: 65042 - protein, 30 aa, Artificial Sequence
  Description of Artificial Sequence: Synthetic polypeptide
DAEEIAATNPVATEQYGSVVATNLQNGTSV

SEQ ID NO: 65043 - protein, 31 aa, Artificial Sequence
  Description of Artificial Sequence: Synthetic polypeptide
DEEEIATTNPVATEQYGSVAGTAPQEGPTRE

SEQ ID NO: 65044 - protein, 30 aa, Artificial Sequence
  Description of Artificial Sequence: Synthetic polypeptide
DAEEIATTNPVATAQWGSVSTNNPDRDGDR

SEQ ID NO: 65045 - protein, 33 aa, Artificial Sequence
  Description of Artificial Sequence: Synthetic polypeptide
DEEEIATTNPVATEQYGSVATGNLNEREGGERN

SEQ ID NO: 65046 - protein, 29 aa, Artificial Sequence
  Description of Artificial Sequence: Synthetic peptide
DEDEIATTNPVAYEPYGSVATNLQDGGDL

SEQ ID NO: 65047 - protein, 29 aa, Artificial Sequence
  Description of Artificial Sequence: Synthetic peptide
DEDEIATTNPVAYEPYGSVATNLQDLNDM

SEQ ID NO: 65048 - protein, 33 aa, Artificial Sequence
  Description of Artificial Sequence: Synthetic polypeptide
AEEEIRTTNPVATEQYGSVSTNLQGVTENQGEG

SEQ ID NO: 65049 - protein, 31 aa, Artificial Sequence
  Description of Artificial Sequence: Synthetic polypeptide
AEEEIRTTNPVATEQYGSVSTNLNSNAEEQT

SEQ ID NO: 65050 - protein, 34 aa, Artificial Sequence
  Description of Artificial Sequence: Synthetic polypeptide
AEEEIRTTNPVATEQYGSVSTNLNQQQQDEGNGG

SEQ ID NO: 65051 - protein, 30 aa, Artificial Sequence
  Description of Artificial Sequence: Synthetic polypeptide
DEDEIATTNPVAYEPYGVVASATNLQEGQR

SEQ ID NO: 65052 - protein, 33 aa, Artificial Sequence
  Description of Artificial Sequence: Synthetic polypeptide
DEEEIATTNPVATEQYGSVATNLQNGNPMEAVQ

SEQ ID NO: 65053 - protein, 33 aa, Artificial Sequence
  Description of Artificial Sequence: Synthetic polypeptide
AEEEIRTTNPVATEQYGSVVTVANLQNQNEGNV

SEQ ID NO: 65054 - protein, 32 aa, Artificial Sequence
  Description of Artificial Sequence: Synthetic polypeptide
AEEEIRTTNPVATEQYGSVVTVNEQAGENQIE

SEQ ID NO: 65055 - protein, 31 aa, Artificial Sequence
  Description of Artificial Sequence: Synthetic polypeptide
AEEEIRTTNPVATEQYGSVVTVNLLENVNGI

SEQ ID NO: 65056 - protein, 33 aa, Artificial Sequence
  Description of Artificial Sequence: Synthetic polypeptide
AEEEIRTTNPVATEQYGSVVTVNLQGNEQGNNN

SEQ ID NO: 65057 - protein, 33 aa, Artificial Sequence
  Description of Artificial Sequence: Synthetic polypeptide
DEEEIRTTNPCATEQYGSTVCATNLQSGDNHAA

SEQ ID NO: 65058 - protein, 34 aa, Artificial Sequence
  Description of Artificial Sequence: Synthetic polypeptide
AEEEIRTTNPVATEQYGSVSTTNLNQQQIGNNNS

SEQ ID NO: 65059 - protein, 34 aa, Artificial Sequence
  Description of Artificial Sequence: Synthetic polypeptide
AEEEIRTTNPVATEQYGSVSTTNLNQQQNGTNQD

SEQ ID NO: 65060 - protein, 33 aa, Artificial Sequence
  Description of Artificial Sequence: Synthetic polypeptide
DEEEIATTNPVATEQYGSVATNLQQDDQDGNEM

SEQ ID NO: 65061 - protein, 34 aa, Artificial Sequence
  Description of Artificial Sequence: Synthetic polypeptide
AEEEIRTTNPVATEQYGSVSTTNLNQQQTGNNVD

SEQ ID NO: 65062 - protein, 34 aa, Artificial Sequence
  Description of Artificial Sequence: Synthetic polypeptide
AEEEIRTTNPVATEQYGSVSTNLNQNQETGNVET

SEQ ID NO: 65063 - protein, 32 aa, Artificial Sequence
  Description of Artificial Sequence: Synthetic polypeptide
AEEEIRTTNPVATEQYGSVSTNLNQNDTTDTE

SEQ ID NO: 65064 - protein, 32 aa, Artificial Sequence
  Description of Artificial Sequence: Synthetic polypeptide
DEEEIATTNPVATEQYGSVATNLTDPGENMNN

SEQ ID NO: 65065 - protein, 34 aa, Artificial Sequence
  Description of Artificial Sequence: Synthetic polypeptide
AEEEIRTTNPVATEQYGSVSTNLQLGNQQGNTNP

SEQ ID NO: 65066 - protein, 32 aa, Artificial Sequence
  Description of Artificial Sequence: Synthetic polypeptide
AEEEIRTTNPVATEQYGSVSTTNLNQQQDEAE

SEQ ID NO: 65067 - protein, 32 aa, Artificial Sequence
  Description of Artificial Sequence: Synthetic polypeptide
DEEEIRTTNPCATEQYGSVAATNLQAEPNHAV

SEQ ID NO: 65068 - protein, 34 aa, Artificial Sequence
  Description of Artificial Sequence: Synthetic polypeptide
AEEEIRTTNPVATEQYGSVSTNLQLQQQNGNNDE

SEQ ID NO: 65069 - protein, 34 aa, Artificial Sequence
  Description of Artificial Sequence: Synthetic polypeptide
AEEEIRTTNPVATEQYGSVSTTNLNQQGNGNNDI

SEQ ID NO: 65070 - protein, 34 aa, Artificial Sequence
  Description of Artificial Sequence: Synthetic polypeptide
AEEEIRTTNPVATEQYGSVSTTNLNQQGNNENAD

SEQ ID NO: 65071 - protein, 33 aa, Artificial Sequence
  Description of Artificial Sequence: Synthetic polypeptide
AEEEIRTTNPVATEQYGSVSTNLQQNEDEQNGT

SEQ ID NO: 65072 - protein, 32 aa, Artificial Sequence
  Description of Artificial Sequence: Synthetic polypeptide
DEEEIATTNPVATEQYGSVATNLPQDNNHNDE

SEQ ID NO: 65073 - protein, 33 aa, Artificial Sequence
  Description of Artificial Sequence: Synthetic polypeptide
AEEEIRTTNPVATEQYGSVSTNLQQNEDEENEG

SEQ ID NO: 65074 - protein, 30 aa, Artificial Sequence
  Description of Artificial Sequence: Synthetic polypeptide
DEEEIRTTNPCATEQYGSVATTWLADGDEM

SEQ ID NO: 65075 - protein, 30 aa, Artificial Sequence
  Description of Artificial Sequence: Synthetic polypeptide
DEEEIRTTNPCATEQYGSVATTVQLAAGEE

SEQ ID NO: 65076 - protein, 32 aa, Artificial Sequence
  Description of Artificial Sequence: Synthetic polypeptide
DEEEIATTNPVATEQYGSVATNLQADDPNNDQ

SEQ ID NO: 65077 - protein, 31 aa, Artificial Sequence
  Description of Artificial Sequence: Synthetic polypeptide
DEEEIATTNPVATEQYGSVATNLQAEDDTDD

SEQ ID NO: 65078 - protein, 31 aa, Artificial Sequence
  Description of Artificial Sequence: Synthetic polypeptide
DAEEIATTNPVATEQYGSVCATNDEQDDGNH

SEQ ID NO: 65079 - protein, 32 aa, Artificial Sequence
  Description of Artificial Sequence: Synthetic polypeptide
DEEEIATTNPVATEQYGSVATNLQAEDDTVRV

SEQ ID NO: 65080 - protein, 32 aa, Artificial Sequence
  Description of Artificial Sequence: Synthetic polypeptide
DEEEIATTNPVATEQYGSVATNLQDDPVGEGE

SEQ ID NO: 65081 - protein, 33 aa, Artificial Sequence
  Description of Artificial Sequence: Synthetic polypeptide
DEEEIATTNPVATEQYGSVATNLQDQAGDGNDT

SEQ ID NO: 65082 - protein, 33 aa, Artificial Sequence
  Description of Artificial Sequence: Synthetic polypeptide
AEEEIRTTNPVATEQYGSVSTNLQNSNNANNQT

SEQ ID NO: 65083 - protein, 32 aa, Artificial Sequence
  Description of Artificial Sequence: Synthetic polypeptide
DEEEIATTNPVATEQYGSVATNLQGEPLEGAP

SEQ ID NO: 65084 - protein, 32 aa, Artificial Sequence
  Description of Artificial Sequence: Synthetic polypeptide
AEEEIRTTNPVATEQYGSVSTNLQNNDTTDTA

SEQ ID NO: 65085 - protein, 34 aa, Artificial Sequence
  Description of Artificial Sequence: Synthetic polypeptide
AEEEIRTTNPVATEQYGSVSTNLQLQQTTNGNTE

SEQ ID NO: 65086 - protein, 34 aa, Artificial Sequence
  Description of Artificial Sequence: Synthetic polypeptide
AEEEIRTTNPVATEQYGSVSTTNLNQQGNNQNDN

SEQ ID NO: 65087 - protein, 29 aa, Artificial Sequence
  Description of Artificial Sequence: Synthetic peptide
DEDEIATTNPVAYEPYGNVATNLQSGNQF

SEQ ID NO: 65088 - protein, 29 aa, Artificial Sequence
  Description of Artificial Sequence: Synthetic peptide
DEDEIATTNPVAYEPYGSVATNLQDDGGD

SEQ ID NO: 65089 - protein, 29 aa, Artificial Sequence
  Description of Artificial Sequence: Synthetic peptide
DEDEIATTNPVAYEPWGSVATNLQDGNDD

SEQ ID NO: 65090 - protein, 32 aa, Artificial Sequence
  Description of Artificial Sequence: Synthetic polypeptide
DAEEIATTNPVATEQYGSVCATNDEQDNDGNR

SEQ ID NO: 65091 - protein, 32 aa, Artificial Sequence
  Description of Artificial Sequence: Synthetic polypeptide
DEEEIATTNPVATEQYGSVATNLTDSGENDEH

SEQ ID NO: 65092 - protein, 31 aa, Artificial Sequence
  Description of Artificial Sequence: Synthetic polypeptide
DEEEIATTNPVATEQYGSVATNPLEATDGEF

SEQ ID NO: 65093 - protein, 33 aa, Artificial Sequence
  Description of Artificial Sequence: Synthetic polypeptide
AEEEIRTTNPVATEQYGSVSTTNLQNEDENEGG

SEQ ID NO: 65094 - protein, 34 aa, Artificial Sequence
  Description of Artificial Sequence: Synthetic polypeptide
AEEEIRTTNPVATEQYGSVSTNLNLENQEQGNQE

SEQ ID NO: 65095 - protein, 31 aa, Artificial Sequence
  Description of Artificial Sequence: Synthetic polypeptide
CEECICTTNPVATEQYGSVSWNEGQDRGNSS

SEQ ID NO: 65096 - protein, 33 aa, Artificial Sequence
  Description of Artificial Sequence: Synthetic polypeptide
AEEEIRTTNPVATEQYGSVSTTNLQNNNEDTDE

SEQ ID NO: 65097 - protein, 33 aa, Artificial Sequence
  Description of Artificial Sequence: Synthetic polypeptide
AEEEIRTTNPVATEQYGSVSTTNLQNQDEENDG

SEQ ID NO: 65098 - protein, 32 aa, Artificial Sequence
  Description of Artificial Sequence: Synthetic polypeptide
AEEEIRTTNPVATEQYGSVSTTNLQNQDTTDT

SEQ ID NO: 65099 - protein, 34 aa, Artificial Sequence
  Description of Artificial Sequence: Synthetic polypeptide
AEEEIRTTNPVATEQYGSVSTNLNGNQETGNTEQ

SEQ ID NO: 65100 - protein, 31 aa, Artificial Sequence
  Description of Artificial Sequence: Synthetic polypeptide
DEAEIATTNPVATEQYGSVATNLPQENNHNE

SEQ ID NO: 65101 - protein, 31 aa, Artificial Sequence
  Description of Artificial Sequence: Synthetic polypeptide
CEECICTTNPVATEQYGSVSWNEGQDRTGNH

SEQ ID NO: 65102 - protein, 33 aa, Artificial Sequence
  Description of Artificial Sequence: Synthetic polypeptide
AEEEIRTTNPVATEQYGSVSTTNLQGQTNNQND

SEQ ID NO: 65103 - protein, 29 aa, Artificial Sequence
  Description of Artificial Sequence: Synthetic peptide
DEAEIATTNPVAYEQWGCVSTNLQADGDV

SEQ ID NO: 65104 - protein, 34 aa, Artificial Sequence
  Description of Artificial Sequence: Synthetic polypeptide
AEEEIRTTNPVATEQYGSVSTTNLQNQGEENATE

SEQ ID NO: 65105 - protein, 34 aa, Artificial Sequence
  Description of Artificial Sequence: Synthetic polypeptide
AEEEIRTTNPVATEQYGSVSTTNLQNQQGENTED

SEQ ID NO: 65106 - protein, 31 aa, Artificial Sequence
  Description of Artificial Sequence: Synthetic polypeptide
DEDEIATTNPVAYEQWGSVSTNLQADGGNDS

SEQ ID NO: 65107 - protein, 31 aa, Artificial Sequence
  Description of Artificial Sequence: Synthetic polypeptide
DEDEIATTNPVAYEQWGSVSTNLQAGGTGNT

SEQ ID NO: 65108 - protein, 31 aa, Artificial Sequence
  Description of Artificial Sequence: Synthetic polypeptide
DEDEIATTNPVAYEQWGSVSTNLQAGGVNNM

SEQ ID NO: 65109 - protein, 34 aa, Artificial Sequence
  Description of Artificial Sequence: Synthetic polypeptide
AEEEIRTTNPVATEQYGSVSTNLLQQQEGGNNNN

SEQ ID NO: 65110 - protein, 33 aa, Artificial Sequence
  Description of Artificial Sequence: Synthetic polypeptide
AEEEIRTTNPVATEQYGSVSTNLLIGNEGTGGG

SEQ ID NO: 65111 - protein, 33 aa, Artificial Sequence
  Description of Artificial Sequence: Synthetic polypeptide
AEEEIRTTNPVATEQYGSVSTTNLQNSNANEQT

SEQ ID NO: 65112 - protein, 30 aa, Artificial Sequence
  Description of Artificial Sequence: Synthetic polypeptide
DEDEIATTNPVAYEQWGSVSTNLQLGEDDS

SEQ ID NO: 65113 - protein, 31 aa, Artificial Sequence
  Description of Artificial Sequence: Synthetic polypeptide
DEDEIATTNPVAYEQWGSVSTANLQDGENDS

SEQ ID NO: 65114 - protein, 31 aa, Artificial Sequence
  Description of Artificial Sequence: Synthetic polypeptide
DEEEIRTTNPCATEQYGSVATVLAQGNQNES

SEQ ID NO: 65115 - protein, 34 aa, Artificial Sequence
  Description of Artificial Sequence: Synthetic polypeptide
AEEEIRTTNPVATEQYGSVSTNLNLQQQGNNGNE

SEQ ID NO: 65116 - protein, 31 aa, Artificial Sequence
  Description of Artificial Sequence: Synthetic polypeptide
DEEEIATTNPVATEQYGSVCAADLQPDDGNN

SEQ ID NO: 65117 - protein, 31 aa, Artificial Sequence
  Description of Artificial Sequence: Synthetic polypeptide
DEEEIATTNPVATEQYGSVATNVLDQGAEEF

SEQ ID NO: 65118 - protein, 34 aa, Artificial Sequence
  Description of Artificial Sequence: Synthetic polypeptide
AEEEIRTTNPVATEQYGSVSTTNLQEGNAGGNQE

SEQ ID NO: 65119 - protein, 34 aa, Artificial Sequence
  Description of Artificial Sequence: Synthetic polypeptide
AEEEIRTTNPVATEQYGSVSTTNLQENDNGTNTN

SEQ ID NO: 65120 - protein, 33 aa, Artificial Sequence
  Description of Artificial Sequence: Synthetic polypeptide
DEEEIRTTNPCATEQYGSGAIATTNLQRGENID

SEQ ID NO: 65121 - protein, 32 aa, Artificial Sequence
  Description of Artificial Sequence: Synthetic polypeptide
DEEEIATTNPVATEQYGSVATTNGLDQTAGEF

SEQ ID NO: 65122 - protein, 33 aa, Artificial Sequence
  Description of Artificial Sequence: Synthetic polypeptide
AEEEIRTTNPVATEQYGSVVTVNLQSNEGGINN

SEQ ID NO: 65123 - protein, 31 aa, Artificial Sequence
  Description of Artificial Sequence: Synthetic polypeptide
DEEEIATTNPVATEQYGSVATTNLDANNNNE

SEQ ID NO: 65124 - protein, 33 aa, Artificial Sequence
  Description of Artificial Sequence: Synthetic polypeptide
AEEEIRTTNPVATEQYGSVVTVNLQSNENGNNA

SEQ ID NO: 65125 - protein, 33 aa, Artificial Sequence
  Description of Artificial Sequence: Synthetic polypeptide
DEEEIATTNPVATEQYGSVATTSLQIRAFQNER

SEQ ID NO: 65126 - protein, 31 aa, Artificial Sequence
  Description of Artificial Sequence: Synthetic polypeptide
CEECIATTNPVATEQYGSVSWNEGQDREGNS

SEQ ID NO: 65127 - protein, 33 aa, Artificial Sequence
  Description of Artificial Sequence: Synthetic polypeptide
AEEEIRTTNPVATEQYGSVSTNLNNEQGSTNLE

SEQ ID NO: 65128 - protein, 32 aa, Artificial Sequence
  Description of Artificial Sequence: Synthetic polypeptide
DEEEIATTNPVATEQWGAVSTNLQGEGGMNNP

SEQ ID NO: 65129 - protein, 34 aa, Artificial Sequence
  Description of Artificial Sequence: Synthetic polypeptide
AEEEIRTTNPVATEQYGSVSTTNLQEQNGTTNTT

SEQ ID NO: 65130 - protein, 31 aa, Artificial Sequence
  Description of Artificial Sequence: Synthetic polypeptide
DECEICTTNPVATEQYGVVSTMANLQGNPND

SEQ ID NO: 65131 - protein, 30 aa, Artificial Sequence
  Description of Artificial Sequence: Synthetic polypeptide
DECEICTTNPVATEQYGVVSTAQLQVNPND

SEQ ID NO: 65132 - protein, 33 aa, Artificial Sequence
  Description of Artificial Sequence: Synthetic polypeptide
AEEEIRTTNPVATEQYGSVSTTNLQEVTEQGEG

SEQ ID NO: 65133 - protein, 30 aa, Artificial Sequence
  Description of Artificial Sequence: Synthetic polypeptide
DECEICTTNPVATEQYGVVSTALQGNPEND

SEQ ID NO: 65134 - protein, 30 aa, Artificial Sequence
  Description of Artificial Sequence: Synthetic polypeptide
DECEICTTNPVATEQYGVVSTALLQNNPND

SEQ ID NO: 65135 - protein, 30 aa, Artificial Sequence
  Description of Artificial Sequence: Synthetic polypeptide
DECEICTTNPVATEQYGVVSTALGQNPNGD

SEQ ID NO: 65136 - protein, 31 aa, Artificial Sequence
  Description of Artificial Sequence: Synthetic polypeptide
DEEEIATTNPVATEQYGSVCAAANNLQMDNH

SEQ ID NO: 65137 - protein, 30 aa, Artificial Sequence
  Description of Artificial Sequence: Synthetic polypeptide
DECEICTTNPVATEQYGVVSTQLQGNPNND

SEQ ID NO: 65138 - protein, 29 aa, Artificial Sequence
  Description of Artificial Sequence: Synthetic peptide
DEDEIATTNPVAYEGWGEVSTNLQGGNAN

SEQ ID NO: 65139 - protein, 34 aa, Artificial Sequence
  Description of Artificial Sequence: Synthetic polypeptide
AEEEIRTTNPVATEQYGSVSTTNLNQQGNGGNDA

SEQ ID NO: 65140 - protein, 30 aa, Artificial Sequence
  Description of Artificial Sequence: Synthetic polypeptide
DEEEIRTTNPLAYDQYGQVATDLSQRVGNF

SEQ ID NO: 65141 - protein, 33 aa, Artificial Sequence
  Description of Artificial Sequence: Synthetic polypeptide
AEEEIRTTNPVATEQYGSVSVTTNQQQNGNQTQ

SEQ ID NO: 65142 - protein, 34 aa, Artificial Sequence
  Description of Artificial Sequence: Synthetic polypeptide
AEEEIRTTNPVATEQYGSVSVTTNQQQLQGNGNE

SEQ ID NO: 65143 - protein, 34 aa, Artificial Sequence
  Description of Artificial Sequence: Synthetic polypeptide
AEEEIRTTNPVATEQYGSVSTNNNQLGNQQGNLN

SEQ ID NO: 65144 - protein, 33 aa, Artificial Sequence
  Description of Artificial Sequence: Synthetic polypeptide
AEEEIRTTNPVATEQYGSVVTVANLQNNQTGNM

SEQ ID NO: 65145 - protein, 33 aa, Artificial Sequence
  Description of Artificial Sequence: Synthetic polypeptide
AEEEIRTTNPVATEQYGSVSTTNLLQQQENNED

SEQ ID NO: 65146 - protein, 33 aa, Artificial Sequence
  Description of Artificial Sequence: Synthetic polypeptide
AEEEIRTTNPVATEQYGSVSTNNNQLGIIQGNG

SEQ ID NO: 65147 - protein, 32 aa, Artificial Sequence
  Description of Artificial Sequence: Synthetic polypeptide
AEEEIRTTNPVATEQYGSVSTNNNPEEQGNGG

SEQ ID NO: 65148 - protein, 32 aa, Artificial Sequence
  Description of Artificial Sequence: Synthetic polypeptide
AEEEIRTTNPVATEQYGSVSTNNNPEEQGNDG

SEQ ID NO: 65149 - protein, 31 aa, Artificial Sequence
  Description of Artificial Sequence: Synthetic polypeptide
DAEEIATTNPVATEQWGSVTSATGLQRGGGE

SEQ ID NO: 65150 - protein, 30 aa, Artificial Sequence
  Description of Artificial Sequence: Synthetic polypeptide
DAEEIATTNPVATEQWGSVTSADLDRGGTR

SEQ ID NO: 65151 - protein, 32 aa, Artificial Sequence
  Description of Artificial Sequence: Synthetic polypeptide
AEEEIRTTNPVATEQYGSVSTNNNPEEEQGND

SEQ ID NO: 65152 - protein, 34 aa, Artificial Sequence
  Description of Artificial Sequence: Synthetic polypeptide
AEEEIRTTNPVATEQYGSVSTTNLLQQQGENNEG

SEQ ID NO: 65153 - protein, 33 aa, Artificial Sequence
  Description of Artificial Sequence: Synthetic polypeptide
AEEEIRTTNPVATEQYGSVSTNNNNLQGSNLEG

SEQ ID NO: 65154 - protein, 33 aa, Artificial Sequence
  Description of Artificial Sequence: Synthetic polypeptide
AEEEIRTTNPVATEQYGSVSVTTNQNQQTGNLT

SEQ ID NO: 65155 - protein, 34 aa, Artificial Sequence
  Description of Artificial Sequence: Synthetic polypeptide
AEEEIRTTNPVATEQYGSVSTNNNLQSGSTNLEE

SEQ ID NO: 65156 - protein, 33 aa, Artificial Sequence
  Description of Artificial Sequence: Synthetic polypeptide
AEEEIRTTNPVATEQYGSVSTNNNLQQTNGIDT

SEQ ID NO: 65157 - protein, 34 aa, Artificial Sequence
  Description of Artificial Sequence: Synthetic polypeptide
AEEEIRTTNPVATEQYGSVSTNNNLQQQGTEDNE

SEQ ID NO: 65158 - protein, 32 aa, Artificial Sequence
  Description of Artificial Sequence: Synthetic polypeptide
DEEEIATTNPVATEQYGSVATNGEPDQGGNNQ

SEQ ID NO: 65159 - protein, 33 aa, Artificial Sequence
  Description of Artificial Sequence: Synthetic polypeptide
AEEEIRTTNPVATEQYGSVSTNNNLQQNDENDQ

SEQ ID NO: 65160 - protein, 31 aa, Artificial Sequence
  Description of Artificial Sequence: Synthetic polypeptide
DEEEIRTTNPCATEQYGSVATVNLAQGQAED

SEQ ID NO: 65161 - protein, 31 aa, Artificial Sequence
  Description of Artificial Sequence: Synthetic polypeptide
DAEEIATTNPVATEQWGSVTSGNGLDRGGTR

SEQ ID NO: 65162 - protein, 33 aa, Artificial Sequence
  Description of Artificial Sequence: Synthetic polypeptide
AEEEIRTTNPVATEQYGSVSTNNNLQIGTDEQT

SEQ ID NO: 65163 - protein, 31 aa, Artificial Sequence
  Description of Artificial Sequence: Synthetic polypeptide
DAEEIATTNPVATEQWGSVTGTVALQRGDDR

SEQ ID NO: 65164 - protein, 33 aa, Artificial Sequence
  Description of Artificial Sequence: Synthetic polypeptide
AEEEIRTTNPVATEQYGSVSTNNNQQGGNNGSG

SEQ ID NO: 65165 - protein, 34 aa, Artificial Sequence
  Description of Artificial Sequence: Synthetic polypeptide
AEEEIRTTNPVATEQYGSVSTNNQLGNTQQGNEN

SEQ ID NO: 65166 - protein, 30 aa, Artificial Sequence
  Description of Artificial Sequence: Synthetic polypeptide
DEAEIATTNPVAYEPYGVVAATNLQADGNR

SEQ ID NO: 65167 - protein, 32 aa, Artificial Sequence
  Description of Artificial Sequence: Synthetic polypeptide
DEEEIATTNPVATEQWGSVSMSGNLGQDGEND

SEQ ID NO: 65168 - protein, 30 aa, Artificial Sequence
  Description of Artificial Sequence: Synthetic polypeptide
DEDEIATTNPVATEQYGSVATNLQAAASEN

SEQ ID NO: 65169 - protein, 30 aa, Artificial Sequence
  Description of Artificial Sequence: Synthetic polypeptide
DEAEIATTNPVAYEPYGVVAATNLQQGNRN

SEQ ID NO: 65170 - protein, 31 aa, Artificial Sequence
  Description of Artificial Sequence: Synthetic polypeptide
DEDEIATTNPVATEQYGSVATNLQAAPNTES

SEQ ID NO: 65171 - protein, 30 aa, Artificial Sequence
  Description of Artificial Sequence: Synthetic polypeptide
DAEEIATTNPVATAQWGSVSTNNPDRGNQD

SEQ ID NO: 65172 - protein, 32 aa, Artificial Sequence
  Description of Artificial Sequence: Synthetic polypeptide
DEDEIATTNPVATEQYGSVATNLQDQGDGNDA

SEQ ID NO: 65173 - protein, 31 aa, Artificial Sequence
  Description of Artificial Sequence: Synthetic polypeptide
DEDEIATTNPVATEQYGSVATNLQNDMNNPF

SEQ ID NO: 65174 - protein, 34 aa, Artificial Sequence
  Description of Artificial Sequence: Synthetic polypeptide
AEEEIRTTNPVATEQYGSVSTNNNQLQQGNVATE

SEQ ID NO: 65175 - protein, 30 aa, Artificial Sequence
  Description of Artificial Sequence: Synthetic polypeptide
DEAEIATTNPVAYEPYGVVAATNLQVGDNR

SEQ ID NO: 65176 - protein, 33 aa, Artificial Sequence
  Description of Artificial Sequence: Synthetic polypeptide
AEEEIRTTNPVATEQYGSVSTNNNQQQQGNNVD

SEQ ID NO: 65177 - protein, 31 aa, Artificial Sequence
  Description of Artificial Sequence: Synthetic polypeptide
DEDEIATTNPVATEQYGSVATNLTDDGNNDI

SEQ ID NO: 65178 - protein, 33 aa, Artificial Sequence
  Description of Artificial Sequence: Synthetic polypeptide
AEEEIRTTNPVATEQYGSVSTNNNQQQIGNEGE

SEQ ID NO: 65179 - protein, 31 aa, Artificial Sequence
  Description of Artificial Sequence: Synthetic polypeptide
DEDEIATTNPVATEQYGSVATNLTDDGNNDV

SEQ ID NO: 65180 - protein, 31 aa, Artificial Sequence
  Description of Artificial Sequence: Synthetic polypeptide
DECEICTTNPVAVEQYGSVSTTTNLEQTTNG

SEQ ID NO: 65181 - protein, 33 aa, Artificial Sequence
  Description of Artificial Sequence: Synthetic polypeptide
AEEEIRTTNPVATEQYGSVSVTTQNGNQGGNQD

SEQ ID NO: 65182 - protein, 32 aa, Artificial Sequence
  Description of Artificial Sequence: Synthetic polypeptide
DEDEIATTNPVATEQYGSVATPNLQAMAGNES

SEQ ID NO: 65183 - protein, 33 aa, Artificial Sequence
  Description of Artificial Sequence: Synthetic polypeptide
AEEEIRTTNPVATEQYGSVSVTTNTNLQGNEEV

SEQ ID NO: 65184 - protein, 29 aa, Artificial Sequence
  Description of Artificial Sequence: Synthetic peptide
DAEEIATTNPVATEQWGSVSQNPDRGPQD

SEQ ID NO: 65185 - protein, 33 aa, Artificial Sequence
  Description of Artificial Sequence: Synthetic polypeptide
AEEEIRTTNPVATEQYGSVSTNNQAGSTNQANA

SEQ ID NO: 65186 - protein, 32 aa, Artificial Sequence
  Description of Artificial Sequence: Synthetic polypeptide
DEDEIATTNPVATEQYGSVATNLERPGENPNN

SEQ ID NO: 65187 - protein, 33 aa, Artificial Sequence
  Description of Artificial Sequence: Synthetic polypeptide
AEEEIRTTNPVATEQYGSVSTNNNLQGTSTNLE

SEQ ID NO: 65188 - protein, 31 aa, Artificial Sequence
  Description of Artificial Sequence: Synthetic polypeptide
DEEEIRTTNPCATEQYGSVATVNLAAGEESE

SEQ ID NO: 65189 - protein, 32 aa, Artificial Sequence
  Description of Artificial Sequence: Synthetic polypeptide
AEEEIRTTNPVATEQYGSVSTNNNAITEGNNG

SEQ ID NO: 65190 - protein, 32 aa, Artificial Sequence
  Description of Artificial Sequence: Synthetic polypeptide
AEEEIRTTNPVATEQYGSVSTNNLQQNDTTDT

SEQ ID NO: 65191 - protein, 32 aa, Artificial Sequence
  Description of Artificial Sequence: Synthetic polypeptide
DEEEIATTNPVATEQYGSVATNLEQAGDEPGT

SEQ ID NO: 65192 - protein, 31 aa, Artificial Sequence
  Description of Artificial Sequence: Synthetic polypeptide
DEDEIATTNPVATEQYGSVSTTGNGDGMNRQ

SEQ ID NO: 65193 - protein, 32 aa, Artificial Sequence
  Description of Artificial Sequence: Synthetic polypeptide
AEEEIRTTNPVATEQYGSVSTNNLLNQEEQTQ

SEQ ID NO: 65194 - protein, 33 aa, Artificial Sequence
  Description of Artificial Sequence: Synthetic polypeptide
AEEEIRTTNPVATEQYGSVSTNNLLGGNQGNNS

SEQ ID NO: 65195 - protein, 33 aa, Artificial Sequence
  Description of Artificial Sequence: Synthetic polypeptide
AEEEIRTTNPVATEQYGSVSTTNLNENGNNQVE

SEQ ID NO: 65196 - protein, 34 aa, Artificial Sequence
  Description of Artificial Sequence: Synthetic polypeptide
AEEEIRTTNPVATEQYGSVSVTTNQLEQQGNQNE

SEQ ID NO: 65197 - protein, 32 aa, Artificial Sequence
  Description of Artificial Sequence: Synthetic polypeptide
AEEEIRTTNPVATEQYGSVSTNNLLEGQEEEQ

SEQ ID NO: 65198 - protein, 32 aa, Artificial Sequence
  Description of Artificial Sequence: Synthetic polypeptide
AEEEIRTTNPVATEQYGSVSTNNNDEILGNNE

SEQ ID NO: 65199 - protein, 32 aa, Artificial Sequence
  Description of Artificial Sequence: Synthetic polypeptide
DEEEIRTTNPLATEQYGSVSCCNISFRVGNND

SEQ ID NO: 65200 - protein, 28 aa, Artificial Sequence
  Description of Artificial Sequence: Synthetic peptide
DEDEIATTNPVATESYGCHSTAEQRDNF

SEQ ID NO: 65201 - protein, 33 aa, Artificial Sequence
  Description of Artificial Sequence: Synthetic polypeptide
AEEEIRTTNPVATEQYGSVSVTTNNVQNGTNGN

SEQ ID NO: 65202 - protein, 31 aa, Artificial Sequence
  Description of Artificial Sequence: Synthetic polypeptide
DEEEIRTTNPLATEQYGSVVPTVLSARGGKE

SEQ ID NO: 65203 - protein, 33 aa, Artificial Sequence
  Description of Artificial Sequence: Synthetic polypeptide
AEEEIRTTNPVATEQYGSVSTNNENQNETGNTD

SEQ ID NO: 65204 - protein, 33 aa, Artificial Sequence
  Description of Artificial Sequence: Synthetic polypeptide
AEEEIRTTNPVATEQYGSVSTNNENQETGNNED

SEQ ID NO: 65205 - protein, 32 aa, Artificial Sequence
  Description of Artificial Sequence: Synthetic polypeptide
AEEEIRTTNPVATEQYGSVSTNNELGIIQTNN

SEQ ID NO: 65206 - protein, 33 aa, Artificial Sequence
  Description of Artificial Sequence: Synthetic polypeptide
AEEEIRTTNPVATEQYGSVSTNNDQQGDEGNIE

SEQ ID NO: 65207 - protein, 33 aa, Artificial Sequence
  Description of Artificial Sequence: Synthetic polypeptide
AEEEIRTTNPVATEQYGSVSTNNDENQNETGNS

SEQ ID NO: 65208 - protein, 31 aa, Artificial Sequence
  Description of Artificial Sequence: Synthetic polypeptide
DEEEIATTNPVATEQYGSVATNLNGNGEGEH

SEQ ID NO: 65209 - protein, 32 aa, Artificial Sequence
  Description of Artificial Sequence: Synthetic polypeptide
DEEEIRTTNPLATEQYGSVSCINAISHRGGND

SEQ ID NO: 65210 - protein, 33 aa, Artificial Sequence
  Description of Artificial Sequence: Synthetic polypeptide
AEEEIRTTNPVATEQYGSVSTNNNLQGSTNQEN

SEQ ID NO: 65211 - protein, 32 aa, Artificial Sequence
  Description of Artificial Sequence: Synthetic polypeptide
CTEEIRATNPVATEQYGSVVSNTNLQNDGQTR

SEQ ID NO: 65212 - protein, 31 aa, Artificial Sequence
  Description of Artificial Sequence: Synthetic polypeptide
DEDEIATTNPVATEQYGSVSAGNLDNNNMIR

SEQ ID NO: 65213 - protein, 31 aa, Artificial Sequence
  Description of Artificial Sequence: Synthetic polypeptide
DEEEIRTTNPCATEQYGSVATVLNAQGNQQE

SEQ ID NO: 65214 - protein, 32 aa, Artificial Sequence
  Description of Artificial Sequence: Synthetic polypeptide
CTEEIRATNPVATEQYGSVVSTNLQNEGETRE

SEQ ID NO: 65215 - protein, 30 aa, Artificial Sequence
  Description of Artificial Sequence: Synthetic polypeptide
DEEEIATTNPVATEQYGSVATNLDINPEDN

SEQ ID NO: 65216 - protein, 30 aa, Artificial Sequence
  Description of Artificial Sequence: Synthetic polypeptide
DEEEIATTNPVATEQWGSVATNPDNRGDQM

SEQ ID NO: 65217 - protein, 34 aa, Artificial Sequence
  Description of Artificial Sequence: Synthetic polypeptide
AEEEIRTTNPVATEQYGSVSTNNNLNQQNGNEQV

SEQ ID NO: 65218 - protein, 33 aa, Artificial Sequence
  Description of Artificial Sequence: Synthetic polypeptide
AEEEIRTTNPVATEQYGSVSTTNLLQQQNENDT

SEQ ID NO: 65219 - protein, 31 aa, Artificial Sequence
  Description of Artificial Sequence: Synthetic polypeptide
DEEEIATTNPVATEQWGSVATANLDQAGTES

SEQ ID NO: 65220 - protein, 33 aa, Artificial Sequence
  Description of Artificial Sequence: Synthetic polypeptide
AEEEIRTTNPVATEQYGSVSTTNLLQQQNQNDE

SEQ ID NO: 65221 - protein, 31 aa, Artificial Sequence
  Description of Artificial Sequence: Synthetic polypeptide
DEEEIATTNPVATEQYGSVATNLEDPENEAE

SEQ ID NO: 65222 - protein, 30 aa, Artificial Sequence
  Description of Artificial Sequence: Synthetic polypeptide
DEDEIATTNPVATEQYGSVSATHGGQPGAF

SEQ ID NO: 65223 - protein, 31 aa, Artificial Sequence
  Description of Artificial Sequence: Synthetic polypeptide
DEEEIATTNPVATEQWGSVAMNLEQGGNPEN

SEQ ID NO: 65224 - protein, 32 aa, Artificial Sequence
  Description of Artificial Sequence: Synthetic polypeptide
DEEEIATTNPVATEQYGSVATNLEDSGDNNDI

SEQ ID NO: 65225 - protein, 30 aa, Artificial Sequence
  Description of Artificial Sequence: Synthetic polypeptide
DEEEIRTTNPCATEQYGSVATVLNAAGEEE

SEQ ID NO: 65226 - protein, 31 aa, Artificial Sequence
  Description of Artificial Sequence: Synthetic polypeptide
DEDEIATTNPVATEQYGSVCATNLTAEGNDD

SEQ ID NO: 65227 - protein, 32 aa, Artificial Sequence
  Description of Artificial Sequence: Synthetic polypeptide
DEEEIRTTNPCATEQYGSVATVLLQQGNQQED

SEQ ID NO: 65228 - protein, 33 aa, Artificial Sequence
  Description of Artificial Sequence: Synthetic polypeptide
AEEEIRTTNPVATEQYGSVSTNNNENQETGNET

SEQ ID NO: 65229 - protein, 30 aa, Artificial Sequence
  Description of Artificial Sequence: Synthetic polypeptide
DEEEIRTTNPCATEQYGSVATVLGAAQGEE

SEQ ID NO: 65230 - protein, 31 aa, Artificial Sequence
  Description of Artificial Sequence: Synthetic polypeptide
DEEEIATTNPVATEQYGSVATNLEMNPANAE

SEQ ID NO: 65231 - protein, 32 aa, Artificial Sequence
  Description of Artificial Sequence: Synthetic polypeptide
DEEEIATTNPVATEQYGSVATNLENRDGDTDM

SEQ ID NO: 65232 - protein, 34 aa, Artificial Sequence
  Description of Artificial Sequence: Synthetic polypeptide
AEEEIRTTNPVATEQYGSVSVTTNQLEQQGTNND

SEQ ID NO: 65233 - protein, 29 aa, Artificial Sequence
  Description of Artificial Sequence: Synthetic peptide
DEEEIATTNPVATEQWGSVAMNDDNNGND

SEQ ID NO: 65234 - protein, 32 aa, Artificial Sequence
  Description of Artificial Sequence: Synthetic polypeptide
DEEEIRTTNPCATEQYGSVIETEELQREVNPA

SEQ ID NO: 65235 - protein, 33 aa, Artificial Sequence
  Description of Artificial Sequence: Synthetic polypeptide
AEEEIRTTNPVATEQYGSVSTTNGNQGTVGNGV

SEQ ID NO: 65236 - protein, 33 aa, Artificial Sequence
  Description of Artificial Sequence: Synthetic polypeptide
AEEEIRTTNPVATEQYGSVSTSNLQQQGEGGIG

SEQ ID NO: 65237 - protein, 32 aa, Artificial Sequence
  Description of Artificial Sequence: Synthetic polypeptide
AEEEIRTTNPVATEQYGSVVTTNLGGNGGNDN

SEQ ID NO: 65238 - protein, 33 aa, Artificial Sequence
  Description of Artificial Sequence: Synthetic polypeptide
AEEEIRTTNPVATEQYGSVVTTNLGGQEQGENN

SEQ ID NO: 65239 - protein, 33 aa, Artificial Sequence
  Description of Artificial Sequence: Synthetic polypeptide
AEEEIRTTNPVATEQYGSVVTTNLQGNDTGNGQ

SEQ ID NO: 65240 - protein, 32 aa, Artificial Sequence
  Description of Artificial Sequence: Synthetic polypeptide
AEEEIRTTNPVATEQYGSVSTSTNLQQSTQEN

SEQ ID NO: 65241 - protein, 34 aa, Artificial Sequence
  Description of Artificial Sequence: Synthetic polypeptide
AEEEIRTTNPVATEQYGSVSTSTNLQQQGNQEED

SEQ ID NO: 65242 - protein, 33 aa, Artificial Sequence
  Description of Artificial Sequence: Synthetic polypeptide
AEEEIRTTNPVATEQYGSVSTSTNLQQNSTNPQ

SEQ ID NO: 65243 - protein, 32 aa, Artificial Sequence
  Description of Artificial Sequence: Synthetic polypeptide
AEEEIRTTNPVATEQYGSVVTTNLQQEDENNG

SEQ ID NO: 65244 - protein, 33 aa, Artificial Sequence
  Description of Artificial Sequence: Synthetic polypeptide
AEEEIRTTNPVATEQYGSVVTTNLQQGVEGING

SEQ ID NO: 65245 - protein, 32 aa, Artificial Sequence
  Description of Artificial Sequence: Synthetic polypeptide
DEAEIATTNPVATEQYGSVSAGNLERNNMNRE

SEQ ID NO: 65246 - protein, 33 aa, Artificial Sequence
  Description of Artificial Sequence: Synthetic polypeptide
AEEEIRTTNPVATEQYGSVVTTNLQQQEGTNLG

SEQ ID NO: 65247 - protein, 33 aa, Artificial Sequence
  Description of Artificial Sequence: Synthetic polypeptide
AEEEIRTTNPVATEQYGSVSTSTNLGQNSTNQT

SEQ ID NO: 65248 - protein, 33 aa, Artificial Sequence
  Description of Artificial Sequence: Synthetic polypeptide
AEEEIRTTNPVATEQYGSVSTSTNENQGQTGNT

SEQ ID NO: 65249 - protein, 33 aa, Artificial Sequence
  Description of Artificial Sequence: Synthetic polypeptide
AEEEIRTTNPVATEQYGSVSTSSNQQQTEGNED

SEQ ID NO: 65250 - protein, 31 aa, Artificial Sequence
  Description of Artificial Sequence: Synthetic polypeptide
DEAEIATTNPVATESYGSVATNLQNRNDTRA

SEQ ID NO: 65251 - protein, 34 aa, Artificial Sequence
  Description of Artificial Sequence: Synthetic polypeptide
DEEEIRTTNPCATEQYGSVSVTTNLQQQQGTNSA

SEQ ID NO: 65252 - protein, 32 aa, Artificial Sequence
  Description of Artificial Sequence: Synthetic polypeptide
DEEEIRTTNPCATEQYGSVSVTSLLDQGLQNE

SEQ ID NO: 65253 - protein, 33 aa, Artificial Sequence
  Description of Artificial Sequence: Synthetic polypeptide
AEEEIRTTNPVATEQYGSVVTTNLQSNEGNNND

SEQ ID NO: 65254 - protein, 32 aa, Artificial Sequence
  Description of Artificial Sequence: Synthetic polypeptide
DEAEIATTNPVATEQYGSVSAAANLEERGENE

SEQ ID NO: 65255 - protein, 33 aa, Artificial Sequence
  Description of Artificial Sequence: Synthetic polypeptide
AEEEIRTTNPVATEQYGSVVTTNLQSNEQGNGN

SEQ ID NO: 65256 - protein, 34 aa, Artificial Sequence
  Description of Artificial Sequence: Synthetic polypeptide
AEEEIRTTNPVATEQYGSVSTSTNNLDEQNGNND

SEQ ID NO: 65257 - protein, 30 aa, Artificial Sequence
  Description of Artificial Sequence: Synthetic polypeptide
DECEIRTTNPVCTEHYGSVSMPNLQELENL

SEQ ID NO: 65258 - protein, 31 aa, Artificial Sequence
  Description of Artificial Sequence: Synthetic polypeptide
DAAEIATTNPVATEQYGSVSTNPLQVMGPMN

SEQ ID NO: 65259 - protein, 33 aa, Artificial Sequence
  Description of Artificial Sequence: Synthetic polypeptide
AEEEIRTTNPVATEQYGSVSTSTNNLQNSTNLQ

SEQ ID NO: 65260 - protein, 33 aa, Artificial Sequence
  Description of Artificial Sequence: Synthetic polypeptide
DEEEIRTTNPCATEQYGSVTVTTNLQQGNNSAG

SEQ ID NO: 65261 - protein, 33 aa, Artificial Sequence
  Description of Artificial Sequence: Synthetic polypeptide
DEEEIRTTNPCATEQYGSVTSTDNGQGEGGNQG

SEQ ID NO: 65262 - protein, 30 aa, Artificial Sequence
  Description of Artificial Sequence: Synthetic polypeptide
DEEEIATTNPVATEQYGSASTDCQHEGEDK

SEQ ID NO: 65263 - protein, 32 aa, Artificial Sequence
  Description of Artificial Sequence: Synthetic polypeptide
AEEEIRTTNPVATEQYGSVVTTNLGGNEAGNV

SEQ ID NO: 65264 - protein, 30 aa, Artificial Sequence
  Description of Artificial Sequence: Synthetic polypeptide
DEEEIRTTNPCATEQYGSVSYNIPMTVTND

SEQ ID NO: 65265 - protein, 30 aa, Artificial Sequence
  Description of Artificial Sequence: Synthetic polypeptide
DEEEIRTTNPCATEQYGSVSYNIERPQVDQ

SEQ ID NO: 65266 - protein, 30 aa, Artificial Sequence
  Description of Artificial Sequence: Synthetic polypeptide
DECEIYTTNPVATESYGSVSPTNLTMYGET

SEQ ID NO: 65267 - protein, 32 aa, Artificial Sequence
  Description of Artificial Sequence: Synthetic polypeptide
DEAEIATTNPVATEQYGSVSANLQESGDNDNN

SEQ ID NO: 65268 - protein, 31 aa, Artificial Sequence
  Description of Artificial Sequence: Synthetic polypeptide
DECEIYTTNPVATEQYGSVSPTNLNYSGMET

SEQ ID NO: 65269 - protein, 33 aa, Artificial Sequence
  Description of Artificial Sequence: Synthetic polypeptide
DEAEIATTNPVATEQYGSVPNTNALSQRPGNNS

SEQ ID NO: 65270 - protein, 31 aa, Artificial Sequence
  Description of Artificial Sequence: Synthetic polypeptide
DEAEIATTNPVATEQYGSVSANLEADENTRD

SEQ ID NO: 65271 - protein, 30 aa, Artificial Sequence
  Description of Artificial Sequence: Synthetic polypeptide
DEDEIACTNPVATEQYGCVATNLQRDGEGN

SEQ ID NO: 65272 - protein, 32 aa, Artificial Sequence
  Description of Artificial Sequence: Synthetic polypeptide
AEEEIRTTNPVATEQYGSVSTTNDQGDEGGGG

SEQ ID NO: 65273 - protein, 33 aa, Artificial Sequence
  Description of Artificial Sequence: Synthetic polypeptide
AEEEIRTTNPVATEQYGSVSTSTNNNNQDGNNL

SEQ ID NO: 65274 - protein, 31 aa, Artificial Sequence
  Description of Artificial Sequence: Synthetic polypeptide
DEEEIATTNPVATEQYGSCAAGNNLDRDNRN

SEQ ID NO: 65275 - protein, 32 aa, Artificial Sequence
  Description of Artificial Sequence: Synthetic polypeptide
AEEEIRTTNPVATEQYGSVVTTNLGGNEGNDG

SEQ ID NO: 65276 - protein, 33 aa, Artificial Sequence
  Description of Artificial Sequence: Synthetic polypeptide
AEEEIRTTNPVATEQYGSVSTSTNNNLDEGGND

SEQ ID NO: 65277 - protein, 32 aa, Artificial Sequence
  Description of Artificial Sequence: Synthetic polypeptide
AEEEIRTTNPVATEQYGSVVTTNLGGNEGNND

SEQ ID NO: 65278 - protein, 34 aa, Artificial Sequence
  Description of Artificial Sequence: Synthetic polypeptide
DEEEIRTTNPCATEQYGSVSVVTNLQLQQGTNEA

SEQ ID NO: 65279 - protein, 31 aa, Artificial Sequence
  Description of Artificial Sequence: Synthetic polypeptide
DEEEIATTNPVATEQYGSAATNLQAEPPNEN

SEQ ID NO: 65280 - protein, 30 aa, Artificial Sequence
  Description of Artificial Sequence: Synthetic polypeptide
DEDEIACTNPVATEQYGCVATNLQRDDNSE

SEQ ID NO: 65281 - protein, 33 aa, Artificial Sequence
  Description of Artificial Sequence: Synthetic polypeptide
AEEEIRTTNPVATEQYGSVVTTNLQSNETGNND

SEQ ID NO: 65282 - protein, 34 aa, Artificial Sequence
  Description of Artificial Sequence: Synthetic polypeptide
DEEEIRTTNPCATEQYGSVSVTNQLNQQQGTNSA

SEQ ID NO: 65283 - protein, 30 aa, Artificial Sequence
  Description of Artificial Sequence: Synthetic polypeptide
DECEIRTTNPVAYEQYGVCSTGLQRPNTDS

SEQ ID NO: 65284 - protein, 29 aa, Artificial Sequence
  Description of Artificial Sequence: Synthetic peptide
DEDEIACTNPVATEQYGSVATNLEDPGAE

SEQ ID NO: 65285 - protein, 32 aa, Artificial Sequence
  Description of Artificial Sequence: Synthetic polypeptide
DEEEIRTTNPCATEQYGSVSTVTNTNFEQGND

SEQ ID NO: 65286 - protein, 29 aa, Artificial Sequence
  Description of Artificial Sequence: Synthetic peptide
DECEIRTTNPVAYEQYGVCSTGDQRPNDN

SEQ ID NO: 65287 - protein, 32 aa, Artificial Sequence
  Description of Artificial Sequence: Synthetic polypeptide
DEEEIATTNPVATEQYGMVSTNLQQGGDGGHS

SEQ ID NO: 65288 - protein, 30 aa, Artificial Sequence
  Description of Artificial Sequence: Synthetic polypeptide
DEDEIACTNPVATEQYGSVATNLQAAENNE

SEQ ID NO: 65289 - protein, 32 aa, Artificial Sequence
  Description of Artificial Sequence: Synthetic polypeptide
DEEEIATTNPVATEQYGSCPMTENLEADIGNR

SEQ ID NO: 65290 - protein, 32 aa, Artificial Sequence
  Description of Artificial Sequence: Synthetic polypeptide
DEDEIACTNPVATEQYGSVATNLQDRGGNDTA

SEQ ID NO: 65291 - protein, 33 aa, Artificial Sequence
  Description of Artificial Sequence: Synthetic polypeptide
DEEEIRTTNPCATEQYGSVSTVSNGIQEQGNND

SEQ ID NO: 65292 - protein, 33 aa, Artificial Sequence
  Description of Artificial Sequence: Synthetic polypeptide
DEEEIRTTNPCATEQYGSVSTVQNNIQEQGNVD

SEQ ID NO: 65293 - protein, 33 aa, Artificial Sequence
  Description of Artificial Sequence: Synthetic polypeptide
DEEEIRTTNPCATEQYGSVSTVVNIQEQGNTDN

SEQ ID NO: 65294 - protein, 32 aa, Artificial Sequence
  Description of Artificial Sequence: Synthetic polypeptide
AEEEIRTTNPVATEQYGSVVTTNNLGDTGENG

SEQ ID NO: 65295 - protein, 31 aa, Artificial Sequence
  Description of Artificial Sequence: Synthetic polypeptide
DEDEIACTNPVATEQYGSVATNLQNSDNNGR

SEQ ID NO: 65296 - protein, 32 aa, Artificial Sequence
  Description of Artificial Sequence: Synthetic polypeptide
DEAEIATTNPVATEQYGSVCSTNDQHQGNNHS

SEQ ID NO: 65297 - protein, 31 aa, Artificial Sequence
  Description of Artificial Sequence: Synthetic polypeptide
DEAEIATTNPVATETWGTVSTNLQGQDGDNR

SEQ ID NO: 65298 - protein, 33 aa, Artificial Sequence
  Description of Artificial Sequence: Synthetic polypeptide
AEEEIRTTNPVATEQYGSVVTTNNLGNQEGQNE

SEQ ID NO: 65299 - protein, 32 aa, Artificial Sequence
  Description of Artificial Sequence: Synthetic polypeptide
AEEEIRTTNPVATEQYGSVSTTNDVQQNENND

SEQ ID NO: 65300 - protein, 32 aa, Artificial Sequence
  Description of Artificial Sequence: Synthetic polypeptide
DEEEIATTNPVATEQYGEVSTTNLGEGDGNTS

SEQ ID NO: 65301 - protein, 32 aa, Artificial Sequence
  Description of Artificial Sequence: Synthetic polypeptide
DEDEIACTNPVATEQYGSVATNLQQGEGNPRE

SEQ ID NO: 65302 - protein, 31 aa, Artificial Sequence
  Description of Artificial Sequence: Synthetic polypeptide
DEDEIACTNPVATEQYGSVATNLQQGGNVQD

SEQ ID NO: 65303 - protein, 31 aa, Artificial Sequence
  Description of Artificial Sequence: Synthetic polypeptide
DEDEIACTNPVATEQYGSVATNLQRDENNSE

SEQ ID NO: 65304 - protein, 34 aa, Artificial Sequence
  Description of Artificial Sequence: Synthetic polypeptide
DEAEIATTNPVATEQYGSVCSTNPLQDAGENTRQ

SEQ ID NO: 65305 - protein, 32 aa, Artificial Sequence
  Description of Artificial Sequence: Synthetic polypeptide
AEEEIRTTNPVATEQYGSVTTNNQQEGNNTEI

SEQ ID NO: 65306 - protein, 32 aa, Artificial Sequence
  Description of Artificial Sequence: Synthetic polypeptide
DEAEIATTNPVATEQYGSVCTNLPEQGFDNQR

SEQ ID NO: 65307 - protein, 30 aa, Artificial Sequence
  Description of Artificial Sequence: Synthetic polypeptide
DEEEIRTTNPCAYEQYGSVSVNIFHGDNDH

SEQ ID NO: 65308 - protein, 33 aa, Artificial Sequence
  Description of Artificial Sequence: Synthetic polypeptide
AEEEIRTTNPVATEQYGSVVTTNNGNLQQGNIE

SEQ ID NO: 65309 - protein, 33 aa, Artificial Sequence
  Description of Artificial Sequence: Synthetic polypeptide
AEEEIRTTNPVATEQYGSVVTTNNGNLQQGTNI

SEQ ID NO: 65310 - protein, 33 aa, Artificial Sequence
  Description of Artificial Sequence: Synthetic polypeptide
DEEEIRTTNPCATEQYGSVSVTNDIGTRVGDND

SEQ ID NO: 65311 - protein, 33 aa, Artificial Sequence
  Description of Artificial Sequence: Synthetic polypeptide
AEEEIRTTNPVATEQYGSVSTSQNNNEQGGNQD

SEQ ID NO: 65312 - protein, 32 aa, Artificial Sequence
  Description of Artificial Sequence: Synthetic polypeptide
AEEEIRTTNPVATEQYGSVSTSQNNDTNGNDN

SEQ ID NO: 65313 - protein, 32 aa, Artificial Sequence
  Description of Artificial Sequence: Synthetic polypeptide
AEEEIRTTNPVATEQYGSVSTSQNNDETGNNV

SEQ ID NO: 65314 - protein, 33 aa, Artificial Sequence
  Description of Artificial Sequence: Synthetic polypeptide
DEEEIRTTNPCAYEQYGSTVCATNLQRGDNEAM

SEQ ID NO: 65315 - protein, 32 aa, Artificial Sequence
  Description of Artificial Sequence: Synthetic polypeptide
DEEEIRTTNPCAYEQYGSTVSCTNLSQGSSRF

SEQ ID NO: 65316 - protein, 33 aa, Artificial Sequence
  Description of Artificial Sequence: Synthetic polypeptide
DEEEIRTTNPCAYEQYGSVCSCTNLSQAGGNMF

SEQ ID NO: 65317 - protein, 30 aa, Artificial Sequence
  Description of Artificial Sequence: Synthetic polypeptide
DEEEIRTTNPCATEQYGSVSVEEISRVNNG

SEQ ID NO: 65318 - protein, 31 aa, Artificial Sequence
  Description of Artificial Sequence: Synthetic polypeptide
DEAEIATTNPVATEQYGSVCTPNLQDGPQDD

SEQ ID NO: 65319 - protein, 30 aa, Artificial Sequence
  Description of Artificial Sequence: Synthetic polypeptide
DEEEIRTTNPCAYEQYGSVPCTWLARGGSE

SEQ ID NO: 65320 - protein, 29 aa, Artificial Sequence
  Description of Artificial Sequence: Synthetic peptide
DEEEIRTTNPCAYEQYGSVPNWLARGDEW

SEQ ID NO: 65321 - protein, 30 aa, Artificial Sequence
  Description of Artificial Sequence: Synthetic polypeptide
DEEEIRTTNPCATEQYGSVSVNIPTVMNDQ

SEQ ID NO: 65322 - protein, 31 aa, Artificial Sequence
  Description of Artificial Sequence: Synthetic polypeptide
DEEEIRTTNPCATEQYGSVSVNIPRVTNNDY

SEQ ID NO: 65323 - protein, 33 aa, Artificial Sequence
  Description of Artificial Sequence: Synthetic polypeptide
DEEEIRTTNPCAYEQYGSVPSYNALSQRGGNND

SEQ ID NO: 65324 - protein, 31 aa, Artificial Sequence
  Description of Artificial Sequence: Synthetic polypeptide
DEEEIRTTNPCAYEQYGSVSCTDLSQAGGSE

SEQ ID NO: 65325 - protein, 32 aa, Artificial Sequence
  Description of Artificial Sequence: Synthetic polypeptide
DEEEIRTTNPCAYEQYGSVSCTNLSQAGGSTA

SEQ ID NO: 65326 - protein, 29 aa, Artificial Sequence
  Description of Artificial Sequence: Synthetic peptide
DEDEIACTNPVATEQYGSVATALIRMNGM

SEQ ID NO: 65327 - protein, 30 aa, Artificial Sequence
  Description of Artificial Sequence: Synthetic polypeptide
DEEEIRTTNPCAYEQYGSVSGNIPFHGNDM

SEQ ID NO: 65328 - protein, 33 aa, Artificial Sequence
  Description of Artificial Sequence: Synthetic polypeptide
AEEEIRTTNPVATEQYGSVSVVTNNQQQGNNST

SEQ ID NO: 65329 - protein, 33 aa, Artificial Sequence
  Description of Artificial Sequence: Synthetic polypeptide
AEEEIRTTNPVATEQYGSVTTTNLQNQENGNNQ

SEQ ID NO: 65330 - protein, 33 aa, Artificial Sequence
  Description of Artificial Sequence: Synthetic polypeptide
AEEEIRTTNPVATEQYGSVTTTNLQQGTNGEDT

SEQ ID NO: 65331 - protein, 29 aa, Artificial Sequence
  Description of Artificial Sequence: Synthetic peptide
DECNIRTTNPVATEQYGVVHTHKLERPND

SEQ ID NO: 65332 - protein, 32 aa, Artificial Sequence
  Description of Artificial Sequence: Synthetic polypeptide
DEEEIRTTNPCATETYGSVSTESVQNQQGNQR

SEQ ID NO: 65333 - protein, 33 aa, Artificial Sequence
  Description of Artificial Sequence: Synthetic polypeptide
AEEEIRTTNPVATEQYGSVVTNLQNQEGTNQGE

SEQ ID NO: 65334 - protein, 30 aa, Artificial Sequence
  Description of Artificial Sequence: Synthetic polypeptide
DEEEIRTTNPCATEVYGSVCYNIEDRGHND

SEQ ID NO: 65335 - protein, 33 aa, Artificial Sequence
  Description of Artificial Sequence: Synthetic polypeptide
AEEEIRTTNPVATEQYGSVVTNLQQGTNGENDQ

SEQ ID NO: 65336 - protein, 33 aa, Artificial Sequence
  Description of Artificial Sequence: Synthetic polypeptide
AEEEIRTTNPVATEQYGSVVTNLQSNELGGNND

SEQ ID NO: 65337 - protein, 31 aa, Artificial Sequence
  Description of Artificial Sequence: Synthetic polypeptide
AEEEIRTTNPVATEQYGSVTVTNDQGTNVTE

SEQ ID NO: 65338 - protein, 32 aa, Artificial Sequence
  Description of Artificial Sequence: Synthetic polypeptide
AEEEIRTTNPVATEQYGSVSTTDQQLGIENND

SEQ ID NO: 65339 - protein, 33 aa, Artificial Sequence
  Description of Artificial Sequence: Synthetic polypeptide
AEEEIRTTNPVATEQYGSVSTTNAQGTNLGNNY

SEQ ID NO: 65340 - protein, 30 aa, Artificial Sequence
  Description of Artificial Sequence: Synthetic polypeptide
DECTICTTNPVATEQYGSVTVTNELIIGNL

SEQ ID NO: 65341 - protein, 33 aa, Artificial Sequence
  Description of Artificial Sequence: Synthetic polypeptide
AEEEIRTTNPVATEQYGSVTVTNNLQNNNGIND

SEQ ID NO: 65342 - protein, 31 aa, Artificial Sequence
  Description of Artificial Sequence: Synthetic polypeptide
DECTICTTNPVATEQYGSVTVSTENLIIGNL

SEQ ID NO: 65343 - protein, 32 aa, Artificial Sequence
  Description of Artificial Sequence: Synthetic polypeptide
AEEEIRTTNPVATEQYGSVVTNTNLQNQENNV

SEQ ID NO: 65344 - protein, 33 aa, Artificial Sequence
  Description of Artificial Sequence: Synthetic polypeptide
AEEEIRTTNPVATEQYGSVVTNTNLQQGNGNVN

SEQ ID NO: 65345 - protein, 33 aa, Artificial Sequence
  Description of Artificial Sequence: Synthetic polypeptide
AEEEIRTTNPVATEQYGSVVTNTNLQSGNNNNF

SEQ ID NO: 65346 - protein, 30 aa, Artificial Sequence
  Description of Artificial Sequence: Synthetic polypeptide
DEAEIATTNPVATEQYGSVSTPNLENDMEA

SEQ ID NO: 65347 - protein, 33 aa, Artificial Sequence
  Description of Artificial Sequence: Synthetic polypeptide
DEAEIATTNPVATEQYGSVSTNPLPQTQAGDNN

SEQ ID NO: 65348 - protein, 29 aa, Artificial Sequence
  Description of Artificial Sequence: Synthetic peptide
DEEEIRTTNPCATTQYGTVATTLQQSTNV

SEQ ID NO: 65349 - protein, 33 aa, Artificial Sequence
  Description of Artificial Sequence: Synthetic polypeptide
AEEEIRTTNPVATEQYGSVVTNTNNNNQEGENR

SEQ ID NO: 65350 - protein, 33 aa, Artificial Sequence
  Description of Artificial Sequence: Synthetic polypeptide
AEEEIRTTNPVATEQYGSVVTSGTNLQNNENNT

SEQ ID NO: 65351 - protein, 30 aa, Artificial Sequence
  Description of Artificial Sequence: Synthetic polypeptide
DAAEIATTNPVATEQYGSVATNLQGNQEGD

SEQ ID NO: 65352 - protein, 34 aa, Artificial Sequence
  Description of Artificial Sequence: Synthetic polypeptide
AEEEIRTTNPVATEQYGSVVTNSTNLQQGTVGNQ

SEQ ID NO: 65353 - protein, 33 aa, Artificial Sequence
  Description of Artificial Sequence: Synthetic polypeptide
AEEEIRTTNPVATEQYGSVVTSGTNNNNQDGNL

SEQ ID NO: 65354 - protein, 30 aa, Artificial Sequence
  Description of Artificial Sequence: Synthetic polypeptide
DEEEIRTTNPCATESYGSVVATLHEERGNQ

SEQ ID NO: 65355 - protein, 29 aa, Artificial Sequence
  Description of Artificial Sequence: Synthetic peptide
DEEEIRTTNPCATESYGSVATLHERANGA

SEQ ID NO: 65356 - protein, 32 aa, Artificial Sequence
  Description of Artificial Sequence: Synthetic polypeptide
AEEEIRTTNPVATEQYGSVVNTNNQNNGGNVG

SEQ ID NO: 65357 - protein, 31 aa, Artificial Sequence
  Description of Artificial Sequence: Synthetic polypeptide
AEEEIRTTNPVATEQYGSVVNTNVDTGVNNT

SEQ ID NO: 65358 - protein, 34 aa, Artificial Sequence
  Description of Artificial Sequence: Synthetic polypeptide
AEEEIRTTNPVATEQYGSVSTTLNLGNQEGTNEG

SEQ ID NO: 65359 - protein, 33 aa, Artificial Sequence
  Description of Artificial Sequence: Synthetic polypeptide
AEEEIRTTNPVATEQYGSVSTTLNQQIQGTNDE

SEQ ID NO: 65360 - protein, 33 aa, Artificial Sequence
  Description of Artificial Sequence: Synthetic polypeptide
AEEEIRTTNPVATEQYGSVSTTLEQGIGNQTEQ

SEQ ID NO: 65361 - protein, 33 aa, Artificial Sequence
  Description of Artificial Sequence: Synthetic polypeptide
AEEEIRTTNPVATEQYGSVSTTLNQQQTGTNDE

SEQ ID NO: 65362 - protein, 33 aa, Artificial Sequence
  Description of Artificial Sequence: Synthetic polypeptide
AEEEIRTTNPVATEQYGSVVTNANLQNQEGNGV

SEQ ID NO: 65363 - protein, 30 aa, Artificial Sequence
  Description of Artificial Sequence: Synthetic polypeptide
DEDAIRTTNPVATEQYDYCVSIELQRGDNE

SEQ ID NO: 65364 - protein, 33 aa, Artificial Sequence
  Description of Artificial Sequence: Synthetic polypeptide
AEEEIRTTNPVATEQYGSVSTTGNQQTANGNNV

SEQ ID NO: 65365 - protein, 31 aa, Artificial Sequence
  Description of Artificial Sequence: Synthetic polypeptide
DEEEIRTTNPCATESYGSVATNTHEVRGNEQ

SEQ ID NO: 65366 - protein, 31 aa, Artificial Sequence
  Description of Artificial Sequence: Synthetic polypeptide
DECVIGTTNPVATEQDGSVSTNDFLQRGIDE

SEQ ID NO: 65367 - protein, 32 aa, Artificial Sequence
  Description of Artificial Sequence: Synthetic polypeptide
AEEEIRTTNPVATEQYGSVSTTEQQDTNSGNN

SEQ ID NO: 65368 - protein, 29 aa, Artificial Sequence
  Description of Artificial Sequence: Synthetic peptide
DEEEIRTTNPCATESYGSCSNHLARGQPW

SEQ ID NO: 65369 - protein, 33 aa, Artificial Sequence
  Description of Artificial Sequence: Synthetic polypeptide
AEEEIRTTNPVATEQYGSVSTTLQQLGNDEGND

SEQ ID NO: 65370 - protein, 30 aa, Artificial Sequence
  Description of Artificial Sequence: Synthetic polypeptide
DECTICTTNPVATEQYGSVTVVTNLEIGNL

SEQ ID NO: 65371 - protein, 29 aa, Artificial Sequence
  Description of Artificial Sequence: Synthetic peptide
DEDEIACTNPVATAQYGCVATNLERGNPM

SEQ ID NO: 65372 - protein, 32 aa, Artificial Sequence
  Description of Artificial Sequence: Synthetic polypeptide
AEEEIRTTNPVATEQYGSVSTTENNIDETGND

SEQ ID NO: 65373 - protein, 32 aa, Artificial Sequence
  Description of Artificial Sequence: Synthetic polypeptide
AEEEIRTTNPVATEQYGSVSTTLVNGNEGGDD

SEQ ID NO: 65374 - protein, 32 aa, Artificial Sequence
  Description of Artificial Sequence: Synthetic polypeptide
AEEEIRTTNPVATEQYGSVTVTPNDQEGNEQI

SEQ ID NO: 65375 - protein, 33 aa, Artificial Sequence
  Description of Artificial Sequence: Synthetic polypeptide
AEEEIRTTNPVATEQYGSVVTNLNQNQEGTNEG

SEQ ID NO: 65376 - protein, 32 aa, Artificial Sequence
  Description of Artificial Sequence: Synthetic polypeptide
AEEEIRTTNPVATEQYGSVVTNLLQNNEQGTS

SEQ ID NO: 65377 - protein, 33 aa, Artificial Sequence
  Description of Artificial Sequence: Synthetic polypeptide
AEEEIRTTNPVATEQYGSVSTSQNGENQQTGNT

SEQ ID NO: 65378 - protein, 33 aa, Artificial Sequence
  Description of Artificial Sequence: Synthetic polypeptide
AEEEIRTTNPVATEQYGSVVTSGVNLQQGNNTG

SEQ ID NO: 65379 - protein, 32 aa, Artificial Sequence
  Description of Artificial Sequence: Synthetic polypeptide
AEEEIRTTNPVATEQYGSVVTSNTNNQNGIVG

SEQ ID NO: 65380 - protein, 32 aa, Artificial Sequence
  Description of Artificial Sequence: Synthetic polypeptide
AEEEIRTTNPVATEQYGSVSTTANNNEGNGNQ

SEQ ID NO: 65381 - protein, 32 aa, Artificial Sequence
  Description of Artificial Sequence: Synthetic polypeptide
AEEEIRTTNPVATEQYGSVSTTANNNEGGNEQ

SEQ ID NO: 65382 - protein, 32 aa, Artificial Sequence
  Description of Artificial Sequence: Synthetic polypeptide
AEEEIRTTNPVATEQYGSVVTTNEQQQGEGNI

SEQ ID NO: 65383 - protein, 33 aa, Artificial Sequence
  Description of Artificial Sequence: Synthetic polypeptide
AEEEIRTTNPVATEQYGSVVTTNGNLQAGNNIE

SEQ ID NO: 65384 - protein, 32 aa, Artificial Sequence
  Description of Artificial Sequence: Synthetic polypeptide
AEEEIRTTNPVATEQYGSVSTTANLGNENNNY

SEQ ID NO: 65385 - protein, 31 aa, Artificial Sequence
  Description of Artificial Sequence: Synthetic polypeptide
DEAEIATTNPVATEQYGSVSGTPLQAPNNDN

SEQ ID NO: 65386 - protein, 32 aa, Artificial Sequence
  Description of Artificial Sequence: Synthetic polypeptide
AEEEIRTTNPVATEQYGSVSTTANENSEGGNQ

SEQ ID NO: 65387 - protein, 33 aa, Artificial Sequence
  Description of Artificial Sequence: Synthetic polypeptide
AEEEIRTTNPVATEQYGSVVTTNGNLQAGTNIG

SEQ ID NO: 65388 - protein, 34 aa, Artificial Sequence
  Description of Artificial Sequence: Synthetic polypeptide
AEEEIRTTNPVATEQYGSVSTSVTNLQQGTNQQE

SEQ ID NO: 65389 - protein, 33 aa, Artificial Sequence
  Description of Artificial Sequence: Synthetic polypeptide
AEEEIRTTNPVATEQYGSVSTTANNNQEGGNQT

SEQ ID NO: 65390 - protein, 32 aa, Artificial Sequence
  Description of Artificial Sequence: Synthetic polypeptide
AEEEIRTTNPVATEQYGSVVTTNGNLQGNTIV

SEQ ID NO: 65391 - protein, 32 aa, Artificial Sequence
  Description of Artificial Sequence: Synthetic polypeptide
AEEEIRTTNPVATEQYGSVTTTNLQQNEENNS

SEQ ID NO: 65392 - protein, 32 aa, Artificial Sequence
  Description of Artificial Sequence: Synthetic polypeptide
AEEEIRTTNPVATEQYGSVVTTNGNQEGENGE

SEQ ID NO: 65393 - protein, 28 aa, Artificial Sequence
  Description of Artificial Sequence: Synthetic peptide
DEEEIATTNPVATEQYGSAPEVLQHEEK

SEQ ID NO: 65394 - protein, 31 aa, Artificial Sequence
  Description of Artificial Sequence: Synthetic polypeptide
AEEEIRTTNPVATEQYGSVVTTNGNQEQENN

SEQ ID NO: 65395 - protein, 31 aa, Artificial Sequence
  Description of Artificial Sequence: Synthetic polypeptide
DEAEIATTNPVATEQYGSVSATNLTANGDDD

SEQ ID NO: 65396 - protein, 33 aa, Artificial Sequence
  Description of Artificial Sequence: Synthetic polypeptide
AEEEIRTTNPVATEQYGSVVTTNLEQGTVGNNN

SEQ ID NO: 65397 - protein, 29 aa, Artificial Sequence
  Description of Artificial Sequence: Synthetic peptide
DEEEIATTNPVATEQYGSAPTVLQHEEEK

SEQ ID NO: 65398 - protein, 32 aa, Artificial Sequence
  Description of Artificial Sequence: Synthetic polypeptide
AEEEIRTTNPVATEQYGSVVTTNLGGEQGNNL

SEQ ID NO: 65399 - protein, 33 aa, Artificial Sequence
  Description of Artificial Sequence: Synthetic polypeptide
AEEEIRTTNPVATEQYGSVSTSTTNLQNSTNQL

SEQ ID NO: 65400 - protein, 31 aa, Artificial Sequence
  Description of Artificial Sequence: Synthetic polypeptide
AEEEIRTTNPVATEQYGSVVTTNGNLTGNIG

SEQ ID NO: 65401 - protein, 33 aa, Artificial Sequence
  Description of Artificial Sequence: Synthetic polypeptide
AEEEIRTTNPVATEQYGSVVTSNANLGNQTGNT

SEQ ID NO: 65402 - protein, 29 aa, Artificial Sequence
  Description of Artificial Sequence: Synthetic peptide
DEEEIATTNPVATEQYGSAPAEVLQHGEL

SEQ ID NO: 65403 - protein, 33 aa, Artificial Sequence
  Description of Artificial Sequence: Synthetic polypeptide
AEEEIRTTNPVATEQYGSVVTTANLGNQEGNVT

SEQ ID NO: 65404 - protein, 33 aa, Artificial Sequence
  Description of Artificial Sequence: Synthetic polypeptide
AEEEIRTTNPVATEQYGSVVTSTNLLQNQENNT

SEQ ID NO: 65405 - protein, 33 aa, Artificial Sequence
  Description of Artificial Sequence: Synthetic polypeptide
AEEEIRTTNPVATEQYGSVVTSTNLNQNNENNM

SEQ ID NO: 65406 - protein, 32 aa, Artificial Sequence
  Description of Artificial Sequence: Synthetic polypeptide
DEAEIATTNPVATEQYGSVSTNLQGDSGGDAM

SEQ ID NO: 65407 - protein, 33 aa, Artificial Sequence
  Description of Artificial Sequence: Synthetic polypeptide
AEEEIRTTNPVATEQYGSVVTSTNLQNNENQNA

SEQ ID NO: 65408 - protein, 32 aa, Artificial Sequence
  Description of Artificial Sequence: Synthetic polypeptide
AEEEIRTTNPVATEQYGSVSTTDNGEQGTTNQ

SEQ ID NO: 65409 - protein, 33 aa, Artificial Sequence
  Description of Artificial Sequence: Synthetic polypeptide
AEEEIRTTNPVATEQYGSVVTSTNLQNQENNNS

SEQ ID NO: 65410 - protein, 33 aa, Artificial Sequence
  Description of Artificial Sequence: Synthetic polypeptide
AEEEIRTTNPVATEQYGSVVTSTNLQNQENNQF

SEQ ID NO: 65411 - protein, 33 aa, Artificial Sequence
  Description of Artificial Sequence: Synthetic polypeptide
AEEEIRTTNPVATEQYGSVVTSTNLQQNVENNQ

SEQ ID NO: 65412 - protein, 33 aa, Artificial Sequence
  Description of Artificial Sequence: Synthetic polypeptide
AEEEIRTTNPVATEQYGSVVTSTNNLQNNENNQ

SEQ ID NO: 65413 - protein, 32 aa, Artificial Sequence
  Description of Artificial Sequence: Synthetic polypeptide
AEEEIRTTNPVATEQYGSVSTTANQNEGEGNE

SEQ ID NO: 65414 - protein, 33 aa, Artificial Sequence
  Description of Artificial Sequence: Synthetic polypeptide
AEEEIRTTNPVATEQYGSVVTSTNNNQQGENGS

SEQ ID NO: 65415 - protein, 30 aa, Artificial Sequence
  Description of Artificial Sequence: Synthetic polypeptide
DEEEIRTTNPCAYDQYGQVPPTDLSQRGNF

SEQ ID NO: 65416 - protein, 30 aa, Artificial Sequence
  Description of Artificial Sequence: Synthetic polypeptide
AEEEIRTTNPVATEQYGSVVTSTTGAGNGN

SEQ ID NO: 65417 - protein, 30 aa, Artificial Sequence
  Description of Artificial Sequence: Synthetic polypeptide
DEEEIRTTNPCAYEAYGISVACTNHGRGNA

SEQ ID NO: 65418 - protein, 30 aa, Artificial Sequence
  Description of Artificial Sequence: Synthetic polypeptide
DAAEIATTNPVATEQYGSVCTNPLQSMMDR

SEQ ID NO: 65419 - protein, 33 aa, Artificial Sequence
  Description of Artificial Sequence: Synthetic polypeptide
AEEEIRTTNPVATEQYGSVVTSTTNNNQDGNNL

SEQ ID NO: 65420 - protein, 32 aa, Artificial Sequence
  Description of Artificial Sequence: Synthetic polypeptide
DEAEIATTNPVATEQYGSVSLNNTLRQTGNDM

SEQ ID NO: 65421 - protein, 32 aa, Artificial Sequence
  Description of Artificial Sequence: Synthetic polypeptide
AEEEIRTTNPVATEQYGSVSTTANQNEGGNQQ

SEQ ID NO: 65422 - protein, 33 aa, Artificial Sequence
  Description of Artificial Sequence: Synthetic polypeptide
AEEEIRTTNPVATEQYGSVVTSVTNLQNQENNN

SEQ ID NO: 65423 - protein, 33 aa, Artificial Sequence
  Description of Artificial Sequence: Synthetic polypeptide
AEEEIRTTNPVATEQYGSVVTSVTNNNQDGGNL

SEQ ID NO: 65424 - protein, 33 aa, Artificial Sequence
  Description of Artificial Sequence: Synthetic polypeptide
AEEEIRTTNPVATEQYGSVVTSTNNQQQGNGSG

SEQ ID NO: 65425 - protein, 32 aa, Artificial Sequence
  Description of Artificial Sequence: Synthetic polypeptide
AEEEIRTTNPVATEQYGSVSTSQNDTNQGTND

SEQ ID NO: 65426 - protein, 33 aa, Artificial Sequence
  Description of Artificial Sequence: Synthetic polypeptide
DEEEIRTTNPCATEQYGSVSTVNNQIQEQGEND

SEQ ID NO: 65427 - protein, 33 aa, Artificial Sequence
  Description of Artificial Sequence: Synthetic polypeptide
AEEEIRTTNPVATEQYGSVVTTNNLLQEIGNNV

SEQ ID NO: 65428 - protein, 30 aa, Artificial Sequence
  Description of Artificial Sequence: Synthetic polypeptide
DEEEIRTTNPEATEQYGSVPTWLHFSGEIE

SEQ ID NO: 65429 - protein, 32 aa, Artificial Sequence
  Description of Artificial Sequence: Synthetic polypeptide
AEEEIRTTNPVATEQYGSVSVVNLQNGEQGQT

SEQ ID NO: 65430 - protein, 31 aa, Artificial Sequence
  Description of Artificial Sequence: Synthetic polypeptide
DEEEIRTTNPCATEQYGSVPVTALVATRGGE

SEQ ID NO: 65431 - protein, 31 aa, Artificial Sequence
  Description of Artificial Sequence: Synthetic polypeptide
DEEEIRTTNPCATEQYGSVPVTALVARIGVE

SEQ ID NO: 65432 - protein, 29 aa, Artificial Sequence
  Description of Artificial Sequence: Synthetic peptide
DEDEIATTNPVATAQWGCVSTALERGNDQ

SEQ ID NO: 65433 - protein, 31 aa, Artificial Sequence
  Description of Artificial Sequence: Synthetic polypeptide
DEEEIRTTNPCATEQYGSVPVTALVARGETE

SEQ ID NO: 65434 - protein, 30 aa, Artificial Sequence
  Description of Artificial Sequence: Synthetic polypeptide
DEAEIATTNPVAYDQYGKVSCTALSQPGNR

SEQ ID NO: 65435 - protein, 32 aa, Artificial Sequence
  Description of Artificial Sequence: Synthetic polypeptide
AEEEIRTTNPVATEQYGSVSVTVVNQQQTNNE

SEQ ID NO: 65436 - protein, 32 aa, Artificial Sequence
  Description of Artificial Sequence: Synthetic polypeptide
AEEEIRTTNPVATEQYGSVVTTVNTNQEGENG

SEQ ID NO: 65437 - protein, 32 aa, Artificial Sequence
  Description of Artificial Sequence: Synthetic polypeptide
AEEEIRTTNPVATEQYGSVSVVNLQQNDEIND

SEQ ID NO: 65438 - protein, 33 aa, Artificial Sequence
  Description of Artificial Sequence: Synthetic polypeptide
AEEEIRTTNPVATEQYGSVSTTNGEQNQGGNNT

SEQ ID NO: 65439 - protein, 31 aa, Artificial Sequence
  Description of Artificial Sequence: Synthetic polypeptide
DEEEIRTTNPEATQQYGEVCTIDDLDQRGNF

SEQ ID NO: 65440 - protein, 32 aa, Artificial Sequence
  Description of Artificial Sequence: Synthetic polypeptide
DECEIRTTNPVATECYGVVSTNLQGDAGNGEH

SEQ ID NO: 65441 - protein, 31 aa, Artificial Sequence
  Description of Artificial Sequence: Synthetic polypeptide
DEEEIRTTNPEATQQYGEVCTIDLGQRQGNS

SEQ ID NO: 65442 - protein, 31 aa, Artificial Sequence
  Description of Artificial Sequence: Synthetic polypeptide
DEEEIRTTNPEATQQYGEVCTIDLHQREGNA

SEQ ID NO: 65443 - protein, 29 aa, Artificial Sequence
  Description of Artificial Sequence: Synthetic peptide
DEDEIATTNPVATAQWGSVATALQNGNDN

SEQ ID NO: 65444 - protein, 30 aa, Artificial Sequence
  Description of Artificial Sequence: Synthetic polypeptide
DEEEIRTTNPEATQQYGEVCTIDLQQHGNF

SEQ ID NO: 65445 - protein, 32 aa, Artificial Sequence
  Description of Artificial Sequence: Synthetic polypeptide
DEAEIATTNPVATEQYGSVCATNPLQDQGNED

SEQ ID NO: 65446 - protein, 33 aa, Artificial Sequence
  Description of Artificial Sequence: Synthetic polypeptide
DEAEIATTNPVATEQYGSVCATNLEAREGDNRE

SEQ ID NO: 65447 - protein, 33 aa, Artificial Sequence
  Description of Artificial Sequence: Synthetic polypeptide
DEEEIATTNPVATEQYGSVAATANLQESMGNDV

SEQ ID NO: 65448 - protein, 33 aa, Artificial Sequence
  Description of Artificial Sequence: Synthetic polypeptide
AEEEIRTTNPVATEQYGSVSTTNGEQQEGGNNN

SEQ ID NO: 65449 - protein, 30 aa, Artificial Sequence
  Description of Artificial Sequence: Synthetic polypeptide
DEEEIRTTNPCATEQYGSVPVAALVARGME

SEQ ID NO: 65450 - protein, 32 aa, Artificial Sequence
  Description of Artificial Sequence: Synthetic polypeptide
DEEEIRTTNPCATEQYGSVSATNIGFHGDNSA

SEQ ID NO: 65451 - protein, 31 aa, Artificial Sequence
  Description of Artificial Sequence: Synthetic polypeptide
DEEEIRTTNPEATEQYGSVPTWLARGGKFEG

SEQ ID NO: 65452 - protein, 31 aa, Artificial Sequence
  Description of Artificial Sequence: Synthetic polypeptide
DEEEIRTTNPEATEQYGSVCPTELARGSVQA

SEQ ID NO: 65453 - protein, 30 aa, Artificial Sequence
  Description of Artificial Sequence: Synthetic polypeptide
DEEEIRTTNPEATEQYGSVCPTGELANGEQ

SEQ ID NO: 65454 - protein, 34 aa, Artificial Sequence
  Description of Artificial Sequence: Synthetic polypeptide
AEEEIRTTNPVATEQYGSVSTSNNNLQTGTQEND

SEQ ID NO: 65455 - protein, 30 aa, Artificial Sequence
  Description of Artificial Sequence: Synthetic polypeptide
DEDEIACTNPVAYEQYGSVATNLQDDGDNH

SEQ ID NO: 65456 - protein, 30 aa, Artificial Sequence
  Description of Artificial Sequence: Synthetic polypeptide
DEDEIACTNPVAYEQYGSVATNLQNGDNDQ

SEQ ID NO: 65457 - protein, 32 aa, Artificial Sequence
  Description of Artificial Sequence: Synthetic polypeptide
DECEIRTTNPVATEQYGSVATGPNGQDAGGNV

SEQ ID NO: 65458 - protein, 32 aa, Artificial Sequence
  Description of Artificial Sequence: Synthetic polypeptide
DECEIRTTNPVATEQYGSVATGNGQDAGGNNV

SEQ ID NO: 65459 - protein, 32 aa, Artificial Sequence
  Description of Artificial Sequence: Synthetic polypeptide
DECEIRTTNPVATEQYGSVATGNGDQDAGNGV

SEQ ID NO: 65460 - protein, 31 aa, Artificial Sequence
  Description of Artificial Sequence: Synthetic polypeptide
DECEIRTTNPVATEQYGSMSINLDQWYLNQA

SEQ ID NO: 65461 - protein, 31 aa, Artificial Sequence
  Description of Artificial Sequence: Synthetic polypeptide
DEEEIRTTNPEATEQYGSVPTWLARMGFIEG

SEQ ID NO: 65462 - protein, 34 aa, Artificial Sequence
  Description of Artificial Sequence: Synthetic polypeptide
DEEEIATTNPVATEQYGSTVSVSGNLSQRVGNNI

SEQ ID NO: 65463 - protein, 32 aa, Artificial Sequence
  Description of Artificial Sequence: Synthetic polypeptide
AEEEIRTTNPVATEQYGSVSTSNNNDEVGNQE

SEQ ID NO: 65464 - protein, 31 aa, Artificial Sequence
  Description of Artificial Sequence: Synthetic polypeptide
DEEEIRTTNPEATEQYGSVPRTWNLAREEKE

SEQ ID NO: 65465 - protein, 34 aa, Artificial Sequence
  Description of Artificial Sequence: Synthetic polypeptide
DEEEIATTNPVATEQYGESVTLTDGLPQRNGQNR

SEQ ID NO: 65466 - protein, 29 aa, Artificial Sequence
  Description of Artificial Sequence: Synthetic peptide
DEEEIRTTNPEATEQYGSVPSELANGSDQ

SEQ ID NO: 65467 - protein, 30 aa, Artificial Sequence
  Description of Artificial Sequence: Synthetic polypeptide
DEEEIRTTNPCATEQYGSVSGGIPFHGDND

SEQ ID NO: 65468 - protein, 31 aa, Artificial Sequence
  Description of Artificial Sequence: Synthetic polypeptide
DECEIRTTNPVATEQYGEVATGNGQDAGGNA

SEQ ID NO: 65469 - protein, 31 aa, Artificial Sequence
  Description of Artificial Sequence: Synthetic polypeptide
DEEEIRTTNPEATEQYGSVPTELARFGSDQQ

SEQ ID NO: 65470 - protein, 30 aa, Artificial Sequence
  Description of Artificial Sequence: Synthetic polypeptide
DEEEIRTTNPEATEQYGSVPTEVIVARGKE

SEQ ID NO: 65471 - protein, 30 aa, Artificial Sequence
  Description of Artificial Sequence: Synthetic polypeptide
DEEEIRTTNPEATEQYGSVPTWLAIGGKQE

SEQ ID NO: 65472 - protein, 31 aa, Artificial Sequence
  Description of Artificial Sequence: Synthetic polypeptide
DECEIRTTNPVATEQYGEVSTNPGDRDNNES

SEQ ID NO: 65473 - protein, 33 aa, Artificial Sequence
  Description of Artificial Sequence: Synthetic polypeptide
AEEEIRTTNPVATEQYGSVVTTVNLQSNEGNNN

SEQ ID NO: 65474 - protein, 31 aa, Artificial Sequence
  Description of Artificial Sequence: Synthetic polypeptide
DEEEIRTTNPEATQQYGEVCTIDQLQREGNS

SEQ ID NO: 65475 - protein, 31 aa, Artificial Sequence
  Description of Artificial Sequence: Synthetic polypeptide
DEEEIRTTNPCATEQYGSVPTWDLDERGMKE

SEQ ID NO: 65476 - protein, 32 aa, Artificial Sequence
  Description of Artificial Sequence: Synthetic polypeptide
DECEIRTTNPVATEAYGSVSTMNVGQDRINQP

SEQ ID NO: 65477 - protein, 32 aa, Artificial Sequence
  Description of Artificial Sequence: Synthetic polypeptide
AEEEIRTTNPVATEQYGSVSTTNGNGTVGNVN

SEQ ID NO: 65478 - protein, 32 aa, Artificial Sequence
  Description of Artificial Sequence: Synthetic polypeptide
DEDEIATTNPVATENYGSVSTTNLQGGPNNGM

SEQ ID NO: 65479 - protein, 32 aa, Artificial Sequence
  Description of Artificial Sequence: Synthetic polypeptide
DEDEIATTNPVATENYGSVSTTNLQGPGNEGE

SEQ ID NO: 65480 - protein, 29 aa, Artificial Sequence
  Description of Artificial Sequence: Synthetic peptide
DAAEIAATNPVAYEQYGSTVATNLQNGTR

SEQ ID NO: 65481 - protein, 28 aa, Artificial Sequence
  Description of Artificial Sequence: Synthetic peptide
DEEEIATTNPVATEQYGEAPEVGQRGEV

SEQ ID NO: 65482 - protein, 28 aa, Artificial Sequence
  Description of Artificial Sequence: Synthetic peptide
DEEEIATTNPVATEQYGEAPEVCQRGEV

SEQ ID NO: 65483 - protein, 33 aa, Artificial Sequence
  Description of Artificial Sequence: Synthetic polypeptide
AEEEIRTTNPVATEQYGSVSTSNNENQQTGNVT

SEQ ID NO: 65484 - protein, 33 aa, Artificial Sequence
  Description of Artificial Sequence: Synthetic polypeptide
AEEEIRTTNPVATEQYGSVSTSNNENQQTGNTT

SEQ ID NO: 65485 - protein, 32 aa, Artificial Sequence
  Description of Artificial Sequence: Synthetic polypeptide
AEEEIRTTNPVATEQYGSVSTTNGLGNEEGEA

SEQ ID NO: 65486 - protein, 33 aa, Artificial Sequence
  Description of Artificial Sequence: Synthetic polypeptide
AEEEIRTTNPVATEQYGSVSTSNNENQQTGNNE

SEQ ID NO: 65487 - protein, 34 aa, Artificial Sequence
  Description of Artificial Sequence: Synthetic polypeptide
AEEEIRTTNPVATEQYGSVSTSNLQQQNGNLQIG

SEQ ID NO: 65488 - protein, 34 aa, Artificial Sequence
  Description of Artificial Sequence: Synthetic polypeptide
AEEEIRTTNPVATEQYGSVSVTVVNLQQGEENNL

SEQ ID NO: 65489 - protein, 34 aa, Artificial Sequence
  Description of Artificial Sequence: Synthetic polypeptide
AEEEIRTTNPVATEQYGSVSTSNLQQQGNGQIGT

SEQ ID NO: 65490 - protein, 30 aa, Artificial Sequence
  Description of Artificial Sequence: Synthetic polypeptide
DEDEIATTNPVATEPYGSVCATNDTRGGNS

SEQ ID NO: 65491 - protein, 34 aa, Artificial Sequence
  Description of Artificial Sequence: Synthetic polypeptide
AEEEIRTTNPVATEQYGSVSTSNLQQQGNGNSEG

SEQ ID NO: 65492 - protein, 34 aa, Artificial Sequence
  Description of Artificial Sequence: Synthetic polypeptide
AEEEIRTTNPVATEQYGSVSTSNLQQQGNGNEGG

SEQ ID NO: 65493 - protein, 34 aa, Artificial Sequence
  Description of Artificial Sequence: Synthetic polypeptide
AEEEIRTTNPVATEQYGSVSTSNLQQQGNGINGG

SEQ ID NO: 65494 - protein, 32 aa, Artificial Sequence
  Description of Artificial Sequence: Synthetic polypeptide
DEDEIATTNPVATEPYGSVPSCTNMLSQRSNS

SEQ ID NO: 65495 - protein, 34 aa, Artificial Sequence
  Description of Artificial Sequence: Synthetic polypeptide
AEEEIRTTNPVATEQYGSVSTSNLQQQGNGEIGG

SEQ ID NO: 65496 - protein, 33 aa, Artificial Sequence
  Description of Artificial Sequence: Synthetic polypeptide
AEEEIRTTNPVATEQYGSVSTSNLQQQNLGEIG

SEQ ID NO: 65497 - protein, 30 aa, Artificial Sequence
  Description of Artificial Sequence: Synthetic polypeptide
DEEEIRTTNPCATEQYGSVPTWDLVDNGKE

SEQ ID NO: 65498 - protein, 33 aa, Artificial Sequence
  Description of Artificial Sequence: Synthetic polypeptide
AEEEIRTTNPVATEQYGSVVTVANLGNQEGGNV

SEQ ID NO: 65499 - protein, 33 aa, Artificial Sequence
  Description of Artificial Sequence: Synthetic polypeptide
AEEEIRTTNPVATEQYGSVSTTNGEQQNEGGNT

SEQ ID NO: 65500 - protein, 33 aa, Artificial Sequence
  Description of Artificial Sequence: Synthetic polypeptide
AEEEIRTTNPVATEQYGSVVTVANLENQEGNVT

SEQ ID NO: 65501 - protein, 31 aa, Artificial Sequence
  Description of Artificial Sequence: Synthetic polypeptide
DEEEIRTTNPCATEQYGSVPTWDLADRQGGE

SEQ ID NO: 65502 - protein, 30 aa, Artificial Sequence
  Description of Artificial Sequence: Synthetic polypeptide
DEEEIRTTNPEATRQYGQVPTDDLQRGEFN

SEQ ID NO: 65503 - protein, 31 aa, Artificial Sequence
  Description of Artificial Sequence: Synthetic polypeptide
DEEEIRTTNPEATRQYGQVPTDLQPRGSNFS

SEQ ID NO: 65504 - protein, 28 aa, Artificial Sequence
  Description of Artificial Sequence: Synthetic peptide
DEDEIATTNPVATASWGCVATNLERGNQ

SEQ ID NO: 65505 - protein, 34 aa, Artificial Sequence
  Description of Artificial Sequence: Synthetic polypeptide
AEEEIRTTNPVATEQYGSVSTSNNLQQQGNGTNG

SEQ ID NO: 65506 - protein, 30 aa, Artificial Sequence
  Description of Artificial Sequence: Synthetic polypeptide
DEEEIRTTNPEAYEQYGSVPCTGLSTRGKE

SEQ ID NO: 65507 - protein, 28 aa, Artificial Sequence
  Description of Artificial Sequence: Synthetic peptide
DEEEIRTTNPFATDQYGSVAYNIFVGED

SEQ ID NO: 65508 - protein, 29 aa, Artificial Sequence
  Description of Artificial Sequence: Synthetic peptide
DECEIRTTNPVATECYGAHSTNEQPISNF

SEQ ID NO: 65509 - protein, 34 aa, Artificial Sequence
  Description of Artificial Sequence: Synthetic polypeptide
DEEEIRTTNPCATEQYGSVPEPTNNLQRGVNPDL

SEQ ID NO: 65510 - protein, 30 aa, Artificial Sequence
  Description of Artificial Sequence: Synthetic polypeptide
DEEEIRTTNPFATEAYGSVSYNIFRTGMDP

SEQ ID NO: 65511 - protein, 30 aa, Artificial Sequence
  Description of Artificial Sequence: Synthetic polypeptide
DEEEIRTTNPFATEQYGSVCVYNIFRGGDE

SEQ ID NO: 65512 - protein, 31 aa, Artificial Sequence
  Description of Artificial Sequence: Synthetic polypeptide
DEEEIRTTNPCATEQYGSVPTTVLARQGKEN

SEQ ID NO: 65513 - protein, 33 aa, Artificial Sequence
  Description of Artificial Sequence: Synthetic polypeptide
AEEEIRTTNPVATEQYGSVSTSNNLQQQEGGIG

SEQ ID NO: 65514 - protein, 30 aa, Artificial Sequence
  Description of Artificial Sequence: Synthetic polypeptide
DEEEIRTTNPCATEQYGSVPTDHSARGGKE

SEQ ID NO: 65515 - protein, 34 aa, Artificial Sequence
  Description of Artificial Sequence: Synthetic polypeptide
AEEEIRTTNPVATEQYGSVSVTVVNLQVEEGNND

SEQ ID NO: 65516 - protein, 31 aa, Artificial Sequence
  Description of Artificial Sequence: Synthetic polypeptide
DEEEIATTNPVATEQYGSVAATNDERNNNPD

SEQ ID NO: 65517 - protein, 32 aa, Artificial Sequence
  Description of Artificial Sequence: Synthetic polypeptide
DEDEIATTNPVATEAYGEVTSTNLSQRGGDNS

SEQ ID NO: 65518 - protein, 28 aa, Artificial Sequence
  Description of Artificial Sequence: Synthetic peptide
DEEEIRTTNPIASENYGSVGTGDQGGMF

SEQ ID NO: 65519 - protein, 30 aa, Artificial Sequence
  Description of Artificial Sequence: Synthetic polypeptide
DEEEIRTTNPIATAQYGQVPTADLQRGESF

SEQ ID NO: 65520 - protein, 34 aa, Artificial Sequence
  Description of Artificial Sequence: Synthetic polypeptide
AEEEIRTTNPVATEQYGSVSTSNNLQQQGNGIGE

SEQ ID NO: 65521 - protein, 33 aa, Artificial Sequence
  Description of Artificial Sequence: Synthetic polypeptide
AEEEIRTTNPVATEQYGSVSTTNLQNSNANTQD

SEQ ID NO: 65522 - protein, 32 aa, Artificial Sequence
  Description of Artificial Sequence: Synthetic polypeptide
DECEIRTTNPVATEQYGSVATTLGDENGGNNR

SEQ ID NO: 65523 - protein, 31 aa, Artificial Sequence
  Description of Artificial Sequence: Synthetic polypeptide
AEEEIRTTNPVATEQYGSVSVVNQGNDQGNS

SEQ ID NO: 65524 - protein, 29 aa, Artificial Sequence
  Description of Artificial Sequence: Synthetic peptide
DEEEIRTTNPEAFEQYGSVPTEVLATGKT

SEQ ID NO: 65525 - protein, 32 aa, Artificial Sequence
  Description of Artificial Sequence: Synthetic polypeptide
DEEEIRTTNPCATEQYGSVSTTQGQRGVVEED

SEQ ID NO: 65526 - protein, 32 aa, Artificial Sequence
  Description of Artificial Sequence: Synthetic polypeptide
DEEEIATTNPVATEQYGSCSMTGNIEADIGNR

SEQ ID NO: 65527 - protein, 28 aa, Artificial Sequence
  Description of Artificial Sequence: Synthetic peptide
DEEEIRTTNPEATAQWGQCPTADQRGNQ

SEQ ID NO: 65528 - protein, 29 aa, Artificial Sequence
  Description of Artificial Sequence: Synthetic peptide
DEEEIRTTNPEATAQWGTVPTADDQRGNT

SEQ ID NO: 65529 - protein, 32 aa, Artificial Sequence
  Description of Artificial Sequence: Synthetic polypeptide
AEEEIRTTNPVATEQYGSVSTSNQNGTVGNAG

SEQ ID NO: 65530 - protein, 31 aa, Artificial Sequence
  Description of Artificial Sequence: Synthetic polypeptide
DEEEIATTNPVATEQYGSCSTNLDTQEPTPE

SEQ ID NO: 65531 - protein, 31 aa, Artificial Sequence
  Description of Artificial Sequence: Synthetic polypeptide
DEDEIACTNPVATEQYGSVATNLQVADNNRD

SEQ ID NO: 65532 - protein, 32 aa, Artificial Sequence
  Description of Artificial Sequence: Synthetic polypeptide
DEEEIRTTNPCATEQYGSVSTNNGQREVETPE

SEQ ID NO: 65533 - protein, 33 aa, Artificial Sequence
  Description of Artificial Sequence: Synthetic polypeptide
AEEEIRTTNPVATEQYGSVVTTNNLQQGQNGND

SEQ ID NO: 65534 - protein, 32 aa, Artificial Sequence
  Description of Artificial Sequence: Synthetic polypeptide
AEEEIRTTNPVATEQYGSVSTTNFQGEEGGGG

SEQ ID NO: 65535 - protein, 33 aa, Artificial Sequence
  Description of Artificial Sequence: Synthetic polypeptide
DEEEIATTNPVATEQYGSCSTNPLQAEMGDNLH

SEQ ID NO: 65536 - protein, 29 aa, Artificial Sequence
  Description of Artificial Sequence: Synthetic peptide
DAAEIATTNPVATEQWGAVSTNLQNNGPD

SEQ ID NO: 65537 - protein, 33 aa, Artificial Sequence
  Description of Artificial Sequence: Synthetic polypeptide
AEEEIRTTNPVATEQYGSVVTTNNNLQGEEGNT

SEQ ID NO: 65538 - protein, 30 aa, Artificial Sequence
  Description of Artificial Sequence: Synthetic polypeptide
DEEEIRTTNPEATCQYGCVCPTDLQRFGEQ

SEQ ID NO: 65539 - protein, 34 aa, Artificial Sequence
  Description of Artificial Sequence: Synthetic polypeptide
DEEEIRTTNPCATEQYGSVSSTNLIQGGGNNQGD

SEQ ID NO: 65540 - protein, 33 aa, Artificial Sequence
  Description of Artificial Sequence: Synthetic polypeptide
AEEEIRTTNPVATEQYGSVVTTNNNLQQEGNTE

SEQ ID NO: 65541 - protein, 30 aa, Artificial Sequence
  Description of Artificial Sequence: Synthetic polypeptide
DEEEIRTTNPEATCQYGCVPTDHNQRGSNQ

SEQ ID NO: 65542 - protein, 33 aa, Artificial Sequence
  Description of Artificial Sequence: Synthetic polypeptide
AEEEIRTTNPVATEQYGSVSVVTNNLQIQNNNV

SEQ ID NO: 65543 - protein, 30 aa, Artificial Sequence
  Description of Artificial Sequence: Synthetic polypeptide
DEEEIRTTNPEATCQYGCVPTEHQRFGSNF

SEQ ID NO: 65544 - protein, 34 aa, Artificial Sequence
  Description of Artificial Sequence: Synthetic polypeptide
DEEEIRTTNPCATEQYGSVSSTTPALPNRNGNPR

SEQ ID NO: 65545 - protein, 31 aa, Artificial Sequence
  Description of Artificial Sequence: Synthetic polypeptide
DECEIRTTNPVATEQYGVVSITKLQRPTQDT

SEQ ID NO: 65546 - protein, 33 aa, Artificial Sequence
  Description of Artificial Sequence: Synthetic polypeptide
AEEEIRTTNPVATEQYGSVSTSNQNQEQGNVNV

SEQ ID NO: 65547 - protein, 33 aa, Artificial Sequence
  Description of Artificial Sequence: Synthetic polypeptide
AEEEIRTTNPVATEQYGSVVTTNNLQQGEGNQG

SEQ ID NO: 65548 - protein, 32 aa, Artificial Sequence
  Description of Artificial Sequence: Synthetic polypeptide
AEEEIRTTNPVATEQYGSVSTTNENGTVGGNV

SEQ ID NO: 65549 - protein, 32 aa, Artificial Sequence
  Description of Artificial Sequence: Synthetic polypeptide
AEEEIRTTNPVATEQYGSVSTSNTNQQQANED

SEQ ID NO: 65550 - protein, 33 aa, Artificial Sequence
  Description of Artificial Sequence: Synthetic polypeptide
AEEEIRTTNPVATEQYGSVSTSNTNNLQNSTNQ

SEQ ID NO: 65551 - protein, 33 aa, Artificial Sequence
  Description of Artificial Sequence: Synthetic polypeptide
AEEEIRTTNPVATEQYGSVVTTNNLNQEGQNEE

SEQ ID NO: 65552 - protein, 31 aa, Artificial Sequence
  Description of Artificial Sequence: Synthetic polypeptide
DEEEIATTNPVATEQYGSCSAGNMLGQHDNN

SEQ ID NO: 65553 - protein, 33 aa, Artificial Sequence
  Description of Artificial Sequence: Synthetic polypeptide
AEEEIRTTNPVATEQYGSVVTTNNLNQQEGNTT

SEQ ID NO: 65554 - protein, 33 aa, Artificial Sequence
  Description of Artificial Sequence: Synthetic polypeptide
AEEEIRTTNPVATEQYGSVVTTNNLQDEEGTNT

SEQ ID NO: 65555 - protein, 33 aa, Artificial Sequence
  Description of Artificial Sequence: Synthetic polypeptide
DEEEIRTTNPCATEQYGSVSTVNNDIQEQGNTD

SEQ ID NO: 65556 - protein, 33 aa, Artificial Sequence
  Description of Artificial Sequence: Synthetic polypeptide
AEEEIRTTNPVATEQYGSVVTTNNLQNDEGGNV

SEQ ID NO: 65557 - protein, 33 aa, Artificial Sequence
  Description of Artificial Sequence: Synthetic polypeptide
AEEEIRTTNPVATEQYGSVSTSNQNQETGNENS

SEQ ID NO: 65558 - protein, 33 aa, Artificial Sequence
  Description of Artificial Sequence: Synthetic polypeptide
AEEEIRTTNPVATEQYGSVVTTNNLQNNEGNTD

SEQ ID NO: 65559 - protein, 30 aa, Artificial Sequence
  Description of Artificial Sequence: Synthetic polypeptide
DEDEIACTNPVATEQYGSVATNLQSEDNLS

SEQ ID NO: 65560 - protein, 32 aa, Artificial Sequence
  Description of Artificial Sequence: Synthetic polypeptide
DEEEIRTTNPCCTEQYGSVSTMELQCAFGNDY

SEQ ID NO: 65561 - protein, 33 aa, Artificial Sequence
  Description of Artificial Sequence: Synthetic polypeptide
AEEEIRTTNPVATEQYGSVSTTNEQQQGNGNQN

SEQ ID NO: 65562 - protein, 33 aa, Artificial Sequence
  Description of Artificial Sequence: Synthetic polypeptide
AEEEIRTTNPVATEQYGSVVTTNNLQQEGTNTN

SEQ ID NO: 65563 - protein, 30 aa, Artificial Sequence
  Description of Artificial Sequence: Synthetic polypeptide
DEEEIRTTNPDATEGYGSCCSTELAGGSNQ

SEQ ID NO: 65564 - protein, 30 aa, Artificial Sequence
  Description of Artificial Sequence: Synthetic polypeptide
DEEEIRTTNPDATEGYGSCSTPLARSGEPN

SEQ ID NO: 65565 - protein, 34 aa, Artificial Sequence
  Description of Artificial Sequence: Synthetic polypeptide
DEEEIRTTNPCATEQYGSVSTVNGILQAGNNQDE

SEQ ID NO: 65566 - protein, 30 aa, Artificial Sequence
  Description of Artificial Sequence: Synthetic polypeptide
DEEEIRTTNPDATEGYGSCSTPLGARVGED

SEQ ID NO: 65567 - protein, 31 aa, Artificial Sequence
  Description of Artificial Sequence: Synthetic polypeptide
DEEEIRTTNPCATEQYGSVSTTQGRNVVERQ

SEQ ID NO: 65568 - protein, 30 aa, Artificial Sequence
  Description of Artificial Sequence: Synthetic polypeptide
DEDEIACTNPVATEQYGSVATNLQRTTPEH

SEQ ID NO: 65569 - protein, 32 aa, Artificial Sequence
  Description of Artificial Sequence: Synthetic polypeptide
AEEEIRTTNPVATEQYGSVVTTVNGNLQGNID

SEQ ID NO: 65570 - protein, 30 aa, Artificial Sequence
  Description of Artificial Sequence: Synthetic polypeptide
DEEEIRTTNPCATEQYGSVSPVNIPVVVND

SEQ ID NO: 65571 - protein, 32 aa, Artificial Sequence
  Description of Artificial Sequence: Synthetic polypeptide
AEEEIRTTNPVATEQYGSVVTTNNNQQFGNTD

SEQ ID NO: 65572 - protein, 33 aa, Artificial Sequence
  Description of Artificial Sequence: Synthetic polypeptide
AEEEIRTTNPVATEQYGSVVTTTNLGQNGNNAE

SEQ ID NO: 65573 - protein, 32 aa, Artificial Sequence
  Description of Artificial Sequence: Synthetic polypeptide
DEEEIRTTNPCATEQYGSVSPTENLQLPVTTV

SEQ ID NO: 65574 - protein, 33 aa, Artificial Sequence
  Description of Artificial Sequence: Synthetic polypeptide
AEEEIRTTNPVATEQYGSVVTTTNLQGDTGTNG

SEQ ID NO: 65575 - protein, 32 aa, Artificial Sequence
  Description of Artificial Sequence: Synthetic polypeptide
AEEEIRTTNPVATEQYGSVVTTTNLQNDENNS

SEQ ID NO: 65576 - protein, 32 aa, Artificial Sequence
  Description of Artificial Sequence: Synthetic polypeptide
AEEEIRTTNPVATEQYGSVVTTTNLQQEENQG

SEQ ID NO: 65577 - protein, 32 aa, Artificial Sequence
  Description of Artificial Sequence: Synthetic polypeptide
DECEIRTTNPVATEQYGSVSTQNGNDANGNED

SEQ ID NO: 65578 - protein, 34 aa, Artificial Sequence
  Description of Artificial Sequence: Synthetic polypeptide
AEEEIRTTNPVATEQYGSVSTSNNQLQNDEGNNE

SEQ ID NO: 65579 - protein, 33 aa, Artificial Sequence
  Description of Artificial Sequence: Synthetic polypeptide
AEEEIRTTNPVATEQYGSVVTTTNNGNLQQGNI

SEQ ID NO: 65580 - protein, 32 aa, Artificial Sequence
  Description of Artificial Sequence: Synthetic polypeptide
DECEIRTTNPVATEQYGSVSTNGGDLGGDNAE

SEQ ID NO: 65581 - protein, 32 aa, Artificial Sequence
  Description of Artificial Sequence: Synthetic polypeptide
AEEEIRTTNPVATEQYGSVVTTTNLGGNNGND

SEQ ID NO: 65582 - protein, 33 aa, Artificial Sequence
  Description of Artificial Sequence: Synthetic polypeptide
AEEEIRTTNPVATEQYGSVSTSNNQEQAGNNNI

SEQ ID NO: 65583 - protein, 33 aa, Artificial Sequence
  Description of Artificial Sequence: Synthetic polypeptide
AEEEIRTTNPVATEQYGSVSTSNNQENQQTGNN

SEQ ID NO: 65584 - protein, 32 aa, Artificial Sequence
  Description of Artificial Sequence: Synthetic polypeptide
DECEIRTTNPVATEQYGSVSTDMLHQYGELDV

SEQ ID NO: 65585 - protein, 31 aa, Artificial Sequence
  Description of Artificial Sequence: Synthetic polypeptide
DECEIRTTNPVATEQYGSVHCSNLDFPGNSG

SEQ ID NO: 65586 - protein, 32 aa, Artificial Sequence
  Description of Artificial Sequence: Synthetic polypeptide
DEEEIRTTNPEATEQYGCVCQTNLQRGSDTAS

SEQ ID NO: 65587 - protein, 31 aa, Artificial Sequence
  Description of Artificial Sequence: Synthetic polypeptide
DEEEIRTTNPEATEQYGCVCSYNIFRGSNDS

SEQ ID NO: 65588 - protein, 32 aa, Artificial Sequence
  Description of Artificial Sequence: Synthetic polypeptide
AEEEIRTTNPVATEQYGSVVTTTNNQQGNGEQ

SEQ ID NO: 65589 - protein, 30 aa, Artificial Sequence
  Description of Artificial Sequence: Synthetic polypeptide
DEEEIRTTNPEATEQYGCVPTELARGSEAA

SEQ ID NO: 65590 - protein, 32 aa, Artificial Sequence
  Description of Artificial Sequence: Synthetic polypeptide
DECEIRTTNPVATEQYGSVATTLGDGEQGNNR

SEQ ID NO: 65591 - protein, 33 aa, Artificial Sequence
  Description of Artificial Sequence: Synthetic polypeptide
AEEEIRTTNPVATEQYGSVSTSNNNQNQQGNSQ

SEQ ID NO: 65592 - protein, 33 aa, Artificial Sequence
  Description of Artificial Sequence: Synthetic polypeptide
AEEEIRTTNPVATEQYGSVVTTTNNNLQQGNGQ

SEQ ID NO: 65593 - protein, 32 aa, Artificial Sequence
  Description of Artificial Sequence: Synthetic polypeptide
AEEEIRTTNPVATEQYGSVVTTNNNQEGENDT

SEQ ID NO: 65594 - protein, 31 aa, Artificial Sequence
  Description of Artificial Sequence: Synthetic polypeptide
DAAEIACTNPVATEQYGSVATNLQARPGERN

SEQ ID NO: 65595 - protein, 33 aa, Artificial Sequence
  Description of Artificial Sequence: Synthetic polypeptide
DEEEIRTTNPCATEQYGSVSPTNNGQRGVEVVD

SEQ ID NO: 65596 - protein, 31 aa, Artificial Sequence
  Description of Artificial Sequence: Synthetic polypeptide
AEEEIRTTNPVATEQYGSVVTTNNQEDTENS

SEQ ID NO: 65597 - protein, 29 aa, Artificial Sequence
  Description of Artificial Sequence: Synthetic peptide
DEEEIRTTNPEATEEYGCVGTNHGRFGDA

SEQ ID NO: 65598 - protein, 31 aa, Artificial Sequence
  Description of Artificial Sequence: Synthetic polypeptide
DAAEIACTNPVATEQYGSVSTNLQHGDNSAE

SEQ ID NO: 65599 - protein, 30 aa, Artificial Sequence
  Description of Artificial Sequence: Synthetic polypeptide
DEEEIRTTNPEATEGYGCCSTNLAYGSNQS

SEQ ID NO: 65600 - protein, 29 aa, Artificial Sequence
  Description of Artificial Sequence: Synthetic peptide
DEEEIRTTNPEATEHYGAVPTEVLARGKT

SEQ ID NO: 65601 - protein, 32 aa, Artificial Sequence
  Description of Artificial Sequence: Synthetic polypeptide
AEEEIRTTNPVATEQYGSVVTTNNQQGEGNTD

SEQ ID NO: 65602 - protein, 32 aa, Artificial Sequence
  Description of Artificial Sequence: Synthetic polypeptide
AEEEIRTTNPVATEQYGSVVTTNQLGGEEGNV

SEQ ID NO: 65603 - protein, 30 aa, Artificial Sequence
  Description of Artificial Sequence: Synthetic polypeptide
DEEEIRTTNPEATEQWGTVPTDLARGGDNS

SEQ ID NO: 65604 - protein, 31 aa, Artificial Sequence
  Description of Artificial Sequence: Synthetic polypeptide
DEAEIATTNPVATEYYGSVSTNLQANGDEDD

SEQ ID NO: 65605 - protein, 32 aa, Artificial Sequence
  Description of Artificial Sequence: Synthetic polypeptide
AEEEIRTTNPVATEQYGSVVTTTNLGGENGND

SEQ ID NO: 65606 - protein, 32 aa, Artificial Sequence
  Description of Artificial Sequence: Synthetic polypeptide
AEEEIRTTNPVATEQYGSVVTTNQLQDEGGED

SEQ ID NO: 65607 - protein, 33 aa, Artificial Sequence
  Description of Artificial Sequence: Synthetic polypeptide
AEEEIRTTNPVATEQYGSVVTTSNGNLQSGTNI

SEQ ID NO: 65608 - protein, 33 aa, Artificial Sequence
  Description of Artificial Sequence: Synthetic polypeptide
AEEEIRTTNPVATEQYGSVSVVTNLQQQQNNVT

SEQ ID NO: 65609 - protein, 30 aa, Artificial Sequence
  Description of Artificial Sequence: Synthetic polypeptide
DEDEIACTNPVAYEPYGSVATNLQRGNNSM

SEQ ID NO: 65610 - protein, 33 aa, Artificial Sequence
  Description of Artificial Sequence: Synthetic polypeptide
AEEEIRTTNPVATEQYGSVSTSNNQQQQTGNIG

SEQ ID NO: 65611 - protein, 32 aa, Artificial Sequence
  Description of Artificial Sequence: Synthetic polypeptide
AEEEIRTTNPVATEQYGSVVTTTDNGNLQGNI

SEQ ID NO: 65612 - protein, 33 aa, Artificial Sequence
  Description of Artificial Sequence: Synthetic polypeptide
AEEEIRTTNPVATEQYGSVSTTNGEQEGTNENN

SEQ ID NO: 65613 - protein, 33 aa, Artificial Sequence
  Description of Artificial Sequence: Synthetic polypeptide
AEEEIRTTNPVATEQYGSVVTTTNGNLQQGNIE

SEQ ID NO: 65614 - protein, 35 aa, Artificial Sequence
  Description of Artificial Sequence: Synthetic polypeptide
DEEEIATTNPVATEQYGETVSCTNLSQREPGNERA

SEQ ID NO: 65615 - protein, 29 aa, Artificial Sequence
  Description of Artificial Sequence: Synthetic peptide
DEDEIACTNPVAYEPYGSVATNLQVGNLM

SEQ ID NO: 65616 - protein, 33 aa, Artificial Sequence
  Description of Artificial Sequence: Synthetic polypeptide
AEEEIRTTNPVATEQYGSVVTTSNGNLQQGNQI

SEQ ID NO: 65617 - protein, 34 aa, Artificial Sequence
  Description of Artificial Sequence: Synthetic polypeptide
AEEEIRTTNPVATEQYGSVSTNLGQIGTTNGNEQ

SEQ ID NO: 65618 - protein, 30 aa, Artificial Sequence
  Description of Artificial Sequence: Synthetic polypeptide
CEECICTTNPVATEQYGSVSWNEGQQSGNS

SEQ ID NO: 65619 - protein, 33 aa, Artificial Sequence
  Description of Artificial Sequence: Synthetic polypeptide
AEEEIRTTNPVATEQYGSVSTTNLQQGEEGGGG

SEQ ID NO: 65620 - protein, 31 aa, Artificial Sequence
  Description of Artificial Sequence: Synthetic polypeptide
DEEEIATTNPVATEAWGSVSTNEHSPQTGNH

SEQ ID NO: 65621 - protein, 30 aa, Artificial Sequence
  Description of Artificial Sequence: Synthetic polypeptide
DEAEIATTNPVAYEQYGSIATNLERDPNGR

SEQ ID NO: 65622 - protein, 29 aa, Artificial Sequence
  Description of Artificial Sequence: Synthetic peptide
DEAEIATTNPVAYEQYGSISAANLEAPNR

SEQ ID NO: 65623 - protein, 30 aa, Artificial Sequence
  Description of Artificial Sequence: Synthetic polypeptide
DCEEITSTNPVATEQYGSVSTNQQAHNGQN

SEQ ID NO: 65624 - protein, 32 aa, Artificial Sequence
  Description of Artificial Sequence: Synthetic polypeptide
DCGEIRTTNPVATEQYGSVSPTNLAVPVGGNQ

SEQ ID NO: 65625 - protein, 34 aa, Artificial Sequence
  Description of Artificial Sequence: Synthetic polypeptide
AEEEIRTTNPVATEQYGSVVVSVTNLQNGNNEGD

SEQ ID NO: 65626 - protein, 32 aa, Artificial Sequence
  Description of Artificial Sequence: Synthetic polypeptide
DCSEIRTTNPVATEQYGSVSYTQNHVRGGNQG

SEQ ID NO: 65627 - protein, 30 aa, Artificial Sequence
  Description of Artificial Sequence: Synthetic polypeptide
DDAEIRTTNPVATEQYGCVCSTEALQGGDQ

SEQ ID NO: 65628 - protein, 32 aa, Artificial Sequence
  Description of Artificial Sequence: Synthetic polypeptide
DEEEIRTTNPVATEAWGQEVSTNQSQRSGSRS

SEQ ID NO: 65629 - protein, 34 aa, Artificial Sequence
  Description of Artificial Sequence: Synthetic polypeptide
AEEEIRTTNPVATEQYGSVVVSVTNLQNGNNQAT

SEQ ID NO: 65630 - protein, 34 aa, Artificial Sequence
  Description of Artificial Sequence: Synthetic polypeptide
AEEEIRTTNPVATEQYGSVVVSVTNLQNGNQNAN

SEQ ID NO: 65631 - protein, 34 aa, Artificial Sequence
  Description of Artificial Sequence: Synthetic polypeptide
AEEEIRTTNPVATEQYGSVSVTNNNLGQNGTNPT

SEQ ID NO: 65632 - protein, 32 aa, Artificial Sequence
  Description of Artificial Sequence: Synthetic polypeptide
DEEEIRTTNPVATEAWGVVPSCTNESQETGNR

SEQ ID NO: 65633 - protein, 31 aa, Artificial Sequence
  Description of Artificial Sequence: Synthetic polypeptide
DEEEIRTTNPVATEAWGVVPSCTNGSQEGGR

SEQ ID NO: 65634 - protein, 32 aa, Artificial Sequence
  Description of Artificial Sequence: Synthetic polypeptide
DDAEIRTTNPVATEQYGCVCSTNDLQSGSDRM

SEQ ID NO: 65635 - protein, 32 aa, Artificial Sequence
  Description of Artificial Sequence: Synthetic polypeptide
DEEEIRTTNPVATEAWGVVPSCTNMISQEGNR

SEQ ID NO: 65636 - protein, 34 aa, Artificial Sequence
  Description of Artificial Sequence: Synthetic polypeptide
AEEEIRTTNPVATEQYGSVSVTNNNLAQGTNGNG

SEQ ID NO: 65637 - protein, 34 aa, Artificial Sequence
  Description of Artificial Sequence: Synthetic polypeptide
AEEEIRTTNPVATEQYGSVSTTNNLQQQNGQTNA

SEQ ID NO: 65638 - protein, 34 aa, Artificial Sequence
  Description of Artificial Sequence: Synthetic polypeptide
AEEEIRTTNPVATEQYGSVSTTNNLQQQNGTNAT

SEQ ID NO: 65639 - protein, 29 aa, Artificial Sequence
  Description of Artificial Sequence: Synthetic peptide
DEAEIATTNPVAYEQYGSIATNLEAPNRE

SEQ ID NO: 65640 - protein, 31 aa, Artificial Sequence
  Description of Artificial Sequence: Synthetic polypeptide
DEAEIATTNPVAYEQYGSIACTNLVRTPGNR

SEQ ID NO: 65641 - protein, 31 aa, Artificial Sequence
  Description of Artificial Sequence: Synthetic polypeptide
DEDEIATTNPVAYEQYGSVCTNLQQDGDNEM

SEQ ID NO: 65642 - protein, 31 aa, Artificial Sequence
  Description of Artificial Sequence: Synthetic polypeptide
DCEEIRTTNPVAYDQYGSVSTNGNDGNGNHR

SEQ ID NO: 65643 - protein, 33 aa, Artificial Sequence
  Description of Artificial Sequence: Synthetic polypeptide
AEEEIRTTNPVATEQYGSVSNVNLGNQTGTNDE

SEQ ID NO: 65644 - protein, 31 aa, Artificial Sequence
  Description of Artificial Sequence: Synthetic polypeptide
DEEEIRTTNPCATEPYGSVATNDGRGDNEAD

SEQ ID NO: 65645 - protein, 32 aa, Artificial Sequence
  Description of Artificial Sequence: Synthetic polypeptide
AEEEIRTTNPVATEQYGSVSNVNGNQETGNND

SEQ ID NO: 65646 - protein, 30 aa, Artificial Sequence
  Description of Artificial Sequence: Synthetic polypeptide
DCEEIRTTNPVATEQYGSVSALEQIASIRN

SEQ ID NO: 65647 - protein, 32 aa, Artificial Sequence
  Description of Artificial Sequence: Synthetic polypeptide
AEEEIRTTNPVATEQYGSVSNVNGEQTGNNDG

SEQ ID NO: 65648 - protein, 31 aa, Artificial Sequence
  Description of Artificial Sequence: Synthetic polypeptide
DEEEIRTTNPCATEPYGSVAITNDGRGDNAV

SEQ ID NO: 65649 - protein, 34 aa, Artificial Sequence
  Description of Artificial Sequence: Synthetic polypeptide
AEEEIRTTNPVATEQYGSVSNTTNLQQNNGNNNN

SEQ ID NO: 65650 - protein, 34 aa, Artificial Sequence
  Description of Artificial Sequence: Synthetic polypeptide
AEEEIRTTNPVATEQYGSVSNTTNLNQNENGNND

SEQ ID NO: 65651 - protein, 32 aa, Artificial Sequence
  Description of Artificial Sequence: Synthetic polypeptide
AEEEIRTTNPVATEQYGSVSNTQNGNQTTTNT

SEQ ID NO: 65652 - protein, 32 aa, Artificial Sequence
  Description of Artificial Sequence: Synthetic polypeptide
AEEEIRTTNPVATEQYGSVSNTDNGNQTNTNV

SEQ ID NO: 65653 - protein, 34 aa, Artificial Sequence
  Description of Artificial Sequence: Synthetic polypeptide
AEEEIRTTNPVATEQYGSVSNTNNLQQGNNNATD

SEQ ID NO: 65654 - protein, 33 aa, Artificial Sequence
  Description of Artificial Sequence: Synthetic polypeptide
AEEEIRTTNPVATEQYGSVSNTNLQQGTEVGTE

SEQ ID NO: 65655 - protein, 34 aa, Artificial Sequence
  Description of Artificial Sequence: Synthetic polypeptide
AEEEIRTTNPVATEQYGSVSNTNLQQGNNENATE

SEQ ID NO: 65656 - protein, 30 aa, Artificial Sequence
  Description of Artificial Sequence: Synthetic polypeptide
DECEIATTNPVAYERYGSVSTNLNDGNNDS

SEQ ID NO: 65657 - protein, 33 aa, Artificial Sequence
  Description of Artificial Sequence: Synthetic polypeptide
AEEEIRTTNPVATEQYGSVSNTNLLGGNQGNNQ

SEQ ID NO: 65658 - protein, 30 aa, Artificial Sequence
  Description of Artificial Sequence: Synthetic polypeptide
DECEIATTNPVAYERWGSVSTNLQDGDNDS

SEQ ID NO: 65659 - protein, 33 aa, Artificial Sequence
  Description of Artificial Sequence: Synthetic polypeptide
DEDEIATTNPVAYEQYGSVCTNLEQNRGGENRE

SEQ ID NO: 65660 - protein, 34 aa, Artificial Sequence
  Description of Artificial Sequence: Synthetic polypeptide
AEEEIRTTNPVATEQYGSVSTTNNLQQQGNGNTD

SEQ ID NO: 65661 - protein, 32 aa, Artificial Sequence
  Description of Artificial Sequence: Synthetic polypeptide
DEDEIATTNPVAYEQYGSVCTNLEQNRNNERH

SEQ ID NO: 65662 - protein, 31 aa, Artificial Sequence
  Description of Artificial Sequence: Synthetic polypeptide
DEDEIATTNPVAYEQYGSVCTNLNQNANERE

SEQ ID NO: 65663 - protein, 34 aa, Artificial Sequence
  Description of Artificial Sequence: Synthetic polypeptide
AEEEIRTTNPVATEQYGSVSNTNNLQQGENNATE

SEQ ID NO: 65664 - protein, 32 aa, Artificial Sequence
  Description of Artificial Sequence: Synthetic polypeptide
DDAEIRTTNPVATEQYGSVCSTNDLQSGSDQN

SEQ ID NO: 65665 - protein, 34 aa, Artificial Sequence
  Description of Artificial Sequence: Synthetic polypeptide
AEEEIRTTNPVATEQYGSVSTTNNLQQQQGNETD

SEQ ID NO: 65666 - protein, 30 aa, Artificial Sequence
  Description of Artificial Sequence: Synthetic polypeptide
DEEEIRTTNPVATEAYGCICSTNEQNNNQA

SEQ ID NO: 65667 - protein, 34 aa, Artificial Sequence
  Description of Artificial Sequence: Synthetic polypeptide
AEEEIRTTNPVATEQYGSVSTTNNLQQTEGENEG

SEQ ID NO: 65668 - protein, 33 aa, Artificial Sequence
  Description of Artificial Sequence: Synthetic polypeptide
AEEEIRTTNPVATEQYGSVSNNQLGNNQQGNTN

SEQ ID NO: 65669 - protein, 28 aa, Artificial Sequence
  Description of Artificial Sequence: Synthetic peptide
CDAEIRTTNPVATEQYGICSTVLQHQDR

SEQ ID NO: 65670 - protein, 34 aa, Artificial Sequence
  Description of Artificial Sequence: Synthetic polypeptide
AEEEIRTTNPVATEQYGSVSVTNNLQQGEQQNEG

SEQ ID NO: 65671 - protein, 33 aa, Artificial Sequence
  Description of Artificial Sequence: Synthetic polypeptide
AEEEIRTTNPVATEQYGSVSTTNNLQTNNNELF

SEQ ID NO: 65672 - protein, 34 aa, Artificial Sequence
  Description of Artificial Sequence: Synthetic polypeptide
AEEEIRTTNPVATEQYGSVSVTNNLQQGEQGENF

SEQ ID NO: 65673 - protein, 33 aa, Artificial Sequence
  Description of Artificial Sequence: Synthetic polypeptide
AEEEIRTTNPVATEQYGSVSTTNNLQVTGEQGE

SEQ ID NO: 65674 - protein, 31 aa, Artificial Sequence
  Description of Artificial Sequence: Synthetic polypeptide
DEDEIATTNPVAYEQYGSVVATNLQQGPNIQ

SEQ ID NO: 65675 - protein, 32 aa, Artificial Sequence
  Description of Artificial Sequence: Synthetic polypeptide
DEDEIATTNPVAYEQYGSVVSATNLQQGNIQN

SEQ ID NO: 65676 - protein, 31 aa, Artificial Sequence
  Description of Artificial Sequence: Synthetic polypeptide
DEEEIRTTNPCATEPYGSVACTNEHGRGGNA

SEQ ID NO: 65677 - protein, 32 aa, Artificial Sequence
  Description of Artificial Sequence: Synthetic polypeptide
DEAEIATTNPVAYEQYGSVAGTNLQREGNDIQ

SEQ ID NO: 65678 - protein, 31 aa, Artificial Sequence
  Description of Artificial Sequence: Synthetic polypeptide
DEDEIATTNPVAYEQYGTVSTGNLGMEGVNR

SEQ ID NO: 65679 - protein, 31 aa, Artificial Sequence
  Description of Artificial Sequence: Synthetic polypeptide
DEDEIATTNPVAYEQYGVCVSGTNLQWGNQI

SEQ ID NO: 65680 - protein, 33 aa, Artificial Sequence
  Description of Artificial Sequence: Synthetic polypeptide
AEEEIRTTNPVATEQYGSVSNNQLGGNNQGGND

SEQ ID NO: 65681 - protein, 32 aa, Artificial Sequence
  Description of Artificial Sequence: Synthetic polypeptide
DEAEIATTNPVAYEQYGSVAITDNLQPGNDRL

SEQ ID NO: 65682 - protein, 30 aa, Artificial Sequence
  Description of Artificial Sequence: Synthetic polypeptide
DEAEIATTNPVAYEQYGSVAITNDQNGNES

SEQ ID NO: 65683 - protein, 33 aa, Artificial Sequence
  Description of Artificial Sequence: Synthetic polypeptide
DEEEIRTTNPVATEAYGKTVSTANLSGREAGNE

SEQ ID NO: 65684 - protein, 32 aa, Artificial Sequence
  Description of Artificial Sequence: Synthetic polypeptide
DEAEIATTNPVAYEQYGSVAITNDQRGPNDRG

SEQ ID NO: 65685 - protein, 30 aa, Artificial Sequence
  Description of Artificial Sequence: Synthetic polypeptide
DEAEIATTNPVAYEQYGSVAITNLQAPNDN

SEQ ID NO: 65686 - protein, 34 aa, Artificial Sequence
  Description of Artificial Sequence: Synthetic polypeptide
AEEEIRTTNPVATEQYGSVSVTNNLQQGEEQNNE

SEQ ID NO: 65687 - protein, 34 aa, Artificial Sequence
  Description of Artificial Sequence: Synthetic polypeptide
AEEEIRTTNPVATEQYGSVSVTNNLQQGEGENSE

SEQ ID NO: 65688 - protein, 31 aa, Artificial Sequence
  Description of Artificial Sequence: Synthetic polypeptide
DEEEIRTTNPCATEPYGSVATNDGRGGDNAM

SEQ ID NO: 65689 - protein, 32 aa, Artificial Sequence
  Description of Artificial Sequence: Synthetic polypeptide
AEEEIRTTNPVATEQYGSVSNNQNENQETGNT

SEQ ID NO: 65690 - protein, 31 aa, Artificial Sequence
  Description of Artificial Sequence: Synthetic polypeptide
DEDEIATTNPVAYEQYGSVSTNLQNDDDNEM

SEQ ID NO: 65691 - protein, 30 aa, Artificial Sequence
  Description of Artificial Sequence: Synthetic polypeptide
DEEEIRTTNPVATEAYGCISTEEQRNSNFA

SEQ ID NO: 65692 - protein, 34 aa, Artificial Sequence
  Description of Artificial Sequence: Synthetic polypeptide
AEEEIRTTNPVATEQYGSVSTTNNLQQQQGNETS

SEQ ID NO: 65693 - protein, 34 aa, Artificial Sequence
  Description of Artificial Sequence: Synthetic polypeptide
AEEEIRTTNPVATEQYGSVSVTNNLVQNGTNNVN

SEQ ID NO: 65694 - protein, 32 aa, Artificial Sequence
  Description of Artificial Sequence: Synthetic polypeptide
DDAEIRTTNPVATEQYGSVSDTTWNETRSQNR

SEQ ID NO: 65695 - protein, 34 aa, Artificial Sequence
  Description of Artificial Sequence: Synthetic polypeptide
AEEEIRTTNPVATEQYGSVSVTNNLQQQNGTNVN

SEQ ID NO: 65696 - protein, 34 aa, Artificial Sequence
  Description of Artificial Sequence: Synthetic polypeptide
AEEEIRTTNPVATEQYGSVSTTNNLQQQQGNNQE

SEQ ID NO: 65697 - protein, 34 aa, Artificial Sequence
  Description of Artificial Sequence: Synthetic polypeptide
AEEEIRTTNPVATEQYGSVSVTNNLQQNEGTNVN

SEQ ID NO: 65698 - protein, 32 aa, Artificial Sequence
  Description of Artificial Sequence: Synthetic polypeptide
DEAEIATTNPVAYEQYGSVAATNDQRGDNTRG

SEQ ID NO: 65699 - protein, 32 aa, Artificial Sequence
  Description of Artificial Sequence: Synthetic polypeptide
AEEEIRTTNPVATEQYGSVSNSNNENQGTGNG

SEQ ID NO: 65700 - protein, 34 aa, Artificial Sequence
  Description of Artificial Sequence: Synthetic polypeptide
AEEEIRTTNPVATEQYGSVSTTNNLQQSGNSTTQ

SEQ ID NO: 65701 - protein, 34 aa, Artificial Sequence
  Description of Artificial Sequence: Synthetic polypeptide
DEEEIRTTNPVATEAYGCSVSSNSLSQRAVGNNP

SEQ ID NO: 65702 - protein, 34 aa, Artificial Sequence
  Description of Artificial Sequence: Synthetic polypeptide
AEEEIRTTNPVATEQYGSVSVTNNLQQGTTTIRE

SEQ ID NO: 65703 - protein, 32 aa, Artificial Sequence
  Description of Artificial Sequence: Synthetic polypeptide
DEDEIATTNPVAYEQYGSVSTGNTQQDNGNER

SEQ ID NO: 65704 - protein, 32 aa, Artificial Sequence
  Description of Artificial Sequence: Synthetic polypeptide
AEEEIRTTNPVATEQYGSVSNSNLAGNGNINA

SEQ ID NO: 65705 - protein, 30 aa, Artificial Sequence
  Description of Artificial Sequence: Synthetic polypeptide
DEAEIATTNPVAYEQYGSVAATNDTAGNRD

SEQ ID NO: 65706 - protein, 34 aa, Artificial Sequence
  Description of Artificial Sequence: Synthetic polypeptide
AEEEIRTTNPVATEQYGSVSTTNNLQQQTGGTNE

SEQ ID NO: 65707 - protein, 31 aa, Artificial Sequence
  Description of Artificial Sequence: Synthetic polypeptide
DEDEIATTNPVAYEQYGSVSTNLQADGTEPE

SEQ ID NO: 65708 - protein, 32 aa, Artificial Sequence
  Description of Artificial Sequence: Synthetic polypeptide
AEEEIRTTNPVATEQYGSVSNNQQGNQQGNNL

SEQ ID NO: 65709 - protein, 32 aa, Artificial Sequence
  Description of Artificial Sequence: Synthetic polypeptide
DEEEIRTTNPVATEAYGEVISTGYLSQPGGNA

SEQ ID NO: 65710 - protein, 32 aa, Artificial Sequence
  Description of Artificial Sequence: Synthetic polypeptide
DECEIATTNPVAYEQYGTVSTNLQHDGGNGNR

SEQ ID NO: 65711 - protein, 34 aa, Artificial Sequence
  Description of Artificial Sequence: Synthetic polypeptide
AEEEIRTTNPVATEQYGSVSVTNNLQQNDEGNDE

SEQ ID NO: 65712 - protein, 31 aa, Artificial Sequence
  Description of Artificial Sequence: Synthetic polypeptide
DECEICTTNPCATEQYGSVVTNLQHGGNNGN

SEQ ID NO: 65713 - protein, 33 aa, Artificial Sequence
  Description of Artificial Sequence: Synthetic polypeptide
DEEEIATTNPVATEAYGSVISCTDNLSQKTGER

SEQ ID NO: 65714 - protein, 31 aa, Artificial Sequence
  Description of Artificial Sequence: Synthetic polypeptide
DECEICTTNPCATEQYGSVVTTNLQHGGNGG

SEQ ID NO: 65715 - protein, 33 aa, Artificial Sequence
  Description of Artificial Sequence: Synthetic polypeptide
AEEEIRTTNPVATEQYGSVSSTNNQNQIGENTD

SEQ ID NO: 65716 - protein, 33 aa, Artificial Sequence
  Description of Artificial Sequence: Synthetic polypeptide
AEEEIRTTNPVATEQYGSVSSTNNNQQGIGNTE

SEQ ID NO: 65717 - protein, 33 aa, Artificial Sequence
  Description of Artificial Sequence: Synthetic polypeptide
AEEEIRTTNPVATEQYGSVSSTNNNNQQIGNTQ

SEQ ID NO: 65718 - protein, 31 aa, Artificial Sequence
  Description of Artificial Sequence: Synthetic polypeptide
DCEEIASTNPVATEQYGSVSWNENQERNGQR

SEQ ID NO: 65719 - protein, 34 aa, Artificial Sequence
  Description of Artificial Sequence: Synthetic polypeptide
AEEEIRTTNPVATEQYGSVVVSTTNNQLQNGNNL

SEQ ID NO: 65720 - protein, 34 aa, Artificial Sequence
  Description of Artificial Sequence: Synthetic polypeptide
AEEEIRTTNPVATEQYGSVSVTNNQLQQQGNNTE

SEQ ID NO: 65721 - protein, 34 aa, Artificial Sequence
  Description of Artificial Sequence: Synthetic polypeptide
DEEEIRTTNPVATDQWGSVSNTGNALSQSGTSNR

SEQ ID NO: 65722 - protein, 34 aa, Artificial Sequence
  Description of Artificial Sequence: Synthetic polypeptide
AEEEIRTTNPVATEQYGSVSVTNNQLQGQEGTNG

SEQ ID NO: 65723 - protein, 34 aa, Artificial Sequence
  Description of Artificial Sequence: Synthetic polypeptide
AEEEIRTTNPVATEQYGSVSTTNNLQNQIGNQNT

SEQ ID NO: 65724 - protein, 34 aa, Artificial Sequence
  Description of Artificial Sequence: Synthetic polypeptide
AEEEIRTTNPVATEQYGSVSSTNQLNQGNGNNNE

SEQ ID NO: 65725 - protein, 34 aa, Artificial Sequence
  Description of Artificial Sequence: Synthetic polypeptide
AEEEIRTTNPVATEQYGSVSTTNNLQNQQGNIAE

SEQ ID NO: 65726 - protein, 32 aa, Artificial Sequence
  Description of Artificial Sequence: Synthetic polypeptide
DECEICTTNPVATEQYGSVSTNLLNQVNLGEQ

SEQ ID NO: 65727 - protein, 33 aa, Artificial Sequence
  Description of Artificial Sequence: Synthetic polypeptide
AEEEIRTTNPVATEQYGSVVVSVNLGNQQGNGE

SEQ ID NO: 65728 - protein, 29 aa, Artificial Sequence
  Description of Artificial Sequence: Synthetic peptide
DCEEIRATNPVAYEQWGSSSTNMQRDGMN

SEQ ID NO: 65729 - protein, 33 aa, Artificial Sequence
  Description of Artificial Sequence: Synthetic polypeptide
AEEEIRTTNPVATEQYGSVVVSVNLNNQQGNNG

SEQ ID NO: 65730 - protein, 32 aa, Artificial Sequence
  Description of Artificial Sequence: Synthetic polypeptide
DECEICTTNPVATEQYGSVSTNLLNQVNGSEG

SEQ ID NO: 65731 - protein, 32 aa, Artificial Sequence
  Description of Artificial Sequence: Synthetic polypeptide
DECEICTTNPVATEQYGSVSTNLLNQENGDEF

SEQ ID NO: 65732 - protein, 30 aa, Artificial Sequence
  Description of Artificial Sequence: Synthetic polypeptide
DCEEIRATNPVAYEQWGSSTSTNMQRGDNN

SEQ ID NO: 65733 - protein, 29 aa, Artificial Sequence
  Description of Artificial Sequence: Synthetic peptide
DCEEIRATNPVAYEQWGSSYTNMQRGNDN

SEQ ID NO: 65734 - protein, 33 aa, Artificial Sequence
  Description of Artificial Sequence: Synthetic polypeptide
AEEEIRTTNPVATEQYGSVSSTNNNNQIGTNTQ

SEQ ID NO: 65735 - protein, 32 aa, Artificial Sequence
  Description of Artificial Sequence: Synthetic polypeptide
DECEICTTNPVATEQYGSVSTNLNNQVNGEEE

SEQ ID NO: 65736 - protein, 33 aa, Artificial Sequence
  Description of Artificial Sequence: Synthetic polypeptide
AEEEIRTTNPVATEQYGSVVVSVNLNQQGENGN

SEQ ID NO: 65737 - protein, 31 aa, Artificial Sequence
  Description of Artificial Sequence: Synthetic polypeptide
DEAEIATTNPVAYEQWGSVSTNLQSNGDNGM

SEQ ID NO: 65738 - protein, 30 aa, Artificial Sequence
  Description of Artificial Sequence: Synthetic polypeptide
DEAEIATTNPVAYEQWGSVSTNLQSGGQEE

SEQ ID NO: 65739 - protein, 32 aa, Artificial Sequence
  Description of Artificial Sequence: Synthetic polypeptide
DEDEIATTNPVAYEQYGSVATNLQRVGDNMDD

SEQ ID NO: 65740 - protein, 33 aa, Artificial Sequence
  Description of Artificial Sequence: Synthetic polypeptide
AEEEIRTTNPVATEQYGSVSVTNNQNQQQGNTE

SEQ ID NO: 65741 - protein, 30 aa, Artificial Sequence
  Description of Artificial Sequence: Synthetic polypeptide
DEAEIATTNPVAYEQWGSVSTNLQQPGDVE

SEQ ID NO: 65742 - protein, 32 aa, Artificial Sequence
  Description of Artificial Sequence: Synthetic polypeptide
DEDEIATTNPVAYEQYGSVATNLQTTPGNDRH

SEQ ID NO: 65743 - protein, 34 aa, Artificial Sequence
  Description of Artificial Sequence: Synthetic polypeptide
AEEEIRTTNPVATEQYGSVVVSTTNLQNGNQNGD

SEQ ID NO: 65744 - protein, 34 aa, Artificial Sequence
  Description of Artificial Sequence: Synthetic polypeptide
AEEEIRTTNPVATEQYGSVVVSTTNLQQNGNNAD

SEQ ID NO: 65745 - protein, 34 aa, Artificial Sequence
  Description of Artificial Sequence: Synthetic polypeptide
AEEEIRTTNPVATEQYGSVSTTNNLQNDNGNQSG

SEQ ID NO: 65746 - protein, 34 aa, Artificial Sequence
  Description of Artificial Sequence: Synthetic polypeptide
AEEEIRTTNPVATEQYGSVVVSTTNNLQQGTANV

SEQ ID NO: 65747 - protein, 33 aa, Artificial Sequence
  Description of Artificial Sequence: Synthetic polypeptide
AEEEIRTTNPVATEQYGSVSSTTNNNQNIGNTE

SEQ ID NO: 65748 - protein, 32 aa, Artificial Sequence
  Description of Artificial Sequence: Synthetic polypeptide
AEEEIRTTNPVATEQYGSVSSTNQQQTNGTIY

SEQ ID NO: 65749 - protein, 33 aa, Artificial Sequence
  Description of Artificial Sequence: Synthetic polypeptide
DEEEIRTTNPVATAQYGSAVCSTNPLGQESSER

SEQ ID NO: 65750 - protein, 32 aa, Artificial Sequence
  Description of Artificial Sequence: Synthetic polypeptide
DEDEIATTNPVAYEQYGSVATNLQVADGNDRN

SEQ ID NO: 65751 - protein, 33 aa, Artificial Sequence
  Description of Artificial Sequence: Synthetic polypeptide
AEEEIRTTNPVATEQYGSVSTTNNLQNEDEDNG

SEQ ID NO: 65752 - protein, 33 aa, Artificial Sequence
  Description of Artificial Sequence: Synthetic polypeptide
AEEEIRTTNPVATEQYGSVSTTNNLQNEDENEG

SEQ ID NO: 65753 - protein, 33 aa, Artificial Sequence
  Description of Artificial Sequence: Synthetic polypeptide
AEEEIRTTNPVATEQYGSVSSTTNNNNQIGNTE

SEQ ID NO: 65754 - protein, 31 aa, Artificial Sequence
  Description of Artificial Sequence: Synthetic polypeptide
DEDEIATTNPVAYEQYGSVATNLQVGDNTDQ

SEQ ID NO: 65755 - protein, 30 aa, Artificial Sequence
  Description of Artificial Sequence: Synthetic polypeptide
DEDEIATTNPVAYEQYGSVATNLQVGDQGQ

SEQ ID NO: 65756 - protein, 34 aa, Artificial Sequence
  Description of Artificial Sequence: Synthetic polypeptide
AEEEIRTTNPVATEQYGSVSSTTNLPNMRNGMNV

SEQ ID NO: 65757 - protein, 32 aa, Artificial Sequence
  Description of Artificial Sequence: Synthetic polypeptide
DEEEIRTTNPVATCQYGSVCSTPLQNFGSEQS

SEQ ID NO: 65758 - protein, 33 aa, Artificial Sequence
  Description of Artificial Sequence: Synthetic polypeptide
AEEEIRTTNPVATEQYGSVSSTNTNTQIGTNTE

SEQ ID NO: 65759 - protein, 33 aa, Artificial Sequence
  Description of Artificial Sequence: Synthetic polypeptide
AEEEIRTTNPVATEQYGSVSSTTNNNQIGTNTE

SEQ ID NO: 65760 - protein, 33 aa, Artificial Sequence
  Description of Artificial Sequence: Synthetic polypeptide
DEEEIRTTNPVATEAYGKTVSTANLSMREVGNM

SEQ ID NO: 65761 - protein, 34 aa, Artificial Sequence
  Description of Artificial Sequence: Synthetic polypeptide
AEEEIRTTNPVATEQYGSVSTTNNLQQDEGNNEE

SEQ ID NO: 65762 - protein, 33 aa, Artificial Sequence
  Description of Artificial Sequence: Synthetic polypeptide
DEEEIRTTNPVATDQYGSVSSANGLTTRTGNTW

SEQ ID NO: 65763 - protein, 34 aa, Artificial Sequence
  Description of Artificial Sequence: Synthetic polypeptide
AEEEIRTTNPVATEQYGSVSTTNNLQQIGTNEES

SEQ ID NO: 65764 - protein, 29 aa, Artificial Sequence
  Description of Artificial Sequence: Synthetic peptide
DEAEIATTNPVAYEQYGEVASNLQRGDME

SEQ ID NO: 65765 - protein, 33 aa, Artificial Sequence
  Description of Artificial Sequence: Synthetic polypeptide
DEAEIATTNPVAYEQYGQSVSATNDLLQRGIAR

SEQ ID NO: 65766 - protein, 34 aa, Artificial Sequence
  Description of Artificial Sequence: Synthetic polypeptide
AEEEIRTTNPVATEQYGSVSSTNLNQQGEGNNNT

SEQ ID NO: 65767 - protein, 34 aa, Artificial Sequence
  Description of Artificial Sequence: Synthetic polypeptide
AEEEIRTTNPVATEQYGSVSTTNNLQQNEQGNNQ

SEQ ID NO: 65768 - protein, 34 aa, Artificial Sequence
  Description of Artificial Sequence: Synthetic polypeptide
AEEEIRTTNPVATEQYGSVSSTNLNQNGNGNNNN

SEQ ID NO: 65769 - protein, 34 aa, Artificial Sequence
  Description of Artificial Sequence: Synthetic polypeptide
AEEEIRTTNPVATEQYGSVSSTNLNQLGGNNNNE

SEQ ID NO: 65770 - protein, 31 aa, Artificial Sequence
  Description of Artificial Sequence: Synthetic polypeptide
DEEEIRTTNPCATEPYGSVATNHGRGPNAAM

SEQ ID NO: 65771 - protein, 32 aa, Artificial Sequence
  Description of Artificial Sequence: Synthetic polypeptide
AEEEIRTTNPVATEQYGSVSSSNLQNQEQGIG

SEQ ID NO: 65772 - protein, 30 aa, Artificial Sequence
  Description of Artificial Sequence: Synthetic polypeptide
DECEICTTNPVATDQYGVVSTDALQTGTND

SEQ ID NO: 65773 - protein, 33 aa, Artificial Sequence
  Description of Artificial Sequence: Synthetic polypeptide
AEEEIRTTNPVATEQYGSVSSNTNNNQIGTNTE

SEQ ID NO: 65774 - protein, 30 aa, Artificial Sequence
  Description of Artificial Sequence: Synthetic polypeptide
DECEICTTNPVATDQYGVVSTALQQGENDE

SEQ ID NO: 65775 - protein, 30 aa, Artificial Sequence
  Description of Artificial Sequence: Synthetic polypeptide
DECEICTTNPVATDQYGVVSTALQMGNNDD

SEQ ID NO: 65776 - protein, 30 aa, Artificial Sequence
  Description of Artificial Sequence: Synthetic polypeptide
DECEICTTNPVATDQYGSVNTQLQAGNTDD

SEQ ID NO: 65777 - protein, 32 aa, Artificial Sequence
  Description of Artificial Sequence: Synthetic polypeptide
AEEEIRTTNPVATEQYGSVSSNNLQNQEQGIG

SEQ ID NO: 65778 - protein, 32 aa, Artificial Sequence
  Description of Artificial Sequence: Synthetic polypeptide
DEEEIRTTNPVATDRWGSVSTNALSESGTSNR

SEQ ID NO: 65779 - protein, 32 aa, Artificial Sequence
  Description of Artificial Sequence: Synthetic polypeptide
AEEEIRTTNPVATEQYGSVSSNNENQGETGNT

SEQ ID NO: 65780 - protein, 28 aa, Artificial Sequence
  Description of Artificial Sequence: Synthetic peptide
CEAEIACTNPVAYEQYGETSENLQRGGR

SEQ ID NO: 65781 - protein, 29 aa, Artificial Sequence
  Description of Artificial Sequence: Synthetic peptide
DEAEIATTNPVAYEQYGSCATNLPAPNER

SEQ ID NO: 65782 - protein, 34 aa, Artificial Sequence
  Description of Artificial Sequence: Synthetic polypeptide
AEEEIRTTNPVATEQYGSVSVTNNNLQQNDNGNT

SEQ ID NO: 65783 - protein, 34 aa, Artificial Sequence
  Description of Artificial Sequence: Synthetic polypeptide
AEEEIRTTNPVATEQYGSVVVSVTNLQLGGNANG

SEQ ID NO: 65784 - protein, 33 aa, Artificial Sequence
  Description of Artificial Sequence: Synthetic polypeptide
DEEEIATTNPVATEAYGSVVSNCTNLSQQTGER

SEQ ID NO: 65785 - protein, 34 aa, Artificial Sequence
  Description of Artificial Sequence: Synthetic polypeptide
AEEEIRTTNPVATEQYGSVSSTNLNQQGIGTNND

SEQ ID NO: 65786 - protein, 34 aa, Artificial Sequence
  Description of Artificial Sequence: Synthetic polypeptide
AEEEIRTTNPVATEQYGSVVVSVTNLEQGGNQDE

SEQ ID NO: 65787 - protein, 32 aa, Artificial Sequence
  Description of Artificial Sequence: Synthetic polypeptide
DEEEIATTNPVATEAYGSVVSCTNLSHKTNER

SEQ ID NO: 65788 - protein, 32 aa, Artificial Sequence
  Description of Artificial Sequence: Synthetic polypeptide
DECEICTTNPVATEQYGSVSTNLLNQDNGEEQ

SEQ ID NO: 65789 - protein, 33 aa, Artificial Sequence
  Description of Artificial Sequence: Synthetic polypeptide
DEEEIRTTNPCATEQWGSGVIATANLQRGENID

SEQ ID NO: 65790 - protein, 33 aa, Artificial Sequence
  Description of Artificial Sequence: Synthetic polypeptide
AEEEIRTTNPVATEQYGSVSVTNNQGNLGINNI

SEQ ID NO: 65791 - protein, 33 aa, Artificial Sequence
  Description of Artificial Sequence: Synthetic polypeptide
AEEEIRTTNPVATEQYGSVSVTNNQGNLGINGT

SEQ ID NO: 65792 - protein, 33 aa, Artificial Sequence
  Description of Artificial Sequence: Synthetic polypeptide
AEEEIRTTNPVATEQYGSVSTTNNLQQEGETED

SEQ ID NO: 65793 - protein, 33 aa, Artificial Sequence
  Description of Artificial Sequence: Synthetic polypeptide
AEEEIRTTNPVATEQYGSVSVTNNNVQNGTNQN

SEQ ID NO: 65794 - protein, 34 aa, Artificial Sequence
  Description of Artificial Sequence: Synthetic polypeptide
AEEEIRTTNPVATEQYGSVSTTNNLQQGEENATD

SEQ ID NO: 65795 - protein, 33 aa, Artificial Sequence
  Description of Artificial Sequence: Synthetic polypeptide
AEEEIRTTNPVATEQYGSVSVTNNNQNDQGNVD

SEQ ID NO: 65796 - protein, 32 aa, Artificial Sequence
  Description of Artificial Sequence: Synthetic polypeptide
AEEEIRTTNPVATEQYGSVSSTNLQENEQEEE

SEQ ID NO: 65797 - protein, 30 aa, Artificial Sequence
  Description of Artificial Sequence: Synthetic polypeptide
DCEEIRSTNPVATEQYGAVSTNQIAQNGQK

SEQ ID NO: 65798 - protein, 33 aa, Artificial Sequence
  Description of Artificial Sequence: Synthetic polypeptide
AEEEIRTTNPVATEQYGSVSTTNNLQQGTQGSG

SEQ ID NO: 65799 - protein, 31 aa, Artificial Sequence
  Description of Artificial Sequence: Synthetic polypeptide
DCEEIRSTNPVATEQYGSVSTNQIAHNDHQR

SEQ ID NO: 65800 - protein, 30 aa, Artificial Sequence
  Description of Artificial Sequence: Synthetic polypeptide
DCEEIRSTNPVATEQYGSVSTNQIAHNMQH

SEQ ID NO: 65801 - protein, 30 aa, Artificial Sequence
  Description of Artificial Sequence: Synthetic polypeptide
DCEEIRSTNPVATEQYGSVSTNQVAHNGQG

SEQ ID NO: 65802 - protein, 30 aa, Artificial Sequence
  Description of Artificial Sequence: Synthetic polypeptide
DCEEIRSTNPVAYEQWGSCSTNMQRQGENN

SEQ ID NO: 65803 - protein, 34 aa, Artificial Sequence
  Description of Artificial Sequence: Synthetic polypeptide
AEEEIRTTNPVATEQYGSVSSTNNLNQGIGTNVD

SEQ ID NO: 65804 - protein, 32 aa, Artificial Sequence
  Description of Artificial Sequence: Synthetic polypeptide
AEEEIRTTNPVATEQYGSVSSTNNEGNAGGNE

SEQ ID NO: 65805 - protein, 30 aa, Artificial Sequence
  Description of Artificial Sequence: Synthetic polypeptide
DECEICTTNPVATDQYGVVSTTALQTGNQD

SEQ ID NO: 65806 - protein, 30 aa, Artificial Sequence
  Description of Artificial Sequence: Synthetic polypeptide
DECEICTTNPVATDQYGVVSTTALQQGNDN

SEQ ID NO: 65807 - protein, 33 aa, Artificial Sequence
  Description of Artificial Sequence: Synthetic polypeptide
DEEEIRTTNPVATDQYGTVASTPNDHQPGNERT

SEQ ID NO: 65808 - protein, 32 aa, Artificial Sequence
  Description of Artificial Sequence: Synthetic polypeptide
AEEEIRTTNPVATEQYGSVSNNQENQETGTNT

SEQ ID NO: 65809 - protein, 34 aa, Artificial Sequence
  Description of Artificial Sequence: Synthetic polypeptide
AEEEIRTTNPVATEQYGSVSVTNNLQQGDNGNVT

SEQ ID NO: 65810 - protein, 32 aa, Artificial Sequence
  Description of Artificial Sequence: Synthetic polypeptide
DEEEIATTNPMATEQYGSVPTVQLDHRQGNFR

SEQ ID NO: 65811 - protein, 34 aa, Artificial Sequence
  Description of Artificial Sequence: Synthetic polypeptide
AEEEIRTTNPVATEQYGSVSTTNNNLQQIGENDG

SEQ ID NO: 65812 - protein, 31 aa, Artificial Sequence
  Description of Artificial Sequence: Synthetic polypeptide
AEEEIRTTNPVATEQYGSVAEDNLYQGDGLE

SEQ ID NO: 65813 - protein, 30 aa, Artificial Sequence
  Description of Artificial Sequence: Synthetic polypeptide
AEEEIRTTNPVATEQYGSTSTQQLQGEQGE

SEQ ID NO: 65814 - protein, 31 aa, Artificial Sequence
  Description of Artificial Sequence: Synthetic polypeptide
DEAEIATTNPVAYEQYGSVATNLQPGDNNDQ

SEQ ID NO: 65815 - protein, 30 aa, Artificial Sequence
  Description of Artificial Sequence: Synthetic polypeptide
DEEEIASVNPVCTEQYGSVSDINLPQSGNQ

SEQ ID NO: 65816 - protein, 31 aa, Artificial Sequence
  Description of Artificial Sequence: Synthetic polypeptide
DEAEIATTNPVAYEQYGSVATNLQRGDQTEQ

SEQ ID NO: 65817 - protein, 34 aa, Artificial Sequence
  Description of Artificial Sequence: Synthetic polypeptide
AEEEIRTTNPVATEQYGSVSTTNNNLQQIGNNGE

SEQ ID NO: 65818 - protein, 33 aa, Artificial Sequence
  Description of Artificial Sequence: Synthetic polypeptide
DEEEIATTNPVATEQYGSVCADTNPLQDDQGNE

SEQ ID NO: 65819 - protein, 33 aa, Artificial Sequence
  Description of Artificial Sequence: Synthetic polypeptide
DEEEIATTNPVATEQYGSVCADTNPLQDQGDNE

SEQ ID NO: 65820 - protein, 31 aa, Artificial Sequence
  Description of Artificial Sequence: Synthetic polypeptide
DEEEIASVNPVCTEQYGSVSTDNGQMRGNPQ

SEQ ID NO: 65821 - protein, 31 aa, Artificial Sequence
  Description of Artificial Sequence: Synthetic polypeptide
DEAEIATTNPVAYEQYGSVATNLQRPGGETL

SEQ ID NO: 65822 - protein, 33 aa, Artificial Sequence
  Description of Artificial Sequence: Synthetic polypeptide
AEEEIRTTNPVATEQYGSVSVTNDQLGNGNEQE

SEQ ID NO: 65823 - protein, 33 aa, Artificial Sequence
  Description of Artificial Sequence: Synthetic polypeptide
AEEEIRTTNPVATEQYGSVSVTNDQAGNGTNQE

SEQ ID NO: 65824 - protein, 33 aa, Artificial Sequence
  Description of Artificial Sequence: Synthetic polypeptide
AEEEIRTTNPVATEQYGSVSVTNDQAGNGNTEG

SEQ ID NO: 65825 - protein, 33 aa, Artificial Sequence
  Description of Artificial Sequence: Synthetic polypeptide
AEEEIRTTNPVATEQYGSVSVTNDNQQGNGNDE

SEQ ID NO: 65826 - protein, 29 aa, Artificial Sequence
  Description of Artificial Sequence: Synthetic peptide
DEEEIASVNPVCTEQWGVVSDNLQREGNQ

SEQ ID NO: 65827 - protein, 33 aa, Artificial Sequence
  Description of Artificial Sequence: Synthetic polypeptide
AEEEIRTTNPVATEQYGSVSVTNDGQGNGNNQE

SEQ ID NO: 65828 - protein, 34 aa, Artificial Sequence
  Description of Artificial Sequence: Synthetic polypeptide
AEEEIRTTNPVATEQYGSVSTTNNNLQQQEGNAE

SEQ ID NO: 65829 - protein, 33 aa, Artificial Sequence
  Description of Artificial Sequence: Synthetic polypeptide
AEEEIRTTNPVATEQYGSVSVTNDEQGVNGNNI

SEQ ID NO: 65830 - protein, 32 aa, Artificial Sequence
  Description of Artificial Sequence: Synthetic polypeptide
AEEEIRTTNPVATEQYGSVSVTLLQGQNNNAT

SEQ ID NO: 65831 - protein, 29 aa, Artificial Sequence
  Description of Artificial Sequence: Synthetic peptide
DEEEIASVNPVCTEQYGSVSADNLQSGEQ

SEQ ID NO: 65832 - protein, 33 aa, Artificial Sequence
  Description of Artificial Sequence: Synthetic polypeptide
AEEEIRTTNPVATEQYGSVSVTENQGQNGNNNN

SEQ ID NO: 65833 - protein, 31 aa, Artificial Sequence
  Description of Artificial Sequence: Synthetic polypeptide
AEEEIRTTNPVATEQYGSVATTNQQNQENTN

SEQ ID NO: 65834 - protein, 33 aa, Artificial Sequence
  Description of Artificial Sequence: Synthetic polypeptide
AEEEIRTTNPVATEQYGSVSVTNDQQGNGNDET

SEQ ID NO: 65835 - protein, 32 aa, Artificial Sequence
  Description of Artificial Sequence: Synthetic polypeptide
AEEEIRTTNPVATEQYGSVSVTNLLIGEGGGG

SEQ ID NO: 65836 - protein, 28 aa, Artificial Sequence
  Description of Artificial Sequence: Synthetic peptide
ANNEIACTNPVATEQYGEASENLQRGGR

SEQ ID NO: 65837 - protein, 33 aa, Artificial Sequence
  Description of Artificial Sequence: Synthetic polypeptide
AEEEIRTTNPVATEQYGSVSVTNLEQGVTNNNI

SEQ ID NO: 65838 - protein, 34 aa, Artificial Sequence
  Description of Artificial Sequence: Synthetic polypeptide
AEEEIRTTNPVATEQYGSVSTTNNNLQQGENATE

SEQ ID NO: 65839 - protein, 30 aa, Artificial Sequence
  Description of Artificial Sequence: Synthetic polypeptide
DEAEIATTNPVAYEQYGSVATNLQAGPDGE

SEQ ID NO: 65840 - protein, 34 aa, Artificial Sequence
  Description of Artificial Sequence: Synthetic polypeptide
AEEEIRTTNPVATEQYGSVSVTNLEQGSTTNGNI

SEQ ID NO: 65841 - protein, 28 aa, Artificial Sequence
  Description of Artificial Sequence: Synthetic peptide
DEEEIASVNPVCTEQYGVVSDPLQSGNQ

SEQ ID NO: 65842 - protein, 28 aa, Artificial Sequence
  Description of Artificial Sequence: Synthetic peptide
DEEEIASVNPVCTEQYGVVSDELQSGNQ

SEQ ID NO: 65843 - protein, 28 aa, Artificial Sequence
  Description of Artificial Sequence: Synthetic peptide
DEEEIASVNPVCTEQYGVVSDDLQSGNQ

SEQ ID NO: 65844 - protein, 29 aa, Artificial Sequence
  Description of Artificial Sequence: Synthetic peptide
DEEEIASVNPVCTEQYGVVCSDNLQSGNQ

SEQ ID NO: 65845 - protein, 30 aa, Artificial Sequence
  Description of Artificial Sequence: Synthetic polypeptide
DEAEIATTNPVAYEQYGSVATNLQDTGDFH

SEQ ID NO: 65846 - protein, 28 aa, Artificial Sequence
  Description of Artificial Sequence: Synthetic peptide
DEEEIASVNPVCTEQYGVVSDAGQRGNQ

SEQ ID NO: 65847 - protein, 31 aa, Artificial Sequence
  Description of Artificial Sequence: Synthetic polypeptide
DEAEIATTNPVAYEQYGSVATNLQGAGMNDN

SEQ ID NO: 65848 - protein, 29 aa, Artificial Sequence
  Description of Artificial Sequence: Synthetic peptide
DDEDIRCTNPVATEQYGCVSTNHQLDNQQ

SEQ ID NO: 65849 - protein, 32 aa, Artificial Sequence
  Description of Artificial Sequence: Synthetic polypeptide
DDEEEIRTTNPVAYEPYGQVSCTNLQSGGNEN

SEQ ID NO: 65850 - protein, 34 aa, Artificial Sequence
  Description of Artificial Sequence: Synthetic polypeptide
AEEEIRTTNPVATEQYGSVVVSVTNQLQNGNNGN

SEQ ID NO: 65851 - protein, 29 aa, Artificial Sequence
  Description of Artificial Sequence: Synthetic peptide
DEEEIASVNPVCTEQYGVVSADNLQSGNQ

SEQ ID NO: 65852 - protein, 33 aa, Artificial Sequence
  Description of Artificial Sequence: Synthetic polypeptide
AEEEIRTTNPVATEQYGSVSVTNEQQQQGTNVD

SEQ ID NO: 65853 - protein, 32 aa, Artificial Sequence
  Description of Artificial Sequence: Synthetic polypeptide
DEEEIATTNPVATEQYGSVCADTNDQSGDNQE

SEQ ID NO: 65854 - protein, 33 aa, Artificial Sequence
  Description of Artificial Sequence: Synthetic polypeptide
AEEEIRTTNPVATEQYGSVSVTNDQQGNGNNTE

SEQ ID NO: 65855 - protein, 31 aa, Artificial Sequence
  Description of Artificial Sequence: Synthetic polypeptide
DEAEIATTNPVAYEQYGSVATNLQERGEGEA

SEQ ID NO: 65856 - protein, 29 aa, Artificial Sequence
  Description of Artificial Sequence: Synthetic peptide
DEEEIASVNPVCTEQYGVVSTNLVEFGND

SEQ ID NO: 65857 - protein, 28 aa, Artificial Sequence
  Description of Artificial Sequence: Synthetic peptide
DEEEIASVNPVCTEGYGVVSNNLQRGQQ

SEQ ID NO: 65858 - protein, 29 aa, Artificial Sequence
  Description of Artificial Sequence: Synthetic peptide
DEEEIASVNPVATEQYGVVSSDAGQRGNQ

SEQ ID NO: 65859 - protein, 31 aa, Artificial Sequence
  Description of Artificial Sequence: Synthetic polypeptide
CEEEIACTNPVATEQYGCVATNLQQDGNDRN

SEQ ID NO: 65860 - protein, 31 aa, Artificial Sequence
  Description of Artificial Sequence: Synthetic polypeptide
DEAEIATTNPVAYEQYGSVSTGNGNQSGNDE

SEQ ID NO: 65861 - protein, 34 aa, Artificial Sequence
  Description of Artificial Sequence: Synthetic polypeptide
AEEEIRTTNPVATEQYGSVVVSVTTNLQNGNNAD

SEQ ID NO: 65862 - protein, 28 aa, Artificial Sequence
  Description of Artificial Sequence: Synthetic peptide
AINEIACTNPVATEQYGEASENLQRGGR

SEQ ID NO: 65863 - protein, 30 aa, Artificial Sequence
  Description of Artificial Sequence: Synthetic polypeptide
DEAEIATTNPVAYEQYGSVSTNEGQGENHE

SEQ ID NO: 65864 - protein, 30 aa, Artificial Sequence
  Description of Artificial Sequence: Synthetic polypeptide
DEEEIASTNPVCTECYGSVSCNLPQSEGNQ

SEQ ID NO: 65865 - protein, 32 aa, Artificial Sequence
  Description of Artificial Sequence: Synthetic polypeptide
DEAEIATTNPVAYEQYGSVSTNLQANGDDNEM

SEQ ID NO: 65866 - protein, 32 aa, Artificial Sequence
  Description of Artificial Sequence: Synthetic polypeptide
AEEEIRTTNPVATEQYGEVSSTTNGNRNGMNV

SEQ ID NO: 65867 - protein, 34 aa, Artificial Sequence
  Description of Artificial Sequence: Synthetic polypeptide
AEEEIRTTNPVATEQYGSVSTTNNNLQQQNGNTQ

SEQ ID NO: 65868 - protein, 33 aa, Artificial Sequence
  Description of Artificial Sequence: Synthetic polypeptide
AEEEIRTTNPVATEQYGSVSVTENNGNQQGNND

SEQ ID NO: 65869 - protein, 28 aa, Artificial Sequence
  Description of Artificial Sequence: Synthetic peptide
AGNEIACTNPVATEQYGEASENLQRGGR

SEQ ID NO: 65870 - protein, 30 aa, Artificial Sequence
  Description of Artificial Sequence: Synthetic polypeptide
DEEEIASTNPVATEQYGSVSTDLESEGEDQ

SEQ ID NO: 65871 - protein, 31 aa, Artificial Sequence
  Description of Artificial Sequence: Synthetic polypeptide
DEAEIATTNPVAYEQYGSVSTNLQGEDNGHE

SEQ ID NO: 65872 - protein, 32 aa, Artificial Sequence
  Description of Artificial Sequence: Synthetic polypeptide
DEAEIATTNPVAYEQYGSVSTNLQNRAGMEDN

SEQ ID NO: 65873 - protein, 31 aa, Artificial Sequence
  Description of Artificial Sequence: Synthetic polypeptide
AEEEIRTTNPVATEQYGCVSTNHARNSNFQN

SEQ ID NO: 65874 - protein, 32 aa, Artificial Sequence
  Description of Artificial Sequence: Synthetic polypeptide
DEEEIATTNPVATEQYGSVCAGTNLQDLNDDE

SEQ ID NO: 65875 - protein, 28 aa, Artificial Sequence
  Description of Artificial Sequence: Synthetic peptide
AEYEIACTNPVATEQYGEAYENLQRGGR

SEQ ID NO: 65876 - protein, 31 aa, Artificial Sequence
  Description of Artificial Sequence: Synthetic polypeptide
DEEEIASTNPVATEQYGSVSDINEPQSEGNQ

SEQ ID NO: 65877 - protein, 31 aa, Artificial Sequence
  Description of Artificial Sequence: Synthetic polypeptide
DEEEIASTNPVATEQYGSVSATDLQDSEGEL

SEQ ID NO: 65878 - protein, 31 aa, Artificial Sequence
  Description of Artificial Sequence: Synthetic polypeptide
DEEEIASTNPVATEQYGSVSATDLQDHEGEL

SEQ ID NO: 65879 - protein, 31 aa, Artificial Sequence
  Description of Artificial Sequence: Synthetic polypeptide
AEEEIRTTNPVATEQYGCYSTDLETMRGNNY

SEQ ID NO: 65880 - protein, 28 aa, Artificial Sequence
  Description of Artificial Sequence: Synthetic peptide
DEEEIASVNPVCTEGYGVVSDNLQSGNQ

SEQ ID NO: 65881 - protein, 32 aa, Artificial Sequence
  Description of Artificial Sequence: Synthetic polypeptide
DEEEIRTTNPVATEAYGSCSTGNGNTDSGNTR

SEQ ID NO: 65882 - protein, 32 aa, Artificial Sequence
  Description of Artificial Sequence: Synthetic polypeptide
DEEEIATTNPVATEQYGSVCAGNNLQNDNERE

SEQ ID NO: 65883 - protein, 28 aa, Artificial Sequence
  Description of Artificial Sequence: Synthetic peptide
DEEEIASVNPVATEQYGVVSEIEQSGNQ

SEQ ID NO: 65884 - protein, 28 aa, Artificial Sequence
  Description of Artificial Sequence: Synthetic peptide
DEEEIASVNPVATEQYGVVSEIEQAGNQ

SEQ ID NO: 65885 - protein, 33 aa, Artificial Sequence
  Description of Artificial Sequence: Synthetic polypeptide
AEEEIRTTNPVATEQYGSVSVTENQGQNGNNND

SEQ ID NO: 65886 - protein, 31 aa, Artificial Sequence
  Description of Artificial Sequence: Synthetic polypeptide
DEEEIASVNPVATEQYGVVSCNLPQREGENQ

SEQ ID NO: 65887 - protein, 28 aa, Artificial Sequence
  Description of Artificial Sequence: Synthetic peptide
DEEEIASVNPVATEQYGTVSDNPESGNQ

SEQ ID NO: 65888 - protein, 29 aa, Artificial Sequence
  Description of Artificial Sequence: Synthetic peptide
DEEEIASVNPVATEQYGSVSTAGNSGMNV

SEQ ID NO: 65889 - protein, 32 aa, Artificial Sequence
  Description of Artificial Sequence: Synthetic polypeptide
DEEEIRTTNPCATEGYGSCSTNLSARTGGNNQ

SEQ ID NO: 65890 - protein, 34 aa, Artificial Sequence
  Description of Artificial Sequence: Synthetic polypeptide
AEEEIRTTNPVATEQYGSVSTTNNNLQQQGNQTD

SEQ ID NO: 65891 - protein, 31 aa, Artificial Sequence
  Description of Artificial Sequence: Synthetic polypeptide
DEAEIATTNPVAYEQYGSVSAGNLFRNNMNR

SEQ ID NO: 65892 - protein, 28 aa, Artificial Sequence
  Description of Artificial Sequence: Synthetic peptide
AISEIACTNPVATEQYGEASENLQRGGR

SEQ ID NO: 65893 - protein, 33 aa, Artificial Sequence
  Description of Artificial Sequence: Synthetic polypeptide
AEEEIRTTNPVATEQYGSVSVTENNGQQGNNAG

SEQ ID NO: 65894 - protein, 28 aa, Artificial Sequence
  Description of Artificial Sequence: Synthetic peptide
AMNEIACTNPVATEQYGEASENLQRGGR

SEQ ID NO: 65895 - protein, 31 aa, Artificial Sequence
  Description of Artificial Sequence: Synthetic polypeptide
DEEEIRTTNPCATEGYGSCCSTNLAGGSNQS

SEQ ID NO: 65896 - protein, 29 aa, Artificial Sequence
  Description of Artificial Sequence: Synthetic peptide
DEEEIASTNPVCTEQYGVVSDNPQSEGNQ

SEQ ID NO: 65897 - protein, 30 aa, Artificial Sequence
  Description of Artificial Sequence: Synthetic polypeptide
DEEEIASTNPVCTEQYGVVSDINLQDSGNQ

SEQ ID NO: 65898 - protein, 28 aa, Artificial Sequence
  Description of Artificial Sequence: Synthetic peptide
DEEEIASTNPVCTEQYGVVSDIEQAGNQ

SEQ ID NO: 65899 - protein, 29 aa, Artificial Sequence
  Description of Artificial Sequence: Synthetic peptide
DEEEIASTNPVCTEQYGVVSDEDLQSGNQ

SEQ ID NO: 65900 - protein, 34 aa, Artificial Sequence
  Description of Artificial Sequence: Synthetic polypeptide
AEEEIRTTNPVATEQYGSVVVSVTTNLGQETGNT

SEQ ID NO: 65901 - protein, 30 aa, Artificial Sequence
  Description of Artificial Sequence: Synthetic polypeptide
DDEEIATTNPVATTQYGEVSTNGDGNGNHR

SEQ ID NO: 65902 - protein, 28 aa, Artificial Sequence
  Description of Artificial Sequence: Synthetic peptide
ALNEIACTNPVATEQYGEASENLQRGGR

SEQ ID NO: 65903 - protein, 33 aa, Artificial Sequence
  Description of Artificial Sequence: Synthetic polypeptide
AEEEIRTTNPVATEQYGSVVVSVTTNLGGTGNG

SEQ ID NO: 65904 - protein, 31 aa, Artificial Sequence
  Description of Artificial Sequence: Synthetic polypeptide
DEAEIATTNPVAYEQWGSVSTNLQNAGDNNM

SEQ ID NO: 65905 - protein, 29 aa, Artificial Sequence
  Description of Artificial Sequence: Synthetic peptide
DEEEIASVNPVCTEQYGVVSTNLVEFGNQ

SEQ ID NO: 65906 - protein, 34 aa, Artificial Sequence
  Description of Artificial Sequence: Synthetic polypeptide
AEEEIRTTNPVATEQYGSVSVTNLNQNQQGNTED

SEQ ID NO: 65907 - protein, 29 aa, Artificial Sequence
  Description of Artificial Sequence: Synthetic peptide
DDCEIRTTNPVATEWYGVVSTHKLERPND

SEQ ID NO: 65908 - protein, 33 aa, Artificial Sequence
  Description of Artificial Sequence: Synthetic polypeptide
AEEEIRTTNPVATEQYGSVSNNLLGNNQQGNNQ

SEQ ID NO: 65909 - protein, 34 aa, Artificial Sequence
  Description of Artificial Sequence: Synthetic polypeptide
AEEEIRTTNPVATEQYGSVSVTNNLQGNLGINQN

SEQ ID NO: 65910 - protein, 31 aa, Artificial Sequence
  Description of Artificial Sequence: Synthetic polypeptide
DDDEIRTTNPVATEQYGSVSTVLLEQGMQQR

SEQ ID NO: 65911 - protein, 30 aa, Artificial Sequence
  Description of Artificial Sequence: Synthetic polypeptide
DEEEIRTTNPCATEPYGSCSTNDAAGMNWD

SEQ ID NO: 65912 - protein, 30 aa, Artificial Sequence
  Description of Artificial Sequence: Synthetic polypeptide
DDEAIRTTNPVATEQYGCVCSTNHQQISNL

SEQ ID NO: 65913 - protein, 31 aa, Artificial Sequence
  Description of Artificial Sequence: Synthetic polypeptide
DDEAIRTTNPVATEQYGCVCSTNHQRSSNLS

SEQ ID NO: 65914 - protein, 31 aa, Artificial Sequence
  Description of Artificial Sequence: Synthetic polypeptide
DDEAIRTTNPVATEQYGTVCSTNHQRFVSNL

SEQ ID NO: 65915 - protein, 31 aa, Artificial Sequence
  Description of Artificial Sequence: Synthetic polypeptide
DEDEIATTNPVAYESYGSVSTNLSQSGGNQS

SEQ ID NO: 65916 - protein, 32 aa, Artificial Sequence
  Description of Artificial Sequence: Synthetic polypeptide
AEEEIRTTNPVATEQYGSVSNNNLGGNQGNNQ

SEQ ID NO: 65917 - protein, 34 aa, Artificial Sequence
  Description of Artificial Sequence: Synthetic polypeptide
AEEEIRTTNPVATEQYGSVSVTNNLQGNLGINGE

SEQ ID NO: 65918 - protein, 34 aa, Artificial Sequence
  Description of Artificial Sequence: Synthetic polypeptide
AEEEIRTTNPVATEQYGSVSVTNNLQGNLGINDT

SEQ ID NO: 65919 - protein, 30 aa, Artificial Sequence
  Description of Artificial Sequence: Synthetic polypeptide
DEDEIATTNPVCTEPYGSVSNPNLQDGNDL

SEQ ID NO: 65920 - protein, 34 aa, Artificial Sequence
  Description of Artificial Sequence: Synthetic polypeptide
AEEEIRTTNPVATEQYGSVSVTNNLQGANGNNII

SEQ ID NO: 65921 - protein, 33 aa, Artificial Sequence
  Description of Artificial Sequence: Synthetic polypeptide
AEEEIRTTNPVATEQYGSVVVSVTNNNQQGNGS

SEQ ID NO: 65922 - protein, 31 aa, Artificial Sequence
  Description of Artificial Sequence: Synthetic polypeptide
DECEIATTNPVAYEQYGSVSTDQNQDGGSNR

SEQ ID NO: 65923 - protein, 34 aa, Artificial Sequence
  Description of Artificial Sequence: Synthetic polypeptide
AEEEIRTTNPVATEQYGSVSVTNNLGQNQGNNNP

SEQ ID NO: 65924 - protein, 29 aa, Artificial Sequence
  Description of Artificial Sequence: Synthetic peptide
DEDEIATVNPVATEQYGCVATNLEEGGNH

SEQ ID NO: 65925 - protein, 30 aa, Artificial Sequence
  Description of Artificial Sequence: Synthetic polypeptide
DEEEIRTTNPCATEPYGSCATNDGRGDNAE

SEQ ID NO: 65926 - protein, 33 aa, Artificial Sequence
  Description of Artificial Sequence: Synthetic polypeptide
AEEEIRTTNPVATEQYGSVNTTSNLAQQGENLE

SEQ ID NO: 65927 - protein, 30 aa, Artificial Sequence
  Description of Artificial Sequence: Synthetic polypeptide
DEEEIRTTNPCATEPYGSCATNLANAGNEW

SEQ ID NO: 65928 - protein, 32 aa, Artificial Sequence
  Description of Artificial Sequence: Synthetic polypeptide
AEEEIRTTNPVATEQYGSVNTSNLVELGENYD

SEQ ID NO: 65929 - protein, 34 aa, Artificial Sequence
  Description of Artificial Sequence: Synthetic polypeptide
AEEEIRTTNPVATEQYGSVSVTNNLQGNQGINND

SEQ ID NO: 65930 - protein, 32 aa, Artificial Sequence
  Description of Artificial Sequence: Synthetic polypeptide
AEEEIRTTNPVATEQYGSVSTTNNNGTVGNVN

SEQ ID NO: 65931 - protein, 33 aa, Artificial Sequence
  Description of Artificial Sequence: Synthetic polypeptide
DEDEIATTNPVAYEQYGVSVSAGNDLDQRGNQR

SEQ ID NO: 65932 - protein, 31 aa, Artificial Sequence
  Description of Artificial Sequence: Synthetic polypeptide
DECEIATTNPVAYEQYGSVSTNLQHNGGGDV

SEQ ID NO: 65933 - protein, 32 aa, Artificial Sequence
  Description of Artificial Sequence: Synthetic polypeptide
DECEIATTNPVAYEQYGSVSTGNLQGDVGNEH

SEQ ID NO: 65934 - protein, 32 aa, Artificial Sequence
  Description of Artificial Sequence: Synthetic polypeptide
DECEIATTNPVAYEQYGSVSTGNLQDHEGNEH

SEQ ID NO: 65935 - protein, 32 aa, Artificial Sequence
  Description of Artificial Sequence: Synthetic polypeptide
DECEIATTNPVAYEQYGSVSTGNGQEDRGNAD

SEQ ID NO: 65936 - protein, 30 aa, Artificial Sequence
  Description of Artificial Sequence: Synthetic polypeptide
DECEIATTNPVAYEQYGSVSTGNGLEGNAD

SEQ ID NO: 65937 - protein, 34 aa, Artificial Sequence
  Description of Artificial Sequence: Synthetic polypeptide
AEEEIRTTNPVATEQYGSVSVTNNLQQGDEGNGE

SEQ ID NO: 65938 - protein, 33 aa, Artificial Sequence
  Description of Artificial Sequence: Synthetic polypeptide
AEEEIRTTNPVATEQYGSVSTTNNNDQGIGNQD

SEQ ID NO: 65939 - protein, 34 aa, Artificial Sequence
  Description of Artificial Sequence: Synthetic polypeptide
AEEEIRTTNPVATEQYGSVSVTNNLQQDEGNNEE

SEQ ID NO: 65940 - protein, 34 aa, Artificial Sequence
  Description of Artificial Sequence: Synthetic polypeptide
AEEEIRTTNPVATEQYGSVSVTNNLQGQQGNNQS

SEQ ID NO: 65941 - protein, 32 aa, Artificial Sequence
  Description of Artificial Sequence: Synthetic polypeptide
AEEEIRTTNPVATEQYGSVSNNNNLQNNDENQ

SEQ ID NO: 65942 - protein, 30 aa, Artificial Sequence
  Description of Artificial Sequence: Synthetic polypeptide
DEAEIATTNPVAYEQYGSVASNDQGGNDRG

SEQ ID NO: 65943 - protein, 30 aa, Artificial Sequence
  Description of Artificial Sequence: Synthetic polypeptide
DEEEIRTTNPCATEPYGSCSTNLAAPPNDH

SEQ ID NO: 65944 - protein, 31 aa, Artificial Sequence
  Description of Artificial Sequence: Synthetic polypeptide
DECEIATTNPVAYEQYGSVSTGLQGDVGNEA

SEQ ID NO: 65945 - protein, 32 aa, Artificial Sequence
  Description of Artificial Sequence: Synthetic polypeptide
DEEEIATTNPMATEQWGSVTPTNDQHRDGNGR

SEQ ID NO: 65946 - protein, 30 aa, Artificial Sequence
  Description of Artificial Sequence: Synthetic polypeptide
DEAEIATTNPVAYEQYGSVATADQRGNDQG

SEQ ID NO: 65947 - protein, 31 aa, Artificial Sequence
  Description of Artificial Sequence: Synthetic polypeptide
DEEEIATTNPLAYESYGKVSTNLSQRGGNQS

SEQ ID NO: 65948 - protein, 32 aa, Artificial Sequence
  Description of Artificial Sequence: Synthetic polypeptide
DECEIATTNPVAYEQYGSVSTGDQNQDRGGNR

SEQ ID NO: 65949 - protein, 32 aa, Artificial Sequence
  Description of Artificial Sequence: Synthetic polypeptide
AEEEIRTTNPVATEQYGSVSTTNNNGTVGNQV

SEQ ID NO: 65950 - protein, 32 aa, Artificial Sequence
  Description of Artificial Sequence: Synthetic polypeptide
AEEEIRTTNPVATEQYGSVSTTNNNGTVGNVD

SEQ ID NO: 65951 - protein, 33 aa, Artificial Sequence
  Description of Artificial Sequence: Synthetic polypeptide
DEEEIATTNPMATEQYGCVCPTNLQERFGSNTR

SEQ ID NO: 65952 - protein, 33 aa, Artificial Sequence
  Description of Artificial Sequence: Synthetic polypeptide
DEEEIATTNPVATEQYGSVCAATNPLQDQGPNE

SEQ ID NO: 65953 - protein, 29 aa, Artificial Sequence
  Description of Artificial Sequence: Synthetic peptide
DEDEIATVNPVATEQYGCVATNLTMGGNH

SEQ ID NO: 65954 - protein, 34 aa, Artificial Sequence
  Description of Artificial Sequence: Synthetic polypeptide
AEEEIRTTNPVATEQYGSVSVTNNLGQANGTNNT

SEQ ID NO: 65955 - protein, 32 aa, Artificial Sequence
  Description of Artificial Sequence: Synthetic polypeptide
DEDEIGTTNPVAYEQYGVSVSTTLAQRNGGRN

SEQ ID NO: 65956 - protein, 33 aa, Artificial Sequence
  Description of Artificial Sequence: Synthetic polypeptide
AEEEIRTTNPVATEQYGSVSVTNNDQGNGTNQQ

SEQ ID NO: 65957 - protein, 31 aa, Artificial Sequence
  Description of Artificial Sequence: Synthetic polypeptide
DEEEIATTNPCATEQYGSVPTNEIDHEGNGR

SEQ ID NO: 65958 - protein, 32 aa, Artificial Sequence
  Description of Artificial Sequence: Synthetic polypeptide
DEDEIKTTNPVATEAYGSVSTMDLQREGVNVV

SEQ ID NO: 65959 - protein, 30 aa, Artificial Sequence
  Description of Artificial Sequence: Synthetic polypeptide
DEEEIRTTNPCATEPYGSCAATNLAAGNHH

SEQ ID NO: 65960 - protein, 31 aa, Artificial Sequence
  Description of Artificial Sequence: Synthetic polypeptide
DEEEIRTTNPVATEAYGNVPSTNNVDLDGNW

SEQ ID NO: 65961 - protein, 33 aa, Artificial Sequence
  Description of Artificial Sequence: Synthetic polypeptide
AEEEIRTTNPVATEQYGSVSVTNNDQAGNGNSN

SEQ ID NO: 65962 - protein, 28 aa, Artificial Sequence
  Description of Artificial Sequence: Synthetic peptide
ASNEIACTNPVATEQYGEASENLQRGGR

SEQ ID NO: 65963 - protein, 32 aa, Artificial Sequence
  Description of Artificial Sequence: Synthetic polypeptide
DEEEIATTNPCATEEYGSVSTNLNGNGNDNDR

SEQ ID NO: 65964 - protein, 29 aa, Artificial Sequence
  Description of Artificial Sequence: Synthetic peptide
DEAEIATTNPVAYEQYGSVATNDTQGNVD

SEQ ID NO: 65965 - protein, 33 aa, Artificial Sequence
  Description of Artificial Sequence: Synthetic polypeptide
AEEEIRTTNPVATEQYGSVSVTNNDEQGNGNQE

SEQ ID NO: 65966 - protein, 28 aa, Artificial Sequence
  Description of Artificial Sequence: Synthetic peptide
AQNEIACTNPVATEQYGEASENLQRGGR

SEQ ID NO: 65967 - protein, 33 aa, Artificial Sequence
  Description of Artificial Sequence: Synthetic polypeptide
AEEEIRTTNPVATEQYGSVCSTGNLARNSNFQP

SEQ ID NO: 65968 - protein, 33 aa, Artificial Sequence
  Description of Artificial Sequence: Synthetic polypeptide
AEEEIRTTNPVATEQYGSVSVTNLTQGNLNINT

SEQ ID NO: 65969 - protein, 34 aa, Artificial Sequence
  Description of Artificial Sequence: Synthetic polypeptide
AEEEIRTTNPVATEQYGSVSVTNLQQNDEGTNVE

SEQ ID NO: 65970 - protein, 31 aa, Artificial Sequence
  Description of Artificial Sequence: Synthetic polypeptide
DEEEIATTNPCASEQYGSVSSTTALNRGMNV

SEQ ID NO: 65971 - protein, 32 aa, Artificial Sequence
  Description of Artificial Sequence: Synthetic polypeptide
DEEEIATTNPVATEQYGSVCAATNLEIDLENR

SEQ ID NO: 65972 - protein, 29 aa, Artificial Sequence
  Description of Artificial Sequence: Synthetic peptide
AQAEIRTTNPVATEGYGCCSTVLQHGNDR

SEQ ID NO: 65973 - protein, 28 aa, Artificial Sequence
  Description of Artificial Sequence: Synthetic peptide
APNEIACTNPVATEQYGEASENLQRGGR

SEQ ID NO: 65974 - protein, 34 aa, Artificial Sequence
  Description of Artificial Sequence: Synthetic polypeptide
AEEEIRTTNPVATEQYGSVSVTNLQQGNLGINTT

SEQ ID NO: 65975 - protein, 33 aa, Artificial Sequence
  Description of Artificial Sequence: Synthetic polypeptide
AEEEIRTTNPVATEQYGSVSVTNNANQTGTNSA

SEQ ID NO: 65976 - protein, 33 aa, Artificial Sequence
  Description of Artificial Sequence: Synthetic polypeptide
AEEEIRTTNPVATEQYGSVNTSNLAQQGENQTT

SEQ ID NO: 65977 - protein, 28 aa, Artificial Sequence
  Description of Artificial Sequence: Synthetic peptide
ATNEIACTNPVATEQYGEASENLQRGGR

SEQ ID NO: 65978 - protein, 31 aa, Artificial Sequence
  Description of Artificial Sequence: Synthetic polypeptide
DEDEICTTNPVAYEQWGSVSTNLQSGGENDN

SEQ ID NO: 65979 - protein, 34 aa, Artificial Sequence
  Description of Artificial Sequence: Synthetic polypeptide
AEEEIRTTNPVATEQYGSVSVTNNLEQQNGNGII

SEQ ID NO: 65980 - protein, 34 aa, Artificial Sequence
  Description of Artificial Sequence: Synthetic polypeptide
AEEEIRTTNPVATEQYGSVSVTNNLEQGVEGNNI

SEQ ID NO: 65981 - protein, 31 aa, Artificial Sequence
  Description of Artificial Sequence: Synthetic polypeptide
DEDEICTTNPVATEQYGSVATNLQADGMTPM

SEQ ID NO: 65982 - protein, 31 aa, Artificial Sequence
  Description of Artificial Sequence: Synthetic polypeptide
DEDEICTTNPVATEQYGSVATNLQGNGEGAE

SEQ ID NO: 65983 - protein, 32 aa, Artificial Sequence
  Description of Artificial Sequence: Synthetic polypeptide
DEDEICTTNPVATEQYGSVSWTEQLQEDMGNL

SEQ ID NO: 65984 - protein, 31 aa, Artificial Sequence
  Description of Artificial Sequence: Synthetic polypeptide
DEEEIATTNPFATEQYGSVCSGNIDHRGNDS

SEQ ID NO: 65985 - protein, 29 aa, Artificial Sequence
  Description of Artificial Sequence: Synthetic peptide
DEDEICTTNPVATEQYGTVTTERNQNGND

SEQ ID NO: 65986 - protein, 34 aa, Artificial Sequence
  Description of Artificial Sequence: Synthetic polypeptide
AEEEIRTTNPVATEQYGSVSTTNNNLQEGTNFTG

SEQ ID NO: 65987 - protein, 33 aa, Artificial Sequence
  Description of Artificial Sequence: Synthetic polypeptide
AEEEIRTTNPVATEQYGSVSVTNNDQQGNGNSE

SEQ ID NO: 65988 - protein, 30 aa, Artificial Sequence
  Description of Artificial Sequence: Synthetic polypeptide
DEAEIATTNPVAYEQYGSVATNDQRHNDVG

SEQ ID NO: 65989 - protein, 32 aa, Artificial Sequence
  Description of Artificial Sequence: Synthetic polypeptide
DEAEIATTNPVAYEQYGSVATGLQNRDGNTRM

SEQ ID NO: 65990 - protein, 30 aa, Artificial Sequence
  Description of Artificial Sequence: Synthetic polypeptide
DDECIRTTNPVATEQYGCVSTNHQRSSDLS

SEQ ID NO: 65991 - protein, 31 aa, Artificial Sequence
  Description of Artificial Sequence: Synthetic polypeptide
DECEIATTNPVAYEQWGSVSTNLQGDHGNTE

SEQ ID NO: 65992 - protein, 31 aa, Artificial Sequence
  Description of Artificial Sequence: Synthetic polypeptide
DEEEIATTNPVATEQYGSVCAATNDQDPGQN

SEQ ID NO: 65993 - protein, 32 aa, Artificial Sequence
  Description of Artificial Sequence: Synthetic polypeptide
DDECIRTTNPVATEQYGKVPSTNEHSQRVGNL

SEQ ID NO: 65994 - protein, 30 aa, Artificial Sequence
  Description of Artificial Sequence: Synthetic polypeptide
DEAEIATTNPVAYEQYGSVATNDQDGNDVH

SEQ ID NO: 65995 - protein, 31 aa, Artificial Sequence
  Description of Artificial Sequence: Synthetic polypeptide
DEAEIATTNPVAYEQYGSVATNDQRGDNDDG

SEQ ID NO: 65996 - protein, 32 aa, Artificial Sequence
  Description of Artificial Sequence: Synthetic polypeptide
DDECIRTTNPVATEQYGKVSTGNHSQRVGNNP

SEQ ID NO: 65997 - protein, 28 aa, Artificial Sequence
  Description of Artificial Sequence: Synthetic peptide
AVNEIACTNPVATEQYGEASENLQRGGR

SEQ ID NO: 65998 - protein, 28 aa, Artificial Sequence
  Description of Artificial Sequence: Synthetic peptide
ATNEIACTNPVATEQYGEASENLQRGQR

SEQ ID NO: 65999 - protein, 33 aa, Artificial Sequence
  Description of Artificial Sequence: Synthetic polypeptide
AEEEIRTTNPVATEQYGSVSVTNNDQQGNGGNQ

SEQ ID NO: 66000 - protein, 32 aa, Artificial Sequence
  Description of Artificial Sequence: Synthetic polypeptide
DEAEIRTTNGVAYCQYGSVTSTNPLQRGIDRQ

SEQ ID NO: 66001 - protein, 34 aa, Artificial Sequence
  Description of Artificial Sequence: Synthetic polypeptide
AEEEIRTTNPVATEQYGSVSTTNNLQGQQGNNVA

SEQ ID NO: 66002 - protein, 32 aa, Artificial Sequence
  Description of Artificial Sequence: Synthetic polypeptide
DEDEIATTNPVAYEQYGSVATNLQRGGDNQDA

SEQ ID NO: 66003 - protein, 29 aa, Artificial Sequence
  Description of Artificial Sequence: Synthetic peptide
DEDEIATTNPVAYEQYGSVAATNDQSGSD

SEQ ID NO: 66004 - protein, 32 aa, Artificial Sequence
  Description of Artificial Sequence: Synthetic polypeptide
DEEEIRTTNPCATEQYGCVCGTNLQGGSNTAS

SEQ ID NO: 66005 - protein, 34 aa, Artificial Sequence
  Description of Artificial Sequence: Synthetic polypeptide
AEEEIRTTNPVATEQYGSVSTGNNNLQQGEQGNN

SEQ ID NO: 66006 - protein, 33 aa, Artificial Sequence
  Description of Artificial Sequence: Synthetic polypeptide
AEEEIRTTNPVATEQYGSVSVTTNGGNQVGNDQ

SEQ ID NO: 66007 - protein, 34 aa, Artificial Sequence
  Description of Artificial Sequence: Synthetic polypeptide
AEEEIRTTNPVATEQYGSVSTGNLNQTNGEQGNN

SEQ ID NO: 66008 - protein, 32 aa, Artificial Sequence
  Description of Artificial Sequence: Synthetic polypeptide
AEEEIRTTNPVATEQYGSVSTTNMNQEEENDG

SEQ ID NO: 66009 - protein, 33 aa, Artificial Sequence
  Description of Artificial Sequence: Synthetic polypeptide
AEEEIRTTNPVATEQYGSVSVTTNGEQLGGNDE

SEQ ID NO: 66010 - protein, 32 aa, Artificial Sequence
  Description of Artificial Sequence: Synthetic polypeptide
DEEEIATTNPVATEPYGSVCFTNEDHRGGNGR

SEQ ID NO: 66011 - protein, 33 aa, Artificial Sequence
  Description of Artificial Sequence: Synthetic polypeptide
AEEEIRTTNPVATEQYGSVSTENQLQNDEINNQ

SEQ ID NO: 66012 - protein, 32 aa, Artificial Sequence
  Description of Artificial Sequence: Synthetic polypeptide
AEEEIRTTNPVATEQYGSVSTTNMNQEENTEG

SEQ ID NO: 66013 - protein, 31 aa, Artificial Sequence
  Description of Artificial Sequence: Synthetic polypeptide
CEYEIRATNPVATEQYGSVETNLQHGGNGQN

SEQ ID NO: 66014 - protein, 33 aa, Artificial Sequence
  Description of Artificial Sequence: Synthetic polypeptide
AEEEIRTTNPVATEQYGSVSVTTNEQQGNNQET

SEQ ID NO: 66015 - protein, 31 aa, Artificial Sequence
  Description of Artificial Sequence: Synthetic polypeptide
DAEEIATTNPVAYMQYGSVSTNGVQGSGNMR

SEQ ID NO: 66016 - protein, 31 aa, Artificial Sequence
  Description of Artificial Sequence: Synthetic polypeptide
CEYEIRATNPVATEQYGSVDTVNLQHGGNGQ

SEQ ID NO: 66017 - protein, 33 aa, Artificial Sequence
  Description of Artificial Sequence: Synthetic polypeptide
AEEEIRTTNPVATEQYGSVSVTTNDQQQGTNNG

SEQ ID NO: 66018 - protein, 33 aa, Artificial Sequence
  Description of Artificial Sequence: Synthetic polypeptide
AEEEIRTTNPVATEQYGSVSTENNQQQDEGNNT

SEQ ID NO: 66019 - protein, 31 aa, Artificial Sequence
  Description of Artificial Sequence: Synthetic polypeptide
DAEEIATTNPVAYMQYGSVSTNGVQNPGNMR

SEQ ID NO: 66020 - protein, 32 aa, Artificial Sequence
  Description of Artificial Sequence: Synthetic polypeptide
DEEEIRTTNPMATEQYGCVCETNLQRFGSDTA

SEQ ID NO: 66021 - protein, 30 aa, Artificial Sequence
  Description of Artificial Sequence: Synthetic polypeptide
DEDEIATTNPVAYEQYGSVAATNDTRGNDI

SEQ ID NO: 66022 - protein, 32 aa, Artificial Sequence
  Description of Artificial Sequence: Synthetic polypeptide
DEEEIRTTNPCATEQYGCVCGTNLQNFGNTAG

SEQ ID NO: 66023 - protein, 33 aa, Artificial Sequence
  Description of Artificial Sequence: Synthetic polypeptide
AEEEIRTTNPVATEQYGSVSVTTNGNQLGGNVD

SEQ ID NO: 66024 - protein, 32 aa, Artificial Sequence
  Description of Artificial Sequence: Synthetic polypeptide
CQEEIATTNPVATEQYGVVSCTNQSQRPGGNR

SEQ ID NO: 66025 - protein, 34 aa, Artificial Sequence
  Description of Artificial Sequence: Synthetic polypeptide
AEEEIRTTNPVATEQYGSVSTTNLVQTGTTNNND

SEQ ID NO: 66026 - protein, 34 aa, Artificial Sequence
  Description of Artificial Sequence: Synthetic polypeptide
AEEEIRTTNPVATEQYGSVSTTNLQQQQGTNQTQ

SEQ ID NO: 66027 - protein, 34 aa, Artificial Sequence
  Description of Artificial Sequence: Synthetic polypeptide
AEEEIRTTNPVATEQYGSVSTTNLQQQQIGENNE

SEQ ID NO: 66028 - protein, 33 aa, Artificial Sequence
  Description of Artificial Sequence: Synthetic polypeptide
DEEEIATTNPVATEPYGSVSTNLQGNDMGNNSS

SEQ ID NO: 66029 - protein, 33 aa, Artificial Sequence
  Description of Artificial Sequence: Synthetic polypeptide
DECEICTTNPVATEQYGSVSTTTNQLQEQQGNL

SEQ ID NO: 66030 - protein, 33 aa, Artificial Sequence
  Description of Artificial Sequence: Synthetic polypeptide
AEEEIRTTNPVATEQYGSVSTGNQQQNDEGNTN

SEQ ID NO: 66031 - protein, 33 aa, Artificial Sequence
  Description of Artificial Sequence: Synthetic polypeptide
DECEICTTNPVATEQYGSVSTTTNLQMNQQGNT

SEQ ID NO: 66032 - protein, 33 aa, Artificial Sequence
  Description of Artificial Sequence: Synthetic polypeptide
DEEEIATTNPVATEPYGSVSTNLQGDLGNNGGS

SEQ ID NO: 66033 - protein, 33 aa, Artificial Sequence
  Description of Artificial Sequence: Synthetic polypeptide
AEEEIRTTNPVATEQYGSVSTGNQQQNDEGNNE

SEQ ID NO: 66034 - protein, 34 aa, Artificial Sequence
  Description of Artificial Sequence: Synthetic polypeptide
AEEEIRTTNPVATEQYGSVSTTNLQQQQIGNNQN

SEQ ID NO: 66035 - protein, 29 aa, Artificial Sequence
  Description of Artificial Sequence: Synthetic peptide
DEDEIATTNPVAYEQYGSVAATNDTSGNH

SEQ ID NO: 66036 - protein, 33 aa, Artificial Sequence
  Description of Artificial Sequence: Synthetic polypeptide
AEEEIRTTNPVATEQYGSVSTTNLQQQQNNTNA

SEQ ID NO: 66037 - protein, 33 aa, Artificial Sequence
  Description of Artificial Sequence: Synthetic polypeptide
AEEEIRTTNPVATEQYGSVSTTNLQQQQQGEDE

SEQ ID NO: 66038 - protein, 33 aa, Artificial Sequence
  Description of Artificial Sequence: Synthetic polypeptide
AEEEIRTTNPVATEQYGSVSTGNNQQNDEGNNN

SEQ ID NO: 66039 - protein, 33 aa, Artificial Sequence
  Description of Artificial Sequence: Synthetic polypeptide
AEEEIRTTNPVATEQYGSVSTGNNQQGEGTNND

SEQ ID NO: 66040 - protein, 30 aa, Artificial Sequence
  Description of Artificial Sequence: Synthetic polypeptide
DEDEIATTNPVAYEQYGSVAATNDDTRGND

SEQ ID NO: 66041 - protein, 34 aa, Artificial Sequence
  Description of Artificial Sequence: Synthetic polypeptide
AEEEIRTTNPVATEQYGSVSTTNLQQQTGGTTND

SEQ ID NO: 66042 - protein, 33 aa, Artificial Sequence
  Description of Artificial Sequence: Synthetic polypeptide
AEEEIRTTNPVATEQYGSVSTTNLQQSGESTTT

SEQ ID NO: 66043 - protein, 33 aa, Artificial Sequence
  Description of Artificial Sequence: Synthetic polypeptide
AEEEIRTTNPVATEQYGSVSTTNLQTGIGTTTD

SEQ ID NO: 66044 - protein, 34 aa, Artificial Sequence
  Description of Artificial Sequence: Synthetic polypeptide
AEEEIRTTNPVATEQYGSVSTTNLQVNTEGTNVD

SEQ ID NO: 66045 - protein, 30 aa, Artificial Sequence
  Description of Artificial Sequence: Synthetic polypeptide
DEDEIATTNPVAYEQYGSVAATNDQRTNQD

SEQ ID NO: 66046 - protein, 32 aa, Artificial Sequence
  Description of Artificial Sequence: Synthetic polypeptide
AEEEIRTTNPVATEQYGSVSTGNNQQNGIEAT

SEQ ID NO: 66047 - protein, 35 aa, Artificial Sequence
  Description of Artificial Sequence: Synthetic polypeptide
DEEEIATTNPVATEPYGISVVSTVNLPQDRIGNRA

SEQ ID NO: 66048 - protein, 33 aa, Artificial Sequence
  Description of Artificial Sequence: Synthetic polypeptide
DEEEIATTNPVATEPYGISPSTVNDLQDRIGNT

SEQ ID NO: 66049 - protein, 30 aa, Artificial Sequence
  Description of Artificial Sequence: Synthetic polypeptide
CEYEIRATNPVATEQYGSVDTNLQHEGGGQ

SEQ ID NO: 66050 - protein, 31 aa, Artificial Sequence
  Description of Artificial Sequence: Synthetic polypeptide
DAEEIRATNPVATEQYGSCSTNHQADGGNNN

SEQ ID NO: 66051 - protein, 32 aa, Artificial Sequence
  Description of Artificial Sequence: Synthetic polypeptide
DEEEIRTTNPCATEQYGCVCATELQRGSNTAA

SEQ ID NO: 66052 - protein, 30 aa, Artificial Sequence
  Description of Artificial Sequence: Synthetic polypeptide
DAEEIRATNPVATEQYGSCSTNQQEMDNNN

SEQ ID NO: 66053 - protein, 32 aa, Artificial Sequence
  Description of Artificial Sequence: Synthetic polypeptide
DEDEIATTNPVAYEQYGSVAITPLQNRDGNRM

SEQ ID NO: 66054 - protein, 32 aa, Artificial Sequence
  Description of Artificial Sequence: Synthetic polypeptide
DAEEIRSTNPVATEQYGSVSPTNDLETGNEQE

SEQ ID NO: 66055 - protein, 34 aa, Artificial Sequence
  Description of Artificial Sequence: Synthetic polypeptide
DEEEIRTTNPMATEQYGSVPACTNALQRTGGNNA

SEQ ID NO: 66056 - protein, 32 aa, Artificial Sequence
  Description of Artificial Sequence: Synthetic polypeptide
DEEEIATTNPVATEIYGSVSTNLNGDAGNNEQ

SEQ ID NO: 66057 - protein, 31 aa, Artificial Sequence
  Description of Artificial Sequence: Synthetic polypeptide
DAEEIRSTNPVATEQYGSVSPTNLETGFEQP

SEQ ID NO: 66058 - protein, 33 aa, Artificial Sequence
  Description of Artificial Sequence: Synthetic polypeptide
DECEICTTNPVATEQYGSVSTTNQLQQEEMGNL

SEQ ID NO: 66059 - protein, 34 aa, Artificial Sequence
  Description of Artificial Sequence: Synthetic polypeptide
AEEEIRTTNPVATEQYGSVSVTSNLQGEQGTNAN

SEQ ID NO: 66060 - protein, 31 aa, Artificial Sequence
  Description of Artificial Sequence: Synthetic polypeptide
DEEEIATTNPVATEQYGSVCAANDQSDGMER

SEQ ID NO: 66061 - protein, 30 aa, Artificial Sequence
  Description of Artificial Sequence: Synthetic polypeptide
DEDEIATTNPVAYEQYGSVAPTNLDRTDRE

SEQ ID NO: 66062 - protein, 30 aa, Artificial Sequence
  Description of Artificial Sequence: Synthetic polypeptide
DEDEIATTNPVAYEQYGSVASNDQRDNNRM

SEQ ID NO: 66063 - protein, 31 aa, Artificial Sequence
  Description of Artificial Sequence: Synthetic polypeptide
DEDEIATTNPVAYEQYGSVASNDTQRGENDR

SEQ ID NO: 66064 - protein, 33 aa, Artificial Sequence
  Description of Artificial Sequence: Synthetic polypeptide
DECEICTTNPVATEQYGSVSTTNQLQEQQGNNM

SEQ ID NO: 66065 - protein, 34 aa, Artificial Sequence
  Description of Artificial Sequence: Synthetic polypeptide
AEEEIRTTNPVATEQYGSVSVTNVNQLQQGTNND

SEQ ID NO: 66066 - protein, 33 aa, Artificial Sequence
  Description of Artificial Sequence: Synthetic polypeptide
AEEEIRTTNPVATEQYGSVSTDNQQEENGNNQI

SEQ ID NO: 66067 - protein, 32 aa, Artificial Sequence
  Description of Artificial Sequence: Synthetic polypeptide
AEEEIRTTNPVATEQYGSVSTDNQNQANINTE

SEQ ID NO: 66068 - protein, 30 aa, Artificial Sequence
  Description of Artificial Sequence: Synthetic polypeptide
DAEEIRTTNPCAYEPYGSVSANLQATEGNM

SEQ ID NO: 66069 - protein, 33 aa, Artificial Sequence
  Description of Artificial Sequence: Synthetic polypeptide
AEEEIRTTNPVATEQYGSVSVTNTNQAIGNGNI

SEQ ID NO: 66070 - protein, 28 aa, Artificial Sequence
  Description of Artificial Sequence: Synthetic peptide
CETEIACTNPVATEQYGEASENLQRGGE

SEQ ID NO: 66071 - protein, 34 aa, Artificial Sequence
  Description of Artificial Sequence: Synthetic polypeptide
AEEEIRTTNPVATEQYGSVSTTNLQQQQGIGNQD

SEQ ID NO: 66072 - protein, 30 aa, Artificial Sequence
  Description of Artificial Sequence: Synthetic polypeptide
DAEEIRATNPVATEQYGSCATNHQADPGNN

SEQ ID NO: 66073 - protein, 30 aa, Artificial Sequence
  Description of Artificial Sequence: Synthetic polypeptide
DAEEIRATNPVATEQYGSASANHQERDGGN

SEQ ID NO: 66074 - protein, 32 aa, Artificial Sequence
  Description of Artificial Sequence: Synthetic polypeptide
DEEEIATTNPVATEPWGSVSTNLQGNDMGNNG

SEQ ID NO: 66075 - protein, 33 aa, Artificial Sequence
  Description of Artificial Sequence: Synthetic polypeptide
AEEEIRTTNPVATEQYGSVSTENNQQQDEGNNQ

SEQ ID NO: 66076 - protein, 33 aa, Artificial Sequence
  Description of Artificial Sequence: Synthetic polypeptide
AEEEIRTTNPVATEQYGSVSVTTNDNQQGNINE

SEQ ID NO: 66077 - protein, 33 aa, Artificial Sequence
  Description of Artificial Sequence: Synthetic polypeptide
AEEEIRTTNPVATEQYGSVSTENNLQQNDEINA

SEQ ID NO: 66078 - protein, 33 aa, Artificial Sequence
  Description of Artificial Sequence: Synthetic polypeptide
AEEEIRTTNPVATEQYGSVSVTTNDEQGNGNTQ

SEQ ID NO: 66079 - protein, 33 aa, Artificial Sequence
  Description of Artificial Sequence: Synthetic polypeptide
AEEEIRTTNPVATEQYGSVSTENNLQNDENNEN

SEQ ID NO: 66080 - protein, 30 aa, Artificial Sequence
  Description of Artificial Sequence: Synthetic polypeptide
DEDEIATTNPVAYEQYGSVAGTNDQRNDRM

SEQ ID NO: 66081 - protein, 32 aa, Artificial Sequence
  Description of Artificial Sequence: Synthetic polypeptide
DEEEIRTTNPMATEQYGKVPACTNHQRGGNNA

SEQ ID NO: 66082 - protein, 32 aa, Artificial Sequence
  Description of Artificial Sequence: Synthetic polypeptide
AEEEIRTTNPVATEQYGSVSTTNNDELGNNLI

SEQ ID NO: 66083 - protein, 29 aa, Artificial Sequence
  Description of Artificial Sequence: Synthetic peptide
DAEEIRATNPVATEQYGSASTNHQADPPN

SEQ ID NO: 66084 - protein, 34 aa, Artificial Sequence
  Description of Artificial Sequence: Synthetic polypeptide
AEEEIRTTNPVATEQYGSVSTENNLQGNDEGNNE

SEQ ID NO: 66085 - protein, 33 aa, Artificial Sequence
  Description of Artificial Sequence: Synthetic polypeptide
AEEEIRTTNPVATEQYGSVSVTTNAGNQQGNQQ

SEQ ID NO: 66086 - protein, 33 aa, Artificial Sequence
  Description of Artificial Sequence: Synthetic polypeptide
AEEEIRTTNPVATEQYGSVSTENLQQQNDEIGS

SEQ ID NO: 66087 - protein, 33 aa, Artificial Sequence
  Description of Artificial Sequence: Synthetic polypeptide
AEEEIRTTNPVATEQYGSVSTENLQQQNDEENA

SEQ ID NO: 66088 - protein, 33 aa, Artificial Sequence
  Description of Artificial Sequence: Synthetic polypeptide
AEEEIRTTNPVATEQYGSVSTENLQNDEINTNT

SEQ ID NO: 66089 - protein, 32 aa, Artificial Sequence
  Description of Artificial Sequence: Synthetic polypeptide
AEEEIRTTNPVATEQYGSVSTENLLGEGGGGG

SEQ ID NO: 66090 - protein, 31 aa, Artificial Sequence
  Description of Artificial Sequence: Synthetic polypeptide
DAEEICSTNPVATEQYGSVATNLQARPGDQS

SEQ ID NO: 66091 - protein, 33 aa, Artificial Sequence
  Description of Artificial Sequence: Synthetic polypeptide
AEEEIRTTNPVATEQYGSVSVTSNQQQQGNNEE

SEQ ID NO: 66092 - protein, 33 aa, Artificial Sequence
  Description of Artificial Sequence: Synthetic polypeptide
AEEEIRTTNPVATEQYGSVSVTSNNNQQGNNSQ

SEQ ID NO: 66093 - protein, 30 aa, Artificial Sequence
  Description of Artificial Sequence: Synthetic polypeptide
DAEEIRATNPVATEQYGCASTNHQEADGNN

SEQ ID NO: 66094 - protein, 33 aa, Artificial Sequence
  Description of Artificial Sequence: Synthetic polypeptide
AEEEIRTTNPVATEQYGSVSVTTNAGNQVGNND

SEQ ID NO: 66095 - protein, 32 aa, Artificial Sequence
  Description of Artificial Sequence: Synthetic polypeptide
AEEEIRTTNPVATEQYGSVSTGQQNQEVGNND

SEQ ID NO: 66096 - protein, 33 aa, Artificial Sequence
  Description of Artificial Sequence: Synthetic polypeptide
AEEEIRTTNPVATEQYGSVSTGVNQQNDEGGNN

SEQ ID NO: 66097 - protein, 34 aa, Artificial Sequence
  Description of Artificial Sequence: Synthetic polypeptide
AEEEIRTTNPVATEQYGSVSTTNLQQQQELNGND

SEQ ID NO: 66098 - protein, 28 aa, Artificial Sequence
  Description of Artificial Sequence: Synthetic peptide
DEDEIATTNPVAYEQYGCTATNLQGGDL

SEQ ID NO: 66099 - protein, 32 aa, Artificial Sequence
  Description of Artificial Sequence: Synthetic polypeptide
CSEEIRTTNPVATEQWGVVSTNEHSQRPGGNR

SEQ ID NO: 66100 - protein, 30 aa, Artificial Sequence
  Description of Artificial Sequence: Synthetic polypeptide
CEEEIACTNPVATEPYGSVATNDQRGNEAL

SEQ ID NO: 66101 - protein, 34 aa, Artificial Sequence
  Description of Artificial Sequence: Synthetic polypeptide
AEEEIRTTNPVATEQYGSVSTTNLQQLQQGNNTG

SEQ ID NO: 66102 - protein, 33 aa, Artificial Sequence
  Description of Artificial Sequence: Synthetic polypeptide
AEEEIRTTNPVATEQYGSVSTTNLQQNEDEDNG

SEQ ID NO: 66103 - protein, 34 aa, Artificial Sequence
  Description of Artificial Sequence: Synthetic polypeptide
AEEEIRTTNPVATEQYGSVSVTTNNLGQNNQGNP

SEQ ID NO: 66104 - protein, 29 aa, Artificial Sequence
  Description of Artificial Sequence: Synthetic peptide
DAEEIATTNPVAYEPYGNVATNLQDGNDD

SEQ ID NO: 66105 - protein, 31 aa, Artificial Sequence
  Description of Artificial Sequence: Synthetic polypeptide
AEEEIRTTNPVATEQYGSVSTNFEGNEGGGG

SEQ ID NO: 66106 - protein, 30 aa, Artificial Sequence
  Description of Artificial Sequence: Synthetic polypeptide
DEEEIRTTNPLAYEQWGSVSCNISGRGGND

SEQ ID NO: 66107 - protein, 33 aa, Artificial Sequence
  Description of Artificial Sequence: Synthetic polypeptide
AEEEIRTTNPVATEQYGSVSTTNLQQLEGETET

SEQ ID NO: 66108 - protein, 33 aa, Artificial Sequence
  Description of Artificial Sequence: Synthetic polypeptide
DECEICTTNPVATEQYGSVSTVNQLLQEQEGNL

SEQ ID NO: 66109 - protein, 33 aa, Artificial Sequence
  Description of Artificial Sequence: Synthetic polypeptide
DECEICTTNPVATEQYGSVSTVNLNMNQQGNTE

SEQ ID NO: 66110 - protein, 32 aa, Artificial Sequence
  Description of Artificial Sequence: Synthetic polypeptide
DEEEIRTTNPLAYEQYGQSVATNSLSTRVGDR

SEQ ID NO: 66111 - protein, 30 aa, Artificial Sequence
  Description of Artificial Sequence: Synthetic polypeptide
DEDEIATTNPVAYEQYGCVATNLQRDDNAQ

SEQ ID NO: 66112 - protein, 34 aa, Artificial Sequence
  Description of Artificial Sequence: Synthetic polypeptide
AEEEIRTTNPVATEQYGSVSVTTNLQSGVNNNIL

SEQ ID NO: 66113 - protein, 33 aa, Artificial Sequence
  Description of Artificial Sequence: Synthetic polypeptide
AEEEIRTTNPVATEQYGSVVTVTNNLQVGGNDG

SEQ ID NO: 66114 - protein, 34 aa, Artificial Sequence
  Description of Artificial Sequence: Synthetic polypeptide
AEEEIRTTNPVATEQYGSVSVTTNLQSGGNQDET

SEQ ID NO: 66115 - protein, 33 aa, Artificial Sequence
  Description of Artificial Sequence: Synthetic polypeptide
DEDEIATTNPVAYEQYGQSVSATNDLDQRGNQT

SEQ ID NO: 66116 - protein, 32 aa, Artificial Sequence
  Description of Artificial Sequence: Synthetic polypeptide
AEEEIRTTNPVATEQYGSVVTVTNNNQEGENE

SEQ ID NO: 66117 - protein, 34 aa, Artificial Sequence
  Description of Artificial Sequence: Synthetic polypeptide
AEEEIRTTNPVATEQYGSVSVTTNLQQQIGTNNT

SEQ ID NO: 66118 - protein, 33 aa, Artificial Sequence
  Description of Artificial Sequence: Synthetic polypeptide
DECEICTTNPVATEQYGSVSTVNLQNQQGNQTD

SEQ ID NO: 66119 - protein, 34 aa, Artificial Sequence
  Description of Artificial Sequence: Synthetic polypeptide
AEEEIRTTNPVATEQYGSVSVTTNLQQQGTNNNT

SEQ ID NO: 66120 - protein, 30 aa, Artificial Sequence
  Description of Artificial Sequence: Synthetic polypeptide
CEEEIACTNPVATEMYGVVSTNLQQGNEAP

SEQ ID NO: 66121 - protein, 34 aa, Artificial Sequence
  Description of Artificial Sequence: Synthetic polypeptide
AEEEIRTTNPVATEQYGSVSTTNLQQGTNDTEDD

SEQ ID NO: 66122 - protein, 31 aa, Artificial Sequence
  Description of Artificial Sequence: Synthetic polypeptide
DEAEIATTNPVATEQYGSVATNLERDENDNW

SEQ ID NO: 66123 - protein, 32 aa, Artificial Sequence
  Description of Artificial Sequence: Synthetic polypeptide
DEAEIATTNPVATEQYGSVATNLENRGDNQDT

SEQ ID NO: 66124 - protein, 31 aa, Artificial Sequence
  Description of Artificial Sequence: Synthetic polypeptide
CEECICTTNPVATEQYGSVSWNEGQRDGNSS

SEQ ID NO: 66125 - protein, 32 aa, Artificial Sequence
  Description of Artificial Sequence: Synthetic polypeptide
CEECIRTTNPVATEQYGSVETCNLVAGGNERN

SEQ ID NO: 66126 - protein, 30 aa, Artificial Sequence
  Description of Artificial Sequence: Synthetic polypeptide
DEAEIATTNPVAYEQWGEVSTNLGQGNGPR

SEQ ID NO: 66127 - protein, 34 aa, Artificial Sequence
  Description of Artificial Sequence: Synthetic polypeptide
AEEEIRTTNPVATEQYGSVSVTTNNLQSGSNNQQ

SEQ ID NO: 66128 - protein, 32 aa, Artificial Sequence
  Description of Artificial Sequence: Synthetic polypeptide
AEEEIRTTNPVATEQYGSVVTVSNNQQTGNQE

SEQ ID NO: 66129 - protein, 32 aa, Artificial Sequence
  Description of Artificial Sequence: Synthetic polypeptide
AEEEIRTTNPVATEQYGSVSTNLDDENETTNV

SEQ ID NO: 66130 - protein, 34 aa, Artificial Sequence
  Description of Artificial Sequence: Synthetic polypeptide
AEEEIRTTNPVATEQYGSVSVTTNNLQQGDEGNE

SEQ ID NO: 66131 - protein, 31 aa, Artificial Sequence
  Description of Artificial Sequence: Synthetic polypeptide
DAEEIATTNPVATTQYGVVSTNGDHQNGNHR

SEQ ID NO: 66132 - protein, 32 aa, Artificial Sequence
  Description of Artificial Sequence: Synthetic polypeptide
AEEEIRTTNPVATEQYGSVVTVTNGNLETGNI

SEQ ID NO: 66133 - protein, 34 aa, Artificial Sequence
  Description of Artificial Sequence: Synthetic polypeptide
AEEEIRTTNPVATEQYGSVSTTNLQQGNQTDTEV

SEQ ID NO: 66134 - protein, 31 aa, Artificial Sequence
  Description of Artificial Sequence: Synthetic polypeptide
AEEEIRTTNPVATEQYGSVVTVTNIQTTNQV

SEQ ID NO: 66135 - protein, 33 aa, Artificial Sequence
  Description of Artificial Sequence: Synthetic polypeptide
AEEEIRTTNPVATEQYGSVVTVTNLGGQEGNVE

SEQ ID NO: 66136 - protein, 34 aa, Artificial Sequence
  Description of Artificial Sequence: Synthetic polypeptide
AEEEIRTTNPVATEQYGSVSTTNLQQGQIGNENE

SEQ ID NO: 66137 - protein, 32 aa, Artificial Sequence
  Description of Artificial Sequence: Synthetic polypeptide
AEEEIRTTNPVATEQYGSVVTVTNLNSNGNNV

SEQ ID NO: 66138 - protein, 34 aa, Artificial Sequence
  Description of Artificial Sequence: Synthetic polypeptide
AEEEIRTTNPVATEQYGSVSTTNLQQGSNQNNDG

SEQ ID NO: 66139 - protein, 33 aa, Artificial Sequence
  Description of Artificial Sequence: Synthetic polypeptide
AEEEIRTTNPVATEQYGSVVTVTNLQNGNTNEA

SEQ ID NO: 66140 - protein, 33 aa, Artificial Sequence
  Description of Artificial Sequence: Synthetic polypeptide
AEEEIRTTNPVATEQYGSVVTVTNLQNNGINED

SEQ ID NO: 66141 - protein, 30 aa, Artificial Sequence
  Description of Artificial Sequence: Synthetic polypeptide
CEEEIACTNPVATEAYGSVATNLQEAGNDE

SEQ ID NO: 66142 - protein, 33 aa, Artificial Sequence
  Description of Artificial Sequence: Synthetic polypeptide
AEEEIRTTNPVATEQYGSVSTNGNQQDGNNIGT

SEQ ID NO: 66143 - protein, 31 aa, Artificial Sequence
  Description of Artificial Sequence: Synthetic polypeptide
DEEEIATTNPVATEQYGSVCAANHLQDEGDE

SEQ ID NO: 66144 - protein, 33 aa, Artificial Sequence
  Description of Artificial Sequence: Synthetic polypeptide
DEEEIRTTNPCATEQYGIVSTTPALPQRNGTPR

SEQ ID NO: 66145 - protein, 33 aa, Artificial Sequence
  Description of Artificial Sequence: Synthetic polypeptide
AEEEIRTTNPVATEQYGSVSVTTNLQQNEQGLG

SEQ ID NO: 66146 - protein, 33 aa, Artificial Sequence
  Description of Artificial Sequence: Synthetic polypeptide
AEEEIRTTNPVATEQYGSVSTTNLQQQNDTDGE

SEQ ID NO: 66147 - protein, 34 aa, Artificial Sequence
  Description of Artificial Sequence: Synthetic polypeptide
AEEEIRTTNPVATEQYGSVSVTTNLLQGNLGING

SEQ ID NO: 66148 - protein, 32 aa, Artificial Sequence
  Description of Artificial Sequence: Synthetic polypeptide
AEEEIRTTNPVATEQYGSVSTMQGNNNEGGNY

SEQ ID NO: 66149 - protein, 34 aa, Artificial Sequence
  Description of Artificial Sequence: Synthetic polypeptide
AEEEIRTTNPVATEQYGSVSVTTNLGQNNGTNPT

SEQ ID NO: 66150 - protein, 34 aa, Artificial Sequence
  Description of Artificial Sequence: Synthetic polypeptide
AEEEIRTTNPVATEQYGSVSTTNLQQQNGTNQDT

SEQ ID NO: 66151 - protein, 34 aa, Artificial Sequence
  Description of Artificial Sequence: Synthetic polypeptide
AEEEIRTTNPVATEQYGSVSTTNLQQQNGTTNAD

SEQ ID NO: 66152 - protein, 32 aa, Artificial Sequence
  Description of Artificial Sequence: Synthetic polypeptide
AEEEIRTTNPVATEQYGSVSTMNQQQQGEGGT

SEQ ID NO: 66153 - protein, 32 aa, Artificial Sequence
  Description of Artificial Sequence: Synthetic polypeptide
AEEEIRTTNPVATEQYGSVSTMNQQQGEIGTE

SEQ ID NO: 66154 - protein, 34 aa, Artificial Sequence
  Description of Artificial Sequence: Synthetic polypeptide
AEEEIRTTNPVATEQYGSVSVTTNLGQNNGTNPN

SEQ ID NO: 66155 - protein, 33 aa, Artificial Sequence
  Description of Artificial Sequence: Synthetic polypeptide
AEEEIRTTNPVATEQYGSVSVTTNLLQNEGTDG

SEQ ID NO: 66156 - protein, 32 aa, Artificial Sequence
  Description of Artificial Sequence: Synthetic polypeptide
AEEEIRTTNPVATEQYGSVVTVTNQLNSNGND

SEQ ID NO: 66157 - protein, 32 aa, Artificial Sequence
  Description of Artificial Sequence: Synthetic polypeptide
AEEEIRTTNPVATEQYGSVSTINNGNNDNGNG

SEQ ID NO: 66158 - protein, 33 aa, Artificial Sequence
  Description of Artificial Sequence: Synthetic polypeptide
AEEEIRTTNPVATEQYGSVSTTNLQQQNNGESE

SEQ ID NO: 66159 - protein, 34 aa, Artificial Sequence
  Description of Artificial Sequence: Synthetic polypeptide
AEEEIRTTNPVATEQYGSVSVTTNLGQGNGTNDT

SEQ ID NO: 66160 - protein, 34 aa, Artificial Sequence
  Description of Artificial Sequence: Synthetic polypeptide
AEEEIRTTNPVATEQYGSVSVTTNLENQQEGNNN

SEQ ID NO: 66161 - protein, 31 aa, Artificial Sequence
  Description of Artificial Sequence: Synthetic polypeptide
DEEEIRTTNPLAYEQYGSVSCANHSFRGGND

SEQ ID NO: 66162 - protein, 31 aa, Artificial Sequence
  Description of Artificial Sequence: Synthetic polypeptide
DEEEIRTTNPLAYEQYGSVSINAISGRGGND

SEQ ID NO: 66163 - protein, 33 aa, Artificial Sequence
  Description of Artificial Sequence: Synthetic polypeptide
AEEEIRTTNPVATEQYGSVSTTNLQQQNSGGDG

SEQ ID NO: 66164 - protein, 32 aa, Artificial Sequence
  Description of Artificial Sequence: Synthetic polypeptide
AEEEIRTTNPVATEQYGSVSTINNGNDGNNTE

SEQ ID NO: 66165 - protein, 34 aa, Artificial Sequence
  Description of Artificial Sequence: Synthetic polypeptide
AEEEIRTTNPVATEQYGSVSTTNLQQQQANGNDE

SEQ ID NO: 66166 - protein, 33 aa, Artificial Sequence
  Description of Artificial Sequence: Synthetic polypeptide
AEEEIRTTNPVATEQYGSVSTLLQQGEGGGNNN

SEQ ID NO: 66167 - protein, 33 aa, Artificial Sequence
  Description of Artificial Sequence: Synthetic polypeptide
AEEEIRTTNPVATEQYGSVSVTTNLQQNNGDTE

SEQ ID NO: 66168 - protein, 33 aa, Artificial Sequence
  Description of Artificial Sequence: Synthetic polypeptide
AEEEIRTTNPVATEQYGSVSTTNLQQQNATNAD

SEQ ID NO: 66169 - protein, 29 aa, Artificial Sequence
  Description of Artificial Sequence: Synthetic peptide
DEDEIATTNPVAYEQYGSVAAANDDRGNT

SEQ ID NO: 66170 - protein, 33 aa, Artificial Sequence
  Description of Artificial Sequence: Synthetic polypeptide
DEEEIRTTNPCATEQYGIVSSTTNGPNRNGNPR

SEQ ID NO: 66171 - protein, 31 aa, Artificial Sequence
  Description of Artificial Sequence: Synthetic polypeptide
DAEEIATTNPVAYEQYGSVAATNLQRGDGES

SEQ ID NO: 66172 - protein, 31 aa, Artificial Sequence
  Description of Artificial Sequence: Synthetic polypeptide
DEEEIRTTNPCATEQYGCVCSYNPARGSNDA

SEQ ID NO: 66173 - protein, 34 aa, Artificial Sequence
  Description of Artificial Sequence: Synthetic polypeptide
AEEEIRTTNPVATEQYGSVSVTTNLQQGDEGNNE

SEQ ID NO: 66174 - protein, 30 aa, Artificial Sequence
  Description of Artificial Sequence: Synthetic polypeptide
DEEEIRTTNPCATEQYGCVCSYNHFYGSND

SEQ ID NO: 66175 - protein, 34 aa, Artificial Sequence
  Description of Artificial Sequence: Synthetic polypeptide
AEEEIRTTNPVATEQYGSVSVTTNLQNTETGNTV

SEQ ID NO: 66176 - protein, 34 aa, Artificial Sequence
  Description of Artificial Sequence: Synthetic polypeptide
AEEEIRTTNPVATEQYGSVSTTNLQQNQQGNQED

SEQ ID NO: 66177 - protein, 30 aa, Artificial Sequence
  Description of Artificial Sequence: Synthetic polypeptide
DAEEIATTNPVAYEQYGSVATNLQANPPNN

SEQ ID NO: 66178 - protein, 32 aa, Artificial Sequence
  Description of Artificial Sequence: Synthetic polypeptide
DAEEIATTNPVAYEQYGSVATNLQDRGDNAAM

SEQ ID NO: 66179 - protein, 29 aa, Artificial Sequence
  Description of Artificial Sequence: Synthetic peptide
DEDEIATTNPVAYEQYGSVAAANDQRDND

SEQ ID NO: 66180 - protein, 34 aa, Artificial Sequence
  Description of Artificial Sequence: Synthetic polypeptide
AEEEIRTTNPVATEQYGSVSVTTNLNQLQEGNNE

SEQ ID NO: 66181 - protein, 31 aa, Artificial Sequence
  Description of Artificial Sequence: Synthetic polypeptide
DEEEIRTTNPCATEQYGCVCSWNIARFGSNA

SEQ ID NO: 66182 - protein, 31 aa, Artificial Sequence
  Description of Artificial Sequence: Synthetic polypeptide
DAEEIATTNPVAYEQYGSVATNLQRPGETDI

SEQ ID NO: 66183 - protein, 32 aa, Artificial Sequence
  Description of Artificial Sequence: Synthetic polypeptide
AEEEIRTTNPVATEQYGSVSTMVGNQNGTNTT

SEQ ID NO: 66184 - protein, 31 aa, Artificial Sequence
  Description of Artificial Sequence: Synthetic polypeptide
AEEEIRTTNPVATEQYGSVSTMQQQNQGEIT

SEQ ID NO: 66185 - protein, 34 aa, Artificial Sequence
  Description of Artificial Sequence: Synthetic polypeptide
AEEEIRTTNPVATEQYGSVSTTNLQQQENGNNQG

SEQ ID NO: 66186 - protein, 33 aa, Artificial Sequence
  Description of Artificial Sequence: Synthetic polypeptide
AEEEIRTTNPVATEQYGSVSTTNLQQQEQGEGG

SEQ ID NO: 66187 - protein, 33 aa, Artificial Sequence
  Description of Artificial Sequence: Synthetic polypeptide
DEEEIRTTNPLAYEQYGQSVSTGNSTSQRVGDR

SEQ ID NO: 66188 - protein, 34 aa, Artificial Sequence
  Description of Artificial Sequence: Synthetic polypeptide
AEEEIRTTNPVATEQYGSVSVTTNLLQQGNNNAN

SEQ ID NO: 66189 - protein, 34 aa, Artificial Sequence
  Description of Artificial Sequence: Synthetic polypeptide
AEEEIRTTNPVATEQYGSVSVTTNLLQQGNNINE

SEQ ID NO: 66190 - protein, 30 aa, Artificial Sequence
  Description of Artificial Sequence: Synthetic polypeptide
DEEEIRTTNPCATEQYGCVCSWNIFHFGND

SEQ ID NO: 66191 - protein, 33 aa, Artificial Sequence
  Description of Artificial Sequence: Synthetic polypeptide
DEEEIATTNPVATEQYGSVCAANLQESDGNGRN

SEQ ID NO: 66192 - protein, 32 aa, Artificial Sequence
  Description of Artificial Sequence: Synthetic polypeptide
AEEEIRTTNPVATEQYGSVSTDNQGNDQGNDT

SEQ ID NO: 66193 - protein, 31 aa, Artificial Sequence
  Description of Artificial Sequence: Synthetic polypeptide
DEEEIRTTNPMAYEPYGSCSCTNLSARGGND

SEQ ID NO: 66194 - protein, 34 aa, Artificial Sequence
  Description of Artificial Sequence: Synthetic polypeptide
AEEEIRTTNPVATEQYGSVSSVTNLQQGNGTNVN

SEQ ID NO: 66195 - protein, 32 aa, Artificial Sequence
  Description of Artificial Sequence: Synthetic polypeptide
AEEEIRTTNPVATEQYGSVVVSTNNQNGTTVG

SEQ ID NO: 66196 - protein, 30 aa, Artificial Sequence
  Description of Artificial Sequence: Synthetic polypeptide
DEDEIATTNPVAYEQYGSVATNLETGNDVY

SEQ ID NO: 66197 - protein, 30 aa, Artificial Sequence
  Description of Artificial Sequence: Synthetic polypeptide
DEEEIRTTNPVAFEQYGSVVDTDFQAFDSR

SEQ ID NO: 66198 - protein, 32 aa, Artificial Sequence
  Description of Artificial Sequence: Synthetic polypeptide
AEEEIRTTNPVATEQYGSVSVTNQNQQANNED

SEQ ID NO: 66199 - protein, 33 aa, Artificial Sequence
  Description of Artificial Sequence: Synthetic polypeptide
AEEEIRTTNPVATEQYGSVVVSTNNQNQQGNGG

SEQ ID NO: 66200 - protein, 32 aa, Artificial Sequence
  Description of Artificial Sequence: Synthetic polypeptide
AEEEIRTTNPVATEQYGSVVVSTNNQQEDENE

SEQ ID NO: 66201 - protein, 33 aa, Artificial Sequence
  Description of Artificial Sequence: Synthetic polypeptide
AEEEIRTTNPVATEQYGSVVVSTNNQQNGNQQN

SEQ ID NO: 66202 - protein, 32 aa, Artificial Sequence
  Description of Artificial Sequence: Synthetic polypeptide
AEEEIRTTNPVATEQYGSVSVTNQNGTVGNQI

SEQ ID NO: 66203 - protein, 31 aa, Artificial Sequence
  Description of Artificial Sequence: Synthetic polypeptide
DEDEIATTNPVAYEQYGSVATNLETGDNDRQ

SEQ ID NO: 66204 - protein, 34 aa, Artificial Sequence
  Description of Artificial Sequence: Synthetic polypeptide
AEEEIRTTNPVATEQYGSVSTTNNLNQQGNTNGD

SEQ ID NO: 66205 - protein, 32 aa, Artificial Sequence
  Description of Artificial Sequence: Synthetic polypeptide
AEEEIRTTNPVATEQYGSVVVSTTDNQIGENG

SEQ ID NO: 66206 - protein, 30 aa, Artificial Sequence
  Description of Artificial Sequence: Synthetic polypeptide
DEDEIATTNPVAYEQYGSVATNLETPGNDT

SEQ ID NO: 66207 - protein, 30 aa, Artificial Sequence
  Description of Artificial Sequence: Synthetic polypeptide
DEDEIATTNPVAYEQYGSVATNLQADDNDE

SEQ ID NO: 66208 - protein, 30 aa, Artificial Sequence
  Description of Artificial Sequence: Synthetic polypeptide
DEDEIATTNPVAYEQYGSVATNLQANPPER

SEQ ID NO: 66209 - protein, 32 aa, Artificial Sequence
  Description of Artificial Sequence: Synthetic polypeptide
DEDEIATTNPVAYEQYGSVATNLQDADGNARY

SEQ ID NO: 66210 - protein, 32 aa, Artificial Sequence
  Description of Artificial Sequence: Synthetic polypeptide
AEEEIRTTNPVATEQYGSVSSVNQQQTAGNIN

SEQ ID NO: 66211 - protein, 31 aa, Artificial Sequence
  Description of Artificial Sequence: Synthetic polypeptide
DEAEIATTNPVAYEQWGSVSTALQDQGNNDR

SEQ ID NO: 66212 - protein, 31 aa, Artificial Sequence
  Description of Artificial Sequence: Synthetic polypeptide
DEDEIATTNPVAYEQYGSVATNLQDAGPNEH

SEQ ID NO: 66213 - protein, 32 aa, Artificial Sequence
  Description of Artificial Sequence: Synthetic polypeptide
DEDEIATTNPVAYEQYGSVATNLQDAPGNDRH

SEQ ID NO: 66214 - protein, 31 aa, Artificial Sequence
  Description of Artificial Sequence: Synthetic polypeptide
DEDEIATTNPVAYEQYGSVATNLETPGDNTR

SEQ ID NO: 66215 - protein, 31 aa, Artificial Sequence
  Description of Artificial Sequence: Synthetic polypeptide
DEEEIRTTNPVAFESYGSVSTDLQTEQTNQV

SEQ ID NO: 66216 - protein, 31 aa, Artificial Sequence
  Description of Artificial Sequence: Synthetic polypeptide
DEDEIATTNPVAYEQYGSVATNLETDGNDRN

SEQ ID NO: 66217 - protein, 33 aa, Artificial Sequence
  Description of Artificial Sequence: Synthetic polypeptide
AEEEIRTTNPVATEQYGSVSSVTNNNNQIGNTT

SEQ ID NO: 66218 - protein, 29 aa, Artificial Sequence
  Description of Artificial Sequence: Synthetic peptide
DEEEIRTTNPCATEQWGTVPTDLANRGDE

SEQ ID NO: 66219 - protein, 33 aa, Artificial Sequence
  Description of Artificial Sequence: Synthetic polypeptide
AEEEIRTTNPVATEQYGSVSTANNEQGGNNQET

SEQ ID NO: 66220 - protein, 32 aa, Artificial Sequence
  Description of Artificial Sequence: Synthetic polypeptide
AEEEIRTTNPVATEQYGSVSTANNDEGGTNNE

SEQ ID NO: 66221 - protein, 33 aa, Artificial Sequence
  Description of Artificial Sequence: Synthetic polypeptide
AEEEIRTTNPVATEQYGSVSTANLQGTNPNNQA

SEQ ID NO: 66222 - protein, 32 aa, Artificial Sequence
  Description of Artificial Sequence: Synthetic polypeptide
AEEEIRTTNPVATEQYGSVSTANGNTEGGNEQ

SEQ ID NO: 66223 - protein, 33 aa, Artificial Sequence
  Description of Artificial Sequence: Synthetic polypeptide
AEEEIRTTNPVATEQYGSVSVTNQQQQGNNDEM

SEQ ID NO: 66224 - protein, 31 aa, Artificial Sequence
  Description of Artificial Sequence: Synthetic polypeptide
DEDEIATTNPVAYEQYGSVATNLAQDGNEAM

SEQ ID NO: 66225 - protein, 33 aa, Artificial Sequence
  Description of Artificial Sequence: Synthetic polypeptide
DECEICTTNPVATEQYGSVSTTNLLNQVNGNEQ

SEQ ID NO: 66226 - protein, 33 aa, Artificial Sequence
  Description of Artificial Sequence: Synthetic polypeptide
AEEEIRTTNPVATEQYGSVSSVTNNNQNIGNTQ

SEQ ID NO: 66227 - protein, 32 aa, Artificial Sequence
  Description of Artificial Sequence: Synthetic polypeptide
DEDEIATTNPVAYEQYGSVATNLEQNRNGERD

SEQ ID NO: 66228 - protein, 32 aa, Artificial Sequence
  Description of Artificial Sequence: Synthetic polypeptide
DEEEIRTTNPVAFEQYGQVVNNNDLDQRGDRD

SEQ ID NO: 66229 - protein, 34 aa, Artificial Sequence
  Description of Artificial Sequence: Synthetic polypeptide
AEEEIRTTNPVATEQYGSVSTTNNLNQGGTNEAN

SEQ ID NO: 66230 - protein, 34 aa, Artificial Sequence
  Description of Artificial Sequence: Synthetic polypeptide
DEEEIRTTNPVAFEQYGQVVSGGTNDLLQRGIRG

SEQ ID NO: 66231 - protein, 33 aa, Artificial Sequence
  Description of Artificial Sequence: Synthetic polypeptide
AEEEIRTTNPVATEQYGSVVVSTNNNNQQGNGD

SEQ ID NO: 66232 - protein, 34 aa, Artificial Sequence
  Description of Artificial Sequence: Synthetic polypeptide
AEEEIRTTNPVATEQYGSVSTTNNLNQGQGTNED

SEQ ID NO: 66233 - protein, 33 aa, Artificial Sequence
  Description of Artificial Sequence: Synthetic polypeptide
AEEEIRTTNPVATEQYGSVSVTNQQGNLGINTV

SEQ ID NO: 66234 - protein, 33 aa, Artificial Sequence
  Description of Artificial Sequence: Synthetic polypeptide
AEEEIRTTNPVATEQYGSVSVTNQQGNLGINTG

SEQ ID NO: 66235 - protein, 33 aa, Artificial Sequence
  Description of Artificial Sequence: Synthetic polypeptide
AEEEIRTTNPVATEQYGSVVVSTNNNQQQGNGL

SEQ ID NO: 66236 - protein, 34 aa, Artificial Sequence
  Description of Artificial Sequence: Synthetic polypeptide
AEEEIRTTNPVATEQYGSVVVSTNNQLQNGTNLG

SEQ ID NO: 66237 - protein, 33 aa, Artificial Sequence
  Description of Artificial Sequence: Synthetic polypeptide
DEEEIRTTNPVAFEQYGQVVSTNDELQRIIRGQ

SEQ ID NO: 66238 - protein, 31 aa, Artificial Sequence
  Description of Artificial Sequence: Synthetic polypeptide
DEDEIATTNPVAYEQYGSVATNLEDTGNDRL

SEQ ID NO: 66239 - protein, 33 aa, Artificial Sequence
  Description of Artificial Sequence: Synthetic polypeptide
AEEEIRTTNPVATEQYGSVSVTNQQQQQGNEED

SEQ ID NO: 66240 - protein, 32 aa, Artificial Sequence
  Description of Artificial Sequence: Synthetic polypeptide
AEEEIRTTNPVATEQYGSVSSVNQNQTQGNID

SEQ ID NO: 66241 - protein, 32 aa, Artificial Sequence
  Description of Artificial Sequence: Synthetic polypeptide
AEEEIRTTNPVATEQYGSVSSVNNQEEGNNQI

SEQ ID NO: 66242 - protein, 33 aa, Artificial Sequence
  Description of Artificial Sequence: Synthetic polypeptide
AEEEIRTTNPVATEQYGSVSVTNNVQNQGTNLN

SEQ ID NO: 66243 - protein, 33 aa, Artificial Sequence
  Description of Artificial Sequence: Synthetic polypeptide
AEEEIRTTNPVATEQYGSVSVTNNVQNGTNQEN

SEQ ID NO: 66244 - protein, 30 aa, Artificial Sequence
  Description of Artificial Sequence: Synthetic polypeptide
DEDEIATTNPVAYEQYGSVATNLQGVNAQM

SEQ ID NO: 66245 - protein, 30 aa, Artificial Sequence
  Description of Artificial Sequence: Synthetic polypeptide
DEDEIATTNPVAYEQYGSVATNLQPGDIDQ

SEQ ID NO: 66246 - protein, 30 aa, Artificial Sequence
  Description of Artificial Sequence: Synthetic polypeptide
DEDEIATTNPVAYEQYGSVATNLQQDGDTH

SEQ ID NO: 66247 - protein, 31 aa, Artificial Sequence
  Description of Artificial Sequence: Synthetic polypeptide
DEDEIATTNPVAYEQYGSVATNLQQGDNQDH

SEQ ID NO: 66248 - protein, 30 aa, Artificial Sequence
  Description of Artificial Sequence: Synthetic polypeptide
DEAEIATTNPVAYEQWGSVSTNLQDEGDVV

SEQ ID NO: 66249 - protein, 33 aa, Artificial Sequence
  Description of Artificial Sequence: Synthetic polypeptide
AEEEIRTTNPVATEQYGSVVVSTTNLNGDEGNG

SEQ ID NO: 66250 - protein, 30 aa, Artificial Sequence
  Description of Artificial Sequence: Synthetic polypeptide
DEAEIATTNPVAYEQWGSVSTNLQDGGDSV

SEQ ID NO: 66251 - protein, 33 aa, Artificial Sequence
  Description of Artificial Sequence: Synthetic polypeptide
AEEEIRTTNPVATEQYGSVVVSTTNLGGNQGND

SEQ ID NO: 66252 - protein, 31 aa, Artificial Sequence
  Description of Artificial Sequence: Synthetic polypeptide
DEDEIATTNPVAYEQYGSVATNLQQRGEEQM

SEQ ID NO: 66253 - protein, 33 aa, Artificial Sequence
  Description of Artificial Sequence: Synthetic polypeptide
AEEEIRTTNPVATEQYGSVSVTNNVQGNGTNSN

SEQ ID NO: 66254 - protein, 31 aa, Artificial Sequence
  Description of Artificial Sequence: Synthetic polypeptide
DEEEIRTTNPCATEQWGSVIQVDNDQRGNHA

SEQ ID NO: 66255 - protein, 32 aa, Artificial Sequence
  Description of Artificial Sequence: Synthetic polypeptide
AEEEIRTTNPVATEQYGSVSVTNNTNQVGTDD

SEQ ID NO: 66256 - protein, 32 aa, Artificial Sequence
  Description of Artificial Sequence: Synthetic polypeptide
DEAEIATTNPVAYEQWGSVSTNLQGNEGDNER

SEQ ID NO: 66257 - protein, 32 aa, Artificial Sequence
  Description of Artificial Sequence: Synthetic polypeptide
AEEEIRTTNPVATEQYGSVSVTNNSNTESGNI

SEQ ID NO: 66258 - protein, 33 aa, Artificial Sequence
  Description of Artificial Sequence: Synthetic polypeptide
AEEEIRTTNPVATEQYGSVSVTNNQQQQIGNTE

SEQ ID NO: 66259 - protein, 30 aa, Artificial Sequence
  Description of Artificial Sequence: Synthetic polypeptide
DEAEIATTNPVAYEQWGSVSTNLQLDAGDV

SEQ ID NO: 66260 - protein, 33 aa, Artificial Sequence
  Description of Artificial Sequence: Synthetic polypeptide
AEEEIRTTNPVATEQYGSVSVTNNQQQQGTNNS

SEQ ID NO: 66261 - protein, 32 aa, Artificial Sequence
  Description of Artificial Sequence: Synthetic polypeptide
DEEEIRTTNPVASEQYGSVSCPALNMSNGNPR

SEQ ID NO: 66262 - protein, 32 aa, Artificial Sequence
  Description of Artificial Sequence: Synthetic polypeptide
DEDEIATTNPVAYEQYGSVATNLQQRGNDEDM

SEQ ID NO: 66263 - protein, 29 aa, Artificial Sequence
  Description of Artificial Sequence: Synthetic peptide
DEEEIRTTNPCATEQWGSVPTWDLDGGKE

SEQ ID NO: 66264 - protein, 34 aa, Artificial Sequence
  Description of Artificial Sequence: Synthetic polypeptide
AEEEIRTTNPVATEQYGSVSVTNQLGQENGTNAT

SEQ ID NO: 66265 - protein, 30 aa, Artificial Sequence
  Description of Artificial Sequence: Synthetic polypeptide
DEDEIATTNPVAYEQYGSVATNLQGPDSRN

SEQ ID NO: 66266 - protein, 33 aa, Artificial Sequence
  Description of Artificial Sequence: Synthetic polypeptide
AEEEIRTTNPVATEQYGSVSTTNNLQAIQTNQD

SEQ ID NO: 66267 - protein, 32 aa, Artificial Sequence
  Description of Artificial Sequence: Synthetic polypeptide
AEEEIRTTNPVATEQYGSVSSVNENQQTGTNE

SEQ ID NO: 66268 - protein, 32 aa, Artificial Sequence
  Description of Artificial Sequence: Synthetic polypeptide
AEEEIRTTNPVATEQYGSVSSVNENQQGTGNN

SEQ ID NO: 66269 - protein, 32 aa, Artificial Sequence
  Description of Artificial Sequence: Synthetic polypeptide
DEDEIATTNPVAYEQYGSVATNLQDRGDNAEN

SEQ ID NO: 66270 - protein, 32 aa, Artificial Sequence
  Description of Artificial Sequence: Synthetic polypeptide
AEEEIRTTNPVATEQYGSVSTTNNLQEDTETE

SEQ ID NO: 66271 - protein, 30 aa, Artificial Sequence
  Description of Artificial Sequence: Synthetic polypeptide
DEAEIATTNPVAYEQWGSVSTNAGQGENNR

SEQ ID NO: 66272 - protein, 32 aa, Artificial Sequence
  Description of Artificial Sequence: Synthetic polypeptide
AEEEIRTTNPVATEQYGSVSVTNQNGTESGNI

SEQ ID NO: 66273 - protein, 34 aa, Artificial Sequence
  Description of Artificial Sequence: Synthetic polypeptide
AEEEIRTTNPVATEQYGSVSVTNQLQQVTEQGNE

SEQ ID NO: 66274 - protein, 32 aa, Artificial Sequence
  Description of Artificial Sequence: Synthetic polypeptide
DEEEIATTNPVATEQYGSVCAANNLQEGAANH

SEQ ID NO: 66275 - protein, 30 aa, Artificial Sequence
  Description of Artificial Sequence: Synthetic polypeptide
DEAEIATTNPVAYEQWGSVSTNLNQDNGDV

SEQ ID NO: 66276 - protein, 33 aa, Artificial Sequence
  Description of Artificial Sequence: Synthetic polypeptide
AEEEIRTTNPVATEQYGSVSTTNNLQEIGETET

SEQ ID NO: 66277 - protein, 30 aa, Artificial Sequence
  Description of Artificial Sequence: Synthetic polypeptide
DEDEIATTNPVAYEQYGSVATNLQDTGDDN

SEQ ID NO: 66278 - protein, 32 aa, Artificial Sequence
  Description of Artificial Sequence: Synthetic polypeptide
AEEEIRTTNPVATEQYGSVSTTNNLQENETTE

SEQ ID NO: 66279 - protein, 31 aa, Artificial Sequence
  Description of Artificial Sequence: Synthetic polypeptide
DEEEIRTTNPVAHEQYGSVWTNLQPVFDVSL

SEQ ID NO: 66280 - protein, 30 aa, Artificial Sequence
  Description of Artificial Sequence: Synthetic polypeptide
DEEEIRTTNPVAHEQYGSVWTPLAVFDSQR

SEQ ID NO: 66281 - protein, 31 aa, Artificial Sequence
  Description of Artificial Sequence: Synthetic polypeptide
DEAEIATTNPVAYEQWGSVSTNLNGDTGNNR

SEQ ID NO: 66282 - protein, 33 aa, Artificial Sequence
  Description of Artificial Sequence: Synthetic polypeptide
AEEEIRTTNPVATEQYGSVVVSTTNLGGNEGNE

SEQ ID NO: 66283 - protein, 33 aa, Artificial Sequence
  Description of Artificial Sequence: Synthetic polypeptide
AEEEIRTTNPVATEQYGSVVVSTTNLGGNGNNE

SEQ ID NO: 66284 - protein, 32 aa, Artificial Sequence
  Description of Artificial Sequence: Synthetic polypeptide
DEEEIRTTNPVAHEQYGSVYTNLQPVFDVSTR

SEQ ID NO: 66285 - protein, 30 aa, Artificial Sequence
  Description of Artificial Sequence: Synthetic polypeptide
DEDEIATTNPVAYEQYGSVATNLQGNPEGA

SEQ ID NO: 66286 - protein, 31 aa, Artificial Sequence
  Description of Artificial Sequence: Synthetic polypeptide
DEEEIRTTNPVAHEQYGSVVTGLQGGDQDDG

SEQ ID NO: 66287 - protein, 34 aa, Artificial Sequence
  Description of Artificial Sequence: Synthetic polypeptide
AEEEIRTTNPVATEQYGSVSTTNNLQGQNGNTNT

SEQ ID NO: 66288 - protein, 32 aa, Artificial Sequence
  Description of Artificial Sequence: Synthetic polypeptide
AEEEIRTTNPVATEQYGSVSTANNNDEGGNEG

SEQ ID NO: 66289 - protein, 33 aa, Artificial Sequence
  Description of Artificial Sequence: Synthetic polypeptide
AEEEIRTTNPVATEQYGSVSTANNNEQGNGNNQ

SEQ ID NO: 66290 - protein, 33 aa, Artificial Sequence
  Description of Artificial Sequence: Synthetic polypeptide
DEEEIRTTNPNATEQYGSVTSTTNLSEGEVDNQ

SEQ ID NO: 66291 - protein, 31 aa, Artificial Sequence
  Description of Artificial Sequence: Synthetic polypeptide
DEEEIRTTNPQATEQYGSVISTPNQVQGDFL

SEQ ID NO: 66292 - protein, 32 aa, Artificial Sequence
  Description of Artificial Sequence: Synthetic polypeptide
AEEEIRTTNPVATEQYGSVSTTNNGTVGNNID

SEQ ID NO: 66293 - protein, 32 aa, Artificial Sequence
  Description of Artificial Sequence: Synthetic polypeptide
AEEEIRTTNPVATEQYGSVSVTNSNQQANNED

SEQ ID NO: 66294 - protein, 32 aa, Artificial Sequence
  Description of Artificial Sequence: Synthetic polypeptide
AEEEIRTTNPVATEQYGSVSTTNNINDEGNTD

SEQ ID NO: 66295 - protein, 34 aa, Artificial Sequence
  Description of Artificial Sequence: Synthetic polypeptide
AEEEIRTTNPVATEQYGSVSTDNLQQEENGNNNI

SEQ ID NO: 66296 - protein, 33 aa, Artificial Sequence
  Description of Artificial Sequence: Synthetic polypeptide
AEEEIRTTNPVATEQYGSVSTDNLGQEENNNQI

SEQ ID NO: 66297 - protein, 31 aa, Artificial Sequence
  Description of Artificial Sequence: Synthetic polypeptide
DAGEIATTNPVATEQYGSVSWNDLQDTGMRQ

SEQ ID NO: 66298 - protein, 32 aa, Artificial Sequence
  Description of Artificial Sequence: Synthetic polypeptide
AEEEIRTTNPVATEQYGSVSTDNGNTDNGNNQ

SEQ ID NO: 66299 - protein, 31 aa, Artificial Sequence
  Description of Artificial Sequence: Synthetic polypeptide
DAGEIATTNPVATEQYGSVSTNPLQHQGGEM

SEQ ID NO: 66300 - protein, 31 aa, Artificial Sequence
  Description of Artificial Sequence: Synthetic polypeptide
DAGEIATTNPVATEQYGSVSWNDLVQTGGMR

SEQ ID NO: 66301 - protein, 33 aa, Artificial Sequence
  Description of Artificial Sequence: Synthetic polypeptide
AEEEIRTTNPVATEQYGSVSVTNSNQEANEGND

SEQ ID NO: 66302 - protein, 33 aa, Artificial Sequence
  Description of Artificial Sequence: Synthetic polypeptide
AEEEIRTTNPVATEQYGSVSTDNGNQEQGNNAA

SEQ ID NO: 66303 - protein, 33 aa, Artificial Sequence
  Description of Artificial Sequence: Synthetic polypeptide
AEEEIRTTNPVATEQYGSVSTDNGNQDEGNNTD

SEQ ID NO: 66304 - protein, 32 aa, Artificial Sequence
  Description of Artificial Sequence: Synthetic polypeptide
DEEEIATTNPVATEEYGSVSTNLNGGEGNNEQ

SEQ ID NO: 66305 - protein, 32 aa, Artificial Sequence
  Description of Artificial Sequence: Synthetic polypeptide
AEEEIRTTNPVATEQYGSVVVNTNDQSGVDNT

SEQ ID NO: 66306 - protein, 32 aa, Artificial Sequence
  Description of Artificial Sequence: Synthetic polypeptide
AEEEIRTTNPVATEQYGSVSTDNGNNDGGNQD

SEQ ID NO: 66307 - protein, 32 aa, Artificial Sequence
  Description of Artificial Sequence: Synthetic polypeptide
AEEEIRTTNPVATEQYGSVSTDNGNGTVGNNV

SEQ ID NO: 66308 - protein, 32 aa, Artificial Sequence
  Description of Artificial Sequence: Synthetic polypeptide
DEEEIATTNPVATEEYGSVSTNLNGEGNNDEQ

SEQ ID NO: 66309 - protein, 32 aa, Artificial Sequence
  Description of Artificial Sequence: Synthetic polypeptide
AEEEIRTTNPVATEQYGSVSTDNGNEDNGNNQ

SEQ ID NO: 66310 - protein, 32 aa, Artificial Sequence
  Description of Artificial Sequence: Synthetic polypeptide
AEEEIRTTNPVATEQYGSVSVTNSNQEQNANT

SEQ ID NO: 66311 - protein, 32 aa, Artificial Sequence
  Description of Artificial Sequence: Synthetic polypeptide
AEEEIRTTNPVATEQYGSVSTDNGNEDEGNTT

SEQ ID NO: 66312 - protein, 30 aa, Artificial Sequence
  Description of Artificial Sequence: Synthetic polypeptide
DEEEIRTTNPNATEEYGSVIATNQGPGANA

SEQ ID NO: 66313 - protein, 30 aa, Artificial Sequence
  Description of Artificial Sequence: Synthetic polypeptide
DEEEIRTTNPNATEEYGSVCGTNHARGSDA

SEQ ID NO: 66314 - protein, 31 aa, Artificial Sequence
  Description of Artificial Sequence: Synthetic polypeptide
DEEEIRTTNPMAYEPYGSCSTNELSARGGNE

SEQ ID NO: 66315 - protein, 33 aa, Artificial Sequence
  Description of Artificial Sequence: Synthetic polypeptide
AEEEIRTTNPVATEQYGSVSVTNTDQGNGNNQE

SEQ ID NO: 66316 - protein, 31 aa, Artificial Sequence
  Description of Artificial Sequence: Synthetic polypeptide
DEEEIRTTNPMAYEPYGSTCSTNLSARGGNA

SEQ ID NO: 66317 - protein, 30 aa, Artificial Sequence
  Description of Artificial Sequence: Synthetic polypeptide
DAEEIRTTNPVAYEAYGSVATYLSQPVGNQ

SEQ ID NO: 66318 - protein, 31 aa, Artificial Sequence
  Description of Artificial Sequence: Synthetic polypeptide
DEDEIATTNPVAYEQYGSVATADQRDGNSRM

SEQ ID NO: 66319 - protein, 30 aa, Artificial Sequence
  Description of Artificial Sequence: Synthetic polypeptide
DEDEIATTNPVAYEQYGSVATADQRGNDQL

SEQ ID NO: 66320 - protein, 33 aa, Artificial Sequence
  Description of Artificial Sequence: Synthetic polypeptide
DEEEIRTTNPMAYEQYGSVPACTNLQRTGGNQA

SEQ ID NO: 66321 - protein, 33 aa, Artificial Sequence
  Description of Artificial Sequence: Synthetic polypeptide
DECEICTTNPVATEQYGSVSTTNQLQEQQGNGT

SEQ ID NO: 66322 - protein, 30 aa, Artificial Sequence
  Description of Artificial Sequence: Synthetic polypeptide
DEDEIATTNPVAYEQYGSVATALQNSDGNN

SEQ ID NO: 66323 - protein, 31 aa, Artificial Sequence
  Description of Artificial Sequence: Synthetic polypeptide
DEEEIRTTNPNATEEYGSVCVTNHGRGSNAS

SEQ ID NO: 66324 - protein, 33 aa, Artificial Sequence
  Description of Artificial Sequence: Synthetic polypeptide
AEEEIRTTNPVATEQYGSVSTDNNNQQIGENGT

SEQ ID NO: 66325 - protein, 29 aa, Artificial Sequence
  Description of Artificial Sequence: Synthetic peptide
DAEQIATTNPVATEQYGCVATNDQDGNSD

SEQ ID NO: 66326 - protein, 30 aa, Artificial Sequence
  Description of Artificial Sequence: Synthetic polypeptide
DEDEIATTNPVAYEQYGSVATALQRNNNTE

SEQ ID NO: 66327 - protein, 33 aa, Artificial Sequence
  Description of Artificial Sequence: Synthetic polypeptide
AEEEIRTTNPVATEQYGSVSTDNNNQEEGNNQI

SEQ ID NO: 66328 - protein, 33 aa, Artificial Sequence
  Description of Artificial Sequence: Synthetic polypeptide
AEEEIRTTNPVATEQYGSVSTDNNENQQTGTNQ

SEQ ID NO: 66329 - protein, 31 aa, Artificial Sequence
  Description of Artificial Sequence: Synthetic polypeptide
DAGEIATTNPVATEQYGSVSATNPLQDSMMR

SEQ ID NO: 66330 - protein, 32 aa, Artificial Sequence
  Description of Artificial Sequence: Synthetic polypeptide
DAGEIATTNPVATEQYGSVSTGNPLQHQGGMR

SEQ ID NO: 66331 - protein, 29 aa, Artificial Sequence
  Description of Artificial Sequence: Synthetic peptide
DEEEIRTTNPNATEEYGSVATMGHGRGEA

SEQ ID NO: 66332 - protein, 30 aa, Artificial Sequence
  Description of Artificial Sequence: Synthetic polypeptide
DEEEIRTTNPNATEEYGSVATNHGRGTDEG

SEQ ID NO: 66333 - protein, 32 aa, Artificial Sequence
  Description of Artificial Sequence: Synthetic polypeptide
AEEEIRTTNPVATEQYGSVVVNANLNQIGNTE

SEQ ID NO: 66334 - protein, 32 aa, Artificial Sequence
  Description of Artificial Sequence: Synthetic polypeptide
AEEEIRTTNPVATEQYGSVSVTNSNTQESNNM

SEQ ID NO: 66335 - protein, 30 aa, Artificial Sequence
  Description of Artificial Sequence: Synthetic polypeptide
DEDEIATTNPVAYEQYGSVATNLADDGNED

SEQ ID NO: 66336 - protein, 32 aa, Artificial Sequence
  Description of Artificial Sequence: Synthetic polypeptide
AEEEIRTTNPVATEQYGSVSTDNGNDQGTNET

SEQ ID NO: 66337 - protein, 33 aa, Artificial Sequence
  Description of Artificial Sequence: Synthetic polypeptide
AEEEIRTTNPVATEQYGSVSTTNNLEDGNNDTN

SEQ ID NO: 66338 - protein, 33 aa, Artificial Sequence
  Description of Artificial Sequence: Synthetic polypeptide
DECEICTTNPVATEQYGSVSTTNLQMQQGTNET

SEQ ID NO: 66339 - protein, 32 aa, Artificial Sequence
  Description of Artificial Sequence: Synthetic polypeptide
AEEEIRTTNPVATEQYGSVVVSTDGNQIGNNS

SEQ ID NO: 66340 - protein, 32 aa, Artificial Sequence
  Description of Artificial Sequence: Synthetic polypeptide
AEEEIRTTNPVATEQYGSVVVSTDNQGIGNGN

SEQ ID NO: 66341 - protein, 32 aa, Artificial Sequence
  Description of Artificial Sequence: Synthetic polypeptide
AEEEIRTTNPVATEQYGSVVVSTDNQGIGNNS

SEQ ID NO: 66342 - protein, 33 aa, Artificial Sequence
  Description of Artificial Sequence: Synthetic polypeptide
AEEEIRTTNPVATEQYGSVVVSTNDNNQIGTNM

SEQ ID NO: 66343 - protein, 32 aa, Artificial Sequence
  Description of Artificial Sequence: Synthetic polypeptide
DAGEIATTNPVATEQYGSVSWTLNDLQDTGTR

SEQ ID NO: 66344 - protein, 33 aa, Artificial Sequence
  Description of Artificial Sequence: Synthetic polypeptide
AEEEIRTTNPVATEQYGSVVVSTNLGGNGGNND

SEQ ID NO: 66345 - protein, 33 aa, Artificial Sequence
  Description of Artificial Sequence: Synthetic polypeptide
AEEEIRTTNPVATEQYGSVVVSTNNLGGNGNTE

SEQ ID NO: 66346 - protein, 33 aa, Artificial Sequence
  Description of Artificial Sequence: Synthetic polypeptide
AEEEIRTTNPVATEQYGSVVVSTNNLGNETGNT

SEQ ID NO: 66347 - protein, 32 aa, Artificial Sequence
  Description of Artificial Sequence: Synthetic polypeptide
DEEEIRTTNPVACESYGSVSTLNLVDNQFDNI

SEQ ID NO: 66348 - protein, 33 aa, Artificial Sequence
  Description of Artificial Sequence: Synthetic polypeptide
AEEEIRTTNPVATEQYGSVSTATNLETGNNNTN

SEQ ID NO: 66349 - protein, 34 aa, Artificial Sequence
  Description of Artificial Sequence: Synthetic polypeptide
AEEEIRTTNPVATEQYGSVSTTNNLLQNQGNDEG

SEQ ID NO: 66350 - protein, 34 aa, Artificial Sequence
  Description of Artificial Sequence: Synthetic polypeptide
AEEEIRTTNPVATEQYGSVVVSTNNLNNQAGNNA

SEQ ID NO: 66351 - protein, 33 aa, Artificial Sequence
  Description of Artificial Sequence: Synthetic polypeptide
AEEEIRTTNPVATEQYGSVSTATNLETGENGNN

SEQ ID NO: 66352 - protein, 33 aa, Artificial Sequence
  Description of Artificial Sequence: Synthetic polypeptide
AEEEIRTTNPVATEQYGSVSTAQNNLDEFGNVT

SEQ ID NO: 66353 - protein, 32 aa, Artificial Sequence
  Description of Artificial Sequence: Synthetic polypeptide
AEEEIRTTNPVATEQYGSVSTANQNEEGGNNE

SEQ ID NO: 66354 - protein, 32 aa, Artificial Sequence
  Description of Artificial Sequence: Synthetic polypeptide
AEEEIRTTNPVATEQYGSVSTANQLNQNDEQN

SEQ ID NO: 66355 - protein, 34 aa, Artificial Sequence
  Description of Artificial Sequence: Synthetic polypeptide
AEEEIRTTNPVATEQYGSVVVSTNNLQQGNANVN

SEQ ID NO: 66356 - protein, 32 aa, Artificial Sequence
  Description of Artificial Sequence: Synthetic polypeptide
AEEEIRTTNPVATEQYGSVSTANNNTEGGNNE

SEQ ID NO: 66357 - protein, 32 aa, Artificial Sequence
  Description of Artificial Sequence: Synthetic polypeptide
AEEEIRTTNPVATEQYGSVSTANNNNEEGGNQ

SEQ ID NO: 66358 - protein, 34 aa, Artificial Sequence
  Description of Artificial Sequence: Synthetic polypeptide
AEEEIRTTNPVATEQYGSVSTTNNLLQNNGNEQG

SEQ ID NO: 66359 - protein, 32 aa, Artificial Sequence
  Description of Artificial Sequence: Synthetic polypeptide
AEEEIRTTNPVATEQYGSVSTDNGNDQGNQTG

SEQ ID NO: 66360 - protein, 33 aa, Artificial Sequence
  Description of Artificial Sequence: Synthetic polypeptide
DEEEIRTTNPVACERYGSVYTNLSQYATGTNLR

SEQ ID NO: 66361 - protein, 32 aa, Artificial Sequence
  Description of Artificial Sequence: Synthetic polypeptide
DEEEIRTTNPVACEQYGVVSTTNDNLQAGIDE

SEQ ID NO: 66362 - protein, 30 aa, Artificial Sequence
  Description of Artificial Sequence: Synthetic polypeptide
DAGEIATTNPVATEQYGSVSWNEDQTMGMR

SEQ ID NO: 66363 - protein, 32 aa, Artificial Sequence
  Description of Artificial Sequence: Synthetic polypeptide
DEEEIATTNPVATECYGVVSTNLQDHDGGGER

SEQ ID NO: 66364 - protein, 32 aa, Artificial Sequence
  Description of Artificial Sequence: Synthetic polypeptide
AEEEIRTTNPVATEQYGSVSVTNSEQEATTND

SEQ ID NO: 66365 - protein, 33 aa, Artificial Sequence
  Description of Artificial Sequence: Synthetic polypeptide
AEEEIRTTNPVATEQYGSVSTDNGENQQTGNNN

SEQ ID NO: 66366 - protein, 32 aa, Artificial Sequence
  Description of Artificial Sequence: Synthetic polypeptide
DEEEIATTNPVATECYGSVSTTNGMQDNGNTE

SEQ ID NO: 66367 - protein, 31 aa, Artificial Sequence
  Description of Artificial Sequence: Synthetic polypeptide
DEDEIATTNPVAYEQYGSVATNDQRGPNDQG

SEQ ID NO: 66368 - protein, 33 aa, Artificial Sequence
  Description of Artificial Sequence: Synthetic polypeptide
AEEEIRTTNPVATEQYGSVSTTNNLIQENGETE

SEQ ID NO: 66369 - protein, 30 aa, Artificial Sequence
  Description of Artificial Sequence: Synthetic polypeptide
DEDEIATTNPVAYEQYGSVATNDTSGDNQR

SEQ ID NO: 66370 - protein, 33 aa, Artificial Sequence
  Description of Artificial Sequence: Synthetic polypeptide
AEEEIRTTNPVATEQYGSVSTDGNGQNGNNNDE

SEQ ID NO: 66371 - protein, 33 aa, Artificial Sequence
  Description of Artificial Sequence: Synthetic polypeptide
AEEEIRTTNPVATEQYGSVVVSNTNEQAGNGNS

SEQ ID NO: 66372 - protein, 30 aa, Artificial Sequence
  Description of Artificial Sequence: Synthetic polypeptide
DEEEIRTTNPTAYEAYGSVATNHSGRTGNA

SEQ ID NO: 66373 - protein, 31 aa, Artificial Sequence
  Description of Artificial Sequence: Synthetic polypeptide
AEEEIRTTNPVATEQYGSVSTDELGNTEGGS

SEQ ID NO: 66374 - protein, 32 aa, Artificial Sequence
  Description of Artificial Sequence: Synthetic polypeptide
DECEICTTNPVATEQYGSVSTTNNLLQGNQTQ

SEQ ID NO: 66375 - protein, 31 aa, Artificial Sequence
  Description of Artificial Sequence: Synthetic polypeptide
DEEEIATTNPVATECYGSVSTNINGEGNNEQ

SEQ ID NO: 66376 - protein, 33 aa, Artificial Sequence
  Description of Artificial Sequence: Synthetic polypeptide
DEEEIRTTNPVACEQYGSVSTVQNQLLQAGIGN

SEQ ID NO: 66377 - protein, 32 aa, Artificial Sequence
  Description of Artificial Sequence: Synthetic polypeptide
DEEEIRTTNPVACEQYGSVVNQNNLLQNGIIR

SEQ ID NO: 66378 - protein, 32 aa, Artificial Sequence
  Description of Artificial Sequence: Synthetic polypeptide
DEEEIRTTNPVACEQYGSVVTNNDNLQNGIGV

SEQ ID NO: 66379 - protein, 32 aa, Artificial Sequence
  Description of Artificial Sequence: Synthetic polypeptide
DEEEIRTTNPVACEQYGSVVTTNDLLQIGTTE

SEQ ID NO: 66380 - protein, 32 aa, Artificial Sequence
  Description of Artificial Sequence: Synthetic polypeptide
DEEEIRTTNPVACEQYGSVVTVNDNLQSGIGN

SEQ ID NO: 66381 - protein, 32 aa, Artificial Sequence
  Description of Artificial Sequence: Synthetic polypeptide
DEEEIRTTNPVACEQYGSVVVVNNLLQNGIRT

SEQ ID NO: 66382 - protein, 32 aa, Artificial Sequence
  Description of Artificial Sequence: Synthetic polypeptide
DECEICTTNPVATEQYGSVSTTNNLMQGNNTQ

SEQ ID NO: 66383 - protein, 32 aa, Artificial Sequence
  Description of Artificial Sequence: Synthetic polypeptide
DEAEIRTTNPVAYEQWGSVSTNLNGEEGNTDR

SEQ ID NO: 66384 - protein, 32 aa, Artificial Sequence
  Description of Artificial Sequence: Synthetic polypeptide
AEEEIRTTNPVATEQYGVVSTVTNSNQGGNGE

SEQ ID NO: 66385 - protein, 33 aa, Artificial Sequence
  Description of Artificial Sequence: Synthetic polypeptide
AEEEIRTTNPVATEQYGSVSTTLNQQANNGGNS

SEQ ID NO: 66386 - protein, 32 aa, Artificial Sequence
  Description of Artificial Sequence: Synthetic polypeptide
DEAEIRTTNPVATEQYGSVSTYGLQESGGEDM

SEQ ID NO: 66387 - protein, 29 aa, Artificial Sequence
  Description of Artificial Sequence: Synthetic peptide
AENEIACTNPVATEQYGETSENLQRKGGR

SEQ ID NO: 66388 - protein, 29 aa, Artificial Sequence
  Description of Artificial Sequence: Synthetic peptide
AENEIACTNPVATEQYGETSENLQRGQGR

SEQ ID NO: 66389 - protein, 33 aa, Artificial Sequence
  Description of Artificial Sequence: Synthetic polypeptide
DEAEIRTTNPVATEQYGSVCSTMLEQRGEEEHI

SEQ ID NO: 66390 - protein, 28 aa, Artificial Sequence
  Description of Artificial Sequence: Synthetic peptide
AENEIACTNPVATEQYGEASEDLQRGER

SEQ ID NO: 66391 - protein, 33 aa, Artificial Sequence
  Description of Artificial Sequence: Synthetic polypeptide
DEAEIRTTNPVATEIYGSVDYSTNVLQEGNEEK

SEQ ID NO: 66392 - protein, 29 aa, Artificial Sequence
  Description of Artificial Sequence: Synthetic peptide
AENEIACTNPVATEQYGETSENLQRGGNQ

SEQ ID NO: 66393 - protein, 33 aa, Artificial Sequence
  Description of Artificial Sequence: Synthetic polypeptide
DEEEIRTTNPVATECYGSVSCINGPQDRNGMNV

SEQ ID NO: 66394 - protein, 33 aa, Artificial Sequence
  Description of Artificial Sequence: Synthetic polypeptide
DEEEIRTTNPVATEFYGSVNSDTNLVNNGNFED

SEQ ID NO: 66395 - protein, 32 aa, Artificial Sequence
  Description of Artificial Sequence: Synthetic polypeptide
AEEEIRTTNPVATEQYGSVSTVTTNLNEQANV

SEQ ID NO: 66396 - protein, 28 aa, Artificial Sequence
  Description of Artificial Sequence: Synthetic peptide
AENEIACTNPVATEQYGEASEDLQRGGR

SEQ ID NO: 66397 - protein, 31 aa, Artificial Sequence
  Description of Artificial Sequence: Synthetic polypeptide
DEDEIRTTNPVATTAYGSVSTNLQENTNNME

SEQ ID NO: 66398 - protein, 31 aa, Artificial Sequence
  Description of Artificial Sequence: Synthetic polypeptide
DEDEIRTTNPVATTAYGSVSTNLQGATNDET

SEQ ID NO: 66399 - protein, 32 aa, Artificial Sequence
  Description of Artificial Sequence: Synthetic polypeptide
DEAEIRTTNPVATEQYGSVCSTELQNFGSEQM

SEQ ID NO: 66400 - protein, 28 aa, Artificial Sequence
  Description of Artificial Sequence: Synthetic peptide
AENEIACTNPVATSQYGEASENLQRGGR

SEQ ID NO: 66401 - protein, 32 aa, Artificial Sequence
  Description of Artificial Sequence: Synthetic polypeptide
DEAEIRTTNPVATEQYGSVCSTELQHFNSNQL

SEQ ID NO: 66402 - protein, 28 aa, Artificial Sequence
  Description of Artificial Sequence: Synthetic peptide
AENEIACTNPVATTQYGEASENLQRGGR

SEQ ID NO: 66403 - protein, 28 aa, Artificial Sequence
  Description of Artificial Sequence: Synthetic peptide
AENEIACTNPVATVQYGEASENLQRGGR

SEQ ID NO: 66404 - protein, 32 aa, Artificial Sequence
  Description of Artificial Sequence: Synthetic polypeptide
DEEEIRCTNPVATEQYGSVSTPAGPNMRGNPV

SEQ ID NO: 66405 - protein, 33 aa, Artificial Sequence
  Description of Artificial Sequence: Synthetic polypeptide
DEEEIRATNPVATEQYGDVSNTNLQSEFGVNGG

SEQ ID NO: 66406 - protein, 28 aa, Artificial Sequence
  Description of Artificial Sequence: Synthetic peptide
AENEIACTNPVATWQYGEASENLQRGGR

SEQ ID NO: 66407 - protein, 28 aa, Artificial Sequence
  Description of Artificial Sequence: Synthetic peptide
AENEIACTNPVATEQYGEASEELQRGGR

SEQ ID NO: 66408 - protein, 33 aa, Artificial Sequence
  Description of Artificial Sequence: Synthetic polypeptide
AEEEIRTTNPVATEQYGSVSTVNTNQQTGNNVD

SEQ ID NO: 66409 - protein, 33 aa, Artificial Sequence
  Description of Artificial Sequence: Synthetic polypeptide
DEEEIRCTNPVATEQYGSVSTNLAQNRWDQDGM

SEQ ID NO: 66410 - protein, 28 aa, Artificial Sequence
  Description of Artificial Sequence: Synthetic peptide
AENEIACTNPVATYQYGEASENLQRGGR

SEQ ID NO: 66411 - protein, 33 aa, Artificial Sequence
  Description of Artificial Sequence: Synthetic polypeptide
AEEEIRTTNPVATEQYGSVSTVNTNQQQIGNNI

SEQ ID NO: 66412 - protein, 28 aa, Artificial Sequence
  Description of Artificial Sequence: Synthetic peptide
AENEIACTNPVATRQYGEASENLQRGGR

SEQ ID NO: 66413 - protein, 30 aa, Artificial Sequence
  Description of Artificial Sequence: Synthetic polypeptide
DDSEIASTNPVATEQYGNVSAETLQRVGNR

SEQ ID NO: 66414 - protein, 33 aa, Artificial Sequence
  Description of Artificial Sequence: Synthetic polypeptide
DEEEIRTTNPVATECYGSVSCINGPQDREGENV

SEQ ID NO: 66415 - protein, 33 aa, Artificial Sequence
  Description of Artificial Sequence: Synthetic polypeptide
DEAEIRTTNPVATEQYGSVCSTNMLERSGEDDN

SEQ ID NO: 66416 - protein, 34 aa, Artificial Sequence
  Description of Artificial Sequence: Synthetic polypeptide
DEAEIRTTNPVATEQYGSVSPTDLENQRGQDERY

SEQ ID NO: 66417 - protein, 29 aa, Artificial Sequence
  Description of Artificial Sequence: Synthetic peptide
AENEIACTNPVATEQYGEADSENLQRGGR

SEQ ID NO: 66418 - protein, 32 aa, Artificial Sequence
  Description of Artificial Sequence: Synthetic polypeptide
DEDEIRTTNPVATTAYGSVSTNLQYGTTNATD

SEQ ID NO: 66419 - protein, 30 aa, Artificial Sequence
  Description of Artificial Sequence: Synthetic polypeptide
AENEIACTNPVATEQYGEACSTDNLQRGGR

SEQ ID NO: 66420 - protein, 29 aa, Artificial Sequence
  Description of Artificial Sequence: Synthetic peptide
AENEIACTNPVATEQYGEVASENLQQGGR

SEQ ID NO: 66421 - protein, 29 aa, Artificial Sequence
  Description of Artificial Sequence: Synthetic peptide
AENEIACTNPVATEQYGEVASENDQRGGR

SEQ ID NO: 66422 - protein, 34 aa, Artificial Sequence
  Description of Artificial Sequence: Synthetic polypeptide
DEAEIRTTNPVATEQYGCCVACTNLSQRPGGNRE

SEQ ID NO: 66423 - protein, 32 aa, Artificial Sequence
  Description of Artificial Sequence: Synthetic polypeptide
DEEEICTTNPVATECYGSVSTNLVNYEGANWA

SEQ ID NO: 66424 - protein, 32 aa, Artificial Sequence
  Description of Artificial Sequence: Synthetic polypeptide
DEEEICTTNPVATECYGSVSTNGQGGAGNNED

SEQ ID NO: 66425 - protein, 28 aa, Artificial Sequence
  Description of Artificial Sequence: Synthetic peptide
AENEIACTNPVATQQYGEASENLQRGLR

SEQ ID NO: 66426 - protein, 30 aa, Artificial Sequence
  Description of Artificial Sequence: Synthetic polypeptide
DEACIRTTNPVATEQYGCVETNPNQYGSNQ

SEQ ID NO: 66427 - protein, 29 aa, Artificial Sequence
  Description of Artificial Sequence: Synthetic peptide
AEAEIACTNPVATEQYGEASENLQRVGGR

SEQ ID NO: 66428 - protein, 33 aa, Artificial Sequence
  Description of Artificial Sequence: Synthetic polypeptide
DEEEIRCTNPVATEQYGSVSTTNGPNMRNGGPR

SEQ ID NO: 66429 - protein, 28 aa, Artificial Sequence
  Description of Artificial Sequence: Synthetic peptide
AEAEIACTNPVATEQYGEASENIQRGGR

SEQ ID NO: 66430 - protein, 28 aa, Artificial Sequence
  Description of Artificial Sequence: Synthetic peptide
AENEIACTNPVATQQYGEASYNLQRGGR

SEQ ID NO: 66431 - protein, 30 aa, Artificial Sequence
  Description of Artificial Sequence: Synthetic polypeptide
AENEIACTNPVATEQYGEACSENLQREGNR

SEQ ID NO: 66432 - protein, 32 aa, Artificial Sequence
  Description of Artificial Sequence: Synthetic polypeptide
DEDEIRTTNPVATTAYGSVSTNLQQGATTNSA

SEQ ID NO: 66433 - protein, 32 aa, Artificial Sequence
  Description of Artificial Sequence: Synthetic polypeptide
DEAEIRTTNPVATEQYGSVSVANLTFGNMNEI

SEQ ID NO: 66434 - protein, 32 aa, Artificial Sequence
  Description of Artificial Sequence: Synthetic polypeptide
DEEEICTTNPVATECYGSVSTNDQGGGGQNND

SEQ ID NO: 66435 - protein, 33 aa, Artificial Sequence
  Description of Artificial Sequence: Synthetic polypeptide
DEAEIRTTNPVATEQYGSVCSTNNDQRGQEDGM

SEQ ID NO: 66436 - protein, 32 aa, Artificial Sequence
  Description of Artificial Sequence: Synthetic polypeptide
DEDEIRTTNPVATTAYGSVSTNLQQGANTENM

SEQ ID NO: 66437 - protein, 32 aa, Artificial Sequence
  Description of Artificial Sequence: Synthetic polypeptide
DEAEIRTTNPVATEQYGSVSTYGLQSNGEDFN

SEQ ID NO: 66438 - protein, 31 aa, Artificial Sequence
  Description of Artificial Sequence: Synthetic polypeptide
DEDEIRTTNPVATTAYGSVSTNLQNATTNEN

SEQ ID NO: 66439 - protein, 33 aa, Artificial Sequence
  Description of Artificial Sequence: Synthetic polypeptide
DEEEIRTTNPVATECYGSVSCINEPQDREGENG

SEQ ID NO: 66440 - protein, 28 aa, Artificial Sequence
  Description of Artificial Sequence: Synthetic peptide
AEAEIACTNPDATEQYGEASENLQRGGR

SEQ ID NO: 66441 - protein, 33 aa, Artificial Sequence
  Description of Artificial Sequence: Synthetic polypeptide
DEEEIRTTNPVATECYGSVSCINEPQDREGMNG

SEQ ID NO: 66442 - protein, 29 aa, Artificial Sequence
  Description of Artificial Sequence: Synthetic peptide
AENEIACTNPVATEQYGEACSENLQRGAR

SEQ ID NO: 66443 - protein, 33 aa, Artificial Sequence
  Description of Artificial Sequence: Synthetic polypeptide
DEAEIRTTNPVATEQYGSVSTYDLNNGNENNRQ

SEQ ID NO: 66444 - protein, 31 aa, Artificial Sequence
  Description of Artificial Sequence: Synthetic polypeptide
DEEAIRTTNPVATEQYGSVSPTNDNHGELDE

SEQ ID NO: 66445 - protein, 32 aa, Artificial Sequence
  Description of Artificial Sequence: Synthetic polypeptide
DEDEIRTTNPVATQQYGCTVSCTNLSERTGNP

SEQ ID NO: 66446 - protein, 32 aa, Artificial Sequence
  Description of Artificial Sequence: Synthetic polypeptide
DEECIRTTNPVATEQYGEAYSIDNGHQRGDNR

SEQ ID NO: 66447 - protein, 32 aa, Artificial Sequence
  Description of Artificial Sequence: Synthetic polypeptide
DEECIRTTNPVATEQYGETVLIDNHQRGGDNR

SEQ ID NO: 66448 - protein, 32 aa, Artificial Sequence
  Description of Artificial Sequence: Synthetic polypeptide
DEDEIRTTNPVAYEQWGEVSTNLNQQGDGNER

SEQ ID NO: 66449 - protein, 33 aa, Artificial Sequence
  Description of Artificial Sequence: Synthetic polypeptide
DEAEIRTTNPVATEQYGSVSTTVANLESGNDDN

SEQ ID NO: 66450 - protein, 33 aa, Artificial Sequence
  Description of Artificial Sequence: Synthetic polypeptide
AEEEIRTTNPVATEQYGSVSTVNQQYGTESGND

SEQ ID NO: 66451 - protein, 32 aa, Artificial Sequence
  Description of Artificial Sequence: Synthetic polypeptide
AEEEIRTTNPVATEQYGSVSTVNQQQTNVNVD

SEQ ID NO: 66452 - protein, 31 aa, Artificial Sequence
  Description of Artificial Sequence: Synthetic polypeptide
DEDEIRTTNPVAYEQWGEVSTNLNRGDGNMQ

SEQ ID NO: 66453 - protein, 28 aa, Artificial Sequence
  Description of Artificial Sequence: Synthetic peptide
AENEIACTNPVATEQYGEASEILQRGGR

SEQ ID NO: 66454 - protein, 32 aa, Artificial Sequence
  Description of Artificial Sequence: Synthetic polypeptide
DEECIRTTNPVATEQYGKTVSCTNASQDVTNR

SEQ ID NO: 66455 - protein, 31 aa, Artificial Sequence
  Description of Artificial Sequence: Synthetic polypeptide
DDTEIRTTNPVATEQYGSVCSTNLLELGVQQ

SEQ ID NO: 66456 - protein, 33 aa, Artificial Sequence
  Description of Artificial Sequence: Synthetic polypeptide
DEECIATTNPVCTEQYGQSTVSCTNLSQSGGNR

SEQ ID NO: 66457 - protein, 28 aa, Artificial Sequence
  Description of Artificial Sequence: Synthetic peptide
AENEIACTNPVAWEQYGEASENLQRGGR

SEQ ID NO: 66458 - protein, 33 aa, Artificial Sequence
  Description of Artificial Sequence: Synthetic polypeptide
DEDEIRTTNPVATETYGCVSTGNGQQDRGENDR

SEQ ID NO: 66459 - protein, 32 aa, Artificial Sequence
  Description of Artificial Sequence: Synthetic polypeptide
AEEEIRTTNPVATEQYGSVSTVNQQQQQTNNT

SEQ ID NO: 66460 - protein, 33 aa, Artificial Sequence
  Description of Artificial Sequence: Synthetic polypeptide
AEEEIRTTNPVATEQYGSVSTVNQQQQGTQNNQ

SEQ ID NO: 66461 - protein, 28 aa, Artificial Sequence
  Description of Artificial Sequence: Synthetic peptide
AENEIACTNPVATEQYGEASEKLQRGGR

SEQ ID NO: 66462 - protein, 33 aa, Artificial Sequence
  Description of Artificial Sequence: Synthetic polypeptide
DEEAEIATTNPVATEPYGSVSTNLQGNEGNGEQ

SEQ ID NO: 66463 - protein, 30 aa, Artificial Sequence
  Description of Artificial Sequence: Synthetic polypeptide
DEAEIRTTNPVATEQYGVVCSTEDQRPSEQ

SEQ ID NO: 66464 - protein, 32 aa, Artificial Sequence
  Description of Artificial Sequence: Synthetic polypeptide
AEEEIRTTNPVATEQYGSVSTVNQQQQETNNE

SEQ ID NO: 66465 - protein, 33 aa, Artificial Sequence
  Description of Artificial Sequence: Synthetic polypeptide
DEEAIRTTNPVATEQYGSVSTNDEQRTSQEDRI

SEQ ID NO: 66466 - protein, 31 aa, Artificial Sequence
  Description of Artificial Sequence: Synthetic polypeptide
DEAEIRTTNPVATEQYGCLSTELQREGEDSL

SEQ ID NO: 66467 - protein, 33 aa, Artificial Sequence
  Description of Artificial Sequence: Synthetic polypeptide
AEEEIRTTNPVATEQYGSVSTVNQQQNDEGNTN

SEQ ID NO: 66468 - protein, 32 aa, Artificial Sequence
  Description of Artificial Sequence: Synthetic polypeptide
DEAEIRTTNPVATEQYGVVCSTELQERFPSNA

SEQ ID NO: 66469 - protein, 32 aa, Artificial Sequence
  Description of Artificial Sequence: Synthetic polypeptide
DEEEIRATNPVATEQYGMVSMTNGFQEGGGNA

SEQ ID NO: 66470 - protein, 30 aa, Artificial Sequence
  Description of Artificial Sequence: Synthetic polypeptide
DEDEIRTTNPVATESWGSVSTTDQMGGMNQ

SEQ ID NO: 66471 - protein, 32 aa, Artificial Sequence
  Description of Artificial Sequence: Synthetic polypeptide
CEEEISTTNPVATEQYGCVCSTNLQRFGSEQN

SEQ ID NO: 66472 - protein, 34 aa, Artificial Sequence
  Description of Artificial Sequence: Synthetic polypeptide
DEDEIRTTNPVATESYGSVSETVNLERAGEENRS

SEQ ID NO: 66473 - protein, 30 aa, Artificial Sequence
  Description of Artificial Sequence: Synthetic polypeptide
DEECIATVNPVATEAWGSVSCDNLSERGNR

SEQ ID NO: 66474 - protein, 32 aa, Artificial Sequence
  Description of Artificial Sequence: Synthetic polypeptide
DEEEICTTNPVATECYGSVSTGNDNQNGGDMR

SEQ ID NO: 66475 - protein, 33 aa, Artificial Sequence
  Description of Artificial Sequence: Synthetic polypeptide
DEAEIRTTNPVATEQYGSVSTVLDDSQEGNEIG

SEQ ID NO: 66476 - protein, 30 aa, Artificial Sequence
  Description of Artificial Sequence: Synthetic polypeptide
DEDEIRTTNPVAYEQWGSVSTGDAHQNGNA

SEQ ID NO: 66477 - protein, 32 aa, Artificial Sequence
  Description of Artificial Sequence: Synthetic polypeptide
DEDEIRTTNPVAYEQWGEVSTNLNQGDGNDGR

SEQ ID NO: 66478 - protein, 33 aa, Artificial Sequence
  Description of Artificial Sequence: Synthetic polypeptide
DEEEICTTNPVATECYGSVSTGNGLQGGGQNQH

SEQ ID NO: 66479 - protein, 31 aa, Artificial Sequence
  Description of Artificial Sequence: Synthetic polypeptide
DEAEIRTTNPVATEQYGSASTNNDQRNQEDG

SEQ ID NO: 66480 - protein, 32 aa, Artificial Sequence
  Description of Artificial Sequence: Synthetic polypeptide
AEEEIRTTNPVATEQYGSVSTVNTNQQEANED

SEQ ID NO: 66481 - protein, 34 aa, Artificial Sequence
  Description of Artificial Sequence: Synthetic polypeptide
DEEEICTTNPVATECYGSVSTGNGLGQDGGNQRQ

SEQ ID NO: 66482 - protein, 28 aa, Artificial Sequence
  Description of Artificial Sequence: Synthetic peptide
AENEIACTNPVAVEQYGEASENLQRGGR

SEQ ID NO: 66483 - protein, 33 aa, Artificial Sequence
  Description of Artificial Sequence: Synthetic polypeptide
DEEEICTTNPVATECYGSVSTGNGLGDEGGNRR

SEQ ID NO: 66484 - protein, 33 aa, Artificial Sequence
  Description of Artificial Sequence: Synthetic polypeptide
DEAEIRTTNPVATEHYGSVSTNLQGNDNGGNVN

SEQ ID NO: 66485 - protein, 29 aa, Artificial Sequence
  Description of Artificial Sequence: Synthetic peptide
AENEIACTNPVATEQYGEASENLQSRGGR

SEQ ID NO: 66486 - protein, 33 aa, Artificial Sequence
  Description of Artificial Sequence: Synthetic polypeptide
DEAEIRTTNPVATEQYGCKVACTNQSQRGNNRE

SEQ ID NO: 66487 - protein, 32 aa, Artificial Sequence
  Description of Artificial Sequence: Synthetic polypeptide
AEEEIRTTNPVATEQYGSVSTVNTNEQGNNQD

SEQ ID NO: 66488 - protein, 31 aa, Artificial Sequence
  Description of Artificial Sequence: Synthetic polypeptide
DEDEIRTTNPVAYEQWGSVSTGDDLQGQGNA

SEQ ID NO: 66489 - protein, 32 aa, Artificial Sequence
  Description of Artificial Sequence: Synthetic polypeptide
DEECIRTTNPVATEQYGCVSCTNEHSQFGNNP

SEQ ID NO: 66490 - protein, 33 aa, Artificial Sequence
  Description of Artificial Sequence: Synthetic polypeptide
DEEAEIATTNPVAYEQWGSVSTNLQGQGGDNNR

SEQ ID NO: 66491 - protein, 29 aa, Artificial Sequence
  Description of Artificial Sequence: Synthetic peptide
DEDEIRTTNPVAYEQWGSVSTGDEMNGNV

SEQ ID NO: 66492 - protein, 30 aa, Artificial Sequence
  Description of Artificial Sequence: Synthetic polypeptide
DEDEIRTTNPVAYEQWGSVSTGDNQQGPNS

SEQ ID NO: 66493 - protein, 31 aa, Artificial Sequence
  Description of Artificial Sequence: Synthetic polypeptide
DEEEIRTTNPVATECYGSVSECGPNRGMNPV

SEQ ID NO: 66494 - protein, 31 aa, Artificial Sequence
  Description of Artificial Sequence: Synthetic polypeptide
DEECIATVNPVATEAYGCVSHDNLQERGMNR

SEQ ID NO: 66495 - protein, 34 aa, Artificial Sequence
  Description of Artificial Sequence: Synthetic polypeptide
DEAEIRTTNPVATEQYGSVSTVNNLMQGQDGNEE

SEQ ID NO: 66496 - protein, 34 aa, Artificial Sequence
  Description of Artificial Sequence: Synthetic polypeptide
AEEEIRTTNPVATEQYGSVSTVVNLQQIGNNDTT

SEQ ID NO: 66497 - protein, 28 aa, Artificial Sequence
  Description of Artificial Sequence: Synthetic peptide
AENEIACTNPVATEQYGEACENLQRGGR

SEQ ID NO: 66498 - protein, 30 aa, Artificial Sequence
  Description of Artificial Sequence: Synthetic polypeptide
DEECIRTTNPVATEQYGCVSTNSQFLDKSM

SEQ ID NO: 66499 - protein, 29 aa, Artificial Sequence
  Description of Artificial Sequence: Synthetic peptide
AENEIACTNPVATEQYGEASEFNLQRGGR

SEQ ID NO: 66500 - protein, 33 aa, Artificial Sequence
  Description of Artificial Sequence: Synthetic polypeptide
DEAEIRTTNPVATEQYGSVCSPENLQRNGSDDE

SEQ ID NO: 66501 - protein, 32 aa, Artificial Sequence
  Description of Artificial Sequence: Synthetic polypeptide
DEECIRTTNPVATEQYGCVTSTNLNDNFGSNQ

SEQ ID NO: 66502 - protein, 30 aa, Artificial Sequence
  Description of Artificial Sequence: Synthetic polypeptide
DEDEIRTTNPVAYEQWGSVSTGHQGDGGMR

SEQ ID NO: 66503 - protein, 31 aa, Artificial Sequence
  Description of Artificial Sequence: Synthetic polypeptide
DEEEIRTTNPVATECYGSVPSEVNQQLMNCL

SEQ ID NO: 66504 - protein, 32 aa, Artificial Sequence
  Description of Artificial Sequence: Synthetic polypeptide
DEECIRTTNPVATEQYGCVCSTNPQEFGSNQF

SEQ ID NO: 66505 - protein, 32 aa, Artificial Sequence
  Description of Artificial Sequence: Synthetic polypeptide
DEECIRTTNPVATEQYGCVCSTNLQGFNSNQM

SEQ ID NO: 66506 - protein, 28 aa, Artificial Sequence
  Description of Artificial Sequence: Synthetic peptide
AEAEIACTNPVAYEQYGEASANLQRGGR

SEQ ID NO: 66507 - protein, 32 aa, Artificial Sequence
  Description of Artificial Sequence: Synthetic polypeptide
DEAEIRTTNPVATEPYGEVSTNLQIGDGNNES

SEQ ID NO: 66508 - protein, 32 aa, Artificial Sequence
  Description of Artificial Sequence: Synthetic polypeptide
DEECIRTTNPVATEQYGCVCSTELQSFGSERA

SEQ ID NO: 66509 - protein, 28 aa, Artificial Sequence
  Description of Artificial Sequence: Synthetic peptide
AENEIACTNPVATECYGAASENLQRGGR

SEQ ID NO: 66510 - protein, 32 aa, Artificial Sequence
  Description of Artificial Sequence: Synthetic polypeptide
DEAEIRTTNPVATEPYGEVSTNLQIGDGNNEE

SEQ ID NO: 66511 - protein, 29 aa, Artificial Sequence
  Description of Artificial Sequence: Synthetic peptide
DDSEIRCTNPVSTEQYGSVSNTIQRVGQR

SEQ ID NO: 66512 - protein, 34 aa, Artificial Sequence
  Description of Artificial Sequence: Synthetic polypeptide
DEEEICTTNPVATEHWGSTVSCTNLSQDRGGNRW

SEQ ID NO: 66513 - protein, 28 aa, Artificial Sequence
  Description of Artificial Sequence: Synthetic peptide
AENEIACTNPVATHQYGEASENLQRGGR

SEQ ID NO: 66514 - protein, 31 aa, Artificial Sequence
  Description of Artificial Sequence: Synthetic polypeptide
DEEEIRTTNPVATEGYGCVCFTNLTYFGSNA

SEQ ID NO: 66515 - protein, 28 aa, Artificial Sequence
  Description of Artificial Sequence: Synthetic peptide
AENEIACTNPVATECYGDVSENLQRGGL

SEQ ID NO: 66516 - protein, 28 aa, Artificial Sequence
  Description of Artificial Sequence: Synthetic peptide
AENEIACTNPVATIQYGEASCNLQRGGR

SEQ ID NO: 66517 - protein, 30 aa, Artificial Sequence
  Description of Artificial Sequence: Synthetic polypeptide
DEEAICTVNPVATEAYGSVSSTDNLESGNV

SEQ ID NO: 66518 - protein, 29 aa, Artificial Sequence
  Description of Artificial Sequence: Synthetic peptide
DEEEIRCTNPVATEQWGDVSEIEMRAGNA

SEQ ID NO: 66519 - protein, 32 aa, Artificial Sequence
  Description of Artificial Sequence: Synthetic polypeptide
DEECIRTTNPVATEQYGCVCSTELQENGSNQM

SEQ ID NO: 66520 - protein, 31 aa, Artificial Sequence
  Description of Artificial Sequence: Synthetic polypeptide
DEECIRTTNPVATEQYGCVCSTEPQFGSNQI

SEQ ID NO: 66521 - protein, 29 aa, Artificial Sequence
  Description of Artificial Sequence: Synthetic peptide
DEEAICTVNPVATEAYGSVSDNLEEGNVQ

SEQ ID NO: 66522 - protein, 29 aa, Artificial Sequence
  Description of Artificial Sequence: Synthetic peptide
DEEAICTVNPVATEAYGSVSDDNLESGNV

SEQ ID NO: 66523 - protein, 29 aa, Artificial Sequence
  Description of Artificial Sequence: Synthetic peptide
AENEIACTNPVATEQYGEASSNPLQRGGR

SEQ ID NO: 66524 - protein, 32 aa, Artificial Sequence
  Description of Artificial Sequence: Synthetic polypeptide
DEEEIRATNPVATEQYGCVAATNLDQMPGDNN

SEQ ID NO: 66525 - protein, 29 aa, Artificial Sequence
  Description of Artificial Sequence: Synthetic peptide
DEDEIRTTNPVAYEQWGETSTNLQMGDDS

SEQ ID NO: 66526 - protein, 33 aa, Artificial Sequence
  Description of Artificial Sequence: Synthetic polypeptide
AEEEIRTTNPVATEQYGSVSTVQNLSNDEGNGE

SEQ ID NO: 66527 - protein, 28 aa, Artificial Sequence
  Description of Artificial Sequence: Synthetic peptide
AENEIACTNPVATKQYGEASENLQRGGR

SEQ ID NO: 66528 - protein, 28 aa, Artificial Sequence
  Description of Artificial Sequence: Synthetic peptide
AENEIACTNPVATLQYGEASENLQRGGR

SEQ ID NO: 66529 - protein, 33 aa, Artificial Sequence
  Description of Artificial Sequence: Synthetic polypeptide
DEAEIRTTNPVATEQYGSVSNTNNLQFFGSDQS

SEQ ID NO: 66530 - protein, 28 aa, Artificial Sequence
  Description of Artificial Sequence: Synthetic peptide
AENEIACTNPVATEQYGEVSECLQRGEL

SEQ ID NO: 66531 - protein, 33 aa, Artificial Sequence
  Description of Artificial Sequence: Synthetic polypeptide
DEEEIRATNPVATEQYGCVAITNLEQGEGGNRQ

SEQ ID NO: 66532 - protein, 32 aa, Artificial Sequence
  Description of Artificial Sequence: Synthetic polypeptide
DEEEIRATNPVATEQYGCVAITNLEQGEGNVN

SEQ ID NO: 66533 - protein, 31 aa, Artificial Sequence
  Description of Artificial Sequence: Synthetic polypeptide
DEECIRTTNPVATEQYGCVCSTEPQNGSNQS

SEQ ID NO: 66534 - protein, 32 aa, Artificial Sequence
  Description of Artificial Sequence: Synthetic polypeptide
DEDEIRTTNPVATTQYGSVSTTLQLNQTGTND

SEQ ID NO: 66535 - protein, 32 aa, Artificial Sequence
  Description of Artificial Sequence: Synthetic polypeptide
DEEEIRATNPVATEQYGCVAATNLDQMGGNHQ

SEQ ID NO: 66536 - protein, 34 aa, Artificial Sequence
  Description of Artificial Sequence: Synthetic polypeptide
DEEEICTTNPVATEHYGSVSTGNGLQGDTGGNER

SEQ ID NO: 66537 - protein, 28 aa, Artificial Sequence
  Description of Artificial Sequence: Synthetic peptide
AENEIACTNPVATEQYGEASSNLQQGGR

SEQ ID NO: 66538 - protein, 28 aa, Artificial Sequence
  Description of Artificial Sequence: Synthetic peptide
AENEIACTNPVATEQYGEASSNLQRGDT

SEQ ID NO: 66539 - protein, 32 aa, Artificial Sequence
  Description of Artificial Sequence: Synthetic polypeptide
DEAEIRTTNPVATEQYGSVSNNLESGGGNVES

SEQ ID NO: 66540 - protein, 32 aa, Artificial Sequence
  Description of Artificial Sequence: Synthetic polypeptide
DEAEIRTTNPVATEQYGSVESSSNLGNGINST

SEQ ID NO: 66541 - protein, 31 aa, Artificial Sequence
  Description of Artificial Sequence: Synthetic polypeptide
DEECIRTTNPVATEQYGCVCSTADQNFGSNQ

SEQ ID NO: 66542 - protein, 29 aa, Artificial Sequence
  Description of Artificial Sequence: Synthetic peptide
AENEIACTNPVATEQYGEVSENLMRAGDR

SEQ ID NO: 66543 - protein, 29 aa, Artificial Sequence
  Description of Artificial Sequence: Synthetic peptide
AENEIACTNPVATEQYGEAHTENLQRGGR

SEQ ID NO: 66544 - protein, 28 aa, Artificial Sequence
  Description of Artificial Sequence: Synthetic peptide
AENEIACTNPVATFQYGEASENLQRGMR

SEQ ID NO: 66545 - protein, 30 aa, Artificial Sequence
  Description of Artificial Sequence: Synthetic polypeptide
DEAEIRTTNPVATEQYGSVSNPLYQNSQDE

SEQ ID NO: 66546 - protein, 28 aa, Artificial Sequence
  Description of Artificial Sequence: Synthetic peptide
AENEIACTNPVATGQYGEASENLQRGGR

SEQ ID NO: 66547 - protein, 32 aa, Artificial Sequence
  Description of Artificial Sequence: Synthetic polypeptide
DEAEIRTTNPVATEQYGAVSTNAQNNGEHDNS

SEQ ID NO: 66548 - protein, 31 aa, Artificial Sequence
  Description of Artificial Sequence: Synthetic polypeptide
DEAEIRTTNPVATEPYGSVCFVTNLTTGGDR

SEQ ID NO: 66549 - protein, 29 aa, Artificial Sequence
  Description of Artificial Sequence: Synthetic peptide
AENEIACTNPVATEQYGEAHSENLQRGGR

SEQ ID NO: 66550 - protein, 30 aa, Artificial Sequence
  Description of Artificial Sequence: Synthetic polypeptide
DEAEIRTTNPVATEQYGSVSNSLDVNSGEI

SEQ ID NO: 66551 - protein, 28 aa, Artificial Sequence
  Description of Artificial Sequence: Synthetic peptide
AENEIACTNPVATEQYGEAHENLQRGGR

SEQ ID NO: 66552 - protein, 33 aa, Artificial Sequence
  Description of Artificial Sequence: Synthetic polypeptide
DEEEIRTTNPVATECYGSVCFTNEDHERGGNQR

SEQ ID NO: 66553 - protein, 32 aa, Artificial Sequence
  Description of Artificial Sequence: Synthetic polypeptide
DEEEICTTNPVATEHYGSVSTNGGGQTNGGNQ

SEQ ID NO: 66554 - protein, 28 aa, Artificial Sequence
  Description of Artificial Sequence: Synthetic peptide
AENEIACTNPVATEQYGEASSNLQRGGC

SEQ ID NO: 66555 - protein, 29 aa, Artificial Sequence
  Description of Artificial Sequence: Synthetic peptide
AENEIACTNPVATEQYGEASANLQRGGRN

SEQ ID NO: 66556 - protein, 33 aa, Artificial Sequence
  Description of Artificial Sequence: Synthetic polypeptide
DEEEIRATNPVATEQYGCTVACTNLSQGGGNRL

SEQ ID NO: 66557 - protein, 33 aa, Artificial Sequence
  Description of Artificial Sequence: Synthetic polypeptide
DEEEIRATNPVATEQYGCTVCCTNALSQGGGNR

SEQ ID NO: 66558 - protein, 31 aa, Artificial Sequence
  Description of Artificial Sequence: Synthetic polypeptide
DEEEIRATNPVATEQYGCVAATGNLDQMMER

SEQ ID NO: 66559 - protein, 28 aa, Artificial Sequence
  Description of Artificial Sequence: Synthetic peptide
AENEIACTNPVATECWGSASENLQRGGR

SEQ ID NO: 66560 - protein, 30 aa, Artificial Sequence
  Description of Artificial Sequence: Synthetic polypeptide
DEEAICTVNPVATEAYGSVSTDNLEQGNVV

SEQ ID NO: 66561 - protein, 33 aa, Artificial Sequence
  Description of Artificial Sequence: Synthetic polypeptide
DEDEIRTTNPVATTQYGSVSTTNGNLQTGNNAD

SEQ ID NO: 66562 - protein, 32 aa, Artificial Sequence
  Description of Artificial Sequence: Synthetic polypeptide
DEEEIRTTNPVATEGYGCVCFTNLTSGGSNRS

SEQ ID NO: 66563 - protein, 32 aa, Artificial Sequence
  Description of Artificial Sequence: Synthetic polypeptide
DEDEIRTTNPVATTQYGSVSTTLQLQTGTNDE

SEQ ID NO: 66564 - protein, 33 aa, Artificial Sequence
  Description of Artificial Sequence: Synthetic polypeptide
DEEEIRTTNPVATEFYGSVSNMNLEQAEGGNDG

SEQ ID NO: 66565 - protein, 32 aa, Artificial Sequence
  Description of Artificial Sequence: Synthetic polypeptide
DEEEIRATNPVATEQYGNVLMTNEVQVGNNQR

SEQ ID NO: 66566 - protein, 32 aa, Artificial Sequence
  Description of Artificial Sequence: Synthetic polypeptide
DEAEIRTTNPVATEQYGSVSNVLQRSGPEDGQ

SEQ ID NO: 66567 - protein, 30 aa, Artificial Sequence
  Description of Artificial Sequence: Synthetic polypeptide
DEEAICTTNPVANEQYGQVSTVNVTQSGNN

SEQ ID NO: 66568 - protein, 31 aa, Artificial Sequence
  Description of Artificial Sequence: Synthetic polypeptide
DEAEIRTTNPVATENYGTVSTNLQLGGDGSD

SEQ ID NO: 66569 - protein, 31 aa, Artificial Sequence
  Description of Artificial Sequence: Synthetic polypeptide
DEECIATVNPVATEAYGSVSVDNLSERGGNR

SEQ ID NO: 66570 - protein, 31 aa, Artificial Sequence
  Description of Artificial Sequence: Synthetic polypeptide
AENEIACTNPVATEQYGEASSTENLQRGMNR

SEQ ID NO: 66571 - protein, 31 aa, Artificial Sequence
  Description of Artificial Sequence: Synthetic polypeptide
DEDEIRTTNPVATTAYGSVSTTNLQENTNMD

SEQ ID NO: 66572 - protein, 29 aa, Artificial Sequence
  Description of Artificial Sequence: Synthetic peptide
AENEIACTNPVATEQYGEAFSENLQRGGR

SEQ ID NO: 66573 - protein, 32 aa, Artificial Sequence
  Description of Artificial Sequence: Synthetic polypeptide
DEAEIRTTNPVATENYGTVSTNLQGGAGDGSR

SEQ ID NO: 66574 - protein, 29 aa, Artificial Sequence
  Description of Artificial Sequence: Synthetic peptide
AENEIACTNPVATEQYGEASENLQVRGGR

SEQ ID NO: 66575 - protein, 28 aa, Artificial Sequence
  Description of Artificial Sequence: Synthetic peptide
AENEIACTNPVATEQYGEASENLQVGGR

SEQ ID NO: 66576 - protein, 31 aa, Artificial Sequence
  Description of Artificial Sequence: Synthetic polypeptide
DEAEIRTTNPVATEQYGSVSVQNDLFGNMNH

SEQ ID NO: 66577 - protein, 32 aa, Artificial Sequence
  Description of Artificial Sequence: Synthetic polypeptide
DEAEIRTTNPVATENYGSVSTNLNGNSGNNEM

SEQ ID NO: 66578 - protein, 28 aa, Artificial Sequence
  Description of Artificial Sequence: Synthetic peptide
DDSEVASTNPVATEQYGEASENLQRGGR

SEQ ID NO: 66579 - protein, 30 aa, Artificial Sequence
  Description of Artificial Sequence: Synthetic polypeptide
AENEIACTNPVATEQYGEVATSENLQRGGR

SEQ ID NO: 66580 - protein, 29 aa, Artificial Sequence
  Description of Artificial Sequence: Synthetic peptide
DEECIATVNPVATEAYGSVSWNHERGSNQ

SEQ ID NO: 66581 - protein, 29 aa, Artificial Sequence
  Description of Artificial Sequence: Synthetic peptide
AENEIACTNPVATEQYGEASENLQTRGGR

SEQ ID NO: 66582 - protein, 28 aa, Artificial Sequence
  Description of Artificial Sequence: Synthetic peptide
AENEIACTNPVATQQYGEASENLQRGGR

SEQ ID NO: 66583 - protein, 33 aa, Artificial Sequence
  Description of Artificial Sequence: Synthetic polypeptide
DEECIRTTNPVATEQYGCVCSTGNLQFFGSNQA

SEQ ID NO: 66584 - protein, 32 aa, Artificial Sequence
  Description of Artificial Sequence: Synthetic polypeptide
DEEAEIRTTNPVAYEQWGSVSTNQQHNGNDGS

SEQ ID NO: 66585 - protein, 33 aa, Artificial Sequence
  Description of Artificial Sequence: Synthetic polypeptide
DEEAEIRTTNPVAYEQWGSVSTNLQQQGGDNEK

SEQ ID NO: 66586 - protein, 33 aa, Artificial Sequence
  Description of Artificial Sequence: Synthetic polypeptide
DEEAEIRTTNPVAYEQWGSVSTNLQGNAGNENE

SEQ ID NO: 66587 - protein, 28 aa, Artificial Sequence
  Description of Artificial Sequence: Synthetic peptide
AENEIACTNPVATEQYGEASENLQTGGR

SEQ ID NO: 66588 - protein, 29 aa, Artificial Sequence
  Description of Artificial Sequence: Synthetic peptide
AENEIACTNPVATEQYGEAESENLQRGGR

SEQ ID NO: 66589 - protein, 33 aa, Artificial Sequence
  Description of Artificial Sequence: Synthetic polypeptide
AEEEIRTTNPVATEQYGSVSTVQENNQEQGNDD

SEQ ID NO: 66590 - protein, 32 aa, Artificial Sequence
  Description of Artificial Sequence: Synthetic polypeptide
DEDEIRTTNPVAYEQWGSVSTDNGGQDNGNTR

SEQ ID NO: 66591 - protein, 31 aa, Artificial Sequence
  Description of Artificial Sequence: Synthetic polypeptide
DEAEIRTTNPVATENWGTVSTNLQGDGDGSR

SEQ ID NO: 66592 - protein, 31 aa, Artificial Sequence
  Description of Artificial Sequence: Synthetic polypeptide
DEEEIRTTNPVATECYGSVNSVDNLETPELR

SEQ ID NO: 66593 - protein, 29 aa, Artificial Sequence
  Description of Artificial Sequence: Synthetic peptide
AENEIACTNPVATEQYGEVASENLQRGGS

SEQ ID NO: 66594 - protein, 30 aa, Artificial Sequence
  Description of Artificial Sequence: Synthetic polypeptide
DEAEIRTTNPVATEQYGSVSPNNIDNSGED

SEQ ID NO: 66595 - protein, 32 aa, Artificial Sequence
  Description of Artificial Sequence: Synthetic polypeptide
DEEEIRATNPVATEQYGCVSMTNDNQEGGSNQ

SEQ ID NO: 66596 - protein, 31 aa, Artificial Sequence
  Description of Artificial Sequence: Synthetic polypeptide
DEAEIRTTNPVATEPWGEVSTNLQIGDGNEM

SEQ ID NO: 66597 - protein, 28 aa, Artificial Sequence
  Description of Artificial Sequence: Synthetic peptide
AENEIACTNPVATNQYGEASENLQRGGR

SEQ ID NO: 66598 - protein, 30 aa, Artificial Sequence
  Description of Artificial Sequence: Synthetic polypeptide
DEEAICTTNPVANEQYGQVSTVNVQGGNND

SEQ ID NO: 66599 - protein, 31 aa, Artificial Sequence
  Description of Artificial Sequence: Synthetic polypeptide
DEECIRTTNPVATEQYGCVCSTGEELRGNQS

SEQ ID NO: 66600 - protein, 31 aa, Artificial Sequence
  Description of Artificial Sequence: Synthetic polypeptide
DEAEIRTTNPVATEQYGSVCSWNLANNSNQF

SEQ ID NO: 66601 - protein, 31 aa, Artificial Sequence
  Description of Artificial Sequence: Synthetic polypeptide
DEEAICCTNPVATEQYGCVSTNLQQHGQNQY

SEQ ID NO: 66602 - protein, 30 aa, Artificial Sequence
  Description of Artificial Sequence: Synthetic polypeptide
AENEIACTNPVATEQYGEVSCNLQDRGEGR

SEQ ID NO: 66603 - protein, 28 aa, Artificial Sequence
  Description of Artificial Sequence: Synthetic peptide
AENEIACTNPVATEQYGEASCNLQGGDR

SEQ ID NO: 66604 - protein, 28 aa, Artificial Sequence
  Description of Artificial Sequence: Synthetic peptide
AENEIACTNPVATEQYGEASCNLQRGGH

SEQ ID NO: 66605 - protein, 29 aa, Artificial Sequence
  Description of Artificial Sequence: Synthetic peptide
AENEIACTNPVATEQYGEASCNLQRGGRE

SEQ ID NO: 66606 - protein, 29 aa, Artificial Sequence
  Description of Artificial Sequence: Synthetic peptide
AENEIACTNPVATEQYGEASCNLQRGKGR

SEQ ID NO: 66607 - protein, 28 aa, Artificial Sequence
  Description of Artificial Sequence: Synthetic peptide
AENEIACTNPVATEQYGEASCNRQRGGR

SEQ ID NO: 66608 - protein, 34 aa, Artificial Sequence
  Description of Artificial Sequence: Synthetic polypeptide
DEAEIRTTNPVATEQYGAVSTTQNLQGDVGQNDR

SEQ ID NO: 66609 - protein, 28 aa, Artificial Sequence
  Description of Artificial Sequence: Synthetic peptide
AENEIACTNPVATLQYGEASENLQRGQR

SEQ ID NO: 66610 - protein, 32 aa, Artificial Sequence
  Description of Artificial Sequence: Synthetic polypeptide
DEAEIRTTNPVATEQYGSVCSVENLDRNGEDE

SEQ ID NO: 66611 - protein, 28 aa, Artificial Sequence
  Description of Artificial Sequence: Synthetic peptide
AENEIACTNPVATEQYGEAGENLQRGGR

SEQ ID NO: 66612 - protein, 29 aa, Artificial Sequence
  Description of Artificial Sequence: Synthetic peptide
AENEIACTNPVATEQYGEASDNLQRGGMR

SEQ ID NO: 66613 - protein, 29 aa, Artificial Sequence
  Description of Artificial Sequence: Synthetic peptide
AENEIACTNPVATEQYGEAFSVNLQRGGR

SEQ ID NO: 66614 - protein, 33 aa, Artificial Sequence
  Description of Artificial Sequence: Synthetic polypeptide
AEEEIRTTNPVATEQYGSVSTVQNLNQTIATNE

SEQ ID NO: 66615 - protein, 29 aa, Artificial Sequence
  Description of Artificial Sequence: Synthetic peptide
AENEIACTNPVATEQYGEASDNLQRQGGR

SEQ ID NO: 66616 - protein, 28 aa, Artificial Sequence
  Description of Artificial Sequence: Synthetic peptide
AENEIACTNPVATEQYGEASENLQYGGR

SEQ ID NO: 66617 - protein, 33 aa, Artificial Sequence
  Description of Artificial Sequence: Synthetic polypeptide
DEEAIATTNPVATESYGSTVSCTNLSQRGGNQS

SEQ ID NO: 66618 - protein, 28 aa, Artificial Sequence
  Description of Artificial Sequence: Synthetic peptide
AENEIACTNPVATMQYGEASENLQRGGR

SEQ ID NO: 66619 - protein, 33 aa, Artificial Sequence
  Description of Artificial Sequence: Synthetic polypeptide
AEEEIRTTNPVATEQYGSVSTVQNLGQNNINNT

SEQ ID NO: 66620 - protein, 28 aa, Artificial Sequence
  Description of Artificial Sequence: Synthetic peptide
AENEIACTNPVATEQYGEASDNLQSGGR

SEQ ID NO: 66621 - protein, 33 aa, Artificial Sequence
  Description of Artificial Sequence: Synthetic polypeptide
DEEEIRATNPVATEQYGCVSMTNDFQGFGSNRF

SEQ ID NO: 66622 - protein, 28 aa, Artificial Sequence
  Description of Artificial Sequence: Synthetic peptide
AENEIACTNPVATEQYGEASENLQWGGR

SEQ ID NO: 66623 - protein, 32 aa, Artificial Sequence
  Description of Artificial Sequence: Synthetic polypeptide
DEEEIRCTNPVATEQYGSVSWGNHDRGSNTQM

SEQ ID NO: 66624 - protein, 28 aa, Artificial Sequence
  Description of Artificial Sequence: Synthetic peptide
AENEIACTNPVATECYGEASENLQRGGR

SEQ ID NO: 66625 - protein, 29 aa, Artificial Sequence
  Description of Artificial Sequence: Synthetic peptide
AENEIACTNPVATEQYGEASCNLEQRGGR

SEQ ID NO: 66626 - protein, 32 aa, Artificial Sequence
  Description of Artificial Sequence: Synthetic polypeptide
DEAEIRTTNPVATEPYGSVSTNLNQGEHNDQQ

SEQ ID NO: 66627 - protein, 33 aa, Artificial Sequence
  Description of Artificial Sequence: Synthetic polypeptide
DEAEIRTTNPVATEQYGVVVNQNLSQRGGENRC

SEQ ID NO: 66628 - protein, 33 aa, Artificial Sequence
  Description of Artificial Sequence: Synthetic polypeptide
DEDEIRTTNPVATERYGSVPSCTNMESQRENNR

SEQ ID NO: 66629 - protein, 32 aa, Artificial Sequence
  Description of Artificial Sequence: Synthetic polypeptide
AEDEIRTTNPVATEQYGSVSTTNNLQLIGSTV

SEQ ID NO: 66630 - protein, 31 aa, Artificial Sequence
  Description of Artificial Sequence: Synthetic polypeptide
DEECIRTTNPVAYEAYGKTVSTNASQNGNRW

SEQ ID NO: 66631 - protein, 31 aa, Artificial Sequence
  Description of Artificial Sequence: Synthetic polypeptide
DEEEICTTNPMATEMYGSVPTNDPQHAGNDR

SEQ ID NO: 66632 - protein, 32 aa, Artificial Sequence
  Description of Artificial Sequence: Synthetic polypeptide
AEDEIRTTNPVATEQYGSVSTTNQLQIGSTDQ

SEQ ID NO: 66633 - protein, 33 aa, Artificial Sequence
  Description of Artificial Sequence: Synthetic polypeptide
AEDEIRTTNPVATEQYGSVSTTNQLQQIGSNVT

SEQ ID NO: 66634 - protein, 33 aa, Artificial Sequence
  Description of Artificial Sequence: Synthetic polypeptide
DEEEIRATNPVATEQYGSVATNLQEAPGENGEE

SEQ ID NO: 66635 - protein, 32 aa, Artificial Sequence
  Description of Artificial Sequence: Synthetic polypeptide
AEDEIRTTNPVATEQYGSVSTTQNLQQIGSTV

SEQ ID NO: 66636 - protein, 30 aa, Artificial Sequence
  Description of Artificial Sequence: Synthetic polypeptide
DEAEIRTTNPVAYEAWGVVTTNLQDGDDNR

SEQ ID NO: 66637 - protein, 28 aa, Artificial Sequence
  Description of Artificial Sequence: Synthetic peptide
ADNEIACTNPVATEQYGEASFNLQRGGR

SEQ ID NO: 66638 - protein, 33 aa, Artificial Sequence
  Description of Artificial Sequence: Synthetic polypeptide
AEDEIRTTNPVATEQYGSVSTTTNLQQIGSNVQ

SEQ ID NO: 66639 - protein, 32 aa, Artificial Sequence
  Description of Artificial Sequence: Synthetic polypeptide
DEAEIRTTNPVATEQYGSVSPTNLETTGVSQG

SEQ ID NO: 66640 - protein, 28 aa, Artificial Sequence
  Description of Artificial Sequence: Synthetic peptide
ADNEIACTNPVATEQYGEASENLQRGGR

SEQ ID NO: 66641 - protein, 33 aa, Artificial Sequence
  Description of Artificial Sequence: Synthetic polypeptide
AEDEIRTTNPVATEQYGSVSTTNLQQIGESNVE

SEQ ID NO: 66642 - protein, 28 aa, Artificial Sequence
  Description of Artificial Sequence: Synthetic peptide
AEGEIACTNPCSTEQYGIVSCNLQRGGR

SEQ ID NO: 66643 - protein, 32 aa, Artificial Sequence
  Description of Artificial Sequence: Synthetic polypeptide
DEEEICTTNPAATEQYGSVVPTNLQMGGNGDT

SEQ ID NO: 66644 - protein, 28 aa, Artificial Sequence
  Description of Artificial Sequence: Synthetic peptide
AEGEIACTNPCATEQYGEASENLQRGTR

SEQ ID NO: 66645 - protein, 33 aa, Artificial Sequence
  Description of Artificial Sequence: Synthetic polypeptide
DEEEIGTTNPVATEQYGCVCSTNDLQNFGSNQS

SEQ ID NO: 66646 - protein, 29 aa, Artificial Sequence
  Description of Artificial Sequence: Synthetic peptide
AENEIACTNPVATEQYGEASENLDQRGGR

SEQ ID NO: 66647 - protein, 31 aa, Artificial Sequence
  Description of Artificial Sequence: Synthetic polypeptide
DEEEIRATNPVATEQYGSVATPNITAEGNDE

SEQ ID NO: 66648 - protein, 28 aa, Artificial Sequence
  Description of Artificial Sequence: Synthetic peptide
AENEIACTNPVATEQYGEASENLDRGGR

SEQ ID NO: 66649 - protein, 29 aa, Artificial Sequence
  Description of Artificial Sequence: Synthetic peptide
DDSEVACTNPVSTEQYGSVSAETLQRGNR

SEQ ID NO: 66650 - protein, 29 aa, Artificial Sequence
  Description of Artificial Sequence: Synthetic peptide
AEFEIACTNPVATEQYGEASENLQRPGGR

SEQ ID NO: 66651 - protein, 28 aa, Artificial Sequence
  Description of Artificial Sequence: Synthetic peptide
AENEIACTNPVATEQYGEASLNLQNGGR

SEQ ID NO: 66652 - protein, 28 aa, Artificial Sequence
  Description of Artificial Sequence: Synthetic peptide
AEFEIACTNPVATEQYGEASENLQRHGR

SEQ ID NO: 66653 - protein, 33 aa, Artificial Sequence
  Description of Artificial Sequence: Synthetic polypeptide
AEEEIRTTNPVATEQYGSVSTVTNLQNNNLVEL

SEQ ID NO: 66654 - protein, 30 aa, Artificial Sequence
  Description of Artificial Sequence: Synthetic polypeptide
DEEEIATVNPVCTEQYGVVSTDALQSGNPQ

SEQ ID NO: 66655 - protein, 31 aa, Artificial Sequence
  Description of Artificial Sequence: Synthetic polypeptide
DEEEICTTNPCATEQYGCVPTNLQEGGSNGQ

SEQ ID NO: 66656 - protein, 31 aa, Artificial Sequence
  Description of Artificial Sequence: Synthetic polypeptide
DEAEIRTTNPVATEQYGSVSPTNVDGMNSDQ

SEQ ID NO: 66657 - protein, 28 aa, Artificial Sequence
  Description of Artificial Sequence: Synthetic peptide
AEGEIACTNPVASEQYGEASCNLQRGGR

SEQ ID NO: 66658 - protein, 31 aa, Artificial Sequence
  Description of Artificial Sequence: Synthetic polypeptide
DEECIRTTNPVAYEAYGKTVSCTNAPQDGNR

SEQ ID NO: 66659 - protein, 28 aa, Artificial Sequence
  Description of Artificial Sequence: Synthetic peptide
AENEIACTNPVATEEYGIASENLQRGGR

SEQ ID NO: 66660 - protein, 29 aa, Artificial Sequence
  Description of Artificial Sequence: Synthetic peptide
AEGEIACTNPVATEQYGEASENLQREGGR

SEQ ID NO: 66661 - protein, 33 aa, Artificial Sequence
  Description of Artificial Sequence: Synthetic polypeptide
DEECIRTTNPVATEWWGVSIVVDSTNLQHRGTR

SEQ ID NO: 66662 - protein, 33 aa, Artificial Sequence
  Description of Artificial Sequence: Synthetic polypeptide
DEEEICTTNPMATEQYGSVPITMNLQQDHGNIR

SEQ ID NO: 66663 - protein, 35 aa, Artificial Sequence
  Description of Artificial Sequence: Synthetic polypeptide
DEAEIRTTNPVATEQYGCSVVACTNLSQRTGNNRE

SEQ ID NO: 66664 - protein, 29 aa, Artificial Sequence
  Description of Artificial Sequence: Synthetic peptide
DEECIRTTNPVAWEMYGQASTINVQGGNN

SEQ ID NO: 66665 - protein, 30 aa, Artificial Sequence
  Description of Artificial Sequence: Synthetic polypeptide
DEDQEIACTNPVAYEPYGSVATNLQRGNEM

SEQ ID NO: 66666 - protein, 30 aa, Artificial Sequence
  Description of Artificial Sequence: Synthetic polypeptide
DEDEIRTTNPVAYEQWGSVSTNDGHEGTER

SEQ ID NO: 66667 - protein, 28 aa, Artificial Sequence
  Description of Artificial Sequence: Synthetic peptide
AENEIACTNPVATEQYGEASENHQRGGR

SEQ ID NO: 66668 - protein, 28 aa, Artificial Sequence
  Description of Artificial Sequence: Synthetic peptide
ADNEIASTNPVATEQYGNASENLQRGQR

SEQ ID NO: 66669 - protein, 32 aa, Artificial Sequence
  Description of Artificial Sequence: Synthetic polypeptide
DEECIRTTNPVAWEQYGQVSTINDGGQRGGNN

SEQ ID NO: 66670 - protein, 30 aa, Artificial Sequence
  Description of Artificial Sequence: Synthetic polypeptide
DEDKIRTTNPVATEQYGCVETNPQGGTNPN

SEQ ID NO: 66671 - protein, 28 aa, Artificial Sequence
  Description of Artificial Sequence: Synthetic peptide
AENEIACTNPVCTEQYGEASDNLQRGGR

SEQ ID NO: 66672 - protein, 32 aa, Artificial Sequence
  Description of Artificial Sequence: Synthetic polypeptide
DEECIRTTNPVAWEQYGQVSTINDGQRQGNTN

SEQ ID NO: 66673 - protein, 28 aa, Artificial Sequence
  Description of Artificial Sequence: Synthetic peptide
AENEIACTNPVATEFYGEASENLQRGGR

SEQ ID NO: 66674 - protein, 30 aa, Artificial Sequence
  Description of Artificial Sequence: Synthetic polypeptide
DEEEIRATNPVATEQYGSVATNLEDNPTQN

SEQ ID NO: 66675 - protein, 28 aa, Artificial Sequence
  Description of Artificial Sequence: Synthetic peptide
ADNEIASTNPVATEQYGEASENLQRGGR

SEQ ID NO: 66676 - protein, 28 aa, Artificial Sequence
  Description of Artificial Sequence: Synthetic peptide
AENEIACTNPVATEQYGEASENIQRGGR

SEQ ID NO: 66677 - protein, 28 aa, Artificial Sequence
  Description of Artificial Sequence: Synthetic peptide
AENEIACTNPVATEQYGEASENKQRGGR

SEQ ID NO: 66678 - protein, 30 aa, Artificial Sequence
  Description of Artificial Sequence: Synthetic polypeptide
DEEEICTTNPMATENYGSVPTNPMHAGNGR

SEQ ID NO: 66679 - protein, 28 aa, Artificial Sequence
  Description of Artificial Sequence: Synthetic peptide
ADNEIACTNPVATEQYGNVSETLQRGGR

SEQ ID NO: 66680 - protein, 33 aa, Artificial Sequence
  Description of Artificial Sequence: Synthetic polypeptide
DEAEIRTTNPVATEQYGSVAPTNPLPESGPNPR

SEQ ID NO: 66681 - protein, 33 aa, Artificial Sequence
  Description of Artificial Sequence: Synthetic polypeptide
AEEEIRTTNPVATEQYGSVSTVNNQQQGVNAES

SEQ ID NO: 66682 - protein, 28 aa, Artificial Sequence
  Description of Artificial Sequence: Synthetic peptide
AEGEIACTNPVATEQYGEASENLERGGR

SEQ ID NO: 66683 - protein, 28 aa, Artificial Sequence
  Description of Artificial Sequence: Synthetic peptide
AENEIACTNPVATEQYGEAAENLQRGGR

SEQ ID NO: 66684 - protein, 29 aa, Artificial Sequence
  Description of Artificial Sequence: Synthetic peptide
ADNEIACTNPVATEQYGEVSENLQSRGGR

SEQ ID NO: 66685 - protein, 31 aa, Artificial Sequence
  Description of Artificial Sequence: Synthetic polypeptide
DEECIRTTNPVAWEQYGQVSTINVGDRGNNQ

SEQ ID NO: 66686 - protein, 29 aa, Artificial Sequence
  Description of Artificial Sequence: Synthetic peptide
DEEEIATVNPVCTEQYGVVSMENIQSGNH

SEQ ID NO: 66687 - protein, 29 aa, Artificial Sequence
  Description of Artificial Sequence: Synthetic peptide
DEEEIATVNPVCTEQYGVVSDENIQSGNH

SEQ ID NO: 66688 - protein, 33 aa, Artificial Sequence
  Description of Artificial Sequence: Synthetic polypeptide
DEEEIKTTNPVAYEAYGQSVVSTNLQGTGTNNR

SEQ ID NO: 66689 - protein, 30 aa, Artificial Sequence
  Description of Artificial Sequence: Synthetic polypeptide
DEEEIATVNPVATEQYGSVATGLQEANNQE

SEQ ID NO: 66690 - protein, 31 aa, Artificial Sequence
  Description of Artificial Sequence: Synthetic polypeptide
DEAEIRTTNPVAYECWGSVSTNLQLGGDNDH

SEQ ID NO: 66691 - protein, 28 aa, Artificial Sequence
  Description of Artificial Sequence: Synthetic peptide
AENEIACTNPVATEGYGEASENLQRGGR

SEQ ID NO: 66692 - protein, 32 aa, Artificial Sequence
  Description of Artificial Sequence: Synthetic polypeptide
DEAEIRTTNPVATEQYGSFDSYTNISQNGNQN

SEQ ID NO: 66693 - protein, 33 aa, Artificial Sequence
  Description of Artificial Sequence: Synthetic polypeptide
DEEEIRCTNPVATEQYGSVSSTTPALNRGMNPV

SEQ ID NO: 66694 - protein, 29 aa, Artificial Sequence
  Description of Artificial Sequence: Synthetic peptide
AENEIACTNPVATEQYGDASENNLQRGGR

SEQ ID NO: 66695 - protein, 28 aa, Artificial Sequence
  Description of Artificial Sequence: Synthetic peptide
AENEIACTNPVATEQYGDASENLQRGGA

SEQ ID NO: 66696 - protein, 28 aa, Artificial Sequence
  Description of Artificial Sequence: Synthetic peptide
AENEIACTNPVATEQYGDASENLQRGDA

SEQ ID NO: 66697 - protein, 28 aa, Artificial Sequence
  Description of Artificial Sequence: Synthetic peptide
AENEIACTNPVATEQYGDASENLQREGR

SEQ ID NO: 66698 - protein, 28 aa, Artificial Sequence
  Description of Artificial Sequence: Synthetic peptide
AENEIACTNPVATEQYGDASENLQREDR

SEQ ID NO: 66699 - protein, 28 aa, Artificial Sequence
  Description of Artificial Sequence: Synthetic peptide
AENEIACTNPVCTEQYGEASFNLQRGGR

SEQ ID NO: 66700 - protein, 28 aa, Artificial Sequence
  Description of Artificial Sequence: Synthetic peptide
AENEIACTNPVCTEQYGVASENLQRGGR

SEQ ID NO: 66701 - protein, 32 aa, Artificial Sequence
  Description of Artificial Sequence: Synthetic polypeptide
CEEEIRTTNPVATEQYGHVEWTGLQNRGMNDE

SEQ ID NO: 66702 - protein, 28 aa, Artificial Sequence
  Description of Artificial Sequence: Synthetic peptide
AENEIACTNPVATEGYGEASLNLQRGGR

SEQ ID NO: 66703 - protein, 29 aa, Artificial Sequence
  Description of Artificial Sequence: Synthetic peptide
AENEIACTNPVATEQYGDASENLQRAGGR

SEQ ID NO: 66704 - protein, 33 aa, Artificial Sequence
  Description of Artificial Sequence: Synthetic polypeptide
DEEEIRGTNPVATEQYGSVYSTQDMLQCENQAR

SEQ ID NO: 66705 - protein, 32 aa, Artificial Sequence
  Description of Artificial Sequence: Synthetic polypeptide
DEEEIRTTNPVATECYGSVSTCGPNMRGMNPV

SEQ ID NO: 66706 - protein, 31 aa, Artificial Sequence
  Description of Artificial Sequence: Synthetic polypeptide
DEDEIRTTNPVAYEQWGSVSTNLNAGDGNEA

SEQ ID NO: 66707 - protein, 32 aa, Artificial Sequence
  Description of Artificial Sequence: Synthetic polypeptide
DEEEIRTTNPVATEGYGICVSTVEHQDRISNR

SEQ ID NO: 66708 - protein, 31 aa, Artificial Sequence
  Description of Artificial Sequence: Synthetic polypeptide
DEDEIRTTNPVAYEQWGSVSTNLNAGDGNTD

SEQ ID NO: 66709 - protein, 34 aa, Artificial Sequence
  Description of Artificial Sequence: Synthetic polypeptide
DEEEIRTTNPVATECYGSVSTCINEPQDREGMNG

SEQ ID NO: 66710 - protein, 28 aa, Artificial Sequence
  Description of Artificial Sequence: Synthetic peptide
AENEIACTNPVATEGYGEMSENLQRGGR

SEQ ID NO: 66711 - protein, 33 aa, Artificial Sequence
  Description of Artificial Sequence: Synthetic polypeptide
DEEEIRTTNPVATEGYGICVSTVNLQERISNTQ

SEQ ID NO: 66712 - protein, 33 aa, Artificial Sequence
  Description of Artificial Sequence: Synthetic polypeptide
DEEEIRTTNPVATEGYGICVTSTVNLQERISNA

SEQ ID NO: 66713 - protein, 30 aa, Artificial Sequence
  Description of Artificial Sequence: Synthetic polypeptide
DEEEIATTNPVSTEQYGSVTFNDLQGGQGT

SEQ ID NO: 66714 - protein, 29 aa, Artificial Sequence
  Description of Artificial Sequence: Synthetic peptide
AENEIACTNPVATEQYGEASENLKQRGGR

SEQ ID NO: 66715 - protein, 31 aa, Artificial Sequence
  Description of Artificial Sequence: Synthetic polypeptide
DEEEIRCTNPVATECWGSVSCNEMDREGENR

SEQ ID NO: 66716 - protein, 30 aa, Artificial Sequence
  Description of Artificial Sequence: Synthetic polypeptide
DEEEIATVNPVATEQYGSVATGLQSAENQE

SEQ ID NO: 66717 - protein, 32 aa, Artificial Sequence
  Description of Artificial Sequence: Synthetic polypeptide
DEEEIRCTNPVATECYGSVSCINEPMDREGNR

SEQ ID NO: 66718 - protein, 31 aa, Artificial Sequence
  Description of Artificial Sequence: Synthetic polypeptide
AENEIACTNPVATEQYGEASSTTPNLQRGNR

SEQ ID NO: 66719 - protein, 29 aa, Artificial Sequence
  Description of Artificial Sequence: Synthetic peptide
DEEEIATVNPVCTEQYGVVSDALQSGNPQ

SEQ ID NO: 66720 - protein, 29 aa, Artificial Sequence
  Description of Artificial Sequence: Synthetic peptide
DEEEIATVNPVCTEQYGTVSMENIQSGNH

SEQ ID NO: 66721 - protein, 28 aa, Artificial Sequence
  Description of Artificial Sequence: Synthetic peptide
AENEIACTNPVCTEQYGEASENLQRGGR

SEQ ID NO: 66722 - protein, 30 aa, Artificial Sequence
  Description of Artificial Sequence: Synthetic polypeptide
DEDEIRTTNPVAYEQWGSVSTNDGHEQGNA

SEQ ID NO: 66723 - protein, 31 aa, Artificial Sequence
  Description of Artificial Sequence: Synthetic polypeptide
DEECIRTTNPVAYEPYGATVSCTNASQDGNR

SEQ ID NO: 66724 - protein, 31 aa, Artificial Sequence
  Description of Artificial Sequence: Synthetic polypeptide
DEECIRTTNPVAYEPYGQVATNFSQRNGGNR

SEQ ID NO: 66725 - protein, 31 aa, Artificial Sequence
  Description of Artificial Sequence: Synthetic polypeptide
CEEEIRTTNPVATEQYGCVSTYHQRFNSNQD

SEQ ID NO: 66726 - protein, 30 aa, Artificial Sequence
  Description of Artificial Sequence: Synthetic polypeptide
AEETISTTNPVATEQYGSVSEMNSQRLENS

SEQ ID NO: 66727 - protein, 31 aa, Artificial Sequence
  Description of Artificial Sequence: Synthetic polypeptide
DEDEIRTTNPVAYEQWGSVSTNDQQSGGDAR

SEQ ID NO: 66728 - protein, 32 aa, Artificial Sequence
  Description of Artificial Sequence: Synthetic polypeptide
DEEEIRGTNPVATEQYGSVTSPNQLDVMGNVE

SEQ ID NO: 66729 - protein, 31 aa, Artificial Sequence
  Description of Artificial Sequence: Synthetic polypeptide
DEEEIATVNPVATEQYGVVSSDNLQMSNGNQ

SEQ ID NO: 66730 - protein, 30 aa, Artificial Sequence
  Description of Artificial Sequence: Synthetic polypeptide
DEEEIATVNPVATEQYGVVSATDLESEGNQ

SEQ ID NO: 66731 - protein, 28 aa, Artificial Sequence
  Description of Artificial Sequence: Synthetic peptide
AENEIACTNPVATEQYGDVSENLQHGGL

SEQ ID NO: 66732 - protein, 32 aa, Artificial Sequence
  Description of Artificial Sequence: Synthetic polypeptide
DEEEIATVNPVATEQYGSVSSTDAGQRNGMNV

SEQ ID NO: 66733 - protein, 31 aa, Artificial Sequence
  Description of Artificial Sequence: Synthetic polypeptide
AEDEIRTTNPVATEQYGSVTTNLQLIGSTVT

SEQ ID NO: 66734 - protein, 31 aa, Artificial Sequence
  Description of Artificial Sequence: Synthetic polypeptide
AEDEIRTTNPVATEQYGSVTVTNNLQIGSTV

SEQ ID NO: 66735 - protein, 30 aa, Artificial Sequence
  Description of Artificial Sequence: Synthetic polypeptide
DEEEIATVNPVATEQYGSVSADDLQSGEDL

SEQ ID NO: 66736 - protein, 29 aa, Artificial Sequence
  Description of Artificial Sequence: Synthetic peptide
AENEIACTNPVATEQYGEASENLEQRGGR

SEQ ID NO: 66737 - protein, 28 aa, Artificial Sequence
  Description of Artificial Sequence: Synthetic peptide
AEESIATTNPVATEQYGCVATNLTMLER

SEQ ID NO: 66738 - protein, 29 aa, Artificial Sequence
  Description of Artificial Sequence: Synthetic peptide
AENEIACTNPVATEQYGDVSENLMRAGDR

SEQ ID NO: 66739 - protein, 31 aa, Artificial Sequence
  Description of Artificial Sequence: Synthetic polypeptide
DEEEIRATNPVATEQYGSVATTNDTHGENDQ

SEQ ID NO: 66740 - protein, 30 aa, Artificial Sequence
  Description of Artificial Sequence: Synthetic polypeptide
AEESIATTNPVATECYGSVATAGLQNRGNM

SEQ ID NO: 66741 - protein, 32 aa, Artificial Sequence
  Description of Artificial Sequence: Synthetic polypeptide
DEAEIRTTNPVATEQYGSVSPTVNVQRNDDEE

SEQ ID NO: 66742 - protein, 31 aa, Artificial Sequence
  Description of Artificial Sequence: Synthetic polypeptide
DEEEIATVNPVATEQYGSVATGLQSRNNQEQ

SEQ ID NO: 66743 - protein, 33 aa, Artificial Sequence
  Description of Artificial Sequence: Synthetic polypeptide
DEEAIRTTNPVATEWYGSVSVTNNLNQMGTNMM

SEQ ID NO: 66744 - protein, 34 aa, Artificial Sequence
  Description of Artificial Sequence: Synthetic polypeptide
AEEEIRTTNPVATEQYGSVSTVTNLQQGEEGNNN

SEQ ID NO: 66745 - protein, 28 aa, Artificial Sequence
  Description of Artificial Sequence: Synthetic peptide
AENEIACTNPVATEQYGEASENLERGGR

SEQ ID NO: 66746 - protein, 34 aa, Artificial Sequence
  Description of Artificial Sequence: Synthetic polypeptide
DEEEICTTNPMATEQYGSVPTNALSQNRTGGNNR

SEQ ID NO: 66747 - protein, 34 aa, Artificial Sequence
  Description of Artificial Sequence: Synthetic polypeptide
DEEEICTTNPMATEQYGSVVPCTNALSQNRGNNR

SEQ ID NO: 66748 - protein, 32 aa, Artificial Sequence
  Description of Artificial Sequence: Synthetic polypeptide
DEEEIRATNPVATEQYGSVAANLQESNDNTRT

SEQ ID NO: 66749 - protein, 33 aa, Artificial Sequence
  Description of Artificial Sequence: Synthetic polypeptide
AEEEIRTTNPVATEQYGSVSTVNQEQGNGGNDT

SEQ ID NO: 66750 - protein, 29 aa, Artificial Sequence
  Description of Artificial Sequence: Synthetic peptide
DEDVIRTTNPVATEQYGAVEVNPQGGTNQ

SEQ ID NO: 66751 - protein, 31 aa, Artificial Sequence
  Description of Artificial Sequence: Synthetic polypeptide
DEECIRTTNPVATEQYGSVCSTEHQSFGSED

SEQ ID NO: 66752 - protein, 31 aa, Artificial Sequence
  Description of Artificial Sequence: Synthetic polypeptide
AEDEIRATNPVATEQYGSVETTNLQQSGTNQ

SEQ ID NO: 66753 - protein, 33 aa, Artificial Sequence
  Description of Artificial Sequence: Synthetic polypeptide
DEDEIRTTNPVAYEQWGSVSTGNLPQQGADNQR

SEQ ID NO: 66754 - protein, 31 aa, Artificial Sequence
  Description of Artificial Sequence: Synthetic polypeptide
AEDEIRATNPVATEQYGSVETTNNLQSGNNQ

SEQ ID NO: 66755 - protein, 32 aa, Artificial Sequence
  Description of Artificial Sequence: Synthetic polypeptide
AEDEIRATNPVATEQYGSVSETNLQSGTNNQD

SEQ ID NO: 66756 - protein, 32 aa, Artificial Sequence
  Description of Artificial Sequence: Synthetic polypeptide
DEAEIRTTNPVATEYYGEVSTNLQANGGDNND

SEQ ID NO: 66757 - protein, 32 aa, Artificial Sequence
  Description of Artificial Sequence: Synthetic polypeptide
DEEEICTTNPVATEAYGSVSCQNDSQPPGTNR

SEQ ID NO: 66758 - protein, 32 aa, Artificial Sequence
  Description of Artificial Sequence: Synthetic polypeptide
DEAEIRTTNPVATEFWGSVSTNLQANGNDDDD

SEQ ID NO: 66759 - protein, 30 aa, Artificial Sequence
  Description of Artificial Sequence: Synthetic polypeptide
DDSDIRTTNPVATEQYGKVSTNHQRVVDNL

SEQ ID NO: 66760 - protein, 28 aa, Artificial Sequence
  Description of Artificial Sequence: Synthetic peptide
AENEIACTNPVATEQYGETSENLQRGGN

SEQ ID NO: 66761 - protein, 31 aa, Artificial Sequence
  Description of Artificial Sequence: Synthetic polypeptide
DEECIRTTNPVATEQYGSVSAGNDINPDPNR

SEQ ID NO: 66762 - protein, 30 aa, Artificial Sequence
  Description of Artificial Sequence: Synthetic polypeptide
DEAEIRTTNPVATEYWGCVSTNLQHNGDTD

SEQ ID NO: 66763 - protein, 34 aa, Artificial Sequence
  Description of Artificial Sequence: Synthetic polypeptide
DEECIRTTNPVATEQYGSVSCTNMLRDDNGQNRQ

SEQ ID NO: 66764 - protein, 34 aa, Artificial Sequence
  Description of Artificial Sequence: Synthetic polypeptide
DEECIRTTNPVATEQYGSVSCTNMLRDTNGQNDR

SEQ ID NO: 66765 - protein, 28 aa, Artificial Sequence
  Description of Artificial Sequence: Synthetic peptide
ADNEIASTNPVATEQYGNVSENIQRGQR

SEQ ID NO: 66766 - protein, 34 aa, Artificial Sequence
  Description of Artificial Sequence: Synthetic polypeptide
DEECIRTTNPVATEQYGSVSCTNQLRDNDGQNQR

SEQ ID NO: 66767 - protein, 32 aa, Artificial Sequence
  Description of Artificial Sequence: Synthetic polypeptide
AEEEIRTTNPVATEQYGSVSTVNQNQQQTNDN

SEQ ID NO: 66768 - protein, 32 aa, Artificial Sequence
  Description of Artificial Sequence: Synthetic polypeptide
DEECIRTTNPVATEQYGSVSKTLEELRGGNET

SEQ ID NO: 66769 - protein, 32 aa, Artificial Sequence
  Description of Artificial Sequence: Synthetic polypeptide
DEAEIRTTNPVATECYGSVSTNLQGNDGDGEA

SEQ ID NO: 66770 - protein, 31 aa, Artificial Sequence
  Description of Artificial Sequence: Synthetic polypeptide
DEDEIRTTNPVAYEQWGSVSTGNNGDRGPNS

SEQ ID NO: 66771 - protein, 29 aa, Artificial Sequence
  Description of Artificial Sequence: Synthetic peptide
AEHEIACTNPVATEQYWGEASENLQRGGR

SEQ ID NO: 66772 - protein, 31 aa, Artificial Sequence
  Description of Artificial Sequence: Synthetic polypeptide
DEAEIRTTNPVATEYYGVCQVSTELQAFNRV

SEQ ID NO: 66773 - protein, 34 aa, Artificial Sequence
  Description of Artificial Sequence: Synthetic polypeptide
DEEEIRTTNPVATECYGSVSSTINEPQDREGENG

SEQ ID NO: 66774 - protein, 32 aa, Artificial Sequence
  Description of Artificial Sequence: Synthetic polypeptide
DEAEIRTTNPVATEQYGSVSTTPDDQGQGNQK

SEQ ID NO: 66775 - protein, 32 aa, Artificial Sequence
  Description of Artificial Sequence: Synthetic polypeptide
DEECIRTTNPVATEQYGSVSYLNLGFEGVNIN

SEQ ID NO: 66776 - protein, 33 aa, Artificial Sequence
  Description of Artificial Sequence: Synthetic polypeptide
DEECIRTTNPVATEQYGSVSCTNMLRDNDQNER

SEQ ID NO: 66777 - protein, 28 aa, Artificial Sequence
  Description of Artificial Sequence: Synthetic peptide
AENEIACTNPVATEQYGEASENAQRGGR

SEQ ID NO: 66778 - protein, 31 aa, Artificial Sequence
  Description of Artificial Sequence: Synthetic polypeptide
AEDEIRATNPVATEQYGSVETNLQSGVNNQN

SEQ ID NO: 66779 - protein, 31 aa, Artificial Sequence
  Description of Artificial Sequence: Synthetic polypeptide
DEDVVIATTNPVATEQWGSVSTDGLQRGDND

SEQ ID NO: 66780 - protein, 31 aa, Artificial Sequence
  Description of Artificial Sequence: Synthetic polypeptide
DEDEIRTTNPVAYEQWGEVSTNLQHQGGNDM

SEQ ID NO: 66781 - protein, 28 aa, Artificial Sequence
  Description of Artificial Sequence: Synthetic peptide
AENEIACTNPVAWEQYGERSENLQRGGR

SEQ ID NO: 66782 - protein, 32 aa, Artificial Sequence
  Description of Artificial Sequence: Synthetic polypeptide
DEEEIRATNPVATEQYGNVSMTNTQGQQQNER

SEQ ID NO: 66783 - protein, 28 aa, Artificial Sequence
  Description of Artificial Sequence: Synthetic peptide
AENEIACTNPVAWEQYGIASENLQRGGR

SEQ ID NO: 66784 - protein, 31 aa, Artificial Sequence
  Description of Artificial Sequence: Synthetic polypeptide
DEEEIRATNPVATEQYGNVSSTVEVQVGNVP

SEQ ID NO: 66785 - protein, 31 aa, Artificial Sequence
  Description of Artificial Sequence: Synthetic polypeptide
DEAEIRTTNPVATEQYGYTISFNELQRGFEH

SEQ ID NO: 66786 - protein, 33 aa, Artificial Sequence
  Description of Artificial Sequence: Synthetic polypeptide
DEAEIRTTNPVATEQYGYTISYNELTQRGQNRF

SEQ ID NO: 66787 - protein, 33 aa, Artificial Sequence
  Description of Artificial Sequence: Synthetic polypeptide
DEDEIRTTNPVATEQYGVVVTVSTNLQAGNTTS

SEQ ID NO: 66788 - protein, 28 aa, Artificial Sequence
  Description of Artificial Sequence: Synthetic peptide
AENEIACTNPVATEQYGEASELLQRGGR

SEQ ID NO: 66789 - protein, 32 aa, Artificial Sequence
  Description of Artificial Sequence: Synthetic polypeptide
DEDEIRTTNPVATEQYGVVTVSTTNLQAGTGS

SEQ ID NO: 66790 - protein, 32 aa, Artificial Sequence
  Description of Artificial Sequence: Synthetic polypeptide
AEEEIRTTNPVATEQYGSVSTVNQQQEENDEG

SEQ ID NO: 66791 - protein, 32 aa, Artificial Sequence
  Description of Artificial Sequence: Synthetic polypeptide
DEDEIRTTNPVATEQYGVVTTSVTNLQAGTTS

SEQ ID NO: 66792 - protein, 33 aa, Artificial Sequence
  Description of Artificial Sequence: Synthetic polypeptide
DEEEIRTTNPVATEGYGCVCSTGNHQNFGSNNR

SEQ ID NO: 66793 - protein, 33 aa, Artificial Sequence
  Description of Artificial Sequence: Synthetic polypeptide
DEAEIRTTNPVATEQYGSVCSMNELETRGNNEG

SEQ ID NO: 66794 - protein, 29 aa, Artificial Sequence
  Description of Artificial Sequence: Synthetic peptide
AELEIACTNPVATEQYGEASENLQRGKGR

SEQ ID NO: 66795 - protein, 29 aa, Artificial Sequence
  Description of Artificial Sequence: Synthetic peptide
AELEIACTNPVATEQYGEASENLQRGGKR

SEQ ID NO: 66796 - protein, 28 aa, Artificial Sequence
  Description of Artificial Sequence: Synthetic peptide
AENEIACTNPVATEQYGEASELLQRGSR

SEQ ID NO: 66797 - protein, 29 aa, Artificial Sequence
  Description of Artificial Sequence: Synthetic peptide
AEKEIACTNPVATEQYGEASENLQREGGR

SEQ ID NO: 66798 - protein, 29 aa, Artificial Sequence
  Description of Artificial Sequence: Synthetic peptide
DDSEIACTNPVATEQYGNVSANTIQRGGR

SEQ ID NO: 66799 - protein, 29 aa, Artificial Sequence
  Description of Artificial Sequence: Synthetic peptide
AEIEIACTNPVATEQYGEASENLKQRGGR

SEQ ID NO: 66800 - protein, 34 aa, Artificial Sequence
  Description of Artificial Sequence: Synthetic polypeptide
DEEAIRTTNPVATEQYGSVSTNDLQTGVVQDERF

SEQ ID NO: 66801 - protein, 32 aa, Artificial Sequence
  Description of Artificial Sequence: Synthetic polypeptide
DEAEIRTTNPVATEQYGSVSTTPDGQQNGNQK

SEQ ID NO: 66802 - protein, 30 aa, Artificial Sequence
  Description of Artificial Sequence: Synthetic polypeptide
DDSEIACTNPVATEQYGNVSAETLQSRGNR

SEQ ID NO: 66803 - protein, 32 aa, Artificial Sequence
  Description of Artificial Sequence: Synthetic polypeptide
CEEEIRTTNPVGTERYGESVSTNATSQRGDRM

SEQ ID NO: 66804 - protein, 30 aa, Artificial Sequence
  Description of Artificial Sequence: Synthetic polypeptide
DDSEIACTNPVATEQYGNVAANTLQSRGNR

SEQ ID NO: 66805 - protein, 31 aa, Artificial Sequence
  Description of Artificial Sequence: Synthetic polypeptide
AEDEIRATNPVATEQYGSVETNLQQSGNNQG

SEQ ID NO: 66806 - protein, 32 aa, Artificial Sequence
  Description of Artificial Sequence: Synthetic polypeptide
DEAEIRTTNPVATETYGEVSTNLQGDVGGNQQ

SEQ ID NO: 66807 - protein, 32 aa, Artificial Sequence
  Description of Artificial Sequence: Synthetic polypeptide
DEAEIRTTNPVATEYYGVVSTNLQANGDNGDD

SEQ ID NO: 66808 - protein, 31 aa, Artificial Sequence
  Description of Artificial Sequence: Synthetic polypeptide
CEEEISTTNPVATEQYGCVSTNLQNFFSNQA

SEQ ID NO: 66809 - protein, 34 aa, Artificial Sequence
  Description of Artificial Sequence: Synthetic polypeptide
DEEEIRTTNPVATECYGSVSSTINGPQMREGENG

SEQ ID NO: 66810 - protein, 29 aa, Artificial Sequence
  Description of Artificial Sequence: Synthetic peptide
DEAEIRTTNPVATECYGKHSTIEQRTQNE

SEQ ID NO: 66811 - protein, 32 aa, Artificial Sequence
  Description of Artificial Sequence: Synthetic polypeptide
CEEEIRTTNPVAYEQYGQVSCTFLSGRTGGNR

SEQ ID NO: 66812 - protein, 28 aa, Artificial Sequence
  Description of Artificial Sequence: Synthetic peptide
AENEIACTNPVATEQYGEASENDQRGTR

SEQ ID NO: 66813 - protein, 35 aa, Artificial Sequence
  Description of Artificial Sequence: Synthetic polypeptide
DEAEIRTTNPVATEQYGCSVACTGNLSQRGGNLRE

SEQ ID NO: 66814 - protein, 34 aa, Artificial Sequence
  Description of Artificial Sequence: Synthetic polypeptide
AEEEIRTTNPVATEQYGSVSTVNQLQTGNGTTTT

SEQ ID NO: 66815 - protein, 31 aa, Artificial Sequence
  Description of Artificial Sequence: Synthetic polypeptide
DEEEICTTNPMATETYGSVPTNLQHVGGTDR

SEQ ID NO: 66816 - protein, 30 aa, Artificial Sequence
  Description of Artificial Sequence: Synthetic polypeptide
DEEEICTTNPMATETYGSVPTNLQHAGTDE

SEQ ID NO: 66817 - protein, 29 aa, Artificial Sequence
  Description of Artificial Sequence: Synthetic peptide
AENEIACTNPVATEQYGETSENLQARGGR

SEQ ID NO: 66818 - protein, 32 aa, Artificial Sequence
  Description of Artificial Sequence: Synthetic polypeptide
DEAEIRTTNPVATEQYGSVCNTFNLYGRETDR

SEQ ID NO: 66819 - protein, 34 aa, Artificial Sequence
  Description of Artificial Sequence: Synthetic polypeptide
DEAEIRTTNPVATEQYGCSVACTNELSQRGGERE

SEQ ID NO: 66820 - protein, 34 aa, Artificial Sequence
  Description of Artificial Sequence: Synthetic polypeptide
DEAEIRTTNPVATEQYGCSVACTNLSQRTGGNPE

SEQ ID NO: 66821 - protein, 28 aa, Artificial Sequence
  Description of Artificial Sequence: Synthetic peptide
AENEIACTNPVATECYGEVSENLQRGGL

SEQ ID NO: 66822 - protein, 28 aa, Artificial Sequence
  Description of Artificial Sequence: Synthetic peptide
AENEIACTNPVAYEQYGEISENLQRGGR

SEQ ID NO: 66823 - protein, 28 aa, Artificial Sequence
  Description of Artificial Sequence: Synthetic peptide
AENEIACTNPVATEQYGEASENDQRGGR

SEQ ID NO: 66824 - protein, 28 aa, Artificial Sequence
  Description of Artificial Sequence: Synthetic peptide
AENEIACTNPVATECYGTASENLQRGGR

SEQ ID NO: 66825 - protein, 33 aa, Artificial Sequence
  Description of Artificial Sequence: Synthetic polypeptide
DEAEIRTTNPVATEQYGSVSTTNHQTDFGGTNQ

SEQ ID NO: 66826 - protein, 31 aa, Artificial Sequence
  Description of Artificial Sequence: Synthetic polypeptide
DEDEIRTTNPVAYEQWGNVSTNLQGQGDNNA

SEQ ID NO: 66827 - protein, 28 aa, Artificial Sequence
  Description of Artificial Sequence: Synthetic peptide
AENEIACTNPVATEQYGEASENFQRGGR

SEQ ID NO: 66828 - protein, 35 aa, Artificial Sequence
  Description of Artificial Sequence: Synthetic polypeptide
DEAEIRTTNPVATEQYGCSVQACTNLSQRGGNNRE

SEQ ID NO: 66829 - protein, 33 aa, Artificial Sequence
  Description of Artificial Sequence: Synthetic polypeptide
DEAEIRTTNPVATEQYGSVSTTNHNGQDGGQNM

SEQ ID NO: 66830 - protein, 32 aa, Artificial Sequence
  Description of Artificial Sequence: Synthetic polypeptide
DEECIRTTNPVATEQYYASVCSWNDQRFGDNQ

SEQ ID NO: 66831 - protein, 33 aa, Artificial Sequence
  Description of Artificial Sequence: Synthetic polypeptide
AEEEIRTTNPVATEQYGSVSTVNQLGENNQGNQ

SEQ ID NO: 66832 - protein, 28 aa, Artificial Sequence
  Description of Artificial Sequence: Synthetic peptide
AENEIACTNPVATEQYGEASENGQRGGR

SEQ ID NO: 66833 - protein, 28 aa, Artificial Sequence
  Description of Artificial Sequence: Synthetic peptide
AENEIACTNPVATEQYGEASENGQRGQR

SEQ ID NO: 66834 - protein, 33 aa, Artificial Sequence
  Description of Artificial Sequence: Synthetic polypeptide
DEEEICTTNPMATETYGSVPTENDLQHRGQNTR

SEQ ID NO: 66835 - protein, 28 aa, Artificial Sequence
  Description of Artificial Sequence: Synthetic peptide
AENEIACTNPVATEEYGEASENLQRGGR

SEQ ID NO: 66836 - protein, 31 aa, Artificial Sequence
  Description of Artificial Sequence: Synthetic polypeptide
DEAEIRTTNPVATEQYGSCSTTNLDNLEEDR

SEQ ID NO: 66837 - protein, 28 aa, Artificial Sequence
  Description of Artificial Sequence: Synthetic peptide
AENEIACTNPVATEQYGEASENEQRGGR

SEQ ID NO: 66838 - protein, 28 aa, Artificial Sequence
  Description of Artificial Sequence: Synthetic peptide
AENEIACTNPVATEQYGEAAENLQRGSR

SEQ ID NO: 66839 - protein, 34 aa, Artificial Sequence
  Description of Artificial Sequence: Synthetic polypeptide
DEAEIRTTNPVATEQYGCSTVAVTNLSQRGGNEE

SEQ ID NO: 66840 - protein, 28 aa, Artificial Sequence
  Description of Artificial Sequence: Synthetic peptide
AENEIACTNPVAYEQYGEASENLQRGGR

SEQ ID NO: 66841 - protein, 28 aa, Artificial Sequence
  Description of Artificial Sequence: Synthetic peptide
AEHEIACTNPVATEQYGEASENLQRPGR

SEQ ID NO: 66842 - protein, 34 aa, Artificial Sequence
  Description of Artificial Sequence: Synthetic polypeptide
DEEEIRTTNPVATECYGSVSSTINGPQMRNGENG

SEQ ID NO: 66843 - protein, 34 aa, Artificial Sequence
  Description of Artificial Sequence: Synthetic polypeptide
DEEAIRTTNPVATEQYGSVVSTGNEQSQTTGNNR

SEQ ID NO: 66844 - protein, 28 aa, Artificial Sequence
  Description of Artificial Sequence: Synthetic peptide
AENEIACTNPVAYEQYGEASDNLQRGGR

SEQ ID NO: 66845 - protein, 28 aa, Artificial Sequence
  Description of Artificial Sequence: Synthetic peptide
AENEIACTNPVATEQYGEASENCQRGGR

SEQ ID NO: 66846 - protein, 30 aa, Artificial Sequence
  Description of Artificial Sequence: Synthetic polypeptide
DEAEIRTTNPVATKHYGSVSTDNLQETEEM

SEQ ID NO: 66847 - protein, 31 aa, Artificial Sequence
  Description of Artificial Sequence: Synthetic polypeptide
DEAEIRTTNPVATKHYGSVSTLNLETRGTDM

SEQ ID NO: 66848 - protein, 32 aa, Artificial Sequence
  Description of Artificial Sequence: Synthetic polypeptide
DEEEICTTNPVATEAYGSTVSCTNDSQPPGNK

SEQ ID NO: 66849 - protein, 31 aa, Artificial Sequence
  Description of Artificial Sequence: Synthetic polypeptide
CEEEIRTTNPVATEQYGCVSTNHQNNSNNQS

SEQ ID NO: 66850 - protein, 32 aa, Artificial Sequence
  Description of Artificial Sequence: Synthetic polypeptide
DEEEICTTNPVATEAWGSVSTNDSQPPGGNRP

SEQ ID NO: 66851 - protein, 31 aa, Artificial Sequence
  Description of Artificial Sequence: Synthetic polypeptide
DEEEICTTNPTAYEQYGSVATNLQNPGNDMD

SEQ ID NO: 66852 - protein, 31 aa, Artificial Sequence
  Description of Artificial Sequence: Synthetic polypeptide
DEEEIRTTNPVATEGYGCVSTEHQSFGSNQG

SEQ ID NO: 66853 - protein, 31 aa, Artificial Sequence
  Description of Artificial Sequence: Synthetic polypeptide
DEEEIRTTNPVATEGYGCVSTELQGFGSEQN

SEQ ID NO: 66854 - protein, 32 aa, Artificial Sequence
  Description of Artificial Sequence: Synthetic polypeptide
DEEEICTTNPTATEQYGSVATNLQHAAGNDMQ

SEQ ID NO: 66855 - protein, 33 aa, Artificial Sequence
  Description of Artificial Sequence: Synthetic polypeptide
DEEEICTTNPMAYEQYGSVVPCTNLSQYRGNNR

SEQ ID NO: 66856 - protein, 30 aa, Artificial Sequence
  Description of Artificial Sequence: Synthetic polypeptide
DEEEIRTTNPVATEGYGCVSTELQNNSEQS

SEQ ID NO: 66857 - protein, 28 aa, Artificial Sequence
  Description of Artificial Sequence: Synthetic peptide
AEGEIAPTNPVASEQYGEVSCNLQSGTR

SEQ ID NO: 66858 - protein, 33 aa, Artificial Sequence
  Description of Artificial Sequence: Synthetic polypeptide
DEEEICTTNPMAYEQYGSVPPTNALSQNRGNNR

SEQ ID NO: 66859 - protein, 32 aa, Artificial Sequence
  Description of Artificial Sequence: Synthetic polypeptide
DEECIRTTNPVATEQYSACVCSTNDLQYGSNQ

SEQ ID NO: 66860 - protein, 28 aa, Artificial Sequence
  Description of Artificial Sequence: Synthetic peptide
AEGEIAPTNPVASEQYGEASCNLQRGGR

SEQ ID NO: 66861 - protein, 28 aa, Artificial Sequence
  Description of Artificial Sequence: Synthetic peptide
AEGEIAPTNPCSTEQYGEVSENLQRGTR

SEQ ID NO: 66862 - protein, 31 aa, Artificial Sequence
  Description of Artificial Sequence: Synthetic polypeptide
DEEEIRTTNPVATEGYGCVSTNHQSFGSEQS

SEQ ID NO: 66863 - protein, 30 aa, Artificial Sequence
  Description of Artificial Sequence: Synthetic polypeptide
DEAEIRTTNPVAVEQYGSCSSTDLEREENQ

SEQ ID NO: 66864 - protein, 32 aa, Artificial Sequence
  Description of Artificial Sequence: Synthetic polypeptide
DEECIRTTNPVATEQYSACVCSTNLQNGSNNQ

SEQ ID NO: 66865 - protein, 34 aa, Artificial Sequence
  Description of Artificial Sequence: Synthetic polypeptide
DEEEIRCTNPVATEQYGSVSTEPALPNMRGMNPR

SEQ ID NO: 66866 - protein, 32 aa, Artificial Sequence
  Description of Artificial Sequence: Synthetic polypeptide
DEECIRTTNPVATEQYSACVCSTNLQSGSNQN

SEQ ID NO: 66867 - protein, 31 aa, Artificial Sequence
  Description of Artificial Sequence: Synthetic polypeptide
DEAEIRTTNPVAVEQYGSCSTNLERPQEDRN

SEQ ID NO: 66868 - protein, 32 aa, Artificial Sequence
  Description of Artificial Sequence: Synthetic polypeptide
CEEEIRTTNPVATEQYGCVSTGELQRFNSNAD

SEQ ID NO: 66869 - protein, 31 aa, Artificial Sequence
  Description of Artificial Sequence: Synthetic polypeptide
DEDEIRTTNPVAYEQWGSVSNNDGQDNGNER

SEQ ID NO: 66870 - protein, 28 aa, Artificial Sequence
  Description of Artificial Sequence: Synthetic peptide
AENEIACTNPVATFQYGEASENLQRGGR

SEQ ID NO: 66871 - protein, 33 aa, Artificial Sequence
  Description of Artificial Sequence: Synthetic polypeptide
DEEEIRCTNPVATEQYGTVTSMTNLFQGFGSNQ

SEQ ID NO: 66872 - protein, 30 aa, Artificial Sequence
  Description of Artificial Sequence: Synthetic polypeptide
AENEIACTNPVATEQYGSEASENLQQRGGR

SEQ ID NO: 66873 - protein, 32 aa, Artificial Sequence
  Description of Artificial Sequence: Synthetic polypeptide
CEEEIRTTNPVATEQYGCVCSTGNLQNGSETQ

SEQ ID NO: 66874 - protein, 29 aa, Artificial Sequence
  Description of Artificial Sequence: Synthetic peptide
AENEIACTNPVATEQYGSEAVENLQRGGR

SEQ ID NO: 66875 - protein, 34 aa, Artificial Sequence
  Description of Artificial Sequence: Synthetic polypeptide
AEEEIRTTNPVATEQYGSVSTVTNLNQQIGNNTE

SEQ ID NO: 66876 - protein, 32 aa, Artificial Sequence
  Description of Artificial Sequence: Synthetic polypeptide
DEEEIRTTNPVATEFYGSVSTTNLIGNGTGGN

SEQ ID NO: 66877 - protein, 28 aa, Artificial Sequence
  Description of Artificial Sequence: Synthetic peptide
AEDEIACTNPVATEQYGEASENLQLGGR

SEQ ID NO: 66878 - protein, 29 aa, Artificial Sequence
  Description of Artificial Sequence: Synthetic peptide
AENEIACTNPVATEQYGEANSENLQRGSR

SEQ ID NO: 66879 - protein, 31 aa, Artificial Sequence
  Description of Artificial Sequence: Synthetic polypeptide
DEECIRCTNPVAYEQYGSVVSCNEHQRGGNL

SEQ ID NO: 66880 - protein, 28 aa, Artificial Sequence
  Description of Artificial Sequence: Synthetic peptide
AENEIACTNPVATEQYGFASENLQRLGR

SEQ ID NO: 66881 - protein, 32 aa, Artificial Sequence
  Description of Artificial Sequence: Synthetic polypeptide
CEEEIRTTNPVATEQYGCVCSTGNLQNSGSDA

SEQ ID NO: 66882 - protein, 31 aa, Artificial Sequence
  Description of Artificial Sequence: Synthetic polypeptide
DEECIRCTNPVAYEQYGSVVSQNEHSQRGNL

SEQ ID NO: 66883 - protein, 31 aa, Artificial Sequence
  Description of Artificial Sequence: Synthetic polypeptide
AENEIACTNPVATEQYGSVSTALPQRNGMGR

SEQ ID NO: 66884 - protein, 28 aa, Artificial Sequence
  Description of Artificial Sequence: Synthetic peptide
AENEIACTNPVATEQYGEASRNKQRGGR

SEQ ID NO: 66885 - protein, 32 aa, Artificial Sequence
  Description of Artificial Sequence: Synthetic polypeptide
DEAEIRTTNPVATEQYGSVTSYLLDRGENNEM

SEQ ID NO: 66886 - protein, 34 aa, Artificial Sequence
  Description of Artificial Sequence: Synthetic polypeptide
DEAEIRTTNPVATEQYGSVTSTNGNDDERGGNDR

SEQ ID NO: 66887 - protein, 31 aa, Artificial Sequence
  Description of Artificial Sequence: Synthetic polypeptide
CEEEIRTTNPVATEQYGCVCSTELDQSGSEQ

SEQ ID NO: 66888 - protein, 29 aa, Artificial Sequence
  Description of Artificial Sequence: Synthetic peptide
AENEIACTNPVATEQYGSVSTDLQDHGEL

SEQ ID NO: 66889 - protein, 29 aa, Artificial Sequence
  Description of Artificial Sequence: Synthetic peptide
AENEIACTNPVATEQYGFACSENLQRGGR

SEQ ID NO: 66890 - protein, 30 aa, Artificial Sequence
  Description of Artificial Sequence: Synthetic polypeptide
DEECIRTTNPAAWEQYGQVSTINVQGGNDN

SEQ ID NO: 66891 - protein, 33 aa, Artificial Sequence
  Description of Artificial Sequence: Synthetic polypeptide
DEAEIRTTNPVATEQYGSVTGTNDNGERGGNSR

SEQ ID NO: 66892 - protein, 31 aa, Artificial Sequence
  Description of Artificial Sequence: Synthetic polypeptide
DEEEICTTNPVAYEQWGKVSCTNELTRQGNK

SEQ ID NO: 66893 - protein, 32 aa, Artificial Sequence
  Description of Artificial Sequence: Synthetic polypeptide
DEEEICTTNPVAYEQWGIVVSCTNELSQAGNR

SEQ ID NO: 66894 - protein, 28 aa, Artificial Sequence
  Description of Artificial Sequence: Synthetic peptide
AENCIACTNPVATEQYGEASENLQRGGR

SEQ ID NO: 66895 - protein, 33 aa, Artificial Sequence
  Description of Artificial Sequence: Synthetic polypeptide
DEAEIRTTNPVATEQYGSVWSTNLGEMSINEDR

SEQ ID NO: 66896 - protein, 29 aa, Artificial Sequence
  Description of Artificial Sequence: Synthetic peptide
AENEIACTNPVATEQYGEYSWNLQRGGRP

SEQ ID NO: 66897 - protein, 32 aa, Artificial Sequence
  Description of Artificial Sequence: Synthetic polypeptide
DEAEIRTTNPVATEQYGSVSYNNDLTEGMNQN

SEQ ID NO: 66898 - protein, 33 aa, Artificial Sequence
  Description of Artificial Sequence: Synthetic polypeptide
DEECIRSTNPVATEPYGSTVPSCTNLSQRGTNT

SEQ ID NO: 66899 - protein, 30 aa, Artificial Sequence
  Description of Artificial Sequence: Synthetic polypeptide
DEAEIRTTNPVATEQYGSVWTDMQHSNSQE

SEQ ID NO: 66900 - protein, 28 aa, Artificial Sequence
  Description of Artificial Sequence: Synthetic peptide
AENDIACTNPVATEQYGCASENLQRGGR

SEQ ID NO: 66901 - protein, 28 aa, Artificial Sequence
  Description of Artificial Sequence: Synthetic peptide
AEDEIACTNPVATEQYGEASENLQFGGR

SEQ ID NO: 66902 - protein, 29 aa, Artificial Sequence
  Description of Artificial Sequence: Synthetic peptide
AENEIACTNPVATEQYGSASENGPQRGGR

SEQ ID NO: 66903 - protein, 29 aa, Artificial Sequence
  Description of Artificial Sequence: Synthetic peptide
AENEIACTNPVATEQYGSASENGQRGGPR

SEQ ID NO: 66904 - protein, 28 aa, Artificial Sequence
  Description of Artificial Sequence: Synthetic peptide
AENEIACTNPVATEQYGHASENLQSGGR

SEQ ID NO: 66905 - protein, 28 aa, Artificial Sequence
  Description of Artificial Sequence: Synthetic peptide
AENEIACTNPVATEQYGEASFILQRGGR

SEQ ID NO: 66906 - protein, 29 aa, Artificial Sequence
  Description of Artificial Sequence: Synthetic peptide
AENEIACTNPVATEQYGSASENLQDHGER

SEQ ID NO: 66907 - protein, 29 aa, Artificial Sequence
  Description of Artificial Sequence: Synthetic peptide
AENEIACTNPVATEQYGSASENLQDHGGR

SEQ ID NO: 66908 - protein, 31 aa, Artificial Sequence
  Description of Artificial Sequence: Synthetic polypeptide
DEDEIRTTNPVAYEHWGSVSTNLQADGNNQH

SEQ ID NO: 66909 - protein, 28 aa, Artificial Sequence
  Description of Artificial Sequence: Synthetic peptide
AENEIAATNPVATEQYGEASENLQAGGR

SEQ ID NO: 66910 - protein, 29 aa, Artificial Sequence
  Description of Artificial Sequence: Synthetic peptide
AENEIACTNPVATEQYGEASQNLQRGGRT

SEQ ID NO: 66911 - protein, 31 aa, Artificial Sequence
  Description of Artificial Sequence: Synthetic polypeptide
DEECIRCTNPVATEQYGSVSWNEGQTGQNNL

SEQ ID NO: 66912 - protein, 30 aa, Artificial Sequence
  Description of Artificial Sequence: Synthetic polypeptide
DEDEIRTTNPVAYEHWGSVSTNLQAGGDEN

SEQ ID NO: 66913 - protein, 30 aa, Artificial Sequence
  Description of Artificial Sequence: Synthetic polypeptide
DEECIRCTNPVATEQYGSVSWNHARGSELS

SEQ ID NO: 66914 - protein, 28 aa, Artificial Sequence
  Description of Artificial Sequence: Synthetic peptide
AENEIACTNPIATEQYGEASENLQRGGR

SEQ ID NO: 66915 - protein, 32 aa, Artificial Sequence
  Description of Artificial Sequence: Synthetic polypeptide
CEEEIRTTNPVATEQYGCVCSTGELQHGSNQN

SEQ ID NO: 66916 - protein, 35 aa, Artificial Sequence
  Description of Artificial Sequence: Synthetic polypeptide
DEEEIRTTNPVATEFYGSVTNMTENGLSQRIGNRA

SEQ ID NO: 66917 - protein, 30 aa, Artificial Sequence
  Description of Artificial Sequence: Synthetic polypeptide
DEAEIRTTNPVATEQYGSVWFTVNSELDDR

SEQ ID NO: 66918 - protein, 29 aa, Artificial Sequence
  Description of Artificial Sequence: Synthetic peptide
AENEIACTNPVATEQYGFLASENLQRGGR

SEQ ID NO: 66919 - protein, 30 aa, Artificial Sequence
  Description of Artificial Sequence: Synthetic polypeptide
DEECIRCTNPVATEQYGSVSWPNFETGVNQ

SEQ ID NO: 66920 - protein, 34 aa, Artificial Sequence
  Description of Artificial Sequence: Synthetic polypeptide
AEEEIRTTNPVATEQYGSVSTVTNLNQQEQGNTE

SEQ ID NO: 66921 - protein, 31 aa, Artificial Sequence
  Description of Artificial Sequence: Synthetic polypeptide
DEEEIRTTNPVATEFYGSVTGGNGQGEGNGN

SEQ ID NO: 66922 - protein, 30 aa, Artificial Sequence
  Description of Artificial Sequence: Synthetic polypeptide
DEEEIRTTNPVATECWGMHSINEQRDRGNF

SEQ ID NO: 66923 - protein, 32 aa, Artificial Sequence
  Description of Artificial Sequence: Synthetic polypeptide
DEECIRCTNPVATEQYGSVVSCINFSQRGNNL

SEQ ID NO: 66924 - protein, 29 aa, Artificial Sequence
  Description of Artificial Sequence: Synthetic peptide
AENEIACTNPVATEQYGSASTDLEREGGR

SEQ ID NO: 66925 - protein, 31 aa, Artificial Sequence
  Description of Artificial Sequence: Synthetic polypeptide
AENEIACTNPVATEQYGSASTNLPQRNGMGR

SEQ ID NO: 66926 - protein, 32 aa, Artificial Sequence
  Description of Artificial Sequence: Synthetic polypeptide
CEEEIRTTNPVATEQYGCVCSTGELQRGSEQN

SEQ ID NO: 66927 - protein, 28 aa, Artificial Sequence
  Description of Artificial Sequence: Synthetic peptide
AENDIACTNPVATEQYGEASENLQRGGR

SEQ ID NO: 66928 - protein, 31 aa, Artificial Sequence
  Description of Artificial Sequence: Synthetic polypeptide
DEECIRCTNPVATEQYGSVSWNHQNFGSNQS

SEQ ID NO: 66929 - protein, 31 aa, Artificial Sequence
  Description of Artificial Sequence: Synthetic polypeptide
DEAEIRTTNPVATEQYGSVWTEPLDRGSEDI

SEQ ID NO: 66930 - protein, 31 aa, Artificial Sequence
  Description of Artificial Sequence: Synthetic polypeptide
DEAEIRTTNPVATEQYGIVSLYNLQDGSIEN

SEQ ID NO: 66931 - protein, 30 aa, Artificial Sequence
  Description of Artificial Sequence: Synthetic polypeptide
DEAEIRTTNPVATEQYGSVWVELLDRGEDM

SEQ ID NO: 66932 - protein, 32 aa, Artificial Sequence
  Description of Artificial Sequence: Synthetic polypeptide
DEDEIRTTNPVAYEAYGSVSTVNLSQAGGEYR

SEQ ID NO: 66933 - protein, 28 aa, Artificial Sequence
  Description of Artificial Sequence: Synthetic peptide
AENEIACTNPMATEQYGEASENLQRGGR

SEQ ID NO: 66934 - protein, 28 aa, Artificial Sequence
  Description of Artificial Sequence: Synthetic peptide
AENAIACTNPVATEQYGCASWNLQRGGR

SEQ ID NO: 66935 - protein, 32 aa, Artificial Sequence
  Description of Artificial Sequence: Synthetic polypeptide
DEEEIRTTNPVATEFYGSVSTPNVGMTEGNNG

SEQ ID NO: 66936 - protein, 31 aa, Artificial Sequence
  Description of Artificial Sequence: Synthetic polypeptide
DEAEIRTTNPVATEQYGSVWVTVLDERGEDI

SEQ ID NO: 66937 - protein, 31 aa, Artificial Sequence
  Description of Artificial Sequence: Synthetic polypeptide
DEECIRTTNPVAEEQYGQVSITINVERGNAN

SEQ ID NO: 66938 - protein, 32 aa, Artificial Sequence
  Description of Artificial Sequence: Synthetic polypeptide
DEEEICTTNPVATESYGSVSTPLDQKGEGLRR

SEQ ID NO: 66939 - protein, 31 aa, Artificial Sequence
  Description of Artificial Sequence: Synthetic polypeptide
DEECIRTTNPVAGEQYGYQVSTINVQMRGHN

SEQ ID NO: 66940 - protein, 31 aa, Artificial Sequence
  Description of Artificial Sequence: Synthetic polypeptide
DEDEIRTTNPVAYEAWGTVSTNLQRGDDNQS

SEQ ID NO: 66941 - protein, 29 aa, Artificial Sequence
  Description of Artificial Sequence: Synthetic peptide
AENEIACTNPVATEQYGVAASENLQRGGR

SEQ ID NO: 66942 - protein, 29 aa, Artificial Sequence
  Description of Artificial Sequence: Synthetic peptide
DEEEIRCTNPVSTEPYGTVSMENLMQGNH

SEQ ID NO: 66943 - protein, 28 aa, Artificial Sequence
  Description of Artificial Sequence: Synthetic peptide
AENEIACTNPNATEQYGEASENLQRGGR

SEQ ID NO: 66944 - protein, 28 aa, Artificial Sequence
  Description of Artificial Sequence: Synthetic peptide
AENEIACTNPLATEQYGELSENLQRGGR

SEQ ID NO: 66945 - protein, 32 aa, Artificial Sequence
  Description of Artificial Sequence: Synthetic polypeptide
DEAEIRTTNPVATEQWGEVSTNLQIGGGMNEA

SEQ ID NO: 66946 - protein, 31 aa, Artificial Sequence
  Description of Artificial Sequence: Synthetic polypeptide
DEECIRTTNPVATEAYGKTVSCTNASQDGNI

SEQ ID NO: 66947 - protein, 31 aa, Artificial Sequence
  Description of Artificial Sequence: Synthetic polypeptide
DEECIRTTNPVATEAYGSTVSCTHESLRGNT

SEQ ID NO: 66948 - protein, 33 aa, Artificial Sequence
  Description of Artificial Sequence: Synthetic polypeptide
CEEEIRTTNPVATEQYGCVCSTPNLQHFGSNQA

SEQ ID NO: 66949 - protein, 28 aa, Artificial Sequence
  Description of Artificial Sequence: Synthetic peptide
AENEIACTNPVATEQYGEASETLQRGDR

SEQ ID NO: 66950 - protein, 29 aa, Artificial Sequence
  Description of Artificial Sequence: Synthetic peptide
AENEIACTNPVATEQYGVAHSENLQRGGR

SEQ ID NO: 66951 - protein, 33 aa, Artificial Sequence
  Description of Artificial Sequence: Synthetic polypeptide
DEAEIRTTNPVATEQYGKTVSCTNLTDTGNNRG

SEQ ID NO: 66952 - protein, 28 aa, Artificial Sequence
  Description of Artificial Sequence: Synthetic peptide
AENEIACTNPVATEQYGVASENCQRGGR

SEQ ID NO: 66953 - protein, 31 aa, Artificial Sequence
  Description of Artificial Sequence: Synthetic polypeptide
DEECIRTTNPVATECYGCVSHTNDVQFQGNA

SEQ ID NO: 66954 - protein, 32 aa, Artificial Sequence
  Description of Artificial Sequence: Synthetic polypeptide
CEEEIRTTNPVATEQYGCVCSTYHQNFGSNNR

SEQ ID NO: 66955 - protein, 28 aa, Artificial Sequence
  Description of Artificial Sequence: Synthetic peptide
AENEIACTNPQATEQYGEASENLQRGGR

SEQ ID NO: 66956 - protein, 30 aa, Artificial Sequence
  Description of Artificial Sequence: Synthetic polypeptide
DEAEIRTTNPVATEQYGSVWVTVMEGNERN

SEQ ID NO: 66957 - protein, 28 aa, Artificial Sequence
  Description of Artificial Sequence: Synthetic peptide
AENEIACTNPVATEQYGVASENLQHGGR

SEQ ID NO: 66958 - protein, 34 aa, Artificial Sequence
  Description of Artificial Sequence: Synthetic polypeptide
AEEEIRTTNPVATEQYGSVSTVSTNLQAGNNEQE

SEQ ID NO: 66959 - protein, 30 aa, Artificial Sequence
  Description of Artificial Sequence: Synthetic polypeptide
DEECIRTTNPVACEQYGVVCTIEDGQRGNE

SEQ ID NO: 66960 - protein, 31 aa, Artificial Sequence
  Description of Artificial Sequence: Synthetic polypeptide
DEECIRTTNPVACEQYGQVSTIDGQRGNGNM

SEQ ID NO: 66961 - protein, 32 aa, Artificial Sequence
  Description of Artificial Sequence: Synthetic polypeptide
DEEEIRTTNPVATEFYGSVSTPNVGMTEVGNT

SEQ ID NO: 66962 - protein, 31 aa, Artificial Sequence
  Description of Artificial Sequence: Synthetic polypeptide
DEDEIRTTNPVAYEKWGEVSTNLNQGDGNAR

SEQ ID NO: 66963 - protein, 31 aa, Artificial Sequence
  Description of Artificial Sequence: Synthetic polypeptide
DEEEIRGTNPVATEQWGTIVSTLLNRGGGNG

SEQ ID NO: 66964 - protein, 33 aa, Artificial Sequence
  Description of Artificial Sequence: Synthetic polypeptide
CEEEIRTTNPVATEQYGCVCSTNLNQRFNSNQE

SEQ ID NO: 66965 - protein, 28 aa, Artificial Sequence
  Description of Artificial Sequence: Synthetic peptide
AENEIACTNPVATEQYGTASENLQRGGH

SEQ ID NO: 66966 - protein, 31 aa, Artificial Sequence
  Description of Artificial Sequence: Synthetic polypeptide
DEEEIRGTNPVATEQWGTSVSTLLIDGGNQG

SEQ ID NO: 66967 - protein, 28 aa, Artificial Sequence
  Description of Artificial Sequence: Synthetic peptide
AENEIACTNPVATEQYGTASENLQRGGL

SEQ ID NO: 66968 - protein, 33 aa, Artificial Sequence
  Description of Artificial Sequence: Synthetic polypeptide
AEEEIRTTNPVATEQYGSVSTVTNLNSGNGTNG

SEQ ID NO: 66969 - protein, 32 aa, Artificial Sequence
  Description of Artificial Sequence: Synthetic polypeptide
DEEEICTTNPVAYEPYGSTVSTNDSQPPGTNR

SEQ ID NO: 66970 - protein, 32 aa, Artificial Sequence
  Description of Artificial Sequence: Synthetic polypeptide
DEEEICTTNPVAYEPYGQSVSTNESQRSGSRS

SEQ ID NO: 66971 - protein, 31 aa, Artificial Sequence
  Description of Artificial Sequence: Synthetic polypeptide
DEEAIRTTNPVATEIYGCVTTNLQENFGSNQ

SEQ ID NO: 66972 - protein, 31 aa, Artificial Sequence
  Description of Artificial Sequence: Synthetic polypeptide
DEEEIRGTNPVATEQWGTVVSTLLIRGGNGD

SEQ ID NO: 66973 - protein, 31 aa, Artificial Sequence
  Description of Artificial Sequence: Synthetic polypeptide
DEEAIRTTNPVATEIYGCVTQTELQRFGSNQ

SEQ ID NO: 66974 - protein, 32 aa, Artificial Sequence
  Description of Artificial Sequence: Synthetic polypeptide
DEECIRTTNPCATEQYGSVIATDNHDQRGNHA

SEQ ID NO: 66975 - protein, 30 aa, Artificial Sequence
  Description of Artificial Sequence: Synthetic polypeptide
DEEAIRTTNPVATEIYGCVQTNDQNFGSNQ

SEQ ID NO: 66976 - protein, 29 aa, Artificial Sequence
  Description of Artificial Sequence: Synthetic peptide
AENEIACTNPVATEQYGTASTGLVQRGGR

SEQ ID NO: 66977 - protein, 28 aa, Artificial Sequence
  Description of Artificial Sequence: Synthetic peptide
AENAIACTNPVATEQYGEASENLQRGGR

SEQ ID NO: 66978 - protein, 30 aa, Artificial Sequence
  Description of Artificial Sequence: Synthetic polypeptide
DEEAIRTTNPVATEIYGCVCQTNPQYGSNQ

SEQ ID NO: 66979 - protein, 31 aa, Artificial Sequence
  Description of Artificial Sequence: Synthetic polypeptide
DEEEICTTNPVAYEAYGSVSTNFSQPPGTSR

SEQ ID NO: 66980 - protein, 29 aa, Artificial Sequence
  Description of Artificial Sequence: Synthetic peptide
AENEIACTNPVATEQYGTEASENLQRGGR

SEQ ID NO: 66981 - protein, 32 aa, Artificial Sequence
  Description of Artificial Sequence: Synthetic polypeptide
DEEEICTTNPVAYEAYGSVSGNELSQGTGGNR

SEQ ID NO: 66982 - protein, 32 aa, Artificial Sequence
  Description of Artificial Sequence: Synthetic polypeptide
DEEEICTTNPVAYEAYGSVSCTNSLSQVRGEE

SEQ ID NO: 66983 - protein, 31 aa, Artificial Sequence
  Description of Artificial Sequence: Synthetic polypeptide
DEEEICTTNPVAYEAYGKTVSTNDSQPPGNR

SEQ ID NO: 66984 - protein, 32 aa, Artificial Sequence
  Description of Artificial Sequence: Synthetic polypeptide
CEEEIRTTNPVATEQYGCVCSTNLQHSNSDQS

SEQ ID NO: 66985 - protein, 28 aa, Artificial Sequence
  Description of Artificial Sequence: Synthetic peptide
AENEIACTNPLATEQYGEASENLQRGGR

SEQ ID NO: 66986 - protein, 30 aa, Artificial Sequence
  Description of Artificial Sequence: Synthetic polypeptide
DEDEIRTTNPVAYEKYGSVSCTNHQDPMRV

SEQ ID NO: 66987 - protein, 31 aa, Artificial Sequence
  Description of Artificial Sequence: Synthetic polypeptide
DEEEICTTNPVATETWGTVSTNQQGGGDNNR

SEQ ID NO: 66988 - protein, 31 aa, Artificial Sequence
  Description of Artificial Sequence: Synthetic polypeptide
DEECIRTTNPVAAECYGQVSTINVTQRGNDN

SEQ ID NO: 66989 - protein, 28 aa, Artificial Sequence
  Description of Artificial Sequence: Synthetic peptide
AENEIACTNPVATEQYGEASFNLQRAGR

SEQ ID NO: 66990 - protein, 30 aa, Artificial Sequence
  Description of Artificial Sequence: Synthetic polypeptide
AENEIACTNPVATEQYGSASAENLQRGEDR

SEQ ID NO: 66991 - protein, 32 aa, Artificial Sequence
  Description of Artificial Sequence: Synthetic polypeptide
DEEAIRTTNPVATEQWGCVCGTNELQHGSNRS

SEQ ID NO: 66992 - protein, 29 aa, Artificial Sequence
  Description of Artificial Sequence: Synthetic peptide
AENEIACTNPVATEQYGIASENLQRAGGR

SEQ ID NO: 66993 - protein, 28 aa, Artificial Sequence
  Description of Artificial Sequence: Synthetic peptide
AENEIACTNPVATEQYGMAWENLQRGGR

SEQ ID NO: 66994 - protein, 33 aa, Artificial Sequence
  Description of Artificial Sequence: Synthetic polypeptide
AEEEIRTTNPVATEQYGSVSTVTNLLIGNEQGE

SEQ ID NO: 66995 - protein, 31 aa, Artificial Sequence
  Description of Artificial Sequence: Synthetic polypeptide
DEEEIRATNPCATEQYGSVCATNLQSGDEHA

SEQ ID NO: 66996 - protein, 30 aa, Artificial Sequence
  Description of Artificial Sequence: Synthetic polypeptide
DEDEIRTTNPVAYEGWGSVATNLQGGQNEN

SEQ ID NO: 66997 - protein, 31 aa, Artificial Sequence
  Description of Artificial Sequence: Synthetic polypeptide
DEEAIRTTNPVATEQYDYCVSIALQRIGDNE

SEQ ID NO: 66998 - protein, 33 aa, Artificial Sequence
  Description of Artificial Sequence: Synthetic polypeptide
DEEEINTTNPVATEQYGSVSTNSLFQVYVGEEF

SEQ ID NO: 66999 - protein, 32 aa, Artificial Sequence
  Description of Artificial Sequence: Synthetic polypeptide
DEEAIRTTNPVATEQYDYCCVSINLQRGDNFE

SEQ ID NO: 67000 - protein, 32 aa, Artificial Sequence
  Description of Artificial Sequence: Synthetic polypeptide
DEAEIRTTNPVATEQYGSVQTNEDDRGENEHT

SEQ ID NO: 67001 - protein, 31 aa, Artificial Sequence
  Description of Artificial Sequence: Synthetic polypeptide
DEEAIRTTNPVATEQWGSVGTNNPQHFGSNQ

SEQ ID NO: 67002 - protein, 32 aa, Artificial Sequence
  Description of Artificial Sequence: Synthetic polypeptide
CEEEIRTTNPVATEQYGCVCSTGEEQRFGSNQ

SEQ ID NO: 67003 - protein, 32 aa, Artificial Sequence
  Description of Artificial Sequence: Synthetic polypeptide
DEEAIRTTNPVATEQWGSVGTNELQHFGSNQA

SEQ ID NO: 67004 - protein, 32 aa, Artificial Sequence
  Description of Artificial Sequence: Synthetic polypeptide
DEEEINTTNPVATEQYGSVSTDNSNGQVDGEH

SEQ ID NO: 67005 - protein, 31 aa, Artificial Sequence
  Description of Artificial Sequence: Synthetic polypeptide
DEDEIRTTNPVAYEQWGSVSENLQPGGAGNA

SEQ ID NO: 67006 - protein, 30 aa, Artificial Sequence
  Description of Artificial Sequence: Synthetic polypeptide
DEDEIRTTNPVAYEGWGSVATNLQGNGNMN

SEQ ID NO: 67007 - protein, 28 aa, Artificial Sequence
  Description of Artificial Sequence: Synthetic peptide
AENEIACTNPVATEQYGNAAENLQRGGR

SEQ ID NO: 67008 - protein, 33 aa, Artificial Sequence
  Description of Artificial Sequence: Synthetic polypeptide
AEEEIRTTNPVATEQYGSVSTVTNGNQNIGNQD

SEQ ID NO: 67009 - protein, 33 aa, Artificial Sequence
  Description of Artificial Sequence: Synthetic polypeptide
DEEEINTTNPVATEQYGSVSTDNSLFTVRGETF

SEQ ID NO: 67010 - protein, 28 aa, Artificial Sequence
  Description of Artificial Sequence: Synthetic peptide
AENEIACTNAVATEQYGEASENLQRGGR

SEQ ID NO: 67011 - protein, 33 aa, Artificial Sequence
  Description of Artificial Sequence: Synthetic polypeptide
DEEEIRTTNPVATEFYGSVVMTTNNLQARIING

SEQ ID NO: 67012 - protein, 32 aa, Artificial Sequence
  Description of Artificial Sequence: Synthetic polypeptide
DEEEICTTNPVAYEQYGSVSCTNDSTHPGNDR

SEQ ID NO: 67013 - protein, 32 aa, Artificial Sequence
  Description of Artificial Sequence: Synthetic polypeptide
DEEEICTTNPVAYEQYGSVSCTNDSQPPVTNR

SEQ ID NO: 67014 - protein, 28 aa, Artificial Sequence
  Description of Artificial Sequence: Synthetic peptide
AENEIAATNPVATEQYGETSENLQRGGN

SEQ ID NO: 67015 - protein, 32 aa, Artificial Sequence
  Description of Artificial Sequence: Synthetic polypeptide
DEEAIRTTNPVATEQWGSVCETNNLQGGSNQA

SEQ ID NO: 67016 - protein, 29 aa, Artificial Sequence
  Description of Artificial Sequence: Synthetic peptide
AENEIAATNPVATEQYGEASENLQRGGVR

SEQ ID NO: 67017 - protein, 34 aa, Artificial Sequence
  Description of Artificial Sequence: Synthetic polypeptide
DEEEICTTNPVAYEQYGSVPSTNELSQERTGENL

SEQ ID NO: 67018 - protein, 30 aa, Artificial Sequence
  Description of Artificial Sequence: Synthetic polypeptide
DEDEIRTTNPVAYECYGVVSTNLQMGGDDA

SEQ ID NO: 67019 - protein, 31 aa, Artificial Sequence
  Description of Artificial Sequence: Synthetic polypeptide
DEECIRCTNPVATEQYGCVSWNHQRGGSNLM

SEQ ID NO: 67020 - protein, 30 aa, Artificial Sequence
  Description of Artificial Sequence: Synthetic polypeptide
DEDEIRTTNPVAYEGWGSVATNLQGGGNNN

SEQ ID NO: 67021 - protein, 30 aa, Artificial Sequence
  Description of Artificial Sequence: Synthetic polypeptide
DEDEIRTTNPVAYEGWGSVATNLQGEGNVE

SEQ ID NO: 67022 - protein, 29 aa, Artificial Sequence
  Description of Artificial Sequence: Synthetic peptide
AENEIACTNPVATEQYGEASNENLQRGPR

SEQ ID NO: 67023 - protein, 33 aa, Artificial Sequence
  Description of Artificial Sequence: Synthetic polypeptide
DEEEICTTNPVAYEQYGSVSTGNLQPDPGGNAN

SEQ ID NO: 67024 - protein, 34 aa, Artificial Sequence
  Description of Artificial Sequence: Synthetic polypeptide
DEAEIRTTNPVATEQYGSVSCTQSLQDRSGEERN

SEQ ID NO: 67025 - protein, 29 aa, Artificial Sequence
  Description of Artificial Sequence: Synthetic peptide
AENEIACTNPVATEQYGEASHNLQRGGVR

SEQ ID NO: 67026 - protein, 29 aa, Artificial Sequence
  Description of Artificial Sequence: Synthetic peptide
AENEIACTNPVATEQYGEASHNLQRGGRL

SEQ ID NO: 67027 - protein, 33 aa, Artificial Sequence
  Description of Artificial Sequence: Synthetic polypeptide
DEAEIRTTNPVATEQYGSVSCTNGGQRSGSKFP

SEQ ID NO: 67028 - protein, 28 aa, Artificial Sequence
  Description of Artificial Sequence: Synthetic peptide
AENEIACTNPCSTEQYGIVSCNLQRGGR

SEQ ID NO: 67029 - protein, 28 aa, Artificial Sequence
  Description of Artificial Sequence: Synthetic peptide
AENEIACTNPCATEQYGEASENLQRGGR

SEQ ID NO: 67030 - protein, 32 aa, Artificial Sequence
  Description of Artificial Sequence: Synthetic polypeptide
DEEAIRTTNPVATEQYGCVCPTNHQRFGSNDA

SEQ ID NO: 67031 - protein, 29 aa, Artificial Sequence
  Description of Artificial Sequence: Synthetic peptide
AENEIACTNPVATEQYGEASMNLQRPGGR

SEQ ID NO: 67032 - protein, 29 aa, Artificial Sequence
  Description of Artificial Sequence: Synthetic peptide
AENEIACTNPVATEQYGEASHNLQRGGAR

SEQ ID NO: 67033 - protein, 28 aa, Artificial Sequence
  Description of Artificial Sequence: Synthetic peptide
AECEIACTNPVATEQYGEAGENLQRGGR

SEQ ID NO: 67034 - protein, 33 aa, Artificial Sequence
  Description of Artificial Sequence: Synthetic polypeptide
DEAEIRTTNPVATEQYGEVSTGNLAGNAGENDR

SEQ ID NO: 67035 - protein, 32 aa, Artificial Sequence
  Description of Artificial Sequence: Synthetic polypeptide
DEAEIRTTNPVATEQYGSVSCTDLEQETFDRD

SEQ ID NO: 67036 - protein, 28 aa, Artificial Sequence
  Description of Artificial Sequence: Synthetic peptide
AENEIACTNPCASEQYGIVSCNLQRGTR

SEQ ID NO: 67037 - protein, 30 aa, Artificial Sequence
  Description of Artificial Sequence: Synthetic polypeptide
DEDEIRTTNPVAYEGWGEVSTNLQGEGNEN

SEQ ID NO: 67038 - protein, 28 aa, Artificial Sequence
  Description of Artificial Sequence: Synthetic peptide
AENEIACTNPCASEQYGEVSCNLQRGTR

SEQ ID NO: 67039 - protein, 29 aa, Artificial Sequence
  Description of Artificial Sequence: Synthetic peptide
AENEIACTNPVATEQYGLASENVLQRGGR

SEQ ID NO: 67040 - protein, 28 aa, Artificial Sequence
  Description of Artificial Sequence: Synthetic peptide
AENEIACTNPAATEQYGEASENLQRGGR

SEQ ID NO: 67041 - protein, 31 aa, Artificial Sequence
  Description of Artificial Sequence: Synthetic polypeptide
DEAEIRTTNPVATEQYGSVSCTDALQESEQA

SEQ ID NO: 67042 - protein, 28 aa, Artificial Sequence
  Description of Artificial Sequence: Synthetic peptide
AENEIACTNCVATEQYGEASENLQRGGR

SEQ ID NO: 67043 - protein, 30 aa, Artificial Sequence
  Description of Artificial Sequence: Synthetic polypeptide
DEECIRCTNPVATEQYGCVCSWNNQSGNLS

SEQ ID NO: 67044 - protein, 31 aa, Artificial Sequence
  Description of Artificial Sequence: Synthetic polypeptide
DEEEINTTNPVAYEAYGSVSCTNLESAVGNA

SEQ ID NO: 67045 - protein, 28 aa, Artificial Sequence
  Description of Artificial Sequence: Synthetic peptide
AENEIACTNPEATEQYGEASENLQRGGR

SEQ ID NO: 67046 - protein, 31 aa, Artificial Sequence
  Description of Artificial Sequence: Synthetic polypeptide
DEEEICTTNPVAYESYGQVSCINLSQATGNR

SEQ ID NO: 67047 - protein, 28 aa, Artificial Sequence
  Description of Artificial Sequence: Synthetic peptide
AENEIACTNPGATEQYGEASENLQRGGR

SEQ ID NO: 67048 - protein, 33 aa, Artificial Sequence
  Description of Artificial Sequence: Synthetic polypeptide
AEEEIRTTNPVATEQYGSVSTVTNLLNSNGGNT

SEQ ID NO: 67049 - protein, 32 aa, Artificial Sequence
  Description of Artificial Sequence: Synthetic polypeptide
DEEEINTTNPVATEQYGSVSTNSLFTVPSGEF

SEQ ID NO: 67050 - protein, 31 aa, Artificial Sequence
  Description of Artificial Sequence: Synthetic polypeptide
DEECIRCTNPVATEQYGQSVSWNGFQGGNVL

SEQ ID NO: 67051 - protein, 29 aa, Artificial Sequence
  Description of Artificial Sequence: Synthetic peptide
DEDEIRTTNPVAYEAWGETSTNLSQRGDS

SEQ ID NO: 67052 - protein, 32 aa, Artificial Sequence
  Description of Artificial Sequence: Synthetic polypeptide
DEECIRCTNPVATEQYGSTVSCCNQSQRGGNL

SEQ ID NO: 67053 - protein, 30 aa, Artificial Sequence
  Description of Artificial Sequence: Synthetic polypeptide
DEDEIRTTNPVAYEGWGSVSTNDGQGGNVN

SEQ ID NO: 67054 - protein, 29 aa, Artificial Sequence
  Description of Artificial Sequence: Synthetic peptide
AENEIACTNPVATEQYGNASNNLQSRGGR

SEQ ID NO: 67055 - protein, 29 aa, Artificial Sequence
  Description of Artificial Sequence: Synthetic peptide
DEDEIRTTNPVAYEGWGTVSTELQGGNVN

SEQ ID NO: 67056 - protein, 34 aa, Artificial Sequence
  Description of Artificial Sequence: Synthetic polypeptide
DEEEICTTNPVAYEQYGSTVSCTNLQDRTGGTRW

SEQ ID NO: 67057 - protein, 28 aa, Artificial Sequence
  Description of Artificial Sequence: Synthetic peptide
AENEIACTNPVATEQYGQADENLQRGGR

SEQ ID NO: 67058 - protein, 28 aa, Artificial Sequence
  Description of Artificial Sequence: Synthetic peptide
AEDEIACTNPVATEKYGEASENLQRGGR

SEQ ID NO: 67059 - protein, 32 aa, Artificial Sequence
  Description of Artificial Sequence: Synthetic polypeptide
CEEEIRTTNPVATEQYGCVCSTELQRFNSEQN

SEQ ID NO: 67060 - protein, 28 aa, Artificial Sequence
  Description of Artificial Sequence: Synthetic peptide
AENEIACTNPVATEQYGKASENLQEGGR

SEQ ID NO: 67061 - protein, 31 aa, Artificial Sequence
  Description of Artificial Sequence: Synthetic polypeptide
DEEEIRATNPVATEQWGFVSGDNDFQGGGNR

SEQ ID NO: 67062 - protein, 28 aa, Artificial Sequence
  Description of Artificial Sequence: Synthetic peptide
AENEIACTNPVATEQYGQASENEQRGGR

SEQ ID NO: 67063 - protein, 28 aa, Artificial Sequence
  Description of Artificial Sequence: Synthetic peptide
AENEIACTNPVATEQYGQASENLQRGGD

SEQ ID NO: 67064 - protein, 35 aa, Artificial Sequence
  Description of Artificial Sequence: Synthetic polypeptide
DEEEICTTNPVAYEQYGSTVQSTNLSQDRTGGNRW

SEQ ID NO: 67065 - protein, 32 aa, Artificial Sequence
  Description of Artificial Sequence: Synthetic polypeptide
DEEEICTTNPVAYEQYGQWVACTNELSQAGNR

SEQ ID NO: 67066 - protein, 28 aa, Artificial Sequence
  Description of Artificial Sequence: Synthetic peptide
AENEIACTNPVATEQYGKASENLQRGGI

SEQ ID NO: 67067 - protein, 34 aa, Artificial Sequence
  Description of Artificial Sequence: Synthetic polypeptide
DEEEICTTNPVAYEQYGQSVSTNELSQERTGNNL

SEQ ID NO: 67068 - protein, 28 aa, Artificial Sequence
  Description of Artificial Sequence: Synthetic peptide
AENEIACTNPVATEQYGEASGNLQRAGR

SEQ ID NO: 67069 - protein, 29 aa, Artificial Sequence
  Description of Artificial Sequence: Synthetic peptide
AENEIACTNPVATEQYGSASAENLERGER

SEQ ID NO: 67070 - protein, 31 aa, Artificial Sequence
  Description of Artificial Sequence: Synthetic polypeptide
DEDEIRTTNPVAYEHWGEVSTNLQQDGNMNR

SEQ ID NO: 67071 - protein, 34 aa, Artificial Sequence
  Description of Artificial Sequence: Synthetic polypeptide
DEAEIRTTNPVATEQWGSVVSCTGNMLQRVGERR

SEQ ID NO: 67072 - protein, 31 aa, Artificial Sequence
  Description of Artificial Sequence: Synthetic polypeptide
DEEEIRATNPVATEQWGFVSMGNDFQGGDNR

SEQ ID NO: 67073 - protein, 29 aa, Artificial Sequence
  Description of Artificial Sequence: Synthetic peptide
AENEIACTNPVATEQYGIIASENLQRGGR

SEQ ID NO: 67074 - protein, 31 aa, Artificial Sequence
  Description of Artificial Sequence: Synthetic polypeptide
DEEEIRATNPVATEQWGFVSMLNDFQGGNQR

SEQ ID NO: 67075 - protein, 32 aa, Artificial Sequence
  Description of Artificial Sequence: Synthetic polypeptide
DEEEIRATNPVATEQWGFVSMTNDFQGEGNNR

SEQ ID NO: 67076 - protein, 29 aa, Artificial Sequence
  Description of Artificial Sequence: Synthetic peptide
AENEIACTNPVATEQYGEASQENLQRGQR

SEQ ID NO: 67077 - protein, 29 aa, Artificial Sequence
  Description of Artificial Sequence: Synthetic peptide
AENEIACTNPVATEQYGEASFNLQRGGTR

SEQ ID NO: 67078 - protein, 31 aa, Artificial Sequence
  Description of Artificial Sequence: Synthetic polypeptide
DEECIRCTNPVATEQYGSVSWNEGQDTGNTL

SEQ ID NO: 67079 - protein, 32 aa, Artificial Sequence
  Description of Artificial Sequence: Synthetic polypeptide
DEECIRCTNPVATEQYGSVSWNEGQQERGGNM

SEQ ID NO: 67080 - protein, 29 aa, Artificial Sequence
  Description of Artificial Sequence: Synthetic peptide
AENEIACTNPVATEQYGQEASENLQRGGR

SEQ ID NO: 67081 - protein, 32 aa, Artificial Sequence
  Description of Artificial Sequence: Synthetic polypeptide
DEEAIRTTNPVATEQWGCVCGTNNLQHGSNTR

SEQ ID NO: 67082 - protein, 29 aa, Artificial Sequence
  Description of Artificial Sequence: Synthetic peptide
AENEIAATNPVATEQYGEASENLQGRGGR

SEQ ID NO: 67083 - protein, 32 aa, Artificial Sequence
  Description of Artificial Sequence: Synthetic polypeptide
DEECIRCTNPVATEQYGSVSWNEGEQDTGNLR

SEQ ID NO: 67084 - protein, 34 aa, Artificial Sequence
  Description of Artificial Sequence: Synthetic polypeptide
DEEEICTTNPVAYEQYGSVPSCTNSLSQVRGENF

SEQ ID NO: 67085 - protein, 29 aa, Artificial Sequence
  Description of Artificial Sequence: Synthetic peptide
AENEIAATNPVATEQYGEASENLQRGDGR

SEQ ID NO: 67086 - protein, 28 aa, Artificial Sequence
  Description of Artificial Sequence: Synthetic peptide
AENEIACTNPVATEQYGEASPNLQSGGR

SEQ ID NO: 67087 - protein, 31 aa, Artificial Sequence
  Description of Artificial Sequence: Synthetic polypeptide
DEAEIRTTNPVATEQWGTSVATYLLDREGNS

SEQ ID NO: 67088 - protein, 29 aa, Artificial Sequence
  Description of Artificial Sequence: Synthetic peptide
DEEEIRTTNPVATECWGLHSWNEDQRRNF

SEQ ID NO: 67089 - protein, 31 aa, Artificial Sequence
  Description of Artificial Sequence: Synthetic polypeptide
DEEEIRTTNPVATECWGKHSTNEQQDRGNFS

SEQ ID NO: 67090 - protein, 31 aa, Artificial Sequence
  Description of Artificial Sequence: Synthetic polypeptide
DEEEIRTTNPVATECWGKHSTNEQHDRGNEF

SEQ ID NO: 67091 - protein, 31 aa, Artificial Sequence
  Description of Artificial Sequence: Synthetic polypeptide
DEEEIRTTNPVATECWGKHSTNEQGDRGNDF

SEQ ID NO: 67092 - protein, 30 aa, Artificial Sequence
  Description of Artificial Sequence: Synthetic polypeptide
DEEEIRTTNPVATECWGKHSTNEQDRPDNF

SEQ ID NO: 67093 - protein, 31 aa, Artificial Sequence
  Description of Artificial Sequence: Synthetic polypeptide
DEDEIRTTNPVAYEGWGSVSTNLNQGGGNEN

SEQ ID NO: 67094 - protein, 31 aa, Artificial Sequence
  Description of Artificial Sequence: Synthetic polypeptide
DEDEIRTTNPVAYEGWGSVSTNLQAGGDNVN

SEQ ID NO: 67095 - protein, 30 aa, Artificial Sequence
  Description of Artificial Sequence: Synthetic polypeptide
DEEEIRTTNPVATECWGKHSTNEDQRNNDF

SEQ ID NO: 67096 - protein, 31 aa, Artificial Sequence
  Description of Artificial Sequence: Synthetic polypeptide
DEAEIRTTNPVATEQYGSVVALNSEHRGNDQ

SEQ ID NO: 67097 - protein, 33 aa, Artificial Sequence
  Description of Artificial Sequence: Synthetic polypeptide
AEEEIRTTNPVATEQYGSVSTVVNGTQGGNNTQ

SEQ ID NO: 67098 - protein, 29 aa, Artificial Sequence
  Description of Artificial Sequence: Synthetic peptide
AENEIACTNPVATEQYGEAQSSNLQRGQR

SEQ ID NO: 67099 - protein, 31 aa, Artificial Sequence
  Description of Artificial Sequence: Synthetic polypeptide
DEDEIRTTNPVAYEGWGSVSTNLQGMGNNEN

SEQ ID NO: 67100 - protein, 30 aa, Artificial Sequence
  Description of Artificial Sequence: Synthetic polypeptide
DEDEIRTTNPVAYECWGVVSTNLQAGGDNA

SEQ ID NO: 67101 - protein, 31 aa, Artificial Sequence
  Description of Artificial Sequence: Synthetic polypeptide
DEDEIRTTNPVAYEGWGSVSTNLQGNGGNNN

SEQ ID NO: 67102 - protein, 31 aa, Artificial Sequence
  Description of Artificial Sequence: Synthetic polypeptide
DEECIRCTNPVATEQYGSVSWMNHQNGSNLS

SEQ ID NO: 67103 - protein, 31 aa, Artificial Sequence
  Description of Artificial Sequence: Synthetic polypeptide
DEDEIRTTNPVAYEGWGSVSTNLQGNGNGEN

SEQ ID NO: 67104 - protein, 29 aa, Artificial Sequence
  Description of Artificial Sequence: Synthetic peptide
AENEIACTNPVATEQYGNASENLGQRGGR

SEQ ID NO: 67105 - protein, 28 aa, Artificial Sequence
  Description of Artificial Sequence: Synthetic peptide
AENEIACTNPVATEQYGEAPENLQRGGR

SEQ ID NO: 67106 - protein, 30 aa, Artificial Sequence
  Description of Artificial Sequence: Synthetic polypeptide
DEECIRCTNPVATEQYGSVSWNEGEQDGDL

SEQ ID NO: 67107 - protein, 31 aa, Artificial Sequence
  Description of Artificial Sequence: Synthetic polypeptide
DEECIRCTNPVATEQYGSVSWNEGEQDGNDH

SEQ ID NO: 67108 - protein, 29 aa, Artificial Sequence
  Description of Artificial Sequence: Synthetic peptide
AENEIACTNPVATEQYGNASENLQSRGGR

SEQ ID NO: 67109 - protein, 28 aa, Artificial Sequence
  Description of Artificial Sequence: Synthetic peptide
AENEIACTNPVATEQYGEASGNLQRGGI

SEQ ID NO: 67110 - protein, 31 aa, Artificial Sequence
  Description of Artificial Sequence: Synthetic polypeptide
DEDEIRTTNPVAYEGWGSVSTTNLQGEGNVN

SEQ ID NO: 67111 - protein, 31 aa, Artificial Sequence
  Description of Artificial Sequence: Synthetic polypeptide
DEEAIRTTNPVATEQWGCVGTNNLQHFGSNV

SEQ ID NO: 67112 - protein, 31 aa, Artificial Sequence
  Description of Artificial Sequence: Synthetic polypeptide
AEMEIVTTNPVATEQYGEACSTDNLEREGNR

SEQ ID NO: 67113 - protein, 29 aa, Artificial Sequence
  Description of Artificial Sequence: Synthetic peptide
AENEIACTNPVATEQYGVASENLQRGDGR

SEQ ID NO: 67114 - protein, 32 aa, Artificial Sequence
  Description of Artificial Sequence: Synthetic polypeptide
DEEEIRTTNPVATEFYGSVSTPNSGTVGNGDD

SEQ ID NO: 67115 - protein, 31 aa, Artificial Sequence
  Description of Artificial Sequence: Synthetic polypeptide
DEEEIRTTNPVATECYGEAQVSLNEQREVNF

SEQ ID NO: 67116 - protein, 33 aa, Artificial Sequence
  Description of Artificial Sequence: Synthetic polypeptide
DEEEICTTNPVATEQYGKVSCTGNDSQPPGTNR

SEQ ID NO: 67117 - protein, 31 aa, Artificial Sequence
  Description of Artificial Sequence: Synthetic polypeptide
DEEEICTTNPVATEQYGEVSTNGGQGNGEGA

SEQ ID NO: 67118 - protein, 30 aa, Artificial Sequence
  Description of Artificial Sequence: Synthetic polypeptide
AENEIACTNPVATEQYGEASEPNLPQRGNR

SEQ ID NO: 67119 - protein, 32 aa, Artificial Sequence
  Description of Artificial Sequence: Synthetic polypeptide
DEAEIRTTNPVATEQYGSVSLTNHTETGDENE

SEQ ID NO: 67120 - protein, 31 aa, Artificial Sequence
  Description of Artificial Sequence: Synthetic polypeptide
DEEEIRTTNPVATEFYGSVSTMGFGGGEGNQ

SEQ ID NO: 67121 - protein, 28 aa, Artificial Sequence
  Description of Artificial Sequence: Synthetic peptide
AENEIACTNPVATEQYGEASENWQRGGR

SEQ ID NO: 67122 - protein, 32 aa, Artificial Sequence
  Description of Artificial Sequence: Synthetic polypeptide
DEEEIRGTNPVATEQYGSVSLVNDDRMGSNSE

SEQ ID NO: 67123 - protein, 30 aa, Artificial Sequence
  Description of Artificial Sequence: Synthetic polypeptide
DEEAICTVNPVATEAYGSVSVDTNLENGNQ

SEQ ID NO: 67124 - protein, 30 aa, Artificial Sequence
  Description of Artificial Sequence: Synthetic polypeptide
DEECIATVNPVAYEAYGSVSDNELSTRGNR

SEQ ID NO: 67125 - protein, 31 aa, Artificial Sequence
  Description of Artificial Sequence: Synthetic polypeptide
DEEEICTTNPVATEQYGEVSTGNGEGDGNTA

SEQ ID NO: 67126 - protein, 28 aa, Artificial Sequence
  Description of Artificial Sequence: Synthetic peptide
AENEIACTNPVATEQYGEALYNLQRGGR

SEQ ID NO: 67127 - protein, 32 aa, Artificial Sequence
  Description of Artificial Sequence: Synthetic polypeptide
DEEEIRGTNPVATEQYGSVSGNGQEEGGENST

SEQ ID NO: 67128 - protein, 28 aa, Artificial Sequence
  Description of Artificial Sequence: Synthetic peptide
AENEIACTNPVATEAYGEASENLQRGGR

SEQ ID NO: 67129 - protein, 28 aa, Artificial Sequence
  Description of Artificial Sequence: Synthetic peptide
AENEIACTNPVATEQYGEASENVQRGGR

SEQ ID NO: 67130 - protein, 30 aa, Artificial Sequence
  Description of Artificial Sequence: Synthetic polypeptide
DEECIATVNPVAYEAYGSTVSCDNLTRGNR

SEQ ID NO: 67131 - protein, 28 aa, Artificial Sequence
  Description of Artificial Sequence: Synthetic peptide
AENEIACTNPVATEQYGEASENTQRGQR

SEQ ID NO: 67132 - protein, 30 aa, Artificial Sequence
  Description of Artificial Sequence: Synthetic polypeptide
DEECIATVNPVATEWYGSVYVDNHQERGNR

SEQ ID NO: 67133 - protein, 28 aa, Artificial Sequence
  Description of Artificial Sequence: Synthetic peptide
AENEIACTNPVATEQYGEASENTQRGGR

SEQ ID NO: 67134 - protein, 29 aa, Artificial Sequence
  Description of Artificial Sequence: Synthetic peptide
AENEIACTNPVATEQYGEWSENLQRGVGR

SEQ ID NO: 67135 - protein, 28 aa, Artificial Sequence
  Description of Artificial Sequence: Synthetic peptide
AENEIACTNPVATEQYGEASENSQRGGR

SEQ ID NO: 67136 - protein, 33 aa, Artificial Sequence
  Description of Artificial Sequence: Synthetic polypeptide
DEDEIRTTNPVATTQYGSVSTTNQNLQTGNTDG

SEQ ID NO: 67137 - protein, 31 aa, Artificial Sequence
  Description of Artificial Sequence: Synthetic polypeptide
DEECIATVNPVATEWYGSVSNDNLGERGNER

SEQ ID NO: 67138 - protein, 31 aa, Artificial Sequence
  Description of Artificial Sequence: Synthetic polypeptide
DEEEIRTTNPVATECYGETISTNEEQRNVNF

SEQ ID NO: 67139 - protein, 33 aa, Artificial Sequence
  Description of Artificial Sequence: Synthetic polypeptide
DEECIRTTNPVATEQYGCVCSMTNHQRFGSNQA

SEQ ID NO: 67140 - protein, 34 aa, Artificial Sequence
  Description of Artificial Sequence: Synthetic polypeptide
DEEEIRGTNPVATEQYGSVSTTNLQQETVHNLRS

SEQ ID NO: 67141 - protein, 31 aa, Artificial Sequence
  Description of Artificial Sequence: Synthetic polypeptide
DEAEIRTTNPVATEQFGTIVSTYLLRGQNES

SEQ ID NO: 67142 - protein, 33 aa, Artificial Sequence
  Description of Artificial Sequence: Synthetic polypeptide
DEEEIRTTNPVATEFYGSVSTMNDQIGMGNEEE

SEQ ID NO: 67143 - protein, 31 aa, Artificial Sequence
  Description of Artificial Sequence: Synthetic polypeptide
DEEAIRATNPVATDQYGFVSMTNLFQGGENI

SEQ ID NO: 67144 - protein, 32 aa, Artificial Sequence
  Description of Artificial Sequence: Synthetic polypeptide
DEEEICTTNPVATEQYGKVSCTNMDSTPPGNR

SEQ ID NO: 67145 - protein, 32 aa, Artificial Sequence
  Description of Artificial Sequence: Synthetic polypeptide
DEECIRTTNPVATEQWGQTVSVTNSSQDGGNR

SEQ ID NO: 67146 - protein, 33 aa, Artificial Sequence
  Description of Artificial Sequence: Synthetic polypeptide
DEECIRTTNPVATEQWGSVACTNNLSQNLGGNR

SEQ ID NO: 67147 - protein, 33 aa, Artificial Sequence
  Description of Artificial Sequence: Synthetic polypeptide
AEEEIRTTNPVATEQYGSVSTVTNLNSNNGNTG

SEQ ID NO: 67148 - protein, 31 aa, Artificial Sequence
  Description of Artificial Sequence: Synthetic polypeptide
DEECIRTTNPVATEQWGSVATDNLQLDVNEE

SEQ ID NO: 67149 - protein, 33 aa, Artificial Sequence
  Description of Artificial Sequence: Synthetic polypeptide
DEECIRTTNPVATEQWGSVATGNLSQLGGNNRE

SEQ ID NO: 67150 - protein, 29 aa, Artificial Sequence
  Description of Artificial Sequence: Synthetic peptide
DEECIETVNPVATEWYGSVSDNLESGENQ

SEQ ID NO: 67151 - protein, 33 aa, Artificial Sequence
  Description of Artificial Sequence: Synthetic polypeptide
DEEEIRTTNPVATEFYGSVSTMNLQIDNGTGGN

SEQ ID NO: 67152 - protein, 31 aa, Artificial Sequence
  Description of Artificial Sequence: Synthetic polypeptide
DEAEIRTTNPVATEQYGSVISTNGHGGDQVL

SEQ ID NO: 67153 - protein, 31 aa, Artificial Sequence
  Description of Artificial Sequence: Synthetic polypeptide
DEECIRTTNPVATEQWGSVATNNLLQLDVNQ

SEQ ID NO: 67154 - protein, 33 aa, Artificial Sequence
  Description of Artificial Sequence: Synthetic polypeptide
DEECIRTTNPVATEQWGSVCTLNMLSQTGGNNR

SEQ ID NO: 67155 - protein, 33 aa, Artificial Sequence
  Description of Artificial Sequence: Synthetic polypeptide
DEEEIRTTNPVATEFYGSVSTMNLDQEDGEEST

SEQ ID NO: 67156 - protein, 32 aa, Artificial Sequence
  Description of Artificial Sequence: Synthetic polypeptide
AEEEIRTTNPVATEQYGSVSTVQQNQEVGNDT

SEQ ID NO: 67157 - protein, 30 aa, Artificial Sequence
  Description of Artificial Sequence: Synthetic polypeptide
DEECIETVNPVATEWYGSVSDNLERGGNQH

SEQ ID NO: 67158 - protein, 30 aa, Artificial Sequence
  Description of Artificial Sequence: Synthetic polypeptide
DEECIETVNPVATEWYGSVSDNLERAGNLQ

SEQ ID NO: 67159 - protein, 30 aa, Artificial Sequence
  Description of Artificial Sequence: Synthetic polypeptide
DEECIETVNPVATEWYGSVSDNLEMQVGTR

SEQ ID NO: 67160 - protein, 30 aa, Artificial Sequence
  Description of Artificial Sequence: Synthetic polypeptide
DEECIETVNPVATEWYGSVSDNLEMIGNRE

SEQ ID NO: 67161 - protein, 31 aa, Artificial Sequence
  Description of Artificial Sequence: Synthetic polypeptide
DEECIRTTNPVATEQWGSVSKTLDELRGGNT

SEQ ID NO: 67162 - protein, 30 aa, Artificial Sequence
  Description of Artificial Sequence: Synthetic polypeptide
DEECIETVNPVATEWYGSVSDNLDERGNQE

SEQ ID NO: 67163 - protein, 32 aa, Artificial Sequence
  Description of Artificial Sequence: Synthetic polypeptide
DEEEICTTNPVATEQYGSTVSCTNHSGFGDNE

SEQ ID NO: 67164 - protein, 28 aa, Artificial Sequence
  Description of Artificial Sequence: Synthetic peptide
AENEIACTNPVATETYGEASENLQRGGR

SEQ ID NO: 67165 - protein, 32 aa, Artificial Sequence
  Description of Artificial Sequence: Synthetic polypeptide
DEEEIRGTNPVATEQYGSVSDQDLIQRIQNEG

SEQ ID NO: 67166 - protein, 28 aa, Artificial Sequence
  Description of Artificial Sequence: Synthetic peptide
AENEIACTNPVATEQYGEARENLQRGGR

SEQ ID NO: 67167 - protein, 32 aa, Artificial Sequence
  Description of Artificial Sequence: Synthetic polypeptide
DEDEIRTTNPVATTQYGSVSTTQLQGTGNNGD

SEQ ID NO: 67168 - protein, 32 aa, Artificial Sequence
  Description of Artificial Sequence: Synthetic polypeptide
DEEEIRTTNPVATEFYGSVSTMNGQEDGESGE

SEQ ID NO: 67169 - protein, 32 aa, Artificial Sequence
  Description of Artificial Sequence: Synthetic polypeptide
DEEEIRTTNPVATEFYGSVSTMNEGTGNGDND

SEQ ID NO: 67170 - protein, 31 aa, Artificial Sequence
  Description of Artificial Sequence: Synthetic polypeptide
DEEEICTTNPVATEQYGSCSATVSLDRDFRW

SEQ ID NO: 67171 - protein, 29 aa, Artificial Sequence
  Description of Artificial Sequence: Synthetic peptide
AENEIACTNPVATEQYGEARSENLQRGGR

SEQ ID NO: 67172 - protein, 30 aa, Artificial Sequence
  Description of Artificial Sequence: Synthetic polypeptide
DEECIATVNPVATEWYGSVSGDNLENGNDR

SEQ ID NO: 67173 - protein, 28 aa, Artificial Sequence
  Description of Artificial Sequence: Synthetic peptide
AENEIACTNPVATESYGQASENLQRGGR

SEQ ID NO: 67174 - protein, 33 aa, Artificial Sequence
  Description of Artificial Sequence: Synthetic polypeptide
DEEEIRGTNPVATEQYGSVSTVNQGDRGGSNSE

SEQ ID NO: 67175 - protein, 33 aa, Artificial Sequence
  Description of Artificial Sequence: Synthetic polypeptide
DEDEIRTTNPVATTQYGSVSTTNQNLQQGNNDE

SEQ ID NO: 67176 - protein, 28 aa, Artificial Sequence
  Description of Artificial Sequence: Synthetic peptide
AENEIACTNPVATEQYGEASENMQRGGR

SEQ ID NO: 67177 - protein, 29 aa, Artificial Sequence
  Description of Artificial Sequence: Synthetic peptide
DEDEIRTTNPVAYEQWGCTSTNLQDGDSD

SEQ ID NO: 67178 - protein, 31 aa, Artificial Sequence
  Description of Artificial Sequence: Synthetic polypeptide
DEEAICTVNPVATEAYGSVSTDQNLENGNQR

SEQ ID NO: 67179 - protein, 32 aa, Artificial Sequence
  Description of Artificial Sequence: Synthetic polypeptide
DEEEIRTTNPVATECYGKISTNMESQRTVGNF

SEQ ID NO: 67180 - protein, 32 aa, Artificial Sequence
  Description of Artificial Sequence: Synthetic polypeptide
CEEEIRTTNPVATEQYGCVSTEHQRFGSNNAS

SEQ ID NO: 67181 - protein, 28 aa, Artificial Sequence
  Description of Artificial Sequence: Synthetic peptide
AENEIACTNPVATEQYGEAKENLQRGGR

SEQ ID NO: 67182 - protein, 28 aa, Artificial Sequence
  Description of Artificial Sequence: Synthetic peptide
AENEIACTNPVATEVYGEASENLQRGGR

SEQ ID NO: 67183 - protein, 34 aa, Artificial Sequence
  Description of Artificial Sequence: Synthetic polypeptide
DEEEIRTTNPVATEFYGSVSSDTTNLAQEGNGNI

SEQ ID NO: 67184 - protein, 31 aa, Artificial Sequence
  Description of Artificial Sequence: Synthetic polypeptide
DEAEIRTTNPVATEQYGSVEWNDEQRTNEDQ

SEQ ID NO: 67185 - protein, 29 aa, Artificial Sequence
  Description of Artificial Sequence: Synthetic peptide
AENEIACTNPVATEQYGEAISVNLQRGGR

SEQ ID NO: 67186 - protein, 30 aa, Artificial Sequence
  Description of Artificial Sequence: Synthetic polypeptide
AENEIACTNPVATEQYGEVSSEPALQRGNR

SEQ ID NO: 67187 - protein, 29 aa, Artificial Sequence
  Description of Artificial Sequence: Synthetic peptide
AEMEIACTNPVATEQYGEASENLQRGGPR

SEQ ID NO: 67188 - protein, 30 aa, Artificial Sequence
  Description of Artificial Sequence: Synthetic polypeptide
DEAEIRTTNPVATEQFGTCVSTYLLRGEES

SEQ ID NO: 67189 - protein, 28 aa, Artificial Sequence
  Description of Artificial Sequence: Synthetic peptide
AEMEIACTNPVATEQYGEASENLERGGR

SEQ ID NO: 67190 - protein, 30 aa, Artificial Sequence
  Description of Artificial Sequence: Synthetic polypeptide
AEMEIACTNPVATEQYGEACSENLQREGNR

SEQ ID NO: 67191 - protein, 32 aa, Artificial Sequence
  Description of Artificial Sequence: Synthetic polypeptide
DEEEICTTNPVATEPWGSVSTNELSQNNGGPR

SEQ ID NO: 67192 - protein, 31 aa, Artificial Sequence
  Description of Artificial Sequence: Synthetic polypeptide
DEEAICTVNPVATEAYGSVSTDNQLEQSGNV

SEQ ID NO: 67193 - protein, 29 aa, Artificial Sequence
  Description of Artificial Sequence: Synthetic peptide
AENEIACTNPVATEQYGEASENLVQFGNR

SEQ ID NO: 67194 - protein, 29 aa, Artificial Sequence
  Description of Artificial Sequence: Synthetic peptide
AENEIACTNPVATEQYGEVSENLQREGEL

SEQ ID NO: 67195 - protein, 32 aa, Artificial Sequence
  Description of Artificial Sequence: Synthetic polypeptide
DEEEIRATNPVATEQWGSVSTPNPEQNQGNQD

SEQ ID NO: 67196 - protein, 28 aa, Artificial Sequence
  Description of Artificial Sequence: Synthetic peptide
AENEIACTNPVATEVYGEASNNLQRGGR

SEQ ID NO: 67197 - protein, 28 aa, Artificial Sequence
  Description of Artificial Sequence: Synthetic peptide
AENEIACTNPVATEWYGEASENLQRGGR

SEQ ID NO: 67198 - protein, 29 aa, Artificial Sequence
  Description of Artificial Sequence: Synthetic peptide
AENEIACTNPVATEQYGEVSENLQNREGR

SEQ ID NO: 67199 - protein, 28 aa, Artificial Sequence
  Description of Artificial Sequence: Synthetic peptide
AENEIACTNPVATEWYGVASENLQRGGR

SEQ ID NO: 67200 - protein, 28 aa, Artificial Sequence
  Description of Artificial Sequence: Synthetic peptide
AENEIACTNPVATEYYGEASENLQRGGR

SEQ ID NO: 67201 - protein, 32 aa, Artificial Sequence
  Description of Artificial Sequence: Synthetic polypeptide
DEEEICTTNPVATEPWGSVPFTNLSQRNGGPR

SEQ ID NO: 67202 - protein, 34 aa, Artificial Sequence
  Description of Artificial Sequence: Synthetic polypeptide
DEACIRTTNPVATEQYGCSVACTNMLSQRGGNRE

SEQ ID NO: 67203 - protein, 31 aa, Artificial Sequence
  Description of Artificial Sequence: Synthetic polypeptide
DEEEIRCTNPVAYEHYGSVSVNQSTRGGNNR

SEQ ID NO: 67204 - protein, 31 aa, Artificial Sequence
  Description of Artificial Sequence: Synthetic polypeptide
DEAEIRTTNPVATEQYGSVSMVDQGGNQDEE

SEQ ID NO: 67205 - protein, 30 aa, Artificial Sequence
  Description of Artificial Sequence: Synthetic polypeptide
DEEEIRTTNPVATECYGKHSVDNEQLGLNF

SEQ ID NO: 67206 - protein, 30 aa, Artificial Sequence
  Description of Artificial Sequence: Synthetic polypeptide
DEECIATVNPVATEWYGSVCHDDLQERGNR

SEQ ID NO: 67207 - protein, 32 aa, Artificial Sequence
  Description of Artificial Sequence: Synthetic polypeptide
DEEEICTTNPVATEQYGCVCSTNHQHFGSNQD

SEQ ID NO: 67208 - protein, 33 aa, Artificial Sequence
  Description of Artificial Sequence: Synthetic polypeptide
DEDEIRTTNPVATTQYGSVSTTNQNLQAGNNDE

SEQ ID NO: 67209 - protein, 31 aa, Artificial Sequence
  Description of Artificial Sequence: Synthetic polypeptide
DEEEIRGTNPVATEQYGSVSVNDGDYGSNSE

SEQ ID NO: 67210 - protein, 29 aa, Artificial Sequence
  Description of Artificial Sequence: Synthetic peptide
AENEIACTNPVATEQYGEALSENLQRGGR

SEQ ID NO: 67211 - protein, 29 aa, Artificial Sequence
  Description of Artificial Sequence: Synthetic peptide
AEMEIACTNPVATEQYGTASTGLVQRGGR

SEQ ID NO: 67212 - protein, 33 aa, Artificial Sequence
  Description of Artificial Sequence: Synthetic polypeptide
DEEEIRTTNPVATEFYGSVSTDNGNEQNEGGNQ

SEQ ID NO: 67213 - protein, 29 aa, Artificial Sequence
  Description of Artificial Sequence: Synthetic peptide
DEECIATVNPVATEPYGSVAAGNLERGNT

SEQ ID NO: 67214 - protein, 28 aa, Artificial Sequence
  Description of Artificial Sequence: Synthetic peptide
AENEIACTNPVATEQYGEASENQQRGGR

SEQ ID NO: 67215 - protein, 31 aa, Artificial Sequence
  Description of Artificial Sequence: Synthetic polypeptide
DEEEIRGTNPVATEQYGSVSVNQGDRGSPEE

SEQ ID NO: 67216 - protein, 29 aa, Artificial Sequence
  Description of Artificial Sequence: Synthetic peptide
CEEEISTTNPVATDQYGSVSTELPRMTDL

SEQ ID NO: 67217 - protein, 28 aa, Artificial Sequence
  Description of Artificial Sequence: Synthetic peptide
AENEIACTNPVATEQYGEASENPQRGGR

SEQ ID NO: 67218 - protein, 28 aa, Artificial Sequence
  Description of Artificial Sequence: Synthetic peptide
AENEIATTNPVATEQYGEASENLQREGL

SEQ ID NO: 67219 - protein, 33 aa, Artificial Sequence
  Description of Artificial Sequence: Synthetic polypeptide
AEEEIRTTNPVATEQYGSVSTVTNLQENATNAQ

SEQ ID NO: 67220 - protein, 32 aa, Artificial Sequence
  Description of Artificial Sequence: Synthetic polypeptide
DEEEICTTNPVATEQWGSVSTNLQNPGEDTAM

SEQ ID NO: 67221 - protein, 29 aa, Artificial Sequence
  Description of Artificial Sequence: Synthetic peptide
AENEIACTNPVATEQYGEAKSENLQRGGR

SEQ ID NO: 67222 - protein, 31 aa, Artificial Sequence
  Description of Artificial Sequence: Synthetic polypeptide
DEECIRTTNPVATEQYGCVCSNTNDQFGSEQ

SEQ ID NO: 67223 - protein, 29 aa, Artificial Sequence
  Description of Artificial Sequence: Synthetic peptide
AENEIACTNPVATEQYGEASENPLQRGGR

SEQ ID NO: 67224 - protein, 31 aa, Artificial Sequence
  Description of Artificial Sequence: Synthetic polypeptide
DEEEIRCTNPVAYEQWGSVSVNQSDRGGNNR

SEQ ID NO: 67225 - protein, 31 aa, Artificial Sequence
  Description of Artificial Sequence: Synthetic polypeptide
DEEEIRGTNPVATEQYGSVSVVGDRVSNSRN

SEQ ID NO: 67226 - protein, 32 aa, Artificial Sequence
  Description of Artificial Sequence: Synthetic polypeptide
DEEEIRGTNPVATEQYGSVSVVMQDRVSNNRN

SEQ ID NO: 67227 - protein, 33 aa, Artificial Sequence
  Description of Artificial Sequence: Synthetic polypeptide
DEEEICTTNPVATEQWGSTVSTNEDSQPPGGNR

SEQ ID NO: 67228 - protein, 29 aa, Artificial Sequence
  Description of Artificial Sequence: Synthetic peptide
DEDEIRTTNPVAYEQWGATSTNLQQGDTS

SEQ ID NO: 67229 - protein, 29 aa, Artificial Sequence
  Description of Artificial Sequence: Synthetic peptide
AENEIACTNPVATEQYGEAKETNLQRGGR

SEQ ID NO: 67230 - protein, 30 aa, Artificial Sequence
  Description of Artificial Sequence: Synthetic polypeptide
DEECIATVNPVATEEYGCVSHDNLQEEGNR

SEQ ID NO: 67231 - protein, 29 aa, Artificial Sequence
  Description of Artificial Sequence: Synthetic peptide
AENEIACTNPVATEQYGEWASENLQRGGR

SEQ ID NO: 67232 - protein, 28 aa, Artificial Sequence
  Description of Artificial Sequence: Synthetic peptide
AENEIACTNPVATEQYGEASENNQRGGR

SEQ ID NO: 67233 - protein, 33 aa, Artificial Sequence
  Description of Artificial Sequence: Synthetic polypeptide
DEDEIRTTNPVATTQYGSVSTTNQNLQQGNNTD

SEQ ID NO: 67234 - protein, 34 aa, Artificial Sequence
  Description of Artificial Sequence: Synthetic polypeptide
DEEEIRTTNPVATEGYGIVVSGTVNLQDRNVNRT

SEQ ID NO: 67235 - protein, 32 aa, Artificial Sequence
  Description of Artificial Sequence: Synthetic polypeptide
DEAEIRTTNPVATEQYGSVISTNLDVNTDNQE

SEQ ID NO: 67236 - protein, 33 aa, Artificial Sequence
  Description of Artificial Sequence: Synthetic polypeptide
DEEEIRCTNPVAYEQYGSVVSVNEQSDRGGNNR

SEQ ID NO: 67237 - protein, 33 aa, Artificial Sequence
  Description of Artificial Sequence: Synthetic polypeptide
DEEEICTTNPVATEQYGSVSTGLNQGNAGENGM

SEQ ID NO: 67238 - protein, 32 aa, Artificial Sequence
  Description of Artificial Sequence: Synthetic polypeptide
DEEEICTTNPVATEQYGSVSTGGNQGNQGNNM

SEQ ID NO: 67239 - protein, 32 aa, Artificial Sequence
  Description of Artificial Sequence: Synthetic polypeptide
DEEEICTTNPVATEQYGSVSTGGNQGGHGDNA

SEQ ID NO: 67240 - protein, 32 aa, Artificial Sequence
  Description of Artificial Sequence: Synthetic polypeptide
DEEEIRTTNPVATEFYGSVSTPNDQEDGEMGG

SEQ ID NO: 67241 - protein, 34 aa, Artificial Sequence
  Description of Artificial Sequence: Synthetic polypeptide
DEEEICTTNPVATEQYGSVSTGGNLQDHQGGNGM

SEQ ID NO: 67242 - protein, 29 aa, Artificial Sequence
  Description of Artificial Sequence: Synthetic peptide
DEEAIRTTNPVATECYGKGSTNEQPPSNP

SEQ ID NO: 67243 - protein, 28 aa, Artificial Sequence
  Description of Artificial Sequence: Synthetic peptide
AENEIACTNPVACEQYGEASENLQRGGR

SEQ ID NO: 67244 - protein, 34 aa, Artificial Sequence
  Description of Artificial Sequence: Synthetic polypeptide
DEEEINTTNPVATEQYGKVSCTNSLSQVRGGENG

SEQ ID NO: 67245 - protein, 28 aa, Artificial Sequence
  Description of Artificial Sequence: Synthetic peptide
AENEIACTNPVACEQYGEASENLQRGSR

SEQ ID NO: 67246 - protein, 34 aa, Artificial Sequence
  Description of Artificial Sequence: Synthetic polypeptide
AEEEIRTTNPVATEQYGSVSTVSNLEQGTEAGNE

SEQ ID NO: 67247 - protein, 33 aa, Artificial Sequence
  Description of Artificial Sequence: Synthetic polypeptide
DEEEICTTNPVATEQYGSVSTGGLQGNHGDNEH

SEQ ID NO: 67248 - protein, 32 aa, Artificial Sequence
  Description of Artificial Sequence: Synthetic polypeptide
DEEAIRTTNPVATEQYGCVSHTQNDQHQGGNA

SEQ ID NO: 67249 - protein, 32 aa, Artificial Sequence
  Description of Artificial Sequence: Synthetic polypeptide
DEEEICTTNPVATEQYGSVSTGNGDSQGNDEE

SEQ ID NO: 67250 - protein, 31 aa, Artificial Sequence
  Description of Artificial Sequence: Synthetic polypeptide
AEEEIRTTNPVATEQYGSVSTVQQQQTNQNT

SEQ ID NO: 67251 - protein, 28 aa, Artificial Sequence
  Description of Artificial Sequence: Synthetic peptide
AENEIACTNPVATEQYGEASERLQRGGR

SEQ ID NO: 67252 - protein, 28 aa, Artificial Sequence
  Description of Artificial Sequence: Synthetic peptide
AENEIACTNPVADEQYGEASYNLQRGGR

SEQ ID NO: 67253 - protein, 28 aa, Artificial Sequence
  Description of Artificial Sequence: Synthetic peptide
AENEIACTNPVATEQYGWASENLQYGGR

SEQ ID NO: 67254 - protein, 33 aa, Artificial Sequence
  Description of Artificial Sequence: Synthetic polypeptide
AEEEIRTTNPVATEQYGSVSTVTNLNSNGNNST

SEQ ID NO: 67255 - protein, 32 aa, Artificial Sequence
  Description of Artificial Sequence: Synthetic polypeptide
DEAEIRTTNPVATEQYGSVNSADQQRGENHPG

SEQ ID NO: 67256 - protein, 28 aa, Artificial Sequence
  Description of Artificial Sequence: Synthetic peptide
AENEIACTNPVAFEQYGEASENLQRGGR

SEQ ID NO: 67257 - protein, 32 aa, Artificial Sequence
  Description of Artificial Sequence: Synthetic polypeptide
DEEEICTTNPVATEQYGSVSTGDQGGHGNTEE

SEQ ID NO: 67258 - protein, 30 aa, Artificial Sequence
  Description of Artificial Sequence: Synthetic polypeptide
DDSEIRTTNPVAWEQYGEVSNYNNLQGPNR

SEQ ID NO: 67259 - protein, 33 aa, Artificial Sequence
  Description of Artificial Sequence: Synthetic polypeptide
DEEEICTTNPVATEQYGSVSTDNGGGDRQGGNS

SEQ ID NO: 67260 - protein, 31 aa, Artificial Sequence
  Description of Artificial Sequence: Synthetic polypeptide
DEEAIRTTNPVATEQYGCVSTELQYFGSEQA

SEQ ID NO: 67261 - protein, 28 aa, Artificial Sequence
  Description of Artificial Sequence: Synthetic peptide
AENEIACTNPVATEQYGYASEQLQRGGR

SEQ ID NO: 67262 - protein, 33 aa, Artificial Sequence
  Description of Artificial Sequence: Synthetic polypeptide
AEEEIRTTNPVATEQYGSVSTVTNSTTNQSGNY

SEQ ID NO: 67263 - protein, 28 aa, Artificial Sequence
  Description of Artificial Sequence: Synthetic peptide
AENEIACTNPVADEQYGEASENLQRGGR

SEQ ID NO: 67264 - protein, 29 aa, Artificial Sequence
  Description of Artificial Sequence: Synthetic peptide
AENEIACTNPVATEQYGWASENILQRGGR

SEQ ID NO: 67265 - protein, 29 aa, Artificial Sequence
  Description of Artificial Sequence: Synthetic peptide
AENEIACTNPVATEQYGVVASENLQRGGT

SEQ ID NO: 67266 - protein, 29 aa, Artificial Sequence
  Description of Artificial Sequence: Synthetic peptide
AENEIACTNPVATEQYGVTSENLQRGGRE

SEQ ID NO: 67267 - protein, 29 aa, Artificial Sequence
  Description of Artificial Sequence: Synthetic peptide
DEEEIRCTNPVSTEPYGTISMNIQQRGNH

SEQ ID NO: 67268 - protein, 32 aa, Artificial Sequence
  Description of Artificial Sequence: Synthetic polypeptide
DEEEIRTTNPVATECWGSVSCINEPQDRGENG

SEQ ID NO: 67269 - protein, 31 aa, Artificial Sequence
  Description of Artificial Sequence: Synthetic polypeptide
DEEEICTTNPVATERWGSVVFTNWQQGLNRM

SEQ ID NO: 67270 - protein, 34 aa, Artificial Sequence
  Description of Artificial Sequence: Synthetic polypeptide
DEAEIRTTNPVATEQYGSVNSTQNLEIDPSGSNR

SEQ ID NO: 67271 - protein, 32 aa, Artificial Sequence
  Description of Artificial Sequence: Synthetic polypeptide
DEAEIRTTNPVATEQWGEVSTNLQIGGDNDEE

SEQ ID NO: 67272 - protein, 29 aa, Artificial Sequence
  Description of Artificial Sequence: Synthetic peptide
AENEIACTNPVATEQYGVEASENLQRGGR

SEQ ID NO: 67273 - protein, 28 aa, Artificial Sequence
  Description of Artificial Sequence: Synthetic peptide
AENEIACTNPSATEQYGEASENLQRGGR

SEQ ID NO: 67274 - protein, 31 aa, Artificial Sequence
  Description of Artificial Sequence: Synthetic polypeptide
DEAEIRTTNPVATEQWGEVSTNLQGNDDNGA

SEQ ID NO: 67275 - protein, 32 aa, Artificial Sequence
  Description of Artificial Sequence: Synthetic polypeptide
DEEEIRTTNPVATEFYGSVSTPNNGTGGENGD

SEQ ID NO: 67276 - protein, 32 aa, Artificial Sequence
  Description of Artificial Sequence: Synthetic polypeptide
DEEEIRTTNPVATEFYGSVSTPNMGTVGNDQD

SEQ ID NO: 67277 - protein, 28 aa, Artificial Sequence
  Description of Artificial Sequence: Synthetic peptide
AENEIACTNPTATEQYGEASENLQRGGR

SEQ ID NO: 67278 - protein, 33 aa, Artificial Sequence
  Description of Artificial Sequence: Synthetic polypeptide
DEEEICTTNPVATEQYGSVVSCTNEPSQPPVNR

SEQ ID NO: 67279 - protein, 32 aa, Artificial Sequence
  Description of Artificial Sequence: Synthetic polypeptide
DEAEIRTTNPVATEQYGSVSFTYVLSNGEDRF

SEQ ID NO: 67280 - protein, 31 aa, Artificial Sequence
  Description of Artificial Sequence: Synthetic polypeptide
DEEEICTTNPVATEQYGSVVNKPNDDRMNDR

SEQ ID NO: 67281 - protein, 32 aa, Artificial Sequence
  Description of Artificial Sequence: Synthetic polypeptide
DEAEIRTTNPVATEQWGEVSTNLNSNGDNGSR

SEQ ID NO: 67282 - protein, 32 aa, Artificial Sequence
  Description of Artificial Sequence: Synthetic polypeptide
DEEEIRTTNPVATEFYGSVSTPNMGMTGGNGG

SEQ ID NO: 67283 - protein, 32 aa, Artificial Sequence
  Description of Artificial Sequence: Synthetic polypeptide
DEEEICTTNPVATEQYGSVSVSGGLSQTVGNQ

SEQ ID NO: 67284 - protein, 33 aa, Artificial Sequence
  Description of Artificial Sequence: Synthetic polypeptide
AEEEIRTTNPVATEQYGSVSTVTNLNSNEGTNT

SEQ ID NO: 67285 - protein, 34 aa, Artificial Sequence
  Description of Artificial Sequence: Synthetic polypeptide
DEEEICTTNPVATEQYGSVSTNGGLQGNQGENGQ

SEQ ID NO: 67286 - protein, 32 aa, Artificial Sequence
  Description of Artificial Sequence: Synthetic polypeptide
DEEEICTTNPVATEQYGSVSTNGGGEHGNGPS

SEQ ID NO: 67287 - protein, 32 aa, Artificial Sequence
  Description of Artificial Sequence: Synthetic polypeptide
DEEEIRTTNPVATECWGSVSEINEPQREGENK

SEQ ID NO: 67288 - protein, 32 aa, Artificial Sequence
  Description of Artificial Sequence: Synthetic polypeptide
DEEEICTTNPVATEQYGSVSTGPDQGGHGGNE

SEQ ID NO: 67289 - protein, 33 aa, Artificial Sequence
  Description of Artificial Sequence: Synthetic polypeptide
DEEEIRTTNPVATEFYGSVSTPNLQEDGFEQGE

SEQ ID NO: 67290 - protein, 33 aa, Artificial Sequence
  Description of Artificial Sequence: Synthetic polypeptide
DEEEICTTNPVATEQYGSVSTGNQGQDGGGGRE

SEQ ID NO: 67291 - protein, 34 aa, Artificial Sequence
  Description of Artificial Sequence: Synthetic polypeptide
DEEEICTTNPVATEQYGSVSTGNLQGNHGENNGQ

SEQ ID NO: 67292 - protein, 34 aa, Artificial Sequence
  Description of Artificial Sequence: Synthetic polypeptide
DEEEICTTNPVATEQYGSVSTGNLGQGNQGQNNM

SEQ ID NO: 67293 - protein, 32 aa, Artificial Sequence
  Description of Artificial Sequence: Synthetic polypeptide
DEEEIRTTNPVATEFYGSVSTPNFGMTNGGNG

SEQ ID NO: 67294 - protein, 30 aa, Artificial Sequence
  Description of Artificial Sequence: Synthetic polypeptide
DEECIRTTNPVATEIYGCVETNLQHFGSDQ

SEQ ID NO: 67295 - protein, 28 aa, Artificial Sequence
  Description of Artificial Sequence: Synthetic peptide
AEMEICATNPVATEQYGVASENLQVGER

SEQ ID NO: 67296 - protein, 32 aa, Artificial Sequence
  Description of Artificial Sequence: Synthetic polypeptide
DEEAIRTTNPVATEQYGCVSTGNHQNFGSNQM

SEQ ID NO: 67297 - protein, 28 aa, Artificial Sequence
  Description of Artificial Sequence: Synthetic peptide
AENEIACTNPVAHEQYGEASENLQRGGR

SEQ ID NO: 67298 - protein, 31 aa, Artificial Sequence
  Description of Artificial Sequence: Synthetic polypeptide
DEDEIRTTNPVATTQYGVVSTNLEEGNNDQN

SEQ ID NO: 67299 - protein, 32 aa, Artificial Sequence
  Description of Artificial Sequence: Synthetic polypeptide
AEEEIRTTNPVATEQYGSVSTVQQQQGTNAND

SEQ ID NO: 67300 - protein, 32 aa, Artificial Sequence
  Description of Artificial Sequence: Synthetic polypeptide
DEECIRTTNPVATEPYGQVATNGLSQNGGNNR

SEQ ID NO: 67301 - protein, 34 aa, Artificial Sequence
  Description of Artificial Sequence: Synthetic polypeptide
DEECIRTTNPVATEPYGSTVSCTNMLQTGGNPRR

SEQ ID NO: 67302 - protein, 31 aa, Artificial Sequence
  Description of Artificial Sequence: Synthetic polypeptide
DEDEIRTTNPVATTQYGVVSTNLEAGNDEDE

SEQ ID NO: 67303 - protein, 31 aa, Artificial Sequence
  Description of Artificial Sequence: Synthetic polypeptide
AEEEIRTTNPVATEQYGSVSTVQQQQDTNEN

SEQ ID NO: 67304 - protein, 33 aa, Artificial Sequence
  Description of Artificial Sequence: Synthetic polypeptide
AEEEIRTTNPVATEQYGSVSTVTNLNSNNGNGG

SEQ ID NO: 67305 - protein, 28 aa, Artificial Sequence
  Description of Artificial Sequence: Synthetic peptide
AENEIACTNPVATDQYGEASENLQRGGR

SEQ ID NO: 67306 - protein, 32 aa, Artificial Sequence
  Description of Artificial Sequence: Synthetic polypeptide
AEEEIRTTNPVATEQYGSVSTVQQQGQTNNND

SEQ ID NO: 67307 - protein, 30 aa, Artificial Sequence
  Description of Artificial Sequence: Synthetic polypeptide
DEECIRTTNPVATEQWGCVATDNLQLDVNQ

SEQ ID NO: 67308 - protein, 30 aa, Artificial Sequence
  Description of Artificial Sequence: Synthetic polypeptide
DEDEIRTTNPVATTQYGVVSTDNNEEGNVD

SEQ ID NO: 67309 - protein, 28 aa, Artificial Sequence
  Description of Artificial Sequence: Synthetic peptide
AENEIACTNPVATERYGEASENLQRGGR

SEQ ID NO: 67310 - protein, 28 aa, Artificial Sequence
  Description of Artificial Sequence: Synthetic peptide
AENEIACTNPVATCQYGEASENLQRGGR

SEQ ID NO: 67311 - protein, 31 aa, Artificial Sequence
  Description of Artificial Sequence: Synthetic polypeptide
DEEEIRTTNPVATEFYGSVSTPGFGGNEGNQ

SEQ ID NO: 67312 - protein, 34 aa, Artificial Sequence
  Description of Artificial Sequence: Synthetic polypeptide
DEEEICTTNPVATEQYGSVPSCTNNGSQPPGTNR

SEQ ID NO: 67313 - protein, 32 aa, Artificial Sequence
  Description of Artificial Sequence: Synthetic polypeptide
DEDEIRTTNPVAYEPYGQSVSTNQSQREGSRS

SEQ ID NO: 67314 - protein, 32 aa, Artificial Sequence
  Description of Artificial Sequence: Synthetic polypeptide
DEEEICTTNPVATEQYGSVCETNNAQLRGGLE

SEQ ID NO: 67315 - protein, 30 aa, Artificial Sequence
  Description of Artificial Sequence: Synthetic polypeptide
DEEAIRTTNPDATEGYGSCSTPLARGNQDD

SEQ ID NO: 67316 - protein, 31 aa, Artificial Sequence
  Description of Artificial Sequence: Synthetic polypeptide
DEEEIRTTNPVATEFYGSVSTPDIGTDGNED

SEQ ID NO: 67317 - protein, 31 aa, Artificial Sequence
  Description of Artificial Sequence: Synthetic polypeptide
DEEEICTTNPVATEQYGSVAITNLETGEDTM

SEQ ID NO: 67318 - protein, 30 aa, Artificial Sequence
  Description of Artificial Sequence: Synthetic polypeptide
DEACIRTTNPLATEQFGSVCSWNLQSFGNQ

SEQ ID NO: 67319 - protein, 28 aa, Artificial Sequence
  Description of Artificial Sequence: Synthetic peptide
AENEIACTNPVATESYGEASENLQRGGR

SEQ ID NO: 67320 - protein, 28 aa, Artificial Sequence
  Description of Artificial Sequence: Synthetic peptide
AENEIACTNPVATESYGEASVNLQRGGR

SEQ ID NO: 67321 - protein, 34 aa, Artificial Sequence
  Description of Artificial Sequence: Synthetic polypeptide
DEEEIGTTNPVATEHYGSVSYTNELQERTVGNNL

SEQ ID NO: 67322 - protein, 33 aa, Artificial Sequence
  Description of Artificial Sequence: Synthetic polypeptide
DEDEIRTTNPVATTQYGSVSTVNQNLQQGSNDE

SEQ ID NO: 67323 - protein, 29 aa, Artificial Sequence
  Description of Artificial Sequence: Synthetic peptide
DEEAIRTTNPDATEGYGSCSTNLARTQDP

SEQ ID NO: 67324 - protein, 29 aa, Artificial Sequence
  Description of Artificial Sequence: Synthetic peptide
AENEIACTNPVATEQYGEAMSENLQRGGR

SEQ ID NO: 67325 - protein, 28 aa, Artificial Sequence
  Description of Artificial Sequence: Synthetic peptide
AENEIACTNPVATAQYGEASENLQRGGR

SEQ ID NO: 67326 - protein, 31 aa, Artificial Sequence
  Description of Artificial Sequence: Synthetic polypeptide
DEEEIRCTNPVAYERYGSVSSNQSDRGGNNR

SEQ ID NO: 67327 - protein, 28 aa, Artificial Sequence
  Description of Artificial Sequence: Synthetic peptide
AENEIACTNPVASEQYGIVSCNLQSGGR

SEQ ID NO: 67328 - protein, 34 aa, Artificial Sequence
  Description of Artificial Sequence: Synthetic polypeptide
DEEEIGTTNPVATEAYGSVPSCTNMLQERTGGNL

SEQ ID NO: 67329 - protein, 29 aa, Artificial Sequence
  Description of Artificial Sequence: Synthetic peptide
AENEIACTNPVATEQYGYAWSENLQRGGR

SEQ ID NO: 67330 - protein, 28 aa, Artificial Sequence
  Description of Artificial Sequence: Synthetic peptide
AENEIACTNPVAIEQYGEASENLQRGGR

SEQ ID NO: 67331 - protein, 32 aa, Artificial Sequence
  Description of Artificial Sequence: Synthetic polypeptide
AEEEIRTTNPVATEQYGSVSTVTNLNSNNDNT

SEQ ID NO: 67332 - protein, 33 aa, Artificial Sequence
  Description of Artificial Sequence: Synthetic polypeptide
DEEEIGTTNPVATECYGSVSTGNQGAQERMGNL

SEQ ID NO: 67333 - protein, 33 aa, Artificial Sequence
  Description of Artificial Sequence: Synthetic polypeptide
DEAEIRTTNPVATEQYGSVSWTDMLEQRGGEDY

SEQ ID NO: 67334 - protein, 28 aa, Artificial Sequence
  Description of Artificial Sequence: Synthetic peptide
AENEIACTNPVAMEQYGEASENLQRGGR

SEQ ID NO: 67335 - protein, 28 aa, Artificial Sequence
  Description of Artificial Sequence: Synthetic peptide
AENEIACTNPVAMEQYGETSENLQRGGR

SEQ ID NO: 67336 - protein, 29 aa, Artificial Sequence
  Description of Artificial Sequence: Synthetic peptide
AENEIACTNPVATEQYWGEASENLQRGGR

SEQ ID NO: 67337 - protein, 31 aa, Artificial Sequence
  Description of Artificial Sequence: Synthetic polypeptide
DEEAIRTTNPVATEQYGCVSTNDCQFGIEKI

SEQ ID NO: 67338 - protein, 32 aa, Artificial Sequence
  Description of Artificial Sequence: Synthetic polypeptide
DEECIRTTNPVATEIYGQVTTNLNQGDTGNNR

SEQ ID NO: 67339 - protein, 31 aa, Artificial Sequence
  Description of Artificial Sequence: Synthetic polypeptide
DEECIRTTNPVATEIYGQVTTNMNQGDGSNR

SEQ ID NO: 67340 - protein, 30 aa, Artificial Sequence
  Description of Artificial Sequence: Synthetic polypeptide
DEEAIRTTNPVATEQYGCVSTNICQFNEEF

SEQ ID NO: 67341 - protein, 31 aa, Artificial Sequence
  Description of Artificial Sequence: Synthetic polypeptide
DEDEIRTTNPVATTQYGVVSTNLESGTNTNN

SEQ ID NO: 67342 - protein, 31 aa, Artificial Sequence
  Description of Artificial Sequence: Synthetic polypeptide
DEDEIRTTNPVATTQYGVVSTNLEQGNTQDE

SEQ ID NO: 67343 - protein, 28 aa, Artificial Sequence
  Description of Artificial Sequence: Synthetic peptide
AENEIACTNPVASEQYGEASCNLQRGGR

SEQ ID NO: 67344 - protein, 31 aa, Artificial Sequence
  Description of Artificial Sequence: Synthetic polypeptide
DEDEIRTTNPVATTQYGVVSTNLEEGTNEED

SEQ ID NO: 67345 - protein, 30 aa, Artificial Sequence
  Description of Artificial Sequence: Synthetic polypeptide
DEEEIRTTNPVATECYGAAHSTNEQYPINF

SEQ ID NO: 67346 - protein, 29 aa, Artificial Sequence
  Description of Artificial Sequence: Synthetic peptide
AEDEIACTNPVATEQYGEASENLQRGMGR

SEQ ID NO: 67347 - protein, 30 aa, Artificial Sequence
  Description of Artificial Sequence: Synthetic polypeptide
DEEEIRTTNPVATECYGAMSTGNEQGDTNE

SEQ ID NO: 67348 - protein, 28 aa, Artificial Sequence
  Description of Artificial Sequence: Synthetic peptide
AENEIACTNPVASEQYGEASENLQRGGR

SEQ ID NO: 67349 - protein, 32 aa, Artificial Sequence
  Description of Artificial Sequence: Synthetic polypeptide
DEAEIRTTNPVATEQYGSVSLTNHNTGDENEM

SEQ ID NO: 67350 - protein, 29 aa, Artificial Sequence
  Description of Artificial Sequence: Synthetic peptide
DEECIGTVNPVATEGYGSVCSWELERGNQ

SEQ ID NO: 67351 - protein, 31 aa, Artificial Sequence
  Description of Artificial Sequence: Synthetic polypeptide
DEDEIRTTNPVATTQYGVVSTNLEEGNNEDT

SEQ ID NO: 67352 - protein, 31 aa, Artificial Sequence
  Description of Artificial Sequence: Synthetic polypeptide
DEEEIRTTNPVATEFYGSVSTPGFGTGEGNI

SEQ ID NO: 67353 - protein, 31 aa, Artificial Sequence
  Description of Artificial Sequence: Synthetic polypeptide
DEEEIRTTNPVATEGYGCISTENEQRFSSNF

SEQ ID NO: 67354 - protein, 30 aa, Artificial Sequence
  Description of Artificial Sequence: Synthetic polypeptide
DEAEIRTTNPVATEQYGSVMVQNLFGNMNM

SEQ ID NO: 67355 - protein, 34 aa, Artificial Sequence
  Description of Artificial Sequence: Synthetic polypeptide
DEEEICTTNPVATEQYGSVSCTHDLIQIRENANR

SEQ ID NO: 67356 - protein, 28 aa, Artificial Sequence
  Description of Artificial Sequence: Synthetic peptide
AENEIACTNPVGTEQYGEASENLQRGGR

SEQ ID NO: 67357 - protein, 33 aa, Artificial Sequence
  Description of Artificial Sequence: Synthetic polypeptide
DEEEICTTNPVAYEQYGSVSYTNEQSQERTGNL

SEQ ID NO: 67358 - protein, 33 aa, Artificial Sequence
  Description of Artificial Sequence: Synthetic polypeptide
DEEEIRCTNPVATEQYGSVSSTPNGNMRNGNPV

SEQ ID NO: 67359 - protein, 28 aa, Artificial Sequence
  Description of Artificial Sequence: Synthetic peptide
AENEIACTNPVATEQYGEASENLQRGGG

SEQ ID NO: 67360 - protein, 29 aa, Artificial Sequence
  Description of Artificial Sequence: Synthetic peptide
AENEIACTNPVATEQYGEASENLQRGGGR

SEQ ID NO: 67361 - protein, 34 aa, Artificial Sequence
  Description of Artificial Sequence: Synthetic polypeptide
AEEEIRTTNPVATEQYGSVSTVNLLQSGNVNTNA

SEQ ID NO: 67362 - protein, 29 aa, Artificial Sequence
  Description of Artificial Sequence: Synthetic peptide
AEEEIACTNPVATEQYGAVATNLQDGGDD

SEQ ID NO: 67363 - protein, 30 aa, Artificial Sequence
  Description of Artificial Sequence: Synthetic polypeptide
AEEEIACTNPVATEQYGAVATNLQDPGVDR

SEQ ID NO: 67364 - protein, 28 aa, Artificial Sequence
  Description of Artificial Sequence: Synthetic peptide
AENEIACTNPVATEQYGEASENLQRGGH

SEQ ID NO: 67365 - protein, 28 aa, Artificial Sequence
  Description of Artificial Sequence: Synthetic peptide
AENEIACTNPVATEQYGEASENLQRGGI

SEQ ID NO: 67366 - protein, 29 aa, Artificial Sequence
  Description of Artificial Sequence: Synthetic peptide
AENEIACTNPVATEQYGEASENLQRGGIR

SEQ ID NO: 67367 - protein, 33 aa, Artificial Sequence
  Description of Artificial Sequence: Synthetic polypeptide
DEEEIRTTNPVATEGYGSVCSNTELQGFGSNDS

SEQ ID NO: 67368 - protein, 28 aa, Artificial Sequence
  Description of Artificial Sequence: Synthetic peptide
AENEIACTNPVATEQYGEASENLQRGGK

SEQ ID NO: 67369 - protein, 29 aa, Artificial Sequence
  Description of Artificial Sequence: Synthetic peptide
DEAEIRTTNPDATEGYGSCSTPLFRGEDG

SEQ ID NO: 67370 - protein, 32 aa, Artificial Sequence
  Description of Artificial Sequence: Synthetic polypeptide
DEEEIATTNPVAYEQYGSVATNLQGAPAEGNP

SEQ ID NO: 67371 - protein, 32 aa, Artificial Sequence
  Description of Artificial Sequence: Synthetic polypeptide
CEEEIRTTNPVATEQYGCVCSMTNHQGGSNTQ

SEQ ID NO: 67372 - protein, 34 aa, Artificial Sequence
  Description of Artificial Sequence: Synthetic polypeptide
AEEEIRTTNPVATEQYGSVSTVNLLQNQIGTNEI

SEQ ID NO: 67373 - protein, 29 aa, Artificial Sequence
  Description of Artificial Sequence: Synthetic peptide
AENEIACTNPVATEQYGEASENLQRGGKR

SEQ ID NO: 67374 - protein, 28 aa, Artificial Sequence
  Description of Artificial Sequence: Synthetic peptide
AENEIACTNPVATEQYGEASENLQRGGL

SEQ ID NO: 67375 - protein, 32 aa, Artificial Sequence
  Description of Artificial Sequence: Synthetic polypeptide
DEEEIRATNPVATEQYGSVSTVNQDTGSNNQD

SEQ ID NO: 67376 - protein, 28 aa, Artificial Sequence
  Description of Artificial Sequence: Synthetic peptide
AENEIACTNPVATEQYGEASENLQRVGR

SEQ ID NO: 67377 - protein, 29 aa, Artificial Sequence
  Description of Artificial Sequence: Synthetic peptide
AENEIACTNPVATEQYGEASENLQRVGQR

SEQ ID NO: 67378 - protein, 29 aa, Artificial Sequence
  Description of Artificial Sequence: Synthetic peptide
AENEIACTNPVATEQYGAAHSENLQRGGR

SEQ ID NO: 67379 - protein, 33 aa, Artificial Sequence
  Description of Artificial Sequence: Synthetic polypeptide
DEEEIRATNPVATEQYGSVSTVQNQQDTGSNNQ

SEQ ID NO: 67380 - protein, 28 aa, Artificial Sequence
  Description of Artificial Sequence: Synthetic peptide
AENEIACTNPVATEQYGAASEGLQRGGR

SEQ ID NO: 67381 - protein, 29 aa, Artificial Sequence
  Description of Artificial Sequence: Synthetic peptide
AENEIACTNPVATEQYGEASENLQRGGLR

SEQ ID NO: 67382 - protein, 30 aa, Artificial Sequence
  Description of Artificial Sequence: Synthetic polypeptide
DEAEIRTTNPVAYEQWGSVCTGLIREMNNR

SEQ ID NO: 67383 - protein, 29 aa, Artificial Sequence
  Description of Artificial Sequence: Synthetic peptide
AENEIACTNPVATEQYGAASIENLQRGGR

SEQ ID NO: 67384 - protein, 29 aa, Artificial Sequence
  Description of Artificial Sequence: Synthetic peptide
AENEIACTNPVATEQYGEASENLQRGGFR

SEQ ID NO: 67385 - protein, 32 aa, Artificial Sequence
  Description of Artificial Sequence: Synthetic polypeptide
DEEEIATTNPVAYEQYGSVATNLQMNPDGERG

SEQ ID NO: 67386 - protein, 30 aa, Artificial Sequence
  Description of Artificial Sequence: Synthetic polypeptide
AEEEIACTNPVATEQWGSVAITNDQDRGNQ

SEQ ID NO: 67387 - protein, 33 aa, Artificial Sequence
  Description of Artificial Sequence: Synthetic polypeptide
AEEEIRTTNPVATEQYGSVSTVNLNENNNGNTQ

SEQ ID NO: 67388 - protein, 28 aa, Artificial Sequence
  Description of Artificial Sequence: Synthetic peptide
AENEIACTNPVATEQYGEASENLQRGGA

SEQ ID NO: 67389 - protein, 29 aa, Artificial Sequence
  Description of Artificial Sequence: Synthetic peptide
AENEIACTNPVATEQYGEASENLQRGGAR

SEQ ID NO: 67390 - protein, 28 aa, Artificial Sequence
  Description of Artificial Sequence: Synthetic peptide
AENEIACTNPVATEQYGEASENLQRGGC

SEQ ID NO: 67391 - protein, 34 aa, Artificial Sequence
  Description of Artificial Sequence: Synthetic polypeptide
DEEEIRATNPVATEQYGSVSTVNLQNDEQGSNNE

SEQ ID NO: 67392 - protein, 31 aa, Artificial Sequence
  Description of Artificial Sequence: Synthetic polypeptide
DEEEIATTNPVAYEQYGSVATNLQVPDESNN

SEQ ID NO: 67393 - protein, 28 aa, Artificial Sequence
  Description of Artificial Sequence: Synthetic peptide
DEECEATTNPIAYEQWGEVSTNLQHGNA

SEQ ID NO: 67394 - protein, 32 aa, Artificial Sequence
  Description of Artificial Sequence: Synthetic polypeptide
DEEEIRATNPVTTEQYGSVATNNNLQQGTNNG

SEQ ID NO: 67395 - protein, 28 aa, Artificial Sequence
  Description of Artificial Sequence: Synthetic peptide
DEAEIAATNGCAYMQYGSVATNLQRGDR

SEQ ID NO: 67396 - protein, 30 aa, Artificial Sequence
  Description of Artificial Sequence: Synthetic polypeptide
DEEEIATTNPVAYEQYGSVATNLQVNDSDE

SEQ ID NO: 67397 - protein, 29 aa, Artificial Sequence
  Description of Artificial Sequence: Synthetic peptide
AENEIACTNPVATEQYGEATSENLQRGAR

SEQ ID NO: 67398 - protein, 29 aa, Artificial Sequence
  Description of Artificial Sequence: Synthetic peptide
DEAEIAATNGCAYMQYGSVSTNLQPGDNR

SEQ ID NO: 67399 - protein, 31 aa, Artificial Sequence
  Description of Artificial Sequence: Synthetic polypeptide
DEEEIATTNPVAYEQYGSVATNLQVGDQLDQ

SEQ ID NO: 67400 - protein, 31 aa, Artificial Sequence
  Description of Artificial Sequence: Synthetic polypeptide
DEEEIATTNPVAYEQYGSVATNLQDTGADTN

SEQ ID NO: 67401 - protein, 28 aa, Artificial Sequence
  Description of Artificial Sequence: Synthetic peptide
AENEIACTNPVATEQYGEASENLQRGGD

SEQ ID NO: 67402 - protein, 29 aa, Artificial Sequence
  Description of Artificial Sequence: Synthetic peptide
AENEIACTNPVATEQYGEASENLQRGGDR

SEQ ID NO: 67403 - protein, 32 aa, Artificial Sequence
  Description of Artificial Sequence: Synthetic polypeptide
DEEEIATTNPVAYEQYGSVATNLQTPPGNDPH

SEQ ID NO: 67404 - protein, 28 aa, Artificial Sequence
  Description of Artificial Sequence: Synthetic peptide
AENEIACTNPVATEQYGEASENLQRGGE

SEQ ID NO: 67405 - protein, 32 aa, Artificial Sequence
  Description of Artificial Sequence: Synthetic polypeptide
DEEEIATTNPVAYEQYGSVATNLQTDGPDERG

SEQ ID NO: 67406 - protein, 32 aa, Artificial Sequence
  Description of Artificial Sequence: Synthetic polypeptide
DEEEIATTNPVAYEQYGSVATNLQRNHPDGLA

SEQ ID NO: 67407 - protein, 32 aa, Artificial Sequence
  Description of Artificial Sequence: Synthetic polypeptide
DEEEIATTNPVAYEQYGSVATNLQPDGEGNQD

SEQ ID NO: 67408 - protein, 29 aa, Artificial Sequence
  Description of Artificial Sequence: Synthetic peptide
AENEIACTNPVATEQYGEASENLQRGGER

SEQ ID NO: 67409 - protein, 28 aa, Artificial Sequence
  Description of Artificial Sequence: Synthetic peptide
AENEIACTNPVATEQYGEASENLQRGGF

SEQ ID NO: 67410 - protein, 28 aa, Artificial Sequence
  Description of Artificial Sequence: Synthetic peptide
AENEIACTNPVATEQYGEAVENLQRGGR

SEQ ID NO: 67411 - protein, 28 aa, Artificial Sequence
  Description of Artificial Sequence: Synthetic peptide
DEAEIACTNPVATAQWGCVATNLERGND

SEQ ID NO: 67412 - protein, 29 aa, Artificial Sequence
  Description of Artificial Sequence: Synthetic peptide
DEEEIRATNPVTTEQYGSVATNNEQGIGT

SEQ ID NO: 67413 - protein, 33 aa, Artificial Sequence
  Description of Artificial Sequence: Synthetic polypeptide
AEEEIRTTNPVATEQYGSVSTVNLNENNNGNVE

SEQ ID NO: 67414 - protein, 31 aa, Artificial Sequence
  Description of Artificial Sequence: Synthetic polypeptide
DEEEIATTNPVAYEQYGSVATNLQVDDNPDE

SEQ ID NO: 67415 - protein, 34 aa, Artificial Sequence
  Description of Artificial Sequence: Synthetic polypeptide
AEEEIRTTNPVATEQYGSVSTVNLGQTGNSTNNE

SEQ ID NO: 67416 - protein, 32 aa, Artificial Sequence
  Description of Artificial Sequence: Synthetic polypeptide
DEEEIATTNPVAYEQYGSVATNLQDSGEPTRE

SEQ ID NO: 67417 - protein, 28 aa, Artificial Sequence
  Description of Artificial Sequence: Synthetic peptide
AENEIACTNPVATEQYGEASENLQRGGM

SEQ ID NO: 67418 - protein, 32 aa, Artificial Sequence
  Description of Artificial Sequence: Synthetic polypeptide
DEEEIATTNPVAYEQYGSVATNLQANGGVEND

SEQ ID NO: 67419 - protein, 31 aa, Artificial Sequence
  Description of Artificial Sequence: Synthetic polypeptide
DEEEIATTNPVAYEQYGSVATNLQAGDEMGN

SEQ ID NO: 67420 - protein, 31 aa, Artificial Sequence
  Description of Artificial Sequence: Synthetic polypeptide
DEEEIATTNPVAYEQYGSVATNLQAEGPVEN

SEQ ID NO: 67421 - protein, 29 aa, Artificial Sequence
  Description of Artificial Sequence: Synthetic peptide
AENEIACTNPVATEQYGEASENLQRGGPR

SEQ ID NO: 67422 - protein, 30 aa, Artificial Sequence
  Description of Artificial Sequence: Synthetic polypeptide
DEEEIRATNPVATEQYGSVSVNNDGGSTST

SEQ ID NO: 67423 - protein, 33 aa, Artificial Sequence
  Description of Artificial Sequence: Synthetic polypeptide
DEDEIRTTNPVATEQYGVVSTSTTNLQAGTNSQ

SEQ ID NO: 67424 - protein, 32 aa, Artificial Sequence
  Description of Artificial Sequence: Synthetic polypeptide
DEDEIRTTNPVATEQYGVVSTSTTNLQAGQTS

SEQ ID NO: 67425 - protein, 32 aa, Artificial Sequence
  Description of Artificial Sequence: Synthetic polypeptide
DEDEIRTTNPVATEQYGVVSTSTNNLQAGTES

SEQ ID NO: 67426 - protein, 28 aa, Artificial Sequence
  Description of Artificial Sequence: Synthetic peptide
AENEIACTNPVATEQYGEMSENLQRGGI

SEQ ID NO: 67427 - protein, 31 aa, Artificial Sequence
  Description of Artificial Sequence: Synthetic polypeptide
DEEEIATTNPVAYEQYGSVATNLEDTPGNDV

SEQ ID NO: 67428 - protein, 32 aa, Artificial Sequence
  Description of Artificial Sequence: Synthetic polypeptide
DEEEIRATNPVATEQYGSVSVTNQDAGSNNDE

SEQ ID NO: 67429 - protein, 28 aa, Artificial Sequence
  Description of Artificial Sequence: Synthetic peptide
AENEIACTNPVATEQYGEASENLQRGGQ

SEQ ID NO: 67430 - protein, 33 aa, Artificial Sequence
  Description of Artificial Sequence: Synthetic polypeptide
DEEEIRATNPVATEQYGSVSTVVNQDQTGSNNQ

SEQ ID NO: 67431 - protein, 29 aa, Artificial Sequence
  Description of Artificial Sequence: Synthetic peptide
AENEIACTNPVATEQYGEASENLQRTGPR

SEQ ID NO: 67432 - protein, 32 aa, Artificial Sequence
  Description of Artificial Sequence: Synthetic polypeptide
AEEEIRTTNPVATEQYGSVSTVNGNNNDEGNS

SEQ ID NO: 67433 - protein, 30 aa, Artificial Sequence
  Description of Artificial Sequence: Synthetic polypeptide
AEEEIACTNPVATEQYGCVATNLQNQGDND

SEQ ID NO: 67434 - protein, 32 aa, Artificial Sequence
  Description of Artificial Sequence: Synthetic polypeptide
AEEEIRTTNPVATEQYGSVSTVNGNNDQGNES

SEQ ID NO: 67435 - protein, 29 aa, Artificial Sequence
  Description of Artificial Sequence: Synthetic peptide
AENEIACTNPVATEQYGEASENLQRGGQR

SEQ ID NO: 67436 - protein, 31 aa, Artificial Sequence
  Description of Artificial Sequence: Synthetic polypeptide
DEEEIRATNPVGTEQYGFVASTTNQFQGGMR

SEQ ID NO: 67437 - protein, 31 aa, Artificial Sequence
  Description of Artificial Sequence: Synthetic polypeptide
DEEEIRATNPVAYEQYGSVSTNEQQKGFEGD

SEQ ID NO: 67438 - protein, 29 aa, Artificial Sequence
  Description of Artificial Sequence: Synthetic peptide
AENEIACTNPVATEQYGEASENLQRTGGR

SEQ ID NO: 67439 - protein, 29 aa, Artificial Sequence
  Description of Artificial Sequence: Synthetic peptide
AENEIACTNPVATEQYGEASENLQRGGRA

SEQ ID NO: 67440 - protein, 28 aa, Artificial Sequence
  Description of Artificial Sequence: Synthetic peptide
AENEIACTNPVATEQYGCAPENLQRGGR

SEQ ID NO: 67441 - protein, 29 aa, Artificial Sequence
  Description of Artificial Sequence: Synthetic peptide
AENEIACTNPVATEQYGEASENLQRGGRD

SEQ ID NO: 67442 - protein, 31 aa, Artificial Sequence
  Description of Artificial Sequence: Synthetic polypeptide
DEEEIRATNPVATEQYGSVSVVNQDEGSNNI

SEQ ID NO: 67443 - protein, 33 aa, Artificial Sequence
  Description of Artificial Sequence: Synthetic polypeptide
AEEEIRTTNPVATEQYGSVSTVNGGQEQGNQNN

SEQ ID NO: 67444 - protein, 32 aa, Artificial Sequence
  Description of Artificial Sequence: Synthetic polypeptide
DEEEIRATNPVATEQYGSVSVTNQDGNGSNNA

SEQ ID NO: 67445 - protein, 33 aa, Artificial Sequence
  Description of Artificial Sequence: Synthetic polypeptide
DEEEIRATNPVATEQYGSVSTTMNGGQTGGNNG

SEQ ID NO: 67446 - protein, 32 aa, Artificial Sequence
  Description of Artificial Sequence: Synthetic polypeptide
DEEEIRATNPVATEQYGSVSTVVNQDIGSNNE

SEQ ID NO: 67447 - protein, 33 aa, Artificial Sequence
  Description of Artificial Sequence: Synthetic polypeptide
AEEEIRTTNPVATEQYGSVSTVNGNQNDGNNNQ

SEQ ID NO: 67448 - protein, 33 aa, Artificial Sequence
  Description of Artificial Sequence: Synthetic polypeptide
AEEEIRTTNPVATEQYGSVSTVNLGQQQNNNDE

SEQ ID NO: 67449 - protein, 33 aa, Artificial Sequence
  Description of Artificial Sequence: Synthetic polypeptide
AEEEIRTTNPVATEQYGSVSTVNLGQQENNQND

SEQ ID NO: 67450 - protein, 34 aa, Artificial Sequence
  Description of Artificial Sequence: Synthetic polypeptide
AEEEIRTTNPVATEQYGSVSTVNLGQIGTTNAEQ

SEQ ID NO: 67451 - protein, 29 aa, Artificial Sequence
  Description of Artificial Sequence: Synthetic peptide
AENEIACTNPVATEQYGEASENLQRGGMR

SEQ ID NO: 67452 - protein, 33 aa, Artificial Sequence
  Description of Artificial Sequence: Synthetic polypeptide
AEEEIRTTNPVATEQYGSVSTVNLGENNGNNQD

SEQ ID NO: 67453 - protein, 30 aa, Artificial Sequence
  Description of Artificial Sequence: Synthetic polypeptide
AEEEIACTNPVATEQYGCVATNLQATNNRL

SEQ ID NO: 67454 - protein, 33 aa, Artificial Sequence
  Description of Artificial Sequence: Synthetic polypeptide
AEEEIRTTNPVATEQYGSVSTVNLENNQGNNGT

SEQ ID NO: 67455 - protein, 33 aa, Artificial Sequence
  Description of Artificial Sequence: Synthetic polypeptide
AEEEIRTTNPVATEQYGSVSTVNLENNNGENNQ

SEQ ID NO: 67456 - protein, 31 aa, Artificial Sequence
  Description of Artificial Sequence: Synthetic polypeptide
DEEEIATTNPVAYEQYGSVATNLQDPGDEAL

SEQ ID NO: 67457 - protein, 30 aa, Artificial Sequence
  Description of Artificial Sequence: Synthetic polypeptide
AEEEIACTNPVATEQYGCVATNLQDGVDRH

SEQ ID NO: 67458 - protein, 28 aa, Artificial Sequence
  Description of Artificial Sequence: Synthetic peptide
AENEIACTNPVATEQYGEASENLQRGGN

SEQ ID NO: 67459 - protein, 31 aa, Artificial Sequence
  Description of Artificial Sequence: Synthetic polypeptide
DEEEIATTNPVAYEQYGSVATNLQDDSNGSM
